United States Patent 11,640,849 (METHODS FOR HISTOLOGICAL DIAGNOSIS AND TREATMENT OF DISEASES) - sequence listing, part 80

SEQ ID NO: 3046130 - protein, 25 aa, Entamoeba invadens
LVFFFAFFVFAIDLPMCVDVKTIKV

SEQ ID NO: 3046131 - protein, 24 aa, Entamoeba invadens
LVGQKQILLFAKAYNDSLDLKEEV

SEQ ID NO: 3046132 - protein, 27 aa, Entamoeba invadens
LVGQKQILLLAKPFFDSLNFSDEVFIA

SEQ ID NO: 3046133 - protein, 17 aa, Entamoeba invadens
LVIFSTAHKNKESKPNK

SEQ ID NO: 3046134 - protein, 30 aa, Entamoeba invadens
LVKRNIFWRRMVFLFLLFASAFSQTQTQKF

SEQ ID NO: 3046135 - protein, 17 aa, Entamoeba invadens
LVLALCVFGQSSGFWMS

SEQ ID NO: 3046136 - protein, 17 aa, Entamoeba invadens
LVLCEAIKCPPRMDGCG

SEQ ID NO: 3046137 - protein, 20 aa, Entamoeba invadens
LVSHSMGCPVTFDALSKFNP

SEQ ID NO: 3046138 - protein, 17 aa, Entamoeba invadens
LVTLAKLYKKENKMMKV

SEQ ID NO: 3046139 - protein, 26 aa, Entamoeba invadens
LVVTIVTIFVLLYLVQPHKQEFMNSV

SEQ ID NO: 3046140 - protein, 24 aa, Entamoeba invadens
LVYLDSFGHIKTFWLPEIRHFNQD

SEQ ID NO: 3046141 - protein, 22 aa, Entamoeba invadens
LVYSFQCSPGCPDGCITQFTCT

SEQ ID NO: 3046142 - protein, 27 aa, Entamoeba invadens
LYDEILQQKVPLKGWNTWLHKRITLRN

SEQ ID NO: 3046143 - protein, 18 aa, Entamoeba invadens
LYILINSSIATCKLEYDN

SEQ ID NO: 3046144 - protein, 25 aa, Entamoeba invadens
LYQCMSRVLYLIPSNLYDCTQKLGI

SEQ ID NO: 3046145 - protein, 19 aa, Entamoeba invadens
LYRNLFKIFRFTKPRKSVP

SEQ ID NO: 3046146 - protein, 29 aa, Entamoeba invadens
LYTASSLFPIDVYPTCRFYSSPQIFSVTD

SEQ ID NO: 3046147 - protein, 17 aa, Entamoeba invadens
LYYLVFRGRILDEGINI

SEQ ID NO: 3046148 - protein, 17 aa, Entamoeba invadens
MADLFEPWLSERSLEMF

SEQ ID NO: 3046149 - protein, 34 aa, Entamoeba invadens
MAINSQWMFNYAADLWVPFLTKDALESFKHGGYY

SEQ ID NO: 3046150 - protein, 25 aa, Entamoeba invadens
MCEQCKIGYWYNSGKCSKCITNCDK

SEQ ID NO: 3046151 - protein, 33 aa, Entamoeba invadens
MDEKTKLFYVPSRQIPKPKDPMFGLYYCDSNKN

SEQ ID NO: 3046152 - protein, 24 aa, Entamoeba invadens
MDKMAKTYGGYKATKKFLKERKEK

SEQ ID NO: 3046153 - protein, 26 aa, Entamoeba invadens
MDPTKNVFVKFYAPWCGHCKALAPKY

SEQ ID NO: 3046154 - protein, 26 aa, Entamoeba invadens
MDSLFQNYEMPPVFAENYQVDPMVLD

SEQ ID NO: 3046155 - protein, 26 aa, Entamoeba invadens
MECRSAIDGLIRRLEHKYLAIVKSRK

SEQ ID NO: 3046156 - protein, 19 aa, Entamoeba invadens
MECRSAIDGLIRRLEHQYL

SEQ ID NO: 3046157 - protein, 18 aa, Entamoeba invadens
MEKRKQLRLLRRVTDKIA

SEQ ID NO: 3046158 - protein, 35 aa, Entamoeba invadens
MENFGVFHFPVCMPTFLLKMVVFTINFNGNYSLLI

SEQ ID NO: 3046159 - protein, 24 aa, Entamoeba invadens
MENGELVLPIGLYYSTVGNTELKE

SEQ ID NO: 3046160 - protein, 23 aa, Entamoeba invadens
MEYLIIKMKSFLCYITDEEFVKA

SEQ ID NO: 3046161 - protein, 17 aa, Entamoeba invadens
MFALSIDWCWEGDMLQC

SEQ ID NO: 3046162 - protein, 17 aa, Entamoeba invadens
MFVVLNANFATTPEGAQ

SEQ ID NO: 3046163 - protein, 24 aa, Entamoeba invadens
MGFFIQPRTAMLLHRLFAIGMAVC

SEQ ID NO: 3046164 - protein, 34 aa, Entamoeba invadens
MGNELQFWEFAPYKMFISFPIPRRVHDIRSGAIV

SEQ ID NO: 3046165 - protein, 18 aa, Entamoeba invadens
MIIFLVISIVLGQPDKHK

SEQ ID NO: 3046166 - protein, 20 aa, Entamoeba invadens
MITMIYKQLAELKTHKLSQI

SEQ ID NO: 3046167 - protein, 18 aa, Entamoeba invadens
MIYLLMITLSVCFGQPEK

SEQ ID NO: 3046168 - protein, 19 aa, Entamoeba invadens
MKHQLIQRKQLPDPFEGAP

SEQ ID NO: 3046169 - protein, 27 aa, Entamoeba invadens
MKKQLKTLWRLRIMDHRLRHLKHKRRW

SEQ ID NO: 3046170 - protein, 34 aa, Entamoeba invadens
MKMLESYNKMYTLFRLALTEKLFVNHTIVNSTTE

SEQ ID NO: 3046171 - protein, 22 aa, Entamoeba invadens
MKSFSVIKRRFRKIQKQYVQVD

SEQ ID NO: 3046172 - protein, 26 aa, Entamoeba invadens
MKVVFTLLLVYIAASRVVLDPVTMEA

SEQ ID NO: 3046173 - protein, 22 aa, Entamoeba invadens
MKWFTPIKRNNSIKQKLLMFFF

SEQ ID NO: 3046174 - protein, 18 aa, Entamoeba invadens
MLFGALSALTGSHVVGLA

SEQ ID NO: 3046175 - protein, 28 aa, Entamoeba invadens
MLFVNGLFFIPFFIFGVQAVGKTSILYQ

SEQ ID NO: 3046176 - protein, 18 aa, Entamoeba invadens
MLGKKLVRHCGTSTFDYG

SEQ ID NO: 3046177 - protein, 17 aa, Entamoeba invadens
MLIVLTHSFTQPEESKR

SEQ ID NO: 3046178 - protein, 30 aa, Entamoeba invadens
MLNAKRCIYPLFLFLHGMECLLQSYPSMFQ

SEQ ID NO: 3046179 - protein, 19 aa, Entamoeba invadens
MLNKLPSDLRERVIRDIHV

SEQ ID NO: 3046180 - protein, 20 aa, Entamoeba invadens
MLSQKRLIRFCKTLFDDSVL

SEQ ID NO: 3046181 - protein, 18 aa, Entamoeba invadens
MMPLRTKHRYHDGYSGWN

SEQ ID NO: 3046182 - protein, 43 aa, Entamoeba invadens
MNAFYQCTLVETFHFYRLKKVLFDFSNAKFLFYHNTFAPLEIS

SEQ ID NO: 3046183 - protein, 25 aa, Entamoeba invadens
MNSYYKNIPFILSTGFYSGIQQYGG

SEQ ID NO: 3046184 - protein, 26 aa, Entamoeba invadens
MRDGFTMHGWWPEFVSNGYPSCCTSP

SEQ ID NO: 3046185 - protein, 17 aa, Entamoeba invadens
MRRSKASLILEKYVKKF

SEQ ID NO: 3046186 - protein, 26 aa, Entamoeba invadens
MSADIYSFGITFYETLKWGEAYDKNE

SEQ ID NO: 3046187 - protein, 24 aa, Entamoeba invadens
MSARAAIKYFKKEKFIGKPINAQL

SEQ ID NO: 3046188 - protein, 17 aa, Entamoeba invadens
MSCYACENGFYSAGIDT

SEQ ID NO: 3046189 - protein, 36 aa, Entamoeba invadens
MSKLYSDYQKKFFPYQKVRPLASGFVNNAPKIRFHR

SEQ ID NO: 3046190 - protein, 18 aa, Entamoeba invadens
MSVDAIKCIIGKGQGDFI

SEQ ID NO: 3046191 - protein, 17 aa, Entamoeba invadens
MTMARCYSQMNLMLIKY

SEQ ID NO: 3046192 - protein, 26 aa, Entamoeba invadens
MTPTTHLPLVLKFEKSNWQKQLKEVL

SEQ ID NO: 3046193 - protein, 17 aa, Entamoeba invadens
MTRVMKYFNIQLSSDYL

SEQ ID NO: 3046194 - protein, 25 aa, Entamoeba invadens
MTVSKDLMYRLYDPRIAPEPITSFV

SEQ ID NO: 3046195 - protein, 24 aa, Entamoeba invadens
MVHKLKGIIQGRYSVKYIAEVLRE

SEQ ID NO: 3046196 - protein, 18 aa, Entamoeba invadens
MVIFSYSNEIGAHCKVVT

SEQ ID NO: 3046197 - protein, 36 aa, Entamoeba invadens
MVIIHWKGLRCVYYVRLLSVLLVVQQLGSALHVHWE

SEQ ID NO: 3046198 - protein, 20 aa, Entamoeba invadens
MVKFEKFPEYLLNHETAPRN

SEQ ID NO: 3046199 - protein, 19 aa, Entamoeba invadens
MVLALDLCFYGPYGIPFYT

SEQ ID NO: 3046200 - protein, 24 aa, Entamoeba invadens
MVLLLVLLYFLFTKGQPDKPKEPE

SEQ ID NO: 3046201 - protein, 17 aa, Entamoeba invadens
MVTNILKRKGVQKSVIK

SEQ ID NO: 3046202 - protein, 27 aa, Entamoeba invadens
MVYKRPCGYMRYALNVIGKFDNGNDTW

SEQ ID NO: 3046203 - protein, 19 aa, Entamoeba invadens
MWYSSVFTVLFSQNPTLGT

SEQ ID NO: 3046204 - protein, 39 aa, Entamoeba invadens
MYECFTWTNAYPKEYFKFPWTIAEFVIKGLRLPKPDEMS

SEQ ID NO: 3046205 - protein, 17 aa, Entamoeba invadens
MYFVKRGPSELAITAFT

SEQ ID NO: 3046206 - protein, 18 aa, Entamoeba invadens
MYKDFIAKRFNGFTSELV

SEQ ID NO: 3046207 - protein, 18 aa, Entamoeba invadens
MYLLSGILMNEHVNLYSS

SEQ ID NO: 3046208 - protein, 20 aa, Entamoeba invadens
MYRRINIWKVLRRSKLKVRT

SEQ ID NO: 3046209 - protein, 17 aa, Entamoeba invadens
MYSLVGHPVIALGGSYS

SEQ ID NO: 3046210 - protein, 27 aa, Entamoeba invadens
MYYQCSDFFNGFRACPKGTWCKGEQDK

SEQ ID NO: 3046211 - protein, 24 aa, Entamoeba invadens
NADLPKEVIPLDLFLNASRTFESV

SEQ ID NO: 3046212 - protein, 18 aa, Entamoeba invadens
NAEGTILRFFHADNNQFD

SEQ ID NO: 3046213 - protein, 26 aa, Entamoeba invadens
NAFDDVFYFLKNNVFLETLDLSYNSI

SEQ ID NO: 3046214 - protein, 24 aa, Entamoeba invadens
NALNTLARPLVDIGHGYLDKKAPT

SEQ ID NO: 3046215 - protein, 18 aa, Entamoeba invadens
NAVKPVFSFRTIENAKKN

SEQ ID NO: 3046216 - protein, 24 aa, Entamoeba invadens
NAWRFASWIRGTTTQFLVVVNYSD

SEQ ID NO: 3046217 - protein, 24 aa, Entamoeba invadens
NAYNPYSFYGNKLGMYGGMDIPLG

SEQ ID NO: 3046218 - protein, 23 aa, Entamoeba invadens
NCDSCLNGYYLKDGLCVQCPPNC

SEQ ID NO: 3046219 - protein, 40 aa, Entamoeba invadens
NCEDYHPPKPYFTILDCNKYLLKVPTKDVNKYPYCTPYIP

SEQ ID NO: 3046220 - protein, 19 aa, Entamoeba invadens
NCERSLRFDILCPDSGDVL

SEQ ID NO: 3046221 - protein, 21 aa, Entamoeba invadens
NCISCFEYYNLISGNCIKCDS

SEQ ID NO: 3046222 - protein, 18 aa, Entamoeba invadens
NCKRLIDLIQRNSPLQIT

SEQ ID NO: 3046223 - protein, 25 aa, Entamoeba invadens
NCLSCKNGFYYTNGYCLPCELNCGR

SEQ ID NO: 3046224 - protein, 22 aa, Entamoeba invadens
NCLSCVQGERYLWNNQCLSCSN

SEQ ID NO: 3046225 - protein, 18 aa, Entamoeba invadens
NCPDMYFKDNAEKMCKRC

SEQ ID NO: 3046226 - protein, 28 aa, Entamoeba invadens
NCPPNTMKLDLIWKYKSGDLCVDTCEVL

SEQ ID NO: 3046227 - protein, 22 aa, Entamoeba invadens
NCSICPASYYSSGGTSLCSKCA

SEQ ID NO: 3046228 - protein, 23 aa, Entamoeba invadens
NCSICPASYYSSGGTSLCSKCAT

SEQ ID NO: 3046229 - protein, 22 aa, Entamoeba invadens
NCSTCMISYYYSNGYCIQCSPN

SEQ ID NO: 3046230 - protein, 23 aa, Entamoeba invadens
NCTHYIAKILAVNSGLPDFNSFF

SEQ ID NO: 3046231 - protein, 17 aa, Entamoeba invadens
NCTSCMTNFVLNGGECQ

SEQ ID NO: 3046232 - protein, 18 aa, Entamoeba invadens
NCVTGYGLAAGKCAICPK

SEQ ID NO: 3046233 - protein, 24 aa, Entamoeba invadens
NDDLSSFSYIFYHGETAPSQITST

SEQ ID NO: 3046234 - protein, 22 aa, Entamoeba invadens
NDEERHRTIYLTALETNKKLNA

SEQ ID NO: 3046235 - protein, 31 aa, Entamoeba invadens
NDFHYRWNPQVIAGFGYIVFAPNFHGSGSYG

SEQ ID NO: 3046236 - protein, 27 aa, Entamoeba invadens
NDGYHSNYFYLCTERFNGYLKCPRNTV

SEQ ID NO: 3046237 - protein, 24 aa, Entamoeba invadens
NDIKQLNVELVLYALKELDAALKN

SEQ ID NO: 3046238 - protein, 25 aa, Entamoeba invadens
NDKTYCLIRQKLSQIRSFISDNDRA

SEQ ID NO: 3046239 - protein, 25 aa, Entamoeba invadens
NDQLQMHYRDLRLAANPTTRAQLER

SEQ ID NO: 3046240 - protein, 25 aa, Entamoeba invadens
NDQLSQLNMNILSLVRTDALETKAP

SEQ ID NO: 3046241 - protein, 18 aa, Entamoeba invadens
NDRKFKHILVKLQNIFSV

SEQ ID NO: 3046242 - protein, 22 aa, Entamoeba invadens
NDYRACVKCASGFYKDSNNKCI

SEQ ID NO: 3046243 - protein, 22 aa, Entamoeba invadens
NDYSICLRVKYGNFVYATCGDL

SEQ ID NO: 3046244 - protein, 19 aa, Entamoeba invadens
NECYTCFKGYYVDKNSCLK

SEQ ID NO: 3046245 - protein, 27 aa, Entamoeba invadens
NEEAELFVKGLYNTALIQSGYPVTNSN

SEQ ID NO: 3046246 - protein, 20 aa, Entamoeba invadens
NEEKGYFVEAIWQDSKKQKV

SEQ ID NO: 3046247 - protein, 30 aa, Entamoeba invadens
NEELRNIVFFRYPKWVGGLYCSPSIPGSRA

SEQ ID NO: 3046248 - protein, 24 aa, Entamoeba invadens
NEFTQIPTIQWEFSPQLDLKVKVV

SEQ ID NO: 3046249 - protein, 23 aa, Entamoeba invadens
NEKSSLLVLFYEKDGQVRNLPIQ

SEQ ID NO: 3046250 - protein, 24 aa, Entamoeba invadens
NETKPLLMYDFAVTNYDFNEVNYT

SEQ ID NO: 3046251 - protein, 19 aa, Entamoeba invadens
NEVPVIRPLFYNFPDDENS

SEQ ID NO: 3046252 - protein, 25 aa, Entamoeba invadens
NEVREKLRRISPLKNVISKKVEWIE

SEQ ID NO: 3046253 - protein, 19 aa, Entamoeba invadens
NEYMNVYLLDKCYYSGGNT

SEQ ID NO: 3046254 - protein, 25 aa, Entamoeba invadens
NFDEVWSFRAIKKGFVWVNATYNIP

SEQ ID NO: 3046255 - protein, 24 aa, Entamoeba invadens
NFERVKLLKKVLHHYGPFVVSLYT

SEQ ID NO: 3046256 - protein, 18 aa, Entamoeba invadens
NFKEIKMEWLWVDDKKEN

SEQ ID NO: 3046257 - protein, 17 aa, Entamoeba invadens
NFKTFFIKEHYPNTLYD

SEQ ID NO: 3046258 - protein, 24 aa, Entamoeba invadens
NFLNTYDIWKIFKANGVLPDGSTG

SEQ ID NO: 3046259 - protein, 23 aa, Entamoeba invadens
NFNRYVRCEMLKLKIPECTKCPQ

SEQ ID NO: 3046260 - protein, 26 aa, Entamoeba invadens
NFQKQMRALIVLVLITITLGDKRGLV

SEQ ID NO: 3046261 - protein, 17 aa, Entamoeba invadens
NFVLESCHVFAPKGLNL

SEQ ID NO: 3046262 - protein, 20 aa, Entamoeba invadens
NGAIAYMKQLFEVSLYSSFP

SEQ ID NO: 3046263 - protein, 18 aa, Entamoeba invadens
NGALYPMLEQIGDIIDFK

SEQ ID NO: 3046264 - protein, 26 aa, Entamoeba invadens
NGDDRTMFMFFSLLQLEILKNNQAVL

SEQ ID NO: 3046265 - protein, 18 aa, Entamoeba invadens
NGEEYWIVKNSWGTNWGE

SEQ ID NO: 3046266 - protein, 19 aa, Entamoeba invadens
NGEEYWIVKNSWGTNWGEN

SEQ ID NO: 3046267 - protein, 25 aa, Entamoeba invadens
NGGPSDYWYMDPKNIRPYGICIIKL

SEQ ID NO: 3046268 - protein, 19 aa, Entamoeba invadens
NGHYPFTINPCILDGYIFK

SEQ ID NO: 3046269 - protein, 26 aa, Entamoeba invadens
NGKCLGCIEGFFLTADFRCEGCSKEC

SEQ ID NO: 3046270 - protein, 18 aa, Entamoeba invadens
NGLEWYAQPYLIAESIPS

SEQ ID NO: 3046271 - protein, 18 aa, Entamoeba invadens
NGNDYWIVKNSWGTEWGD

SEQ ID NO: 3046272 - protein, 24 aa, Entamoeba invadens
NGNIKIKTFNGSSIWWFAVVVSEH

SEQ ID NO: 3046273 - protein, 24 aa, Entamoeba invadens
NGNYTLSILALESSLRFAKGGLWT

SEQ ID NO: 3046274 - protein, 26 aa, Entamoeba invadens
NGRCTKCFGPFKPVDGKCTSSVAPVI

SEQ ID NO: 3046275 - protein, 21 aa, Entamoeba invadens
NGVYIQTFFISVLESKYVAKN

SEQ ID NO: 3046276 - protein, 17 aa, Entamoeba invadens
NGYGRYLLLLKENIENV

SEQ ID NO: 3046277 - protein, 22 aa, Entamoeba invadens
NHLYMINEKLIRYCPNGLNSVD

SEQ ID NO: 3046278 - protein, 18 aa, Entamoeba invadens
NHSDLCIIVYSITDKPSF

SEQ ID NO: 3046279 - protein, 22 aa, Entamoeba invadens
NIAKAFKKYGARFDFTCLEMTG

SEQ ID NO: 3046280 - protein, 29 aa, Entamoeba invadens
NICTPMKFVFFVVFLLTTNGYHCDCTPTG

SEQ ID NO: 3046281 - protein, 27 aa, Entamoeba invadens
NIEFYNFHTIIFLFKDITLLNCAQQII

SEQ ID NO: 3046282 - protein, 18 aa, Entamoeba invadens
NIMYKCKTVYDGDVSSCI

SEQ ID NO: 3046283 - protein, 25 aa, Entamoeba invadens
NINSVNSFLFLTALSIRHCSIQQTE

SEQ ID NO: 3046284 - protein, 23 aa, Entamoeba invadens
NIQYINCTLLKYVEINLVKQRKA

SEQ ID NO: 3046285 - protein, 20 aa, Entamoeba invadens
NITSLFNYFSTNFSFGTLTV

SEQ ID NO: 3046286 - protein, 22 aa, Entamoeba invadens
NIYILLSLLNFTSSQICSFSDT

SEQ ID NO: 3046287 - protein, 26 aa, Entamoeba invadens
NKAEYLYRLAVFLDNAKFVAANPNTE

SEQ ID NO: 3046288 - protein, 25 aa, Entamoeba invadens
NKAEYLYRLAVYLDNKKFVENTANT

SEQ ID NO: 3046289 - protein, 24 aa, Entamoeba invadens
NKAMFSMSLLIEKIAKNAILPKQG

SEQ ID NO: 3046290 - protein, 24 aa, Entamoeba invadens
NKAQLGIIDYKLKYLAEALKKYKK

SEQ ID NO: 3046291 - protein, 20 aa, Entamoeba invadens
NKCILCPNLTYSTGGTSTCL

SEQ ID NO: 3046292 - protein, 24 aa, Entamoeba invadens
NKCNGCVSGYYLQSGDKSPCLLCS

SEQ ID NO: 3046293 - protein, 34 aa, Entamoeba invadens
NKCQCCRKCLEVQPPVFHCANVPKLDNFKKQPSQ

SEQ ID NO: 3046294 - protein, 26 aa, Entamoeba invadens
NKCQCCRRCLEVPPPKCNCGPVKQPV

SEQ ID NO: 3046295 - protein, 25 aa, Entamoeba invadens
NKFRSEYIVHFYGAVFIISKICMVT

SEQ ID NO: 3046296 - protein, 24 aa, Entamoeba invadens
NKGPIDVIRIPRIQKRILETQNEI

SEQ ID NO: 3046297 - protein, 21 aa, Entamoeba invadens
NKKAQLMKKIQKQQGVVRSAK

SEQ ID NO: 3046298 - protein, 22 aa, Entamoeba invadens
NKKYIFTPFNDKITSMIFTHFE

SEQ ID NO: 3046299 - protein, 24 aa, Entamoeba invadens
NKLAGIKHAILSKSKKKLDPKKTK

SEQ ID NO: 3046300 - protein, 24 aa, Entamoeba invadens
NKLKPNCIWLNVIDGWYSDIPDRQ

SEQ ID NO: 3046301 - protein, 23 aa, Entamoeba invadens
NKLSRFIYQVFQLVNSTQSYIKR

SEQ ID NO: 3046302 - protein, 23 aa, Entamoeba invadens
NKNKFLICSDVFKGFLTCPSGSV

SEQ ID NO: 3046303 - protein, 25 aa, Entamoeba invadens
NKQTSYFVAYVPDTCYFRNNFQAAQ

SEQ ID NO: 3046304 - protein, 23 aa, Entamoeba invadens
NKQYYTQWNPLNFVANYKTPQLT

SEQ ID NO: 3046305 - protein, 17 aa, Entamoeba invadens
NKRYKLVDLLMRIKTEN

SEQ ID NO: 3046306 - protein, 33 aa, Entamoeba invadens
NKVDHFIDSLKYKAYMTTLSLLVEKSKNGPIDE

SEQ ID NO: 3046307 - protein, 22 aa, Entamoeba invadens
NKVSYCPKLIYIGDEAFYQTNL

SEQ ID NO: 3046308 - protein, 19 aa, Entamoeba invadens
NKWMSLTLCRHLIHQWDKH

SEQ ID NO: 3046309 - protein, 23 aa, Entamoeba invadens
NKYFEFALKHNLAVYQTGSSCDL

SEQ ID NO: 3046310 - protein, 24 aa, Entamoeba invadens
NLDTPVLCMVAGSFHPKLYGEEIT

SEQ ID NO: 3046311 - protein, 30 aa, Entamoeba invadens
NLEISKFHKYLDWINLMTYDLHGSWDDVTG

SEQ ID NO: 3046312 - protein, 30 aa, Entamoeba invadens
NLEVSKFHPYLDWINLMTYDLHGAWDEVTG

SEQ ID NO: 3046313 - protein, 26 aa, Entamoeba invadens
NLEYVTTIFYHGFFEPIVQSGVSIST

SEQ ID NO: 3046314 - protein, 22 aa, Entamoeba invadens
NLFCDDLSYNNYLPLKTHNKKY

SEQ ID NO: 3046315 - protein, 23 aa, Entamoeba invadens
NLIKRQDMFSHLLALISGGLDEM

SEQ ID NO: 3046316 - protein, 17 aa, Entamoeba invadens
NLILTLTSTFKVSTDRT

SEQ ID NO: 3046317 - protein, 18 aa, Entamoeba invadens
NLKAGFGNYLFYVSRNVE

SEQ ID NO: 3046318 - protein, 18 aa, Entamoeba invadens
NLKVALLEKARDVSTGAT

SEQ ID NO: 3046319 - protein, 24 aa, Entamoeba invadens
NLMSGIHKFWMSLLNCRFAMAQYE

SEQ ID NO: 3046320 - protein, 26 aa, Entamoeba invadens
NLNGEEYWIVRNSWGRSWGDKGYILM

SEQ ID NO: 3046321 - protein, 17 aa, Entamoeba invadens
NLPMIFPSHTRNAVVSK

SEQ ID NO: 3046322 - protein, 19 aa, Entamoeba invadens
NLRLFTQFYELINQQQSWN

SEQ ID NO: 3046323 - protein, 19 aa, Entamoeba invadens
NLSGPIPHSLFLGKSLEKV

SEQ ID NO: 3046324 - protein, 23 aa, Entamoeba invadens
NLSRYWLNYRHSSSAMLVYNTLK

SEQ ID NO: 3046325 - protein, 26 aa, Entamoeba invadens
NLVGLKRRLFLLGTSQMKYIKDSVYQ

SEQ ID NO: 3046326 - protein, 20 aa, Entamoeba invadens
NLVGVLPKLSGLTKLYALVI

SEQ ID NO: 3046327 - protein, 29 aa, Entamoeba invadens
NLVKQRKAMTIFLNYKNFNLKYIDNKYNN

SEQ ID NO: 3046328 - protein, 40 aa, Entamoeba invadens
NLVLRHVLHVKMVITQPVNLLYVILVVQICLSCINGYGLN

SEQ ID NO: 3046329 - protein, 17 aa, Entamoeba invadens
NMMMLMNKNAQAAPAPQ

SEQ ID NO: 3046330 - protein, 17 aa, Entamoeba invadens
NMRIEKRIKNLKRVILV

SEQ ID NO: 3046331 - protein, 18 aa, Entamoeba invadens
NMVKHNMFYQSQLGMYWS

SEQ ID NO: 3046332 - protein, 27 aa, Entamoeba invadens
NMVTEIYLQYYKTLYQISFQSGYASVI

SEQ ID NO: 3046333 - protein, 18 aa, Entamoeba invadens
NMYPSLDTGKWISCSTTC

SEQ ID NO: 3046334 - protein, 28 aa, Entamoeba invadens
NNCKVTWDFVLLVTTWPGYFCSTKCCDS

SEQ ID NO: 3046335 - protein, 19 aa, Entamoeba invadens
NNCLSCLFSYGFSNGYCVK

SEQ ID NO: 3046336 - protein, 26 aa, Entamoeba invadens
NNCLSCSKFYYLLNGQCLECDSSCNT

SEQ ID NO: 3046337 - protein, 24 aa, Entamoeba invadens
NNCLTCEFLYGVSNGYCVKCDSSC

SEQ ID NO: 3046338 - protein, 26 aa, Entamoeba invadens
NNCLTRRPYYYLSNGYCLKCDSSCRT

SEQ ID NO: 3046339 - protein, 24 aa, Entamoeba invadens
NNDEEFEIVYFIDSQYLDSASETS

SEQ ID NO: 3046340 - protein, 22 aa, Entamoeba invadens
NNEEFFIIRNSWENGWGEYNNY

SEQ ID NO: 3046341 - protein, 30 aa, Entamoeba invadens
NNIEINIFINKWYTLLITNYQTYIFKSSLN

SEQ ID NO: 3046342 - protein, 19 aa, Entamoeba invadens
NNIMPMYFGEFDRSYVIMI

SEQ ID NO: 3046343 - protein, 22 aa, Entamoeba invadens
NNLDTIFYFDSISLLQNPNAPS

SEQ ID NO: 3046344 - protein, 29 aa, Entamoeba invadens
NNNTYIYSHKLYNFTLSPLQMIPNTDFFN

SEQ ID NO: 3046345 - protein, 29 aa, Entamoeba invadens
NNSIKQKLLMFFFVLFVCAFSQCTKQLCT

SEQ ID NO: 3046346 - protein, 26 aa, Entamoeba invadens
NNTSVFNWCTLLSKVKFINNDETTCK

SEQ ID NO: 3046347 - protein, 29 aa, Entamoeba invadens
NNYACQFTFKHVYLDLGMNPSLVIVERKK

SEQ ID NO: 3046348 - protein, 22 aa, Entamoeba invadens
NNYLHDVFPIEIYIDNAHNVVV

SEQ ID NO: 3046349 - protein, 17 aa, Entamoeba invadens
NNYYGFCYKCEKGFYFD

SEQ ID NO: 3046350 - protein, 18 aa, Entamoeba invadens
NNYYHMFYDELYGTKFGK

SEQ ID NO: 3046351 - protein, 26 aa, Entamoeba invadens
NPELNKPRIILWNSTYIHLNKNITGR

SEQ ID NO: 3046352 - protein, 28 aa, Entamoeba invadens
NPFVEYLQTFLPCPIVPQNATRPNSPPM

SEQ ID NO: 3046353 - protein, 33 aa, Entamoeba invadens
NPKNLESFFQYNPYRIFRFTAKDLYTFVATLDF

SEQ ID NO: 3046354 - protein, 18 aa, Entamoeba invadens
NPLIRPMTYPIPSPKEEK

SEQ ID NO: 3046355 - protein, 19 aa, Entamoeba invadens
NPPVLKQGLLFKMLHDFEI

SEQ ID NO: 3046356 - protein, 19 aa, Entamoeba invadens
NPQIIMWNSTYLHLNYKYV

SEQ ID NO: 3046357 - protein, 25 aa, Entamoeba invadens
NPQLNRPQIILWNSSYLHLNRNITN

SEQ ID NO: 3046358 - protein, 20 aa, Entamoeba invadens
NPVLYGMRLVAYNFPGEVFT

SEQ ID NO: 3046359 - protein, 30 aa, Entamoeba invadens
NPYGVVSYLPFLLISLPNINTLYLNALNVQ

SEQ ID NO: 3046360 - protein, 24 aa, Entamoeba invadens
NQALLRYDHALGMLWSGGSGSSGH

SEQ ID NO: 3046361 - protein, 18 aa, Entamoeba invadens
NQCEMCDLKYYLNNKKCE

SEQ ID NO: 3046362 - protein, 23 aa, Entamoeba invadens
NQDKYFKAVIEMRIRCTRGEGVG

SEQ ID NO: 3046363 - protein, 24 aa, Entamoeba invadens
NQFKNNFVFSTYQWEAALVNKNMS

SEQ ID NO: 3046364 - protein, 25 aa, Entamoeba invadens
NQFKNNFVYTTYKWYAAVVNETEKN

SEQ ID NO: 3046365 - protein, 27 aa, Entamoeba invadens
NQIDTTCYLCDFTAMLLNGVCNVKNEK

SEQ ID NO: 3046366 - protein, 26 aa, Entamoeba invadens
NQILKEVVRALRPLTPALQGQLLRNT

SEQ ID NO: 3046367 - protein, 20 aa, Entamoeba invadens
NQIMFAPFPEYLLDPETAPR

SEQ ID NO: 3046368 - protein, 34 aa, Entamoeba invadens
NQKSFNRIQHKKNFLLFIIKMSLSENQIDPVTLR

SEQ ID NO: 3046369 - protein, 25 aa, Entamoeba invadens
NQLSLENLYLFQNATLQVLDNSVVS

SEQ ID NO: 3046370 - protein, 24 aa, Entamoeba invadens
NQLVIPHTLFKKILQMLSTFVRYF

SEQ ID NO: 3046371 - protein, 20 aa, Entamoeba invadens
NQMYLRRFADQYQPVQSGVF

SEQ ID NO: 3046372 - protein, 25 aa, Entamoeba invadens
NRELNYFFKWSFHKVNPDLSIISLK

SEQ ID NO: 3046373 - protein, 21 aa, Entamoeba invadens
NRFHTIMFVKFWPGEKCSGIT

SEQ ID NO: 3046374 - protein, 19 aa, Entamoeba invadens
NRITLSDYSLFIIAGYFHS

SEQ ID NO: 3046375 - protein, 22 aa, Entamoeba invadens
NRKFEETPFLKNAMIKRSSEQY

SEQ ID NO: 3046376 - protein, 24 aa, Entamoeba invadens
NRKMRRFVRSRWFRRYNRSHKNSV

SEQ ID NO: 3046377 - protein, 19 aa, Entamoeba invadens
NRNGFGGGFNPFEDFFRNN

SEQ ID NO: 3046378 - protein, 18 aa, Entamoeba invadens
NRNLMIGKYFNILASHFS

SEQ ID NO: 3046379 - protein, 17 aa, Entamoeba invadens
NRRIRMSFSSSPGLIHS

SEQ ID NO: 3046380 - protein, 18 aa, Entamoeba invadens
NSASSLLAGAFLFAIVLV

SEQ ID NO: 3046381 - protein, 25 aa, Entamoeba invadens
NSCGNQIMFAPFPEYLLNPETAPRN

SEQ ID NO: 3046382 - protein, 25 aa, Entamoeba invadens
NSFGQLFFTLLHSTIAPFDSLEQCV

SEQ ID NO: 3046383 - protein, 36 aa, Entamoeba invadens
NSFYIKKLYKKIDPFTLLSWQRVLVAMYFQKTCKKV

SEQ ID NO: 3046384 - protein, 20 aa, Entamoeba invadens
NSGNIFWVKAPQNDGNKLII

SEQ ID NO: 3046385 - protein, 24 aa, Entamoeba invadens
NSGNIFWVKAPQNKGNKLIIYEFN

SEQ ID NO: 3046386 - protein, 28 aa, Entamoeba invadens
NSGSVSASYKFNDKFKMNANAQKSKVNG

SEQ ID NO: 3046387 - protein, 18 aa, Entamoeba invadens
NSIKPFFEKYNWTIPFGV

SEQ ID NO: 3046388 - protein, 31 aa, Entamoeba invadens
NSITATIKNMNRYIKGWKYDQKLRILDVAKA

SEQ ID NO: 3046389 - protein, 32 aa, Entamoeba invadens
NSKIKYINCTFLKYVEIYFVEQRKAITIFLNY

SEQ ID NO: 3046390 - protein, 21 aa, Entamoeba invadens
NSKTYILYSHIANKGGYSGGE

SEQ ID NO: 3046391 - protein, 24 aa, Entamoeba invadens
NSLAKIEGYFSIAGKLLILNPKLD

SEQ ID NO: 3046392 - protein, 26 aa, Entamoeba invadens
NSLHQQAFMNCYFLSNIRLSDNITSL

SEQ ID NO: 3046393 - protein, 19 aa, Entamoeba invadens
NSLRLTVVSINTILYGPKL

SEQ ID NO: 3046394 - protein, 25 aa, Entamoeba invadens
NSNIKYIICTLLKYVEINLVKQRKE

SEQ ID NO: 3046395 - protein, 25 aa, Entamoeba invadens
NSPYGYFNLTLLTFQDYNVWSIIRN

SEQ ID NO: 3046396 - protein, 20 aa, Entamoeba invadens
NSTCIMFSKSSINLTMDIYI

SEQ ID NO: 3046397 - protein, 26 aa, Entamoeba invadens
NSTDIMTTMFLYPNAFMIAYDYESIE

SEQ ID NO: 3046398 - protein, 23 aa, Entamoeba invadens
NSTELLHFPIDIATPLNITESSL

SEQ ID NO: 3046399 - protein, 24 aa, Entamoeba invadens
NSTTRYICYLPLAHIFELAVELCN

SEQ ID NO: 3046400 - protein, 21 aa, Entamoeba invadens
NSVCTSCQSGYYLFNGICTYC

SEQ ID NO: 3046401 - protein, 25 aa, Entamoeba invadens
NTCTGCNNGYYLKGNTCTKCGSNCV

SEQ ID NO: 3046402 - protein, 24 aa, Entamoeba invadens
NTCTGCVDGYYKSGQTCTKCAANC

SEQ ID NO: 3046403 - protein, 24 aa, Entamoeba invadens
NTCTGCVDGYYLEGGKCNKCTNGC

SEQ ID NO: 3046404 - protein, 28 aa, Entamoeba invadens
NTDGEYWIMRNSWGKSWGDEGYFLLARN

SEQ ID NO: 3046405 - protein, 25 aa, Entamoeba invadens
NTDNDKFVYPVWNNTCELDKDDSIN

SEQ ID NO: 3046406 - protein, 25 aa, Entamoeba invadens
NTEDLRKVIYPIFNVNPVFSCKEIG

SEQ ID NO: 3046407 - protein, 17 aa, Entamoeba invadens
NTKRFHFSWNIAEFVVS

SEQ ID NO: 3046408 - protein, 23 aa, Entamoeba invadens
NTNNCLSCPPYYYYSSGSCLKCS

SEQ ID NO: 3046409 - protein, 25 aa, Entamoeba invadens
NTQLFTNHYYPYYISPNYISDNSNC

SEQ ID NO: 3046410 - protein, 23 aa, Entamoeba invadens
NTTDRHYLSFLSENYRVEIKMTL

SEQ ID NO: 3046411 - protein, 25 aa, Entamoeba invadens
NTTTVLGFVIFEDFIVLPGETGIEK

SEQ ID NO: 3046412 - protein, 30 aa, Entamoeba invadens; identical to SEQ ID NO: 3011500

SEQ ID NO: 3046413 - protein, 17 aa, Entamoeba invadens
NVILFSDKPKRTLMLKS

SEQ ID NO: 3046414 - protein, 22 aa, Entamoeba invadens
NVKGKLLLVPYPQIVEANFLNP

SEQ ID NO: 3046415 - protein, 17 aa, Entamoeba invadens
NVKLEFPVFLKMYSINN

SEQ ID NO: 3046416 - protein, 17 aa, Entamoeba invadens
NVLSKAEEFFSQTRLNG

SEQ ID NO: 3046417 - protein, 19 aa, Entamoeba invadens
NVLTFKLTPTWSVNQNLQL

SEQ ID NO: 3046418 - protein, 18 aa, Entamoeba invadens
NVLTKKILKFCKGKKEES

SEQ ID NO: 3046419 - protein, 23 aa, Entamoeba invadens
NVNTKLFISKSVKFFQIYDFGDQ

SEQ ID NO: 3046420 - protein, 20 aa, Entamoeba invadens
NVQFNIMWLDIDGQGWYTIQ

SEQ ID NO: 3046421 - protein, 23 aa, Entamoeba invadens
NVSDVHVLFPSNNKVYNVITSGT

SEQ ID NO: 3046422 - protein, 28 aa, Entamoeba invadens
NWIEKWPIRIWCQFNQQIRTDNLSECYH

SEQ ID NO: 3046423 - protein, 17 aa, Entamoeba invadens
NWMSIESCLLALYQWDK

SEQ ID NO: 3046424 - protein, 19 aa, Entamoeba invadens
NWWPSKGYYIGIFGFEYQT

SEQ ID NO: 3046425 - protein, 24 aa, Entamoeba invadens
NYAPKFAFFDYNGKLLPFDSYESE

SEQ ID NO: 3046426 - protein, 29 aa, Entamoeba invadens
NYDLCRKYKYMKKPVYLFVFVQYWPGDKC

SEQ ID NO: 3046427 - protein, 17 aa, Entamoeba invadens
NYDYVFGENYGSGRYLF

SEQ ID NO: 3046428 - protein, 24 aa, Entamoeba invadens
NYFVTEIAYPFKLLNKVGTEKNSY

SEQ ID NO: 3046429 - protein, 18 aa, Entamoeba invadens
NYGFVEILSRRPITLNAN

SEQ ID NO: 3046430 - protein, 32 aa, Entamoeba invadens
NYKITQFYTMNPINFVFKGKDVYLRVVNTILG

SEQ ID NO: 3046431 - protein, 20 aa, Entamoeba invadens
NYLFVLTSLVNKLRKFDLIR

SEQ ID NO: 3046432 - protein, 21 aa, Entamoeba invadens
NYLKALFIREQSTLVRIFIWD

SEQ ID NO: 3046433 - protein, 23 aa, Entamoeba invadens
NYVIALFCYFTQQSCVPYIQTIE

SEQ ID NO: 3046434 - protein, 21 aa, Entamoeba invadens
PAMFLTLFLCTLAVEAGKKCQ

SEQ ID NO: 3046435 - protein, 23 aa, Entamoeba invadens
PCCDFFGRLLFNNCSNLAEVYMP

SEQ ID NO: 3046436 - protein, 21 aa, Entamoeba invadens
PDNILVFSLDFNYKVNAKLTD

SEQ ID NO: 3046437 - protein, 19 aa, Entamoeba invadens
PDSNYNIMFGPDVCGSSKR

SEQ ID NO: 3046438 - protein, 20 aa, Entamoeba invadens
PDSSALNFVLLALTFIALLF

SEQ ID NO: 3046439 - protein, 26 aa, Entamoeba invadens
PEARDDAWYYPYGCLNFRTFSLNISE

SEQ ID NO: 3046440 - protein, 25 aa, Entamoeba invadens
PEARDDAWYYPYGCLNYNTFSLNIS

SEQ ID NO: 3046441 - protein, 18 aa, Entamoeba invadens
PEDYVERWVTVGGAWLGA

SEQ ID NO: 3046442 - protein, 24 aa, Entamoeba invadens
PEENHWVLRPYNSIDWHAQVQDWL

SEQ ID NO: 3046443 - protein, 17 aa, Entamoeba invadens
PEKYFLQDKKCLKCQEK

SEQ ID NO: 3046444 - protein, 17 aa, Entamoeba invadens
PEPFLEMKSFNKVLQLL

SEQ ID NO: 3046445 - protein, 23 aa, Entamoeba invadens
PEYQFLMKYFEKSVALIYSEDFN

SEQ ID NO: 3046446 - protein, 18 aa, Entamoeba invadens
PEYYYMFYEYKDAKDCIF

SEQ ID NO: 3046447 - protein, 19 aa, Entamoeba invadens
PFEPKPPSFIPPRIQRQFE

SEQ ID NO: 3046448 - protein, 17 aa, Entamoeba invadens
PFLALSIEQPKLNQAVV

SEQ ID NO: 3046449 - protein, 19 aa, Entamoeba invadens
PFLSLWLDYSEPSSYYSNE

SEQ ID NO: 3046450 - protein, 31 aa, Entamoeba invadens
PFMAQSPYMMAMRRPIYPSMGYTYTYPPVNY

SEQ ID NO: 3046451 - protein, 17 aa, Entamoeba invadens
PFMNRWFDLTVATNEIY

SEQ ID NO: 3046452 - protein, 25 aa, Entamoeba invadens
PFPARYASGWLLRDILNYQMDRING

SEQ ID NO: 3046453 - protein, 17 aa, Entamoeba invadens
PFTLSTYYKIINAMAMF

SEQ ID NO: 3046454 - protein, 30 aa, Entamoeba invadens
PFTVHNLNIDKLILNFKWINTEFTQIDSTI

SEQ ID NO: 3046455 - protein, 22 aa, Entamoeba invadens
PGHNMDLPISATLFRSICRTME

SEQ ID NO: 3046456 - protein, 30 aa, Entamoeba invadens
PGNELQFWEFAPYKMYISFPIPRRVHDIRG

SEQ ID NO: 3046457 - protein, 28 aa, Entamoeba invadens
PGTSCIYFDQIPIGFNPCGIPPQSLKCT

SEQ ID NO: 3046458 - protein, 21 aa, Entamoeba invadens
PGWYLLVLEMTDHKLFHNCFH

SEQ ID NO: 3046459 - protein, 24 aa, Entamoeba invadens
PIEEFRLTHLIREIGRKKSASTIY

SEQ ID NO: 3046460 - protein, 19 aa, Entamoeba invadens
PILAKLDLRFELNHPLVLE

SEQ ID NO: 3046461 - protein, 24 aa, Entamoeba invadens
PISKTTFLEEFPLNYVVKNNYLGV

SEQ ID NO: 3046462 - protein, 17 aa, Entamoeba invadens
PKDSYVFYLNQIDLDAN

SEQ ID NO: 3046463 - protein, 17 aa, Entamoeba invadens
PKEIVFPTQPPGGLQVT

SEQ ID NO: 3046464 - protein, 18 aa, Entamoeba invadens
PKESFTSAPYYTLGFTYG

SEQ ID NO: 3046465 - protein, 19 aa, Entamoeba invadens
PKHCAFFKKSFIVAKPIVV

SEQ ID NO: 3046466 - protein, 31 aa, Entamoeba invadens
PKIQQFFEIGTLPIIYYFMDSSSVQVFSKKA

SEQ ID NO: 3046467 - protein, 23 aa, Entamoeba invadens
PKNKPYIDLFMGIIANKTLSNDV

SEQ ID NO: 3046468 - protein, 21 aa, Entamoeba invadens
PKRSKFLLKSIVKKPSITKKS

SEQ ID NO: 3046469 - protein, 29 aa, Entamoeba invadens
PLEYMQTALFLYDKYDLWKLLQESELKVE

SEQ ID NO: 3046470 - protein, 18 aa, Entamoeba invadens
PLLLVTVLSSCYTIDDKT

SEQ ID NO: 3046471 - protein, 18 aa, Entamoeba invadens
PLMFEKIRRHIKMEDFED

SEQ ID NO: 3046472 - protein, 31 aa, Entamoeba invadens
PLTPALQGQLLRNTGLFYKFAPEYNSDVARY

SEQ ID NO: 3046473 - protein, 20 aa, Entamoeba invadens
PMFGFFLLTLAVSKCDHSNF

SEQ ID NO: 3046474 - protein, 21 aa, Entamoeba invadens
PMKCILCSQNAYFKTPKTCEK

SEQ ID NO: 3046475 - protein, 25 aa, Entamoeba invadens
PMQRLPRYELLLKDLLKTPVFKDNQ

SEQ ID NO: 3046476 - protein, 21 aa, Entamoeba invadens
PMQYINVAIDLYQKMDLWQLL

SEQ ID NO: 3046477 - protein, 25 aa, Entamoeba invadens
PMSLNIFIDVLKFLHKMSLEECEKV

SEQ ID NO: 3046478 - protein, 19 aa, Entamoeba invadens
PNATLFPNNKIWSAECYPA

SEQ ID NO: 3046479 - protein, 27 aa, Entamoeba invadens
PNAYIERMMFFYFRDNATFNMGNYSSI

SEQ ID NO: 3046480 - protein, 24 aa, Entamoeba invadens
PNCHIVIIFFSELPKRCKNDYRKL

SEQ ID NO: 3046481 - protein, 17 aa, Entamoeba invadens
PNFVIQKMYFISRSCKS

SEQ ID NO: 3046482 - protein, 22 aa, Entamoeba invadens
PNLVFFPFESNCSMGGYGCYNQ

SEQ ID NO: 3046483 - protein, 26 aa, Entamoeba invadens
PNNCILCRFSYYLTNGYCLKCDSSCV

SEQ ID NO: 3046484 - protein, 28 aa, Entamoeba invadens
PNYNLACDLLKTLQFFMPMDDHMVAKTS

SEQ ID NO: 3046485 - protein, 18 aa, Entamoeba invadens
PPIPKEIVFPTQPPGGLQ

SEQ ID NO: 3046486 - protein, 25 aa, Entamoeba invadens
PPWGVVTMFMSWAELLYDEFDNHAN

SEQ ID NO: 3046487 - protein, 21 aa, Entamoeba invadens
PQDVLIPIYENKTCVSECPSP

SEQ ID NO: 3046488 - protein, 24 aa, Entamoeba invadens
PQIRRAQIYMNNNWVKTCMKAWSL

SEQ ID NO: 3046489 - protein, 18 aa, Entamoeba invadens
PQLDKPPIVLWKSDWLHL

SEQ ID NO: 3046490 - protein, 21 aa, Entamoeba invadens
PQPINYNLTREMKANAVKPVF

SEQ ID NO: 3046491 - protein, 23 aa, Entamoeba invadens
PQTPLVAPLYIKVTSIAGDVVYA

SEQ ID NO: 3046492 - protein, 23 aa, Entamoeba invadens
PRLAPKVLIFAKSQLVVSGAKVA

SEQ ID NO: 3046493 - protein, 20 aa, Entamoeba invadens
PRNIKPLLKEQIEKVWPSQH

SEQ ID NO: 3046494 - protein, 21 aa, Entamoeba invadens
PSAHLPLVLKFDKDNWQEQIK

SEQ ID NO: 3046495 - protein, 25 aa, Entamoeba invadens
PSAYVKFMNLTLTGGKFSVLDETEI

SEQ ID NO: 3046496 - protein, 18 aa, Entamoeba invadens
PSFILQRPGYQKRFYYDE

SEQ ID NO: 3046497 - protein, 26 aa, Entamoeba invadens
PSHTGCVFCADGTRYVGFDKVLPCEF

SEQ ID NO: 3046498 - protein, 18 aa, Entamoeba invadens
PSHYFTKRNKYPLKNYEV

SEQ ID NO: 3046499 - protein, 23 aa, Entamoeba invadens
PSIKMLDLMNLKYGERLKAVITV

SEQ ID NO: 3046500 - protein, 29 aa, Entamoeba invadens
PSLFSKVMNYFWPSYFTVSTPPPLHEDKA

SEQ ID NO: 3046501 - protein, 28 aa, Entamoeba invadens
PSPWIRDYNNFFLSFNKAIRVDSATPAY

SEQ ID NO: 3046502 - protein, 19 aa, Entamoeba invadens
PSTLFKAFLNFLERVAAIQ

SEQ ID NO: 3046503 - protein, 24 aa, Entamoeba invadens
PSTVQAITQFQIKYGLKVDGDAGP

SEQ ID NO: 3046504 - protein, 25 aa, Entamoeba invadens
PTELQTFLTIILPGVAVVQGFGMTE

SEQ ID NO: 3046505 - protein, 26 aa, Entamoeba invadens
PTELQTFLTLILPKVSVVQGFGMTEL

SEQ ID NO: 3046506 - protein, 18 aa, Entamoeba invadens
PTEMLFAQDFKEARITVE

SEQ ID NO: 3046507 - protein, 24 aa, Entamoeba invadens
PTFEKKPNFLIMKKATEEEIHKME

SEQ ID NO: 3046508 - protein, 26 aa, Entamoeba invadens
PTLQELRVMSWLGFIGGAKGMFYYSY

SEQ ID NO: 3046509 - protein, 17 aa, Entamoeba invadens
PTTITYLENHRKCLRYY

SEQ ID NO: 3046510 - protein, 25 aa, Entamoeba invadens
PTVTDGIIVIYLHPGITSTYISAVL

SEQ ID NO: 3046511 - protein, 17 aa, Entamoeba invadens
PVCKTCYSGFFVNSEGK

SEQ ID NO: 3046512 - protein, 29 aa, Entamoeba invadens
PVDVRNNIVANLKLDRRFTNADQALDAVK

SEQ ID NO: 3046513 - protein, 17 aa, Entamoeba invadens
PVPPEIIQIKALLDKLD

SEQ ID NO: 3046514 - protein, 24 aa, Entamoeba invadens
PVSPRLYPTFSFLSTVPPKMREEL

SEQ ID NO: 3046515 - protein, 17 aa, Entamoeba invadens
PVTLQRFLKTVLPNTDV

SEQ ID NO: 3046516 - protein, 17 aa, Entamoeba invadens
PVTPDIFPMKKILETLS

SEQ ID NO: 3046517 - protein, 25 aa, Entamoeba invadens
PWGVTTMFMAWAELLIDSYDGNAGL

SEQ ID NO: 3046518 - protein, 18 aa, Entamoeba invadens
PYIKNYYIVTLNQIPDFL

SEQ ID NO: 3046519 - protein, 19 aa, Entamoeba invadens
PYNNLPDLPEGDIIPLYHS

SEQ ID NO: 3046520 - protein, 18 aa, Entamoeba invadens
PYYAMSRIYKTYVLAYTR

SEQ ID NO: 3046521 - protein, 17 aa, Entamoeba invadens
QADDAFVTLFRELARLT

SEQ ID NO: 3046522 - protein, 24 aa, Entamoeba invadens
QADSQLIVFPSGYSILIDAGETST

SEQ ID NO: 3046523 - protein, 20 aa, Entamoeba invadens
QAGLHWQPVLSFHACGGNVG

SEQ ID NO: 3046524 - protein, 25 aa, Entamoeba invadens
QARGVMFAYLVLSWPGTFCLDKCCH

SEQ ID NO: 3046525 - protein, 19 aa, Entamoeba invadens
QARPMMFKSFKGLPKNTQS

SEQ ID NO: 3046526 - protein, 29 aa, Entamoeba invadens
QAVDFSRLNLIILPRYFFNCLDNVQTRRL

SEQ ID NO: 3046527 - protein, 30 aa, Entamoeba invadens
QCETLDLMYRMFIKTNYFGKFLFDFQNNVN

SEQ ID NO: 3046528 - protein, 17 aa, Entamoeba invadens
QCFVTGAIAPKVPILSR

SEQ ID NO: 3046529 - protein, 17 aa, Entamoeba invadens
QCMFASAVQYYVPLRIK

SEQ ID NO: 3046530 - protein, 18 aa, Entamoeba invadens
QCNACLNGFFVDQTVCKE

SEQ ID NO: 3046531 - protein, 23 aa, Entamoeba invadens
QCSSYFEMFNYHPTFKQIAKRFV

SEQ ID NO: 3046532 - protein, 18 aa, Entamoeba invadens
QCTSCYTGYGLFLSNVCE

SEQ ID NO: 3046533 - protein, 18 aa, Entamoeba invadens
QDFTNASPTLFYCLSCVK

SEQ ID NO: 3046534 - protein, 26 aa, Entamoeba invadens
QDIVKRLLLSINFFDNKHKVMQQLAQ

SEQ ID NO: 3046535 - protein, 21 aa, Entamoeba invadens
QDLLNLVLMAFIPVMVNKNIA

SEQ ID NO: 3046536 - protein, 23 aa, Entamoeba invadens
QDMFAPGYDWRYANRQRDDWIAK

SEQ ID NO: 3046537 - protein, 26 aa, Entamoeba invadens
QDQLFDWCDLLHLMASRLKTYKITNQ

SEQ ID NO: 3046538 - protein, 17 aa, Entamoeba invadens
QEIRQNWMSIESCLLAL

SEQ ID NO: 3046539 - protein, 18 aa, Entamoeba invadens
QENCIFKDLIQNCWNQNP

SEQ ID NO: 3046540 - protein, 20 aa, Entamoeba invadens
QERCKFFPENERPTCYSTAF

SEQ ID NO: 3046541 - protein, 21 aa, Entamoeba invadens
QFGAPYFQYGQYPMNYYHPMQ

SEQ ID NO: 3046542 - protein, 24 aa, Entamoeba invadens
QFGVQGFPTVKLFSAQKTHSKRTP

SEQ ID NO: 3046543 - protein, 18 aa, Entamoeba invadens
QFYLITLSVAKTASVVKG

SEQ ID NO: 3046544 - protein, 19 aa, Entamoeba invadens
QGITRIKNGINLLEEKMKA

SEQ ID NO: 3046545 - protein, 25 aa, Entamoeba invadens
QGNDWLRILQLLIDKLRHYPQLSDS

SEQ ID NO: 3046546 - protein, 26 aa, Entamoeba invadens
QGPRYFLDFFEAFTQLPILSNDGSFP

SEQ ID NO: 3046547 - protein, 30 aa, Entamoeba invadens
QGREYYINYIKNTVVPHFKRGTPMGLNINY

SEQ ID NO: 3046548 - protein, 27 aa, Entamoeba invadens
QGVPLEKIILGIALYGRGWSLETIVNH

SEQ ID NO: 3046549 - protein, 27 aa, Entamoeba invadens
QIDICKKFLVLDFPNLVFFDKKNKETT

SEQ ID NO: 3046550 - protein, 27 aa, Entamoeba invadens
QIENKYLNFKCRGLGLFCIIDGIHNDQ

SEQ ID NO: 3046551 - protein, 28 aa, Entamoeba invadens
QIGDSAFFKCYLLTQFEFGESLTAVNSR

SEQ ID NO: 3046552 - protein, 19 aa, Entamoeba invadens
QIIQHINPFDWVLSETACS

SEQ ID NO: 3046553 - protein, 25 aa, Entamoeba invadens
QIISFLFLLIQVTCSTEINTFADIK

SEQ ID NO: 3046554 - protein, 18 aa, Entamoeba invadens
QINKIKLMAYKKTATCSC

SEQ ID NO: 3046555 - protein, 23 aa, Entamoeba invadens
QINPQQFPLIPQQQPIVPHQPQQ

SEQ ID NO: 3046556 - protein, 19 aa, Entamoeba invadens
QIRSAFVPAPLYSFQVFNS

SEQ ID NO: 3046557 - protein, 22 aa, Entamoeba invadens
QISYQYMIFNNSGVLKLGKCLM

SEQ ID NO: 3046558 - protein, 23 aa, Entamoeba invadens
QISYQYMIFNNSGVLKLGKCLMP

SEQ ID NO: 3046559 - protein, 17 aa, Entamoeba invadens
QIVTLKRGFACEFEIFL

SEQ ID NO: 3046560 - protein, 17 aa, Entamoeba invadens
QKALSMLCAFKTFNWKK

SEQ ID NO: 3046561 - protein, 18 aa, Entamoeba invadens
QKKLLNPAKLNTSTKKEK

SEQ ID NO: 3046562 - protein, 18 aa, Entamoeba invadens
QKKRKIFSTPKRSKFLLK

SEQ ID NO: 3046563 - protein, 20 aa, Entamoeba invadens
QKLRYTFGKMPNVNLTCVYS

SEQ ID NO: 3046564 - protein, 21 aa, Entamoeba invadens
QKNIWHRSVGYSNERVNAIFK

SEQ ID NO: 3046565 - protein, 17 aa, Entamoeba invadens
QKRFYYDEWNAGTIYEF

SEQ ID NO: 3046566 - protein, 20 aa, Entamoeba invadens
QKTCVSCKAGFYLEGSKCTV

SEQ ID NO: 3046567 - protein, 25 aa, Entamoeba invadens
QLCGHTHMDAYRLLPNYTDATFPSI

SEQ ID NO: 3046568 - protein, 18 aa, Entamoeba invadens
QLCPQGVKVMILGNKVDL

SEQ ID NO: 3046569 - protein, 18 aa, Entamoeba invadens
QLEKIVSITLPQSLVFFD

SEQ ID NO: 3046570 - protein, 21 aa, Entamoeba invadens
QLFSNNLPEYSAVAYSYLDAE

SEQ ID NO: 3046571 - protein, 18 aa, Entamoeba invadens
QLIVFPSGYSILIDAGET

SEQ ID NO: 3046572 - protein, 22 aa, Entamoeba invadens
QLIYANYTYFKNSSKISKLLFT

SEQ ID NO: 3046573 - protein, 17 aa, Entamoeba invadens
QLKPIIEAFTKNVQIEK

SEQ ID NO: 3046574 - protein, 21 aa, Entamoeba invadens
QLMHLNRKPVFLKANNKFGDF

SEQ ID NO: 3046575 - protein, 18 aa, Entamoeba invadens
QLNDFKFVGGSIKKVEFK

SEQ ID NO: 3046576 - protein, 22 aa, Entamoeba invadens
QLPDIQQCMLLLNYKSKHPLIG

SEQ ID NO: 3046577 - protein, 18 aa, Entamoeba invadens
QLQKIRALLPQLHLKMKQ

SEQ ID NO: 3046578 - protein, 24 aa, Entamoeba invadens
QLQLIEKLLRKPLFRHNREYERTR

SEQ ID NO: 3046579 - protein, 26 aa, Entamoeba invadens
QLRCKSCIFWFRFKMSASNALGLTSA

SEQ ID NO: 3046580 - protein, 20 aa, Entamoeba invadens
QLRKASVLESMKKELGAVPE

SEQ ID NO: 3046581 - protein, 23 aa, Entamoeba invadens
QLTNFMAKQYLWWAEQCKTNKTE

SEQ ID NO: 3046582 - protein, 25 aa, Entamoeba invadens
QMGVNYLGHFLLTQLVLPKIEKVHG

SEQ ID NO: 3046583 - protein, 24 aa, Entamoeba invadens
QNAVIALLGLIHYLDLQVVRCVQM

SEQ ID NO: 3046584 - protein, 18 aa, Entamoeba invadens
QNCVTCATDFTRKCIACK

SEQ ID NO: 3046585 - protein, 30 aa, Entamoeba invadens
QNIFETLYDFSCEFNFVLDLSSTCFKDENC

SEQ ID NO: 3046586 - protein, 19 aa, Entamoeba invadens
QNNLSYVICFLEKTIIKFD

SEQ ID NO: 3046587 - protein, 19 aa, Entamoeba invadens
QNRLYFIKSRKHSFGPYSS

SEQ ID NO: 3046588 - protein, 23 aa, Entamoeba invadens
QNSKVKIYLRKNSYKTWTTVEKT

SEQ ID NO: 3046589 - protein, 26 aa, Entamoeba invadens
QNVKEKFFLHGFWPQYENSRDMVCCI

SEQ ID NO: 3046590 - protein, 23 aa, Entamoeba invadens
QNVPKYVFISKPFNEEFSMDLPV

SEQ ID NO: 3046591 - protein, 17 aa, Entamoeba invadens
QPACKKYHRLCKKVYRR

SEQ ID NO: 3046592 - protein, 17 aa, Entamoeba invadens
QPGYKYIVSMLTPAECE

SEQ ID NO: 3046593 - protein, 20 aa, Entamoeba invadens
QPIEGYTPVLLQMVFRHGDR

SEQ ID NO: 3046594 - protein, 31 aa, Entamoeba invadens
QPISLFQALQRRGITSRLLRFPYSNNIIEKN

SEQ ID NO: 3046595 - protein, 17 aa, Entamoeba invadens
QPITRKLNLMVYVEYWP

SEQ ID NO: 3046596 - protein, 25 aa, Entamoeba invadens
QPKMDYIMFVQFWPGVSCTATNKCT

SEQ ID NO: 3046597 - protein, 19 aa, Entamoeba invadens
QPNYREIMLKKYKMNHIPN

SEQ ID NO: 3046598 - protein, 28 aa, Entamoeba invadens
QPTQQQYYYYPRPFQQPLYPTQHFPHFV

SEQ ID NO: 3046599 - protein, 20 aa, Entamoeba invadens
QPVQSGVFCPVLMPNIECGY

SEQ ID NO: 3046600 - protein, 21 aa, Entamoeba invadens
QQAFRVSPHPKFIILSGDLPA

SEQ ID NO: 3046601 - protein, 18 aa, Entamoeba invadens
QQKPPKLKFVRPKRARSL

SEQ ID NO: 3046602 - protein, 17 aa, Entamoeba invadens
QQKQILMLGYGYHNNIF

SEQ ID NO: 3046603 - protein, 17 aa, Entamoeba invadens
QQLAQLMHLNRKPVFLK

SEQ ID NO: 3046604 - protein, 37 aa, Entamoeba invadens
QQQQNLINQMKFQNPTPLPFPTPAPITAPEKVVEVQK

SEQ ID NO: 3046605 - protein, 24 aa, Entamoeba invadens
QQQQQYYYYYPGVHGQLYPQQQQQ

SEQ ID NO: 3046606 - protein, 19 aa, Entamoeba invadens
QQQYYYYPQQLPQQTVYPT

SEQ ID NO: 3046607 - protein, 24 aa, Entamoeba invadens
QQSPIIIQQMPSEKPISLTSPTIN

SEQ ID NO: 3046608 - protein, 22 aa, Entamoeba invadens
QQSVRFILIDRTKTTNYSTLCD

SEQ ID NO: 3046609 - protein, 31 aa, Entamoeba invadens
QRDYIGIPPESRFITIIDPLSLPDRVTPIVI

SEQ ID NO: 3046610 - protein, 18 aa, Entamoeba invadens
QRFVYVHPYNGYPSNEKY

SEQ ID NO: 3046611 - protein, 27 aa, Entamoeba invadens
QRIALRNRMFVINYYKNLAKQQQQKRK

SEQ ID NO: 3046612 - protein, 29 aa, Entamoeba invadens
QRIRKLEDFLLYRDWKNLIKPDYSIWEES

SEQ ID NO: 3046613 - protein, 18 aa, Entamoeba invadens
QRLIAIKSMRENDRKIIR

SEQ ID NO: 3046614 - protein, 25 aa, Entamoeba invadens
QRQAWNTWNYTPQTPLVAPLYIKVT

SEQ ID NO: 3046615 - protein, 26 aa, Entamoeba invadens
QRQFALILDLCFYGPYGIPVYTPIIS

SEQ ID NO: 3046616 - protein, 20 aa, Entamoeba invadens
QRRLWIVRTPPRVSLSRIEA

SEQ ID NO: 3046617 - protein, 23 aa, Entamoeba invadens
QRTLEFMLFVQYWPGEHCANDYC

SEQ ID NO: 3046618 - protein, 28 aa, Entamoeba invadens
QRTNFEDFMKRFIFSKKILKSRMSKLKM

SEQ ID NO: 3046619 - protein, 21 aa, Entamoeba invadens
QSDRIYTWKYYLELAEAIQQA

SEQ ID NO: 3046620 - protein, 18 aa, Entamoeba invadens
QSFTLLLKEFREAINAEK

SEQ ID NO: 3046621 - protein, 21 aa, Entamoeba invadens
QSGYYLFNGICTYCGDHCVNS

SEQ ID NO: 3046622 - protein, 19 aa, Entamoeba invadens
QSIAFRHFQLEEYTPAAVA

SEQ ID NO: 3046623 - protein, 28 aa, Entamoeba invadens
QSKFDTTSFLFAPLRLEVFKEPLLPSER

SEQ ID NO: 3046624 - protein, 26 aa, Entamoeba invadens
QSNMDTWYIGHYLDNKPYPKSLYNYI

SEQ ID NO: 3046625 - protein, 24 aa, Entamoeba invadens
QSPIHKLVFISFNNNYPLPPMDVV

SEQ ID NO: 3046626 - protein, 17 aa, Entamoeba invadens
QSRLDRIIVKGYSLITN

SEQ ID NO: 3046627 - protein, 28 aa, Entamoeba invadens
QSSPAISYTPSFTPSYTPSYTPTNTYTP

SEQ ID NO: 3046628 - protein, 27 aa, Entamoeba invadens
QSVGVPVCLLCYSPYVLASQTKTCVSC

SEQ ID NO: 3046629 - protein, 25 aa, Entamoeba invadens
QSVLNSIFYSLYYKRENYTFERCTQ

SEQ ID NO: 3046630 - protein, 28 aa, Entamoeba invadens
QSWTGFPNVFSDLWKPYLEITLRDVEEN

SEQ ID NO: 3046631 - protein, 34 aa, Entamoeba invadens
QSYPSMFQFKNELLYFLMYHTLSKRFSTMSTDEN

SEQ ID NO: 3046632 - protein, 23 aa, Entamoeba invadens
QTEKIICVLIKLLSHKSLLIVEV

SEQ ID NO: 3046633 - protein, 23 aa, Entamoeba invadens
QTLPPLLKKLLSEPIHFTPLHTL

SEQ ID NO: 3046634 - protein, 22 aa, Entamoeba invadens
QTNIRQLLFSREDDILVLLSQQ

SEQ ID NO: 3046635 - protein, 23 aa, Entamoeba invadens
QTPELQILLDEYEKYLIRYLENM

SEQ ID NO: 3046636 - protein, 25 aa, Entamoeba invadens
QTRLGDFLESLKILYSDESLKIHRR

SEQ ID NO: 3046637 - protein, 26 aa, Entamoeba invadens
QTRRTLMRTLYKLVSKLSLKQQGRLI

SEQ ID NO: 3046638 - protein, 28 aa, Entamoeba invadens
QTWTDTSLMRFFFPPLSRAGTSAAFYAW

SEQ ID NO: 3046639 - protein, 17 aa, Entamoeba invadens
QVGFANGKYQKTTTRKL

SEQ ID NO: 3046640 - protein, 21 aa, Entamoeba invadens
QVLYLSVLSNTVNYEVTDLSN

SEQ ID NO: 3046641 - protein, 27 aa, Entamoeba invadens
QVMLNKIEALLYSYQLEKKLSELKQEK

SEQ ID NO: 3046642 - protein, 23 aa, Entamoeba invadens
QVMPTTILFKKGEQYRVLFGMHD

SEQ ID NO: 3046643 - protein, 18 aa, Entamoeba invadens
QVPAPFPFGPKHPEHNNH

SEQ ID NO: 3046644 - protein, 17 aa, Entamoeba invadens
QVQTDRLKSWGFNALPN

SEQ ID NO: 3046645 - protein, 25 aa, Entamoeba invadens
QVTMNELVFDLGVNPSLIVLDRTSS

SEQ ID NO: 3046646 - protein, 26 aa, Entamoeba invadens
QVVKNPLMIWYTYKVNKTFKPELLNM

SEQ ID NO: 3046647 - protein, 23 aa, Entamoeba invadens
QYIDKFLMVSAPVYGSALSVKEV

SEQ ID NO: 3046648 - protein, 22 aa, Entamoeba invadens
QYKQHFYIPYQNNYDYALCYQA

SEQ ID NO: 3046649 - protein, 24 aa, Entamoeba invadens
QYLSGTICFSCRAGTYSSGGTTTS

SEQ ID NO: 3046650 - protein, 20 aa, Entamoeba invadens
QYNTILLRLFHKKLAPQVDK

SEQ ID NO: 3046651 - protein, 20 aa, Entamoeba invadens
QYQQYYYIDPLSGQYTFFCL

SEQ ID NO: 3046652 - protein, 31 aa, Entamoeba invadens
QYVTFNISNDFFLALFVDYLNTIQISMINPI

SEQ ID NO: 3046653 - protein, 19 aa, Entamoeba invadens
RADYVRCLGQRRGFMRSAG

SEQ ID NO: 3046654 - protein, 20 aa, Entamoeba invadens
RAEKKALKQAKKQGLNKKQT

SEQ ID NO: 3046655 - protein, 18 aa, Entamoeba invadens
RAFLNCISLSKITFGKSV

SEQ ID NO: 3046656 - protein, 21 aa, Entamoeba invadens
RAILVAFILTFTRDAEDLKID

SEQ ID NO: 3046657 - protein, 18 aa, Entamoeba invadens
RALLAVVRMHLPAIEYFV

SEQ ID NO: 3046658 - protein, 28 aa, Entamoeba invadens
RAQIGEVQVWLKKKVTMLTSEKKTILDA

SEQ ID NO: 3046659 - protein, 23 aa, Entamoeba invadens
RARLARLNAQRRKQAVVKRKQVQ

SEQ ID NO: 3046660 - protein, 27 aa, Entamoeba invadens
RATIPVIQIMDWTWYAKKDPVTFKDRL

SEQ ID NO: 3046661 - protein, 17 aa, Entamoeba invadens
RAYMDSLFQNYEMPPVF

SEQ ID NO: 3046662 - protein, 25 aa, Entamoeba invadens
RCDEKVMFKPLPLKLTNRETISRNE

SEQ ID NO: 3046663 - protein, 18 aa, Entamoeba invadens
RCGNQIMFAPFPEYLLDP

SEQ ID NO: 3046664 - protein, 24 aa, Entamoeba invadens
RCKPHFAQCLTLQTPVPGTSIYSN

SEQ ID NO: 3046665 - protein, 24 aa, Entamoeba invadens
RCLRDYYCPNGILMYPCLLGTHCD

SEQ ID NO: 3046666 - protein, 21 aa, Entamoeba invadens
RDAFYKMKGWCRDKLKHAVYL

SEQ ID NO: 3046667 - protein, 20 aa, Entamoeba invadens
RDAILGMFIPKSGWTENHLE

SEQ ID NO: 3046668 - protein, 18 aa, Entamoeba invadens
RDIKIFPFTIVDQENKPY

SEQ ID NO: 3046669 - protein, 20 aa, Entamoeba invadens
RDINKSLQPLKIIEKTLKEK

SEQ ID NO: 3046670 - protein, 23 aa, Entamoeba invadens
RDKISSVNMFFRGKAYQSLSDIK

SEQ ID NO: 3046671 - protein, 26 aa, Entamoeba invadens
RDKSEALEFLRWIKFNYMSESQDTLG

SEQ ID NO: 3046672 - protein, 18 aa, Entamoeba invadens
RDLALLKLPQEMYTKSVQ

SEQ ID NO: 3046673 - protein, 17 aa, Entamoeba invadens
RDSQGALIVYDITSRQS

SEQ ID NO: 3046674 - protein, 30 aa, Entamoeba invadens
RDWKFSGIINMKHIFFMTRPRQEKMTIYED

SEQ ID NO: 3046675 - protein, 27 aa, Entamoeba invadens
REAAFSNFLAVFLLERGFTLVTSTKKM

SEQ ID NO: 3046676 - protein, 25 aa, Entamoeba invadens
REAAFSNFLSFVLVQRGYSLCLNLT

SEQ ID NO: 3046677 - protein, 25 aa, Entamoeba invadens
REAEKLEFPFLPPKAKYPNRIPVTP

SEQ ID NO: 3046678 - protein, 24 aa, Entamoeba invadens
REAIRRGIDWLLENGYFAQANKAE

SEQ ID NO: 3046679 - protein, 27 aa, Entamoeba invadens
REEGVLRFNKSLRLGTKKIRKVISLRE

SEQ ID NO: 3046680 - protein, 25 aa, Entamoeba invadens
REEKQILRSARTLLKTMRHKGKGFM

SEQ ID NO: 3046681 - protein, 43 aa, Entamoeba invadens
REERISLRKIARTKRLVLSKMYKILRVLSPLEQSRVIRQLNLL

SEQ ID NO: 3046682 - protein, 28 aa, Entamoeba invadens
REINNAKVLFWENSLNKCQCCRRCLEVP

SEQ ID NO: 3046683 - protein, 26 aa, Entamoeba invadens
REINRRKRLILAEQLKAAKITRNAEM

SEQ ID NO: 3046684 - protein, 30 aa, Entamoeba invadens
REKNITIPQNYPFFVELLNTNSTTRALQVD

SEQ ID NO: 3046685 - protein, 20 aa, Entamoeba invadens
RELQRQFDNLKMEKNNLNEE

SEQ ID NO: 3046686 - protein, 25 aa, Entamoeba invadens
RENDRKIIRLQKRYISIIEEKGKSI

SEQ ID NO: 3046687 - protein, 23 aa, Entamoeba invadens
REQYRLIRRMDLRHRFNLGTEMD

SEQ ID NO: 3046688 - protein, 25 aa, Entamoeba invadens
RERFIAYLPLAHIFEIGIEFALLMD

SEQ ID NO: 3046689 - protein, 24 aa, Entamoeba invadens
RERKLSVTLFIDPIMREAQKAAEY

SEQ ID NO: 3046690 - protein, 25 aa, Entamoeba invadens
RETMRILQDILAEFGFLVFIEKETV

SEQ ID NO: 3046691 - protein, 36 aa, Entamoeba invadens
REVKQKRLWVAIKDINPFVNDCYLGYLRPTYVASSN

SEQ ID NO: 3046692 - protein, 20 aa, Entamoeba invadens
REVMREIFGVKPAFLCRRMN

SEQ ID NO: 3046693 - protein, 26 aa, Entamoeba invadens
RFGDTLRVFIAVHLYYSYLSNTCEQG

SEQ ID NO: 3046694 - protein, 19 aa, Entamoeba invadens
RFLVDKYLLDQQMKGSLRN

SEQ ID NO: 3046695 - protein, 29 aa, Entamoeba invadens
RFRHGYQFEFWLYYIKTFQQGRAKYKQAD

SEQ ID NO: 3046696 - protein, 26 aa, Entamoeba invadens
RGAFEGYTLIIWAKKPPLDEGTNNQR

SEQ ID NO: 3046697 - protein, 29 aa, Entamoeba invadens
RGFNLFGNLGSLLMGILRNFTDSVKSEID

SEQ ID NO: 3046698 - protein, 25 aa, Entamoeba invadens
RGGIWSLIENYGFTFKKYVDRDIGT

SEQ ID NO: 3046699 - protein, 26 aa, Entamoeba invadens
RGLPFPLNSLVYHLPKLGSLGTNVVQ

SEQ ID NO: 3046700 - protein, 23 aa, Entamoeba invadens
RGNLRDNGRGMWLLSVVIGFVFL

SEQ ID NO: 3046701 - protein, 24 aa, Entamoeba invadens
RGPSDYWYMDPKNIRPYGICIIKL

SEQ ID NO: 3046702 - protein, 26 aa, Entamoeba invadens
RGWMWNSFVPRWCELTERNLMLFMNR

SEQ ID NO: 3046703 - protein, 25 aa, Entamoeba invadens
RHTSRLWFYLYGVHGMMEKLSRAVG

SEQ ID NO: 3046704 - protein, 25 aa, Entamoeba invadens
RHTTLLKTILMTYAFFNMRINYRQG

SEQ ID NO: 3046705 - protein, 20 aa, Entamoeba invadens
RIADCILLCFSLYTDKSTCF

SEQ ID NO: 3046706 - protein, 27 aa, Entamoeba invadens
RIELLVPYFNTVASFFRPKMAIALLKQ

SEQ ID NO: 3046707 - protein, 17 aa, Entamoeba invadens
RIHAVHREIKELRTEKK

SEQ ID NO: 3046708 - protein, 19 aa, Entamoeba invadens
RIIVKGYSLITNPMNNLPY

SEQ ID NO: 3046709 - protein, 21 aa, Entamoeba invadens
RIKKVVLLRKRVRQIEAQITE

SEQ ID NO: 3046710 - protein, 17 aa, Entamoeba invadens
RILDPFGIPIKEALPGV

SEQ ID NO: 3046711 - protein, 19 aa, Entamoeba invadens
RINYYFLNGLLKALSDAKS

SEQ ID NO: 3046712 - protein, 19 aa, Entamoeba invadens
RIRMSFSSSPGLIHSKDDY

SEQ ID NO: 3046713 - protein, 21 aa, Entamoeba invadens
RITYGGFVIPKNYTKCVAGYY

SEQ ID NO: 3046714 - protein, 26 aa, Entamoeba invadens
RKALASRPLPPLPITPLQHPTTSDSD

SEQ ID NO: 3046715 - protein, 20 aa, Entamoeba invadens
RKCKKCVFGYYPSTAGTCVE

SEQ ID NO: 3046716 - protein, 18 aa, Entamoeba invadens
RKCVTCDSGYYPSNGICV

SEQ ID NO: 3046717 - protein, 24 aa, Entamoeba invadens
RKDGKMIQLELYKLVKKISKVNQL

SEQ ID NO: 3046718 - protein, 26 aa, Entamoeba invadens
RKEKSRFERLLAQKKKLLKEANQLAS

SEQ ID NO: 3046719 - protein, 27 aa, Entamoeba invadens
RKINAKFFPPLFYSTFVFYASVEGMNI

SEQ ID NO: 3046720 - protein, 18 aa, Entamoeba invadens
RKLKEARVKLLNYKNLVK

SEQ ID NO: 3046721 - protein, 21 aa, Entamoeba invadens
RKMKSLDGKMYSKLTMLKGAK

SEQ ID NO: 3046722 - protein, 28 aa, Entamoeba invadens
RKNKPKRYILFLVGLLNYIEVLDDDDVF

SEQ ID NO: 3046723 - protein, 20 aa, Entamoeba invadens
RKQLRLLRRVTDKIASPDRD

SEQ ID NO: 3046724 - protein, 22 aa, Entamoeba invadens
RKYKPITKRKIANFVANEIKNA

SEQ ID NO: 3046725 - protein, 26 aa, Entamoeba invadens
RLEKVDLKLTMYFAEKRKKVTERISQ

SEQ ID NO: 3046726 - protein, 20 aa, Entamoeba invadens
RLELLVLVEYWPGDKCSKEV

SEQ ID NO: 3046727 - protein, 19 aa, Entamoeba invadens
RLGVKFLSSPIFKNEVPYQ

SEQ ID NO: 3046728 - protein, 21 aa, Entamoeba invadens
RLIYGKKENYLRAHKLQIVLF

SEQ ID NO: 3046729 - protein, 21 aa, Entamoeba invadens
RLKVRYGVNPVLYGMRLVAYN

SEQ ID NO: 3046730 - protein, 18 aa, Entamoeba invadens
RLLRFPYSNNIIEKNEDI

SEQ ID NO: 3046731 - protein, 18 aa, Entamoeba invadens
RLQNITLFRSSLANNQYI

SEQ ID NO: 3046732 - protein, 21 aa, Entamoeba invadens
RLRHKIFKHLVKQRKFVVGMS

SEQ ID NO: 3046733 - protein, 26 aa, Entamoeba invadens
RLSSYYDDIFYWCTKLETADLTRVYS

SEQ ID NO: 3046734 - protein, 18 aa, Entamoeba invadens
RLTSPFLTGQWFKLDMNY

SEQ ID NO: 3046735 - protein, 23 aa, Entamoeba invadens
RMKRRYIVYGLDKWVLIERIKQI

SEQ ID NO: 3046736 - protein, 42 aa, Entamoeba invadens
RMKSRLNLYLMFDFKVFLYRHELLLKLSSFIGLLKSPHFLKA

SEQ ID NO: 3046737 - protein, 26 aa, Entamoeba invadens
RMRHQIFLNMFYYREKLELISLLALY

SEQ ID NO: 3046738 - protein, 21 aa, Entamoeba invadens
RNAELRLFSDELIDVLVCGDD

SEQ ID NO: 3046739 - protein, 19 aa, Entamoeba invadens
RNAEMITMIYKQLAELKTH

SEQ ID NO: 3046740 - protein, 27 aa, Entamoeba invadens
RNKEACFVNYLALNLVQRGYSLITNVT

SEQ ID NO: 3046741 - protein, 23 aa, Entamoeba invadens
RNKNLYCCINWYGPDNFDTLLLM

SEQ ID NO: 3046742 - protein, 18 aa, Entamoeba invadens
RNLALIGFSEKRRLCAKF

SEQ ID NO: 3046743 - protein, 18 aa, Entamoeba invadens
RNMYCCTNFFGPDNVENM

SEQ ID NO: 3046744 - protein, 17 aa, Entamoeba invadens
RNRFPQCTDFVPSGSVQ

SEQ ID NO: 3046745 - protein, 20 aa, Entamoeba invadens
RNYYEILGVTKTATASELKK

SEQ ID NO: 3046746 - protein, 33 aa, Entamoeba invadens
RQKFKQFFKDYTEFIVLLNHHREFFKDRENWFS

SEQ ID NO: 3046747 - protein, 26 aa, Entamoeba invadens
RQMNLDDFRLSLFAPIDLINLTPDIQ

SEQ ID NO: 3046748 - protein, 17 aa, Entamoeba invadens
RQRAILYSVLYDFETKE

SEQ ID NO: 3046749 - protein, 24 aa, Entamoeba invadens
RQTKLEILRALRKQADSLTGVERG

SEQ ID NO: 3046750 - protein, 30 aa, Entamoeba invadens
RQVGSQCVYADPFLAFKYQDYKQQVDGLIN

SEQ ID NO: 3046751 - protein, 24 aa, Entamoeba invadens
RSCFHFPGRYNLVQTLACEESGAG

SEQ ID NO: 3046752 - protein, 19 aa, Entamoeba invadens
RSGFSLIIKMLNAPIRLLL

SEQ ID NO: 3046753 - protein, 17 aa, Entamoeba invadens
RSPVVMVPGLMSSILEA

SEQ ID NO: 3046754 - protein, 22 aa, Entamoeba invadens
RSRDQQFLITGKLTEWYSNPQT

SEQ ID NO: 3046755 - protein, 24 aa, Entamoeba invadens
RSRKLIKKFHNRRSRRARATRRIY

SEQ ID NO: 3046756 - protein, 19 aa, Entamoeba invadens
RSRLLLTIAAPAGPKNIEN

SEQ ID NO: 3046757 - protein, 20 aa, Entamoeba invadens
RSRLLLTIAAPAGPKNIENL

SEQ ID NO: 3046758 - protein, 25 aa, Entamoeba invadens
RSSKFGTLFVTINVMYPASLSDNQI

SEQ ID NO: 3046759 - protein, 22 aa, Entamoeba invadens
RSTNYWCEHSNTLTLQTNSSEC

SEQ ID NO: 3046760 - protein, 24 aa, Entamoeba invadens
RSTSPFILSIFIFRSNKFEEFFTM

SEQ ID NO: 3046761 - protein, 24 aa, Entamoeba invadens
RSTWPVIQAMNWMSYALQFPEKYK

SEQ ID NO: 3046762 - protein, 24 aa, Entamoeba invadens
RSVRDVRLLLRRVGIELHKINRTL

SEQ ID NO: 3046763 - protein, 25 aa, Entamoeba invadens
RTAQDTPYSLGFWLQIQSAEDGYVS

SEQ ID NO: 3046764 - protein, 21 aa, Entamoeba invadens
RTCSKCVSGYYPESGNCYNCS

SEQ ID NO: 3046765 - protein, 25 aa, Entamoeba invadens
RTDRNWTHRLLLSSFTLVDGLNGND

SEQ ID NO: 3046766 - protein, 25 aa, Entamoeba invadens
RTDRNWTHRLLLSSYTLQDGLNGND

SEQ ID NO: 3046767 - protein, 19 aa, Entamoeba invadens
RTDTGIYCLLLARALERDT

SEQ ID NO: 3046768 - protein, 22 aa, Entamoeba invadens
RTEHLIFKDPKTTNLILRNWVS

SEQ ID NO: 3046769 - protein, 24 aa, Entamoeba invadens
RTEKKIVKMFLKGMKGKRCAVDQK

SEQ ID NO: 3046770 - protein, 26 aa, Entamoeba invadens
RTHSNKLHYLYRDLKYATVVEDRTRL

SEQ ID NO: 3046771 - protein, 34 aa, Entamoeba invadens
RTIFGDSLFLVGKISCIHWWWMDDSHAGEMTAGY

SEQ ID NO: 3046772 - protein, 24 aa, Entamoeba invadens
RTISPDIPVIIIATKIDLKDDKET

SEQ ID NO: 3046773 - protein, 23 aa, Entamoeba invadens
RTLMIIDCFVLVKDNYYSKTSII

SEQ ID NO: 3046774 - protein, 30 aa, Entamoeba invadens
RTLQSMEAFLQRFYPIKERGKYTDLEILTR

SEQ ID NO: 3046775 - protein, 41 aa, Entamoeba invadens
RTQKLRSYNDLMLQLMFFELKRKVLLQLGKETKIHKSVDFI

SEQ ID NO: 3046776 - protein, 31 aa, Entamoeba invadens
RVIRQLNLLNRLHVNHLALLGVDEARLAFSN

SEQ ID NO: 3046777 - protein, 30 aa, Entamoeba invadens
RVITKFDHIICIIILIKLKILFCGSMSTEQ

SEQ ID NO: 3046778 - protein, 30 aa, Entamoeba invadens
RVLKPSSLVRIPLFYRDDGAYIVTATSCSS

SEQ ID NO: 3046779 - protein, 18 aa, Entamoeba invadens
RVLLLQFSTSLIKPPFFG

SEQ ID NO: 3046780 - protein, 29 aa, Entamoeba invadens
RVLNIDFSFIKTFKIISFIEVKFDNEFLC

SEQ ID NO: 3046781 - protein, 17 aa, Entamoeba invadens
RVLPRKTVSTIKKVGEK

SEQ ID NO: 3046782 - protein, 21 aa, Entamoeba invadens
RVLRRNLALEKKLKVKLAEFT

SEQ ID NO: 3046783 - protein, 21 aa, Entamoeba invadens
RVMLRLKRDRLKRRLQRNKKI

SEQ ID NO: 3046784 - protein, 18 aa, Entamoeba invadens
RVNYRFQSELLDFIKPVI

SEQ ID NO: 3046785 - protein, 18 aa, Entamoeba invadens
RVPPPFPFGPKHPDHNNH

SEQ ID NO: 3046786 - protein, 28 aa, Entamoeba invadens
RVQDLPVYSLWFFYNSTLTQDQISMFKS

SEQ ID NO: 3046787 - protein, 19 aa, Entamoeba invadens
RVWDTIFAFPNRKMFYYIT

SEQ ID NO: 3046788 - protein, 28 aa, Entamoeba invadens
RWIYDPDKPLIIPYYLQVTAISGESVNI

SEQ ID NO: 3046789 - protein, 20 aa, Entamoeba invadens
RYEATVTHFLWRSVNQADEI

SEQ ID NO: 3046790 - protein, 19 aa, Entamoeba invadens
RYEMIRFDLLTNLKMLNIT

SEQ ID NO: 3046791 - protein, 28 aa, Entamoeba invadens
RYSMRNAHIVLLLFSFPPQKCKHDLTRL

SEQ ID NO: 3046792 - protein, 28 aa, Entamoeba invadens
RYYDFLRVFLSKTPPLRFFENLQHLHFK

SEQ ID NO: 3046793 - protein, 18 aa, Entamoeba invadens
SACVACESDYVLIGKRCV

SEQ ID NO: 3046794 - protein, 17 aa, Entamoeba invadens
SALDFQAWTAKYNKRFS

SEQ ID NO: 3046795 - protein, 18 aa, Entamoeba invadens
SAPRLKVRYGVNPVLYGM

SEQ ID NO: 3046796 - protein, 23 aa, Entamoeba invadens
SASPKMVAALPQVKRLVSESTSR

SEQ ID NO: 3046797 - protein, 24 aa, Entamoeba invadens
SAYGKFFMDFYSNMLLEHTKNVLS

SEQ ID NO: 3046798 - protein, 20 aa, Entamoeba invadens
SCAMLLMGALFEGAQVRFLK

SEQ ID NO: 3046799 - protein, 24 aa, Entamoeba invadens
SCHKRVMLKEFPGYLLDPSIIPRN

SEQ ID NO: 3046800 - protein, 18 aa, Entamoeba invadens
SCLPTCPTGYYSSNKVCM

SEQ ID NO: 3046801 - protein, 19 aa, Entamoeba invadens
SCLQGFYFHFNYSECLSCK

SEQ ID NO: 3046802 - protein, 29 aa, Entamoeba invadens
SCRDLYDDRYKFYKPVNGKCLRYSEVLKL

SEQ ID NO: 3046803 - protein, 22 aa, Entamoeba invadens
SCSTCPAGYFSAGGASSCTKCS

SEQ ID NO: 3046804 - protein, 20 aa, Entamoeba invadens
SCVTCPDMQYSFAGSTTCKS

SEQ ID NO: 3046805 - protein, 20 aa, Entamoeba invadens
SDAPYLYDYVDIITPRVCHD

SEQ ID NO: 3046806 - protein, 25 aa, Entamoeba invadens
SDCVVICYCPYIPRSFDRVIEAAKE

SEQ ID NO: 3046807 - protein, 24 aa, Entamoeba invadens
SDEVFIAYLPLAHIFELCIEFAIM

SEQ ID NO: 3046808 - protein, 32 aa, Entamoeba invadens
SDFFADYVYMIDAGKIYLWFGAKSINETRRFS

SEQ ID NO: 3046809 - protein, 26 aa, Entamoeba invadens
SDIAKVKLWMSWFPMEVGKCDGRELV

SEQ ID NO: 3046810 - protein, 25 aa, Entamoeba invadens
SDIDQYFYIMIYWVGNESPVQLFID

SEQ ID NO: 3046811 - protein, 26 aa, Entamoeba invadens
SDIMKVKIWQSWYPSEWGKCEGTIAW

SEQ ID NO: 3046812 - protein, 19 aa, Entamoeba invadens
SDITFFGDGAFLNSNLRVL

SEQ ID NO: 3046813 - protein, 27 aa, Entamoeba invadens
SDLNVWNTIIFMKSYQSLIIGTDIILT

SEQ ID NO: 3046814 - protein, 24 aa, Entamoeba invadens
SDNQRFIYVHPYDSSFYTSAVEQN

SEQ ID NO: 3046815 - protein, 27 aa, Entamoeba invadens
SEDETYYPSSLLLEALKKLLKETEKVI

SEQ ID NO: 3046816 - protein, 35 aa, Entamoeba invadens
SEECNKPFVCKEDGLFCVIDGIHNNQYYECANTFK

SEQ ID NO: 3046817 - protein, 20 aa, Entamoeba invadens
SEGTCRYRLFKVTVKKVDEC

SEQ ID NO: 3046818 - protein, 26 aa, Entamoeba invadens
SEKAQHILYFWQGRDASLMDLGTLAH

SEQ ID NO: 3046819 - protein, 23 aa, Entamoeba invadens
SELTGSDLLLWASSAQFTSSRIV

SEQ ID NO: 3046820 - protein, 28 aa, Entamoeba invadens
SERCQVYLPKGLWFNFFSDEIIQSNASY

SEQ ID NO: 3046821 - protein, 36 aa, Entamoeba invadens
SESTSHLYTITYPKLYKRSFSNTLCSSFSVAYTEEE

SEQ ID NO: 3046822 - protein, 17 aa, Entamoeba invadens
SETELFLRGLKYSNYHD

SEQ ID NO: 3046823 - protein, 18 aa, Entamoeba invadens
SETELFLRGLKYSNYHDS

SEQ ID NO: 3046824 - protein, 39 aa, Entamoeba invadens
SFAITMYECFIWKEAYPKEDFKFPWKIAEFVNSGKRFDN

SEQ ID NO: 3046825 - protein, 24 aa, Entamoeba invadens
SFDRKFFQLLYSLFSKYHDGENVL

SEQ ID NO: 3046826 - protein, 20 aa, Entamoeba invadens
SFFRPKMAIALLKQGAKMKS

SEQ ID NO: 3046827 - protein, 17 aa, Entamoeba invadens
SFIGLFESENEPDFILN

SEQ ID NO: 3046828 - protein, 22 aa, Entamoeba invadens
SFKNYNFLLRPKGKKKGEKGKE

SEQ ID NO: 3046829 - protein, 20 aa, Entamoeba invadens
SFLFLFISGKIVDFIQIADV

SEQ ID NO: 3046830 - protein, 17 aa, Entamoeba invadens
SFLKRNLALIGFSEKRR

SEQ ID NO: 3046831 - protein, 17 aa, Entamoeba invadens
SFTLSYEFWQITDIHYD

SEQ ID NO: 3046832 - protein, 29 aa, Entamoeba invadens
SGAVDLHIRYNWEYNTVSTVLYIANVMTR

SEQ ID NO: 3046833 - protein, 18 aa, Entamoeba invadens
SGFAFSNCLLCPDGTYTF

SEQ ID NO: 3046834 - protein, 20 aa, Entamoeba invadens
SGFCTSCISGYGLRAESSLS

SEQ ID NO: 3046835 - protein, 29 aa, Entamoeba invadens
SGFDLYDDSIRFLFKMTADYNYTKAEIEF

SEQ ID NO: 3046836 - protein, 24 aa, Entamoeba invadens
SGGSLVMTFRYIKTNGIMAESDYK

SEQ ID NO: 3046837 - protein, 25 aa, Entamoeba invadens
SGGSLVMTFRYIKTNGIMAESDYKY

SEQ ID NO: 3046838 - protein, 27 aa, Entamoeba invadens
SGGVRLCLTCNNGYHFSTTSPYNCIPC

SEQ ID NO: 3046839 - protein, 34 aa, Entamoeba invadens
SGKDAFVFFIPDKTQFINFLTLLGLNMKIVGTYG

SEQ ID NO: 3046840 - protein, 27 aa, Entamoeba invadens
SGMKLMPGSLYLFKTLNKLYSIEGSQV

SEQ ID NO: 3046841 - protein, 23 aa, Entamoeba invadens
SGNIFWVRAPDNNGNKLIISEFN

SEQ ID NO: 3046842 - protein, 18 aa, Entamoeba invadens
SGPYPIEMLIKPGCVKTS

SEQ ID NO: 3046843 - protein, 23 aa, Entamoeba invadens
SGPYPLEMLIKTGCVKTSVTTSS

SEQ ID NO: 3046844 - protein, 18 aa, Entamoeba invadens
SGTKLRNLKLPNKSIILE

SEQ ID NO: 3046845 - protein, 26 aa, Entamoeba invadens
SGTPTNPIIIRPSLNAKLVFETLIGA

SEQ ID NO: 3046846 - protein, 17 aa, Entamoeba invadens
SGYMLNLEKTCTNCSVY

SEQ ID NO: 3046847 - protein, 32 aa, Entamoeba invadens
SGYYCLDDVDYVYQYLWCSDSYKGYMKCPKGT

SEQ ID NO: 3046848 - protein, 19 aa, Entamoeba invadens
SHCTGLIKLLPDYSDLFVA

SEQ ID NO: 3046849 - protein, 21 aa, Entamoeba invadens
SHLCISRLDFHCGVSSTYSQC

SEQ ID NO: 3046850 - protein, 17 aa, Entamoeba invadens
SHRIVEDALRLLTKHER

SEQ ID NO: 3046851 - protein, 35 aa, Entamoeba invadens
SHSLRKLRLTRVKLMALMRRVLADLSYEQQARVIR

SEQ ID NO: 3046852 - protein, 21 aa, Entamoeba invadens
SHYEIYNSLFFFNSNSEHNTH

SEQ ID NO: 3046853 - protein, 23 aa, Entamoeba invadens
SIAGLLSGRLPIEKGQKAVCIVS

SEQ ID NO: 3046854 - protein, 21 aa, Entamoeba invadens
SICELNRTFCYCESLKEVVIP

SEQ ID NO: 3046855 - protein, 25 aa, Entamoeba invadens
SIGNYAFRNCYLLKNLPNTKTVTQI

SEQ ID NO: 3046856 - protein, 27 aa, Entamoeba invadens
SIKDFPRFKWRGLMVDCARNPFTLSTY

SEQ ID NO: 3046857 - protein, 18 aa, Entamoeba invadens
SILLTVVLTISVAEDVTE

SEQ ID NO: 3046858 - protein, 23 aa, Entamoeba invadens
SINGYAEFFLVSPTVLQLSQQFE

SEQ ID NO: 3046859 - protein, 28 aa, Entamoeba invadens
SINQSCLWYIFDFLNLVLKYKELNLMNE

SEQ ID NO: 3046860 - protein, 18 aa, Entamoeba invadens
SIPTTLPIDFDIPQSIRK

SEQ ID NO: 3046861 - protein, 22 aa, Entamoeba invadens
SIQVPQWRGFQFTTGNHQIASK

SEQ ID NO: 3046862 - protein, 25 aa, Entamoeba invadens
SIYDNSLFLFFSSTFNLILKNTAAF

SEQ ID NO: 3046863 - protein, 25 aa, Entamoeba invadens
SKASRMMSDMLKAMNTRQAAKSRFK

SEQ ID NO: 3046864 - protein, 26 aa, Entamoeba invadens
SKDGLLSVIFNYPTEMLFAQDFKEAR

SEQ ID NO: 3046865 - protein, 19 aa, Entamoeba invadens
SKGVDSFILLTLFLMVLII

SEQ ID NO: 3046866 - protein, 22 aa, Entamoeba invadens
SKHYAILNLKLETTVPLIEIPL

SEQ ID NO: 3046867 - protein, 25 aa, Entamoeba invadens
SKKFDQFILVPKSPIYNLIYVNKQV

SEQ ID NO: 3046868 - protein, 22 aa, Entamoeba invadens
SKLFSKPHIAEGWKTLGGALEK

SEQ ID NO: 3046869 - protein, 20 aa, Entamoeba invadens
SKMTFGIFTSKKYWEGVFGD

SEQ ID NO: 3046870 - protein, 27 aa, Entamoeba invadens
SKNYTLPVFEWNTIIISLQKSYTLTSI

SEQ ID NO: 3046871 - protein, 26 aa, Entamoeba invadens
SKVKEKFFLHGLWPQSNRNMFCCQNK

SEQ ID NO: 3046872 - protein, 27 aa, Entamoeba invadens
SKVSTVIAPFTGPMAPAFAAVGATAGT

SEQ ID NO: 3046873 - protein, 33 aa, Entamoeba invadens
SLAAYPVDLQYPVAFWHVYVGIDTYFGSSLNYE

SEQ ID NO: 3046874 - protein, 25 aa, Entamoeba invadens
SLEEKLMEYLRRKDFKDYVYDVKMI

SEQ ID NO: 3046875 - protein, 18 aa, Entamoeba invadens
SLEFYQEVAKFWIEKYEI

SEQ ID NO: 3046876 - protein, 21 aa, Entamoeba invadens
SLEIHVFAIGQADSQLIVYPS

SEQ ID NO: 3046877 - protein, 27 aa, Entamoeba invadens
SLEQVDVPVLFYYYISAMTGATFMKKI

SEQ ID NO: 3046878 - protein, 29 aa, Entamoeba invadens
SLFECAIWEEPFPKIRFKFAWDIVDFVVS

SEQ ID NO: 3046879 - protein, 24 aa, Entamoeba invadens
SLFTCLILSFFSFAQDSPSNNQPI

SEQ ID NO: 3046880 - protein, 23 aa, Entamoeba invadens
SLGVPTCEKGYYFSPTGNCARCE

SEQ ID NO: 3046881 - protein, 26 aa, Entamoeba invadens
SLIIFSQIQLFIYNADIYKKTIFTLL

SEQ ID NO: 3046882 - protein, 23 aa, Entamoeba invadens
SLIKPPFFGFGSLEPKFAVYFTE

SEQ ID NO: 3046883 - protein, 30 aa, Entamoeba invadens
SLLDSDLFKCAAVHAPILSIKSHYYTDAQY

SEQ ID NO: 3046884 - protein, 19 aa, Entamoeba invadens
SLLERAGIKVVVIIDRETK

SEQ ID NO: 3046885 - protein, 21 aa, Entamoeba invadens
SLLFFFTTCLSLKWCGNGGQV

SEQ ID NO: 3046886 - protein, 21 aa, Entamoeba invadens
SLLLFLISTSSEICEAGYYLS

SEQ ID NO: 3046887 - protein, 18 aa, Entamoeba invadens
SLLSRYALQTTSSGIFVY

SEQ ID NO: 3046888 - protein, 22 aa, Entamoeba invadens
SLNAHPAWLKGCELMHITPVII

SEQ ID NO: 3046889 - protein, 23 aa, Entamoeba invadens
SLRHELDLLLKYYPKVGVRVTKD

SEQ ID NO: 3046890 - protein, 25 aa, Entamoeba invadens
SLSTKSIQLPLINDGFIIKCNRNTH

SEQ ID NO: 3046891 - protein, 21 aa, Entamoeba invadens
SLTFVSELPVFDFVENYYGQI

SEQ ID NO: 3046892 - protein, 19 aa, Entamoeba invadens
SLVDFYSSNLTKRAFSRKP

SEQ ID NO: 3046893 - protein, 22 aa, Entamoeba invadens
SLWSKFMKVYSTTSFYTCADDC

SEQ ID NO: 3046894 - protein, 27 aa, Entamoeba invadens
SMCRTLKIVLLPLQILYHSTAQSDIIN

SEQ ID NO: 3046895 - protein, 23 aa, Entamoeba invadens
SMEKIGIWLLSTTKLDLKPVSDD

SEQ ID NO: 3046896 - protein, 17 aa, Entamoeba invadens
SMELFKQQFPPVTKSRK

SEQ ID NO: 3046897 - protein, 27 aa, Entamoeba invadens
SMLNEPYTLIVLLSLQSSNQFKTEKSI

SEQ ID NO: 3046898 - protein, 24 aa, Entamoeba invadens
SNCLTIKKLHFPGGLISADVASFI

SEQ ID NO: 3046899 - protein, 26 aa, Entamoeba invadens
SNETNTFFFLIPRRVIHFEMCGGSVT

SEQ ID NO: 3046900 - protein, 20 aa, Entamoeba invadens
SNFQFLPKHIDPTQYDVLNY

SEQ ID NO: 3046901 - protein, 18 aa, Entamoeba invadens
SNGGSIKFLINKNSYIRL

SEQ ID NO: 3046902 - protein, 18 aa, Entamoeba invadens
SNGYCLPCDKNCKYCSGT

SEQ ID NO: 3046903 - protein, 24 aa, Entamoeba invadens
SNIDQHWWIVFHRNETLSYSPYIL

SEQ ID NO: 3046904 - protein, 17 aa, Entamoeba invadens
SNKKMIRFCPNGIQLDT

SEQ ID NO: 3046905 - protein, 23 aa, Entamoeba invadens
SNNEVILHYTLSKSIPDCPVYSL

SEQ ID NO: 3046906 - protein, 22 aa, Entamoeba invadens
SNNHEISVLSGFYTMKVIKRSE

SEQ ID NO: 3046907 - protein, 24 aa, Entamoeba invadens
SNNKDFLSTLLPTVSLISCGAGNS

SEQ ID NO: 3046908 - protein, 29 aa, Entamoeba invadens
SNVILDDTYKLILIKSFKHENSGYLPIGQ

SEQ ID NO: 3046909 - protein, 24 aa, Entamoeba invadens
SPNSKTKNLKYSATYKPTDNLKLS

SEQ ID NO: 3046910 - protein, 19 aa, Entamoeba invadens
SPQVIMYKDFIAKRFNGFT

SEQ ID NO: 3046911 - protein, 22 aa, Entamoeba invadens
SPRFKWRGLMLDCARNPLSKET

SEQ ID NO: 3046912 - protein, 28 aa, Entamoeba invadens
SPTEIIPPFYTVLIRFRHGYQFEFWLYY

SEQ ID NO: 3046913 - protein, 25 aa, Entamoeba invadens
SPTKNYFILVTTSFKMPVTITLSVN

SEQ ID NO: 3046914 - protein, 20 aa, Entamoeba invadens
SPVLVYKPAFETDLVMNDIA

SEQ ID NO: 3046915 - protein, 23 aa, Entamoeba invadens
SQDNYTWIKLARNSNNRWIYDPD

SEQ ID NO: 3046916 - protein, 19 aa, Entamoeba invadens
SQKNLFYHGKRQPKVLPVT

SEQ ID NO: 3046917 - protein, 24 aa, Entamoeba invadens
SQNSKLKIFASIGGWDFSSEKATR

SEQ ID NO: 3046918 - protein, 17 aa, Entamoeba invadens
SQQRLIYEQLKGLYVGY

SEQ ID NO: 3046919 - protein, 18 aa, Entamoeba invadens
SQWMLDHLSDLFSDWLSP

SEQ ID NO: 3046920 - protein, 23 aa, Entamoeba invadens
SQYAKKRLYKGKSSHPYSKLFGK

SEQ ID NO: 3046921 - protein, 24 aa, Entamoeba invadens
SRAFANSFAFLHSLSVGGSLTLKS

SEQ ID NO: 3046922 - protein, 20 aa, Entamoeba invadens
SRATFIKSAMDFARKYNLDG

SEQ ID NO: 3046923 - protein, 26 aa, Entamoeba invadens
SRAWVDAFQLFYISKDTTVVLNGSFH

SEQ ID NO: 3046924 - protein, 25 aa, Entamoeba invadens
SREDDILVLLSQQSVRFILIDRTKT

SEQ ID NO: 3046925 - protein, 23 aa, Entamoeba invadens
SRIYKTYVLAYTRNARPITFPSS

SEQ ID NO: 3046926 - protein, 18 aa, Entamoeba invadens
SRKCVVCNDGYYVVDGKC

SEQ ID NO: 3046927 - protein, 22 aa, Entamoeba invadens
SRKLRVYRKYVKILKREETAVN

SEQ ID NO: 3046928 - protein, 23 aa, Entamoeba invadens
SRLCHRRMISLAYSGNNIINSNK

SEQ ID NO: 3046929 - protein, 19 aa, Entamoeba invadens
SRLCVRCASGMYPSSSGSC

SEQ ID NO: 3046930 - protein, 25 aa, Entamoeba invadens
SRNKDMMIIFHTPNNPKFVFHFEPQ

SEQ ID NO: 3046931 - protein, 19 aa, Entamoeba invadens
SRPCGYMRYALNVLGKYDD

SEQ ID NO: 3046932 - protein, 19 aa, Entamoeba invadens
SRPCGYMRYALNVLGKYDN

SEQ ID NO: 3046933 - protein, 26 aa, Entamoeba invadens
SRTAYNAFVLTPKSALKLPFQVKVTS

SEQ ID NO: 3046934 - protein, 25 aa, Entamoeba invadens
SRTDQNWTHRLLLSSYTQIQSTNGN

SEQ ID NO: 3046935 - protein, 25 aa, Entamoeba invadens
SSAFDFDSWLIKFNKSFSAVESLRR

SEQ ID NO: 3046936 - protein, 27 aa, Entamoeba invadens
SSATRKYVILFFCYASVISNQEIDILQ

SEQ ID NO: 3046937 - protein, 23 aa, Entamoeba invadens
SSCYFFDDLIGGKLLYIVENQPN

SEQ ID NO: 3046938 - protein, 26 aa, Entamoeba invadens
SSDIYFWRHHFVISGKRIQKRESITQ

SEQ ID NO: 3046939 - protein, 22 aa, Entamoeba invadens
SSDLKACNLGYTTTTYYDTDDH

SEQ ID NO: 3046940 - protein, 21 aa, Entamoeba invadens
SSFSRLFSFVIRNKKSKPMEG

SEQ ID NO: 3046941 - protein, 17 aa, Entamoeba invadens
SSGFWMSTLYRVEERAG

SEQ ID NO: 3046942 - protein, 18 aa, Entamoeba invadens
SSGLRKMGFKKGDKIGIF

SEQ ID NO: 3046943 - protein, 31 aa, Entamoeba invadens
SSKVFYHCTSLDSFPFSPSIKMILAYAFADT

SEQ ID NO: 3046944 - protein, 23 aa, Entamoeba invadens
SSLEFYHMICRLSSGLRKMGFKK

SEQ ID NO: 3046945 - protein, 31 aa, Entamoeba invadens
SSLWRNMTGFTKALYAVVLFLVGRNCWEGAQ

SEQ ID NO: 3046946 - protein, 20 aa, Entamoeba invadens
SSMILHKMAKIAAQYLGFNV

SEQ ID NO: 3046947 - protein, 17 aa, Entamoeba invadens
SSNNLVGVLPKLSGLTK

SEQ ID NO: 3046948 - protein, 24 aa, Entamoeba invadens
SSRILRIQSALRRAPTDKLKKRLR

SEQ ID NO: 3046949 - protein, 21 aa, Entamoeba invadens
STAFKVAKYAANLFDPEELKV

SEQ ID NO: 3046950 - protein, 27 aa, Entamoeba invadens
STAHFFGDAPIFMPTKKDLPALESSTS

SEQ ID NO: 3046951 - protein, 20 aa, Entamoeba invadens
STAINWICYATQQTLITKIQ

SEQ ID NO: 3046952 - protein, 24 aa, Entamoeba invadens
STCKKCLSGYLIDRQRNICVTCDK

SEQ ID NO: 3046953 - protein, 24 aa, Entamoeba invadens
STDIPLFSGLVPPSKTLEATLTKM

SEQ ID NO: 3046954 - protein, 18 aa, Entamoeba invadens
STFDYGILCVFLKSEMNN

SEQ ID NO: 3046955 - protein, 29 aa, Entamoeba invadens
STFFDLNLVGFTDYRFKQVGWATINYSER

SEQ ID NO: 3046956 - protein, 23 aa, Entamoeba invadens
STGVNLAGKALTKGKLDELMVNE

SEQ ID NO: 3046957 - protein, 22 aa, Entamoeba invadens
STKFTFLCFSGEKELRELEKRM

SEQ ID NO: 3046958 - protein, 21 aa, Entamoeba invadens
STLLRVYANPNKRLLNSSQVS

SEQ ID NO: 3046959 - protein, 20 aa, Entamoeba invadens
STNLFAFTAPHCPCTTYDGF

SEQ ID NO: 3046960 - protein, 17 aa, Entamoeba invadens
STPSFILQRPGYQKRFY

SEQ ID NO: 3046961 - protein, 24 aa, Entamoeba invadens
STTSFLEVGGIRDQLYRVLEKDPG

SEQ ID NO: 3046962 - protein, 25 aa, Entamoeba invadens
SVDPNWPISLMTKAFHDLIKKFEKL

SEQ ID NO: 3046963 - protein, 24 aa, Entamoeba invadens
SVFMKAMLFTLEYKGRGYVFIDTR

SEQ ID NO: 3046964 - protein, 19 aa, Entamoeba invadens
SVFRRSLVVITASAAFKVF

SEQ ID NO: 3046965 - protein, 29 aa, Entamoeba invadens
SVKKIYYFFSKFIMLNSLIFRGSNKITQF

SEQ ID NO: 3046966 - protein, 20 aa, Entamoeba invadens
SVLDRFRYNPIPVRSKKLFP

SEQ ID NO: 3046967 - protein, 26 aa, Entamoeba invadens
SVREEFLLHGFWPQIRINRNLICCEF

SEQ ID NO: 3046968 - protein, 19 aa, Entamoeba invadens
SVRIAFNPTRKYFNNFLTI

SEQ ID NO: 3046969 - protein, 29 aa, Entamoeba invadens
SVVKFYAPWCSHCIALKPVFEKLSDEFQD

SEQ ID NO: 3046970 - protein, 26 aa, Entamoeba invadens
SVVMQPFPRWGNFQSFGEFLAVTSDE

SEQ ID NO: 3046971 - protein, 24 aa, Entamoeba invadens
SVYKQHFYIPYQNNYNYALCYQAR

SEQ ID NO: 3046972 - protein, 17 aa, Entamoeba invadens
SWGDEGYFLLARNQNNR

SEQ ID NO: 3046973 - protein, 18 aa, Entamoeba invadens
SWGDEGYFLLARNQNNRC

SEQ ID NO: 3046974 - protein, 18 aa, Entamoeba invadens
SWMQCFVTGAIAPKVPIL

SEQ ID NO: 3046975 - protein, 19 aa, Entamoeba invadens
SWPPYASYIIFELYEKEGE

SEQ ID NO: 3046976 - protein, 17 aa, Entamoeba invadens
SWYVSDMGFLSPTPYGM

SEQ ID NO: 3046977 - protein, 26 aa, Entamoeba invadens
SYCTPRVMEILSKRLGIPMTSVSKSI

SEQ ID NO: 3046978 - protein, 20 aa, Entamoeba invadens
SYFRGRHAMCFCFDITRKET

SEQ ID NO: 3046979 - protein, 24 aa, Entamoeba invadens
SYKGSIFHRVIPGFMIQGGDFTNF

SEQ ID NO: 3046980 - protein, 26 aa, Entamoeba invadens
SYSKKYILTQSFLKELIDYAELRGII

SEQ ID NO: 3046981 - protein, 25 aa, Entamoeba invadens
SYTTPFKVLLDGHLLRYGTSDKIYC

SEQ ID NO: 3046982 - protein, 18 aa, Entamoeba invadens
SYVDVAVLTHLHMDHLGV

SEQ ID NO: 3046983 - protein, 19 aa, Entamoeba invadens
TACNAEYLVPDGVKCKCKT

SEQ ID NO: 3046984 - protein, 38 aa, Entamoeba invadens
TAEDLDDFFTFFENEESAYLLDDGWFQGLKEGISDAVD

SEQ ID NO: 3046985 - protein, 23 aa, Entamoeba invadens
TAFLLSKNRLLRFCPKNTTLERT

SEQ ID NO: 3046986 - protein, 26 aa, Entamoeba invadens
TAIRRAKVIFKKYNKKYLKFELKKNQ

SEQ ID NO: 3046987 - protein, 18 aa, Entamoeba invadens
TALFLNSKFEFWKVLRES

SEQ ID NO: 3046988 - protein, 19 aa, Entamoeba invadens
TAMAMVVATFKDRSVTPVQ

SEQ ID NO: 3046989 - protein, 23 aa, Entamoeba invadens
TANVWYSAIFGASKAYTVTPLPT

SEQ ID NO: 3046990 - protein, 23 aa, Entamoeba invadens
TARKGEEYLLDKKLKGIVKSVIF

SEQ ID NO: 3046991 - protein, 17 aa, Entamoeba invadens
TATSLLRTVGVVRGVFE

SEQ ID NO: 3046992 - protein, 24 aa, Entamoeba invadens
TATYEEFIIFLKNIIQLYQTENIK

SEQ ID NO: 3046993 - protein, 23 aa, Entamoeba invadens
TAVINAMRGWMGLGAISAKELGI

SEQ ID NO: 3046994 - protein, 22 aa, Entamoeba invadens
TAVVQHIPRPYSTYFQKMMNTE

SEQ ID NO: 3046995 - protein, 22 aa, Entamoeba invadens
TAYKRLLFSKTPVLRSGFSLII

SEQ ID NO: 3046996 - protein, 20 aa, Entamoeba invadens
TCASGYWVNAGKCATFAHCP

SEQ ID NO: 3046997 - protein, 37 aa, Entamoeba invadens
TCDSTCNAPYFQYPGSMCYIKCPSGYIGNSATHICEK

SEQ ID NO: 3046998 - protein, 38 aa, Entamoeba invadens
TCDYSYNVIPKCQIADFVNNQHICTACFAPYVTSSDLK

SEQ ID NO: 3046999 - protein, 24 aa, Entamoeba invadens
TCELRSDGYFPTNYDWYTGSVIGF

SEQ ID NO: 3047000 - protein, 20 aa, Entamoeba invadens
TCKKNCPEAYFAKDKVCTAC

SEQ ID NO: 3047001 - protein, 21 aa, Entamoeba invadens
TCKYKIVINTPCACTEESLTD

SEQ ID NO: 3047002 - protein, 20 aa, Entamoeba invadens
TCLLCRDGFYSTEKSSICLQ

SEQ ID NO: 3047003 - protein, 19 aa, Entamoeba invadens
TCNTCKTGFKLSSNKTSCN

SEQ ID NO: 3047004 - protein, 24 aa, Entamoeba invadens
TCSSTYCMAGYYLSVTGSSCLVCR

SEQ ID NO: 3047005 - protein, 26 aa, Entamoeba invadens
TCSTPAATPVKKWSNRPKTTCYTEQQ

SEQ ID NO: 3047006 - protein, 22 aa, Entamoeba invadens
TCVFKRDLFCEETFENQCTKCT

SEQ ID NO: 3047007 - protein, 36 aa, Entamoeba invadens
TCYTEQQLLTSSLFGPVPTSPLSAEHSPLPVGESQP

SEQ ID NO: 3047008 - protein, 22 aa, Entamoeba invadens
TDAGMKVLQGKSLDLSKKNLKS

SEQ ID NO: 3047009 - protein, 19 aa, Entamoeba invadens
TDCIVFPRNWIYEDNKCIR

SEQ ID NO: 3047010 - protein, 23 aa, Entamoeba invadens
TDCKSCINKSYWLDTSTNKCIRC

SEQ ID NO: 3047011 - protein, 24 aa, Entamoeba invadens
TDDAFLVGYYVKYNFYKDNDCTTK

SEQ ID NO: 3047012 - protein, 23 aa, Entamoeba invadens
TDDISYVNKYIWGAFGVLRSKSE

SEQ ID NO: 3047013 - protein, 22 aa, Entamoeba invadens
TDFELILADLVYKTDFVEFTNT

SEQ ID NO: 3047014 - protein, 23 aa, Entamoeba invadens
TDFELILADLVYKTDFVEFTNTS

SEQ ID NO: 3047015 - protein, 24 aa, Entamoeba invadens
TDGEYWIIRNSWGTSWGDEGYFLL

SEQ ID NO: 3047016 - protein, 25 aa, Entamoeba invadens
TDGEYWIIRNSWGTSWGDEGYFLLA

SEQ ID NO: 3047017 - protein, 18 aa, Entamoeba invadens
TDILSLKEKVDKLEKDVD

SEQ ID NO: 3047018 - protein, 25 aa, Entamoeba invadens
TDLNKFIVPETILDWLRIVVAVRHS

SEQ ID NO: 3047019 - protein, 24 aa, Entamoeba invadens
TDNQRFIYVHPYDSSFYTSAVEQN

SEQ ID NO: 3047020 - protein, 33 aa, Entamoeba invadens
TDVYCRIYVNYIYSPPLLVFANGTIPKLISAKV

SEQ ID NO: 3047021 - protein, 24 aa, Entamoeba invadens
TEARYNQIALQWKRNDFIIKKMQG

SEQ ID NO: 3047022 - protein, 24 aa, Entamoeba invadens
TECLSCPQGYYLQDGECENCNVMT

SEQ ID NO: 3047023 - protein, 26 aa, Entamoeba invadens
TECRSAIDGLIRRLEHKYLAIVKSRK

SEQ ID NO: 3047024 - protein, 23 aa, Entamoeba invadens
TECYSCAWGYYLQGSNTCVKCSF

SEQ ID NO: 3047025 - protein, 21 aa, Entamoeba invadens
TEDVKLIYIYSFKLVATCCSS

SEQ ID NO: 3047026 - protein, 21 aa, Entamoeba invadens
TEFMSMPNYTSIALEIQTLLL

SEQ ID NO: 3047027 - protein, 26 aa, Entamoeba invadens
TEIVKEGFFLHGFWPQFYTQKHLQCC

SEQ ID NO: 3047028 - protein, 18 aa, Entamoeba invadens
TELNQLSKKYVNPVLLCY

SEQ ID NO: 3047029 - protein, 23 aa, Entamoeba invadens
TESFDFAVFPTATLIDENKLPEG

SEQ ID NO: 3047030 - protein, 26 aa, Entamoeba invadens
TESLKLLVVFICVQKPSHKENSLNRN

SEQ ID NO: 3047031 - protein, 25 aa, Entamoeba invadens
TESYRFWYQESWKNALNGRPYHISA

SEQ ID NO: 3047032 - protein, 17 aa, Entamoeba invadens
TEVQGDFMFSCVNALYN

SEQ ID NO: 3047033 - protein, 18 aa, Entamoeba invadens
TFCTSACTLDINSAYPRC

SEQ ID NO: 3047034 - protein, 18 aa, Entamoeba invadens
TFDFELLSGVYGSQVIFV

SEQ ID NO: 3047035 - protein, 18 aa, Entamoeba invadens
TFEWSLVYIINKKTREIS

SEQ ID NO: 3047036 - protein, 17 aa, Entamoeba invadens
TFKVNFNMRIVNVAISI

SEQ ID NO: 3047037 - protein, 20 aa, Entamoeba invadens
TFLLLFLSRSTNYWCEHSNT

SEQ ID NO: 3047038 - protein, 17 aa, Entamoeba invadens
TFLTIKVNATYPQNNAR

SEQ ID NO: 3047039 - protein, 18 aa, Entamoeba invadens
TFMNGVPLVFNRIKKILV

SEQ ID NO: 3047040 - protein, 17 aa, Entamoeba invadens
TFQCVPLMFSQLYTLHF

SEQ ID NO: 3047041 - protein, 29 aa, Entamoeba invadens
TFSEDIYRELWGFLSFYQGVLFDSTIPTD

SEQ ID NO: 3047042 - protein, 21 aa, Entamoeba invadens
TFSHASSVPLWYPHYDNSASF

SEQ ID NO: 3047043 - protein, 17 aa, Entamoeba invadens
TFVFSFKDQPTRRPIEP

SEQ ID NO: 3047044 - protein, 27 aa, Entamoeba invadens
TFVHNMMFDLLLEKGFFFNSTLSRKTK

SEQ ID NO: 3047045 - protein, 21 aa, Entamoeba invadens
TGCQTNYVFSDPKGLTCQMCY

SEQ ID NO: 3047046 - protein, 24 aa, Entamoeba invadens
TGDLKLQFVLFWDDKKSTEAEDRV

SEQ ID NO: 3047047 - protein, 17 aa, Entamoeba invadens
TGMINLFGKKRFDAALH

SEQ ID NO: 3047048 - protein, 25 aa, Entamoeba invadens
TGNCLSCISGYGFYTNKCILCPNLT

SEQ ID NO: 3047049 - protein, 24 aa, Entamoeba invadens
TGNGVLYVGLLNKADRISDKPFLL

SEQ ID NO: 3047050 - protein, 22 aa, Entamoeba invadens
TGSLWIIKCADKKCKSGQPVKE

SEQ ID NO: 3047051 - protein, 24 aa, Entamoeba invadens
TGVCLTCYSGYQLNASQSCEICRR

SEQ ID NO: 3047052 - protein, 20 aa, Entamoeba invadens
THLQCALIAFISTKADIKLS

SEQ ID NO: 3047053 - protein, 26 aa, Entamoeba invadens
THYNKYFEMLLQNLPKNKTILVHSHI

SEQ ID NO: 3047054 - protein, 28 aa, Entamoeba invadens
TICNVTCPNGLYRLKEKGNWRCVSTCPA

SEQ ID NO: 3047055 - protein, 18 aa, Entamoeba invadens
TICSKCETGYYLEKGKCT

SEQ ID NO: 3047056 - protein, 19 aa, Entamoeba invadens
TIDCPILGNKTFKMAMEIP

SEQ ID NO: 3047057 - protein, 19 aa, Entamoeba invadens
TIDLSQVIIIPASCFEGCT

SEQ ID NO: 3047058 - protein, 27 aa, Entamoeba invadens
TIEDNFRYFLTLDGTVFDITFIDTYYP

SEQ ID NO: 3047059 - protein, 26 aa, Entamoeba invadens
TIFAFPNRKMFYYITAAILKEYTTDI

SEQ ID NO: 3047060 - protein, 24 aa, Entamoeba invadens
TIGLFFVVFCVNLELVNGCELSQY

SEQ ID NO: 3047061 - protein, 19 aa, Entamoeba invadens
TIGSFAFQFSALTSFDFKG

SEQ ID NO: 3047062 - protein, 31 aa, Entamoeba invadens
TIHCTTRIRGMKIPYTVWFSKSKTTLHSIAE

SEQ ID NO: 3047063 - protein, 23 aa, Entamoeba invadens
TIIIFVFIRSSFAALICEKGYHV

SEQ ID NO: 3047064 - protein, 20 aa, Entamoeba invadens
TIKEFISFGFIEVATRSEID

SEQ ID NO: 3047065 - protein, 17 aa, Entamoeba invadens
TIKTWRYGENIPALNPT

SEQ ID NO: 3047066 - protein, 19 aa, Entamoeba invadens
TIKYFFGSGGQFLLLIEEW

SEQ ID NO: 3047067 - protein, 28 aa, Entamoeba invadens
TILDAMKKMMAVLPVEQRLAMLRRLKIE

SEQ ID NO: 3047068 - protein, 24 aa, Entamoeba invadens
TILLLILLVVIYKVVSTPIENKDK

SEQ ID NO: 3047069 - protein, 32 aa, Entamoeba invadens
TINCTTRIRGMKIPYTVWFSKSKSSLLEIAEH

SEQ ID NO: 3047070 - protein, 19 aa, Entamoeba invadens
TINPCILDGYIFKSTENSE

SEQ ID NO: 3047071 - protein, 22 aa, Entamoeba invadens
TIVIFLFVVTCSSTYCMAGYYL

SEQ ID NO: 3047072 - protein, 20 aa, Entamoeba invadens
TIVLHTFLDQYLPRSSPFEN

SEQ ID NO: 3047073 - protein, 21 aa, Entamoeba invadens
TIYEESYVKNFPFTLPHCPCD

SEQ ID NO: 3047074 - protein, 24 aa, Entamoeba invadens
TKAAQMFKMYGSRFTFTCFEMSDS

SEQ ID NO: 3047075 - protein, 20 aa, Entamoeba invadens
TKCKFIASPLLYSEKHQITN

SEQ ID NO: 3047076 - protein, 18 aa, Entamoeba invadens
TKCNLGYYASSSGSSSCT

SEQ ID NO: 3047077 - protein, 19 aa, Entamoeba invadens
TKFMVLPDKIQIAIPQISE

SEQ ID NO: 3047078 - protein, 22 aa, Entamoeba invadens
TKHVQTMLIVLGYSCGSNGADG

SEQ ID NO: 3047079 - protein, 18 aa, Entamoeba invadens
TKILRKDVLVAFYGPSLP

SEQ ID NO: 3047080 - protein, 18 aa, Entamoeba invadens
TKLGFSYILGGVNGIYNF

SEQ ID NO: 3047081 - protein, 17 aa, Entamoeba invadens
TKNVVVKFYAPWCGICK

SEQ ID NO: 3047082 - protein, 30 aa, Entamoeba invadens
TKPDGSYGVLLWNTNTSLIYFRKVDETGKE

SEQ ID NO: 3047083 - protein, 27 aa, Entamoeba invadens
TKPSPLVRIPVFYRDNGAYVVTATNCA

SEQ ID NO: 3047084 - protein, 24 aa, Entamoeba invadens
TKPYTLSPCVLLNDNSIENPQKST

SEQ ID NO: 3047085 - protein, 30 aa, Entamoeba invadens
TKQLVMELLMYFKLNWLEKWPIKLWCQFNQ

SEQ ID NO: 3047086 - protein, 55 aa, Entamoeba invadens
TKQSFFFFKIYKNIEMSLNFMFRYNLIFYIMKLLLIVLICTLLLSVDAKKSSRRV

SEQ ID NO: 3047087 - protein, 27 aa, Entamoeba invadens
TKRVKEKFFLHGLWPSIFANRNIFCCR

SEQ ID NO: 3047088 - protein, 29 aa, Entamoeba invadens
TKSVVKQMLINILSFFSAHSFGKNHNHNN

SEQ ID NO: 3047089 - protein, 27 aa, Entamoeba invadens
TKTCVAVCPIPYYSDKKTWTCVKQCTN

SEQ ID NO: 3047090 - protein, 21 aa, Entamoeba invadens
TKTGKYIVFVRKASLLERAGI

SEQ ID NO: 3047091 - protein, 20 aa, Entamoeba invadens
TLAFEYLTKDGVNYVRALLN

SEQ ID NO: 3047092 - protein, 20 aa, Entamoeba invadens
TLALPVYYYDTLSCFQQGSQ

SEQ ID NO: 3047093 - protein, 17 aa, Entamoeba invadens
TLCVYSQPPQKPKPTPK

SEQ ID NO: 3047094 - protein, 29 aa, Entamoeba invadens
TLCWAATTANLIDWFQKSIGWSNVPKDTP

SEQ ID NO: 3047095 - protein, 18 aa, Entamoeba invadens
TLHGYWPHFYKNRNMYCC

SEQ ID NO: 3047096 - protein, 18 aa, Entamoeba invadens
TLILVGDSGVGKTCLARQ

SEQ ID NO: 3047097 - protein, 21 aa, Entamoeba invadens
TLKEACLAGYYKSGSVCLPCS

SEQ ID NO: 3047098 - protein, 29 aa, Entamoeba invadens
TLLASYHPLYYYKVWSRDAVFSSIIMTAL

SEQ ID NO: 3047099 - protein, 18 aa, Entamoeba invadens
TLLNLLHRYGVVLSVTQS

SEQ ID NO: 3047100 - protein, 22 aa, Entamoeba invadens
TLNKLFVIQGGCYFYGLVKIKK

SEQ ID NO: 3047101 - protein, 23 aa, Entamoeba invadens
TLPGWYLLVLEMTNFELYHSCFH

SEQ ID NO: 3047102 - protein, 23 aa, Entamoeba invadens
TLRTRIGFQTGQWYGLSALVEAD

SEQ ID NO: 3047103 - protein, 17 aa, Entamoeba invadens
TLSYALLKEKITPYEVT

SEQ ID NO: 3047104 - protein, 18 aa, Entamoeba invadens
TLSYALLKEKITPYEVTL

SEQ ID NO: 3047105 - protein, 17 aa, Entamoeba invadens
TLTASLKISFDDSLVSL

SEQ ID NO: 3047106 - protein, 17 aa, Entamoeba invadens
TLTLRGLQRRINRANRI

SEQ ID NO: 3047107 - protein, 23 aa, Entamoeba invadens
TLTQLKVMNFIQLVIEYEDTELY

SEQ ID NO: 3047108 - protein, 19 aa, Entamoeba invadens
TLTTLLVYSKPETFETVMD

SEQ ID NO: 3047109 - protein, 26 aa, Entamoeba invadens
TLVASFHPLYYYKTWTRDAAYSAAIL

SEQ ID NO: 3047110 - protein, 19 aa, Entamoeba invadens
TLVLLVLSSEVVKVTYEVS

SEQ ID NO: 3047111 - protein, 24 aa, Entamoeba invadens
TMDHVRLVLLLTPIVIHVTLINLE

SEQ ID NO: 3047112 - protein, 18 aa, Entamoeba invadens
TNDVIFYYKTKSSSFDLI

SEQ ID NO: 3047113 - protein, 26 aa, Entamoeba invadens
TNFRENFLLHGLWPQKSGAKHFECCS

SEQ ID NO: 3047114 - protein, 19 aa, Entamoeba invadens
TNGLLIRYKSKTGDILILK

SEQ ID NO: 3047115 - protein, 24 aa, Entamoeba invadens
TNGSQFFITLVTTAWLDGRHVVFG

SEQ ID NO: 3047116 - protein, 18 aa, Entamoeba invadens
TNILKRKGVQKSVIKESK

SEQ ID NO: 3047117 - protein, 31 aa, Entamoeba invadens
TNLFCGLNTLPFLFDLVFSSTFGGSYKISGE

SEQ ID NO: 3047118 - protein, 18 aa, Entamoeba invadens
TNLIIMTPSGISPTFYAF

SEQ ID NO: 3047119 - protein, 24 aa, Entamoeba invadens
TNNTILFDFLLHKWDAESLIADKI

SEQ ID NO: 3047120 - protein, 24 aa, Entamoeba invadens
TNRKFLEDLLQAASGSGIRYGIYS

SEQ ID NO: 3047121 - protein, 26 aa, Entamoeba invadens
TNTKKISIQYFLNDTYFTPEGPLFVD

SEQ ID NO: 3047122 - protein, 23 aa, Entamoeba invadens
TNVFAATSCSSGLYLSGTSCYSC

SEQ ID NO: 3047123 - protein, 23 aa, Entamoeba invadens
TPCLLSVGLFCSPAILAGENFSE

SEQ ID NO: 3047124 - protein, 25 aa, Entamoeba invadens
TPIPFRPKIVLFEKYYFCDSYKPQD

SEQ ID NO: 3047125 - protein, 26 aa, Entamoeba invadens
TPIQRLELVPRVKIFAGKAAIGYAMA

SEQ ID NO: 3047126 - protein, 27 aa, Entamoeba invadens
TPKFARTFFNKFKQWPPNLYFKSYNIF

SEQ ID NO: 3047127 - protein, 32 aa, Entamoeba invadens
TPNNPKFVFHFEPQVVFLSPRRMKLVTCYMTI

SEQ ID NO: 3047128 - protein, 23 aa, Entamoeba invadens
TPSELLRRRLIFEQSLREIEEFN

SEQ ID NO: 3047129 - protein, 26 aa, Entamoeba invadens
TPTKRAVLCMKSMFVVNNREYFKVEV

SEQ ID NO: 3047130 - protein, 19 aa, Entamoeba invadens
TQCKNNFYLVPDTSKCVEK

SEQ ID NO: 3047131 - protein, 20 aa, Entamoeba invadens
TQCTSGYYLNEKQSCEPCQS

SEQ ID NO: 3047132 - protein, 25 aa, Entamoeba invadens
TQGAQLLFTAFYDVNRKWGTDGLMR

SEQ ID NO: 3047133 - protein, 22 aa, Entamoeba invadens
TQKKRSLDLKFTKGQFIELKEE

SEQ ID NO: 3047134 - protein, 39 aa, Entamoeba invadens
TQRKMLFKKITAMNKKIRLIRKRSIRIGLSLQRHVIKKA

SEQ ID NO: 3047135 - protein, 22 aa, Entamoeba invadens
TQTTLPIFAHKFKGIFFEEIVI

SEQ ID NO: 3047136 - protein, 24 aa, Entamoeba invadens
TQVTLFEVAFDLGVSPSLYVLNRT

SEQ ID NO: 3047137 - protein, 23 aa, Entamoeba invadens
TRALLQWFSFFQQDTENSPLFFK

SEQ ID NO: 3047138 - protein, 18 aa, Entamoeba invadens
TREGACIFCNKYFRQCSE

SEQ ID NO: 3047139 - protein, 24 aa, Entamoeba invadens
TREGACIFCSKYFTYCEECDGQTM

SEQ ID NO: 3047140 - protein, 20 aa, Entamoeba invadens
TRIILELKDKYFLDENVLKE

SEQ ID NO: 3047141 - protein, 23 aa, Entamoeba invadens
TRKYFNNFLTIEQFIKNDTYLRL

SEQ ID NO: 3047142 - protein, 17 aa, Entamoeba invadens
TRNRSFNVLSKPIKIEL

SEQ ID NO: 3047143 - protein, 18 aa, Entamoeba invadens
TRSYCFNNYFNFSTRILN

SEQ ID NO: 3047144 - protein, 24 aa, Entamoeba invadens
TRVQQLMNWYYYKNYQDKNGVYYT

SEQ ID NO: 3047145 - protein, 23 aa, Entamoeba invadens
TSCDVCMSGFYRTADGKCEVNNV

SEQ ID NO: 3047146 - protein, 22 aa, Entamoeba invadens
TSCLDGFAYNASSFSCLYCPSV

SEQ ID NO: 3047147 - protein, 22 aa, Entamoeba invadens
TSCNDGYYLNNNKCTKCTTGCS

SEQ ID NO: 3047148 - protein, 24 aa, Entamoeba invadens
TSCTSCIVGYYLNDKTCEKCEGIC

SEQ ID NO: 3047149 - protein, 23 aa, Entamoeba invadens
TSDCYSLIPKYKQTVKGYNLHSE

SEQ ID NO: 3047150 - protein, 27 aa, Entamoeba invadens
TSDHMAYYPIYFGSDPVYLTVTIHNIN

SEQ ID NO: 3047151 - protein, 31 aa, Entamoeba invadens
TSESVPHQIPFPPFKYLLPTTITALENHQKC

SEQ ID NO: 3047152 - protein, 22 aa, Entamoeba invadens
TSGSINGKYKFNDKFSVNGNAQ

SEQ ID NO: 3047153 - protein, 36 aa, Entamoeba invadens
TSLFRYYPKILMAIINLLLRIVFKSPLEGVQTALHL

SEQ ID NO: 3047154 - protein, 23 aa, Entamoeba invadens
TSLPSVLKWQIWQGTVSGSGSQI

SEQ ID NO: 3047155 - protein, 17 aa, Entamoeba invadens
TSLTLQRKTYNLRFLLL

SEQ ID NO: 3047156 - protein, 18 aa, Entamoeba invadens
TSNPNCHVCATKSSRCLS

SEQ ID NO: 3047157 - protein, 25 aa, Entamoeba invadens
TSNTTFTFGFSYLAIIDALGYAREY

SEQ ID NO: 3047158 - protein, 25 aa, Entamoeba invadens
TSPKKVVTPIQWPTSNFYKLKDYQM

SEQ ID NO: 3047159 - protein, 25 aa, Entamoeba invadens
TSPKNKIFLEKSMKKAWEIKRQKLG

SEQ ID NO: 3047160 - protein, 19 aa, Entamoeba invadens
TSRDLWLTAFSFDTTQKWL

SEQ ID NO: 3047161 - protein, 25 aa, Entamoeba invadens
TSRETTMYLYFPIIEGEYLLQHKSD

SEQ ID NO: 3047162 - protein, 26 aa, Entamoeba invadens
TSRKCIICIKGYYPSTVSPFKCIPCD

SEQ ID NO: 3047163 - protein, 31 aa, Entamoeba invadens
TSSCGVFYQEILWNDIILKNGTKVFLSDRML

SEQ ID NO: 3047164 - protein, 33 aa, Entamoeba invadens
TSSINIKFEISKWFSLLFKMNNVYILESIKNKT

SEQ ID NO: 3047165 - protein, 21 aa, Entamoeba invadens
TTANLIDWFQKSIGWDHVPQN

SEQ ID NO: 3047166 - protein, 21 aa, Entamoeba invadens
TTCCRVIFATPYNYDNNRFFT

SEQ ID NO: 3047167 - protein, 26 aa, Entamoeba invadens
TTCKLFNKTFAFCLSLKTILIPESVE

SEQ ID NO: 3047168 - protein, 26 aa, Entamoeba invadens
TTCLSCTSGYYFKSGFCTRCATGCLS

SEQ ID NO: 3047169 - protein, 24 aa, Entamoeba invadens
TTCLSCTSGYYLKSGSCTRCATGC

SEQ ID NO: 3047170 - protein, 24 aa, Entamoeba invadens
TTCLSCTVGYYLKSGSCIKCTIGC

SEQ ID NO: 3047171 - protein, 20 aa, Entamoeba invadens
TTCPGGYYSASSGSAKCTAC

SEQ ID NO: 3047172 - protein, 24 aa, Entamoeba invadens
TTCTSCYYSYFLSGSECLKCDGSC

SEQ ID NO: 3047173 - protein, 24 aa, Entamoeba invadens
TTCVSCTAGYYLEGGKCKKCKTGC

SEQ ID NO: 3047174 - protein, 17 aa, Entamoeba invadens
TTFFKTNRKLPSMLVRE

SEQ ID NO: 3047175 - protein, 18 aa, Entamoeba invadens
TTGKYDGRYILYTQMSSG

SEQ ID NO: 3047176 - protein, 17 aa, Entamoeba invadens
TTHIIVRMLTGKEITLS

SEQ ID NO: 3047177 - protein, 18 aa, Entamoeba invadens
TTIFTRRWDDLKTTIHVS

SEQ ID NO: 3047178 - protein, 29 aa, Entamoeba invadens
TTKDTKALEIIPFKTFPSVTILSMKSKEA

SEQ ID NO: 3047179 - protein, 25 aa, Entamoeba invadens
TTKNEFIQLCLLLSKIYNLHEVHHG

SEQ ID NO: 3047180 - protein, 27 aa, Entamoeba invadens
TTKSPFGIYLHGPWFTPSRVTVLLKFL

SEQ ID NO: 3047181 - protein, 30 aa, Entamoeba invadens
TTLSTINIYLTAPIYFPTLKIGIDEDYQLS

SEQ ID NO: 3047182 - protein, 19 aa, Entamoeba invadens
TTPIPFRPNIVIFEKFEMC

SEQ ID NO: 3047183 - protein, 39 aa, Entamoeba invadens
TTQIDARMKTRLKLYLVLDFNWFLNRRSMLKELSSFIGL

SEQ ID NO: 3047184 - protein, 24 aa, Entamoeba invadens
TTRKPLLFIPGVMSTVLYSKLDIP

SEQ ID NO: 3047185 - protein, 19 aa, Entamoeba invadens
TTSIEWVCYATQTKLVTKI

SEQ ID NO: 3047186 - protein, 24 aa, Entamoeba invadens
TTVIPNYFFKNCTALAEIVNFDKI

SEQ ID NO: 3047187 - protein, 31 aa, Entamoeba invadens
TTVIVTPVELVFPFSTIPQIRRAQIYMNNNW

SEQ ID NO: 3047188 - protein, 23 aa, Entamoeba invadens
TTVVRLGQCYYIGSGIYVKAEED

SEQ ID NO: 3047189 - protein, 23 aa, Entamoeba invadens
TVLLLSLLLVTVFSQTPSKKTKR

SEQ ID NO: 3047190 - protein, 25 aa, Entamoeba invadens
TVQEQFNMRTVYGGQIYSLTLIDTS

SEQ ID NO: 3047191 - protein, 25 aa, Entamoeba invadens
TVQRLLFNLCFYIKRELYVKMQMRP

SEQ ID NO: 3047192 - protein, 23 aa, Entamoeba invadens
TVTITFLNQIFPIKSVLINDVEY

SEQ ID NO: 3047193 - protein, 20 aa, Entamoeba invadens
TVTRKVYFDKIQLVKDPSAP

SEQ ID NO: 3047194 - protein, 23 aa, Entamoeba invadens
TVVPKLLSKVYPNLSLTFTSSDE

SEQ ID NO: 3047195 - protein, 24 aa, Entamoeba invadens
TVVPKLLSKVYPNLSLTFTSSDEK

SEQ ID NO: 3047196 - protein, 26 aa, Entamoeba invadens
TWIRQKYPNIIDGSWASSAPLEAVVD

SEQ ID NO: 3047197 - protein, 28 aa, Entamoeba invadens
TWKDPFDEKLFPYSWDITNLISKGERPA

SEQ ID NO: 3047198 - protein, 48 aa, Entamoeba invadens
TYCPDGIYMYRCPKVLLIFAKHVFPGLIPLGIIKKFAQSVLLGLISLR

SEQ ID NO: 3047199 - protein, 28 aa, Entamoeba invadens
TYFPKDHHFVFRLYTIFGNTTNCYQFYQ

SEQ ID NO: 3047200 - protein, 25 aa, Entamoeba invadens
TYGMARYSYDTFFYRSRWSSKEVGE

SEQ ID NO: 3047201 - protein, 25 aa, Entamoeba invadens
TYGTTIPSGYYKRCNDNWKYNESTG

SEQ ID NO: 3047202 - protein, 24 aa, Entamoeba invadens
TYGYPLRVSVLKSAWRFPNPIFRS

SEQ ID NO: 3047203 - protein, 19 aa, Entamoeba invadens
TYIKFIETPTNGLQFFKSN

SEQ ID NO: 3047204 - protein, 23 aa, Entamoeba invadens
TYNNQWIVFDANAWKLKKEALFI

SEQ ID NO: 3047205 - protein, 25 aa, Entamoeba invadens
TYPKNTITYIIHRSFEVFYERGEWN

SEQ ID NO: 3047206 - protein, 20 aa, Entamoeba invadens
TYPPVNYLGMKYPTLCHQGY

SEQ ID NO: 3047207 - protein, 18 aa, Entamoeba invadens
TYSNAGSVPLWYPHYDNW

SEQ ID NO: 3047208 - protein, 24 aa, Entamoeba invadens
TYTSNLIPGIYYNISVYIKMSNVQ

SEQ ID NO: 3047209 - protein, 17 aa, Entamoeba invadens
VAFSLNFQRVRFSKEEL

SEQ ID NO: 3047210 - protein, 18 aa, Entamoeba invadens
VAGFFGMVLGKREFKRWK

SEQ ID NO: 3047211 - protein, 18 aa, Entamoeba invadens
VALFFSTFVNAGNIIKTK

SEQ ID NO: 3047212 - protein, 23 aa, Entamoeba invadens
VALTAYYYYYKMTGKNTLLLDNN

SEQ ID NO: 3047213 - protein, 26 aa, Entamoeba invadens
VAPLFQHFEEQLCYKTCPSELFEYDS

SEQ ID NO: 3047214 - protein, 17 aa, Entamoeba invadens
VAQGITRIKNGINLLEE

SEQ ID NO: 3047215 - protein, 17 aa, Entamoeba invadens
VATKFDVFNFPEQMEKF

SEQ ID NO: 3047216 - protein, 22 aa, Entamoeba invadens
VCATCEYGYTQVSTSCEYVPYC

SEQ ID NO: 3047217 - protein, 18 aa, Entamoeba invadens
VCEKGYYLLGNQCVQAPP

SEQ ID NO: 3047218 - protein, 18 aa, Entamoeba invadens
VCKKLNVFFDTPTAIIYV

SEQ ID NO: 3047219 - protein, 17 aa, Entamoeba invadens
VCKYFLSTPLKRVSKRL

SEQ ID NO: 3047220 - protein, 26 aa, Entamoeba invadens
VCNRNGVIRYLLFDTGYAGVTDNTEC

SEQ ID NO: 3047221 - protein, 19 aa, Entamoeba invadens
VCPNGTYTYPKDSLCYQNC

SEQ ID NO: 3047222 - protein, 19 aa, Entamoeba invadens
VCQECESNYFLSVDKNKCI

SEQ ID NO: 3047223 - protein, 25 aa, Entamoeba invadens
VCRAFKMQKLFRPVGLVGGGATCRL

SEQ ID NO: 3047224 - protein, 19 aa, Entamoeba invadens
VCSKCDPNFVGYISSEGVC

SEQ ID NO: 3047225 - protein, 24 aa, Entamoeba invadens
VCSQCSEGYYLDSIKNLCVKCNNK

SEQ ID NO: 3047226 - protein, 26 aa, Entamoeba invadens
VCTDCKTGYWPRNGICAICHEKCAED

SEQ ID NO: 3047227 - protein, 23 aa, Entamoeba invadens
VCTKCINGYYIEKNVCKGCSDGC

SEQ ID NO: 3047228 - protein, 21 aa, Entamoeba invadens
VCTLCGDLTYSEGGVLQCQQC

SEQ ID NO: 3047229 - protein, 18 aa, Entamoeba invadens
VCVICESGYYKDVDRCKV

SEQ ID NO: 3047230 - protein, 24 aa, Entamoeba invadens
VDATPLTLGIMTAGGVMAPVIPRG

SEQ ID NO: 3047231 - protein, 24 aa, Entamoeba invadens
VDDIVYINVYAYPASRKLLSSEVS

SEQ ID NO: 3047232 - protein, 19 aa, Entamoeba invadens
VDEYLWENTLFFSKELSVY

SEQ ID NO: 3047233 - protein, 28 aa, Entamoeba invadens
VDGKCRCISGYIFVLDKDEEEKGTCQSC

SEQ ID NO: 3047234 - protein, 27 aa, Entamoeba invadens
VDGTRHVFVKFFAPWCGHCKKLAPEYV

SEQ ID NO: 3047235 - protein, 19 aa, Entamoeba invadens
VDIVIPFKQLNGDGAVSVI

SEQ ID NO: 3047236 - protein, 24 aa, Entamoeba invadens
VDKYIQRVVSISTPWLGAVKTIKA

SEQ ID NO: 3047237 - protein, 25 aa, Entamoeba invadens
VDLGTFGLSMKISFMPSLPSDESDF

SEQ ID NO: 3047238 - protein, 33 aa, Entamoeba invadens
VDPQVFAEQLFLFDLWILRDLRPSDFMENNASV

SEQ ID NO: 3047239 - protein, 26 aa, Entamoeba invadens
VDSVSYSSLFKEIAFLAKNIIKLPSD

SEQ ID NO: 3047240 - protein, 30 aa, Entamoeba invadens
VDYSHKYCMKCYPGFRLSIDTMKCIFGDEF

SEQ ID NO: 3047241 - protein, 25 aa, Entamoeba invadens
VEDQHYYFYILYSDTEFIIRTRYRA

SEQ ID NO: 3047242 - protein, 27 aa, Entamoeba invadens
VEFFQRPLVLSQLFDHPTFKKSDLLIA

SEQ ID NO: 3047243 - protein, 29 aa, Entamoeba invadens
VEFPNIPVITYWPHLLIKEGAYPCEWGNE

SEQ ID NO: 3047244 - protein, 18 aa, Entamoeba invadens
VEFSYLRYLFSGNEFTQI

SEQ ID NO: 3047245 - protein, 26 aa, Entamoeba invadens
VEILKKRLKRILKPTFEKKPNFLIMK

SEQ ID NO: 3047246 - protein, 25 aa, Entamoeba invadens
VENGDGWLLIMNSITPEVVHNGVPV

SEQ ID NO: 3047247 - protein, 19 aa, Entamoeba invadens
VENLPEYAAVSYAYIDAKD

SEQ ID NO: 3047248 - protein, 34 aa, Entamoeba invadens
VESQLNTLVRRKAKILSTMKVYLESVPVDVRNNI

SEQ ID NO: 3047249 - protein, 24 aa, Entamoeba invadens
VETNCFFPLFVRKVGDNPKPMNYT

SEQ ID NO: 3047250 - protein, 29 aa, Entamoeba invadens
VEWKGQDMAWWMNVVVFPLFDRLDDDMAD

SEQ ID NO: 3047251 - protein, 18 aa, Entamoeba invadens
VEYFHTTFGRFKVPLIKE

SEQ ID NO: 3047252 - protein, 25 aa, Entamoeba invadens
VFAPKGLNLLIETFKFISQSTIPPS

SEQ ID NO: 3047253 - protein, 18 aa, Entamoeba invadens
VFAYCLELREIDINGANY

SEQ ID NO: 3047254 - protein, 20 aa, Entamoeba invadens
VFFYQCDSRWKSKMYSSRND

SEQ ID NO: 3047255 - protein, 25 aa, Entamoeba invadens
VFKLLDYFQVNWIEKWPIRIWCQFN

SEQ ID NO: 3047256 - protein, 20 aa, Entamoeba invadens
VFLCFVFVSLCVQAEETREC

SEQ ID NO: 3047257 - protein, 19 aa, Entamoeba invadens
VFLFHKHSLGVPTCEKGYY

SEQ ID NO: 3047258 - protein, 27 aa, Entamoeba invadens
VFLKQKFGKIWKRLIVISLTSISCNTN

SEQ ID NO: 3047259 - protein, 43 aa, Entamoeba invadens
VFLKQKFGKIWKSLIVATDFFYQNLTLHIKNSNIKYIICTLLK

SEQ ID NO: 3047260 - protein, 18 aa, Entamoeba invadens
VFLSSTLAVECPVECGGI

SEQ ID NO: 3047261 - protein, 17 aa, Entamoeba invadens
VFLTFVNAISSYDFAED

SEQ ID NO: 3047262 - protein, 18 aa, Entamoeba invadens
VFLVITVGQQVTNTIANR

SEQ ID NO: 3047263 - protein, 17 aa, Entamoeba invadens
VFTYYDPRILLGFDQDY

SEQ ID NO: 3047264 - protein, 19 aa, Entamoeba invadens
VFVENYLWKYISTTEAQWS

SEQ ID NO: 3047265 - protein, 18 aa, Entamoeba invadens
VFVVNGSWEVFSDEDVLG

SEQ ID NO: 3047266 - protein, 25 aa, Entamoeba invadens
VFYQMKNVYEYLPSLDLFGSDTYPV

SEQ ID NO: 3047267 - protein, 26 aa, Entamoeba invadens
VGDIPTIHLPLWAEKSILTNDAFFKD

SEQ ID NO: 3047268 - protein, 26 aa, Entamoeba invadens
VGDVKLKIITLPKILKEIGEAAFADC

SEQ ID NO: 3047269 - protein, 18 aa, Entamoeba invadens
VGGSTRIPKVRDLLKEFF

SEQ ID NO: 3047270 - protein, 26 aa, Entamoeba invadens
VGGVDLFVHLFAISWGLTHPTRFALI

SEQ ID NO: 3047271 - protein, 56 aa, Entamoeba invadens
VGKSNWFKRFMFSTGFYIKKALYVDYNLCPPYLFTPLLKVVDGIIFKPLSKSLLGK

SEQ ID NO: 3047272 - protein, 18 aa, Entamoeba invadens
VGNTLIIWAKKPPLDIGT

SEQ ID NO: 3047273 - protein, 24 aa, Entamoeba invadens
VGNTVYINVFAYPANRKLLSTEVQ

SEQ ID NO: 3047274 - protein, 26 aa, Entamoeba invadens
VGNYIPSYILSTQTKLGFSYILGGVN

SEQ ID NO: 3047275 - protein, 27 aa, Entamoeba invadens
VGSYAFALSGLHKITLNPTTKFGENAF

SEQ ID NO: 3047276 - protein, 23 aa, Entamoeba invadens
VGVALYVYYYYTQMTQTTGLIKD

SEQ ID NO: 3047277 - protein, 22 aa, Entamoeba invadens
VGVMSDIWWGLVETSPKTYNWN

SEQ ID NO: 3047278 - protein, 24 aa, Entamoeba invadens
VGYYPGTNVSYIFQFLPVDGKCND

SEQ ID NO: 3047279 - protein, 30 aa, Entamoeba invadens
VHCSCCDGFLTLFFRPLLTSTGDIGDHFDL

SEQ ID NO: 3047280 - protein, 25 aa, Entamoeba invadens
VHHGYGKYILLLRNNLESISKTTQI

SEQ ID NO: 3047281 - protein, 23 aa, Entamoeba invadens
VHRGFEDFLPLNKAMFSMSLLIE

SEQ ID NO: 3047282 - protein, 23 aa, Entamoeba invadens
VHSLDFNTWYTLHNKKYQAVEFL

SEQ ID NO: 3047283 - protein, 17 aa, Entamoeba invadens
VIGLFRGAAGKNDLYTY

SEQ ID NO: 3047284 - protein, 39 aa, Entamoeba invadens
VIKSIYNINLYNKSIFIFKTLGFFNSYFTISIGDNSIFK

SEQ ID NO: 3047285 - protein, 24 aa, Entamoeba invadens
VIKVISFDFLLPTLNSTCMTDFVA

SEQ ID NO: 3047286 - protein, 25 aa, Entamoeba invadens
VILICAVLYILRPKSYDKAKQGEWI

SEQ ID NO: 3047287 - protein, 24 aa, Entamoeba invadens
VILRSFISVLPLFKDYISPPQTEK

SEQ ID NO: 3047288 - protein, 18 aa, Entamoeba invadens
VILSFGCAQQYEIIHKKR

SEQ ID NO: 3047289 - protein, 19 aa, Entamoeba invadens
VILTLFSFVSAYESDEYDD

SEQ ID NO: 3047290 - protein, 26 aa, Entamoeba invadens
VILVTLVILYYLRPSTYPKKLNGQWV

SEQ ID NO: 3047291 - protein, 18 aa, Entamoeba invadens
VINAMRGWMGLTPITSKE

SEQ ID NO: 3047292 - protein, 31 aa, Entamoeba invadens
VIPFGLKEDVILWFKKYDFLNVLSDSNPEGI

SEQ ID NO: 3047293 - protein, 19 aa, Entamoeba invadens
VIQAENIYTIIPKITGRTI

SEQ ID NO: 3047294 - protein, 17 aa, Entamoeba invadens
VISLISFSPSMSPDQMV

SEQ ID NO: 3047295 - protein, 28 aa, Entamoeba invadens
VISLLFVFFFIVFVVITDGSVYGFSVQN

SEQ ID NO: 3047296 - protein, 23 aa, Entamoeba invadens
VITSFVYLPAQKVEIGAKAFKGA

SEQ ID NO: 3047297 - protein, 28 aa, Entamoeba invadens
VIVTHSMGGLLLYKFLDFVGKKFCNKYI

SEQ ID NO: 3047298 - protein, 24 aa, Entamoeba invadens
VKCEYPCVYCSNRTFCTKCDDYSY

SEQ ID NO: 3047299 - protein, 19 aa, Entamoeba invadens
VKCSPYCAEGKCDGLTGCT

SEQ ID NO: 3047300 - protein, 24 aa, Entamoeba invadens
VKERIEIQKLKDEFYKLSALKEKQ

SEQ ID NO: 3047301 - protein, 28 aa, Entamoeba invadens
VKHKTSHPLRFWLVEDFLSPSGRKTLPE

SEQ ID NO: 3047302 - protein, 24 aa, Entamoeba invadens
VKKIVKKAPKKIITKVTKKVTPKA

SEQ ID NO: 3047303 - protein, 25 aa, Entamoeba invadens
VKLTKRYIVIPTKPFTLEKYEITNE

SEQ ID NO: 3047304 - protein, 17 aa, Entamoeba invadens
VKRIKKVVLLRKRVRQI

SEQ ID NO: 3047305 - protein, 26 aa, Entamoeba invadens
VKSLSKMIVLIQVITLFLCTVHSTET

SEQ ID NO: 3047306 - protein, 24 aa, Entamoeba invadens
VKVVKRYFMVPNRPILMEAYDITN

SEQ ID NO: 3047307 - protein, 18 aa, Entamoeba invadens
VLCDVAVSTSYPLKIFLL

SEQ ID NO: 3047308 - protein, 18 aa, Entamoeba invadens
VLEIYFINAMGDLSTLNK

SEQ ID NO: 3047309 - protein, 19 aa, Entamoeba invadens
VLEPAKWNRITVNLTALAL

SEQ ID NO: 3047310 - protein, 18 aa, Entamoeba invadens
VLFFVGLQAVDYDDEYAD

SEQ ID NO: 3047311 - protein, 17 aa, Entamoeba invadens
VLFNPFLNEYATASYKL

SEQ ID NO: 3047312 - protein, 18 aa, Entamoeba invadens
VLIILALSTCPPNIMEET

SEQ ID NO: 3047313 - protein, 18 aa, Entamoeba invadens
VLIPLTQSQTLCMTDFVV

SEQ ID NO: 3047314 - protein, 17 aa, Entamoeba invadens
VLIVWDILISTKLEITM

SEQ ID NO: 3047315 - protein, 21 aa, Entamoeba invadens
VLKFDIKVVSVVKYADLRKQQ

SEQ ID NO: 3047316 - protein, 26 aa, Entamoeba invadens
VLKKSIFFFSFGLKEKLYINYNYLSP

SEQ ID NO: 3047317 - protein, 27 aa, Entamoeba invadens
VLKNFNHFFVHWYYQSRLDTYRFADCE

SEQ ID NO: 3047318 - protein, 21 aa, Entamoeba invadens
VLLFGVLCLGKNAVIALDPET

SEQ ID NO: 3047319 - protein, 25 aa, Entamoeba invadens
VLLYFLLLIHSVISQLYFPDKLSSL

SEQ ID NO: 3047320 - protein, 20 aa, Entamoeba invadens
VLQTLKELPPYVVIRRVYDE

SEQ ID NO: 3047321 - protein, 26 aa, Entamoeba invadens
VLSFSYENWLTLHKVKYLTTEYLRRK

SEQ ID NO: 3047322 - protein, 17 aa, Entamoeba invadens
VLTISSAVTYDDLKAQL

SEQ ID NO: 3047323 - protein, 24 aa, Entamoeba invadens
VLTQKFLKELIAYAKTRGIIVYPE

SEQ ID NO: 3047324 - protein, 20 aa, Entamoeba invadens
VLTRSYYFGSQKYGAMWTGD

SEQ ID NO: 3047325 - protein, 18 aa, Entamoeba invadens
VLVAVGLATHFTTTSTTK

SEQ ID NO: 3047326 - protein, 18 aa, Entamoeba invadens
VMGTRSTWPVIQAMNWMS

SEQ ID NO: 3047327 - protein, 21 aa, Entamoeba invadens
VMINEIFPKKNIKYFGGSEET

SEQ ID NO: 3047328 - protein, 17 aa, Entamoeba invadens
VMKMRIKLMLDTAKGIQ

SEQ ID NO: 3047329 - protein, 19 aa, Entamoeba invadens
VMRITSNITLLVMKNELQE

SEQ ID NO: 3047330 - protein, 25 aa, Entamoeba invadens
VMTEWVFHYISPATKKVKSIIELDE

SEQ ID NO: 3047331 - protein, 24 aa, Entamoeba invadens
VNAYILAKTLFPDYLFYSRVDDEI

SEQ ID NO: 3047332 - protein, 20 aa, Entamoeba invadens
VNFPLLKHIYKRADFLKTGP

SEQ ID NO: 3047333 - protein, 21 aa, Entamoeba invadens
VNGSVYLYVPYDNGRCKTDST

SEQ ID NO: 3047334 - protein, 20 aa, Entamoeba invadens
VNIPLPNWVLVAGKSKGIFF

SEQ ID NO: 3047335 - protein, 28 aa, Entamoeba invadens
VNNAPKIRFHRTVKQHYINKARAKSLLE

SEQ ID NO: 3047336 - protein, 24 aa, Entamoeba invadens
VNNQKMYFLVINSFYTPNQSEYIE

SEQ ID NO: 3047337 - protein, 27 aa, Entamoeba invadens
VNQKKLLKVIEFFAHKYAKMASEIAAS

SEQ ID NO: 3047338 - protein, 37 aa, Entamoeba invadens
VNTSLFQFYPKILVIIAHPLLRIVFKSPLEGVQTALH

SEQ ID NO: 3047339 - protein, 28 aa, Entamoeba invadens
VNVCTSRRPVFLFNGILGSSLSANISNY

SEQ ID NO: 3047340 - protein, 18 aa, Entamoeba invadens
VNVLFSKNLTPLSNCQKA

SEQ ID NO: 3047341 - protein, 25 aa, Entamoeba invadens
VNYADFSKYEKLPRKFKTCNAKEGI

SEQ ID NO: 3047342 - protein, 17 aa, Entamoeba invadens
VPAPFPFGPKHPEHNNH

SEQ ID NO: 3047343 - protein, 18 aa, Entamoeba invadens
VPETELMYSVFEKCLKLN

SEQ ID NO: 3047344 - protein, 25 aa, Entamoeba invadens
VPMINVYNPMMYMGRPFMAQSPYMM

SEQ ID NO: 3047345 - protein, 50 aa, Entamoeba invadens
VPNTISTEFPITYPFCRYRGKQGYFEDLYPAYYVLLKDKDETYNNVYCNP

SEQ ID NO: 3047346 - protein, 17 aa, Entamoeba invadens
VPVYLNRSAPESLDLRT

SEQ ID NO: 3047347 - protein, 17 aa, Entamoeba invadens
VPYMYRERVLADCPALV

SEQ ID NO: 3047348 - protein, 19 aa, Entamoeba invadens
VQFKKFPEYLLDPKTAFRN

SEQ ID NO: 3047349 - protein, 23 aa, Entamoeba invadens
VQGLYCILDGVHDKEYYECSDNY

SEQ ID NO: 3047350 - protein, 21 aa, Entamoeba invadens
VQICLSCINGYGLNGLSECFK

SEQ ID NO: 3047351 - protein, 29 aa, Entamoeba invadens
VQNYNQIRLFKFTFWVTSVDLEEIEQPQQ

SEQ ID NO: 3047352 - protein, 18 aa, Entamoeba invadens
VQTMLIQLGYSCGSSGAD

SEQ ID NO: 3047353 - protein, 20 aa, Entamoeba invadens
VRADYLRCVGLRRNILKGSG

SEQ ID NO: 3047354 - protein, 23 aa, Entamoeba invadens
VRDAKYKISKLPKKLKTKVSQLK

SEQ ID NO: 3047355 - protein, 22 aa, Entamoeba invadens
VRDYLKYFTYPMLKTQHGWRED

SEQ ID NO: 3047356 - protein, 30 aa, Entamoeba invadens
VRGKRYRGVRFMRKVYVPKKYRIGRKWKFS

SEQ ID NO: 3047357 - protein, 18 aa, Entamoeba invadens
VRHYGSYVIAYYNLQQKE

SEQ ID NO: 3047358 - protein, 19 aa, Entamoeba invadens
VRRFNRKMRMLKRKSKHLE

SEQ ID NO: 3047359 - protein, 21 aa, Entamoeba invadens
VRSCLICSVGYYPSSGMCVSC

SEQ ID NO: 3047360 - protein, 20 aa, Entamoeba invadens
VRSCLMCLTGYYPSSGMCVE

SEQ ID NO: 3047361 - protein, 28 aa, Entamoeba invadens
VSDKLSVMRWYLFKITDGKTYEWISDTN

SEQ ID NO: 3047362 - protein, 17 aa, Entamoeba invadens
VSDNYTLDLLKAAAKAA

SEQ ID NO: 3047363 - protein, 20 aa, Entamoeba invadens
VSFCRRYNFDGIDIDWEYPG

SEQ ID NO: 3047364 - protein, 21 aa, Entamoeba invadens
VSFNSVLYYLSPSLFKSNDEA

SEQ ID NO: 3047365 - protein, 17 aa, Entamoeba invadens
VSGAVISNGVCSLCNSG

SEQ ID NO: 3047366 - protein, 17 aa, Entamoeba invadens
VSGYYPESGNCYNCSKI

SEQ ID NO: 3047367 - protein, 22 aa, Entamoeba invadens
VSHKLINKYLPLKAFVTTPSST

SEQ ID NO: 3047368 - protein, 23 aa, Entamoeba invadens
VSKEGYFQLLTPPGSYSLHLENS

SEQ ID NO: 3047369 - protein, 29 aa, Entamoeba invadens
VSKLKTIAFYKPSDIPLMFEKIRRHIKME

SEQ ID NO: 3047370 - protein, 28 aa, Entamoeba invadens
VSPMQRVIRYKLFIENISKLPQFKGNRV

SEQ ID NO: 3047371 - protein, 23 aa, Entamoeba invadens
VSTLESLYLQEGFTKYTVDTLDL

SEQ ID NO: 3047372 - protein, 24 aa, Entamoeba invadens
VSTSYPLKIFLLNEQHHLSCVGVD

SEQ ID NO: 3047373 - protein, 28 aa, Entamoeba invadens
VSTTKGCLRCLSGYYLADRMCVKCEYPC

SEQ ID NO: 3047374 - protein, 17 aa, Entamoeba invadens
VSVFTVMTIIYSMERLV

SEQ ID NO: 3047375 - protein, 28 aa, Entamoeba invadens
VSVRDNKYLFIYFALEKCVYSGNNVYMK

SEQ ID NO: 3047376 - protein, 27 aa, Entamoeba invadens
VSVTVSGYFWNVFQNAKVLLGKRGQSV

SEQ ID NO: 3047377 - protein, 23 aa, Entamoeba invadens
VSYFTNWAQYRWASIDGWACKFT

SEQ ID NO: 3047378 - protein, 24 aa, Entamoeba invadens
VTAEQYFDWCFKAIQLIEDRKNSK

SEQ ID NO: 3047379 - protein, 28 aa, Entamoeba invadens
VTCATDFTRKCIACKPNYYIKMSGDYKC

SEQ ID NO: 3047380 - protein, 18 aa, Entamoeba invadens
VTCLTCEPVALGGNGRDA

SEQ ID NO: 3047381 - protein, 17 aa, Entamoeba invadens
VTDAMVFLLACEGYKLT

SEQ ID NO: 3047382 - protein, 19 aa, Entamoeba invadens
VTFCAWAYTAKTRPVAKSL

SEQ ID NO: 3047383 - protein, 25 aa, Entamoeba invadens
VTIKSSSMFILFSTEVILGENNRIS

SEQ ID NO: 3047384 - protein, 27 aa, Entamoeba invadens
VTLPHEIQSFGFIFLDKRGLVVGILGD

SEQ ID NO: 3047385 - protein, 32 aa, Entamoeba invadens
VTLTIASNLFKKFWCKVLPVARVALSGFTGVR

SEQ ID NO: 3047386 - protein, 27 aa, Entamoeba invadens
VTMKVLTLILLSVFAYSELTGLSECGS

SEQ ID NO: 3047387 - protein, 23 aa, Entamoeba invadens
VTMYAAPFDWRYFRFDEYSHVSN

SEQ ID NO: 3047388 - protein, 23 aa, Entamoeba invadens
VTVIPRNFFQGCTSLKSVIGFDK

SEQ ID NO: 3047389 - protein, 28 aa, Entamoeba invadens
VTVKRVIKLITLIKKTLNILPEPMNTKL

SEQ ID NO: 3047390 - protein, 26 aa, Entamoeba invadens
VTVVTCVILYFLRPKGYPKEKEGEWV

SEQ ID NO: 3047391 - protein, 26 aa, Entamoeba invadens
VTYMKTFKYKTFYPFYNVYAHTQNGN

SEQ ID NO: 3047392 - protein, 29 aa, Entamoeba invadens
VVALHKNLLPITWSYYHKMGYNSTTRYIC

SEQ ID NO: 3047393 - protein, 17 aa, Entamoeba invadens
VVDKSQPISLFQALQRR

SEQ ID NO: 3047394 - protein, 17 aa, Entamoeba invadens
VVFLMGVRGSSDDDGQH

SEQ ID NO: 3047395 - protein, 17 aa, Entamoeba invadens
VVIVVRSEDFFHPYLHS

SEQ ID NO: 3047396 - protein, 39 aa, Entamoeba invadens
VVKAKHKKLQDVTLALASKFFEQYYCKIQPTVNAALSKF

SEQ ID NO: 3047397 - protein, 18 aa, Entamoeba invadens
VVLKWHVEYYWGSLFIAS

SEQ ID NO: 3047398 - protein, 25 aa, Entamoeba invadens
VVLQTYMDIISPTYLIPILERVETI

SEQ ID NO: 3047399 - protein, 20 aa, Entamoeba invadens
VVMPTILEKVGFIATATTSF

SEQ ID NO: 3047400 - protein, 19 aa, Entamoeba invadens
VVMVPGLMSSILEAKIDVA

SEQ ID NO: 3047401 - protein, 18 aa, Entamoeba invadens
VVPGLNAVAAPIAAGAKT

SEQ ID NO: 3047402 - protein, 33 aa, Entamoeba invadens
VVPSTSVNPLPLPIVQPFPIPPSQADPKPVELV

SEQ ID NO: 3047403 - protein, 17 aa, Entamoeba invadens
VVTMLPGDKIVFTTNDS

SEQ ID NO: 3047404 - protein, 17 aa, Entamoeba invadens
VVVKFYAPWCGICKGMK

SEQ ID NO: 3047405 - protein, 25 aa, Entamoeba invadens
VVVVTCIILYYLRPKGYPKEKEGEW

SEQ ID NO: 3047406 - protein, 19 aa, Entamoeba invadens
VWRFGNLIRRKFGITRQST

SEQ ID NO: 3047407 - protein, 28 aa, Entamoeba invadens
VYCMIAGSFNFTFQGKPFPPKAAVVGVS

SEQ ID NO: 3047408 - protein, 20 aa, Entamoeba invadens
VYCPVGTICGYIGRVPDSDS

SEQ ID NO: 3047409 - protein, 23 aa, Entamoeba invadens
VYDLRICYYPFPDAQNPQPMRCP

SEQ ID NO: 3047410 - protein, 24 aa, Entamoeba invadens
VYEQSTLQQLYYLNKPYPTEHPHF

SEQ ID NO: 3047411 - protein, 17 aa, Entamoeba invadens
VYLFTTSCGAGDFWVVW

SEQ ID NO: 3047412 - protein, 17 aa, Entamoeba invadens
VYMAFEILNKQHYKKPA

SEQ ID NO: 3047413 - protein, 33 aa, Entamoeba invadens
VYSNLWKDWHPWLLWVLSPSFYIFWKNPKEACQ

SEQ ID NO: 3047414 - protein, 19 aa, Entamoeba invadens
WAATTANLIDWYQQSINFT

SEQ ID NO: 3047415 - protein, 23 aa, Entamoeba invadens
WADGFILNSGWLVGLSDLAVEQE

SEQ ID NO: 3047416 - protein, 18 aa, Entamoeba invadens
WCSEHFNIPFFETSAKNA

SEQ ID NO: 3047417 - protein, 18 aa, Entamoeba invadens
WDMLLPKEIEDPKISKPS

SEQ ID NO: 3047418 - protein, 19 aa, Entamoeba invadens
WEQNILLRPLKPGNELQFW

SEQ ID NO: 3047419 - protein, 17 aa, Entamoeba invadens
WEVVTMLPGDKIVFTTN

SEQ ID NO: 3047420 - protein, 25 aa, Entamoeba invadens
WGRHKAALAFLATYTGPITVYYGDE

SEQ ID NO: 3047421 - protein, 26 aa, Entamoeba invadens
WGYDQALINWLFYNGKFKEVDMKSVL

SEQ ID NO: 3047422 - protein, 21 aa, Entamoeba invadens
WGYDQALLNVLYYNGSFDEVG

SEQ ID NO: 3047423 - protein, 21 aa, Entamoeba invadens
WKNQNLIFRQFRGLVSGYNKY

SEQ ID NO: 3047424 - protein, 30 aa, Entamoeba invadens
WKVEKYCFIPHKESVLYHKGVYAKYSHLDG

SEQ ID NO: 3047425 - protein, 25 aa, Entamoeba invadens
WLEKWPIKLWCQFNQKLRTDNLSES

SEQ ID NO: 3047426 - protein, 29 aa, Entamoeba invadens
WLLWGGLILLNLFILVVTIVSACLLGNEI

SEQ ID NO: 3047427 - protein, 17 aa, Entamoeba invadens
WLSLFKCKSPMYQYDKH

SEQ ID NO: 3047428 - protein, 19 aa, Entamoeba invadens
WNMINHRFVLYKNYLIEHE

SEQ ID NO: 3047429 - protein, 20 aa, Entamoeba invadens
WPHFYKNRNMYCCTNFFGPD

SEQ ID NO: 3047430 - protein, 18 aa, Entamoeba invadens
WPSLKRCLFFNYEFLKHA

SEQ ID NO: 3047431 - protein, 28 aa, Entamoeba invadens
WSLVKNPMIIMAAVSLGLLGFSKLTLSA

SEQ ID NO: 3047432 - protein, 17 aa, Entamoeba invadens
WSTIKTWRYGENIPALN

SEQ ID NO: 3047433 - protein, 26 aa, Entamoeba invadens
WTSEDILDWDPFYLEFDNVGQAPIIN

SEQ ID NO: 3047434 - protein, 23 aa, Entamoeba invadens
WTSILGSYTFKYASDIPLWYAHY

SEQ ID NO: 3047435 - protein, 19 aa, Entamoeba invadens
WVDMSDYYYYFYNTELLIE

SEQ ID NO: 3047436 - protein, 26 aa, Entamoeba invadens
YAIYNESCYIPPKPIIPDGSKGVDSF

SEQ ID NO: 3047437 - protein, 22 aa, Entamoeba invadens
YATLTFAMIWEDVYDNLRMSVA

SEQ ID NO: 3047438 - protein, 25 aa, Entamoeba invadens
YCDHKLDLHYSFDSTITNPKCADGY

SEQ ID NO: 3047439 - protein, 19 aa, Entamoeba invadens
YCEKCIMGKYPSFDTNRCQ

SEQ ID NO: 3047440 - protein, 18 aa, Entamoeba invadens
YCITGYYIDKESGTCKLG

SEQ ID NO: 3047441 - protein, 29 aa, Entamoeba invadens
YCLGYLEAYLTHHQMYLYWNNYKMNEYNK

SEQ ID NO: 3047442 - protein, 29 aa, Entamoeba invadens
YCSKKFSLKTLWLSVESFIPFINECGLGY

SEQ ID NO: 3047443 - protein, 22 aa, Entamoeba invadens
YDDWVFPQRKVADIIIPWGEIS

SEQ ID NO: 3047444 - protein, 19 aa, Entamoeba invadens
YDGWYIKYEKSANGIKRYM

SEQ ID NO: 3047445 - protein, 29 aa, Entamoeba invadens
YDKAFYFDRWSLFRYLDQAHKFKTRRSVP

SEQ ID NO: 3047446 - protein, 17 aa, Entamoeba invadens
YDKDKIHYIGWHPEKPA

SEQ ID NO: 3047447 - protein, 24 aa, Entamoeba invadens
YDKNHLYFCTRFPGSSPSIGEIVN

SEQ ID NO: 3047448 - protein, 25 aa, Entamoeba invadens
YDLTAVCKYGWYSNQWFSFDDEITI

SEQ ID NO: 3047449 - protein, 24 aa, Entamoeba invadens
YDNVYVCFVSCLFLVLTDKYYRSF

SEQ ID NO: 3047450 - protein, 23 aa, Entamoeba invadens
YDTSYLFCHYKGVNTVFEEIVPT

SEQ ID NO: 3047451 - protein, 19 aa, Entamoeba invadens
YEAVPTDCIVFPRNWIYED

SEQ ID NO: 3047452 - protein, 23 aa, Entamoeba invadens
YECSDNYQGFRPCAPNTRCAKEG

SEQ ID NO: 3047453 - protein, 28 aa, Entamoeba invadens
YETISWIDPYLQEKFKFPWKIAEFISSG

SEQ ID NO: 3047454 - protein, 17 aa, Entamoeba invadens
YEVLKTKAINRLHTRRS

SEQ ID NO: 3047455 - protein, 17 aa, Entamoeba invadens
YFGSQKYGAMWTGDSDA

SEQ ID NO: 3047456 - protein, 17 aa, Entamoeba invadens
YFIEVLSTVTVKCESEG

SEQ ID NO: 3047457 - protein, 19 aa, Entamoeba invadens
YFLIFLCVNSTTRCQVTCE

SEQ ID NO: 3047458 - protein, 33 aa, Entamoeba invadens
YFVEQRKAITIFLNYTYFNLKYIDNKYNNTAFN

SEQ ID NO: 3047459 - protein, 17 aa, Entamoeba invadens
YFYGAVFVPNKICLVTQ

SEQ ID NO: 3047460 - protein, 19 aa, Entamoeba invadens
YGAFDNPIKIRPALNAKVV

SEQ ID NO: 3047461 - protein, 17 aa, Entamoeba invadens
YGAVFVPNKICLVTQFA

SEQ ID NO: 3047462 - protein, 19 aa, Entamoeba invadens
YGCFTCKDGYYLTQNSKCQ

SEQ ID NO: 3047463 - protein, 23 aa, Entamoeba invadens
YGKENSLYWGRHKAALAFLATYT

SEQ ID NO: 3047464 - protein, 25 aa, Entamoeba invadens
YGNTFKKLIWPFTLDYGCPQINDAN

SEQ ID NO: 3047465 - protein, 23 aa, Entamoeba invadens
YGPYGIPFYTPLIQPCLIALNSY

SEQ ID NO: 3047466 - protein, 22 aa, Entamoeba invadens
YGYCTSCKLGYVLKLDKQSLIC

SEQ ID NO: 3047467 - protein, 19 aa, Entamoeba invadens
YIDLVNYKCVLKCPDTLKV

SEQ ID NO: 3047468 - protein, 18 aa, Entamoeba invadens
YIGYYRSVPVAVKQFRWE

SEQ ID NO: 3047469 - protein, 19 aa, Entamoeba invadens
YIHDVFPSMITVDNAKNLL

SEQ ID NO: 3047470 - protein, 38 aa, Entamoeba invadens
YIINDVLDDMKSGIPLTLFLQTVTGKTVKRFNMKPNGQ

SEQ ID NO: 3047471 - protein, 18 aa, Entamoeba invadens
YIKDLGMNALWMTPIFNS

SEQ ID NO: 3047472 - protein, 21 aa, Entamoeba invadens
YILVLTYVFGDTVCYPNSPNC

SEQ ID NO: 3047473 - protein, 19 aa, Entamoeba invadens
YIMSVLQYQKLVPLFKYDK

SEQ ID NO: 3047474 - protein, 26 aa, Entamoeba invadens
YINLEPLDFVWSIPAANLPSNYQKGQ

SEQ ID NO: 3047475 - protein, 48 aa, Entamoeba invadens
YISQLPITISDFPRFKWRGLLVDPSRNQILPKTFYKIVDSLAAFKINI

SEQ ID NO: 3047476 - protein, 20 aa, Entamoeba invadens
YIVRNSWGASWGLDGYILMS

SEQ ID NO: 3047477 - protein, 21 aa, Entamoeba invadens
YIVRNSWGASWGLDGYILMSR

SEQ ID NO: 3047478 - protein, 26 aa, Entamoeba invadens
YKFKGKPIEIRWALLQKKVNFEELNF

SEQ ID NO: 3047479 - protein, 44 aa, Entamoeba invadens
YKKVDLPPLSFFMLYLRSYFPDYAPFLIPPVYPSQLIVFDNYFK

SEQ ID NO: 3047480 - protein, 19 aa, Entamoeba invadens
YKLVGYSCYYNGCTVANCE

SEQ ID NO: 3047481 - protein, 17 aa, Entamoeba invadens
YKMFTVYVLPRRVHDIR

SEQ ID NO: 3047482 - protein, 25 aa, Entamoeba invadens
YKNPKYQFNTYTNPYMKQYDGDINM

SEQ ID NO: 3047483 - protein, 27 aa, Entamoeba invadens
YKSEYGKFFLNWYHQQLIKHAENILSS

SEQ ID NO: 3047484 - protein, 22 aa, Entamoeba invadens
YKSIRFMVRFDDSGDVKYLPLN

SEQ ID NO: 3047485 - protein, 22 aa, Entamoeba invadens
YKYAPYIKRYFLATADQVPSYL

SEQ ID NO: 3047486 - protein, 18 aa, Entamoeba invadens
YLGDPKCTIWTKLNNKMI

SEQ ID NO: 3047487 - protein, 17 aa, Entamoeba invadens
YLGRKILRICPIEYNYD

SEQ ID NO: 3047488 - protein, 21 aa, Entamoeba invadens
YLKVNPVLPLPLSEETPKKIG

SEQ ID NO: 3047489 - protein, 18 aa, Entamoeba invadens
YLMLCSKAIEDTECCTLD

SEQ ID NO: 3047490 - protein, 26 aa, Entamoeba invadens
YLNVTQWFSIIFKTNRKYILNGIDVS

SEQ ID NO: 3047491 - protein, 26 aa, Entamoeba invadens
YLRAHKLQIVLFKINQKLETIHAEYV

SEQ ID NO: 3047492 - protein, 18 aa, Entamoeba invadens
YLSETFRRAIKGIDGKTY

SEQ ID NO: 3047493 - protein, 18 aa, Entamoeba invadens
YLSFALRQCYIEDLFYNS

SEQ ID NO: 3047494 - protein, 26 aa, Entamoeba invadens
YMKVTLFLHSTSQYWKLLKESPLHVE

SEQ ID NO: 3047495 - protein, 30 aa, Entamoeba invadens
YMKYYPSQLNWYRYLYLFTSTYTMINKLEL

SEQ ID NO: 3047496 - protein, 17 aa, Entamoeba invadens
YMNVIHWSDNSLLSVAL

SEQ ID NO: 3047497 - protein, 17 aa, Entamoeba invadens
YNATFLFNATESYFPGA

SEQ ID NO: 3047498 - protein, 19 aa, Entamoeba invadens
YNCLSCNTGYYLSNGNCLE

SEQ ID NO: 3047499 - protein, 24 aa, Entamoeba invadens
YNDFKLRILMAETGLPFTLNFGVF

SEQ ID NO: 3047500 - protein, 25 aa, Entamoeba invadens
YNGAEKFLKWLAKAELRDGGFFATT

SEQ ID NO: 3047501 - protein, 22 aa, Entamoeba invadens
YNKIDRIFLMDIRIVLFYSDFF

SEQ ID NO: 3047502 - protein, 29 aa, Entamoeba invadens
YNYRDDQCMWWNVPNCISYIERGVCATCE

SEQ ID NO: 3047503 - protein, 18 aa, Entamoeba invadens
YPANLIYVLMNDTGPDKV

SEQ ID NO: 3047504 - protein, 19 aa, Entamoeba invadens
YPILRNKLYYPNTTCFILC

SEQ ID NO: 3047505 - protein, 19 aa, Entamoeba invadens
YPPKSQWMLDHLSDLFSDW

SEQ ID NO: 3047506 - protein, 25 aa, Entamoeba invadens
YPSDPNWFHVPRQPNMTYQQCTVPT

SEQ ID NO: 3047507 - protein, 19 aa, Entamoeba invadens
YPVILYTHGGPESPWTNDF

SEQ ID NO: 3047508 - protein, 25 aa, Entamoeba invadens
YQAVEFLRRRAIFAQNARVVSKHNA

SEQ ID NO: 3047509 - protein, 31 aa, Entamoeba invadens
YQKKTSRMQFLLFVLFWPGEKCYDIECSLPV

SEQ ID NO: 3047510 - protein, 29 aa, Entamoeba invadens
YQMPQAIRNTWWFPLLNTISMDQYQRVYM

SEQ ID NO: 3047511 - protein, 17 aa, Entamoeba invadens
YQQPYRPFYQRQQPTHN

SEQ ID NO: 3047512 - protein, 33 aa, Entamoeba invadens
YQSEYGKFFQQWYFDLLLSHTDKILFSARTIFG

SEQ ID NO: 3047513 - protein, 25 aa, Entamoeba invadens
YREKLELISLLALYFKCETTETYLL

SEQ ID NO: 3047514 - protein, 18 aa, Entamoeba invadens
YRNLFKIFRFTKPRKSVP

SEQ ID NO: 3047515 - protein, 33 aa, Entamoeba invadens
YRTSLLHQLVLPRSYFEKLFNFLTKVREEPMYS

SEQ ID NO: 3047516 - protein, 26 aa, Entamoeba invadens
YSDIEMWYTLLPKSKVPFLSINAIDD

SEQ ID NO: 3047517 - protein, 26 aa, Entamoeba invadens
YSEETKHIQTMLILLGFSCGSSGADG

SEQ ID NO: 3047518 - protein, 18 aa, Entamoeba invadens
YSEGEFEVFAMLALFIAC

SEQ ID NO: 3047519 - protein, 24 aa, Entamoeba invadens
YSFAITMFEVFSWEEAFKKDDERF

SEQ ID NO: 3047520 - protein, 38 aa, Entamoeba invadens
YSFCTYNPRYRIGKWFRLDMSTITDPYIWIKMDKDIGV

SEQ ID NO: 3047521 - protein, 33 aa, Entamoeba invadens
YSFFDRIRQANTFMLLLLDPDWYNSECFQMLRK

SEQ ID NO: 3047522 - protein, 23 aa, Entamoeba invadens
YSFVSAPFRYKIAALHLTPPINS

SEQ ID NO: 3047523 - protein, 26 aa, Entamoeba invadens
YSFVSAPFRYKIAALHLTPPINSNFY

SEQ ID NO: 3047524 - protein, 18 aa, Entamoeba invadens
YSIANKCEYCPLGMYSSS

SEQ ID NO: 3047525 - protein, 33 aa, Entamoeba invadens
YSIMTFNKLFRHFLILTLLLLLSPVQSKAVRKI

SEQ ID NO: 3047526 - protein, 19 aa, Entamoeba invadens
YSLRSVYAYAPYIKNYYIV

SEQ ID NO: 3047527 - protein, 19 aa, Entamoeba invadens
YSMANGWKDDSYGTAWALF

SEQ ID NO: 3047528 - protein, 19 aa, Entamoeba invadens
YSNFYDPDFFVHSQYWLGE

SEQ ID NO: 3047529 - protein, 31 aa, Entamoeba invadens
YSQIGDYPVIMFYQVQFFGKEFFGDEHKKMY

SEQ ID NO: 3047530 - protein, 23 aa, Entamoeba invadens
YTCYTCRTYYYLSGTSCSSCAYS

SEQ ID NO: 3047531 - protein, 18 aa, Entamoeba invadens
YTESIPKIPPPKPQRKSL

SEQ ID NO: 3047532 - protein, 17 aa, Entamoeba invadens
YTGSYLESGECIHCLAG

SEQ ID NO: 3047533 - protein, 24 aa, Entamoeba invadens
YTIALRIQFGDFVYFTAGDLDGED

SEQ ID NO: 3047534 - protein, 23 aa, Entamoeba invadens
YTIDKRPLFNKALYQRQAVDFSR

SEQ ID NO: 3047535 - protein, 17 aa, Entamoeba invadens
YTLQSNVLTFKLTPTWS

SEQ ID NO: 3047536 - protein, 20 aa, Entamoeba invadens
YTRTAILLYKKYDVWKILKE

SEQ ID NO: 3047537 - protein, 24 aa, Entamoeba invadens
YTSDLVTFPEFFARYTKLIQNAHN

SEQ ID NO: 3047538 - protein, 17 aa, Entamoeba invadens
YTTLEYCNVPLLGATGS

SEQ ID NO: 3047539 - protein, 22 aa, Entamoeba invadens
YTTLFDFSLSYTESFDFAVFPT

SEQ ID NO: 3047540 - protein, 17 aa, Entamoeba invadens
YTVIMLPIIHANNTTSG

SEQ ID NO: 3047541 - protein, 17 aa, Entamoeba invadens
YVEINLVKQRKAMTIFL

SEQ ID NO: 3047542 - protein, 25 aa, Entamoeba invadens
YVERWVTVGGAWLGAVELLNEVLNG

SEQ ID NO: 3047543 - protein, 24 aa, Entamoeba invadens
YVKHMTLNFFFTDTLRIAIKETQS

SEQ ID NO: 3047544 - protein, 30 aa, Entamoeba invadens
YVKMQMRPRLLFYPLIKLTDILVFNGIKKT

SEQ ID NO: 3047545 - protein, 17 aa, Entamoeba invadens
YVKRLETMKKAVQSCQK

SEQ ID NO: 3047546 - protein, 20 aa, Entamoeba invadens
YVLFICYITSMITSVRASCP

SEQ ID NO: 3047547 - protein, 27 aa, Entamoeba invadens
YVNVTQWFSIIFKPNRKYILNGLENNE

SEQ ID NO: 3047548 - protein, 24 aa, Entamoeba invadens
YVQGRVPILSLPQEWLWCESWCNK

SEQ ID NO: 3047549 - protein, 30 aa, Entamoeba invadens
YVSAEDYLYKLLFPSTYYTKRYIARINETT

SEQ ID NO: 3047550 - protein, 29 aa, Entamoeba invadens
YVTTYIGFQEHLFHLLTAGFAYEGDNFVQ

SEQ ID NO: 3047551 - protein, 25 aa, Entamoeba invadens
YVYDANLYKFENFKYIGIDVWQVKS

SEQ ID NO: 3047552 - protein, 20 aa, Entamoeba invadens
YWGNIFGDYTWGGASYTPLW

SEQ ID NO: 3047553 - protein, 25 aa, Entamoeba invadens
YYAPNPFCFIHFFSNKTNYNTIGRF

SEQ ID NO: 3047554 - protein, 17 aa, Entamoeba invadens
YYLLGNQCVQAPPNYFV

SEQ ID NO: 3047555 - protein, 18 aa, Entamoeba invadens
YYLYATLHFSNDILSFEC

SEQ ID NO: 3047556 - protein, 24 aa, Entamoeba invadens
YYNQCDGRWKYSMYSDRGNTGNTI

SEQ ID NO: 3047557 - protein, 21 aa, Entamoeba invadens
YYPQQNKLNFLLFVQHWPGER

SEQ ID NO: 3047558 - protein, 25 aa, Entamoeba invadens
YYSQDKFDLCSMFDLKIFVETDDDV

SEQ ID NO: 3047559 - protein, 26 aa, Entamoeba invadens
QSEYGKFFQQWYFDLLLSHTDKVLSA

SEQ ID NO: 3047560 - protein, 27 aa, Entamoeba invadens
PQDNLLNPWYWVYQPVAYKLTSRMGTR

SEQ ID NO: 3047561 - protein, 18 aa, Entamoeba invadens
FHKYLDWINLMTYDLHGS

SEQ ID NO: 3047562 - protein, 23 aa, Entamoeba invadens
LVFFFAFFVFAIDLPMCVDVKTI

SEQ ID NO: 3047563 - protein, 18 aa, Entamoeba invadens
RTTLIFAVYTEIVTTRIG

SEQ ID NO: 3047564 - protein, 17 aa, Entamoeba invadens
AAWFYYGAMTRVMKYFN

SEQ ID NO: 3047565 - protein, 17 aa, Entamoeba invadens
ADIYSFGITFYETLKWG

SEQ ID NO: 3047566 - protein, 21 aa, Entamoeba invadens
AGYLTYFFFGKAMNSNVVTTY

SEQ ID NO: 3047567 - protein, 20 aa, Entamoeba invadens
AHELALRIIKARKYIATLME

SEQ ID NO: 3047568 - protein, 19 aa, Entamoeba invadens
AICYDIRFPVWLRNDKKDP

SEQ ID NO: 3047569 - protein, 24 aa, Entamoeba invadens
AKKDGLLLIFPLPNKPIPSVSESS

SEQ ID NO: 3047570 - protein, 25 aa, Entamoeba invadens
AKSKTLLHLFLQNFPFPFLSLFEDI

SEQ ID NO: 3047571 - protein, 17 aa, Entamoeba invadens
ALIVLAFSNCPLNEIEG

SEQ ID NO: 3047572 - protein, 20 aa, Entamoeba invadens
ALTQLFAKKFKKDLKKNGWM

SEQ ID NO: 3047573 - protein, 17 aa, Entamoeba invadens
APKIRFHRTVKQHYINK

SEQ ID NO: 3047574 - protein, 20 aa, Entamoeba invadens
AQHILYFWQGRDASLMDLGT

SEQ ID NO: 3047575 - protein, 19 aa, Entamoeba invadens
AVHTTSIECYCRIGWEGAC

SEQ ID NO: 3047576 - protein, 24 aa, Entamoeba invadens
CDANGQNCLLCRSGYTFNGTNCLK

SEQ ID NO: 3047577 - protein, 20 aa, Entamoeba invadens
CFFVLLMAAPVHICTDHLHA

SEQ ID NO: 3047578 - protein, 18 aa, Entamoeba invadens
CIEGFFLTADFRCEGCSK

SEQ ID NO: 3047579 - protein, 22 aa, Entamoeba invadens
CLSCYDGYFLNGKMCDTCSAGT

SEQ ID NO: 3047580 - protein, 23 aa, Entamoeba invadens
CTPMKFVFFVVFLLTTNGYHCDC

SEQ ID NO: 3047581 - protein, 25 aa, Entamoeba invadens
DALSILLSFIVRKDERRTKDDEVDF

SEQ ID NO: 3047582 - protein, 17 aa, Entamoeba invadens
DCKTGYWPRNGICAICH

SEQ ID NO: 3047583 - protein, 20 aa, Entamoeba invadens
DDLFLLPSFFNHSHLRAINI

SEQ ID NO: 3047584 - protein, 28 aa, Entamoeba invadens
DDMKSGIPLTLFLQTVTGKTVKRFNMKP

SEQ ID NO: 3047585 - protein, 18 aa, Entamoeba invadens
DDRYKFYKPVNGKCLRYS

SEQ ID NO: 3047586 - protein, 24 aa, Entamoeba invadens
DDTLYPLMVFFKQNFIELPSLASY

SEQ ID NO: 3047587 - protein, 23 aa, Entamoeba invadens
DDVDYVYQYLWCSDSYKGYMKCP

SEQ ID NO: 3047588 - protein, 25 aa, Entamoeba invadens
DFINLRTFPIFPIIDFPLFERVQDL

SEQ ID NO: 3047589 - protein, 18 aa, Entamoeba invadens
DGFLTLFFRPLLTSTGDI

SEQ ID NO: 3047590 - protein, 20 aa, Entamoeba invadens
DHILRMLRKTLMNVPLRARE

SEQ ID NO: 3047591 - protein, 21 aa, Entamoeba invadens
DHLGVPFKNGFWYLMETAGIS

SEQ ID NO: 3047592 - protein, 19 aa, Entamoeba invadens
DICKKFLVLDFPNLVFFDK

SEQ ID NO: 3047593 - protein, 24 aa, Entamoeba invadens
DIDQYFWIMIFRTTARIAYLFIDG

SEQ ID NO: 3047594 - protein, 23 aa, Entamoeba invadens
DIERHWHDVIDHLNLDATVAVGA

SEQ ID NO: 3047595 - protein, 24 aa, Entamoeba invadens
DIERMGYILQLFLLLICSSRGQFP

SEQ ID NO: 3047596 - protein, 17 aa, Entamoeba invadens
DKLQKEYMLKKKVLYLK

SEQ ID NO: 3047597 - protein, 22 aa, Entamoeba invadens
DKLSVMRWYLFKITDGKTYEWI

SEQ ID NO: 3047598 - protein, 18 aa, Entamoeba invadens
DNGQMSAWYLFNALGFYS

SEQ ID NO: 3047599 - protein, 17 aa, Entamoeba invadens
DNKANKLYNLAALLLML

SEQ ID NO: 3047600 - protein, 21 aa, Entamoeba invadens
DRTMFMFFSLLQLEILKNNQA

SEQ ID NO: 3047601 - protein, 23 aa, Entamoeba invadens
DVERHLHDVLDRLGLDLSVTLEK

SEQ ID NO: 3047602 - protein, 17 aa, Entamoeba invadens
DYDFYICADGYHGFLDC

SEQ ID NO: 3047603 - protein, 22 aa, Entamoeba invadens
DYGKFYLKFIAQLLLDHGDRVL

SEQ ID NO: 3047604 - protein, 23 aa, Entamoeba invadens
DYPHNLPVFWFFSDKKHMKKEEK

SEQ ID NO: 3047605 - protein, 17 aa, Entamoeba invadens
ECFIWKEAYPKEDFKFP

SEQ ID NO: 3047606 - protein, 17 aa, Entamoeba invadens
ECKYGMWLNLNGNCLFC

SEQ ID NO: 3047607 - protein, 29 aa, Entamoeba invadens
EERRELFTSLALAFKFLLSQQQCNTINVT

SEQ ID NO: 3047608 - protein, 19 aa, Entamoeba invadens
EGTYWEFFCSVASKYGMRC

SEQ ID NO: 3047609 - protein, 20 aa, Entamoeba invadens
EGYFVGKALNWFFTGADTLL

SEQ ID NO: 3047610 - protein, 17 aa, Entamoeba invadens
EGYGYYLKSIPAALEAA

SEQ ID NO: 3047611 - protein, 24 aa, Entamoeba invadens
EINWFYSFPFLYDKILPSAVCPYT

SEQ ID NO: 3047612 - protein, 26 aa, Entamoeba invadens
ENRSIYLQLLYHFDWINTFDKKLLVL

SEQ ID NO: 3047613 - protein, 18 aa, Entamoeba invadens
EQVCLVLRLQLLNKLRSH

SEQ ID NO: 3047614 - protein, 20 aa, Entamoeba invadens
ETKHIQTMLILLGFSCGSSG

SEQ ID NO: 3047615 - protein, 23 aa, Entamoeba invadens
ETNTFFFLIPRRVIHFEMCGGSV

SEQ ID NO: 3047616 - protein, 17 aa, Entamoeba invadens
ETVILPRDKPKQGFHTS

SEQ ID NO: 3047617 - protein, 21 aa, Entamoeba invadens
EYLYRLAVFLDNAKFVAANPN

SEQ ID NO: 3047618 - protein, 19 aa, Entamoeba invadens
FARTFFNKFKQWPPNLYFK

SEQ ID NO: 3047619 - protein, 24 aa, Entamoeba invadens
FCDKYILRWIAMSTPFIGTGIAND

SEQ ID NO: 3047620 - protein, 17 aa, Entamoeba invadens
FCSTYYKGYLPCPLGTK

SEQ ID NO: 3047621 - protein, 25 aa, Entamoeba invadens
FECAIWEEPFPKIRFKFAWDIVDFV

SEQ ID NO: 3047622 - protein, 19 aa, Entamoeba invadens
FFADYVYMIDAGKIYLWFG

SEQ ID NO: 3047623 - protein, 18 aa, Entamoeba invadens
FFILLSLVVISLVFQISF

SEQ ID NO: 3047624 - protein, 19 aa, Entamoeba invadens
FFLCVTLGIRWCFEYENVV

SEQ ID NO: 3047625 - protein, 18 aa, Entamoeba invadens
FFLFFGINTISFTRKYEV

SEQ ID NO: 3047626 - protein, 18 aa, Entamoeba invadens
FFYVTYALPPIPKEIVFP

SEQ ID NO: 3047627 - protein, 19 aa, Entamoeba invadens
FHPYLDWINLMTYDLHGAW

SEQ ID NO: 3047628 - protein, 18 aa, Entamoeba invadens
FIFFVLSSYPFQRSNIEE

SEQ ID NO: 3047629 - protein, 17 aa, Entamoeba invadens
FIQLCLLLSKIYNLHEV

SEQ ID NO: 3047630 - protein, 18 aa, Entamoeba invadens
FKCAAVHAPILSIKSHYY

SEQ ID NO: 3047631 - protein, 19 aa, Entamoeba invadens
FKERFFLHGLWPNFWANQN

SEQ ID NO: 3047632 - protein, 19 aa, Entamoeba invadens
FLCLFFVSPVSSHDVESFS

SEQ ID NO: 3047633 - protein, 18 aa, Entamoeba invadens
FLFVFQISSHSAEISDYE

SEQ ID NO: 3047634 - protein, 18 aa, Entamoeba invadens
FLMKLVWSQCTPFCTCNK

SEQ ID NO: 3047635 - protein, 17 aa, Entamoeba invadens
FLTFGVSFSQPVEVASA

SEQ ID NO: 3047636 - protein, 18 aa, Entamoeba invadens
FLVLDFPNLVFFDKKNKE

SEQ ID NO: 3047637 - protein, 18 aa, Entamoeba invadens
FNISAYPTITFFPKDFKY

SEQ ID NO: 3047638 - protein, 25 aa, Entamoeba invadens
FNLAVIPLLQLFEVLPNRTPMLWYM

SEQ ID NO: 3047639 - protein, 17 aa, Entamoeba invadens
FPGMKYGMFPNGYPLGY

SEQ ID NO: 3047640 - protein, 21 aa, Entamoeba invadens
FSYLLYLSVLLRTINRYQYVK

SEQ ID NO: 3047641 - protein, 23 aa, Entamoeba invadens
FTQTCFPVFLYLALPSLEGKSRV

SEQ ID NO: 3047642 - protein, 19 aa, Entamoeba invadens
FTWDNPFPKTLYPFAWSIA

SEQ ID NO: 3047643 - protein, 17 aa, Entamoeba invadens
FVLSVWSISFEGWESLH

SEQ ID NO: 3047644 - protein, 25 aa, Entamoeba invadens
FWQSKFLTYILIVKYSIYSNTKSVK

SEQ ID NO: 3047645 - protein, 23 aa, Entamoeba invadens
GDTLRVFIAVHLYYSYLSNTCEQ

SEQ ID NO: 3047646 - protein, 18 aa, Entamoeba invadens
GGVLPRKIAKDIIKESLT

SEQ ID NO: 3047647 - protein, 22 aa, Entamoeba invadens
GKCQYVPFCYLFNKDKTKCIIC

SEQ ID NO: 3047648 - protein, 22 aa, Entamoeba invadens
GKDIKLPLLPPLRPKTPKPTEE

SEQ ID NO: 3047649 - protein, 23 aa, Entamoeba invadens
GKMLGFIQILLDTNMYKLEALMK

SEQ ID NO: 3047650 - protein, 22 aa, Entamoeba invadens
GKTEIRIFIPGHPLYEATIVEI

SEQ ID NO: 3047651 - protein, 23 aa, Entamoeba invadens
GLKEDVILWFKKYDFLNVLSDSN

SEQ ID NO: 3047652 - protein, 25 aa, Entamoeba invadens
GLNTLPFLFDLVFSSTFGGSYKISG

SEQ ID NO: 3047653 - protein, 23 aa, Entamoeba invadens
GLVLGWLLSYFFPCKEILYNLYS

SEQ ID NO: 3047654 - protein, 20 aa, Entamoeba invadens
GMFITLLGFCESCDAGYYLN

SEQ ID NO: 3047655 - protein, 17 aa, Entamoeba invadens
GMLLVVFVTAGTTSLTD

SEQ ID NO: 3047656 - protein, 24 aa, Entamoeba invadens
GNESDFLLDDGWLDKAKSSIHNVV

SEQ ID NO: 3047657 - protein, 18 aa, Entamoeba invadens
GQLLRNTGLFYKFAPEYN

SEQ ID NO: 3047658 - protein, 19 aa, Entamoeba invadens
GSGIRYGIYSSSGVWPSVM

SEQ ID NO: 3047659 - protein, 24 aa, Entamoeba invadens
GSQCVYADPFLAFKYQDYKQQVDG

SEQ ID NO: 3047660 - protein, 23 aa, Entamoeba invadens
GYDQYFLGYASYPYLYYSPLRRW

SEQ ID NO: 3047661 - protein, 25 aa, Entamoeba invadens
GYFEDLYPAYYVLLKDKDETYNNVY

SEQ ID NO: 3047662 - protein, 21 aa, Entamoeba invadens
HDNLYFECSNYFRGLRPCAPG

SEQ ID NO: 3047663 - protein, 17 aa, Entamoeba invadens
HFILFFMSIGYSITWCE

SEQ ID NO: 3047664 - protein, 18 aa, Entamoeba invadens
HIAPIFAYIKSDPLSKTA

SEQ ID NO: 3047665 - protein, 22 aa, Entamoeba invadens
HKYCMKCYPGFRLSIDTMKCIF

SEQ ID NO: 3047666 - protein, 17 aa, Entamoeba invadens
HLLFHPLVSFMMRNEDV

SEQ ID NO: 3047667 - protein, 17 aa, Entamoeba invadens
HLLGDFMLTGLKKAPRG

SEQ ID NO: 3047668 - protein, 25 aa, Entamoeba invadens
HPPKPYFTILDCNKYLLKVPTKDVN

SEQ ID NO: 3047669 - protein, 18 aa, Entamoeba invadens
HVELLGSFIFKLSRNNLQ

SEQ ID NO: 3047670 - protein, 24 aa, Entamoeba invadens
HYNKYFEMLLQNLPKNKTILVHSH

SEQ ID NO: 3047671 - protein, 22 aa, Entamoeba invadens
IALRNRMFVINYYKNLAKQQQQ

SEQ ID NO: 3047672 - protein, 17 aa, Entamoeba invadens
IDDFPYIIFHRGLYKDR

SEQ ID NO: 3047673 - protein, 19 aa, Entamoeba invadens
IEALLYSYQLEKKLSELKQ

SEQ ID NO: 3047674 - protein, 41 aa, Entamoeba invadens
IEMSLNFMFRYNLIFYIMKLLLIVLICTLLLSVDAKKSSRR

SEQ ID NO: 3047675 - protein, 20 aa, Entamoeba invadens
IIILICILLVFVRLFAAGGV

SEQ ID NO: 3047676 - protein, 20 aa, Entamoeba invadens
IIILICILLVFVRLYAAGGV

SEQ ID NO: 3047677 - protein, 20 aa, Entamoeba invadens
IISFLFLLIQVTCSTEINTF

SEQ ID NO: 3047678 - protein, 18 aa, Entamoeba invadens
IKKRGFLDWLRFLDRSYN

SEQ ID NO: 3047679 - protein, 21 aa, Entamoeba invadens
ILFVLIFFTLILSLVSSTHRP

SEQ ID NO: 3047680 - protein, 18 aa, Entamoeba invadens
ILLFFISFVHSNYVYQLG

SEQ ID NO: 3047681 - protein, 18 aa, Entamoeba invadens
ILLSFIITTFGECVGMNE

SEQ ID NO: 3047682 - protein, 24 aa, Entamoeba invadens
ILMCVLFTFLYFTTPQFLIDPRVV

SEQ ID NO: 3047683 - protein, 17 aa, Entamoeba invadens
ILNTFSIASPSSYCNKV

SEQ ID NO: 3047684 - protein, 23 aa, Entamoeba invadens
ILSLLFVFFIFAFVVSTDNSIHK

SEQ ID NO: 3047685 - protein, 29 aa, Entamoeba invadens
IMTFNKLFRHFLILTLLLLLSPVQSKAVR

SEQ ID NO: 3047686 - protein, 18 aa, Entamoeba invadens
INAKFFPPLFYSTFVFYA

SEQ ID NO: 3047687 - protein, 17 aa, Entamoeba invadens
INPLTMMYFLYYGGNIN

SEQ ID NO: 3047688 - protein, 17 aa, Entamoeba invadens
INPLYQRIWYALGITYM

SEQ ID NO: 3047689 - protein, 22 aa, Entamoeba invadens
INRRKRLILAEQLKAAKITRNA

SEQ ID NO: 3047690 - protein, 26 aa, Entamoeba invadens
INYNYLSPYLFWPIIKVLDLVVFQNL

SEQ ID NO: 3047691 - protein, 23 aa, Entamoeba invadens
IPNDLVSIWILLNNTKLLIKTKN

SEQ ID NO: 3047692 - protein, 18 aa, Entamoeba invadens
IPVIQIMDWTWYAKKDPV

SEQ ID NO: 3047693 - protein, 23 aa, Entamoeba invadens
IQGYPTIFLFRNGKRKPFEGERS

SEQ ID NO: 3047694 - protein, 24 aa, Entamoeba invadens
IRQANTFMLLLLDPDWYNSECFQM

SEQ ID NO: 3047695 - protein, 19 aa, Entamoeba invadens
ISALQFVLLFIFVYCYSVN

SEQ ID NO: 3047696 - protein, 24 aa, Entamoeba invadens
ISIIKLHAIVRGLLKLKIIDAQMR

SEQ ID NO: 3047697 - protein, 24 aa, Entamoeba invadens
ISLLFVFFFIVFVVITDGSVYGFS

SEQ ID NO: 3047698 - protein, 23 aa, Entamoeba invadens
ITNPMLLWYFYRVNYRFQSELLD

SEQ ID NO: 3047699 - protein, 23 aa, Entamoeba invadens
IVKRLLLSINFFDNKHKVMQQLA

SEQ ID NO: 3047700 - protein, 18 aa, Entamoeba invadens
IVLLVTALILYYLRPKPY

SEQ ID NO: 3047701 - protein, 18 aa, Entamoeba invadens
IVVVLAKDPKPKKSTQVS

SEQ ID NO: 3047702 - protein, 22 aa, Entamoeba invadens
KCFKCLDGFYLVSGQCALCNNT

SEQ ID NO: 3047703 - protein, 18 aa, Entamoeba invadens
KCLGCIEGFFLTADFRCE

SEQ ID NO: 3047704 - protein, 20 aa, Entamoeba invadens
KDCFFFKWSLILKINRKSKE

SEQ ID NO: 3047705 - protein, 20 aa, Entamoeba invadens
KEILYNLYSQLFKRFTRATG

SEQ ID NO: 3047706 - protein, 18 aa, Entamoeba invadens
KEKIDYVPLPYKLKVRML

SEQ ID NO: 3047707 - protein, 17 aa, Entamoeba invadens
KERFYIHGFWPHYHRNK

SEQ ID NO: 3047708 - protein, 18 aa, Entamoeba invadens
KEYMLKKKVLYLKRCLRA

SEQ ID NO: 3047709 - protein, 21 aa, Entamoeba invadens
KIKDFVPYDWYLESPFLEKEI

SEQ ID NO: 3047710 - protein, 19 aa, Entamoeba invadens
KIRFHRTVKQHYINKARAK

SEQ ID NO: 3047711 - protein, 18 aa, Entamoeba invadens
KIRLIRKRSIRIGLSLQR

SEQ ID NO: 3047712 - protein, 21 aa, Entamoeba invadens
KIVGGFLFLRIFCPAIASPEN

SEQ ID NO: 3047713 - protein, 20 aa, Entamoeba invadens
KKFQILIFVLFWPGEKCQME

SEQ ID NO: 3047714 - protein, 20 aa, Entamoeba invadens
KKYSLYGGLIPTPLSPGFLA

SEQ ID NO: 3047715 - protein, 24 aa, Entamoeba invadens
KLSDDIFMWFGFFSSFLVKTAKFL

SEQ ID NO: 3047716 - protein, 27 aa, Entamoeba invadens
KLYSDYQKKFFPYQKVRPLASGFVNNA

SEQ ID NO: 3047717 - protein, 23 aa, Entamoeba invadens
KMLLFLSLLVLALSRSGIWGGLD

SEQ ID NO: 3047718 - protein, 22 aa, Entamoeba invadens
KNELLYFLMYHTLSKRFSTMST

SEQ ID NO: 3047719 - protein, 23 aa, Entamoeba invadens
KNFNHFFVHWYYQSRLDTYRFAD

SEQ ID NO: 3047720 - protein, 17 aa, Entamoeba invadens
KNMFYKNITFKSLVFSN

SEQ ID NO: 3047721 - protein, 26 aa, Entamoeba invadens
KNNYACQFTFYYVYLDLMMNPSLVIV

SEQ ID NO: 3047722 - protein, 17 aa, Entamoeba invadens
KQKFGKIWKRLIVISLT

SEQ ID NO: 3047723 - protein, 22 aa, Entamoeba invadens
KQRKAMTIFLNYKNFNLKYIDN

SEQ ID NO: 3047724 - protein, 20 aa, Entamoeba invadens
KQVPLISWFIGRQATIHQRV

SEQ ID NO: 3047725 - protein, 19 aa, Entamoeba invadens
KRRIQKIEKFLLYSEWKNL

SEQ ID NO: 3047726 - protein, 17 aa, Entamoeba invadens
KTEIRIFISGHPLYEAT

SEQ ID NO: 3047727 - protein, 21 aa, Entamoeba invadens
KTNFVLLYKLFSNNNFVSFAT

SEQ ID NO: 3047728 - protein, 19 aa, Entamoeba invadens
KVCEICEMYLFYYRKVMSQ

SEQ ID NO: 3047729 - protein, 24 aa, Entamoeba invadens
KVDFFSWQLWRFNPDLKTWKVSLD

SEQ ID NO: 3047730 - protein, 23 aa, Entamoeba invadens
KVFNNFLLFGFKQGVRLYSLEDD

SEQ ID NO: 3047731 - protein, 18 aa, Entamoeba invadens
KVMNYFWPSYFTVSTPPP

SEQ ID NO: 3047732 - protein, 19 aa, Entamoeba invadens
KVPLNYCDDFFFMNELTNN

SEQ ID NO: 3047733 - protein, 23 aa, Entamoeba invadens
LALLAYVGYLFYAKELTFPIDQS

SEQ ID NO: 3047734 - protein, 24 aa, Entamoeba invadens
LAVNIPKYFYFPLGFFSMFSRDIV

SEQ ID NO: 3047735 - protein, 17 aa, Entamoeba invadens
LAYMVIPLDNPIMGKYV

SEQ ID NO: 3047736 - protein, 18 aa, Entamoeba invadens
LCCLVLYSSGHESLFVDE

SEQ ID NO: 3047737 - protein, 17 aa, Entamoeba invadens
LDDFFTFFENEESAYLL

SEQ ID NO: 3047738 - protein, 19 aa, Entamoeba invadens
LECKYGMWLNLNGNCLFCS

SEQ ID NO: 3047739 - protein, 28 aa, Entamoeba invadens
LESYNKMYTLFRLALTEKLFVNHTIVNS

SEQ ID NO: 3047740 - protein, 21 aa, Entamoeba invadens
LFLLFFCVNLELVNGCELGQY

SEQ ID NO: 3047741 - protein, 19 aa, Entamoeba invadens
LFLSLLFYSRSLELCSGRV

SEQ ID NO: 3047742 - protein, 19 aa, Entamoeba invadens
LFLVFTITLSAIVGMDVGT

SEQ ID NO: 3047743 - protein, 19 aa, Entamoeba invadens
LFVKGLYNTALIQSGYPVT

SEQ ID NO: 3047744 - protein, 17 aa, Entamoeba invadens
LGFILSVSSMSADEEAE

SEQ ID NO: 3047745 - protein, 18 aa, Entamoeba invadens
LHIRYNWEYNTVSTVLYI

SEQ ID NO: 3047746 - protein, 26 aa, Entamoeba invadens
LHMERYFKVYPFIVPNIRKEIPINRD

SEQ ID NO: 3047747 - protein, 17 aa, Entamoeba invadens
LIITLSQGKRKSKKRES

SEQ ID NO: 3047748 - protein, 19 aa, Entamoeba invadens
LIIVFTKGTPFLKIDGKEP

SEQ ID NO: 3047749 - protein, 24 aa, Entamoeba invadens
LLANLEVLLIWEYVPFVNQEQNQI

SEQ ID NO: 3047750 - protein, 24 aa, Entamoeba invadens
LLASYHPLYYYKVWSRDAVFSSII

SEQ ID NO: 3047751 - protein, 20 aa, Entamoeba invadens
LLIVVFIVEADLNILTRKDQ

SEQ ID NO: 3047752 - protein, 18 aa, Entamoeba invadens
LLLFVTHTLSLQWCLNGN

SEQ ID NO: 3047753 - protein, 20 aa, Entamoeba invadens
LLLLIFFFSSIQPSLTFEDE

SEQ ID NO: 3047754 - protein, 20 aa, Entamoeba invadens
LLLVFLALGDTLPQTNVTID

SEQ ID NO: 3047755 - protein, 32 aa, Entamoeba invadens
LLTTVLGAASTPFYVLQYYETENRLSLLESEM

SEQ ID NO: 3047756 - protein, 17 aa, Entamoeba invadens
LMALMRRVLADLSYEQQ

SEQ ID NO: 3047757 - protein, 24 aa, Entamoeba invadens
LRIENVLFYFYMASELFFSINNQL

SEQ ID NO: 3047758 - protein, 23 aa, Entamoeba invadens
LSCHYYHYLLNGYCLKCDYLCKT

SEQ ID NO: 3047759 - protein, 17 aa, Entamoeba invadens
LSKMRQMKFALDKKIVL

SEQ ID NO: 3047760 - protein, 17 aa, Entamoeba invadens
LSQLNMNILSLVRTDAL

SEQ ID NO: 3047761 - protein, 23 aa, Entamoeba invadens
LVASFHPLYYYKTWTRDAAYSAA

SEQ ID NO: 3047762 - protein, 21 aa, Entamoeba invadens
LVFGATYLFKYLFNSNEVSQI

SEQ ID NO: 3047763 - protein, 18 aa, Entamoeba invadens
LVRIPVFYRDNGAYVVTA

SEQ ID NO: 3047764 - protein, 28 aa, Entamoeba invadens
LVVNTKSWFIPNDYFRIIYYLNGQYEEC

SEQ ID NO: 3047765 - protein, 29 aa, Entamoeba invadens
LYIDYQICPPYLFMPLLKMIDKVVFQGIK

SEQ ID NO: 3047766 - protein, 17 aa, Entamoeba invadens
LYLVLDFNWFLNRRSML

SEQ ID NO: 3047767 - protein, 18 aa, Entamoeba invadens
LYQFFPQFSFQLQLYSVP

SEQ ID NO: 3047768 - protein, 18 aa, Entamoeba invadens
MKVKYLVLFAKLLKVQKT

SEQ ID NO: 3047769 - protein, 25 aa, Entamoeba invadens
MKVVFTLLLVYIAASRVVLDPVTME

SEQ ID NO: 3047770 - protein, 17 aa, Entamoeba invadens
MLFVNGLFFIPFFIFGV

SEQ ID NO: 3047771 - protein, 18 aa, Entamoeba invadens
MLNKIEALLYSYQLEKKL

SEQ ID NO: 3047772 - protein, 23 aa, Entamoeba invadens
MRPRLLFYPLIKLTDILVFNGIK

SEQ ID NO: 3047773 - protein, 26 aa, Entamoeba invadens
MRQMKFALDKKIVLLRRLRGMVEKKL

SEQ ID NO: 3047774 - protein, 19 aa, Entamoeba invadens
MSAWYLFNALGFYSTMPSS

SEQ ID NO: 3047775 - protein, 17 aa, Entamoeba invadens
MSDMLKAMNTRQAAKSR

SEQ ID NO: 3047776 - protein, 26 aa, Entamoeba invadens
MSQGYLLRTIIPQQLNSYKAVLNYVN

SEQ ID NO: 3047777 - protein, 17 aa, Entamoeba invadens
MVIFSYSNEIGAHCKVV

SEQ ID NO: 3047778 - protein, 20 aa, Entamoeba invadens
MVLLLVLLYFLFTKGQPDKP

SEQ ID NO: 3047779 - protein, 17 aa, Entamoeba invadens
MYINYNICPPYLFMPLL

SEQ ID NO: 3047780 - protein, 25 aa, Entamoeba invadens
NEEYDLQFFFRLLYQIVADKDSDID

SEQ ID NO: 3047781 - protein, 22 aa, Entamoeba invadens
NGLFFIPFFIFGVQAVGKTSIL

SEQ ID NO: 3047782 - protein, 23 aa, Entamoeba invadens
NIKFEISKWFSLLFKMNNVYILE

SEQ ID NO: 3047783 - protein, 18 aa, Entamoeba invadens
NIYILLSLLNFTSSQICS

SEQ ID NO: 3047784 - protein, 20 aa, Entamoeba invadens
NLLNRLHVNHLALLGVDEAR

SEQ ID NO: 3047785 - protein, 27 aa, Entamoeba invadens
NLWKDWHPWLLWVLSPSFYIFWKNPKE

SEQ ID NO: 3047786 - protein, 26 aa, Entamoeba invadens
NMRVDYPNINIWRDITNYFKTNAVTP

SEQ ID NO: 3047787 - protein, 17 aa, Entamoeba invadens
NNRYLLWMFYNKTSDVN

SEQ ID NO: 3047788 - protein, 26 aa, Entamoeba invadens
NNVDKKWWFYDPNGYPYFIIGANSIN

SEQ ID NO: 3047789 - protein, 25 aa, Entamoeba invadens
NQEIDILQILRILSNFFFSSHTQLF

SEQ ID NO: 3047790 - protein, 18 aa, Entamoeba invadens
NSASSLLIGVLFFAIVLT

SEQ ID NO: 3047791 - protein, 24 aa, Entamoeba invadens
NSFIKWWVCFWWGSKNEKKTLEII

SEQ ID NO: 3047792 - protein, 26 aa, Entamoeba invadens
NSIKQKLLMFFFVLFVCAFSQCTKQL

SEQ ID NO: 3047793 - protein, 19 aa, Entamoeba invadens
NTLVRRKAKILSTMKVYLE

SEQ ID NO: 3047794 - protein, 25 aa, Entamoeba invadens
NVNVLTDFLRENGFLMITSSNFIEK

SEQ ID NO: 3047795 - protein, 24 aa, Entamoeba invadens
NVTQWFSIIFKPNRKYILNGLENN

SEQ ID NO: 3047796 - protein, 18 aa, Entamoeba invadens
NYIYSPPLLVFANGTIPK

SEQ ID NO: 3047797 - protein, 18 aa, Entamoeba invadens
PDKPLIIPYYLQVTAISG

SEQ ID NO: 3047798 - protein, 19 aa, Entamoeba invadens
PEDVRNNIIANLKLDRRFS

SEQ ID NO: 3047799 - protein, 17 aa, Entamoeba invadens
PEGLFYIVGFKECVEVC

SEQ ID NO: 3047800 - protein, 18 aa, Entamoeba invadens
PFTLLSWQRVLVAMYFQK

SEQ ID NO: 3047801 - protein, 17 aa, Entamoeba invadens
PHEIQSFGFIFLDKRGL

SEQ ID NO: 3047802 - protein, 25 aa, Entamoeba invadens
PHQIPFPPFKYLLPTTITALENHQK

SEQ ID NO: 3047803 - protein, 17 aa, Entamoeba invadens
PIIIRPSLNAKLVFETL

SEQ ID NO: 3047804 - protein, 17 aa, Entamoeba invadens
PKLELPLLQWVSLLFAA

SEQ ID NO: 3047805 - protein, 21 aa, Entamoeba invadens
PKRYILFLVGLLNYIEVLDDD

SEQ ID NO: 3047806 - protein, 18 aa, Entamoeba invadens
PLFPLRLAWIFSAAFSTS

SEQ ID NO: 3047807 - protein, 18 aa, Entamoeba invadens
PMFGFFLLTLAVSKCDHS

SEQ ID NO: 3047808 - protein, 17 aa, Entamoeba invadens
PRFKWRGLLVDPSRNQI

SEQ ID NO: 3047809 - protein, 18 aa, Entamoeba invadens
PSQSLYCFLLPRKRIFIN

SEQ ID NO: 3047810 - protein, 17 aa, Entamoeba invadens
PTKIVGGFLFLRIFCPA

SEQ ID NO: 3047811 - protein, 17 aa, Entamoeba invadens
PYLFTPLLKVVDGIIFK

SEQ ID NO: 3047812 - protein, 25 aa, Entamoeba invadens
QDGYLNPWYWVYQPVAYTLNSRMGT

SEQ ID NO: 3047813 - protein, 29 aa, Entamoeba invadens
QDHVGVPFKSGFWYLLESSGINFGKIIDR

SEQ ID NO: 3047814 - protein, 25 aa, Entamoeba invadens
QDHVGVPFKSGFWYLLETSGISFGQ

SEQ ID NO: 3047815 - protein, 26 aa, Entamoeba invadens
QDNLLNPWYWVYQPVAYKLTSRMGTR

SEQ ID NO: 3047816 - protein, 20 aa, Entamoeba invadens
QFEYILFNFYAPYGTAWLDN

SEQ ID NO: 3047817 - protein, 19 aa, Entamoeba invadens
QFMISLIPTPWFSGRYIVV

SEQ ID NO: 3047818 - protein, 23 aa, Entamoeba invadens
QHKKNFLLFIIKMSLSENQIDPV

SEQ ID NO: 3047819 - protein, 24 aa, Entamoeba invadens
QIPYPPYTYLLPTTITYLENHRKC

SEQ ID NO: 3047820 - protein, 21 aa, Entamoeba invadens
QIRLFKFTFWVTSVDLEEIEQ

SEQ ID NO: 3047821 - protein, 24 aa, Entamoeba invadens
QLFSNSVFLWVLQTNSFVSVSPYY

SEQ ID NO: 3047822 - protein, 19 aa, Entamoeba invadens
QLLFYRNGVFFSSYDGLKK

SEQ ID NO: 3047823 - protein, 19 aa, Entamoeba invadens
QMLRLYVRRVFVSGDFYKT

SEQ ID NO: 3047824 - protein, 33 aa, Entamoeba invadens
QNLINQMKFQNPTPLPFPTPAPITAPEKVVEVQ

SEQ ID NO: 3047825 - protein, 28 aa, Entamoeba invadens
QQERNFMDTLFYLYRDLKYATLTEDRTR

SEQ ID NO: 3047826 - protein, 19 aa, Entamoeba invadens
QQQYYYYPRPFQQPLYPTQ

SEQ ID NO: 3047827 - protein, 27 aa, Entamoeba invadens
QRLQDEILNIKRLLLRGIKLEAEEDNS

SEQ ID NO: 3047828 - protein, 21 aa, Entamoeba invadens
QSCLWYIFDFLNLVLKYKELN

SEQ ID NO: 3047829 - protein, 26 aa, Entamoeba invadens
QSEYGKFFQQWYFDLLLSHTDKILFS

SEQ ID NO: 3047830 - protein, 24 aa, Entamoeba invadens
QSMKLRVYLMPYKTPLFSSDVVLS

SEQ ID NO: 3047831 - protein, 27 aa, Entamoeba invadens
QVFAEQLFLFDLWILRDLRPSDFMENN

SEQ ID NO: 3047832 - protein, 17 aa, Entamoeba invadens
QVLYLSVLSNTVNYEVT

SEQ ID NO: 3047833 - protein, 23 aa, Entamoeba invadens
QVSPLFYAVPWKMTGNGVLYVGL

SEQ ID NO: 3047834 - protein, 23 aa, Entamoeba invadens
RDITYFFCFKWNALLFKRLFNEK

SEQ ID NO: 3047835 - protein, 22 aa, Entamoeba invadens
RDNKYLFIYFALEKCVYSGNNV

SEQ ID NO: 3047836 - protein, 17 aa, Entamoeba invadens
RETLRKVSLRRLNELRK

SEQ ID NO: 3047837 - protein, 20 aa, Entamoeba invadens
RFWIEFYRTITQIAYLFIDG

SEQ ID NO: 3047838 - protein, 18 aa, Entamoeba invadens
RICLKCKVGYRLDTNKTC

SEQ ID NO: 3047839 - protein, 20 aa, Entamoeba invadens
RICTKCLSGYYLQDGECLQI

SEQ ID NO: 3047840 - protein, 18 aa, Entamoeba invadens
RIRGMKIPYTVWFSKSKT

SEQ ID NO: 3047841 - protein, 19 aa, Entamoeba invadens
RKCLRYYPLKKGKYDFLVL

SEQ ID NO: 3047842 - protein, 25 aa, Entamoeba invadens
RKTYNLRFLLLFKPTTGVLRSNEST

SEQ ID NO: 3047843 - protein, 20 aa, Entamoeba invadens
RLNLYLMFDFKVFLYRHELL

SEQ ID NO: 3047844 - protein, 25 aa, Entamoeba invadens
RLSDYYLFVLFWPIKCYDIVCSLPQ

SEQ ID NO: 3047845 - protein, 17 aa, Entamoeba invadens
RNAHIVLLLFSFPPQKC

SEQ ID NO: 3047846 - protein, 18 aa, Entamoeba invadens
RNFVRPIGILLFLVITFL

SEQ ID NO: 3047847 - protein, 19 aa, Entamoeba invadens
RNVTTLYFNLVFQVLQTDK

SEQ ID NO: 3047848 - protein, 21 aa, Entamoeba invadens
RRKMYEKLKKYYWSLGCKCKC

SEQ ID NO: 3047849 - protein, 26 aa, Entamoeba invadens
RSYNDLMLQLMFFELKRKVLLQLGKE

SEQ ID NO: 3047850 - protein, 24 aa, Entamoeba invadens
RTKRLVLSKMYKILRVLSPLEQSR

SEQ ID NO: 3047851 - protein, 17 aa, Entamoeba invadens
RYGIYSSSGVWPSVMGS

SEQ ID NO: 3047852 - protein, 17 aa, Entamoeba invadens
RYLLWMFYNKTSDVNLE

SEQ ID NO: 3047853 - protein, 34 aa, Entamoeba invadens
SDQAIQKFLACLIKKYWFKDYDVTPSTFDKWATR

SEQ ID NO: 3047854 - protein, 23 aa, Entamoeba invadens
SEYGKFFLNWYHQQLIKHAENIL

SEQ ID NO: 3047855 - protein, 24 aa, Entamoeba invadens
SFFQYNPYRIFRFTAKDLYTFVAT

SEQ ID NO: 3047856 - protein, 23 aa, Entamoeba invadens
SGYSAYWLIPLENPIMGKYVVDT

SEQ ID NO: 3047857 - protein, 17 aa, Entamoeba invadens
SINIKFEISKWFSLLFK

SEQ ID NO: 3047858 - protein, 18 aa, Entamoeba invadens
SKKLTFKKLAKFLDTKTQ

SEQ ID NO: 3047859 - protein, 23 aa, Entamoeba invadens
SKKTAHFFIWNKIITPENVVINV

SEQ ID NO: 3047860 - protein, 20 aa, Entamoeba invadens
SLFTCLILSFFSFAQDSPSN

SEQ ID NO: 3047861 - protein, 17 aa, Entamoeba invadens
SLLFFFTTCLSLKWCGN

SEQ ID NO: 3047862 - protein, 18 aa, Entamoeba invadens
SLLLFLISTSSEICEAGY

SEQ ID NO: 3047863 - protein, 29 aa, Entamoeba invadens
SLNRNSMNRLLLLSFKTPSTLGTNSEIGS

SEQ ID NO: 3047864 - protein, 24 aa, Entamoeba invadens
SLSPYTFVFKNWSTVLPIAVKILE

SEQ ID NO: 3047865 - protein, 17 aa, Entamoeba invadens
SNYFYLCTERFNGYLKC

SEQ ID NO: 3047866 - protein, 20 aa, Entamoeba invadens
SPEFLLWQNVSFLSKNPICN

SEQ ID NO: 3047867 - protein, 22 aa, Entamoeba invadens
SRMQFLLFVLFWPGEKCYDIEC

SEQ ID NO: 3047868 - protein, 21 aa, Entamoeba invadens
SSLVRIPLFYRDDGAYIVTAT

SEQ ID NO: 3047869 - protein, 24 aa, Entamoeba invadens
STKMPFLMWYFYSVYNNVPHMMNN

SEQ ID NO: 3047870 - protein, 23 aa, Entamoeba invadens
STSHLYTITYPKLYKRSFSNTLC

SEQ ID NO: 3047871 - protein, 18 aa, Entamoeba invadens
SVLLPLKSLLKLLTTCKP

SEQ ID NO: 3047872 - protein, 24 aa, Entamoeba invadens
SVNPLPLPIVQPFPIPPSQADPKP

SEQ ID NO: 3047873 - protein, 25 aa, Entamoeba invadens
SVVKQMLINILSFFSAHSFGKNHNH

SEQ ID NO: 3047874 - protein, 17 aa, Entamoeba invadens
SYLAYMVIPLDNPIMGK

SEQ ID NO: 3047875 - protein, 24 aa, Entamoeba invadens
TCYDLYHMWVWTFKDFYANDPTKE

SEQ ID NO: 3047876 - protein, 23 aa, Entamoeba invadens
TDLKYYYIFLRTKDYAFADFHLE

SEQ ID NO: 3047877 - protein, 23 aa, Entamoeba invadens
TEQQLLTSSLFGPVPTSPLSAEH

SEQ ID NO: 3047878 - protein, 22 aa, Entamoeba invadens
TESLKLLVVFICVQKPSHKENS

SEQ ID NO: 3047879 - protein, 17 aa, Entamoeba invadens
TFLLLFLSRSTNYWCEH

SEQ ID NO: 3047880 - protein, 20 aa, Entamoeba invadens
THFYVLKYYETENNLSLLET

SEQ ID NO: 3047881 - protein, 17 aa, Entamoeba invadens
THHLIYLYWKNFLANEY

SEQ ID NO: 3047882 - protein, 28 aa, Entamoeba invadens
TIASNLFKKFWCKVLPVARVALSGFTGV

SEQ ID NO: 3047883 - protein, 24 aa, Entamoeba invadens
TIDFGFYGFTLMDLFTLPKQLRNV

SEQ ID NO: 3047884 - protein, 19 aa, Entamoeba invadens
TIIIFVFIRSSFAALICEK

SEQ ID NO: 3047885 - protein, 19 aa, Entamoeba invadens
TILLLILLVVIYKVVSTPI

SEQ ID NO: 3047886 - protein, 20 aa, Entamoeba invadens
TIVIFLFVVTCSSTYCMAGY

SEQ ID NO: 3047887 - protein, 23 aa, Entamoeba invadens
TKDTKALEIIPFKTFPSVTILSM

SEQ ID NO: 3047888 - protein, 24 aa, Entamoeba invadens
TKQSFFFFKIYKNIEMSLNFMFRY

SEQ ID NO: 3047889 - protein, 17 aa, Entamoeba invadens
TLNPFPRWGSYQKFALY

SEQ ID NO: 3047890 - protein, 24 aa, Entamoeba invadens
TLVETFHFYRLKKVLFDFSNAKFL

SEQ ID NO: 3047891 - protein, 20 aa, Entamoeba invadens
TPRVMEILSKRLGIPMTSVS

SEQ ID NO: 3047892 - protein, 19 aa, Entamoeba invadens
TRHVFVKFFAPWCGHCKKL

SEQ ID NO: 3047893 - protein, 19 aa, Entamoeba invadens
TSIFVTPTSYFRILEDVNG

SEQ ID NO: 3047894 - protein, 22 aa, Entamoeba invadens
TSVFNWCTLLSKVKFINNDETT

SEQ ID NO: 3047895 - protein, 18 aa, Entamoeba invadens
TVLLLSLLLVTVFSQTPS

SEQ ID NO: 3047896 - protein, 17 aa, Entamoeba invadens
TVVTCVILYFLRPKGYP

SEQ ID NO: 3047897 - protein, 17 aa, Entamoeba invadens
VAVCPIPYYSDKKTWTC

SEQ ID NO: 3047898 - protein, 17 aa, Entamoeba invadens
VCPIPYYSDKKTWTCVK

SEQ ID NO: 3047899 - protein, 25 aa, Entamoeba invadens
VDFSRLNLIILPRYFFNCLDNVQTR

SEQ ID NO: 3047900 - protein, 31 aa, Entamoeba invadens
VDLPPLSFFMLYLRSYFPDYAPFLIPPVYPS

SEQ ID NO: 3047901 - protein, 26 aa, Entamoeba invadens
VEQRKAITIFLNYTYFNLKYIDNKYN

SEQ ID NO: 3047902 - protein, 17 aa, Entamoeba invadens
VFLFHKHSLGVPTCEKG

SEQ ID NO: 3047903 - protein, 17 aa, Entamoeba invadens
VFLKQKFGKIWKSLIVA

SEQ ID NO: 3047904 - protein, 17 aa, Entamoeba invadens
VFLVITVGQQVTNTIAN

SEQ ID NO: 3047905 - protein, 17 aa, Entamoeba invadens
VGSGHLALLAKGAQVGK

SEQ ID NO: 3047906 - protein, 17 aa, Entamoeba invadens
VIWFYKHFSPDTIDFGF

SEQ ID NO: 3047907 - protein, 23 aa, Entamoeba invadens
VKEPLFQLPTILVYPHIPTKYIE

SEQ ID NO: 3047908 - protein, 27 aa, Entamoeba invadens
VKRNIFWRRMVFLFLLFASAFSQTQTQ

SEQ ID NO: 3047909 - protein, 17 aa, Entamoeba invadens
VLFFVGLQAVDYDDEYA

SEQ ID NO: 3047910 - protein, 18 aa, Entamoeba invadens
VLLFGVLCLGKNAVIALD

SEQ ID NO: 3047911 - protein, 21 aa, Entamoeba invadens
VLLYFLLLIHSVISQLYFPDK

SEQ ID NO: 3047912 - protein, 18 aa, Entamoeba invadens
VMQPFPRWGNFQSFGEFL

SEQ ID NO: 3047913 - protein, 18 aa, Entamoeba invadens
VNNSQSIFTILLFAVFLI

SEQ ID NO: 3047914 - protein, 25 aa, Entamoeba invadens
VNVTQWFSIIFKPNRKYILNGLETH

SEQ ID NO: 3047915 - protein, 28 aa, Entamoeba invadens
VRTALWQFFPYWMQIVCGPVLRVIFKSP

SEQ ID NO: 3047916 - protein, 25 aa, Entamoeba invadens
VSAEDYLYKLLFPSTYYTKRYIARI

SEQ ID NO: 3047917 - protein, 17 aa, Entamoeba invadens
VSASYKFNDKFKMNANA

SEQ ID NO: 3047918 - protein, 24 aa, Entamoeba invadens
VSQTAAALPMWYSHYDHTASFDDY

SEQ ID NO: 3047919 - protein, 22 aa, Entamoeba invadens
VSTVIAPFTGPMAPAFAAVGAT

SEQ ID NO: 3047920 - protein, 17 aa, Entamoeba invadens
VYSLWFFYNSTLTQDQI

SEQ ID NO: 3047921 - protein, 17 aa, Entamoeba invadens
WFYYGAMTRVMKYFNIQ

SEQ ID NO: 3047922 - protein, 17 aa, Entamoeba invadens
WIDPYLQEKFKFPWKIA

SEQ ID NO: 3047923 - protein, 23 aa, Entamoeba invadens
WLLWGGLILLNLFILVVTIVSAC

SEQ ID NO: 3047924 - protein, 20 aa, Entamoeba invadens
WPIRIWCQFNQQIRTDNLSE

SEQ ID NO: 3047925 - protein, 18 aa, Entamoeba invadens
WTNAYPKEYFKFPWTIAE

SEQ ID NO: 3047926 - protein, 17 aa, Entamoeba invadens
YCFLLPRKRIFINKDFE

SEQ ID NO: 3047927 - protein, 19 aa, Entamoeba invadens
YCRIYVNYIYSPPLLVFAN

SEQ ID NO: 3047928 - protein, 17 aa, Entamoeba invadens
YFLIFLCVNSTTRCQVT

SEQ ID NO: 3047929 - protein, 17 aa, Entamoeba invadens
YFLKWHILQPDYAINLV

SEQ ID NO: 3047930 - protein, 18 aa, Entamoeba invadens
YFRIIYYLNGQYEECGDV

SEQ ID NO: 3047931 - protein, 18 aa, Entamoeba invadens
YIHGFWPHYHRNKNLYCC

SEQ ID NO: 3047932 - protein, 17 aa, Entamoeba invadens
YILVLTYVFGDTVCYPN

SEQ ID NO: 3047933 - protein, 21 aa, Entamoeba invadens
YINCTFLKYVEIYFVEQRKAI

SEQ ID NO: 3047934 - protein, 19 aa, Entamoeba invadens
YITPTRFLYVTPNPFYVAV

SEQ ID NO: 3047935 - protein, 17 aa, Entamoeba invadens
YIVHFYGAVFIPNKICM

SEQ ID NO: 3047936 - protein, 31 aa, Entamoeba invadens
YKNTFYTLLFVPKFYYLCMYKTLIEISKDKK

SEQ ID NO: 3047937 - protein, 18 aa, Entamoeba invadens
YLPFLLISLPNINTLYLN

SEQ ID NO: 3047938 - protein, 17 aa, Entamoeba invadens
YMVIPLDNPIMGKYVVD

SEQ ID NO: 3047939 - protein, 23 aa, Entamoeba invadens
YNDECFLISGWYKYFIVKENGKS

SEQ ID NO: 3047940 - protein, 23 aa, Entamoeba invadens
YNICPPYLFMPLLHVIDTVVFKG

SEQ ID NO: 3047941 - protein, 19 aa, Entamoeba invadens
YNLCPPYLFTPLLKVVDGI

SEQ ID NO: 3047942 - protein, 19 aa, Entamoeba invadens
YQEILWNDIILKNGTKVFL

SEQ ID NO: 3047943 - protein, 17 aa, Entamoeba invadens
YRMLPYWYSLLYYHRVN

SEQ ID NO: 3047944 - protein, 17 aa, Entamoeba invadens
YVKIDKLIFIKGNVYFE

SEQ ID NO: 3047945 - protein, 18 aa, Entamoeba invadens
YVPLPYKLKVRMLYDTSR

SEQ ID NO: 3047946 - protein, 20 aa, Entamoeba invadens
YVTTIFYHGFFEPIVQSGVS

SEQ ID NO: 3047947 - protein, 24 aa, Entamoeba invadens
YYPKILMAIINLLLRIVFKSPLEG

SEQ ID NO: 3047948 - protein, 17 aa, Entamoeba invadens
YYYPRPFQQPLYPTQHF

SEQ ID NO: 3047949 - protein, 12 aa, Giardia lamblia
KKTNPSDPTGTC

SEQ ID NO: 3047950 - protein, 19 aa, Giardia lamblia
AGTADKCTKCDANGAAPYL

SEQ ID NO: 3047951 - protein, 22 aa, Giardia lamblia
CQGSAGYYTDDSVSDAKECKKC

SEQ ID NO: 3047952 - protein, 5 aa, Giardia lamblia
DAPQS

SEQ ID NO: 3047953 - protein, 5 aa, Giardia lamblia
AVPIS

SEQ ID NO: 3047954 - protein, 5 aa, Giardia lamblia
ECTSP

SEQ ID NO: 3047955 - protein, 8 aa, Giardia lamblia
QRGTDGTV

SEQ ID NO: 3047956 - protein, 7 aa, Giardia lamblia
RGGLGGG

SEQ ID NO: 3047957 - protein, 7 aa, Giardia lamblia
SDTGGMD

SEQ ID NO: 3047958 - protein, 8 aa, Giardia lamblia
TDKGGGSV

SEQ ID NO: 3047959 - protein, 6 aa, Giardia lamblia
ACQDSD

SEQ ID NO: 3047960 - protein, 7 aa, Giardia lamblia
ASKKCRK

SEQ ID NO: 3047961 - protein, 4 aa, Giardia lamblia
AYGD

SEQ ID NO: 3047962 - protein, 7 aa, Giardia lamblia
CDAPRAG

SEQ ID NO: 3047963 - protein, 9 aa, Giardia lamblia
PGLAGLSAD

SEQ ID NO: 3047964 - protein, 9 aa, Giardia lamblia
PQGIDAPQS

SEQ ID NO: 3047965 - protein, 8 aa, Giardia lamblia
PYDQTEKT

SEQ ID NO: 3047966 - protein, 5 aa, Giardia lamblia
AERDP

SEQ ID NO: 3047967 - protein, 6 aa, Giardia lamblia
AKDQGL

SEQ ID NO: 3047968 - protein, 11 aa, Giardia lamblia
AYDTPGDRLEA

SEQ ID NO: 3047969 - protein, 11 aa, Giardia lamblia
CGGSMYPDEDL

SEQ ID NO: 3047970 - protein, 9 aa, Giardia lamblia
CNDNGEDTG

SEQ ID NO: 3047971 - protein, 6 aa, Giardia lamblia
DAHGGT

SEQ ID NO: 3047972 - protein, 5 aa, Giardia lamblia
DRHPR

SEQ ID NO: 3047973 - protein, 7 aa, Giardia lamblia
EKTGDTY

SEQ ID NO: 3047974 - protein, 5 aa, Giardia lamblia
GEVSG

SEQ ID NO: 3047975 - protein, 10 aa, Giardia lamblia
GGRPKRGAKY

SEQ ID NO: 3047976 - protein, 6 aa, Giardia lamblia
GPDRDG

SEQ ID NO: 3047977 - protein, 6 aa, Giardia lamblia
KLAKES

SEQ ID NO: 3047978 - protein, 6 aa, Giardia lamblia
PDEAQK

SEQ ID NO: 3047979 - protein, 7 aa, Giardia lamblia
QTAPQGL

SEQ ID NO: 3047980 - protein, 5 aa, Giardia lamblia
RHSST

SEQ ID NO: 3047981 - protein, 16 aa, Giardia lamblia
RTCAEGCGARASSNQG

SEQ ID NO: 3047982 - protein, 7 aa, Giardia lamblia
SHGDRRD

SEQ ID NO: 3047983 - protein, 12 aa, Giardia lamblia
SSRYRTDKKTGQ

SEQ ID NO: 3047984 - protein, 6 aa, Giardia lamblia
SYSAST

SEQ ID NO: 3047985 - protein, 4 aa, Giardia lamblia
TCAS

SEQ ID NO: 3047986 - protein, 9 aa, Giardia lamblia
TECTGSSKC

SEQ ID NO: 3047987 - protein, 15 aa, Giardia lamblia
TESGVDTSIDKDYES

SEQ ID NO: 3047988 - protein, 11 aa, Giardia lamblia
TTSGQTPADRA

SEQ ID NO: 3047989 - protein, 12 aa, Giardia lamblia
YGLSGGSCSPCT

SEQ ID NO: 3047990 - protein, 6 aa, Giardia lamblia
AAKWDP

SEQ ID NO: 3047991 - protein, 10 aa, Giardia lamblia
ACSKDSATTC

SEQ ID NO: 3047992 - protein, 8 aa, Giardia lamblia
ADAEGPVN

SEQ ID NO: 3047993 - protein, 12 aa, Giardia lamblia
AEADPKEHRCRK

SEQ ID NO: 3047994 - protein, 8 aa, Giardia lamblia
ANGAGKST

SEQ ID NO: 3047995 - protein, 6 aa, Giardia lamblia
AQAGSG

SEQ ID NO: 3047996 - protein, 5 aa, Giardia lamblia
ARART

SEQ ID NO: 3047997 - protein, 5 aa, Giardia lamblia
ARVPV

SEQ ID NO: 3047998 - protein, 5 aa, Giardia lamblia
ASTYP

SEQ ID NO: 3047999 - protein, 10 aa, Giardia lamblia
ATPSPTSCTR

SEQ ID NO: 3048000 - protein, 10 aa, Giardia lamblia
ATSGGGKSTA

SEQ ID NO: 3048001 - protein, 6 aa, Giardia lamblia
ATTCSA

SEQ ID NO: 3048002 - protein, 16 aa, Giardia lamblia
CGNTGTYTTYGDPSNP

SEQ ID NO: 3048003 - protein, 7 aa, Giardia lamblia
CGTGPAC

SEQ ID NO: 3048004 - protein, 6 aa, Giardia lamblia
CKANDD

SEQ ID NO: 3048005 - protein, 4 aa, Giardia lamblia
CTST

SEQ ID NO: 3048006 - protein, 7 aa, Giardia lamblia
DDPNTCT

SEQ ID NO: 3048007 - protein, 8 aa, Giardia lamblia
DGYYASGN

SEQ ID NO: 3048008 - protein, 13 aa, Giardia lamblia
DPLHPAPELATTE

SEQ ID NO: 3048009 - protein, 5 aa, Giardia lamblia
DPNRC

SEQ ID NO: 3048010 - protein, 6 aa, Giardia lamblia
DPQPFP

SEQ ID NO: 3048011 - protein, 6 aa, Giardia lamblia
DPRRAS

SEQ ID NO: 3048012 - protein, 4 aa, Giardia lamblia
DPTK

SEQ ID NO: 3048013 - protein, 4 aa, Giardia lamblia
DTIE

SEQ ID NO: 3048014 - protein, 6 aa, Giardia lamblia
EGPVAG

SEQ ID NO: 3048015 - protein, 8 aa, Giardia lamblia
ENYQTVAD

SEQ ID NO: 3048016 - protein, 7 aa, Giardia lamblia
EPGSQGL

SEQ ID NO: 3048017 - protein, 10 aa, Giardia lamblia
ETNSSTICNG

SEQ ID NO: 3048018 - protein, 8 aa, Giardia lamblia
FEPSSDGA

SEQ ID NO: 3048019 - protein, 5 aa, Giardia lamblia
FSVPA

SEQ ID NO: 3048020 - protein, 4 aa, Giardia lamblia
GCTS

SEQ ID NO: 3048021 - protein, 13 aa, Giardia lamblia
GDRQTGSLGTNET

SEQ ID NO: 3048022 - protein, 11 aa, Giardia lamblia
GEDDAQPEPLR

SEQ ID NO: 3048023 - protein, 13 aa, Giardia lamblia
GGSSVKRRLGPGA

SEQ ID NO: 3048024 - protein, 9 aa, Giardia lamblia
GHGTCKTDD

SEQ ID NO: 3048025 - protein, 7 aa, Giardia lamblia
GQHEAGS

SEQ ID NO: 3048026 - protein, 6 aa, Giardia lamblia
GRSPGT

SEQ ID NO: 3048027 - protein, 8 aa, Giardia lamblia
GRTQADAP

SEQ ID NO: 3048028 - protein, 8 aa, Giardia lamblia
GTCAEPKE

SEQ ID NO: 3048029 - protein, 6 aa, Giardia lamblia
GTEFTY

SEQ ID NO: 3048030 - protein, 7 aa, Giardia lamblia
GYERGQL

SEQ ID NO: 3048031 - protein, 9 aa, Giardia lamblia
HKQASALSG

SEQ ID NO: 3048032 - protein, 6 aa, Giardia lamblia
HQATLG

SEQ ID NO: 3048033 - protein, 11 aa, Giardia lamblia
IRTTPSSGTCA

SEQ ID NO: 3048034 - protein, 9 aa, Giardia lamblia
ITKDGSPAT

SEQ ID NO: 3048035 - protein, 7 aa, Giardia lamblia
KCDSTGC

SEQ ID NO: 3048036 - protein, 14 aa, Giardia lamblia
KDGTPTGCQQCSPG

SEQ ID NO: 3048037 - protein, 15 aa, Giardia lamblia
KDRTPDGSDSEESGL

SEQ ID NO: 3048038 - protein, 9 aa, Giardia lamblia
KDVPDGVSC

SEQ ID NO: 3048039 - protein, 10 aa, Giardia lamblia
KHIPSEDGSR

SEQ ID NO: 3048040 - protein, 20 aa, Giardia lamblia
KKKGSSSNSGAAGSDEYEYD

SEQ ID NO: 3048041 - protein, 4 aa, Giardia lamblia
KREG

SEQ ID NO: 3048042 - protein, 6 aa, Giardia lamblia
KVAGPA

SEQ ID NO: 3048043 - protein, 9 aa, Giardia lamblia
LAPSGGQCA

SEQ ID NO: 3048044 - protein, 10 aa, Giardia lamblia
LDEDRKPSVT

SEQ ID NO: 3048045 - protein, 7 aa, Giardia lamblia
LEGPSNK

SEQ ID NO: 3048046 - protein, 9 aa, Giardia lamblia
LGDSNRDRY

SEQ ID NO: 3048047 - protein, 27 aa, Giardia lamblia
LGPDLKGDTQANSQSANADDKSKKQDS

SEQ ID NO: 3048048 - protein, 13 aa, Giardia lamblia
LQSPSSGLGEGTL

SEQ ID NO: 3048049 - protein, 6 aa, Giardia lamblia
LRAEGA

SEQ ID NO: 3048050 - protein, 6 aa, Giardia lamblia
LSTGTE

SEQ ID NO: 3048051 - protein, 7 aa, Giardia lamblia
NATAGGP

SEQ ID NO: 3048052 - protein, 6 aa, Giardia lamblia
NEPQQI

SEQ ID NO: 3048053 - protein, 5 aa, Giardia lamblia
NGGTE

SEQ ID NO: 3048054 - protein, 5 aa, Giardia lamblia
NIRNP

SEQ ID NO: 3048055 - protein, 5 aa, Giardia lamblia
NLGPS

SEQ ID NO: 3048056 - protein, 11 aa, Giardia lamblia
PAADPAEAHRR

SEQ ID NO: 3048057 - protein, 7 aa, Giardia lamblia
PAGPRGL

SEQ ID NO: 3048058 - protein, 4 aa, Giardia lamblia
PCPD

SEQ ID NO: 3048059 - protein, 4 aa, Giardia lamblia
PCTP

SEQ ID NO: 3048060 - protein, 5 aa, Giardia lamblia
PGYRH

SEQ ID NO: 3048061 - protein, 8 aa, Giardia lamblia
QKDEVPVD

SEQ ID NO: 3048062 - protein, 10 aa, Giardia lamblia
QKKDKSGYEC

SEQ ID NO: 3048063 - protein, 9 aa, Giardia lamblia
RCVSENGVK

SEQ ID NO: 3048064 - protein, 6 aa, Giardia lamblia
RESRAA

SEQ ID NO: 3048065 - protein, 7 aa, Giardia lamblia
RPNIKST

SEQ ID NO: 3048066 - protein, 5 aa, Giardia lamblia
RPTAG

SEQ ID NO: 3048067 - protein, 6 aa, Giardia lamblia
RQPTAS

SEQ ID NO: 3048068 - protein, 10 aa, Giardia lamblia
SAGEYPGTGI

SEQ ID NO: 3048069 - protein, 6 aa, Giardia lamblia
SGRKAL

SEQ ID NO: 3048070 - protein, 11 aa, Giardia lamblia
SGSDSSTGACR

SEQ ID NO: 3048071 - protein, 4 aa, Giardia lamblia
SGYY

SEQ ID NO: 3048072 - protein, 7 aa, Giardia lamblia
SHDANEI

SEQ ID NO: 3048073 - protein, 6 aa, Giardia lamblia
SMGPAD

SEQ ID NO: 3048074 - protein, 19 aa, Giardia lamblia
SNNQESCKNGGTCVKSDGE

SEQ ID NO: 3048075 - protein, 11 aa, Giardia lamblia
SNREASDIPQA

SEQ ID NO: 3048076 - protein, 5 aa, Giardia lamblia
SPATV

SEQ ID NO: 3048077 - protein, 7 aa, Giardia lamblia
SSESADC

SEQ ID NO: 3048078 - protein, 8 aa, Giardia lamblia
SSGTCTPC

SEQ ID NO: 3048079 - protein, 9 aa, Giardia lamblia
TENSDTLKG

SEQ ID NO: 3048080 - protein, 8 aa, Giardia lamblia
TSESRDAI

SEQ ID NO: 3048081 - protein, 7 aa, Giardia lamblia
TTTPGSG

SEQ ID NO: 3048082 - protein, 8 aa, Giardia lamblia
TVGDGGAK

SEQ ID NO: 3048083 - protein, 10 aa, Giardia lamblia
VNGGSGTPKK

SEQ ID NO: 3048084 - protein, 6 aa, Giardia lamblia
VSSDNK

SEQ ID NO: 3048085 - protein, 6 aa, Giardia lamblia
VTSGAG

SEQ ID NO: 3048086 - protein, 17 aa, Giardia lamblia
AAAGPSSAPLDADSPKM

SEQ ID NO: 3048087 - protein, 18 aa, Giardia lamblia
AAKKMGKTDSQAYKANVR

SEQ ID NO: 3048088 - protein, 4 aa, Giardia lamblia
AAKT

SEQ ID NO: 3048089 - protein, 14 aa, Giardia lamblia
AAPPASPGRGCNSS

SEQ ID NO: 3048090 - protein, 9 aa, Giardia lamblia
AAQATSPLN

SEQ ID NO: 3048091 - protein, 4 aa, Giardia lamblia
AARD

SEQ ID NO: 3048092 - protein, 12 aa, Giardia lamblia
ACSGDAASCTSC

SEQ ID NO: 3048093 - protein, 7 aa, Giardia lamblia
ACTPKDN

SEQ ID NO: 3048094 - protein, 7 aa, Giardia lamblia
ADGQSSK

SEQ ID NO: 3048095 - protein, 12 aa, Giardia lamblia
ADNCGTEENTSV

SEQ ID NO: 3048096 - protein, 4 aa, Giardia lamblia
ADSS

SEQ ID NO: 3048097 - protein, 9 aa, Giardia lamblia
AEGSESTEV

SEQ ID NO: 3048098 - protein, 8 aa, Giardia lamblia
AEKDPTKP

SEQ ID NO: 3048099 - protein, 8 aa, Giardia lamblia
AERAPGNT

SEQ ID NO: 3048100 - protein, 9 aa, Giardia lamblia
AGAGGGWTG

SEQ ID NO: 3048101 - protein, 6 aa, Giardia lamblia
AGDKES

SEQ ID NO: 3048102 - protein, 7 aa, Giardia lamblia
AGHDDAE

SEQ ID NO: 3048103 - protein, 4 aa, Giardia lamblia
AGHE

SEQ ID NO: 3048104 - protein, 7 aa, Giardia lamblia
AHYPGST

SEQ ID NO: 3048105 - protein, 5 aa, Giardia lamblia
AISPG

SEQ ID NO: 3048106 - protein, 6 aa, Giardia lamblia
AKGPHN

SEQ ID NO: 3048107 - protein, 5 aa, Giardia lamblia
AKGYS

SEQ ID NO: 3048108 - protein, 6 aa, Giardia lamblia
AKPSDN

SEQ ID NO: 3048109 - protein, 9 aa, Giardia lamblia
AKQGTFSRD

SEQ ID NO: 3048110 - protein, 4 aa, Giardia lamblia
AKTD

SEQ ID NO: 3048111 - protein, 6 aa, Giardia lamblia
ANPGVD

SEQ ID NO: 3048112 - protein, 11 aa, Giardia lamblia
ANPNSADGQPK

SEQ ID NO: 3048113 - protein, 4 aa, Giardia lamblia
ANSA

SEQ ID NO: 3048114 - protein, 11 aa, Giardia lamblia
APGPGRCTRCP

SEQ ID NO: 3048115 - protein, 4 aa, Giardia lamblia
APLD

SEQ ID NO: 3048116 - protein, 9 aa, Giardia lamblia
APPSNGQGS

SEQ ID NO: 3048117 - protein, 8 aa, Giardia lamblia
APTAESSA

SEQ ID NO: 3048118 - protein, 7 aa, Giardia lamblia
ARDPDYD

SEQ ID NO: 3048119 - protein, 6 aa, Giardia lamblia
AREFQQ

SEQ ID NO: 3048120 - protein, 4 aa, Giardia lamblia
ARGS

SEQ ID NO: 3048121 - protein, 11 aa, Giardia lamblia
ASDTDCPTGSV

SEQ ID NO: 3048122 - protein, 6 aa, Giardia lamblia
ASENHA

SEQ ID NO: 3048123 - protein, 7 aa, Giardia lamblia
ASGETVS

SEQ ID NO: 3048124 - protein, 17 aa, Giardia lamblia
ASGKADTPATCTECQEG

SEQ ID NO: 3048125 - protein, 10 aa, Giardia lamblia
ASKVETSDSV

SEQ ID NO: 3048126 - protein, 6 aa, Giardia lamblia
ASPFNN

SEQ ID NO: 3048127 - protein, 6 aa, Giardia lamblia
ASPRAR

SEQ ID NO: 3048128 - protein, 8 aa, Giardia lamblia
ASSPTGGL

SEQ ID NO: 3048129 - protein, 4 aa, Giardia lamblia
ASTS

SEQ ID NO: 3048130 - protein, 7 aa, Giardia lamblia
ASYAPRN

SEQ ID NO: 3048131 - protein, 5 aa, Giardia lamblia
ATGVA

SEQ ID NO: 3048132 - protein, 20 aa, Giardia lamblia
ATPEKAAPDDGTKCQDTNIG

SEQ ID NO: 3048133 - protein, 4 aa, Giardia lamblia
ATPQ

SEQ ID NO: 3048134 - protein, 7 aa, Giardia lamblia
ATQSSKS

SEQ ID NO: 3048135 - protein, 9 aa, Giardia lamblia
CAEGTGGYE

SEQ ID NO: 3048136 - protein, 4 aa, Giardia lamblia
CASS

SEQ ID NO: 3048137 - protein, 9 aa, Giardia lamblia
CASSDSSSV

SEQ ID NO: 3048138 - protein, 4 aa, Giardia lamblia
CDES

SEQ ID NO: 3048139 - protein, 18 aa, Giardia lamblia
CDGGGTCNENTKKCDCNS

SEQ ID NO: 3048140 - protein, 10 aa, Giardia lamblia
CEACPDGRIG

SEQ ID NO: 3048141 - protein, 6 aa, Giardia lamblia
CENNNG

SEQ ID NO: 3048142 - protein, 15 aa, Giardia lamblia
CGGNGNCPLSTDSTC

SEQ ID NO: 3048143 - protein, 12 aa, Giardia lamblia
CGGPGAGYIDST

SEQ ID NO: 3048144 - protein, 5 aa, Giardia lamblia
CGGPT

SEQ ID NO: 3048145 - protein, 12 aa, Giardia lamblia
CKECSAADGGVT

SEQ ID NO: 3048146 - protein, 14 aa, Giardia lamblia
CKTCQDSAAKCTGC

SEQ ID NO: 3048147 - protein, 4 aa, Giardia lamblia
CPAS

SEQ ID NO: 3048148 - protein, 4 aa, Giardia lamblia
CRNA

SEQ ID NO: 3048149 - protein, 8 aa, Giardia lamblia
CSDPRGNG

SEQ ID NO: 3048150 - protein, 8 aa, Giardia lamblia
CSQNSDEI

SEQ ID NO: 3048151 - protein, 9 aa, Giardia lamblia
CSTNAETSC

SEQ ID NO: 3048152 - protein, 19 aa, Giardia lamblia
CTAELDGNTCTSSKCTACG

SEQ ID NO: 3048153 - protein, 9 aa, Giardia lamblia
CTDEGNTGT

SEQ ID NO: 3048154 - protein, 5 aa, Giardia lamblia
CTGHD

SEQ ID NO: 3048155 - protein, 4 aa, Giardia lamblia
CTKD

SEQ ID NO: 3048156 - protein, 9 aa, Giardia lamblia
CVEEEGDKG

SEQ ID NO: 3048157 - protein, 9 aa, Giardia lamblia
DAKKGRCTA

SEQ ID NO: 3048158 - protein, 7 aa, Giardia lamblia
DASGELR

SEQ ID NO: 3048159 - protein, 7 aa, Giardia lamblia
DDCTVKG

SEQ ID NO: 3048160 - protein, 8 aa, Giardia lamblia
DDGNEAKG

SEQ ID NO: 3048161 - protein, 11 aa, Giardia lamblia
DDQKCAKGQVE

SEQ ID NO: 3048162 - protein, 22 aa, Giardia lamblia
DEDDSTSTCSKCEDGYMSSGNG

SEQ ID NO: 3048163 - protein, 25 aa, Giardia lamblia
DGCKDDADCSSSQTCNISTSSSTGT

SEQ ID NO: 3048164 - protein, 5 aa, Giardia lamblia
DGDRC

SEQ ID NO: 3048165 - protein, 14 aa, Giardia lamblia
DGGGTCSEDTKKCN

SEQ ID NO: 3048166 - protein, 13 aa, Giardia lamblia
DGHSAQDGACTSC

SEQ ID NO: 3048167 - protein, 6 aa, Giardia lamblia
DGMGAD

SEQ ID NO: 3048168 - protein, 5 aa, Giardia lamblia
DGPLN

SEQ ID NO: 3048169 - protein, 4 aa, Giardia lamblia
DGSA

SEQ ID NO: 3048170 - protein, 6 aa, Giardia lamblia
DGTGGC

SEQ ID NO: 3048171 - protein, 15 aa, Giardia lamblia
DGTTGDCTNDKGTYS

SEQ ID NO: 3048172 - protein, 4 aa, Giardia lamblia
DGYT

SEQ ID NO: 3048173 - protein, 5 aa, Giardia lamblia
DGYTR

SEQ ID NO: 3048174 - protein, 16 aa, Giardia lamblia
DKQLERQYSHSLYRSE

SEQ ID NO: 3048175 - protein, 4 aa, Giardia lamblia
DKSE

SEQ ID NO: 3048176 - protein, 8 aa, Giardia lamblia
DKTGTLTR

SEQ ID NO: 3048177 - protein, 13 aa, Giardia lamblia
DNTTDPTKGCSTC

SEQ ID NO: 3048178 - protein, 6 aa, Giardia lamblia
DNYQST

SEQ ID NO: 3048179 - protein, 4 aa, Giardia lamblia
DPDA

SEQ ID NO: 3048180 - protein, 4 aa, Giardia lamblia
DPLS

SEQ ID NO: 3048181 - protein, 11 aa, Giardia lamblia
DQYRTDKKTGQ

SEQ ID NO: 3048182 - protein, 6 aa, Giardia lamblia
DRARAG

SEQ ID NO: 3048183 - protein, 7 aa, Giardia lamblia
DRQRTLP

SEQ ID NO: 3048184 - protein, 9 aa, Giardia lamblia
DRSKPMYRA

SEQ ID NO: 3048185 - protein, 7 aa, Giardia lamblia
DSDGNGY

SEQ ID NO: 3048186 - protein, 10 aa, Giardia lamblia
DSLSGGPEGY

SEQ ID NO: 3048187 - protein, 8 aa, Giardia lamblia
DSPETLAA

SEQ ID NO: 3048188 - protein, 7 aa, Giardia lamblia
DSQPAVQ

SEQ ID NO: 3048189 - protein, 6 aa, Giardia lamblia
DSSPGS

SEQ ID NO: 3048190 - protein, 4 aa, Giardia lamblia
DSYV

SEQ ID NO: 3048191 - protein, 4 aa, Giardia lamblia
DTAK

SEQ ID NO: 3048192 - protein, 7 aa, Giardia lamblia
DTDKSYN

SEQ ID NO: 3048193 - protein, 4 aa, Giardia lamblia
DTEV

SEQ ID NO: 3048194 - protein, 9 aa, Giardia lamblia
DTSGSTWKG

SEQ ID NO: 3048195 - protein, 9 aa, Giardia lamblia
DVTSQNGFT

SEQ ID NO: 3048196 - protein, 4 aa, Giardia lamblia
EADS

SEQ ID NO: 3048197 - protein, 6 aa, Giardia lamblia
EAPDTM

SEQ ID NO: 3048198 - protein, 17 aa, Giardia lamblia
EASNGACSTCNTNETSN

SEQ ID NO: 3048199 - protein, 8 aa, Giardia lamblia
ECDQQNAQ

SEQ ID NO: 3048200 - protein, 5 aa, Giardia lamblia
ECKSG

SEQ ID NO: 3048201 - protein, 7 aa, Giardia lamblia
ECSGDKV

SEQ ID NO: 3048202 - protein, 5 aa, Giardia lamblia
EDDGA

SEQ ID NO: 3048203 - protein, 8 aa, Giardia lamblia
EDRSQPVQ

SEQ ID NO: 3048204 - protein, 6 aa, Giardia lamblia
EDSIDG

SEQ ID NO: 3048205 - protein, 14 aa, Giardia lamblia
EECGGNGSCTRSGD

SEQ ID NO: 3048206 - protein, 4 aa, Giardia lamblia
EEED

SEQ ID NO: 3048207 - protein, 10 aa, Giardia lamblia
EEGDGAPKCA

SEQ ID NO: 3048208 - protein, 5 aa, Giardia lamblia
EEYET

SEQ ID NO: 3048209 - protein, 6 aa, Giardia lamblia
EGHAEA

SEQ ID NO: 3048210 - protein, 5 aa, Giardia lamblia
EGIGP

SEQ ID NO: 3048211 - protein, 6 aa, Giardia lamblia
EGVPAS

SEQ ID NO: 3048212 - protein, 9 aa, Giardia lamblia
EGVPASGPI

SEQ ID NO: 3048213 - protein, 7 aa, Giardia lamblia
EKGDNYG

SEQ ID NO: 3048214 - protein, 4 aa, Giardia lamblia
EKKV

SEQ ID NO: 3048215 - protein, 7 aa, Giardia lamblia
EKSSSTK

SEQ ID NO: 3048216 - protein, 15 aa, Giardia lamblia
ENCSSGYTRDRSSRT

SEQ ID NO: 3048217 - protein, 9 aa, Giardia lamblia
ENRRTKVPS

SEQ ID NO: 3048218 - protein, 7 aa, Giardia lamblia
EPPDREA

SEQ ID NO: 3048219 - protein, 4 aa, Giardia lamblia
ESEA

SEQ ID NO: 3048220 - protein, 4 aa, Giardia lamblia
ESPL

SEQ ID NO: 3048221 - protein, 10 aa, Giardia lamblia
ETCSSGAADS

SEQ ID NO: 3048222 - protein, 7 aa, Giardia lamblia
ETSEVQE

SEQ ID NO: 3048223 - protein, 12 aa, Giardia lamblia
EYPSQGSTTTLA

SEQ ID NO: 3048224 - protein, 5 aa, Giardia lamblia
EYTEG

SEQ ID NO: 3048225 - protein, 15 aa, Giardia lamblia
FGGGSQAEHTVDDNT

SEQ ID NO: 3048226 - protein, 32 aa, Giardia lamblia
FKTDPGKCECRPGYDGTKCETCANGYKEHTDA

SEQ ID NO: 3048227 - protein, 13 aa, Giardia lamblia
GAEVASGVDNPYK

SEQ ID NO: 3048228 - protein, 9 aa, Giardia lamblia
GAGSTPCTK

SEQ ID NO: 3048229 - protein, 9 aa, Giardia lamblia
GAGSTTGTC

SEQ ID NO: 3048230 - protein, 27 aa, Giardia lamblia
GASPAPLPSNIPPSTGRPPYVPPSEPL

SEQ ID NO: 3048231 - protein, 9 aa, Giardia lamblia
GCYTKTETV

SEQ ID NO: 3048232 - protein, 4 aa, Giardia lamblia
GEEG

SEQ ID NO: 3048233 - protein, 9 aa, Giardia lamblia
GENANGGIE

SEQ ID NO: 3048234 - protein, 4 aa, Giardia lamblia
GEQC

SEQ ID NO: 3048235 - protein, 4 aa, Giardia lamblia
GETQ

SEQ ID NO: 3048236 - protein, 6 aa, Giardia lamblia
GEVPGG

SEQ ID NO: 3048237 - protein, 4 aa, Giardia lamblia
GGET

SEQ ID NO: 3048238 - protein, 9 aa, Giardia lamblia
GGPGKGTYN

SEQ ID NO: 3048239 - protein, 4 aa, Giardia lamblia
GHNV

SEQ ID NO: 3048240 - protein, 7 aa, Giardia lamblia
GHYGEKC

SEQ ID NO: 3048241 - protein, 4 aa, Giardia lamblia
GLST

SEQ ID NO: 3048242 - protein, 4 aa, Giardia lamblia
GNGA

SEQ ID NO: 3048243 - protein, 4 aa, Giardia lamblia
GNGR

SEQ ID NO: 3048244 - protein, 5 aa, Giardia lamblia
GNHPE

SEQ ID NO: 3048245 - protein, 4 aa, Giardia lamblia
GNYP

SEQ ID NO: 3048246 - protein, 10 aa, Giardia lamblia
GPNGAAKTTT

SEQ ID NO: 3048247 - protein, 11 aa, Giardia lamblia
GPNGAGKSTTL

SEQ ID NO: 3048248 - protein, 4 aa, Giardia lamblia
GPRD

SEQ ID NO: 3048249 - protein, 4 aa, Giardia lamblia
GPSG

SEQ ID NO: 3048250 - protein, 4 aa, Giardia lamblia
GPST

SEQ ID NO: 3048251 - protein, 4 aa, Giardia lamblia
GQGT

SEQ ID NO: 3048252 - protein, 11 aa, Giardia lamblia
GQYAENCADGQ

SEQ ID NO: 3048253 - protein, 11 aa, Giardia lamblia
GRCVSENGVTP

SEQ ID NO: 3048254 - protein, 9 aa, Giardia lamblia
GSDHGSLEN

SEQ ID NO: 3048255 - protein, 8 aa, Giardia lamblia
GSGIESAS

SEQ ID NO: 3048256 - protein, 16 aa, Giardia lamblia
GSGIKTESESGSGWPS

SEQ ID NO: 3048257 - protein, 13 aa, Giardia lamblia
GSKSLGIGDGAND

SEQ ID NO: 3048258 - protein, 4 aa, Giardia lamblia
GSLT

SEQ ID NO: 3048259 - protein, 6 aa, Giardia lamblia
GSSPDE

SEQ ID NO: 3048260 - protein, 5 aa, Giardia lamblia
GSTTE

SEQ ID NO: 3048261 - protein, 5 aa, Giardia lamblia
GSYKG

SEQ ID NO: 3048262 - protein, 8 aa, Giardia lamblia
GTCGGEGS

SEQ ID NO: 3048263 - protein, 4 aa, Giardia lamblia
GTLT

SEQ ID NO: 3048264 - protein, 5 aa, Giardia lamblia
GTRVS

SEQ ID NO: 3048265 - protein, 6 aa, Giardia lamblia
GTSCSR

SEQ ID NO: 3048266 - protein, 4 aa, Giardia lamblia
GVAR

SEQ ID NO: 3048267 - protein, 5 aa, Giardia lamblia
GVPSG

SEQ ID NO: 3048268 - protein, 10 aa, Giardia lamblia
GVPTGPPPAE

SEQ ID NO: 3048269 - protein, 4 aa, Giardia lamblia
GVSR

SEQ ID NO: 3048270 - protein, 12 aa, Giardia lamblia
GYYKESSNSITC

SEQ ID NO: 3048271 - protein, 10 aa, Giardia lamblia
HGRKSKNGRT

SEQ ID NO: 3048272 - protein, 16 aa, Giardia lamblia
HPRRGKGSLGPDAETR

SEQ ID NO: 3048273 - protein, 14 aa, Giardia lamblia
HPSPRTRSSTPNSY

SEQ ID NO: 3048274 - protein, 7 aa, Giardia lamblia
HSSGTGF

SEQ ID NO: 3048275 - protein, 4 aa, Giardia lamblia
HSSR

SEQ ID NO: 3048276 - protein, 10 aa, Giardia lamblia
HSYRKGAHAL

SEQ ID NO: 3048277 - protein, 10 aa, Giardia lamblia
IEVGQEDKTP

SEQ ID NO: 3048278 - protein, 5 aa, Giardia lamblia
IGKGD

SEQ ID NO: 3048279 - protein, 6 aa, Giardia lamblia
IGSTFT

SEQ ID NO: 3048280 - protein, 4 aa, Giardia lamblia
IPEE

SEQ ID NO: 3048281 - protein, 5 aa, Giardia lamblia
IPSRA

SEQ ID NO: 3048282 - protein, 5 aa, Giardia lamblia
IPTRS

SEQ ID NO: 3048283 - protein, 14 aa, Giardia lamblia
ISSSPASKQKMTTA

SEQ ID NO: 3048284 - protein, 5 aa, Giardia lamblia
ITSQS

SEQ ID NO: 3048285 - protein, 12 aa, Giardia lamblia
KAESGKCTECRQ

SEQ ID NO: 3048286 - protein, 6 aa, Giardia lamblia
KAPPAI

SEQ ID NO: 3048287 - protein, 11 aa, Giardia lamblia
KCGSDKKLSPL

SEQ ID NO: 3048288 - protein, 9 aa, Giardia lamblia
KDPRPDGYE

SEQ ID NO: 3048289 - protein, 8 aa, Giardia lamblia
KDTTDSSV

SEQ ID NO: 3048290 - protein, 4 aa, Giardia lamblia
KECA

SEQ ID NO: 3048291 - protein, 6 aa, Giardia lamblia
KEFDTP

SEQ ID NO: 3048292 - protein, 8 aa, Giardia lamblia
KGAAAGTA

SEQ ID NO: 3048293 - protein, 5 aa, Giardia lamblia
KGDLD

SEQ ID NO: 3048294 - protein, 10 aa, Giardia lamblia
KGECTDTTCE

SEQ ID NO: 3048295 - protein, 14 aa, Giardia lamblia
KGSGQARKDQVRTS

SEQ ID NO: 3048296 - protein, 7 aa, Giardia lamblia
KGSHTCE

SEQ ID NO: 3048297 - protein, 13 aa, Giardia lamblia
KHKSQASGLRPLT

SEQ ID NO: 3048298 - protein, 9 aa, Giardia lamblia
KKPKHPLDI

SEQ ID NO: 3048299 - protein, 4 aa, Giardia lamblia
KKQR

SEQ ID NO: 3048300 - protein, 19 aa, Giardia lamblia
KNGNNGNDKSFSNTVGGYS

SEQ ID NO: 3048301 - protein, 11 aa, Giardia lamblia
KNPSASSSATS

SEQ ID NO: 3048302 - protein, 12 aa, Giardia lamblia
KPSFNQDHPGLS

SEQ ID NO: 3048303 - protein, 7 aa, Giardia lamblia
KRDDTIS

SEQ ID NO: 3048304 - protein, 8 aa, Giardia lamblia
KRDGEVPI

SEQ ID NO: 3048305 - protein, 5 aa, Giardia lamblia
KRGVR

SEQ ID NO: 3048306 - protein, 4 aa, Giardia lamblia
KRYR

SEQ ID NO: 3048307 - protein, 5 aa, Giardia lamblia
KSGDK

SEQ ID NO: 3048308 - protein, 7 aa, Giardia lamblia
KSLTSTH

SEQ ID NO: 3048309 - protein, 4 aa, Giardia lamblia
KSNG

SEQ ID NO: 3048310 - protein, 4 aa, Giardia lamblia
KSTR

SEQ ID NO: 3048311 - protein, 6 aa, Giardia lamblia
KTCKDT

SEQ ID NO: 3048312 - protein, 14 aa, Giardia lamblia
KTKNPSVSVDATEE

SEQ ID NO: 3048313 - protein, 7 aa, Giardia lamblia
KTSNQPS

SEQ ID NO: 3048314 - protein, 14 aa, Giardia lamblia
KTYPATRLSPEKHA

SEQ ID NO: 3048315 - protein, 19 aa, Giardia lamblia
KVCNGGGTCSGEGSSATCS

SEQ ID NO: 3048316 - protein, 20 aa, Giardia lamblia
KVCNGGGTCSGEGSSATCSC

SEQ ID NO: 3048317 - protein, 5 aa, Giardia lamblia
KYGPI

SEQ ID NO: 3048318 - protein, 13 aa, Giardia lamblia
LCGGPGAGYIDST

SEQ ID NO: 3048319 - protein, 5 aa, Giardia lamblia
LDDPA

SEQ ID NO: 3048320 - protein, 6 aa, Giardia lamblia
LDGETD

SEQ ID NO: 3048321 - protein, 4 aa, Giardia lamblia
LDPG

SEQ ID NO: 3048322 - protein, 4 aa, Giardia lamblia
LENE

SEQ ID NO: 3048323 - protein, 14 aa, Giardia lamblia
LEPQSTRAGGYAPL

SEQ ID NO: 3048324 - protein, 5 aa, Giardia lamblia
LGLPT

SEQ ID NO: 3048325 - protein, 7 aa, Giardia lamblia
LGPQRKA

SEQ ID NO: 3048326 - protein, 7 aa, Giardia lamblia
LKPTSGY

SEQ ID NO: 3048327 - protein, 4 aa, Giardia lamblia
LNPP

SEQ ID NO: 3048328 - protein, 4 aa, Giardia lamblia
LPPA

SEQ ID NO: 3048329 - protein, 6 aa, Giardia lamblia
LPPNED

SEQ ID NO: 3048330 - protein, 24 aa, Giardia lamblia
LRSGPADLKQKIRSDPGLQSDPPN

SEQ ID NO: 3048331 - protein, 6 aa, Giardia lamblia
LSDSPT

SEQ ID NO: 3048332 - protein, 7 aa, Giardia lamblia
LSETTSM

SEQ ID NO: 3048333 - protein, 4 aa, Giardia lamblia
LSGS

SEQ ID NO: 3048334 - protein, 4 aa, Giardia lamblia
LSPS

SEQ ID NO: 3048335 - protein, 4 aa, Giardia lamblia
LSTR

SEQ ID NO: 3048336 - protein, 7 aa, Giardia lamblia
LTGETSA

SEQ ID NO: 3048337 - protein, 8 aa, Giardia lamblia
MGTTDNRE

SEQ ID NO: 3048338 - protein, 15 aa, Giardia lamblia
NAIAAGSSSSDALPT

SEQ ID NO: 3048339 - protein, 8 aa, Giardia lamblia
NDCKDGYY

SEQ ID NO: 3048340 - protein, 16 aa, Giardia lamblia
NDSRSESGNCKAGSCT

SEQ ID NO: 3048341 - protein, 12 aa, Giardia lamblia
NETECEEPSSGY

SEQ ID NO: 3048342 - protein, 5 aa, Giardia lamblia
NGAGY

SEQ ID NO: 3048343 - protein, 8 aa, Giardia lamblia
NGDNNKNG

SEQ ID NO: 3048344 - protein, 8 aa, Giardia lamblia
NGRQRTLP

SEQ ID NO: 3048345 - protein, 8 aa, Giardia lamblia
NGYKGASG

SEQ ID NO: 3048346 - protein, 12 aa, Giardia lamblia
NLSTSSSTTTVT

SEQ ID NO: 3048347 - protein, 4 aa, Giardia lamblia
NNST

SEQ ID NO: 3048348 - protein, 8 aa, Giardia lamblia
NPDDSAAE

SEQ ID NO: 3048349 - protein, 8 aa, Giardia lamblia
NPDTSAAE

SEQ ID NO: 3048350 - protein, 4 aa, Giardia lamblia
NPSV

SEQ ID NO: 3048351 - protein, 9 aa, Giardia lamblia
NPVSSTATE

SEQ ID NO: 3048352 - protein, 4 aa, Giardia lamblia
NQRV

SEQ ID NO: 3048353 - protein, 8 aa, Giardia lamblia
NQSTGECS

SEQ ID NO: 3048354 - protein, 20 aa, Giardia lamblia
NRCEESCPEVEESSKATGKC

SEQ ID NO: 3048355 - protein, 6 aa, Giardia lamblia
NRPYGE

SEQ ID NO: 3048356 - protein, 8 aa, Giardia lamblia
NRTDPLGQ

SEQ ID NO: 3048357 - protein, 11 aa, Giardia lamblia
NRTEKEYTDIP

SEQ ID NO: 3048358 - protein, 11 aa, Giardia lamblia
NRTEQDYTDIP

SEQ ID NO: 3048359 - protein, 6 aa, Giardia lamblia
NSSGYS

SEQ ID NO: 3048360 - protein, 4 aa, Giardia lamblia
NTSV

SEQ ID NO: 3048361 - protein, 7 aa, Giardia lamblia
NVTTENV

SEQ ID NO: 3048362 - protein, 8 aa, Giardia lamblia
PAAIPGSG

SEQ ID NO: 3048363 - protein, 13 aa, Giardia lamblia
PAGTYPDNRDSTG

SEQ ID NO: 3048364 - protein, 13 aa, Giardia lamblia
PAPSNKSSGGTTA

SEQ ID NO: 3048365 - protein, 11 aa, Giardia lamblia
PAPSNKSSSTI

SEQ ID NO: 3048366 - protein, 7 aa, Giardia lamblia
PDCSSQS

SEQ ID NO: 3048367 - protein, 8 aa, Giardia lamblia
PDNRLSDG

SEQ ID NO: 3048368 - protein, 4 aa, Giardia lamblia
PDSD

SEQ ID NO: 3048369 - protein, 4 aa, Giardia lamblia
PDVD

SEQ ID NO: 3048370 - protein, 5 aa, Giardia lamblia
PEQQR

SEQ ID NO: 3048371 - protein, 8 aa, Giardia lamblia
PESPLRDA

SEQ ID NO: 3048372 - protein, 4 aa, Giardia lamblia
PGIA

SEQ ID NO: 3048373 - protein, 10 aa, Giardia lamblia
PGRDPSKVGA

SEQ ID NO: 3048374 - protein, 7 aa, Giardia lamblia
PGYYNAS

SEQ ID NO: 3048375 - protein, 4 aa, Giardia lamblia
PKGI

SEQ ID NO: 3048376 - protein, 10 aa, Giardia lamblia
PKGTWGPRCS

SEQ ID NO: 3048377 - protein, 4 aa, Giardia lamblia
PKQY

SEQ ID NO: 3048378 - protein, 4 aa, Giardia lamblia
PNTA

SEQ ID NO: 3048379 - protein, 11 aa, Giardia lamblia
PPKAAGPATCT

SEQ ID NO: 3048380 - protein, 5 aa, Giardia lamblia
PPTST

SEQ ID NO: 3048381 - protein, 6 aa, Giardia lamblia
PRNTAE

SEQ ID NO: 3048382 - protein, 5 aa, Giardia lamblia
PRPPN

SEQ ID NO: 3048383 - protein, 4 aa, Giardia lamblia
PSIE

SEQ ID NO: 3048384 - protein, 5 aa, Giardia lamblia
PSSLQ

SEQ ID NO: 3048385 - protein, 11 aa, Giardia lamblia
PTKRRGRRERS

SEQ ID NO: 3048386 - protein, 9 aa, Giardia lamblia
PTKSCKSNE

SEQ ID NO: 3048387 - protein, 8 aa, Giardia lamblia
PTKSEDIK

SEQ ID NO: 3048388 - protein, 6 aa, Giardia lamblia
PVASTA

SEQ ID NO: 3048389 - protein, 8 aa, Giardia lamblia
QADPETPE

SEQ ID NO: 3048390 - protein, 6 aa, Giardia lamblia
QANGTC

SEQ ID NO: 3048391 - protein, 7 aa, Giardia lamblia
QATDCPS

SEQ ID NO: 3048392 - protein, 12 aa, Giardia lamblia
QESGAKDCSIPT

SEQ ID NO: 3048393 - protein, 4 aa, Giardia lamblia
QGHI

SEQ ID NO: 3048394 - protein, 20 aa, Giardia lamblia
QGNTGGYNCEKTKCNGKISE

SEQ ID NO: 3048395 - protein, 18 aa, Giardia lamblia
QGYYSTQSSVSAPSDCRP

SEQ ID NO: 3048396 - protein, 6 aa, Giardia lamblia
QKCTNG

SEQ ID NO: 3048397 - protein, 8 aa, Giardia lamblia
QNLPGQNG

SEQ ID NO: 3048398 - protein, 5 aa, Giardia lamblia
QPDHY

SEQ ID NO: 3048399 - protein, 4 aa, Giardia lamblia
QPDY

SEQ ID NO: 3048400 - protein, 6 aa, Giardia lamblia
QQCSPG

SEQ ID NO: 3048401 - protein, 8 aa, Giardia lamblia
QQGSVSGT

SEQ ID NO: 3048402 - protein, 8 aa, Giardia lamblia
QQNGLESE

SEQ ID NO: 3048403 - protein, 16 aa, Giardia lamblia
QQQPPDPQPSLRTATA

SEQ ID NO: 3048404 - protein, 12 aa, Giardia lamblia
QRASPSPGSGQW

SEQ ID NO: 3048405 - protein, 5 aa, Giardia lamblia
QSPNC

SEQ ID NO: 3048406 - protein, 8 aa, Giardia lamblia
QYPPSAAS

SEQ ID NO: 3048407 - protein, 10 aa, Giardia lamblia
RCSPKPSGTM

SEQ ID NO: 3048408 - protein, 10 aa, Giardia lamblia
RCTGPGKCTA

SEQ ID NO: 3048409 - protein, 6 aa, Giardia lamblia
RDDPNS

SEQ ID NO: 3048410 - protein, 6 aa, Giardia lamblia
RDGAGY

SEQ ID NO: 3048411 - protein, 6 aa, Giardia lamblia
RDISQN

SEQ ID NO: 3048412 - protein, 4 aa, Giardia lamblia
REAN

SEQ ID NO: 3048413 - protein, 5 aa, Giardia lamblia
REPPV

SEQ ID NO: 3048414 - protein, 6 aa, Giardia lamblia
RESQQN

SEQ ID NO: 3048415 - protein, 12 aa, Giardia lamblia
RGKEGNQAANAA

SEQ ID NO: 3048416 - protein, 8 aa, Giardia lamblia
RGRNANEA

SEQ ID NO: 3048417 - protein, 5 aa, Giardia lamblia
RIETA

SEQ ID NO: 3048418 - protein, 11 aa, Giardia lamblia
RIPARADLADK

SEQ ID NO: 3048419 - protein, 34 aa, Giardia lamblia
RKSGELRERAPRKGPSFSGSQKLKKQASSKASLH

SEQ ID NO: 3048420 - protein, 7 aa, Giardia lamblia
RKTYRKA

SEQ ID NO: 3048421 - protein, 6 aa, Giardia lamblia
RLRKGV

SEQ ID NO: 3048422 - protein, 32 aa, Giardia lamblia
RRGGPLRERAPQKGSKSSRSKLKRQATSNASL

SEQ ID NO: 3048423 - protein, 8 aa, Giardia lamblia
RRVKQGSL

SEQ ID NO: 3048424 - protein, 12 aa, Giardia lamblia
RSYTLTKGETVP

SEQ ID NO: 3048425 - protein, 7 aa, Giardia lamblia
RTEGSVK

SEQ ID NO: 3048426 - protein, 12 aa, Giardia lamblia
RTNSQDRSGALQ

SEQ ID NO: 3048427 - protein, 4 aa, Giardia lamblia
RVGQ

SEQ ID NO: 3048428 - protein, 5 aa, Giardia lamblia
SAGVI

SEQ ID NO: 3048429 - protein, 7 aa, Giardia lamblia
SANGHDV

SEQ ID NO: 3048430 - protein, 4 aa, Giardia lamblia
SAPG

SEQ ID NO: 3048431 - protein, 5 aa, Giardia lamblia
SCGPT

SEQ ID NO: 3048432 - protein, 10 aa, Giardia lamblia
SCTDTTSTTC

SEQ ID NO: 3048433 - protein, 11 aa, Giardia lamblia
SDENGSKTVCK

SEQ ID NO: 3048434 - protein, 4 aa, Giardia lamblia
SDKS

SEQ ID NO: 3048435 - protein, 5 aa, Giardia lamblia
SDNGR

SEQ ID NO: 3048436 - protein, 4 aa, Giardia lamblia
SDQS

SEQ ID NO: 3048437 - protein, 4 aa, Giardia lamblia
SDSA

SEQ ID NO: 3048438 - protein, 24 aa, Giardia lamblia
SDSTEPGEDGACPRALPPATPEGC

SEQ ID NO: 3048439 - protein, 9 aa, Giardia lamblia
SDTSGRDSW

SEQ ID NO: 3048440 - protein, 13 aa, Giardia lamblia
SDTSPPPKDTENR

SEQ ID NO: 3048441 - protein, 7 aa, Giardia lamblia
SEDGVEP

SEQ ID NO: 3048442 - protein, 7 aa, Giardia lamblia
SESKISS

SEQ ID NO: 3048443 - protein, 5 aa, Giardia lamblia
SETKR

SEQ ID NO: 3048444 - protein, 4 aa, Giardia lamblia
SFEE

SEQ ID NO: 3048445 - protein, 13 aa, Giardia lamblia
SGCGDGYYADPEE

SEQ ID NO: 3048446 - protein, 6 aa, Giardia lamblia
SGKVPI

SEQ ID NO: 3048447 - protein, 7 aa, Giardia lamblia
SGLKPGV

SEQ ID NO: 3048448 - protein, 4 aa, Giardia lamblia
SGNR

SEQ ID NO: 3048449 - protein, 4 aa, Giardia lamblia
SGSV

SEQ ID NO: 3048450 - protein, 19 aa, Giardia lamblia
SINSGSESHNEFLLEEPDL

SEQ ID NO: 3048451 - protein, 4 aa, Giardia lamblia
SITK

SEQ ID NO: 3048452 - protein, 4 aa, Giardia lamblia
SKAE

SEQ ID NO: 3048453 - protein, 7 aa, Giardia lamblia
SKCQDKE

SEQ ID NO: 3048454 - protein, 12 aa, Giardia lamblia
SKCTGSASPQQC

SEQ ID NO: 3048455 - protein, 7 aa, Giardia lamblia
SKDTDSM

SEQ ID NO: 3048456 - protein, 6 aa, Giardia lamblia
SKECLS

SEQ ID NO: 3048457 - protein, 23 aa, Giardia lamblia
SKNSDSPCDPMRTGTNNKPLDPS

SEQ ID NO: 3048458 - protein, 14 aa, Giardia lamblia
SKSKNADPKTQRAR

SEQ ID NO: 3048459 - protein, 6 aa, Giardia lamblia
SLAGPW

SEQ ID NO: 3048460 - protein, 9 aa, Giardia lamblia
SNFSSRGAG

SEQ ID NO: 3048461 - protein, 6 aa, Giardia lamblia
SNKNGK

SEQ ID NO: 3048462 - protein, 6 aa, Giardia lamblia
SNNGRV

SEQ ID NO: 3048463 - protein, 4 aa, Giardia lamblia
SQAG

SEQ ID NO: 3048464 - protein, 5 aa, Giardia lamblia
SQDYN

SEQ ID NO: 3048465 - protein, 15 aa, Giardia lamblia
SRREKRLNRKKRPGS

SEQ ID NO: 3048466 - protein, 6 aa, Giardia lamblia
SSALPQ

SEQ ID NO: 3048467 - protein, 4 aa, Giardia lamblia
SSAT

SEQ ID NO: 3048468 - protein, 6 aa, Giardia lamblia
SSEPGF

SEQ ID NO: 3048469 - protein, 4 aa, Giardia lamblia
SSKA

SEQ ID NO: 3048470 - protein, 4 aa, Giardia lamblia
SSRD

SEQ ID NO: 3048471 - protein, 4 aa, Giardia lamblia
SSTF

SEQ ID NO: 3048472 - protein, 4 aa, Giardia lamblia
STGS

SEQ ID NO: 3048473 - protein, 4 aa, Giardia lamblia
STLP

SEQ ID NO: 3048474 - protein, 8 aa, Giardia lamblia
STNLRDNS

SEQ ID NO: 3048475 - protein, 30 aa, Giardia lamblia
STPQPPTARAADSRVCGPDGQYTTFGDPSN

SEQ ID NO: 3048476 - protein, 5 aa, Giardia lamblia
STQYQ

SEQ ID NO: 3048477 - protein, 7 aa, Giardia lamblia
STRLNEA

SEQ ID NO: 3048478 - protein, 5 aa, Giardia lamblia
STTGG

SEQ ID NO: 3048479 - protein, 4 aa, Giardia lamblia
STTT

SEQ ID NO: 3048480 - protein, 13 aa, Giardia lamblia
SYKNTLEKCEDPN

SEQ ID NO: 3048481 - protein, 10 aa, Giardia lamblia
TAASADLANR

SEQ ID NO: 3048482 - protein, 9 aa, Giardia lamblia
TAQVDREND

SEQ ID NO: 3048483 - protein, 12 aa, Giardia lamblia
TATLYGSTTIQS

SEQ ID NO: 3048484 - protein, 7 aa, Giardia lamblia
TATNCTN

SEQ ID NO: 3048485 - protein, 4 aa, Giardia lamblia
TATS

SEQ ID NO: 3048486 - protein, 7 aa, Giardia lamblia
TCNNPNS

SEQ ID NO: 3048487 - protein, 10 aa, Giardia lamblia
TCQDGYTKGL

SEQ ID NO: 3048488 - protein, 11 aa, Giardia lamblia
TCTDKSAKING

SEQ ID NO: 3048489 - protein, 12 aa, Giardia lamblia
TCTPGKSAQVGD

SEQ ID NO: 3048490 - protein, 8 aa, Giardia lamblia
TDCSADQV

SEQ ID NO: 3048491 - protein, 9 aa, Giardia lamblia
TDGTHGSAT

SEQ ID NO: 3048492 - protein, 6 aa, Giardia lamblia
TDLAEE

SEQ ID NO: 3048493 - protein, 4 aa, Giardia lamblia
TDQR

SEQ ID NO: 3048494 - protein, 8 aa, Giardia lamblia
TDSAATEI

SEQ ID NO: 3048495 - protein, 9 aa, Giardia lamblia
TDSSQLTVG

SEQ ID NO: 3048496 - protein, 23 aa, Giardia lamblia
TDSTEPKDNTCPQALPPTTPEGC

SEQ ID NO: 3048497 - protein, 8 aa, Giardia lamblia
TECTESNK

SEQ ID NO: 3048498 - protein, 5 aa, Giardia lamblia
TEDTY

SEQ ID NO: 3048499 - protein, 9 aa, Giardia lamblia
TERTETCKR

SEQ ID NO: 3048500 - protein, 4 aa, Giardia lamblia
TESP

SEQ ID NO: 3048501 - protein, 4 aa, Giardia lamblia
TGAS

SEQ ID NO: 3048502 - protein, 8 aa, Giardia lamblia
TGGSTGAN

SEQ ID NO: 3048503 - protein, 6 aa, Giardia lamblia
TGLSSR

SEQ ID NO: 3048504 - protein, 9 aa, Giardia lamblia
TGRDAGTCR

SEQ ID NO: 3048505 - protein, 4 aa, Giardia lamblia
TGRY

SEQ ID NO: 3048506 - protein, 11 aa, Giardia lamblia
TGSNPTPGSCS

SEQ ID NO: 3048507 - protein, 4 aa, Giardia lamblia
TGSP

SEQ ID NO: 3048508 - protein, 8 aa, Giardia lamblia
TKDASRGL

SEQ ID NO: 3048509 - protein, 10 aa, Giardia lamblia
TKGRAPGTSI

SEQ ID NO: 3048510 - protein, 4 aa, Giardia lamblia
TNRC

SEQ ID NO: 3048511 - protein, 8 aa, Giardia lamblia
TNSSSTGG

SEQ ID NO: 3048512 - protein, 4 aa, Giardia lamblia
TPFT

SEQ ID NO: 3048513 - protein, 4 aa, Giardia lamblia
TPIG

SEQ ID NO: 3048514 - protein, 8 aa, Giardia lamblia
TPLGGPRD

SEQ ID NO: 3048515 - protein, 11 aa, Giardia lamblia
TQDSDCGGATG

SEQ ID NO: 3048516 - protein, 10 aa, Giardia lamblia
TQESDGAETV

SEQ ID NO: 3048517 - protein, 9 aa, Giardia lamblia
TQTDEEKRR

SEQ ID NO: 3048518 - protein, 4 aa, Giardia lamblia
TSAA

SEQ ID NO: 3048519 - protein, 7 aa, Giardia lamblia
TSASVSI

SEQ ID NO: 3048520 - protein, 6 aa, Giardia lamblia
TSDRQE

SEQ ID NO: 3048521 - protein, 9 aa, Giardia lamblia
TSDSTCQAC

SEQ ID NO: 3048522 - protein, 16 aa, Giardia lamblia
TSRGSAVTPTDTTCAS

SEQ ID NO: 3048523 - protein, 9 aa, Giardia lamblia
TTDNKYRQI

SEQ ID NO: 3048524 - protein, 5 aa, Giardia lamblia
TTGEA

SEQ ID NO: 3048525 - protein, 12 aa, Giardia lamblia
TTNTGKASTDRA

SEQ ID NO: 3048526 - protein, 8 aa, Giardia lamblia
TTPKNRGT

SEQ ID NO: 3048527 - protein, 6 aa, Giardia lamblia
TTPTGR

SEQ ID NO: 3048528 - protein, 5 aa, Giardia lamblia
TTPYR

SEQ ID NO: 3048529 - protein, 16 aa, Giardia lamblia
TTSVASGLNNAGRIES

SEQ ID NO: 3048530 - protein, 5 aa, Giardia lamblia
TTTRA

SEQ ID NO: 3048531 - protein, 4 aa, Giardia lamblia
VCSA

SEQ ID NO: 3048532 - protein, 12 aa, Giardia lamblia
VESSSSDALPTC

SEQ ID NO: 3048533 - protein, 6 aa, Giardia lamblia
VGGSKY

SEQ ID NO: 3048534 - protein, 6 aa, Giardia lamblia
VGTYDK

SEQ ID NO: 3048535 - protein, 20 aa, Giardia lamblia
VKKHTSKLRASENTAPLTTQ

SEQ ID NO: 3048536 - protein, 4 aa, Giardia lamblia
VRGT

SEQ ID NO: 3048537 - protein, 8 aa, Giardia lamblia
VRPTHSSA

SEQ ID NO: 3048538 - protein, 6 aa, Giardia lamblia
VRRRTR

SEQ ID NO: 3048539 - protein, 6 aa, Giardia lamblia
VSADDK

SEQ ID NO: 3048540 - protein, 5 aa, Giardia lamblia
VSGSA

SEQ ID NO: 3048541 - protein, 14 aa, Giardia lamblia
VSQTRKASSSSTTV

SEQ ID NO: 3048542 - protein, 9 aa, Giardia lamblia
VTGCTPGDG

SEQ ID NO: 3048543 - protein, 18 aa, Giardia lamblia
YDRGSADSLLPEGSADSA

SEQ ID NO: 3048544 - protein, 37 aa, Giardia lamblia
YDRTKATALTQPDALTAEPTNDPSEVDVPEETLKVDQ

SEQ ID NO: 3048545 - protein, 7 aa, Giardia lamblia
YGDNGRL

SEQ ID NO: 3048546 - protein, 19 aa, Giardia lamblia
YLKETDQGKTVCEAPPPTC

SEQ ID NO: 3048547 - protein, 9 aa, Giardia lamblia
YLKGGDPTS

SEQ ID NO: 3048548 - protein, 7 aa, Giardia lamblia
YPSETPK

SEQ ID NO: 3048549 - protein, 7 aa, Giardia lamblia
YPTTPSL

SEQ ID NO: 3048550 - protein, 5 aa, Giardia lamblia
YSGND

SEQ ID NO: 3048551 - protein, 9 aa, Giardia lamblia
YSNETSPGN

SEQ ID NO: 3048552 - protein, 4 aa, Giardia lamblia
YTPS

SEQ ID NO: 3048553 - protein, 20 aa, Giardia lamblia
AAAAASEAARGAVQGLIQGW

SEQ ID NO: 3048554 - protein, 8 aa, Giardia lamblia
AAAAEQCD

SEQ ID NO: 3048555 - protein, 46 aa, Giardia lamblia
AAADEDPDDAQSEISKGSSRSKLSSMSAATSAVGLSETGKKSSQQR

SEQ ID NO: 3048556 - protein, 7 aa, Giardia lamblia
AAADEYS

SEQ ID NO: 3048557 - protein, 7 aa, Giardia lamblia
AAADGKV

SEQ ID NO: 3048558 - protein, 6 aa, Giardia lamblia
AAAGEQ

SEQ ID NO: 3048559 - protein, 17 aa, Giardia lamblia
AAAGPPSAPLDADSPKM

SEQ ID NO: 3048560 - protein, 14 aa, Giardia lamblia
AAAGSSASDQDGRV

SEQ ID NO: 3048561 - protein, 7 aa, Giardia lamblia
AAAGVLD

SEQ ID NO: 3048562 - protein, 20 aa, Giardia lamblia
AAAKRKSTMYPPFSTPTPTV

SEQ ID NO: 3048563 - protein, 8 aa, Giardia lamblia
AAAPRTSR

SEQ ID NO: 3048564 - protein, 6 aa, Giardia lamblia
AAAQGT

SEQ ID NO: 3048565 - protein, 15 aa, Giardia lamblia
AAAQYSDEATQLRSG

SEQ ID NO: 3048566 - protein, 7 aa, Giardia lamblia
AAASTDD

SEQ ID NO: 3048567 - protein, 10 aa, Giardia lamblia
AAATKAATHG

SEQ ID NO: 3048568 - protein, 6 aa, Giardia lamblia
AADARK

SEQ ID NO: 3048569 - protein, 13 aa, Giardia lamblia
AADARVKAGPAAL

SEQ ID NO: 3048570 - protein, 9 aa, Giardia lamblia
AADDSSLAQ

SEQ ID NO: 3048571 - protein, 8 aa, Giardia lamblia
AADGAPAT

SEQ ID NO: 3048572 - protein, 17 aa, Giardia lamblia
AADGETPDTKPEDIDPK

SEQ ID NO: 3048573 - protein, 4 aa, Giardia lamblia
AADI

SEQ ID NO: 3048574 - protein, 13 aa, Giardia lamblia
AADISSEHRLEEE

SEQ ID NO: 3048575 - protein, 7 aa, Giardia lamblia
AADNTEI

SEQ ID NO: 3048576 - protein, 17 aa, Giardia lamblia
AADPRDPEPPEEGRNVN

SEQ ID NO: 3048577 - protein, 15 aa, Giardia lamblia
AADREHSSSVYSPRD

SEQ ID NO: 3048578 - protein, 6 aa, Giardia lamblia
AADSLN

SEQ ID NO: 3048579 - protein, 8 aa, Giardia lamblia
AAEAKSPC

SEQ ID NO: 3048580 - protein, 38 aa, Giardia lamblia
AAEASQMSETGHSAVSGPVEAETSDTSRTLSREPTAHG

SEQ ID NO: 3048581 - protein, 5 aa, Giardia lamblia
AAEDC

SEQ ID NO: 3048582 - protein, 8 aa, Giardia lamblia
AAEEHETG

SEQ ID NO: 3048583 - protein, 5 aa, Giardia lamblia
AAEET

SEQ ID NO: 3048584 - protein, 5 aa, Giardia lamblia
AAEGD

SEQ ID NO: 3048585 - protein, 5 aa, Giardia lamblia
AAEIP

SEQ ID NO: 3048586 - protein, 9 aa, Giardia lamblia
AAEPGLPGR

SEQ ID NO: 3048587 - protein, 9 aa, Giardia lamblia
AAEPKASGI

SEQ ID NO: 3048588 - protein, 4 aa, Giardia lamblia
AAEQ

SEQ ID NO: 3048589 - protein, 5 aa, Giardia lamblia
AAEQE

SEQ ID NO: 3048590 - protein, 10 aa, Giardia lamblia
AAERPSLGLG

SEQ ID NO: 3048591 - protein, 6 aa, Giardia lamblia
AAERSP

SEQ ID NO: 3048592 - protein, 8 aa, Giardia lamblia
AAESTEYD

SEQ ID NO: 3048593 - protein, 5 aa, Giardia lamblia
AAETH

SEQ ID NO: 3048594 - protein, 6 aa, Giardia lamblia
AAETRA

SEQ ID NO: 3048595 - protein, 10 aa, Giardia lamblia
AAETRRYNSS

SEQ ID NO: 3048596 - protein, 31 aa, Giardia lamblia
AAEYNTYDTSEHPQDRKPSGAQQPTSDVSSV

SEQ ID NO: 3048597 - protein, 6 aa, Giardia lamblia
AAFSSS

SEQ ID NO: 3048598 - protein, 9 aa, Giardia lamblia
AAGDTIEPL

SEQ ID NO: 3048599 - protein, 5 aa, Giardia lamblia
AAGEG

SEQ ID NO: 3048600 - protein, 9 aa, Giardia lamblia
AAGEPYQSS

SEQ ID NO: 3048601 - protein, 15 aa, Giardia lamblia
AAGGRPVNRHSKPGI

SEQ ID NO: 3048602 - protein, 7 aa, Giardia lamblia
AAGGTRR

SEQ ID NO: 3048603 - protein, 8 aa, Giardia lamblia
AAGLPTDE

SEQ ID NO: 3048604 - protein, 7 aa, Giardia lamblia
AAGNGHS

SEQ ID NO: 3048605 - protein, 8 aa, Giardia lamblia
AAGNKEEL

SEQ ID NO: 3048606 - protein, 9 aa, Giardia lamblia
AAGQHSTEL

SEQ ID NO: 3048607 - protein, 15 aa, Giardia lamblia
AAGRAKSAASYSQNP

SEQ ID NO: 3048608 - protein, 7 aa, Giardia lamblia
AAGRDAS

SEQ ID NO: 3048609 - protein, 5 aa, Giardia lamblia
AAGSI

SEQ ID NO: 3048610 - protein, 5 aa, Giardia lamblia
AAGTS

SEQ ID NO: 3048611 - protein, 5 aa, Giardia lamblia
AAGYS

SEQ ID NO: 3048612 - protein, 16 aa, Giardia lamblia
AAHDSATEFEQENPYL

SEQ ID NO: 3048613 - protein, 5 aa, Giardia lamblia
AAIDN

SEQ ID NO: 3048614 - protein, 5 aa, Giardia lamblia
AAIDR

SEQ ID NO: 3048615 - protein, 4 aa, Giardia lamblia
AAIK

SEQ ID NO: 3048616 - protein, 11 aa, Giardia lamblia
AAIQRSGNKQC

SEQ ID NO: 3048617 - protein, 6 aa, Giardia lamblia
AAITKG

SEQ ID NO: 3048618 - protein, 7 aa, Giardia lamblia
AAKAAGL

SEQ ID NO: 3048619 - protein, 5 aa, Giardia lamblia
AAKAE

SEQ ID NO: 3048620 - protein, 10 aa, Giardia lamblia
AAKARKDKRL

SEQ ID NO: 3048621 - protein, 6 aa, Giardia lamblia
AAKDDF

SEQ ID NO: 3048622 - protein, 9 aa, Giardia lamblia
AAKDDPESL

SEQ ID NO: 3048623 - protein, 7 aa, Giardia lamblia
AAKDEKI

SEQ ID NO: 3048624 - protein, 13 aa, Giardia lamblia
AAKDGAQRSAEPG

SEQ ID NO: 3048625 - protein, 6 aa, Giardia lamblia
AAKGER

SEQ ID NO: 3048626 - protein, 6 aa, Giardia lamblia
AAKGPS

SEQ ID NO: 3048627 - protein, 9 aa, Giardia lamblia
AAKKHKKVR

SEQ ID NO: 3048628 - protein, 6 aa, Giardia lamblia
AAKKTI

SEQ ID NO: 3048629 - protein, 7 aa, Giardia lamblia
AAKNSIQ

SEQ ID NO: 3048630 - protein, 4 aa, Giardia lamblia
AAKQ

SEQ ID NO: 3048631 - protein, 6 aa, Giardia lamblia
AAKQEL

SEQ ID NO: 3048632 - protein, 10 aa, Giardia lamblia
AAKRKTDDKC

SEQ ID NO: 3048633 - protein, 7 aa, Giardia lamblia
AAKSGKT

SEQ ID NO: 3048634 - protein, 11 aa, Giardia lamblia
AAKTRQASSIN

SEQ ID NO: 3048635 - protein, 13 aa, Giardia lamblia
AALNERAKSLTGR

SEQ ID NO: 3048636 - protein, 7 aa, Giardia lamblia
AALRQAE

SEQ ID NO: 3048637 - protein, 10 aa, Giardia lamblia
AALSAEPKDG

SEQ ID NO: 3048638 - protein, 12 aa, Giardia lamblia
AALSQASEQGCS

SEQ ID NO: 3048639 - protein, 6 aa, Giardia lamblia
AANAKI

SEQ ID NO: 3048640 - protein, 4 aa, Giardia lamblia
AANE

SEQ ID NO: 3048641 - protein, 8 aa, Giardia lamblia
AANGKAHA

SEQ ID NO: 3048642 - protein, 15 aa, Giardia lamblia
AANKEQSNPLKTGSY

SEQ ID NO: 3048643 - protein, 9 aa, Giardia lamblia
AANNTDSTV

SEQ ID NO: 3048644 - protein, 5 aa, Giardia lamblia
AANPS

SEQ ID NO: 3048645 - protein, 8 aa, Giardia lamblia
AANPSTQI

SEQ ID NO: 3048646 - protein, 13 aa, Giardia lamblia
AANSKSTAMRGTA

SEQ ID NO: 3048647 - protein, 11 aa, Giardia lamblia
AANTQDPTGLD

SEQ ID NO: 3048648 - protein, 17 aa, Giardia lamblia
AANVETEPLRNSPYQNG

SEQ ID NO: 3048649 - protein, 14 aa, Giardia lamblia
AAPAGSPRQQQRRC

SEQ ID NO: 3048650 - protein, 30 aa, Giardia lamblia
AAPAPRAASPVPAAPVAQQPATPQVSQGGS

SEQ ID NO: 3048651 - protein, 20 aa, Giardia lamblia
AAPDPAYTKESLKQQKPSLY

SEQ ID NO: 3048652 - protein, 8 aa, Giardia lamblia
AAPEAETR

SEQ ID NO: 3048653 - protein, 16 aa, Giardia lamblia
AAPEGTQQSQVDISLS

SEQ ID NO: 3048654 - protein, 9 aa, Giardia lamblia
AAPETSFPY

SEQ ID NO: 3048655 - protein, 13 aa, Giardia lamblia
AAPGDASPSPNQL

SEQ ID NO: 3048656 - protein, 7 aa, Giardia lamblia
AAPKDKY

SEQ ID NO: 3048657 - protein, 8 aa, Giardia lamblia
AAPKEQDT

SEQ ID NO: 3048658 - protein, 8 aa, Giardia lamblia
AAPPSSYG

SEQ ID NO: 3048659 - protein, 7 aa, Giardia lamblia
AAPRTTL

SEQ ID NO: 3048660 - protein, 5 aa, Giardia lamblia
AAPSG

SEQ ID NO: 3048661 - protein, 9 aa, Giardia lamblia
AAPSSRSSA

SEQ ID NO: 3048662 - protein, 10 aa, Giardia lamblia
AAPTGAGKTN

SEQ ID NO: 3048663 - protein, 19 aa, Giardia lamblia
AAPTKQTHPEPDLDGSTDS

SEQ ID NO: 3048664 - protein, 5 aa, Giardia lamblia
AAPYA

SEQ ID NO: 3048665 - protein, 11 aa, Giardia lamblia
AAQGNLAGSTV

SEQ ID NO: 3048666 - protein, 5 aa, Giardia lamblia
AAQGP

SEQ ID NO: 3048667 - protein, 16 aa, Giardia lamblia
AAQIGPGEDGGNSSAL

SEQ ID NO: 3048668 - protein, 5 aa, Giardia lamblia
AAQNG

SEQ ID NO: 3048669 - protein, 22 aa, Giardia lamblia
AAQQAESKDVELRPQGQQDISN

SEQ ID NO: 3048670 - protein, 5 aa, Giardia lamblia
AAQSG

SEQ ID NO: 3048671 - protein, 20 aa, Giardia lamblia
AAQSSANRHSSTTAAIHDED

SEQ ID NO: 3048672 - protein, 5 aa, Giardia lamblia
AAQTT

SEQ ID NO: 3048673 - protein, 11 aa, Giardia lamblia
AARADTAKTGI

SEQ ID NO: 3048674 - protein, 8 aa, Giardia lamblia
AARDPSAD

SEQ ID NO: 3048675 - protein, 11 aa, Giardia lamblia
AARDRGKGHST

SEQ ID NO: 3048676 - protein, 11 aa, Giardia lamblia
AAREERDRARN

SEQ ID NO: 3048677 - protein, 8 aa, Giardia lamblia
AARGADPS

SEQ ID NO: 3048678 - protein, 10 aa, Giardia lamblia
AARKRDPGQI

SEQ ID NO: 3048679 - protein, 10 aa, Giardia lamblia
AARLSDSTLT

SEQ ID NO: 3048680 - protein, 8 aa, Giardia lamblia
AARNKDRI

SEQ ID NO: 3048681 - protein, 4 aa, Giardia lamblia
AARP

SEQ ID NO: 3048682 - protein, 4 aa, Giardia lamblia
AARS

SEQ ID NO: 3048683 - protein, 8 aa, Giardia lamblia
AASAAEAT

SEQ ID NO: 3048684 - protein, 16 aa, Giardia lamblia
AASASSRGHRRQPLSL

SEQ ID NO: 3048685 - protein, 14 aa, Giardia lamblia
AASCEPSSSESGKT

SEQ ID NO: 3048686 - protein, 4 aa, Giardia lamblia
AASD

SEQ ID NO: 3048687 - protein, 10 aa, Giardia lamblia
AASDNSFASS

SEQ ID NO: 3048688 - protein, 11 aa, Giardia lamblia
AASDSAPSSTE

SEQ ID NO: 3048689 - protein, 6 aa, Giardia lamblia
AASDTL

SEQ ID NO: 3048690 - protein, 10 aa, Giardia lamblia
AASEADTADV

SEQ ID NO: 3048691 - protein, 17 aa, Giardia lamblia
AASERPKTAINTSSPIT

SEQ ID NO: 3048692 - protein, 9 aa, Giardia lamblia
AASGASAGT

SEQ ID NO: 3048693 - protein, 7 aa, Giardia lamblia
AASGETQ

SEQ ID NO: 3048694 - protein, 15 aa, Giardia lamblia
AASGSVSSALNTPSI

SEQ ID NO: 3048695 - protein, 11 aa, Giardia lamblia
AASKSNRSTMQ

SEQ ID NO: 3048696 - protein, 4 aa, Giardia lamblia
AASL

SEQ ID NO: 3048697 - protein, 12 aa, Giardia lamblia
AASNPNDGSSGA

SEQ ID NO: 3048698 - protein, 18 aa, Giardia lamblia
AASPALESELESTAVSDD

SEQ ID NO: 3048699 - protein, 8 aa, Giardia lamblia
AASPATFP

SEQ ID NO: 3048700 - protein, 7 aa, Giardia lamblia
AASPGGG

SEQ ID NO: 3048701 - protein, 8 aa, Giardia lamblia
AASPTPSL

SEQ ID NO: 3048702 - protein, 10 aa, Giardia lamblia
AASRKQEADT

SEQ ID NO: 3048703 - protein, 16 aa, Giardia lamblia
AASSANPWLPPADPAA

SEQ ID NO: 3048704 - protein, 6 aa, Giardia lamblia
AASSEK

SEQ ID NO: 3048705 - protein, 20 aa, Giardia lamblia
AASSRRKNAYIGKNTSPNTV

SEQ ID NO: 3048706 - protein, 7 aa, Giardia lamblia
AASSSFS

SEQ ID NO: 3048707 - protein, 11 aa, Giardia lamblia
AASSSNLPGTI

SEQ ID NO: 3048708 - protein, 4 aa, Giardia lamblia
AAST

SEQ ID NO: 3048709 - protein, 13 aa, Giardia lamblia
AASTAEHDTDEER

SEQ ID NO: 3048710 - protein, 20 aa, Giardia lamblia
AASTAKGKKPADIPETVPSN

SEQ ID NO: 3048711 - protein, 12 aa, Giardia lamblia
AASTEHTNGKIS

SEQ ID NO: 3048712 - protein, 7 aa, Giardia lamblia
AASTSIS

SEQ ID NO: 3048713 - protein, 4 aa, Giardia lamblia
AASY

SEQ ID NO: 3048714 - protein, 4 aa, Giardia lamblia
AATA

SEQ ID NO: 3048715 - protein, 7 aa, Giardia lamblia
AATAEGH

SEQ ID NO: 3048716 - protein, 12 aa, Giardia lamblia
AATAPSVSEDKS

SEQ ID NO: 3048717 - protein, 6 aa, Giardia lamblia
AATDVQ

SEQ ID NO: 3048718 - protein, 48 aa, Giardia lamblia
AATFAETRSFTSAETAKSAKAAFERSSRSTSRAGTGSRNGDKKPGNIS

SEQ ID NO: 3048719 - protein, 15 aa, Giardia lamblia
AATGDGSNDAPQLKA

SEQ ID NO: 3048720 - protein, 6 aa, Giardia lamblia
AATGHP

SEQ ID NO: 3048721 - protein, 12 aa, Giardia lamblia
AATGKRSSITQA

SEQ ID NO: 3048722 - protein, 9 aa, Giardia lamblia
AATHEPNPT

SEQ ID NO: 3048723 - protein, 9 aa, Giardia lamblia
AATKETEIE

SEQ ID NO: 3048724 - protein, 13 aa, Giardia lamblia
AATLPPPSKKNSC

SEQ ID NO: 3048725 - protein, 18 aa, Giardia lamblia
AATLPTEECADGSADPLT

SEQ ID NO: 3048726 - protein, 13 aa, Giardia lamblia
AATMPAQGDEHTL

SEQ ID NO: 3048727 - protein, 7 aa, Giardia lamblia
AATNGDY

SEQ ID NO: 3048728 - protein, 6 aa, Giardia lamblia
AATPAQ

SEQ ID NO: 3048729 - protein, 7 aa, Giardia lamblia
AATPPLS

SEQ ID NO: 3048730 - protein, 5 aa, Giardia lamblia
AATPV

SEQ ID NO: 3048731 - protein, 7 aa, Giardia lamblia
AATQTSR

SEQ ID NO: 3048732 - protein, 8 aa, Giardia lamblia
AATSSAAR

SEQ ID NO: 3048733 - protein, 6 aa, Giardia lamblia
AATTIR

SEQ ID NO: 3048734 - protein, 6 aa, Giardia lamblia
AATTTK

SEQ ID NO: 3048735 - protein, 7 aa, Giardia lamblia
AATTTNV

SEQ ID NO: 3048736 - protein, 4 aa, Giardia lamblia
AATV

SEQ ID NO: 3048737 - protein, 8 aa, Giardia lamblia
AATYAGSS

SEQ ID NO: 3048738 - protein, 16 aa, Giardia lamblia
AAVGGRSVGSDDSRRR

SEQ ID NO: 3048739 - protein, 11 aa, Giardia lamblia
AAVGSSSELKN

SEQ ID NO: 3048740 - protein, 5 aa, Giardia lamblia
AAVKG

SEQ ID NO: 3048741 - protein, 23 aa, Giardia lamblia
AAVPSGPEGPKQAEKVASDAKGL

SEQ ID NO: 3048742 - protein, 19 aa, Giardia lamblia
AAVQQAAAKEEANGAKSGC

SEQ ID NO: 3048743 - protein, 6 aa, Giardia lamblia
AAVSTT

SEQ ID NO: 3048744 - protein, 8 aa, Giardia lamblia
AAYGPAAD

SEQ ID NO: 3048745 - protein, 13 aa, Giardia lamblia
AAYGTAKAGSGLG

SEQ ID NO: 3048746 - protein, 11 aa, Giardia lamblia
AAYREGVPGNQ

SEQ ID NO: 3048747 - protein, 15 aa, Giardia lamblia
ACEDPTACGGTSGAC

SEQ ID NO: 3048748 - protein, 17 aa, Giardia lamblia
ACEGASSAEANLYDDEP

SEQ ID NO: 3048749 - protein, 8 aa, Giardia lamblia
ACPASDAS

SEQ ID NO: 3048750 - protein, 4 aa, Giardia lamblia
ACPD

SEQ ID NO: 3048751 - protein, 5 aa, Giardia lamblia
ACPEN

SEQ ID NO: 3048752 - protein, 8 aa, Giardia lamblia
ACRQNDGA

SEQ ID NO: 3048753 - protein, 6 aa, Giardia lamblia
ACSSGQ

SEQ ID NO: 3048754 - protein, 6 aa, Giardia lamblia
ACTGCK

SEQ ID NO: 3048755 - protein, 13 aa, Giardia lamblia
ACTNNNKPNLAGS

SEQ ID NO: 3048756 - protein, 25 aa, Giardia lamblia
ACTTRGGAYGGDPVGRTAQEGRCET

SEQ ID NO: 3048757 - protein, 23 aa, Giardia lamblia
ACYEEGSGPYSVSPYYDQNGQEV

SEQ ID NO: 3048758 - protein, 5 aa, Giardia lamblia
ADAAE

SEQ ID NO: 3048759 - protein, 13 aa, Giardia lamblia
ADAANDSKPPLSR

SEQ ID NO: 3048760 - protein, 5 aa, Giardia lamblia
ADADA

SEQ ID NO: 3048761 - protein, 21 aa, Giardia lamblia
ADADMGSGGDEVKKGSGNDGF

SEQ ID NO: 3048762 - protein, 23 aa, Giardia lamblia
ADADPTCGGHGTCNSGTCTCNEG

SEQ ID NO: 3048763 - protein, 5 aa, Giardia lamblia
ADAGN

SEQ ID NO: 3048764 - protein, 7 aa, Giardia lamblia
ADANHGP

SEQ ID NO: 3048765 - protein, 7 aa, Giardia lamblia
ADAPRRV

SEQ ID NO: 3048766 - protein, 4 aa, Giardia lamblia
ADAS

SEQ ID NO: 3048767 - protein, 8 aa, Giardia lamblia
ADASSPDA

SEQ ID NO: 3048768 - protein, 7 aa, Giardia lamblia
ADATTLD

SEQ ID NO: 3048769 - protein, 5 aa, Giardia lamblia
ADDCT

SEQ ID NO: 3048770 - protein, 6 aa, Giardia lamblia
ADDDAY

SEQ ID NO: 3048771 - protein, 8 aa, Giardia lamblia
ADDDEEVV

SEQ ID NO: 3048772 - protein, 11 aa, Giardia lamblia
ADDDTKDEASI

SEQ ID NO: 3048773 - protein, 4 aa, Giardia lamblia
ADDP

SEQ ID NO: 3048774 - protein, 6 aa, Giardia lamblia
ADDPLD

SEQ ID NO: 3048775 - protein, 7 aa, Giardia lamblia
ADDPVKD

SEQ ID NO: 3048776 - protein, 7 aa, Giardia lamblia
ADDQKRT

SEQ ID NO: 3048777 - protein, 13 aa, Giardia lamblia
ADDSVDASGKMNA

SEQ ID NO: 3048778 - protein, 19 aa, Giardia lamblia
ADDSVSEEPPASPSRITQS

SEQ ID NO: 3048779 - protein, 16 aa, Giardia lamblia
ADDTGDSDVDQTPGKK

SEQ ID NO: 3048780 - protein, 6 aa, Giardia lamblia
ADDTSK

SEQ ID NO: 3048781 - protein, 4 aa, Giardia lamblia
ADDV

SEQ ID NO: 3048782 - protein, 19 aa, Giardia lamblia
ADECSGSLSAGALSGISAP

SEQ ID NO: 3048783 - protein, 8 aa, Giardia lamblia
ADEDDDLS

SEQ ID NO: 3048784 - protein, 4 aa, Giardia lamblia
ADEE

SEQ ID NO: 3048785 - protein, 6 aa, Giardia lamblia
ADEIGE

SEQ ID NO: 3048786 - protein, 26 aa, Giardia lamblia
ADEQTMPLRSTSARLKTYSTNTDTHV

SEQ ID NO: 3048787 - protein, 14 aa, Giardia lamblia
ADESGIHSESLGRN

SEQ ID NO: 3048788 - protein, 5 aa, Giardia lamblia
ADESQ

SEQ ID NO: 3048789 - protein, 8 aa, Giardia lamblia
ADETKNSE

SEQ ID NO: 3048790 - protein, 4 aa, Giardia lamblia
ADGA

SEQ ID NO: 3048791 - protein, 5 aa, Giardia lamblia
ADGDM

SEQ ID NO: 3048792 - protein, 11 aa, Giardia lamblia
ADGGGEGEVQE

SEQ ID NO: 3048793 - protein, 20 aa, Giardia lamblia
ADGGKCVDTTDEYNINSKGE

SEQ ID NO: 3048794 - protein, 14 aa, Giardia lamblia
ADGLNAASSRPNNS

SEQ ID NO: 3048795 - protein, 8 aa, Giardia lamblia
ADGNRYEA

SEQ ID NO: 3048796 - protein, 31 aa, Giardia lamblia
ADGPSKTAVSECQSPGNAAAHSPWRQPQSDS

SEQ ID NO: 3048797 - protein, 4 aa, Giardia lamblia
ADGS

SEQ ID NO: 3048798 - protein, 5 aa, Giardia lamblia
ADGSL

SEQ ID NO: 3048799 - protein, 5 aa, Giardia lamblia
ADGSV

SEQ ID NO: 3048800 - protein, 8 aa, Giardia lamblia
ADGTAKGL

SEQ ID NO: 3048801 - protein, 6 aa, Giardia lamblia
ADGYEL

SEQ ID NO: 3048802 - protein, 14 aa, Giardia lamblia
ADIGAKDESSQLDA

SEQ ID NO: 3048803 - protein, 13 aa, Giardia lamblia
ADINTSSTSFSGT

SEQ ID NO: 3048804 - protein, 5 aa, Giardia lamblia
ADKAV

SEQ ID NO: 3048805 - protein, 12 aa, Giardia lamblia
ADKGLSSAEHSQ

SEQ ID NO: 3048806 - protein, 5 aa, Giardia lamblia
ADKKE

SEQ ID NO: 3048807 - protein, 11 aa, Giardia lamblia
ADKNTGKYKNS

SEQ ID NO: 3048808 - protein, 7 aa, Giardia lamblia
ADKQYYR

SEQ ID NO: 3048809 - protein, 4 aa, Giardia lamblia
ADKS

SEQ ID NO: 3048810 - protein, 10 aa, Giardia lamblia
ADLSSSGSGV

SEQ ID NO: 3048811 - protein, 5 aa, Giardia lamblia
ADLTK

SEQ ID NO: 3048812 - protein, 8 aa, Giardia lamblia
ADLTKPDV

SEQ ID NO: 3048813 - protein, 5 aa, Giardia lamblia
ADMEQ

SEQ ID NO: 3048814 - protein, 13 aa, Giardia lamblia
ADNCGTEENTSVG

SEQ ID NO: 3048815 - protein, 9 aa, Giardia lamblia
ADNGPQTPL

SEQ ID NO: 3048816 - protein, 5 aa, Giardia lamblia
ADNLE

SEQ ID NO: 3048817 - protein, 4 aa, Giardia lamblia
ADNP

SEQ ID NO: 3048818 - protein, 7 aa, Giardia lamblia
ADNPNPL

SEQ ID NO: 3048819 - protein, 14 aa, Giardia lamblia
ADNSCNTGGECSCT

SEQ ID NO: 3048820 - protein, 8 aa, Giardia lamblia
ADNSGTLR

SEQ ID NO: 3048821 - protein, 58 aa, Giardia lamblia
ADNSNADEKPEDHSEDREQSSIEPEEQSSNMPIDEPTENAQDELKTDEAQGTNVLPPD

SEQ ID NO: 3048822 - protein, 12 aa, Giardia lamblia
ADNTCKDGCTGL

SEQ ID NO: 3048823 - protein, 10 aa, Giardia lamblia
ADNTDPSSHY

SEQ ID NO: 3048824 - protein, 5 aa, Giardia lamblia
ADPAA

SEQ ID NO: 3048825 - protein, 18 aa, Giardia lamblia
ADPDPSSIPTPKPVRPPI

SEQ ID NO: 3048826 - protein, 9 aa, Giardia lamblia
ADPDSTSLI

SEQ ID NO: 3048827 - protein, 17 aa, Giardia lamblia
ADPESLPSEDTPQDTCQ

SEQ ID NO: 3048828 - protein, 5 aa, Giardia lamblia
ADPIR

SEQ ID NO: 3048829 - protein, 12 aa, Giardia lamblia
ADPKGSREYPTK

SEQ ID NO: 3048830 - protein, 9 aa, Giardia lamblia
ADPLAKANS

SEQ ID NO: 3048831 - protein, 7 aa, Giardia lamblia
ADPNKSL

SEQ ID NO: 3048832 - protein, 9 aa, Giardia lamblia
ADPPDGDSV

SEQ ID NO: 3048833 - protein, 6 aa, Giardia lamblia
ADPPND

SEQ ID NO: 3048834 - protein, 8 aa, Giardia lamblia
ADPPPPTN

SEQ ID NO: 3048835 - protein, 6 aa, Giardia lamblia
ADPQAV

SEQ ID NO: 3048836 - protein, 9 aa, Giardia lamblia
ADPQSSDFV

SEQ ID NO: 3048837 - protein, 7 aa, Giardia lamblia
ADPRNLY

SEQ ID NO: 3048838 - protein, 14 aa, Giardia lamblia
ADPSESVADPLKDR

SEQ ID NO: 3048839 - protein, 6 aa, Giardia lamblia
ADPSSD

SEQ ID NO: 3048840 - protein, 7 aa, Giardia lamblia
ADPTSLD

SEQ ID NO: 3048841 - protein, 12 aa, Giardia lamblia
ADPTVAKREMEQ

SEQ ID NO: 3048842 - protein, 7 aa, Giardia lamblia
ADPVGAE

SEQ ID NO: 3048843 - protein, 8 aa, Giardia lamblia
ADQEAGAF

SEQ ID NO: 3048844 - protein, 6 aa, Giardia lamblia
ADQKGN

SEQ ID NO: 3048845 - protein, 9 aa, Giardia lamblia
ADQRYSKYR

SEQ ID NO: 3048846 - protein, 6 aa, Giardia lamblia
ADQSGI

SEQ ID NO: 3048847 - protein, 5 aa, Giardia lamblia
ADQSH

SEQ ID NO: 3048848 - protein, 25 aa, Giardia lamblia
ADQSPSKPASPKKAKHKAAKDQQEY

SEQ ID NO: 3048849 - protein, 4 aa, Giardia lamblia
ADQY

SEQ ID NO: 3048850 - protein, 18 aa, Giardia lamblia
ADRAAEKSSANPSPSKEI

SEQ ID NO: 3048851 - protein, 7 aa, Giardia lamblia
ADRDPSH

SEQ ID NO: 3048852 - protein, 7 aa, Giardia lamblia
ADRDTAQ

SEQ ID NO: 3048853 - protein, 5 aa, Giardia lamblia
ADRGK

SEQ ID NO: 3048854 - protein, 6 aa, Giardia lamblia
ADRGSA

SEQ ID NO: 3048855 - protein, 8 aa, Giardia lamblia
ADRIGAGS

SEQ ID NO: 3048856 - protein, 8 aa, Giardia lamblia
ADRTTKRG

SEQ ID NO: 3048857 - protein, 7 aa, Giardia lamblia
ADSAEER

SEQ ID NO: 3048858 - protein, 31 aa, Giardia lamblia
ADSASTQPDESTNSSSTASDESDGSRGEDGS

SEQ ID NO: 3048859 - protein, 12 aa, Giardia lamblia
ADSDASQASSMN

SEQ ID NO: 3048860 - protein, 10 aa, Giardia lamblia
ADSNARRRQL

SEQ ID NO: 3048861 - protein, 7 aa, Giardia lamblia
ADSPVQK

SEQ ID NO: 3048862 - protein, 9 aa, Giardia lamblia
ADSQANSFS

SEQ ID NO: 3048863 - protein, 8 aa, Giardia lamblia
ADSRNLEK

SEQ ID NO: 3048864 - protein, 10 aa, Giardia lamblia
ADSSHPKRQE

SEQ ID NO: 3048865 - protein, 7 aa, Giardia lamblia
ADSSKTE

SEQ ID NO: 3048866 - protein, 18 aa, Giardia lamblia
ADSSMTNVDENLGSSVGG

SEQ ID NO: 3048867 - protein, 8 aa, Giardia lamblia
ADSSSSGV

SEQ ID NO: 3048868 - protein, 6 aa, Giardia lamblia
ADSSTL

SEQ ID NO: 3048869 - protein, 30 aa, Giardia lamblia
ADSSTNAITNSEHNSSVQSNTQSNAKASKY

SEQ ID NO: 3048870 - protein, 11 aa, Giardia lamblia
ADSTATHGKVS

SEQ ID NO: 3048871 - protein, 9 aa, Giardia lamblia
ADSTCGGTG

SEQ ID NO: 3048872 - protein, 7 aa, Giardia lamblia
ADSTEVS

SEQ ID NO: 3048873 - protein, 5 aa, Giardia lamblia
ADSVE

SEQ ID NO: 3048874 - protein, 8 aa, Giardia lamblia
ADSVSAAL

SEQ ID NO: 3048875 - protein, 7 aa, Giardia lamblia
ADSYNTR

SEQ ID NO: 3048876 - protein, 10 aa, Giardia lamblia
ADTAEQSQAR

SEQ ID NO: 3048877 - protein, 10 aa, Giardia lamblia
ADTAFTTNST

SEQ ID NO: 3048878 - protein, 10 aa, Giardia lamblia
ADTATKESIG

SEQ ID NO: 3048879 - protein, 11 aa, Giardia lamblia
ADTDAPYYKAT

SEQ ID NO: 3048880 - protein, 15 aa, Giardia lamblia
ADTDYLQKKETGTDL

SEQ ID NO: 3048881 - protein, 12 aa, Giardia lamblia
ADTESDNISVSN

SEQ ID NO: 3048882 - protein, 4 aa, Giardia lamblia
ADTF

SEQ ID NO: 3048883 - protein, 5 aa, Giardia lamblia
ADTKR

SEQ ID NO: 3048884 - protein, 5 aa, Giardia lamblia
ADTNV

SEQ ID NO: 3048885 - protein, 5 aa, Giardia lamblia
ADTPK

SEQ ID NO: 3048886 - protein, 8 aa, Giardia lamblia
ADTPSEAS

SEQ ID NO: 3048887 - protein, 6 aa, Giardia lamblia
ADTQLP

SEQ ID NO: 3048888 - protein, 12 aa, Giardia lamblia
ADTQRGLPKTLT

SEQ ID NO: 3048889 - protein, 8 aa, Giardia lamblia
ADTSDTTE

SEQ ID NO: 3048890 - protein, 9 aa, Giardia lamblia
ADTSPLSSK

SEQ ID NO: 3048891 - protein, 4 aa, Giardia lamblia
ADTT

SEQ ID NO: 3048892 - protein, 4 aa, Giardia lamblia
ADTV

SEQ ID NO: 3048893 - protein, 4 aa, Giardia lamblia
ADVA

SEQ ID NO: 3048894 - protein, 9 aa, Giardia lamblia
ADVSEEASF

SEQ ID NO: 3048895 - protein, 12 aa, Giardia lamblia
ADVSQRRNVPSQ

SEQ ID NO: 3048896 - protein, 6 aa, Giardia lamblia
ADYASQ

SEQ ID NO: 3048897 - protein, 6 aa, Giardia lamblia
ADYNPR

SEQ ID NO: 3048898 - protein, 7 aa, Giardia lamblia
ADYPSPQ

SEQ ID NO: 3048899 - protein, 8 aa, Giardia lamblia
ADYQETTN

SEQ ID NO: 3048900 - protein, 6 aa, Giardia lamblia
ADYSPL

SEQ ID NO: 3048901 - protein, 15 aa, Giardia lamblia
ADYTKPQTSSDDPHA

SEQ ID NO: 3048902 - protein, 5 aa, Giardia lamblia
ADYTP

SEQ ID NO: 3048903 - protein, 7 aa, Giardia lamblia
AEAADQY

SEQ ID NO: 3048904 - protein, 8 aa, Giardia lamblia
AEAAPPTS

SEQ ID NO: 3048905 - protein, 14 aa, Giardia lamblia
AEAARSCQAQSEAR

SEQ ID NO: 3048906 - protein, 8 aa, Giardia lamblia
AEADASPN

SEQ ID NO: 3048907 - protein, 7 aa, Giardia lamblia
AEAPPGS

SEQ ID NO: 3048908 - protein, 4 aa, Giardia lamblia
AEAQ

SEQ ID NO: 3048909 - protein, 9 aa, Giardia lamblia
AEAQGSIDQ

SEQ ID NO: 3048910 - protein, 11 aa, Giardia lamblia
AEASKGSVDPR

SEQ ID NO: 3048911 - protein, 10 aa, Giardia lamblia
AEASTSANVR

SEQ ID NO: 3048912 - protein, 8 aa, Giardia lamblia
AEATDSQQ

SEQ ID NO: 3048913 - protein, 9 aa, Giardia lamblia
AEATGVPGS

SEQ ID NO: 3048914 - protein, 21 aa, Giardia lamblia
AEATKEREGRTSALAAADKSA

SEQ ID NO: 3048915 - protein, 5 aa, Giardia lamblia
AECAT

SEQ ID NO: 3048916 - protein, 8 aa, Giardia lamblia
AECDAGSS

SEQ ID NO: 3048917 - protein, 7 aa, Giardia lamblia
AECDPQS

SEQ ID NO: 3048918 - protein, 34 aa, Giardia lamblia
AEDASQRLGPLSTQTSFDGSRSVLSSKKDTSDDL

SEQ ID NO: 3048919 - protein, 9 aa, Giardia lamblia
AEDDEKQGH

SEQ ID NO: 3048920 - protein, 8 aa, Giardia lamblia
AEDDQENV

SEQ ID NO: 3048921 - protein, 6 aa, Giardia lamblia
AEDEHA

SEQ ID NO: 3048922 - protein, 14 aa, Giardia lamblia
AEDSARHTDEGDAD

SEQ ID NO: 3048923 - protein, 6 aa, Giardia lamblia
AEDVQE

SEQ ID NO: 3048924 - protein, 8 aa, Giardia lamblia
AEEAEDLS

SEQ ID NO: 3048925 - protein, 7 aa, Giardia lamblia
AEEAYSQ

SEQ ID NO: 3048926 - protein, 6 aa, Giardia lamblia
AEEDGV

SEQ ID NO: 3048927 - protein, 6 aa, Giardia lamblia
AEEELQ

SEQ ID NO: 3048928 - protein, 5 aa, Giardia lamblia
AEEGR

SEQ ID NO: 3048929 - protein, 5 aa, Giardia lamblia
AEEKT

SEQ ID NO: 3048930 - protein, 6 aa, Giardia lamblia
AEEKTL

SEQ ID NO: 3048931 - protein, 6 aa, Giardia lamblia
AEELRS

SEQ ID NO: 3048932 - protein, 6 aa, Giardia lamblia
AEEQGT

SEQ ID NO: 3048933 - protein, 5 aa, Giardia lamblia
AEERI

SEQ ID NO: 3048934 - protein, 12 aa, Giardia lamblia
AEGAPAKSLDDE

SEQ ID NO: 3048935 - protein, 9 aa, Giardia lamblia
AEGDRSNAI

SEQ ID NO: 3048936 - protein, 11 aa, Giardia lamblia
AEGGDTENAKY

SEQ ID NO: 3048937 - protein, 8 aa, Giardia lamblia
AEGGEQMA

SEQ ID NO: 3048938 - protein, 11 aa, Giardia lamblia
AEGGLTSSIGQ

SEQ ID NO: 3048939 - protein, 8 aa, Giardia lamblia
AEGHTSNY

SEQ ID NO: 3048940 - protein, 4 aa, Giardia lamblia
AEGI

SEQ ID NO: 3048941 - protein, 11 aa, Giardia lamblia
AEGISTGTIPS

SEQ ID NO: 3048942 - protein, 15 aa, Giardia lamblia
AEGITPKDMPPGVER

SEQ ID NO: 3048943 - protein, 15 aa, Giardia lamblia
AEGLQPGPGVEKVPD

SEQ ID NO: 3048944 - protein, 19 aa, Giardia lamblia
AEGQQKGGDGASSGSSGSY

SEQ ID NO: 3048945 - protein, 9 aa, Giardia lamblia
AEGQSEVTE

SEQ ID NO: 3048946 - protein, 6 aa, Giardia lamblia
AEGRNK

SEQ ID NO: 3048947 - protein, 7 aa, Giardia lamblia
AEGSEYY

SEQ ID NO: 3048948 - protein, 4 aa, Giardia lamblia
AEHE

SEQ ID NO: 3048949 - protein, 7 aa, Giardia lamblia
AEHEVAD

SEQ ID NO: 3048950 - protein, 61 aa, Giardia lamblia
AEIEADNTITDTGPIYGDNDEEDVPLDPVPDPQPNPNPDVPPNPPGPGAVTKKQSGAAIGG

SEQ ID NO: 3048951 - protein, 16 aa, Giardia lamblia
AEKANTPSKSLSGGMR

SEQ ID NO: 3048952 - protein, 7 aa, Giardia lamblia
AEKHHKC

SEQ ID NO: 3048953 - protein, 11 aa, Giardia lamblia
AEKNDKDNNNC

SEQ ID NO: 3048954 - protein, 7 aa, Giardia lamblia
AEKQKYC

SEQ ID NO: 3048955 - protein, 10 aa, Giardia lamblia
AEKRAHGFGQ

SEQ ID NO: 3048956 - protein, 5 aa, Giardia lamblia
AEKVV

SEQ ID NO: 3048957 - protein, 10 aa, Giardia lamblia
AELGEGGETL

SEQ ID NO: 3048958 - protein, 10 aa, Giardia lamblia
AELRGKDPCA

SEQ ID NO: 3048959 - protein, 12 aa, Giardia lamblia
AELSDPDSIRSQ

SEQ ID NO: 3048960 - protein, 5 aa, Giardia lamblia
AELTG

SEQ ID NO: 3048961 - protein, 4 aa, Giardia lamblia
AEMP

SEQ ID NO: 3048962 - protein, 10 aa, Giardia lamblia
AEMSGPDDPY

SEQ ID NO: 3048963 - protein, 8 aa, Giardia lamblia
AENERDSI

SEQ ID NO: 3048964 - protein, 9 aa, Giardia lamblia
AENKPADYA

SEQ ID NO: 3048965 - protein, 8 aa, Giardia lamblia
AENPNMPR

SEQ ID NO: 3048966 - protein, 8 aa, Giardia lamblia
AENPQTKQ

SEQ ID NO: 3048967 - protein, 6 aa, Giardia lamblia
AENRAS

SEQ ID NO: 3048968 - protein, 12 aa, Giardia lamblia
AENSTMKKALDE

SEQ ID NO: 3048969 - protein, 5 aa, Giardia lamblia
AENVS

SEQ ID NO: 3048970 - protein, 7 aa, Giardia lamblia
AEPDDSM

SEQ ID NO: 3048971 - protein, 5 aa, Giardia lamblia
AEPIQ

SEQ ID NO: 3048972 - protein, 7 aa, Giardia lamblia
AEPNSVE

SEQ ID NO: 3048973 - protein, 5 aa, Giardia lamblia
AEPPV

SEQ ID NO: 3048974 - protein, 12 aa, Giardia lamblia
AEPSKKNVPRPV

SEQ ID NO: 3048975 - protein, 9 aa, Giardia lamblia
AEPSSEPYI

SEQ ID NO: 3048976 - protein, 19 aa, Giardia lamblia
AEPTGAPTLSSSAPLMPPD

SEQ ID NO: 3048977 - protein, 9 aa, Giardia lamblia
AEPTTKPTR

SEQ ID NO: 3048978 - protein, 12 aa, Giardia lamblia
AEPYPSPLPPEK

SEQ ID NO: 3048979 - protein, 42 aa, Giardia lamblia
AEQDSTTSDSVLNTSSSNSDSQQALESNSRSVSPGTDTPESI

SEQ ID NO: 3048980 - protein, 14 aa, Giardia lamblia
AEQEAAASILDSAS

SEQ ID NO: 3048981 - protein, 10 aa, Giardia lamblia
AEQESTSDDE

SEQ ID NO: 3048982 - protein, 7 aa, Giardia lamblia
AEQNRPD

SEQ ID NO: 3048983 - protein, 14 aa, Giardia lamblia
AEQPDNAAGEGSQK

SEQ ID NO: 3048984 - protein, 7 aa, Giardia lamblia
AEQTSVL

SEQ ID NO: 3048985 - protein, 8 aa, Giardia lamblia
AEQVATEK

SEQ ID NO: 3048986 - protein, 12 aa, Giardia lamblia
AERASGTTRAGK

SEQ ID NO: 3048987 - protein, 4 aa, Giardia lamblia
AERF

SEQ ID NO: 3048988 - protein, 4 aa, Giardia lamblia
AERG

SEQ ID NO: 3048989 - protein, 8 aa, Giardia lamblia
AERHDSRS

SEQ ID NO: 3048990 - protein, 22 aa, Giardia lamblia
AESADDDATGSSEKEAQEEDNC

SEQ ID NO: 3048991 - protein, 13 aa, Giardia lamblia
AESAPKPSKSYTS

SEQ ID NO: 3048992 - protein, 16 aa, Giardia lamblia
AESDHSNPSQAPQRVP

SEQ ID NO: 3048993 - protein, 13 aa, Giardia lamblia
AESGMRSTDGQSY

SEQ ID NO: 3048994 - protein, 6 aa, Giardia lamblia
AESIAG

SEQ ID NO: 3048995 - protein, 10 aa, Giardia lamblia
AESKAEKRSA

SEQ ID NO: 3048996 - protein, 27 aa, Giardia lamblia
AESLNPKVAHSTGSSTGSSTLSRGPNY

SEQ ID NO: 3048997 - protein, 6 aa, Giardia lamblia
AESPKL

SEQ ID NO: 3048998 - protein, 11 aa, Giardia lamblia
AESQQEGSEHE

SEQ ID NO: 3048999 - protein, 9 aa, Giardia lamblia
AESSASGKL

SEQ ID NO: 3049000 - protein, 10 aa, Giardia lamblia
AESSRGRGRC

SEQ ID NO: 3049001 - protein, 33 aa, Giardia lamblia
AESTATSSIRASNVQSRVSRTKNQSLSASFSAT

SEQ ID NO: 3049002 - protein, 8 aa, Giardia lamblia
AESTKDRK

SEQ ID NO: 3049003 - protein, 8 aa, Giardia lamblia
AESVEPKD

SEQ ID NO: 3049004 - protein, 9 aa, Giardia lamblia
AESYSETGG

SEQ ID NO: 3049005 - protein, 4 aa, Giardia lamblia
AETA

SEQ ID NO: 3049006 - protein, 6 aa, Giardia lamblia
AETAGF

SEQ ID NO: 3049007 - protein, 18 aa, Giardia lamblia
AETGDTYEMDKAKNAPIK

SEQ ID NO: 3049008 - protein, 4 aa, Giardia lamblia
AETL

SEQ ID NO: 3049009 - protein, 4 aa, Giardia lamblia
AETR

SEQ ID NO: 3049010 - protein, 7 aa, Giardia lamblia
AETRIGP

SEQ ID NO: 3049011 - protein, 6 aa, Giardia lamblia
AETTGK

SEQ ID NO: 3049012 - protein, 5 aa, Giardia lamblia
AETVR

SEQ ID NO: 3049013 - protein, 6 aa, Giardia lamblia
AEVRTD

SEQ ID NO: 3049014 - protein, 4 aa, Giardia lamblia
AEVT

SEQ ID NO: 3049015 - protein, 4 aa, Giardia lamblia
AEYD

SEQ ID NO: 3049016 - protein, 6 aa, Giardia lamblia
AEYDTP

SEQ ID NO: 3049017 - protein, 6 aa, Giardia lamblia
AFAPKN

SEQ ID NO: 3049018 - protein, 4 aa, Giardia lamblia
AFNA

SEQ ID NO: 3049019 - protein, 26 aa, Giardia lamblia
AFNGTAGPTAPSGASHENGPPTEEEL

SEQ ID NO: 3049020 - protein, 12 aa, Giardia lamblia
AFPAPAPTSESA

SEQ ID NO: 3049021 - protein, 9 aa, Giardia lamblia
AFPPDAPEA

SEQ ID NO: 3049022 - protein, 5 aa, Giardia lamblia
AFPPE

SEQ ID NO: 3049023 - protein, 6 aa, Giardia lamblia
AFPRTT

SEQ ID NO: 3049024 - protein, 8 aa, Giardia lamblia
AFQGPSRT

SEQ ID NO: 3049025 - protein, 6 aa, Giardia lamblia
AFQTTY

SEQ ID NO: 3049026 - protein, 4 aa, Giardia lamblia
AFRP

SEQ ID NO: 3049027 - protein, 9 aa, Giardia lamblia
AFSANTGTD

SEQ ID NO: 3049028 - protein, 10 aa, Giardia lamblia
AFSGIGSSLE

SEQ ID NO: 3049029 - protein, 5 aa, Giardia lamblia
AFSGQ

SEQ ID NO: 3049030 - protein, 9 aa, Giardia lamblia
AFSKSNRSI

SEQ ID NO: 3049031 - protein, 12 aa, Giardia lamblia
AFSSQKSDAGIS

SEQ ID NO: 3049032 - protein, 6 aa, Giardia lamblia
AFTPQT

SEQ ID NO: 3049033 - protein, 6 aa, Giardia lamblia
AFTSTT

SEQ ID NO: 3049034 - protein, 9 aa, Giardia lamblia
AGAAPDNGP

SEQ ID NO: 3049035 - protein, 8 aa, Giardia lamblia
AGAEEYDE

SEQ ID NO: 3049036 - protein, 5 aa, Giardia lamblia
AGAET

SEQ ID NO: 3049037 - protein, 5 aa, Giardia lamblia
AGAGD

SEQ ID NO: 3049038 - protein, 6 aa, Giardia lamblia
AGAGTL

SEQ ID NO: 3049039 - protein, 10 aa, Giardia lamblia
AGAKSAHALE

SEQ ID NO: 3049040 - protein, 9 aa, Giardia lamblia
AGAQCTSCE

SEQ ID NO: 3049041 - protein, 8 aa, Giardia lamblia
AGAQKLTT

SEQ ID NO: 3049042 - protein, 5 aa, Giardia lamblia
AGARC

SEQ ID NO: 3049043 - protein, 5 aa, Giardia lamblia
AGARF

SEQ ID NO: 3049044 - protein, 12 aa, Giardia lamblia
AGASSAPAPVVQ

SEQ ID NO: 3049045 - protein, 6 aa, Giardia lamblia
AGATAG

SEQ ID NO: 3049046 - protein, 7 aa, Giardia lamblia
AGAVEGV

SEQ ID NO: 3049047 - protein, 13 aa, Giardia lamblia
AGAYPNSLPPETG

SEQ ID NO: 3049048 - protein, 7 aa, Giardia lamblia
AGCKGAD

SEQ ID NO: 3049049 - protein, 7 aa, Giardia lamblia
AGDAAEV

SEQ ID NO: 3049050 - protein, 7 aa, Giardia lamblia
AGDEVSG

SEQ ID NO: 3049051 - protein, 11 aa, Giardia lamblia
AGDGASANAIT

SEQ ID NO: 3049052 - protein, 7 aa, Giardia lamblia
AGDHTPA

SEQ ID NO: 3049053 - protein, 4 aa, Giardia lamblia
AGDN

SEQ ID NO: 3049054 - protein, 6 aa, Giardia lamblia
AGDSSQ

SEQ ID NO: 3049055 - protein, 14 aa, Giardia lamblia
AGDTGTREPSDAVR

SEQ ID NO: 3049056 - protein, 7 aa, Giardia lamblia
AGDTQRV

SEQ ID NO: 3049057 - protein, 5 aa, Giardia lamblia
AGDTS

SEQ ID NO: 3049058 - protein, 6 aa, Giardia lamblia
AGDTTA

SEQ ID NO: 3049059 - protein, 21 aa, Giardia lamblia
AGEDKTNELQDEPLTEAEDDT

SEQ ID NO: 3049060 - protein, 8 aa, Giardia lamblia
AGEEERAR

SEQ ID NO: 3049061 - protein, 5 aa, Giardia lamblia
AGEFG

SEQ ID NO: 3049062 - protein, 13 aa, Giardia lamblia
AGEPIGAPCNGRG

SEQ ID NO: 3049063 - protein, 6 aa, Giardia lamblia
AGERLA

SEQ ID NO: 3049064 - protein, 27 aa, Giardia lamblia
AGERYKRSSKVGSRGGASSTRRCPTAG

SEQ ID NO: 3049065 - protein, 10 aa, Giardia lamblia
AGETGSSNKE

SEQ ID NO: 3049066 - protein, 7 aa, Giardia lamblia
AGFGSSV

SEQ ID NO: 3049067 - protein, 5 aa, Giardia lamblia
AGFPH

SEQ ID NO: 3049068 - protein, 21 aa, Giardia lamblia
AGGDTELLTSDSRNNSPGHGV

SEQ ID NO: 3049069 - protein, 22 aa, Giardia lamblia
AGGENESKLTGDNTTPPSVTTR

SEQ ID NO: 3049070 - protein, 5 aa, Giardia lamblia
AGGGT

SEQ ID NO: 3049071 - protein, 4 aa, Giardia lamblia
AGGI

SEQ ID NO: 3049072 - protein, 6 aa, Giardia lamblia
AGGIGG

SEQ ID NO: 3049073 - protein, 11 aa, Giardia lamblia
AGGKGARTSSE

SEQ ID NO: 3049074 - protein, 8 aa, Giardia lamblia
AGGPAGTC

SEQ ID NO: 3049075 - protein, 8 aa, Giardia lamblia
AGGPEDTI

SEQ ID NO: 3049076 - protein, 5 aa, Giardia lamblia
AGGVP

SEQ ID NO: 3049077 - protein, 7 aa, Giardia lamblia
AGGVSLT

SEQ ID NO: 3049078 - protein, 5 aa, Giardia lamblia
AGHRP

SEQ ID NO: 3049079 - protein, 11 aa, Giardia lamblia
AGHTQVDPGTV

SEQ ID NO: 3049080 - protein, 8 aa, Giardia lamblia
AGIHDNDG

SEQ ID NO: 3049081 - protein, 8 aa, Giardia lamblia
AGIQQSDG

SEQ ID NO: 3049082 - protein, 8 aa, Giardia lamblia
AGIQTKEG

SEQ ID NO: 3049083 - protein, 9 aa, Giardia lamblia
AGKDADEVA

SEQ ID NO: 3049084 - protein, 6 aa, Giardia lamblia
AGKDQV

SEQ ID NO: 3049085 - protein, 12 aa, Giardia lamblia
AGKEGTQAANSA

SEQ ID NO: 3049086 - protein, 8 aa, Giardia lamblia
AGKHTKES

SEQ ID NO: 3049087 - protein, 10 aa, Giardia lamblia
AGKIYSSGSL

SEQ ID NO: 3049088 - protein, 8 aa, Giardia lamblia
AGKPPTIL

SEQ ID NO: 3049089 - protein, 8 aa, Giardia lamblia
AGKQMKNG

SEQ ID NO: 3049090 - protein, 5 aa, Giardia lamblia
AGKSA

SEQ ID NO: 3049091 - protein, 5 aa, Giardia lamblia
AGKST

SEQ ID NO: 3049092 - protein, 6 aa, Giardia lamblia
AGKSTS

SEQ ID NO: 3049093 - protein, 10 aa, Giardia lamblia
AGKTGNQKPF

SEQ ID NO: 3049094 - protein, 13 aa, Giardia lamblia
AGKTRLNDTTNAK

SEQ ID NO: 3049095 - protein, 23 aa, Giardia lamblia
AGLCNAEGKTAGTLANEQGNTQI

SEQ ID NO: 3049096 - protein, 19 aa, Giardia lamblia
AGLKGRPHRSASASTSVQG

SEQ ID NO: 3049097 - protein, 4 aa, Giardia lamblia
AGLN

SEQ ID NO: 3049098 - protein, 5 aa, Giardia lamblia
AGLQN

SEQ ID NO: 3049099 - protein, 42 aa, Giardia lamblia
AGLSGDQTQQASPLRDKDKKKQPADPKKPSGATTEVDGAVSP

SEQ ID NO: 3049100 - protein, 9 aa, Giardia lamblia
AGMADSCGN

SEQ ID NO: 3049101 - protein, 5 aa, Giardia lamblia
AGMPS

SEQ ID NO: 3049102 - protein, 8 aa, Giardia lamblia
AGMQTDSG

SEQ ID NO: 3049103 - protein, 11 aa, Giardia lamblia
AGMQTRDIPPY

SEQ ID NO: 3049104 - protein, 4 aa, Giardia lamblia
AGNA

SEQ ID NO: 3049105 - protein, 8 aa, Giardia lamblia
AGNARASE

SEQ ID NO: 3049106 - protein, 6 aa, Giardia lamblia
AGNGHE

SEQ ID NO: 3049107 - protein, 5 aa, Giardia lamblia
AGNQH

SEQ ID NO: 3049108 - protein, 7 aa, Giardia lamblia
AGNRDPV

SEQ ID NO: 3049109 - protein, 14 aa, Giardia lamblia
AGNSPIEGSTVSGY

SEQ ID NO: 3049110 - protein, 6 aa, Giardia lamblia
AGNYED

SEQ ID NO: 3049111 - protein, 5 aa, Giardia lamblia
AGNYS

SEQ ID NO: 3049112 - protein, 15 aa, Giardia lamblia
AGPESESQAATSEAT

SEQ ID NO: 3049113 - protein, 4 aa, Giardia lamblia
AGPI

SEQ ID NO: 3049114 - protein, 26 aa, Giardia lamblia
AGPKKTKASPTSASACAGPPTRLPHA

SEQ ID NO: 3049115 - protein, 10 aa, Giardia lamblia
AGPNYTTDNT

SEQ ID NO: 3049116 - protein, 6 aa, Giardia lamblia
AGPPIE

SEQ ID NO: 3049117 - protein, 7 aa, Giardia lamblia
AGPQEGV

SEQ ID NO: 3049118 - protein, 9 aa, Giardia lamblia
AGPQGSEKI

SEQ ID NO: 3049119 - protein, 10 aa, Giardia lamblia
AGPSGAPQKV

SEQ ID NO: 3049120 - protein, 5 aa, Giardia lamblia
AGPSI

SEQ ID NO: 3049121 - protein, 12 aa, Giardia lamblia
AGPSKDVQNSYT

SEQ ID NO: 3049122 - protein, 9 aa, Giardia lamblia
AGQAGIEED

SEQ ID NO: 3049123 - protein, 6 aa, Giardia lamblia
AGQATI

SEQ ID NO: 3049124 - protein, 9 aa, Giardia lamblia
AGQAVTGTI

SEQ ID NO: 3049125 - protein, 9 aa, Giardia lamblia
AGQEQGTSI

SEQ ID NO: 3049126 - protein, 24 aa, Giardia lamblia
AGQKQQKNLRRVSTSSQTSGLAGV

SEQ ID NO: 3049127 - protein, 6 aa, Giardia lamblia
AGQSRE

SEQ ID NO: 3049128 - protein, 6 aa, Giardia lamblia
AGQTAP

SEQ ID NO: 3049129 - protein, 7 aa, Giardia lamblia
AGRCGPD

SEQ ID NO: 3049130 - protein, 4 aa, Giardia lamblia
AGRI

SEQ ID NO: 3049131 - protein, 10 aa, Giardia lamblia
AGRKDISGGT

SEQ ID NO: 3049132 - protein, 10 aa, Giardia lamblia
AGRKTDAGDT

SEQ ID NO: 3049133 - protein, 6 aa, Giardia lamblia
AGRMGQ

SEQ ID NO: 3049134 - protein, 4 aa, Giardia lamblia
AGRP

SEQ ID NO: 3049135 - protein, 7 aa, Giardia lamblia
AGRQDKL

SEQ ID NO: 3049136 - protein, 5 aa, Giardia lamblia
AGRRP

SEQ ID NO: 3049137 - protein, 12 aa, Giardia lamblia
AGRSMQTQQGNS

SEQ ID NO: 3049138 - protein, 9 aa, Giardia lamblia
AGRTQTTKG

SEQ ID NO: 3049139 - protein, 10 aa, Giardia lamblia
AGSAAGNTCD

SEQ ID NO: 3049140 - protein, 11 aa, Giardia lamblia
AGSAAGNTCSK

SEQ ID NO: 3049141 - protein, 7 aa, Giardia lamblia
AGSCGEA

SEQ ID NO: 3049142 - protein, 8 aa, Giardia lamblia
AGSDRDTA

SEQ ID NO: 3049143 - protein, 17 aa, Giardia lamblia
AGSESNIPAKGARKSRA

SEQ ID NO: 3049144 - protein, 8 aa, Giardia lamblia
AGSLSGGE

SEQ ID NO: 3049145 - protein, 15 aa, Giardia lamblia
AGSLTETSMKGNDDP

SEQ ID NO: 3049146 - protein, 15 aa, Giardia lamblia
AGSNASLNCDSASSF

SEQ ID NO: 3049147 - protein, 33 aa, Giardia lamblia
AGSPATTTKQGSPGTNGAAGTLSSSQSGQDTDV

SEQ ID NO: 3049148 - protein, 8 aa, Giardia lamblia
AGSPTEGL

SEQ ID NO: 3049149 - protein, 10 aa, Giardia lamblia
AGSQSLPATQ

SEQ ID NO: 3049150 - protein, 12 aa, Giardia lamblia
AGSRRSQSTRDL

SEQ ID NO: 3049151 - protein, 25 aa, Giardia lamblia
AGSSPPCVNPQKRNNSISRKPVVPQ

SEQ ID NO: 3049152 - protein, 8 aa, Giardia lamblia
AGSTDGLT

SEQ ID NO: 3049153 - protein, 9 aa, Giardia lamblia
AGSTDTAAQ

SEQ ID NO: 3049154 - protein, 8 aa, Giardia lamblia
AGSTHPQG

SEQ ID NO: 3049155 - protein, 11 aa, Giardia lamblia
AGSYDNESSSI

SEQ ID NO: 3049156 - protein, 12 aa, Giardia lamblia
AGSYKSPNTNEC

SEQ ID NO: 3049157 - protein, 6 aa, Giardia lamblia
AGSYTD

SEQ ID NO: 3049158 - protein, 6 aa, Giardia lamblia
AGTANN

SEQ ID NO: 3049159 - protein, 16 aa, Giardia lamblia
AGTASTAIPKSSVKPI

SEQ ID NO: 3049160 - protein, 13 aa, Giardia lamblia
AGTCTSDGCTCNS

SEQ ID NO: 3049161 - protein, 4 aa, Giardia lamblia
AGTD

SEQ ID NO: 3049162 - protein, 7 aa, Giardia lamblia
AGTDDDY

SEQ ID NO: 3049163 - protein, 8 aa, Giardia lamblia
AGTDEPRC

SEQ ID NO: 3049164 - protein, 6 aa, Giardia lamblia
AGTGGF

SEQ ID NO: 3049165 - protein, 8 aa, Giardia lamblia
AGTPLSEK

SEQ ID NO: 3049166 - protein, 8 aa, Giardia lamblia
AGTPLSER

SEQ ID NO: 3049167 - protein, 4 aa, Giardia lamblia
AGTS

SEQ ID NO: 3049168 - protein, 14 aa, Giardia lamblia
AGTSEAKASSPEPL

SEQ ID NO: 3049169 - protein, 6 aa, Giardia lamblia
AGTSNK

SEQ ID NO: 3049170 - protein, 13 aa, Giardia lamblia
AGTSSTGKTAAQQ

SEQ ID NO: 3049171 - protein, 7 aa, Giardia lamblia
AGTTSGG

SEQ ID NO: 3049172 - protein, 25 aa, Giardia lamblia
AGVYPSSEELNPKYPVAERSRRWDQ

SEQ ID NO: 3049173 - protein, 5 aa, Giardia lamblia
AGYPH

SEQ ID NO: 3049174 - protein, 10 aa, Giardia lamblia
AGYQASTSAE

SEQ ID NO: 3049175 - protein, 6 aa, Giardia lamblia
AGYSGP

SEQ ID NO: 3049176 - protein, 12 aa, Giardia lamblia
AHAANTNGISGA

SEQ ID NO: 3049177 - protein, 10 aa, Giardia lamblia
AHASTAQGSH

SEQ ID NO: 3049178 - protein, 8 aa, Giardia lamblia
AHDQASKM

SEQ ID NO: 3049179 - protein, 17 aa, Giardia lamblia
AHDSGGWTRREPPIPYK

SEQ ID NO: 3049180 - protein, 17 aa, Giardia lamblia
AHDSSTYRGYSNDAYLY

SEQ ID NO: 3049181 - protein, 29 aa, Giardia lamblia
AHDTGCQDYHESGHPDHSDGNSESSLGSH

SEQ ID NO: 3049182 - protein, 6 aa, Giardia lamblia
AHEPTT

SEQ ID NO: 3049183 - protein, 7 aa, Giardia lamblia
AHESSEK

SEQ ID NO: 3049184 - protein, 13 aa, Giardia lamblia
AHGASSAAAVATS

SEQ ID NO: 3049185 - protein, 5 aa, Giardia lamblia
AHGSR

SEQ ID NO: 3049186 - protein, 5 aa, Giardia lamblia
AHKGR

SEQ ID NO: 3049187 - protein, 9 aa, Giardia lamblia
AHKPRERVG

SEQ ID NO: 3049188 - protein, 10 aa, Giardia lamblia
AHLNDSSPQL

SEQ ID NO: 3049189 - protein, 4 aa, Giardia lamblia
AHNT

SEQ ID NO: 3049190 - protein, 6 aa, Giardia lamblia
AHPELE

SEQ ID NO: 3049191 - protein, 20 aa, Giardia lamblia
AHPSKSPSTVSTKESSISVP

SEQ ID NO: 3049192 - protein, 18 aa, Giardia lamblia
AHQNQPPSGKVKEAAQTG

SEQ ID NO: 3049193 - protein, 6 aa, Giardia lamblia
AHQQNL

SEQ ID NO: 3049194 - protein, 5 aa, Giardia lamblia
AHRGE

SEQ ID NO: 3049195 - protein, 6 aa, Giardia lamblia
AHRPSH

SEQ ID NO: 3049196 - protein, 4 aa, Giardia lamblia
AHRQ

SEQ ID NO: 3049197 - protein, 33 aa, Giardia lamblia
AHSFNGSARAVTQGSSSANDCNTSDAVEEATTV

SEQ ID NO: 3049198 - protein, 7 aa, Giardia lamblia
AHSGKTK

SEQ ID NO: 3049199 - protein, 7 aa, Giardia lamblia
AHSSEEL

SEQ ID NO: 3049200 - protein, 5 aa, Giardia lamblia
AHSTE

SEQ ID NO: 3049201 - protein, 19 aa, Giardia lamblia
AHTRASAAPEDEDERRGFS

SEQ ID NO: 3049202 - protein, 18 aa, Giardia lamblia
AIAPPENPVNPVSNTTGL

SEQ ID NO: 3049203 - protein, 7 aa, Giardia lamblia
AIDGSRS

SEQ ID NO: 3049204 - protein, 10 aa, Giardia lamblia
AIDPEYSTLN

SEQ ID NO: 3049205 - protein, 4 aa, Giardia lamblia
AIDS

SEQ ID NO: 3049206 - protein, 7 aa, Giardia lamblia
AIDSSPV

SEQ ID NO: 3049207 - protein, 10 aa, Giardia lamblia
AIEGDTRASS

SEQ ID NO: 3049208 - protein, 10 aa, Giardia lamblia
AIETNAGSSV

SEQ ID NO: 3049209 - protein, 4 aa, Giardia lamblia
AIFP

SEQ ID NO: 3049210 - protein, 8 aa, Giardia lamblia
AIKPVAES

SEQ ID NO: 3049211 - protein, 5 aa, Giardia lamblia
AINPS

SEQ ID NO: 3049212 - protein, 9 aa, Giardia lamblia
AINSNAKAR

SEQ ID NO: 3049213 - protein, 5 aa, Giardia lamblia
AIPPE

SEQ ID NO: 3049214 - protein, 4 aa, Giardia lamblia
AIPS

SEQ ID NO: 3049215 - protein, 11 aa, Giardia lamblia
AIPTSSSTIYP

SEQ ID NO: 3049216 - protein, 5 aa, Giardia lamblia
AIQGP

SEQ ID NO: 3049217 - protein, 5 aa, Giardia lamblia
AIQQQ

SEQ ID NO: 3049218 - protein, 6 aa, Giardia lamblia
AIRSDQ

SEQ ID NO: 3049219 - protein, 8 aa, Giardia lamblia
AIRSSSRF

SEQ ID NO: 3049220 - protein, 16 aa, Giardia lamblia
AISGKADDSSATPEVT

SEQ ID NO: 3049221 - protein, 5 aa, Giardia lamblia
AISSD

SEQ ID NO: 3049222 - protein, 6 aa, Giardia lamblia
AITNSQ

SEQ ID NO: 3049223 - protein, 7 aa, Giardia lamblia
AITPESE

SEQ ID NO: 3049224 - protein, 4 aa, Giardia lamblia
AITQ

SEQ ID NO: 3049225 - protein, 6 aa, Giardia lamblia
AITSDR

SEQ ID NO: 3049226 - protein, 21 aa, Giardia lamblia
AITSGDDRLGKTKLDTTITQA

SEQ ID NO: 3049227 - protein, 8 aa, Giardia lamblia
AKADSSIP

SEQ ID NO: 3049228 - protein, 158 aa, Giardia lamblia
AKADTDKKARAAEQARRDEEARAAEQARRDEEARAAEQARRDEEARAAEQARRDEEARAAEQARRDEEARAAEQARRDEEARAAEQARRDEEARAAEQARRDEEARAAEQARRDEEARAAEQARRDEEARAAEQARRDEEARAAEQARRDEEARAAEQ

SEQ ID NO: 3049229 - protein, 14 aa, Giardia lamblia
AKAESGIATDKGKT

SEQ ID NO: 3049230 - protein, 4 aa, Giardia lamblia
AKAG

SEQ ID NO: 3049231 - protein, 10 aa, Giardia lamblia
AKAGPSVQQQ

SEQ ID NO: 3049232 - protein, 7 aa, Giardia lamblia
AKAGTDL

SEQ ID NO: 3049233 - protein, 9 aa, Giardia lamblia
AKAHTGSGK

SEQ ID NO: 3049234 - protein, 15 aa, Giardia lamblia
AKAKLKGKLQEDPHL

SEQ ID NO: 3049235 - protein, 17 aa, Giardia lamblia
AKAPSCTPGTGENAGKC

SEQ ID NO: 3049236 - protein, 8 aa, Giardia lamblia
AKASAGIG

SEQ ID NO: 3049237 - protein, 8 aa, Giardia lamblia
AKASCTRS

SEQ ID NO: 3049238 - protein, 5 aa, Giardia lamblia
AKATL

SEQ ID NO: 3049239 - protein, 9 aa, Giardia lamblia
AKCNDSNAC

SEQ ID NO: 3049240 - protein, 6 aa, Giardia lamblia
AKCPYS

SEQ ID NO: 3049241 - protein, 10 aa, Giardia lamblia
AKCRPGYGSH

SEQ ID NO: 3049242 - protein, 8 aa, Giardia lamblia
AKDADASH

SEQ ID NO: 3049243 - protein, 15 aa, Giardia lamblia
AKDCPTRGTSSPAIG

SEQ ID NO: 3049244 - protein, 9 aa, Giardia lamblia
AKDEESNLE

SEQ ID NO: 3049245 - protein, 5 aa, Giardia lamblia
AKDGG

SEQ ID NO: 3049246 - protein, 9 aa, Giardia lamblia
AKDKSDTSC

SEQ ID NO: 3049247 - protein, 18 aa, Giardia lamblia
AKDTSRHREHSGTTDSLG

SEQ ID NO: 3049248 - protein, 8 aa, Giardia lamblia
AKEDEKTH

SEQ ID NO: 3049249 - protein, 8 aa, Giardia lamblia
AKEGTNRS

SEQ ID NO: 3049250 - protein, 7 aa, Giardia lamblia
AKELATE

SEQ ID NO: 3049251 - protein, 17 aa, Giardia lamblia
AKEMGGSSHTMESSCSD

SEQ ID NO: 3049252 - protein, 8 aa, Giardia lamblia
AKEPQQLT

SEQ ID NO: 3049253 - protein, 5 aa, Giardia lamblia
AKERG

SEQ ID NO: 3049254 - protein, 7 aa, Giardia lamblia
AKERQKT

SEQ ID NO: 3049255 - protein, 6 aa, Giardia lamblia
AKESSF

SEQ ID NO: 3049256 - protein, 7 aa, Giardia lamblia
AKETQNL

SEQ ID NO: 3049257 - protein, 17 aa, Giardia lamblia
AKEVKDATLTAKNNYKN

SEQ ID NO: 3049258 - protein, 7 aa, Giardia lamblia
AKFAPDT

SEQ ID NO: 3049259 - protein, 6 aa, Giardia lamblia
AKGAPV

SEQ ID NO: 3049260 - protein, 8 aa, Giardia lamblia
AKGKAEPL

SEQ ID NO: 3049261 - protein, 9 aa, Giardia lamblia
AKGKKYNTI

SEQ ID NO: 3049262 - protein, 4 aa, Giardia lamblia
AKGL

SEQ ID NO: 3049263 - protein, 7 aa, Giardia lamblia
AKGRTTA

SEQ ID NO: 3049264 - protein, 7 aa, Giardia lamblia
AKGSAGV

SEQ ID NO: 3049265 - protein, 4 aa, Giardia lamblia
AKGT

SEQ ID NO: 3049266 - protein, 6 aa, Giardia lamblia
AKGYSH

SEQ ID NO: 3049267 - protein, 13 aa, Giardia lamblia
AKHKRDGNASAGA

SEQ ID NO: 3049268 - protein, 55 aa, Giardia lamblia
AKIPDQPSPFGSEPRSGFAADRSASTGAGAASKDFPNSRSISRSGGSGKDDTDFL

SEQ ID NO: 3049269 - protein, 42 aa, Giardia lamblia
AKIREERRTGRTAPAPISAPQNNDYTAPQPQQQQQQQPDQFV

SEQ ID NO: 3049270 - protein, 9 aa, Giardia lamblia
AKKARSDSY

SEQ ID NO: 3049271 - protein, 9 aa, Giardia lamblia
AKKDVERST

SEQ ID NO: 3049272 - protein, 5 aa, Giardia lamblia
AKKEL

SEQ ID NO: 3049273 - protein, 8 aa, Giardia lamblia
AKKGHKST

SEQ ID NO: 3049274 - protein, 10 aa, Giardia lamblia
AKKKSRADEE

SEQ ID NO: 3049275 - protein, 5 aa, Giardia lamblia
AKKKT

SEQ ID NO: 3049276 - protein, 7 aa, Giardia lamblia
AKKMGGG

SEQ ID NO: 3049277 - protein, 11 aa, Giardia lamblia
AKKNDKRGCSG

SEQ ID NO: 3049278 - protein, 14 aa, Giardia lamblia
AKKNSSYQTTSGSY

SEQ ID NO: 3049279 - protein, 19 aa, Giardia lamblia
AKKPGDQDAPIKSCVDTDV

SEQ ID NO: 3049280 - protein, 8 aa, Giardia lamblia
AKKTEQYR

SEQ ID NO: 3049281 - protein, 9 aa, Giardia lamblia
AKKTQDTIS

SEQ ID NO: 3049282 - protein, 8 aa, Giardia lamblia
AKKYEQGL

SEQ ID NO: 3049283 - protein, 7 aa, Giardia lamblia
AKLGDAE

SEQ ID NO: 3049284 - protein, 8 aa, Giardia lamblia
AKLSTGSA

SEQ ID NO: 3049285 - protein, 10 aa, Giardia lamblia
AKLSTNPSTI

SEQ ID NO: 3049286 - protein, 10 aa, Giardia lamblia
AKLTDRNGRT

SEQ ID NO: 3049287 - protein, 11 aa, Giardia lamblia
AKMEQEANEDI

SEQ ID NO: 3049288 - protein, 8 aa, Giardia lamblia
AKMGTQHD

SEQ ID NO: 3049289 - protein, 8 aa, Giardia lamblia
AKNGDRVK

SEQ ID NO: 3049290 - protein, 18 aa, Giardia lamblia
AKNGLGAGTTTRHPTVSA

SEQ ID NO: 3049291 - protein, 9 aa, Giardia lamblia
AKNKASLAS

SEQ ID NO: 3049292 - protein, 10 aa, Giardia lamblia
AKNLEHRSAE

SEQ ID NO: 3049293 - protein, 6 aa, Giardia lamblia
AKNNNW

SEQ ID NO: 3049294 - protein, 5 aa, Giardia lamblia
AKNPL

SEQ ID NO: 3049295 - protein, 19 aa, Giardia lamblia
AKNPRKAPAVRSKEATELS

SEQ ID NO: 3049296 - protein, 12 aa, Giardia lamblia
AKNRSQPGNGRR

SEQ ID NO: 3049297 - protein, 7 aa, Giardia lamblia
AKNSDNV

SEQ ID NO: 3049298 - protein, 6 aa, Giardia lamblia
AKNTDL

SEQ ID NO: 3049299 - protein, 7 aa, Giardia lamblia
AKPAPDA

SEQ ID NO: 3049300 - protein, 9 aa, Giardia lamblia
AKPDDLDDN

SEQ ID NO: 3049301 - protein, 5 aa, Giardia lamblia
AKPES

SEQ ID NO: 3049302 - protein, 12 aa, Giardia lamblia
AKPGAQKEECGN

SEQ ID NO: 3049303 - protein, 10 aa, Giardia lamblia
AKPGDAKLPG

SEQ ID NO: 3049304 - protein, 5 aa, Giardia lamblia
AKPLP

SEQ ID NO: 3049305 - protein, 9 aa, Giardia lamblia
AKPLQNNEL

SEQ ID NO: 3049306 - protein, 9 aa, Giardia lamblia
AKPQSSQSL

SEQ ID NO: 3049307 - protein, 20 aa, Giardia lamblia
AKPRVSAAGHQESDLTVSGS

SEQ ID NO: 3049308 - protein, 7 aa, Giardia lamblia
AKPTQQS

SEQ ID NO: 3049309 - protein, 26 aa, Giardia lamblia
AKQENSDSSTADSKFKEGHEETEKPL

SEQ ID NO: 3049310 - protein, 4 aa, Giardia lamblia
AKQG

SEQ ID NO: 3049311 - protein, 6 aa, Giardia lamblia
AKQPAT

SEQ ID NO: 3049312 - protein, 11 aa, Giardia lamblia
AKQQDQQQTLQ

SEQ ID NO: 3049313 - protein, 9 aa, Giardia lamblia
AKQQPGSVI

SEQ ID NO: 3049314 - protein, 11 aa, Giardia lamblia
AKQRPADYTPS

SEQ ID NO: 3049315 - protein, 11 aa, Giardia lamblia
AKQSALDSSVT

SEQ ID NO: 3049316 - protein, 17 aa, Giardia lamblia
AKREEEQRALGKRRPKE

SEQ ID NO: 3049317 - protein, 6 aa, Giardia lamblia
AKREQA

SEQ ID NO: 3049318 - protein, 4 aa, Giardia lamblia
AKRK

SEQ ID NO: 3049319 - protein, 8 aa, Giardia lamblia
AKRLRSST

SEQ ID NO: 3049320 - protein, 44 aa, Giardia lamblia
AKRNRVESARHPEKMGDSDSNKSSLPGLDKAGTQLAVEGKGASI

SEQ ID NO: 3049321 - protein, 7 aa, Giardia lamblia
AKRPSAQ

SEQ ID NO: 3049322 - protein, 12 aa, Giardia lamblia
AKRQQKREKSDI

SEQ ID NO: 3049323 - protein, 7 aa, Giardia lamblia
AKRQTSA

SEQ ID NO: 3049324 - protein, 7 aa, Giardia lamblia
AKRRTQH

SEQ ID NO: 3049325 - protein, 6 aa, Giardia lamblia
AKRTGV

SEQ ID NO: 3049326 - protein, 6 aa, Giardia lamblia
AKRTRR

SEQ ID NO: 3049327 - protein, 9 aa, Giardia lamblia
AKSAETASF

SEQ ID NO: 3049328 - protein, 6 aa, Giardia lamblia
AKSGAK

SEQ ID NO: 3049329 - protein, 9 aa, Giardia lamblia
AKSGGRGDQ

SEQ ID NO: 3049330 - protein, 7 aa, Giardia lamblia
AKSGTPI

SEQ ID NO: 3049331 - protein, 11 aa, Giardia lamblia
AKSHTSNLPNV

SEQ ID NO: 3049332 - protein, 23 aa, Giardia lamblia
AKSNNKLPKRGCSLDEKKARKLG

SEQ ID NO: 3049333 - protein, 14 aa, Giardia lamblia
AKSPAASAPPSLSS

SEQ ID NO: 3049334 - protein, 6 aa, Giardia lamblia
AKSPHH

SEQ ID NO: 3049335 - protein, 10 aa, Giardia lamblia
AKSPPPAAST

SEQ ID NO: 3049336 - protein, 5 aa, Giardia lamblia
AKSQA

SEQ ID NO: 3049337 - protein, 6 aa, Giardia lamblia
AKTATK

SEQ ID NO: 3049338 - protein, 7 aa, Giardia lamblia
AKTESVG

SEQ ID NO: 3049339 - protein, 5 aa, Giardia lamblia
AKTGR

SEQ ID NO: 3049340 - protein, 6 aa, Giardia lamblia
AKTNRQ

SEQ ID NO: 3049341 - protein, 7 aa, Giardia lamblia
AKTPASR

SEQ ID NO: 3049342 - protein, 7 aa, Giardia lamblia
AKTRDED

SEQ ID NO: 3049343 - protein, 10 aa, Giardia lamblia
AKTSDSSTSA

SEQ ID NO: 3049344 - protein, 9 aa, Giardia lamblia
AKTSNVSVS

SEQ ID NO: 3049345 - protein, 10 aa, Giardia lamblia
AKTSRAGDAC

SEQ ID NO: 3049346 - protein, 22 aa, Giardia lamblia
AKVSSYNNSSASNSEASSNVLP

SEQ ID NO: 3049347 - protein, 10 aa, Giardia lamblia
AKYADAASTG

SEQ ID NO: 3049348 - protein, 6 aa, Giardia lamblia
ALAQNA

SEQ ID NO: 3049349 - protein, 6 aa, Giardia lamblia
ALASPP

SEQ ID NO: 3049350 - protein, 16 aa, Giardia lamblia
ALDPRSCAESDGTHTH

SEQ ID NO: 3049351 - protein, 11 aa, Giardia lamblia
ALDSLNSSDIT

SEQ ID NO: 3049352 - protein, 23 aa, Giardia lamblia
ALDSPSSTPFSTPKPTRSTERRE

SEQ ID NO: 3049353 - protein, 21 aa, Giardia lamblia
ALEETEEATWSETCPSTSIKQ

SEQ ID NO: 3049354 - protein, 8 aa, Giardia lamblia
ALGGGALD

SEQ ID NO: 3049355 - protein, 7 aa, Giardia lamblia
ALGPPLG

SEQ ID NO: 3049356 - protein, 13 aa, Giardia lamblia
ALGSSKKTGFQQS

SEQ ID NO: 3049357 - protein, 4 aa, Giardia lamblia
ALGT

SEQ ID NO: 3049358 - protein, 9 aa, Giardia lamblia
ALGTGEPFD

SEQ ID NO: 3049359 - protein, 5 aa, Giardia lamblia
ALKGQ

SEQ ID NO: 3049360 - protein, 6 aa, Giardia lamblia
ALKSQA

SEQ ID NO: 3049361 - protein, 5 aa, Giardia lamblia
ALNAD

SEQ ID NO: 3049362 - protein, 4 aa, Giardia lamblia
ALNT

SEQ ID NO: 3049363 - protein, 5 aa, Giardia lamblia
ALPDE

SEQ ID NO: 3049364 - protein, 6 aa, Giardia lamblia
ALPEGA

SEQ ID NO: 3049365 - protein, 8 aa, Giardia lamblia
ALPEPHRR

SEQ ID NO: 3049366 - protein, 17 aa, Giardia lamblia
ALPETYGATGDRRMGTS

SEQ ID NO: 3049367 - protein, 4 aa, Giardia lamblia
ALPG

SEQ ID NO: 3049368 - protein, 6 aa, Giardia lamblia
ALPGWS

SEQ ID NO: 3049369 - protein, 7 aa, Giardia lamblia
ALPHSNN

SEQ ID NO: 3049370 - protein, 12 aa, Giardia lamblia
ALPLADPSKLDS

SEQ ID NO: 3049371 - protein, 10 aa, Giardia lamblia
ALPNASTDPL

SEQ ID NO: 3049372 - protein, 6 aa, Giardia lamblia
ALPNSE

SEQ ID NO: 3049373 - protein, 7 aa, Giardia lamblia
ALPPQSD

SEQ ID NO: 3049374 - protein, 5 aa, Giardia lamblia
ALPSN

SEQ ID NO: 3049375 - protein, 7 aa, Giardia lamblia
ALPSPEI

SEQ ID NO: 3049376 - protein, 20 aa, Giardia lamblia
ALPSTEKVTSDPSDDPQTSF

SEQ ID NO: 3049377 - protein, 15 aa, Giardia lamblia
ALQEEGEIPSSPPDY

SEQ ID NO: 3049378 - protein, 4 aa, Giardia lamblia
ALRP

SEQ ID NO: 3049379 - protein, 6 aa, Giardia lamblia
ALSAPG

SEQ ID NO: 3049380 - protein, 8 aa, Giardia lamblia
ALSDATDV

SEQ ID NO: 3049381 - protein, 6 aa, Giardia lamblia
ALSDRT

SEQ ID NO: 3049382 - protein, 8 aa, Giardia lamblia
ALSESSSI

SEQ ID NO: 3049383 - protein, 13 aa, Giardia lamblia
ALSSPNPDIRGYA

SEQ ID NO: 3049384 - protein, 5 aa, Giardia lamblia
ALSSQ

SEQ ID NO: 3049385 - protein, 9 aa, Giardia lamblia
ALSSQKDLD

SEQ ID NO: 3049386 - protein, 8 aa, Giardia lamblia
ALSSSQAA

SEQ ID NO: 3049387 - protein, 5 aa, Giardia lamblia
ALTEE

SEQ ID NO: 3049388 - protein, 6 aa, Giardia lamblia
ALTGPS

SEQ ID NO: 3049389 - protein, 5 aa, Giardia lamblia
ALTIP

SEQ ID NO: 3049390 - protein, 7 aa, Giardia lamblia
ALTPEST

SEQ ID NO: 3049391 - protein, 6 aa, Giardia lamblia
ALTTDE

SEQ ID NO: 3049392 - protein, 29 aa, Giardia lamblia
ALTTPTRSLSQTRSGSRALSARSSSPHSI

SEQ ID NO: 3049393 - protein, 7 aa, Giardia lamblia
ALVPSGK

SEQ ID NO: 3049394 - protein, 4 aa, Giardia lamblia
ALYP

SEQ ID NO: 3049395 - protein, 12 aa, Giardia lamblia
AMEKNESVLGKS

SEQ ID NO: 3049396 - protein, 9 aa, Giardia lamblia
AMKGRKREV

SEQ ID NO: 3049397 - protein, 7 aa, Giardia lamblia
AMKPGAS

SEQ ID NO: 3049398 - protein, 14 aa, Giardia lamblia
AMKSPKKMARPGQT

SEQ ID NO: 3049399 - protein, 13 aa, Giardia lamblia
AMPYGNKTDKLDG

SEQ ID NO: 3049400 - protein, 12 aa, Giardia lamblia
AMQGDVGEADRM

SEQ ID NO: 3049401 - protein, 12 aa, Giardia lamblia
AMQNTKKREEFD

SEQ ID NO: 3049402 - protein, 8 aa, Giardia lamblia
AMRGGSDS

SEQ ID NO: 3049403 - protein, 9 aa, Giardia lamblia
AMSSETSKG

SEQ ID NO: 3049404 - protein, 11 aa, Giardia lamblia
AMTAPGEEPLA

SEQ ID NO: 3049405 - protein, 4 aa, Giardia lamblia
AMTD

SEQ ID NO: 3049406 - protein, 7 aa, Giardia lamblia
AMTSSSA

SEQ ID NO: 3049407 - protein, 7 aa, Giardia lamblia
ANAASLP

SEQ ID NO: 3049408 - protein, 10 aa, Giardia lamblia
ANADQSALKS

SEQ ID NO: 3049409 - protein, 10 aa, Giardia lamblia
ANADVKNTFS

SEQ ID NO: 3049410 - protein, 5 aa, Giardia lamblia
ANAEV

SEQ ID NO: 3049411 - protein, 17 aa, Giardia lamblia
ANAIATESSSSDSLPTC

SEQ ID NO: 3049412 - protein, 5 aa, Giardia lamblia
ANANA

SEQ ID NO: 3049413 - protein, 5 aa, Giardia lamblia
ANAPD

SEQ ID NO: 3049414 - protein, 15 aa, Giardia lamblia
ANAPHEKTLPAERDS

SEQ ID NO: 3049415 - protein, 10 aa, Giardia lamblia
ANAPPPGKNY

SEQ ID NO: 3049416 - protein, 27 aa, Giardia lamblia
ANASQELEQAKRRADAKKVSSKASTVD

SEQ ID NO: 3049417 - protein, 8 aa, Giardia lamblia
ANASQTAN

SEQ ID NO: 3049418 - protein, 9 aa, Giardia lamblia
ANASQTANA

SEQ ID NO: 3049419 - protein, 13 aa, Giardia lamblia
ANATGGDASGDVG

SEQ ID NO: 3049420 - protein, 8 aa, Giardia lamblia
ANDAPPEP

SEQ ID NO: 3049421 - protein, 9 aa, Giardia lamblia
ANDFQASNN

SEQ ID NO: 3049422 - protein, 6 aa, Giardia lamblia
ANDGTT

SEQ ID NO: 3049423 - protein, 17 aa, Giardia lamblia
ANDNSNRKCGGLGTCEG

SEQ ID NO: 3049424 - protein, 9 aa, Giardia lamblia
ANDNTPTVE

SEQ ID NO: 3049425 - protein, 22 aa, Giardia lamblia
ANDPSSTQFQPSQERTQEKRDT

SEQ ID NO: 3049426 - protein, 7 aa, Giardia lamblia
ANDTATY

SEQ ID NO: 3049427 - protein, 10 aa, Giardia lamblia
ANDTSVPENT

SEQ ID NO: 3049428 - protein, 10 aa, Giardia lamblia
ANEAQQSTLR

SEQ ID NO: 3049429 - protein, 7 aa, Giardia lamblia
ANENEDE

SEQ ID NO: 3049430 - protein, 14 aa, Giardia lamblia
ANENEVPREGGCKR

SEQ ID NO: 3049431 - protein, 5 aa, Giardia lamblia
ANESL

SEQ ID NO: 3049432 - protein, 11 aa, Giardia lamblia
ANESPPYREGK

SEQ ID NO: 3049433 - protein, 16 aa, Giardia lamblia
ANESSSRSQSSQEIGR

SEQ ID NO: 3049434 - protein, 8 aa, Giardia lamblia
ANETSEVQ

SEQ ID NO: 3049435 - protein, 5 aa, Giardia lamblia
ANFPP

SEQ ID NO: 3049436 - protein, 8 aa, Giardia lamblia
ANGADQWD

SEQ ID NO: 3049437 - protein, 9 aa, Giardia lamblia
ANGAGKSTI

SEQ ID NO: 3049438 - protein, 8 aa, Giardia lamblia
ANGDDSGL

SEQ ID NO: 3049439 - protein, 7 aa, Giardia lamblia
ANGKDAA

SEQ ID NO: 3049440 - protein, 15 aa, Giardia lamblia
ANGKEETQKAMQSYK

SEQ ID NO: 3049441 - protein, 14 aa, Giardia lamblia
ANGNDDDQTLPPQN

SEQ ID NO: 3049442 - protein, 19 aa, Giardia lamblia
ANGNSGASAANRINRPTAR

SEQ ID NO: 3049443 - protein, 4 aa, Giardia lamblia
ANGR

SEQ ID NO: 3049444 - protein, 7 aa, Giardia lamblia
ANGRKGH

SEQ ID NO: 3049445 - protein, 8 aa, Giardia lamblia
ANGRKYNN

SEQ ID NO: 3049446 - protein, 9 aa, Giardia lamblia
ANGSGKSNV

SEQ ID NO: 3049447 - protein, 8 aa, Giardia lamblia
ANGSGKST

SEQ ID NO: 3049448 - protein, 13 aa, Giardia lamblia
ANGTNTPPSARTY

SEQ ID NO: 3049449 - protein, 11 aa, Giardia lamblia
ANGVTPKRSSQ

SEQ ID NO: 3049450 - protein, 10 aa, Giardia lamblia
ANHSSSPALT

SEQ ID NO: 3049451 - protein, 7 aa, Giardia lamblia
ANHTGAP

SEQ ID NO: 3049452 - protein, 6 aa, Giardia lamblia
ANITDQ

SEQ ID NO: 3049453 - protein, 9 aa, Giardia lamblia
ANKAVTTQY

SEQ ID NO: 3049454 - protein, 4 aa, Giardia lamblia
ANKH

SEQ ID NO: 3049455 - protein, 4 aa, Giardia lamblia
ANKP

SEQ ID NO: 3049456 - protein, 7 aa, Giardia lamblia
ANKPVEE

SEQ ID NO: 3049457 - protein, 13 aa, Giardia lamblia
ANKQEIKQLLIRL

SEQ ID NO: 3049458 - protein, 5 aa, Giardia lamblia
ANKSD

SEQ ID NO: 3049459 - protein, 13 aa, Giardia lamblia
ANLGRKKERKEKE

SEQ ID NO: 3049460 - protein, 5 aa, Giardia lamblia
ANLPT

SEQ ID NO: 3049461 - protein, 7 aa, Giardia lamblia
ANMSDGG

SEQ ID NO: 3049462 - protein, 5 aa, Giardia lamblia
ANNDE

SEQ ID NO: 3049463 - protein, 5 aa, Giardia lamblia
ANNEN

SEQ ID NO: 3049464 - protein, 8 aa, Giardia lamblia
ANNPSNQD

SEQ ID NO: 3049465 - protein, 11 aa, Giardia lamblia
ANNSLESHNTS

SEQ ID NO: 3049466 - protein, 7 aa, Giardia lamblia
ANNSQTL

SEQ ID NO: 3049467 - protein, 7 aa, Giardia lamblia
ANNTNSA

SEQ ID NO: 3049468 - protein, 21 aa, Giardia lamblia
ANPEETCADGTTAEDSTAGME

SEQ ID NO: 3049469 - protein, 6 aa, Giardia lamblia
ANPESL

SEQ ID NO: 3049470 - protein, 6 aa, Giardia lamblia
ANPFDT

SEQ ID NO: 3049471 - protein, 7 aa, Giardia lamblia
ANPGADP

SEQ ID NO: 3049472 - protein, 8 aa, Giardia lamblia
ANPGADPL

SEQ ID NO: 3049473 - protein, 5 aa, Giardia lamblia
ANPKD

SEQ ID NO: 3049474 - protein, 4 aa, Giardia lamblia
ANPL

SEQ ID NO: 3049475 - protein, 20 aa, Giardia lamblia
ANPPDATTQNSNRASVDSTY

SEQ ID NO: 3049476 - protein, 5 aa, Giardia lamblia
ANPPL

SEQ ID NO: 3049477 - protein, 5 aa, Giardia lamblia
ANPPR

SEQ ID NO: 3049478 - protein, 4 aa, Giardia lamblia
ANPR

SEQ ID NO: 3049479 - protein, 5 aa, Giardia lamblia
ANPRG

SEQ ID NO: 3049480 - protein, 8 aa, Giardia lamblia
ANPSFSPE

SEQ ID NO: 3049481 - protein, 7 aa, Giardia lamblia
ANPSSDI

SEQ ID NO: 3049482 - protein, 16 aa, Giardia lamblia
ANQATESSTDDFTDSS

SEQ ID NO: 3049483 - protein, 7 aa, Giardia lamblia
ANQEINR

SEQ ID NO: 3049484 - protein, 6 aa, Giardia lamblia
ANQETI

SEQ ID NO: 3049485 - protein, 4 aa, Giardia lamblia
ANQF

SEQ ID NO: 3049486 - protein, 4 aa, Giardia lamblia
ANQG

SEQ ID NO: 3049487 - protein, 6 aa, Giardia lamblia
ANQGKQ

SEQ ID NO: 3049488 - protein, 4 aa, Giardia lamblia
ANQI

SEQ ID NO: 3049489 - protein, 5 aa, Giardia lamblia
ANQQT

SEQ ID NO: 3049490 - protein, 19 aa, Giardia lamblia
ANQRRTQIQSASYGNKDNR

SEQ ID NO: 3049491 - protein, 6 aa, Giardia lamblia
ANQTQN

SEQ ID NO: 3049492 - protein, 8 aa, Giardia lamblia
ANQYPEDF

SEQ ID NO: 3049493 - protein, 7 aa, Giardia lamblia
ANRHDDV

SEQ ID NO: 3049494 - protein, 12 aa, Giardia lamblia
ANRNCDEAGTIG

SEQ ID NO: 3049495 - protein, 7 aa, Giardia lamblia
ANRNDVK

SEQ ID NO: 3049496 - protein, 27 aa, Giardia lamblia
ANRQDASNTNIGNVKRGPSASPASPMN

SEQ ID NO: 3049497 - protein, 11 aa, Giardia lamblia
ANRSLENRSFT

SEQ ID NO: 3049498 - protein, 32 aa, Giardia lamblia
ANSDASTMKSPISSAGHSRHASHNGGASDFRR

SEQ ID NO: 3049499 - protein, 6 aa, Giardia lamblia
ANSDDT

SEQ ID NO: 3049500 - protein, 9 aa, Giardia lamblia
ANSEYSAKV

SEQ ID NO: 3049501 - protein, 7 aa, Giardia lamblia
ANSIEGN

SEQ ID NO: 3049502 - protein, 6 aa, Giardia lamblia
ANSIEP

SEQ ID NO: 3049503 - protein, 6 aa, Giardia lamblia
ANSNHA

SEQ ID NO: 3049504 - protein, 8 aa, Giardia lamblia
ANSPESAL

SEQ ID NO: 3049505 - protein, 15 aa, Giardia lamblia
ANSQSSQNAQSGSSL

SEQ ID NO: 3049506 - protein, 13 aa, Giardia lamblia
ANSSANGGHVDQS

SEQ ID NO: 3049507 - protein, 7 aa, Giardia lamblia
ANSSNLK

SEQ ID NO: 3049508 - protein, 14 aa, Giardia lamblia
ANSSTFNATSPVGI

SEQ ID NO: 3049509 - protein, 6 aa, Giardia lamblia
ANSSTT

SEQ ID NO: 3049510 - protein, 19 aa, Giardia lamblia
ANSSVKPANCTSATGTSDD

SEQ ID NO: 3049511 - protein, 4 aa, Giardia lamblia
ANSV

SEQ ID NO: 3049512 - protein, 6 aa, Giardia lamblia
ANSVEG

SEQ ID NO: 3049513 - protein, 10 aa, Giardia lamblia
ANTAAGNQSK

SEQ ID NO: 3049514 - protein, 15 aa, Giardia lamblia
ANTDNCGEPTANADF

SEQ ID NO: 3049515 - protein, 6 aa, Giardia lamblia
ANTEVK

SEQ ID NO: 3049516 - protein, 6 aa, Giardia lamblia
ANTLPT

SEQ ID NO: 3049517 - protein, 6 aa, Giardia lamblia
ANTQTH

SEQ ID NO: 3049518 - protein, 8 aa, Giardia lamblia
ANTRATGV

SEQ ID NO: 3049519 - protein, 9 aa, Giardia lamblia
ANTSPEKQA

SEQ ID NO: 3049520 - protein, 9 aa, Giardia lamblia
ANTTDQGAN

SEQ ID NO: 3049521 - protein, 4 aa, Giardia lamblia
ANVE

SEQ ID NO: 3049522 - protein, 9 aa, Giardia lamblia
ANVSEENTA

SEQ ID NO: 3049523 - protein, 5 aa, Giardia lamblia
ANYEK

SEQ ID NO: 3049524 - protein, 17 aa, Giardia lamblia
ANYGSSALNTEGGKDAD

SEQ ID NO: 3049525 - protein, 11 aa, Giardia lamblia
ANYVSSDNSVI

SEQ ID NO: 3049526 - protein, 8 aa, Giardia lamblia
APAGGGRN

SEQ ID NO: 3049527 - protein, 6 aa, Giardia lamblia
APAKFA

SEQ ID NO: 3049528 - protein, 7 aa, Giardia lamblia
APAPCTD

SEQ ID NO: 3049529 - protein, 10 aa, Giardia lamblia
APAPVSNNPF

SEQ ID NO: 3049530 - protein, 16 aa, Giardia lamblia
APASGSQNRDHASPYT

SEQ ID NO: 3049531 - protein, 14 aa, Giardia lamblia
APASQDDSQKSNDC

SEQ ID NO: 3049532 - protein, 14 aa, Giardia lamblia
APASQDDSQKSTDC

SEQ ID NO: 3049533 - protein, 16 aa, Giardia lamblia
APASQDGDQKSNDCTT

SEQ ID NO: 3049534 - protein, 16 aa, Giardia lamblia
APASQDGDQKSTDCTT

SEQ ID NO: 3049535 - protein, 12 aa, Giardia lamblia
APATTGQCSHQP

SEQ ID NO: 3049536 - protein, 10 aa, Giardia lamblia
APDANRTAAC

SEQ ID NO: 3049537 - protein, 7 aa, Giardia lamblia
APDFTPA

SEQ ID NO: 3049538 - protein, 5 aa, Giardia lamblia
APDGL

SEQ ID NO: 3049539 - protein, 9 aa, Giardia lamblia
APDLGERSV

SEQ ID NO: 3049540 - protein, 7 aa, Giardia lamblia
APDLRSR

SEQ ID NO: 3049541 - protein, 7 aa, Giardia lamblia
APDQPYN

SEQ ID NO: 3049542 - protein, 7 aa, Giardia lamblia
APDSPMS

SEQ ID NO: 3049543 - protein, 8 aa, Giardia lamblia
APDSPYRN

SEQ ID NO: 3049544 - protein, 8 aa, Giardia lamblia
APEKASSM

SEQ ID NO: 3049545 - protein, 11 aa, Giardia lamblia
APEPEDRTDEI

SEQ ID NO: 3049546 - protein, 4 aa, Giardia lamblia
APER

SEQ ID NO: 3049547 - protein, 7 aa, Giardia lamblia
APESLRA

SEQ ID NO: 3049548 - protein, 11 aa, Giardia lamblia
APESPAPSPTA

SEQ ID NO: 3049549 - protein, 10 aa, Giardia lamblia
APESSAGDRV

SEQ ID NO: 3049550 - protein, 18 aa, Giardia lamblia
APETNTTGAQPRAASIKE

SEQ ID NO: 3049551 - protein, 23 aa, Giardia lamblia
APFQGSNSCSSATLSHKSATEAR

SEQ ID NO: 3049552 - protein, 11 aa, Giardia lamblia
APFTAKSGTIG

SEQ ID NO: 3049553 - protein, 4 aa, Giardia lamblia
APGD

SEQ ID NO: 3049554 - protein, 7 aa, Giardia lamblia
APGDPFA

SEQ ID NO: 3049555 - protein, 5 aa, Giardia lamblia
APGGW

SEQ ID NO: 3049556 - protein, 7 aa, Giardia lamblia
APGPGHC

SEQ ID NO: 3049557 - protein, 12 aa, Giardia lamblia
APGPGRCTRCPS

SEQ ID NO: 3049558 - protein, 36 aa, Giardia lamblia
APGPIASGNPYAPAQQPGWQTSEPGNAIGSSGMNLD

SEQ ID NO: 3049559 - protein, 7 aa, Giardia lamblia
APGQPID

SEQ ID NO: 3049560 - protein, 17 aa, Giardia lamblia
APGRQSTPATAGLSGNN

SEQ ID NO: 3049561 - protein, 17 aa, Giardia lamblia
APGSEPCTGPNDPNYRK

SEQ ID NO: 3049562 - protein, 7 aa, Giardia lamblia
APGSTEA

SEQ ID NO: 3049563 - protein, 11 aa, Giardia lamblia
APGTESECSAP

SEQ ID NO: 3049564 - protein, 19 aa, Giardia lamblia
APGTKKSDKHKAADSVDYS

SEQ ID NO: 3049565 - protein, 5 aa, Giardia lamblia
APGYV

SEQ ID NO: 3049566 - protein, 4 aa, Giardia lamblia
APHL

SEQ ID NO: 3049567 - protein, 10 aa, Giardia lamblia
APHPDGSKQE

SEQ ID NO: 3049568 - protein, 4 aa, Giardia lamblia
APHR

SEQ ID NO: 3049569 - protein, 5 aa, Giardia lamblia
APHRT

SEQ ID NO: 3049570 - protein, 5 aa, Giardia lamblia
APIAS

SEQ ID NO: 3049571 - protein, 4 aa, Giardia lamblia
APIN

SEQ ID NO: 3049572 - protein, 8 aa, Giardia lamblia
APISTNFD

SEQ ID NO: 3049573 - protein, 7 aa, Giardia lamblia
APISTPQ

SEQ ID NO: 3049574 - protein, 11 aa, Giardia lamblia
APITNATPSIN

SEQ ID NO: 3049575 - protein, 10 aa, Giardia lamblia
APKASSRRAS

SEQ ID NO: 3049576 - protein, 8 aa, Giardia lamblia
APKDKNSL

SEQ ID NO: 3049577 - protein, 15 aa, Giardia lamblia
APKEEDSQSQEDLRG

SEQ ID NO: 3049578 - protein, 7 aa, Giardia lamblia
APKPVHQ

SEQ ID NO: 3049579 - protein, 15 aa, Giardia lamblia
APKRPEVPAKHRPHS

SEQ ID NO: 3049580 - protein, 7 aa, Giardia lamblia
APKSTGS

SEQ ID NO: 3049581 - protein, 8 aa, Giardia lamblia
APLGTDAA

SEQ ID NO: 3049582 - protein, 6 aa, Giardia lamblia
APLNQE

SEQ ID NO: 3049583 - protein, 6 aa, Giardia lamblia
APLPGT

SEQ ID NO: 3049584 - protein, 15 aa, Giardia lamblia
APLPSEKDSAAPRNP

SEQ ID NO: 3049585 - protein, 4 aa, Giardia lamblia
APLS

SEQ ID NO: 3049586 - protein, 32 aa, Giardia lamblia
APLSDGAEPRTSPSNSSVDTPSSAGGISQKDP

SEQ ID NO: 3049587 - protein, 6 aa, Giardia lamblia
APLSDT

SEQ ID NO: 3049588 - protein, 14 aa, Giardia lamblia
APLSESGHSATDRE

SEQ ID NO: 3049589 - protein, 9 aa, Giardia lamblia
APLSGPADN

SEQ ID NO: 3049590 - protein, 14 aa, Giardia lamblia
APLSKNDAPTFQGD

SEQ ID NO: 3049591 - protein, 6 aa, Giardia lamblia
APLSLR

SEQ ID NO: 3049592 - protein, 8 aa, Giardia lamblia
APMTQDDD

SEQ ID NO: 3049593 - protein, 13 aa, Giardia lamblia
APMTSSETPSLQP

SEQ ID NO: 3049594 - protein, 8 aa, Giardia lamblia
APNANGAN

SEQ ID NO: 3049595 - protein, 6 aa, Giardia lamblia
APNAVD

SEQ ID NO: 3049596 - protein, 13 aa, Giardia lamblia
APNEEPSGSAENR

SEQ ID NO: 3049597 - protein, 6 aa, Giardia lamblia
APNMNS

SEQ ID NO: 3049598 - protein, 18 aa, Giardia lamblia
APNTPGSACSDSSCATSK

SEQ ID NO: 3049599 - protein, 6 aa, Giardia lamblia
APNTSL

SEQ ID NO: 3049600 - protein, 8 aa, Giardia lamblia
APNYGSTK

SEQ ID NO: 3049601 - protein, 11 aa, Giardia lamblia
APPAGGNGGPV

SEQ ID NO: 3049602 - protein, 6 aa, Giardia lamblia
APPKDA

SEQ ID NO: 3049603 - protein, 37 aa, Giardia lamblia
APPLAPEKDTSEEGAGKNSLTESSELDDEGSVDGNGV

SEQ ID NO: 3049604 - protein, 4 aa, Giardia lamblia
APPP

SEQ ID NO: 3049605 - protein, 21 aa, Giardia lamblia
APPPAVAGGYSGVNKTPGNLK

SEQ ID NO: 3049606 - protein, 7 aa, Giardia lamblia
APPPLSP

SEQ ID NO: 3049607 - protein, 8 aa, Giardia lamblia
APPPPECQ

SEQ ID NO: 3049608 - protein, 15 aa, Giardia lamblia
APPPRKKSGSRGTPV

SEQ ID NO: 3049609 - protein, 6 aa, Giardia lamblia
APPQRR

SEQ ID NO: 3049610 - protein, 8 aa, Giardia lamblia
APPREEQT

SEQ ID NO: 3049611 - protein, 26 aa, Giardia lamblia
APPTDSTAVHSEDKQDMDTPAVSGSL

SEQ ID NO: 3049612 - protein, 11 aa, Giardia lamblia
APPTGGNGGSV

SEQ ID NO: 3049613 - protein, 5 aa, Giardia lamblia
APPTL

SEQ ID NO: 3049614 - protein, 6 aa, Giardia lamblia
APPTVS

SEQ ID NO: 3049615 - protein, 4 aa, Giardia lamblia
APPV

SEQ ID NO: 3049616 - protein, 9 aa, Giardia lamblia
APPYDSSSS

SEQ ID NO: 3049617 - protein, 4 aa, Giardia lamblia
APQD

SEQ ID NO: 3049618 - protein, 5 aa, Giardia lamblia
APQKY

SEQ ID NO: 3049619 - protein, 7 aa, Giardia lamblia
APQNSPF

SEQ ID NO: 3049620 - protein, 13 aa, Giardia lamblia
APQPGSRATTPRV

SEQ ID NO: 3049621 - protein, 6 aa, Giardia lamblia
APQPHR

SEQ ID NO: 3049622 - protein, 5 aa, Giardia lamblia
APQRF

SEQ ID NO: 3049623 - protein, 11 aa, Giardia lamblia
APQSASSTEAR

SEQ ID NO: 3049624 - protein, 4 aa, Giardia lamblia
APQY

SEQ ID NO: 3049625 - protein, 5 aa, Giardia lamblia
APRDT

SEQ ID NO: 3049626 - protein, 6 aa, Giardia lamblia
APRKEA

SEQ ID NO: 3049627 - protein, 10 aa, Giardia lamblia
APRNTRSKPI

SEQ ID NO: 3049628 - protein, 4 aa, Giardia lamblia
APRP

SEQ ID NO: 3049629 - protein, 10 aa, Giardia lamblia
APRPATSSLS

SEQ ID NO: 3049630 - protein, 7 aa, Giardia lamblia
APRPSTT

SEQ ID NO: 3049631 - protein, 22 aa, Giardia lamblia
APRRPRTRPGHRTHEEPPDEEH

SEQ ID NO: 3049632 - protein, 4 aa, Giardia lamblia
APRT

SEQ ID NO: 3049633 - protein, 9 aa, Giardia lamblia
APSAKANRR

SEQ ID NO: 3049634 - protein, 5 aa, Giardia lamblia
APSAV

SEQ ID NO: 3049635 - protein, 6 aa, Giardia lamblia
APSDGQ

SEQ ID NO: 3049636 - protein, 6 aa, Giardia lamblia
APSETS

SEQ ID NO: 3049637 - protein, 6 aa, Giardia lamblia
APSKMP

SEQ ID NO: 3049638 - protein, 9 aa, Giardia lamblia
APSKSDANV

SEQ ID NO: 3049639 - protein, 7 aa, Giardia lamblia
APSKTKH

SEQ ID NO: 3049640 - protein, 20 aa, Giardia lamblia
APSLNDRHDQYNSEYSYHQS

SEQ ID NO: 3049641 - protein, 13 aa, Giardia lamblia
APSNSEASHRTNA

SEQ ID NO: 3049642 - protein, 15 aa, Giardia lamblia
APSPADADVASRGGL

SEQ ID NO: 3049643 - protein, 15 aa, Giardia lamblia
APSPTSPTNHAEPEA

SEQ ID NO: 3049644 - protein, 26 aa, Giardia lamblia
APSRSASLKVQDSSRSTVPISAEPQP

SEQ ID NO: 3049645 - protein, 12 aa, Giardia lamblia
APSSGKTSPVVP

SEQ ID NO: 3049646 - protein, 5 aa, Giardia lamblia
APSSP

SEQ ID NO: 3049647 - protein, 4 aa, Giardia lamblia
APST

SEQ ID NO: 3049648 - protein, 18 aa, Giardia lamblia
APSTSASSATNPETQPAA

SEQ ID NO: 3049649 - protein, 5 aa, Giardia lamblia
APSVE

SEQ ID NO: 3049650 - protein, 7 aa, Giardia lamblia
APTAFTP

SEQ ID NO: 3049651 - protein, 9 aa, Giardia lamblia
APTNPYPHI

SEQ ID NO: 3049652 - protein, 11 aa, Giardia lamblia
APTPPLPGVSA

SEQ ID NO: 3049653 - protein, 4 aa, Giardia lamblia
APTR

SEQ ID NO: 3049654 - protein, 14 aa, Giardia lamblia
APTSLSTTEPSSRV

SEQ ID NO: 3049655 - protein, 6 aa, Giardia lamblia
APTSRS

SEQ ID NO: 3049656 - protein, 4 aa, Giardia lamblia
APTT

SEQ ID NO: 3049657 - protein, 5 aa, Giardia lamblia
APTTI

SEQ ID NO: 3049658 - protein, 9 aa, Giardia lamblia
APTVKRSKS

SEQ ID NO: 3049659 - protein, 6 aa, Giardia lamblia
APTYSN

SEQ ID NO: 3049660 - protein, 8 aa, Giardia lamblia
APVAQPPA

SEQ ID NO: 3049661 - protein, 18 aa, Giardia lamblia
APVQPKRFSTSKIPTAPL

SEQ ID NO: 3049662 - protein, 13 aa, Giardia lamblia
APVRAHTTDMNTQ

SEQ ID NO: 3049663 - protein, 37 aa, Giardia lamblia
APVVSQPTSRPASRTATATKQGSKQTKATDQHNADQT

SEQ ID NO: 3049664 - protein, 6 aa, Giardia lamblia
APYATG

SEQ ID NO: 3049665 - protein, 5 aa, Giardia lamblia
APYGS

SEQ ID NO: 3049666 - protein, 4 aa, Giardia lamblia
APYN

SEQ ID NO: 3049667 - protein, 5 aa, Giardia lamblia
APYSI

SEQ ID NO: 3049668 - protein, 14 aa, Giardia lamblia
APYYPKDSEDPGDL

SEQ ID NO: 3049669 - protein, 8 aa, Giardia lamblia
AQAADSSR

SEQ ID NO: 3049670 - protein, 19 aa, Giardia lamblia
AQAETSEAIQPDDTPSVTE

SEQ ID NO: 3049671 - protein, 8 aa, Giardia lamblia
AQAKARAD

SEQ ID NO: 3049672 - protein, 7 aa, Giardia lamblia
AQAQDTE

SEQ ID NO: 3049673 - protein, 26 aa, Giardia lamblia
AQARQTTQNTGKIRPESSSSKPSTRH

SEQ ID NO: 3049674 - protein, 7 aa, Giardia lamblia
AQATDQS

SEQ ID NO: 3049675 - protein, 9 aa, Giardia lamblia
AQDDATDRC

SEQ ID NO: 3049676 - protein, 5 aa, Giardia lamblia
AQDGN

SEQ ID NO: 3049677 - protein, 4 aa, Giardia lamblia
AQDL

SEQ ID NO: 3049678 - protein, 25 aa, Giardia lamblia
AQDPIATLPPPALRAPTISAERYPE

SEQ ID NO: 3049679 - protein, 7 aa, Giardia lamblia
AQDRERR

SEQ ID NO: 3049680 - protein, 9 aa, Giardia lamblia
AQDSGGGAL

SEQ ID NO: 3049681 - protein, 8 aa, Giardia lamblia
AQDSPDSW

SEQ ID NO: 3049682 - protein, 5 aa, Giardia lamblia
AQEAE

SEQ ID NO: 3049683 - protein, 15 aa, Giardia lamblia
AQEAPFKESNTGDSR

SEQ ID NO: 3049684 - protein, 9 aa, Giardia lamblia
AQEEDVNNA

SEQ ID NO: 3049685 - protein, 7 aa, Giardia lamblia
AQEENSL

SEQ ID NO: 3049686 - protein, 30 aa, Giardia lamblia
AQEGSFREAESVSAGATMKPASSSSRTEYA

SEQ ID NO: 3049687 - protein, 12 aa, Giardia lamblia
AQEHEQAGSLSA

SEQ ID NO: 3049688 - protein, 6 aa, Giardia lamblia
AQEHHR

SEQ ID NO: 3049689 - protein, 4 aa, Giardia lamblia
AQEI

SEQ ID NO: 3049690 - protein, 87 aa, Giardia lamblia
AQEKDQDSINSELSDPSGEQHEEQADATGSTDEQAQEDDYNDLDDKNLSGQSDLSVPEADGEDETVNEELEEEQQQMSDLSNPDQDA

SEQ ID NO: 3049691 - protein, 12 aa, Giardia lamblia
AQEKSKSRNVKS

SEQ ID NO: 3049692 - protein, 17 aa, Giardia lamblia
AQERSHSCSSPKSGLRS

SEQ ID NO: 3049693 - protein, 10 aa, Giardia lamblia
AQESSTPTHA

SEQ ID NO: 3049694 - protein, 11 aa, Giardia lamblia
AQESTSNQGGC

SEQ ID NO: 3049695 - protein, 12 aa, Giardia lamblia
AQGADKQKNASH

SEQ ID NO: 3049696 - protein, 7 aa, Giardia lamblia
AQGAENT

SEQ ID NO: 3049697 - protein, 7 aa, Giardia lamblia
AQGCSGG

SEQ ID NO: 3049698 - protein, 8 aa, Giardia lamblia
AQGDKLAK

SEQ ID NO: 3049699 - protein, 8 aa, Giardia lamblia
AQGGADHG

SEQ ID NO: 3049700 - protein, 6 aa, Giardia lamblia
AQGGDS

SEQ ID NO: 3049701 - protein, 7 aa, Giardia lamblia
AQGNSGS

SEQ ID NO: 3049702 - protein, 6 aa, Giardia lamblia
AQGRSD

SEQ ID NO: 3049703 - protein, 4 aa, Giardia lamblia
AQGT

SEQ ID NO: 3049704 - protein, 8 aa, Giardia lamblia
AQHPGNRA

SEQ ID NO: 3049705 - protein, 9 aa, Giardia lamblia
AQKEEEEKI

SEQ ID NO: 3049706 - protein, 18 aa, Giardia lamblia
AQKETIEHARAGGERAEE

SEQ ID NO: 3049707 - protein, 5 aa, Giardia lamblia
AQKIK

SEQ ID NO: 3049708 - protein, 9 aa, Giardia lamblia
AQKRDSVGE

SEQ ID NO: 3049709 - protein, 18 aa, Giardia lamblia
AQKRRRRGHRGPKKQRNI

SEQ ID NO: 3049710 - protein, 13 aa, Giardia lamblia
AQKRSEEAAENTK

SEQ ID NO: 3049711 - protein, 4 aa, Giardia lamblia
AQKS

SEQ ID NO: 3049712 - protein, 5 aa, Giardia lamblia
AQLSN

SEQ ID NO: 3049713 - protein, 5 aa, Giardia lamblia
AQNAY

SEQ ID NO: 3049714 - protein, 4 aa, Giardia lamblia
AQNE

SEQ ID NO: 3049715 - protein, 8 aa, Giardia lamblia
AQNGGSSD

SEQ ID NO: 3049716 - protein, 8 aa, Giardia lamblia
AQNPPKVL

SEQ ID NO: 3049717 - protein, 26 aa, Giardia lamblia
AQNQKGYEPTYYDPTQDKIDPTDRVG

SEQ ID NO: 3049718 - protein, 8 aa, Giardia lamblia
AQNQNASS

SEQ ID NO: 3049719 - protein, 8 aa, Giardia lamblia
AQQDEEED

SEQ ID NO: 3049720 - protein, 10 aa, Giardia lamblia
AQQDKHSACD

SEQ ID NO: 3049721 - protein, 18 aa, Giardia lamblia
AQQESKGISPQRSGKTHQ

SEQ ID NO: 3049722 - protein, 7 aa, Giardia lamblia
AQQGSEE

SEQ ID NO: 3049723 - protein, 6 aa, Giardia lamblia
AQQNNQ

SEQ ID NO: 3049724 - protein, 22 aa, Giardia lamblia
AQQNPASERATGAIGDDNLGEY

SEQ ID NO: 3049725 - protein, 52 aa, Giardia lamblia
AQQQATNDEEEMQKDTEYDQENITDSNPDANEVGTNDQKQTHEDNDQFRQEN

SEQ ID NO: 3049726 - protein, 14 aa, Giardia lamblia
AQQQKQADTKTSVD

SEQ ID NO: 3049727 - protein, 31 aa, Giardia lamblia
AQQRTQDLADSRDSCVESNTASDLAYSASDE

SEQ ID NO: 3049728 - protein, 10 aa, Giardia lamblia
AQQSDGASLG

SEQ ID NO: 3049729 - protein, 10 aa, Giardia lamblia
AQQSLSSNLE

SEQ ID NO: 3049730 - protein, 9 aa, Giardia lamblia
AQQSRRQPF

SEQ ID NO: 3049731 - protein, 5 aa, Giardia lamblia
AQQTD

SEQ ID NO: 3049732 - protein, 6 aa, Giardia lamblia
AQQTTR

SEQ ID NO: 3049733 - protein, 5 aa, Giardia lamblia
AQQVK

SEQ ID NO: 3049734 - protein, 18 aa, Giardia lamblia
AQREEQNSKAQKNSESFG

SEQ ID NO: 3049735 - protein, 6 aa, Giardia lamblia
AQRKQK

SEQ ID NO: 3049736 - protein, 14 aa, Giardia lamblia
AQRMGPGNKAATIE

SEQ ID NO: 3049737 - protein, 10 aa, Giardia lamblia
AQSDDSLKIS

SEQ ID NO: 3049738 - protein, 7 aa, Giardia lamblia
AQSDDTY

SEQ ID NO: 3049739 - protein, 11 aa, Giardia lamblia
AQSDGSGGSVE

SEQ ID NO: 3049740 - protein, 10 aa, Giardia lamblia
AQSGETDFSY

SEQ ID NO: 3049741 - protein, 11 aa, Giardia lamblia
AQSGSPGTYTF

SEQ ID NO: 3049742 - protein, 8 aa, Giardia lamblia
AQSGSTGK

SEQ ID NO: 3049743 - protein, 19 aa, Giardia lamblia
AQSGTLTTNQHASSSTMST

SEQ ID NO: 3049744 - protein, 5 aa, Giardia lamblia
AQSIE

SEQ ID NO: 3049745 - protein, 7 aa, Giardia lamblia
AQSKQEY

SEQ ID NO: 3049746 - protein, 4 aa, Giardia lamblia
AQSL

SEQ ID NO: 3049747 - protein, 8 aa, Giardia lamblia
AQSPVSAG

SEQ ID NO: 3049748 - protein, 9 aa, Giardia lamblia
AQSSSLETD

SEQ ID NO: 3049749 - protein, 6 aa, Giardia lamblia
AQSTRA

SEQ ID NO: 3049750 - protein, 5 aa, Giardia lamblia
AQSVN

SEQ ID NO: 3049751 - protein, 5 aa, Giardia lamblia
AQTDK

SEQ ID NO: 3049752 - protein, 5 aa, Giardia lamblia
AQTDP

SEQ ID NO: 3049753 - protein, 6 aa, Giardia lamblia
AQTEPL

SEQ ID NO: 3049754 - protein, 6 aa, Giardia lamblia
AQTGDV

SEQ ID NO: 3049755 - protein, 22 aa, Giardia lamblia
AQTKKKSAQEKAKSKASRTNVA

SEQ ID NO: 3049756 - protein, 30 aa, Giardia lamblia
AQTNDNGATKRCTSCTGRKGSRSDDPNAET

SEQ ID NO: 3049757 - protein, 5 aa, Giardia lamblia
AQTPA

SEQ ID NO: 3049758 - protein, 7 aa, Giardia lamblia
AQTSGEA

SEQ ID NO: 3049759 - protein, 5 aa, Giardia lamblia
AQTTD

SEQ ID NO: 3049760 - protein, 15 aa, Giardia lamblia
AQVETLQKEQEALAP

SEQ ID NO: 3049761 - protein, 7 aa, Giardia lamblia
AQVNSKL

SEQ ID NO: 3049762 - protein, 9 aa, Giardia lamblia
AQVPTGDHE

SEQ ID NO: 3049763 - protein, 19 aa, Giardia lamblia
AQVSQDDKNSDSASKRQRD

SEQ ID NO: 3049764 - protein, 20 aa, Giardia lamblia
AQYDAQRPAGEAENEKAEEQ

SEQ ID NO: 3049765 - protein, 6 aa, Giardia lamblia
AQYDRP

SEQ ID NO: 3049766 - protein, 5 aa, Giardia lamblia
AQYPQ

SEQ ID NO: 3049767 - protein, 7 aa, Giardia lamblia
AQYTKSA

SEQ ID NO: 3049768 - protein, 4 aa, Giardia lamblia
ARAG

SEQ ID NO: 3049769 - protein, 14 aa, Giardia lamblia
ARAKGKKHQSGRRS

SEQ ID NO: 3049770 - protein, 7 aa, Giardia lamblia
ARAMTEE

SEQ ID NO: 3049771 - protein, 5 aa, Giardia lamblia
ARANK

SEQ ID NO: 3049772 - protein, 6 aa, Giardia lamblia
ARAPHK

SEQ ID NO: 3049773 - protein, 6 aa, Giardia lamblia
ARARSS

SEQ ID NO: 3049774 - protein, 10 aa, Giardia lamblia
ARARTGRAIY

SEQ ID NO: 3049775 - protein, 19 aa, Giardia lamblia
ARASAGSKQTRGYKGTYQS

SEQ ID NO: 3049776 - protein, 17 aa, Giardia lamblia
ARASSETVQKAAQETES

SEQ ID NO: 3049777 - protein, 4 aa, Giardia lamblia
ARDA

SEQ ID NO: 3049778 - protein, 11 aa, Giardia lamblia
ARDAARGKKRM

SEQ ID NO: 3049779 - protein, 8 aa, Giardia lamblia
ARDADTRS

SEQ ID NO: 3049780 - protein, 13 aa, Giardia lamblia
ARDPAVREQREME

SEQ ID NO: 3049781 - protein, 8 aa, Giardia lamblia
ARDPTEPM

SEQ ID NO: 3049782 - protein, 7 aa, Giardia lamblia
ARDTASS

SEQ ID NO: 3049783 - protein, 7 aa, Giardia lamblia
ARDTTNT

SEQ ID NO: 3049784 - protein, 8 aa, Giardia lamblia
AREAQKAE

SEQ ID NO: 3049785 - protein, 5 aa, Giardia lamblia
AREFQ

SEQ ID NO: 3049786 - protein, 14 aa, Giardia lamblia
AREQARPGQSPNKL

SEQ ID NO: 3049787 - protein, 8 aa, Giardia lamblia
ARFPPRTK

SEQ ID NO: 3049788 - protein, 4 aa, Giardia lamblia
ARGG

SEQ ID NO: 3049789 - protein, 13 aa, Giardia lamblia
ARGGASVQNNEDD

SEQ ID NO: 3049790 - protein, 5 aa, Giardia lamblia
ARGIP

SEQ ID NO: 3049791 - protein, 7 aa, Giardia lamblia
ARGLDSK

SEQ ID NO: 3049792 - protein, 22 aa, Giardia lamblia
ARGQISSDTPSGRKTPRSHSSV

SEQ ID NO: 3049793 - protein, 10 aa, Giardia lamblia
ARGRQATARP

SEQ ID NO: 3049794 - protein, 10 aa, Giardia lamblia
ARGSADSSSE

SEQ ID NO: 3049795 - protein, 13 aa, Giardia lamblia
ARGSSELADEDPA

SEQ ID NO: 3049796 - protein, 10 aa, Giardia lamblia
ARHSNEGKKF

SEQ ID NO: 3049797 - protein, 11 aa, Giardia lamblia
ARKADTSDSFS

SEQ ID NO: 3049798 - protein, 18 aa, Giardia lamblia
ARKGKAPEGRAGKKTRAL

SEQ ID NO: 3049799 - protein, 8 aa, Giardia lamblia
ARKGVTGS

SEQ ID NO: 3049800 - protein, 7 aa, Giardia lamblia
ARKHDLN

SEQ ID NO: 3049801 - protein, 7 aa, Giardia lamblia
ARKKDAA

SEQ ID NO: 3049802 - protein, 13 aa, Giardia lamblia
ARKRSTDVTRPSL

SEQ ID NO: 3049803 - protein, 12 aa, Giardia lamblia
ARKRTAAIAGGT

SEQ ID NO: 3049804 - protein, 13 aa, Giardia lamblia
ARKRTAAIAGGTV

SEQ ID NO: 3049805 - protein, 9 aa, Giardia lamblia
ARKTDLSKM

SEQ ID NO: 3049806 - protein, 7 aa, Giardia lamblia
ARKYYDP

SEQ ID NO: 3049807 - protein, 8 aa, Giardia lamblia
ARLQARTE

SEQ ID NO: 3049808 - protein, 11 aa, Giardia lamblia
ARLSSEQCTRR

SEQ ID NO: 3049809 - protein, 11 aa, Giardia lamblia
ARMQDKNGTTA

SEQ ID NO: 3049810 - protein, 9 aa, Giardia lamblia
ARMQDNDGY

SEQ ID NO: 3049811 - protein, 5 aa, Giardia lamblia
ARMQN

SEQ ID NO: 3049812 - protein, 7 aa, Giardia lamblia
ARNCSPE

SEQ ID NO: 3049813 - protein, 14 aa, Giardia lamblia
ARNKASAPLASRPD

SEQ ID NO: 3049814 - protein, 5 aa, Giardia lamblia
ARNQG

SEQ ID NO: 3049815 - protein, 4 aa, Giardia lamblia
ARNV

SEQ ID NO: 3049816 - protein, 6 aa, Giardia lamblia
ARNVPL

SEQ ID NO: 3049817 - protein, 4 aa, Giardia lamblia
ARPA

SEQ ID NO: 3049818 - protein, 4 aa, Giardia lamblia
ARPF

SEQ ID NO: 3049819 - protein, 52 aa, Giardia lamblia
ARPFTEKEKESKTPDSSDSQEPASHPTEDHSGSFKEDISTADSSDNSNDKVI

SEQ ID NO: 3049820 - protein, 5 aa, Giardia lamblia
ARPGT

SEQ ID NO: 3049821 - protein, 8 aa, Giardia lamblia
ARPKDSST

SEQ ID NO: 3049822 - protein, 6 aa, Giardia lamblia
ARPLDQ

SEQ ID NO: 3049823 - protein, 13 aa, Giardia lamblia
ARPLSSSLTTKPG

SEQ ID NO: 3049824 - protein, 6 aa, Giardia lamblia
ARPNEV

SEQ ID NO: 3049825 - protein, 4 aa, Giardia lamblia
ARPY

SEQ ID NO: 3049826 - protein, 7 aa, Giardia lamblia
ARPYSRE

SEQ ID NO: 3049827 - protein, 7 aa, Giardia lamblia
ARQDSTE

SEQ ID NO: 3049828 - protein, 14 aa, Giardia lamblia
ARQEHEDGDEQTQF

SEQ ID NO: 3049829 - protein, 63 aa, Giardia lamblia
ARQGDSMDTRPSGDEAEPAPTEAGDAEGSDRARQESKLPDQGGEERTKEDPDTDMHDAPQPSL

SEQ ID NO: 3049830 - protein, 11 aa, Giardia lamblia
ARQSSASPATC

SEQ ID NO: 3049831 - protein, 9 aa, Giardia lamblia
ARRADTASL

SEQ ID NO: 3049832 - protein, 11 aa, Giardia lamblia
ARRASTDARTS

SEQ ID NO: 3049833 - protein, 5 aa, Giardia lamblia
ARRED

SEQ ID NO: 3049834 - protein, 5 aa, Giardia lamblia
ARRPV

SEQ ID NO: 3049835 - protein, 4 aa, Giardia lamblia
ARRQ

SEQ ID NO: 3049836 - protein, 12 aa, Giardia lamblia
ARRSPSQSPKNK

SEQ ID NO: 3049837 - protein, 6 aa, Giardia lamblia
ARSAAL

SEQ ID NO: 3049838 - protein, 8 aa, Giardia lamblia
ARSETQSL

SEQ ID NO: 3049839 - protein, 16 aa, Giardia lamblia
ARSGQKSSESGLADTA

SEQ ID NO: 3049840 - protein, 19 aa, Giardia lamblia
ARSGVSVTSNRTHDTLSST

SEQ ID NO: 3049841 - protein, 4 aa, Giardia lamblia
ARSI

SEQ ID NO: 3049842 - protein, 8 aa, Giardia lamblia
ARSPTGDG

SEQ ID NO: 3049843 - protein, 7 aa, Giardia lamblia
ARSQVRT

SEQ ID NO: 3049844 - protein, 4 aa, Giardia lamblia
ARSR

SEQ ID NO: 3049845 - protein, 12 aa, Giardia lamblia
ARSRRNTCGGPL

SEQ ID NO: 3049846 - protein, 7 aa, Giardia lamblia
ARSSHSS

SEQ ID NO: 3049847 - protein, 6 aa, Giardia lamblia
ARSSSF

SEQ ID NO: 3049848 - protein, 6 aa, Giardia lamblia
ARSVRS

SEQ ID NO: 3049849 - protein, 4 aa, Giardia lamblia
ARSY

SEQ ID NO: 3049850 - protein, 6 aa, Giardia lamblia
ARSYQT

SEQ ID NO: 3049851 - protein, 10 aa, Giardia lamblia
ARSYSSGSNG

SEQ ID NO: 3049852 - protein, 5 aa, Giardia lamblia
ARTAA

SEQ ID NO: 3049853 - protein, 6 aa, Giardia lamblia
ARTPLS

SEQ ID NO: 3049854 - protein, 5 aa, Giardia lamblia
ARTQK

SEQ ID NO: 3049855 - protein, 4 aa, Giardia lamblia
ARTR

SEQ ID NO: 3049856 - protein, 10 aa, Giardia lamblia
ARTSDSSYHP

SEQ ID NO: 3049857 - protein, 5 aa, Giardia lamblia
ARVAR

SEQ ID NO: 3049858 - protein, 10 aa, Giardia lamblia
ARVSRENLGH

SEQ ID NO: 3049859 - protein, 9 aa, Giardia lamblia
ARYPNRAPL

SEQ ID NO: 3049860 - protein, 9 aa, Giardia lamblia
ARYSNGNPN

SEQ ID NO: 3049861 - protein, 4 aa, Giardia lamblia
ASAA

SEQ ID NO: 3049862 - protein, 12 aa, Giardia lamblia
ASADSSGNTCDK

SEQ ID NO: 3049863 - protein, 7 aa, Giardia lamblia
ASADVNN

SEQ ID NO: 3049864 - protein, 4 aa, Giardia lamblia
ASAE

SEQ ID NO: 3049865 - protein, 7 aa, Giardia lamblia
ASAEAKN

SEQ ID NO: 3049866 - protein, 17 aa, Giardia lamblia
ASAEGSKSTSCPGAPSS

SEQ ID NO: 3049867 - protein, 5 aa, Giardia lamblia
ASAGQ

SEQ ID NO: 3049868 - protein, 20 aa, Giardia lamblia
ASAKRVSLDDADEDDGMTPS

SEQ ID NO: 3049869 - protein, 8 aa, Giardia lamblia
ASALSGGR

SEQ ID NO: 3049870 - protein, 13 aa, Giardia lamblia
ASANDIETGISDA

SEQ ID NO: 3049871 - protein, 6 aa, Giardia lamblia
ASANGI

SEQ ID NO: 3049872 - protein, 8 aa, Giardia lamblia
ASANGITG

SEQ ID NO: 3049873 - protein, 4 aa, Giardia lamblia
ASAP

SEQ ID NO: 3049874 - protein, 10 aa, Giardia lamblia
ASAPQPRVSS

SEQ ID NO: 3049875 - protein, 8 aa, Giardia lamblia
ASAQGLDR

SEQ ID NO: 3049876 - protein, 9 aa, Giardia lamblia
ASARKYGRP

SEQ ID NO: 3049877 - protein, 31 aa, Giardia lamblia
ASASAPADASDHASESVNETPNGATRGEANL

SEQ ID NO: 3049878 - protein, 7 aa, Giardia lamblia
ASASARI

SEQ ID NO: 3049879 - protein, 9 aa, Giardia lamblia
ASASFESES

SEQ ID NO: 3049880 - protein, 22 aa, Giardia lamblia
ASASPHKSISSRPYSSEAGAVS

SEQ ID NO: 3049881 - protein, 6 aa, Giardia lamblia
ASATDV

SEQ ID NO: 3049882 - protein, 9 aa, Giardia lamblia
ASATTREAN

SEQ ID NO: 3049883 - protein, 5 aa, Giardia lamblia
ASAVP

SEQ ID NO: 3049884 - protein, 11 aa, Giardia lamblia
ASAVSETTENR

SEQ ID NO: 3049885 - protein, 6 aa, Giardia lamblia
ASAYQD

SEQ ID NO: 3049886 - protein, 20 aa, Giardia lamblia
ASDAPDISPEKDAGVDFPDP

SEQ ID NO: 3049887 - protein, 8 aa, Giardia lamblia
ASDDLQSN

SEQ ID NO: 3049888 - protein, 11 aa, Giardia lamblia
ASDDTKQKTMC

SEQ ID NO: 3049889 - protein, 6 aa, Giardia lamblia
ASDEAT

SEQ ID NO: 3049890 - protein, 12 aa, Giardia lamblia
ASDEQSRPSTSS

SEQ ID NO: 3049891 - protein, 16 aa, Giardia lamblia
ASDKADSGTKGATDLA

SEQ ID NO: 3049892 - protein, 7 aa, Giardia lamblia
ASDKDFP

SEQ ID NO: 3049893 - protein, 5 aa, Giardia lamblia
ASDLQ

SEQ ID NO: 3049894 - protein, 6 aa, Giardia lamblia
ASDNEE

SEQ ID NO: 3049895 - protein, 12 aa, Giardia lamblia
ASDNGTSSVGAP

SEQ ID NO: 3049896 - protein, 15 aa, Giardia lamblia
ASDPGSGTWGPEPYK

SEQ ID NO: 3049897 - protein, 7 aa, Giardia lamblia
ASDRISS

SEQ ID NO: 3049898 - protein, 8 aa, Giardia lamblia
ASDSDDMD

SEQ ID NO: 3049899 - protein, 11 aa, Giardia lamblia
ASDSNSGTLDP

SEQ ID NO: 3049900 - protein, 13 aa, Giardia lamblia
ASDTSDTGSKQHE

SEQ ID NO: 3049901 - protein, 6 aa, Giardia lamblia
ASDVKD

SEQ ID NO: 3049902 - protein, 9 aa, Giardia lamblia
ASDYGSPQG

SEQ ID NO: 3049903 - protein, 7 aa, Giardia lamblia
ASEDAEQ

SEQ ID NO: 3049904 - protein, 28 aa, Giardia lamblia
ASEDGPEDVRPTETLPPPAEEFRGRGRS

SEQ ID NO: 3049905 - protein, 20 aa, Giardia lamblia
ASEETKRAPEDVAAASARGN

SEQ ID NO: 3049906 - protein, 15 aa, Giardia lamblia
ASEIARTKYTPESVS

SEQ ID NO: 3049907 - protein, 31 aa, Giardia lamblia
ASELDRKPALVPKQRPSSKSRSARKAKTASF

SEQ ID NO: 3049908 - protein, 11 aa, Giardia lamblia
ASENDETENSV

SEQ ID NO: 3049909 - protein, 12 aa, Giardia lamblia
ASENLKRSYPVT

SEQ ID NO: 3049910 - protein, 7 aa, Giardia lamblia
ASENRLS

SEQ ID NO: 3049911 - protein, 7 aa, Giardia lamblia
ASENSSE

SEQ ID NO: 3049912 - protein, 9 aa, Giardia lamblia
ASEQARRNM

SEQ ID NO: 3049913 - protein, 15 aa, Giardia lamblia
ASERSATETSPEHSV

SEQ ID NO: 3049914 - protein, 8 aa, Giardia lamblia
ASESQKIY

SEQ ID NO: 3049915 - protein, 8 aa, Giardia lamblia
ASETQVET

SEQ ID NO: 3049916 - protein, 7 aa, Giardia lamblia
ASEVPTK

SEQ ID NO: 3049917 - protein, 8 aa, Giardia lamblia
ASFDPRAD

SEQ ID NO: 3049918 - protein, 7 aa, Giardia lamblia
ASFGAPR

SEQ ID NO: 3049919 - protein, 8 aa, Giardia lamblia
ASGADTER

SEQ ID NO: 3049920 - protein, 7 aa, Giardia lamblia
ASGALST

SEQ ID NO: 3049921 - protein, 7 aa, Giardia lamblia
ASGDSEW

SEQ ID NO: 3049922 - protein, 7 aa, Giardia lamblia
ASGEVSV

SEQ ID NO: 3049923 - protein, 8 aa, Giardia lamblia
ASGGGKST

SEQ ID NO: 3049924 - protein, 21 aa, Giardia lamblia
ASGGPAGESGEKANASNSGLS

SEQ ID NO: 3049925 - protein, 9 aa, Giardia lamblia
ASGIDPDAH

SEQ ID NO: 3049926 - protein, 10 aa, Giardia lamblia
ASGLEEKPLQ

SEQ ID NO: 3049927 - protein, 4 aa, Giardia lamblia
ASGQ

SEQ ID NO: 3049928 - protein, 6 aa, Giardia lamblia
ASGRFG

SEQ ID NO: 3049929 - protein, 5 aa, Giardia lamblia
ASGRM

SEQ ID NO: 3049930 - protein, 7 aa, Giardia lamblia
ASGRQQE

SEQ ID NO: 3049931 - protein, 13 aa, Giardia lamblia
ASGSVDDLSAQSR

SEQ ID NO: 3049932 - protein, 8 aa, Giardia lamblia
ASGTCSSE

SEQ ID NO: 3049933 - protein, 7 aa, Giardia lamblia
ASGVTTK

SEQ ID NO: 3049934 - protein, 16 aa, Giardia lamblia
ASGYKKYTSNDEYNGR

SEQ ID NO: 3049935 - protein, 23 aa, Giardia lamblia
ASHAPSNETSACPAPEKPQEAKD

SEQ ID NO: 3049936 - protein, 6 aa, Giardia lamblia
ASHDSP

SEQ ID NO: 3049937 - protein, 7 aa, Giardia lamblia
ASHETTS

SEQ ID NO: 3049938 - protein, 5 aa, Giardia lamblia
ASHGL

SEQ ID NO: 3049939 - protein, 6 aa, Giardia lamblia
ASHSGH

SEQ ID NO: 3049940 - protein, 8 aa, Giardia lamblia
ASHSSSGK

SEQ ID NO: 3049941 - protein, 9 aa, Giardia lamblia
ASIADSAGH

SEQ ID NO: 3049942 - protein, 4 aa, Giardia lamblia
ASIP

SEQ ID NO: 3049943 - protein, 7 aa, Giardia lamblia
ASIRPQS

SEQ ID NO: 3049944 - protein, 8 aa, Giardia lamblia
ASKAGGVT

SEQ ID NO: 3049945 - protein, 8 aa, Giardia lamblia
ASKDSEGF

SEQ ID NO: 3049946 - protein, 6 aa, Giardia lamblia
ASKDYI

SEQ ID NO: 3049947 - protein, 8 aa, Giardia lamblia
ASKESEAN

SEQ ID NO: 3049948 - protein, 10 aa, Giardia lamblia
ASKGDDLKPN

SEQ ID NO: 3049949 - protein, 5 aa, Giardia lamblia
ASKHE

SEQ ID NO: 3049950 - protein, 8 aa, Giardia lamblia
ASKIGDRY

SEQ ID NO: 3049951 - protein, 7 aa, Giardia lamblia
ASKISQG

SEQ ID NO: 3049952 - protein, 10 aa, Giardia lamblia
ASKPSPKPAV

SEQ ID NO: 3049953 - protein, 7 aa, Giardia lamblia
ASKQGAL

SEQ ID NO: 3049954 - protein, 7 aa, Giardia lamblia
ASKQRRR

SEQ ID NO: 3049955 - protein, 7 aa, Giardia lamblia
ASKRAKA

SEQ ID NO: 3049956 - protein, 19 aa, Giardia lamblia
ASKRSLAAASRRDSGRLEE

SEQ ID NO: 3049957 - protein, 8 aa, Giardia lamblia
ASKRTAGL

SEQ ID NO: 3049958 - protein, 10 aa, Giardia lamblia
ASKVETSDSI

SEQ ID NO: 3049959 - protein, 11 aa, Giardia lamblia
ASLDGESNLKP

SEQ ID NO: 3049960 - protein, 7 aa, Giardia lamblia
ASLEEQK

SEQ ID NO: 3049961 - protein, 7 aa, Giardia lamblia
ASLGKYY

SEQ ID NO: 3049962 - protein, 11 aa, Giardia lamblia
ASLPNPKKTFS

SEQ ID NO: 3049963 - protein, 6 aa, Giardia lamblia
ASLPSL

SEQ ID NO: 3049964 - protein, 9 aa, Giardia lamblia
ASLQQTDPT

SEQ ID NO: 3049965 - protein, 7 aa, Giardia lamblia
ASLRAKA

SEQ ID NO: 3049966 - protein, 6 aa, Giardia lamblia
ASLSEK

SEQ ID NO: 3049967 - protein, 13 aa, Giardia lamblia
ASLSGGAKNHARK

SEQ ID NO: 3049968 - protein, 21 aa, Giardia lamblia
ASLSSSQGASLASPLQRGSDA

SEQ ID NO: 3049969 - protein, 11 aa, Giardia lamblia
ASLTPSNGHRF

SEQ ID NO: 3049970 - protein, 5 aa, Giardia lamblia
ASLTS

SEQ ID NO: 3049971 - protein, 7 aa, Giardia lamblia
ASLTTKS

SEQ ID NO: 3049972 - protein, 11 aa, Giardia lamblia
ASMGKRPIQPE

SEQ ID NO: 3049973 - protein, 6 aa, Giardia lamblia
ASMPRN

SEQ ID NO: 3049974 - protein, 12 aa, Giardia lamblia
ASMQKGEGSPKC

SEQ ID NO: 3049975 - protein, 7 aa, Giardia lamblia
ASNATIE

SEQ ID NO: 3049976 - protein, 7 aa, Giardia lamblia
ASNEMTK

SEQ ID NO: 3049977 - protein, 4 aa, Giardia lamblia
ASNG

SEQ ID NO: 3049978 - protein, 11 aa, Giardia lamblia
ASNGELSPRTL

SEQ ID NO: 3049979 - protein, 6 aa, Giardia lamblia
ASNGNI

SEQ ID NO: 3049980 - protein, 5 aa, Giardia lamblia
ASNGV

SEQ ID NO: 3049981 - protein, 15 aa, Giardia lamblia
ASNKRIGQGNSQGID

SEQ ID NO: 3049982 - protein, 5 aa, Giardia lamblia
ASNKT

SEQ ID NO: 3049983 - protein, 10 aa, Giardia lamblia
ASNNGKFTDN

SEQ ID NO: 3049984 - protein, 8 aa, Giardia lamblia
ASNNNECT

SEQ ID NO: 3049985 - protein, 10 aa, Giardia lamblia
ASNPPSPSTS

SEQ ID NO: 3049986 - protein, 6 aa, Giardia lamblia
ASNPSS

SEQ ID NO: 3049987 - protein, 7 aa, Giardia lamblia
ASNQPDH

SEQ ID NO: 3049988 - protein, 7 aa, Giardia lamblia
ASNSLRT

SEQ ID NO: 3049989 - protein, 6 aa, Giardia lamblia
ASNSMS

SEQ ID NO: 3049990 - protein, 8 aa, Giardia lamblia
ASNSNSEV

SEQ ID NO: 3049991 - protein, 6 aa, Giardia lamblia
ASNSNT

SEQ ID NO: 3049992 - protein, 14 aa, Giardia lamblia
ASPARQSANADSLT

SEQ ID NO: 3049993 - protein, 7 aa, Giardia lamblia
ASPDDTV

SEQ ID NO: 3049994 - protein, 6 aa, Giardia lamblia
ASPDLN

SEQ ID NO: 3049995 - protein, 6 aa, Giardia lamblia
ASPDRT

SEQ ID NO: 3049996 - protein, 4 aa, Giardia lamblia
ASPE

SEQ ID NO: 3049997 - protein, 5 aa, Giardia lamblia
ASPEY

SEQ ID NO: 3049998 - protein, 4 aa, Giardia lamblia
ASPF

SEQ ID NO: 3049999 - protein, 6 aa, Giardia lamblia
ASPFNS

SEQ ID NO: 3050000 - protein, 7 aa, Giardia lamblia
ASPFSSK

SEQ ID NO: 3050001 - protein, 5 aa, Giardia lamblia
ASPGY

SEQ ID NO: 3050002 - protein, 4 aa, Giardia lamblia
ASPH

SEQ ID NO: 3050003 - protein, 35 aa, Giardia lamblia
ASPHTHSAKNPNENPSKKTLHGVSSSSDAQLKTDD

SEQ ID NO: 3050004 - protein, 6 aa, Giardia lamblia
ASPIEG

SEQ ID NO: 3050005 - protein, 6 aa, Giardia lamblia
ASPITT

SEQ ID NO: 3050006 - protein, 4 aa, Giardia lamblia
ASPK

SEQ ID NO: 3050007 - protein, 7 aa, Giardia lamblia
ASPPCPR

SEQ ID NO: 3050008 - protein, 6 aa, Giardia lamblia
ASPPGN

SEQ ID NO: 3050009 - protein, 7 aa, Giardia lamblia
ASPPKLA

SEQ ID NO: 3050010 - protein, 39 aa, Giardia lamblia
ASPPSDSDSDVAESTTTATTAIDSSEEESGHAADPTDEL

SEQ ID NO: 3050011 - protein, 6 aa, Giardia lamblia
ASPQFR

SEQ ID NO: 3050012 - protein, 5 aa, Giardia lamblia
ASPSA

SEQ ID NO: 3050013 - protein, 6 aa, Giardia lamblia
ASPSEL

SEQ ID NO: 3050014 - protein, 12 aa, Giardia lamblia
ASPSKTKPKTID

SEQ ID NO: 3050015 - protein, 6 aa, Giardia lamblia
ASPSTT

SEQ ID NO: 3050016 - protein, 12 aa, Giardia lamblia
ASPSVSVPPFQQ

SEQ ID NO: 3050017 - protein, 5 aa, Giardia lamblia
ASPTQ

SEQ ID NO: 3050018 - protein, 6 aa, Giardia lamblia
ASPTVV

SEQ ID NO: 3050019 - protein, 8 aa, Giardia lamblia
ASPWPNTG

SEQ ID NO: 3050020 - protein, 4 aa, Giardia lamblia
ASQC

SEQ ID NO: 3050021 - protein, 6 aa, Giardia lamblia
ASQDHV

SEQ ID NO: 3050022 - protein, 4 aa, Giardia lamblia
ASQE

SEQ ID NO: 3050023 - protein, 25 aa, Giardia lamblia
ASQEDQPVTADKHTEHPSSLEPEHG

SEQ ID NO: 3050024 - protein, 21 aa, Giardia lamblia
ASQPPVPDRDNLGNDDDEYAK

SEQ ID NO: 3050025 - protein, 11 aa, Giardia lamblia
ASQQSSKREVT

SEQ ID NO: 3050026 - protein, 7 aa, Giardia lamblia
ASQSSTL

SEQ ID NO: 3050027 - protein, 5 aa, Giardia lamblia
ASQTD

SEQ ID NO: 3050028 - protein, 8 aa, Giardia lamblia
ASQTPQHT

SEQ ID NO: 3050029 - protein, 10 aa, Giardia lamblia
ASRARKEECA

SEQ ID NO: 3050030 - protein, 8 aa, Giardia lamblia
ASRGGLDG

SEQ ID NO: 3050031 - protein, 9 aa, Giardia lamblia
ASRNKKLGS

SEQ ID NO: 3050032 - protein, 7 aa, Giardia lamblia
ASRNNNN

SEQ ID NO: 3050033 - protein, 5 aa, Giardia lamblia
ASRNP

SEQ ID NO: 3050034 - protein, 7 aa, Giardia lamblia
ASRNSQG

SEQ ID NO: 3050035 - protein, 6 aa, Giardia lamblia
ASRSAR

SEQ ID NO: 3050036 - protein, 6 aa, Giardia lamblia
ASRSPR

SEQ ID NO: 3050037 - protein, 5 aa, Giardia lamblia
ASRTR

SEQ ID NO: 3050038 - protein, 7 aa, Giardia lamblia
ASSADAL

SEQ ID NO: 3050039 - protein, 7 aa, Giardia lamblia
ASSAFKG

SEQ ID NO: 3050040 - protein, 8 aa, Giardia lamblia
ASSAKLPA

SEQ ID NO: 3050041 - protein, 9 aa, Giardia lamblia
ASSASTATA

SEQ ID NO: 3050042 - protein, 30 aa, Giardia lamblia
ASSCNGDKYPDPSTGKCTACNGAADQGGIP

SEQ ID NO: 3050043 - protein, 21 aa, Giardia lamblia
ASSDLDKHSYDLQSSSITNEY

SEQ ID NO: 3050044 - protein, 7 aa, Giardia lamblia
ASSDPID

SEQ ID NO: 3050045 - protein, 6 aa, Giardia lamblia
ASSEQY

SEQ ID NO: 3050046 - protein, 15 aa, Giardia lamblia
ASSESLDTSKGTIKT

SEQ ID NO: 3050047 - protein, 9 aa, Giardia lamblia
ASSESSPTT

SEQ ID NO: 3050048 - protein, 6 aa, Giardia lamblia
ASSEYE

SEQ ID NO: 3050049 - protein, 8 aa, Giardia lamblia
ASSFNPQY

SEQ ID NO: 3050050 - protein, 8 aa, Giardia lamblia
ASSFTIPS

SEQ ID NO: 3050051 - protein, 6 aa, Giardia lamblia
ASSGSC

SEQ ID NO: 3050052 - protein, 31 aa, Giardia lamblia
ASSHKQSQKEDRRMGKKKRTRAAPPKKAGRS

SEQ ID NO: 3050053 - protein, 14 aa, Giardia lamblia
ASSINGYEQDRTAN

SEQ ID NO: 3050054 - protein, 11 aa, Giardia lamblia
ASSKPNSEEDG

SEQ ID NO: 3050055 - protein, 4 aa, Giardia lamblia
ASSL

SEQ ID NO: 3050056 - protein, 5 aa, Giardia lamblia
ASSLS

SEQ ID NO: 3050057 - protein, 5 aa, Giardia lamblia
ASSNL

SEQ ID NO: 3050058 - protein, 10 aa, Giardia lamblia
ASSPAARYTS

SEQ ID NO: 3050059 - protein, 7 aa, Giardia lamblia
ASSPAEI

SEQ ID NO: 3050060 - protein, 7 aa, Giardia lamblia
ASSPDEI

SEQ ID NO: 3050061 - protein, 8 aa, Giardia lamblia
ASSPGSAQ

SEQ ID NO: 3050062 - protein, 9 aa, Giardia lamblia
ASSPSLEYT

SEQ ID NO: 3050063 - protein, 8 aa, Giardia lamblia
ASSPTLIG

SEQ ID NO: 3050064 - protein, 7 aa, Giardia lamblia
ASSPTSD

SEQ ID NO: 3050065 - protein, 9 aa, Giardia lamblia
ASSPVPTAQ

SEQ ID NO: 3050066 - protein, 10 aa, Giardia lamblia
ASSQEQARPS

SEQ ID NO: 3050067 - protein, 5 aa, Giardia lamblia
ASSQN

SEQ ID NO: 3050068 - protein, 8 aa, Giardia lamblia
ASSRASPE

SEQ ID NO: 3050069 - protein, 8 aa, Giardia lamblia
ASSSDPLE

SEQ ID NO: 3050070 - protein, 10 aa, Giardia lamblia
ASSSLKSNSY

SEQ ID NO: 3050071 - protein, 14 aa, Giardia lamblia
ASSSPPPTFKENEY

SEQ ID NO: 3050072 - protein, 7 aa, Giardia lamblia
ASSTDQS

SEQ ID NO: 3050073 - protein, 7 aa, Giardia lamblia
ASSTGLS

SEQ ID NO: 3050074 - protein, 31 aa, Giardia lamblia
ASSTQSPSHNNDAQESPEPNSALAAADTQAI

SEQ ID NO: 3050075 - protein, 5 aa, Giardia lamblia
ASSTS

SEQ ID NO: 3050076 - protein, 11 aa, Giardia lamblia
ASSTSTGQSLQ

SEQ ID NO: 3050077 - protein, 9 aa, Giardia lamblia
ASSTVDEEH

SEQ ID NO: 3050078 - protein, 6 aa, Giardia lamblia
ASSTVS

SEQ ID NO: 3050079 - protein, 6 aa, Giardia lamblia
ASSYNA

SEQ ID NO: 3050080 - protein, 45 aa, Giardia lamblia
ASSYRTGTKSDLSPSVDTTTTHLSPETCDDEPPHDGNSLESNGYA

SEQ ID NO: 3050081 - protein, 7 aa, Giardia lamblia
ASTAPDH

SEQ ID NO: 3050082 - protein, 7 aa, Giardia lamblia
ASTASVQ

SEQ ID NO: 3050083 - protein, 5 aa, Giardia lamblia
ASTAV

SEQ ID NO: 3050084 - protein, 10 aa, Giardia lamblia
ASTDQDARAA

SEQ ID NO: 3050085 - protein, 12 aa, Giardia lamblia
ASTDSSGNTCDK

SEQ ID NO: 3050086 - protein, 10 aa, Giardia lamblia
ASTDTVTNNH

SEQ ID NO: 3050087 - protein, 23 aa, Giardia lamblia
ASTFEETESYISDKENSPTRAGL

SEQ ID NO: 3050088 - protein, 9 aa, Giardia lamblia
ASTFTTSPD

SEQ ID NO: 3050089 - protein, 19 aa, Giardia lamblia
ASTGQCERCSEGCKQCTDS

SEQ ID NO: 3050090 - protein, 6 aa, Giardia lamblia
ASTGRG

SEQ ID NO: 3050091 - protein, 7 aa, Giardia lamblia
ASTGSQE

SEQ ID NO: 3050092 - protein, 7 aa, Giardia lamblia
ASTIKTK

SEQ ID NO: 3050093 - protein, 10 aa, Giardia lamblia
ASTKSSFYTR

SEQ ID NO: 3050094 - protein, 14 aa, Giardia lamblia
ASTPAESSHQHSQS

SEQ ID NO: 3050095 - protein, 4 aa, Giardia lamblia
ASTQ

SEQ ID NO: 3050096 - protein, 7 aa, Giardia lamblia
ASTQSTD

SEQ ID NO: 3050097 - protein, 5 aa, Giardia lamblia
ASTRR

SEQ ID NO: 3050098 - protein, 13 aa, Giardia lamblia
ASTSKLKKQALSA

SEQ ID NO: 3050099 - protein, 7 aa, Giardia lamblia
ASTSSTM

SEQ ID NO: 3050100 - protein, 8 aa, Giardia lamblia
ASTSTDHR

SEQ ID NO: 3050101 - protein, 7 aa, Giardia lamblia
ASTTLDT

SEQ ID NO: 3050102 - protein, 20 aa, Giardia lamblia
ASTTRDASGCKASGGKCTEC

SEQ ID NO: 3050103 - protein, 14 aa, Giardia lamblia
ASTVGATEQLTPRV

SEQ ID NO: 3050104 - protein, 17 aa, Giardia lamblia
ASVAPTASTYNQDLGQA

SEQ ID NO: 3050105 - protein, 8 aa, Giardia lamblia
ASVGNSSH

SEQ ID NO: 3050106 - protein, 10 aa, Giardia lamblia
ASVNGTALPS

SEQ ID NO: 3050107 - protein, 19 aa, Giardia lamblia
ASVPEDGAQQSGQIGASNT

SEQ ID NO: 3050108 - protein, 5 aa, Giardia lamblia
ASVPS

SEQ ID NO: 3050109 - protein, 8 aa, Giardia lamblia
ASVPTTLN

SEQ ID NO: 3050110 - protein, 6 aa, Giardia lamblia
ASVSGV

SEQ ID NO: 3050111 - protein, 7 aa, Giardia lamblia
ASVSREN

SEQ ID NO: 3050112 - protein, 8 aa, Giardia lamblia
ASVSSSTM

SEQ ID NO: 3050113 - protein, 8 aa, Giardia lamblia
ASVTAEGQ

SEQ ID NO: 3050114 - protein, 9 aa, Giardia lamblia
ASVTTKTAL

SEQ ID NO: 3050115 - protein, 8 aa, Giardia lamblia
ASVTYSNE

SEQ ID NO: 3050116 - protein, 4 aa, Giardia lamblia
ASVV

SEQ ID NO: 3050117 - protein, 4 aa, Giardia lamblia
ASYA

SEQ ID NO: 3050118 - protein, 10 aa, Giardia lamblia
ASYKPGNVST

SEQ ID NO: 3050119 - protein, 8 aa, Giardia lamblia
ASYRADQG

SEQ ID NO: 3050120 - protein, 13 aa, Giardia lamblia
ASYSGKNIDRTDT

SEQ ID NO: 3050121 - protein, 9 aa, Giardia lamblia
ASYSNGDIS

SEQ ID NO: 3050122 - protein, 4 aa, Giardia lamblia
ASYT

SEQ ID NO: 3050123 - protein, 10 aa, Giardia lamblia
ATAAGATDEI

SEQ ID NO: 3050124 - protein, 7 aa, Giardia lamblia
ATAEGTT

SEQ ID NO: 3050125 - protein, 9 aa, Giardia lamblia
ATAGDPPHC

SEQ ID NO: 3050126 - protein, 11 aa, Giardia lamblia
ATAIKNGRVRY

SEQ ID NO: 3050127 - protein, 8 aa, Giardia lamblia
ATAKSPAH

SEQ ID NO: 3050128 - protein, 4 aa, Giardia lamblia
ATAL

SEQ ID NO: 3050129 - protein, 5 aa, Giardia lamblia
ATALT

SEQ ID NO: 3050130 - protein, 8 aa, Giardia lamblia
ATARPARI

SEQ ID NO: 3050131 - protein, 7 aa, Giardia lamblia
ATASTIR

SEQ ID NO: 3050132 - protein, 11 aa, Giardia lamblia
ATATPTPTKVD

SEQ ID NO: 3050133 - protein, 4 aa, Giardia lamblia
ATAY

SEQ ID NO: 3050134 - protein, 4 aa, Giardia lamblia
ATCP

SEQ ID NO: 3050135 - protein, 13 aa, Giardia lamblia
ATCPGSETGMSAK

SEQ ID NO: 3050136 - protein, 26 aa, Giardia lamblia
ATCPYDGDLPGRYAAQDTTGKYATAN

SEQ ID NO: 3050137 - protein, 14 aa, Giardia lamblia
ATCRDERKTKYKSF

SEQ ID NO: 3050138 - protein, 14 aa, Giardia lamblia
ATCRGEQKAEPTSP

SEQ ID NO: 3050139 - protein, 4 aa, Giardia lamblia
ATCS

SEQ ID NO: 3050140 - protein, 9 aa, Giardia lamblia
ATDATQGNY

SEQ ID NO: 3050141 - protein, 7 aa, Giardia lamblia
ATDDGTV

SEQ ID NO: 3050142 - protein, 11 aa, Giardia lamblia
ATDGAPSSAVS

SEQ ID NO: 3050143 - protein, 9 aa, Giardia lamblia
ATDKGGQSW

SEQ ID NO: 3050144 - protein, 6 aa, Giardia lamblia
ATDPDA

SEQ ID NO: 3050145 - protein, 31 aa, Giardia lamblia
ATDPDGASEQIPQVTEPTDFRPTTPANAISN

SEQ ID NO: 3050146 - protein, 10 aa, Giardia lamblia
ATDPDGFRSY

SEQ ID NO: 3050147 - protein, 7 aa, Giardia lamblia
ATDPNNY

SEQ ID NO: 3050148 - protein, 6 aa, Giardia lamblia
ATDQDS

SEQ ID NO: 3050149 - protein, 6 aa, Giardia lamblia
ATDSSS

SEQ ID NO: 3050150 - protein, 6 aa, Giardia lamblia
ATDTTQ

SEQ ID NO: 3050151 - protein, 5 aa, Giardia lamblia
ATDVP

SEQ ID NO: 3050152 - protein, 9 aa, Giardia lamblia
ATECTRAAS

SEQ ID NO: 3050153 - protein, 18 aa, Giardia lamblia
ATEDENTNAGTESNRRTT

SEQ ID NO: 3050154 - protein, 8 aa, Giardia lamblia
ATEDPAKN

SEQ ID NO: 3050155 - protein, 16 aa, Giardia lamblia
ATEESMNQLRSTSSIE

SEQ ID NO: 3050156 - protein, 33 aa, Giardia lamblia
ATEETDKEPTPGDETKQIAEAVSTTDALPDPQI

SEQ ID NO: 3050157 - protein, 7 aa, Giardia lamblia
ATEHNTY

SEQ ID NO: 3050158 - protein, 9 aa, Giardia lamblia
ATELASKAE

SEQ ID NO: 3050159 - protein, 4 aa, Giardia lamblia
ATEM

SEQ ID NO: 3050160 - protein, 10 aa, Giardia lamblia
ATEPPTPGSL

SEQ ID NO: 3050161 - protein, 11 aa, Giardia lamblia
ATEQPNNANTT

SEQ ID NO: 3050162 - protein, 5 aa, Giardia lamblia
ATERK

SEQ ID NO: 3050163 - protein, 8 aa, Giardia lamblia
ATESTESS

SEQ ID NO: 3050164 - protein, 8 aa, Giardia lamblia
ATETTIED

SEQ ID NO: 3050165 - protein, 25 aa, Giardia lamblia
ATFGDGNIEDSDSSDSTTQTNGGAD

SEQ ID NO: 3050166 - protein, 5 aa, Giardia lamblia
ATFPA

SEQ ID NO: 3050167 - protein, 12 aa, Giardia lamblia
ATFTEDKDLDST

SEQ ID NO: 3050168 - protein, 6 aa, Giardia lamblia
ATGALS

SEQ ID NO: 3050169 - protein, 4 aa, Giardia lamblia
ATGC

SEQ ID NO: 3050170 - protein, 5 aa, Giardia lamblia
ATGDA

SEQ ID NO: 3050171 - protein, 4 aa, Giardia lamblia
ATGE

SEQ ID NO: 3050172 - protein, 6 aa, Giardia lamblia
ATGEEI

SEQ ID NO: 3050173 - protein, 9 aa, Giardia lamblia
ATGEKDQQM

SEQ ID NO: 3050174 - protein, 6 aa, Giardia lamblia
ATGEQE

SEQ ID NO: 3050175 - protein, 11 aa, Giardia lamblia
ATGHASSTRYT

SEQ ID NO: 3050176 - protein, 5 aa, Giardia lamblia
ATGKL

SEQ ID NO: 3050177 - protein, 5 aa, Giardia lamblia
ATGNP

SEQ ID NO: 3050178 - protein, 4 aa, Giardia lamblia
ATGP

SEQ ID NO: 3050179 - protein, 6 aa, Giardia lamblia
ATGPAS

SEQ ID NO: 3050180 - protein, 5 aa, Giardia lamblia
ATGPQ

SEQ ID NO: 3050181 - protein, 6 aa, Giardia lamblia
ATGQSV

SEQ ID NO: 3050182 - protein, 12 aa, Giardia lamblia
ATGSLPEETEQA

SEQ ID NO: 3050183 - protein, 7 aa, Giardia lamblia
ATGSTTY

SEQ ID NO: 3050184 - protein, 19 aa, Giardia lamblia
ATGTTPHTSSDSGGHNDPH

SEQ ID NO: 3050185 - protein, 9 aa, Giardia lamblia
ATHARDTDH

SEQ ID NO: 3050186 - protein, 16 aa, Giardia lamblia
ATHERATRMANKTLYI

SEQ ID NO: 3050187 - protein, 6 aa, Giardia lamblia
ATHGIT

SEQ ID NO: 3050188 - protein, 12 aa, Giardia lamblia
ATIKSKTRQQHR

SEQ ID NO: 3050189 - protein, 6 aa, Giardia lamblia
ATITNR

SEQ ID NO: 3050190 - protein, 7 aa, Giardia lamblia
ATKEGVA

SEQ ID NO: 3050191 - protein, 5 aa, Giardia lamblia
ATKGN

SEQ ID NO: 3050192 - protein, 22 aa, Giardia lamblia
ATKKLEDAAQAQAKMAEKTDSK

SEQ ID NO: 3050193 - protein, 19 aa, Giardia lamblia
ATKKLSSADIEEPKAQKQE

SEQ ID NO: 3050194 - protein, 8 aa, Giardia lamblia
ATKPDDHL

SEQ ID NO: 3050195 - protein, 9 aa, Giardia lamblia
ATKQTRPII

SEQ ID NO: 3050196 - protein, 6 aa, Giardia lamblia
ATKRVE

SEQ ID NO: 3050197 - protein, 8 aa, Giardia lamblia
ATKSENIK

SEQ ID NO: 3050198 - protein, 8 aa, Giardia lamblia
ATKSGAYE

SEQ ID NO: 3050199 - protein, 11 aa, Giardia lamblia
ATKSSTTTTFS

SEQ ID NO: 3050200 - protein, 9 aa, Giardia lamblia
ATLEDTGNM

SEQ ID NO: 3050201 - protein, 10 aa, Giardia lamblia
ATLERAGNHD

SEQ ID NO: 3050202 - protein, 16 aa, Giardia lamblia
ATLPGGSDKNVECSGH

SEQ ID NO: 3050203 - protein, 29 aa, Giardia lamblia
ATLSNRPQQYGASEVETGALPQLSQEPTH

SEQ ID NO: 3050204 - protein, 12 aa, Giardia lamblia
ATLTNSRDKWPA

SEQ ID NO: 3050205 - protein, 6 aa, Giardia lamblia
ATLTSS

SEQ ID NO: 3050206 - protein, 5 aa, Giardia lamblia
ATMED

SEQ ID NO: 3050207 - protein, 15 aa, Giardia lamblia
ATMEQKREKRLRPKE

SEQ ID NO: 3050208 - protein, 14 aa, Giardia lamblia
ATMRGSAAAQERPR

SEQ ID NO: 3050209 - protein, 9 aa, Giardia lamblia
ATNDQEDHL

SEQ ID NO: 3050210 - protein, 6 aa, Giardia lamblia
ATNGHE

SEQ ID NO: 3050211 - protein, 8 aa, Giardia lamblia
ATNINSQD

SEQ ID NO: 3050212 - protein, 9 aa, Giardia lamblia
ATNNTNTRA

SEQ ID NO: 3050213 - protein, 4 aa, Giardia lamblia
ATNP

SEQ ID NO: 3050214 - protein, 22 aa, Giardia lamblia
ATNPDSETGAVANGSLTDDEVT

SEQ ID NO: 3050215 - protein, 8 aa, Giardia lamblia
ATNPQTHT

SEQ ID NO: 3050216 - protein, 7 aa, Giardia lamblia
ATNQNAM

SEQ ID NO: 3050217 - protein, 7 aa, Giardia lamblia
ATNRQTS

SEQ ID NO: 3050218 - protein, 4 aa, Giardia lamblia
ATNS

SEQ ID NO: 3050219 - protein, 17 aa, Giardia lamblia
ATNSSSKEKDTKEDTFS

SEQ ID NO: 3050220 - protein, 12 aa, Giardia lamblia
ATNTGVKLTSNS

SEQ ID NO: 3050221 - protein, 21 aa, Giardia lamblia
ATNTSSGTTPSSNYSTSDKTF

SEQ ID NO: 3050222 - protein, 9 aa, Giardia lamblia
ATPDFNPAK

SEQ ID NO: 3050223 - protein, 13 aa, Giardia lamblia
ATPDTSNDDDPEG

SEQ ID NO: 3050224 - protein, 19 aa, Giardia lamblia
ATPEKAAPDDGTKCQGTNI

SEQ ID NO: 3050225 - protein, 19 aa, Giardia lamblia
ATPEKAAPDNGAKCQDANI

SEQ ID NO: 3050226 - protein, 9 aa, Giardia lamblia
ATPERTCQP

SEQ ID NO: 3050227 - protein, 7 aa, Giardia lamblia
ATPFSEK

SEQ ID NO: 3050228 - protein, 4 aa, Giardia lamblia
ATPG

SEQ ID NO: 3050229 - protein, 9 aa, Giardia lamblia
ATPGKTGFK

SEQ ID NO: 3050230 - protein, 6 aa, Giardia lamblia
ATPHEQ

SEQ ID NO: 3050231 - protein, 8 aa, Giardia lamblia
ATPMASSF

SEQ ID NO: 3050232 - protein, 12 aa, Giardia lamblia
ATPMDSKAYRNS

SEQ ID NO: 3050233 - protein, 4 aa, Giardia lamblia
ATPN

SEQ ID NO: 3050234 - protein, 25 aa, Giardia lamblia
ATPNDQLSDENSHSVGHEKEGSVVN

SEQ ID NO: 3050235 - protein, 33 aa, Giardia lamblia
ATPNTKSVQNSKPITPAVPTPPPEIQETHADSN

SEQ ID NO: 3050236 - protein, 4 aa, Giardia lamblia
ATPP

SEQ ID NO: 3050237 - protein, 7 aa, Giardia lamblia
ATPPDML

SEQ ID NO: 3050238 - protein, 7 aa, Giardia lamblia
ATPPSDI

SEQ ID NO: 3050239 - protein, 20 aa, Giardia lamblia
ATPRGLPSSFAETEKGTPWS

SEQ ID NO: 3050240 - protein, 13 aa, Giardia lamblia
ATPRLPSKYSTTS

SEQ ID NO: 3050241 - protein, 6 aa, Giardia lamblia
ATPTTQ

SEQ ID NO: 3050242 - protein, 4 aa, Giardia lamblia
ATPV

SEQ ID NO: 3050243 - protein, 9 aa, Giardia lamblia
ATPYNQHPL

SEQ ID NO: 3050244 - protein, 4 aa, Giardia lamblia
ATQD

SEQ ID NO: 3050245 - protein, 6 aa, Giardia lamblia
ATQKDY

SEQ ID NO: 3050246 - protein, 5 aa, Giardia lamblia
ATQNV

SEQ ID NO: 3050247 - protein, 5 aa, Giardia lamblia
ATQSV

SEQ ID NO: 3050248 - protein, 7 aa, Giardia lamblia
ATRAATA

SEQ ID NO: 3050249 - protein, 16 aa, Giardia lamblia
ATRAEGGPTDEELARS

SEQ ID NO: 3050250 - protein, 13 aa, Giardia lamblia
ATRGRGLSHPSDY

SEQ ID NO: 3050251 - protein, 13 aa, Giardia lamblia
ATRPSGCFSDSTD

SEQ ID NO: 3050252 - protein, 9 aa, Giardia lamblia
ATRQVESND

SEQ ID NO: 3050253 - protein, 20 aa, Giardia lamblia
ATRRERKAKPGKKAATEMQA

SEQ ID NO: 3050254 - protein, 5 aa, Giardia lamblia
ATRSV

SEQ ID NO: 3050255 - protein, 29 aa, Giardia lamblia
ATRTQSRGSRSGRAGCCGKDRNSKFGSSV

SEQ ID NO: 3050256 - protein, 4 aa, Giardia lamblia
ATSA

SEQ ID NO: 3050257 - protein, 11 aa, Giardia lamblia
ATSAAQSSQNY

SEQ ID NO: 3050258 - protein, 8 aa, Giardia lamblia
ATSAGIPC

SEQ ID NO: 3050259 - protein, 6 aa, Giardia lamblia
ATSALQ

SEQ ID NO: 3050260 - protein, 7 aa, Giardia lamblia
ATSCGTC

SEQ ID NO: 3050261 - protein, 6 aa, Giardia lamblia
ATSCSD

SEQ ID NO: 3050262 - protein, 7 aa, Giardia lamblia
ATSDTCP

SEQ ID NO: 3050263 - protein, 11 aa, Giardia lamblia
ATSEAPKAVTR

SEQ ID NO: 3050264 - protein, 13 aa, Giardia lamblia
ATSHDATARVDAA

SEQ ID NO: 3050265 - protein, 4 aa, Giardia lamblia
ATSI

SEQ ID NO: 3050266 - protein, 5 aa, Giardia lamblia
ATSIS

SEQ ID NO: 3050267 - protein, 6 aa, Giardia lamblia
ATSKPL

SEQ ID NO: 3050268 - protein, 4 aa, Giardia lamblia
ATSN

SEQ ID NO: 3050269 - protein, 8 aa, Giardia lamblia
ATSPEESY

SEQ ID NO: 3050270 - protein, 10 aa, Giardia lamblia
ATSPINADGF

SEQ ID NO: 3050271 - protein, 15 aa, Giardia lamblia
ATSPQGKPDDETTFG

SEQ ID NO: 3050272 - protein, 8 aa, Giardia lamblia
ATSSADRM

SEQ ID NO: 3050273 - protein, 17 aa, Giardia lamblia
ATSSAQKPRKENAGYPL

SEQ ID NO: 3050274 - protein, 5 aa, Giardia lamblia
ATSSD

SEQ ID NO: 3050275 - protein, 6 aa, Giardia lamblia
ATSSIK

SEQ ID NO: 3050276 - protein, 17 aa, Giardia lamblia
ATSSSSNDNLLAPSTRN

SEQ ID NO: 3050277 - protein, 13 aa, Giardia lamblia
ATSTAPPNSKAQN

SEQ ID NO: 3050278 - protein, 10 aa, Giardia lamblia
ATTAANTPAC

SEQ ID NO: 3050279 - protein, 6 aa, Giardia lamblia
ATTAGV

SEQ ID NO: 3050280 - protein, 12 aa, Giardia lamblia
ATTARNKSISAL

SEQ ID NO: 3050281 - protein, 5 aa, Giardia lamblia
ATTAS

SEQ ID NO: 3050282 - protein, 5 aa, Giardia lamblia
ATTDG

SEQ ID NO: 3050283 - protein, 46 aa, Giardia lamblia
ATTEPSATLPTTTHAAAQETIDTCQQDAEISSFPDQMEEAKRPVST

SEQ ID NO: 3050284 - protein, 5 aa, Giardia lamblia
ATTES

SEQ ID NO: 3050285 - protein, 5 aa, Giardia lamblia
ATTFD

SEQ ID NO: 3050286 - protein, 4 aa, Giardia lamblia
ATTG

SEQ ID NO: 3050287 - protein, 7 aa, Giardia lamblia
ATTGKVV

SEQ ID NO: 3050288 - protein, 6 aa, Giardia lamblia
ATTGRR

SEQ ID NO: 3050289 - protein, 10 aa, Giardia lamblia
ATTGTDPETK

SEQ ID NO: 3050290 - protein, 15 aa, Giardia lamblia
ATTGVPKDSSATDIL

SEQ ID NO: 3050291 - protein, 4 aa, Giardia lamblia
ATTH

SEQ ID NO: 3050292 - protein, 9 aa, Giardia lamblia
ATTKAHKSM

SEQ ID NO: 3050293 - protein, 15 aa, Giardia lamblia
ATTQAEACENSKTAS

SEQ ID NO: 3050294 - protein, 8 aa, Giardia lamblia
ATTQEQKD

SEQ ID NO: 3050295 - protein, 7 aa, Giardia lamblia
ATTREKD

SEQ ID NO: 3050296 - protein, 4 aa, Giardia lamblia
ATTS

SEQ ID NO: 3050297 - protein, 7 aa, Giardia lamblia
ATTTPEK

SEQ ID NO: 3050298 - protein, 9 aa, Giardia lamblia
ATVAKETGD

SEQ ID NO: 3050299 - protein, 42 aa, Giardia lamblia
ATVPEQTDISVNDSESRSTVPATATLDAEASPGEQTARNSID

SEQ ID NO: 3050300 - protein, 13 aa, Giardia lamblia
ATYASEQASNVDV

SEQ ID NO: 3050301 - protein, 6 aa, Giardia lamblia
ATYDSG

SEQ ID NO: 3050302 - protein, 5 aa, Giardia lamblia
ATYSD

SEQ ID NO: 3050303 - protein, 19 aa, Giardia lamblia
ATYTANDTGQTYTYNPDDV

SEQ ID NO: 3050304 - protein, 19 aa, Giardia lamblia
AVAQPEKDLSGDNRTDATV

SEQ ID NO: 3050305 - protein, 37 aa, Giardia lamblia
AVAQRRAEKLKKAKASKSPRLKASKKEEGSGNRSEQV

SEQ ID NO: 3050306 - protein, 7 aa, Giardia lamblia
AVATDPA

SEQ ID NO: 3050307 - protein, 8 aa, Giardia lamblia
AVCPPDEQ

SEQ ID NO: 3050308 - protein, 36 aa, Giardia lamblia
AVDNQKGGDEKHASSDDSSDEDSDSSSSNKSSDKGA

SEQ ID NO: 3050309 - protein, 4 aa, Giardia lamblia
AVDS

SEQ ID NO: 3050310 - protein, 7 aa, Giardia lamblia
AVEGADG

SEQ ID NO: 3050311 - protein, 10 aa, Giardia lamblia
AVEGSSDKVG

SEQ ID NO: 3050312 - protein, 13 aa, Giardia lamblia
AVEKDSVRSPKRW

SEQ ID NO: 3050313 - protein, 10 aa, Giardia lamblia
AVERDKTLPL

SEQ ID NO: 3050314 - protein, 5 aa, Giardia lamblia
AVETK

SEQ ID NO: 3050315 - protein, 8 aa, Giardia lamblia
AVKEGKPE

SEQ ID NO: 3050316 - protein, 13 aa, Giardia lamblia
AVPEAEAEGDNKK

SEQ ID NO: 3050317 - protein, 18 aa, Giardia lamblia
AVPEKEEEQDSQSGNRPL

SEQ ID NO: 3050318 - protein, 7 aa, Giardia lamblia
AVPPGEA

SEQ ID NO: 3050319 - protein, 7 aa, Giardia lamblia
AVPPLPA

SEQ ID NO: 3050320 - protein, 8 aa, Giardia lamblia
AVPPPDQI

SEQ ID NO: 3050321 - protein, 6 aa, Giardia lamblia
AVPSNP

SEQ ID NO: 3050322 - protein, 6 aa, Giardia lamblia
AVQDGD

SEQ ID NO: 3050323 - protein, 8 aa, Giardia lamblia
AVQDGTTY

SEQ ID NO: 3050324 - protein, 13 aa, Giardia lamblia
AVRHGKGRGGKRL

SEQ ID NO: 3050325 - protein, 10 aa, Giardia lamblia
AVSASSAGGL

SEQ ID NO: 3050326 - protein, 25 aa, Giardia lamblia
AVSEGNDTETHSVTQPAEAAAKSKF

SEQ ID NO: 3050327 - protein, 8 aa, Giardia lamblia
AVSGSPGY

SEQ ID NO: 3050328 - protein, 6 aa, Giardia lamblia
AVSPKT

SEQ ID NO: 3050329 - protein, 7 aa, Giardia lamblia
AVSPTIN

SEQ ID NO: 3050330 - protein, 11 aa, Giardia lamblia
AVSQTDPNNAM

SEQ ID NO: 3050331 - protein, 9 aa, Giardia lamblia
AVSSQTRTI

SEQ ID NO: 3050332 - protein, 10 aa, Giardia lamblia
AVSTKREQAV

SEQ ID NO: 3050333 - protein, 7 aa, Giardia lamblia
AVSTPKR

SEQ ID NO: 3050334 - protein, 6 aa, Giardia lamblia
AVTDSK

SEQ ID NO: 3050335 - protein, 5 aa, Giardia lamblia
AVTET

SEQ ID NO: 3050336 - protein, 7 aa, Giardia lamblia
AVTGPGE

SEQ ID NO: 3050337 - protein, 4 aa, Giardia lamblia
AVTN

SEQ ID NO: 3050338 - protein, 8 aa, Giardia lamblia
AVTQTPDA

SEQ ID NO: 3050339 - protein, 10 aa, Giardia lamblia
AVTRAQNAEK

SEQ ID NO: 3050340 - protein, 8 aa, Giardia lamblia
AVTSPSLS

SEQ ID NO: 3050341 - protein, 6 aa, Giardia lamblia
AVTTKD

SEQ ID NO: 3050342 - protein, 5 aa, Giardia lamblia
AVTTQ

SEQ ID NO: 3050343 - protein, 14 aa, Giardia lamblia
AWSNPPSVTSQETE

SEQ ID NO: 3050344 - protein, 13 aa, Giardia lamblia
AWSPSLKPREGPH

SEQ ID NO: 3050345 - protein, 8 aa, Giardia lamblia
AYAATPSR

SEQ ID NO: 3050346 - protein, 13 aa, Giardia lamblia
AYASPDNRGLTKE

SEQ ID NO: 3050347 - protein, 8 aa, Giardia lamblia
AYCTSKAN

SEQ ID NO: 3050348 - protein, 14 aa, Giardia lamblia
AYCTSTTNGACTTC

SEQ ID NO: 3050349 - protein, 17 aa, Giardia lamblia
AYDGGSCSNNFGGESHG

SEQ ID NO: 3050350 - protein, 6 aa, Giardia lamblia
AYDGRT

SEQ ID NO: 3050351 - protein, 7 aa, Giardia lamblia
AYDPLPP

SEQ ID NO: 3050352 - protein, 8 aa, Giardia lamblia
AYDSQRAI

SEQ ID NO: 3050353 - protein, 12 aa, Giardia lamblia
AYDTNSLPTTYT

SEQ ID NO: 3050354 - protein, 5 aa, Giardia lamblia
AYEAR

SEQ ID NO: 3050355 - protein, 5 aa, Giardia lamblia
AYEEE

SEQ ID NO: 3050356 - protein, 7 aa, Giardia lamblia
AYEPDED

SEQ ID NO: 3050357 - protein, 12 aa, Giardia lamblia
AYGADREGVEPS

SEQ ID NO: 3050358 - protein, 9 aa, Giardia lamblia
AYGPGSALS

SEQ ID NO: 3050359 - protein, 5 aa, Giardia lamblia
AYGSV

SEQ ID NO: 3050360 - protein, 12 aa, Giardia lamblia
AYGTAKSGKGVV

SEQ ID NO: 3050361 - protein, 7 aa, Giardia lamblia
AYKGPAA

SEQ ID NO: 3050362 - protein, 9 aa, Giardia lamblia
AYNEHGAKA

SEQ ID NO: 3050363 - protein, 21 aa, Giardia lamblia
AYNGDGTTGTCKAGCTPDSTC

SEQ ID NO: 3050364 - protein, 9 aa, Giardia lamblia
AYPARPGDN

SEQ ID NO: 3050365 - protein, 7 aa, Giardia lamblia
AYPGSSA

SEQ ID NO: 3050366 - protein, 7 aa, Giardia lamblia
AYPPNSN

SEQ ID NO: 3050367 - protein, 8 aa, Giardia lamblia
AYQDGANA

SEQ ID NO: 3050368 - protein, 4 aa, Giardia lamblia
AYQN

SEQ ID NO: 3050369 - protein, 10 aa, Giardia lamblia
AYRDAAPDAL

SEQ ID NO: 3050370 - protein, 5 aa, Giardia lamblia
AYSGP

SEQ ID NO: 3050371 - protein, 7 aa, Giardia lamblia
AYSNPDE

SEQ ID NO: 3050372 - protein, 17 aa, Giardia lamblia
AYSPDAESSKQIPPIDN

SEQ ID NO: 3050373 - protein, 5 aa, Giardia lamblia
AYSSD

SEQ ID NO: 3050374 - protein, 10 aa, Giardia lamblia
AYSSGAAASL

SEQ ID NO: 3050375 - protein, 12 aa, Giardia lamblia
AYSVSANSNKTI

SEQ ID NO: 3050376 - protein, 9 aa, Giardia lamblia
AYTDGTGYE

SEQ ID NO: 3050377 - protein, 4 aa, Giardia lamblia
AYTN

SEQ ID NO: 3050378 - protein, 4 aa, Giardia lamblia
AYTS

SEQ ID NO: 3050379 - protein, 11 aa, Giardia lamblia
AYTSGGRAGRW

SEQ ID NO: 3050380 - protein, 5 aa, Giardia lamblia
AYVRK

SEQ ID NO: 3050381 - protein, 23 aa, Giardia lamblia
AYYNTGDPNDTTDNAGSSLSLGK

SEQ ID NO: 3050382 - protein, 10 aa, Giardia lamblia
CAAGTDGDSK

SEQ ID NO: 3050383 - protein, 6 aa, Giardia lamblia
CAANTR

SEQ ID NO: 3050384 - protein, 7 aa, Giardia lamblia
CAEENSL

SEQ ID NO: 3050385 - protein, 13 aa, Giardia lamblia
CAEGCGARASSNQ

SEQ ID NO: 3050386 - protein, 9 aa, Giardia lamblia
CAKDTKDQC

SEQ ID NO: 3050387 - protein, 12 aa, Giardia lamblia
CANSGNDRTGFT

SEQ ID NO: 3050388 - protein, 32 aa, Giardia lamblia
CANSSEIPHNGNCKPSGRWNSCEKDASEGRCT

SEQ ID NO: 3050389 - protein, 6 aa, Giardia lamblia
CANTKG

SEQ ID NO: 3050390 - protein, 10 aa, Giardia lamblia
CAPASSDPGV

SEQ ID NO: 3050391 - protein, 12 aa, Giardia lamblia
CAQGKPAECEEC

SEQ ID NO: 3050392 - protein, 19 aa, Giardia lamblia
CASPPSPGVLRSESRGQRY

SEQ ID NO: 3050393 - protein, 7 aa, Giardia lamblia
CASTSRI

SEQ ID NO: 3050394 - protein, 7 aa, Giardia lamblia
CATPGEV

SEQ ID NO: 3050395 - protein, 5 aa, Giardia lamblia
CATPR

SEQ ID NO: 3050396 - protein, 5 aa, Giardia lamblia
CATSY

SEQ ID NO: 3050397 - protein, 7 aa, Giardia lamblia
CDAKGSV

SEQ ID NO: 3050398 - protein, 12 aa, Giardia lamblia
CDASATSALGHS

SEQ ID NO: 3050399 - protein, 5 aa, Giardia lamblia
CDDKS

SEQ ID NO: 3050400 - protein, 14 aa, Giardia lamblia
CDGEAVSSLDSTPI

SEQ ID NO: 3050401 - protein, 10 aa, Giardia lamblia
CDGKQENCAQ

SEQ ID NO: 3050402 - protein, 8 aa, Giardia lamblia
CDGPGNNC

SEQ ID NO: 3050403 - protein, 8 aa, Giardia lamblia
CDGSTCTK

SEQ ID NO: 3050404 - protein, 8 aa, Giardia lamblia
CDISDEAR

SEQ ID NO: 3050405 - protein, 11 aa, Giardia lamblia
CDKRTDLSADM

SEQ ID NO: 3050406 - protein, 12 aa, Giardia lamblia
CDLPKDTNLQNT

SEQ ID NO: 3050407 - protein, 8 aa, Giardia lamblia
CDNGGTFN

SEQ ID NO: 3050408 - protein, 10 aa, Giardia lamblia
CDNPKTDNEV

SEQ ID NO: 3050409 - protein, 13 aa, Giardia lamblia
CDNSAQKCNCGNT

SEQ ID NO: 3050410 - protein, 6 aa, Giardia lamblia
CDPSTM

SEQ ID NO: 3050411 - protein, 6 aa, Giardia lamblia
CDQSDA

SEQ ID NO: 3050412 - protein, 10 aa, Giardia lamblia
CDRANGELPL

SEQ ID NO: 3050413 - protein, 13 aa, Giardia lamblia
CDSCKGEKDTDCL

SEQ ID NO: 3050414 - protein, 12 aa, Giardia lamblia
CDSNGKSCSRCK

SEQ ID NO: 3050415 - protein, 10 aa, Giardia lamblia
CDSPDGVSFA

SEQ ID NO: 3050416 - protein, 15 aa, Giardia lamblia
CDSTQLSTSGLHNDP

SEQ ID NO: 3050417 - protein, 8 aa, Giardia lamblia
CDTATEGT

SEQ ID NO: 3050418 - protein, 10 aa, Giardia lamblia
CDTEENATSL

SEQ ID NO: 3050419 - protein, 8 aa, Giardia lamblia
CDTPNANN

SEQ ID NO: 3050420 - protein, 11 aa, Giardia lamblia
CDTSEASYRKI

SEQ ID NO: 3050421 - protein, 6 aa, Giardia lamblia
CECSGG

SEQ ID NO: 3050422 - protein, 12 aa, Giardia lamblia
CEDESSVTDEGV

SEQ ID NO: 3050423 - protein, 13 aa, Giardia lamblia
CEDPTACGGTSGA

SEQ ID NO: 3050424 - protein, 5 aa, Giardia lamblia
CEDSP

SEQ ID NO: 3050425 - protein, 6 aa, Giardia lamblia
CEETVS

SEQ ID NO: 3050426 - protein, 19 aa, Giardia lamblia
CEGDNANCNGGTCSESGEC

SEQ ID NO: 3050427 - protein, 10 aa, Giardia lamblia
CEGKQENCAQ

SEQ ID NO: 3050428 - protein, 6 aa, Giardia lamblia
CEHGEN

SEQ ID NO: 3050429 - protein, 6 aa, Giardia lamblia
CEITDD

SEQ ID NO: 3050430 - protein, 10 aa, Giardia lamblia
CEKNNSSQNV

SEQ ID NO: 3050431 - protein, 5 aa, Giardia lamblia
CEKNQ

SEQ ID NO: 3050432 - protein, 4 aa, Giardia lamblia
CEKP

SEQ ID NO: 3050433 - protein, 11 aa, Giardia lamblia
CEKPGGIDQSV

SEQ ID NO: 3050434 - protein, 9 aa, Giardia lamblia
CENGPSEVN

SEQ ID NO: 3050435 - protein, 12 aa, Giardia lamblia
CEPPNPGKSGPV

SEQ ID NO: 3050436 - protein, 22 aa, Giardia lamblia
CEQGGNVKASRERGKKRKQGTV

SEQ ID NO: 3050437 - protein, 4 aa, Giardia lamblia
CEQL

SEQ ID NO: 3050438 - protein, 10 aa, Giardia lamblia
CERSPESNTG

SEQ ID NO: 3050439 - protein, 9 aa, Giardia lamblia
CESCSGPDV

SEQ ID NO: 3050440 - protein, 12 aa, Giardia lamblia
CETCDTATAEEI

SEQ ID NO: 3050441 - protein, 7 aa, Giardia lamblia
CETVGST

SEQ ID NO: 3050442 - protein, 13 aa, Giardia lamblia
CETYSTVDGPSSV

SEQ ID NO: 3050443 - protein, 6 aa, Giardia lamblia
CGASTY

SEQ ID NO: 3050444 - protein, 12 aa, Giardia lamblia
CGDQTKQSNRPI

SEQ ID NO: 3050445 - protein, 10 aa, Giardia lamblia
CGDSSNDQLE

SEQ ID NO: 3050446 - protein, 7 aa, Giardia lamblia
CGEGPQQ

SEQ ID NO: 3050447 - protein, 8 aa, Giardia lamblia
CGENTARR

SEQ ID NO: 3050448 - protein, 6 aa, Giardia lamblia
CGGGCA

SEQ ID NO: 3050449 - protein, 22 aa, Giardia lamblia
CGGGPDSDFAYSTQSYTGFEPT

SEQ ID NO: 3050450 - protein, 7 aa, Giardia lamblia
CGGKRPE

SEQ ID NO: 3050451 - protein, 15 aa, Giardia lamblia
CGGNGDCPLSTDSTC

SEQ ID NO: 3050452 - protein, 24 aa, Giardia lamblia
CGGNGDCQLSDGGSCSCRSGYETV

SEQ ID NO: 3050453 - protein, 8 aa, Giardia lamblia
CGGPGAGF

SEQ ID NO: 3050454 - protein, 11 aa, Giardia lamblia
CGGPGAGYINE

SEQ ID NO: 3050455 - protein, 4 aa, Giardia lamblia
CGGR

SEQ ID NO: 3050456 - protein, 4 aa, Giardia lamblia
CGGS

SEQ ID NO: 3050457 - protein, 10 aa, Giardia lamblia
CGGYKNDQCN

SEQ ID NO: 3050458 - protein, 11 aa, Giardia lamblia
CGKGKKNNSTN

SEQ ID NO: 3050459 - protein, 14 aa, Giardia lamblia
CGKQSNGKCTTTKK

SEQ ID NO: 3050460 - protein, 29 aa, Giardia lamblia
CGLDSESPNNTASSLSASSSLKASDKQVL

SEQ ID NO: 3050461 - protein, 8 aa, Giardia lamblia
CGNDNNCA

SEQ ID NO: 3050462 - protein, 9 aa, Giardia lamblia
CGPDATWDQ

SEQ ID NO: 3050463 - protein, 9 aa, Giardia lamblia
CGPDATWNP

SEQ ID NO: 3050464 - protein, 14 aa, Giardia lamblia
CGPESSGVKTAQAI

SEQ ID NO: 3050465 - protein, 6 aa, Giardia lamblia
CGPGSA

SEQ ID NO: 3050466 - protein, 6 aa, Giardia lamblia
CGPGSD

SEQ ID NO: 3050467 - protein, 6 aa, Giardia lamblia
CGQCSS

SEQ ID NO: 3050468 - protein, 8 aa, Giardia lamblia
CGRRGQPA

SEQ ID NO: 3050469 - protein, 13 aa, Giardia lamblia
CGSGTARSLDGRE

SEQ ID NO: 3050470 - protein, 7 aa, Giardia lamblia
CGSHRTR

SEQ ID NO: 3050471 - protein, 9 aa, Giardia lamblia
CGSSSDKCT

SEQ ID NO: 3050472 - protein, 6 aa, Giardia lamblia
CGTGPE

SEQ ID NO: 3050473 - protein, 4 aa, Giardia lamblia
CGVT

SEQ ID NO: 3050474 - protein, 10 aa, Giardia lamblia
CHDGETGHSW

SEQ ID NO: 3050475 - protein, 4 aa, Giardia lamblia
CHEN

SEQ ID NO: 3050476 - protein, 10 aa, Giardia lamblia
CIGQRDERGM

SEQ ID NO: 3050477 - protein, 10 aa, Giardia lamblia
CIGQRDKRGM

SEQ ID NO: 3050478 - protein, 6 aa, Giardia lamblia
CIPPPE

SEQ ID NO: 3050479 - protein, 9 aa, Giardia lamblia
CITSGSAEG

SEQ ID NO: 3050480 - protein, 7 aa, Giardia lamblia
CKAGDEQ

SEQ ID NO: 3050481 - protein, 9 aa, Giardia lamblia
CKAPSTGHG

SEQ ID NO: 3050482 - protein, 13 aa, Giardia lamblia
CKAPTAPSDGGMT

SEQ ID NO: 3050483 - protein, 7 aa, Giardia lamblia
CKARDTV

SEQ ID NO: 3050484 - protein, 6 aa, Giardia lamblia
CKASKR

SEQ ID NO: 3050485 - protein, 11 aa, Giardia lamblia
CKDDGTTPHQL

SEQ ID NO: 3050486 - protein, 11 aa, Giardia lamblia
CKDGTQTNYTG

SEQ ID NO: 3050487 - protein, 9 aa, Giardia lamblia
CKDGYTGDH

SEQ ID NO: 3050488 - protein, 8 aa, Giardia lamblia
CKDNATGQ

SEQ ID NO: 3050489 - protein, 8 aa, Giardia lamblia
CKDPTKYP

SEQ ID NO: 3050490 - protein, 5 aa, Giardia lamblia
CKDSS

SEQ ID NO: 3050491 - protein, 11 aa, Giardia lamblia
CKEADSGSSGL

SEQ ID NO: 3050492 - protein, 11 aa, Giardia lamblia
CKEGMTSTSHN

SEQ ID NO: 3050493 - protein, 9 aa, Giardia lamblia
CKENEDGCA

SEQ ID NO: 3050494 - protein, 10 aa, Giardia lamblia
CKENPEGSNS

SEQ ID NO: 3050495 - protein, 16 aa, Giardia lamblia
CKEQEPKKPVRPSKLN

SEQ ID NO: 3050496 - protein, 33 aa, Giardia lamblia
CKGAASNQCSACPAGKKLTYTDDSNPNNGGACG

SEQ ID NO: 3050497 - protein, 7 aa, Giardia lamblia
CKHNDDY

SEQ ID NO: 3050498 - protein, 10 aa, Giardia lamblia
CKKKGGYKED

SEQ ID NO: 3050499 - protein, 14 aa, Giardia lamblia
CKKSTRGKSVKGIP

SEQ ID NO: 3050500 - protein, 6 aa, Giardia lamblia
CKNGGT

SEQ ID NO: 3050501 - protein, 11 aa, Giardia lamblia
CKPCTGSFSGE

SEQ ID NO: 3050502 - protein, 17 aa, Giardia lamblia
CKPDLDTDKRKENGRLA

SEQ ID NO: 3050503 - protein, 17 aa, Giardia lamblia
CKPNYKKQSNEDANDDY

SEQ ID NO: 3050504 - protein, 14 aa, Giardia lamblia
CKPNYKQSGTGPFT

SEQ ID NO: 3050505 - protein, 4 aa, Giardia lamblia
CKPS

SEQ ID NO: 3050506 - protein, 9 aa, Giardia lamblia
CKQDKDGQT

SEQ ID NO: 3050507 - protein, 24 aa, Giardia lamblia
CKQKGDSAVTTAGCKKANGTGLAE

SEQ ID NO: 3050508 - protein, 10 aa, Giardia lamblia
CKQNSKDNTY

SEQ ID NO: 3050509 - protein, 8 aa, Giardia lamblia
CKQTGTAS

SEQ ID NO: 3050510 - protein, 10 aa, Giardia lamblia
CKREEDGIRD

SEQ ID NO: 3050511 - protein, 4 aa, Giardia lamblia
CKRP

SEQ ID NO: 3050512 - protein, 30 aa, Giardia lamblia
CKRPQRRSAISDNNAGADGKEIQMNSTQIS

SEQ ID NO: 3050513 - protein, 10 aa, Giardia lamblia
CKSEGAGQFP

SEQ ID NO: 3050514 - protein, 8 aa, Giardia lamblia
CKSSPTKL

SEQ ID NO: 3050515 - protein, 21 aa, Giardia lamblia
CKSSSNGTRKRQQRSAVPQSS

SEQ ID NO: 3050516 - protein, 16 aa, Giardia lamblia
CKSSSTVHKQDVQDPR

SEQ ID NO: 3050517 - protein, 9 aa, Giardia lamblia
CKSTNNYAP

SEQ ID NO: 3050518 - protein, 6 aa, Giardia lamblia
CKSTTA

SEQ ID NO: 3050519 - protein, 13 aa, Giardia lamblia
CKTCQDSATKCTG

SEQ ID NO: 3050520 - protein, 9 aa, Giardia lamblia
CKTDHTGRT

SEQ ID NO: 3050521 - protein, 34 aa, Giardia lamblia
CKTPRDKSGRSANGQGSAKKSHQTSESQRSGSPF

SEQ ID NO: 3050522 - protein, 10 aa, Giardia lamblia
CKTSEPQLPI

SEQ ID NO: 3050523 - protein, 12 aa, Giardia lamblia
CKTSTQAPLNGN

SEQ ID NO: 3050524 - protein, 7 aa, Giardia lamblia
CKVRDQN

SEQ ID NO: 3050525 - protein, 6 aa, Giardia lamblia
CNCNSD

SEQ ID NO: 3050526 - protein, 5 aa, Giardia lamblia
CNDGA

SEQ ID NO: 3050527 - protein, 14 aa, Giardia lamblia
CNDNGEATGECSCN

SEQ ID NO: 3050528 - protein, 17 aa, Giardia lamblia
CNDSGSESGNCKAGSCT

SEQ ID NO: 3050529 - protein, 5 aa, Giardia lamblia
CNESG

SEQ ID NO: 3050530 - protein, 9 aa, Giardia lamblia
CNGDANAAS

SEQ ID NO: 3050531 - protein, 6 aa, Giardia lamblia
CNGDPE

SEQ ID NO: 3050532 - protein, 12 aa, Giardia lamblia
CNGRGTASLKDP

SEQ ID NO: 3050533 - protein, 20 aa, Giardia lamblia
CNKGYTGSKCESCATGYRET

SEQ ID NO: 3050534 - protein, 11 aa, Giardia lamblia
CNKNSDNGSYS

SEQ ID NO: 3050535 - protein, 6 aa, Giardia lamblia
CNNEEP

SEQ ID NO: 3050536 - protein, 11 aa, Giardia lamblia
CNNSPEPTSCT

SEQ ID NO: 3050537 - protein, 5 aa, Giardia lamblia
CNPHT

SEQ ID NO: 3050538 - protein, 10 aa, Giardia lamblia
CNPKNADDQI

SEQ ID NO: 3050539 - protein, 8 aa, Giardia lamblia
CNPSTQGN

SEQ ID NO: 3050540 - protein, 20 aa, Giardia lamblia
CNPYPNTDGSCTDCKKGGVS

SEQ ID NO: 3050541 - protein, 19 aa, Giardia lamblia
CNPYPNTDGSCTNCTRSGV

SEQ ID NO: 3050542 - protein, 9 aa, Giardia lamblia
CNRSPSNAT

SEQ ID NO: 3050543 - protein, 7 aa, Giardia lamblia
CNSDTHT

SEQ ID NO: 3050544 - protein, 9 aa, Giardia lamblia
CNSGLTPTC

SEQ ID NO: 3050545 - protein, 4 aa, Giardia lamblia
CNSS

SEQ ID NO: 3050546 - protein, 7 aa, Giardia lamblia
CNSSDGA

SEQ ID NO: 3050547 - protein, 5 aa, Giardia lamblia
CNTDS

SEQ ID NO: 3050548 - protein, 15 aa, Giardia lamblia
CNTDTTDYSADPDIA

SEQ ID NO: 3050549 - protein, 6 aa, Giardia lamblia
CNTGES

SEQ ID NO: 3050550 - protein, 9 aa, Giardia lamblia
CNTSRSTGI

SEQ ID NO: 3050551 - protein, 23 aa, Giardia lamblia
CNTSTQNQEDSEYSELSYQQGDT

SEQ ID NO: 3050552 - protein, 7 aa, Giardia lamblia
CNTTDTT

SEQ ID NO: 3050553 - protein, 7 aa, Giardia lamblia
CNTTNAD

SEQ ID NO: 3050554 - protein, 11 aa, Giardia lamblia
CNTTTDAITGP

SEQ ID NO: 3050555 - protein, 7 aa, Giardia lamblia
CNVSPLP

SEQ ID NO: 3050556 - protein, 4 aa, Giardia lamblia
CPAG

SEQ ID NO: 3050557 - protein, 15 aa, Giardia lamblia
CPASRDSKKVTPGSA

SEQ ID NO: 3050558 - protein, 10 aa, Giardia lamblia
CPDETESYGG

SEQ ID NO: 3050559 - protein, 4 aa, Giardia lamblia
CPDP

SEQ ID NO: 3050560 - protein, 5 aa, Giardia lamblia
CPDSF

SEQ ID NO: 3050561 - protein, 21 aa, Giardia lamblia
CPDSVSEQSTRESAIQAPTSP

SEQ ID NO: 3050562 - protein, 6 aa, Giardia lamblia
CPECSE

SEQ ID NO: 3050563 - protein, 4 aa, Giardia lamblia
CPER

SEQ ID NO: 3050564 - protein, 10 aa, Giardia lamblia
CPGDTAKGVP

SEQ ID NO: 3050565 - protein, 18 aa, Giardia lamblia
CPKPSSSRIEAAKDARNP

SEQ ID NO: 3050566 - protein, 14 aa, Giardia lamblia
CPLPTDSLQPRSGQ

SEQ ID NO: 3050567 - protein, 8 aa, Giardia lamblia
CPNGRTGI

SEQ ID NO: 3050568 - protein, 7 aa, Giardia lamblia
CPNKTSL

SEQ ID NO: 3050569 - protein, 5 aa, Giardia lamblia
CPPDG

SEQ ID NO: 3050570 - protein, 4 aa, Giardia lamblia
CPPG

SEQ ID NO: 3050571 - protein, 6 aa, Giardia lamblia
CPPGNP

SEQ ID NO: 3050572 - protein, 5 aa, Giardia lamblia
CPPHR

SEQ ID NO: 3050573 - protein, 11 aa, Giardia lamblia
CPPNKTTVHDG

SEQ ID NO: 3050574 - protein, 12 aa, Giardia lamblia
CPPNSVAATNKK

SEQ ID NO: 3050575 - protein, 4 aa, Giardia lamblia
CPQK

SEQ ID NO: 3050576 - protein, 12 aa, Giardia lamblia
CPQNSSPKEENR

SEQ ID NO: 3050577 - protein, 5 aa, Giardia lamblia
CPSGM

SEQ ID NO: 3050578 - protein, 6 aa, Giardia lamblia
CPSGQY

SEQ ID NO: 3050579 - protein, 6 aa, Giardia lamblia
CPSTAE

SEQ ID NO: 3050580 - protein, 13 aa, Giardia lamblia
CPTGSKPDTSTPT

SEQ ID NO: 3050581 - protein, 13 aa, Giardia lamblia
CPVRPGESYYGDN

SEQ ID NO: 3050582 - protein, 10 aa, Giardia lamblia
CPYSSRGCNN

SEQ ID NO: 3050583 - protein, 8 aa, Giardia lamblia
CQDRSGKT

SEQ ID NO: 3050584 - protein, 6 aa, Giardia lamblia
CQGDKV

SEQ ID NO: 3050585 - protein, 33 aa, Giardia lamblia
CQGSAGYYTDDSVSDAKECKKCAEGQKPNTAGT

SEQ ID NO: 3050586 - protein, 5 aa, Giardia lamblia
CQNKC

SEQ ID NO: 3050587 - protein, 14 aa, Giardia lamblia
CQNTCQVSGGAPWT

SEQ ID NO: 3050588 - protein, 13 aa, Giardia lamblia
CQNTDKARNISSS

SEQ ID NO: 3050589 - protein, 7 aa, Giardia lamblia
CQSSTVE

SEQ ID NO: 3050590 - protein, 4 aa, Giardia lamblia
CQST

SEQ ID NO: 3050591 - protein, 7 aa, Giardia lamblia
CQTSPGS

SEQ ID NO: 3050592 - protein, 5 aa, Giardia lamblia
CRCNN

SEQ ID NO: 3050593 - protein, 12 aa, Giardia lamblia
CRDQNEDASEDT

SEQ ID NO: 3050594 - protein, 9 aa, Giardia lamblia
CRGNDGRYT

SEQ ID NO: 3050595 - protein, 35 aa, Giardia lamblia
CRKGEGDPTRKPPGSSRKGKEALRKQKKTPSSGIK

SEQ ID NO: 3050596 - protein, 5 aa, Giardia lamblia
CRNTS

SEQ ID NO: 3050597 - protein, 18 aa, Giardia lamblia
CRPLTSTGADLDDSSAPF

SEQ ID NO: 3050598 - protein, 7 aa, Giardia lamblia
CRPSNGQ

SEQ ID NO: 3050599 - protein, 11 aa, Giardia lamblia
CRPSRPSLPPG

SEQ ID NO: 3050600 - protein, 6 aa, Giardia lamblia
CRSDKM

SEQ ID NO: 3050601 - protein, 8 aa, Giardia lamblia
CRSGTSEQ

SEQ ID NO: 3050602 - protein, 17 aa, Giardia lamblia
CRTISERTEENTSPKDL

SEQ ID NO: 3050603 - protein, 11 aa, Giardia lamblia
CSAAGNDQCTK

SEQ ID NO: 3050604 - protein, 8 aa, Giardia lamblia
CSADGDER

SEQ ID NO: 3050605 - protein, 8 aa, Giardia lamblia
CSADGKSC

SEQ ID NO: 3050606 - protein, 8 aa, Giardia lamblia
CSAEENEH

SEQ ID NO: 3050607 - protein, 9 aa, Giardia lamblia
CSANNEAEL

SEQ ID NO: 3050608 - protein, 5 aa, Giardia lamblia
CSARS

SEQ ID NO: 3050609 - protein, 8 aa, Giardia lamblia
CSASEHTK

SEQ ID NO: 3050610 - protein, 10 aa, Giardia lamblia
CSASTSPSIF

SEQ ID NO: 3050611 - protein, 9 aa, Giardia lamblia
CSDEQDSEN

SEQ ID NO: 3050612 - protein, 6 aa, Giardia lamblia
CSDGAA

SEQ ID NO: 3050613 - protein, 10 aa, Giardia lamblia
CSDGSVPQNN

SEQ ID NO: 3050614 - protein, 8 aa, Giardia lamblia
CSDKERAA

SEQ ID NO: 3050615 - protein, 11 aa, Giardia lamblia
CSDSTSTTGSV

SEQ ID NO: 3050616 - protein, 10 aa, Giardia lamblia
CSDTANGGIA

SEQ ID NO: 3050617 - protein, 8 aa, Giardia lamblia
CSECETTD

SEQ ID NO: 3050618 - protein, 14 aa, Giardia lamblia
CSECNTKGSNPTAE

SEQ ID NO: 3050619 - protein, 13 aa, Giardia lamblia
CSECSTGYGLTDN

SEQ ID NO: 3050620 - protein, 22 aa, Giardia lamblia
CSEDGSDAASVGRSRPTSAGME

SEQ ID NO: 3050621 - protein, 14 aa, Giardia lamblia
CSEEGSSKDMATKD

SEQ ID NO: 3050622 - protein, 4 aa, Giardia lamblia
CSES

SEQ ID NO: 3050623 - protein, 10 aa, Giardia lamblia
CSGATAEPTD

SEQ ID NO: 3050624 - protein, 4 aa, Giardia lamblia
CSGH

SEQ ID NO: 3050625 - protein, 13 aa, Giardia lamblia
CSGSKEDKNKVGK

SEQ ID NO: 3050626 - protein, 13 aa, Giardia lamblia
CSGTKRPNAAGST

SEQ ID NO: 3050627 - protein, 9 aa, Giardia lamblia
CSIKSSENH

SEQ ID NO: 3050628 - protein, 11 aa, Giardia lamblia
CSKPSTGTPSC

SEQ ID NO: 3050629 - protein, 9 aa, Giardia lamblia
CSKSGNGIK

SEQ ID NO: 3050630 - protein, 6 aa, Giardia lamblia
CSKTGL

SEQ ID NO: 3050631 - protein, 5 aa, Giardia lamblia
CSNCT

SEQ ID NO: 3050632 - protein, 10 aa, Giardia lamblia
CSNDAECSTS

SEQ ID NO: 3050633 - protein, 9 aa, Giardia lamblia
CSNDGATCE

SEQ ID NO: 3050634 - protein, 6 aa, Giardia lamblia
CSNGEL

SEQ ID NO: 3050635 - protein, 8 aa, Giardia lamblia
CSNSETLN

SEQ ID NO: 3050636 - protein, 13 aa, Giardia lamblia
CSNTSSANRTASQ

SEQ ID NO: 3050637 - protein, 7 aa, Giardia lamblia
CSPEQKS

SEQ ID NO: 3050638 - protein, 6 aa, Giardia lamblia
CSPGYS

SEQ ID NO: 3050639 - protein, 6 aa, Giardia lamblia
CSPHDS

SEQ ID NO: 3050640 - protein, 8 aa, Giardia lamblia
CSPNEATN

SEQ ID NO: 3050641 - protein, 10 aa, Giardia lamblia
CSPSDSSGRS

SEQ ID NO: 3050642 - protein, 5 aa, Giardia lamblia
CSPSI

SEQ ID NO: 3050643 - protein, 10 aa, Giardia lamblia
CSPSKPISPH

SEQ ID NO: 3050644 - protein, 11 aa, Giardia lamblia
CSPTDGQQCTQ

SEQ ID NO: 3050645 - protein, 8 aa, Giardia lamblia
CSQDGRSC

SEQ ID NO: 3050646 - protein, 10 aa, Giardia lamblia
CSQGSIKSTM

SEQ ID NO: 3050647 - protein, 10 aa, Giardia lamblia
CSQNQSEGDA

SEQ ID NO: 3050648 - protein, 12 aa, Giardia lamblia
CSQRSQGGSPEI

SEQ ID NO: 3050649 - protein, 34 aa, Giardia lamblia
CSQTESSKYSSTTKAPLTRNSATKTQWPRVSQEN

SEQ ID NO: 3050650 - protein, 7 aa, Giardia lamblia
CSQTSQS

SEQ ID NO: 3050651 - protein, 12 aa, Giardia lamblia
CSRQTREDTVRG

SEQ ID NO: 3050652 - protein, 11 aa, Giardia lamblia
CSRSLSASTTK

SEQ ID NO: 3050653 - protein, 10 aa, Giardia lamblia
CSSAEESQND

SEQ ID NO: 3050654 - protein, 11 aa, Giardia lamblia
CSSAQGGTCQT

SEQ ID NO: 3050655 - protein, 12 aa, Giardia lamblia
CSSDTDCTETPK

SEQ ID NO: 3050656 - protein, 7 aa, Giardia lamblia
CSSEEDD

SEQ ID NO: 3050657 - protein, 13 aa, Giardia lamblia
CSSGKKVSPGRKS

SEQ ID NO: 3050658 - protein, 10 aa, Giardia lamblia
CSSISSSKQH

SEQ ID NO: 3050659 - protein, 6 aa, Giardia lamblia
CSSKRL

SEQ ID NO: 3050660 - protein, 7 aa, Giardia lamblia
CSSKTTC

SEQ ID NO: 3050661 - protein, 8 aa, Giardia lamblia
CSSSSSRL

SEQ ID NO: 3050662 - protein, 6 aa, Giardia lamblia
CSSTGK

SEQ ID NO: 3050663 - protein, 17 aa, Giardia lamblia
CSSTRSTSANGSAPNLP

SEQ ID NO: 3050664 - protein, 4 aa, Giardia lamblia
CSSV

SEQ ID NO: 3050665 - protein, 15 aa, Giardia lamblia
CSTADAADKCKTCAT

SEQ ID NO: 3050666 - protein, 6 aa, Giardia lamblia
CSTCDS

SEQ ID NO: 3050667 - protein, 7 aa, Giardia lamblia
CSTCDSS

SEQ ID NO: 3050668 - protein, 5 aa, Giardia lamblia
CSTCN

SEQ ID NO: 3050669 - protein, 13 aa, Giardia lamblia
CSTKPDYTSCTKG

SEQ ID NO: 3050670 - protein, 13 aa, Giardia lamblia
CSTPKPRRDSASG

SEQ ID NO: 3050671 - protein, 7 aa, Giardia lamblia
CSTTNSG

SEQ ID NO: 3050672 - protein, 10 aa, Giardia lamblia
CSTYKGSDNA

SEQ ID NO: 3050673 - protein, 12 aa, Giardia lamblia
CSTYSGNENTKG

SEQ ID NO: 3050674 - protein, 12 aa, Giardia lamblia
CTCTNGANAYTL

SEQ ID NO: 3050675 - protein, 6 aa, Giardia lamblia
CTDAST

SEQ ID NO: 3050676 - protein, 4 aa, Giardia lamblia
CTDD

SEQ ID NO: 3050677 - protein, 7 aa, Giardia lamblia
CTDDSDF

SEQ ID NO: 3050678 - protein, 12 aa, Giardia lamblia
CTDDTLKSATTD

SEQ ID NO: 3050679 - protein, 9 aa, Giardia lamblia
CTDESRSKI

SEQ ID NO: 3050680 - protein, 9 aa, Giardia lamblia
CTDKDSPGT

SEQ ID NO: 3050681 - protein, 5 aa, Giardia lamblia
CTDMQ

SEQ ID NO: 3050682 - protein, 7 aa, Giardia lamblia
CTDNNRS

SEQ ID NO: 3050683 - protein, 8 aa, Giardia lamblia
CTDNTTEV

SEQ ID NO: 3050684 - protein, 26 aa, Giardia lamblia
CTDSPRNKSKAASYKPSSCTDGMDDD

SEQ ID NO: 3050685 - protein, 7 aa, Giardia lamblia
CTEGEPT

SEQ ID NO: 3050686 - protein, 13 aa, Giardia lamblia
CTEGGKRPNIDGS

SEQ ID NO: 3050687 - protein, 5 aa, Giardia lamblia
CTEPP

SEQ ID NO: 3050688 - protein, 10 aa, Giardia lamblia
CTESESASKI

SEQ ID NO: 3050689 - protein, 12 aa, Giardia lamblia
CTGATSKFSTAL

SEQ ID NO: 3050690 - protein, 8 aa, Giardia lamblia
CTGDPTEW

SEQ ID NO: 3050691 - protein, 8 aa, Giardia lamblia
CTGDPTKW

SEQ ID NO: 3050692 - protein, 10 aa, Giardia lamblia
CTGEDSRADY

SEQ ID NO: 3050693 - protein, 8 aa, Giardia lamblia
CTGERPED

SEQ ID NO: 3050694 - protein, 5 aa, Giardia lamblia
CTGGS

SEQ ID NO: 3050695 - protein, 7 aa, Giardia lamblia
CTGPEEA

SEQ ID NO: 3050696 - protein, 7 aa, Giardia lamblia
CTGPGAS

SEQ ID NO: 3050697 - protein, 17 aa, Giardia lamblia
CTGPPKPEEKPSLPVPR

SEQ ID NO: 3050698 - protein, 5 aa, Giardia lamblia
CTGQS

SEQ ID NO: 3050699 - protein, 6 aa, Giardia lamblia
CTGRDT

SEQ ID NO: 3050700 - protein, 8 aa, Giardia lamblia
CTKDNDKG

SEQ ID NO: 3050701 - protein, 8 aa, Giardia lamblia
CTKSKEPT

SEQ ID NO: 3050702 - protein, 6 aa, Giardia lamblia
CTLSGE

SEQ ID NO: 3050703 - protein, 8 aa, Giardia lamblia
CTNNDDCD

SEQ ID NO: 3050704 - protein, 5 aa, Giardia lamblia
CTNRG

SEQ ID NO: 3050705 - protein, 10 aa, Giardia lamblia
CTPASNARAS

SEQ ID NO: 3050706 - protein, 7 aa, Giardia lamblia
CTPGASL

SEQ ID NO: 3050707 - protein, 11 aa, Giardia lamblia
CTPGNDGTCTA

SEQ ID NO: 3050708 - protein, 15 aa, Giardia lamblia
CTPGTYQPNSGSGTC

SEQ ID NO: 3050709 - protein, 9 aa, Giardia lamblia
CTPHTQQNG

SEQ ID NO: 3050710 - protein, 4 aa, Giardia lamblia
CTPP

SEQ ID NO: 3050711 - protein, 4 aa, Giardia lamblia
CTQN

SEQ ID NO: 3050712 - protein, 11 aa, Giardia lamblia
CTRDDQGLEER

SEQ ID NO: 3050713 - protein, 13 aa, Giardia lamblia
CTRDEASSHTEVS

SEQ ID NO: 3050714 - protein, 6 aa, Giardia lamblia
CTRPDA

SEQ ID NO: 3050715 - protein, 12 aa, Giardia lamblia
CTSDSDCGGVSG

SEQ ID NO: 3050716 - protein, 13 aa, Giardia lamblia
CTSENGSSGGQRC

SEQ ID NO: 3050717 - protein, 4 aa, Giardia lamblia
CTSK

SEQ ID NO: 3050718 - protein, 10 aa, Giardia lamblia
CTSKGTLNAS

SEQ ID NO: 3050719 - protein, 7 aa, Giardia lamblia
CTSNTAQ

SEQ ID NO: 3050720 - protein, 8 aa, Giardia lamblia
CTSSSDGL

SEQ ID NO: 3050721 - protein, 11 aa, Giardia lamblia
CTSTDDQERDV

SEQ ID NO: 3050722 - protein, 7 aa, Giardia lamblia
CTSVDKE

SEQ ID NO: 3050723 - protein, 6 aa, Giardia lamblia
CTSYKD

SEQ ID NO: 3050724 - protein, 12 aa, Giardia lamblia
CTTAAQKDTCAT

SEQ ID NO: 3050725 - protein, 10 aa, Giardia lamblia
CTTDKSGNCT

SEQ ID NO: 3050726 - protein, 6 aa, Giardia lamblia
CTTGTR

SEQ ID NO: 3050727 - protein, 5 aa, Giardia lamblia
CTTSI

SEQ ID NO: 3050728 - protein, 12 aa, Giardia lamblia
CTTTSEAGQTVC

SEQ ID NO: 3050729 - protein, 28 aa, Giardia lamblia
CVNGTDSSATVCGGTTGGSCVGSGGQYR

SEQ ID NO: 3050730 - protein, 5 aa, Giardia lamblia
CVSSP

SEQ ID NO: 3050731 - protein, 8 aa, Giardia lamblia
CYEKGTPI

SEQ ID NO: 3050732 - protein, 12 aa, Giardia lamblia
CYQTDRQPGKQV

SEQ ID NO: 3050733 - protein, 11 aa, Giardia lamblia
CYSKTGTGNTI

SEQ ID NO: 3050734 - protein, 6 aa, Giardia lamblia
DAAASS

SEQ ID NO: 3050735 - protein, 5 aa, Giardia lamblia
DAAEA

SEQ ID NO: 3050736 - protein, 9 aa, Giardia lamblia
DAAHDPDEP

SEQ ID NO: 3050737 - protein, 7 aa, Giardia lamblia
DAAKQTV

SEQ ID NO: 3050738 - protein, 8 aa, Giardia lamblia
DAAQSSAY

SEQ ID NO: 3050739 - protein, 9 aa, Giardia lamblia
DAATEKTTR

SEQ ID NO: 3050740 - protein, 12 aa, Giardia lamblia
DAATSAVGSTLG

SEQ ID NO: 3050741 - protein, 7 aa, Giardia lamblia
DAAVGDK

SEQ ID NO: 3050742 - protein, 5 aa, Giardia lamblia
DACER

SEQ ID NO: 3050743 - protein, 8 aa, Giardia lamblia
DADEKRTP

SEQ ID NO: 3050744 - protein, 8 aa, Giardia lamblia
DADESKLR

SEQ ID NO: 3050745 - protein, 14 aa, Giardia lamblia
DADESYAKTAEGSF

SEQ ID NO: 3050746 - protein, 5 aa, Giardia lamblia
DADID

SEQ ID NO: 3050747 - protein, 9 aa, Giardia lamblia
DADNADADV

SEQ ID NO: 3050748 - protein, 6 aa, Giardia lamblia
DADSEL

SEQ ID NO: 3050749 - protein, 7 aa, Giardia lamblia
DADTPGC

SEQ ID NO: 3050750 - protein, 5 aa, Giardia lamblia
DAEAH

SEQ ID NO: 3050751 - protein, 6 aa, Giardia lamblia
DAEAKL

SEQ ID NO: 3050752 - protein, 7 aa, Giardia lamblia
DAEDSSI

SEQ ID NO: 3050753 - protein, 14 aa, Giardia lamblia
DAEEDGAELTQRTF

SEQ ID NO: 3050754 - protein, 7 aa, Giardia lamblia
DAEERTK

SEQ ID NO: 3050755 - protein, 4 aa, Giardia lamblia
DAEG

SEQ ID NO: 3050756 - protein, 4 aa, Giardia lamblia
DAEL

SEQ ID NO: 3050757 - protein, 13 aa, Giardia lamblia
DAEPGWRRAREDA

SEQ ID NO: 3050758 - protein, 4 aa, Giardia lamblia
DAEQ

SEQ ID NO: 3050759 - protein, 7 aa, Giardia lamblia
DAETVKR

SEQ ID NO: 3050760 - protein, 7 aa, Giardia lamblia
DAGAGSQ

SEQ ID NO: 3050761 - protein, 7 aa, Giardia lamblia
DAGEVAE

SEQ ID NO: 3050762 - protein, 9 aa, Giardia lamblia
DAGEYPVDG

SEQ ID NO: 3050763 - protein, 8 aa, Giardia lamblia
DAGNNGVR

SEQ ID NO: 3050764 - protein, 6 aa, Giardia lamblia
DAGNNK

SEQ ID NO: 3050765 - protein, 7 aa, Giardia lamblia
DAGREHA

SEQ ID NO: 3050766 - protein, 8 aa, Giardia lamblia
DAHEKELK

SEQ ID NO: 3050767 - protein, 11 aa, Giardia lamblia
DAHKNKVHNSS

SEQ ID NO: 3050768 - protein, 6 aa, Giardia lamblia
DAHSQI

SEQ ID NO: 3050769 - protein, 4 aa, Giardia lamblia
DAIE

SEQ ID NO: 3050770 - protein, 15 aa, Giardia lamblia
DAITRARSISTAAPV

SEQ ID NO: 3050771 - protein, 4 aa, Giardia lamblia
DAKG

SEQ ID NO: 3050772 - protein, 8 aa, Giardia lamblia
DAKGPPDI

SEQ ID NO: 3050773 - protein, 7 aa, Giardia lamblia
DAKNGGI

SEQ ID NO: 3050774 - protein, 5 aa, Giardia lamblia
DAKPS

SEQ ID NO: 3050775 - protein, 15 aa, Giardia lamblia
DAKRDSEENSSTSTS

SEQ ID NO: 3050776 - protein, 10 aa, Giardia lamblia
DAKSITGSVT

SEQ ID NO: 3050777 - protein, 11 aa, Giardia lamblia
DAKSTRTQEEL

SEQ ID NO: 3050778 - protein, 4 aa, Giardia lamblia
DAKT

SEQ ID NO: 3050779 - protein, 6 aa, Giardia lamblia
DAKTGN

SEQ ID NO: 3050780 - protein, 4 aa, Giardia lamblia
DALD

SEQ ID NO: 3050781 - protein, 4 aa, Giardia lamblia
DALK

SEQ ID NO: 3050782 - protein, 4 aa, Giardia lamblia
DALN

SEQ ID NO: 3050783 - protein, 8 aa, Giardia lamblia
DALPGSAY

SEQ ID NO: 3050784 - protein, 9 aa, Giardia lamblia
DALTRAPVS

SEQ ID NO: 3050785 - protein, 7 aa, Giardia lamblia
DANNMTN

SEQ ID NO: 3050786 - protein, 5 aa, Giardia lamblia
DANQA

SEQ ID NO: 3050787 - protein, 4 aa, Giardia lamblia
DANR

SEQ ID NO: 3050788 - protein, 4 aa, Giardia lamblia
DANS

SEQ ID NO: 3050789 - protein, 9 aa, Giardia lamblia
DAPAASSTL

SEQ ID NO: 3050790 - protein, 16 aa, Giardia lamblia
DAPDNDSQDGTEPANL

SEQ ID NO: 3050791 - protein, 10 aa, Giardia lamblia
DAPKGYKTRP

SEQ ID NO: 3050792 - protein, 4 aa, Giardia lamblia
DAPL

SEQ ID NO: 3050793 - protein, 7 aa, Giardia lamblia
DAPNGPC

SEQ ID NO: 3050794 - protein, 6 aa, Giardia lamblia
DAPPLA

SEQ ID NO: 3050795 - protein, 4 aa, Giardia lamblia
DAPQ

SEQ ID NO: 3050796 - protein, 6 aa, Giardia lamblia
DAPRAG

SEQ ID NO: 3050797 - protein, 10 aa, Giardia lamblia
DAPSAGIDGK

SEQ ID NO: 3050798 - protein, 70 aa, Giardia lamblia
DAPSSMRAAQPASSPLLPPPPPPALESKRTIEEKEATDPKDSNLQATREGPDVSKKEDGEEKQKQKLAPT

SEQ ID NO: 3050799 - protein, 6 aa, Giardia lamblia
DAPTAG

SEQ ID NO: 3050800 - protein, 8 aa, Giardia lamblia
DAPYSGTL

SEQ ID NO: 3050801 - protein, 13 aa, Giardia lamblia
DAQADETKRTTDT

SEQ ID NO: 3050802 - protein, 8 aa, Giardia lamblia
DAQDKPSH

SEQ ID NO: 3050803 - protein, 8 aa, Giardia lamblia
DAQESKVS

SEQ ID NO: 3050804 - protein, 7 aa, Giardia lamblia
DAQKDLD

SEQ ID NO: 3050805 - protein, 5 aa, Giardia lamblia
DAQPT

SEQ ID NO: 3050806 - protein, 5 aa, Giardia lamblia
DAQQM

SEQ ID NO: 3050807 - protein, 12 aa, Giardia lamblia
DAQQPNQSNNSL

SEQ ID NO: 3050808 - protein, 12 aa, Giardia lamblia
DAQSDPDAVPSN

SEQ ID NO: 3050809 - protein, 6 aa, Giardia lamblia
DARGST

SEQ ID NO: 3050810 - protein, 14 aa, Giardia lamblia
DARRKGGDKDVNDH

SEQ ID NO: 3050811 - protein, 7 aa, Giardia lamblia
DARRSPV

SEQ ID NO: 3050812 - protein, 7 aa, Giardia lamblia
DARSAEI

SEQ ID NO: 3050813 - protein, 4 aa, Giardia lamblia
DASD

SEQ ID NO: 3050814 - protein, 10 aa, Giardia lamblia
DASDDDALDK

SEQ ID NO: 3050815 - protein, 8 aa, Giardia lamblia
DASDDQRE

SEQ ID NO: 3050816 - protein, 8 aa, Giardia lamblia
DASETSDI

SEQ ID NO: 3050817 - protein, 8 aa, Giardia lamblia
DASGKKTV

SEQ ID NO: 3050818 - protein, 5 aa, Giardia lamblia
DASHD

SEQ ID NO: 3050819 - protein, 11 aa, Giardia lamblia
DASQPNSNSTY

SEQ ID NO: 3050820 - protein, 4 aa, Giardia lamblia
DASR

SEQ ID NO: 3050821 - protein, 7 aa, Giardia lamblia
DASSCAK

SEQ ID NO: 3050822 - protein, 9 aa, Giardia lamblia
DASSDWNER

SEQ ID NO: 3050823 - protein, 8 aa, Giardia lamblia
DASTGTTP

SEQ ID NO: 3050824 - protein, 8 aa, Giardia lamblia
DASTPQGA

SEQ ID NO: 3050825 - protein, 13 aa, Giardia lamblia
DASTQETDNSLPE

SEQ ID NO: 3050826 - protein, 15 aa, Giardia lamblia
DATAPGSETKSDLAE

SEQ ID NO: 3050827 - protein, 9 aa, Giardia lamblia
DATDEQCEE

SEQ ID NO: 3050828 - protein, 7 aa, Giardia lamblia
DATGDLR

SEQ ID NO: 3050829 - protein, 11 aa, Giardia lamblia
DATGSDPAVKG

SEQ ID NO: 3050830 - protein, 11 aa, Giardia lamblia
DATISNEDQTK

SEQ ID NO: 3050831 - protein, 6 aa, Giardia lamblia
DATKKV

SEQ ID NO: 3050832 - protein, 12 aa, Giardia lamblia
DATNESVATAKS

SEQ ID NO: 3050833 - protein, 8 aa, Giardia lamblia
DATNGGVS

SEQ ID NO: 3050834 - protein, 5 aa, Giardia lamblia
DATNT

SEQ ID NO: 3050835 - protein, 14 aa, Giardia lamblia
DATSNEVSRLLLAY

SEQ ID NO: 3050836 - protein, 6 aa, Giardia lamblia
DATTAY

SEQ ID NO: 3050837 - protein, 31 aa, Giardia lamblia
DAVDKANKVNNYSHKSNRSAGNDACPKPSDE

SEQ ID NO: 3050838 - protein, 18 aa, Giardia lamblia
DAVGEVASESALPSPKTC

SEQ ID NO: 3050839 - protein, 4 aa, Giardia lamblia
DAVP

SEQ ID NO: 3050840 - protein, 15 aa, Giardia lamblia
DAWTRGSDSIVSTAT

SEQ ID NO: 3050841 - protein, 15 aa, Giardia lamblia
DAYCTSTANGACTTC

SEQ ID NO: 3050842 - protein, 7 aa, Giardia lamblia
DAYKDES

SEQ ID NO: 3050843 - protein, 21 aa, Giardia lamblia
DCEESVSGSRSFTATKTLGTL

SEQ ID NO: 3050844 - protein, 4 aa, Giardia lamblia
DCEN

SEQ ID NO: 3050845 - protein, 6 aa, Giardia lamblia
DCEPTY

SEQ ID NO: 3050846 - protein, 24 aa, Giardia lamblia
DCKSSEEFQRGPQKLPEDTTPLKE

SEQ ID NO: 3050847 - protein, 9 aa, Giardia lamblia
DCNDIDEDY

SEQ ID NO: 3050848 - protein, 9 aa, Giardia lamblia
DCNSTQKQG

SEQ ID NO: 3050849 - protein, 6 aa, Giardia lamblia
DCPENC

SEQ ID NO: 3050850 - protein, 7 aa, Giardia lamblia
DCPSNRA

SEQ ID NO: 3050851 - protein, 9 aa, Giardia lamblia
DCSPTDPNT

SEQ ID NO: 3050852 - protein, 6 aa, Giardia lamblia
DCSQPS

SEQ ID NO: 3050853 - protein, 5 aa, Giardia lamblia
DDADS

SEQ ID NO: 3050854 - protein, 6 aa, Giardia lamblia
DDAGEA

SEQ ID NO: 3050855 - protein, 14 aa, Giardia lamblia
DDAKEIPFNQDRDA

SEQ ID NO: 3050856 - protein, 18 aa, Giardia lamblia
DDAKSIGKAGAHKPNKDP

SEQ ID NO: 3050857 - protein, 20 aa, Giardia lamblia
DDANAIDAKTPSQDNLPTCN

SEQ ID NO: 3050858 - protein, 7 aa, Giardia lamblia
DDANHEQ

SEQ ID NO: 3050859 - protein, 15 aa, Giardia lamblia
DDAPSVEREITDQQR

SEQ ID NO: 3050860 - protein, 13 aa, Giardia lamblia
DDAPSYGTPGSDD

SEQ ID NO: 3050861 - protein, 16 aa, Giardia lamblia
DDASSIKKEGHMQNPA

SEQ ID NO: 3050862 - protein, 16 aa, Giardia lamblia
DDATNQATNPAQRAST

SEQ ID NO: 3050863 - protein, 9 aa, Giardia lamblia
DDATSTCTP

SEQ ID NO: 3050864 - protein, 11 aa, Giardia lamblia
DDCTSTDKTTS

SEQ ID NO: 3050865 - protein, 7 aa, Giardia lamblia
DDCTVKE

SEQ ID NO: 3050866 - protein, 5 aa, Giardia lamblia
DDDDL

SEQ ID NO: 3050867 - protein, 8 aa, Giardia lamblia
DDDFSNKI

SEQ ID NO: 3050868 - protein, 11 aa, Giardia lamblia
DDDKRYGNAKE

SEQ ID NO: 3050869 - protein, 7 aa, Giardia lamblia
DDDKRYN

SEQ ID NO: 3050870 - protein, 8 aa, Giardia lamblia
DDDPRLPD

SEQ ID NO: 3050871 - protein, 10 aa, Giardia lamblia
DDEARFSPSS

SEQ ID NO: 3050872 - protein, 6 aa, Giardia lamblia
DDEDNT

SEQ ID NO: 3050873 - protein, 7 aa, Giardia lamblia
DDEESNV

SEQ ID NO: 3050874 - protein, 7 aa, Giardia lamblia
DDEGNTA

SEQ ID NO: 3050875 - protein, 12 aa, Giardia lamblia
DDEGQPPKEDGI

SEQ ID NO: 3050876 - protein, 9 aa, Giardia lamblia
DDEGSRASS

SEQ ID NO: 3050877 - protein, 8 aa, Giardia lamblia
DDENADKI

SEQ ID NO: 3050878 - protein, 8 aa, Giardia lamblia
DDEPKAPD

SEQ ID NO: 3050879 - protein, 6 aa, Giardia lamblia
DDEPLT

SEQ ID NO: 3050880 - protein, 4 aa, Giardia lamblia
DDER

SEQ ID NO: 3050881 - protein, 9 aa, Giardia lamblia
DDESSDSSA

SEQ ID NO: 3050882 - protein, 10 aa, Giardia lamblia
DDGAFRPPSW

SEQ ID NO: 3050883 - protein, 7 aa, Giardia lamblia
DDGHPSQ

SEQ ID NO: 3050884 - protein, 14 aa, Giardia lamblia
DDGKNKVSKGTTNY

SEQ ID NO: 3050885 - protein, 7 aa, Giardia lamblia
DDGNTQL

SEQ ID NO: 3050886 - protein, 5 aa, Giardia lamblia
DDGRC

SEQ ID NO: 3050887 - protein, 8 aa, Giardia lamblia
DDGSAVAS

SEQ ID NO: 3050888 - protein, 25 aa, Giardia lamblia
DDGSDISLASDDSSMKKSTDVLGPS

SEQ ID NO: 3050889 - protein, 11 aa, Giardia lamblia
DDGSFKDYDDN

SEQ ID NO: 3050890 - protein, 7 aa, Giardia lamblia
DDGTTIS

SEQ ID NO: 3050891 - protein, 10 aa, Giardia lamblia
DDGYPSDDIP

SEQ ID NO: 3050892 - protein, 6 aa, Giardia lamblia
DDHTEE

SEQ ID NO: 3050893 - protein, 25 aa, Giardia lamblia
DDHTTSDDTKGTIGEHSQTSGREES

SEQ ID NO: 3050894 - protein, 4 aa, Giardia lamblia
DDIA

SEQ ID NO: 3050895 - protein, 8 aa, Giardia lamblia
DDIEGSAK

SEQ ID NO: 3050896 - protein, 7 aa, Giardia lamblia
DDIPEEA

SEQ ID NO: 3050897 - protein, 18 aa, Giardia lamblia
DDIPPDASVSIDGPTQAA

SEQ ID NO: 3050898 - protein, 6 aa, Giardia lamblia
DDKDVN

SEQ ID NO: 3050899 - protein, 23 aa, Giardia lamblia
DDKRTRSTACKGNCPKSGKIGTV

SEQ ID NO: 3050900 - protein, 11 aa, Giardia lamblia
DDLDTAARDTL

SEQ ID NO: 3050901 - protein, 19 aa, Giardia lamblia
DDLEERSERAHTRMPGPSY

SEQ ID NO: 3050902 - protein, 22 aa, Giardia lamblia
DDLHPNTSAPPSASLKQKATTM

SEQ ID NO: 3050903 - protein, 13 aa, Giardia lamblia
DDLNSTERQATRA

SEQ ID NO: 3050904 - protein, 8 aa, Giardia lamblia
DDLPGRAL

SEQ ID NO: 3050905 - protein, 7 aa, Giardia lamblia
DDLPGSL

SEQ ID NO: 3050906 - protein, 5 aa, Giardia lamblia
DDNSQ

SEQ ID NO: 3050907 - protein, 4 aa, Giardia lamblia
DDNT

SEQ ID NO: 3050908 - protein, 6 aa, Giardia lamblia
DDNTSI

SEQ ID NO: 3050909 - protein, 5 aa, Giardia lamblia
DDPDA

SEQ ID NO: 3050910 - protein, 5 aa, Giardia lamblia
DDPDK

SEQ ID NO: 3050911 - protein, 7 aa, Giardia lamblia
DDPDRVD

SEQ ID NO: 3050912 - protein, 10 aa, Giardia lamblia
DDPEKAEAYN

SEQ ID NO: 3050913 - protein, 5 aa, Giardia lamblia
DDPEV

SEQ ID NO: 3050914 - protein, 12 aa, Giardia lamblia
DDPGNNNPMTGI

SEQ ID NO: 3050915 - protein, 5 aa, Giardia lamblia
DDPPI

SEQ ID NO: 3050916 - protein, 8 aa, Giardia lamblia
DDPTHGAT

SEQ ID NO: 3050917 - protein, 6 aa, Giardia lamblia
DDPTTL

SEQ ID NO: 3050918 - protein, 7 aa, Giardia lamblia
DDPTVKQ

SEQ ID NO: 3050919 - protein, 9 aa, Giardia lamblia
DDPYEGSPR

SEQ ID NO: 3050920 - protein, 10 aa, Giardia lamblia
DDQGAQRSYI

SEQ ID NO: 3050921 - protein, 6 aa, Giardia lamblia
DDQGGV

SEQ ID NO: 3050922 - protein, 9 aa, Giardia lamblia
DDQISEELP

SEQ ID NO: 3050923 - protein, 33 aa, Giardia lamblia
DDQKETDNDNQSGLGLGDGTGDQNVSKEAAKEL

SEQ ID NO: 3050924 - protein, 18 aa, Giardia lamblia
DDQSKDEDDRAQYRGVPA

SEQ ID NO: 3050925 - protein, 8 aa, Giardia lamblia
DDQSQEND

SEQ ID NO: 3050926 - protein, 8 aa, Giardia lamblia
DDQTGDYV

SEQ ID NO: 3050927 - protein, 7 aa, Giardia lamblia
DDRMGKN

SEQ ID NO: 3050928 - protein, 7 aa, Giardia lamblia
DDRNDLK

SEQ ID NO: 3050929 - protein, 17 aa, Giardia lamblia
DDRNRKVSQLSGGSQRR

SEQ ID NO: 3050930 - protein, 5 aa, Giardia lamblia
DDRPL

SEQ ID NO: 3050931 - protein, 6 aa, Giardia lamblia
DDRTAS

SEQ ID NO: 3050932 - protein, 9 aa, Giardia lamblia
DDRTDASHS

SEQ ID NO: 3050933 - protein, 4 aa, Giardia lamblia
DDSC

SEQ ID NO: 3050934 - protein, 9 aa, Giardia lamblia
DDSGDYSEN

SEQ ID NO: 3050935 - protein, 6 aa, Giardia lamblia
DDSGQL

SEQ ID NO: 3050936 - protein, 6 aa, Giardia lamblia
DDSGRL

SEQ ID NO: 3050937 - protein, 5 aa, Giardia lamblia
DDSHR

SEQ ID NO: 3050938 - protein, 18 aa, Giardia lamblia
DDSIGSDVDSGKSCDTTI

SEQ ID NO: 3050939 - protein, 7 aa, Giardia lamblia
DDSKELD

SEQ ID NO: 3050940 - protein, 12 aa, Giardia lamblia
DDSKQGQESGEA

SEQ ID NO: 3050941 - protein, 9 aa, Giardia lamblia
DDSNKVPYD

SEQ ID NO: 3050942 - protein, 7 aa, Giardia lamblia
DDSPYLP

SEQ ID NO: 3050943 - protein, 4 aa, Giardia lamblia
DDSR

SEQ ID NO: 3050944 - protein, 7 aa, Giardia lamblia
DDSSDEE

SEQ ID NO: 3050945 - protein, 12 aa, Giardia lamblia
DDSSTQAKQCSS

SEQ ID NO: 3050946 - protein, 8 aa, Giardia lamblia
DDSTFNET

SEQ ID NO: 3050947 - protein, 5 aa, Giardia lamblia
DDSVL

SEQ ID NO: 3050948 - protein, 5 aa, Giardia lamblia
DDSYV

SEQ ID NO: 3050949 - protein, 5 aa, Giardia lamblia
DDTAT

SEQ ID NO: 3050950 - protein, 9 aa, Giardia lamblia
DDTEEDSSA

SEQ ID NO: 3050951 - protein, 17 aa, Giardia lamblia
DDTETQPAIDTNSNGCS

SEQ ID NO: 3050952 - protein, 6 aa, Giardia lamblia
DDTPYI

SEQ ID NO: 3050953 - protein, 7 aa, Giardia lamblia
DDTQTPV

SEQ ID NO: 3050954 - protein, 6 aa, Giardia lamblia
DDTRAS

SEQ ID NO: 3050955 - protein, 14 aa, Giardia lamblia
DDTSPSDSNNSVVQ

SEQ ID NO: 3050956 - protein, 16 aa, Giardia lamblia
DDTTQTQSADESLDRK

SEQ ID NO: 3050957 - protein, 16 aa, Giardia lamblia
DDVGSSDDFSQGSDVA

SEQ ID NO: 3050958 - protein, 6 aa, Giardia lamblia
DDVTIR

SEQ ID NO: 3050959 - protein, 15 aa, Giardia lamblia
DDWKKASGEYQQDTY

SEQ ID NO: 3050960 - protein, 5 aa, Giardia lamblia
DDYGI

SEQ ID NO: 3050961 - protein, 30 aa, Giardia lamblia
DDYNEEELDGVASPEPEYQPVTRESPVPKP

SEQ ID NO: 3050962 - protein, 9 aa, Giardia lamblia
DEAAEQDRQ

SEQ ID NO: 3050963 - protein, 7 aa, Giardia lamblia
DEADGLE

SEQ ID NO: 3050964 - protein, 11 aa, Giardia lamblia
DEADNSGEDQL

SEQ ID NO: 3050965 - protein, 20 aa, Giardia lamblia
DEADTNGSPEGEGNNLAANH

SEQ ID NO: 3050966 - protein, 8 aa, Giardia lamblia
DEAEYAAG

SEQ ID NO: 3050967 - protein, 6 aa, Giardia lamblia
DEAFAR

SEQ ID NO: 3050968 - protein, 12 aa, Giardia lamblia
DEAGDADNEGRT

SEQ ID NO: 3050969 - protein, 6 aa, Giardia lamblia
DEALQN

SEQ ID NO: 3050970 - protein, 5 aa, Giardia lamblia
DEANI

SEQ ID NO: 3050971 - protein, 5 aa, Giardia lamblia
DEAQK

SEQ ID NO: 3050972 - protein, 7 aa, Giardia lamblia
DEAQKGI

SEQ ID NO: 3050973 - protein, 9 aa, Giardia lamblia
DEARKQRSL

SEQ ID NO: 3050974 - protein, 8 aa, Giardia lamblia
DEAVTGSP

SEQ ID NO: 3050975 - protein, 12 aa, Giardia lamblia
DECKASAKLDDG

SEQ ID NO: 3050976 - protein, 5 aa, Giardia lamblia
DEDAA

SEQ ID NO: 3050977 - protein, 6 aa, Giardia lamblia
DEDDDE

SEQ ID NO: 3050978 - protein, 8 aa, Giardia lamblia
DEDDGEEE

SEQ ID NO: 3050979 - protein, 8 aa, Giardia lamblia
DEDEDIEN

SEQ ID NO: 3050980 - protein, 14 aa, Giardia lamblia
DEDGEGGSAINQTE

SEQ ID NO: 3050981 - protein, 4 aa, Giardia lamblia
DEDH

SEQ ID NO: 3050982 - protein, 21 aa, Giardia lamblia
DEDHAPQVSQSHMGTTKVQAT

SEQ ID NO: 3050983 - protein, 16 aa, Giardia lamblia
DEDLDEPGFRNTNSAT

SEQ ID NO: 3050984 - protein, 6 aa, Giardia lamblia
DEDNQL

SEQ ID NO: 3050985 - protein, 6 aa, Giardia lamblia
DEDTRL

SEQ ID NO: 3050986 - protein, 8 aa, Giardia lamblia
DEEAGAQQ

SEQ ID NO: 3050987 - protein, 15 aa, Giardia lamblia
DEEATLPNSVNDESG

SEQ ID NO: 3050988 - protein, 8 aa, Giardia lamblia
DEEERGRL

SEQ ID NO: 3050989 - protein, 14 aa, Giardia lamblia
DEEGNEMLNPDGTT

SEQ ID NO: 3050990 - protein, 4 aa, Giardia lamblia
DEEH

SEQ ID NO: 3050991 - protein, 4 aa, Giardia lamblia
DEEP

SEQ ID NO: 3050992 - protein, 4 aa, Giardia lamblia
DEEQ

SEQ ID NO: 3050993 - protein, 7 aa, Giardia lamblia
DEEQDTL

SEQ ID NO: 3050994 - protein, 7 aa, Giardia lamblia
DEESSYT

SEQ ID NO: 3050995 - protein, 6 aa, Giardia lamblia
DEEYVE

SEQ ID NO: 3050996 - protein, 28 aa, Giardia lamblia
DEFSDSPLDQCSSGSSSCQTQNITKSKY

SEQ ID NO: 3050997 - protein, 9 aa, Giardia lamblia
DEGKNNPVR

SEQ ID NO: 3050998 - protein, 24 aa, Giardia lamblia
DEGNCDDLDSSDMASPAHKNGRSM

SEQ ID NO: 3050999 - protein, 4 aa, Giardia lamblia
DEGP

SEQ ID NO: 3051000 - protein, 8 aa, Giardia lamblia
DEGRLSPS

SEQ ID NO: 3051001 - protein, 4 aa, Giardia lamblia
DEGS

SEQ ID NO: 3051002 - protein, 12 aa, Giardia lamblia
DEHANTAPEDTE

SEQ ID NO: 3051003 - protein, 5 aa, Giardia lamblia
DEHDP

SEQ ID NO: 3051004 - protein, 8 aa, Giardia lamblia
DEHPDHNY

SEQ ID NO: 3051005 - protein, 9 aa, Giardia lamblia
DEHSAYAER

SEQ ID NO: 3051006 - protein, 9 aa, Giardia lamblia
DEIAADADL

SEQ ID NO: 3051007 - protein, 26 aa, Giardia lamblia
DEIEECREEKQIEQSEASRGTESESI

SEQ ID NO: 3051008 - protein, 4 aa, Giardia lamblia
DEIN

SEQ ID NO: 3051009 - protein, 16 aa, Giardia lamblia
DEISRRRSTGSSFSES

SEQ ID NO: 3051010 - protein, 7 aa, Giardia lamblia
DEKDAKI

SEQ ID NO: 3051011 - protein, 23 aa, Giardia lamblia
DEKDNKQPNVDLGKSSRKCGNNI

SEQ ID NO: 3051012 - protein, 4 aa, Giardia lamblia
DEKG

SEQ ID NO: 3051013 - protein, 11 aa, Giardia lamblia
DEKRAKSSISQ

SEQ ID NO: 3051014 - protein, 6 aa, Giardia lamblia
DELEEQ

SEQ ID NO: 3051015 - protein, 37 aa, Giardia lamblia
DELEKARSQSATPTAGSVPSSEGTTNSSAPQKTTIET

SEQ ID NO: 3051016 - protein, 5 aa, Giardia lamblia
DELKP

SEQ ID NO: 3051017 - protein, 5 aa, Giardia lamblia
DELNP

SEQ ID NO: 3051018 - protein, 6 aa, Giardia lamblia
DELSKY

SEQ ID NO: 3051019 - protein, 17 aa, Giardia lamblia
DELSSTIRSKEDEISEL

SEQ ID NO: 3051020 - protein, 4 aa, Giardia lamblia
DEMT

SEQ ID NO: 3051021 - protein, 5 aa, Giardia lamblia
DENAN

SEQ ID NO: 3051022 - protein, 19 aa, Giardia lamblia
DENAPGPVNPTDQTSQGEA

SEQ ID NO: 3051023 - protein, 10 aa, Giardia lamblia
DENDPAIQRS

SEQ ID NO: 3051024 - protein, 8 aa, Giardia lamblia
DENEAPIN

SEQ ID NO: 3051025 - protein, 9 aa, Giardia lamblia
DENIYGSTS

SEQ ID NO: 3051026 - protein, 10 aa, Giardia lamblia
DENKDNPKIP

SEQ ID NO: 3051027 - protein, 6 aa, Giardia lamblia
DENNTV

SEQ ID NO: 3051028 - protein, 4 aa, Giardia lamblia
DENS

SEQ ID NO: 3051029 - protein, 6 aa, Giardia lamblia
DEPGEV

SEQ ID NO: 3051030 - protein, 6 aa, Giardia lamblia
DEPNGH

SEQ ID NO: 3051031 - protein, 12 aa, Giardia lamblia
DEPNKSSSASFT

SEQ ID NO: 3051032 - protein, 9 aa, Giardia lamblia
DEPQHDAEY

SEQ ID NO: 3051033 - protein, 7 aa, Giardia lamblia
DEPTTLS

SEQ ID NO: 3051034 - protein, 29 aa, Giardia lamblia
DEQEEYEHRQQEEHRTDAKDSIPKPDRRQ

SEQ ID NO: 3051035 - protein, 4 aa, Giardia lamblia
DEQK

SEQ ID NO: 3051036 - protein, 14 aa, Giardia lamblia
DEQPPQKRSGPRHK

SEQ ID NO: 3051037 - protein, 11 aa, Giardia lamblia
DEQQEDSRTVH

SEQ ID NO: 3051038 - protein, 9 aa, Giardia lamblia
DEQTPAKPV

SEQ ID NO: 3051039 - protein, 4 aa, Giardia lamblia
DERA

SEQ ID NO: 3051040 - protein, 8 aa, Giardia lamblia
DERDTALA

SEQ ID NO: 3051041 - protein, 11 aa, Giardia lamblia
DERGSPHQPST

SEQ ID NO: 3051042 - protein, 4 aa, Giardia lamblia
DERI

SEQ ID NO: 3051043 - protein, 9 aa, Giardia lamblia
DERKKAADE

SEQ ID NO: 3051044 - protein, 7 aa, Giardia lamblia
DERKRYN

SEQ ID NO: 3051045 - protein, 16 aa, Giardia lamblia
DERNKTKRLAATANRF

SEQ ID NO: 3051046 - protein, 4 aa, Giardia lamblia
DERR

SEQ ID NO: 3051047 - protein, 7 aa, Giardia lamblia
DERTSDS

SEQ ID NO: 3051048 - protein, 4 aa, Giardia lamblia
DERY

SEQ ID NO: 3051049 - protein, 5 aa, Giardia lamblia
DESDI

SEQ ID NO: 3051050 - protein, 7 aa, Giardia lamblia
DESFSDT

SEQ ID NO: 3051051 - protein, 5 aa, Giardia lamblia
DESGD

SEQ ID NO: 3051052 - protein, 15 aa, Giardia lamblia
DESGMTGESDEIKKD

SEQ ID NO: 3051053 - protein, 8 aa, Giardia lamblia
DESITDSA

SEQ ID NO: 3051054 - protein, 11 aa, Giardia lamblia
DESLSERSSLK

SEQ ID NO: 3051055 - protein, 12 aa, Giardia lamblia
DESQSRDEESRM

SEQ ID NO: 3051056 - protein, 19 aa, Giardia lamblia
DESRRSPPATSRSDARTTV

SEQ ID NO: 3051057 - protein, 6 aa, Giardia lamblia
DESTTT

SEQ ID NO: 3051058 - protein, 4 aa, Giardia lamblia
DESV

SEQ ID NO: 3051059 - protein, 5 aa, Giardia lamblia
DESYN

SEQ ID NO: 3051060 - protein, 7 aa, Giardia lamblia
DETARYQ

SEQ ID NO: 3051061 - protein, 10 aa, Giardia lamblia
DETDAGIGAD

SEQ ID NO: 3051062 - protein, 5 aa, Giardia lamblia
DETES

SEQ ID NO: 3051063 - protein, 15 aa, Giardia lamblia
DETGARLQKDALPPE

SEQ ID NO: 3051064 - protein, 10 aa, Giardia lamblia
DETGDTETCS

SEQ ID NO: 3051065 - protein, 8 aa, Giardia lamblia
DETGEPRW

SEQ ID NO: 3051066 - protein, 7 aa, Giardia lamblia
DETKDIN

SEQ ID NO: 3051067 - protein, 9 aa, Giardia lamblia
DETNQDPHQ

SEQ ID NO: 3051068 - protein, 8 aa, Giardia lamblia
DETPAEQV

SEQ ID NO: 3051069 - protein, 8 aa, Giardia lamblia
DETSSATY

SEQ ID NO: 3051070 - protein, 5 aa, Giardia lamblia
DEVNA

SEQ ID NO: 3051071 - protein, 10 aa, Giardia lamblia
DEVNDTAQMS

SEQ ID NO: 3051072 - protein, 5 aa, Giardia lamblia
DEVQK

SEQ ID NO: 3051073 - protein, 5 aa, Giardia lamblia
DEVQR

SEQ ID NO: 3051074 - protein, 4 aa, Giardia lamblia
DEVV

SEQ ID NO: 3051075 - protein, 13 aa, Giardia lamblia
DEYDGLQGDQRLE

SEQ ID NO: 3051076 - protein, 4 aa, Giardia lamblia
DEYT

SEQ ID NO: 3051077 - protein, 18 aa, Giardia lamblia
DEYTPQSSFSNVTQSGSY

SEQ ID NO: 3051078 - protein, 5 aa, Giardia lamblia
DFDGG

SEQ ID NO: 3051079 - protein, 4 aa, Giardia lamblia
DFDN

SEQ ID NO: 3051080 - protein, 7 aa, Giardia lamblia
DFDPERA

SEQ ID NO: 3051081 - protein, 18 aa, Giardia lamblia
DFKQSGHSSSDDGYNIPS

SEQ ID NO: 3051082 - protein, 9 aa, Giardia lamblia
DFKREAQKD

SEQ ID NO: 3051083 - protein, 5 aa, Giardia lamblia
DFKTE

SEQ ID NO: 3051084 - protein, 7 aa, Giardia lamblia
DFLGPDG

SEQ ID NO: 3051085 - protein, 7 aa, Giardia lamblia
DFNNPSV

SEQ ID NO: 3051086 - protein, 9 aa, Giardia lamblia
DFNTDYRTG

SEQ ID NO: 3051087 - protein, 7 aa, Giardia lamblia
DFPPSEK

SEQ ID NO: 3051088 - protein, 6 aa, Giardia lamblia
DFSPER

SEQ ID NO: 3051089 - protein, 9 aa, Giardia lamblia
DFSSTSTSI

SEQ ID NO: 3051090 - protein, 7 aa, Giardia lamblia
DFTQNSP

SEQ ID NO: 3051091 - protein, 4 aa, Giardia lamblia
DFTS

SEQ ID NO: 3051092 - protein, 14 aa, Giardia lamblia
DGAAPTGGKTCPEP

SEQ ID NO: 3051093 - protein, 8 aa, Giardia lamblia
DGADAGSI

SEQ ID NO: 3051094 - protein, 9 aa, Giardia lamblia
DGAHEEQGL

SEQ ID NO: 3051095 - protein, 11 aa, Giardia lamblia
DGATSGSSDIN

SEQ ID NO: 3051096 - protein, 4 aa, Giardia lamblia
DGCQ

SEQ ID NO: 3051097 - protein, 21 aa, Giardia lamblia
DGCTENAMTNQADKCTGCKEG

SEQ ID NO: 3051098 - protein, 12 aa, Giardia lamblia
DGDKTPANAPPT

SEQ ID NO: 3051099 - protein, 10 aa, Giardia lamblia
DGDRSSFSYT

SEQ ID NO: 3051100 - protein, 4 aa, Giardia lamblia
DGEA

SEQ ID NO: 3051101 - protein, 6 aa, Giardia lamblia
DGECTE

SEQ ID NO: 3051102 - protein, 12 aa, Giardia lamblia
DGEDTEPCQGRG

SEQ ID NO: 3051103 - protein, 11 aa, Giardia lamblia
DGEKGTATENL

SEQ ID NO: 3051104 - protein, 27 aa, Giardia lamblia
DGESIAGSDNLSSRGSSITTRSRGTSI

SEQ ID NO: 3051105 - protein, 7 aa, Giardia lamblia
DGETERA

SEQ ID NO: 3051106 - protein, 5 aa, Giardia lamblia
DGFAD

SEQ ID NO: 3051107 - protein, 4 aa, Giardia lamblia
DGFD

SEQ ID NO: 3051108 - protein, 7 aa, Giardia lamblia
DGFSTDA

SEQ ID NO: 3051109 - protein, 6 aa, Giardia lamblia
DGGAEV

SEQ ID NO: 3051110 - protein, 8 aa, Giardia lamblia
DGGAVDTS

SEQ ID NO: 3051111 - protein, 9 aa, Giardia lamblia
DGGGKQPSL

SEQ ID NO: 3051112 - protein, 5 aa, Giardia lamblia
DGGGP

SEQ ID NO: 3051113 - protein, 29 aa, Giardia lamblia
DGGGTCSEDTKKCNCNSSGFQSLDGQNGC

SEQ ID NO: 3051114 - protein, 16 aa, Giardia lamblia
DGGGTCTETGDTGTCN

SEQ ID NO: 3051115 - protein, 4 aa, Giardia lamblia
DGGK

SEQ ID NO: 3051116 - protein, 5 aa, Giardia lamblia
DGGRL

SEQ ID NO: 3051117 - protein, 8 aa, Giardia lamblia
DGGSELSG

SEQ ID NO: 3051118 - protein, 6 aa, Giardia lamblia
DGGSSA

SEQ ID NO: 3051119 - protein, 6 aa, Giardia lamblia
DGGTSR

SEQ ID NO: 3051120 - protein, 7 aa, Giardia lamblia
DGHSGSC

SEQ ID NO: 3051121 - protein, 16 aa, Giardia lamblia
DGIAPTPYKASIGTPY

SEQ ID NO: 3051122 - protein, 7 aa, Giardia lamblia
DGIGNAS

SEQ ID NO: 3051123 - protein, 12 aa, Giardia lamblia
DGIGSVATAPDC

SEQ ID NO: 3051124 - protein, 6 aa, Giardia lamblia
DGIKSR

SEQ ID NO: 3051125 - protein, 4 aa, Giardia lamblia
DGIN

SEQ ID NO: 3051126 - protein, 8 aa, Giardia lamblia
DGIPSAPR

SEQ ID NO: 3051127 - protein, 6 aa, Giardia lamblia
DGKCTK

SEQ ID NO: 3051128 - protein, 25 aa, Giardia lamblia
DGKDAQGRGSSRKADQDDDDEAHGV

SEQ ID NO: 3051129 - protein, 14 aa, Giardia lamblia
DGKECSGRGTCTQI

SEQ ID NO: 3051130 - protein, 5 aa, Giardia lamblia
DGKIT

SEQ ID NO: 3051131 - protein, 11 aa, Giardia lamblia
DGKRSTTPIDG

SEQ ID NO: 3051132 - protein, 17 aa, Giardia lamblia
DGKSCSESCSGDTQGAC

SEQ ID NO: 3051133 - protein, 16 aa, Giardia lamblia
DGKSCSESCSGDTRGA

SEQ ID NO: 3051134 - protein, 15 aa, Giardia lamblia
DGKSCSKSCSGDTRG

SEQ ID NO: 3051135 - protein, 14 aa, Giardia lamblia
DGLETKRKDMEEER

SEQ ID NO: 3051136 - protein, 10 aa, Giardia lamblia
DGLSSSSASA

SEQ ID NO: 3051137 - protein, 7 aa, Giardia lamblia
DGMESSA

SEQ ID NO: 3051138 - protein, 4 aa, Giardia lamblia
DGMG

SEQ ID NO: 3051139 - protein, 5 aa, Giardia lamblia
DGMGA

SEQ ID NO: 3051140 - protein, 5 aa, Giardia lamblia
DGMNT

SEQ ID NO: 3051141 - protein, 5 aa, Giardia lamblia
DGNDE

SEQ ID NO: 3051142 - protein, 8 aa, Giardia lamblia
DGNENKSI

SEQ ID NO: 3051143 - protein, 5 aa, Giardia lamblia
DGNFG

SEQ ID NO: 3051144 - protein, 5 aa, Giardia lamblia
DGNKS

SEQ ID NO: 3051145 - protein, 6 aa, Giardia lamblia
DGNPPV

SEQ ID NO: 3051146 - protein, 8 aa, Giardia lamblia
DGNQDLSS

SEQ ID NO: 3051147 - protein, 5 aa, Giardia lamblia
DGNTC

SEQ ID NO: 3051148 - protein, 10 aa, Giardia lamblia
DGPGSNCKTC

SEQ ID NO: 3051149 - protein, 5 aa, Giardia lamblia
DGPGY

SEQ ID NO: 3051150 - protein, 20 aa, Giardia lamblia
DGPKPEKQSQKTATDPSLTK

SEQ ID NO: 3051151 - protein, 11 aa, Giardia lamblia
DGPPPAGDAPQ

SEQ ID NO: 3051152 - protein, 9 aa, Giardia lamblia
DGPSSVAGV

SEQ ID NO: 3051153 - protein, 10 aa, Giardia lamblia
DGPTESRESS

SEQ ID NO: 3051154 - protein, 26 aa, Giardia lamblia
DGPVKPDWNGASTASRVSPEANTAGN

SEQ ID NO: 3051155 - protein, 10 aa, Giardia lamblia
DGQCTANVGG

SEQ ID NO: 3051156 - protein, 13 aa, Giardia lamblia
DGQDDASCTSCNS

SEQ ID NO: 3051157 - protein, 17 aa, Giardia lamblia
DGQDDQGAEERVYRSDN

SEQ ID NO: 3051158 - protein, 7 aa, Giardia lamblia
DGQGKSI

SEQ ID NO: 3051159 - protein, 30 aa, Giardia lamblia
DGQPAVKATYNTTQNAKLKAGELVKNEEKT

SEQ ID NO: 3051160 - protein, 10 aa, Giardia lamblia
DGQPSVEDEI

SEQ ID NO: 3051161 - protein, 6 aa, Giardia lamblia
DGQWGE

SEQ ID NO: 3051162 - protein, 9 aa, Giardia lamblia
DGRCTSCKG

SEQ ID NO: 3051163 - protein, 7 aa, Giardia lamblia
DGRLGPE

SEQ ID NO: 3051164 - protein, 11 aa, Giardia lamblia
DGRLGRNEGIR

SEQ ID NO: 3051165 - protein, 10 aa, Giardia lamblia
DGRLKPEDTD

SEQ ID NO: 3051166 - protein, 12 aa, Giardia lamblia
DGRPQDESSDSL

SEQ ID NO: 3051167 - protein, 6 aa, Giardia lamblia
DGSCEN

SEQ ID NO: 3051168 - protein, 4 aa, Giardia lamblia
DGSD

SEQ ID NO: 3051169 - protein, 25 aa, Giardia lamblia
DGSDALAGHEAEEDRNQGSPGEAVA

SEQ ID NO: 3051170 - protein, 8 aa, Giardia lamblia
DGSLTSGS

SEQ ID NO: 3051171 - protein, 11 aa, Giardia lamblia
DGSNDVEGLRS

SEQ ID NO: 3051172 - protein, 4 aa, Giardia lamblia
DGSP

SEQ ID NO: 3051173 - protein, 15 aa, Giardia lamblia
DGSPEEVSRSTYSSI

SEQ ID NO: 3051174 - protein, 7 aa, Giardia lamblia
DGSQPLG

SEQ ID NO: 3051175 - protein, 10 aa, Giardia lamblia
DGSSSKDDMN

SEQ ID NO: 3051176 - protein, 7 aa, Giardia lamblia
DGSTDID

SEQ ID NO: 3051177 - protein, 7 aa, Giardia lamblia
DGSTDTA

SEQ ID NO: 3051178 - protein, 9 aa, Giardia lamblia
DGSTPSFNR

SEQ ID NO: 3051179 - protein, 8 aa, Giardia lamblia
DGSTPYKN

SEQ ID NO: 3051180 - protein, 4 aa, Giardia lamblia
DGSV

SEQ ID NO: 3051181 - protein, 4 aa, Giardia lamblia
DGTA

SEQ ID NO: 3051182 - protein, 6 aa, Giardia lamblia
DGTDEL

SEQ ID NO: 3051183 - protein, 10 aa, Giardia lamblia
DGTEAEDVDD

SEQ ID NO: 3051184 - protein, 4 aa, Giardia lamblia
DGTF

SEQ ID NO: 3051185 - protein, 10 aa, Giardia lamblia
DGTGQNEEPD

SEQ ID NO: 3051186 - protein, 16 aa, Giardia lamblia
DGTIDTETKGTDRQNQ

SEQ ID NO: 3051187 - protein, 8 aa, Giardia lamblia
DGTISMDD

SEQ ID NO: 3051188 - protein, 4 aa, Giardia lamblia
DGTK

SEQ ID NO: 3051189 - protein, 4 aa, Giardia lamblia
DGTN

SEQ ID NO: 3051190 - protein, 4 aa, Giardia lamblia
DGTP

SEQ ID NO: 3051191 - protein, 13 aa, Giardia lamblia
DGTRTGEMESSAS

SEQ ID NO: 3051192 - protein, 7 aa, Giardia lamblia
DGTSGNR

SEQ ID NO: 3051193 - protein, 5 aa, Giardia lamblia
DGTSP

SEQ ID NO: 3051194 - protein, 11 aa, Giardia lamblia
DGTTTAGSPTC

SEQ ID NO: 3051195 - protein, 4 aa, Giardia lamblia
DGTV

SEQ ID NO: 3051196 - protein, 15 aa, Giardia lamblia
DGVENPLGVSPASPL

SEQ ID NO: 3051197 - protein, 14 aa, Giardia lamblia
DGVPEASCPVQTDK

SEQ ID NO: 3051198 - protein, 17 aa, Giardia lamblia
DGVTKSTKSKKAKAIAR

SEQ ID NO: 3051199 - protein, 7 aa, Giardia lamblia
DGWEQKQ

SEQ ID NO: 3051200 - protein, 7 aa, Giardia lamblia
DGWPGPR

SEQ ID NO: 3051201 - protein, 5 aa, Giardia lamblia
DGYAP

SEQ ID NO: 3051202 - protein, 12 aa, Giardia lamblia
DGYGADGYSGVE

SEQ ID NO: 3051203 - protein, 18 aa, Giardia lamblia
DHALDEKQVDDAPQMQTQ

SEQ ID NO: 3051204 - protein, 25 aa, Giardia lamblia
DHAQGDNHLNDPPSTIEEKDNSEAV

SEQ ID NO: 3051205 - protein, 8 aa, Giardia lamblia
DHASTEIH

SEQ ID NO: 3051206 - protein, 5 aa, Giardia lamblia
DHDGE

SEQ ID NO: 3051207 - protein, 7 aa, Giardia lamblia
DHDSSQF

SEQ ID NO: 3051208 - protein, 8 aa, Giardia lamblia
DHDSTNFS

SEQ ID NO: 3051209 - protein, 10 aa, Giardia lamblia
DHGRGYGGRT

SEQ ID NO: 3051210 - protein, 6 aa, Giardia lamblia
DHGTLT

SEQ ID NO: 3051211 - protein, 4 aa, Giardia lamblia
DHHR

SEQ ID NO: 3051212 - protein, 6 aa, Giardia lamblia
DHKEGK

SEQ ID NO: 3051213 - protein, 9 aa, Giardia lamblia
DHKPTRTSF

SEQ ID NO: 3051214 - protein, 6 aa, Giardia lamblia
DHNEGV

SEQ ID NO: 3051215 - protein, 10 aa, Giardia lamblia
DHNGRPTLQE

SEQ ID NO: 3051216 - protein, 10 aa, Giardia lamblia
DHNKPSDVSR

SEQ ID NO: 3051217 - protein, 6 aa, Giardia lamblia
DHRNDV

SEQ ID NO: 3051218 - protein, 7 aa, Giardia lamblia
DHRRNQS

SEQ ID NO: 3051219 - protein, 4 aa, Giardia lamblia
DHSD

SEQ ID NO: 3051220 - protein, 7 aa, Giardia lamblia
DHSNSSQ

SEQ ID NO: 3051221 - protein, 5 aa, Giardia lamblia
DHSPY

SEQ ID NO: 3051222 - protein, 5 aa, Giardia lamblia
DHSTR

SEQ ID NO: 3051223 - protein, 13 aa, Giardia lamblia
DHSTTSPLAEERN

SEQ ID NO: 3051224 - protein, 12 aa, Giardia lamblia
DHTPRGDASVSD

SEQ ID NO: 3051225 - protein, 14 aa, Giardia lamblia
DHVNQGDQAKALSA

SEQ ID NO: 3051226 - protein, 20 aa, Giardia lamblia
DIAESSSMVSSESSAFSTGP

SEQ ID NO: 3051227 - protein, 11 aa, Giardia lamblia
DIASDTSASVS

SEQ ID NO: 3051228 - protein, 20 aa, Giardia lamblia
DIDARTADARVATGRAKAAS

SEQ ID NO: 3051229 - protein, 9 aa, Giardia lamblia
DIDGSKDTY

SEQ ID NO: 3051230 - protein, 6 aa, Giardia lamblia
DIDTQN

SEQ ID NO: 3051231 - protein, 10 aa, Giardia lamblia
DIEDNTSQKD

SEQ ID NO: 3051232 - protein, 14 aa, Giardia lamblia
DIEDSGSDVQDNST

SEQ ID NO: 3051233 - protein, 5 aa, Giardia lamblia
DIEPK

SEQ ID NO: 3051234 - protein, 12 aa, Giardia lamblia
DIGYATSKSVTV

SEQ ID NO: 3051235 - protein, 13 aa, Giardia lamblia
DIKDKASKTSQPD

SEQ ID NO: 3051236 - protein, 5 aa, Giardia lamblia
DIKEA

SEQ ID NO: 3051237 - protein, 9 aa, Giardia lamblia
DIKGSGYSR

SEQ ID NO: 3051238 - protein, 16 aa, Giardia lamblia
DIKSGWGRSPRGAGYT

SEQ ID NO: 3051239 - protein, 7 aa, Giardia lamblia
DIKTPDN

SEQ ID NO: 3051240 - protein, 8 aa, Giardia lamblia
DINTEDSY

SEQ ID NO: 3051241 - protein, 20 aa, Giardia lamblia
DINTSDPDGHALKKSLEAIL

SEQ ID NO: 3051242 - protein, 6 aa, Giardia lamblia
DIPADH

SEQ ID NO: 3051243 - protein, 7 aa, Giardia lamblia
DIPEENA

SEQ ID NO: 3051244 - protein, 5 aa, Giardia lamblia
DIPNP

SEQ ID NO: 3051245 - protein, 5 aa, Giardia lamblia
DIPPH

SEQ ID NO: 3051246 - protein, 9 aa, Giardia lamblia
DIPQKLSDS

SEQ ID NO: 3051247 - protein, 6 aa, Giardia lamblia
DIPTDY

SEQ ID NO: 3051248 - protein, 7 aa, Giardia lamblia
DIQGAQN

SEQ ID NO: 3051249 - protein, 7 aa, Giardia lamblia
DISEGPW

SEQ ID NO: 3051250 - protein, 6 aa, Giardia lamblia
DISGRG

SEQ ID NO: 3051251 - protein, 7 aa, Giardia lamblia
DISPAAK

SEQ ID NO: 3051252 - protein, 4 aa, Giardia lamblia
DISS

SEQ ID NO: 3051253 - protein, 6 aa, Giardia lamblia
DISSEQ

SEQ ID NO: 3051254 - protein, 17 aa, Giardia lamblia
DISTKSYTSTTSANAGT

SEQ ID NO: 3051255 - protein, 5 aa, Giardia lamblia
DITPS

SEQ ID NO: 3051256 - protein, 4 aa, Giardia lamblia
DITT

SEQ ID NO: 3051257 - protein, 7 aa, Giardia lamblia
DKAGETA

SEQ ID NO: 3051258 - protein, 14 aa, Giardia lamblia
DKAGVVEQKDVTRA

SEQ ID NO: 3051259 - protein, 15 aa, Giardia lamblia
DKALLGSDAHPQTLD

SEQ ID NO: 3051260 - protein, 9 aa, Giardia lamblia
DKANSKQYK

SEQ ID NO: 3051261 - protein, 7 aa, Giardia lamblia
DKASESH

SEQ ID NO: 3051262 - protein, 5 aa, Giardia lamblia
DKCTD

SEQ ID NO: 3051263 - protein, 8 aa, Giardia lamblia
DKDDHDLE

SEQ ID NO: 3051264 - protein, 6 aa, Giardia lamblia
DKDDRY

SEQ ID NO: 3051265 - protein, 9 aa, Giardia lamblia
DKDESGQDA

SEQ ID NO: 3051266 - protein, 4 aa, Giardia lamblia
DKDF

SEQ ID NO: 3051267 - protein, 6 aa, Giardia lamblia
DKDFNE

SEQ ID NO: 3051268 - protein, 9 aa, Giardia lamblia
DKDGEINNE

SEQ ID NO: 3051269 - protein, 7 aa, Giardia lamblia
DKDGNTP

SEQ ID NO: 3051270 - protein, 9 aa, Giardia lamblia
DKDKTRYSP

SEQ ID NO: 3051271 - protein, 8 aa, Giardia lamblia
DKDNVPDS

SEQ ID NO: 3051272 - protein, 14 aa, Giardia lamblia
DKDSGNSSRRVTHQ

SEQ ID NO: 3051273 - protein, 6 aa, Giardia lamblia
DKDSHK

SEQ ID NO: 3051274 - protein, 4 aa, Giardia lamblia
DKDV

SEQ ID NO: 3051275 - protein, 12 aa, Giardia lamblia
DKDYNTTQTRGL

SEQ ID NO: 3051276 - protein, 6 aa, Giardia lamblia
DKEAYS

SEQ ID NO: 3051277 - protein, 24 aa, Giardia lamblia
DKEEAKAAKKTAQGEEYTPSGGNI

SEQ ID NO: 3051278 - protein, 6 aa, Giardia lamblia
DKEEPS

SEQ ID NO: 3051279 - protein, 7 aa, Giardia lamblia
DKEKEVT

SEQ ID NO: 3051280 - protein, 5 aa, Giardia lamblia
DKELN

SEQ ID NO: 3051281 - protein, 7 aa, Giardia lamblia
DKENPSV

SEQ ID NO: 3051282 - protein, 14 aa, Giardia lamblia
DKERGKIKKYASNI

SEQ ID NO: 3051283 - protein, 5 aa, Giardia lamblia
DKESI

SEQ ID NO: 3051284 - protein, 5 aa, Giardia lamblia
DKETY

SEQ ID NO: 3051285 - protein, 5 aa, Giardia lamblia
DKEYG

SEQ ID NO: 3051286 - protein, 5 aa, Giardia lamblia
DKEYN

SEQ ID NO: 3051287 - protein, 7 aa, Giardia lamblia
DKEYYTK

SEQ ID NO: 3051288 - protein, 9 aa, Giardia lamblia
DKFTQSNSE

SEQ ID NO: 3051289 - protein, 6 aa, Giardia lamblia
DKGAPA

SEQ ID NO: 3051290 - protein, 8 aa, Giardia lamblia
DKGDGTGF

SEQ ID NO: 3051291 - protein, 5 aa, Giardia lamblia
DKGGT

SEQ ID NO: 3051292 - protein, 5 aa, Giardia lamblia
DKGLY

SEQ ID NO: 3051293 - protein, 4 aa, Giardia lamblia
DKGR

SEQ ID NO: 3051294 - protein, 7 aa, Giardia lamblia
DKGTSCS

SEQ ID NO: 3051295 - protein, 8 aa, Giardia lamblia
DKHSDSAG

SEQ ID NO: 3051296 - protein, 29 aa, Giardia lamblia
DKIKTRGPKHGGSSRSKANRSHTIESEDG

SEQ ID NO: 3051297 - protein, 12 aa, Giardia lamblia
DKIPEKYKKPVE

SEQ ID NO: 3051298 - protein, 11 aa, Giardia lamblia
DKKAAKSLETG

SEQ ID NO: 3051299 - protein, 42 aa, Giardia lamblia
DKKDDRRAKQSPFSRRTQSKVRVSNRSSFSSQKDGDDRSSFS

SEQ ID NO: 3051300 - protein, 8 aa, Giardia lamblia
DKKDQLAS

SEQ ID NO: 3051301 - protein, 8 aa, Giardia lamblia
DKLPTDRV

SEQ ID NO: 3051302 - protein, 6 aa, Giardia lamblia
DKNAGK

SEQ ID NO: 3051303 - protein, 17 aa, Giardia lamblia
DKNEEDISSTLTTTETI

SEQ ID NO: 3051304 - protein, 5 aa, Giardia lamblia
DKNEG

SEQ ID NO: 3051305 - protein, 6 aa, Giardia lamblia
DKNLSQ

SEQ ID NO: 3051306 - protein, 7 aa, Giardia lamblia
DKNPNHV

SEQ ID NO: 3051307 - protein, 5 aa, Giardia lamblia
DKNSW

SEQ ID NO: 3051308 - protein, 12 aa, Giardia lamblia
DKNTVENKPESV

SEQ ID NO: 3051309 - protein, 19 aa, Giardia lamblia
DKPAAESSIGSGTDKTLNS

SEQ ID NO: 3051310 - protein, 9 aa, Giardia lamblia
DKPAVQRSQ

SEQ ID NO: 3051311 - protein, 6 aa, Giardia lamblia
DKPEVK

SEQ ID NO: 3051312 - protein, 6 aa, Giardia lamblia
DKPEVR

SEQ ID NO: 3051313 - protein, 6 aa, Giardia lamblia
DKPFPQ

SEQ ID NO: 3051314 - protein, 7 aa, Giardia lamblia
DKPGPCT

SEQ ID NO: 3051315 - protein, 7 aa, Giardia lamblia
DKPGSEI

SEQ ID NO: 3051316 - protein, 20 aa, Giardia lamblia
DKPKLDVKETSEFDFHKINN

SEQ ID NO: 3051317 - protein, 9 aa, Giardia lamblia
DKPRVDSTK

SEQ ID NO: 3051318 - protein, 5 aa, Giardia lamblia
DKPSL

SEQ ID NO: 3051319 - protein, 7 aa, Giardia lamblia
DKPTEIG

SEQ ID NO: 3051320 - protein, 8 aa, Giardia lamblia
DKPTSEEV

SEQ ID NO: 3051321 - protein, 8 aa, Giardia lamblia
DKPVTKGP

SEQ ID NO: 3051322 - protein, 8 aa, Giardia lamblia
DKQARTEH

SEQ ID NO: 3051323 - protein, 6 aa, Giardia lamblia
DKQGLS

SEQ ID NO: 3051324 - protein, 6 aa, Giardia lamblia
DKQGSC

SEQ ID NO: 3051325 - protein, 4 aa, Giardia lamblia
DKQP

SEQ ID NO: 3051326 - protein, 6 aa, Giardia lamblia
DKQQRL

SEQ ID NO: 3051327 - protein, 21 aa, Giardia lamblia
DKQSGGKCTTTKEGYGISPDG

SEQ ID NO: 3051328 - protein, 10 aa, Giardia lamblia
DKQSIGAYST

SEQ ID NO: 3051329 - protein, 20 aa, Giardia lamblia
DKQSNGKCEKTKEGYGISDD

SEQ ID NO: 3051330 - protein, 13 aa, Giardia lamblia
DKQSNGKCTTTKK

SEQ ID NO: 3051331 - protein, 21 aa, Giardia lamblia
DKQSNGKCTTTKKGYGISPDG

SEQ ID NO: 3051332 - protein, 7 aa, Giardia lamblia
DKQYPSE

SEQ ID NO: 3051333 - protein, 6 aa, Giardia lamblia
DKRATK

SEQ ID NO: 3051334 - protein, 7 aa, Giardia lamblia
DKRGQTA

SEQ ID NO: 3051335 - protein, 4 aa, Giardia lamblia
DKRH

SEQ ID NO: 3051336 - protein, 12 aa, Giardia lamblia
DKRPIPPSKSAL

SEQ ID NO: 3051337 - protein, 4 aa, Giardia lamblia
DKRR

SEQ ID NO: 3051338 - protein, 7 aa, Giardia lamblia
DKSDTCE

SEQ ID NO: 3051339 - protein, 6 aa, Giardia lamblia
DKSDTS

SEQ ID NO: 3051340 - protein, 8 aa, Giardia lamblia
DKSEISEQ

SEQ ID NO: 3051341 - protein, 9 aa, Giardia lamblia
DKSGCRREE

SEQ ID NO: 3051342 - protein, 7 aa, Giardia lamblia
DKSMENG

SEQ ID NO: 3051343 - protein, 19 aa, Giardia lamblia
DKSPGSESELSYDNASPSK

SEQ ID NO: 3051344 - protein, 6 aa, Giardia lamblia
DKSTKS

SEQ ID NO: 3051345 - protein, 7 aa, Giardia lamblia
DKSTPVT

SEQ ID NO: 3051346 - protein, 5 aa, Giardia lamblia
DKTEC

SEQ ID NO: 3051347 - protein, 10 aa, Giardia lamblia
DKTETAGQRK

SEQ ID NO: 3051348 - protein, 9 aa, Giardia lamblia
DKTFSDGPR

SEQ ID NO: 3051349 - protein, 6 aa, Giardia lamblia
DKTGWR

SEQ ID NO: 3051350 - protein, 18 aa, Giardia lamblia
DKTIPSVAGKGSLPFGEE

SEQ ID NO: 3051351 - protein, 19 aa, Giardia lamblia
DKTQNPPNLDSVTSAGEGG

SEQ ID NO: 3051352 - protein, 7 aa, Giardia lamblia
DKTQTAV

SEQ ID NO: 3051353 - protein, 9 aa, Giardia lamblia
DKTSETTEL

SEQ ID NO: 3051354 - protein, 5 aa, Giardia lamblia
DKTST

SEQ ID NO: 3051355 - protein, 4 aa, Giardia lamblia
DKTY

SEQ ID NO: 3051356 - protein, 19 aa, Giardia lamblia
DKTYSHGSANLTARSTHSS

SEQ ID NO: 3051357 - protein, 4 aa, Giardia lamblia
DKVA

SEQ ID NO: 3051358 - protein, 15 aa, Giardia lamblia
DKVESEYATLSQAEA

SEQ ID NO: 3051359 - protein, 4 aa, Giardia lamblia
DLAE

SEQ ID NO: 3051360 - protein, 7 aa, Giardia lamblia
DLAGISR

SEQ ID NO: 3051361 - protein, 7 aa, Giardia lamblia
DLAKDSH

SEQ ID NO: 3051362 - protein, 9 aa, Giardia lamblia
DLATSDSSK

SEQ ID NO: 3051363 - protein, 12 aa, Giardia lamblia
DLDEEAKEAQDR

SEQ ID NO: 3051364 - protein, 8 aa, Giardia lamblia
DLDEEPQL

SEQ ID NO: 3051365 - protein, 7 aa, Giardia lamblia
DLDIPSQ

SEQ ID NO: 3051366 - protein, 5 aa, Giardia lamblia
DLDPQ

SEQ ID NO: 3051367 - protein, 9 aa, Giardia lamblia
DLDSGPEKY

SEQ ID NO: 3051368 - protein, 12 aa, Giardia lamblia
DLEDEEESSGSI

SEQ ID NO: 3051369 - protein, 12 aa, Giardia lamblia
DLERMEDEYESK

SEQ ID NO: 3051370 - protein, 6 aa, Giardia lamblia
DLEYQS

SEQ ID NO: 3051371 - protein, 23 aa, Giardia lamblia
DLGGTEGRTQKPRYSTLSHSKSG

SEQ ID NO: 3051372 - protein, 10 aa, Giardia lamblia
DLGKTNTTGY

SEQ ID NO: 3051373 - protein, 9 aa, Giardia lamblia
DLGSESSTA

SEQ ID NO: 3051374 - protein, 9 aa, Giardia lamblia
DLGSRGADL

SEQ ID NO: 3051375 - protein, 5 aa, Giardia lamblia
DLKAE

SEQ ID NO: 3051376 - protein, 5 aa, Giardia lamblia
DLKGL

SEQ ID NO: 3051377 - protein, 17 aa, Giardia lamblia
DLKGTTDETVLQNPDSY

SEQ ID NO: 3051378 - protein, 12 aa, Giardia lamblia
DLKSNSKPLREQ

SEQ ID NO: 3051379 - protein, 8 aa, Giardia lamblia
DLNAPPEH

SEQ ID NO: 3051380 - protein, 17 aa, Giardia lamblia
DLNAPSPNASESGVQPK

SEQ ID NO: 3051381 - protein, 9 aa, Giardia lamblia
DLNEGSTSM

SEQ ID NO: 3051382 - protein, 15 aa, Giardia lamblia
DLNLSSSESLLRDEG

SEQ ID NO: 3051383 - protein, 8 aa, Giardia lamblia
DLNSARAT

SEQ ID NO: 3051384 - protein, 8 aa, Giardia lamblia
DLNSEQNM

SEQ ID NO: 3051385 - protein, 7 aa, Giardia lamblia
DLPAENG

SEQ ID NO: 3051386 - protein, 8 aa, Giardia lamblia
DLPEDQTP

SEQ ID NO: 3051387 - protein, 11 aa, Giardia lamblia
DLPGKKSYKHV

SEQ ID NO: 3051388 - protein, 20 aa, Giardia lamblia
DLPPATEPALEAQRSPYTDM

SEQ ID NO: 3051389 - protein, 4 aa, Giardia lamblia
DLPS

SEQ ID NO: 3051390 - protein, 12 aa, Giardia lamblia
DLPSDDSTKDSL

SEQ ID NO: 3051391 - protein, 12 aa, Giardia lamblia
DLPSYKTQTPPP

SEQ ID NO: 3051392 - protein, 10 aa, Giardia lamblia
DLPTDTSPYP

SEQ ID NO: 3051393 - protein, 4 aa, Giardia lamblia
DLQL

SEQ ID NO: 3051394 - protein, 9 aa, Giardia lamblia
DLQNTEQSD

SEQ ID NO: 3051395 - protein, 5 aa, Giardia lamblia
DLRAT

SEQ ID NO: 3051396 - protein, 13 aa, Giardia lamblia
DLRGSTRASLDPA

SEQ ID NO: 3051397 - protein, 11 aa, Giardia lamblia
DLRNNAGKTAL

SEQ ID NO: 3051398 - protein, 6 aa, Giardia lamblia
DLRPAT

SEQ ID NO: 3051399 - protein, 4 aa, Giardia lamblia
DLRQ

SEQ ID NO: 3051400 - protein, 21 aa, Giardia lamblia
DLSADTPSSETSSFTDQSQTV

SEQ ID NO: 3051401 - protein, 16 aa, Giardia lamblia
DLSASGKIEEDAPLQA

SEQ ID NO: 3051402 - protein, 7 aa, Giardia lamblia
DLSASTR

SEQ ID NO: 3051403 - protein, 19 aa, Giardia lamblia
DLSEFKSKQSSPDIDEQHT

SEQ ID NO: 3051404 - protein, 18 aa, Giardia lamblia
DLSEVPPQCRPGSSFSYT

SEQ ID NO: 3051405 - protein, 14 aa, Giardia lamblia
DLSGPRGNPRDEVD

SEQ ID NO: 3051406 - protein, 9 aa, Giardia lamblia
DLSGTDETM

SEQ ID NO: 3051407 - protein, 5 aa, Giardia lamblia
DLSGV

SEQ ID NO: 3051408 - protein, 5 aa, Giardia lamblia
DLSPS

SEQ ID NO: 3051409 - protein, 15 aa, Giardia lamblia
DLSSAKQASAQSSVL

SEQ ID NO: 3051410 - protein, 7 aa, Giardia lamblia
DLSSGDN

SEQ ID NO: 3051411 - protein, 7 aa, Giardia lamblia
DLSSKPE

SEQ ID NO: 3051412 - protein, 9 aa, Giardia lamblia
DLSSNSRIA

SEQ ID NO: 3051413 - protein, 8 aa, Giardia lamblia
DLSSQQTS

SEQ ID NO: 3051414 - protein, 7 aa, Giardia lamblia
DLSTKDE

SEQ ID NO: 3051415 - protein, 8 aa, Giardia lamblia
DLSTPGCT

SEQ ID NO: 3051416 - protein, 16 aa, Giardia lamblia
DLTDERPIDTKKIEGT

SEQ ID NO: 3051417 - protein, 7 aa, Giardia lamblia
DLTPDDL

SEQ ID NO: 3051418 - protein, 14 aa, Giardia lamblia
DLTPPEETDTKDKN

SEQ ID NO: 3051419 - protein, 9 aa, Giardia lamblia
DLYPGGAAD

SEQ ID NO: 3051420 - protein, 4 aa, Giardia lamblia
DMAQ

SEQ ID NO: 3051421 - protein, 8 aa, Giardia lamblia
DMDNADSA

SEQ ID NO: 3051422 - protein, 12 aa, Giardia lamblia
DMGAAARGEASV

SEQ ID NO: 3051423 - protein, 12 aa, Giardia lamblia
DMGNSSDSGEER

SEQ ID NO: 3051424 - protein, 14 aa, Giardia lamblia
DMLPQESPTCGSKS

SEQ ID NO: 3051425 - protein, 7 aa, Giardia lamblia
DMNPRDV

SEQ ID NO: 3051426 - protein, 9 aa, Giardia lamblia
DMPSKGTTD

SEQ ID NO: 3051427 - protein, 12 aa, Giardia lamblia
DMSQRKTQPEFA

SEQ ID NO: 3051428 - protein, 6 aa, Giardia lamblia
DMSTTK

SEQ ID NO: 3051429 - protein, 7 aa, Giardia lamblia
DMTEETP

SEQ ID NO: 3051430 - protein, 14 aa, Giardia lamblia
DMTKRERKEAGDTI

SEQ ID NO: 3051431 - protein, 6 aa, Giardia lamblia
DNAENS

SEQ ID NO: 3051432 - protein, 5 aa, Giardia lamblia
DNAGI

SEQ ID NO: 3051433 - protein, 6 aa, Giardia lamblia
DNAGKC

SEQ ID NO: 3051434 - protein, 10 aa, Giardia lamblia
DNAPPSSSVL

SEQ ID NO: 3051435 - protein, 8 aa, Giardia lamblia
DNARQLYS

SEQ ID NO: 3051436 - protein, 6 aa, Giardia lamblia
DNASAD

SEQ ID NO: 3051437 - protein, 10 aa, Giardia lamblia
DNASSRSRHS

SEQ ID NO: 3051438 - protein, 5 aa, Giardia lamblia
DNAYN

SEQ ID NO: 3051439 - protein, 28 aa, Giardia lamblia
DNCDANSHAPSPLPRAARSGASFGPGPL

SEQ ID NO: 3051440 - protein, 5 aa, Giardia lamblia
DNCEG

SEQ ID NO: 3051441 - protein, 6 aa, Giardia lamblia
DNDIDG

SEQ ID NO: 3051442 - protein, 8 aa, Giardia lamblia
DNDQSLQN

SEQ ID NO: 3051443 - protein, 8 aa, Giardia lamblia
DNDSSELR

SEQ ID NO: 3051444 - protein, 7 aa, Giardia lamblia
DNDVEAR

SEQ ID NO: 3051445 - protein, 14 aa, Giardia lamblia
DNEESDDENDDDVS

SEQ ID NO: 3051446 - protein, 7 aa, Giardia lamblia
DNEGNTA

SEQ ID NO: 3051447 - protein, 11 aa, Giardia lamblia
DNEHAKDHYNQ

SEQ ID NO: 3051448 - protein, 7 aa, Giardia lamblia
DNEIKGL

SEQ ID NO: 3051449 - protein, 12 aa, Giardia lamblia
DNEVDDDEKAHL

SEQ ID NO: 3051450 - protein, 8 aa, Giardia lamblia
DNFQSGSE

SEQ ID NO: 3051451 - protein, 9 aa, Giardia lamblia
DNGEYGDDT

SEQ ID NO: 3051452 - protein, 8 aa, Giardia lamblia
DNGHASHE

SEQ ID NO: 3051453 - protein, 4 aa, Giardia lamblia
DNGS

SEQ ID NO: 3051454 - protein, 12 aa, Giardia lamblia
DNGSVSQDDKYH

SEQ ID NO: 3051455 - protein, 5 aa, Giardia lamblia
DNGTQ

SEQ ID NO: 3051456 - protein, 6 aa, Giardia lamblia
DNGTTV

SEQ ID NO: 3051457 - protein, 10 aa, Giardia lamblia
DNGYGPKYPD

SEQ ID NO: 3051458 - protein, 5 aa, Giardia lamblia
DNHGR

SEQ ID NO: 3051459 - protein, 27 aa, Giardia lamblia
DNKAATSNGNQGDAEIDATAKKTKKSW

SEQ ID NO: 3051460 - protein, 7 aa, Giardia lamblia
DNLKADQ

SEQ ID NO: 3051461 - protein, 7 aa, Giardia lamblia
DNLSAGQ

SEQ ID NO: 3051462 - protein, 19 aa, Giardia lamblia
DNNEKPFATQVHGARRIFK

SEQ ID NO: 3051463 - protein, 6 aa, Giardia lamblia
DNNGRT

SEQ ID NO: 3051464 - protein, 8 aa, Giardia lamblia
DNNGTSAL

SEQ ID NO: 3051465 - protein, 10 aa, Giardia lamblia
DNNKDLQDKR

SEQ ID NO: 3051466 - protein, 7 aa, Giardia lamblia
DNNLPAN

SEQ ID NO: 3051467 - protein, 4 aa, Giardia lamblia
DNNQ

SEQ ID NO: 3051468 - protein, 7 aa, Giardia lamblia
DNNSNVH

SEQ ID NO: 3051469 - protein, 5 aa, Giardia lamblia
DNNTA

SEQ ID NO: 3051470 - protein, 5 aa, Giardia lamblia
DNNTR

SEQ ID NO: 3051471 - protein, 9 aa, Giardia lamblia
DNPAKPEVV

SEQ ID NO: 3051472 - protein, 4 aa, Giardia lamblia
DNPI

SEQ ID NO: 3051473 - protein, 4 aa, Giardia lamblia
DNPL

SEQ ID NO: 3051474 - protein, 5 aa, Giardia lamblia
DNPNE

SEQ ID NO: 3051475 - protein, 6 aa, Giardia lamblia
DNPRWR

SEQ ID NO: 3051476 - protein, 18 aa, Giardia lamblia
DNPVGGERGNSEQDDEAV

SEQ ID NO: 3051477 - protein, 7 aa, Giardia lamblia
DNPYGTL

SEQ ID NO: 3051478 - protein, 7 aa, Giardia lamblia
DNPYNDS

SEQ ID NO: 3051479 - protein, 8 aa, Giardia lamblia
DNQPPAEL

SEQ ID NO: 3051480 - protein, 5 aa, Giardia lamblia
DNQSD

SEQ ID NO: 3051481 - protein, 7 aa, Giardia lamblia
DNQTLKP

SEQ ID NO: 3051482 - protein, 10 aa, Giardia lamblia
DNRPGPPAVT

SEQ ID NO: 3051483 - protein, 10 aa, Giardia lamblia
DNRRQKRKHT

SEQ ID NO: 3051484 - protein, 15 aa, Giardia lamblia
DNRSVGLGKIERISE

SEQ ID NO: 3051485 - protein, 7 aa, Giardia lamblia
DNSANAS

SEQ ID NO: 3051486 - protein, 13 aa, Giardia lamblia
DNSAQTSPQQTTR

SEQ ID NO: 3051487 - protein, 10 aa, Giardia lamblia
DNSDEHRTQG

SEQ ID NO: 3051488 - protein, 7 aa, Giardia lamblia
DNSITNS

SEQ ID NO: 3051489 - protein, 10 aa, Giardia lamblia
DNSKTHSQDQ

SEQ ID NO: 3051490 - protein, 12 aa, Giardia lamblia
DNSKVPNKGGSG

SEQ ID NO: 3051491 - protein, 6 aa, Giardia lamblia
DNSPDI

SEQ ID NO: 3051492 - protein, 10 aa, Giardia lamblia
DNSPEPSAAV

SEQ ID NO: 3051493 - protein, 6 aa, Giardia lamblia
DNSPLV

SEQ ID NO: 3051494 - protein, 6 aa, Giardia lamblia
DNSSIE

SEQ ID NO: 3051495 - protein, 10 aa, Giardia lamblia
DNSTAECNGA

SEQ ID NO: 3051496 - protein, 29 aa, Giardia lamblia
DNSTISNVKDDSFNRNKRSCGKPDLNSGA

SEQ ID NO: 3051497 - protein, 8 aa, Giardia lamblia
DNSTSDTP

SEQ ID NO: 3051498 - protein, 56 aa, Giardia lamblia
DNTADVPSPIEEQEEQEEQEDREEEEDPRVAQKRRQAKLAKTKKGKESVGPLKEPD

SEQ ID NO: 3051499 - protein, 18 aa, Giardia lamblia
DNTAEKTSVDARTEGSAA

SEQ ID NO: 3051500 - protein, 6 aa, Giardia lamblia
DNTETL

SEQ ID NO: 3051501 - protein, 8 aa, Giardia lamblia
DNTKGSKV

SEQ ID NO: 3051502 - protein, 4 aa, Giardia lamblia
DNTL

SEQ ID NO: 3051503 - protein, 8 aa, Giardia lamblia
DNTPTESV

SEQ ID NO: 3051504 - protein, 4 aa, Giardia lamblia
DNTQ

SEQ ID NO: 3051505 - protein, 14 aa, Giardia lamblia
DNTSKKSALSSSAI

SEQ ID NO: 3051506 - protein, 5 aa, Giardia lamblia
DNTTG

SEQ ID NO: 3051507 - protein, 8 aa, Giardia lamblia
DNTTSFST

SEQ ID NO: 3051508 - protein, 11 aa, Giardia lamblia
DNVQPSASSRK

SEQ ID NO: 3051509 - protein, 14 aa, Giardia lamblia
DNVQRGARQTDRRS

SEQ ID NO: 3051510 - protein, 6 aa, Giardia lamblia
DNYDPE

SEQ ID NO: 3051511 - protein, 6 aa, Giardia lamblia
DNYDSY

SEQ ID NO: 3051512 - protein, 4 aa, Giardia lamblia
DNYN

SEQ ID NO: 3051513 - protein, 7 aa, Giardia lamblia
DNYRSGS

SEQ ID NO: 3051514 - protein, 7 aa, Giardia lamblia
DNYSKNA

SEQ ID NO: 3051515 - protein, 8 aa, Giardia lamblia
DPAAAHKA

SEQ ID NO: 3051516 - protein, 6 aa, Giardia lamblia
DPAASI

SEQ ID NO: 3051517 - protein, 9 aa, Giardia lamblia
DPAATPGSG

SEQ ID NO: 3051518 - protein, 13 aa, Giardia lamblia
DPADATADDPRKL

SEQ ID NO: 3051519 - protein, 15 aa, Giardia lamblia
DPADHTSSVETASTL

SEQ ID NO: 3051520 - protein, 7 aa, Giardia lamblia
DPAERPS

SEQ ID NO: 3051521 - protein, 5 aa, Giardia lamblia
DPAKY

SEQ ID NO: 3051522 - protein, 6 aa, Giardia lamblia
DPALGG

SEQ ID NO: 3051523 - protein, 9 aa, Giardia lamblia
DPANPRNAY

SEQ ID NO: 3051524 - protein, 7 aa, Giardia lamblia
DPAQLNP

SEQ ID NO: 3051525 - protein, 4 aa, Giardia lamblia
DPAS

SEQ ID NO: 3051526 - protein, 13 aa, Giardia lamblia
DPATAFRGSQQEK

SEQ ID NO: 3051527 - protein, 8 aa, Giardia lamblia
DPATTVDD

SEQ ID NO: 3051528 - protein, 9 aa, Giardia lamblia
DPDGPSHSA

SEQ ID NO: 3051529 - protein, 6 aa, Giardia lamblia
DPDTLR

SEQ ID NO: 3051530 - protein, 6 aa, Giardia lamblia
DPDTVT

SEQ ID NO: 3051531 - protein, 6 aa, Giardia lamblia
DPEAQQ

SEQ ID NO: 3051532 - protein, 6 aa, Giardia lamblia
DPEGLA

SEQ ID NO: 3051533 - protein, 7 aa, Giardia lamblia
DPEHSQP

SEQ ID NO: 3051534 - protein, 24 aa, Giardia lamblia
DPEIELRPGSTAQEQQRSTTQPPD

SEQ ID NO: 3051535 - protein, 7 aa, Giardia lamblia
DPEKLPS

SEQ ID NO: 3051536 - protein, 5 aa, Giardia lamblia
DPENC

SEQ ID NO: 3051537 - protein, 5 aa, Giardia lamblia
DPENG

SEQ ID NO: 3051538 - protein, 4 aa, Giardia lamblia
DPER

SEQ ID NO: 3051539 - protein, 7 aa, Giardia lamblia
DPESTTK

SEQ ID NO: 3051540 - protein, 5 aa, Giardia lamblia
DPETK

SEQ ID NO: 3051541 - protein, 5 aa, Giardia lamblia
DPEYA

SEQ ID NO: 3051542 - protein, 6 aa, Giardia lamblia
DPEYTG

SEQ ID NO: 3051543 - protein, 6 aa, Giardia lamblia
DPGAPQ

SEQ ID NO: 3051544 - protein, 6 aa, Giardia lamblia
DPGESL

SEQ ID NO: 3051545 - protein, 8 aa, Giardia lamblia
DPGLESQG

SEQ ID NO: 3051546 - protein, 5 aa, Giardia lamblia
DPGTL

SEQ ID NO: 3051547 - protein, 5 aa, Giardia lamblia
DPGTN

SEQ ID NO: 3051548 - protein, 8 aa, Giardia lamblia
DPGYRQGS

SEQ ID NO: 3051549 - protein, 6 aa, Giardia lamblia
DPHDIS

SEQ ID NO: 3051550 - protein, 6 aa, Giardia lamblia
DPHGAG

SEQ ID NO: 3051551 - protein, 6 aa, Giardia lamblia
DPIGSP

SEQ ID NO: 3051552 - protein, 5 aa, Giardia lamblia
DPITP

SEQ ID NO: 3051553 - protein, 10 aa, Giardia lamblia
DPKDVTEDEY

SEQ ID NO: 3051554 - protein, 8 aa, Giardia lamblia
DPKHNEGV

SEQ ID NO: 3051555 - protein, 7 aa, Giardia lamblia
DPKLTSA

SEQ ID NO: 3051556 - protein, 6 aa, Giardia lamblia
DPKPFP

SEQ ID NO: 3051557 - protein, 11 aa, Giardia lamblia
DPLDGNSTGSY

SEQ ID NO: 3051558 - protein, 5 aa, Giardia lamblia
DPLDP

SEQ ID NO: 3051559 - protein, 12 aa, Giardia lamblia
DPLDSNSVSNTL

SEQ ID NO: 3051560 - protein, 4 aa, Giardia lamblia
DPLG

SEQ ID NO: 3051561 - protein, 4 aa, Giardia lamblia
DPLQ

SEQ ID NO: 3051562 - protein, 6 aa, Giardia lamblia
DPLQEH

SEQ ID NO: 3051563 - protein, 19 aa, Giardia lamblia
DPLSPNGGRFESSTQVTSN

SEQ ID NO: 3051564 - protein, 11 aa, Giardia lamblia
DPNDSAIQNDM

SEQ ID NO: 3051565 - protein, 4 aa, Giardia lamblia
DPNI

SEQ ID NO: 3051566 - protein, 6 aa, Giardia lamblia
DPNLPE

SEQ ID NO: 3051567 - protein, 10 aa, Giardia lamblia
DPNTEQGIAE

SEQ ID NO: 3051568 - protein, 11 aa, Giardia lamblia
DPNTGETTSAC

SEQ ID NO: 3051569 - protein, 4 aa, Giardia lamblia
DPPA

SEQ ID NO: 3051570 - protein, 6 aa, Giardia lamblia
DPPESV

SEQ ID NO: 3051571 - protein, 7 aa, Giardia lamblia
DPPKDGV

SEQ ID NO: 3051572 - protein, 7 aa, Giardia lamblia
DPPPPTN

SEQ ID NO: 3051573 - protein, 14 aa, Giardia lamblia
DPPPTGAENGTCEP

SEQ ID NO: 3051574 - protein, 15 aa, Giardia lamblia
DPPSDDLASDSNVNA

SEQ ID NO: 3051575 - protein, 4 aa, Giardia lamblia
DPQD

SEQ ID NO: 3051576 - protein, 6 aa, Giardia lamblia
DPQGSL

SEQ ID NO: 3051577 - protein, 8 aa, Giardia lamblia
DPQGTAKA

SEQ ID NO: 3051578 - protein, 5 aa, Giardia lamblia
DPQNE

SEQ ID NO: 3051579 - protein, 6 aa, Giardia lamblia
DPQNRR

SEQ ID NO: 3051580 - protein, 5 aa, Giardia lamblia
DPQRL

SEQ ID NO: 3051581 - protein, 7 aa, Giardia lamblia
DPQTSHS

SEQ ID NO: 3051582 - protein, 7 aa, Giardia lamblia
DPQVSAA

SEQ ID NO: 3051583 - protein, 26 aa, Giardia lamblia
DPRAVASGCASEAGKPLKNSAKTCSS

SEQ ID NO: 3051584 - protein, 8 aa, Giardia lamblia
DPREDNHI

SEQ ID NO: 3051585 - protein, 5 aa, Giardia lamblia
DPRPA

SEQ ID NO: 3051586 - protein, 7 aa, Giardia lamblia
DPRQKLG

SEQ ID NO: 3051587 - protein, 10 aa, Giardia lamblia
DPRVSETASS

SEQ ID NO: 3051588 - protein, 14 aa, Giardia lamblia
DPSAPASDATNDSE

SEQ ID NO: 3051589 - protein, 12 aa, Giardia lamblia
DPSDSTDTKRAP

SEQ ID NO: 3051590 - protein, 4 aa, Giardia lamblia
DPSI

SEQ ID NO: 3051591 - protein, 10 aa, Giardia lamblia
DPSKMDKPCP

SEQ ID NO: 3051592 - protein, 30 aa, Giardia lamblia
DPSKPNERRPTGKSAKGINKLRDRTWRYWS

SEQ ID NO: 3051593 - protein, 11 aa, Giardia lamblia
DPSKSQKAAEL

SEQ ID NO: 3051594 - protein, 15 aa, Giardia lamblia
DPSKSTNAISSINRP

SEQ ID NO: 3051595 - protein, 6 aa, Giardia lamblia
DPSKVN

SEQ ID NO: 3051596 - protein, 9 aa, Giardia lamblia
DPSLQDATE

SEQ ID NO: 3051597 - protein, 5 aa, Giardia lamblia
DPSLS

SEQ ID NO: 3051598 - protein, 5 aa, Giardia lamblia
DPSNF

SEQ ID NO: 3051599 - protein, 7 aa, Giardia lamblia
DPSQYPA

SEQ ID NO: 3051600 - protein, 9 aa, Giardia lamblia
DPSRHGTDV

SEQ ID NO: 3051601 - protein, 12 aa, Giardia lamblia
DPSRVQASTDAI

SEQ ID NO: 3051602 - protein, 4 aa, Giardia lamblia
DPSS

SEQ ID NO: 3051603 - protein, 8 aa, Giardia lamblia
DPSSDSIY

SEQ ID NO: 3051604 - protein, 15 aa, Giardia lamblia
DPSSEDKKGLYARPT

SEQ ID NO: 3051605 - protein, 9 aa, Giardia lamblia
DPSSLPSDS

SEQ ID NO: 3051606 - protein, 8 aa, Giardia lamblia
DPSSSTIA

SEQ ID NO: 3051607 - protein, 8 aa, Giardia lamblia
DPSTCNTG

SEQ ID NO: 3051608 - protein, 12 aa, Giardia lamblia
DPTASGLKSQAP

SEQ ID NO: 3051609 - protein, 8 aa, Giardia lamblia
DPTDDRGV

SEQ ID NO: 3051610 - protein, 9 aa, Giardia lamblia
DPTDEASGR

SEQ ID NO: 3051611 - protein, 10 aa, Giardia lamblia
DPTESNISED

SEQ ID NO: 3051612 - protein, 11 aa, Giardia lamblia
DPTGSQELNSQ

SEQ ID NO: 3051613 - protein, 52 aa, Giardia lamblia
DPTKESSSSAATPIPGTVEEQDSEQEQHSDRSETASLATTTQQQSSSKEPHI

SEQ ID NO: 3051614 - protein, 9 aa, Giardia lamblia
DPTNRSSNI

SEQ ID NO: 3051615 - protein, 12 aa, Giardia lamblia
DPTQMQSAAPEP

SEQ ID NO: 3051616 - protein, 5 aa, Giardia lamblia
DPTRG

SEQ ID NO: 3051617 - protein, 4 aa, Giardia lamblia
DPTS

SEQ ID NO: 3051618 - protein, 5 aa, Giardia lamblia
DPTSL

SEQ ID NO: 3051619 - protein, 18 aa, Giardia lamblia
DPTTIQASGQLEQSSQYG

SEQ ID NO: 3051620 - protein, 4 aa, Giardia lamblia
DPTY

SEQ ID NO: 3051621 - protein, 9 aa, Giardia lamblia
DPVDSTTSI

SEQ ID NO: 3051622 - protein, 12 aa, Giardia lamblia
DPVEGEESSISH

SEQ ID NO: 3051623 - protein, 6 aa, Giardia lamblia
DPVEQG

SEQ ID NO: 3051624 - protein, 4 aa, Giardia lamblia
DPVL

SEQ ID NO: 3051625 - protein, 5 aa, Giardia lamblia
DPWSG

SEQ ID NO: 3051626 - protein, 18 aa, Giardia lamblia
DPYAGKGKERKQDNAGTA

SEQ ID NO: 3051627 - protein, 9 aa, Giardia lamblia
DPYKPPTEE

SEQ ID NO: 3051628 - protein, 5 aa, Giardia lamblia
DPYSG

SEQ ID NO: 3051629 - protein, 9 aa, Giardia lamblia
DQAGLPPQM

SEQ ID NO: 3051630 - protein, 10 aa, Giardia lamblia
DQAQSSTTKS

SEQ ID NO: 3051631 - protein, 30 aa, Giardia lamblia
DQCNPSTSFTPTASPPESQPTGAPPQLPTC

SEQ ID NO: 3051632 - protein, 6 aa, Giardia lamblia
DQDGYT

SEQ ID NO: 3051633 - protein, 40 aa, Giardia lamblia
DQDSPEQDTALRPRRRRQPRTCSASTSQSSEQRTSQEPTS

SEQ ID NO: 3051634 - protein, 40 aa, Giardia lamblia
DQDSPEQDTALRPRRRRQPRTCSASTSQSSEQRVSQEPTS

SEQ ID NO: 3051635 - protein, 9 aa, Giardia lamblia
DQDTDSVCP

SEQ ID NO: 3051636 - protein, 13 aa, Giardia lamblia
DQEASIEDTSVQY

SEQ ID NO: 3051637 - protein, 5 aa, Giardia lamblia
DQENF

SEQ ID NO: 3051638 - protein, 8 aa, Giardia lamblia
DQENPVDS

SEQ ID NO: 3051639 - protein, 5 aa, Giardia lamblia
DQEPQ

SEQ ID NO: 3051640 - protein, 16 aa, Giardia lamblia
DQEQEELKPAEPPKLT

SEQ ID NO: 3051641 - protein, 10 aa, Giardia lamblia
DQESGVPGSF

SEQ ID NO: 3051642 - protein, 4 aa, Giardia lamblia
DQET

SEQ ID NO: 3051643 - protein, 15 aa, Giardia lamblia
DQFAAKPEKTVSDSN

SEQ ID NO: 3051644 - protein, 4 aa, Giardia lamblia
DQGA

SEQ ID NO: 3051645 - protein, 16 aa, Giardia lamblia
DQGRYESIEQKSSVSS

SEQ ID NO: 3051646 - protein, 7 aa, Giardia lamblia
DQGTTKH

SEQ ID NO: 3051647 - protein, 8 aa, Giardia lamblia
DQHATETL

SEQ ID NO: 3051648 - protein, 11 aa, Giardia lamblia
DQISQGKTQLP

SEQ ID NO: 3051649 - protein, 24 aa, Giardia lamblia
DQISTVDSQSSLVATGADDSLGNS

SEQ ID NO: 3051650 - protein, 6 aa, Giardia lamblia
DQKEYL

SEQ ID NO: 3051651 - protein, 7 aa, Giardia lamblia
DQLKTTT

SEQ ID NO: 3051652 - protein, 18 aa, Giardia lamblia
DQLPDDSDFDSAADEDIS

SEQ ID NO: 3051653 - protein, 9 aa, Giardia lamblia
DQLPPSVTS

SEQ ID NO: 3051654 - protein, 6 aa, Giardia lamblia
DQLQTD

SEQ ID NO: 3051655 - protein, 9 aa, Giardia lamblia
DQNDGRREL

SEQ ID NO: 3051656 - protein, 7 aa, Giardia lamblia
DQNDKEL

SEQ ID NO: 3051657 - protein, 5 aa, Giardia lamblia
DQNNS

SEQ ID NO: 3051658 - protein, 7 aa, Giardia lamblia
DQPSDLP

SEQ ID NO: 3051659 - protein, 28 aa, Giardia lamblia
DQPSSEVSTKTPTHSGSGDASNADDADD

SEQ ID NO: 3051660 - protein, 15 aa, Giardia lamblia
DQQAKSDPPPDADAA

SEQ ID NO: 3051661 - protein, 10 aa, Giardia lamblia
DQQARSGHHL

SEQ ID NO: 3051662 - protein, 98 aa, Giardia lamblia
DQQEAEQDSASVAKQEPPKKKTTPTTKKPRTESAKTLGPASKEDAGVKKTTKKTPAAASEISKPTVKKTTKKKAKKADGLDIDGEEHESIRPSTNESF

SEQ ID NO: 3051663 - protein, 6 aa, Giardia lamblia
DQQPGL

SEQ ID NO: 3051664 - protein, 7 aa, Giardia lamblia
DQQTISD

SEQ ID NO: 3051665 - protein, 10 aa, Giardia lamblia
DQRAELSSEE

SEQ ID NO: 3051666 - protein, 8 aa, Giardia lamblia
DQREEDGR

SEQ ID NO: 3051667 - protein, 8 aa, Giardia lamblia
DQRESTVG

SEQ ID NO: 3051668 - protein, 8 aa, Giardia lamblia
DQRVNKTR

SEQ ID NO: 3051669 - protein, 10 aa, Giardia lamblia
DQSATGKTAE

SEQ ID NO: 3051670 - protein, 13 aa, Giardia lamblia
DQSAVGSAVGTST

SEQ ID NO: 3051671 - protein, 7 aa, Giardia lamblia
DQSFSDD

SEQ ID NO: 3051672 - protein, 7 aa, Giardia lamblia
DQSLPSL

SEQ ID NO: 3051673 - protein, 7 aa, Giardia lamblia
DQSLSKP

SEQ ID NO: 3051674 - protein, 5 aa, Giardia lamblia
DQSSS

SEQ ID NO: 3051675 - protein, 16 aa, Giardia lamblia
DQSTRSGNTTSNEIQA

SEQ ID NO: 3051676 - protein, 13 aa, Giardia lamblia
DQTAEEDQETNTI

SEQ ID NO: 3051677 - protein, 8 aa, Giardia lamblia
DQTDGVPG

SEQ ID NO: 3051678 - protein, 6 aa, Giardia lamblia
DQTDPY

SEQ ID NO: 3051679 - protein, 8 aa, Giardia lamblia
DQTEDAEP

SEQ ID NO: 3051680 - protein, 11 aa, Giardia lamblia
DQTKDPGIRKQ

SEQ ID NO: 3051681 - protein, 5 aa, Giardia lamblia
DQTRN

SEQ ID NO: 3051682 - protein, 4 aa, Giardia lamblia
DQTT

SEQ ID NO: 3051683 - protein, 7 aa, Giardia lamblia
DQTTAPI

SEQ ID NO: 3051684 - protein, 4 aa, Giardia lamblia
DQVR

SEQ ID NO: 3051685 - protein, 4 aa, Giardia lamblia
DQVS

SEQ ID NO: 3051686 - protein, 18 aa, Giardia lamblia
DRADREDNSTNPEPRASS

SEQ ID NO: 3051687 - protein, 5 aa, Giardia lamblia
DRAEC

SEQ ID NO: 3051688 - protein, 7 aa, Giardia lamblia
DRAKEQQ

SEQ ID NO: 3051689 - protein, 4 aa, Giardia lamblia
DRAN

SEQ ID NO: 3051690 - protein, 8 aa, Giardia lamblia
DRANFSST

SEQ ID NO: 3051691 - protein, 8 aa, Giardia lamblia
DRANNALT

SEQ ID NO: 3051692 - protein, 13 aa, Giardia lamblia
DRAPGHRRTSRSR

SEQ ID NO: 3051693 - protein, 22 aa, Giardia lamblia
DRAQSDMSNSVTAQNGTPLTPS

SEQ ID NO: 3051694 - protein, 56 aa, Giardia lamblia
DRAVTPTGRVHPDNVDSSGSEGPSDSDVPRLNSGTRSPSPTTSLSDTISNEPTEYA

SEQ ID NO: 3051695 - protein, 5 aa, Giardia lamblia
DRDET

SEQ ID NO: 3051696 - protein, 9 aa, Giardia lamblia
DRDGISPRD

SEQ ID NO: 3051697 - protein, 6 aa, Giardia lamblia
DRDGYY

SEQ ID NO: 3051698 - protein, 6 aa, Giardia lamblia
DRDNKT

SEQ ID NO: 3051699 - protein, 5 aa, Giardia lamblia
DRDPA

SEQ ID NO: 3051700 - protein, 8 aa, Giardia lamblia
DRDTNQEL

SEQ ID NO: 3051701 - protein, 80 aa, Giardia lamblia
DRESEKDEAAEPQDMPLQSNKTVEFDDSKSGRDGALGLTESKHRNLTNQEFDNPNEERNVEHNSSCETSQSSHDRPPAEH

SEQ ID NO: 3051702 - protein, 9 aa, Giardia lamblia
DRESNKASR

SEQ ID NO: 3051703 - protein, 8 aa, Giardia lamblia
DRESRYRR

SEQ ID NO: 3051704 - protein, 14 aa, Giardia lamblia
DRETLTKRYSSPLT

SEQ ID NO: 3051705 - protein, 7 aa, Giardia lamblia
DRFQESD

SEQ ID NO: 3051706 - protein, 21 aa, Giardia lamblia
DRGAPDGKRGMRDKPGVPSDA

SEQ ID NO: 3051707 - protein, 8 aa, Giardia lamblia
DRGERPSL

SEQ ID NO: 3051708 - protein, 4 aa, Giardia lamblia
DRGG

SEQ ID NO: 3051709 - protein, 9 aa, Giardia lamblia
DRGRRPTME

SEQ ID NO: 3051710 - protein, 10 aa, Giardia lamblia
DRKLGGHKNI

SEQ ID NO: 3051711 - protein, 8 aa, Giardia lamblia
DRKQPATN

SEQ ID NO: 3051712 - protein, 4 aa, Giardia lamblia
DRLE

SEQ ID NO: 3051713 - protein, 4 aa, Giardia lamblia
DRLG

SEQ ID NO: 3051714 - protein, 6 aa, Giardia lamblia
DRLSED

SEQ ID NO: 3051715 - protein, 7 aa, Giardia lamblia
DRNARDA

SEQ ID NO: 3051716 - protein, 5 aa, Giardia lamblia
DRNGF

SEQ ID NO: 3051717 - protein, 5 aa, Giardia lamblia
DRNNY

SEQ ID NO: 3051718 - protein, 7 aa, Giardia lamblia
DRNQQYS

SEQ ID NO: 3051719 - protein, 6 aa, Giardia lamblia
DRNQTT

SEQ ID NO: 3051720 - protein, 8 aa, Giardia lamblia
DRPRPPFT

SEQ ID NO: 3051721 - protein, 13 aa, Giardia lamblia
DRPSTACTTPATT

SEQ ID NO: 3051722 - protein, 7 aa, Giardia lamblia
DRQELGN

SEQ ID NO: 3051723 - protein, 7 aa, Giardia lamblia
DRQGLDP

SEQ ID NO: 3051724 - protein, 9 aa, Giardia lamblia
DRQKGGTLH

SEQ ID NO: 3051725 - protein, 6 aa, Giardia lamblia
DRQPED

SEQ ID NO: 3051726 - protein, 6 aa, Giardia lamblia
DRRFSD

SEQ ID NO: 3051727 - protein, 7 aa, Giardia lamblia
DRRHTAS

SEQ ID NO: 3051728 - protein, 5 aa, Giardia lamblia
DRRNV

SEQ ID NO: 3051729 - protein, 10 aa, Giardia lamblia
DRSDDDKSLS

SEQ ID NO: 3051730 - protein, 4 aa, Giardia lamblia
DRSI

SEQ ID NO: 3051731 - protein, 4 aa, Giardia lamblia
DRSM

SEQ ID NO: 3051732 - protein, 6 aa, Giardia lamblia
DRSPLA

SEQ ID NO: 3051733 - protein, 7 aa, Giardia lamblia
DRSRTGE

SEQ ID NO: 3051734 - protein, 10 aa, Giardia lamblia
DRSSADGGDI

SEQ ID NO: 3051735 - protein, 36 aa, Giardia lamblia
DRSTDDEDYGDDDDDEHDVKDKRRGQDKVKQERQSA

SEQ ID NO: 3051736 - protein, 6 aa, Giardia lamblia
DRTAQS

SEQ ID NO: 3051737 - protein, 7 aa, Giardia lamblia
DRTDTNI

SEQ ID NO: 3051738 - protein, 6 aa, Giardia lamblia
DRTDWN

SEQ ID NO: 3051739 - protein, 4 aa, Giardia lamblia
DRTE

SEQ ID NO: 3051740 - protein, 24 aa, Giardia lamblia
DRTEEMRATESKLRKELQSASAKI

SEQ ID NO: 3051741 - protein, 13 aa, Giardia lamblia
DRTGAAKLGPPTI

SEQ ID NO: 3051742 - protein, 4 aa, Giardia lamblia
DRTN

SEQ ID NO: 3051743 - protein, 5 aa, Giardia lamblia
DRTSM

SEQ ID NO: 3051744 - protein, 6 aa, Giardia lamblia
DRTSTS

SEQ ID NO: 3051745 - protein, 7 aa, Giardia lamblia
DRYPERK

SEQ ID NO: 3051746 - protein, 12 aa, Giardia lamblia
DRYTRTAKTHLG

SEQ ID NO: 3051747 - protein, 13 aa, Giardia lamblia
DSAAPHASPSNAR

SEQ ID NO: 3051748 - protein, 11 aa, Giardia lamblia
DSADSQHNEKQ

SEQ ID NO: 3051749 - protein, 6 aa, Giardia lamblia
DSAEAA

SEQ ID NO: 3051750 - protein, 13 aa, Giardia lamblia
DSAGGTPFHETGP

SEQ ID NO: 3051751 - protein, 5 aa, Giardia lamblia
DSAGP

SEQ ID NO: 3051752 - protein, 9 aa, Giardia lamblia
DSAKARKTL

SEQ ID NO: 3051753 - protein, 7 aa, Giardia lamblia
DSAKKKT

SEQ ID NO: 3051754 - protein, 6 aa, Giardia lamblia
DSANGN

SEQ ID NO: 3051755 - protein, 8 aa, Giardia lamblia
DSANSSGV

SEQ ID NO: 3051756 - protein, 9 aa, Giardia lamblia
DSAPETPQV

SEQ ID NO: 3051757 - protein, 13 aa, Giardia lamblia
DSARSVGSDIGAS

SEQ ID NO: 3051758 - protein, 9 aa, Giardia lamblia
DSASDNSKF

SEQ ID NO: 3051759 - protein, 9 aa, Giardia lamblia
DSASPLPQH

SEQ ID NO: 3051760 - protein, 7 aa, Giardia lamblia
DSASYQS

SEQ ID NO: 3051761 - protein, 24 aa, Giardia lamblia
DSATGHSVHGSPGGLRKSSFSTKF

SEQ ID NO: 3051762 - protein, 7 aa, Giardia lamblia
DSATNKI

SEQ ID NO: 3051763 - protein, 16 aa, Giardia lamblia
DSATSMQGRSSDKELL

SEQ ID NO: 3051764 - protein, 6 aa, Giardia lamblia
DSATTC

SEQ ID NO: 3051765 - protein, 14 aa, Giardia lamblia
DSCGPSGRSTENSI

SEQ ID NO: 3051766 - protein, 12 aa, Giardia lamblia
DSCGSKNCGTPG

SEQ ID NO: 3051767 - protein, 8 aa, Giardia lamblia
DSCPASAE

SEQ ID NO: 3051768 - protein, 12 aa, Giardia lamblia
DSCPSNSTDDNS

SEQ ID NO: 3051769 - protein, 6 aa, Giardia lamblia
DSDDSF

SEQ ID NO: 3051770 - protein, 16 aa, Giardia lamblia
DSDDVEGNTRSSHQPY

SEQ ID NO: 3051771 - protein, 10 aa, Giardia lamblia
DSDEESDDAP

SEQ ID NO: 3051772 - protein, 11 aa, Giardia lamblia
DSDGGKAENSP

SEQ ID NO: 3051773 - protein, 12 aa, Giardia lamblia
DSDGNTQATLKQ

SEQ ID NO: 3051774 - protein, 9 aa, Giardia lamblia
DSDPSYKTE

SEQ ID NO: 3051775 - protein, 8 aa, Giardia lamblia
DSDQYSDT

SEQ ID NO: 3051776 - protein, 4 aa, Giardia lamblia
DSDR

SEQ ID NO: 3051777 - protein, 12 aa, Giardia lamblia
DSDRQQQQVKKP

SEQ ID NO: 3051778 - protein, 7 aa, Giardia lamblia
DSDTAGD

SEQ ID NO: 3051779 - protein, 6 aa, Giardia lamblia
DSDTVT

SEQ ID NO: 3051780 - protein, 25 aa, Giardia lamblia
DSDYCGPSPSFSDTAIQTASSTAHL

SEQ ID NO: 3051781 - protein, 5 aa, Giardia lamblia
DSEAR

SEQ ID NO: 3051782 - protein, 10 aa, Giardia lamblia
DSEDSSSLTQ

SEQ ID NO: 3051783 - protein, 9 aa, Giardia lamblia
DSEDSYTTQ

SEQ ID NO: 3051784 - protein, 4 aa, Giardia lamblia
DSEE

SEQ ID NO: 3051785 - protein, 30 aa, Giardia lamblia
DSEGCSCRSEYSGDKCQDCATGYKEYTDNR

SEQ ID NO: 3051786 - protein, 9 aa, Giardia lamblia
DSEGGLTMR

SEQ ID NO: 3051787 - protein, 10 aa, Giardia lamblia
DSEGNSLPET

SEQ ID NO: 3051788 - protein, 5 aa, Giardia lamblia
DSEIA

SEQ ID NO: 3051789 - protein, 5 aa, Giardia lamblia
DSENE

SEQ ID NO: 3051790 - protein, 8 aa, Giardia lamblia
DSENESHT

SEQ ID NO: 3051791 - protein, 7 aa, Giardia lamblia
DSENMHP

SEQ ID NO: 3051792 - protein, 7 aa, Giardia lamblia
DSEPAAG

SEQ ID NO: 3051793 - protein, 15 aa, Giardia lamblia
DSEPCAGAAPALPNV

SEQ ID NO: 3051794 - protein, 7 aa, Giardia lamblia
DSEPDTS

SEQ ID NO: 3051795 - protein, 5 aa, Giardia lamblia
DSERS

SEQ ID NO: 3051796 - protein, 15 aa, Giardia lamblia
DSESPGLPRSARYTN

SEQ ID NO: 3051797 - protein, 15 aa, Giardia lamblia
DSESPLECDTPIDDS

SEQ ID NO: 3051798 - protein, 8 aa, Giardia lamblia
DSESSGLY

SEQ ID NO: 3051799 - protein, 6 aa, Giardia lamblia
DSETLG

SEQ ID NO: 3051800 - protein, 9 aa, Giardia lamblia
DSETSSGMV

SEQ ID NO: 3051801 - protein, 6 aa, Giardia lamblia
DSFETN

SEQ ID NO: 3051802 - protein, 5 aa, Giardia lamblia
DSFGN

SEQ ID NO: 3051803 - protein, 6 aa, Giardia lamblia
DSFGSQ

SEQ ID NO: 3051804 - protein, 5 aa, Giardia lamblia
DSFRR

SEQ ID NO: 3051805 - protein, 4 aa, Giardia lamblia
DSFS

SEQ ID NO: 3051806 - protein, 4 aa, Giardia lamblia
DSGA

SEQ ID NO: 3051807 - protein, 6 aa, Giardia lamblia
DSGAHA

SEQ ID NO: 3051808 - protein, 9 aa, Giardia lamblia
DSGALGTQG

SEQ ID NO: 3051809 - protein, 7 aa, Giardia lamblia
DSGEDVS

SEQ ID NO: 3051810 - protein, 8 aa, Giardia lamblia
DSGEVKED

SEQ ID NO: 3051811 - protein, 5 aa, Giardia lamblia
DSGNH

SEQ ID NO: 3051812 - protein, 10 aa, Giardia lamblia
DSGSINGNTC

SEQ ID NO: 3051813 - protein, 6 aa, Giardia lamblia
DSGTNF

SEQ ID NO: 3051814 - protein, 8 aa, Giardia lamblia
DSGTTSCV

SEQ ID NO: 3051815 - protein, 4 aa, Giardia lamblia
DSHG

SEQ ID NO: 3051816 - protein, 6 aa, Giardia lamblia
DSHGNS

SEQ ID NO: 3051817 - protein, 10 aa, Giardia lamblia
DSHKRKQRLD

SEQ ID NO: 3051818 - protein, 10 aa, Giardia lamblia
DSHKRSKFTE

SEQ ID NO: 3051819 - protein, 9 aa, Giardia lamblia
DSHTEQSAL

SEQ ID NO: 3051820 - protein, 10 aa, Giardia lamblia
DSIANDKPVQ

SEQ ID NO: 3051821 - protein, 13 aa, Giardia lamblia
DSIETTIETAART

SEQ ID NO: 3051822 - protein, 7 aa, Giardia lamblia
DSINKDS

SEQ ID NO: 3051823 - protein, 6 aa, Giardia lamblia
DSIRNP

SEQ ID NO: 3051824 - protein, 6 aa, Giardia lamblia
DSISGS

SEQ ID NO: 3051825 - protein, 7 aa, Giardia lamblia
DSITPPD

SEQ ID NO: 3051826 - protein, 9 aa, Giardia lamblia
DSKEGGEGV

SEQ ID NO: 3051827 - protein, 5 aa, Giardia lamblia
DSKEL

SEQ ID NO: 3051828 - protein, 8 aa, Giardia lamblia
DSKEYSRT

SEQ ID NO: 3051829 - protein, 9 aa, Giardia lamblia
DSKHSSDLG

SEQ ID NO: 3051830 - protein, 7 aa, Giardia lamblia
DSKPTHT

SEQ ID NO: 3051831 - protein, 8 aa, Giardia lamblia
DSKQDVCN

SEQ ID NO: 3051832 - protein, 14 aa, Giardia lamblia
DSKTRAVEGLTEEK

SEQ ID NO: 3051833 - protein, 15 aa, Giardia lamblia
DSKYNDLANDNASNS

SEQ ID NO: 3051834 - protein, 6 aa, Giardia lamblia
DSLANT

SEQ ID NO: 3051835 - protein, 7 aa, Giardia lamblia
DSLEQRR

SEQ ID NO: 3051836 - protein, 20 aa, Giardia lamblia
DSLERNDASSVRAPVATRSH

SEQ ID NO: 3051837 - protein, 10 aa, Giardia lamblia
DSLNANPQQL

SEQ ID NO: 3051838 - protein, 6 aa, Giardia lamblia
DSLPAE

SEQ ID NO: 3051839 - protein, 9 aa, Giardia lamblia
DSLPENGTI

SEQ ID NO: 3051840 - protein, 6 aa, Giardia lamblia
DSLPEQ

SEQ ID NO: 3051841 - protein, 22 aa, Giardia lamblia
DSLQDDRMPTCAKPSEGSNLPE

SEQ ID NO: 3051842 - protein, 8 aa, Giardia lamblia
DSLSASEP

SEQ ID NO: 3051843 - protein, 20 aa, Giardia lamblia
DSLSNTCTESTDPDHGTPST

SEQ ID NO: 3051844 - protein, 11 aa, Giardia lamblia
DSLSSGSAKSL

SEQ ID NO: 3051845 - protein, 6 aa, Giardia lamblia
DSLSSI

SEQ ID NO: 3051846 - protein, 7 aa, Giardia lamblia
DSMQHAD

SEQ ID NO: 3051847 - protein, 10 aa, Giardia lamblia
DSNAEDTSMS

SEQ ID NO: 3051848 - protein, 6 aa, Giardia lamblia
DSNDCE

SEQ ID NO: 3051849 - protein, 7 aa, Giardia lamblia
DSNGPGL

SEQ ID NO: 3051850 - protein, 15 aa, Giardia lamblia
DSNGSKGNSNGKNPI

SEQ ID NO: 3051851 - protein, 5 aa, Giardia lamblia
DSNKE

SEQ ID NO: 3051852 - protein, 7 aa, Giardia lamblia
DSNPKAL

SEQ ID NO: 3051853 - protein, 9 aa, Giardia lamblia
DSNSPTTGV

SEQ ID NO: 3051854 - protein, 7 aa, Giardia lamblia
DSNTQNM

SEQ ID NO: 3051855 - protein, 11 aa, Giardia lamblia
DSNVKDSRTLD

SEQ ID NO: 3051856 - protein, 31 aa, Giardia lamblia
DSPAGANSVSLNGAGSTSTLTVSGANKPDTV

SEQ ID NO: 3051857 - protein, 8 aa, Giardia lamblia
DSPEQTPQ

SEQ ID NO: 3051858 - protein, 9 aa, Giardia lamblia
DSPGLPATS

SEQ ID NO: 3051859 - protein, 30 aa, Giardia lamblia
DSPIDKLSKPRSKSKPSGSKRQYGSNHVSS

SEQ ID NO: 3051860 - protein, 5 aa, Giardia lamblia
DSPLE

SEQ ID NO: 3051861 - protein, 11 aa, Giardia lamblia
DSPLKSNQEKA

SEQ ID NO: 3051862 - protein, 13 aa, Giardia lamblia
DSPLRSMPGSRAA

SEQ ID NO: 3051863 - protein, 5 aa, Giardia lamblia
DSPNG

SEQ ID NO: 3051864 - protein, 6 aa, Giardia lamblia
DSPNTR

SEQ ID NO: 3051865 - protein, 5 aa, Giardia lamblia
DSPPS

SEQ ID NO: 3051866 - protein, 7 aa, Giardia lamblia
DSPQSVA

SEQ ID NO: 3051867 - protein, 12 aa, Giardia lamblia
DSPSAANEKELT

SEQ ID NO: 3051868 - protein, 8 aa, Giardia lamblia
DSPSGSEL

SEQ ID NO: 3051869 - protein, 13 aa, Giardia lamblia
DSPSNLLAPTSRS

SEQ ID NO: 3051870 - protein, 6 aa, Giardia lamblia
DSPTIA

SEQ ID NO: 3051871 - protein, 8 aa, Giardia lamblia
DSPTTLSL

SEQ ID NO: 3051872 - protein, 4 aa, Giardia lamblia
DSPY

SEQ ID NO: 3051873 - protein, 10 aa, Giardia lamblia
DSQKQTSTIP

SEQ ID NO: 3051874 - protein, 12 aa, Giardia lamblia
DSQLTNGSASTR

SEQ ID NO: 3051875 - protein, 12 aa, Giardia lamblia
DSQPNDPSNTTK

SEQ ID NO: 3051876 - protein, 7 aa, Giardia lamblia
DSQRNKH

SEQ ID NO: 3051877 - protein, 11 aa, Giardia lamblia
DSQRRRDVNDE

SEQ ID NO: 3051878 - protein, 22 aa, Giardia lamblia
DSQSAASSSVFAGGKQSGTFRS

SEQ ID NO: 3051879 - protein, 4 aa, Giardia lamblia
DSQV

SEQ ID NO: 3051880 - protein, 6 aa, Giardia lamblia
DSQYSR

SEQ ID NO: 3051881 - protein, 7 aa, Giardia lamblia
DSRATGL

SEQ ID NO: 3051882 - protein, 9 aa, Giardia lamblia
DSRDEPDTL

SEQ ID NO: 3051883 - protein, 7 aa, Giardia lamblia
DSREEKI

SEQ ID NO: 3051884 - protein, 4 aa, Giardia lamblia
DSRK

SEQ ID NO: 3051885 - protein, 4 aa, Giardia lamblia
DSRQ

SEQ ID NO: 3051886 - protein, 6 aa, Giardia lamblia
DSRSLR

SEQ ID NO: 3051887 - protein, 6 aa, Giardia lamblia
DSRTGL

SEQ ID NO: 3051888 - protein, 20 aa, Giardia lamblia
DSRTPGADDCNDHQAAPRAH

SEQ ID NO: 3051889 - protein, 13 aa, Giardia lamblia
DSRYQPTVHPNGR

SEQ ID NO: 3051890 - protein, 6 aa, Giardia lamblia
DSSACP

SEQ ID NO: 3051891 - protein, 4 aa, Giardia lamblia
DSSD

SEQ ID NO: 3051892 - protein, 42 aa, Giardia lamblia
DSSDKDTSLKATTRSSLSPRGHLPASAKSKGTPTLRKSGVDD

SEQ ID NO: 3051893 - protein, 6 aa, Giardia lamblia
DSSDPM

SEQ ID NO: 3051894 - protein, 14 aa, Giardia lamblia
DSSDPSTCDTTENT

SEQ ID NO: 3051895 - protein, 5 aa, Giardia lamblia
DSSER

SEQ ID NO: 3051896 - protein, 4 aa, Giardia lamblia
DSSF

SEQ ID NO: 3051897 - protein, 4 aa, Giardia lamblia
DSSG

SEQ ID NO: 3051898 - protein, 8 aa, Giardia lamblia
DSSIYTNP

SEQ ID NO: 3051899 - protein, 13 aa, Giardia lamblia
DSSLPTIDAQGQP

SEQ ID NO: 3051900 - protein, 9 aa, Giardia lamblia
DSSNANYSK

SEQ ID NO: 3051901 - protein, 7 aa, Giardia lamblia
DSSQAPI

SEQ ID NO: 3051902 - protein, 14 aa, Giardia lamblia
DSSQKERSPAEAER

SEQ ID NO: 3051903 - protein, 8 aa, Giardia lamblia
DSSQPEEG

SEQ ID NO: 3051904 - protein, 7 aa, Giardia lamblia
DSSSMAP

SEQ ID NO: 3051905 - protein, 9 aa, Giardia lamblia
DSSTDTNKI

SEQ ID NO: 3051906 - protein, 6 aa, Giardia lamblia
DSSTKT

SEQ ID NO: 3051907 - protein, 9 aa, Giardia lamblia
DSSTNQRVQ

SEQ ID NO: 3051908 - protein, 8 aa, Giardia lamblia
DSSTPPCF

SEQ ID NO: 3051909 - protein, 24 aa, Giardia lamblia
DSSTPRDTTHNQFSEDYYSYHSLL

SEQ ID NO: 3051910 - protein, 5 aa, Giardia lamblia
DSTAP

SEQ ID NO: 3051911 - protein, 16 aa, Giardia lamblia
DSTDPTSLVTKTTDDK

SEQ ID NO: 3051912 - protein, 7 aa, Giardia lamblia
DSTDSGS

SEQ ID NO: 3051913 - protein, 4 aa, Giardia lamblia
DSTI

SEQ ID NO: 3051914 - protein, 9 aa, Giardia lamblia
DSTKPGVNS

SEQ ID NO: 3051915 - protein, 13 aa, Giardia lamblia
DSTMKQSASYPGI

SEQ ID NO: 3051916 - protein, 5 aa, Giardia lamblia
DSTNA

SEQ ID NO: 3051917 - protein, 28 aa, Giardia lamblia
DSTQQGSEKSIDDPGEPVGKSDDSKAVA

SEQ ID NO: 3051918 - protein, 7 aa, Giardia lamblia
DSTRGAF

SEQ ID NO: 3051919 - protein, 7 aa, Giardia lamblia
DSTRRQS

SEQ ID NO: 3051920 - protein, 12 aa, Giardia lamblia
DSTRYQELSTRQ

SEQ ID NO: 3051921 - protein, 5 aa, Giardia lamblia
DSTSI

SEQ ID NO: 3051922 - protein, 7 aa, Giardia lamblia
DSTTLDP

SEQ ID NO: 3051923 - protein, 16 aa, Giardia lamblia
DSTTSNVSCSATETSK

SEQ ID NO: 3051924 - protein, 7 aa, Giardia lamblia
DSTVNKE

SEQ ID NO: 3051925 - protein, 7 aa, Giardia lamblia
DSVAPRQ

SEQ ID NO: 3051926 - protein, 4 aa, Giardia lamblia
DSVD

SEQ ID NO: 3051927 - protein, 4 aa, Giardia lamblia
DSVG

SEQ ID NO: 3051928 - protein, 20 aa, Giardia lamblia
DSVGGTTSDAYSSRDDFATY

SEQ ID NO: 3051929 - protein, 7 aa, Giardia lamblia
DSVGSAD

SEQ ID NO: 3051930 - protein, 9 aa, Giardia lamblia
DSVHGKPRV

SEQ ID NO: 3051931 - protein, 20 aa, Giardia lamblia
DSVSQTPSSVSKMSGTSVQS

SEQ ID NO: 3051932 - protein, 7 aa, Giardia lamblia
DSWGSDE

SEQ ID NO: 3051933 - protein, 8 aa, Giardia lamblia
DSWSRKPG

SEQ ID NO: 3051934 - protein, 6 aa, Giardia lamblia
DSYQGK

SEQ ID NO: 3051935 - protein, 20 aa, Giardia lamblia
DSYQSNVRARARDKSAAQSF

SEQ ID NO: 3051936 - protein, 8 aa, Giardia lamblia
DSYTAETI

SEQ ID NO: 3051937 - protein, 11 aa, Giardia lamblia
DTAAKRRSDKR

SEQ ID NO: 3051938 - protein, 6 aa, Giardia lamblia
DTADLQ

SEQ ID NO: 3051939 - protein, 7 aa, Giardia lamblia
DTAESDH

SEQ ID NO: 3051940 - protein, 10 aa, Giardia lamblia
DTAGSNGYTG

SEQ ID NO: 3051941 - protein, 6 aa, Giardia lamblia
DTAPDG

SEQ ID NO: 3051942 - protein, 5 aa, Giardia lamblia
DTAPI

SEQ ID NO: 3051943 - protein, 4 aa, Giardia lamblia
DTAQ

SEQ ID NO: 3051944 - protein, 14 aa, Giardia lamblia
DTASDRDSADALAD

SEQ ID NO: 3051945 - protein, 8 aa, Giardia lamblia
DTASPDGL

SEQ ID NO: 3051946 - protein, 5 aa, Giardia lamblia
DTASR

SEQ ID NO: 3051947 - protein, 26 aa, Giardia lamblia
DTATSSGAKRSGEKTKGKRAPNGCRT

SEQ ID NO: 3051948 - protein, 4 aa, Giardia lamblia
DTAV

SEQ ID NO: 3051949 - protein, 7 aa, Giardia lamblia
DTCADGG

SEQ ID NO: 3051950 - protein, 12 aa, Giardia lamblia
DTCNPRPCTERY

SEQ ID NO: 3051951 - protein, 8 aa, Giardia lamblia
DTCRAGQV

SEQ ID NO: 3051952 - protein, 4 aa, Giardia lamblia
DTDA

SEQ ID NO: 3051953 - protein, 12 aa, Giardia lamblia
DTDAKNNKEQQR

SEQ ID NO: 3051954 - protein, 8 aa, Giardia lamblia
DTDDECNN

SEQ ID NO: 3051955 - protein, 6 aa, Giardia lamblia
DTDEDK

SEQ ID NO: 3051956 - protein, 5 aa, Giardia lamblia
DTDPT

SEQ ID NO: 3051957 - protein, 6 aa, Giardia lamblia
DTDQNN

SEQ ID NO: 3051958 - protein, 5 aa, Giardia lamblia
DTDSI

SEQ ID NO: 3051959 - protein, 6 aa, Giardia lamblia
DTDSIN

SEQ ID NO: 3051960 - protein, 6 aa, Giardia lamblia
DTDYPT

SEQ ID NO: 3051961 - protein, 4 aa, Giardia lamblia
DTEA

SEQ ID NO: 3051962 - protein, 6 aa, Giardia lamblia
DTEALP

SEQ ID NO: 3051963 - protein, 18 aa, Giardia lamblia
DTECPSHSTPVSDSNASR

SEQ ID NO: 3051964 - protein, 18 aa, Giardia lamblia
DTEDRTCTKDGSRPPAKA

SEQ ID NO: 3051965 - protein, 12 aa, Giardia lamblia
DTEGCSEQEADT

SEQ ID NO: 3051966 - protein, 19 aa, Giardia lamblia
DTEHGTNIYPNSTDHPTRA

SEQ ID NO: 3051967 - protein, 6 aa, Giardia lamblia
DTEHST

SEQ ID NO: 3051968 - protein, 7 aa, Giardia lamblia
DTEIGER

SEQ ID NO: 3051969 - protein, 12 aa, Giardia lamblia
DTEKIRDPRQSM

SEQ ID NO: 3051970 - protein, 4 aa, Giardia lamblia
DTEL

SEQ ID NO: 3051971 - protein, 7 aa, Giardia lamblia
DTEQNTY

SEQ ID NO: 3051972 - protein, 14 aa, Giardia lamblia
DTERNRYKQSDDDL

SEQ ID NO: 3051973 - protein, 10 aa, Giardia lamblia
DTERTPKTKN

SEQ ID NO: 3051974 - protein, 8 aa, Giardia lamblia
DTESVQPY

SEQ ID NO: 3051975 - protein, 6 aa, Giardia lamblia
DTETAS

SEQ ID NO: 3051976 - protein, 7 aa, Giardia lamblia
DTETYYD

SEQ ID NO: 3051977 - protein, 5 aa, Giardia lamblia
DTEYK

SEQ ID NO: 3051978 - protein, 14 aa, Giardia lamblia
DTFKNRSKSVIEQS

SEQ ID NO: 3051979 - protein, 18 aa, Giardia lamblia
DTGAEDTAQTGVEDSRSI

SEQ ID NO: 3051980 - protein, 14 aa, Giardia lamblia
DTGAPLTGGRDRTS

SEQ ID NO: 3051981 - protein, 21 aa, Giardia lamblia
DTGCTKCNPETSLEKKVSNGV

SEQ ID NO: 3051982 - protein, 6 aa, Giardia lamblia
DTGDHY

SEQ ID NO: 3051983 - protein, 11 aa, Giardia lamblia
DTGGTNGYTGV

SEQ ID NO: 3051984 - protein, 14 aa, Giardia lamblia
DTGLSDIQTGKRKD

SEQ ID NO: 3051985 - protein, 6 aa, Giardia lamblia
DTGMSG

SEQ ID NO: 3051986 - protein, 10 aa, Giardia lamblia
DTGSDVTSAD

SEQ ID NO: 3051987 - protein, 9 aa, Giardia lamblia
DTGVARGAT

SEQ ID NO: 3051988 - protein, 5 aa, Giardia lamblia
DTGYQ

SEQ ID NO: 3051989 - protein, 5 aa, Giardia lamblia
DTHNQ

SEQ ID NO: 3051990 - protein, 9 aa, Giardia lamblia
DTHRPGYKH

SEQ ID NO: 3051991 - protein, 14 aa, Giardia lamblia
DTIDETDNDEQVRE

SEQ ID NO: 3051992 - protein, 9 aa, Giardia lamblia
DTIDSGTSN

SEQ ID NO: 3051993 - protein, 7 aa, Giardia lamblia
DTIKTTP

SEQ ID NO: 3051994 - protein, 7 aa, Giardia lamblia
DTIQKSQ

SEQ ID NO: 3051995 - protein, 4 aa, Giardia lamblia
DTIS

SEQ ID NO: 3051996 - protein, 7 aa, Giardia lamblia
DTISASD

SEQ ID NO: 3051997 - protein, 5 aa, Giardia lamblia
DTISG

SEQ ID NO: 3051998 - protein, 5 aa, Giardia lamblia
DTIST

SEQ ID NO: 3051999 - protein, 8 aa, Giardia lamblia
DTKDRPRC

SEQ ID NO: 3052000 - protein, 8 aa, Giardia lamblia
DTKGGTVT

SEQ ID NO: 3052001 - protein, 13 aa, Giardia lamblia
DTKGNSSQLNGQI

SEQ ID NO: 3052002 - protein, 7 aa, Giardia lamblia
DTKQNAQ

SEQ ID NO: 3052003 - protein, 4 aa, Giardia lamblia
DTKS

SEQ ID NO: 3052004 - protein, 5 aa, Giardia lamblia
DTLDG

SEQ ID NO: 3052005 - protein, 7 aa, Giardia lamblia
DTLDRKR

SEQ ID NO: 3052006 - protein, 7 aa, Giardia lamblia
DTLEQAT

SEQ ID NO: 3052007 - protein, 9 aa, Giardia lamblia
DTLEQEEAT

SEQ ID NO: 3052008 - protein, 8 aa, Giardia lamblia
DTLPGNPV

SEQ ID NO: 3052009 - protein, 6 aa, Giardia lamblia
DTLPHG

SEQ ID NO: 3052010 - protein, 33 aa, Giardia lamblia
DTLPPQSVDDIDSDTDYKESSKTDTTTRSSTVV

SEQ ID NO: 3052011 - protein, 6 aa, Giardia lamblia
DTLQND

SEQ ID NO: 3052012 - protein, 9 aa, Giardia lamblia
DTLSKEDEY

SEQ ID NO: 3052013 - protein, 4 aa, Giardia lamblia
DTLT

SEQ ID NO: 3052014 - protein, 8 aa, Giardia lamblia
DTLTGDPS

SEQ ID NO: 3052015 - protein, 4 aa, Giardia lamblia
DTME

SEQ ID NO: 3052016 - protein, 4 aa, Giardia lamblia
DTMP

SEQ ID NO: 3052017 - protein, 7 aa, Giardia lamblia
DTNDSRI

SEQ ID NO: 3052018 - protein, 10 aa, Giardia lamblia
DTNEFNPKDT

SEQ ID NO: 3052019 - protein, 8 aa, Giardia lamblia
DTNGASDF

SEQ ID NO: 3052020 - protein, 7 aa, Giardia lamblia
DTNPRVQ

SEQ ID NO: 3052021 - protein, 5 aa, Giardia lamblia
DTNVR

SEQ ID NO: 3052022 - protein, 5 aa, Giardia lamblia
DTNVT

SEQ ID NO: 3052023 - protein, 4 aa, Giardia lamblia
DTPA

SEQ ID NO: 3052024 - protein, 5 aa, Giardia lamblia
DTPDN

SEQ ID NO: 3052025 - protein, 7 aa, Giardia lamblia
DTPDSIA

SEQ ID NO: 3052026 - protein, 16 aa, Giardia lamblia
DTPDSKQEHGPMPSPE

SEQ ID NO: 3052027 - protein, 50 aa, Giardia lamblia
DTPEKAGYAPIANPSASKPEQLGVTSTDPTDPTLQQNTVPAAGPTVAEGS

SEQ ID NO: 3052028 - protein, 9 aa, Giardia lamblia
DTPENQSSN

SEQ ID NO: 3052029 - protein, 5 aa, Giardia lamblia
DTPGQ

SEQ ID NO: 3052030 - protein, 5 aa, Giardia lamblia
DTPHT

SEQ ID NO: 3052031 - protein, 9 aa, Giardia lamblia
DTPKPELSD

SEQ ID NO: 3052032 - protein, 8 aa, Giardia lamblia
DTPNEAHR

SEQ ID NO: 3052033 - protein, 15 aa, Giardia lamblia
DTPNGRLPHSGKQQL

SEQ ID NO: 3052034 - protein, 7 aa, Giardia lamblia
DTPPQEM

SEQ ID NO: 3052035 - protein, 4 aa, Giardia lamblia
DTPT

SEQ ID NO: 3052036 - protein, 6 aa, Giardia lamblia
DTQEVD

SEQ ID NO: 3052037 - protein, 6 aa, Giardia lamblia
DTQGGH

SEQ ID NO: 3052038 - protein, 19 aa, Giardia lamblia
DTQHGTETSMTPHAHKKST

SEQ ID NO: 3052039 - protein, 5 aa, Giardia lamblia
DTQIR

SEQ ID NO: 3052040 - protein, 9 aa, Giardia lamblia
DTQRQYEET

SEQ ID NO: 3052041 - protein, 9 aa, Giardia lamblia
DTQTKANKC

SEQ ID NO: 3052042 - protein, 29 aa, Giardia lamblia
DTRAPRPQSKGASSSRDAAGSSTRSQGAS

SEQ ID NO: 3052043 - protein, 4 aa, Giardia lamblia
DTRK

SEQ ID NO: 3052044 - protein, 4 aa, Giardia lamblia
DTRN

SEQ ID NO: 3052045 - protein, 10 aa, Giardia lamblia
DTRNGIRTAS

SEQ ID NO: 3052046 - protein, 15 aa, Giardia lamblia
DTRSIREDNDTVNAP

SEQ ID NO: 3052047 - protein, 7 aa, Giardia lamblia
DTRSIRP

SEQ ID NO: 3052048 - protein, 5 aa, Giardia lamblia
DTRTI

SEQ ID NO: 3052049 - protein, 17 aa, Giardia lamblia
DTRYERKMSSRSYADGI

SEQ ID NO: 3052050 - protein, 8 aa, Giardia lamblia
DTSEESSI

SEQ ID NO: 3052051 - protein, 4 aa, Giardia lamblia
DTSF

SEQ ID NO: 3052052 - protein, 10 aa, Giardia lamblia
DTSGCGTGNY

SEQ ID NO: 3052053 - protein, 4 aa, Giardia lamblia
DTSI

SEQ ID NO: 3052054 - protein, 5 aa, Giardia lamblia
DTSLK

SEQ ID NO: 3052055 - protein, 9 aa, Giardia lamblia
DTSLSAPAS

SEQ ID NO: 3052056 - protein, 19 aa, Giardia lamblia
DTSMEKDGKTRSRSKKSRR

SEQ ID NO: 3052057 - protein, 7 aa, Giardia lamblia
DTSNGKA

SEQ ID NO: 3052058 - protein, 21 aa, Giardia lamblia
DTSNNNSTICPEPASAPTPAP

SEQ ID NO: 3052059 - protein, 33 aa, Giardia lamblia
DTSRAAMASNGTNPSSKSSNHDASDAPDLSREC

SEQ ID NO: 3052060 - protein, 12 aa, Giardia lamblia
DTSRAGTTIKHG

SEQ ID NO: 3052061 - protein, 7 aa, Giardia lamblia
DTSSASA

SEQ ID NO: 3052062 - protein, 8 aa, Giardia lamblia
DTSSGVRG

SEQ ID NO: 3052063 - protein, 18 aa, Giardia lamblia
DTSSKENGPDAEQENQEF

SEQ ID NO: 3052064 - protein, 7 aa, Giardia lamblia
DTSSNED

SEQ ID NO: 3052065 - protein, 8 aa, Giardia lamblia
DTSSQHEG

SEQ ID NO: 3052066 - protein, 5 aa, Giardia lamblia
DTSTG

SEQ ID NO: 3052067 - protein, 5 aa, Giardia lamblia
DTSTR

SEQ ID NO: 3052068 - protein, 5 aa, Giardia lamblia
DTSTT

SEQ ID NO: 3052069 - protein, 9 aa, Giardia lamblia
DTSTTPVDN

SEQ ID NO: 3052070 - protein, 12 aa, Giardia lamblia
DTTARVSRSSNL

SEQ ID NO: 3052071 - protein, 10 aa, Giardia lamblia
DTTATGYSGP

SEQ ID NO: 3052072 - protein, 7 aa, Giardia lamblia
DTTDDQL

SEQ ID NO: 3052073 - protein, 15 aa, Giardia lamblia
DTTEAPIPTNKIKTR

SEQ ID NO: 3052074 - protein, 4 aa, Giardia lamblia
DTTI

SEQ ID NO: 3052075 - protein, 6 aa, Giardia lamblia
DTTIEA

SEQ ID NO: 3052076 - protein, 11 aa, Giardia lamblia
DTTITDGYQGV

SEQ ID NO: 3052077 - protein, 10 aa, Giardia lamblia
DTTQEDMEKR

SEQ ID NO: 3052078 - protein, 4 aa, Giardia lamblia
DTTR

SEQ ID NO: 3052079 - protein, 4 aa, Giardia lamblia
DTTS

SEQ ID NO: 3052080 - protein, 4 aa, Giardia lamblia
DTTT

SEQ ID NO: 3052081 - protein, 9 aa, Giardia lamblia
DTTTSKTDQ

SEQ ID NO: 3052082 - protein, 4 aa, Giardia lamblia
DTTV

SEQ ID NO: 3052083 - protein, 12 aa, Giardia lamblia
DTTVSEEPHAEE

SEQ ID NO: 3052084 - protein, 16 aa, Giardia lamblia
DTVGNSAGNCSDVEPA

SEQ ID NO: 3052085 - protein, 10 aa, Giardia lamblia
DTVGSNGYTG

SEQ ID NO: 3052086 - protein, 12 aa, Giardia lamblia
DTVRPDSQATIS

SEQ ID NO: 3052087 - protein, 5 aa, Giardia lamblia
DTVTG

SEQ ID NO: 3052088 - protein, 4 aa, Giardia lamblia
DTYE

SEQ ID NO: 3052089 - protein, 9 aa, Giardia lamblia
DTYEAVQEQ

SEQ ID NO: 3052090 - protein, 7 aa, Giardia lamblia
DTYGNHS

SEQ ID NO: 3052091 - protein, 9 aa, Giardia lamblia
DTYPPLPDE

SEQ ID NO: 3052092 - protein, 4 aa, Giardia lamblia
DTYR

SEQ ID NO: 3052093 - protein, 12 aa, Giardia lamblia
DTYSSTEKRTAL

SEQ ID NO: 3052094 - protein, 9 aa, Giardia lamblia
DVADGSPQD

SEQ ID NO: 3052095 - protein, 5 aa, Giardia lamblia
DVDQG

SEQ ID NO: 3052096 - protein, 21 aa, Giardia lamblia
DVDSSAKGEACLSSQSSAQIQ

SEQ ID NO: 3052097 - protein, 7 aa, Giardia lamblia
DVEAEEN

SEQ ID NO: 3052098 - protein, 7 aa, Giardia lamblia
DVEDPAQ

SEQ ID NO: 3052099 - protein, 30 aa, Giardia lamblia
DVEPGVSQSHCRSQAELAEKETPDGAAKTE

SEQ ID NO: 3052100 - protein, 9 aa, Giardia lamblia
DVEPKDSDH

SEQ ID NO: 3052101 - protein, 5 aa, Giardia lamblia
DVESL

SEQ ID NO: 3052102 - protein, 7 aa, Giardia lamblia
DVESSLR

SEQ ID NO: 3052103 - protein, 4 aa, Giardia lamblia
DVGA

SEQ ID NO: 3052104 - protein, 8 aa, Giardia lamblia
DVGNPDVS

SEQ ID NO: 3052105 - protein, 10 aa, Giardia lamblia
DVGPGDTSLS

SEQ ID NO: 3052106 - protein, 4 aa, Giardia lamblia
DVGT

SEQ ID NO: 3052107 - protein, 14 aa, Giardia lamblia
DVHHSKKSTEKTSP

SEQ ID NO: 3052108 - protein, 7 aa, Giardia lamblia
DVKDSCN

SEQ ID NO: 3052109 - protein, 5 aa, Giardia lamblia
DVKPT

SEQ ID NO: 3052110 - protein, 13 aa, Giardia lamblia
DVNESSEVPDGSD

SEQ ID NO: 3052111 - protein, 7 aa, Giardia lamblia
DVNNREA

SEQ ID NO: 3052112 - protein, 6 aa, Giardia lamblia
DVPDDA

SEQ ID NO: 3052113 - protein, 9 aa, Giardia lamblia
DVPDDDPKG

SEQ ID NO: 3052114 - protein, 13 aa, Giardia lamblia
DVPEEIRNDAKRA

SEQ ID NO: 3052115 - protein, 5 aa, Giardia lamblia
DVPGA

SEQ ID NO: 3052116 - protein, 30 aa, Giardia lamblia
DVPPNTAGSPGQPRSAADVETVTSGPATAV

SEQ ID NO: 3052117 - protein, 9 aa, Giardia lamblia
DVPSPPPLS

SEQ ID NO: 3052118 - protein, 4 aa, Giardia lamblia
DVQE

SEQ ID NO: 3052119 - protein, 6 aa, Giardia lamblia
DVQGQT

SEQ ID NO: 3052120 - protein, 16 aa, Giardia lamblia
DVRDDQENTIRRIEKD

SEQ ID NO: 3052121 - protein, 5 aa, Giardia lamblia
DVREC

SEQ ID NO: 3052122 - protein, 6 aa, Giardia lamblia
DVREGR

SEQ ID NO: 3052123 - protein, 7 aa, Giardia lamblia
DVRNPRK

SEQ ID NO: 3052124 - protein, 11 aa, Giardia lamblia
DVRSEKDVADS

SEQ ID NO: 3052125 - protein, 7 aa, Giardia lamblia
DVSGEWK

SEQ ID NO: 3052126 - protein, 8 aa, Giardia lamblia
DVSINNDN

SEQ ID NO: 3052127 - protein, 5 aa, Giardia lamblia
DVSNK

SEQ ID NO: 3052128 - protein, 4 aa, Giardia lamblia
DVSP

SEQ ID NO: 3052129 - protein, 18 aa, Giardia lamblia
DVSSLSTCRTNRNHSTSN

SEQ ID NO: 3052130 - protein, 12 aa, Giardia lamblia
DVSTSVKTSPPN

SEQ ID NO: 3052131 - protein, 11 aa, Giardia lamblia
DVSVDSDMSDP

SEQ ID NO: 3052132 - protein, 6 aa, Giardia lamblia
DVSVPS

SEQ ID NO: 3052133 - protein, 6 aa, Giardia lamblia
DVTNSG

SEQ ID NO: 3052134 - protein, 5 aa, Giardia lamblia
DVTPD

SEQ ID NO: 3052135 - protein, 7 aa, Giardia lamblia
DWSSPTL

SEQ ID NO: 3052136 - protein, 9 aa, Giardia lamblia
DYASRSSSV

SEQ ID NO: 3052137 - protein, 5 aa, Giardia lamblia
DYDND

SEQ ID NO: 3052138 - protein, 4 aa, Giardia lamblia
DYDP

SEQ ID NO: 3052139 - protein, 15 aa, Giardia lamblia
DYDRAINKSNSRERF

SEQ ID NO: 3052140 - protein, 92 aa, Giardia lamblia
DYDYERSRSRDRNHTRSHEREADHRRRRVDESEHSNTSSRSRSDSGAEHSYSSHTGSEIYDSRARRRRRDSLQNERGRGDRAERSRTGGKSI

SEQ ID NO: 3052141 - protein, 4 aa, Giardia lamblia
DYEP

SEQ ID NO: 3052142 - protein, 4 aa, Giardia lamblia
DYGR

SEQ ID NO: 3052143 - protein, 21 aa, Giardia lamblia
DYKEKKAEADRIEASAKESAI

SEQ ID NO: 3052144 - protein, 10 aa, Giardia lamblia
DYKGDYEASV

SEQ ID NO: 3052145 - protein, 5 aa, Giardia lamblia
DYPSS

SEQ ID NO: 3052146 - protein, 7 aa, Giardia lamblia
DYQDYTT

SEQ ID NO: 3052147 - protein, 4 aa, Giardia lamblia
DYQS

SEQ ID NO: 3052148 - protein, 9 aa, Giardia lamblia
DYRGDPESM

SEQ ID NO: 3052149 - protein, 5 aa, Giardia lamblia
DYRTT

SEQ ID NO: 3052150 - protein, 12 aa, Giardia lamblia
DYSDPENPIEEQ

SEQ ID NO: 3052151 - protein, 7 aa, Giardia lamblia
DYSGKSS

SEQ ID NO: 3052152 - protein, 6 aa, Giardia lamblia
DYSREQ

SEQ ID NO: 3052153 - protein, 5 aa, Giardia lamblia
DYSSE

SEQ ID NO: 3052154 - protein, 23 aa, Giardia lamblia
DYSTGKCMTGKRSAGESSANSES

SEQ ID NO: 3052155 - protein, 15 aa, Giardia lamblia
DYTEKQSLSRSGDTI

SEQ ID NO: 3052156 - protein, 7 aa, Giardia lamblia
DYTKQVE

SEQ ID NO: 3052157 - protein, 4 aa, Giardia lamblia
DYTY

SEQ ID NO: 3052158 - protein, 11 aa, Giardia lamblia
DYYSSSYAASE

SEQ ID NO: 3052159 - protein, 13 aa, Giardia lamblia
EAAEETDKDSSPI

SEQ ID NO: 3052160 - protein, 14 aa, Giardia lamblia
EAAEPPQDTQTTVT

SEQ ID NO: 3052161 - protein, 6 aa, Giardia lamblia
EAAGNT

SEQ ID NO: 3052162 - protein, 7 aa, Giardia lamblia
EAANHPG

SEQ ID NO: 3052163 - protein, 5 aa, Giardia lamblia
EAAQE

SEQ ID NO: 3052164 - protein, 7 aa, Giardia lamblia
EAAQRKL

SEQ ID NO: 3052165 - protein, 7 aa, Giardia lamblia
EADCSTN

SEQ ID NO: 3052166 - protein, 6 aa, Giardia lamblia
EADEVP

SEQ ID NO: 3052167 - protein, 6 aa, Giardia lamblia
EADNAR

SEQ ID NO: 3052168 - protein, 8 aa, Giardia lamblia
EADPSKSY

SEQ ID NO: 3052169 - protein, 15 aa, Giardia lamblia
EADQAGSADDVQTRI

SEQ ID NO: 3052170 - protein, 11 aa, Giardia lamblia
EADRNKAIEQE

SEQ ID NO: 3052171 - protein, 21 aa, Giardia lamblia
EADSEAINTEPQQGQSFSEQE

SEQ ID NO: 3052172 - protein, 6 aa, Giardia lamblia
EADSRR

SEQ ID NO: 3052173 - protein, 8 aa, Giardia lamblia
EADSTDVR

SEQ ID NO: 3052174 - protein, 19 aa, Giardia lamblia
EAEGGLPINDTEDKGYRRN

SEQ ID NO: 3052175 - protein, 12 aa, Giardia lamblia
EAEGKSDQLPKN

SEQ ID NO: 3052176 - protein, 5 aa, Giardia lamblia
EAEGS

SEQ ID NO: 3052177 - protein, 8 aa, Giardia lamblia
EAENPYSE

SEQ ID NO: 3052178 - protein, 10 aa, Giardia lamblia
EAENTLRQDP

SEQ ID NO: 3052179 - protein, 14 aa, Giardia lamblia
EAEQENLPPGSAQA

SEQ ID NO: 3052180 - protein, 8 aa, Giardia lamblia
EAEQPVPQ

SEQ ID NO: 3052181 - protein, 6 aa, Giardia lamblia
EAERQI

SEQ ID NO: 3052182 - protein, 5 aa, Giardia lamblia
EAERS

SEQ ID NO: 3052183 - protein, 17 aa, Giardia lamblia
EAETADKSASLISPDPL

SEQ ID NO: 3052184 - protein, 7 aa, Giardia lamblia
EAETREK

SEQ ID NO: 3052185 - protein, 11 aa, Giardia lamblia
EAGAQDNEGTS

SEQ ID NO: 3052186 - protein, 12 aa, Giardia lamblia
EAGECDSLPSLT

SEQ ID NO: 3052187 - protein, 8 aa, Giardia lamblia
EAGHLSPE

SEQ ID NO: 3052188 - protein, 6 aa, Giardia lamblia
EAGHTD

SEQ ID NO: 3052189 - protein, 4 aa, Giardia lamblia
EAGI

SEQ ID NO: 3052190 - protein, 11 aa, Giardia lamblia
EAGMRTDAGET

SEQ ID NO: 3052191 - protein, 6 aa, Giardia lamblia
EAGNGA

SEQ ID NO: 3052192 - protein, 10 aa, Giardia lamblia
EAGNQNNEGM

SEQ ID NO: 3052193 - protein, 6 aa, Giardia lamblia
EAGQTC

SEQ ID NO: 3052194 - protein, 10 aa, Giardia lamblia
EAGRGRQGRR

SEQ ID NO: 3052195 - protein, 10 aa, Giardia lamblia
EAGSRDLEGR

SEQ ID NO: 3052196 - protein, 7 aa, Giardia lamblia
EAGSSPQ

SEQ ID NO: 3052197 - protein, 17 aa, Giardia lamblia
EAGTGGSVNKSGLSTGA

SEQ ID NO: 3052198 - protein, 9 aa, Giardia lamblia
EAGTTVCKG

SEQ ID NO: 3052199 - protein, 15 aa, Giardia lamblia
EAGTYSNKTAASECD

SEQ ID NO: 3052200 - protein, 15 aa, Giardia lamblia
EAGYPLADGTDNEPL

SEQ ID NO: 3052201 - protein, 4 aa, Giardia lamblia
EAIP

SEQ ID NO: 3052202 - protein, 4 aa, Giardia lamblia
EAIR

SEQ ID NO: 3052203 - protein, 9 aa, Giardia lamblia
EAKAQPSDL

SEQ ID NO: 3052204 - protein, 9 aa, Giardia lamblia
EAKATVKKD

SEQ ID NO: 3052205 - protein, 20 aa, Giardia lamblia
EAKEEISEMSGEDIEPPSLG

SEQ ID NO: 3052206 - protein, 8 aa, Giardia lamblia
EAKLRGSM

SEQ ID NO: 3052207 - protein, 11 aa, Giardia lamblia
EAKPGQSSAEM

SEQ ID NO: 3052208 - protein, 7 aa, Giardia lamblia
EAKQAEL

SEQ ID NO: 3052209 - protein, 9 aa, Giardia lamblia
EAKSSAPTL

SEQ ID NO: 3052210 - protein, 5 aa, Giardia lamblia
EAKTE

SEQ ID NO: 3052211 - protein, 7 aa, Giardia lamblia
EAKVSSA

SEQ ID NO: 3052212 - protein, 8 aa, Giardia lamblia
EALAGAKT

SEQ ID NO: 3052213 - protein, 29 aa, Giardia lamblia
EALDSAKDSFQPGVGSEARDEQAKSPRTD

SEQ ID NO: 3052214 - protein, 11 aa, Giardia lamblia
EALKTGSSTVE

SEQ ID NO: 3052215 - protein, 5 aa, Giardia lamblia
EALPS

SEQ ID NO: 3052216 - protein, 6 aa, Giardia lamblia
EALSNS

SEQ ID NO: 3052217 - protein, 24 aa, Giardia lamblia
EAMENAQRQACTEGFADTGGNSTL

SEQ ID NO: 3052218 - protein, 7 aa, Giardia lamblia
EANECDS

SEQ ID NO: 3052219 - protein, 6 aa, Giardia lamblia
EANEVP

SEQ ID NO: 3052220 - protein, 4 aa, Giardia lamblia
EANF

SEQ ID NO: 3052221 - protein, 5 aa, Giardia lamblia
EANLP

SEQ ID NO: 3052222 - protein, 6 aa, Giardia lamblia
EANSPT

SEQ ID NO: 3052223 - protein, 17 aa, Giardia lamblia
EANSSYQKFNRRSSQSI

SEQ ID NO: 3052224 - protein, 10 aa, Giardia lamblia
EANTRDCAES

SEQ ID NO: 3052225 - protein, 8 aa, Giardia lamblia
EANVRNPN

SEQ ID NO: 3052226 - protein, 5 aa, Giardia lamblia
EAPDA

SEQ ID NO: 3052227 - protein, 9 aa, Giardia lamblia
EAPKTLSDS

SEQ ID NO: 3052228 - protein, 5 aa, Giardia lamblia
EAPPT

SEQ ID NO: 3052229 - protein, 10 aa, Giardia lamblia
EAPRASDTTE

SEQ ID NO: 3052230 - protein, 7 aa, Giardia lamblia
EAPRRAV

SEQ ID NO: 3052231 - protein, 7 aa, Giardia lamblia
EAPSELT

SEQ ID NO: 3052232 - protein, 8 aa, Giardia lamblia
EAPVSPST

SEQ ID NO: 3052233 - protein, 5 aa, Giardia lamblia
EAQAP

SEQ ID NO: 3052234 - protein, 32 aa, Giardia lamblia
EAQDNQQQDTYADEAGASKRSHKAKNRDTSQQ

SEQ ID NO: 3052235 - protein, 10 aa, Giardia lamblia
EAQGKKTRRS

SEQ ID NO: 3052236 - protein, 10 aa, Giardia lamblia
EAQHETTKDA

SEQ ID NO: 3052237 - protein, 7 aa, Giardia lamblia
EAQNTFT

SEQ ID NO: 3052238 - protein, 4 aa, Giardia lamblia
EAQP

SEQ ID NO: 3052239 - protein, 9 aa, Giardia lamblia
EAQQSNLDQ

SEQ ID NO: 3052240 - protein, 7 aa, Giardia lamblia
EAQTNEL

SEQ ID NO: 3052241 - protein, 10 aa, Giardia lamblia
EAQTSTKDFE

SEQ ID NO: 3052242 - protein, 7 aa, Giardia lamblia
EAQYKEN

SEQ ID NO: 3052243 - protein, 11 aa, Giardia lamblia
EARKGSASLTD

SEQ ID NO: 3052244 - protein, 5 aa, Giardia lamblia
EARLS

SEQ ID NO: 3052245 - protein, 9 aa, Giardia lamblia
EARLTTPEQ

SEQ ID NO: 3052246 - protein, 9 aa, Giardia lamblia
EARSEDLPK

SEQ ID NO: 3052247 - protein, 10 aa, Giardia lamblia
EARWDTASKR

SEQ ID NO: 3052248 - protein, 5 aa, Giardia lamblia
EASEP

SEQ ID NO: 3052249 - protein, 9 aa, Giardia lamblia
EASESTRRT

SEQ ID NO: 3052250 - protein, 6 aa, Giardia lamblia
EASEYT

SEQ ID NO: 3052251 - protein, 14 aa, Giardia lamblia
EASINQKKLEPRIA

SEQ ID NO: 3052252 - protein, 6 aa, Giardia lamblia
EASKAK

SEQ ID NO: 3052253 - protein, 8 aa, Giardia lamblia
EASKAPGN

SEQ ID NO: 3052254 - protein, 7 aa, Giardia lamblia
EASPASD

SEQ ID NO: 3052255 - protein, 8 aa, Giardia lamblia
EASPASDV

SEQ ID NO: 3052256 - protein, 5 aa, Giardia lamblia
EASPC

SEQ ID NO: 3052257 - protein, 5 aa, Giardia lamblia
EASPF

SEQ ID NO: 3052258 - protein, 7 aa, Giardia lamblia
EASPGDW

SEQ ID NO: 3052259 - protein, 5 aa, Giardia lamblia
EASPY

SEQ ID NO: 3052260 - protein, 4 aa, Giardia lamblia
EASR

SEQ ID NO: 3052261 - protein, 12 aa, Giardia lamblia
EASRTSNCTNVP

SEQ ID NO: 3052262 - protein, 21 aa, Giardia lamblia
EASSFNADAEKGLYPSKLQDG

SEQ ID NO: 3052263 - protein, 10 aa, Giardia lamblia
EASTRDCAES

SEQ ID NO: 3052264 - protein, 6 aa, Giardia lamblia
EASYND

SEQ ID NO: 3052265 - protein, 10 aa, Giardia lamblia
EATDAMADAS

SEQ ID NO: 3052266 - protein, 5 aa, Giardia lamblia
EATDE

SEQ ID NO: 3052267 - protein, 7 aa, Giardia lamblia
EATHENQ

SEQ ID NO: 3052268 - protein, 11 aa, Giardia lamblia
EATLTDSKGRT

SEQ ID NO: 3052269 - protein, 8 aa, Giardia lamblia
EATPEERG

SEQ ID NO: 3052270 - protein, 11 aa, Giardia lamblia
EATQGRSDEKR

SEQ ID NO: 3052271 - protein, 12 aa, Giardia lamblia
EATRKAESINTE

SEQ ID NO: 3052272 - protein, 8 aa, Giardia lamblia
EATSGIPS

SEQ ID NO: 3052273 - protein, 7 aa, Giardia lamblia
EATTGTG

SEQ ID NO: 3052274 - protein, 20 aa, Giardia lamblia
EATTRATGSQSSYKERKKYK

SEQ ID NO: 3052275 - protein, 9 aa, Giardia lamblia
ECDPEDGTK

SEQ ID NO: 3052276 - protein, 9 aa, Giardia lamblia
ECDRGTEPF

SEQ ID NO: 3052277 - protein, 21 aa, Giardia lamblia
ECDSTGKKCTKCDANGNTPYL

SEQ ID NO: 3052278 - protein, 5 aa, Giardia lamblia
ECGGH

SEQ ID NO: 3052279 - protein, 8 aa, Giardia lamblia
ECKGEGDK

SEQ ID NO: 3052280 - protein, 11 aa, Giardia lamblia
ECKPCTDTSVN

SEQ ID NO: 3052281 - protein, 5 aa, Giardia lamblia
ECNDS

SEQ ID NO: 3052282 - protein, 8 aa, Giardia lamblia
ECNGGHAP

SEQ ID NO: 3052283 - protein, 8 aa, Giardia lamblia
ECNQQNAQ

SEQ ID NO: 3052284 - protein, 5 aa, Giardia lamblia
ECPES

SEQ ID NO: 3052285 - protein, 5 aa, Giardia lamblia
ECPPE

SEQ ID NO: 3052286 - protein, 9 aa, Giardia lamblia
ECPPSHTVD

SEQ ID NO: 3052287 - protein, 7 aa, Giardia lamblia
ECPPSPF

SEQ ID NO: 3052288 - protein, 7 aa, Giardia lamblia
ECQRRDT

SEQ ID NO: 3052289 - protein, 7 aa, Giardia lamblia
ECQTTPR

SEQ ID NO: 3052290 - protein, 7 aa, Giardia lamblia
ECSGNEI

SEQ ID NO: 3052291 - protein, 14 aa, Giardia lamblia
ECSHTGTSGPATCT

SEQ ID NO: 3052292 - protein, 8 aa, Giardia lamblia
ECSPGDSR

SEQ ID NO: 3052293 - protein, 6 aa, Giardia lamblia
ECSSDT

SEQ ID NO: 3052294 - protein, 10 aa, Giardia lamblia
ECTDKDSPGT

SEQ ID NO: 3052295 - protein, 10 aa, Giardia lamblia
ECTEDGSGCK

SEQ ID NO: 3052296 - protein, 4 aa, Giardia lamblia
ECTG

SEQ ID NO: 3052297 - protein, 9 aa, Giardia lamblia
ECTSHDEEY

SEQ ID NO: 3052298 - protein, 13 aa, Giardia lamblia
ECYTQDSSSISET

SEQ ID NO: 3052299 - protein, 6 aa, Giardia lamblia
EDAEEL

SEQ ID NO: 3052300 - protein, 14 aa, Giardia lamblia
EDAEELAGIARARS

SEQ ID NO: 3052301 - protein, 5 aa, Giardia lamblia
EDAES

SEQ ID NO: 3052302 - protein, 11 aa, Giardia lamblia
EDAGVKPRQNY

SEQ ID NO: 3052303 - protein, 8 aa, Giardia lamblia
EDANRSYR

SEQ ID NO: 3052304 - protein, 7 aa, Giardia lamblia
EDAPGTI

SEQ ID NO: 3052305 - protein, 18 aa, Giardia lamblia
EDATGGECGKQARPSLAT

SEQ ID NO: 3052306 - protein, 5 aa, Giardia lamblia
EDAVP

SEQ ID NO: 3052307 - protein, 6 aa, Giardia lamblia
EDDFTT

SEQ ID NO: 3052308 - protein, 18 aa, Giardia lamblia
EDDSTSLEDYSSASANRS

SEQ ID NO: 3052309 - protein, 6 aa, Giardia lamblia
EDDTHR

SEQ ID NO: 3052310 - protein, 7 aa, Giardia lamblia
EDDTPFT

SEQ ID NO: 3052311 - protein, 16 aa, Giardia lamblia
EDEGAEYVDSADSDMP

SEQ ID NO: 3052312 - protein, 4 aa, Giardia lamblia
EDEI

SEQ ID NO: 3052313 - protein, 40 aa, Giardia lamblia
EDELPGSGQRDSEADDPAAFAKNETSESYEYEYYEEEEEQ

SEQ ID NO: 3052314 - protein, 5 aa, Giardia lamblia
EDENG

SEQ ID NO: 3052315 - protein, 7 aa, Giardia lamblia
EDENPHL

SEQ ID NO: 3052316 - protein, 16 aa, Giardia lamblia
EDEREEAASDNVSTSG

SEQ ID NO: 3052317 - protein, 9 aa, Giardia lamblia
EDESNAAQR

SEQ ID NO: 3052318 - protein, 8 aa, Giardia lamblia
EDFKGPDS

SEQ ID NO: 3052319 - protein, 4 aa, Giardia lamblia
EDGD

SEQ ID NO: 3052320 - protein, 17 aa, Giardia lamblia
EDGDLRPPIPDLSDESS

SEQ ID NO: 3052321 - protein, 11 aa, Giardia lamblia
EDGDRDGDQVG

SEQ ID NO: 3052322 - protein, 5 aa, Giardia lamblia
EDGRV

SEQ ID NO: 3052323 - protein, 9 aa, Giardia lamblia
EDGVDNDSF

SEQ ID NO: 3052324 - protein, 11 aa, Giardia lamblia
EDGVEEPRDAP

SEQ ID NO: 3052325 - protein, 6 aa, Giardia lamblia
EDGYAP

SEQ ID NO: 3052326 - protein, 5 aa, Giardia lamblia
EDHRA

SEQ ID NO: 3052327 - protein, 4 aa, Giardia lamblia
EDIE

SEQ ID NO: 3052328 - protein, 15 aa, Giardia lamblia
EDINSRQDKLDQAEE

SEQ ID NO: 3052329 - protein, 12 aa, Giardia lamblia
EDIPSDPTYKTK

SEQ ID NO: 3052330 - protein, 12 aa, Giardia lamblia
EDIRKANESITA

SEQ ID NO: 3052331 - protein, 15 aa, Giardia lamblia
EDKAPRSSRVQGNHP

SEQ ID NO: 3052332 - protein, 8 aa, Giardia lamblia
EDKDSDPA

SEQ ID NO: 3052333 - protein, 8 aa, Giardia lamblia
EDKEGDMS

SEQ ID NO: 3052334 - protein, 4 aa, Giardia lamblia
EDKG

SEQ ID NO: 3052335 - protein, 8 aa, Giardia lamblia
EDKGTGHN

SEQ ID NO: 3052336 - protein, 6 aa, Giardia lamblia
EDKIRT

SEQ ID NO: 3052337 - protein, 7 aa, Giardia lamblia
EDKKQDL

SEQ ID NO: 3052338 - protein, 10 aa, Giardia lamblia
EDKMERDMQK

SEQ ID NO: 3052339 - protein, 8 aa, Giardia lamblia
EDKRPSTT

SEQ ID NO: 3052340 - protein, 9 aa, Giardia lamblia
EDLEDSEAS

SEQ ID NO: 3052341 - protein, 5 aa, Giardia lamblia
EDLEP

SEQ ID NO: 3052342 - protein, 8 aa, Giardia lamblia
EDLNSEQA

SEQ ID NO: 3052343 - protein, 11 aa, Giardia lamblia
EDLNTKEKTEC

SEQ ID NO: 3052344 - protein, 11 aa, Giardia lamblia
EDLTDRQGKTA

SEQ ID NO: 3052345 - protein, 10 aa, Giardia lamblia
EDLTDRQGNT

SEQ ID NO: 3052346 - protein, 9 aa, Giardia lamblia
EDNEPTKPS

SEQ ID NO: 3052347 - protein, 5 aa, Giardia lamblia
EDNFS

SEQ ID NO: 3052348 - protein, 6 aa, Giardia lamblia
EDNGGK

SEQ ID NO: 3052349 - protein, 7 aa, Giardia lamblia
EDNLPQS

SEQ ID NO: 3052350 - protein, 9 aa, Giardia lamblia
EDNQEPGSV

SEQ ID NO: 3052351 - protein, 5 aa, Giardia lamblia
EDNSN

SEQ ID NO: 3052352 - protein, 8 aa, Giardia lamblia
EDNTPPIF

SEQ ID NO: 3052353 - protein, 7 aa, Giardia lamblia
EDPNCNE

SEQ ID NO: 3052354 - protein, 10 aa, Giardia lamblia
EDPPASPSSN

SEQ ID NO: 3052355 - protein, 9 aa, Giardia lamblia
EDPPSSESM

SEQ ID NO: 3052356 - protein, 4 aa, Giardia lamblia
EDPQ

SEQ ID NO: 3052357 - protein, 5 aa, Giardia lamblia
EDPRH

SEQ ID NO: 3052358 - protein, 4 aa, Giardia lamblia
EDPS

SEQ ID NO: 3052359 - protein, 6 aa, Giardia lamblia
EDPSDN

SEQ ID NO: 3052360 - protein, 4 aa, Giardia lamblia
EDPY

SEQ ID NO: 3052361 - protein, 11 aa, Giardia lamblia
EDQLPSKTEAK

SEQ ID NO: 3052362 - protein, 12 aa, Giardia lamblia
EDQLSGRSPSHT

SEQ ID NO: 3052363 - protein, 7 aa, Giardia lamblia
EDQSDCV

SEQ ID NO: 3052364 - protein, 5 aa, Giardia lamblia
EDRDK

SEQ ID NO: 3052365 - protein, 7 aa, Giardia lamblia
EDRHPQL

SEQ ID NO: 3052366 - protein, 23 aa, Giardia lamblia
EDRKHKKKKHNAKAHIKSDKEQG

SEQ ID NO: 3052367 - protein, 4 aa, Giardia lamblia
EDRL

SEQ ID NO: 3052368 - protein, 4 aa, Giardia lamblia
EDRN

SEQ ID NO: 3052369 - protein, 5 aa, Giardia lamblia
EDRNL

SEQ ID NO: 3052370 - protein, 9 aa, Giardia lamblia
EDRNSSLQR

SEQ ID NO: 3052371 - protein, 6 aa, Giardia lamblia
EDRSIT

SEQ ID NO: 3052372 - protein, 6 aa, Giardia lamblia
EDRTTC

SEQ ID NO: 3052373 - protein, 4 aa, Giardia lamblia
EDRV

SEQ ID NO: 3052374 - protein, 16 aa, Giardia lamblia
EDSAPAESVKSMTPYA

SEQ ID NO: 3052375 - protein, 16 aa, Giardia lamblia
EDSDDKNNDLNHGEQQ

SEQ ID NO: 3052376 - protein, 9 aa, Giardia lamblia
EDSEQREKR

SEQ ID NO: 3052377 - protein, 5 aa, Giardia lamblia
EDSGD

SEQ ID NO: 3052378 - protein, 11 aa, Giardia lamblia
EDSGLSPSGRE

SEQ ID NO: 3052379 - protein, 9 aa, Giardia lamblia
EDSGRFSPE

SEQ ID NO: 3052380 - protein, 5 aa, Giardia lamblia
EDSIS

SEQ ID NO: 3052381 - protein, 4 aa, Giardia lamblia
EDSL

SEQ ID NO: 3052382 - protein, 8 aa, Giardia lamblia
EDSMPAQP

SEQ ID NO: 3052383 - protein, 20 aa, Giardia lamblia
EDSQQTLGLPANPASPRHRV

SEQ ID NO: 3052384 - protein, 15 aa, Giardia lamblia
EDSREVEGSLGGQRS

SEQ ID NO: 3052385 - protein, 8 aa, Giardia lamblia
EDSRSGTI

SEQ ID NO: 3052386 - protein, 5 aa, Giardia lamblia
EDSSE

SEQ ID NO: 3052387 - protein, 8 aa, Giardia lamblia
EDSSGNID

SEQ ID NO: 3052388 - protein, 8 aa, Giardia lamblia
EDSSPSGC

SEQ ID NO: 3052389 - protein, 24 aa, Giardia lamblia
EDSTSNNPISHSEMDRPRSLHRPG

SEQ ID NO: 3052390 - protein, 8 aa, Giardia lamblia
EDTAGSEA

SEQ ID NO: 3052391 - protein, 4 aa, Giardia lamblia
EDTD

SEQ ID NO: 3052392 - protein, 7 aa, Giardia lamblia
EDTDQIS

SEQ ID NO: 3052393 - protein, 6 aa, Giardia lamblia
EDTDSW

SEQ ID NO: 3052394 - protein, 13 aa, Giardia lamblia
EDTEDTGSLSPQK

SEQ ID NO: 3052395 - protein, 6 aa, Giardia lamblia
EDTEYN

SEQ ID NO: 3052396 - protein, 43 aa, Giardia lamblia
EDTPAPSEQSETGTEKISENSTGSYRESSSSVLDDASPTHNQQ

SEQ ID NO: 3052397 - protein, 6 aa, Giardia lamblia
EDTRTS

SEQ ID NO: 3052398 - protein, 10 aa, Giardia lamblia
EDTTDRRPAI

SEQ ID NO: 3052399 - protein, 4 aa, Giardia lamblia
EDTV

SEQ ID NO: 3052400 - protein, 5 aa, Giardia lamblia
EDTYT

SEQ ID NO: 3052401 - protein, 8 aa, Giardia lamblia
EDVQTGET

SEQ ID NO: 3052402 - protein, 10 aa, Giardia lamblia
EEAERNEESE

SEQ ID NO: 3052403 - protein, 6 aa, Giardia lamblia
EEAESS

SEQ ID NO: 3052404 - protein, 9 aa, Giardia lamblia
EEAKKNERY

SEQ ID NO: 3052405 - protein, 9 aa, Giardia lamblia
EEARANEAR

SEQ ID NO: 3052406 - protein, 5 aa, Giardia lamblia
EEARN

SEQ ID NO: 3052407 - protein, 7 aa, Giardia lamblia
EEASGLE

SEQ ID NO: 3052408 - protein, 9 aa, Giardia lamblia
EEASNDSFE

SEQ ID NO: 3052409 - protein, 9 aa, Giardia lamblia
EEATKPLKP

SEQ ID NO: 3052410 - protein, 14 aa, Giardia lamblia
EECGKNPAPFGATD

SEQ ID NO: 3052411 - protein, 10 aa, Giardia lamblia
EECSNDSGPF

SEQ ID NO: 3052412 - protein, 11 aa, Giardia lamblia
EECSSQSGPFT

SEQ ID NO: 3052413 - protein, 20 aa, Giardia lamblia
EECTSDKTHFTREKAGDSKG

SEQ ID NO: 3052414 - protein, 6 aa, Giardia lamblia
EEDDLR

SEQ ID NO: 3052415 - protein, 4 aa, Giardia lamblia
EEDE

SEQ ID NO: 3052416 - protein, 4 aa, Giardia lamblia
EEDG

SEQ ID NO: 3052417 - protein, 7 aa, Giardia lamblia
EEDGTVN

SEQ ID NO: 3052418 - protein, 19 aa, Giardia lamblia
EEDLDEEKYKESTKALHEA

SEQ ID NO: 3052419 - protein, 16 aa, Giardia lamblia
EEDRPNSDITSKIQEN

SEQ ID NO: 3052420 - protein, 7 aa, Giardia lamblia
EEDSQGR

SEQ ID NO: 3052421 - protein, 11 aa, Giardia lamblia
EEDSVESNENL

SEQ ID NO: 3052422 - protein, 8 aa, Giardia lamblia
EEDTSFNP

SEQ ID NO: 3052423 - protein, 5 aa, Giardia lamblia
EEDYQ

SEQ ID NO: 3052424 - protein, 22 aa, Giardia lamblia
EEEAAKKSGTSNGSDISDDDSD

SEQ ID NO: 3052425 - protein, 5 aa, Giardia lamblia
EEEAP

SEQ ID NO: 3052426 - protein, 13 aa, Giardia lamblia
EEEDSNGSDEEEV

SEQ ID NO: 3052427 - protein, 5 aa, Giardia lamblia
EEEKH

SEQ ID NO: 3052428 - protein, 8 aa, Giardia lamblia
EEEPTEST

SEQ ID NO: 3052429 - protein, 7 aa, Giardia lamblia
EEESQPL

SEQ ID NO: 3052430 - protein, 7 aa, Giardia lamblia
EEESVRA

SEQ ID NO: 3052431 - protein, 10 aa, Giardia lamblia
EEETDGTYLD

SEQ ID NO: 3052432 - protein, 5 aa, Giardia lamblia
EEETQ

SEQ ID NO: 3052433 - protein, 35 aa, Giardia lamblia
EEEVARRERERERENLSSTPSHPDSSTLDTVQRLN

SEQ ID NO: 3052434 - protein, 5 aa, Giardia lamblia
EEFNK

SEQ ID NO: 3052435 - protein, 11 aa, Giardia lamblia
EEGCKQDDTCE

SEQ ID NO: 3052436 - protein, 4 aa, Giardia lamblia
EEGE

SEQ ID NO: 3052437 - protein, 17 aa, Giardia lamblia
EEGRDTDSAKTVEPDEK

SEQ ID NO: 3052438 - protein, 6 aa, Giardia lamblia
EEGSGW

SEQ ID NO: 3052439 - protein, 7 aa, Giardia lamblia
EEGSNPV

SEQ ID NO: 3052440 - protein, 6 aa, Giardia lamblia
EEGYAP

SEQ ID NO: 3052441 - protein, 5 aa, Giardia lamblia
EEGYK

SEQ ID NO: 3052442 - protein, 5 aa, Giardia lamblia
EEGYR

SEQ ID NO: 3052443 - protein, 31 aa, Giardia lamblia
EEHEANPESQTSTTDPGPQSGGEELSKVQDN

SEQ ID NO: 3052444 - protein, 6 aa, Giardia lamblia
EEHRTE

SEQ ID NO: 3052445 - protein, 23 aa, Giardia lamblia
EEHSRTCPNDHGATHHPNSHEDE

SEQ ID NO: 3052446 - protein, 5 aa, Giardia lamblia
EEIKN

SEQ ID NO: 3052447 - protein, 6 aa, Giardia lamblia
EEIRGS

SEQ ID NO: 3052448 - protein, 9 aa, Giardia lamblia
EEISKSTDQ

SEQ ID NO: 3052449 - protein, 8 aa, Giardia lamblia
EEITSDKQ

SEQ ID NO: 3052450 - protein, 9 aa, Giardia lamblia
EEKASRASY

SEQ ID NO: 3052451 - protein, 4 aa, Giardia lamblia
EEKI

SEQ ID NO: 3052452 - protein, 13 aa, Giardia lamblia
EEKKRASQLTPDN

SEQ ID NO: 3052453 - protein, 9 aa, Giardia lamblia
EEKSEVAND

SEQ ID NO: 3052454 - protein, 8 aa, Giardia lamblia
EEKSKYSL

SEQ ID NO: 3052455 - protein, 11 aa, Giardia lamblia
EEKSRKDVPAY

SEQ ID NO: 3052456 - protein, 9 aa, Giardia lamblia
EEKSTANRP

SEQ ID NO: 3052457 - protein, 4 aa, Giardia lamblia
EELA

SEQ ID NO: 3052458 - protein, 4 aa, Giardia lamblia
EELD

SEQ ID NO: 3052459 - protein, 26 aa, Giardia lamblia
EELEDDPARVDGEDDRRGKRRREAVQ

SEQ ID NO: 3052460 - protein, 21 aa, Giardia lamblia
EELGEGAQEMPPPEEGPVDST

SEQ ID NO: 3052461 - protein, 6 aa, Giardia lamblia
EELQHE

SEQ ID NO: 3052462 - protein, 7 aa, Giardia lamblia
EELRQRN

SEQ ID NO: 3052463 - protein, 8 aa, Giardia lamblia
EELSASEK

SEQ ID NO: 3052464 - protein, 6 aa, Giardia lamblia
EELTPG

SEQ ID NO: 3052465 - protein, 4 aa, Giardia lamblia
EELY

SEQ ID NO: 3052466 - protein, 4 aa, Giardia lamblia
EENA

SEQ ID NO: 3052467 - protein, 19 aa, Giardia lamblia
EEPATSTSLPTNSSPDARR

SEQ ID NO: 3052468 - protein, 9 aa, Giardia lamblia
EEPCSADDP

SEQ ID NO: 3052469 - protein, 11 aa, Giardia lamblia
EEPITDDSTPV

SEQ ID NO: 3052470 - protein, 9 aa, Giardia lamblia
EEPSPKSAL

SEQ ID NO: 3052471 - protein, 5 aa, Giardia lamblia
EEPTE

SEQ ID NO: 3052472 - protein, 6 aa, Giardia lamblia
EEQATS

SEQ ID NO: 3052473 - protein, 5 aa, Giardia lamblia
EEQDG

SEQ ID NO: 3052474 - protein, 6 aa, Giardia lamblia
EEQHKE

SEQ ID NO: 3052475 - protein, 5 aa, Giardia lamblia
EEQRI

SEQ ID NO: 3052476 - protein, 4 aa, Giardia lamblia
EEQY

SEQ ID NO: 3052477 - protein, 18 aa, Giardia lamblia
EERDAQLGGEAEYYTSML

SEQ ID NO: 3052478 - protein, 8 aa, Giardia lamblia
EEREKRNR

SEQ ID NO: 3052479 - protein, 8 aa, Giardia lamblia
EERELNPS

SEQ ID NO: 3052480 - protein, 13 aa, Giardia lamblia
EERIEKAKQRDEV

SEQ ID NO: 3052481 - protein, 4 aa, Giardia lamblia
EERK

SEQ ID NO: 3052482 - protein, 7 aa, Giardia lamblia
EERPDLE

SEQ ID NO: 3052483 - protein, 21 aa, Giardia lamblia
EERREKSGVDSAQKTEKYTTE

SEQ ID NO: 3052484 - protein, 7 aa, Giardia lamblia
EERSSYP

SEQ ID NO: 3052485 - protein, 6 aa, Giardia lamblia
EERYNP

SEQ ID NO: 3052486 - protein, 10 aa, Giardia lamblia
EESDSAGYDS

SEQ ID NO: 3052487 - protein, 6 aa, Giardia lamblia
EESGEA

SEQ ID NO: 3052488 - protein, 6 aa, Giardia lamblia
EESGSS

SEQ ID NO: 3052489 - protein, 4 aa, Giardia lamblia
EESL

SEQ ID NO: 3052490 - protein, 7 aa, Giardia lamblia
EESNDEL

SEQ ID NO: 3052491 - protein, 4 aa, Giardia lamblia
EESP

SEQ ID NO: 3052492 - protein, 7 aa, Giardia lamblia
EESPQIE

SEQ ID NO: 3052493 - protein, 4 aa, Giardia lamblia
EESQ

SEQ ID NO: 3052494 - protein, 7 aa, Giardia lamblia
EESRRAK

SEQ ID NO: 3052495 - protein, 10 aa, Giardia lamblia
EESSGGMKSN

SEQ ID NO: 3052496 - protein, 7 aa, Giardia lamblia
EESSTLH

SEQ ID NO: 3052497 - protein, 9 aa, Giardia lamblia
EESSTPCKV

SEQ ID NO: 3052498 - protein, 4 aa, Giardia lamblia
EEST

SEQ ID NO: 3052499 - protein, 13 aa, Giardia lamblia
EETATSQPEAPQL

SEQ ID NO: 3052500 - protein, 6 aa, Giardia lamblia
EETATT

SEQ ID NO: 3052501 - protein, 17 aa, Giardia lamblia
EETFSSSYSSVPSDLED

SEQ ID NO: 3052502 - protein, 17 aa, Giardia lamblia
EETLSSVQQESDTRGTE

SEQ ID NO: 3052503 - protein, 5 aa, Giardia lamblia
EETNN

SEQ ID NO: 3052504 - protein, 5 aa, Giardia lamblia
EETRI

SEQ ID NO: 3052505 - protein, 13 aa, Giardia lamblia
EETRSAMKTSAAS

SEQ ID NO: 3052506 - protein, 6 aa, Giardia lamblia
EETTES

SEQ ID NO: 3052507 - protein, 5 aa, Giardia lamblia
EETTT

SEQ ID NO: 3052508 - protein, 4 aa, Giardia lamblia
EETY

SEQ ID NO: 3052509 - protein, 7 aa, Giardia lamblia
EEVGGSS

SEQ ID NO: 3052510 - protein, 15 aa, Giardia lamblia
EEYGNRGTEGSDTIT

SEQ ID NO: 3052511 - protein, 43 aa, Giardia lamblia
EFASTQLEKRTHHSSTIPSMHPSKTVPARDDQTGARTTAPEKD

SEQ ID NO: 3052512 - protein, 4 aa, Giardia lamblia
EFDT

SEQ ID NO: 3052513 - protein, 11 aa, Giardia lamblia
EFHPPPKELAS

SEQ ID NO: 3052514 - protein, 34 aa, Giardia lamblia
EFPQGSTDRLHDEPSNQSKCTAVRQADKHKRLTS

SEQ ID NO: 3052515 - protein, 12 aa, Giardia lamblia
EFPQSASSSGPI

SEQ ID NO: 3052516 - protein, 7 aa, Giardia lamblia
EFPSQNA

SEQ ID NO: 3052517 - protein, 4 aa, Giardia lamblia
EFSN

SEQ ID NO: 3052518 - protein, 9 aa, Giardia lamblia
EFTATEKSK

SEQ ID NO: 3052519 - protein, 6 aa, Giardia lamblia
EFYTTG

SEQ ID NO: 3052520 - protein, 9 aa, Giardia lamblia
EGACTEAAP

SEQ ID NO: 3052521 - protein, 10 aa, Giardia lamblia
EGADGSKKIC

SEQ ID NO: 3052522 - protein, 8 aa, Giardia lamblia
EGAERSLT

SEQ ID NO: 3052523 - protein, 5 aa, Giardia lamblia
EGAPP

SEQ ID NO: 3052524 - protein, 16 aa, Giardia lamblia
EGARQHITTSLSNTET

SEQ ID NO: 3052525 - protein, 7 aa, Giardia lamblia
EGATSGS

SEQ ID NO: 3052526 - protein, 18 aa, Giardia lamblia
EGCERPVKTRTHSRQSSS

SEQ ID NO: 3052527 - protein, 4 aa, Giardia lamblia
EGCK

SEQ ID NO: 3052528 - protein, 8 aa, Giardia lamblia
EGCQAPEP

SEQ ID NO: 3052529 - protein, 9 aa, Giardia lamblia
EGDASSLSS

SEQ ID NO: 3052530 - protein, 4 aa, Giardia lamblia
EGDE

SEQ ID NO: 3052531 - protein, 24 aa, Giardia lamblia
EGDHRTASIDGAAPVHPAAGPEQW

SEQ ID NO: 3052532 - protein, 10 aa, Giardia lamblia
EGDKQKEKTL

SEQ ID NO: 3052533 - protein, 15 aa, Giardia lamblia
EGDNSEDSYPAENCH

SEQ ID NO: 3052534 - protein, 12 aa, Giardia lamblia
EGDSPKNVTDRN

SEQ ID NO: 3052535 - protein, 5 aa, Giardia lamblia
EGDTK

SEQ ID NO: 3052536 - protein, 4 aa, Giardia lamblia
EGDW

SEQ ID NO: 3052537 - protein, 4 aa, Giardia lamblia
EGEE

SEQ ID NO: 3052538 - protein, 6 aa, Giardia lamblia
EGEEPA

SEQ ID NO: 3052539 - protein, 14 aa, Giardia lamblia
EGEHMPKEDAEKCK

SEQ ID NO: 3052540 - protein, 10 aa, Giardia lamblia
EGEKQDHNGL

SEQ ID NO: 3052541 - protein, 12 aa, Giardia lamblia
EGEQSTEQPQSL

SEQ ID NO: 3052542 - protein, 9 aa, Giardia lamblia
EGFSGPEKR

SEQ ID NO: 3052543 - protein, 7 aa, Giardia lamblia
EGGDAAI

SEQ ID NO: 3052544 - protein, 9 aa, Giardia lamblia
EGGIQNSDG

SEQ ID NO: 3052545 - protein, 29 aa, Giardia lamblia
EGGKPINLPPGFSPETASTPEGVDDATID

SEQ ID NO: 3052546 - protein, 11 aa, Giardia lamblia
EGGLQDRNGKT

SEQ ID NO: 3052547 - protein, 9 aa, Giardia lamblia
EGGLTDAEG

SEQ ID NO: 3052548 - protein, 11 aa, Giardia lamblia
EGGMKKGKGCT

SEQ ID NO: 3052549 - protein, 9 aa, Giardia lamblia
EGGMQKGRG

SEQ ID NO: 3052550 - protein, 6 aa, Giardia lamblia
EGGNPE

SEQ ID NO: 3052551 - protein, 5 aa, Giardia lamblia
EGGPN

SEQ ID NO: 3052552 - protein, 9 aa, Giardia lamblia
EGGRSQTLQ

SEQ ID NO: 3052553 - protein, 7 aa, Giardia lamblia
EGIDPEN

SEQ ID NO: 3052554 - protein, 7 aa, Giardia lamblia
EGKDPKD

SEQ ID NO: 3052555 - protein, 6 aa, Giardia lamblia
EGKGAK

SEQ ID NO: 3052556 - protein, 10 aa, Giardia lamblia
EGKGHTADGL

SEQ ID NO: 3052557 - protein, 8 aa, Giardia lamblia
EGKKLSES

SEQ ID NO: 3052558 - protein, 8 aa, Giardia lamblia
EGKRQPGQ

SEQ ID NO: 3052559 - protein, 9 aa, Giardia lamblia
EGKRQPGQC

SEQ ID NO: 3052560 - protein, 5 aa, Giardia lamblia
EGKTF

SEQ ID NO: 3052561 - protein, 7 aa, Giardia lamblia
EGKVPEE

SEQ ID NO: 3052562 - protein, 10 aa, Giardia lamblia
EGKYDESTPI

SEQ ID NO: 3052563 - protein, 13 aa, Giardia lamblia
EGLRKEPKTISAQ

SEQ ID NO: 3052564 - protein, 4 aa, Giardia lamblia
EGLT

SEQ ID NO: 3052565 - protein, 13 aa, Giardia lamblia
EGMASKPNSYGVG

SEQ ID NO: 3052566 - protein, 4 aa, Giardia lamblia
EGMT

SEQ ID NO: 3052567 - protein, 5 aa, Giardia lamblia
EGNGL

SEQ ID NO: 3052568 - protein, 9 aa, Giardia lamblia
EGNGPAAAI

SEQ ID NO: 3052569 - protein, 5 aa, Giardia lamblia
EGNQD

SEQ ID NO: 3052570 - protein, 9 aa, Giardia lamblia
EGNSAYGKK

SEQ ID NO: 3052571 - protein, 5 aa, Giardia lamblia
EGNSR

SEQ ID NO: 3052572 - protein, 5 aa, Giardia lamblia
EGPLA

SEQ ID NO: 3052573 - protein, 5 aa, Giardia lamblia
EGPQS

SEQ ID NO: 3052574 - protein, 5 aa, Giardia lamblia
EGQGC

SEQ ID NO: 3052575 - protein, 13 aa, Giardia lamblia
EGQQNVSDRPREV

SEQ ID NO: 3052576 - protein, 14 aa, Giardia lamblia
EGQRETATMPTQLN

SEQ ID NO: 3052577 - protein, 10 aa, Giardia lamblia
EGRDAYNRDS

SEQ ID NO: 3052578 - protein, 18 aa, Giardia lamblia
EGRDGTGSGGDDPQDSVL

SEQ ID NO: 3052579 - protein, 11 aa, Giardia lamblia
EGRKLNKTGAT

SEQ ID NO: 3052580 - protein, 8 aa, Giardia lamblia
EGRKTNKM

SEQ ID NO: 3052581 - protein, 14 aa, Giardia lamblia
EGRPATNKSEYTSR

SEQ ID NO: 3052582 - protein, 8 aa, Giardia lamblia
EGRSAKPF

SEQ ID NO: 3052583 - protein, 7 aa, Giardia lamblia
EGRTSEV

SEQ ID NO: 3052584 - protein, 7 aa, Giardia lamblia
EGSLRTH

SEQ ID NO: 3052585 - protein, 9 aa, Giardia lamblia
EGSPSPYSA

SEQ ID NO: 3052586 - protein, 7 aa, Giardia lamblia
EGSQGLS

SEQ ID NO: 3052587 - protein, 11 aa, Giardia lamblia
EGSSNDDARQH

SEQ ID NO: 3052588 - protein, 8 aa, Giardia lamblia
EGSSQAAV

SEQ ID NO: 3052589 - protein, 7 aa, Giardia lamblia
EGSTVTD

SEQ ID NO: 3052590 - protein, 6 aa, Giardia lamblia
EGTCNT

SEQ ID NO: 3052591 - protein, 5 aa, Giardia lamblia
EGTDN

SEQ ID NO: 3052592 - protein, 16 aa, Giardia lamblia
EGTFPSPCGSSTNSMD

SEQ ID NO: 3052593 - protein, 17 aa, Giardia lamblia
EGTFSTPSSSSEHPYLD

SEQ ID NO: 3052594 - protein, 5 aa, Giardia lamblia
EGTGL

SEQ ID NO: 3052595 - protein, 11 aa, Giardia lamblia
EGTGLSDATPI

SEQ ID NO: 3052596 - protein, 8 aa, Giardia lamblia
EGTHPNPY

SEQ ID NO: 3052597 - protein, 11 aa, Giardia lamblia
EGTLASSDATC

SEQ ID NO: 3052598 - protein, 44 aa, Giardia lamblia
EGTPGAPSMNTPTAPDNPLTSALPNSGNIAPGENNNQSAGLSGI

SEQ ID NO: 3052599 - protein, 4 aa, Giardia lamblia
EGTT

SEQ ID NO: 3052600 - protein, 8 aa, Giardia lamblia
EGTTTTER

SEQ ID NO: 3052601 - protein, 8 aa, Giardia lamblia
EGTTTTGK

SEQ ID NO: 3052602 - protein, 4 aa, Giardia lamblia
EGVS

SEQ ID NO: 3052603 - protein, 14 aa, Giardia lamblia
EGVTGEQKKQHERL

SEQ ID NO: 3052604 - protein, 4 aa, Giardia lamblia
EGYD

SEQ ID NO: 3052605 - protein, 8 aa, Giardia lamblia
EGYGSSDQ

SEQ ID NO: 3052606 - protein, 7 aa, Giardia lamblia
EGYKNNC

SEQ ID NO: 3052607 - protein, 8 aa, Giardia lamblia
EGYPVGNY

SEQ ID NO: 3052608 - protein, 9 aa, Giardia lamblia
EGYQSNPVQ

SEQ ID NO: 3052609 - protein, 14 aa, Giardia lamblia
EGYSSTQKSHEKTG

SEQ ID NO: 3052610 - protein, 12 aa, Giardia lamblia
EHAGAGAPSLVD

SEQ ID NO: 3052611 - protein, 8 aa, Giardia lamblia
EHAGGAPF

SEQ ID NO: 3052612 - protein, 5 aa, Giardia lamblia
EHAGY

SEQ ID NO: 3052613 - protein, 7 aa, Giardia lamblia
EHASGTY

SEQ ID NO: 3052614 - protein, 5 aa, Giardia lamblia
EHDEE

SEQ ID NO: 3052615 - protein, 5 aa, Giardia lamblia
EHDPD

SEQ ID NO: 3052616 - protein, 4 aa, Giardia lamblia
EHED

SEQ ID NO: 3052617 - protein, 6 aa, Giardia lamblia
EHEDAS

SEQ ID NO: 3052618 - protein, 4 aa, Giardia lamblia
EHGD

SEQ ID NO: 3052619 - protein, 6 aa, Giardia lamblia
EHGLQK

SEQ ID NO: 3052620 - protein, 10 aa, Giardia lamblia
EHGNPSELEA

SEQ ID NO: 3052621 - protein, 5 aa, Giardia lamblia
EHGSV

SEQ ID NO: 3052622 - protein, 7 aa, Giardia lamblia
EHHTEAS

SEQ ID NO: 3052623 - protein, 4 aa, Giardia lamblia
EHIT

SEQ ID NO: 3052624 - protein, 4 aa, Giardia lamblia
EHKA

SEQ ID NO: 3052625 - protein, 12 aa, Giardia lamblia
EHKEREHTECPN

SEQ ID NO: 3052626 - protein, 5 aa, Giardia lamblia
EHKSL

SEQ ID NO: 3052627 - protein, 7 aa, Giardia lamblia
EHLSSDS

SEQ ID NO: 3052628 - protein, 4 aa, Giardia lamblia
EHNR

SEQ ID NO: 3052629 - protein, 8 aa, Giardia lamblia
EHPDPTLQ

SEQ ID NO: 3052630 - protein, 13 aa, Giardia lamblia
EHPRPTSSKQTGL

SEQ ID NO: 3052631 - protein, 10 aa, Giardia lamblia
EHPSEDSTNL

SEQ ID NO: 3052632 - protein, 6 aa, Giardia lamblia
EHPSKS

SEQ ID NO: 3052633 - protein, 5 aa, Giardia lamblia
EHPSS

SEQ ID NO: 3052634 - protein, 5 aa, Giardia lamblia
EHQFP

SEQ ID NO: 3052635 - protein, 5 aa, Giardia lamblia
EHQPT

SEQ ID NO: 3052636 - protein, 4 aa, Giardia lamblia
EHQY

SEQ ID NO: 3052637 - protein, 6 aa, Giardia lamblia
EHRSTV

SEQ ID NO: 3052638 - protein, 7 aa, Giardia lamblia
EHSDHPI

SEQ ID NO: 3052639 - protein, 5 aa, Giardia lamblia
EHSSA

SEQ ID NO: 3052640 - protein, 9 aa, Giardia lamblia
EHSSEKHRR

SEQ ID NO: 3052641 - protein, 12 aa, Giardia lamblia
EHTPSGYPEPAF

SEQ ID NO: 3052642 - protein, 11 aa, Giardia lamblia
EHTPSVQDMDT

SEQ ID NO: 3052643 - protein, 7 aa, Giardia lamblia
EHYDPQS

SEQ ID NO: 3052644 - protein, 14 aa, Giardia lamblia
EIADDSALSTNPLS

SEQ ID NO: 3052645 - protein, 8 aa, Giardia lamblia
EIDDPSEG

SEQ ID NO: 3052646 - protein, 9 aa, Giardia lamblia
EIEEEEQKI

SEQ ID NO: 3052647 - protein, 8 aa, Giardia lamblia
EIEENEGD

SEQ ID NO: 3052648 - protein, 10 aa, Giardia lamblia
EIEGKPDFQE

SEQ ID NO: 3052649 - protein, 9 aa, Giardia lamblia
EIEREQASV

SEQ ID NO: 3052650 - protein, 7 aa, Giardia lamblia
EIETPEQ

SEQ ID NO: 3052651 - protein, 8 aa, Giardia lamblia
EIGNSTSR

SEQ ID NO: 3052652 - protein, 5 aa, Giardia lamblia
EIGQE

SEQ ID NO: 3052653 - protein, 10 aa, Giardia lamblia
EIGRGKNSGS

SEQ ID NO: 3052654 - protein, 7 aa, Giardia lamblia
EIKSKSV

SEQ ID NO: 3052655 - protein, 7 aa, Giardia lamblia
EIPGRGS

SEQ ID NO: 3052656 - protein, 5 aa, Giardia lamblia
EIPPS

SEQ ID NO: 3052657 - protein, 4 aa, Giardia lamblia
EIQK

SEQ ID NO: 3052658 - protein, 7 aa, Giardia lamblia
EIQKTAQ

SEQ ID NO: 3052659 - protein, 10 aa, Giardia lamblia
EISSRPSRAF

SEQ ID NO: 3052660 - protein, 13 aa, Giardia lamblia
EISTASHLSTNST

SEQ ID NO: 3052661 - protein, 5 aa, Giardia lamblia
EITEV

SEQ ID NO: 3052662 - protein, 18 aa, Giardia lamblia
EITKEKGSLPGDPSRSPA

SEQ ID NO: 3052663 - protein, 5 aa, Giardia lamblia
EITPS

SEQ ID NO: 3052664 - protein, 8 aa, Giardia lamblia
EITSGQTE

SEQ ID NO: 3052665 - protein, 7 aa, Giardia lamblia
EKADTMA

SEQ ID NO: 3052666 - protein, 6 aa, Giardia lamblia
EKAELT

SEQ ID NO: 3052667 - protein, 4 aa, Giardia lamblia
EKAF

SEQ ID NO: 3052668 - protein, 6 aa, Giardia lamblia
EKAGDT

SEQ ID NO: 3052669 - protein, 29 aa, Giardia lamblia
EKALSSTTRYKENMKESTRDSKDSSPQLL

SEQ ID NO: 3052670 - protein, 8 aa, Giardia lamblia
EKAPKTVR

SEQ ID NO: 3052671 - protein, 10 aa, Giardia lamblia
EKAPTKTSEP

SEQ ID NO: 3052672 - protein, 8 aa, Giardia lamblia
EKARDYDK

SEQ ID NO: 3052673 - protein, 9 aa, Giardia lamblia
EKASSDGVE

SEQ ID NO: 3052674 - protein, 8 aa, Giardia lamblia
EKASSTGG

SEQ ID NO: 3052675 - protein, 5 aa, Giardia lamblia
EKDIG

SEQ ID NO: 3052676 - protein, 5 aa, Giardia lamblia
EKDLT

SEQ ID NO: 3052677 - protein, 9 aa, Giardia lamblia
EKDPNQLAA

SEQ ID NO: 3052678 - protein, 12 aa, Giardia lamblia
EKDRIGKNDAHI

SEQ ID NO: 3052679 - protein, 10 aa, Giardia lamblia
EKDSGQKPIS

SEQ ID NO: 3052680 - protein, 4 aa, Giardia lamblia
EKDT

SEQ ID NO: 3052681 - protein, 28 aa, Giardia lamblia
EKDTQDSQEQGQEQDPEQSTKAASAATA

SEQ ID NO: 3052682 - protein, 6 aa, Giardia lamblia
EKDYMS

SEQ ID NO: 3052683 - protein, 5 aa, Giardia lamblia
EKEER

SEQ ID NO: 3052684 - protein, 7 aa, Giardia lamblia
EKEHAGA

SEQ ID NO: 3052685 - protein, 6 aa, Giardia lamblia
EKEKAE

SEQ ID NO: 3052686 - protein, 16 aa, Giardia lamblia
EKEKVARNDSRVSSDD

SEQ ID NO: 3052687 - protein, 17 aa, Giardia lamblia
EKEMPEVPAVEHGWYCE

SEQ ID NO: 3052688 - protein, 8 aa, Giardia lamblia
EKENGTIT

SEQ ID NO: 3052689 - protein, 12 aa, Giardia lamblia
EKERAASSSSYS

SEQ ID NO: 3052690 - protein, 9 aa, Giardia lamblia
EKERAERDP

SEQ ID NO: 3052691 - protein, 10 aa, Giardia lamblia
EKERERAAPE

SEQ ID NO: 3052692 - protein, 36 aa, Giardia lamblia
EKETAKKAKAAPKSKTSTSRPESRPDGNDEDERPVE

SEQ ID NO: 3052693 - protein, 6 aa, Giardia lamblia
EKETSL

SEQ ID NO: 3052694 - protein, 7 aa, Giardia lamblia
EKGDCGT

SEQ ID NO: 3052695 - protein, 5 aa, Giardia lamblia
EKGDS

SEQ ID NO: 3052696 - protein, 6 aa, Giardia lamblia
EKGEAL

SEQ ID NO: 3052697 - protein, 7 aa, Giardia lamblia
EKGHSNT

SEQ ID NO: 3052698 - protein, 10 aa, Giardia lamblia
EKGIKDKNGW

SEQ ID NO: 3052699 - protein, 10 aa, Giardia lamblia
EKGKELSGSG

SEQ ID NO: 3052700 - protein, 11 aa, Giardia lamblia
EKGKRDTAGRT

SEQ ID NO: 3052701 - protein, 10 aa, Giardia lamblia
EKGLKDKNGW

SEQ ID NO: 3052702 - protein, 17 aa, Giardia lamblia
EKGLRATQKREEYPPGI

SEQ ID NO: 3052703 - protein, 8 aa, Giardia lamblia
EKGPTALD

SEQ ID NO: 3052704 - protein, 9 aa, Giardia lamblia
EKGRDNVSE

SEQ ID NO: 3052705 - protein, 10 aa, Giardia lamblia
EKGSAGSRVA

SEQ ID NO: 3052706 - protein, 7 aa, Giardia lamblia
EKGTTAF

SEQ ID NO: 3052707 - protein, 5 aa, Giardia lamblia
EKGVT

SEQ ID NO: 3052708 - protein, 7 aa, Giardia lamblia
EKHDSDY

SEQ ID NO: 3052709 - protein, 13 aa, Giardia lamblia
EKHPSSEGQQKKI

SEQ ID NO: 3052710 - protein, 15 aa, Giardia lamblia
EKHVQEAKESHANTV

SEQ ID NO: 3052711 - protein, 6 aa, Giardia lamblia
EKIDQA

SEQ ID NO: 3052712 - protein, 5 aa, Giardia lamblia
EKIGG

SEQ ID NO: 3052713 - protein, 5 aa, Giardia lamblia
EKIKS

SEQ ID NO: 3052714 - protein, 8 aa, Giardia lamblia
EKISAGYT

SEQ ID NO: 3052715 - protein, 8 aa, Giardia lamblia
EKKAKRDH

SEQ ID NO: 3052716 - protein, 11 aa, Giardia lamblia
EKKDGKSICEK

SEQ ID NO: 3052717 - protein, 7 aa, Giardia lamblia
EKKDSQD

SEQ ID NO: 3052718 - protein, 4 aa, Giardia lamblia
EKKG

SEQ ID NO: 3052719 - protein, 14 aa, Giardia lamblia
EKKGISDVGQAPVK

SEQ ID NO: 3052720 - protein, 20 aa, Giardia lamblia
EKKKPPPKAVKKSPKSTSNV

SEQ ID NO: 3052721 - protein, 9 aa, Giardia lamblia
EKKKRGVPH

SEQ ID NO: 3052722 - protein, 6 aa, Giardia lamblia
EKKPSL

SEQ ID NO: 3052723 - protein, 8 aa, Giardia lamblia
EKKQEKAR

SEQ ID NO: 3052724 - protein, 10 aa, Giardia lamblia
EKKQTDSKGW

SEQ ID NO: 3052725 - protein, 8 aa, Giardia lamblia
EKLNATNP

SEQ ID NO: 3052726 - protein, 6 aa, Giardia lamblia
EKLSGP

SEQ ID NO: 3052727 - protein, 9 aa, Giardia lamblia
EKLSKTTPI

SEQ ID NO: 3052728 - protein, 5 aa, Giardia lamblia
EKNDD

SEQ ID NO: 3052729 - protein, 8 aa, Giardia lamblia
EKNDSTAA

SEQ ID NO: 3052730 - protein, 4 aa, Giardia lamblia
EKNI

SEQ ID NO: 3052731 - protein, 8 aa, Giardia lamblia
EKNRPYTY

SEQ ID NO: 3052732 - protein, 9 aa, Giardia lamblia
EKNTQSNTF

SEQ ID NO: 3052733 - protein, 5 aa, Giardia lamblia
EKNVD

SEQ ID NO: 3052734 - protein, 4 aa, Giardia lamblia
EKNY

SEQ ID NO: 3052735 - protein, 19 aa, Giardia lamblia
EKPATGKTATSSGTSPVPK

SEQ ID NO: 3052736 - protein, 7 aa, Giardia lamblia
EKPFISN

SEQ ID NO: 3052737 - protein, 14 aa, Giardia lamblia
EKPGDTLQQTESRP

SEQ ID NO: 3052738 - protein, 8 aa, Giardia lamblia
EKPKDQRC

SEQ ID NO: 3052739 - protein, 13 aa, Giardia lamblia
EKPKEKKGKRGKV

SEQ ID NO: 3052740 - protein, 10 aa, Giardia lamblia
EKPQSTIENS

SEQ ID NO: 3052741 - protein, 8 aa, Giardia lamblia
EKPVPEQT

SEQ ID NO: 3052742 - protein, 5 aa, Giardia lamblia
EKQLE

SEQ ID NO: 3052743 - protein, 12 aa, Giardia lamblia
EKQSAITASQIG

SEQ ID NO: 3052744 - protein, 6 aa, Giardia lamblia
EKQSLA

SEQ ID NO: 3052745 - protein, 7 aa, Giardia lamblia
EKREKAQ

SEQ ID NO: 3052746 - protein, 6 aa, Giardia lamblia
EKRHEE

SEQ ID NO: 3052747 - protein, 10 aa, Giardia lamblia
EKSADARRLS

SEQ ID NO: 3052748 - protein, 7 aa, Giardia lamblia
EKSADQC

SEQ ID NO: 3052749 - protein, 7 aa, Giardia lamblia
EKSISSL

SEQ ID NO: 3052750 - protein, 10 aa, Giardia lamblia
EKSKRKLSDQ

SEQ ID NO: 3052751 - protein, 4 aa, Giardia lamblia
EKSL

SEQ ID NO: 3052752 - protein, 6 aa, Giardia lamblia
EKSPAC

SEQ ID NO: 3052753 - protein, 7 aa, Giardia lamblia
EKSPTKN

SEQ ID NO: 3052754 - protein, 7 aa, Giardia lamblia
EKSQPRI

SEQ ID NO: 3052755 - protein, 9 aa, Giardia lamblia
EKSRARSTD

SEQ ID NO: 3052756 - protein, 5 aa, Giardia lamblia
EKSRQ

SEQ ID NO: 3052757 - protein, 5 aa, Giardia lamblia
EKSSG

SEQ ID NO: 3052758 - protein, 6 aa, Giardia lamblia
EKSSKI

SEQ ID NO: 3052759 - protein, 6 aa, Giardia lamblia
EKSTQT

SEQ ID NO: 3052760 - protein, 9 aa, Giardia lamblia
EKSYKNGDK

SEQ ID NO: 3052761 - protein, 15 aa, Giardia lamblia
EKTAEVEREVTAKEE

SEQ ID NO: 3052762 - protein, 6 aa, Giardia lamblia
EKTASE

SEQ ID NO: 3052763 - protein, 9 aa, Giardia lamblia
EKTMSGELQ

SEQ ID NO: 3052764 - protein, 17 aa, Giardia lamblia
EKTQKDQSEAVESSPDP

SEQ ID NO: 3052765 - protein, 5 aa, Giardia lamblia
EKTRP

SEQ ID NO: 3052766 - protein, 7 aa, Giardia lamblia
EKTSGDD

SEQ ID NO: 3052767 - protein, 36 aa, Giardia lamblia
EKTSGSRSRSKSWKRGSRVPEQEQRQREDEDSSEAE

SEQ ID NO: 3052768 - protein, 6 aa, Giardia lamblia
EKTTPG

SEQ ID NO: 3052769 - protein, 14 aa, Giardia lamblia
EKTTRYNSKNTDDV

SEQ ID NO: 3052770 - protein, 9 aa, Giardia lamblia
EKTTTDCSN

SEQ ID NO: 3052771 - protein, 5 aa, Giardia lamblia
EKTTV

SEQ ID NO: 3052772 - protein, 4 aa, Giardia lamblia
EKVP

SEQ ID NO: 3052773 - protein, 6 aa, Giardia lamblia
EKWDQP

SEQ ID NO: 3052774 - protein, 11 aa, Giardia lamblia
EKWGSTKNGEL

SEQ ID NO: 3052775 - protein, 9 aa, Giardia lamblia
EKYAKDPRF

SEQ ID NO: 3052776 - protein, 12 aa, Giardia lamblia
EKYASGLEKAQE

SEQ ID NO: 3052777 - protein, 9 aa, Giardia lamblia
EKYDSTGRL

SEQ ID NO: 3052778 - protein, 7 aa, Giardia lamblia
EKYEDSL

SEQ ID NO: 3052779 - protein, 10 aa, Giardia lamblia
EKYGSKYGPR

SEQ ID NO: 3052780 - protein, 5 aa, Giardia lamblia
EKYKD

SEQ ID NO: 3052781 - protein, 6 aa, Giardia lamblia
ELADTT

SEQ ID NO: 3052782 - protein, 20 aa, Giardia lamblia
ELANPNSLSNKIKDRTLQST

SEQ ID NO: 3052783 - protein, 16 aa, Giardia lamblia
ELARRDAEEAAKTASA

SEQ ID NO: 3052784 - protein, 6 aa, Giardia lamblia
ELDDQT

SEQ ID NO: 3052785 - protein, 8 aa, Giardia lamblia
ELDDSQTS

SEQ ID NO: 3052786 - protein, 5 aa, Giardia lamblia
ELDGI

SEQ ID NO: 3052787 - protein, 7 aa, Giardia lamblia
ELDPDRE

SEQ ID NO: 3052788 - protein, 7 aa, Giardia lamblia
ELDPSSV

SEQ ID NO: 3052789 - protein, 16 aa, Giardia lamblia
ELEDGVSPRCVDGGIS

SEQ ID NO: 3052790 - protein, 5 aa, Giardia lamblia
ELETK

SEQ ID NO: 3052791 - protein, 8 aa, Giardia lamblia
ELETSTDQ

SEQ ID NO: 3052792 - protein, 11 aa, Giardia lamblia
ELGGTSASQET

SEQ ID NO: 3052793 - protein, 6 aa, Giardia lamblia
ELGQPL

SEQ ID NO: 3052794 - protein, 79 aa, Giardia lamblia
ELGSNSFTEETDNIVSSTGSAYSDSKHCRANHKKRVKSADSTSDTHGKAAAKPRPDKESRGNSKRTSRRTSLSLSDRAS

SEQ ID NO: 3052795 - protein, 5 aa, Giardia lamblia
ELGTI

SEQ ID NO: 3052796 - protein, 10 aa, Giardia lamblia
ELGTPSGELS

SEQ ID NO: 3052797 - protein, 7 aa, Giardia lamblia
ELKEESL

SEQ ID NO: 3052798 - protein, 9 aa, Giardia lamblia
ELKQPKRTS

SEQ ID NO: 3052799 - protein, 15 aa, Giardia lamblia
ELKTSIDDNVQPTND

SEQ ID NO: 3052800 - protein, 4 aa, Giardia lamblia
ELNT

SEQ ID NO: 3052801 - protein, 4 aa, Giardia lamblia
ELPC

SEQ ID NO: 3052802 - protein, 17 aa, Giardia lamblia
ELPPRSVHSQDPGSTNL

SEQ ID NO: 3052803 - protein, 9 aa, Giardia lamblia
ELPQDESKT

SEQ ID NO: 3052804 - protein, 21 aa, Giardia lamblia
ELPSPTSLTRPQDYCKPETKS

SEQ ID NO: 3052805 - protein, 7 aa, Giardia lamblia
ELPVESA

SEQ ID NO: 3052806 - protein, 7 aa, Giardia lamblia
ELQAGND

SEQ ID NO: 3052807 - protein, 8 aa, Giardia lamblia
ELQDEEDQ

SEQ ID NO: 3052808 - protein, 6 aa, Giardia lamblia
ELQGKT

SEQ ID NO: 3052809 - protein, 31 aa, Giardia lamblia
ELQSGSRPSQSSRGINSNPQTISEEGREEES

SEQ ID NO: 3052810 - protein, 9 aa, Giardia lamblia
ELQSTNNSG

SEQ ID NO: 3052811 - protein, 9 aa, Giardia lamblia
ELQSTPSKT

SEQ ID NO: 3052812 - protein, 4 aa, Giardia lamblia
ELRR

SEQ ID NO: 3052813 - protein, 8 aa, Giardia lamblia
ELRTYDDT

SEQ ID NO: 3052814 - protein, 19 aa, Giardia lamblia
ELSDTDTDTDTSESSLSAA

SEQ ID NO: 3052815 - protein, 16 aa, Giardia lamblia
ELSEERSEHGNKAKCV

SEQ ID NO: 3052816 - protein, 4 aa, Giardia lamblia
ELSG

SEQ ID NO: 3052817 - protein, 5 aa, Giardia lamblia
ELSGK

SEQ ID NO: 3052818 - protein, 6 aa, Giardia lamblia
ELSGKL

SEQ ID NO: 3052819 - protein, 6 aa, Giardia lamblia
ELSHTS

SEQ ID NO: 3052820 - protein, 18 aa, Giardia lamblia
ELSPDGKEKTIAATSKRR

SEQ ID NO: 3052821 - protein, 7 aa, Giardia lamblia
ELSSPDI

SEQ ID NO: 3052822 - protein, 5 aa, Giardia lamblia
ELSSS

SEQ ID NO: 3052823 - protein, 7 aa, Giardia lamblia
ELSSSAK

SEQ ID NO: 3052824 - protein, 13 aa, Giardia lamblia
ELSTQGESEREEL

SEQ ID NO: 3052825 - protein, 15 aa, Giardia lamblia
ELSTTKPITKKPKRK

SEQ ID NO: 3052826 - protein, 7 aa, Giardia lamblia
ELTDAQT

SEQ ID NO: 3052827 - protein, 6 aa, Giardia lamblia
ELTDDE

SEQ ID NO: 3052828 - protein, 9 aa, Giardia lamblia
ELTSKHQDP

SEQ ID NO: 3052829 - protein, 11 aa, Giardia lamblia
ELTTESSRDRR

SEQ ID NO: 3052830 - protein, 40 aa, Giardia lamblia
EMGDEQGEAIDERNYNEDDDSAEEYSDEQKKNTNNNNDTM

SEQ ID NO: 3052831 - protein, 4 aa, Giardia lamblia
EMGS

SEQ ID NO: 3052832 - protein, 17 aa, Giardia lamblia
EMHEDGDHGHTDPAGKR

SEQ ID NO: 3052833 - protein, 5 aa, Giardia lamblia
EMNDS

SEQ ID NO: 3052834 - protein, 8 aa, Giardia lamblia
EMNETQSA

SEQ ID NO: 3052835 - protein, 5 aa, Giardia lamblia
EMPPD

SEQ ID NO: 3052836 - protein, 8 aa, Giardia lamblia
EMQSHRDG

SEQ ID NO: 3052837 - protein, 5 aa, Giardia lamblia
EMSPE

SEQ ID NO: 3052838 - protein, 6 aa, Giardia lamblia
ENAEKR

SEQ ID NO: 3052839 - protein, 4 aa, Giardia lamblia
ENAT

SEQ ID NO: 3052840 - protein, 7 aa, Giardia lamblia
ENCEAGQ

SEQ ID NO: 3052841 - protein, 4 aa, Giardia lamblia
ENDP

SEQ ID NO: 3052842 - protein, 11 aa, Giardia lamblia
ENDPNACQSQY

SEQ ID NO: 3052843 - protein, 15 aa, Giardia lamblia
ENDREERQPTPLDHQ

SEQ ID NO: 3052844 - protein, 6 aa, Giardia lamblia
ENDTDT

SEQ ID NO: 3052845 - protein, 16 aa, Giardia lamblia
ENDVTDFQSDKAKTFE

SEQ ID NO: 3052846 - protein, 5 aa, Giardia lamblia
ENEID

SEQ ID NO: 3052847 - protein, 4 aa, Giardia lamblia
ENEL

SEQ ID NO: 3052848 - protein, 5 aa, Giardia lamblia
ENEQL

SEQ ID NO: 3052849 - protein, 5 aa, Giardia lamblia
ENETG

SEQ ID NO: 3052850 - protein, 21 aa, Giardia lamblia
ENEYTDEEEALSKAKDNPRTL

SEQ ID NO: 3052851 - protein, 9 aa, Giardia lamblia
ENGEGTAWN

SEQ ID NO: 3052852 - protein, 9 aa, Giardia lamblia
ENGFRDKNG

SEQ ID NO: 3052853 - protein, 4 aa, Giardia lamblia
ENGG

SEQ ID NO: 3052854 - protein, 7 aa, Giardia lamblia
ENGPSPL

SEQ ID NO: 3052855 - protein, 8 aa, Giardia lamblia
ENGQPVSF

SEQ ID NO: 3052856 - protein, 8 aa, Giardia lamblia
ENGSAETA

SEQ ID NO: 3052857 - protein, 6 aa, Giardia lamblia
ENGTVR

SEQ ID NO: 3052858 - protein, 7 aa, Giardia lamblia
ENHKTDP

SEQ ID NO: 3052859 - protein, 4 aa, Giardia lamblia
ENHQ

SEQ ID NO: 3052860 - protein, 9 aa, Giardia lamblia
ENHSTTGSF

SEQ ID NO: 3052861 - protein, 33 aa, Giardia lamblia
ENIRGKSWSATRPLSSPLNPGYPMQQTNKSEPR

SEQ ID NO: 3052862 - protein, 38 aa, Giardia lamblia
ENKLPETEEVPTSLTSTPVQSGQLDQKTPQASRSSPSK

SEQ ID NO: 3052863 - protein, 6 aa, Giardia lamblia
ENKNCG

SEQ ID NO: 3052864 - protein, 7 aa, Giardia lamblia
ENKVCGP

SEQ ID NO: 3052865 - protein, 8 aa, Giardia lamblia
ENLEGAGS

SEQ ID NO: 3052866 - protein, 24 aa, Giardia lamblia
ENLPANDLPTCAKPSDKPDLPETC

SEQ ID NO: 3052867 - protein, 22 aa, Giardia lamblia
ENLPTNNLPTCAKPSGKPDLPE

SEQ ID NO: 3052868 - protein, 22 aa, Giardia lamblia
ENLSTGNLPTCAKPSEKPDLPE

SEQ ID NO: 3052869 - protein, 7 aa, Giardia lamblia
ENMDSGT

SEQ ID NO: 3052870 - protein, 4 aa, Giardia lamblia
ENNT

SEQ ID NO: 3052871 - protein, 4 aa, Giardia lamblia
ENPA

SEQ ID NO: 3052872 - protein, 7 aa, Giardia lamblia
ENPEEAS

SEQ ID NO: 3052873 - protein, 12 aa, Giardia lamblia
ENPEHHTPLSQS

SEQ ID NO: 3052874 - protein, 5 aa, Giardia lamblia
ENPGV

SEQ ID NO: 3052875 - protein, 7 aa, Giardia lamblia
ENPLEEP

SEQ ID NO: 3052876 - protein, 8 aa, Giardia lamblia
ENPPTLND

SEQ ID NO: 3052877 - protein, 5 aa, Giardia lamblia
ENQQL

SEQ ID NO: 3052878 - protein, 4 aa, Giardia lamblia
ENQR

SEQ ID NO: 3052879 - protein, 5 aa, Giardia lamblia
ENQSY

SEQ ID NO: 3052880 - protein, 23 aa, Giardia lamblia
ENQTEHDAHQTMQEQAEQESVPL

SEQ ID NO: 3052881 - protein, 8 aa, Giardia lamblia
ENRANDAD

SEQ ID NO: 3052882 - protein, 10 aa, Giardia lamblia
ENRKNNKTVA

SEQ ID NO: 3052883 - protein, 23 aa, Giardia lamblia
ENRRGSITSAPIEDSVTTATPSL

SEQ ID NO: 3052884 - protein, 14 aa, Giardia lamblia
ENSAGRSSDECTRV

SEQ ID NO: 3052885 - protein, 10 aa, Giardia lamblia
ENSGEPPCGG

SEQ ID NO: 3052886 - protein, 5 aa, Giardia lamblia
ENSMR

SEQ ID NO: 3052887 - protein, 11 aa, Giardia lamblia
ENSPNKSDVAS

SEQ ID NO: 3052888 - protein, 8 aa, Giardia lamblia
ENSQLSAE

SEQ ID NO: 3052889 - protein, 15 aa, Giardia lamblia
ENSRLDSNDSGQLKP

SEQ ID NO: 3052890 - protein, 4 aa, Giardia lamblia
ENSS

SEQ ID NO: 3052891 - protein, 19 aa, Giardia lamblia
ENSSFDTGTSTNNDPQKQL

SEQ ID NO: 3052892 - protein, 5 aa, Giardia lamblia
ENSTI

SEQ ID NO: 3052893 - protein, 5 aa, Giardia lamblia
ENTQT

SEQ ID NO: 3052894 - protein, 8 aa, Giardia lamblia
ENTSSSAM

SEQ ID NO: 3052895 - protein, 4 aa, Giardia lamblia
ENTV

SEQ ID NO: 3052896 - protein, 5 aa, Giardia lamblia
ENTVS

SEQ ID NO: 3052897 - protein, 7 aa, Giardia lamblia
ENVTTSM

SEQ ID NO: 3052898 - protein, 18 aa, Giardia lamblia
ENWDTDGPNVPGITPQRA

SEQ ID NO: 3052899 - protein, 9 aa, Giardia lamblia
ENYDDTLRE

SEQ ID NO: 3052900 - protein, 7 aa, Giardia lamblia
EPAANRQ

SEQ ID NO: 3052901 - protein, 14 aa, Giardia lamblia
EPAEHSSRKYEEEL

SEQ ID NO: 3052902 - protein, 31 aa, Giardia lamblia
EPAGSSDSQNAAARADQKKETQGQQHTAPEA

SEQ ID NO: 3052903 - protein, 6 aa, Giardia lamblia
EPAKIA

SEQ ID NO: 3052904 - protein, 7 aa, Giardia lamblia
EPALDND

SEQ ID NO: 3052905 - protein, 5 aa, Giardia lamblia
EPANP

SEQ ID NO: 3052906 - protein, 6 aa, Giardia lamblia
EPANTL

SEQ ID NO: 3052907 - protein, 7 aa, Giardia lamblia
EPATENL

SEQ ID NO: 3052908 - protein, 8 aa, Giardia lamblia
EPATKTTQ

SEQ ID NO: 3052909 - protein, 15 aa, Giardia lamblia
EPAVQPEKSTRLSER

SEQ ID NO: 3052910 - protein, 7 aa, Giardia lamblia
EPDAGSS

SEQ ID NO: 3052911 - protein, 25 aa, Giardia lamblia
EPDEDLESDQRALKASLSSSNATDL

SEQ ID NO: 3052912 - protein, 4 aa, Giardia lamblia
EPDL

SEQ ID NO: 3052913 - protein, 10 aa, Giardia lamblia
EPDSDTFTTL

SEQ ID NO: 3052914 - protein, 6 aa, Giardia lamblia
EPDTIP

SEQ ID NO: 3052915 - protein, 38 aa, Giardia lamblia
EPDTLHEGEGVTSRCPADNIQEPQKDGPSPSGSLDQPA

SEQ ID NO: 3052916 - protein, 20 aa, Giardia lamblia
EPEAGQVPAPTAASFSSSSV

SEQ ID NO: 3052917 - protein, 5 aa, Giardia lamblia
EPELR

SEQ ID NO: 3052918 - protein, 13 aa, Giardia lamblia
EPENGQDGTAEFT

SEQ ID NO: 3052919 - protein, 10 aa, Giardia lamblia
EPEPAPGGPV

SEQ ID NO: 3052920 - protein, 5 aa, Giardia lamblia
EPEQA

SEQ ID NO: 3052921 - protein, 16 aa, Giardia lamblia
EPERAETDSPPSRQYD

SEQ ID NO: 3052922 - protein, 11 aa, Giardia lamblia
EPFATATEGVS

SEQ ID NO: 3052923 - protein, 7 aa, Giardia lamblia
EPGNRYS

SEQ ID NO: 3052924 - protein, 6 aa, Giardia lamblia
EPGTGW

SEQ ID NO: 3052925 - protein, 11 aa, Giardia lamblia
EPIAPYDVPTN

SEQ ID NO: 3052926 - protein, 5 aa, Giardia lamblia
EPISN

SEQ ID NO: 3052927 - protein, 6 aa, Giardia lamblia
EPKRES

SEQ ID NO: 3052928 - protein, 4 aa, Giardia lamblia
EPLG

SEQ ID NO: 3052929 - protein, 12 aa, Giardia lamblia
EPLQKEGGTNLY

SEQ ID NO: 3052930 - protein, 21 aa, Giardia lamblia
EPNTSEANSKTIEDPGFEPPL

SEQ ID NO: 3052931 - protein, 6 aa, Giardia lamblia
EPPADL

SEQ ID NO: 3052932 - protein, 40 aa, Giardia lamblia
EPPGAALSGSSSGAVPATGFGHGDHDSSGTRIPEGTGSTE

SEQ ID NO: 3052933 - protein, 13 aa, Giardia lamblia
EPPGPAAAPTPLP

SEQ ID NO: 3052934 - protein, 10 aa, Giardia lamblia
EPPGVDRPAR

SEQ ID NO: 3052935 - protein, 9 aa, Giardia lamblia
EPPLNEPPG

SEQ ID NO: 3052936 - protein, 5 aa, Giardia lamblia
EPPLS

SEQ ID NO: 3052937 - protein, 8 aa, Giardia lamblia
EPPQPNTR

SEQ ID NO: 3052938 - protein, 11 aa, Giardia lamblia
EPPSSMSASEC

SEQ ID NO: 3052939 - protein, 9 aa, Giardia lamblia
EPPSSNASR

SEQ ID NO: 3052940 - protein, 6 aa, Giardia lamblia
EPPSSQ

SEQ ID NO: 3052941 - protein, 10 aa, Giardia lamblia
EPQTEGTTLT

SEQ ID NO: 3052942 - protein, 7 aa, Giardia lamblia
EPRTASA

SEQ ID NO: 3052943 - protein, 6 aa, Giardia lamblia
EPSAVQ

SEQ ID NO: 3052944 - protein, 4 aa, Giardia lamblia
EPSL

SEQ ID NO: 3052945 - protein, 4 aa, Giardia lamblia
EPSR

SEQ ID NO: 3052946 - protein, 12 aa, Giardia lamblia
EPSSSATDTKNT

SEQ ID NO: 3052947 - protein, 12 aa, Giardia lamblia
EPSTGLDPESKR

SEQ ID NO: 3052948 - protein, 9 aa, Giardia lamblia
EPSTGLDPV

SEQ ID NO: 3052949 - protein, 4 aa, Giardia lamblia
EPSW

SEQ ID NO: 3052950 - protein, 39 aa, Giardia lamblia
EPTGGLSAQSCRSKSPNVAIQDNQSEQHERDRGEDSSEA

SEQ ID NO: 3052951 - protein, 35 aa, Giardia lamblia
EPTLRSPPDSAQSTLDSPQRPPMSPLSNAGSSISA

SEQ ID NO: 3052952 - protein, 13 aa, Giardia lamblia
EPTNPQSDQIEHN

SEQ ID NO: 3052953 - protein, 6 aa, Giardia lamblia
EPTYQD

SEQ ID NO: 3052954 - protein, 14 aa, Giardia lamblia
EPVADDNGQPPKNF

SEQ ID NO: 3052955 - protein, 11 aa, Giardia lamblia
EPVSTEEAQPV

SEQ ID NO: 3052956 - protein, 5 aa, Giardia lamblia
EPYDP

SEQ ID NO: 3052957 - protein, 5 aa, Giardia lamblia
EPYPQ

SEQ ID NO: 3052958 - protein, 10 aa, Giardia lamblia
EQARGDLKDK

SEQ ID NO: 3052959 - protein, 4 aa, Giardia lamblia
EQAT

SEQ ID NO: 3052960 - protein, 7 aa, Giardia lamblia
EQCPEER

SEQ ID NO: 3052961 - protein, 8 aa, Giardia lamblia
EQDEPSMR

SEQ ID NO: 3052962 - protein, 7 aa, Giardia lamblia
EQDIAGT

SEQ ID NO: 3052963 - protein, 8 aa, Giardia lamblia
EQDKPEKI

SEQ ID NO: 3052964 - protein, 7 aa, Giardia lamblia
EQDLSTH

SEQ ID NO: 3052965 - protein, 35 aa, Giardia lamblia
EQDNNEDDGTDEQAEQGDDGSNSESSYDRSSEYTA

SEQ ID NO: 3052966 - protein, 19 aa, Giardia lamblia
EQDNNSEPEHPNDAEKRPL

SEQ ID NO: 3052967 - protein, 4 aa, Giardia lamblia
EQDR

SEQ ID NO: 3052968 - protein, 17 aa, Giardia lamblia
EQDSHEVGSAGCEVDPD

SEQ ID NO: 3052969 - protein, 8 aa, Giardia lamblia
EQDSTKPI

SEQ ID NO: 3052970 - protein, 14 aa, Giardia lamblia
EQDVAGPDTRKDLE

SEQ ID NO: 3052971 - protein, 7 aa, Giardia lamblia
EQDYQTG

SEQ ID NO: 3052972 - protein, 8 aa, Giardia lamblia
EQEAASSW

SEQ ID NO: 3052973 - protein, 22 aa, Giardia lamblia
EQEHARGRDERRKRENDDNYDA

SEQ ID NO: 3052974 - protein, 5 aa, Giardia lamblia
EQEKN

SEQ ID NO: 3052975 - protein, 8 aa, Giardia lamblia
EQEKQTAF

SEQ ID NO: 3052976 - protein, 4 aa, Giardia lamblia
EQEL

SEQ ID NO: 3052977 - protein, 5 aa, Giardia lamblia
EQESQ

SEQ ID NO: 3052978 - protein, 18 aa, Giardia lamblia
EQESSFVDEGQSSTLSTD

SEQ ID NO: 3052979 - protein, 25 aa, Giardia lamblia
EQETAKSSRTKRKPTRPAGDTPLGT

SEQ ID NO: 3052980 - protein, 11 aa, Giardia lamblia
EQFGSPTITTK

SEQ ID NO: 3052981 - protein, 12 aa, Giardia lamblia
EQGMQDNNGETA

SEQ ID NO: 3052982 - protein, 7 aa, Giardia lamblia
EQGPGYF

SEQ ID NO: 3052983 - protein, 4 aa, Giardia lamblia
EQGR

SEQ ID NO: 3052984 - protein, 14 aa, Giardia lamblia
EQGRTRTACSKQEA

SEQ ID NO: 3052985 - protein, 4 aa, Giardia lamblia
EQGS

SEQ ID NO: 3052986 - protein, 6 aa, Giardia lamblia
EQGSLN

SEQ ID NO: 3052987 - protein, 9 aa, Giardia lamblia
EQGTHSYSG

SEQ ID NO: 3052988 - protein, 8 aa, Giardia lamblia
EQHGPQRE

SEQ ID NO: 3052989 - protein, 5 aa, Giardia lamblia
EQIQE

SEQ ID NO: 3052990 - protein, 20 aa, Giardia lamblia
EQISPSVSQESGSTATTGSI

SEQ ID NO: 3052991 - protein, 12 aa, Giardia lamblia
EQISTKQGDTQQ

SEQ ID NO: 3052992 - protein, 9 aa, Giardia lamblia
EQKAPPSDW

SEQ ID NO: 3052993 - protein, 8 aa, Giardia lamblia
EQKDGSVS

SEQ ID NO: 3052994 - protein, 8 aa, Giardia lamblia
EQKHSPDL

SEQ ID NO: 3052995 - protein, 5 aa, Giardia lamblia
EQKIP

SEQ ID NO: 3052996 - protein, 9 aa, Giardia lamblia
EQKSDTAAQ

SEQ ID NO: 3052997 - protein, 8 aa, Giardia lamblia
EQKTPRSR

SEQ ID NO: 3052998 - protein, 9 aa, Giardia lamblia
EQLGGKGAG

SEQ ID NO: 3052999 - protein, 10 aa, Giardia lamblia
EQLSSPKDSW

SEQ ID NO: 3053000 - protein, 7 aa, Giardia lamblia
EQLTEKS

SEQ ID NO: 3053001 - protein, 5 aa, Giardia lamblia
EQLVS

SEQ ID NO: 3053002 - protein, 11 aa, Giardia lamblia
EQMSSSQEHEI

SEQ ID NO: 3053003 - protein, 41 aa, Giardia lamblia
EQNKARTEDAAEDATNDNLGKDNVRDDEEPKDEDKTEHRIE

SEQ ID NO: 3053004 - protein, 9 aa, Giardia lamblia
EQNLGEYGS

SEQ ID NO: 3053005 - protein, 9 aa, Giardia lamblia
EQNPNITKS

SEQ ID NO: 3053006 - protein, 8 aa, Giardia lamblia
EQNQVSRD

SEQ ID NO: 3053007 - protein, 5 aa, Giardia lamblia
EQNSI

SEQ ID NO: 3053008 - protein, 6 aa, Giardia lamblia
EQPEEY

SEQ ID NO: 3053009 - protein, 17 aa, Giardia lamblia
EQPEREKLPQDWKNRTS

SEQ ID NO: 3053010 - protein, 6 aa, Giardia lamblia
EQPHPI

SEQ ID NO: 3053011 - protein, 4 aa, Giardia lamblia
EQPR

SEQ ID NO: 3053012 - protein, 11 aa, Giardia lamblia
EQPRGYTQPSI

SEQ ID NO: 3053013 - protein, 5 aa, Giardia lamblia
EQPSE

SEQ ID NO: 3053014 - protein, 14 aa, Giardia lamblia
EQPTLQGNQGRRAA

SEQ ID NO: 3053015 - protein, 23 aa, Giardia lamblia
EQQENPNTSVTGSNGTANETPSL

SEQ ID NO: 3053016 - protein, 5 aa, Giardia lamblia
EQQGV

SEQ ID NO: 3053017 - protein, 4 aa, Giardia lamblia
EQQK

SEQ ID NO: 3053018 - protein, 6 aa, Giardia lamblia
EQRGSG

SEQ ID NO: 3053019 - protein, 15 aa, Giardia lamblia
EQRGSTQQKKTEANL

SEQ ID NO: 3053020 - protein, 5 aa, Giardia lamblia
EQRGT

SEQ ID NO: 3053021 - protein, 15 aa, Giardia lamblia
EQRKKEGKRIRSEGG

SEQ ID NO: 3053022 - protein, 33 aa, Giardia lamblia
EQRKLPASAPVSANDELGPGDTARTQTEGDEFG

SEQ ID NO: 3053023 - protein, 7 aa, Giardia lamblia
EQRSGEV

SEQ ID NO: 3053024 - protein, 14 aa, Giardia lamblia
EQSASHTDSKFDRS

SEQ ID NO: 3053025 - protein, 5 aa, Giardia lamblia
EQSEQ

SEQ ID NO: 3053026 - protein, 7 aa, Giardia lamblia
EQSGYDK

SEQ ID NO: 3053027 - protein, 5 aa, Giardia lamblia
EQSME

SEQ ID NO: 3053028 - protein, 10 aa, Giardia lamblia
EQSPDAVKDY

SEQ ID NO: 3053029 - protein, 6 aa, Giardia lamblia
EQSSIS

SEQ ID NO: 3053030 - protein, 8 aa, Giardia lamblia
EQSTGSAH

SEQ ID NO: 3053031 - protein, 20 aa, Giardia lamblia
EQSTPPSTKQEKGSRAPSPI

SEQ ID NO: 3053032 - protein, 11 aa, Giardia lamblia
EQSTTTQGTGD

SEQ ID NO: 3053033 - protein, 5 aa, Giardia lamblia
EQTDL

SEQ ID NO: 3053034 - protein, 25 aa, Giardia lamblia
EQTDTEGLKQGKQRQKQPKATKSVL

SEQ ID NO: 3053035 - protein, 10 aa, Giardia lamblia
EQTESKRAKY

SEQ ID NO: 3053036 - protein, 4 aa, Giardia lamblia
EQTI

SEQ ID NO: 3053037 - protein, 7 aa, Giardia lamblia
EQTKSTM

SEQ ID NO: 3053038 - protein, 5 aa, Giardia lamblia
EQTPT

SEQ ID NO: 3053039 - protein, 4 aa, Giardia lamblia
EQTY

SEQ ID NO: 3053040 - protein, 5 aa, Giardia lamblia
EQTYD

SEQ ID NO: 3053041 - protein, 10 aa, Giardia lamblia
EQVAESDSAA

SEQ ID NO: 3053042 - protein, 4 aa, Giardia lamblia
EQVR

SEQ ID NO: 3053043 - protein, 17 aa, Giardia lamblia
EQYTQTADGDGRVRYGR

SEQ ID NO: 3053044 - protein, 12 aa, Giardia lamblia
ERAGSSHLADSS

SEQ ID NO: 3053045 - protein, 4 aa, Giardia lamblia
ERAH

SEQ ID NO: 3053046 - protein, 23 aa, Giardia lamblia
ERAPRKPGRGLPKPQLTRNSSLT

SEQ ID NO: 3053047 - protein, 13 aa, Giardia lamblia
ERATRLQSPTNPE

SEQ ID NO: 3053048 - protein, 4 aa, Giardia lamblia
ERAY

SEQ ID NO: 3053049 - protein, 5 aa, Giardia lamblia
ERCGN

SEQ ID NO: 3053050 - protein, 8 aa, Giardia lamblia
ERDAAGNT

SEQ ID NO: 3053051 - protein, 14 aa, Giardia lamblia
ERDNAGKWKSRTLP

SEQ ID NO: 3053052 - protein, 10 aa, Giardia lamblia
ERDPDAPQFA

SEQ ID NO: 3053053 - protein, 16 aa, Giardia lamblia
ERDQSAQSGESSPMTL

SEQ ID NO: 3053054 - protein, 15 aa, Giardia lamblia
EREAAKAAAKAAAVS

SEQ ID NO: 3053055 - protein, 12 aa, Giardia lamblia
EREDKTAPAEAT

SEQ ID NO: 3053056 - protein, 5 aa, Giardia lamblia
EREGE

SEQ ID NO: 3053057 - protein, 14 aa, Giardia lamblia
ERELNSSSGDARAL

SEQ ID NO: 3053058 - protein, 8 aa, Giardia lamblia
ERENGTMG

SEQ ID NO: 3053059 - protein, 5 aa, Giardia lamblia
ERGDR

SEQ ID NO: 3053060 - protein, 8 aa, Giardia lamblia
ERGDSRAY

SEQ ID NO: 3053061 - protein, 4 aa, Giardia lamblia
ERGF

SEQ ID NO: 3053062 - protein, 4 aa, Giardia lamblia
ERGG

SEQ ID NO: 3053063 - protein, 9 aa, Giardia lamblia
ERGGKVKTA

SEQ ID NO: 3053064 - protein, 5 aa, Giardia lamblia
ERGHS

SEQ ID NO: 3053065 - protein, 6 aa, Giardia lamblia
ERGHSE

SEQ ID NO: 3053066 - protein, 7 aa, Giardia lamblia
ERGSTEA

SEQ ID NO: 3053067 - protein, 10 aa, Giardia lamblia
ERGTDKTKSF

SEQ ID NO: 3053068 - protein, 5 aa, Giardia lamblia
ERGTR

SEQ ID NO: 3053069 - protein, 7 aa, Giardia lamblia
ERGTTGL

SEQ ID NO: 3053070 - protein, 18 aa, Giardia lamblia
ERIEEEDTGSEGAEDDAS

SEQ ID NO: 3053071 - protein, 7 aa, Giardia lamblia
ERKEGKK

SEQ ID NO: 3053072 - protein, 10 aa, Giardia lamblia
ERKQITDAQI

SEQ ID NO: 3053073 - protein, 9 aa, Giardia lamblia
ERKSDLKPS

SEQ ID NO: 3053074 - protein, 9 aa, Giardia lamblia
ERKTSCSDE

SEQ ID NO: 3053075 - protein, 12 aa, Giardia lamblia
ERLAKQKKHIEG

SEQ ID NO: 3053076 - protein, 5 aa, Giardia lamblia
ERLHG

SEQ ID NO: 3053077 - protein, 7 aa, Giardia lamblia
ERLSTSD

SEQ ID NO: 3053078 - protein, 4 aa, Giardia lamblia
ERLT

SEQ ID NO: 3053079 - protein, 11 aa, Giardia lamblia
ERMERREQARR

SEQ ID NO: 3053080 - protein, 7 aa, Giardia lamblia
ERNEAYA

SEQ ID NO: 3053081 - protein, 9 aa, Giardia lamblia
ERNQESSSL

SEQ ID NO: 3053082 - protein, 4 aa, Giardia lamblia
ERNR

SEQ ID NO: 3053083 - protein, 15 aa, Giardia lamblia
ERNRTRRRARESIDQ

SEQ ID NO: 3053084 - protein, 8 aa, Giardia lamblia
ERNSEKEE

SEQ ID NO: 3053085 - protein, 8 aa, Giardia lamblia
ERNSRDFS

SEQ ID NO: 3053086 - protein, 56 aa, Giardia lamblia
ERPASQASSLPASQETIGNNKVSKHTLQTSPASNTSRRFASAQSDNSTKDGHTSAY

SEQ ID NO: 3053087 - protein, 4 aa, Giardia lamblia
ERPD

SEQ ID NO: 3053088 - protein, 11 aa, Giardia lamblia
ERPLEDASSYR

SEQ ID NO: 3053089 - protein, 6 aa, Giardia lamblia
ERPPPK

SEQ ID NO: 3053090 - protein, 15 aa, Giardia lamblia
ERPSEGQSDGVPFDP

SEQ ID NO: 3053091 - protein, 6 aa, Giardia lamblia
ERQFPG

SEQ ID NO: 3053092 - protein, 19 aa, Giardia lamblia
ERQSSQAEKQRKSAQDTQL

SEQ ID NO: 3053093 - protein, 10 aa, Giardia lamblia
ERRDISDSPQ

SEQ ID NO: 3053094 - protein, 8 aa, Giardia lamblia
ERRGQPGQ

SEQ ID NO: 3053095 - protein, 7 aa, Giardia lamblia
ERRPTAR

SEQ ID NO: 3053096 - protein, 8 aa, Giardia lamblia
ERRPTARE

SEQ ID NO: 3053097 - protein, 4 aa, Giardia lamblia
ERRQ

SEQ ID NO: 3053098 - protein, 7 aa, Giardia lamblia
ERRTRGH

SEQ ID NO: 3053099 - protein, 4 aa, Giardia lamblia
ERSA

SEQ ID NO: 3053100 - protein, 5 aa, Giardia lamblia
ERSDR

SEQ ID NO: 3053101 - protein, 9 aa, Giardia lamblia
ERSGEEGAY

SEQ ID NO: 3053102 - protein, 13 aa, Giardia lamblia
ERSGKSEKPRTSN

SEQ ID NO: 3053103 - protein, 5 aa, Giardia lamblia
ERSKR

SEQ ID NO: 3053104 - protein, 8 aa, Giardia lamblia
ERSPVSDE

SEQ ID NO: 3053105 - protein, 4 aa, Giardia lamblia
ERSR

SEQ ID NO: 3053106 - protein, 8 aa, Giardia lamblia
ERSRTTME

SEQ ID NO: 3053107 - protein, 6 aa, Giardia lamblia
ERSSDP

SEQ ID NO: 3053108 - protein, 6 aa, Giardia lamblia
ERSTNL

SEQ ID NO: 3053109 - protein, 16 aa, Giardia lamblia
ERSYVSKNTTELTTEA

SEQ ID NO: 3053110 - protein, 14 aa, Giardia lamblia
ERTAQSSDKVKQAE

SEQ ID NO: 3053111 - protein, 9 aa, Giardia lamblia
ERTATNPQD

SEQ ID NO: 3053112 - protein, 10 aa, Giardia lamblia
ERTDSESTVG

SEQ ID NO: 3053113 - protein, 18 aa, Giardia lamblia
ERTEESESGISVAGIRPS

SEQ ID NO: 3053114 - protein, 5 aa, Giardia lamblia
ERTEI

SEQ ID NO: 3053115 - protein, 40 aa, Giardia lamblia
ERTKKPVFSPRRKSSVASEDDERASITKSGHLRGYSGQRH

SEQ ID NO: 3053116 - protein, 10 aa, Giardia lamblia
ERTSATTKDA

SEQ ID NO: 3053117 - protein, 6 aa, Giardia lamblia
ERTSCP

SEQ ID NO: 3053118 - protein, 8 aa, Giardia lamblia
ERTSDGRQ

SEQ ID NO: 3053119 - protein, 49 aa, Giardia lamblia
ERTSLDGDRSIRERPPSSRPSSARSRRSISHRDSSSMYDDEQDTSQAFK

SEQ ID NO: 3053120 - protein, 11 aa, Giardia lamblia
ERTTSQMNKRN

SEQ ID NO: 3053121 - protein, 17 aa, Giardia lamblia
ERVGDRAAQAERKANYG

SEQ ID NO: 3053122 - protein, 40 aa, Giardia lamblia
ERVGGRKNRKSRQHTTARQASAISRKSGASRSCCGSRASS

SEQ ID NO: 3053123 - protein, 27 aa, Giardia lamblia
ERVPQKGSKSSSSSRSKLRRQADSSVS

SEQ ID NO: 3053124 - protein, 4 aa, Giardia lamblia
ERVS

SEQ ID NO: 3053125 - protein, 8 aa, Giardia lamblia
ERVSNDDC

SEQ ID NO: 3053126 - protein, 8 aa, Giardia lamblia
ERVTSGRD

SEQ ID NO: 3053127 - protein, 12 aa, Giardia lamblia
ERYGPRQTLSAD

SEQ ID NO: 3053128 - protein, 6 aa, Giardia lamblia
ERYSQN

SEQ ID NO: 3053129 - protein, 10 aa, Giardia lamblia
ESAAKGIGRA

SEQ ID NO: 3053130 - protein, 25 aa, Giardia lamblia
ESAASKKESVCKTASSVSKSKNSIA

SEQ ID NO: 3053131 - protein, 15 aa, Giardia lamblia
ESAASQEAGSRQPRI

SEQ ID NO: 3053132 - protein, 6 aa, Giardia lamblia
ESAEEG

SEQ ID NO: 3053133 - protein, 4 aa, Giardia lamblia
ESAF

SEQ ID NO: 3053134 - protein, 7 aa, Giardia lamblia
ESAGKMM

SEQ ID NO: 3053135 - protein, 14 aa, Giardia lamblia
ESANFPSRSLSGGM

SEQ ID NO: 3053136 - protein, 4 aa, Giardia lamblia
ESAQ

SEQ ID NO: 3053137 - protein, 6 aa, Giardia lamblia
ESAQGE

SEQ ID NO: 3053138 - protein, 9 aa, Giardia lamblia
ESARSQSAM

SEQ ID NO: 3053139 - protein, 6 aa, Giardia lamblia
ESASGS

SEQ ID NO: 3053140 - protein, 7 aa, Giardia lamblia
ESASGSL

SEQ ID NO: 3053141 - protein, 5 aa, Giardia lamblia
ESASQ

SEQ ID NO: 3053142 - protein, 6 aa, Giardia lamblia
ESASRS

SEQ ID NO: 3053143 - protein, 9 aa, Giardia lamblia
ESASSAQNK

SEQ ID NO: 3053144 - protein, 16 aa, Giardia lamblia
ESAVPSPSSPQTDSEI

SEQ ID NO: 3053145 - protein, 6 aa, Giardia lamblia
ESAYKT

SEQ ID NO: 3053146 - protein, 4 aa, Giardia lamblia
ESCS

SEQ ID NO: 3053147 - protein, 5 aa, Giardia lamblia
ESCSW

SEQ ID NO: 3053148 - protein, 14 aa, Giardia lamblia
ESCTQGSPSTCKSC

SEQ ID NO: 3053149 - protein, 6 aa, Giardia lamblia
ESDAKY

SEQ ID NO: 3053150 - protein, 6 aa, Giardia lamblia
ESDDSM

SEQ ID NO: 3053151 - protein, 8 aa, Giardia lamblia
ESDENIAN

SEQ ID NO: 3053152 - protein, 19 aa, Giardia lamblia
ESDPDSSNQSATQPQQLTA

SEQ ID NO: 3053153 - protein, 12 aa, Giardia lamblia
ESDQHEGTLSSK

SEQ ID NO: 3053154 - protein, 14 aa, Giardia lamblia
ESDQSASTDDASDI

SEQ ID NO: 3053155 - protein, 9 aa, Giardia lamblia
ESDSETDKE

SEQ ID NO: 3053156 - protein, 9 aa, Giardia lamblia
ESDSQATGN

SEQ ID NO: 3053157 - protein, 6 aa, Giardia lamblia
ESDTAL

SEQ ID NO: 3053158 - protein, 9 aa, Giardia lamblia
ESDVDSGGS

SEQ ID NO: 3053159 - protein, 5 aa, Giardia lamblia
ESEDW

SEQ ID NO: 3053160 - protein, 11 aa, Giardia lamblia
ESEELESRASS

SEQ ID NO: 3053161 - protein, 12 aa, Giardia lamblia
ESEGIRSRNERY

SEQ ID NO: 3053162 - protein, 11 aa, Giardia lamblia
ESEHARQQSRL

SEQ ID NO: 3053163 - protein, 11 aa, Giardia lamblia
ESELRQVTAAT

SEQ ID NO: 3053164 - protein, 11 aa, Giardia lamblia
ESEPKNHPTEQ

SEQ ID NO: 3053165 - protein, 15 aa, Giardia lamblia
ESEQAVDAEPFEPPE

SEQ ID NO: 3053166 - protein, 8 aa, Giardia lamblia
ESESADIR

SEQ ID NO: 3053167 - protein, 6 aa, Giardia lamblia
ESESCS

SEQ ID NO: 3053168 - protein, 10 aa, Giardia lamblia
ESESEKRTKI

SEQ ID NO: 3053169 - protein, 19 aa, Giardia lamblia
ESETNMQESTAVPPSAISE

SEQ ID NO: 3053170 - protein, 13 aa, Giardia lamblia
ESGGGESSAELRE

SEQ ID NO: 3053171 - protein, 8 aa, Giardia lamblia
ESGMTDVN

SEQ ID NO: 3053172 - protein, 9 aa, Giardia lamblia
ESGPGNTCN

SEQ ID NO: 3053173 - protein, 22 aa, Giardia lamblia
ESGQICSGKGECVPDVGSTGRD

SEQ ID NO: 3053174 - protein, 5 aa, Giardia lamblia
ESGYK

SEQ ID NO: 3053175 - protein, 5 aa, Giardia lamblia
ESHPN

SEQ ID NO: 3053176 - protein, 6 aa, Giardia lamblia
ESIESR

SEQ ID NO: 3053177 - protein, 7 aa, Giardia lamblia
ESISEST

SEQ ID NO: 3053178 - protein, 5 aa, Giardia lamblia
ESIYS

SEQ ID NO: 3053179 - protein, 7 aa, Giardia lamblia
ESKENIE

SEQ ID NO: 3053180 - protein, 7 aa, Giardia lamblia
ESKGVPN

SEQ ID NO: 3053181 - protein, 11 aa, Giardia lamblia
ESKNASKSSVV

SEQ ID NO: 3053182 - protein, 8 aa, Giardia lamblia
ESKPTESD

SEQ ID NO: 3053183 - protein, 4 aa, Giardia lamblia
ESKQ

SEQ ID NO: 3053184 - protein, 7 aa, Giardia lamblia
ESKQGRN

SEQ ID NO: 3053185 - protein, 9 aa, Giardia lamblia
ESKSIPDNA

SEQ ID NO: 3053186 - protein, 20 aa, Giardia lamblia
ESKSVSADIEAKEKQAITTR

SEQ ID NO: 3053187 - protein, 15 aa, Giardia lamblia
ESKTHADKEQSPGGN

SEQ ID NO: 3053188 - protein, 13 aa, Giardia lamblia
ESLGGDQSAAKAK

SEQ ID NO: 3053189 - protein, 13 aa, Giardia lamblia
ESLNSGTTLSNSA

SEQ ID NO: 3053190 - protein, 4 aa, Giardia lamblia
ESLP

SEQ ID NO: 3053191 - protein, 6 aa, Giardia lamblia
ESLPSH

SEQ ID NO: 3053192 - protein, 8 aa, Giardia lamblia
ESLREGLE

SEQ ID NO: 3053193 - protein, 10 aa, Giardia lamblia
ESLTGTAKPS

SEQ ID NO: 3053194 - protein, 17 aa, Giardia lamblia
ESMRSQSKQHDTLEGDN

SEQ ID NO: 3053195 - protein, 7 aa, Giardia lamblia
ESNEGFA

SEQ ID NO: 3053196 - protein, 8 aa, Giardia lamblia
ESNENNNL

SEQ ID NO: 3053197 - protein, 6 aa, Giardia lamblia
ESNERG

SEQ ID NO: 3053198 - protein, 6 aa, Giardia lamblia
ESNGEI

SEQ ID NO: 3053199 - protein, 6 aa, Giardia lamblia
ESNGNK

SEQ ID NO: 3053200 - protein, 6 aa, Giardia lamblia
ESNGVP

SEQ ID NO: 3053201 - protein, 4 aa, Giardia lamblia
ESNI

SEQ ID NO: 3053202 - protein, 5 aa, Giardia lamblia
ESNID

SEQ ID NO: 3053203 - protein, 4 aa, Giardia lamblia
ESNL

SEQ ID NO: 3053204 - protein, 10 aa, Giardia lamblia
ESNLRNPKGV

SEQ ID NO: 3053205 - protein, 5 aa, Giardia lamblia
ESNPK

SEQ ID NO: 3053206 - protein, 5 aa, Giardia lamblia
ESNRL

SEQ ID NO: 3053207 - protein, 11 aa, Giardia lamblia
ESPASPTTSSL

SEQ ID NO: 3053208 - protein, 8 aa, Giardia lamblia
ESPDERSL

SEQ ID NO: 3053209 - protein, 5 aa, Giardia lamblia
ESPKH

SEQ ID NO: 3053210 - protein, 7 aa, Giardia lamblia
ESPLRPS

SEQ ID NO: 3053211 - protein, 11 aa, Giardia lamblia
ESPQGQQATLN

SEQ ID NO: 3053212 - protein, 19 aa, Giardia lamblia
ESPQLPDIAESTSQGSAVD

SEQ ID NO: 3053213 - protein, 18 aa, Giardia lamblia
ESPSETEPEVKKRAETTS

SEQ ID NO: 3053214 - protein, 31 aa, Giardia lamblia
ESPSRKQPTETPVAHGRSNKSAIGNNTPMAP

SEQ ID NO: 3053215 - protein, 10 aa, Giardia lamblia
ESPSSNYACP

SEQ ID NO: 3053216 - protein, 7 aa, Giardia lamblia
ESPSTQV

SEQ ID NO: 3053217 - protein, 8 aa, Giardia lamblia
ESPTERPV

SEQ ID NO: 3053218 - protein, 13 aa, Giardia lamblia
ESPTQELTASSPP

SEQ ID NO: 3053219 - protein, 6 aa, Giardia lamblia
ESPTTD

SEQ ID NO: 3053220 - protein, 22 aa, Giardia lamblia
ESPYGTAKRSLDQRHKTSAASL

SEQ ID NO: 3053221 - protein, 5 aa, Giardia lamblia
ESQEE

SEQ ID NO: 3053222 - protein, 14 aa, Giardia lamblia
ESQPDDKSKKAKAL

SEQ ID NO: 3053223 - protein, 8 aa, Giardia lamblia
ESQPIQAE

SEQ ID NO: 3053224 - protein, 14 aa, Giardia lamblia
ESQRNDAPHESPEE

SEQ ID NO: 3053225 - protein, 4 aa, Giardia lamblia
ESRC

SEQ ID NO: 3053226 - protein, 5 aa, Giardia lamblia
ESRDA

SEQ ID NO: 3053227 - protein, 7 aa, Giardia lamblia
ESRPQDD

SEQ ID NO: 3053228 - protein, 15 aa, Giardia lamblia
ESRPSSTDRSAHSEG

SEQ ID NO: 3053229 - protein, 4 aa, Giardia lamblia
ESRT

SEQ ID NO: 3053230 - protein, 7 aa, Giardia lamblia
ESSAGVL

SEQ ID NO: 3053231 - protein, 5 aa, Giardia lamblia
ESSAT

SEQ ID NO: 3053232 - protein, 4 aa, Giardia lamblia
ESSD

SEQ ID NO: 3053233 - protein, 10 aa, Giardia lamblia
ESSKKAHELD

SEQ ID NO: 3053234 - protein, 10 aa, Giardia lamblia
ESSKKGYGAY

SEQ ID NO: 3053235 - protein, 7 aa, Giardia lamblia
ESSLDTG

SEQ ID NO: 3053236 - protein, 7 aa, Giardia lamblia
ESSMSSA

SEQ ID NO: 3053237 - protein, 4 aa, Giardia lamblia
ESSQ

SEQ ID NO: 3053238 - protein, 7 aa, Giardia lamblia
ESSQPRM

SEQ ID NO: 3053239 - protein, 8 aa, Giardia lamblia
ESSSEPKI

SEQ ID NO: 3053240 - protein, 9 aa, Giardia lamblia
ESSSSADKS

SEQ ID NO: 3053241 - protein, 16 aa, Giardia lamblia
ESSSSSMLPDSVKTRD

SEQ ID NO: 3053242 - protein, 9 aa, Giardia lamblia
ESSTLKKSS

SEQ ID NO: 3053243 - protein, 7 aa, Giardia lamblia
ESSYTSL

SEQ ID NO: 3053244 - protein, 6 aa, Giardia lamblia
ESTDNQ

SEQ ID NO: 3053245 - protein, 10 aa, Giardia lamblia
ESTKRAETHT

SEQ ID NO: 3053246 - protein, 5 aa, Giardia lamblia
ESTLD

SEQ ID NO: 3053247 - protein, 6 aa, Giardia lamblia
ESTLES

SEQ ID NO: 3053248 - protein, 7 aa, Giardia lamblia
ESTSQTV

SEQ ID NO: 3053249 - protein, 8 aa, Giardia lamblia
ESTSYTAK

SEQ ID NO: 3053250 - protein, 7 aa, Giardia lamblia
ESTTPIS

SEQ ID NO: 3053251 - protein, 8 aa, Giardia lamblia
ESVGAPDD

SEQ ID NO: 3053252 - protein, 6 aa, Giardia lamblia
ESVGTT

SEQ ID NO: 3053253 - protein, 7 aa, Giardia lamblia
ESVHPRK

SEQ ID NO: 3053254 - protein, 9 aa, Giardia lamblia
ESVNTPEHE

SEQ ID NO: 3053255 - protein, 12 aa, Giardia lamblia
ESVQKANAQNIS

SEQ ID NO: 3053256 - protein, 10 aa, Giardia lamblia
ESVSSSPASA

SEQ ID NO: 3053257 - protein, 12 aa, Giardia lamblia
ESVTGSKLPAGH

SEQ ID NO: 3053258 - protein, 7 aa, Giardia lamblia
ESWNDRG

SEQ ID NO: 3053259 - protein, 6 aa, Giardia lamblia
ESYNGA

SEQ ID NO: 3053260 - protein, 4 aa, Giardia lamblia
ESYP

SEQ ID NO: 3053261 - protein, 10 aa, Giardia lamblia
ESYYKETTDY

SEQ ID NO: 3053262 - protein, 4 aa, Giardia lamblia
ETAH

SEQ ID NO: 3053263 - protein, 20 aa, Giardia lamblia
ETAHKNGLYNPTTSIASESH

SEQ ID NO: 3053264 - protein, 5 aa, Giardia lamblia
ETANP

SEQ ID NO: 3053265 - protein, 10 aa, Giardia lamblia
ETAQDGSFSA

SEQ ID NO: 3053266 - protein, 11 aa, Giardia lamblia
ETAQKAPFTKT

SEQ ID NO: 3053267 - protein, 5 aa, Giardia lamblia
ETASA

SEQ ID NO: 3053268 - protein, 13 aa, Giardia lamblia
ETASDTDASYKTS

SEQ ID NO: 3053269 - protein, 4 aa, Giardia lamblia
ETAV

SEQ ID NO: 3053270 - protein, 4 aa, Giardia lamblia
ETCD

SEQ ID NO: 3053271 - protein, 10 aa, Giardia lamblia
ETCDTTTAEE

SEQ ID NO: 3053272 - protein, 12 aa, Giardia lamblia
ETCTGSAEPNGC

SEQ ID NO: 3053273 - protein, 9 aa, Giardia lamblia
ETDDDGTVR

SEQ ID NO: 3053274 - protein, 5 aa, Giardia lamblia
ETDGY

SEQ ID NO: 3053275 - protein, 7 aa, Giardia lamblia
ETDIGDN

SEQ ID NO: 3053276 - protein, 11 aa, Giardia lamblia
ETEEDLEKRDK

SEQ ID NO: 3053277 - protein, 8 aa, Giardia lamblia
ETEEGLQR

SEQ ID NO: 3053278 - protein, 21 aa, Giardia lamblia
ETEESQNCQNSNSNSNSNSKS

SEQ ID NO: 3053279 - protein, 4 aa, Giardia lamblia
ETEL

SEQ ID NO: 3053280 - protein, 13 aa, Giardia lamblia
ETEMKPQQLGGPS

SEQ ID NO: 3053281 - protein, 4 aa, Giardia lamblia
ETEN

SEQ ID NO: 3053282 - protein, 7 aa, Giardia lamblia
ETESAAK

SEQ ID NO: 3053283 - protein, 6 aa, Giardia lamblia
ETETEY

SEQ ID NO: 3053284 - protein, 4 aa, Giardia lamblia
ETEV

SEQ ID NO: 3053285 - protein, 18 aa, Giardia lamblia
ETEVEEAAEAEAEAERDT

SEQ ID NO: 3053286 - protein, 7 aa, Giardia lamblia
ETEYDTP

SEQ ID NO: 3053287 - protein, 7 aa, Giardia lamblia
ETFAGRP

SEQ ID NO: 3053288 - protein, 7 aa, Giardia lamblia
ETFNNGN

SEQ ID NO: 3053289 - protein, 7 aa, Giardia lamblia
ETGAESM

SEQ ID NO: 3053290 - protein, 11 aa, Giardia lamblia
ETGAVSHPSID

SEQ ID NO: 3053291 - protein, 12 aa, Giardia lamblia
ETGERKSPAGKH

SEQ ID NO: 3053292 - protein, 32 aa, Giardia lamblia
ETGHSRRTEQPPAQTRTQTGLPSRANLSNSIP

SEQ ID NO: 3053293 - protein, 7 aa, Giardia lamblia
ETGIKDS

SEQ ID NO: 3053294 - protein, 7 aa, Giardia lamblia
ETGKDTG

SEQ ID NO: 3053295 - protein, 5 aa, Giardia lamblia
ETGKE

SEQ ID NO: 3053296 - protein, 6 aa, Giardia lamblia
ETGLKA

SEQ ID NO: 3053297 - protein, 7 aa, Giardia lamblia
ETGNSEA

SEQ ID NO: 3053298 - protein, 6 aa, Giardia lamblia
ETGQDK

SEQ ID NO: 3053299 - protein, 6 aa, Giardia lamblia
ETGRSD

SEQ ID NO: 3053300 - protein, 9 aa, Giardia lamblia
ETGSEARHM

SEQ ID NO: 3053301 - protein, 5 aa, Giardia lamblia
ETGTN

SEQ ID NO: 3053302 - protein, 5 aa, Giardia lamblia
ETHRT

SEQ ID NO: 3053303 - protein, 10 aa, Giardia lamblia
ETINTSSDDS

SEQ ID NO: 3053304 - protein, 38 aa, Giardia lamblia
ETIRQSDSSAASNTQSYESGRDWSRSTTSTNSDSFVSS

SEQ ID NO: 3053305 - protein, 8 aa, Giardia lamblia
ETKETSCH

SEQ ID NO: 3053306 - protein, 9 aa, Giardia lamblia
ETKGLGKRK

SEQ ID NO: 3053307 - protein, 12 aa, Giardia lamblia
ETKRQAANATVD

SEQ ID NO: 3053308 - protein, 15 aa, Giardia lamblia
ETKSQKTMGSAERSL

SEQ ID NO: 3053309 - protein, 15 aa, Giardia lamblia
ETLAREKKKRLETAE

SEQ ID NO: 3053310 - protein, 13 aa, Giardia lamblia
ETLEAKKKEVVED

SEQ ID NO: 3053311 - protein, 12 aa, Giardia lamblia
ETLLPDGSHSIS

SEQ ID NO: 3053312 - protein, 17 aa, Giardia lamblia
ETLRGQSKDKSECSQGE

SEQ ID NO: 3053313 - protein, 6 aa, Giardia lamblia
ETLSAS

SEQ ID NO: 3053314 - protein, 6 aa, Giardia lamblia
ETNGGV

SEQ ID NO: 3053315 - protein, 9 aa, Giardia lamblia
ETNNQDTHW

SEQ ID NO: 3053316 - protein, 5 aa, Giardia lamblia
ETNPI

SEQ ID NO: 3053317 - protein, 5 aa, Giardia lamblia
ETNQD

SEQ ID NO: 3053318 - protein, 6 aa, Giardia lamblia
ETNQNA

SEQ ID NO: 3053319 - protein, 15 aa, Giardia lamblia
ETNQPQEDCSTDRRV

SEQ ID NO: 3053320 - protein, 5 aa, Giardia lamblia
ETPAS

SEQ ID NO: 3053321 - protein, 5 aa, Giardia lamblia
ETPEQ

SEQ ID NO: 3053322 - protein, 21 aa, Giardia lamblia
ETPGGNQIAPNRETEEKDPVD

SEQ ID NO: 3053323 - protein, 5 aa, Giardia lamblia
ETPKH

SEQ ID NO: 3053324 - protein, 9 aa, Giardia lamblia
ETPKKQPNS

SEQ ID NO: 3053325 - protein, 4 aa, Giardia lamblia
ETPL

SEQ ID NO: 3053326 - protein, 6 aa, Giardia lamblia
ETPPVS

SEQ ID NO: 3053327 - protein, 10 aa, Giardia lamblia
ETPQGQESIP

SEQ ID NO: 3053328 - protein, 13 aa, Giardia lamblia
ETPSSLISNTGKE

SEQ ID NO: 3053329 - protein, 14 aa, Giardia lamblia
ETPVEHPKDSEGYK

SEQ ID NO: 3053330 - protein, 7 aa, Giardia lamblia
ETQRTSV

SEQ ID NO: 3053331 - protein, 8 aa, Giardia lamblia
ETRGGTNE

SEQ ID NO: 3053332 - protein, 12 aa, Giardia lamblia
ETRGLTEANGSH

SEQ ID NO: 3053333 - protein, 4 aa, Giardia lamblia
ETRP

SEQ ID NO: 3053334 - protein, 8 aa, Giardia lamblia
ETRPYGPH

SEQ ID NO: 3053335 - protein, 5 aa, Giardia lamblia
ETRYP

SEQ ID NO: 3053336 - protein, 6 aa, Giardia lamblia
ETSDEK

SEQ ID NO: 3053337 - protein, 9 aa, Giardia lamblia
ETSDGYQGL

SEQ ID NO: 3053338 - protein, 10 aa, Giardia lamblia
ETSDPCSNSI

SEQ ID NO: 3053339 - protein, 11 aa, Giardia lamblia
ETSDQKEVSEV

SEQ ID NO: 3053340 - protein, 13 aa, Giardia lamblia
ETSERITDKPESR

SEQ ID NO: 3053341 - protein, 6 aa, Giardia lamblia
ETSEYV

SEQ ID NO: 3053342 - protein, 5 aa, Giardia lamblia
ETSGL

SEQ ID NO: 3053343 - protein, 6 aa, Giardia lamblia
ETSHAS

SEQ ID NO: 3053344 - protein, 13 aa, Giardia lamblia
ETSIDGGGGDQSI

SEQ ID NO: 3053345 - protein, 9 aa, Giardia lamblia
ETSKLPGRD

SEQ ID NO: 3053346 - protein, 9 aa, Giardia lamblia
ETSKYKSNR

SEQ ID NO: 3053347 - protein, 7 aa, Giardia lamblia
ETSPASD

SEQ ID NO: 3053348 - protein, 12 aa, Giardia lamblia
ETSPVKSRKQKK

SEQ ID NO: 3053349 - protein, 9 aa, Giardia lamblia
ETSSSPRTV

SEQ ID NO: 3053350 - protein, 4 aa, Giardia lamblia
ETST

SEQ ID NO: 3053351 - protein, 5 aa, Giardia lamblia
ETTAT

SEQ ID NO: 3053352 - protein, 20 aa, Giardia lamblia
ETTMEYSDTTATSPELDGGI

SEQ ID NO: 3053353 - protein, 7 aa, Giardia lamblia
ETTNSYG

SEQ ID NO: 3053354 - protein, 16 aa, Giardia lamblia
ETTPTNSKKASDNTLD

SEQ ID NO: 3053355 - protein, 8 aa, Giardia lamblia
ETTSSYPS

SEQ ID NO: 3053356 - protein, 10 aa, Giardia lamblia
ETTTATSEEI

SEQ ID NO: 3053357 - protein, 5 aa, Giardia lamblia
ETTVQ

SEQ ID NO: 3053358 - protein, 6 aa, Giardia lamblia
ETVDTD

SEQ ID NO: 3053359 - protein, 11 aa, Giardia lamblia
ETVSEDRHGKK

SEQ ID NO: 3053360 - protein, 8 aa, Giardia lamblia
ETVTGTNC

SEQ ID NO: 3053361 - protein, 5 aa, Giardia lamblia
ETYPE

SEQ ID NO: 3053362 - protein, 6 aa, Giardia lamblia
EVAQSG

SEQ ID NO: 3053363 - protein, 12 aa, Giardia lamblia
EVCNRQSDKSLD

SEQ ID NO: 3053364 - protein, 12 aa, Giardia lamblia
EVDRAEKALPPT

SEQ ID NO: 3053365 - protein, 17 aa, Giardia lamblia
EVEEKCPNGSEYHPNQS

SEQ ID NO: 3053366 - protein, 12 aa, Giardia lamblia
EVEHPSESNFTS

SEQ ID NO: 3053367 - protein, 5 aa, Giardia lamblia
EVEKS

SEQ ID NO: 3053368 - protein, 7 aa, Giardia lamblia
EVEVDSE

SEQ ID NO: 3053369 - protein, 8 aa, Giardia lamblia
EVGDSRPL

SEQ ID NO: 3053370 - protein, 12 aa, Giardia lamblia
EVGEGKDASDVS

SEQ ID NO: 3053371 - protein, 23 aa, Giardia lamblia
EVGVGSDRHDSTPISSRDNVYEE

SEQ ID NO: 3053372 - protein, 13 aa, Giardia lamblia
EVKARRKTSNQSP

SEQ ID NO: 3053373 - protein, 26 aa, Giardia lamblia
EVLQPKPSGSTSQAKHQQPRQDVTRS

SEQ ID NO: 3053374 - protein, 36 aa, Giardia lamblia
EVNAPSKPGNAAKDPGPARSPAAPAPAPAKNASSTP

SEQ ID NO: 3053375 - protein, 9 aa, Giardia lamblia
EVPAGSGTG

SEQ ID NO: 3053376 - protein, 5 aa, Giardia lamblia
EVPEE

SEQ ID NO: 3053377 - protein, 5 aa, Giardia lamblia
EVPKD

SEQ ID NO: 3053378 - protein, 4 aa, Giardia lamblia
EVPS

SEQ ID NO: 3053379 - protein, 7 aa, Giardia lamblia
EVPYPQI

SEQ ID NO: 3053380 - protein, 7 aa, Giardia lamblia
EVSAEHP

SEQ ID NO: 3053381 - protein, 16 aa, Giardia lamblia
EVSSTHSNSIKTIKDP

SEQ ID NO: 3053382 - protein, 5 aa, Giardia lamblia
EVTAE

SEQ ID NO: 3053383 - protein, 7 aa, Giardia lamblia
EVTEYEQ

SEQ ID NO: 3053384 - protein, 6 aa, Giardia lamblia
EVTNPR

SEQ ID NO: 3053385 - protein, 7 aa, Giardia lamblia
EVTPAGQ

SEQ ID NO: 3053386 - protein, 5 aa, Giardia lamblia
EWQGK

SEQ ID NO: 3053387 - protein, 6 aa, Giardia lamblia
EYAANR

SEQ ID NO: 3053388 - protein, 5 aa, Giardia lamblia
EYAKD

SEQ ID NO: 3053389 - protein, 8 aa, Giardia lamblia
EYASESRA

SEQ ID NO: 3053390 - protein, 14 aa, Giardia lamblia
EYATATTNLPPSNG

SEQ ID NO: 3053391 - protein, 4 aa, Giardia lamblia
EYDR

SEQ ID NO: 3053392 - protein, 12 aa, Giardia lamblia
EYEESSKRNRLQ

SEQ ID NO: 3053393 - protein, 15 aa, Giardia lamblia
EYEPASFQANPGEID

SEQ ID NO: 3053394 - protein, 5 aa, Giardia lamblia
EYFPG

SEQ ID NO: 3053395 - protein, 25 aa, Giardia lamblia
EYGATDESDSGTSLDGSSDVPPRLA

SEQ ID NO: 3053396 - protein, 4 aa, Giardia lamblia
EYGD

SEQ ID NO: 3053397 - protein, 9 aa, Giardia lamblia
EYGDDSRGI

SEQ ID NO: 3053398 - protein, 5 aa, Giardia lamblia
EYGIE

SEQ ID NO: 3053399 - protein, 8 aa, Giardia lamblia
EYGKATEE

SEQ ID NO: 3053400 - protein, 5 aa, Giardia lamblia
EYKEG

SEQ ID NO: 3053401 - protein, 5 aa, Giardia lamblia
EYKNK

SEQ ID NO: 3053402 - protein, 7 aa, Giardia lamblia
EYKTHNS

SEQ ID NO: 3053403 - protein, 11 aa, Giardia lamblia
EYMEPSATGAR

SEQ ID NO: 3053404 - protein, 8 aa, Giardia lamblia
EYPEGGET

SEQ ID NO: 3053405 - protein, 14 aa, Giardia lamblia
EYPHSDSHLSSREH

SEQ ID NO: 3053406 - protein, 4 aa, Giardia lamblia
EYPS

SEQ ID NO: 3053407 - protein, 6 aa, Giardia lamblia
EYPSLE

SEQ ID NO: 3053408 - protein, 7 aa, Giardia lamblia
EYPTENA

SEQ ID NO: 3053409 - protein, 27 aa, Giardia lamblia
EYQAKKATFEADRERRMREAEEKGEKF

SEQ ID NO: 3053410 - protein, 5 aa, Giardia lamblia
EYRDG

SEQ ID NO: 3053411 - protein, 4 aa, Giardia lamblia
EYRY

SEQ ID NO: 3053412 - protein, 14 aa, Giardia lamblia
EYSAPGSNECTTCP

SEQ ID NO: 3053413 - protein, 6 aa, Giardia lamblia
EYSPAG

SEQ ID NO: 3053414 - protein, 4 aa, Giardia lamblia
EYTA

SEQ ID NO: 3053415 - protein, 16 aa, Giardia lamblia
EYTDAQMQQRPRSPSI

SEQ ID NO: 3053416 - protein, 4 aa, Giardia lamblia
EYTG

SEQ ID NO: 3053417 - protein, 8 aa, Giardia lamblia
EYTPDQPL

SEQ ID NO: 3053418 - protein, 7 aa, Giardia lamblia
EYTQETR

SEQ ID NO: 3053419 - protein, 15 aa, Giardia lamblia
EYTSPGSAAPRKPRS

SEQ ID NO: 3053420 - protein, 4 aa, Giardia lamblia
EYVA

SEQ ID NO: 3053421 - protein, 18 aa, Giardia lamblia
FADKDQKTPEDDDNSKTL

SEQ ID NO: 3053422 - protein, 12 aa, Giardia lamblia
FADTNEDSEHTV

SEQ ID NO: 3053423 - protein, 4 aa, Giardia lamblia
FAET

SEQ ID NO: 3053424 - protein, 6 aa, Giardia lamblia
FAGGNL

SEQ ID NO: 3053425 - protein, 10 aa, Giardia lamblia
FAGPGENSMK

SEQ ID NO: 3053426 - protein, 9 aa, Giardia lamblia
FAGTTDGDA

SEQ ID NO: 3053427 - protein, 4 aa, Giardia lamblia
FAHD

SEQ ID NO: 3053428 - protein, 11 aa, Giardia lamblia
FANSTPPNLPC

SEQ ID NO: 3053429 - protein, 5 aa, Giardia lamblia
FANSV

SEQ ID NO: 3053430 - protein, 4 aa, Giardia lamblia
FAPE

SEQ ID NO: 3053431 - protein, 9 aa, Giardia lamblia
FAPESPKQY

SEQ ID NO: 3053432 - protein, 6 aa, Giardia lamblia
FAPPTK

SEQ ID NO: 3053433 - protein, 37 aa, Giardia lamblia
FAQGENDEKEEPEEELEEEEEDEEDTKDNPNEERGSR

SEQ ID NO: 3053434 - protein, 14 aa, Giardia lamblia
FASETIRQKNNIAE

SEQ ID NO: 3053435 - protein, 4 aa, Giardia lamblia
FASK

SEQ ID NO: 3053436 - protein, 10 aa, Giardia lamblia
FASQSALSDF

SEQ ID NO: 3053437 - protein, 7 aa, Giardia lamblia
FASTEQQ

SEQ ID NO: 3053438 - protein, 5 aa, Giardia lamblia
FATTS

SEQ ID NO: 3053439 - protein, 16 aa, Giardia lamblia
FDDGSGTYSSEGPSVE

SEQ ID NO: 3053440 - protein, 4 aa, Giardia lamblia
FDDI

SEQ ID NO: 3053441 - protein, 9 aa, Giardia lamblia
FDDPNSTSR

SEQ ID NO: 3053442 - protein, 4 aa, Giardia lamblia
FDDT

SEQ ID NO: 3053443 - protein, 12 aa, Giardia lamblia
FDEDGDEDNGLR

SEQ ID NO: 3053444 - protein, 5 aa, Giardia lamblia
FDERT

SEQ ID NO: 3053445 - protein, 6 aa, Giardia lamblia
FDESDL

SEQ ID NO: 3053446 - protein, 4 aa, Giardia lamblia
FDGS

SEQ ID NO: 3053447 - protein, 4 aa, Giardia lamblia
FDKA

SEQ ID NO: 3053448 - protein, 8 aa, Giardia lamblia
FDKTNPDF

SEQ ID NO: 3053449 - protein, 8 aa, Giardia lamblia
FDNAPGGC

SEQ ID NO: 3053450 - protein, 9 aa, Giardia lamblia
FDPATIPPV

SEQ ID NO: 3053451 - protein, 8 aa, Giardia lamblia
FDPPNGTC

SEQ ID NO: 3053452 - protein, 11 aa, Giardia lamblia
FDPPNGTCSTC

SEQ ID NO: 3053453 - protein, 9 aa, Giardia lamblia
FDPTSTEKT

SEQ ID NO: 3053454 - protein, 10 aa, Giardia lamblia
FDRPSQSTIL

SEQ ID NO: 3053455 - protein, 5 aa, Giardia lamblia
FDSHR

SEQ ID NO: 3053456 - protein, 13 aa, Giardia lamblia
FDSQKKEKPDDPV

SEQ ID NO: 3053457 - protein, 16 aa, Giardia lamblia
FDSQTDAIKDKPAAEL

SEQ ID NO: 3053458 - protein, 18 aa, Giardia lamblia
FDSSNNGSHGPSTGLSSD

SEQ ID NO: 3053459 - protein, 4 aa, Giardia lamblia
FDTP

SEQ ID NO: 3053460 - protein, 6 aa, Giardia lamblia
FEEEAA

SEQ ID NO: 3053461 - protein, 5 aa, Giardia lamblia
FEGTD

SEQ ID NO: 3053462 - protein, 21 aa, Giardia lamblia
FEKQGSGTSGGQTVPSSDKEI

SEQ ID NO: 3053463 - protein, 9 aa, Giardia lamblia
FEKQNNEKI

SEQ ID NO: 3053464 - protein, 21 aa, Giardia lamblia
FEPSPRKSNPDGSSPDTSPLS

SEQ ID NO: 3053465 - protein, 9 aa, Giardia lamblia
FEPSSDSEV

SEQ ID NO: 3053466 - protein, 10 aa, Giardia lamblia
FERPPSADAT

SEQ ID NO: 3053467 - protein, 21 aa, Giardia lamblia
FESGDHSAPSTRVSRAATDIE

SEQ ID NO: 3053468 - protein, 4 aa, Giardia lamblia
FESK

SEQ ID NO: 3053469 - protein, 7 aa, Giardia lamblia
FESRTYT

SEQ ID NO: 3053470 - protein, 12 aa, Giardia lamblia
FESTSDDLEDSM

SEQ ID NO: 3053471 - protein, 10 aa, Giardia lamblia
FETEPTAAFS

SEQ ID NO: 3053472 - protein, 6 aa, Giardia lamblia
FETNAG

SEQ ID NO: 3053473 - protein, 10 aa, Giardia lamblia
FGAPKNEGVT

SEQ ID NO: 3053474 - protein, 6 aa, Giardia lamblia
FGEPEW

SEQ ID NO: 3053475 - protein, 7 aa, Giardia lamblia
FGERDTT

SEQ ID NO: 3053476 - protein, 5 aa, Giardia lamblia
FGGNT

SEQ ID NO: 3053477 - protein, 9 aa, Giardia lamblia
FGGSPGANI

SEQ ID NO: 3053478 - protein, 20 aa, Giardia lamblia
FGGSPGSTVCPKPTSTTGSV

SEQ ID NO: 3053479 - protein, 7 aa, Giardia lamblia
FGKTKDA

SEQ ID NO: 3053480 - protein, 9 aa, Giardia lamblia
FGNDAPIAG

SEQ ID NO: 3053481 - protein, 9 aa, Giardia lamblia
FGPDTGADL

SEQ ID NO: 3053482 - protein, 19 aa, Giardia lamblia
FGPEPGSVDDTPTSSGAQL

SEQ ID NO: 3053483 - protein, 7 aa, Giardia lamblia
FGPEVTE

SEQ ID NO: 3053484 - protein, 10 aa, Giardia lamblia
FGPQASNSAV

SEQ ID NO: 3053485 - protein, 15 aa, Giardia lamblia
FGPTKSTDAAADERV

SEQ ID NO: 3053486 - protein, 7 aa, Giardia lamblia
FGQTRTK

SEQ ID NO: 3053487 - protein, 10 aa, Giardia lamblia
FGSGASSLGS

SEQ ID NO: 3053488 - protein, 11 aa, Giardia lamblia
FGSGEKASKNK

SEQ ID NO: 3053489 - protein, 18 aa, Giardia lamblia
FGSPKGDDALLDNGSGEF

SEQ ID NO: 3053490 - protein, 8 aa, Giardia lamblia
FGSPSRNL

SEQ ID NO: 3053491 - protein, 10 aa, Giardia lamblia
FGSSGTKMSK

SEQ ID NO: 3053492 - protein, 31 aa, Giardia lamblia
FGSSPSHPKNTDSPNSKCVDNDAETQDSNMS

SEQ ID NO: 3053493 - protein, 11 aa, Giardia lamblia
FGSSSTSDVDA

SEQ ID NO: 3053494 - protein, 5 aa, Giardia lamblia
FGSSV

SEQ ID NO: 3053495 - protein, 9 aa, Giardia lamblia
FGSTQFGGS

SEQ ID NO: 3053496 - protein, 16 aa, Giardia lamblia
FGTAQGSTAVEPPVPT

SEQ ID NO: 3053497 - protein, 13 aa, Giardia lamblia
FGTESGAATPENI

SEQ ID NO: 3053498 - protein, 12 aa, Giardia lamblia
FGTGGSGSSLSD

SEQ ID NO: 3053499 - protein, 5 aa, Giardia lamblia
FGTTR

SEQ ID NO: 3053500 - protein, 8 aa, Giardia lamblia
FGTTSSEK

SEQ ID NO: 3053501 - protein, 15 aa, Giardia lamblia
FHPDSNRGYGIQSPM

SEQ ID NO: 3053502 - protein, 7 aa, Giardia lamblia
FHSPTDA

SEQ ID NO: 3053503 - protein, 7 aa, Giardia lamblia
FKAPNPR

SEQ ID NO: 3053504 - protein, 26 aa, Giardia lamblia
FKDNSGNNYCTTKSSVAAASDSPIDR

SEQ ID NO: 3053505 - protein, 4 aa, Giardia lamblia
FKDP

SEQ ID NO: 3053506 - protein, 4 aa, Giardia lamblia
FKES

SEQ ID NO: 3053507 - protein, 9 aa, Giardia lamblia
FKESKGSAF

SEQ ID NO: 3053508 - protein, 4 aa, Giardia lamblia
FKGA

SEQ ID NO: 3053509 - protein, 8 aa, Giardia lamblia
FKKESSRY

SEQ ID NO: 3053510 - protein, 11 aa, Giardia lamblia
FKRGDSPQVSS

SEQ ID NO: 3053511 - protein, 14 aa, Giardia lamblia
FKSKRQDDCSIDPS

SEQ ID NO: 3053512 - protein, 32 aa, Giardia lamblia
FKTDPGKCECRPGYDGTKCETCANGYKEHTNA

SEQ ID NO: 3053513 - protein, 5 aa, Giardia lamblia
FKTRE

SEQ ID NO: 3053514 - protein, 4 aa, Giardia lamblia
FNAT

SEQ ID NO: 3053515 - protein, 15 aa, Giardia lamblia
FNDPDGPSKNLNDID

SEQ ID NO: 3053516 - protein, 4 aa, Giardia lamblia
FNEA

SEQ ID NO: 3053517 - protein, 8 aa, Giardia lamblia
FNETSGKC

SEQ ID NO: 3053518 - protein, 7 aa, Giardia lamblia
FNGHDGT

SEQ ID NO: 3053519 - protein, 23 aa, Giardia lamblia
FNLGPGKESPALTSTTERTALQN

SEQ ID NO: 3053520 - protein, 5 aa, Giardia lamblia
FNNKK

SEQ ID NO: 3053521 - protein, 6 aa, Giardia lamblia
FNPANE

SEQ ID NO: 3053522 - protein, 4 aa, Giardia lamblia
FNPE

SEQ ID NO: 3053523 - protein, 19 aa, Giardia lamblia
FNPSSDSGLSSSDDSLSVS

SEQ ID NO: 3053524 - protein, 4 aa, Giardia lamblia
FNPT

SEQ ID NO: 3053525 - protein, 6 aa, Giardia lamblia
FNQANN

SEQ ID NO: 3053526 - protein, 9 aa, Giardia lamblia
FNRSASQDQ

SEQ ID NO: 3053527 - protein, 9 aa, Giardia lamblia
FNSEEPTNV

SEQ ID NO: 3053528 - protein, 9 aa, Giardia lamblia
FNSGDTSTC

SEQ ID NO: 3053529 - protein, 12 aa, Giardia lamblia
FNSNEQSYKARN

SEQ ID NO: 3053530 - protein, 10 aa, Giardia lamblia
FNSPTDTDTA

SEQ ID NO: 3053531 - protein, 11 aa, Giardia lamblia
FPAGKSSLTIG

SEQ ID NO: 3053532 - protein, 11 aa, Giardia lamblia
FPDASPSLRAS

SEQ ID NO: 3053533 - protein, 8 aa, Giardia lamblia
FPDETPQI

SEQ ID NO: 3053534 - protein, 4 aa, Giardia lamblia
FPDG

SEQ ID NO: 3053535 - protein, 8 aa, Giardia lamblia
FPDPEAKK

SEQ ID NO: 3053536 - protein, 4 aa, Giardia lamblia
FPGP

SEQ ID NO: 3053537 - protein, 8 aa, Giardia lamblia
FPGPDPVD

SEQ ID NO: 3053538 - protein, 4 aa, Giardia lamblia
FPGV

SEQ ID NO: 3053539 - protein, 6 aa, Giardia lamblia
FPKENI

SEQ ID NO: 3053540 - protein, 6 aa, Giardia lamblia
FPKNSG

SEQ ID NO: 3053541 - protein, 28 aa, Giardia lamblia
FPNDSPSVENCPPSTDKLSGDDDLDSMT

SEQ ID NO: 3053542 - protein, 6 aa, Giardia lamblia
FPNEPP

SEQ ID NO: 3053543 - protein, 13 aa, Giardia lamblia
FPPAPASPDPSRK

SEQ ID NO: 3053544 - protein, 8 aa, Giardia lamblia
FPPINDDT

SEQ ID NO: 3053545 - protein, 5 aa, Giardia lamblia
FPPSY

SEQ ID NO: 3053546 - protein, 7 aa, Giardia lamblia
FPPTGKQ

SEQ ID NO: 3053547 - protein, 11 aa, Giardia lamblia
FPRQKTTDLAP

SEQ ID NO: 3053548 - protein, 6 aa, Giardia lamblia
FPSDEN

SEQ ID NO: 3053549 - protein, 4 aa, Giardia lamblia
FPSL

SEQ ID NO: 3053550 - protein, 5 aa, Giardia lamblia
FPSPA

SEQ ID NO: 3053551 - protein, 8 aa, Giardia lamblia
FPSPPDPV

SEQ ID NO: 3053552 - protein, 6 aa, Giardia lamblia
FPSRGS

SEQ ID NO: 3053553 - protein, 5 aa, Giardia lamblia
FPSSG

SEQ ID NO: 3053554 - protein, 5 aa, Giardia lamblia
FPSSP

SEQ ID NO: 3053555 - protein, 4 aa, Giardia lamblia
FPST

SEQ ID NO: 3053556 - protein, 4 aa, Giardia lamblia
FPSV

SEQ ID NO: 3053557 - protein, 9 aa, Giardia lamblia
FPTATSSGK

SEQ ID NO: 3053558 - protein, 5 aa, Giardia lamblia
FPTGS

SEQ ID NO: 3053559 - protein, 9 aa, Giardia lamblia
FPTNTGSSK

SEQ ID NO: 3053560 - protein, 4 aa, Giardia lamblia
FPYS

SEQ ID NO: 3053561 - protein, 10 aa, Giardia lamblia
FQAKDNKGIT

SEQ ID NO: 3053562 - protein, 5 aa, Giardia lamblia
FQASD

SEQ ID NO: 3053563 - protein, 15 aa, Giardia lamblia
FQGSGSELVKSPPAV

SEQ ID NO: 3053564 - protein, 13 aa, Giardia lamblia
FQNKGQKPAEVSN

SEQ ID NO: 3053565 - protein, 5 aa, Giardia lamblia
FQPED

SEQ ID NO: 3053566 - protein, 12 aa, Giardia lamblia
FRGSTSQTPHDI

SEQ ID NO: 3053567 - protein, 6 aa, Giardia lamblia
FRKGGS

SEQ ID NO: 3053568 - protein, 10 aa, Giardia lamblia
FRQPEGKDYQ

SEQ ID NO: 3053569 - protein, 10 aa, Giardia lamblia
FRSNPTPAKP

SEQ ID NO: 3053570 - protein, 6 aa, Giardia lamblia
FRSSGS

SEQ ID NO: 3053571 - protein, 11 aa, Giardia lamblia
FRSSSDGKAFK

SEQ ID NO: 3053572 - protein, 12 aa, Giardia lamblia
FRTDSTSGESTE

SEQ ID NO: 3053573 - protein, 5 aa, Giardia lamblia
FRVPS

SEQ ID NO: 3053574 - protein, 12 aa, Giardia lamblia
FSATSGPTDTRI

SEQ ID NO: 3053575 - protein, 12 aa, Giardia lamblia
FSATTARASKNV

SEQ ID NO: 3053576 - protein, 12 aa, Giardia lamblia
FSDDPQPLTNAD

SEQ ID NO: 3053577 - protein, 14 aa, Giardia lamblia
FSDGDDPETAKEQA

SEQ ID NO: 3053578 - protein, 5 aa, Giardia lamblia
FSDGS

SEQ ID NO: 3053579 - protein, 7 aa, Giardia lamblia
FSEEQNG

SEQ ID NO: 3053580 - protein, 8 aa, Giardia lamblia
FSEGANPT

SEQ ID NO: 3053581 - protein, 12 aa, Giardia lamblia
FSEGGKEADKEE

SEQ ID NO: 3053582 - protein, 9 aa, Giardia lamblia
FSEKGKENI

SEQ ID NO: 3053583 - protein, 12 aa, Giardia lamblia
FSENADNKELEK

SEQ ID NO: 3053584 - protein, 14 aa, Giardia lamblia
FSESSSETFSSTEQ

SEQ ID NO: 3053585 - protein, 5 aa, Giardia lamblia
FSGDT

SEQ ID NO: 3053586 - protein, 4 aa, Giardia lamblia
FSGK

SEQ ID NO: 3053587 - protein, 19 aa, Giardia lamblia
FSGKEANNHEHESQPEAVD

SEQ ID NO: 3053588 - protein, 5 aa, Giardia lamblia
FSGKT

SEQ ID NO: 3053589 - protein, 6 aa, Giardia lamblia
FSGTPL

SEQ ID NO: 3053590 - protein, 11 aa, Giardia lamblia
FSKSEDDAGTV

SEQ ID NO: 3053591 - protein, 8 aa, Giardia lamblia
FSKTPDAS

SEQ ID NO: 3053592 - protein, 7 aa, Giardia lamblia
FSKTSQV

SEQ ID NO: 3053593 - protein, 4 aa, Giardia lamblia
FSNE

SEQ ID NO: 3053594 - protein, 6 aa, Giardia lamblia
FSNTSR

SEQ ID NO: 3053595 - protein, 12 aa, Giardia lamblia
FSPAPRSNAKHA

SEQ ID NO: 3053596 - protein, 9 aa, Giardia lamblia
FSPTDIQRK

SEQ ID NO: 3053597 - protein, 5 aa, Giardia lamblia
FSQDK

SEQ ID NO: 3053598 - protein, 12 aa, Giardia lamblia
FSQSKKQTACSP

SEQ ID NO: 3053599 - protein, 6 aa, Giardia lamblia
FSRKSY

SEQ ID NO: 3053600 - protein, 6 aa, Giardia lamblia
FSRNPQ

SEQ ID NO: 3053601 - protein, 5 aa, Giardia lamblia
FSRPS

SEQ ID NO: 3053602 - protein, 7 aa, Giardia lamblia
FSSAREA

SEQ ID NO: 3053603 - protein, 12 aa, Giardia lamblia
FSSATSKDTVTI

SEQ ID NO: 3053604 - protein, 24 aa, Giardia lamblia
FSSEPDSSVPEAHSAKDPSSSLNY

SEQ ID NO: 3053605 - protein, 8 aa, Giardia lamblia
FSSGTTLN

SEQ ID NO: 3053606 - protein, 8 aa, Giardia lamblia
FSSKDAEA

SEQ ID NO: 3053607 - protein, 11 aa, Giardia lamblia
FSSKRKGKPID

SEQ ID NO: 3053608 - protein, 23 aa, Giardia lamblia
FSSNSSKGEEQSPQNRQATRQKM

SEQ ID NO: 3053609 - protein, 8 aa, Giardia lamblia
FSSQTPDQ

SEQ ID NO: 3053610 - protein, 13 aa, Giardia lamblia
FSSRNTPAGSSVG

SEQ ID NO: 3053611 - protein, 27 aa, Giardia lamblia
FSSRSSVSSDRGLRRSSRGEQKDRKAM

SEQ ID NO: 3053612 - protein, 4 aa, Giardia lamblia
FSSS

SEQ ID NO: 3053613 - protein, 10 aa, Giardia lamblia
FSSSPSQSDP

SEQ ID NO: 3053614 - protein, 19 aa, Giardia lamblia
FSSSQAPSRPSLQERNEST

SEQ ID NO: 3053615 - protein, 4 aa, Giardia lamblia
FSST

SEQ ID NO: 3053616 - protein, 21 aa, Giardia lamblia
FSSTDSSIESMDTGSSDLDES

SEQ ID NO: 3053617 - protein, 8 aa, Giardia lamblia
FSSTPKGE

SEQ ID NO: 3053618 - protein, 7 aa, Giardia lamblia
FSSTQQD

SEQ ID NO: 3053619 - protein, 9 aa, Giardia lamblia
FSSTSPPLD

SEQ ID NO: 3053620 - protein, 4 aa, Giardia lamblia
FSTD

SEQ ID NO: 3053621 - protein, 9 aa, Giardia lamblia
FSTHPPPSP

SEQ ID NO: 3053622 - protein, 11 aa, Giardia lamblia
FSTSASTTYSH

SEQ ID NO: 3053623 - protein, 6 aa, Giardia lamblia
FSTSQV

SEQ ID NO: 3053624 - protein, 7 aa, Giardia lamblia
FTADNGK

SEQ ID NO: 3053625 - protein, 9 aa, Giardia lamblia
FTCTNGEGA

SEQ ID NO: 3053626 - protein, 10 aa, Giardia lamblia
FTDASAPSTS

SEQ ID NO: 3053627 - protein, 4 aa, Giardia lamblia
FTDQ

SEQ ID NO: 3053628 - protein, 7 aa, Giardia lamblia
FTDSRNS

SEQ ID NO: 3053629 - protein, 4 aa, Giardia lamblia
FTFD

SEQ ID NO: 3053630 - protein, 20 aa, Giardia lamblia
FTGESEPQTRKTEPSPENVH

SEQ ID NO: 3053631 - protein, 12 aa, Giardia lamblia
FTGNTTSRRSTA

SEQ ID NO: 3053632 - protein, 5 aa, Giardia lamblia
FTGPS

SEQ ID NO: 3053633 - protein, 16 aa, Giardia lamblia
FTKPNDLSLDSTRSTQ

SEQ ID NO: 3053634 - protein, 10 aa, Giardia lamblia
FTNDSGTCTL

SEQ ID NO: 3053635 - protein, 14 aa, Giardia lamblia
FTNGDSSHNPFQST

SEQ ID NO: 3053636 - protein, 8 aa, Giardia lamblia
FTNPEPNA

SEQ ID NO: 3053637 - protein, 4 aa, Giardia lamblia
FTNT

SEQ ID NO: 3053638 - protein, 4 aa, Giardia lamblia
FTPA

SEQ ID NO: 3053639 - protein, 9 aa, Giardia lamblia
FTPSASPQN

SEQ ID NO: 3053640 - protein, 13 aa, Giardia lamblia
FTQEKQKNESRTH

SEQ ID NO: 3053641 - protein, 10 aa, Giardia lamblia
FTQTAENSHK

SEQ ID NO: 3053642 - protein, 14 aa, Giardia lamblia
FTQYNNRQSPQGVE

SEQ ID NO: 3053643 - protein, 11 aa, Giardia lamblia
FTSEGRAGNHI

SEQ ID NO: 3053644 - protein, 23 aa, Giardia lamblia
FTSESPILPPSTQTDSVTMQEDK

SEQ ID NO: 3053645 - protein, 5 aa, Giardia lamblia
FTSGM

SEQ ID NO: 3053646 - protein, 7 aa, Giardia lamblia
FTSKSGI

SEQ ID NO: 3053647 - protein, 5 aa, Giardia lamblia
FTSPD

SEQ ID NO: 3053648 - protein, 8 aa, Giardia lamblia
FTSTADAG

SEQ ID NO: 3053649 - protein, 5 aa, Giardia lamblia
FTTKD

SEQ ID NO: 3053650 - protein, 8 aa, Giardia lamblia
FTTKTNQS

SEQ ID NO: 3053651 - protein, 8 aa, Giardia lamblia
FTTNTSVS

SEQ ID NO: 3053652 - protein, 9 aa, Giardia lamblia
FTTSETKPW

SEQ ID NO: 3053653 - protein, 39 aa, Giardia lamblia
FVSTSNTSSRPSSRAASRTFRRDTQVRSSDQPKPIDDAR

SEQ ID NO: 3053654 - protein, 12 aa, Giardia lamblia
FYPQKDKSADFT

SEQ ID NO: 3053655 - protein, 37 aa, Giardia lamblia
GAAANESKQSAKASSAEHDKKKDSKAKNMDADRELDS

SEQ ID NO: 3053656 - protein, 32 aa, Giardia lamblia
GAAAPSGSRSASGSGARAPSRGKQTVSSTGEA

SEQ ID NO: 3053657 - protein, 5 aa, Giardia lamblia
GAAAQ

SEQ ID NO: 3053658 - protein, 6 aa, Giardia lamblia
GAADPD

SEQ ID NO: 3053659 - protein, 12 aa, Giardia lamblia
GAAGAGEGFSAE

SEQ ID NO: 3053660 - protein, 4 aa, Giardia lamblia
GAAH

SEQ ID NO: 3053661 - protein, 5 aa, Giardia lamblia
GAAPM

SEQ ID NO: 3053662 - protein, 4 aa, Giardia lamblia
GAAS

SEQ ID NO: 3053663 - protein, 27 aa, Giardia lamblia
GAASHEEGKHSIKGRSIEARAAREAKL

SEQ ID NO: 3053664 - protein, 10 aa, Giardia lamblia
GAASPKYRNT

SEQ ID NO: 3053665 - protein, 6 aa, Giardia lamblia
GACNEQ

SEQ ID NO: 3053666 - protein, 4 aa, Giardia lamblia
GACT

SEQ ID NO: 3053667 - protein, 11 aa, Giardia lamblia
GADAARPSGPI

SEQ ID NO: 3053668 - protein, 10 aa, Giardia lamblia
GADDNSLTEE

SEQ ID NO: 3053669 - protein, 5 aa, Giardia lamblia
GADET

SEQ ID NO: 3053670 - protein, 5 aa, Giardia lamblia
GADFP

SEQ ID NO: 3053671 - protein, 14 aa, Giardia lamblia
GADGPLSSRDFSNY

SEQ ID NO: 3053672 - protein, 8 aa, Giardia lamblia
GADGSTQI

SEQ ID NO: 3053673 - protein, 4 aa, Giardia lamblia
GADN

SEQ ID NO: 3053674 - protein, 10 aa, Giardia lamblia
GADNNGMKGV

SEQ ID NO: 3053675 - protein, 12 aa, Giardia lamblia
GADPKGQACPTC

SEQ ID NO: 3053676 - protein, 14 aa, Giardia lamblia
GADSAGPTEAEEIE

SEQ ID NO: 3053677 - protein, 6 aa, Giardia lamblia
GADSKW

SEQ ID NO: 3053678 - protein, 9 aa, Giardia lamblia
GADSSGGNL

SEQ ID NO: 3053679 - protein, 4 aa, Giardia lamblia
GADT

SEQ ID NO: 3053680 - protein, 9 aa, Giardia lamblia
GADTTSDRF

SEQ ID NO: 3053681 - protein, 9 aa, Giardia lamblia
GAEDGEANS

SEQ ID NO: 3053682 - protein, 8 aa, Giardia lamblia
GAEDPNHP

SEQ ID NO: 3053683 - protein, 12 aa, Giardia lamblia
GAEGAEQCKTGH

SEQ ID NO: 3053684 - protein, 12 aa, Giardia lamblia
GAEGAGQCKTGH

SEQ ID NO: 3053685 - protein, 9 aa, Giardia lamblia
GAEGISPES

SEQ ID NO: 3053686 - protein, 9 aa, Giardia lamblia
GAEPVSDQH

SEQ ID NO: 3053687 - protein, 6 aa, Giardia lamblia
GAEQQY

SEQ ID NO: 3053688 - protein, 7 aa, Giardia lamblia
GAETDTS

SEQ ID NO: 3053689 - protein, 8 aa, Giardia lamblia
GAETHGTT

SEQ ID NO: 3053690 - protein, 12 aa, Giardia lamblia
GAFPKSPYYSEK

SEQ ID NO: 3053691 - protein, 9 aa, Giardia lamblia
GAGDSSVDT

SEQ ID NO: 3053692 - protein, 5 aa, Giardia lamblia
GAGEI

SEQ ID NO: 3053693 - protein, 6 aa, Giardia lamblia
GAGEPY

SEQ ID NO: 3053694 - protein, 8 aa, Giardia lamblia
GAGGEASI

SEQ ID NO: 3053695 - protein, 8 aa, Giardia lamblia
GAGKTTSV

SEQ ID NO: 3053696 - protein, 9 aa, Giardia lamblia
GAGQNCGET

SEQ ID NO: 3053697 - protein, 6 aa, Giardia lamblia
GAGTPF

SEQ ID NO: 3053698 - protein, 7 aa, Giardia lamblia
GAHSEKL

SEQ ID NO: 3053699 - protein, 21 aa, Giardia lamblia
GAHSSLQQTGGLTSLAKKSSI

SEQ ID NO: 3053700 - protein, 6 aa, Giardia lamblia
GAIPPE

SEQ ID NO: 3053701 - protein, 8 aa, Giardia lamblia
GAISEPEG

SEQ ID NO: 3053702 - protein, 8 aa, Giardia lamblia
GAISSAKR

SEQ ID NO: 3053703 - protein, 11 aa, Giardia lamblia
GAISSNNKIPP

SEQ ID NO: 3053704 - protein, 9 aa, Giardia lamblia
GAISTDKDK

SEQ ID NO: 3053705 - protein, 31 aa, Giardia lamblia
GAKEPVPLATDPDSAQESSYHHSESQFDSPR

SEQ ID NO: 3053706 - protein, 6 aa, Giardia lamblia
GAKKEL

SEQ ID NO: 3053707 - protein, 8 aa, Giardia lamblia
GAKLRPKQ

SEQ ID NO: 3053708 - protein, 5 aa, Giardia lamblia
GAKSP

SEQ ID NO: 3053709 - protein, 7 aa, Giardia lamblia
GAKYSDE

SEQ ID NO: 3053710 - protein, 10 aa, Giardia lamblia
GALGDSPAIS

SEQ ID NO: 3053711 - protein, 20 aa, Giardia lamblia
GALQAGNESQTNEGAHKAGS

SEQ ID NO: 3053712 - protein, 4 aa, Giardia lamblia
GALS

SEQ ID NO: 3053713 - protein, 9 aa, Giardia lamblia
GALSDERER

SEQ ID NO: 3053714 - protein, 7 aa, Giardia lamblia
GANADKG

SEQ ID NO: 3053715 - protein, 5 aa, Giardia lamblia
GANAT

SEQ ID NO: 3053716 - protein, 7 aa, Giardia lamblia
GANGYTG

SEQ ID NO: 3053717 - protein, 6 aa, Giardia lamblia
GANKTL

SEQ ID NO: 3053718 - protein, 4 aa, Giardia lamblia
GANS

SEQ ID NO: 3053719 - protein, 17 aa, Giardia lamblia
GAPAGPAGTGKTETVKD

SEQ ID NO: 3053720 - protein, 10 aa, Giardia lamblia
GAPEGTTTNG

SEQ ID NO: 3053721 - protein, 8 aa, Giardia lamblia
GAPNPKNI

SEQ ID NO: 3053722 - protein, 7 aa, Giardia lamblia
GAPPAAV

SEQ ID NO: 3053723 - protein, 18 aa, Giardia lamblia
GAPQGPAGTGKTETTKDL

SEQ ID NO: 3053724 - protein, 8 aa, Giardia lamblia
GAPSNPVL

SEQ ID NO: 3053725 - protein, 10 aa, Giardia lamblia
GAPSQPGASA

SEQ ID NO: 3053726 - protein, 7 aa, Giardia lamblia
GAPSRSV

SEQ ID NO: 3053727 - protein, 6 aa, Giardia lamblia
GAPTSV

SEQ ID NO: 3053728 - protein, 4 aa, Giardia lamblia
GAPV

SEQ ID NO: 3053729 - protein, 7 aa, Giardia lamblia
GAPVPEA

SEQ ID NO: 3053730 - protein, 20 aa, Giardia lamblia
GAPYAKTTQRPVVSKDSPTL

SEQ ID NO: 3053731 - protein, 7 aa, Giardia lamblia
GAQASTT

SEQ ID NO: 3053732 - protein, 27 aa, Giardia lamblia
GAQDKDKDKSRDNCDSGDSSAASDKSQ

SEQ ID NO: 3053733 - protein, 5 aa, Giardia lamblia
GAQEE

SEQ ID NO: 3053734 - protein, 15 aa, Giardia lamblia
GAQETSLSQASDSFP

SEQ ID NO: 3053735 - protein, 29 aa, Giardia lamblia
GAQPKRKSAPSSRRHSAASPSTSSASSSD

SEQ ID NO: 3053736 - protein, 14 aa, Giardia lamblia
GAQPSNSFDPAPSI

SEQ ID NO: 3053737 - protein, 12 aa, Giardia lamblia
GAQRNSGGSAGE

SEQ ID NO: 3053738 - protein, 14 aa, Giardia lamblia
GAQSGPSGDNPPEL

SEQ ID NO: 3053739 - protein, 14 aa, Giardia lamblia
GARLSNPKQRSKTL

SEQ ID NO: 3053740 - protein, 18 aa, Giardia lamblia
GARSATNPSSQSSDSPVP

SEQ ID NO: 3053741 - protein, 5 aa, Giardia lamblia
GARVP

SEQ ID NO: 3053742 - protein, 26 aa, Giardia lamblia
GARYDSKETHCSHEQSNGCHKPAPLH

SEQ ID NO: 3053743 - protein, 4 aa, Giardia lamblia
GASA

SEQ ID NO: 3053744 - protein, 30 aa, Giardia lamblia
GASAANPVYSSGSFQANQTPPPPHPADSHD

SEQ ID NO: 3053745 - protein, 5 aa, Giardia lamblia
GASAG

SEQ ID NO: 3053746 - protein, 12 aa, Giardia lamblia
GASDEVKAVSTD

SEQ ID NO: 3053747 - protein, 10 aa, Giardia lamblia
GASEGGQSRF

SEQ ID NO: 3053748 - protein, 10 aa, Giardia lamblia
GASEVSASSP

SEQ ID NO: 3053749 - protein, 8 aa, Giardia lamblia
GASGCKEE

SEQ ID NO: 3053750 - protein, 18 aa, Giardia lamblia
GASGTGQSMIFDSINLSI

SEQ ID NO: 3053751 - protein, 6 aa, Giardia lamblia
GASPDE

SEQ ID NO: 3053752 - protein, 4 aa, Giardia lamblia
GASR

SEQ ID NO: 3053753 - protein, 13 aa, Giardia lamblia
GASSKSEKVCGGG

SEQ ID NO: 3053754 - protein, 8 aa, Giardia lamblia
GASSNYYT

SEQ ID NO: 3053755 - protein, 10 aa, Giardia lamblia
GASSQYTQTG

SEQ ID NO: 3053756 - protein, 17 aa, Giardia lamblia
GASTSPLEGSQDSIQVD

SEQ ID NO: 3053757 - protein, 12 aa, Giardia lamblia
GATARKFNATSD

SEQ ID NO: 3053758 - protein, 9 aa, Giardia lamblia
GATCSQYGV

SEQ ID NO: 3053759 - protein, 5 aa, Giardia lamblia
GATDH

SEQ ID NO: 3053760 - protein, 12 aa, Giardia lamblia
GATDKYSKESIQ

SEQ ID NO: 3053761 - protein, 17 aa, Giardia lamblia
GATDPAPCITGAGTDAC

SEQ ID NO: 3053762 - protein, 6 aa, Giardia lamblia
GATDTY

SEQ ID NO: 3053763 - protein, 12 aa, Giardia lamblia
GATFDEPPDPIK

SEQ ID NO: 3053764 - protein, 9 aa, Giardia lamblia
GATKGPAAD

SEQ ID NO: 3053765 - protein, 6 aa, Giardia lamblia
GATPPS

SEQ ID NO: 3053766 - protein, 5 aa, Giardia lamblia
GATPV

SEQ ID NO: 3053767 - protein, 7 aa, Giardia lamblia
GATQSHG

SEQ ID NO: 3053768 - protein, 10 aa, Giardia lamblia
GATRYETRED

SEQ ID NO: 3053769 - protein, 25 aa, Giardia lamblia
GATSANTSMKAAGASDKNAKQPVQN

SEQ ID NO: 3053770 - protein, 22 aa, Giardia lamblia
GATTDSLPKSDRTNDPNTQSLS

SEQ ID NO: 3053771 - protein, 13 aa, Giardia lamblia
GATTHQQSQTSLT

SEQ ID NO: 3053772 - protein, 5 aa, Giardia lamblia
GATTK

SEQ ID NO: 3053773 - protein, 23 aa, Giardia lamblia
GATTSLATGSPLSDREHSSVTRD

SEQ ID NO: 3053774 - protein, 10 aa, Giardia lamblia
GATTSSADEH

SEQ ID NO: 3053775 - protein, 11 aa, Giardia lamblia
GATTSSGKEGI

SEQ ID NO: 3053776 - protein, 25 aa, Giardia lamblia
GAVEDGSAAQQQAAKSAPPKKAGSH

SEQ ID NO: 3053777 - protein, 9 aa, Giardia lamblia
GAVGETNAE

SEQ ID NO: 3053778 - protein, 14 aa, Giardia lamblia
GAVPTVEQADTGPL

SEQ ID NO: 3053779 - protein, 10 aa, Giardia lamblia
GAVSESGGSI

SEQ ID NO: 3053780 - protein, 8 aa, Giardia lamblia
GAVTDPEE

SEQ ID NO: 3053781 - protein, 8 aa, Giardia lamblia
GAWAGSGQ

SEQ ID NO: 3053782 - protein, 4 aa, Giardia lamblia
GAYK

SEQ ID NO: 3053783 - protein, 12 aa, Giardia lamblia
GCAGNGSLQPLT

SEQ ID NO: 3053784 - protein, 10 aa, Giardia lamblia
GCAGPATRAA

SEQ ID NO: 3053785 - protein, 14 aa, Giardia lamblia
GCAGSTGEGLRPLY

SEQ ID NO: 3053786 - protein, 11 aa, Giardia lamblia
GCANGSPTDSC

SEQ ID NO: 3053787 - protein, 11 aa, Giardia lamblia
GCATGTDGDSK

SEQ ID NO: 3053788 - protein, 6 aa, Giardia lamblia
GCDGGF

SEQ ID NO: 3053789 - protein, 13 aa, Giardia lamblia
GCDGSRDSVNDQL

SEQ ID NO: 3053790 - protein, 5 aa, Giardia lamblia
GCDSA

SEQ ID NO: 3053791 - protein, 5 aa, Giardia lamblia
GCGEP

SEQ ID NO: 3053792 - protein, 7 aa, Giardia lamblia
GCGKSTT

SEQ ID NO: 3053793 - protein, 9 aa, Giardia lamblia
GCNSGGAKP

SEQ ID NO: 3053794 - protein, 12 aa, Giardia lamblia
GCRDSAGGLPTP

SEQ ID NO: 3053795 - protein, 13 aa, Giardia lamblia
GCSACSADTPTQC

SEQ ID NO: 3053796 - protein, 6 aa, Giardia lamblia
GCSGKT

SEQ ID NO: 3053797 - protein, 7 aa, Giardia lamblia
GCSSTGK

SEQ ID NO: 3053798 - protein, 5 aa, Giardia lamblia
GCSTC

SEQ ID NO: 3053799 - protein, 6 aa, Giardia lamblia
GCTDSK

SEQ ID NO: 3053800 - protein, 5 aa, Giardia lamblia
GCTER

SEQ ID NO: 3053801 - protein, 14 aa, Giardia lamblia
GCTGDNKGSNVYRD

SEQ ID NO: 3053802 - protein, 15 aa, Giardia lamblia
GCTTGTGDDSLEGSL

SEQ ID NO: 3053803 - protein, 16 aa, Giardia lamblia
GDAAEGRVGDSQDNCA

SEQ ID NO: 3053804 - protein, 7 aa, Giardia lamblia
GDADTTK

SEQ ID NO: 3053805 - protein, 8 aa, Giardia lamblia
GDADYGTA

SEQ ID NO: 3053806 - protein, 6 aa, Giardia lamblia
GDAEPA

SEQ ID NO: 3053807 - protein, 6 aa, Giardia lamblia
GDAKDR

SEQ ID NO: 3053808 - protein, 16 aa, Giardia lamblia
GDCGSGGRCDVSTGSC

SEQ ID NO: 3053809 - protein, 10 aa, Giardia lamblia
GDCPSDTQAK

SEQ ID NO: 3053810 - protein, 8 aa, Giardia lamblia
GDDARNPI

SEQ ID NO: 3053811 - protein, 9 aa, Giardia lamblia
GDDCQTDTC

SEQ ID NO: 3053812 - protein, 5 aa, Giardia lamblia
GDDHG

SEQ ID NO: 3053813 - protein, 8 aa, Giardia lamblia
GDDHGSYE

SEQ ID NO: 3053814 - protein, 5 aa, Giardia lamblia
GDDID

SEQ ID NO: 3053815 - protein, 11 aa, Giardia lamblia
GDDNYKPDPEN

SEQ ID NO: 3053816 - protein, 18 aa, Giardia lamblia
GDDREDLRAGAARLTNAE

SEQ ID NO: 3053817 - protein, 8 aa, Giardia lamblia
GDDVSQDQ

SEQ ID NO: 3053818 - protein, 7 aa, Giardia lamblia
GDDWGSK

SEQ ID NO: 3053819 - protein, 12 aa, Giardia lamblia
GDEAGKQNLQGG

SEQ ID NO: 3053820 - protein, 16 aa, Giardia lamblia
GDEEAGGVTTERPCSG

SEQ ID NO: 3053821 - protein, 6 aa, Giardia lamblia
GDEERF

SEQ ID NO: 3053822 - protein, 4 aa, Giardia lamblia
GDEN

SEQ ID NO: 3053823 - protein, 5 aa, Giardia lamblia
GDEQG

SEQ ID NO: 3053824 - protein, 6 aa, Giardia lamblia
GDEQST

SEQ ID NO: 3053825 - protein, 7 aa, Giardia lamblia
GDESKHR

SEQ ID NO: 3053826 - protein, 7 aa, Giardia lamblia
GDETDPT

SEQ ID NO: 3053827 - protein, 5 aa, Giardia lamblia
GDEVP

SEQ ID NO: 3053828 - protein, 6 aa, Giardia lamblia
GDFSAE

SEQ ID NO: 3053829 - protein, 7 aa, Giardia lamblia
GDGANDC

SEQ ID NO: 3053830 - protein, 9 aa, Giardia lamblia
GDGDTDTVS

SEQ ID NO: 3053831 - protein, 7 aa, Giardia lamblia
GDGGNDV

SEQ ID NO: 3053832 - protein, 7 aa, Giardia lamblia
GDGKRAA

SEQ ID NO: 3053833 - protein, 8 aa, Giardia lamblia
GDGPPPPI

SEQ ID NO: 3053834 - protein, 9 aa, Giardia lamblia
GDGRYGQIP

SEQ ID NO: 3053835 - protein, 8 aa, Giardia lamblia
GDGTCESC

SEQ ID NO: 3053836 - protein, 9 aa, Giardia lamblia
GDGVERPCK

SEQ ID NO: 3053837 - protein, 6 aa, Giardia lamblia
GDGYIS

SEQ ID NO: 3053838 - protein, 4 aa, Giardia lamblia
GDIA

SEQ ID NO: 3053839 - protein, 8 aa, Giardia lamblia
GDIPAGKV

SEQ ID NO: 3053840 - protein, 5 aa, Giardia lamblia
GDIPG

SEQ ID NO: 3053841 - protein, 9 aa, Giardia lamblia
GDISPSIEA

SEQ ID NO: 3053842 - protein, 5 aa, Giardia lamblia
GDISV

SEQ ID NO: 3053843 - protein, 5 aa, Giardia lamblia
GDITA

SEQ ID NO: 3053844 - protein, 10 aa, Giardia lamblia
GDKGYECGGH

SEQ ID NO: 3053845 - protein, 12 aa, Giardia lamblia
GDKHEDKSSEEP

SEQ ID NO: 3053846 - protein, 7 aa, Giardia lamblia
GDKPPEL

SEQ ID NO: 3053847 - protein, 7 aa, Giardia lamblia
GDLGQGA

SEQ ID NO: 3053848 - protein, 16 aa, Giardia lamblia
GDLSGQEATKAPCNGR

SEQ ID NO: 3053849 - protein, 4 aa, Giardia lamblia
GDNE

SEQ ID NO: 3053850 - protein, 8 aa, Giardia lamblia
GDNEEEML

SEQ ID NO: 3053851 - protein, 7 aa, Giardia lamblia
GDNGPIE

SEQ ID NO: 3053852 - protein, 14 aa, Giardia lamblia
GDNHEEPPTSVAGE

SEQ ID NO: 3053853 - protein, 4 aa, Giardia lamblia
GDPA

SEQ ID NO: 3053854 - protein, 5 aa, Giardia lamblia
GDPAD

SEQ ID NO: 3053855 - protein, 7 aa, Giardia lamblia
GDPAQRN

SEQ ID NO: 3053856 - protein, 7 aa, Giardia lamblia
GDPDPNV

SEQ ID NO: 3053857 - protein, 8 aa, Giardia lamblia
GDPGVGKS

SEQ ID NO: 3053858 - protein, 14 aa, Giardia lamblia
GDPHNDPSQGGTVT

SEQ ID NO: 3053859 - protein, 7 aa, Giardia lamblia
GDPPPAA

SEQ ID NO: 3053860 - protein, 8 aa, Giardia lamblia
GDPPPAAW

SEQ ID NO: 3053861 - protein, 6 aa, Giardia lamblia
GDPQAL

SEQ ID NO: 3053862 - protein, 17 aa, Giardia lamblia
GDPQKANLKTPSMSGSC

SEQ ID NO: 3053863 - protein, 11 aa, Giardia lamblia
GDQIDDSGVTG

SEQ ID NO: 3053864 - protein, 7 aa, Giardia lamblia
GDQMSST

SEQ ID NO: 3053865 - protein, 4 aa, Giardia lamblia
GDQN

SEQ ID NO: 3053866 - protein, 6 aa, Giardia lamblia
GDQPAV

SEQ ID NO: 3053867 - protein, 9 aa, Giardia lamblia
GDQSRCRQN

SEQ ID NO: 3053868 - protein, 4 aa, Giardia lamblia
GDRA

SEQ ID NO: 3053869 - protein, 5 aa, Giardia lamblia
GDRHG

SEQ ID NO: 3053870 - protein, 15 aa, Giardia lamblia
GDRQARDENVSTEIT

SEQ ID NO: 3053871 - protein, 10 aa, Giardia lamblia
GDRRSNATLK

SEQ ID NO: 3053872 - protein, 7 aa, Giardia lamblia
GDRYEGE

SEQ ID NO: 3053873 - protein, 9 aa, Giardia lamblia
GDSASYYSA

SEQ ID NO: 3053874 - protein, 7 aa, Giardia lamblia
GDSETNC

SEQ ID NO: 3053875 - protein, 5 aa, Giardia lamblia
GDSGL

SEQ ID NO: 3053876 - protein, 26 aa, Giardia lamblia
GDSGRSCVEPSECGDGYYANSDSYTC

SEQ ID NO: 3053877 - protein, 11 aa, Giardia lamblia
GDSHKTYEKDD

SEQ ID NO: 3053878 - protein, 4 aa, Giardia lamblia
GDSI

SEQ ID NO: 3053879 - protein, 5 aa, Giardia lamblia
GDSIS

SEQ ID NO: 3053880 - protein, 8 aa, Giardia lamblia
GDSKGPVY

SEQ ID NO: 3053881 - protein, 10 aa, Giardia lamblia
GDSKLPKQES

SEQ ID NO: 3053882 - protein, 5 aa, Giardia lamblia
GDSLD

SEQ ID NO: 3053883 - protein, 5 aa, Giardia lamblia
GDSLN

SEQ ID NO: 3053884 - protein, 6 aa, Giardia lamblia
GDSMQS

SEQ ID NO: 3053885 - protein, 9 aa, Giardia lamblia
GDSNDDEME

SEQ ID NO: 3053886 - protein, 4 aa, Giardia lamblia
GDSP

SEQ ID NO: 3053887 - protein, 15 aa, Giardia lamblia
GDSPDIKKSYEGQLG

SEQ ID NO: 3053888 - protein, 26 aa, Giardia lamblia
GDSQQAMETDSTSEPAVEKSPPAVSS

SEQ ID NO: 3053889 - protein, 4 aa, Giardia lamblia
GDSR

SEQ ID NO: 3053890 - protein, 5 aa, Giardia lamblia
GDSSG

SEQ ID NO: 3053891 - protein, 4 aa, Giardia lamblia
GDST

SEQ ID NO: 3053892 - protein, 8 aa, Giardia lamblia
GDSTMAKS

SEQ ID NO: 3053893 - protein, 9 aa, Giardia lamblia
GDSTSRRSA

SEQ ID NO: 3053894 - protein, 6 aa, Giardia lamblia
GDSTTL

SEQ ID NO: 3053895 - protein, 23 aa, Giardia lamblia
GDSYGASSRTTSSGETTTSVEDR

SEQ ID NO: 3053896 - protein, 7 aa, Giardia lamblia
GDTCTPC

SEQ ID NO: 3053897 - protein, 5 aa, Giardia lamblia
GDTKP

SEQ ID NO: 3053898 - protein, 14 aa, Giardia lamblia
GDTLSTSASQRTLP

SEQ ID NO: 3053899 - protein, 9 aa, Giardia lamblia
GDTRTCTDC

SEQ ID NO: 3053900 - protein, 13 aa, Giardia lamblia
GDTSSSSHPINSA

SEQ ID NO: 3053901 - protein, 10 aa, Giardia lamblia
GDTTESTSGC

SEQ ID NO: 3053902 - protein, 11 aa, Giardia lamblia
GDTTESTSGCN

SEQ ID NO: 3053903 - protein, 11 aa, Giardia lamblia
GDTTESTSGCT

SEQ ID NO: 3053904 - protein, 11 aa, Giardia lamblia
GDVEKDLGSKK

SEQ ID NO: 3053905 - protein, 11 aa, Giardia lamblia
GDVREARNRRG

SEQ ID NO: 3053906 - protein, 26 aa, Giardia lamblia
GDVSQLANESFSQQFSDGKCSTQLTV

SEQ ID NO: 3053907 - protein, 4 aa, Giardia lamblia
GDYD

SEQ ID NO: 3053908 - protein, 6 aa, Giardia lamblia
GDYDPT

SEQ ID NO: 3053909 - protein, 14 aa, Giardia lamblia
GDYGSLQGKTKTLS

SEQ ID NO: 3053910 - protein, 7 aa, Giardia lamblia
GDYTNQS

SEQ ID NO: 3053911 - protein, 9 aa, Giardia lamblia
GEAGRCTPA

SEQ ID NO: 3053912 - protein, 4 aa, Giardia lamblia
GEAN

SEQ ID NO: 3053913 - protein, 7 aa, Giardia lamblia
GEARSLA

SEQ ID NO: 3053914 - protein, 5 aa, Giardia lamblia
GEATR

SEQ ID NO: 3053915 - protein, 5 aa, Giardia lamblia
GEAVA

SEQ ID NO: 3053916 - protein, 7 aa, Giardia lamblia
GECASGN

SEQ ID NO: 3053917 - protein, 5 aa, Giardia lamblia
GECDL

SEQ ID NO: 3053918 - protein, 6 aa, Giardia lamblia
GECNPE

SEQ ID NO: 3053919 - protein, 6 aa, Giardia lamblia
GECQQV

SEQ ID NO: 3053920 - protein, 6 aa, Giardia lamblia
GECVPE

SEQ ID NO: 3053921 - protein, 4 aa, Giardia lamblia
GEDA

SEQ ID NO: 3053922 - protein, 16 aa, Giardia lamblia
GEDAPVLSPRARGQTL

SEQ ID NO: 3053923 - protein, 19 aa, Giardia lamblia
GEDCGTGSFPGTDSAGNRK

SEQ ID NO: 3053924 - protein, 9 aa, Giardia lamblia
GEDETTDQS

SEQ ID NO: 3053925 - protein, 9 aa, Giardia lamblia
GEDPKPCPA

SEQ ID NO: 3053926 - protein, 10 aa, Giardia lamblia
GEDQDAGTQT

SEQ ID NO: 3053927 - protein, 4 aa, Giardia lamblia
GEDV

SEQ ID NO: 3053928 - protein, 7 aa, Giardia lamblia
GEEAQSV

SEQ ID NO: 3053929 - protein, 5 aa, Giardia lamblia
GEEAS

SEQ ID NO: 3053930 - protein, 5 aa, Giardia lamblia
GEEDD

SEQ ID NO: 3053931 - protein, 16 aa, Giardia lamblia
GEEESTATSVSSTVSL

SEQ ID NO: 3053932 - protein, 5 aa, Giardia lamblia
GEEGY

SEQ ID NO: 3053933 - protein, 17 aa, Giardia lamblia
GEELNDTDSNEAASPVL

SEQ ID NO: 3053934 - protein, 13 aa, Giardia lamblia
GEERSLNGPPFPV

SEQ ID NO: 3053935 - protein, 7 aa, Giardia lamblia
GEESQGT

SEQ ID NO: 3053936 - protein, 4 aa, Giardia lamblia
GEFA

SEQ ID NO: 3053937 - protein, 7 aa, Giardia lamblia
GEGAKEV

SEQ ID NO: 3053938 - protein, 8 aa, Giardia lamblia
GEGDNVTT

SEQ ID NO: 3053939 - protein, 7 aa, Giardia lamblia
GEGRGTC

SEQ ID NO: 3053940 - protein, 5 aa, Giardia lamblia
GEHTP

SEQ ID NO: 3053941 - protein, 9 aa, Giardia lamblia
GEIRPGALP

SEQ ID NO: 3053942 - protein, 5 aa, Giardia lamblia
GEKES

SEQ ID NO: 3053943 - protein, 4 aa, Giardia lamblia
GEKL

SEQ ID NO: 3053944 - protein, 20 aa, Giardia lamblia
GELAPPCSNNLGGQSGVSEE

SEQ ID NO: 3053945 - protein, 14 aa, Giardia lamblia
GELEQPQRSINKPR

SEQ ID NO: 3053946 - protein, 7 aa, Giardia lamblia
GELSEET

SEQ ID NO: 3053947 - protein, 13 aa, Giardia lamblia
GEMSSSESLWQPS

SEQ ID NO: 3053948 - protein, 10 aa, Giardia lamblia
GENATIDESK

SEQ ID NO: 3053949 - protein, 6 aa, Giardia lamblia
GENNSV

SEQ ID NO: 3053950 - protein, 7 aa, Giardia lamblia
GEPAEPE

SEQ ID NO: 3053951 - protein, 9 aa, Giardia lamblia
GEPDSDPAV

SEQ ID NO: 3053952 - protein, 5 aa, Giardia lamblia
GEPEL

SEQ ID NO: 3053953 - protein, 16 aa, Giardia lamblia
GEPLDADRDLEKPRVK

SEQ ID NO: 3053954 - protein, 8 aa, Giardia lamblia
GEPLPIKP

SEQ ID NO: 3053955 - protein, 9 aa, Giardia lamblia
GEPNAKLNS

SEQ ID NO: 3053956 - protein, 6 aa, Giardia lamblia
GEPPEP

SEQ ID NO: 3053957 - protein, 10 aa, Giardia lamblia
GEPSCPPHTT

SEQ ID NO: 3053958 - protein, 10 aa, Giardia lamblia
GEPSNDLTTD

SEQ ID NO: 3053959 - protein, 15 aa, Giardia lamblia
GEPSTYKKNQLPKSY

SEQ ID NO: 3053960 - protein, 14 aa, Giardia lamblia
GEPTKGSKKRRHQN

SEQ ID NO: 3053961 - protein, 4 aa, Giardia lamblia
GEPY

SEQ ID NO: 3053962 - protein, 4 aa, Giardia lamblia
GEQW

SEQ ID NO: 3053963 - protein, 5 aa, Giardia lamblia
GERAR

SEQ ID NO: 3053964 - protein, 16 aa, Giardia lamblia
GERASKEHQKKRRVQH

SEQ ID NO: 3053965 - protein, 10 aa, Giardia lamblia
GERGSGKTTI

SEQ ID NO: 3053966 - protein, 4 aa, Giardia lamblia
GERL

SEQ ID NO: 3053967 - protein, 7 aa, Giardia lamblia
GERQQEA

SEQ ID NO: 3053968 - protein, 4 aa, Giardia lamblia
GERT

SEQ ID NO: 3053969 - protein, 6 aa, Giardia lamblia
GERTIK

SEQ ID NO: 3053970 - protein, 5 aa, Giardia lamblia
GERWG

SEQ ID NO: 3053971 - protein, 11 aa, Giardia lamblia
GESGAEARRRT

SEQ ID NO: 3053972 - protein, 9 aa, Giardia lamblia
GESKAQAAP

SEQ ID NO: 3053973 - protein, 14 aa, Giardia lamblia
GESLKKSEHIKPEH

SEQ ID NO: 3053974 - protein, 12 aa, Giardia lamblia
GESLQSNPGAHN

SEQ ID NO: 3053975 - protein, 6 aa, Giardia lamblia
GESNPA

SEQ ID NO: 3053976 - protein, 7 aa, Giardia lamblia
GESPNEN

SEQ ID NO: 3053977 - protein, 6 aa, Giardia lamblia
GESPTH

SEQ ID NO: 3053978 - protein, 6 aa, Giardia lamblia
GESQQI

SEQ ID NO: 3053979 - protein, 7 aa, Giardia lamblia
GESSKSA

SEQ ID NO: 3053980 - protein, 10 aa, Giardia lamblia
GESSQDTSSI

SEQ ID NO: 3053981 - protein, 7 aa, Giardia lamblia
GESSRLG

SEQ ID NO: 3053982 - protein, 25 aa, Giardia lamblia
GESSSAATTMADSSIESVENKDPSV

SEQ ID NO: 3053983 - protein, 5 aa, Giardia lamblia
GESTQ

SEQ ID NO: 3053984 - protein, 8 aa, Giardia lamblia
GETAQSGV

SEQ ID NO: 3053985 - protein, 11 aa, Giardia lamblia
GETDSYNNSPN

SEQ ID NO: 3053986 - protein, 6 aa, Giardia lamblia
GETERA

SEQ ID NO: 3053987 - protein, 8 aa, Giardia lamblia
GETEYKRG

SEQ ID NO: 3053988 - protein, 6 aa, Giardia lamblia
GETKTY

SEQ ID NO: 3053989 - protein, 4 aa, Giardia lamblia
GETL

SEQ ID NO: 3053990 - protein, 8 aa, Giardia lamblia
GETLPPNL

SEQ ID NO: 3053991 - protein, 4 aa, Giardia lamblia
GETP

SEQ ID NO: 3053992 - protein, 7 aa, Giardia lamblia
GETPSCV

SEQ ID NO: 3053993 - protein, 7 aa, Giardia lamblia
GETSETI

SEQ ID NO: 3053994 - protein, 6 aa, Giardia lamblia
GETVGE

SEQ ID NO: 3053995 - protein, 6 aa, Giardia lamblia
GETVGS

SEQ ID NO: 3053996 - protein, 19 aa, Giardia lamblia
GEVDGKDFSENKTSYNHSA

SEQ ID NO: 3053997 - protein, 36 aa, Giardia lamblia
GEYEPETPPEPNPDPEPSPDPDPSPEPDPSTNESSI

SEQ ID NO: 3053998 - protein, 6 aa, Giardia lamblia
GEYTNG

SEQ ID NO: 3053999 - protein, 8 aa, Giardia lamblia
GFAAAEQQ

SEQ ID NO: 3054000 - protein, 12 aa, Giardia lamblia
GFDGPGGDSLTN

SEQ ID NO: 3054001 - protein, 4 aa, Giardia lamblia
GFGE

SEQ ID NO: 3054002 - protein, 4 aa, Giardia lamblia
GFGG

SEQ ID NO: 3054003 - protein, 10 aa, Giardia lamblia
GFGGSKGIQG

SEQ ID NO: 3054004 - protein, 10 aa, Giardia lamblia
GFKGTAATTD

SEQ ID NO: 3054005 - protein, 10 aa, Giardia lamblia
GFKKSSDGIT

SEQ ID NO: 3054006 - protein, 5 aa, Giardia lamblia
GFPGS

SEQ ID NO: 3054007 - protein, 4 aa, Giardia lamblia
GFPK

SEQ ID NO: 3054008 - protein, 7 aa, Giardia lamblia
GFPNESH

SEQ ID NO: 3054009 - protein, 6 aa, Giardia lamblia
GFPNTK

SEQ ID NO: 3054010 - protein, 6 aa, Giardia lamblia
GFQDNH

SEQ ID NO: 3054011 - protein, 6 aa, Giardia lamblia
GFQRPY

SEQ ID NO: 3054012 - protein, 7 aa, Giardia lamblia
GFQTPEH

SEQ ID NO: 3054013 - protein, 8 aa, Giardia lamblia
GFREEDTA

SEQ ID NO: 3054014 - protein, 5 aa, Giardia lamblia
GFRSD

SEQ ID NO: 3054015 - protein, 5 aa, Giardia lamblia
GFSGE

SEQ ID NO: 3054016 - protein, 8 aa, Giardia lamblia
GFSGNQGV

SEQ ID NO: 3054017 - protein, 7 aa, Giardia lamblia
GFSKSSA

SEQ ID NO: 3054018 - protein, 8 aa, Giardia lamblia
GFSKTDKG

SEQ ID NO: 3054019 - protein, 9 aa, Giardia lamblia
GFSKTDKGC

SEQ ID NO: 3054020 - protein, 8 aa, Giardia lamblia
GFSKTNKG

SEQ ID NO: 3054021 - protein, 7 aa, Giardia lamblia
GFSSNQS

SEQ ID NO: 3054022 - protein, 11 aa, Giardia lamblia
GFTNPAKECTE

SEQ ID NO: 3054023 - protein, 7 aa, Giardia lamblia
GFTNTNG

SEQ ID NO: 3054024 - protein, 5 aa, Giardia lamblia
GFTSD

SEQ ID NO: 3054025 - protein, 10 aa, Giardia lamblia
GFTSDSTYRN

SEQ ID NO: 3054026 - protein, 4 aa, Giardia lamblia
GFTY

SEQ ID NO: 3054027 - protein, 6 aa, Giardia lamblia
GGAAQS

SEQ ID NO: 3054028 - protein, 14 aa, Giardia lamblia
GGAELTEAERAKLA

SEQ ID NO: 3054029 - protein, 7 aa, Giardia lamblia
GGAHSAG

SEQ ID NO: 3054030 - protein, 4 aa, Giardia lamblia
GGAQ

SEQ ID NO: 3054031 - protein, 13 aa, Giardia lamblia
GGATKQTLAEQQH

SEQ ID NO: 3054032 - protein, 5 aa, Giardia lamblia
GGATM

SEQ ID NO: 3054033 - protein, 12 aa, Giardia lamblia
GGATRLSESPTH

SEQ ID NO: 3054034 - protein, 9 aa, Giardia lamblia
GGDAVNKRG

SEQ ID NO: 3054035 - protein, 4 aa, Giardia lamblia
GGDE

SEQ ID NO: 3054036 - protein, 26 aa, Giardia lamblia
GGDGEPTQQREGSDPDREFVVRPMRY

SEQ ID NO: 3054037 - protein, 12 aa, Giardia lamblia
GGDGTYSATDPA

SEQ ID NO: 3054038 - protein, 4 aa, Giardia lamblia
GGDI

SEQ ID NO: 3054039 - protein, 4 aa, Giardia lamblia
GGDT

SEQ ID NO: 3054040 - protein, 25 aa, Giardia lamblia
GGDTNSATGPGGVAAQADAETARER

SEQ ID NO: 3054041 - protein, 4 aa, Giardia lamblia
GGDV

SEQ ID NO: 3054042 - protein, 6 aa, Giardia lamblia
GGEAGA

SEQ ID NO: 3054043 - protein, 4 aa, Giardia lamblia
GGEC

SEQ ID NO: 3054044 - protein, 6 aa, Giardia lamblia
GGECAE

SEQ ID NO: 3054045 - protein, 5 aa, Giardia lamblia
GGEER

SEQ ID NO: 3054046 - protein, 8 aa, Giardia lamblia
GGEESTSY

SEQ ID NO: 3054047 - protein, 4 aa, Giardia lamblia
GGEG

SEQ ID NO: 3054048 - protein, 9 aa, Giardia lamblia
GGEKPEFSP

SEQ ID NO: 3054049 - protein, 11 aa, Giardia lamblia
GGEPPHRTGSV

SEQ ID NO: 3054050 - protein, 9 aa, Giardia lamblia
GGETASGHT

SEQ ID NO: 3054051 - protein, 6 aa, Giardia lamblia
GGFAPE

SEQ ID NO: 3054052 - protein, 13 aa, Giardia lamblia
GGFDPDGTDARNR

SEQ ID NO: 3054053 - protein, 13 aa, Giardia lamblia
GGGGADRSGRENR

SEQ ID NO: 3054054 - protein, 5 aa, Giardia lamblia
GGGGH

SEQ ID NO: 3054055 - protein, 5 aa, Giardia lamblia
GGGLE

SEQ ID NO: 3054056 - protein, 9 aa, Giardia lamblia
GGGLGSGTS

SEQ ID NO: 3054057 - protein, 8 aa, Giardia lamblia
GGGSGYTK

SEQ ID NO: 3054058 - protein, 10 aa, Giardia lamblia
GGGSKETGRP

SEQ ID NO: 3054059 - protein, 22 aa, Giardia lamblia
GGGSSGDGAVTQGSSVATGDAG

SEQ ID NO: 3054060 - protein, 12 aa, Giardia lamblia
GGGTCNEDNKRC

SEQ ID NO: 3054061 - protein, 5 aa, Giardia lamblia
GGGTP

SEQ ID NO: 3054062 - protein, 7 aa, Giardia lamblia
GGGYIGK

SEQ ID NO: 3054063 - protein, 7 aa, Giardia lamblia
GGIPPTA

SEQ ID NO: 3054064 - protein, 9 aa, Giardia lamblia
GGIPRPEGT

SEQ ID NO: 3054065 - protein, 10 aa, Giardia lamblia
GGKATEKKSV

SEQ ID NO: 3054066 - protein, 7 aa, Giardia lamblia
GGKEPAE

SEQ ID NO: 3054067 - protein, 15 aa, Giardia lamblia
GGKEPAEVFVTGGGR

SEQ ID NO: 3054068 - protein, 10 aa, Giardia lamblia
GGKFNTESAP

SEQ ID NO: 3054069 - protein, 9 aa, Giardia lamblia
GGKNPARRH

SEQ ID NO: 3054070 - protein, 5 aa, Giardia lamblia
GGKRY

SEQ ID NO: 3054071 - protein, 17 aa, Giardia lamblia
GGKSTSKKANRRTANGD

SEQ ID NO: 3054072 - protein, 11 aa, Giardia lamblia
GGLDGDPSLQY

SEQ ID NO: 3054073 - protein, 12 aa, Giardia lamblia
GGLNPSKYPRTS

SEQ ID NO: 3054074 - protein, 10 aa, Giardia lamblia
GGLQAEDGTT

SEQ ID NO: 3054075 - protein, 12 aa, Giardia lamblia
GGLQGSNKFSRY

SEQ ID NO: 3054076 - protein, 5 aa, Giardia lamblia
GGMRR

SEQ ID NO: 3054077 - protein, 22 aa, Giardia lamblia
GGNAGQTDTDSIDSTSQDPQHT

SEQ ID NO: 3054078 - protein, 5 aa, Giardia lamblia
GGNAT

SEQ ID NO: 3054079 - protein, 5 aa, Giardia lamblia
GGNED

SEQ ID NO: 3054080 - protein, 6 aa, Giardia lamblia
GGPEGY

SEQ ID NO: 3054081 - protein, 12 aa, Giardia lamblia
GGPGAGALDATT

SEQ ID NO: 3054082 - protein, 8 aa, Giardia lamblia
GGPLKQKA

SEQ ID NO: 3054083 - protein, 8 aa, Giardia lamblia
GGPRRTIT

SEQ ID NO: 3054084 - protein, 7 aa, Giardia lamblia
GGPSFDQ

SEQ ID NO: 3054085 - protein, 17 aa, Giardia lamblia
GGPSTSFGRTPASSTTM

SEQ ID NO: 3054086 - protein, 6 aa, Giardia lamblia
GGPSTV

SEQ ID NO: 3054087 - protein, 7 aa, Giardia lamblia
GGQRAAE

SEQ ID NO: 3054088 - protein, 9 aa, Giardia lamblia
GGQRTKYTD

SEQ ID NO: 3054089 - protein, 6 aa, Giardia lamblia
GGQYAS

SEQ ID NO: 3054090 - protein, 4 aa, Giardia lamblia
GGRG

SEQ ID NO: 3054091 - protein, 4 aa, Giardia lamblia
GGRP

SEQ ID NO: 3054092 - protein, 25 aa, Giardia lamblia
GGRPKRGAKYTSLTRGESYDYRQSL

SEQ ID NO: 3054093 - protein, 11 aa, Giardia lamblia
GGRPRRGGTKY

SEQ ID NO: 3054094 - protein, 7 aa, Giardia lamblia
GGRTGEN

SEQ ID NO: 3054095 - protein, 4 aa, Giardia lamblia
GGRY

SEQ ID NO: 3054096 - protein, 20 aa, Giardia lamblia
GGSCADSKTLTSRETADSLN

SEQ ID NO: 3054097 - protein, 8 aa, Giardia lamblia
GGSEDSKV

SEQ ID NO: 3054098 - protein, 8 aa, Giardia lamblia
GGSGKQSL

SEQ ID NO: 3054099 - protein, 8 aa, Giardia lamblia
GGSGRKSL

SEQ ID NO: 3054100 - protein, 10 aa, Giardia lamblia
GGSLAPEQER

SEQ ID NO: 3054101 - protein, 6 aa, Giardia lamblia
GGSLQD

SEQ ID NO: 3054102 - protein, 13 aa, Giardia lamblia
GGSMYPDDDLGEC

SEQ ID NO: 3054103 - protein, 12 aa, Giardia lamblia
GGSRSTSGFTKT

SEQ ID NO: 3054104 - protein, 14 aa, Giardia lamblia
GGSSVKRSLGPGAI

SEQ ID NO: 3054105 - protein, 11 aa, Giardia lamblia
GGSVQASHVSS

SEQ ID NO: 3054106 - protein, 11 aa, Giardia lamblia
GGSYTGNGATC

SEQ ID NO: 3054107 - protein, 16 aa, Giardia lamblia
GGTATLDQTKITITPP

SEQ ID NO: 3054108 - protein, 11 aa, Giardia lamblia
GGTCGTTAARS

SEQ ID NO: 3054109 - protein, 6 aa, Giardia lamblia
GGTDSV

SEQ ID NO: 3054110 - protein, 12 aa, Giardia lamblia
GGTEDSLCSGNG

SEQ ID NO: 3054111 - protein, 6 aa, Giardia lamblia
GGTLSP

SEQ ID NO: 3054112 - protein, 4 aa, Giardia lamblia
GGTP

SEQ ID NO: 3054113 - protein, 10 aa, Giardia lamblia
GGTSRQKEAN

SEQ ID NO: 3054114 - protein, 15 aa, Giardia lamblia
GGTTGLSEYSDDPYD

SEQ ID NO: 3054115 - protein, 6 aa, Giardia lamblia
GGVGRE

SEQ ID NO: 3054116 - protein, 21 aa, Giardia lamblia
GGVSNTNLPNWDADPGARTAY

SEQ ID NO: 3054117 - protein, 6 aa, Giardia lamblia
GGYRGA

SEQ ID NO: 3054118 - protein, 6 aa, Giardia lamblia
GGYSED

SEQ ID NO: 3054119 - protein, 12 aa, Giardia lamblia
GGYSSHGAAEVT

SEQ ID NO: 3054120 - protein, 6 aa, Giardia lamblia
GGYSTD

SEQ ID NO: 3054121 - protein, 6 aa, Giardia lamblia
GGYSTE

SEQ ID NO: 3054122 - protein, 4 aa, Giardia lamblia
GHAG

SEQ ID NO: 3054123 - protein, 7 aa, Giardia lamblia
GHAGDTC

SEQ ID NO: 3054124 - protein, 6 aa, Giardia lamblia
GHDASR

SEQ ID NO: 3054125 - protein, 6 aa, Giardia lamblia
GHDPET

SEQ ID NO: 3054126 - protein, 7 aa, Giardia lamblia
GHEQTAS

SEQ ID NO: 3054127 - protein, 4 aa, Giardia lamblia
GHGF

SEQ ID NO: 3054128 - protein, 10 aa, Giardia lamblia
GHGNKKVQPE

SEQ ID NO: 3054129 - protein, 8 aa, Giardia lamblia
GHGSSGSR

SEQ ID NO: 3054130 - protein, 10 aa, Giardia lamblia
GHGTCKGDHT

SEQ ID NO: 3054131 - protein, 13 aa, Giardia lamblia
GHGTCKTDDPQDI

SEQ ID NO: 3054132 - protein, 12 aa, Giardia lamblia
GHGTCKTDDPRD

SEQ ID NO: 3054133 - protein, 10 aa, Giardia lamblia
GHGTCKTDNL

SEQ ID NO: 3054134 - protein, 8 aa, Giardia lamblia
GHKDPTIK

SEQ ID NO: 3054135 - protein, 7 aa, Giardia lamblia
GHKDTKK

SEQ ID NO: 3054136 - protein, 9 aa, Giardia lamblia
GHKPTVPHY

SEQ ID NO: 3054137 - protein, 9 aa, Giardia lamblia
GHQANDGTT

SEQ ID NO: 3054138 - protein, 4 aa, Giardia lamblia
GHQP

SEQ ID NO: 3054139 - protein, 8 aa, Giardia lamblia
GHTDPSEN

SEQ ID NO: 3054140 - protein, 10 aa, Giardia lamblia
GHTDSKAKTL

SEQ ID NO: 3054141 - protein, 6 aa, Giardia lamblia
GHTEEQ

SEQ ID NO: 3054142 - protein, 15 aa, Giardia lamblia
GHTKNRTKQQEKPAF

SEQ ID NO: 3054143 - protein, 5 aa, Giardia lamblia
GHTRL

SEQ ID NO: 3054144 - protein, 8 aa, Giardia lamblia
GHTTGVST

SEQ ID NO: 3054145 - protein, 5 aa, Giardia lamblia
GHTTN

SEQ ID NO: 3054146 - protein, 4 aa, Giardia lamblia
GHYP

SEQ ID NO: 3054147 - protein, 7 aa, Giardia lamblia
GIADRDG

SEQ ID NO: 3054148 - protein, 20 aa, Giardia lamblia
GIDADAPKGLTTNIDTPRHE

SEQ ID NO: 3054149 - protein, 17 aa, Giardia lamblia
GIDDDKKTELLVHLATF

SEQ ID NO: 3054150 - protein, 5 aa, Giardia lamblia
GIDEN

SEQ ID NO: 3054151 - protein, 4 aa, Giardia lamblia
GIDP

SEQ ID NO: 3054152 - protein, 4 aa, Giardia lamblia
GIDS

SEQ ID NO: 3054153 - protein, 14 aa, Giardia lamblia
GIKGCEDTLDSEGE

SEQ ID NO: 3054154 - protein, 23 aa, Giardia lamblia
GIKKPGSGTKAPKARMESPLRRT

SEQ ID NO: 3054155 - protein, 5 aa, Giardia lamblia
GINTA

SEQ ID NO: 3054156 - protein, 6 aa, Giardia lamblia
GIPPDV

SEQ ID NO: 3054157 - protein, 4 aa, Giardia lamblia
GIPQ

SEQ ID NO: 3054158 - protein, 6 aa, Giardia lamblia
GIPQGS

SEQ ID NO: 3054159 - protein, 7 aa, Giardia lamblia
GIPSTGT

SEQ ID NO: 3054160 - protein, 9 aa, Giardia lamblia
GIQDRKGQT

SEQ ID NO: 3054161 - protein, 8 aa, Giardia lamblia
GIQGASGS

SEQ ID NO: 3054162 - protein, 4 aa, Giardia lamblia
GIRR

SEQ ID NO: 3054163 - protein, 6 aa, Giardia lamblia
GIRTVR

SEQ ID NO: 3054164 - protein, 12 aa, Giardia lamblia
GISDPGETRQTQ

SEQ ID NO: 3054165 - protein, 28 aa, Giardia lamblia
GISGELNEAEGDITGHEAEPMGQPSSQE

SEQ ID NO: 3054166 - protein, 11 aa, Giardia lamblia
GISGQLARENN

SEQ ID NO: 3054167 - protein, 15 aa, Giardia lamblia
GISGRTSKRMTRKER

SEQ ID NO: 3054168 - protein, 5 aa, Giardia lamblia
GISPT

SEQ ID NO: 3054169 - protein, 48 aa, Giardia lamblia
GISQSGYRPTSALASQTSKYLGGDHKDASSISERSSIDGLSRKEGPKR

SEQ ID NO: 3054170 - protein, 12 aa, Giardia lamblia
GISSASSKRSLN

SEQ ID NO: 3054171 - protein, 10 aa, Giardia lamblia
GISTGQPNVQ

SEQ ID NO: 3054172 - protein, 15 aa, Giardia lamblia
GISTNNQSIVKSTSS

SEQ ID NO: 3054173 - protein, 8 aa, Giardia lamblia
GITDSEAR

SEQ ID NO: 3054174 - protein, 13 aa, Giardia lamblia
GITGSQARYSKTA

SEQ ID NO: 3054175 - protein, 7 aa, Giardia lamblia
GKAAGVA

SEQ ID NO: 3054176 - protein, 7 aa, Giardia lamblia
GKADDSV

SEQ ID NO: 3054177 - protein, 10 aa, Giardia lamblia
GKADPSATAP

SEQ ID NO: 3054178 - protein, 6 aa, Giardia lamblia
GKAGKQ

SEQ ID NO: 3054179 - protein, 9 aa, Giardia lamblia
GKAHESPNV

SEQ ID NO: 3054180 - protein, 13 aa, Giardia lamblia
GKANRQNQGSTVM

SEQ ID NO: 3054181 - protein, 8 aa, Giardia lamblia
GKAQVSTN

SEQ ID NO: 3054182 - protein, 7 aa, Giardia lamblia
GKASAPG

SEQ ID NO: 3054183 - protein, 15 aa, Giardia lamblia
GKASEPESPDYASLR

SEQ ID NO: 3054184 - protein, 8 aa, Giardia lamblia
GKASPRYV

SEQ ID NO: 3054185 - protein, 8 aa, Giardia lamblia
GKASSLTS

SEQ ID NO: 3054186 - protein, 15 aa, Giardia lamblia
GKASTNGEQAPLQPL

SEQ ID NO: 3054187 - protein, 11 aa, Giardia lamblia
GKCATNDKSHY

SEQ ID NO: 3054188 - protein, 7 aa, Giardia lamblia
GKCKNYD

SEQ ID NO: 3054189 - protein, 6 aa, Giardia lamblia
GKCPPC

SEQ ID NO: 3054190 - protein, 11 aa, Giardia lamblia
GKCVSENGVTP

SEQ ID NO: 3054191 - protein, 9 aa, Giardia lamblia
GKDAKKGYY

SEQ ID NO: 3054192 - protein, 7 aa, Giardia lamblia
GKDALSS

SEQ ID NO: 3054193 - protein, 8 aa, Giardia lamblia
GKDANQLY

SEQ ID NO: 3054194 - protein, 36 aa, Giardia lamblia
GKDDVGKSGSSRGAHKQSFSYNSNYDKLKKTKEGAL

SEQ ID NO: 3054195 - protein, 17 aa, Giardia lamblia
GKDEEGEPAKEQAKQTL

SEQ ID NO: 3054196 - protein, 42 aa, Giardia lamblia
GKDPTPPKVDNINSRPQSPSVGKVKNGGVASLSKKDTTPAAL

SEQ ID NO: 3054197 - protein, 6 aa, Giardia lamblia
GKDQIQ

SEQ ID NO: 3054198 - protein, 8 aa, Giardia lamblia
GKDTPGRD

SEQ ID NO: 3054199 - protein, 7 aa, Giardia lamblia
GKEDSLI

SEQ ID NO: 3054200 - protein, 10 aa, Giardia lamblia
GKEELPSSSL

SEQ ID NO: 3054201 - protein, 11 aa, Giardia lamblia
GKEGKQASLAS

SEQ ID NO: 3054202 - protein, 8 aa, Giardia lamblia
GKELPPQF

SEQ ID NO: 3054203 - protein, 9 aa, Giardia lamblia
GKEPKSPDD

SEQ ID NO: 3054204 - protein, 9 aa, Giardia lamblia
GKESKGPVS

SEQ ID NO: 3054205 - protein, 13 aa, Giardia lamblia
GKESQQQSTSFSN

SEQ ID NO: 3054206 - protein, 6 aa, Giardia lamblia
GKESTV

SEQ ID NO: 3054207 - protein, 6 aa, Giardia lamblia
GKEVDR

SEQ ID NO: 3054208 - protein, 12 aa, Giardia lamblia
GKEYNERSSVTT

SEQ ID NO: 3054209 - protein, 6 aa, Giardia lamblia
GKGDFE

SEQ ID NO: 3054210 - protein, 9 aa, Giardia lamblia
GKGEVSAEP

SEQ ID NO: 3054211 - protein, 5 aa, Giardia lamblia
GKGGG

SEQ ID NO: 3054212 - protein, 4 aa, Giardia lamblia
GKGH

SEQ ID NO: 3054213 - protein, 6 aa, Giardia lamblia
GKGREA

SEQ ID NO: 3054214 - protein, 7 aa, Giardia lamblia
GKGTAPL

SEQ ID NO: 3054215 - protein, 6 aa, Giardia lamblia
GKGVSV

SEQ ID NO: 3054216 - protein, 13 aa, Giardia lamblia
GKISSTKKVTQDS

SEQ ID NO: 3054217 - protein, 13 aa, Giardia lamblia
GKKEAAEYDATQR

SEQ ID NO: 3054218 - protein, 8 aa, Giardia lamblia
GKKEPSLN

SEQ ID NO: 3054219 - protein, 4 aa, Giardia lamblia
GKLE

SEQ ID NO: 3054220 - protein, 6 aa, Giardia lamblia
GKLKEE

SEQ ID NO: 3054221 - protein, 8 aa, Giardia lamblia
GKLRAQGS

SEQ ID NO: 3054222 - protein, 16 aa, Giardia lamblia
GKLSRETANNLQGQYT

SEQ ID NO: 3054223 - protein, 17 aa, Giardia lamblia
GKNAARARANPSASISA

SEQ ID NO: 3054224 - protein, 8 aa, Giardia lamblia
GKNASENL

SEQ ID NO: 3054225 - protein, 5 aa, Giardia lamblia
GKNFP

SEQ ID NO: 3054226 - protein, 9 aa, Giardia lamblia
GKNSSPDDA

SEQ ID NO: 3054227 - protein, 4 aa, Giardia lamblia
GKNV

SEQ ID NO: 3054228 - protein, 4 aa, Giardia lamblia
GKPA

SEQ ID NO: 3054229 - protein, 4 aa, Giardia lamblia
GKPK

SEQ ID NO: 3054230 - protein, 11 aa, Giardia lamblia
GKPLGSRSDRS

SEQ ID NO: 3054231 - protein, 11 aa, Giardia lamblia
GKPLSNSPHSR

SEQ ID NO: 3054232 - protein, 9 aa, Giardia lamblia
GKPNRSEVL

SEQ ID NO: 3054233 - protein, 9 aa, Giardia lamblia
GKPPGGYAD

SEQ ID NO: 3054234 - protein, 4 aa, Giardia lamblia
GKPQ

SEQ ID NO: 3054235 - protein, 6 aa, Giardia lamblia
GKPRVG

SEQ ID NO: 3054236 - protein, 16 aa, Giardia lamblia
GKPSSEKNSIRKRHRE

SEQ ID NO: 3054237 - protein, 9 aa, Giardia lamblia
GKPSTHGPG

SEQ ID NO: 3054238 - protein, 11 aa, Giardia lamblia
GKPTEDFDDRD

SEQ ID NO: 3054239 - protein, 6 aa, Giardia lamblia
GKPTVE

SEQ ID NO: 3054240 - protein, 9 aa, Giardia lamblia
GKPYGPRPA

SEQ ID NO: 3054241 - protein, 6 aa, Giardia lamblia
GKPYSE

SEQ ID NO: 3054242 - protein, 4 aa, Giardia lamblia
GKQP

SEQ ID NO: 3054243 - protein, 9 aa, Giardia lamblia
GKQQDLRNG

SEQ ID NO: 3054244 - protein, 9 aa, Giardia lamblia
GKQRGEPSK

SEQ ID NO: 3054245 - protein, 31 aa, Giardia lamblia
GKQRLRRSSSQDRSKARDKDVESKWGSHSGA

SEQ ID NO: 3054246 - protein, 29 aa, Giardia lamblia
GKQTGVGTYYSSAEDTLTEGEFEDGKAQE

SEQ ID NO: 3054247 - protein, 4 aa, Giardia lamblia
GKRI

SEQ ID NO: 3054248 - protein, 4 aa, Giardia lamblia
GKRN

SEQ ID NO: 3054249 - protein, 7 aa, Giardia lamblia
GKRPSSC

SEQ ID NO: 3054250 - protein, 17 aa, Giardia lamblia
GKRREPAKQASSKGTSY

SEQ ID NO: 3054251 - protein, 8 aa, Giardia lamblia
GKRRKTMK

SEQ ID NO: 3054252 - protein, 6 aa, Giardia lamblia
GKSAVG

SEQ ID NO: 3054253 - protein, 14 aa, Giardia lamblia
GKSCSEGCSGDTRG

SEQ ID NO: 3054254 - protein, 7 aa, Giardia lamblia
GKSKRKS

SEQ ID NO: 3054255 - protein, 9 aa, Giardia lamblia
GKSSHTYDP

SEQ ID NO: 3054256 - protein, 10 aa, Giardia lamblia
GKSSTGDARW

SEQ ID NO: 3054257 - protein, 5 aa, Giardia lamblia
GKSVG

SEQ ID NO: 3054258 - protein, 7 aa, Giardia lamblia
GKSYTAS

SEQ ID NO: 3054259 - protein, 9 aa, Giardia lamblia
GKSYVPEPF

SEQ ID NO: 3054260 - protein, 10 aa, Giardia lamblia
GKTGSGKSSL

SEQ ID NO: 3054261 - protein, 4 aa, Giardia lamblia
GKTL

SEQ ID NO: 3054262 - protein, 7 aa, Giardia lamblia
GKTLQNE

SEQ ID NO: 3054263 - protein, 8 aa, Giardia lamblia
GKTQHSNM

SEQ ID NO: 3054264 - protein, 10 aa, Giardia lamblia
GKTSAAESLK

SEQ ID NO: 3054265 - protein, 7 aa, Giardia lamblia
GKTSEYA

SEQ ID NO: 3054266 - protein, 14 aa, Giardia lamblia
GKVAGEQEKARKSE

SEQ ID NO: 3054267 - protein, 11 aa, Giardia lamblia
GKVPGQMASAT

SEQ ID NO: 3054268 - protein, 5 aa, Giardia lamblia
GKVPI

SEQ ID NO: 3054269 - protein, 9 aa, Giardia lamblia
GKVSQHDTE

SEQ ID NO: 3054270 - protein, 24 aa, Giardia lamblia
GKYAAVGGASCDASCSQPTTPTCT

SEQ ID NO: 3054271 - protein, 8 aa, Giardia lamblia
GKYGTRSM

SEQ ID NO: 3054272 - protein, 5 aa, Giardia lamblia
GLAGM

SEQ ID NO: 3054273 - protein, 15 aa, Giardia lamblia
GLASEKKAKAISPEL

SEQ ID NO: 3054274 - protein, 11 aa, Giardia lamblia
GLASEPRSTSL

SEQ ID NO: 3054275 - protein, 10 aa, Giardia lamblia
GLDAQGKRYR

SEQ ID NO: 3054276 - protein, 9 aa, Giardia lamblia
GLDNDTLTH

SEQ ID NO: 3054277 - protein, 4 aa, Giardia lamblia
GLDP

SEQ ID NO: 3054278 - protein, 14 aa, Giardia lamblia
GLDSDTTSDSATST

SEQ ID NO: 3054279 - protein, 8 aa, Giardia lamblia
GLDSSKVN

SEQ ID NO: 3054280 - protein, 9 aa, Giardia lamblia
GLEARRAQQ

SEQ ID NO: 3054281 - protein, 11 aa, Giardia lamblia
GLEGRNQEISN

SEQ ID NO: 3054282 - protein, 11 aa, Giardia lamblia
GLEKDDNSHID

SEQ ID NO: 3054283 - protein, 13 aa, Giardia lamblia
GLEMDSKGEPLPS

SEQ ID NO: 3054284 - protein, 5 aa, Giardia lamblia
GLESP

SEQ ID NO: 3054285 - protein, 11 aa, Giardia lamblia
GLESSPKPKIM

SEQ ID NO: 3054286 - protein, 13 aa, Giardia lamblia
GLESTRVDSENEL

SEQ ID NO: 3054287 - protein, 5 aa, Giardia lamblia
GLGAQ

SEQ ID NO: 3054288 - protein, 7 aa, Giardia lamblia
GLGGAVP

SEQ ID NO: 3054289 - protein, 10 aa, Giardia lamblia
GLHGEAPPEG

SEQ ID NO: 3054290 - protein, 6 aa, Giardia lamblia
GLLPED

SEQ ID NO: 3054291 - protein, 8 aa, Giardia lamblia
GLNPESGQ

SEQ ID NO: 3054292 - protein, 8 aa, Giardia lamblia
GLPATDGE

SEQ ID NO: 3054293 - protein, 7 aa, Giardia lamblia
GLPESHT

SEQ ID NO: 3054294 - protein, 7 aa, Giardia lamblia
GLPSDGD

SEQ ID NO: 3054295 - protein, 20 aa, Giardia lamblia
GLPTESALTEASSSASCGEL

SEQ ID NO: 3054296 - protein, 9 aa, Giardia lamblia
GLPTTAANV

SEQ ID NO: 3054297 - protein, 10 aa, Giardia lamblia
GLQDNANGIN

SEQ ID NO: 3054298 - protein, 9 aa, Giardia lamblia
GLQDNKGNT

SEQ ID NO: 3054299 - protein, 9 aa, Giardia lamblia
GLQDQEGRT

SEQ ID NO: 3054300 - protein, 8 aa, Giardia lamblia
GLQEDGDY

SEQ ID NO: 3054301 - protein, 12 aa, Giardia lamblia
GLRNPKSVCKNK

SEQ ID NO: 3054302 - protein, 10 aa, Giardia lamblia
GLSDSSTTTA

SEQ ID NO: 3054303 - protein, 9 aa, Giardia lamblia
GLSGGQRQR

SEQ ID NO: 3054304 - protein, 5 aa, Giardia lamblia
GLSGV

SEQ ID NO: 3054305 - protein, 5 aa, Giardia lamblia
GLSPA

SEQ ID NO: 3054306 - protein, 6 aa, Giardia lamblia
GLSPAL

SEQ ID NO: 3054307 - protein, 6 aa, Giardia lamblia
GLSTGA

SEQ ID NO: 3054308 - protein, 11 aa, Giardia lamblia
GLSTNRNSNIR

SEQ ID NO: 3054309 - protein, 10 aa, Giardia lamblia
GLSTPQLRPE

SEQ ID NO: 3054310 - protein, 4 aa, Giardia lamblia
GLTG

SEQ ID NO: 3054311 - protein, 4 aa, Giardia lamblia
GLTI

SEQ ID NO: 3054312 - protein, 7 aa, Giardia lamblia
GLTPPTS

SEQ ID NO: 3054313 - protein, 10 aa, Giardia lamblia
GLTPSISSTN

SEQ ID NO: 3054314 - protein, 4 aa, Giardia lamblia
GLTS

SEQ ID NO: 3054315 - protein, 12 aa, Giardia lamblia
GLTSAAKDVRTA

SEQ ID NO: 3054316 - protein, 11 aa, Giardia lamblia
GLTTQDGGCVD

SEQ ID NO: 3054317 - protein, 9 aa, Giardia lamblia
GLYNSRGES

SEQ ID NO: 3054318 - protein, 6 aa, Giardia lamblia
GLYQTD

SEQ ID NO: 3054319 - protein, 8 aa, Giardia lamblia
GMDSTSGL

SEQ ID NO: 3054320 - protein, 4 aa, Giardia lamblia
GMED

SEQ ID NO: 3054321 - protein, 5 aa, Giardia lamblia
GMEDN

SEQ ID NO: 3054322 - protein, 19 aa, Giardia lamblia
GMEETAQEVYEEPEPLGDD

SEQ ID NO: 3054323 - protein, 6 aa, Giardia lamblia
GMESPT

SEQ ID NO: 3054324 - protein, 10 aa, Giardia lamblia
GMKDSKNKTA

SEQ ID NO: 3054325 - protein, 10 aa, Giardia lamblia
GMKGYDGGNL

SEQ ID NO: 3054326 - protein, 19 aa, Giardia lamblia
GMPHGEGVRRQKSGDVYTG

SEQ ID NO: 3054327 - protein, 7 aa, Giardia lamblia
GMPLDSK

SEQ ID NO: 3054328 - protein, 8 aa, Giardia lamblia
GMQSSDGY

SEQ ID NO: 3054329 - protein, 4 aa, Giardia lamblia
GMRP

SEQ ID NO: 3054330 - protein, 7 aa, Giardia lamblia
GMRSSNG

SEQ ID NO: 3054331 - protein, 7 aa, Giardia lamblia
GMSGTSQ

SEQ ID NO: 3054332 - protein, 12 aa, Giardia lamblia
GMTDKGTHGGFS

SEQ ID NO: 3054333 - protein, 11 aa, Giardia lamblia
GMTGKPSAQNT

SEQ ID NO: 3054334 - protein, 9 aa, Giardia lamblia
GMTNNTGQT

SEQ ID NO: 3054335 - protein, 7 aa, Giardia lamblia
GMTTEES

SEQ ID NO: 3054336 - protein, 9 aa, Giardia lamblia
GMTTPDGKT

SEQ ID NO: 3054337 - protein, 9 aa, Giardia lamblia
GNAASQCNG

SEQ ID NO: 3054338 - protein, 21 aa, Giardia lamblia
GNAAVSQANRVTGTSSGHIDR

SEQ ID NO: 3054339 - protein, 10 aa, Giardia lamblia
GNADQKEAKL

SEQ ID NO: 3054340 - protein, 12 aa, Giardia lamblia
GNAFDGESPVKG

SEQ ID NO: 3054341 - protein, 11 aa, Giardia lamblia
GNANDQHTVTR

SEQ ID NO: 3054342 - protein, 5 aa, Giardia lamblia
GNCKP

SEQ ID NO: 3054343 - protein, 6 aa, Giardia lamblia
GNDEPL

SEQ ID NO: 3054344 - protein, 5 aa, Giardia lamblia
GNDES

SEQ ID NO: 3054345 - protein, 5 aa, Giardia lamblia
GNDRG

SEQ ID NO: 3054346 - protein, 5 aa, Giardia lamblia
GNEEP

SEQ ID NO: 3054347 - protein, 14 aa, Giardia lamblia
GNEGLHASNSSDFS

SEQ ID NO: 3054348 - protein, 8 aa, Giardia lamblia
GNEGQQFA

SEQ ID NO: 3054349 - protein, 10 aa, Giardia lamblia
GNETASAGAC

SEQ ID NO: 3054350 - protein, 25 aa, Giardia lamblia
GNEYSASGIEVTEESRQVKQREYSD

SEQ ID NO: 3054351 - protein, 8 aa, Giardia lamblia
GNGAGKST

SEQ ID NO: 3054352 - protein, 4 aa, Giardia lamblia
GNGC

SEQ ID NO: 3054353 - protein, 9 aa, Giardia lamblia
GNGDDANEN

SEQ ID NO: 3054354 - protein, 6 aa, Giardia lamblia
GNGGGI

SEQ ID NO: 3054355 - protein, 7 aa, Giardia lamblia
GNGKEFE

SEQ ID NO: 3054356 - protein, 6 aa, Giardia lamblia
GNGMPA

SEQ ID NO: 3054357 - protein, 14 aa, Giardia lamblia
GNGNGGSGGTNSVK

SEQ ID NO: 3054358 - protein, 10 aa, Giardia lamblia
GNGNNLPNTA

SEQ ID NO: 3054359 - protein, 7 aa, Giardia lamblia
GNGNVSL

SEQ ID NO: 3054360 - protein, 18 aa, Giardia lamblia
GNGTATISSSSADASKPE

SEQ ID NO: 3054361 - protein, 5 aa, Giardia lamblia
GNGVK

SEQ ID NO: 3054362 - protein, 7 aa, Giardia lamblia
GNHDKAV

SEQ ID NO: 3054363 - protein, 5 aa, Giardia lamblia
GNHDT

SEQ ID NO: 3054364 - protein, 17 aa, Giardia lamblia
GNIDDKLDSDTTKSTKV

SEQ ID NO: 3054365 - protein, 6 aa, Giardia lamblia
GNIKDA

SEQ ID NO: 3054366 - protein, 6 aa, Giardia lamblia
GNKARG

SEQ ID NO: 3054367 - protein, 4 aa, Giardia lamblia
GNKD

SEQ ID NO: 3054368 - protein, 12 aa, Giardia lamblia
GNKSTMGGNPRP

SEQ ID NO: 3054369 - protein, 11 aa, Giardia lamblia
GNKTTLADGLT

SEQ ID NO: 3054370 - protein, 5 aa, Giardia lamblia
GNLER

SEQ ID NO: 3054371 - protein, 23 aa, Giardia lamblia
GNLGTSDNETETAPREQTTRKVK

SEQ ID NO: 3054372 - protein, 6 aa, Giardia lamblia
GNNHRT

SEQ ID NO: 3054373 - protein, 5 aa, Giardia lamblia
GNPAL

SEQ ID NO: 3054374 - protein, 4 aa, Giardia lamblia
GNPE

SEQ ID NO: 3054375 - protein, 8 aa, Giardia lamblia
GNPSYSWG

SEQ ID NO: 3054376 - protein, 5 aa, Giardia lamblia
GNPTS

SEQ ID NO: 3054377 - protein, 21 aa, Giardia lamblia
GNQNDRDQQEQQEKDGDDEAI

SEQ ID NO: 3054378 - protein, 4 aa, Giardia lamblia
GNQQ

SEQ ID NO: 3054379 - protein, 6 aa, Giardia lamblia
GNQRGD

SEQ ID NO: 3054380 - protein, 6 aa, Giardia lamblia
GNRCTS

SEQ ID NO: 3054381 - protein, 16 aa, Giardia lamblia
GNRGGGSGIQGTGGTK

SEQ ID NO: 3054382 - protein, 13 aa, Giardia lamblia
GNRSQYGPDPISR

SEQ ID NO: 3054383 - protein, 5 aa, Giardia lamblia
GNSAS

SEQ ID NO: 3054384 - protein, 5 aa, Giardia lamblia
GNSGR

SEQ ID NO: 3054385 - protein, 27 aa, Giardia lamblia
GNSMHRSSAAGEGSSTALGYSSSNAAI

SEQ ID NO: 3054386 - protein, 17 aa, Giardia lamblia
GNSSEARASKTSTEDVE

SEQ ID NO: 3054387 - protein, 14 aa, Giardia lamblia
GNSTGRSTNKSSLS

SEQ ID NO: 3054388 - protein, 16 aa, Giardia lamblia
GNSTGTVQRSESYPAE

SEQ ID NO: 3054389 - protein, 9 aa, Giardia lamblia
GNSTRLQSG

SEQ ID NO: 3054390 - protein, 8 aa, Giardia lamblia
GNTDTKYV

SEQ ID NO: 3054391 - protein, 11 aa, Giardia lamblia
GNTFSSSSKLS

SEQ ID NO: 3054392 - protein, 8 aa, Giardia lamblia
GNTGSGKS

SEQ ID NO: 3054393 - protein, 8 aa, Giardia lamblia
GNTKNLTT

SEQ ID NO: 3054394 - protein, 7 aa, Giardia lamblia
GNTNAQD

SEQ ID NO: 3054395 - protein, 5 aa, Giardia lamblia
GNTQT

SEQ ID NO: 3054396 - protein, 7 aa, Giardia lamblia
GNTSSSS

SEQ ID NO: 3054397 - protein, 7 aa, Giardia lamblia
GNVGSQT

SEQ ID NO: 3054398 - protein, 4 aa, Giardia lamblia
GNVQ

SEQ ID NO: 3054399 - protein, 7 aa, Giardia lamblia
GNVSSAR

SEQ ID NO: 3054400 - protein, 5 aa, Giardia lamblia
GNYAP

SEQ ID NO: 3054401 - protein, 8 aa, Giardia lamblia
GNYGSTHR

SEQ ID NO: 3054402 - protein, 8 aa, Giardia lamblia
GNYLTPTS

SEQ ID NO: 3054403 - protein, 6 aa, Giardia lamblia
GNYTEA

SEQ ID NO: 3054404 - protein, 14 aa, Giardia lamblia
GPAGTGKTESTRQL

SEQ ID NO: 3054405 - protein, 6 aa, Giardia lamblia
GPAISS

SEQ ID NO: 3054406 - protein, 9 aa, Giardia lamblia
GPATTSYRG

SEQ ID NO: 3054407 - protein, 10 aa, Giardia lamblia
GPCKDPSNLT

SEQ ID NO: 3054408 - protein, 16 aa, Giardia lamblia
GPCSNGHQSSREAKRA

SEQ ID NO: 3054409 - protein, 10 aa, Giardia lamblia
GPDEARCDPG

SEQ ID NO: 3054410 - protein, 9 aa, Giardia lamblia
GPDHGANED

SEQ ID NO: 3054411 - protein, 5 aa, Giardia lamblia
GPDIG

SEQ ID NO: 3054412 - protein, 10 aa, Giardia lamblia
GPDLPATPTL

SEQ ID NO: 3054413 - protein, 6 aa, Giardia lamblia
GPDPAK

SEQ ID NO: 3054414 - protein, 11 aa, Giardia lamblia
GPDQNPETLKE

SEQ ID NO: 3054415 - protein, 9 aa, Giardia lamblia
GPEEPNPEL

SEQ ID NO: 3054416 - protein, 10 aa, Giardia lamblia
GPEKMGPKTI

SEQ ID NO: 3054417 - protein, 4 aa, Giardia lamblia
GPEM

SEQ ID NO: 3054418 - protein, 5 aa, Giardia lamblia
GPEPM

SEQ ID NO: 3054419 - protein, 6 aa, Giardia lamblia
GPEVPA

SEQ ID NO: 3054420 - protein, 5 aa, Giardia lamblia
GPGAC

SEQ ID NO: 3054421 - protein, 6 aa, Giardia lamblia
GPGACT

SEQ ID NO: 3054422 - protein, 8 aa, Giardia lamblia
GPGENQCT

SEQ ID NO: 3054423 - protein, 15 aa, Giardia lamblia
GPGERGQASSGTCAP

SEQ ID NO: 3054424 - protein, 5 aa, Giardia lamblia
GPGET

SEQ ID NO: 3054425 - protein, 6 aa, Giardia lamblia
GPGGRR

SEQ ID NO: 3054426 - protein, 14 aa, Giardia lamblia
GPGHHGDDHNLQTA

SEQ ID NO: 3054427 - protein, 4 aa, Giardia lamblia
GPGI

SEQ ID NO: 3054428 - protein, 6 aa, Giardia lamblia
GPGPGD

SEQ ID NO: 3054429 - protein, 6 aa, Giardia lamblia
GPGSTH

SEQ ID NO: 3054430 - protein, 12 aa, Giardia lamblia
GPGTPVQPPTNR

SEQ ID NO: 3054431 - protein, 4 aa, Giardia lamblia
GPHE

SEQ ID NO: 3054432 - protein, 8 aa, Giardia lamblia
GPHGGPDS

SEQ ID NO: 3054433 - protein, 7 aa, Giardia lamblia
GPHSKLD

SEQ ID NO: 3054434 - protein, 14 aa, Giardia lamblia
GPISSVAPNASHVN

SEQ ID NO: 3054435 - protein, 6 aa, Giardia lamblia
GPITKT

SEQ ID NO: 3054436 - protein, 6 aa, Giardia lamblia
GPKESG

SEQ ID NO: 3054437 - protein, 6 aa, Giardia lamblia
GPKTLS

SEQ ID NO: 3054438 - protein, 4 aa, Giardia lamblia
GPLA

SEQ ID NO: 3054439 - protein, 5 aa, Giardia lamblia
GPLED

SEQ ID NO: 3054440 - protein, 5 aa, Giardia lamblia
GPLES

SEQ ID NO: 3054441 - protein, 5 aa, Giardia lamblia
GPLGL

SEQ ID NO: 3054442 - protein, 8 aa, Giardia lamblia
GPLQQPST

SEQ ID NO: 3054443 - protein, 7 aa, Giardia lamblia
GPMSNDD

SEQ ID NO: 3054444 - protein, 49 aa, Giardia lamblia
GPMTTPMKQTPSKESIRTMRSGSRSSSASRSVPRRAGSSDVGRNISRKS

SEQ ID NO: 3054445 - protein, 10 aa, Giardia lamblia
GPNANDCTSC

SEQ ID NO: 3054446 - protein, 8 aa, Giardia lamblia
GPNGASLE

SEQ ID NO: 3054447 - protein, 6 aa, Giardia lamblia
GPNGNA

SEQ ID NO: 3054448 - protein, 9 aa, Giardia lamblia
GPPPAAPLS

SEQ ID NO: 3054449 - protein, 5 aa, Giardia lamblia
GPPQL

SEQ ID NO: 3054450 - protein, 7 aa, Giardia lamblia
GPPSNLD

SEQ ID NO: 3054451 - protein, 23 aa, Giardia lamblia
GPPVEEVKRPPSTSVAKKGDKKV

SEQ ID NO: 3054452 - protein, 6 aa, Giardia lamblia
GPQDDE

SEQ ID NO: 3054453 - protein, 4 aa, Giardia lamblia
GPQE

SEQ ID NO: 3054454 - protein, 4 aa, Giardia lamblia
GPQF

SEQ ID NO: 3054455 - protein, 15 aa, Giardia lamblia
GPQLTKQSTKDLASD

SEQ ID NO: 3054456 - protein, 7 aa, Giardia lamblia
GPQRDSI

SEQ ID NO: 3054457 - protein, 10 aa, Giardia lamblia
GPQSSGKSTL

SEQ ID NO: 3054458 - protein, 5 aa, Giardia lamblia
GPQTA

SEQ ID NO: 3054459 - protein, 18 aa, Giardia lamblia
GPQTPQSLPSSHNSWKQR

SEQ ID NO: 3054460 - protein, 4 aa, Giardia lamblia
GPRQ

SEQ ID NO: 3054461 - protein, 7 aa, Giardia lamblia
GPRSAKY

SEQ ID NO: 3054462 - protein, 5 aa, Giardia lamblia
GPRST

SEQ ID NO: 3054463 - protein, 20 aa, Giardia lamblia
GPRTPTPAEVKSTYPCNSLE

SEQ ID NO: 3054464 - protein, 16 aa, Giardia lamblia
GPRVQQKEEAGDACTP

SEQ ID NO: 3054465 - protein, 4 aa, Giardia lamblia
GPRY

SEQ ID NO: 3054466 - protein, 4 aa, Giardia lamblia
GPSA

SEQ ID NO: 3054467 - protein, 9 aa, Giardia lamblia
GPSADQCEA

SEQ ID NO: 3054468 - protein, 8 aa, Giardia lamblia
GPSATWNE

SEQ ID NO: 3054469 - protein, 7 aa, Giardia lamblia
GPSAVTT

SEQ ID NO: 3054470 - protein, 6 aa, Giardia lamblia
GPSERE

SEQ ID NO: 3054471 - protein, 16 aa, Giardia lamblia
GPSGITKYSDDNSPDH

SEQ ID NO: 3054472 - protein, 14 aa, Giardia lamblia
GPSPSADSNGNTTL

SEQ ID NO: 3054473 - protein, 14 aa, Giardia lamblia
GPSPTVDSKPRHGK

SEQ ID NO: 3054474 - protein, 8 aa, Giardia lamblia
GPSSTPNL

SEQ ID NO: 3054475 - protein, 6 aa, Giardia lamblia
GPSTRP

SEQ ID NO: 3054476 - protein, 14 aa, Giardia lamblia
GPTALAKKSSVENP

SEQ ID NO: 3054477 - protein, 10 aa, Giardia lamblia
GPTDLPPTKE

SEQ ID NO: 3054478 - protein, 11 aa, Giardia lamblia
GPTGCGKSTQV

SEQ ID NO: 3054479 - protein, 8 aa, Giardia lamblia
GPTGNKDV

SEQ ID NO: 3054480 - protein, 8 aa, Giardia lamblia
GPTGRGVS

SEQ ID NO: 3054481 - protein, 9 aa, Giardia lamblia
GPTIGSGAP

SEQ ID NO: 3054482 - protein, 6 aa, Giardia lamblia
GPTNVA

SEQ ID NO: 3054483 - protein, 7 aa, Giardia lamblia
GPTPSLD

SEQ ID NO: 3054484 - protein, 7 aa, Giardia lamblia
GPTSATC

SEQ ID NO: 3054485 - protein, 12 aa, Giardia lamblia
GPYKSLPSGPVA

SEQ ID NO: 3054486 - protein, 5 aa, Giardia lamblia
GPYLP

SEQ ID NO: 3054487 - protein, 7 aa, Giardia lamblia
GPYSNQS

SEQ ID NO: 3054488 - protein, 7 aa, Giardia lamblia
GQACQSA

SEQ ID NO: 3054489 - protein, 25 aa, Giardia lamblia
GQAHSSASFTSNTTDRGKANNPTQS

SEQ ID NO: 3054490 - protein, 15 aa, Giardia lamblia
GQAKTVNYADQTEAL

SEQ ID NO: 3054491 - protein, 9 aa, Giardia lamblia
GQALGSTAM

SEQ ID NO: 3054492 - protein, 7 aa, Giardia lamblia
GQANAKA

SEQ ID NO: 3054493 - protein, 13 aa, Giardia lamblia
GQASSTNTKQQSM

SEQ ID NO: 3054494 - protein, 4 aa, Giardia lamblia
GQAT

SEQ ID NO: 3054495 - protein, 5 aa, Giardia lamblia
GQATC

SEQ ID NO: 3054496 - protein, 6 aa, Giardia lamblia
GQDAPQ

SEQ ID NO: 3054497 - protein, 7 aa, Giardia lamblia
GQDPQRL

SEQ ID NO: 3054498 - protein, 5 aa, Giardia lamblia
GQEDA

SEQ ID NO: 3054499 - protein, 5 aa, Giardia lamblia
GQEEA

SEQ ID NO: 3054500 - protein, 7 aa, Giardia lamblia
GQEGHIR

SEQ ID NO: 3054501 - protein, 4 aa, Giardia lamblia
GQEK

SEQ ID NO: 3054502 - protein, 7 aa, Giardia lamblia
GQETVGY

SEQ ID NO: 3054503 - protein, 6 aa, Giardia lamblia
GQGARW

SEQ ID NO: 3054504 - protein, 7 aa, Giardia lamblia
GQGGSGV

SEQ ID NO: 3054505 - protein, 6 aa, Giardia lamblia
GQHEEA

SEQ ID NO: 3054506 - protein, 5 aa, Giardia lamblia
GQHGT

SEQ ID NO: 3054507 - protein, 4 aa, Giardia lamblia
GQIA

SEQ ID NO: 3054508 - protein, 4 aa, Giardia lamblia
GQKI

SEQ ID NO: 3054509 - protein, 4 aa, Giardia lamblia
GQKK

SEQ ID NO: 3054510 - protein, 8 aa, Giardia lamblia
GQKSPRRI

SEQ ID NO: 3054511 - protein, 7 aa, Giardia lamblia
GQKYTEK

SEQ ID NO: 3054512 - protein, 8 aa, Giardia lamblia
GQLDPQNR

SEQ ID NO: 3054513 - protein, 5 aa, Giardia lamblia
GQNIP

SEQ ID NO: 3054514 - protein, 5 aa, Giardia lamblia
GQNKC

SEQ ID NO: 3054515 - protein, 11 aa, Giardia lamblia
GQNKNNEGTTN

SEQ ID NO: 3054516 - protein, 7 aa, Giardia lamblia
GQNNSLT

SEQ ID NO: 3054517 - protein, 6 aa, Giardia lamblia
GQPASK

SEQ ID NO: 3054518 - protein, 6 aa, Giardia lamblia
GQPGAE

SEQ ID NO: 3054519 - protein, 10 aa, Giardia lamblia
GQPNPSSYTY

SEQ ID NO: 3054520 - protein, 9 aa, Giardia lamblia
GQPQVNVPP

SEQ ID NO: 3054521 - protein, 8 aa, Giardia lamblia
GQPSSSAN

SEQ ID NO: 3054522 - protein, 9 aa, Giardia lamblia
GQQLEDTPQ

SEQ ID NO: 3054523 - protein, 4 aa, Giardia lamblia
GQQN

SEQ ID NO: 3054524 - protein, 7 aa, Giardia lamblia
GQRDEQK

SEQ ID NO: 3054525 - protein, 7 aa, Giardia lamblia
GQRGRDI

SEQ ID NO: 3054526 - protein, 6 aa, Giardia lamblia
GQRQTA

SEQ ID NO: 3054527 - protein, 5 aa, Giardia lamblia
GQRVP

SEQ ID NO: 3054528 - protein, 6 aa, Giardia lamblia
GQSAAE

SEQ ID NO: 3054529 - protein, 5 aa, Giardia lamblia
GQSGG

SEQ ID NO: 3054530 - protein, 9 aa, Giardia lamblia
GQSIDAEKI

SEQ ID NO: 3054531 - protein, 14 aa, Giardia lamblia
GQSIKQGANTAEAK

SEQ ID NO: 3054532 - protein, 36 aa, Giardia lamblia
GQSLEAAGKCQQRQTDSAVDDKPDRTSSFSGSRRNK

SEQ ID NO: 3054533 - protein, 4 aa, Giardia lamblia
GQSS

SEQ ID NO: 3054534 - protein, 6 aa, Giardia lamblia
GQSYSE

SEQ ID NO: 3054535 - protein, 11 aa, Giardia lamblia
GQTLSKPKVKS

SEQ ID NO: 3054536 - protein, 6 aa, Giardia lamblia
GQTPRS

SEQ ID NO: 3054537 - protein, 12 aa, Giardia lamblia
GQTPSGAHTKTP

SEQ ID NO: 3054538 - protein, 8 aa, Giardia lamblia
GQTTPPTL

SEQ ID NO: 3054539 - protein, 6 aa, Giardia lamblia
GQTTTG

SEQ ID NO: 3054540 - protein, 8 aa, Giardia lamblia
GQVNIGTP

SEQ ID NO: 3054541 - protein, 7 aa, Giardia lamblia
GQVSNGA

SEQ ID NO: 3054542 - protein, 6 aa, Giardia lamblia
GQYGEL

SEQ ID NO: 3054543 - protein, 11 aa, Giardia lamblia
GQYQDSSGKTS

SEQ ID NO: 3054544 - protein, 5 aa, Giardia lamblia
GQYRE

SEQ ID NO: 3054545 - protein, 29 aa, Giardia lamblia
GQYTKFGDPSDPFATCTPKDPDSGTVSAY

SEQ ID NO: 3054546 - protein, 12 aa, Giardia lamblia
GRASGLSSGSDS

SEQ ID NO: 3054547 - protein, 7 aa, Giardia lamblia
GRASTSA

SEQ ID NO: 3054548 - protein, 4 aa, Giardia lamblia
GRAT

SEQ ID NO: 3054549 - protein, 12 aa, Giardia lamblia
GRATKTENPPIG

SEQ ID NO: 3054550 - protein, 4 aa, Giardia lamblia
GRCD

SEQ ID NO: 3054551 - protein, 9 aa, Giardia lamblia
GRCNDNGKC

SEQ ID NO: 3054552 - protein, 6 aa, Giardia lamblia
GRCTQC

SEQ ID NO: 3054553 - protein, 10 aa, Giardia lamblia
GRCVDGKKPK

SEQ ID NO: 3054554 - protein, 9 aa, Giardia lamblia
GRCVSENGI

SEQ ID NO: 3054555 - protein, 9 aa, Giardia lamblia
GRDKESHPH

SEQ ID NO: 3054556 - protein, 5 aa, Giardia lamblia
GRDLN

SEQ ID NO: 3054557 - protein, 10 aa, Giardia lamblia
GRDRDPNQDY

SEQ ID NO: 3054558 - protein, 7 aa, Giardia lamblia
GRDSNGM

SEQ ID NO: 3054559 - protein, 7 aa, Giardia lamblia
GREGGTR

SEQ ID NO: 3054560 - protein, 5 aa, Giardia lamblia
GREGI

SEQ ID NO: 3054561 - protein, 7 aa, Giardia lamblia
GRERGGN

SEQ ID NO: 3054562 - protein, 8 aa, Giardia lamblia
GRERSEDL

SEQ ID NO: 3054563 - protein, 6 aa, Giardia lamblia
GRESRS

SEQ ID NO: 3054564 - protein, 6 aa, Giardia lamblia
GRFGSG

SEQ ID NO: 3054565 - protein, 4 aa, Giardia lamblia
GRFS

SEQ ID NO: 3054566 - protein, 8 aa, Giardia lamblia
GRGKKGNA

SEQ ID NO: 3054567 - protein, 5 aa, Giardia lamblia
GRGPW

SEQ ID NO: 3054568 - protein, 6 aa, Giardia lamblia
GRGQWE

SEQ ID NO: 3054569 - protein, 4 aa, Giardia lamblia
GRGS

SEQ ID NO: 3054570 - protein, 14 aa, Giardia lamblia
GRHSSTDAKIGTPA

SEQ ID NO: 3054571 - protein, 5 aa, Giardia lamblia
GRIEN

SEQ ID NO: 3054572 - protein, 5 aa, Giardia lamblia
GRISA

SEQ ID NO: 3054573 - protein, 8 aa, Giardia lamblia
GRITTNKR

SEQ ID NO: 3054574 - protein, 8 aa, Giardia lamblia
GRIVGDAP

SEQ ID NO: 3054575 - protein, 12 aa, Giardia lamblia
GRKDTTNNPAQT

SEQ ID NO: 3054576 - protein, 12 aa, Giardia lamblia
GRKEGEDPRPHE

SEQ ID NO: 3054577 - protein, 6 aa, Giardia lamblia
GRKTVP

SEQ ID NO: 3054578 - protein, 14 aa, Giardia lamblia
GRLKSRGRKDHQTR

SEQ ID NO: 3054579 - protein, 6 aa, Giardia lamblia
GRLSDT

SEQ ID NO: 3054580 - protein, 21 aa, Giardia lamblia
GRLSEEPTGRSIDQSREDLPA

SEQ ID NO: 3054581 - protein, 14 aa, Giardia lamblia
GRLSPKDRATYTAQ

SEQ ID NO: 3054582 - protein, 8 aa, Giardia lamblia
GRMTRDGR

SEQ ID NO: 3054583 - protein, 6 aa, Giardia lamblia
GRNEPE

SEQ ID NO: 3054584 - protein, 4 aa, Giardia lamblia
GRPE

SEQ ID NO: 3054585 - protein, 5 aa, Giardia lamblia
GRPFP

SEQ ID NO: 3054586 - protein, 5 aa, Giardia lamblia
GRPGA

SEQ ID NO: 3054587 - protein, 10 aa, Giardia lamblia
GRPGGSPCSS

SEQ ID NO: 3054588 - protein, 9 aa, Giardia lamblia
GRPRAVSGR

SEQ ID NO: 3054589 - protein, 7 aa, Giardia lamblia
GRPYNNS

SEQ ID NO: 3054590 - protein, 27 aa, Giardia lamblia
GRQNEQLRGISSRATKIQANARGGAEI

SEQ ID NO: 3054591 - protein, 8 aa, Giardia lamblia
GRQPVPGS

SEQ ID NO: 3054592 - protein, 9 aa, Giardia lamblia
GRQSNSKNF

SEQ ID NO: 3054593 - protein, 8 aa, Giardia lamblia
GRRDDESV

SEQ ID NO: 3054594 - protein, 5 aa, Giardia lamblia
GRRGH

SEQ ID NO: 3054595 - protein, 25 aa, Giardia lamblia
GRRSTARLGTANHSLSENNQTSGKL

SEQ ID NO: 3054596 - protein, 15 aa, Giardia lamblia
GRSCSEGCSGDTQGV

SEQ ID NO: 3054597 - protein, 11 aa, Giardia lamblia
GRSDLAQNDTY

SEQ ID NO: 3054598 - protein, 10 aa, Giardia lamblia
GRSDPQSNCS

SEQ ID NO: 3054599 - protein, 4 aa, Giardia lamblia
GRSF

SEQ ID NO: 3054600 - protein, 4 aa, Giardia lamblia
GRSL

SEQ ID NO: 3054601 - protein, 8 aa, Giardia lamblia
GRSPAECP

SEQ ID NO: 3054602 - protein, 11 aa, Giardia lamblia
GRSRSDKISNS

SEQ ID NO: 3054603 - protein, 7 aa, Giardia lamblia
GRSSPSS

SEQ ID NO: 3054604 - protein, 6 aa, Giardia lamblia
GRSTNT

SEQ ID NO: 3054605 - protein, 18 aa, Giardia lamblia
GRSTPGSSVISRRSSAAH

SEQ ID NO: 3054606 - protein, 9 aa, Giardia lamblia
GRTASKPRL

SEQ ID NO: 3054607 - protein, 10 aa, Giardia lamblia
GRTGAGKSSL

SEQ ID NO: 3054608 - protein, 6 aa, Giardia lamblia
GRTPFT

SEQ ID NO: 3054609 - protein, 32 aa, Giardia lamblia
GRTRYKDGTVYEGTYRQEKRDGTGTCHYPDGS

SEQ ID NO: 3054610 - protein, 10 aa, Giardia lamblia
GRVGRVRPGE

SEQ ID NO: 3054611 - protein, 31 aa, Giardia lamblia
GRVKQAPLASLAQPAAQATKKDQSDLTSEQA

SEQ ID NO: 3054612 - protein, 8 aa, Giardia lamblia
GRVNDDSY

SEQ ID NO: 3054613 - protein, 6 aa, Giardia lamblia
GRVPND

SEQ ID NO: 3054614 - protein, 12 aa, Giardia lamblia
GRYDTKTNPSAV

SEQ ID NO: 3054615 - protein, 8 aa, Giardia lamblia
GRYGKQKP

SEQ ID NO: 3054616 - protein, 4 aa, Giardia lamblia
GSAA

SEQ ID NO: 3054617 - protein, 6 aa, Giardia lamblia
GSAAEQ

SEQ ID NO: 3054618 - protein, 5 aa, Giardia lamblia
GSAAF

SEQ ID NO: 3054619 - protein, 9 aa, Giardia lamblia
GSAATSLPM

SEQ ID NO: 3054620 - protein, 15 aa, Giardia lamblia
GSACASSEKDAHHKE

SEQ ID NO: 3054621 - protein, 6 aa, Giardia lamblia
GSAEQQ

SEQ ID NO: 3054622 - protein, 18 aa, Giardia lamblia
GSAFDTSSNMTGETKEID

SEQ ID NO: 3054623 - protein, 8 aa, Giardia lamblia
GSAGSLAA

SEQ ID NO: 3054624 - protein, 14 aa, Giardia lamblia
GSALSTPLPATRKV

SEQ ID NO: 3054625 - protein, 5 aa, Giardia lamblia
GSANS

SEQ ID NO: 3054626 - protein, 9 aa, Giardia lamblia
GSASKERGE

SEQ ID NO: 3054627 - protein, 7 aa, Giardia lamblia
GSASNNA

SEQ ID NO: 3054628 - protein, 4 aa, Giardia lamblia
GSAT

SEQ ID NO: 3054629 - protein, 9 aa, Giardia lamblia
GSATETTTL

SEQ ID NO: 3054630 - protein, 7 aa, Giardia lamblia
GSATLAS

SEQ ID NO: 3054631 - protein, 16 aa, Giardia lamblia
GSCIPKDSQEDPQSSY

SEQ ID NO: 3054632 - protein, 16 aa, Giardia lamblia
GSCNADTKSCSCSPDT

SEQ ID NO: 3054633 - protein, 6 aa, Giardia lamblia
GSCPAD

SEQ ID NO: 3054634 - protein, 6 aa, Giardia lamblia
GSCPKD

SEQ ID NO: 3054635 - protein, 6 aa, Giardia lamblia
GSCSQS

SEQ ID NO: 3054636 - protein, 5 aa, Giardia lamblia
GSCSS

SEQ ID NO: 3054637 - protein, 11 aa, Giardia lamblia
GSCTSTTNGAR

SEQ ID NO: 3054638 - protein, 13 aa, Giardia lamblia
GSDADAKTVSEEA

SEQ ID NO: 3054639 - protein, 10 aa, Giardia lamblia
GSDAERSAAS

SEQ ID NO: 3054640 - protein, 8 aa, Giardia lamblia
GSDEFGPN

SEQ ID NO: 3054641 - protein, 15 aa, Giardia lamblia
GSDFAKPSMTDEEKQ

SEQ ID NO: 3054642 - protein, 5 aa, Giardia lamblia
GSDLD

SEQ ID NO: 3054643 - protein, 8 aa, Giardia lamblia
GSDSATLQ

SEQ ID NO: 3054644 - protein, 8 aa, Giardia lamblia
GSDSEEMD

SEQ ID NO: 3054645 - protein, 15 aa, Giardia lamblia
GSDSRERNQQEAQNI

SEQ ID NO: 3054646 - protein, 8 aa, Giardia lamblia
GSDSSAYV

SEQ ID NO: 3054647 - protein, 17 aa, Giardia lamblia
GSDTNASENSADDTSAV

SEQ ID NO: 3054648 - protein, 9 aa, Giardia lamblia
GSEAKQSLK

SEQ ID NO: 3054649 - protein, 7 aa, Giardia lamblia
GSEGRGV

SEQ ID NO: 3054650 - protein, 8 aa, Giardia lamblia
GSESEPAR

SEQ ID NO: 3054651 - protein, 17 aa, Giardia lamblia
GSESESSRHAHAPTASK

SEQ ID NO: 3054652 - protein, 19 aa, Giardia lamblia
GSESETRNVPYKGDTLPDD

SEQ ID NO: 3054653 - protein, 7 aa, Giardia lamblia
GSESIES

SEQ ID NO: 3054654 - protein, 5 aa, Giardia lamblia
GSETM

SEQ ID NO: 3054655 - protein, 8 aa, Giardia lamblia
GSFAASSV

SEQ ID NO: 3054656 - protein, 9 aa, Giardia lamblia
GSFKNDTGS

SEQ ID NO: 3054657 - protein, 6 aa, Giardia lamblia
GSFTNA

SEQ ID NO: 3054658 - protein, 19 aa, Giardia lamblia
GSGASRADANRSGLSPSAI

SEQ ID NO: 3054659 - protein, 17 aa, Giardia lamblia
GSGCRTPSSRQSPGSSI

SEQ ID NO: 3054660 - protein, 15 aa, Giardia lamblia
GSGEEPLSSAHTTRN

SEQ ID NO: 3054661 - protein, 8 aa, Giardia lamblia
GSGESEEL

SEQ ID NO: 3054662 - protein, 6 aa, Giardia lamblia
GSGGFS

SEQ ID NO: 3054663 - protein, 9 aa, Giardia lamblia
GSGGSPPAS

SEQ ID NO: 3054664 - protein, 5 aa, Giardia lamblia
GSGKT

SEQ ID NO: 3054665 - protein, 5 aa, Giardia lamblia
GSGNA

SEQ ID NO: 3054666 - protein, 7 aa, Giardia lamblia
GSGPGTC

SEQ ID NO: 3054667 - protein, 6 aa, Giardia lamblia
GSGQLK

SEQ ID NO: 3054668 - protein, 9 aa, Giardia lamblia
GSGQPTAQA

SEQ ID NO: 3054669 - protein, 4 aa, Giardia lamblia
GSGT

SEQ ID NO: 3054670 - protein, 19 aa, Giardia lamblia
GSGTSRADANRSGLSPSAI

SEQ ID NO: 3054671 - protein, 11 aa, Giardia lamblia
GSGTYSYDPSK

SEQ ID NO: 3054672 - protein, 12 aa, Giardia lamblia
GSHFANSTHGNN

SEQ ID NO: 3054673 - protein, 5 aa, Giardia lamblia
GSHGL

SEQ ID NO: 3054674 - protein, 5 aa, Giardia lamblia
GSHQT

SEQ ID NO: 3054675 - protein, 4 aa, Giardia lamblia
GSHV

SEQ ID NO: 3054676 - protein, 4 aa, Giardia lamblia
GSID

SEQ ID NO: 3054677 - protein, 5 aa, Giardia lamblia
GSINP

SEQ ID NO: 3054678 - protein, 7 aa, Giardia lamblia
GSINSSD

SEQ ID NO: 3054679 - protein, 6 aa, Giardia lamblia
GSIPRE

SEQ ID NO: 3054680 - protein, 6 aa, Giardia lamblia
GSISEK

SEQ ID NO: 3054681 - protein, 7 aa, Giardia lamblia
GSISKFT

SEQ ID NO: 3054682 - protein, 6 aa, Giardia lamblia
GSISPE

SEQ ID NO: 3054683 - protein, 7 aa, Giardia lamblia
GSITTTA

SEQ ID NO: 3054684 - protein, 8 aa, Giardia lamblia
GSKCETCK

SEQ ID NO: 3054685 - protein, 7 aa, Giardia lamblia
GSKETCT

SEQ ID NO: 3054686 - protein, 15 aa, Giardia lamblia
GSKKAKKKDDALNSF

SEQ ID NO: 3054687 - protein, 13 aa, Giardia lamblia
GSKMRAKSRISAH

SEQ ID NO: 3054688 - protein, 9 aa, Giardia lamblia
GSKNAENNQ

SEQ ID NO: 3054689 - protein, 6 aa, Giardia lamblia
GSLDDG

SEQ ID NO: 3054690 - protein, 9 aa, Giardia lamblia
GSLDGNGNS

SEQ ID NO: 3054691 - protein, 8 aa, Giardia lamblia
GSLDNPPQ

SEQ ID NO: 3054692 - protein, 4 aa, Giardia lamblia
GSLE

SEQ ID NO: 3054693 - protein, 7 aa, Giardia lamblia
GSLGSGW

SEQ ID NO: 3054694 - protein, 12 aa, Giardia lamblia
GSLQDGRKQRYS

SEQ ID NO: 3054695 - protein, 4 aa, Giardia lamblia
GSLS

SEQ ID NO: 3054696 - protein, 6 aa, Giardia lamblia
GSLSDK

SEQ ID NO: 3054697 - protein, 9 aa, Giardia lamblia
GSLSGPKSK

SEQ ID NO: 3054698 - protein, 4 aa, Giardia lamblia
GSND

SEQ ID NO: 3054699 - protein, 8 aa, Giardia lamblia
GSNDQRLR

SEQ ID NO: 3054700 - protein, 9 aa, Giardia lamblia
GSNDSRAAA

SEQ ID NO: 3054701 - protein, 9 aa, Giardia lamblia
GSNDSTSDD

SEQ ID NO: 3054702 - protein, 8 aa, Giardia lamblia
GSNPSRVN

SEQ ID NO: 3054703 - protein, 5 aa, Giardia lamblia
GSNTK

SEQ ID NO: 3054704 - protein, 4 aa, Giardia lamblia
GSPD

SEQ ID NO: 3054705 - protein, 6 aa, Giardia lamblia
GSPGEI

SEQ ID NO: 3054706 - protein, 6 aa, Giardia lamblia
GSPIQY

SEQ ID NO: 3054707 - protein, 4 aa, Giardia lamblia
GSPL

SEQ ID NO: 3054708 - protein, 12 aa, Giardia lamblia
GSPLPTSTGTSF

SEQ ID NO: 3054709 - protein, 4 aa, Giardia lamblia
GSPM

SEQ ID NO: 3054710 - protein, 9 aa, Giardia lamblia
GSPPTPDVF

SEQ ID NO: 3054711 - protein, 28 aa, Giardia lamblia
GSPQAAAAGCTKADGAALDKTATTCEKC

SEQ ID NO: 3054712 - protein, 14 aa, Giardia lamblia
GSPRCTTKTVSEQS

SEQ ID NO: 3054713 - protein, 8 aa, Giardia lamblia
GSPRYKTR

SEQ ID NO: 3054714 - protein, 4 aa, Giardia lamblia
GSPT

SEQ ID NO: 3054715 - protein, 6 aa, Giardia lamblia
GSPTGS

SEQ ID NO: 3054716 - protein, 7 aa, Giardia lamblia
GSPTHSN

SEQ ID NO: 3054717 - protein, 15 aa, Giardia lamblia
GSPTSIEQRSLSSSY

SEQ ID NO: 3054718 - protein, 5 aa, Giardia lamblia
GSQDP

SEQ ID NO: 3054719 - protein, 7 aa, Giardia lamblia
GSQESDN

SEQ ID NO: 3054720 - protein, 4 aa, Giardia lamblia
GSQF

SEQ ID NO: 3054721 - protein, 4 aa, Giardia lamblia
GSQG

SEQ ID NO: 3054722 - protein, 7 aa, Giardia lamblia
GSQGTAR

SEQ ID NO: 3054723 - protein, 8 aa, Giardia lamblia
GSQPSSVG

SEQ ID NO: 3054724 - protein, 12 aa, Giardia lamblia
GSQSGAQETGVF

SEQ ID NO: 3054725 - protein, 10 aa, Giardia lamblia
GSQSGVNQSG

SEQ ID NO: 3054726 - protein, 9 aa, Giardia lamblia
GSRDKYGDT

SEQ ID NO: 3054727 - protein, 10 aa, Giardia lamblia
GSRGKNETKI

SEQ ID NO: 3054728 - protein, 6 aa, Giardia lamblia
GSRNYP

SEQ ID NO: 3054729 - protein, 7 aa, Giardia lamblia
GSRRGSA

SEQ ID NO: 3054730 - protein, 9 aa, Giardia lamblia
GSRTETTNK

SEQ ID NO: 3054731 - protein, 4 aa, Giardia lamblia
GSRY

SEQ ID NO: 3054732 - protein, 8 aa, Giardia lamblia
GSSACTTN

SEQ ID NO: 3054733 - protein, 23 aa, Giardia lamblia
GSSADAHHEIPGGQKSNKISPRN

SEQ ID NO: 3054734 - protein, 36 aa, Giardia lamblia
GSSAIPRDPLSPTSAARGYRAGQSTQTEQRDTSPNS

SEQ ID NO: 3054735 - protein, 9 aa, Giardia lamblia
GSSAPRNIL

SEQ ID NO: 3054736 - protein, 5 aa, Giardia lamblia
GSSAR

SEQ ID NO: 3054737 - protein, 7 aa, Giardia lamblia
GSSARER

SEQ ID NO: 3054738 - protein, 9 aa, Giardia lamblia
GSSDNTPPK

SEQ ID NO: 3054739 - protein, 18 aa, Giardia lamblia
GSSFSSKAPGRWPNNSIP

SEQ ID NO: 3054740 - protein, 7 aa, Giardia lamblia
GSSGKYC

SEQ ID NO: 3054741 - protein, 6 aa, Giardia lamblia
GSSGTI

SEQ ID NO: 3054742 - protein, 6 aa, Giardia lamblia
GSSKST

SEQ ID NO: 3054743 - protein, 10 aa, Giardia lamblia
GSSKVVQKSQ

SEQ ID NO: 3054744 - protein, 5 aa, Giardia lamblia
GSSMP

SEQ ID NO: 3054745 - protein, 18 aa, Giardia lamblia
GSSNAREKTHCQSSTQSE

SEQ ID NO: 3054746 - protein, 15 aa, Giardia lamblia
GSSPDDEAQETDTSA

SEQ ID NO: 3054747 - protein, 6 aa, Giardia lamblia
GSSPPS

SEQ ID NO: 3054748 - protein, 6 aa, Giardia lamblia
GSSQTP

SEQ ID NO: 3054749 - protein, 15 aa, Giardia lamblia
GSSRNSTSSLSTSLH

SEQ ID NO: 3054750 - protein, 7 aa, Giardia lamblia
GSSRVRD

SEQ ID NO: 3054751 - protein, 9 aa, Giardia lamblia
GSSSDTPSV

SEQ ID NO: 3054752 - protein, 8 aa, Giardia lamblia
GSSSNNFS

SEQ ID NO: 3054753 - protein, 17 aa, Giardia lamblia
GSSSSESLSPEEKMRES

SEQ ID NO: 3054754 - protein, 28 aa, Giardia lamblia
GSSSSVSSTNSMESSNPAQNGSTCGQSD

SEQ ID NO: 3054755 - protein, 7 aa, Giardia lamblia
GSSSTTY

SEQ ID NO: 3054756 - protein, 8 aa, Giardia lamblia
GSSTAGKT

SEQ ID NO: 3054757 - protein, 5 aa, Giardia lamblia
GSSTI

SEQ ID NO: 3054758 - protein, 7 aa, Giardia lamblia
GSSVEYD

SEQ ID NO: 3054759 - protein, 5 aa, Giardia lamblia
GSSVS

SEQ ID NO: 3054760 - protein, 8 aa, Giardia lamblia
GSSVSPPS

SEQ ID NO: 3054761 - protein, 7 aa, Giardia lamblia
GSSYTSR

SEQ ID NO: 3054762 - protein, 5 aa, Giardia lamblia
GSTAV

SEQ ID NO: 3054763 - protein, 5 aa, Giardia lamblia
GSTEL

SEQ ID NO: 3054764 - protein, 5 aa, Giardia lamblia
GSTHF

SEQ ID NO: 3054765 - protein, 37 aa, Giardia lamblia
GSTIDGSARAQAAGKKRPTSGASSAASVANTTVPSSS

SEQ ID NO: 3054766 - protein, 6 aa, Giardia lamblia
GSTLSK

SEQ ID NO: 3054767 - protein, 4 aa, Giardia lamblia
GSTM

SEQ ID NO: 3054768 - protein, 4 aa, Giardia lamblia
GSTN

SEQ ID NO: 3054769 - protein, 7 aa, Giardia lamblia
GSTPIHS

SEQ ID NO: 3054770 - protein, 7 aa, Giardia lamblia
GSTPPIV

SEQ ID NO: 3054771 - protein, 9 aa, Giardia lamblia
GSTPPVPDL

SEQ ID NO: 3054772 - protein, 4 aa, Giardia lamblia
GSTR

SEQ ID NO: 3054773 - protein, 9 aa, Giardia lamblia
GSTRSEQSM

SEQ ID NO: 3054774 - protein, 10 aa, Giardia lamblia
GSTSGTKIGS

SEQ ID NO: 3054775 - protein, 6 aa, Giardia lamblia
GSTSRY

SEQ ID NO: 3054776 - protein, 21 aa, Giardia lamblia
GSTSSPNEHSRHDKHHGGHNK

SEQ ID NO: 3054777 - protein, 8 aa, Giardia lamblia
GSTSTYDS

SEQ ID NO: 3054778 - protein, 7 aa, Giardia lamblia
GSTTIGQ

SEQ ID NO: 3054779 - protein, 6 aa, Giardia lamblia
GSTTSA

SEQ ID NO: 3054780 - protein, 6 aa, Giardia lamblia
GSTTYE

SEQ ID NO: 3054781 - protein, 13 aa, Giardia lamblia
GSVDDSSPEMTGS

SEQ ID NO: 3054782 - protein, 5 aa, Giardia lamblia
GSVER

SEQ ID NO: 3054783 - protein, 12 aa, Giardia lamblia
GSVQSDPRDTPR

SEQ ID NO: 3054784 - protein, 6 aa, Giardia lamblia
GSVRTS

SEQ ID NO: 3054785 - protein, 12 aa, Giardia lamblia
GSVVSTDYDDKR

SEQ ID NO: 3054786 - protein, 9 aa, Giardia lamblia
GSVVTNSTN

SEQ ID NO: 3054787 - protein, 5 aa, Giardia lamblia
GSYAV

SEQ ID NO: 3054788 - protein, 6 aa, Giardia lamblia
GSYPVD

SEQ ID NO: 3054789 - protein, 10 aa, Giardia lamblia
GSYSEGEHFD

SEQ ID NO: 3054790 - protein, 7 aa, Giardia lamblia
GSYSTKP

SEQ ID NO: 3054791 - protein, 7 aa, Giardia lamblia
GSYYEGE

SEQ ID NO: 3054792 - protein, 13 aa, Giardia lamblia
GSYYGEGKVPDKR

SEQ ID NO: 3054793 - protein, 7 aa, Giardia lamblia
GTAASDS

SEQ ID NO: 3054794 - protein, 18 aa, Giardia lamblia
GTAGNASSGNAGSTDVSN

SEQ ID NO: 3054795 - protein, 18 aa, Giardia lamblia
GTAGQKETRMQDYSNGKT

SEQ ID NO: 3054796 - protein, 8 aa, Giardia lamblia
GTAHNKGH

SEQ ID NO: 3054797 - protein, 4 aa, Giardia lamblia
GTAI

SEQ ID NO: 3054798 - protein, 9 aa, Giardia lamblia
GTAKDKTVE

SEQ ID NO: 3054799 - protein, 7 aa, Giardia lamblia
GTAKPSL

SEQ ID NO: 3054800 - protein, 13 aa, Giardia lamblia
GTAQDDQITGEGT

SEQ ID NO: 3054801 - protein, 4 aa, Giardia lamblia
GTAR

SEQ ID NO: 3054802 - protein, 7 aa, Giardia lamblia
GTATASQ

SEQ ID NO: 3054803 - protein, 9 aa, Giardia lamblia
GTATKFSST

SEQ ID NO: 3054804 - protein, 5 aa, Giardia lamblia
GTATS

SEQ ID NO: 3054805 - protein, 10 aa, Giardia lamblia
GTATSPNTNR

SEQ ID NO: 3054806 - protein, 4 aa, Giardia lamblia
GTAV

SEQ ID NO: 3054807 - protein, 23 aa, Giardia lamblia
GTCDTSEASNDQSLSEVAGSYSS

SEQ ID NO: 3054808 - protein, 11 aa, Giardia lamblia
GTCDTTSPKDM

SEQ ID NO: 3054809 - protein, 11 aa, Giardia lamblia
GTCEKESGSNV

SEQ ID NO: 3054810 - protein, 5 aa, Giardia lamblia
GTCGS

SEQ ID NO: 3054811 - protein, 6 aa, Giardia lamblia
GTCGST

SEQ ID NO: 3054812 - protein, 12 aa, Giardia lamblia
GTCQPRSCSRDG

SEQ ID NO: 3054813 - protein, 13 aa, Giardia lamblia
GTCRDKGTHECRN

SEQ ID NO: 3054814 - protein, 6 aa, Giardia lamblia
GTCSES

SEQ ID NO: 3054815 - protein, 6 aa, Giardia lamblia
GTCSIE

SEQ ID NO: 3054816 - protein, 6 aa, Giardia lamblia
GTCSPC

SEQ ID NO: 3054817 - protein, 14 aa, Giardia lamblia
GTCTRDDKSNKYTN

SEQ ID NO: 3054818 - protein, 6 aa, Giardia lamblia
GTCVQN

SEQ ID NO: 3054819 - protein, 4 aa, Giardia lamblia
GTCY

SEQ ID NO: 3054820 - protein, 6 aa, Giardia lamblia
GTDASD

SEQ ID NO: 3054821 - protein, 10 aa, Giardia lamblia
GTDGADSASN

SEQ ID NO: 3054822 - protein, 5 aa, Giardia lamblia
GTDLR

SEQ ID NO: 3054823 - protein, 7 aa, Giardia lamblia
GTDNSQI

SEQ ID NO: 3054824 - protein, 6 aa, Giardia lamblia
GTDSSA

SEQ ID NO: 3054825 - protein, 9 aa, Giardia lamblia
GTDSTAKAY

SEQ ID NO: 3054826 - protein, 4 aa, Giardia lamblia
GTEF

SEQ ID NO: 3054827 - protein, 12 aa, Giardia lamblia
GTERKAAKRNIP

SEQ ID NO: 3054828 - protein, 6 aa, Giardia lamblia
GTETAP

SEQ ID NO: 3054829 - protein, 6 aa, Giardia lamblia
GTETSP

SEQ ID NO: 3054830 - protein, 9 aa, Giardia lamblia
GTEYNKSPE

SEQ ID NO: 3054831 - protein, 5 aa, Giardia lamblia
GTFSS

SEQ ID NO: 3054832 - protein, 13 aa, Giardia lamblia
GTFTKRALSSKNL

SEQ ID NO: 3054833 - protein, 5 aa, Giardia lamblia
GTGAH

SEQ ID NO: 3054834 - protein, 18 aa, Giardia lamblia
GTGASGARGRDLGEDEAV

SEQ ID NO: 3054835 - protein, 25 aa, Giardia lamblia
GTGHNENTGENANSSSMAPPTARTK

SEQ ID NO: 3054836 - protein, 5 aa, Giardia lamblia
GTGKC

SEQ ID NO: 3054837 - protein, 6 aa, Giardia lamblia
GTGPAC

SEQ ID NO: 3054838 - protein, 11 aa, Giardia lamblia
GTGQQDEQQRV

SEQ ID NO: 3054839 - protein, 5 aa, Giardia lamblia
GTGRG

SEQ ID NO: 3054840 - protein, 5 aa, Giardia lamblia
GTGSG

SEQ ID NO: 3054841 - protein, 6 aa, Giardia lamblia
GTGSYG

SEQ ID NO: 3054842 - protein, 4 aa, Giardia lamblia
GTHF

SEQ ID NO: 3054843 - protein, 14 aa, Giardia lamblia
GTHFPNDNAENKKK

SEQ ID NO: 3054844 - protein, 7 aa, Giardia lamblia
GTHGNRE

SEQ ID NO: 3054845 - protein, 4 aa, Giardia lamblia
GTHN

SEQ ID NO: 3054846 - protein, 7 aa, Giardia lamblia
GTHTSTI

SEQ ID NO: 3054847 - protein, 5 aa, Giardia lamblia
GTIGS

SEQ ID NO: 3054848 - protein, 8 aa, Giardia lamblia
GTIGSPGF

SEQ ID NO: 3054849 - protein, 4 aa, Giardia lamblia
GTIR

SEQ ID NO: 3054850 - protein, 20 aa, Giardia lamblia
GTIRNSEPGNIESKSATEMA

SEQ ID NO: 3054851 - protein, 4 aa, Giardia lamblia
GTIS

SEQ ID NO: 3054852 - protein, 10 aa, Giardia lamblia
GTKAYKSDTN

SEQ ID NO: 3054853 - protein, 4 aa, Giardia lamblia
GTKF

SEQ ID NO: 3054854 - protein, 9 aa, Giardia lamblia
GTKPFTAPE

SEQ ID NO: 3054855 - protein, 6 aa, Giardia lamblia
GTKQRR

SEQ ID NO: 3054856 - protein, 5 aa, Giardia lamblia
GTKTI

SEQ ID NO: 3054857 - protein, 6 aa, Giardia lamblia
GTLDGA

SEQ ID NO: 3054858 - protein, 9 aa, Giardia lamblia
GTLDGNNHA

SEQ ID NO: 3054859 - protein, 11 aa, Giardia lamblia
GTLGDSSASDL

SEQ ID NO: 3054860 - protein, 11 aa, Giardia lamblia
GTLRDSANFPD

SEQ ID NO: 3054861 - protein, 8 aa, Giardia lamblia
GTLRDSAS

SEQ ID NO: 3054862 - protein, 5 aa, Giardia lamblia
GTLTE

SEQ ID NO: 3054863 - protein, 6 aa, Giardia lamblia
GTLTTD

SEQ ID NO: 3054864 - protein, 12 aa, Giardia lamblia
GTMTEDGTTAGT

SEQ ID NO: 3054865 - protein, 9 aa, Giardia lamblia
GTNANTHSV

SEQ ID NO: 3054866 - protein, 7 aa, Giardia lamblia
GTNARRG

SEQ ID NO: 3054867 - protein, 6 aa, Giardia lamblia
GTNEGI

SEQ ID NO: 3054868 - protein, 11 aa, Giardia lamblia
GTPASCQRRED

SEQ ID NO: 3054869 - protein, 4 aa, Giardia lamblia
GTPD

SEQ ID NO: 3054870 - protein, 8 aa, Giardia lamblia
GTPNPGEL

SEQ ID NO: 3054871 - protein, 4 aa, Giardia lamblia
GTPQ

SEQ ID NO: 3054872 - protein, 6 aa, Giardia lamblia
GTPQDY

SEQ ID NO: 3054873 - protein, 16 aa, Giardia lamblia
GTPTPLKTKELSGPSF

SEQ ID NO: 3054874 - protein, 5 aa, Giardia lamblia
GTPVQ

SEQ ID NO: 3054875 - protein, 4 aa, Giardia lamblia
GTQE

SEQ ID NO: 3054876 - protein, 4 aa, Giardia lamblia
GTQP

SEQ ID NO: 3054877 - protein, 22 aa, Giardia lamblia
GTQQQNLSTDKHTHPLEPQHSD

SEQ ID NO: 3054878 - protein, 8 aa, Giardia lamblia
GTQVSSQL

SEQ ID NO: 3054879 - protein, 12 aa, Giardia lamblia
GTREESEKCAQY

SEQ ID NO: 3054880 - protein, 15 aa, Giardia lamblia
GTRQENCQTCAESGT

SEQ ID NO: 3054881 - protein, 48 aa, Giardia lamblia
GTRSNSRRSVNASSNEESRDTTPRDDLRKQPGVTSVSSVTESSSETDF

SEQ ID NO: 3054882 - protein, 6 aa, Giardia lamblia
GTRSSA

SEQ ID NO: 3054883 - protein, 15 aa, Giardia lamblia
GTRTATQESAEETHQ

SEQ ID NO: 3054884 - protein, 10 aa, Giardia lamblia
GTRTNSDRYS

SEQ ID NO: 3054885 - protein, 9 aa, Giardia lamblia
GTSDDSYAT

SEQ ID NO: 3054886 - protein, 4 aa, Giardia lamblia
GTSF

SEQ ID NO: 3054887 - protein, 6 aa, Giardia lamblia
GTSGPI

SEQ ID NO: 3054888 - protein, 12 aa, Giardia lamblia
GTSISASSYLNN

SEQ ID NO: 3054889 - protein, 5 aa, Giardia lamblia
GTSKC

SEQ ID NO: 3054890 - protein, 6 aa, Giardia lamblia
GTSLPE

SEQ ID NO: 3054891 - protein, 37 aa, Giardia lamblia
GTSLQGSYEEKCASTGAQISREPRRSTIPDHDDRSSD

SEQ ID NO: 3054892 - protein, 10 aa, Giardia lamblia
GTSPNPDTLV

SEQ ID NO: 3054893 - protein, 18 aa, Giardia lamblia
GTSQPRQAASRRKVPQGA

SEQ ID NO: 3054894 - protein, 7 aa, Giardia lamblia
GTSRTTA

SEQ ID NO: 3054895 - protein, 15 aa, Giardia lamblia
GTSSASEPSVGTPPL

SEQ ID NO: 3054896 - protein, 5 aa, Giardia lamblia
GTSSV

SEQ ID NO: 3054897 - protein, 6 aa, Giardia lamblia
GTSTVE

SEQ ID NO: 3054898 - protein, 11 aa, Giardia lamblia
GTSYSVKPSNK

SEQ ID NO: 3054899 - protein, 5 aa, Giardia lamblia
GTTDG

SEQ ID NO: 3054900 - protein, 4 aa, Giardia lamblia
GTTE

SEQ ID NO: 3054901 - protein, 6 aa, Giardia lamblia
GTTGMT

SEQ ID NO: 3054902 - protein, 14 aa, Giardia lamblia
GTTGNSKKVMDNSS

SEQ ID NO: 3054903 - protein, 11 aa, Giardia lamblia
GTTHRTLTSAT

SEQ ID NO: 3054904 - protein, 4 aa, Giardia lamblia
GTTI

SEQ ID NO: 3054905 - protein, 11 aa, Giardia lamblia
GTTKRPSSTLY

SEQ ID NO: 3054906 - protein, 13 aa, Giardia lamblia
GTTLEESSASSNA

SEQ ID NO: 3054907 - protein, 9 aa, Giardia lamblia
GTTSSGKTS

SEQ ID NO: 3054908 - protein, 7 aa, Giardia lamblia
GTTSSTC

SEQ ID NO: 3054909 - protein, 6 aa, Giardia lamblia
GTTTAG

SEQ ID NO: 3054910 - protein, 38 aa, Giardia lamblia
GTVAPDKSSTGANNSVGVTDPEVDARKEASDLESDSAY

SEQ ID NO: 3054911 - protein, 6 aa, Giardia lamblia
GTVDST

SEQ ID NO: 3054912 - protein, 13 aa, Giardia lamblia
GTVQDRTQGTKDS

SEQ ID NO: 3054913 - protein, 5 aa, Giardia lamblia
GTVST

SEQ ID NO: 3054914 - protein, 5 aa, Giardia lamblia
GTVTP

SEQ ID NO: 3054915 - protein, 6 aa, Giardia lamblia
GTVTTD

SEQ ID NO: 3054916 - protein, 7 aa, Giardia lamblia
GTYANDT

SEQ ID NO: 3054917 - protein, 6 aa, Giardia lamblia
GTYKQA

SEQ ID NO: 3054918 - protein, 5 aa, Giardia lamblia
GTYSF

SEQ ID NO: 3054919 - protein, 5 aa, Giardia lamblia
GTYTC

SEQ ID NO: 3054920 - protein, 7 aa, Giardia lamblia
GTYVPQQ

SEQ ID NO: 3054921 - protein, 15 aa, Giardia lamblia
GVAPDAKAKQQRTRR

SEQ ID NO: 3054922 - protein, 14 aa, Giardia lamblia
GVAPNFGNDSETSL

SEQ ID NO: 3054923 - protein, 9 aa, Giardia lamblia
GVCDEPGEV

SEQ ID NO: 3054924 - protein, 6 aa, Giardia lamblia
GVCSSS

SEQ ID NO: 3054925 - protein, 5 aa, Giardia lamblia
GVCTT

SEQ ID NO: 3054926 - protein, 4 aa, Giardia lamblia
GVDC

SEQ ID NO: 3054927 - protein, 12 aa, Giardia lamblia
GVDGTGSVYNPD

SEQ ID NO: 3054928 - protein, 16 aa, Giardia lamblia
GVDPTTSNIYENTSSG

SEQ ID NO: 3054929 - protein, 7 aa, Giardia lamblia
GVEGSSA

SEQ ID NO: 3054930 - protein, 7 aa, Giardia lamblia
GVEKRKV

SEQ ID NO: 3054931 - protein, 4 aa, Giardia lamblia
GVEN

SEQ ID NO: 3054932 - protein, 6 aa, Giardia lamblia
GVEQEE

SEQ ID NO: 3054933 - protein, 12 aa, Giardia lamblia
GVETGSTGGFQT

SEQ ID NO: 3054934 - protein, 13 aa, Giardia lamblia
GVETHGNTRAAAG

SEQ ID NO: 3054935 - protein, 14 aa, Giardia lamblia
GVGGTDPSRNDIYT

SEQ ID NO: 3054936 - protein, 5 aa, Giardia lamblia
GVGRH

SEQ ID NO: 3054937 - protein, 15 aa, Giardia lamblia
GVGSTAIPGEGALQA

SEQ ID NO: 3054938 - protein, 7 aa, Giardia lamblia
GVGTPRL

SEQ ID NO: 3054939 - protein, 8 aa, Giardia lamblia
GVKGRNTA

SEQ ID NO: 3054940 - protein, 5 aa, Giardia lamblia
GVKGV

SEQ ID NO: 3054941 - protein, 5 aa, Giardia lamblia
GVNPD

SEQ ID NO: 3054942 - protein, 7 aa, Giardia lamblia
GVNRDSV

SEQ ID NO: 3054943 - protein, 6 aa, Giardia lamblia
GVPAGY

SEQ ID NO: 3054944 - protein, 9 aa, Giardia lamblia
GVPDNPARF

SEQ ID NO: 3054945 - protein, 6 aa, Giardia lamblia
GVPDQY

SEQ ID NO: 3054946 - protein, 10 aa, Giardia lamblia
GVPEERATKA

SEQ ID NO: 3054947 - protein, 14 aa, Giardia lamblia
GVPESHTSCGTTAT

SEQ ID NO: 3054948 - protein, 4 aa, Giardia lamblia
GVPI

SEQ ID NO: 3054949 - protein, 5 aa, Giardia lamblia
GVPSK

SEQ ID NO: 3054950 - protein, 6 aa, Giardia lamblia
GVPTRK

SEQ ID NO: 3054951 - protein, 6 aa, Giardia lamblia
GVPYPS

SEQ ID NO: 3054952 - protein, 4 aa, Giardia lamblia
GVQE

SEQ ID NO: 3054953 - protein, 27 aa, Giardia lamblia
GVQGGGAVDSVQSLDSDVSRVQQSIED

SEQ ID NO: 3054954 - protein, 9 aa, Giardia lamblia
GVQKRRPHD

SEQ ID NO: 3054955 - protein, 9 aa, Giardia lamblia
GVQQAGSPS

SEQ ID NO: 3054956 - protein, 9 aa, Giardia lamblia
GVQTTTSSR

SEQ ID NO: 3054957 - protein, 5 aa, Giardia lamblia
GVRGR

SEQ ID NO: 3054958 - protein, 14 aa, Giardia lamblia
GVRTAQKTMPNRAA

SEQ ID NO: 3054959 - protein, 8 aa, Giardia lamblia
GVRTDKRG

SEQ ID NO: 3054960 - protein, 6 aa, Giardia lamblia
GVSDAA

SEQ ID NO: 3054961 - protein, 7 aa, Giardia lamblia
GVSKDGY

SEQ ID NO: 3054962 - protein, 11 aa, Giardia lamblia
GVSLSGGQKAR

SEQ ID NO: 3054963 - protein, 12 aa, Giardia lamblia
GVSNKLEAATGK

SEQ ID NO: 3054964 - protein, 6 aa, Giardia lamblia
GVSPAY

SEQ ID NO: 3054965 - protein, 13 aa, Giardia lamblia
GVSPSGNNLSCNT

SEQ ID NO: 3054966 - protein, 53 aa, Giardia lamblia
GVSPSLEDDADAGLGTDEGADTGGGTGVHSSEKARHQDMKAGGSLENANTMQQ

SEQ ID NO: 3054967 - protein, 5 aa, Giardia lamblia
GVSSE

SEQ ID NO: 3054968 - protein, 9 aa, Giardia lamblia
GVSSSFDSL

SEQ ID NO: 3054969 - protein, 6 aa, Giardia lamblia
GVSSSS

SEQ ID NO: 3054970 - protein, 7 aa, Giardia lamblia
GVSTTGV

SEQ ID NO: 3054971 - protein, 4 aa, Giardia lamblia
GVTA

SEQ ID NO: 3054972 - protein, 5 aa, Giardia lamblia
GVTAS

SEQ ID NO: 3054973 - protein, 7 aa, Giardia lamblia
GVTHEQN

SEQ ID NO: 3054974 - protein, 5 aa, Giardia lamblia
GVTQK

SEQ ID NO: 3054975 - protein, 7 aa, Giardia lamblia
GVTQKDK

SEQ ID NO: 3054976 - protein, 7 aa, Giardia lamblia
GVTQSNT

SEQ ID NO: 3054977 - protein, 5 aa, Giardia lamblia
GVTRT

SEQ ID NO: 3054978 - protein, 7 aa, Giardia lamblia
GWKGAHG

SEQ ID NO: 3054979 - protein, 4 aa, Giardia lamblia
GWTP

SEQ ID NO: 3054980 - protein, 8 aa, Giardia lamblia
GYADHTGA

SEQ ID NO: 3054981 - protein, 4 aa, Giardia lamblia
GYAG

SEQ ID NO: 3054982 - protein, 10 aa, Giardia lamblia
GYAGRQELPE

SEQ ID NO: 3054983 - protein, 6 aa, Giardia lamblia
GYAPGT

SEQ ID NO: 3054984 - protein, 10 aa, Giardia lamblia
GYARPKDSKV

SEQ ID NO: 3054985 - protein, 13 aa, Giardia lamblia
GYASAKSASRSTE

SEQ ID NO: 3054986 - protein, 6 aa, Giardia lamblia
GYASKH

SEQ ID NO: 3054987 - protein, 6 aa, Giardia lamblia
GYATRH

SEQ ID NO: 3054988 - protein, 9 aa, Giardia lamblia
GYDEEQTPW

SEQ ID NO: 3054989 - protein, 16 aa, Giardia lamblia
GYDETQAPDDTLTGGA

SEQ ID NO: 3054990 - protein, 6 aa, Giardia lamblia
GYDSTS

SEQ ID NO: 3054991 - protein, 5 aa, Giardia lamblia
GYEDP

SEQ ID NO: 3054992 - protein, 5 aa, Giardia lamblia
GYEKG

SEQ ID NO: 3054993 - protein, 8 aa, Giardia lamblia
GYEPGEDL

SEQ ID NO: 3054994 - protein, 4 aa, Giardia lamblia
GYES

SEQ ID NO: 3054995 - protein, 12 aa, Giardia lamblia
GYETADDGAGYY

SEQ ID NO: 3054996 - protein, 9 aa, Giardia lamblia
GYETRRNKD

SEQ ID NO: 3054997 - protein, 5 aa, Giardia lamblia
GYETV

SEQ ID NO: 3054998 - protein, 4 aa, Giardia lamblia
GYFS

SEQ ID NO: 3054999 - protein, 11 aa, Giardia lamblia
GYGGDTCNEDA

SEQ ID NO: 3055000 - protein, 22 aa, Giardia lamblia
GYGNSSEASGSASSVPVPQGCD

SEQ ID NO: 3055001 - protein, 6 aa, Giardia lamblia
GYGYGA

SEQ ID NO: 3055002 - protein, 9 aa, Giardia lamblia
GYKPPTRSK

SEQ ID NO: 3055003 - protein, 13 aa, Giardia lamblia
GYKSNEPRAEDQT

SEQ ID NO: 3055004 - protein, 20 aa, Giardia lamblia
GYLKETDQGKTVCEAPPPTC

SEQ ID NO: 3055005 - protein, 26 aa, Giardia lamblia
GYLSADGSSCSSECNGPNQVKNGSDN

SEQ ID NO: 3055006 - protein, 7 aa, Giardia lamblia
GYNNGGH

SEQ ID NO: 3055007 - protein, 5 aa, Giardia lamblia
GYPPA

SEQ ID NO: 3055008 - protein, 4 aa, Giardia lamblia
GYPS

SEQ ID NO: 3055009 - protein, 4 aa, Giardia lamblia
GYRE

SEQ ID NO: 3055010 - protein, 5 aa, Giardia lamblia
GYRGG

SEQ ID NO: 3055011 - protein, 13 aa, Giardia lamblia
GYSNSQMQTTSTD

SEQ ID NO: 3055012 - protein, 25 aa, Giardia lamblia
GYSPDSSGTSCVSSGANRSGLSTGA

SEQ ID NO: 3055013 - protein, 7 aa, Giardia lamblia
GYSPKLP

SEQ ID NO: 3055014 - protein, 5 aa, Giardia lamblia
GYSRI

SEQ ID NO: 3055015 - protein, 5 aa, Giardia lamblia
GYSSP

SEQ ID NO: 3055016 - protein, 16 aa, Giardia lamblia
GYSSQTRTQESSANEL

SEQ ID NO: 3055017 - protein, 14 aa, Giardia lamblia
GYTGEDCSSPLCTN

SEQ ID NO: 3055018 - protein, 4 aa, Giardia lamblia
GYTN

SEQ ID NO: 3055019 - protein, 6 aa, Giardia lamblia
GYTPEL

SEQ ID NO: 3055020 - protein, 6 aa, Giardia lamblia
GYTTTE

SEQ ID NO: 3055021 - protein, 9 aa, Giardia lamblia
GYVSRDNQC

SEQ ID NO: 3055022 - protein, 13 aa, Giardia lamblia
GYYAPPDRSSVSD

SEQ ID NO: 3055023 - protein, 4 aa, Giardia lamblia
GYYG

SEQ ID NO: 3055024 - protein, 8 aa, Giardia lamblia
GYYNGDGN

SEQ ID NO: 3055025 - protein, 10 aa, Giardia lamblia
GYYPDTSNGR

SEQ ID NO: 3055026 - protein, 10 aa, Giardia lamblia
GYYPKNSRNV

SEQ ID NO: 3055027 - protein, 13 aa, Giardia lamblia
GYYPPPDRSSVSD

SEQ ID NO: 3055028 - protein, 7 aa, Giardia lamblia
HAASRSQ

SEQ ID NO: 3055029 - protein, 4 aa, Giardia lamblia
HAAT

SEQ ID NO: 3055030 - protein, 12 aa, Giardia lamblia
HADKRAGALSGG

SEQ ID NO: 3055031 - protein, 13 aa, Giardia lamblia
HADKRASALSGGM

SEQ ID NO: 3055032 - protein, 6 aa, Giardia lamblia
HADQEK

SEQ ID NO: 3055033 - protein, 7 aa, Giardia lamblia
HADSSDM

SEQ ID NO: 3055034 - protein, 10 aa, Giardia lamblia
HADTRREESI

SEQ ID NO: 3055035 - protein, 8 aa, Giardia lamblia
HAEASDDH

SEQ ID NO: 3055036 - protein, 9 aa, Giardia lamblia
HAEPTVSGI

SEQ ID NO: 3055037 - protein, 5 aa, Giardia lamblia
HAEQK

SEQ ID NO: 3055038 - protein, 6 aa, Giardia lamblia
HAGERT

SEQ ID NO: 3055039 - protein, 10 aa, Giardia lamblia
HAGGNPPQKL

SEQ ID NO: 3055040 - protein, 12 aa, Giardia lamblia
HAHDSGAKVPSA

SEQ ID NO: 3055041 - protein, 7 aa, Giardia lamblia
HAHSRAD

SEQ ID NO: 3055042 - protein, 7 aa, Giardia lamblia
HAKNDMN

SEQ ID NO: 3055043 - protein, 9 aa, Giardia lamblia
HALEEPSGQ

SEQ ID NO: 3055044 - protein, 6 aa, Giardia lamblia
HANETV

SEQ ID NO: 3055045 - protein, 12 aa, Giardia lamblia
HANKRAGALSGG

SEQ ID NO: 3055046 - protein, 15 aa, Giardia lamblia
HAPPASPPRRPNPYR

SEQ ID NO: 3055047 - protein, 10 aa, Giardia lamblia
HAPSNDALQQ

SEQ ID NO: 3055048 - protein, 4 aa, Giardia lamblia
HAPY

SEQ ID NO: 3055049 - protein, 5 aa, Giardia lamblia
HAQDT

SEQ ID NO: 3055050 - protein, 24 aa, Giardia lamblia
HAQPSSAAEDVEAGSRRPSASPLE

SEQ ID NO: 3055051 - protein, 5 aa, Giardia lamblia
HAQPT

SEQ ID NO: 3055052 - protein, 9 aa, Giardia lamblia
HAQRESDGK

SEQ ID NO: 3055053 - protein, 9 aa, Giardia lamblia
HARTRQQAA

SEQ ID NO: 3055054 - protein, 5 aa, Giardia lamblia
HASGN

SEQ ID NO: 3055055 - protein, 10 aa, Giardia lamblia
HASPKDLSLS

SEQ ID NO: 3055056 - protein, 10 aa, Giardia lamblia
HASSSSYHRH

SEQ ID NO: 3055057 - protein, 11 aa, Giardia lamblia
HASTAPNATRS

SEQ ID NO: 3055058 - protein, 6 aa, Giardia lamblia
HATEHY

SEQ ID NO: 3055059 - protein, 6 aa, Giardia lamblia
HATTEL

SEQ ID NO: 3055060 - protein, 16 aa, Giardia lamblia
HCEEKTKASGKEALQE

SEQ ID NO: 3055061 - protein, 10 aa, Giardia lamblia
HCTDSSDEDA

SEQ ID NO: 3055062 - protein, 5 aa, Giardia lamblia
HDDGM

SEQ ID NO: 3055063 - protein, 47 aa, Giardia lamblia
HDDGMARYSDDEGTYNDEHNEQAGSGDGASPRPVSPGGAGSSSRPAR

SEQ ID NO: 3055064 - protein, 5 aa, Giardia lamblia
HDDPS

SEQ ID NO: 3055065 - protein, 5 aa, Giardia lamblia
HDEEA

SEQ ID NO: 3055066 - protein, 7 aa, Giardia lamblia
HDGGSSR

SEQ ID NO: 3055067 - protein, 6 aa, Giardia lamblia
HDGKSS

SEQ ID NO: 3055068 - protein, 11 aa, Giardia lamblia
HDGNQTYNQNN

SEQ ID NO: 3055069 - protein, 7 aa, Giardia lamblia
HDGQPDS

SEQ ID NO: 3055070 - protein, 8 aa, Giardia lamblia
HDGQSSSQ

SEQ ID NO: 3055071 - protein, 10 aa, Giardia lamblia
HDHDPISTIS

SEQ ID NO: 3055072 - protein, 24 aa, Giardia lamblia
HDHGAPSLPPRRPSCGDSTTEPNS

SEQ ID NO: 3055073 - protein, 4 aa, Giardia lamblia
HDNH

SEQ ID NO: 3055074 - protein, 12 aa, Giardia lamblia
HDNSSGREQDNY

SEQ ID NO: 3055075 - protein, 6 aa, Giardia lamblia
HDPGKR

SEQ ID NO: 3055076 - protein, 4 aa, Giardia lamblia
HDPN

SEQ ID NO: 3055077 - protein, 7 aa, Giardia lamblia
HDPPPAP

SEQ ID NO: 3055078 - protein, 4 aa, Giardia lamblia
HDPR

SEQ ID NO: 3055079 - protein, 14 aa, Giardia lamblia
HDQAEAERTDFDPS

SEQ ID NO: 3055080 - protein, 9 aa, Giardia lamblia
HDQASASAD

SEQ ID NO: 3055081 - protein, 12 aa, Giardia lamblia
HDRADKRRASAL

SEQ ID NO: 3055082 - protein, 13 aa, Giardia lamblia
HDRKYKPNPRYTG

SEQ ID NO: 3055083 - protein, 15 aa, Giardia lamblia
HDSDSTASVSKGHEL

SEQ ID NO: 3055084 - protein, 11 aa, Giardia lamblia
HDSKPGSGVTV

SEQ ID NO: 3055085 - protein, 6 aa, Giardia lamblia
HDSPGH

SEQ ID NO: 3055086 - protein, 9 aa, Giardia lamblia
HDTKKREHL

SEQ ID NO: 3055087 - protein, 10 aa, Giardia lamblia
HDTQASSQEA

SEQ ID NO: 3055088 - protein, 5 aa, Giardia lamblia
HDYQS

SEQ ID NO: 3055089 - protein, 20 aa, Giardia lamblia
HEAEESAEAITESTAKPSVR

SEQ ID NO: 3055090 - protein, 14 aa, Giardia lamblia
HEDACSSLPARSRG

SEQ ID NO: 3055091 - protein, 18 aa, Giardia lamblia
HEDHDQAACDTTSEISTA

SEQ ID NO: 3055092 - protein, 17 aa, Giardia lamblia
HEERDKRRLDNKNHSAG

SEQ ID NO: 3055093 - protein, 5 aa, Giardia lamblia
HEGDQ

SEQ ID NO: 3055094 - protein, 7 aa, Giardia lamblia
HEGDVPA

SEQ ID NO: 3055095 - protein, 11 aa, Giardia lamblia
HEGKDGGEEEV

SEQ ID NO: 3055096 - protein, 8 aa, Giardia lamblia
HEGNTYTG

SEQ ID NO: 3055097 - protein, 8 aa, Giardia lamblia
HEGPEYAA

SEQ ID NO: 3055098 - protein, 9 aa, Giardia lamblia
HEGSTSSRA

SEQ ID NO: 3055099 - protein, 4 aa, Giardia lamblia
HEHI

SEQ ID NO: 3055100 - protein, 4 aa, Giardia lamblia
HEHT

SEQ ID NO: 3055101 - protein, 4 aa, Giardia lamblia
HEIR

SEQ ID NO: 3055102 - protein, 4 aa, Giardia lamblia
HEKP

SEQ ID NO: 3055103 - protein, 16 aa, Giardia lamblia
HEKSQKAGKHKSENTY

SEQ ID NO: 3055104 - protein, 5 aa, Giardia lamblia
HELDD

SEQ ID NO: 3055105 - protein, 5 aa, Giardia lamblia
HENNA

SEQ ID NO: 3055106 - protein, 5 aa, Giardia lamblia
HEPLG

SEQ ID NO: 3055107 - protein, 8 aa, Giardia lamblia
HEQETSGV

SEQ ID NO: 3055108 - protein, 4 aa, Giardia lamblia
HEQN

SEQ ID NO: 3055109 - protein, 6 aa, Giardia lamblia
HERAEA

SEQ ID NO: 3055110 - protein, 7 aa, Giardia lamblia
HERPDSA

SEQ ID NO: 3055111 - protein, 8 aa, Giardia lamblia
HESANGES

SEQ ID NO: 3055112 - protein, 9 aa, Giardia lamblia
HESQNGPQV

SEQ ID NO: 3055113 - protein, 10 aa, Giardia lamblia
HESSGNSPFQ

SEQ ID NO: 3055114 - protein, 6 aa, Giardia lamblia
HESSMT

SEQ ID NO: 3055115 - protein, 10 aa, Giardia lamblia
HESSNENGND

SEQ ID NO: 3055116 - protein, 10 aa, Giardia lamblia
HESSSADADV

SEQ ID NO: 3055117 - protein, 21 aa, Giardia lamblia
HESVPPSGNDPGNQSNLQGST

SEQ ID NO: 3055118 - protein, 4 aa, Giardia lamblia
HETI

SEQ ID NO: 3055119 - protein, 4 aa, Giardia lamblia
HETT

SEQ ID NO: 3055120 - protein, 4 aa, Giardia lamblia
HFED

SEQ ID NO: 3055121 - protein, 6 aa, Giardia lamblia
HFSPDD

SEQ ID NO: 3055122 - protein, 7 aa, Giardia lamblia
HGAETPL

SEQ ID NO: 3055123 - protein, 7 aa, Giardia lamblia
HGAPAKT

SEQ ID NO: 3055124 - protein, 5 aa, Giardia lamblia
HGAPG

SEQ ID NO: 3055125 - protein, 5 aa, Giardia lamblia
HGETL

SEQ ID NO: 3055126 - protein, 6 aa, Giardia lamblia
HGGQCK

SEQ ID NO: 3055127 - protein, 5 aa, Giardia lamblia
HGHAR

SEQ ID NO: 3055128 - protein, 13 aa, Giardia lamblia
HGHMTTSSKATIS

SEQ ID NO: 3055129 - protein, 9 aa, Giardia lamblia
HGKRNNSSW

SEQ ID NO: 3055130 - protein, 6 aa, Giardia lamblia
HGLEPN

SEQ ID NO: 3055131 - protein, 9 aa, Giardia lamblia
HGLSRGEGE

SEQ ID NO: 3055132 - protein, 26 aa, Giardia lamblia
HGNIPTASGKLPITRTSNNTSIPGDF

SEQ ID NO: 3055133 - protein, 4 aa, Giardia lamblia
HGNR

SEQ ID NO: 3055134 - protein, 8 aa, Giardia lamblia
HGNRPGEC

SEQ ID NO: 3055135 - protein, 13 aa, Giardia lamblia
HGPALTPLQKDSL

SEQ ID NO: 3055136 - protein, 6 aa, Giardia lamblia
HGPPKD

SEQ ID NO: 3055137 - protein, 7 aa, Giardia lamblia
HGPQNNK

SEQ ID NO: 3055138 - protein, 9 aa, Giardia lamblia
HGPQRNPGS

SEQ ID NO: 3055139 - protein, 8 aa, Giardia lamblia
HGPRGSSL

SEQ ID NO: 3055140 - protein, 20 aa, Giardia lamblia
HGPRQNSEQNPGVTPDPSAV

SEQ ID NO: 3055141 - protein, 14 aa, Giardia lamblia
HGSCKEDGSGCDCD

SEQ ID NO: 3055142 - protein, 15 aa, Giardia lamblia
HGSIQTQETLTRTAE

SEQ ID NO: 3055143 - protein, 12 aa, Giardia lamblia
HGSSPFKVPPSA

SEQ ID NO: 3055144 - protein, 4 aa, Giardia lamblia
HGST

SEQ ID NO: 3055145 - protein, 5 aa, Giardia lamblia
HGTGA

SEQ ID NO: 3055146 - protein, 5 aa, Giardia lamblia
HGTPE

SEQ ID NO: 3055147 - protein, 7 aa, Giardia lamblia
HGVDAPD

SEQ ID NO: 3055148 - protein, 9 aa, Giardia lamblia
HGVVSKKSS

SEQ ID NO: 3055149 - protein, 9 aa, Giardia lamblia
HHGGSDDSY

SEQ ID NO: 3055150 - protein, 4 aa, Giardia lamblia
HHGK

SEQ ID NO: 3055151 - protein, 45 aa, Giardia lamblia
HHSSRHSSHSGSLANSQAYSHNEDRRRDRSKSGGRDRERSYHRDH

SEQ ID NO: 3055152 - protein, 8 aa, Giardia lamblia
HHSTTRTY

SEQ ID NO: 3055153 - protein, 5 aa, Giardia lamblia
HHTDS

SEQ ID NO: 3055154 - protein, 5 aa, Giardia lamblia
HIATS

SEQ ID NO: 3055155 - protein, 5 aa, Giardia lamblia
HIPEG

SEQ ID NO: 3055156 - protein, 12 aa, Giardia lamblia
HIPQQASPTRTY

SEQ ID NO: 3055157 - protein, 61 aa, Giardia lamblia
HIQDDSKTVPNKIEQHPPSNVRPDSKANNRASTPNQDKKRASSKGRPLSSDQAAESDSSSA

SEQ ID NO: 3055158 - protein, 13 aa, Giardia lamblia
HITESERKKINRK

SEQ ID NO: 3055159 - protein, 16 aa, Giardia lamblia
HKAPSKTASSAGGSGV

SEQ ID NO: 3055160 - protein, 4 aa, Giardia lamblia
HKEH

SEQ ID NO: 3055161 - protein, 9 aa, Giardia lamblia
HKEKERARP

SEQ ID NO: 3055162 - protein, 9 aa, Giardia lamblia
HKESEAPVK

SEQ ID NO: 3055163 - protein, 8 aa, Giardia lamblia
HKGKQLPE

SEQ ID NO: 3055164 - protein, 6 aa, Giardia lamblia
HKGNAS

SEQ ID NO: 3055165 - protein, 5 aa, Giardia lamblia
HKHDP

SEQ ID NO: 3055166 - protein, 8 aa, Giardia lamblia
HKITNASK

SEQ ID NO: 3055167 - protein, 10 aa, Giardia lamblia
HKKGEPVDAE

SEQ ID NO: 3055168 - protein, 10 aa, Giardia lamblia
HKKRQPDAEW

SEQ ID NO: 3055169 - protein, 22 aa, Giardia lamblia
HKLSTELSRATLDAKQSLEDQM

SEQ ID NO: 3055170 - protein, 11 aa, Giardia lamblia
HKNKNEDKLNE

SEQ ID NO: 3055171 - protein, 6 aa, Giardia lamblia
HKPKRV

SEQ ID NO: 3055172 - protein, 6 aa, Giardia lamblia
HKPTQD

SEQ ID NO: 3055173 - protein, 7 aa, Giardia lamblia
HKPTRRA

SEQ ID NO: 3055174 - protein, 12 aa, Giardia lamblia
HKRESRISNGAK

SEQ ID NO: 3055175 - protein, 10 aa, Giardia lamblia
HKRPRTPSYT

SEQ ID NO: 3055176 - protein, 9 aa, Giardia lamblia
HKSKATEEQ

SEQ ID NO: 3055177 - protein, 21 aa, Giardia lamblia
HKSSNEQLRPPKQSTLPDSSK

SEQ ID NO: 3055178 - protein, 8 aa, Giardia lamblia
HKSTADVR

SEQ ID NO: 3055179 - protein, 8 aa, Giardia lamblia
HKTDPSHI

SEQ ID NO: 3055180 - protein, 10 aa, Giardia lamblia
HLHESSKQSI

SEQ ID NO: 3055181 - protein, 5 aa, Giardia lamblia
HLKSN

SEQ ID NO: 3055182 - protein, 13 aa, Giardia lamblia
HLSSSAKSMTYRP

SEQ ID NO: 3055183 - protein, 5 aa, Giardia lamblia
HLSST

SEQ ID NO: 3055184 - protein, 19 aa, Giardia lamblia
HMPNDAADNSAQHRRKTRQ

SEQ ID NO: 3055185 - protein, 4 aa, Giardia lamblia
HNAK

SEQ ID NO: 3055186 - protein, 9 aa, Giardia lamblia
HNAPQSLSS

SEQ ID NO: 3055187 - protein, 18 aa, Giardia lamblia
HNDDINTTNLPAQRTPGG

SEQ ID NO: 3055188 - protein, 8 aa, Giardia lamblia
HNDPRSGF

SEQ ID NO: 3055189 - protein, 4 aa, Giardia lamblia
HNEG

SEQ ID NO: 3055190 - protein, 6 aa, Giardia lamblia
HNESKR

SEQ ID NO: 3055191 - protein, 5 aa, Giardia lamblia
HNESR

SEQ ID NO: 3055192 - protein, 5 aa, Giardia lamblia
HNESS

SEQ ID NO: 3055193 - protein, 6 aa, Giardia lamblia
HNEVNA

SEQ ID NO: 3055194 - protein, 8 aa, Giardia lamblia
HNGAGKST

SEQ ID NO: 3055195 - protein, 9 aa, Giardia lamblia
HNGAPADEV

SEQ ID NO: 3055196 - protein, 5 aa, Giardia lamblia
HNGAS

SEQ ID NO: 3055197 - protein, 16 aa, Giardia lamblia
HNGGIGEDLREPEQAS

SEQ ID NO: 3055198 - protein, 18 aa, Giardia lamblia
HNHNRGPDSNQTSTGTTT

SEQ ID NO: 3055199 - protein, 23 aa, Giardia lamblia
HNIQTDQRTCAEGCGARASSNQG

SEQ ID NO: 3055200 - protein, 5 aa, Giardia lamblia
HNKSA

SEQ ID NO: 3055201 - protein, 8 aa, Giardia lamblia
HNKTHRNT

SEQ ID NO: 3055202 - protein, 6 aa, Giardia lamblia
HNLEQP

SEQ ID NO: 3055203 - protein, 14 aa, Giardia lamblia
HNNPEPAPEPSEIR

SEQ ID NO: 3055204 - protein, 14 aa, Giardia lamblia
HNNRRGLSPTKNPG

SEQ ID NO: 3055205 - protein, 12 aa, Giardia lamblia
HNPQAGATTSPL

SEQ ID NO: 3055206 - protein, 35 aa, Giardia lamblia
HNQRQTDSSTSSQDSDESTGFSDDSDDDSIKQVQR

SEQ ID NO: 3055207 - protein, 38 aa, Giardia lamblia
HNRESTAPSMSHRGHPGRFGDTDSPATGQSYTGLNQET

SEQ ID NO: 3055208 - protein, 9 aa, Giardia lamblia
HNSESKKHM

SEQ ID NO: 3055209 - protein, 5 aa, Giardia lamblia
HNSPS

SEQ ID NO: 3055210 - protein, 9 aa, Giardia lamblia
HNSSVKEKM

SEQ ID NO: 3055211 - protein, 6 aa, Giardia lamblia
HPAAAA

SEQ ID NO: 3055212 - protein, 5 aa, Giardia lamblia
HPASS

SEQ ID NO: 3055213 - protein, 8 aa, Giardia lamblia
HPDAAGEL

SEQ ID NO: 3055214 - protein, 9 aa, Giardia lamblia
HPDKPPKNL

SEQ ID NO: 3055215 - protein, 8 aa, Giardia lamblia
HPDPTSTN

SEQ ID NO: 3055216 - protein, 6 aa, Giardia lamblia
HPDSRR

SEQ ID NO: 3055217 - protein, 4 aa, Giardia lamblia
HPEI

SEQ ID NO: 3055218 - protein, 8 aa, Giardia lamblia
HPGDKEEA

SEQ ID NO: 3055219 - protein, 4 aa, Giardia lamblia
HPGI

SEQ ID NO: 3055220 - protein, 9 aa, Giardia lamblia
HPHNNPRSV

SEQ ID NO: 3055221 - protein, 4 aa, Giardia lamblia
HPHP

SEQ ID NO: 3055222 - protein, 5 aa, Giardia lamblia
HPHTV

SEQ ID NO: 3055223 - protein, 9 aa, Giardia lamblia
HPKASRYVP

SEQ ID NO: 3055224 - protein, 9 aa, Giardia lamblia
HPKPEKEDL

SEQ ID NO: 3055225 - protein, 5 aa, Giardia lamblia
HPKQS

SEQ ID NO: 3055226 - protein, 4 aa, Giardia lamblia
HPLD

SEQ ID NO: 3055227 - protein, 8 aa, Giardia lamblia
HPQESREG

SEQ ID NO: 3055228 - protein, 4 aa, Giardia lamblia
HPQP

SEQ ID NO: 3055229 - protein, 8 aa, Giardia lamblia
HPRARNQF

SEQ ID NO: 3055230 - protein, 5 aa, Giardia lamblia
HPRNE

SEQ ID NO: 3055231 - protein, 7 aa, Giardia lamblia
HPRRPKL

SEQ ID NO: 3055232 - protein, 6 aa, Giardia lamblia
HPSGYS

SEQ ID NO: 3055233 - protein, 14 aa, Giardia lamblia
HPSPRTRSSAPNSH

SEQ ID NO: 3055234 - protein, 11 aa, Giardia lamblia
HPSPSGPEKDM

SEQ ID NO: 3055235 - protein, 4 aa, Giardia lamblia
HPTD

SEQ ID NO: 3055236 - protein, 5 aa, Giardia lamblia
HPTDS

SEQ ID NO: 3055237 - protein, 24 aa, Giardia lamblia
HPTESSCSATRTNTLEPSSKMDSE

SEQ ID NO: 3055238 - protein, 4 aa, Giardia lamblia
HPTS

SEQ ID NO: 3055239 - protein, 11 aa, Giardia lamblia
HPVAKGKVAES

SEQ ID NO: 3055240 - protein, 6 aa, Giardia lamblia
HPVEQS

SEQ ID NO: 3055241 - protein, 5 aa, Giardia lamblia
HPWQN

SEQ ID NO: 3055242 - protein, 5 aa, Giardia lamblia
HPYDG

SEQ ID NO: 3055243 - protein, 5 aa, Giardia lamblia
HQASV

SEQ ID NO: 3055244 - protein, 6 aa, Giardia lamblia
HQFSTS

SEQ ID NO: 3055245 - protein, 8 aa, Giardia lamblia
HQGNERGM

SEQ ID NO: 3055246 - protein, 6 aa, Giardia lamblia
HQHQAG

SEQ ID NO: 3055247 - protein, 7 aa, Giardia lamblia
HQKGKNQ

SEQ ID NO: 3055248 - protein, 4 aa, Giardia lamblia
HQPA

SEQ ID NO: 3055249 - protein, 5 aa, Giardia lamblia
HQPEN

SEQ ID NO: 3055250 - protein, 5 aa, Giardia lamblia
HQPSN

SEQ ID NO: 3055251 - protein, 5 aa, Giardia lamblia
HQPSP

SEQ ID NO: 3055252 - protein, 16 aa, Giardia lamblia
HQQTSCDGTTEESDTV

SEQ ID NO: 3055253 - protein, 8 aa, Giardia lamblia
HQRSNTDM

SEQ ID NO: 3055254 - protein, 6 aa, Giardia lamblia
HQRTAS

SEQ ID NO: 3055255 - protein, 9 aa, Giardia lamblia
HQSGQTNSQ

SEQ ID NO: 3055256 - protein, 5 aa, Giardia lamblia
HQSSE

SEQ ID NO: 3055257 - protein, 20 aa, Giardia lamblia
HQSVESPDNSLQQEDTSSVL

SEQ ID NO: 3055258 - protein, 7 aa, Giardia lamblia
HQTEANQ

SEQ ID NO: 3055259 - protein, 12 aa, Giardia lamblia
HQTRQVDSRGRT

SEQ ID NO: 3055260 - protein, 8 aa, Giardia lamblia
HQTTASDD

SEQ ID NO: 3055261 - protein, 7 aa, Giardia lamblia
HQVAPSE

SEQ ID NO: 3055262 - protein, 16 aa, Giardia lamblia
HRASKADDINKEATPE

SEQ ID NO: 3055263 - protein, 11 aa, Giardia lamblia
HRASLDKTTAI

SEQ ID NO: 3055264 - protein, 7 aa, Giardia lamblia
HRDSCAQ

SEQ ID NO: 3055265 - protein, 19 aa, Giardia lamblia
HREDTDDDDGPTEFAKRVR

SEQ ID NO: 3055266 - protein, 6 aa, Giardia lamblia
HREEGA

SEQ ID NO: 3055267 - protein, 5 aa, Giardia lamblia
HRFSE

SEQ ID NO: 3055268 - protein, 10 aa, Giardia lamblia
HRGSSNGETA

SEQ ID NO: 3055269 - protein, 15 aa, Giardia lamblia
HRKDPDTEMKQTNAM

SEQ ID NO: 3055270 - protein, 13 aa, Giardia lamblia
HRKGGDNKEVTAH

SEQ ID NO: 3055271 - protein, 11 aa, Giardia lamblia
HRKGGTSAPEP

SEQ ID NO: 3055272 - protein, 26 aa, Giardia lamblia
HRKGKQQSSRAKSTMLGSNEDFNSPT

SEQ ID NO: 3055273 - protein, 7 aa, Giardia lamblia
HRNGSLD

SEQ ID NO: 3055274 - protein, 5 aa, Giardia lamblia
HRNLN

SEQ ID NO: 3055275 - protein, 16 aa, Giardia lamblia
HRPARSAMADTSPSSY

SEQ ID NO: 3055276 - protein, 6 aa, Giardia lamblia
HRPPRV

SEQ ID NO: 3055277 - protein, 7 aa, Giardia lamblia
HRPRRDA

SEQ ID NO: 3055278 - protein, 9 aa, Giardia lamblia
HRPSTLSQT

SEQ ID NO: 3055279 - protein, 17 aa, Giardia lamblia
HRQDSSEATKVKDKLGK

SEQ ID NO: 3055280 - protein, 6 aa, Giardia lamblia
HRRNQE

SEQ ID NO: 3055281 - protein, 9 aa, Giardia lamblia
HRRTSRTSF

SEQ ID NO: 3055282 - protein, 7 aa, Giardia lamblia
HRSESLD

SEQ ID NO: 3055283 - protein, 4 aa, Giardia lamblia
HRSN

SEQ ID NO: 3055284 - protein, 19 aa, Giardia lamblia
HRTASSRALEDRPQPKPAQ

SEQ ID NO: 3055285 - protein, 7 aa, Giardia lamblia
HRTGRVS

SEQ ID NO: 3055286 - protein, 14 aa, Giardia lamblia
HRTPRSQKLPSQDD

SEQ ID NO: 3055287 - protein, 6 aa, Giardia lamblia
HRTPSR

SEQ ID NO: 3055288 - protein, 9 aa, Giardia lamblia
HSAEQAPAS

SEQ ID NO: 3055289 - protein, 5 aa, Giardia lamblia
HSAGS

SEQ ID NO: 3055290 - protein, 4 aa, Giardia lamblia
HSAP

SEQ ID NO: 3055291 - protein, 6 aa, Giardia lamblia
HSAPTE

SEQ ID NO: 3055292 - protein, 6 aa, Giardia lamblia
HSAQTL

SEQ ID NO: 3055293 - protein, 11 aa, Giardia lamblia
HSASDTQGESS

SEQ ID NO: 3055294 - protein, 14 aa, Giardia lamblia
HSCENTHSTNNPDL

SEQ ID NO: 3055295 - protein, 6 aa, Giardia lamblia
HSCQAG

SEQ ID NO: 3055296 - protein, 29 aa, Giardia lamblia
HSCSESGESKSDSSKGVSARGNNRYGRAN

SEQ ID NO: 3055297 - protein, 9 aa, Giardia lamblia
HSDDPNPAA

SEQ ID NO: 3055298 - protein, 8 aa, Giardia lamblia
HSDGDLQG

SEQ ID NO: 3055299 - protein, 8 aa, Giardia lamblia
HSDTPDNL

SEQ ID NO: 3055300 - protein, 8 aa, Giardia lamblia
HSDTPSSV

SEQ ID NO: 3055301 - protein, 6 aa, Giardia lamblia
HSDYNQ

SEQ ID NO: 3055302 - protein, 11 aa, Giardia lamblia
HSEDNPDSISR

SEQ ID NO: 3055303 - protein, 9 aa, Giardia lamblia
HSEDRTRTI

SEQ ID NO: 3055304 - protein, 8 aa, Giardia lamblia
HSEPMESR

SEQ ID NO: 3055305 - protein, 7 aa, Giardia lamblia
HSETPLH

SEQ ID NO: 3055306 - protein, 7 aa, Giardia lamblia
HSFSSNG

SEQ ID NO: 3055307 - protein, 7 aa, Giardia lamblia
HSGDNTD

SEQ ID NO: 3055308 - protein, 11 aa, Giardia lamblia
HSGENPKVDTF

SEQ ID NO: 3055309 - protein, 18 aa, Giardia lamblia
HSGKSIPNCRGKGKEYGR

SEQ ID NO: 3055310 - protein, 6 aa, Giardia lamblia
HSGPWS

SEQ ID NO: 3055311 - protein, 9 aa, Giardia lamblia
HSGSPYNYT

SEQ ID NO: 3055312 - protein, 6 aa, Giardia lamblia
HSGTAC

SEQ ID NO: 3055313 - protein, 12 aa, Giardia lamblia
HSHQPEGQKAPT

SEQ ID NO: 3055314 - protein, 9 aa, Giardia lamblia
HSHRGSTVH

SEQ ID NO: 3055315 - protein, 4 aa, Giardia lamblia
HSHS

SEQ ID NO: 3055316 - protein, 11 aa, Giardia lamblia
HSIQKPKRRSS

SEQ ID NO: 3055317 - protein, 6 aa, Giardia lamblia
HSKDRN

SEQ ID NO: 3055318 - protein, 10 aa, Giardia lamblia
HSKEYQSTHG

SEQ ID NO: 3055319 - protein, 6 aa, Giardia lamblia
HSKSQL

SEQ ID NO: 3055320 - protein, 4 aa, Giardia lamblia
HSLP

SEQ ID NO: 3055321 - protein, 12 aa, Giardia lamblia
HSLSSTPSGHTA

SEQ ID NO: 3055322 - protein, 4 aa, Giardia lamblia
HSMN

SEQ ID NO: 3055323 - protein, 6 aa, Giardia lamblia
HSNPGS

SEQ ID NO: 3055324 - protein, 6 aa, Giardia lamblia
HSNSSL

SEQ ID NO: 3055325 - protein, 6 aa, Giardia lamblia
HSNTEY

SEQ ID NO: 3055326 - protein, 9 aa, Giardia lamblia
HSPADAKSM

SEQ ID NO: 3055327 - protein, 6 aa, Giardia lamblia
HSPGQQ

SEQ ID NO: 3055328 - protein, 8 aa, Giardia lamblia
HSQSISSR

SEQ ID NO: 3055329 - protein, 9 aa, Giardia lamblia
HSQTHRGQL

SEQ ID NO: 3055330 - protein, 4 aa, Giardia lamblia
HSRP

SEQ ID NO: 3055331 - protein, 10 aa, Giardia lamblia
HSRPPTAEQK

SEQ ID NO: 3055332 - protein, 7 aa, Giardia lamblia
HSSDGKL

SEQ ID NO: 3055333 - protein, 7 aa, Giardia lamblia
HSSGISD

SEQ ID NO: 3055334 - protein, 30 aa, Giardia lamblia
HSSKNTTKKHKSSERHRSKSKEKRVESQKE

SEQ ID NO: 3055335 - protein, 8 aa, Giardia lamblia
HSSPTAAS

SEQ ID NO: 3055336 - protein, 16 aa, Giardia lamblia
HSSQRTKYTVASKSTA

SEQ ID NO: 3055337 - protein, 6 aa, Giardia lamblia
HSSSHD

SEQ ID NO: 3055338 - protein, 7 aa, Giardia lamblia
HSSSQRQ

SEQ ID NO: 3055339 - protein, 17 aa, Giardia lamblia
HSSTGDAASNLSDNTDL

SEQ ID NO: 3055340 - protein, 8 aa, Giardia lamblia
HSSTISID

SEQ ID NO: 3055341 - protein, 10 aa, Giardia lamblia
HSSVRSPQRM

SEQ ID NO: 3055342 - protein, 11 aa, Giardia lamblia
HSTDSEDSEEQ

SEQ ID NO: 3055343 - protein, 28 aa, Giardia lamblia
HSTDSGPSMQDRDASTNEDNDDKCGIGS

SEQ ID NO: 3055344 - protein, 13 aa, Giardia lamblia
HSTGQDTQEVQEG

SEQ ID NO: 3055345 - protein, 8 aa, Giardia lamblia
HSTGVGPA

SEQ ID NO: 3055346 - protein, 15 aa, Giardia lamblia
HSTHTLGSSAASPRL

SEQ ID NO: 3055347 - protein, 6 aa, Giardia lamblia
HSTIQG

SEQ ID NO: 3055348 - protein, 14 aa, Giardia lamblia
HSTQLDSKRRRGRS

SEQ ID NO: 3055349 - protein, 17 aa, Giardia lamblia
HSTRDLGKKSKLSAGTA

SEQ ID NO: 3055350 - protein, 7 aa, Giardia lamblia
HSTSMER

SEQ ID NO: 3055351 - protein, 10 aa, Giardia lamblia
HSTSSGSTYC

SEQ ID NO: 3055352 - protein, 6 aa, Giardia lamblia
HSTSSH

SEQ ID NO: 3055353 - protein, 14 aa, Giardia lamblia
HSYSEPACTNYSNH

SEQ ID NO: 3055354 - protein, 14 aa, Giardia lamblia
HSYTDKEGLDPDAI

SEQ ID NO: 3055355 - protein, 18 aa, Giardia lamblia
HSYTPKTVSSKPQPYYTD

SEQ ID NO: 3055356 - protein, 12 aa, Giardia lamblia
HTAQPCSRDALG

SEQ ID NO: 3055357 - protein, 10 aa, Giardia lamblia
HTCDRQTKQC

SEQ ID NO: 3055358 - protein, 4 aa, Giardia lamblia
HTDE

SEQ ID NO: 3055359 - protein, 7 aa, Giardia lamblia
HTDRQVP

SEQ ID NO: 3055360 - protein, 12 aa, Giardia lamblia
HTDSPSADTLRT

SEQ ID NO: 3055361 - protein, 23 aa, Giardia lamblia
HTEGTQGLSDTDTLKSDPQHSTE

SEQ ID NO: 3055362 - protein, 18 aa, Giardia lamblia
HTEHTSPPSGGLDDHEEG

SEQ ID NO: 3055363 - protein, 5 aa, Giardia lamblia
HTESA

SEQ ID NO: 3055364 - protein, 14 aa, Giardia lamblia
HTGKSPVATSPEDF

SEQ ID NO: 3055365 - protein, 8 aa, Giardia lamblia
HTHTEGDL

SEQ ID NO: 3055366 - protein, 13 aa, Giardia lamblia
HTIPDSSDLNASS

SEQ ID NO: 3055367 - protein, 12 aa, Giardia lamblia
HTKAKKKAASLA

SEQ ID NO: 3055368 - protein, 5 aa, Giardia lamblia
HTKNK

SEQ ID NO: 3055369 - protein, 8 aa, Giardia lamblia
HTKPPAQV

SEQ ID NO: 3055370 - protein, 5 aa, Giardia lamblia
HTLSR

SEQ ID NO: 3055371 - protein, 4 aa, Giardia lamblia
HTNR

SEQ ID NO: 3055372 - protein, 9 aa, Giardia lamblia
HTPAANRRT

SEQ ID NO: 3055373 - protein, 6 aa, Giardia lamblia
HTPASE

SEQ ID NO: 3055374 - protein, 13 aa, Giardia lamblia
HTPFTRSDKIPKT

SEQ ID NO: 3055375 - protein, 5 aa, Giardia lamblia
HTPGQ

SEQ ID NO: 3055376 - protein, 4 aa, Giardia lamblia
HTPL

SEQ ID NO: 3055377 - protein, 5 aa, Giardia lamblia
HTPLE

SEQ ID NO: 3055378 - protein, 15 aa, Giardia lamblia
HTPLPSGLKDCGNDV

SEQ ID NO: 3055379 - protein, 8 aa, Giardia lamblia
HTRARRNS

SEQ ID NO: 3055380 - protein, 9 aa, Giardia lamblia
HTRPEDPKD

SEQ ID NO: 3055381 - protein, 12 aa, Giardia lamblia
HTSAKQATRTVP

SEQ ID NO: 3055382 - protein, 8 aa, Giardia lamblia
HTSAQYGI

SEQ ID NO: 3055383 - protein, 6 aa, Giardia lamblia
HTSELR

SEQ ID NO: 3055384 - protein, 6 aa, Giardia lamblia
HTSERR

SEQ ID NO: 3055385 - protein, 4 aa, Giardia lamblia
HTSQ

SEQ ID NO: 3055386 - protein, 6 aa, Giardia lamblia
HTSRAS

SEQ ID NO: 3055387 - protein, 6 aa, Giardia lamblia
HTSRQQ

SEQ ID NO: 3055388 - protein, 6 aa, Giardia lamblia
HTTKEH

SEQ ID NO: 3055389 - protein, 10 aa, Giardia lamblia
HTTSKTTRKT

SEQ ID NO: 3055390 - protein, 6 aa, Giardia lamblia
HTTSSP

SEQ ID NO: 3055391 - protein, 9 aa, Giardia lamblia
HTTSSSTDC

SEQ ID NO: 3055392 - protein, 6 aa, Giardia lamblia
HTYPST

SEQ ID NO: 3055393 - protein, 4 aa, Giardia lamblia
HTYR

SEQ ID NO: 3055394 - protein, 9 aa, Giardia lamblia
HVRGGREHA

SEQ ID NO: 3055395 - protein, 15 aa, Giardia lamblia
HVSRQTSRALSRAAS

SEQ ID NO: 3055396 - protein, 12 aa, Giardia lamblia
HVTETSDTSDSY

SEQ ID NO: 3055397 - protein, 8 aa, Giardia lamblia
HYGEERKK

SEQ ID NO: 3055398 - protein, 10 aa, Giardia lamblia
HYGPDCGKNP

SEQ ID NO: 3055399 - protein, 5 aa, Giardia lamblia
HYGSN

SEQ ID NO: 3055400 - protein, 5 aa, Giardia lamblia
HYGSY

SEQ ID NO: 3055401 - protein, 18 aa, Giardia lamblia
HYQRNQHNQGVNSIVLGS

SEQ ID NO: 3055402 - protein, 4 aa, Giardia lamblia
HYSR

SEQ ID NO: 3055403 - protein, 9 aa, Giardia lamblia
HYTDEERKS

SEQ ID NO: 3055404 - protein, 6 aa, Giardia lamblia
HYTSAN

SEQ ID NO: 3055405 - protein, 12 aa, Giardia lamblia
IAANGDNLSAGQ

SEQ ID NO: 3055406 - protein, 8 aa, Giardia lamblia
IAAPTPEF

SEQ ID NO: 3055407 - protein, 15 aa, Giardia lamblia
IAASEKKSLETADER

SEQ ID NO: 3055408 - protein, 9 aa, Giardia lamblia
IADEDRNAV

SEQ ID NO: 3055409 - protein, 5 aa, Giardia lamblia
IADSG

SEQ ID NO: 3055410 - protein, 11 aa, Giardia lamblia
IADTRNSAPTP

SEQ ID NO: 3055411 - protein, 15 aa, Giardia lamblia
IAEEARSLKALFLQF

SEQ ID NO: 3055412 - protein, 5 aa, Giardia lamblia
IAEEQ

SEQ ID NO: 3055413 - protein, 9 aa, Giardia lamblia
IAEGSGDWK

SEQ ID NO: 3055414 - protein, 12 aa, Giardia lamblia
IAENSEDGDSIL

SEQ ID NO: 3055415 - protein, 10 aa, Giardia lamblia
IAESDASTLQ

SEQ ID NO: 3055416 - protein, 10 aa, Giardia lamblia
IAETSKSAIA

SEQ ID NO: 3055417 - protein, 6 aa, Giardia lamblia
IAGTAT

SEQ ID NO: 3055418 - protein, 7 aa, Giardia lamblia
IAKGPPQ

SEQ ID NO: 3055419 - protein, 4 aa, Giardia lamblia
IAKS

SEQ ID NO: 3055420 - protein, 12 aa, Giardia lamblia
IANDGGDHRAAY

SEQ ID NO: 3055421 - protein, 4 aa, Giardia lamblia
IANE

SEQ ID NO: 3055422 - protein, 9 aa, Giardia lamblia
IANKGQIPA

SEQ ID NO: 3055423 - protein, 40 aa, Giardia lamblia
IANTHPGDYNSYKVTDKKTINSDDDTSSEGSVASLTDEDY

SEQ ID NO: 3055424 - protein, 4 aa, Giardia lamblia
IAPD

SEQ ID NO: 3055425 - protein, 10 aa, Giardia lamblia
IAPDSKKKIK

SEQ ID NO: 3055426 - protein, 9 aa, Giardia lamblia
IAPKPSVRS

SEQ ID NO: 3055427 - protein, 20 aa, Giardia lamblia
IAPNSKAAKAHEKHHTREHN

SEQ ID NO: 3055428 - protein, 14 aa, Giardia lamblia
IAPPTKPAVNAPVE

SEQ ID NO: 3055429 - protein, 6 aa, Giardia lamblia
IAPRRE

SEQ ID NO: 3055430 - protein, 12 aa, Giardia lamblia
IAPTSQGDPGTL

SEQ ID NO: 3055431 - protein, 8 aa, Giardia lamblia
IAQKQRDL

SEQ ID NO: 3055432 - protein, 11 aa, Giardia lamblia
IAQNTSQLSNQ

SEQ ID NO: 3055433 - protein, 6 aa, Giardia lamblia
IAQPLD

SEQ ID NO: 3055434 - protein, 12 aa, Giardia lamblia
IAQSGSPDAEQA

SEQ ID NO: 3055435 - protein, 6 aa, Giardia lamblia
IAQTAS

SEQ ID NO: 3055436 - protein, 7 aa, Giardia lamblia
IARNEHK

SEQ ID NO: 3055437 - protein, 7 aa, Giardia lamblia
IARTPVD

SEQ ID NO: 3055438 - protein, 8 aa, Giardia lamblia
IASESAND

SEQ ID NO: 3055439 - protein, 5 aa, Giardia lamblia
IASGS

SEQ ID NO: 3055440 - protein, 6 aa, Giardia lamblia
IASGTS

SEQ ID NO: 3055441 - protein, 25 aa, Giardia lamblia
IASSSSSSSSNLDSGALGDANISGT

SEQ ID NO: 3055442 - protein, 19 aa, Giardia lamblia
IASSSTTRHAPISSTKQYE

SEQ ID NO: 3055443 - protein, 7 aa, Giardia lamblia
IASTDTK

SEQ ID NO: 3055444 - protein, 9 aa, Giardia lamblia
IASTRTESL

SEQ ID NO: 3055445 - protein, 16 aa, Giardia lamblia
IATATAEKEEENSTST

SEQ ID NO: 3055446 - protein, 6 aa, Giardia lamblia
IATQTT

SEQ ID NO: 3055447 - protein, 10 aa, Giardia lamblia
IATSGGADLS

SEQ ID NO: 3055448 - protein, 8 aa, Giardia lamblia
IATSSDST

SEQ ID NO: 3055449 - protein, 9 aa, Giardia lamblia
ICPEGAKTT

SEQ ID NO: 3055450 - protein, 8 aa, Giardia lamblia
ICSPTNQQ

SEQ ID NO: 3055451 - protein, 4 aa, Giardia lamblia
IDAG

SEQ ID NO: 3055452 - protein, 15 aa, Giardia lamblia
IDASPSTMTLIPSKS

SEQ ID NO: 3055453 - protein, 15 aa, Giardia lamblia
IDASPSTMTLISSKS

SEQ ID NO: 3055454 - protein, 8 aa, Giardia lamblia
IDCTGTPN

SEQ ID NO: 3055455 - protein, 22 aa, Giardia lamblia
IDDNEASDEQSTYNDNDRDDAI

SEQ ID NO: 3055456 - protein, 13 aa, Giardia lamblia
IDEKSGKGSLRKR

SEQ ID NO: 3055457 - protein, 34 aa, Giardia lamblia
IDESLKKNKPPTAQEKKPQGAKKPAAGAQETQVS

SEQ ID NO: 3055458 - protein, 9 aa, Giardia lamblia
IDESSEVPE

SEQ ID NO: 3055459 - protein, 5 aa, Giardia lamblia
IDGAT

SEQ ID NO: 3055460 - protein, 55 aa, Giardia lamblia
IDGKYDDTPNLPQNDELRDGAGESTRERSYKIQNKAGAEYTESTEEESDSARGLP

SEQ ID NO: 3055461 - protein, 7 aa, Giardia lamblia
IDGQPYS

SEQ ID NO: 3055462 - protein, 10 aa, Giardia lamblia
IDGSETANNQ

SEQ ID NO: 3055463 - protein, 18 aa, Giardia lamblia
IDGTEKSLKKKAQSDPAL

SEQ ID NO: 3055464 - protein, 9 aa, Giardia lamblia
IDHPTQSAE

SEQ ID NO: 3055465 - protein, 10 aa, Giardia lamblia
IDKDDDDGLS

SEQ ID NO: 3055466 - protein, 7 aa, Giardia lamblia
IDKDTKA

SEQ ID NO: 3055467 - protein, 7 aa, Giardia lamblia
IDKPDID

SEQ ID NO: 3055468 - protein, 12 aa, Giardia lamblia
IDNAGEKEERKE

SEQ ID NO: 3055469 - protein, 4 aa, Giardia lamblia
IDND

SEQ ID NO: 3055470 - protein, 21 aa, Giardia lamblia
IDNSSNHTLPGAPGHEEPNDT

SEQ ID NO: 3055471 - protein, 12 aa, Giardia lamblia
IDNSSVQQETKN

SEQ ID NO: 3055472 - protein, 5 aa, Giardia lamblia
IDPES

SEQ ID NO: 3055473 - protein, 7 aa, Giardia lamblia
IDPGNAT

SEQ ID NO: 3055474 - protein, 11 aa, Giardia lamblia
IDPSTKTYSLG

SEQ ID NO: 3055475 - protein, 8 aa, Giardia lamblia
IDQNSGWQ

SEQ ID NO: 3055476 - protein, 8 aa, Giardia lamblia
IDQSTTSM

SEQ ID NO: 3055477 - protein, 7 aa, Giardia lamblia
IDRAPQL

SEQ ID NO: 3055478 - protein, 18 aa, Giardia lamblia
IDRRAAARRQEPSDSYSD

SEQ ID NO: 3055479 - protein, 4 aa, Giardia lamblia
IDRT

SEQ ID NO: 3055480 - protein, 9 aa, Giardia lamblia
IDRTAGDDI

SEQ ID NO: 3055481 - protein, 6 aa, Giardia lamblia
IDRTPT

SEQ ID NO: 3055482 - protein, 16 aa, Giardia lamblia
IDRTYNRTRQSHQSDN

SEQ ID NO: 3055483 - protein, 12 aa, Giardia lamblia
IDSDSSEEDDKM

SEQ ID NO: 3055484 - protein, 11 aa, Giardia lamblia
IDSPASSSEAA

SEQ ID NO: 3055485 - protein, 12 aa, Giardia lamblia
IDSQHSNAHSNS

SEQ ID NO: 3055486 - protein, 6 aa, Giardia lamblia
IDSSAN

SEQ ID NO: 3055487 - protein, 9 aa, Giardia lamblia
IDSSQRGFT

SEQ ID NO: 3055488 - protein, 6 aa, Giardia lamblia
IDSTKI

SEQ ID NO: 3055489 - protein, 12 aa, Giardia lamblia
IDSTTATHGSLS

SEQ ID NO: 3055490 - protein, 6 aa, Giardia lamblia
IDTKET

SEQ ID NO: 3055491 - protein, 11 aa, Giardia lamblia
IDTKTEGFSVE

SEQ ID NO: 3055492 - protein, 6 aa, Giardia lamblia
IDTPTD

SEQ ID NO: 3055493 - protein, 4 aa, Giardia lamblia
IDTS

SEQ ID NO: 3055494 - protein, 9 aa, Giardia lamblia
IDTSDPPTM

SEQ ID NO: 3055495 - protein, 18 aa, Giardia lamblia
IDTSIGETLTSSQTTHDT

SEQ ID NO: 3055496 - protein, 9 aa, Giardia lamblia
IEAGRYSKA

SEQ ID NO: 3055497 - protein, 5 aa, Giardia lamblia
IEARD

SEQ ID NO: 3055498 - protein, 13 aa, Giardia lamblia
IEASKNKTSCGDE

SEQ ID NO: 3055499 - protein, 4 aa, Giardia lamblia
IEDA

SEQ ID NO: 3055500 - protein, 10 aa, Giardia lamblia
IEDEGKSLQL

SEQ ID NO: 3055501 - protein, 10 aa, Giardia lamblia
IEDKERQRQR

SEQ ID NO: 3055502 - protein, 13 aa, Giardia lamblia
IEDPSTKADHGYV

SEQ ID NO: 3055503 - protein, 5 aa, Giardia lamblia
IEDTS

SEQ ID NO: 3055504 - protein, 26 aa, Giardia lamblia
IEEDDDRDLPSSDENAEEHDEHEAPV

SEQ ID NO: 3055505 - protein, 4 aa, Giardia lamblia
IEEE

SEQ ID NO: 3055506 - protein, 6 aa, Giardia lamblia
IEEERR

SEQ ID NO: 3055507 - protein, 11 aa, Giardia lamblia
IEENQANNEQI

SEQ ID NO: 3055508 - protein, 12 aa, Giardia lamblia
IEENSRKEQQGK

SEQ ID NO: 3055509 - protein, 10 aa, Giardia lamblia
IEESSESRLT

SEQ ID NO: 3055510 - protein, 12 aa, Giardia lamblia
IEETSAANNLDR

SEQ ID NO: 3055511 - protein, 8 aa, Giardia lamblia
IEGEQPEE

SEQ ID NO: 3055512 - protein, 8 aa, Giardia lamblia
IEGKNSSI

SEQ ID NO: 3055513 - protein, 9 aa, Giardia lamblia
IEGNGSRQT

SEQ ID NO: 3055514 - protein, 7 aa, Giardia lamblia
IEGSDGC

SEQ ID NO: 3055515 - protein, 4 aa, Giardia lamblia
IEKQ

SEQ ID NO: 3055516 - protein, 7 aa, Giardia lamblia
IENDEDE

SEQ ID NO: 3055517 - protein, 8 aa, Giardia lamblia
IENEEAQS

SEQ ID NO: 3055518 - protein, 12 aa, Giardia lamblia
IEPPSSGTSEEY

SEQ ID NO: 3055519 - protein, 15 aa, Giardia lamblia
IEPPTEYEDSSPATI

SEQ ID NO: 3055520 - protein, 5 aa, Giardia lamblia
IEPSE

SEQ ID NO: 3055521 - protein, 8 aa, Giardia lamblia
IEPTDKKI

SEQ ID NO: 3055522 - protein, 13 aa, Giardia lamblia
IEPTPIDSTSPAA

SEQ ID NO: 3055523 - protein, 9 aa, Giardia lamblia
IEQGGPSDM

SEQ ID NO: 3055524 - protein, 6 aa, Giardia lamblia
IERNTR

SEQ ID NO: 3055525 - protein, 9 aa, Giardia lamblia
IERPQSTRT

SEQ ID NO: 3055526 - protein, 6 aa, Giardia lamblia
IERRDK

SEQ ID NO: 3055527 - protein, 8 aa, Giardia lamblia
IERSADDT

SEQ ID NO: 3055528 - protein, 6 aa, Giardia lamblia
IERSSA

SEQ ID NO: 3055529 - protein, 8 aa, Giardia lamblia
IESAASRL

SEQ ID NO: 3055530 - protein, 8 aa, Giardia lamblia
IESAEQHE

SEQ ID NO: 3055531 - protein, 6 aa, Giardia lamblia
IESDQR

SEQ ID NO: 3055532 - protein, 7 aa, Giardia lamblia
IESNASA

SEQ ID NO: 3055533 - protein, 13 aa, Giardia lamblia
IESVPEQSAASAL

SEQ ID NO: 3055534 - protein, 5 aa, Giardia lamblia
IETGG

SEQ ID NO: 3055535 - protein, 13 aa, Giardia lamblia
IETSESSSFSDEV

SEQ ID NO: 3055536 - protein, 15 aa, Giardia lamblia
IGASSSTTALVRSKS

SEQ ID NO: 3055537 - protein, 6 aa, Giardia lamblia
IGDAKE

SEQ ID NO: 3055538 - protein, 7 aa, Giardia lamblia
IGDGQND

SEQ ID NO: 3055539 - protein, 9 aa, Giardia lamblia
IGDPEGANI

SEQ ID NO: 3055540 - protein, 10 aa, Giardia lamblia
IGDSATDTTD

SEQ ID NO: 3055541 - protein, 4 aa, Giardia lamblia
IGDT

SEQ ID NO: 3055542 - protein, 14 aa, Giardia lamblia
IGEDGSHNLTPGNA

SEQ ID NO: 3055543 - protein, 5 aa, Giardia lamblia
IGEER

SEQ ID NO: 3055544 - protein, 11 aa, Giardia lamblia
IGEETTDRHTR

SEQ ID NO: 3055545 - protein, 7 aa, Giardia lamblia
IGEPFSG

SEQ ID NO: 3055546 - protein, 7 aa, Giardia lamblia
IGEPPDC

SEQ ID NO: 3055547 - protein, 4 aa, Giardia lamblia
IGEQ

SEQ ID NO: 3055548 - protein, 14 aa, Giardia lamblia
IGESASASLQTSAH

SEQ ID NO: 3055549 - protein, 17 aa, Giardia lamblia
IGESKDDRSKSSSPVRF

SEQ ID NO: 3055550 - protein, 7 aa, Giardia lamblia
IGGDKDG

SEQ ID NO: 3055551 - protein, 4 aa, Giardia lamblia
IGGH

SEQ ID NO: 3055552 - protein, 18 aa, Giardia lamblia
IGGPQQDGSYTPSCARSA

SEQ ID NO: 3055553 - protein, 19 aa, Giardia lamblia
IGGPSTSKQEPHNKPKRMQ

SEQ ID NO: 3055554 - protein, 17 aa, Giardia lamblia
IGGSSGAAGSRAQQSLD

SEQ ID NO: 3055555 - protein, 4 aa, Giardia lamblia
IGGT

SEQ ID NO: 3055556 - protein, 6 aa, Giardia lamblia
IGIDGS

SEQ ID NO: 3055557 - protein, 28 aa, Giardia lamblia
IGKITTRYDKKPPSSGESNKRTLSNPTL

SEQ ID NO: 3055558 - protein, 7 aa, Giardia lamblia
IGKRTST

SEQ ID NO: 3055559 - protein, 6 aa, Giardia lamblia
IGMSEE

SEQ ID NO: 3055560 - protein, 13 aa, Giardia lamblia
IGNAGTGKTEISK

SEQ ID NO: 3055561 - protein, 4 aa, Giardia lamblia
IGNT

SEQ ID NO: 3055562 - protein, 9 aa, Giardia lamblia
IGNTAGNKY

SEQ ID NO: 3055563 - protein, 7 aa, Giardia lamblia
IGPDRTA

SEQ ID NO: 3055564 - protein, 9 aa, Giardia lamblia
IGSADAGKF

SEQ ID NO: 3055565 - protein, 10 aa, Giardia lamblia
IGSAEGSRMV

SEQ ID NO: 3055566 - protein, 6 aa, Giardia lamblia
IGSDNG

SEQ ID NO: 3055567 - protein, 7 aa, Giardia lamblia
IGSFSSK

SEQ ID NO: 3055568 - protein, 18 aa, Giardia lamblia
IGSGAGAASDEQKGIPGV

SEQ ID NO: 3055569 - protein, 6 aa, Giardia lamblia
IGSNTG

SEQ ID NO: 3055570 - protein, 13 aa, Giardia lamblia
IGSPKGDSTIGSL

SEQ ID NO: 3055571 - protein, 9 aa, Giardia lamblia
IGSPPLTSS

SEQ ID NO: 3055572 - protein, 8 aa, Giardia lamblia
IGSSPSLL

SEQ ID NO: 3055573 - protein, 4 aa, Giardia lamblia
IGST

SEQ ID NO: 3055574 - protein, 10 aa, Giardia lamblia
IGTAETRPLV

SEQ ID NO: 3055575 - protein, 10 aa, Giardia lamblia
IGTASSPEAV

SEQ ID NO: 3055576 - protein, 11 aa, Giardia lamblia
IGTDPTPGTMS

SEQ ID NO: 3055577 - protein, 14 aa, Giardia lamblia
IGTEQDGDAVNSLT

SEQ ID NO: 3055578 - protein, 9 aa, Giardia lamblia
IGTGSTSPI

SEQ ID NO: 3055579 - protein, 17 aa, Giardia lamblia
IGTNQTSGTITGKGTPT

SEQ ID NO: 3055580 - protein, 9 aa, Giardia lamblia
IGTRETNYA

SEQ ID NO: 3055581 - protein, 15 aa, Giardia lamblia
IGTSDTSQKRQGKRG

SEQ ID NO: 3055582 - protein, 21 aa, Giardia lamblia
IGTTDKAPDRPDDQPPQPGDA

SEQ ID NO: 3055583 - protein, 5 aa, Giardia lamblia
IGYPP

SEQ ID NO: 3055584 - protein, 5 aa, Giardia lamblia
IHAPE

SEQ ID NO: 3055585 - protein, 18 aa, Giardia lamblia
IHEGSTDGKESRESRRLQ

SEQ ID NO: 3055586 - protein, 16 aa, Giardia lamblia
IHNGPAAQDAVLPTTS

SEQ ID NO: 3055587 - protein, 29 aa, Giardia lamblia
IHSGPDASVVTSEYDRHQDMSPSNSLGSE

SEQ ID NO: 3055588 - protein, 6 aa, Giardia lamblia
IHSPTD

SEQ ID NO: 3055589 - protein, 4 aa, Giardia lamblia
IIPS

SEQ ID NO: 3055590 - protein, 14 aa, Giardia lamblia
IKDKSANSSVPSTL

SEQ ID NO: 3055591 - protein, 9 aa, Giardia lamblia
IKDPTDDNQ

SEQ ID NO: 3055592 - protein, 9 aa, Giardia lamblia
IKDSESAAA

SEQ ID NO: 3055593 - protein, 8 aa, Giardia lamblia
IKDSHSGI

SEQ ID NO: 3055594 - protein, 8 aa, Giardia lamblia
IKECTSSL

SEQ ID NO: 3055595 - protein, 11 aa, Giardia lamblia
IKENGNDRTCV

SEQ ID NO: 3055596 - protein, 14 aa, Giardia lamblia
IKENPVVTSKQTTL

SEQ ID NO: 3055597 - protein, 4 aa, Giardia lamblia
IKER

SEQ ID NO: 3055598 - protein, 16 aa, Giardia lamblia
IKERTESQPVDTDVTA

SEQ ID NO: 3055599 - protein, 6 aa, Giardia lamblia
IKGAEA

SEQ ID NO: 3055600 - protein, 6 aa, Giardia lamblia
IKGASS

SEQ ID NO: 3055601 - protein, 11 aa, Giardia lamblia
IKGPDRADEQI

SEQ ID NO: 3055602 - protein, 6 aa, Giardia lamblia
IKGSKV

SEQ ID NO: 3055603 - protein, 16 aa, Giardia lamblia
IKGTPSVQVGKATPHI

SEQ ID NO: 3055604 - protein, 21 aa, Giardia lamblia
IKHQTTPRLTATNKRLSNPRA

SEQ ID NO: 3055605 - protein, 6 aa, Giardia lamblia
IKIPQR

SEQ ID NO: 3055606 - protein, 8 aa, Giardia lamblia
IKKSKRIT

SEQ ID NO: 3055607 - protein, 19 aa, Giardia lamblia
IKKSPSATEIESAASSYQV

SEQ ID NO: 3055608 - protein, 19 aa, Giardia lamblia
IKNNGSNGPYGINSSCSSS

SEQ ID NO: 3055609 - protein, 5 aa, Giardia lamblia
IKPDP

SEQ ID NO: 3055610 - protein, 10 aa, Giardia lamblia
IKPDSDPEYI

SEQ ID NO: 3055611 - protein, 9 aa, Giardia lamblia
IKPTSQEKI

SEQ ID NO: 3055612 - protein, 7 aa, Giardia lamblia
IKPTSSI

SEQ ID NO: 3055613 - protein, 7 aa, Giardia lamblia
IKQKEDI

SEQ ID NO: 3055614 - protein, 16 aa, Giardia lamblia
IKQQAEIEKQNRLAET

SEQ ID NO: 3055615 - protein, 11 aa, Giardia lamblia
IKRANPSRFSP

SEQ ID NO: 3055616 - protein, 24 aa, Giardia lamblia
IKRGGGDKVSSTRRNRTPDSPELS

SEQ ID NO: 3055617 - protein, 7 aa, Giardia lamblia
IKRPERS

SEQ ID NO: 3055618 - protein, 8 aa, Giardia lamblia
IKRPINPK

SEQ ID NO: 3055619 - protein, 5 aa, Giardia lamblia
IKSEE

SEQ ID NO: 3055620 - protein, 19 aa, Giardia lamblia
IKSQTGPSSSSGKSSHLPT

SEQ ID NO: 3055621 - protein, 7 aa, Giardia lamblia
IKSSHRD

SEQ ID NO: 3055622 - protein, 7 aa, Giardia lamblia
IKSTNHN

SEQ ID NO: 3055623 - protein, 6 aa, Giardia lamblia
IKSTSD

SEQ ID NO: 3055624 - protein, 13 aa, Giardia lamblia
IKTEADEEKQEPC

SEQ ID NO: 3055625 - protein, 5 aa, Giardia lamblia
IKTGR

SEQ ID NO: 3055626 - protein, 5 aa, Giardia lamblia
IKYDT

SEQ ID NO: 3055627 - protein, 27 aa, Giardia lamblia
INCTTSRSAAPNPAVGRAASPASKPYD

SEQ ID NO: 3055628 - protein, 10 aa, Giardia lamblia
INDGSQCEEC

SEQ ID NO: 3055629 - protein, 5 aa, Giardia lamblia
INDQG

SEQ ID NO: 3055630 - protein, 9 aa, Giardia lamblia
INDTSSNAQ

SEQ ID NO: 3055631 - protein, 5 aa, Giardia lamblia
INEDT

SEQ ID NO: 3055632 - protein, 10 aa, Giardia lamblia
INEKLDEGAE

SEQ ID NO: 3055633 - protein, 4 aa, Giardia lamblia
INEQ

SEQ ID NO: 3055634 - protein, 6 aa, Giardia lamblia
INESQK

SEQ ID NO: 3055635 - protein, 9 aa, Giardia lamblia
INKEEERRY

SEQ ID NO: 3055636 - protein, 7 aa, Giardia lamblia
INKTGQT

SEQ ID NO: 3055637 - protein, 10 aa, Giardia lamblia
INNATQKDPV

SEQ ID NO: 3055638 - protein, 4 aa, Giardia lamblia
INNP

SEQ ID NO: 3055639 - protein, 34 aa, Giardia lamblia
INNRERSRSQIRTEQRANETRNRAATLAAPQKAE

SEQ ID NO: 3055640 - protein, 9 aa, Giardia lamblia
INPDDPATV

SEQ ID NO: 3055641 - protein, 6 aa, Giardia lamblia
INPEEA

SEQ ID NO: 3055642 - protein, 6 aa, Giardia lamblia
INPESP

SEQ ID NO: 3055643 - protein, 24 aa, Giardia lamblia
INPPKDPNEEAAAKGRPKSQPGGV

SEQ ID NO: 3055644 - protein, 7 aa, Giardia lamblia
INPRSSL

SEQ ID NO: 3055645 - protein, 7 aa, Giardia lamblia
INPSNAC

SEQ ID NO: 3055646 - protein, 10 aa, Giardia lamblia
INQSPSKKLQ

SEQ ID NO: 3055647 - protein, 6 aa, Giardia lamblia
INQSPY

SEQ ID NO: 3055648 - protein, 8 aa, Giardia lamblia
INQSRGGL

SEQ ID NO: 3055649 - protein, 7 aa, Giardia lamblia
INSGTRV

SEQ ID NO: 3055650 - protein, 14 aa, Giardia lamblia
INSKEAEEEPTKCG

SEQ ID NO: 3055651 - protein, 4 aa, Giardia lamblia
INSQ

SEQ ID NO: 3055652 - protein, 10 aa, Giardia lamblia
INSQPRDRRL

SEQ ID NO: 3055653 - protein, 9 aa, Giardia lamblia
INSTEPSTQ

SEQ ID NO: 3055654 - protein, 10 aa, Giardia lamblia
INSTPGMQTT

SEQ ID NO: 3055655 - protein, 10 aa, Giardia lamblia
INSVDGSNAI

SEQ ID NO: 3055656 - protein, 16 aa, Giardia lamblia
INTDDSSDSETSPADV

SEQ ID NO: 3055657 - protein, 19 aa, Giardia lamblia
INTEVGERGTSLSGGQKAR

SEQ ID NO: 3055658 - protein, 10 aa, Giardia lamblia
INTGEKRQET

SEQ ID NO: 3055659 - protein, 11 aa, Giardia lamblia
INTPSFSDSSQ

SEQ ID NO: 3055660 - protein, 12 aa, Giardia lamblia
INTQKDDDKDYK

SEQ ID NO: 3055661 - protein, 25 aa, Giardia lamblia
INTSGKLSGEEEPPQQKSSADSDRD

SEQ ID NO: 3055662 - protein, 8 aa, Giardia lamblia
INTTTTPF

SEQ ID NO: 3055663 - protein, 11 aa, Giardia lamblia
INYKADDNEIY

SEQ ID NO: 3055664 - protein, 9 aa, Giardia lamblia
IPAGPKRNI

SEQ ID NO: 3055665 - protein, 5 aa, Giardia lamblia
IPAGS

SEQ ID NO: 3055666 - protein, 21 aa, Giardia lamblia
IPATARDASGCKASGGKCTEC

SEQ ID NO: 3055667 - protein, 10 aa, Giardia lamblia
IPATLNPKSY

SEQ ID NO: 3055668 - protein, 6 aa, Giardia lamblia
IPCDPS

SEQ ID NO: 3055669 - protein, 9 aa, Giardia lamblia
IPDDGSTGG

SEQ ID NO: 3055670 - protein, 9 aa, Giardia lamblia
IPDESNNSI

SEQ ID NO: 3055671 - protein, 5 aa, Giardia lamblia
IPDPL

SEQ ID NO: 3055672 - protein, 11 aa, Giardia lamblia
IPDPRGPDYPP

SEQ ID NO: 3055673 - protein, 4 aa, Giardia lamblia
IPDT

SEQ ID NO: 3055674 - protein, 5 aa, Giardia lamblia
IPDYS

SEQ ID NO: 3055675 - protein, 5 aa, Giardia lamblia
IPECN

SEQ ID NO: 3055676 - protein, 18 aa, Giardia lamblia
IPEEPTSQADPRGVTQDA

SEQ ID NO: 3055677 - protein, 8 aa, Giardia lamblia
IPESSNYR

SEQ ID NO: 3055678 - protein, 5 aa, Giardia lamblia
IPGIT

SEQ ID NO: 3055679 - protein, 17 aa, Giardia lamblia
IPGLGGRNSRQAAPRSH

SEQ ID NO: 3055680 - protein, 14 aa, Giardia lamblia
IPGNAAAPFDKSLD

SEQ ID NO: 3055681 - protein, 11 aa, Giardia lamblia
IPKDAAPPSYP

SEQ ID NO: 3055682 - protein, 16 aa, Giardia lamblia
IPKPSILGPSGTPASQ

SEQ ID NO: 3055683 - protein, 11 aa, Giardia lamblia
IPKRTGKSLSE

SEQ ID NO: 3055684 - protein, 14 aa, Giardia lamblia
IPKSKNANSTTHRA

SEQ ID NO: 3055685 - protein, 10 aa, Giardia lamblia
IPKTTRPRSP

SEQ ID NO: 3055686 - protein, 9 aa, Giardia lamblia
IPLGQEPQM

SEQ ID NO: 3055687 - protein, 10 aa, Giardia lamblia
IPNPTETQQT

SEQ ID NO: 3055688 - protein, 6 aa, Giardia lamblia
IPNTSF

SEQ ID NO: 3055689 - protein, 12 aa, Giardia lamblia
IPPATSAATQLS

SEQ ID NO: 3055690 - protein, 14 aa, Giardia lamblia
IPPDSPLSDQASNR

SEQ ID NO: 3055691 - protein, 8 aa, Giardia lamblia
IPPGPQYN

SEQ ID NO: 3055692 - protein, 7 aa, Giardia lamblia
IPPNGES

SEQ ID NO: 3055693 - protein, 14 aa, Giardia lamblia
IPPNTLPRGPYANA

SEQ ID NO: 3055694 - protein, 6 aa, Giardia lamblia
IPPPED

SEQ ID NO: 3055695 - protein, 9 aa, Giardia lamblia
IPPPETQRH

SEQ ID NO: 3055696 - protein, 16 aa, Giardia lamblia
IPPPPNTNLPRRVRTQ

SEQ ID NO: 3055697 - protein, 6 aa, Giardia lamblia
IPPQSL

SEQ ID NO: 3055698 - protein, 7 aa, Giardia lamblia
IPPSDST

SEQ ID NO: 3055699 - protein, 6 aa, Giardia lamblia
IPPTTK

SEQ ID NO: 3055700 - protein, 19 aa, Giardia lamblia
IPQGGESKGEPKTEPKKGC

SEQ ID NO: 3055701 - protein, 19 aa, Giardia lamblia
IPQPEHKDESVRGRPPVTR

SEQ ID NO: 3055702 - protein, 4 aa, Giardia lamblia
IPQS

SEQ ID NO: 3055703 - protein, 8 aa, Giardia lamblia
IPREQTTL

SEQ ID NO: 3055704 - protein, 6 aa, Giardia lamblia
IPRPQE

SEQ ID NO: 3055705 - protein, 4 aa, Giardia lamblia
IPRS

SEQ ID NO: 3055706 - protein, 4 aa, Giardia lamblia
IPRT

SEQ ID NO: 3055707 - protein, 11 aa, Giardia lamblia
IPSAAPRQEHV

SEQ ID NO: 3055708 - protein, 9 aa, Giardia lamblia
IPSEDSIST

SEQ ID NO: 3055709 - protein, 17 aa, Giardia lamblia
IPSERSLKDSSVDAVGG

SEQ ID NO: 3055710 - protein, 35 aa, Giardia lamblia
IPSETDLAGETNEASPKSAVDDKHSIKQANTDHPL

SEQ ID NO: 3055711 - protein, 5 aa, Giardia lamblia
IPSGD

SEQ ID NO: 3055712 - protein, 4 aa, Giardia lamblia
IPSN

SEQ ID NO: 3055713 - protein, 11 aa, Giardia lamblia
IPSRSQAGVET

SEQ ID NO: 3055714 - protein, 6 aa, Giardia lamblia
IPSTVS

SEQ ID NO: 3055715 - protein, 4 aa, Giardia lamblia
IPTC

SEQ ID NO: 3055716 - protein, 4 aa, Giardia lamblia
IPTE

SEQ ID NO: 3055717 - protein, 6 aa, Giardia lamblia
IPTENS

SEQ ID NO: 3055718 - protein, 6 aa, Giardia lamblia
IPTGSI

SEQ ID NO: 3055719 - protein, 11 aa, Giardia lamblia
IPTSSGPKIVS

SEQ ID NO: 3055720 - protein, 11 aa, Giardia lamblia
IPTTDSSAGVS

SEQ ID NO: 3055721 - protein, 7 aa, Giardia lamblia
IPTTTDN

SEQ ID NO: 3055722 - protein, 6 aa, Giardia lamblia
IPYSTT

SEQ ID NO: 3055723 - protein, 11 aa, Giardia lamblia
IQADDSSTPYV

SEQ ID NO: 3055724 - protein, 8 aa, Giardia lamblia
IQAPSDNM

SEQ ID NO: 3055725 - protein, 4 aa, Giardia lamblia
IQDA

SEQ ID NO: 3055726 - protein, 8 aa, Giardia lamblia
IQDADGTT

SEQ ID NO: 3055727 - protein, 12 aa, Giardia lamblia
IQDESAPLPPGQ

SEQ ID NO: 3055728 - protein, 6 aa, Giardia lamblia
IQDTTA

SEQ ID NO: 3055729 - protein, 7 aa, Giardia lamblia
IQESNEQ

SEQ ID NO: 3055730 - protein, 11 aa, Giardia lamblia
IQESNRRLEEN

SEQ ID NO: 3055731 - protein, 22 aa, Giardia lamblia
IQGDGPVTEPGVRSQKDKKQGA

SEQ ID NO: 3055732 - protein, 10 aa, Giardia lamblia
IQGMQSNNPL

SEQ ID NO: 3055733 - protein, 11 aa, Giardia lamblia
IQPAPELEEPG

SEQ ID NO: 3055734 - protein, 6 aa, Giardia lamblia
IQPDRR

SEQ ID NO: 3055735 - protein, 8 aa, Giardia lamblia
IQPPFKPK

SEQ ID NO: 3055736 - protein, 10 aa, Giardia lamblia
IQPQQGLDSS

SEQ ID NO: 3055737 - protein, 6 aa, Giardia lamblia
IQPTGL

SEQ ID NO: 3055738 - protein, 8 aa, Giardia lamblia
IQQPAEAD

SEQ ID NO: 3055739 - protein, 6 aa, Giardia lamblia
IQSGNK

SEQ ID NO: 3055740 - protein, 60 aa, Giardia lamblia
IQSPSRSGRASSRSRSRSSSRSTSRSHYGKGYRPEVKPRTNSASSVARSDSARTSQLKPE

SEQ ID NO: 3055741 - protein, 14 aa, Giardia lamblia
IQSSLQTSTYRSPS

SEQ ID NO: 3055742 - protein, 12 aa, Giardia lamblia
IQSSVSKAQEAA

SEQ ID NO: 3055743 - protein, 21 aa, Giardia lamblia
IQTDSETSDSSESISDEDYPV

SEQ ID NO: 3055744 - protein, 7 aa, Giardia lamblia
IQTGSER

SEQ ID NO: 3055745 - protein, 8 aa, Giardia lamblia
IQTPRDIP

SEQ ID NO: 3055746 - protein, 10 aa, Giardia lamblia
IQTRDNPSSG

SEQ ID NO: 3055747 - protein, 10 aa, Giardia lamblia
IQTSTSKSIN

SEQ ID NO: 3055748 - protein, 9 aa, Giardia lamblia
IRATPNSSA

SEQ ID NO: 3055749 - protein, 10 aa, Giardia lamblia
IRDTPPFPPI

SEQ ID NO: 3055750 - protein, 6 aa, Giardia lamblia
IRERTR

SEQ ID NO: 3055751 - protein, 14 aa, Giardia lamblia
IRESPEESVASRYG

SEQ ID NO: 3055752 - protein, 5 aa, Giardia lamblia
IREST

SEQ ID NO: 3055753 - protein, 15 aa, Giardia lamblia
IRKETATLAGDEGPS

SEQ ID NO: 3055754 - protein, 10 aa, Giardia lamblia
IRKGPGRRRL

SEQ ID NO: 3055755 - protein, 4 aa, Giardia lamblia
IRKR

SEQ ID NO: 3055756 - protein, 18 aa, Giardia lamblia
IRNASETSAKEGTQGNAV

SEQ ID NO: 3055757 - protein, 6 aa, Giardia lamblia
IRNNNS

SEQ ID NO: 3055758 - protein, 17 aa, Giardia lamblia
IRNQETKDQGDTNPRTV

SEQ ID NO: 3055759 - protein, 9 aa, Giardia lamblia
IRPGDTVEQ

SEQ ID NO: 3055760 - protein, 4 aa, Giardia lamblia
IRPP

SEQ ID NO: 3055761 - protein, 7 aa, Giardia lamblia
IRPPAPE

SEQ ID NO: 3055762 - protein, 4 aa, Giardia lamblia
IRQG

SEQ ID NO: 3055763 - protein, 10 aa, Giardia lamblia
IRQQDENAQR

SEQ ID NO: 3055764 - protein, 24 aa, Giardia lamblia
IRQSTDGISGSAIKSKGRYRKPNN

SEQ ID NO: 3055765 - protein, 6 aa, Giardia lamblia
IRRSSG

SEQ ID NO: 3055766 - protein, 6 aa, Giardia lamblia
IRSASG

SEQ ID NO: 3055767 - protein, 17 aa, Giardia lamblia
IRSEGAAGGNPESVDHE

SEQ ID NO: 3055768 - protein, 6 aa, Giardia lamblia
IRSGDE

SEQ ID NO: 3055769 - protein, 13 aa, Giardia lamblia
IRSGRLSKTATSE

SEQ ID NO: 3055770 - protein, 28 aa, Giardia lamblia
IRSTGSILSSSTKLEGNVTGDTHDSSES

SEQ ID NO: 3055771 - protein, 7 aa, Giardia lamblia
IRTAEGR

SEQ ID NO: 3055772 - protein, 5 aa, Giardia lamblia
IRTAG

SEQ ID NO: 3055773 - protein, 6 aa, Giardia lamblia
IRTKEK

SEQ ID NO: 3055774 - protein, 4 aa, Giardia lamblia
IRTP

SEQ ID NO: 3055775 - protein, 4 aa, Giardia lamblia
IRTR

SEQ ID NO: 3055776 - protein, 18 aa, Giardia lamblia
IRTSGACAEDKEACPDTY

SEQ ID NO: 3055777 - protein, 9 aa, Giardia lamblia
ISAASRRRQ

SEQ ID NO: 3055778 - protein, 10 aa, Giardia lamblia
ISADSRNSYL

SEQ ID NO: 3055779 - protein, 7 aa, Giardia lamblia
ISAGKNP

SEQ ID NO: 3055780 - protein, 6 aa, Giardia lamblia
ISAGTA

SEQ ID NO: 3055781 - protein, 10 aa, Giardia lamblia
ISARTKAEPR

SEQ ID NO: 3055782 - protein, 9 aa, Giardia lamblia
ISDASGDSR

SEQ ID NO: 3055783 - protein, 7 aa, Giardia lamblia
ISDATEE

SEQ ID NO: 3055784 - protein, 12 aa, Giardia lamblia
ISDDDDAEENGT

SEQ ID NO: 3055785 - protein, 7 aa, Giardia lamblia
ISDPLER

SEQ ID NO: 3055786 - protein, 32 aa, Giardia lamblia
ISDQYDPIPEPDDISEEEEEIEEDEVEEEPPI

SEQ ID NO: 3055787 - protein, 5 aa, Giardia lamblia
ISDRI

SEQ ID NO: 3055788 - protein, 6 aa, Giardia lamblia
ISDTEW

SEQ ID NO: 3055789 - protein, 7 aa, Giardia lamblia
ISEASYD

SEQ ID NO: 3055790 - protein, 5 aa, Giardia lamblia
ISEDN

SEQ ID NO: 3055791 - protein, 5 aa, Giardia lamblia
ISEES

SEQ ID NO: 3055792 - protein, 7 aa, Giardia lamblia
ISEGEEA

SEQ ID NO: 3055793 - protein, 11 aa, Giardia lamblia
ISEKTTPDPVP

SEQ ID NO: 3055794 - protein, 7 aa, Giardia lamblia
ISELNGE

SEQ ID NO: 3055795 - protein, 4 aa, Giardia lamblia
ISEN

SEQ ID NO: 3055796 - protein, 6 aa, Giardia lamblia
ISGGES

SEQ ID NO: 3055797 - protein, 10 aa, Giardia lamblia
ISGIKTNSEV

SEQ ID NO: 3055798 - protein, 6 aa, Giardia lamblia
ISGNAP

SEQ ID NO: 3055799 - protein, 6 aa, Giardia lamblia
ISGPAN

SEQ ID NO: 3055800 - protein, 8 aa, Giardia lamblia
ISGPGSKI

SEQ ID NO: 3055801 - protein, 11 aa, Giardia lamblia
ISGQTGSSGVF

SEQ ID NO: 3055802 - protein, 10 aa, Giardia lamblia
ISGRSLSECD

SEQ ID NO: 3055803 - protein, 8 aa, Giardia lamblia
ISGSSNAL

SEQ ID NO: 3055804 - protein, 7 aa, Giardia lamblia
ISHDNNE

SEQ ID NO: 3055805 - protein, 4 aa, Giardia lamblia
ISHG

SEQ ID NO: 3055806 - protein, 11 aa, Giardia lamblia
ISHRSRSSTKF

SEQ ID NO: 3055807 - protein, 9 aa, Giardia lamblia
ISHTSPSTL

SEQ ID NO: 3055808 - protein, 7 aa, Giardia lamblia
ISINSQE

SEQ ID NO: 3055809 - protein, 20 aa, Giardia lamblia
ISIPGKAYSELRDNQSESSL

SEQ ID NO: 3055810 - protein, 18 aa, Giardia lamblia
ISKDNRRYVTGGDTEGLS

SEQ ID NO: 3055811 - protein, 7 aa, Giardia lamblia
ISKDTNE

SEQ ID NO: 3055812 - protein, 8 aa, Giardia lamblia
ISKQDDTT

SEQ ID NO: 3055813 - protein, 10 aa, Giardia lamblia
ISLSSKEVST

SEQ ID NO: 3055814 - protein, 9 aa, Giardia lamblia
ISLSTTGRN

SEQ ID NO: 3055815 - protein, 9 aa, Giardia lamblia
ISNAGPMSL

SEQ ID NO: 3055816 - protein, 8 aa, Giardia lamblia
ISNESSDI

SEQ ID NO: 3055817 - protein, 7 aa, Giardia lamblia
ISNGDTP

SEQ ID NO: 3055818 - protein, 9 aa, Giardia lamblia
ISNGKEETE

SEQ ID NO: 3055819 - protein, 8 aa, Giardia lamblia
ISPAASSS

SEQ ID NO: 3055820 - protein, 11 aa, Giardia lamblia
ISPDGTEFKRN

SEQ ID NO: 3055821 - protein, 12 aa, Giardia lamblia
ISPEAAKNAQDL

SEQ ID NO: 3055822 - protein, 15 aa, Giardia lamblia
ISPEIGAGAEKDISS

SEQ ID NO: 3055823 - protein, 6 aa, Giardia lamblia
ISPETY

SEQ ID NO: 3055824 - protein, 8 aa, Giardia lamblia
ISPGAEPK

SEQ ID NO: 3055825 - protein, 12 aa, Giardia lamblia
ISPGSSKSQRMV

SEQ ID NO: 3055826 - protein, 6 aa, Giardia lamblia
ISPGTH

SEQ ID NO: 3055827 - protein, 5 aa, Giardia lamblia
ISPNG

SEQ ID NO: 3055828 - protein, 6 aa, Giardia lamblia
ISPNKS

SEQ ID NO: 3055829 - protein, 6 aa, Giardia lamblia
ISPNPI

SEQ ID NO: 3055830 - protein, 18 aa, Giardia lamblia
ISPRAAAEKMGMNELLPL

SEQ ID NO: 3055831 - protein, 14 aa, Giardia lamblia
ISPRPGNNESCGSA

SEQ ID NO: 3055832 - protein, 6 aa, Giardia lamblia
ISPSGR

SEQ ID NO: 3055833 - protein, 9 aa, Giardia lamblia
ISPTQPEAY

SEQ ID NO: 3055834 - protein, 7 aa, Giardia lamblia
ISQKPGS

SEQ ID NO: 3055835 - protein, 8 aa, Giardia lamblia
ISRASNTS

SEQ ID NO: 3055836 - protein, 5 aa, Giardia lamblia
ISRDE

SEQ ID NO: 3055837 - protein, 7 aa, Giardia lamblia
ISRDSDI

SEQ ID NO: 3055838 - protein, 7 aa, Giardia lamblia
ISREDYK

SEQ ID NO: 3055839 - protein, 11 aa, Giardia lamblia
ISRGSSYSAHT

SEQ ID NO: 3055840 - protein, 8 aa, Giardia lamblia
ISRGYSPD

SEQ ID NO: 3055841 - protein, 9 aa, Giardia lamblia
ISRKEQRSR

SEQ ID NO: 3055842 - protein, 6 aa, Giardia lamblia
ISRPNT

SEQ ID NO: 3055843 - protein, 5 aa, Giardia lamblia
ISRSS

SEQ ID NO: 3055844 - protein, 8 aa, Giardia lamblia
ISRTKRKY

SEQ ID NO: 3055845 - protein, 4 aa, Giardia lamblia
ISSA

SEQ ID NO: 3055846 - protein, 5 aa, Giardia lamblia
ISSAE

SEQ ID NO: 3055847 - protein, 21 aa, Giardia lamblia
ISSDEEESKKRLASYPPVSHD

SEQ ID NO: 3055848 - protein, 11 aa, Giardia lamblia
ISSEPSPIPKQ

SEQ ID NO: 3055849 - protein, 16 aa, Giardia lamblia
ISSESTASHVSATSKT

SEQ ID NO: 3055850 - protein, 11 aa, Giardia lamblia
ISSGSKEEKYA

SEQ ID NO: 3055851 - protein, 32 aa, Giardia lamblia
ISSKASRDSPVDQAGRDMATRSSITTTPRTGF

SEQ ID NO: 3055852 - protein, 7 aa, Giardia lamblia
ISSKESS

SEQ ID NO: 3055853 - protein, 11 aa, Giardia lamblia
ISSKTKLDSRQ

SEQ ID NO: 3055854 - protein, 5 aa, Giardia lamblia
ISSNH

SEQ ID NO: 3055855 - protein, 10 aa, Giardia lamblia
ISSNTTPNTA

SEQ ID NO: 3055856 - protein, 10 aa, Giardia lamblia
ISSPGARHGT

SEQ ID NO: 3055857 - protein, 15 aa, Giardia lamblia
ISSPSSVTPSTIGTV

SEQ ID NO: 3055858 - protein, 7 aa, Giardia lamblia
ISSPTGY

SEQ ID NO: 3055859 - protein, 18 aa, Giardia lamblia
ISSQSAISTNKTTSVSTC

SEQ ID NO: 3055860 - protein, 10 aa, Giardia lamblia
ISSSDSENAT

SEQ ID NO: 3055861 - protein, 7 aa, Giardia lamblia
ISSSEGR

SEQ ID NO: 3055862 - protein, 14 aa, Giardia lamblia
ISSSFGSATSAQSD

SEQ ID NO: 3055863 - protein, 11 aa, Giardia lamblia
ISSSPNSQYDS

SEQ ID NO: 3055864 - protein, 18 aa, Giardia lamblia
ISSSSSGTSSSSSSTTIT

SEQ ID NO: 3055865 - protein, 6 aa, Giardia lamblia
ISSSTI

SEQ ID NO: 3055866 - protein, 5 aa, Giardia lamblia
ISSVE

SEQ ID NO: 3055867 - protein, 9 aa, Giardia lamblia
ISSVQGQTA

SEQ ID NO: 3055868 - protein, 4 aa, Giardia lamblia
ISSY

SEQ ID NO: 3055869 - protein, 6 aa, Giardia lamblia
ISTDSL

SEQ ID NO: 3055870 - protein, 21 aa, Giardia lamblia
ISTGEKEAEALGGSVTQAPQD

SEQ ID NO: 3055871 - protein, 6 aa, Giardia lamblia
ISTKDI

SEQ ID NO: 3055872 - protein, 5 aa, Giardia lamblia
ISTPD

SEQ ID NO: 3055873 - protein, 8 aa, Giardia lamblia
ISTPDLSA

SEQ ID NO: 3055874 - protein, 11 aa, Giardia lamblia
ISTSESTDVSY

SEQ ID NO: 3055875 - protein, 13 aa, Giardia lamblia
ISTSGIDLGTQDY

SEQ ID NO: 3055876 - protein, 24 aa, Giardia lamblia
ISTSPTNVSLTEEQNVGKEKGDDG

SEQ ID NO: 3055877 - protein, 10 aa, Giardia lamblia
ISTSPTSSPL

SEQ ID NO: 3055878 - protein, 5 aa, Giardia lamblia
ISTSS

SEQ ID NO: 3055879 - protein, 9 aa, Giardia lamblia
ISTVGGAAG

SEQ ID NO: 3055880 - protein, 14 aa, Giardia lamblia
ISYSPNNPQTYYER

SEQ ID NO: 3055881 - protein, 10 aa, Giardia lamblia
ITAATSKEIH

SEQ ID NO: 3055882 - protein, 5 aa, Giardia lamblia
ITADG

SEQ ID NO: 3055883 - protein, 12 aa, Giardia lamblia
ITANGDNLSAGQ

SEQ ID NO: 3055884 - protein, 6 aa, Giardia lamblia
ITAPRG

SEQ ID NO: 3055885 - protein, 13 aa, Giardia lamblia
ITAPTSKNQRSPI

SEQ ID NO: 3055886 - protein, 7 aa, Giardia lamblia
ITATTLD

SEQ ID NO: 3055887 - protein, 7 aa, Giardia lamblia
ITDEASA

SEQ ID NO: 3055888 - protein, 7 aa, Giardia lamblia
ITDETDL

SEQ ID NO: 3055889 - protein, 10 aa, Giardia lamblia
ITDGEHGSAS

SEQ ID NO: 3055890 - protein, 9 aa, Giardia lamblia
ITDGSQDAY

SEQ ID NO: 3055891 - protein, 4 aa, Giardia lamblia
ITDN

SEQ ID NO: 3055892 - protein, 5 aa, Giardia lamblia
ITDPK

SEQ ID NO: 3055893 - protein, 8 aa, Giardia lamblia
ITDSDGKS

SEQ ID NO: 3055894 - protein, 6 aa, Giardia lamblia
ITDSEA

SEQ ID NO: 3055895 - protein, 5 aa, Giardia lamblia
ITDTN

SEQ ID NO: 3055896 - protein, 6 aa, Giardia lamblia
ITEEEA

SEQ ID NO: 3055897 - protein, 7 aa, Giardia lamblia
ITEEGDG

SEQ ID NO: 3055898 - protein, 5 aa, Giardia lamblia
ITESV

SEQ ID NO: 3055899 - protein, 11 aa, Giardia lamblia
ITGDSSGASIT

SEQ ID NO: 3055900 - protein, 4 aa, Giardia lamblia
ITGR

SEQ ID NO: 3055901 - protein, 9 aa, Giardia lamblia
ITGRRTCED

SEQ ID NO: 3055902 - protein, 8 aa, Giardia lamblia
ITGSKAGS

SEQ ID NO: 3055903 - protein, 11 aa, Giardia lamblia
ITGSNDGYRSK

SEQ ID NO: 3055904 - protein, 4 aa, Giardia lamblia
ITKG

SEQ ID NO: 3055905 - protein, 12 aa, Giardia lamblia
ITLPPAKAPSII

SEQ ID NO: 3055906 - protein, 5 aa, Giardia lamblia
ITNDD

SEQ ID NO: 3055907 - protein, 7 aa, Giardia lamblia
ITPDIDR

SEQ ID NO: 3055908 - protein, 5 aa, Giardia lamblia
ITPDL

SEQ ID NO: 3055909 - protein, 6 aa, Giardia lamblia
ITPDQI

SEQ ID NO: 3055910 - protein, 5 aa, Giardia lamblia
ITPSN

SEQ ID NO: 3055911 - protein, 6 aa, Giardia lamblia
ITPSSI

SEQ ID NO: 3055912 - protein, 11 aa, Giardia lamblia
ITPSTTKHEAT

SEQ ID NO: 3055913 - protein, 8 aa, Giardia lamblia
ITQPDKKN

SEQ ID NO: 3055914 - protein, 12 aa, Giardia lamblia
ITQQSQDVSNRI

SEQ ID NO: 3055915 - protein, 6 aa, Giardia lamblia
ITQRDD

SEQ ID NO: 3055916 - protein, 13 aa, Giardia lamblia
ITRPDSRASDASL

SEQ ID NO: 3055917 - protein, 7 aa, Giardia lamblia
ITSADTQ

SEQ ID NO: 3055918 - protein, 10 aa, Giardia lamblia
ITSATDRSQM

SEQ ID NO: 3055919 - protein, 9 aa, Giardia lamblia
ITSDPTRAM

SEQ ID NO: 3055920 - protein, 8 aa, Giardia lamblia
ITSGSAEG

SEQ ID NO: 3055921 - protein, 4 aa, Giardia lamblia
ITSH

SEQ ID NO: 3055922 - protein, 4 aa, Giardia lamblia
ITSI

SEQ ID NO: 3055923 - protein, 9 aa, Giardia lamblia
ITSSSPSLS

SEQ ID NO: 3055924 - protein, 12 aa, Giardia lamblia
ITSSSTDTDISS

SEQ ID NO: 3055925 - protein, 4 aa, Giardia lamblia
ITST

SEQ ID NO: 3055926 - protein, 7 aa, Giardia lamblia
ITSVPKS

SEQ ID NO: 3055927 - protein, 12 aa, Giardia lamblia
ITTADKKGSPSF

SEQ ID NO: 3055928 - protein, 8 aa, Giardia lamblia
ITTEADRA

SEQ ID NO: 3055929 - protein, 16 aa, Giardia lamblia
ITTGKEVSNFQLSVQK

SEQ ID NO: 3055930 - protein, 4 aa, Giardia lamblia
ITTS

SEQ ID NO: 3055931 - protein, 22 aa, Giardia lamblia
ITTSATQEHAAAEEGTSARDAS

SEQ ID NO: 3055932 - protein, 11 aa, Giardia lamblia
ITTSEYSTQAN

SEQ ID NO: 3055933 - protein, 12 aa, Giardia lamblia
IVDPAQKNFGDK

SEQ ID NO: 3055934 - protein, 9 aa, Giardia lamblia
IVNPPSDIK

SEQ ID NO: 3055935 - protein, 10 aa, Giardia lamblia
IVQSTDDIAG

SEQ ID NO: 3055936 - protein, 5 aa, Giardia lamblia
IVSSG

SEQ ID NO: 3055937 - protein, 10 aa, Giardia lamblia
IVSTSGKTAL

SEQ ID NO: 3055938 - protein, 5 aa, Giardia lamblia
IYEGS

SEQ ID NO: 3055939 - protein, 10 aa, Giardia lamblia
IYSENNKTYT

SEQ ID NO: 3055940 - protein, 4 aa, Giardia lamblia
IYTP

SEQ ID NO: 3055941 - protein, 10 aa, Giardia lamblia
KAADDDVEAG

SEQ ID NO: 3055942 - protein, 7 aa, Giardia lamblia
KAADQLY

SEQ ID NO: 3055943 - protein, 4 aa, Giardia lamblia
KAAE

SEQ ID NO: 3055944 - protein, 12 aa, Giardia lamblia
KAAEGACTEAAP

SEQ ID NO: 3055945 - protein, 18 aa, Giardia lamblia
KAAEPGTRREPRKGAAVE

SEQ ID NO: 3055946 - protein, 11 aa, Giardia lamblia
KAAGSKSNPFA

SEQ ID NO: 3055947 - protein, 4 aa, Giardia lamblia
KAAK

SEQ ID NO: 3055948 - protein, 8 aa, Giardia lamblia
KAAKKGLA

SEQ ID NO: 3055949 - protein, 17 aa, Giardia lamblia
KAAKKMGKTNTTAYREN

SEQ ID NO: 3055950 - protein, 16 aa, Giardia lamblia
KAAPSALAAAKGSEMA

SEQ ID NO: 3055951 - protein, 7 aa, Giardia lamblia
KAAPSKA

SEQ ID NO: 3055952 - protein, 9 aa, Giardia lamblia
KAASARAGP

SEQ ID NO: 3055953 - protein, 21 aa, Giardia lamblia
KAATLGGASGKTAATSASLGA

SEQ ID NO: 3055954 - protein, 4 aa, Giardia lamblia
KACS

SEQ ID NO: 3055955 - protein, 18 aa, Giardia lamblia
KADGTEAELKSSTHGDPR

SEQ ID NO: 3055956 - protein, 5 aa, Giardia lamblia
KADKA

SEQ ID NO: 3055957 - protein, 19 aa, Giardia lamblia
KADKDKPYTERQKTKASTY

SEQ ID NO: 3055958 - protein, 5 aa, Giardia lamblia
KADKI

SEQ ID NO: 3055959 - protein, 8 aa, Giardia lamblia
KADQAPGN

SEQ ID NO: 3055960 - protein, 8 aa, Giardia lamblia
KADQREPL

SEQ ID NO: 3055961 - protein, 9 aa, Giardia lamblia
KADRSTTPV

SEQ ID NO: 3055962 - protein, 7 aa, Giardia lamblia
KADRTGI

SEQ ID NO: 3055963 - protein, 24 aa, Giardia lamblia
KADSEKDQCSPSSKAALDPHTERN

SEQ ID NO: 3055964 - protein, 17 aa, Giardia lamblia
KADSKINRLEKQRKTLE

SEQ ID NO: 3055965 - protein, 14 aa, Giardia lamblia
KADSKTASIRQESQ

SEQ ID NO: 3055966 - protein, 12 aa, Giardia lamblia
KADSSGICTEAA

SEQ ID NO: 3055967 - protein, 7 aa, Giardia lamblia
KAEADRE

SEQ ID NO: 3055968 - protein, 17 aa, Giardia lamblia
KAEDPYTDLTNEHRSSI

SEQ ID NO: 3055969 - protein, 7 aa, Giardia lamblia
KAEGGDR

SEQ ID NO: 3055970 - protein, 6 aa, Giardia lamblia
KAEGTW

SEQ ID NO: 3055971 - protein, 12 aa, Giardia lamblia
KAELGKQAAKEV

SEQ ID NO: 3055972 - protein, 9 aa, Giardia lamblia
KAENTLKKS

SEQ ID NO: 3055973 - protein, 8 aa, Giardia lamblia
KAEPAIEA

SEQ ID NO: 3055974 - protein, 5 aa, Giardia lamblia
KAEPF

SEQ ID NO: 3055975 - protein, 18 aa, Giardia lamblia
KAEPQVQATTKKGRGRLG

SEQ ID NO: 3055976 - protein, 10 aa, Giardia lamblia
KAESSQSRAH

SEQ ID NO: 3055977 - protein, 4 aa, Giardia lamblia
KAEY

SEQ ID NO: 3055978 - protein, 9 aa, Giardia lamblia
KAEYGEHIS

SEQ ID NO: 3055979 - protein, 4 aa, Giardia lamblia
KAFN

SEQ ID NO: 3055980 - protein, 9 aa, Giardia lamblia
KAGADSPKS

SEQ ID NO: 3055981 - protein, 8 aa, Giardia lamblia
KAGASPAD

SEQ ID NO: 3055982 - protein, 7 aa, Giardia lamblia
KAGDPNA

SEQ ID NO: 3055983 - protein, 18 aa, Giardia lamblia
KAGGSQAGKKGAGEELET

SEQ ID NO: 3055984 - protein, 7 aa, Giardia lamblia
KAGLATG

SEQ ID NO: 3055985 - protein, 5 aa, Giardia lamblia
KAGQD

SEQ ID NO: 3055986 - protein, 16 aa, Giardia lamblia
KAGSTAPSIPKASSSS

SEQ ID NO: 3055987 - protein, 6 aa, Giardia lamblia
KAGTAE

SEQ ID NO: 3055988 - protein, 32 aa, Giardia lamblia
KAGVQTESQGTIHQSDDSDSEGSADKKEDITV

SEQ ID NO: 3055989 - protein, 10 aa, Giardia lamblia
KAGYKSSKLS

SEQ ID NO: 3055990 - protein, 5 aa, Giardia lamblia
KAGYN

SEQ ID NO: 3055991 - protein, 7 aa, Giardia lamblia
KAHGERA

SEQ ID NO: 3055992 - protein, 13 aa, Giardia lamblia
KAHSAGTGSSTCT

SEQ ID NO: 3055993 - protein, 26 aa, Giardia lamblia
KAHSNGHSTSKVEGEGLTSSTKDTTE

SEQ ID NO: 3055994 - protein, 6 aa, Giardia lamblia
KAIDQQ

SEQ ID NO: 3055995 - protein, 6 aa, Giardia lamblia
KAISNS

SEQ ID NO: 3055996 - protein, 29 aa, Giardia lamblia
KAKAGSTTEEDQGSSDRQDANSDAAQESL

SEQ ID NO: 3055997 - protein, 6 aa, Giardia lamblia
KAKELV

SEQ ID NO: 3055998 - protein, 5 aa, Giardia lamblia
KAKQG

SEQ ID NO: 3055999 - protein, 38 aa, Giardia lamblia
KAKRKAMATQSNAPDEQDGAASFSHSNTSELTKSSRCD

SEQ ID NO: 3056000 - protein, 12 aa, Giardia lamblia
KAKRKKKAADAV

SEQ ID NO: 3056001 - protein, 5 aa, Giardia lamblia
KAKRV

SEQ ID NO: 3056002 - protein, 14 aa, Giardia lamblia
KAKSGKGSLGPDAK

SEQ ID NO: 3056003 - protein, 6 aa, Giardia lamblia
KAKSTL

SEQ ID NO: 3056004 - protein, 7 aa, Giardia lamblia
KAKTTSA

SEQ ID NO: 3056005 - protein, 11 aa, Giardia lamblia
KALPPPRTGRD

SEQ ID NO: 3056006 - protein, 5 aa, Giardia lamblia
KALPR

SEQ ID NO: 3056007 - protein, 14 aa, Giardia lamblia
KANDTETKKAPKVL

SEQ ID NO: 3056008 - protein, 10 aa, Giardia lamblia
KANFSTKRPL

SEQ ID NO: 3056009 - protein, 13 aa, Giardia lamblia
KANKELKKQGIRG

SEQ ID NO: 3056010 - protein, 5 aa, Giardia lamblia
KANNL

SEQ ID NO: 3056011 - protein, 16 aa, Giardia lamblia
KANPQKLVPKRGRGAS

SEQ ID NO: 3056012 - protein, 5 aa, Giardia lamblia
KANPV

SEQ ID NO: 3056013 - protein, 5 aa, Giardia lamblia
KANQL

SEQ ID NO: 3056014 - protein, 16 aa, Giardia lamblia
KANSKVKSLSGGQKRR

SEQ ID NO: 3056015 - protein, 8 aa, Giardia lamblia
KANTRPPP

SEQ ID NO: 3056016 - protein, 10 aa, Giardia lamblia
KAPCGGSGEL

SEQ ID NO: 3056017 - protein, 8 aa, Giardia lamblia
KAPGGTKT

SEQ ID NO: 3056018 - protein, 7 aa, Giardia lamblia
KAPPHSG

SEQ ID NO: 3056019 - protein, 9 aa, Giardia lamblia
KAPPSAYAI

SEQ ID NO: 3056020 - protein, 13 aa, Giardia lamblia
KAPQGPFTENDAK

SEQ ID NO: 3056021 - protein, 8 aa, Giardia lamblia
KAPSPSDV

SEQ ID NO: 3056022 - protein, 33 aa, Giardia lamblia
KAPSSTKYAESNDNDTAQAVSSSALSTTISALP

SEQ ID NO: 3056023 - protein, 15 aa, Giardia lamblia
KAQESIASLGQGQGT

SEQ ID NO: 3056024 - protein, 6 aa, Giardia lamblia
KAQKAY

SEQ ID NO: 3056025 - protein, 4 aa, Giardia lamblia
KARE

SEQ ID NO: 3056026 - protein, 6 aa, Giardia lamblia
KARENT

SEQ ID NO: 3056027 - protein, 7 aa, Giardia lamblia
KARSKEI

SEQ ID NO: 3056028 - protein, 6 aa, Giardia lamblia
KARSPI

SEQ ID NO: 3056029 - protein, 7 aa, Giardia lamblia
KARSQSP

SEQ ID NO: 3056030 - protein, 5 aa, Giardia lamblia
KARYR

SEQ ID NO: 3056031 - protein, 7 aa, Giardia lamblia
KASAGYS

SEQ ID NO: 3056032 - protein, 9 aa, Giardia lamblia
KASASLASS

SEQ ID NO: 3056033 - protein, 16 aa, Giardia lamblia
KASDAPQDASSQLRAA

SEQ ID NO: 3056034 - protein, 8 aa, Giardia lamblia
KASDGKCT

SEQ ID NO: 3056035 - protein, 7 aa, Giardia lamblia
KASGSTG

SEQ ID NO: 3056036 - protein, 6 aa, Giardia lamblia
KASIKA

SEQ ID NO: 3056037 - protein, 8 aa, Giardia lamblia
KASNEPVP

SEQ ID NO: 3056038 - protein, 15 aa, Giardia lamblia
KASNVQKDTERQYKR

SEQ ID NO: 3056039 - protein, 7 aa, Giardia lamblia
KASPADK

SEQ ID NO: 3056040 - protein, 8 aa, Giardia lamblia
KASSFRTN

SEQ ID NO: 3056041 - protein, 7 aa, Giardia lamblia
KASSLGG

SEQ ID NO: 3056042 - protein, 5 aa, Giardia lamblia
KASSS

SEQ ID NO: 3056043 - protein, 7 aa, Giardia lamblia
KASTRKF

SEQ ID NO: 3056044 - protein, 7 aa, Giardia lamblia
KASTRLQ

SEQ ID NO: 3056045 - protein, 5 aa, Giardia lamblia
KASYG

SEQ ID NO: 3056046 - protein, 20 aa, Giardia lamblia
KATASTVPSGEAHNPEGPEV

SEQ ID NO: 3056047 - protein, 18 aa, Giardia lamblia
KATEADQPESDMDEATCE

SEQ ID NO: 3056048 - protein, 7 aa, Giardia lamblia
KATEDGV

SEQ ID NO: 3056049 - protein, 7 aa, Giardia lamblia
KATEHST

SEQ ID NO: 3056050 - protein, 13 aa, Giardia lamblia
KATERGENSDNLG

SEQ ID NO: 3056051 - protein, 5 aa, Giardia lamblia
KATFE

SEQ ID NO: 3056052 - protein, 7 aa, Giardia lamblia
KATFGQA

SEQ ID NO: 3056053 - protein, 5 aa, Giardia lamblia
KATGA

SEQ ID NO: 3056054 - protein, 7 aa, Giardia lamblia
KATKEDQ

SEQ ID NO: 3056055 - protein, 6 aa, Giardia lamblia
KATKRI

SEQ ID NO: 3056056 - protein, 11 aa, Giardia lamblia
KATKSMHRNRK

SEQ ID NO: 3056057 - protein, 7 aa, Giardia lamblia
KATLSEN

SEQ ID NO: 3056058 - protein, 25 aa, Giardia lamblia
KATPEKACTPPTCTTTNGQVGGTND

SEQ ID NO: 3056059 - protein, 14 aa, Giardia lamblia
KATSITADTATIGT

SEQ ID NO: 3056060 - protein, 14 aa, Giardia lamblia
KATSPAESQECRST

SEQ ID NO: 3056061 - protein, 6 aa, Giardia lamblia
KAVDSL

SEQ ID NO: 3056062 - protein, 28 aa, Giardia lamblia
KAVGKKETSPRKYDSGFKKDKGAGQPQV

SEQ ID NO: 3056063 - protein, 21 aa, Giardia lamblia
KAVPDQTRHGKQWSASAPLGS

SEQ ID NO: 3056064 - protein, 7 aa, Giardia lamblia
KAYEDGC

SEQ ID NO: 3056065 - protein, 6 aa, Giardia lamblia
KCADKQ

SEQ ID NO: 3056066 - protein, 9 aa, Giardia lamblia
KCAEEPNPS

SEQ ID NO: 3056067 - protein, 13 aa, Giardia lamblia
KCDESCDTCSGGE

SEQ ID NO: 3056068 - protein, 7 aa, Giardia lamblia
KCDPTKE

SEQ ID NO: 3056069 - protein, 10 aa, Giardia lamblia
KCPPAYTGAK

SEQ ID NO: 3056070 - protein, 8 aa, Giardia lamblia
KCRTGDGV

SEQ ID NO: 3056071 - protein, 15 aa, Giardia lamblia
KCSSDTHEDTGPGGK

SEQ ID NO: 3056072 - protein, 4 aa, Giardia lamblia
KCTA

SEQ ID NO: 3056073 - protein, 10 aa, Giardia lamblia
KCTELGSVNS

SEQ ID NO: 3056074 - protein, 12 aa, Giardia lamblia
KCTKDSATPPTC

SEQ ID NO: 3056075 - protein, 12 aa, Giardia lamblia
KCTPGEAPINGR

SEQ ID NO: 3056076 - protein, 10 aa, Giardia lamblia
KCTYSEEQEE

SEQ ID NO: 3056077 - protein, 18 aa, Giardia lamblia
KDADSGNVSAYNGTFSAK

SEQ ID NO: 3056078 - protein, 5 aa, Giardia lamblia
KDAEI

SEQ ID NO: 3056079 - protein, 6 aa, Giardia lamblia
KDAEVS

SEQ ID NO: 3056080 - protein, 7 aa, Giardia lamblia
KDAGLTS

SEQ ID NO: 3056081 - protein, 8 aa, Giardia lamblia
KDAGQDIS

SEQ ID NO: 3056082 - protein, 10 aa, Giardia lamblia
KDAIASDEAF

SEQ ID NO: 3056083 - protein, 14 aa, Giardia lamblia
KDALERNPENALAS

SEQ ID NO: 3056084 - protein, 9 aa, Giardia lamblia
KDANNAESI

SEQ ID NO: 3056085 - protein, 5 aa, Giardia lamblia
KDASR

SEQ ID NO: 3056086 - protein, 18 aa, Giardia lamblia
KDASSGNVSAYNGTFSAP

SEQ ID NO: 3056087 - protein, 7 aa, Giardia lamblia
KDATFSS

SEQ ID NO: 3056088 - protein, 10 aa, Giardia lamblia
KDATKGRCTA

SEQ ID NO: 3056089 - protein, 20 aa, Giardia lamblia
KDDETNNDQDRTTKRDDTPL

SEQ ID NO: 3056090 - protein, 8 aa, Giardia lamblia
KDDPETLA

SEQ ID NO: 3056091 - protein, 6 aa, Giardia lamblia
KDDSHN

SEQ ID NO: 3056092 - protein, 4 aa, Giardia lamblia
KDDT

SEQ ID NO: 3056093 - protein, 6 aa, Giardia lamblia
KDDTRD

SEQ ID NO: 3056094 - protein, 5 aa, Giardia lamblia
KDDTS

SEQ ID NO: 3056095 - protein, 9 aa, Giardia lamblia
KDEGRGDHE

SEQ ID NO: 3056096 - protein, 6 aa, Giardia lamblia
KDEGSY

SEQ ID NO: 3056097 - protein, 7 aa, Giardia lamblia
KDEQGTE

SEQ ID NO: 3056098 - protein, 11 aa, Giardia lamblia
KDESGEQKVAR

SEQ ID NO: 3056099 - protein, 8 aa, Giardia lamblia
KDEVDDDT

SEQ ID NO: 3056100 - protein, 7 aa, Giardia lamblia
KDEVLGK

SEQ ID NO: 3056101 - protein, 6 aa, Giardia lamblia
KDEWPG

SEQ ID NO: 3056102 - protein, 4 aa, Giardia lamblia
KDGD

SEQ ID NO: 3056103 - protein, 8 aa, Giardia lamblia
KDGDEVAT

SEQ ID NO: 3056104 - protein, 6 aa, Giardia lamblia
KDGETA

SEQ ID NO: 3056105 - protein, 6 aa, Giardia lamblia
KDGNYL

SEQ ID NO: 3056106 - protein, 5 aa, Giardia lamblia
KDGQQ

SEQ ID NO: 3056107 - protein, 6 aa, Giardia lamblia
KDGRRP

SEQ ID NO: 3056108 - protein, 8 aa, Giardia lamblia
KDGTPDGC

SEQ ID NO: 3056109 - protein, 7 aa, Giardia lamblia
KDGTTCR

SEQ ID NO: 3056110 - protein, 5 aa, Giardia lamblia
KDGYV

SEQ ID NO: 3056111 - protein, 12 aa, Giardia lamblia
KDHAQLSRAGSS

SEQ ID NO: 3056112 - protein, 8 aa, Giardia lamblia
KDHDNKSA

SEQ ID NO: 3056113 - protein, 7 aa, Giardia lamblia
KDHKGRT

SEQ ID NO: 3056114 - protein, 11 aa, Giardia lamblia
KDHKPNRSSET

SEQ ID NO: 3056115 - protein, 7 aa, Giardia lamblia
KDHKRYS

SEQ ID NO: 3056116 - protein, 11 aa, Giardia lamblia
KDIEKAPKNDH

SEQ ID NO: 3056117 - protein, 13 aa, Giardia lamblia
KDIPTEKETTPMP

SEQ ID NO: 3056118 - protein, 9 aa, Giardia lamblia
KDITAEAAK

SEQ ID NO: 3056119 - protein, 8 aa, Giardia lamblia
KDKALPYY

SEQ ID NO: 3056120 - protein, 8 aa, Giardia lamblia
KDKEKEYK

SEQ ID NO: 3056121 - protein, 13 aa, Giardia lamblia
KDKEKTDPNGARN

SEQ ID NO: 3056122 - protein, 6 aa, Giardia lamblia
KDKKEQ

SEQ ID NO: 3056123 - protein, 10 aa, Giardia lamblia
KDKSEQLQDI

SEQ ID NO: 3056124 - protein, 6 aa, Giardia lamblia
KDKSGP

SEQ ID NO: 3056125 - protein, 7 aa, Giardia lamblia
KDKSRDN

SEQ ID NO: 3056126 - protein, 7 aa, Giardia lamblia
KDKTAQK

SEQ ID NO: 3056127 - protein, 9 aa, Giardia lamblia
KDKTEVDNT

SEQ ID NO: 3056128 - protein, 8 aa, Giardia lamblia
KDKTGGAE

SEQ ID NO: 3056129 - protein, 28 aa, Giardia lamblia
KDLAESKQSTRPVSTNEDRSLTKGPVSK

SEQ ID NO: 3056130 - protein, 7 aa, Giardia lamblia
KDLDQEA

SEQ ID NO: 3056131 - protein, 8 aa, Giardia lamblia
KDLDTELG

SEQ ID NO: 3056132 - protein, 18 aa, Giardia lamblia
KDLDTSKSTRNEDKWASR

SEQ ID NO: 3056133 - protein, 19 aa, Giardia lamblia
KDLGKQQAALQRKGALDDA

SEQ ID NO: 3056134 - protein, 7 aa, Giardia lamblia
KDLNTDL

SEQ ID NO: 3056135 - protein, 15 aa, Giardia lamblia
KDLQERDAGIEQKEA

SEQ ID NO: 3056136 - protein, 11 aa, Giardia lamblia
KDLREASTKPL

SEQ ID NO: 3056137 - protein, 9 aa, Giardia lamblia
KDLSSQDSI

SEQ ID NO: 3056138 - protein, 8 aa, Giardia lamblia
KDLTSSHG

SEQ ID NO: 3056139 - protein, 11 aa, Giardia lamblia
KDMNKEERGTY

SEQ ID NO: 3056140 - protein, 10 aa, Giardia lamblia
KDMSRSTTLA

SEQ ID NO: 3056141 - protein, 9 aa, Giardia lamblia
KDNKGNTPM

SEQ ID NO: 3056142 - protein, 20 aa, Giardia lamblia
KDNRYSDSYPHGLDNIYQRG

SEQ ID NO: 3056143 - protein, 6 aa, Giardia lamblia
KDNTGK

SEQ ID NO: 3056144 - protein, 7 aa, Giardia lamblia
KDPAHRE

SEQ ID NO: 3056145 - protein, 14 aa, Giardia lamblia
KDPAPSNAASTASI

SEQ ID NO: 3056146 - protein, 10 aa, Giardia lamblia
KDPDRTDSGR

SEQ ID NO: 3056147 - protein, 4 aa, Giardia lamblia
KDPE

SEQ ID NO: 3056148 - protein, 4 aa, Giardia lamblia
KDPG

SEQ ID NO: 3056149 - protein, 9 aa, Giardia lamblia
KDPKIHAKN

SEQ ID NO: 3056150 - protein, 9 aa, Giardia lamblia
KDPKPDEYE

SEQ ID NO: 3056151 - protein, 9 aa, Giardia lamblia
KDPKSSGYR

SEQ ID NO: 3056152 - protein, 16 aa, Giardia lamblia
KDPLPRRSYSARRAAE

SEQ ID NO: 3056153 - protein, 5 aa, Giardia lamblia
KDPMP

SEQ ID NO: 3056154 - protein, 6 aa, Giardia lamblia
KDPPSE

SEQ ID NO: 3056155 - protein, 16 aa, Giardia lamblia
KDPQGGGLSPRPPINP

SEQ ID NO: 3056156 - protein, 15 aa, Giardia lamblia
KDPSATSIKTYPPPY

SEQ ID NO: 3056157 - protein, 7 aa, Giardia lamblia
KDPSTSI

SEQ ID NO: 3056158 - protein, 15 aa, Giardia lamblia
KDPTYELKDKDTSPL

SEQ ID NO: 3056159 - protein, 7 aa, Giardia lamblia
KDQAPDN

SEQ ID NO: 3056160 - protein, 6 aa, Giardia lamblia
KDREAH

SEQ ID NO: 3056161 - protein, 7 aa, Giardia lamblia
KDRRKGI

SEQ ID NO: 3056162 - protein, 5 aa, Giardia lamblia
KDRRV

SEQ ID NO: 3056163 - protein, 11 aa, Giardia lamblia
KDRSKYERRKT

SEQ ID NO: 3056164 - protein, 8 aa, Giardia lamblia
KDSAQYPL

SEQ ID NO: 3056165 - protein, 12 aa, Giardia lamblia
KDSARSAIQDDD

SEQ ID NO: 3056166 - protein, 9 aa, Giardia lamblia
KDSDPDSLS

SEQ ID NO: 3056167 - protein, 10 aa, Giardia lamblia
KDSDTASSSH

SEQ ID NO: 3056168 - protein, 13 aa, Giardia lamblia
KDSEHGKGSPVTG

SEQ ID NO: 3056169 - protein, 5 aa, Giardia lamblia
KDSFP

SEQ ID NO: 3056170 - protein, 8 aa, Giardia lamblia
KDSKEPVK

SEQ ID NO: 3056171 - protein, 5 aa, Giardia lamblia
KDSLD

SEQ ID NO: 3056172 - protein, 23 aa, Giardia lamblia
KDSPDDGGRSEPRRTIEPQQAPP

SEQ ID NO: 3056173 - protein, 6 aa, Giardia lamblia
KDSPST

SEQ ID NO: 3056174 - protein, 18 aa, Giardia lamblia
KDSSDGNVSAYNGTFSAK

SEQ ID NO: 3056175 - protein, 19 aa, Giardia lamblia
KDSSDGNVSAYNGTFSAKP

SEQ ID NO: 3056176 - protein, 7 aa, Giardia lamblia
KDSSFQD

SEQ ID NO: 3056177 - protein, 7 aa, Giardia lamblia
KDSSISS

SEQ ID NO: 3056178 - protein, 7 aa, Giardia lamblia
KDSSSSA

SEQ ID NO: 3056179 - protein, 55 aa, Giardia lamblia
KDSTINASFTDGEHGGVRRKEDSSWYDESSHNRGGGDQYQESSDNWGGQARVVGK

SEQ ID NO: 3056180 - protein, 8 aa, Giardia lamblia
KDSTRTSK

SEQ ID NO: 3056181 - protein, 5 aa, Giardia lamblia
KDSYP

SEQ ID NO: 3056182 - protein, 20 aa, Giardia lamblia
KDTAELQQEDHDASPKQNTR

SEQ ID NO: 3056183 - protein, 4 aa, Giardia lamblia
KDTE

SEQ ID NO: 3056184 - protein, 7 aa, Giardia lamblia
KDTEIQD

SEQ ID NO: 3056185 - protein, 10 aa, Giardia lamblia
KDTELDNPTY

SEQ ID NO: 3056186 - protein, 10 aa, Giardia lamblia
KDTKTCRPCP

SEQ ID NO: 3056187 - protein, 6 aa, Giardia lamblia
KDTNLS

SEQ ID NO: 3056188 - protein, 5 aa, Giardia lamblia
KDTQL

SEQ ID NO: 3056189 - protein, 8 aa, Giardia lamblia
KDTRTSYL

SEQ ID NO: 3056190 - protein, 11 aa, Giardia lamblia
KDTSKAPSNGV

SEQ ID NO: 3056191 - protein, 10 aa, Giardia lamblia
KDVPQSDTGQ

SEQ ID NO: 3056192 - protein, 4 aa, Giardia lamblia
KDVT

SEQ ID NO: 3056193 - protein, 13 aa, Giardia lamblia
KDVTEYSSSAPVT

SEQ ID NO: 3056194 - protein, 7 aa, Giardia lamblia
KDWSSVS

SEQ ID NO: 3056195 - protein, 17 aa, Giardia lamblia
KDYPDIPSGMDHPTAKK

SEQ ID NO: 3056196 - protein, 20 aa, Giardia lamblia
KDYSFPDSYEEPSLRKGSPE

SEQ ID NO: 3056197 - protein, 6 aa, Giardia lamblia
KEAERK

SEQ ID NO: 3056198 - protein, 5 aa, Giardia lamblia
KEAGI

SEQ ID NO: 3056199 - protein, 8 aa, Giardia lamblia
KEAGPSTF

SEQ ID NO: 3056200 - protein, 6 aa, Giardia lamblia
KEAKLR

SEQ ID NO: 3056201 - protein, 10 aa, Giardia lamblia
KEAKQESEVL

SEQ ID NO: 3056202 - protein, 5 aa, Giardia lamblia
KEAND

SEQ ID NO: 3056203 - protein, 11 aa, Giardia lamblia
KEANDASGSNF

SEQ ID NO: 3056204 - protein, 7 aa, Giardia lamblia
KEARDVK

SEQ ID NO: 3056205 - protein, 25 aa, Giardia lamblia
KEASASEEKEVAQARRVRRKRPQGI

SEQ ID NO: 3056206 - protein, 7 aa, Giardia lamblia
KEASASN

SEQ ID NO: 3056207 - protein, 13 aa, Giardia lamblia
KEASETKSDRRDR

SEQ ID NO: 3056208 - protein, 9 aa, Giardia lamblia
KEATETIVN

SEQ ID NO: 3056209 - protein, 12 aa, Giardia lamblia
KEAVKSVREGLG

SEQ ID NO: 3056210 - protein, 7 aa, Giardia lamblia
KEDDGRF

SEQ ID NO: 3056211 - protein, 20 aa, Giardia lamblia
KEDLSAGKECPWQQDSQPAM

SEQ ID NO: 3056212 - protein, 6 aa, Giardia lamblia
KEDNDF

SEQ ID NO: 3056213 - protein, 7 aa, Giardia lamblia
KEDPSHP

SEQ ID NO: 3056214 - protein, 13 aa, Giardia lamblia
KEDQKEDKSVAKR

SEQ ID NO: 3056215 - protein, 37 aa, Giardia lamblia
KEEAKGKGGQSVTSASTKDAPPDELEASDTIKEPAIK

SEQ ID NO: 3056216 - protein, 6 aa, Giardia lamblia
KEEANS

SEQ ID NO: 3056217 - protein, 8 aa, Giardia lamblia
KEEATKEI

SEQ ID NO: 3056218 - protein, 6 aa, Giardia lamblia
KEECSP

SEQ ID NO: 3056219 - protein, 6 aa, Giardia lamblia
KEEDND

SEQ ID NO: 3056220 - protein, 6 aa, Giardia lamblia
KEEESE

SEQ ID NO: 3056221 - protein, 4 aa, Giardia lamblia
KEEG

SEQ ID NO: 3056222 - protein, 7 aa, Giardia lamblia
KEEKEQT

SEQ ID NO: 3056223 - protein, 7 aa, Giardia lamblia
KEEKNHV

SEQ ID NO: 3056224 - protein, 9 aa, Giardia lamblia
KEEKTSRWK

SEQ ID NO: 3056225 - protein, 21 aa, Giardia lamblia
KEENTKNTSAAGRSIGSGRSS

SEQ ID NO: 3056226 - protein, 6 aa, Giardia lamblia
KEERTA

SEQ ID NO: 3056227 - protein, 8 aa, Giardia lamblia
KEESSAVS

SEQ ID NO: 3056228 - protein, 5 aa, Giardia lamblia
KEESY

SEQ ID NO: 3056229 - protein, 6 aa, Giardia lamblia
KEEYAK

SEQ ID NO: 3056230 - protein, 5 aa, Giardia lamblia
KEFEK

SEQ ID NO: 3056231 - protein, 6 aa, Giardia lamblia
KEFQDD

SEQ ID NO: 3056232 - protein, 18 aa, Giardia lamblia
KEFSQNSTAVTDRPQSSV

SEQ ID NO: 3056233 - protein, 5 aa, Giardia lamblia
KEGDT

SEQ ID NO: 3056234 - protein, 9 aa, Giardia lamblia
KEGQADPTK

SEQ ID NO: 3056235 - protein, 13 aa, Giardia lamblia
KEGSIADTNGTTP

SEQ ID NO: 3056236 - protein, 4 aa, Giardia lamblia
KEGV

SEQ ID NO: 3056237 - protein, 6 aa, Giardia lamblia
KEGVLS

SEQ ID NO: 3056238 - protein, 11 aa, Giardia lamblia
KEGYASDPPTF

SEQ ID NO: 3056239 - protein, 5 aa, Giardia lamblia
KEHHG

SEQ ID NO: 3056240 - protein, 4 aa, Giardia lamblia
KEHK

SEQ ID NO: 3056241 - protein, 5 aa, Giardia lamblia
KEHPN

SEQ ID NO: 3056242 - protein, 18 aa, Giardia lamblia
KEIAATGKDESSDSQSDR

SEQ ID NO: 3056243 - protein, 4 aa, Giardia lamblia
KEID

SEQ ID NO: 3056244 - protein, 12 aa, Giardia lamblia
KEIEEQPGEPVP

SEQ ID NO: 3056245 - protein, 6 aa, Giardia lamblia
KEIEER

SEQ ID NO: 3056246 - protein, 5 aa, Giardia lamblia
KEIPP

SEQ ID NO: 3056247 - protein, 6 aa, Giardia lamblia
KEIYGN

SEQ ID NO: 3056248 - protein, 9 aa, Giardia lamblia
KEKAERAQQ

SEQ ID NO: 3056249 - protein, 18 aa, Giardia lamblia
KEKDATGAAREPPPVSAQ

SEQ ID NO: 3056250 - protein, 4 aa, Giardia lamblia
KEKE

SEQ ID NO: 3056251 - protein, 8 aa, Giardia lamblia
KEKLIGKK

SEQ ID NO: 3056252 - protein, 7 aa, Giardia lamblia
KEKPSLS

SEQ ID NO: 3056253 - protein, 6 aa, Giardia lamblia
KEKQAA

SEQ ID NO: 3056254 - protein, 6 aa, Giardia lamblia
KEKSGS

SEQ ID NO: 3056255 - protein, 9 aa, Giardia lamblia
KEKSLQDKA

SEQ ID NO: 3056256 - protein, 15 aa, Giardia lamblia
KELEKEQDRYSSTPA

SEQ ID NO: 3056257 - protein, 14 aa, Giardia lamblia
KELETTGINTRTSN

SEQ ID NO: 3056258 - protein, 6 aa, Giardia lamblia
KELGDY

SEQ ID NO: 3056259 - protein, 11 aa, Giardia lamblia
KELGSDPATGL

SEQ ID NO: 3056260 - protein, 21 aa, Giardia lamblia
KELVKEQDRLGARAKDTLTHE

SEQ ID NO: 3056261 - protein, 4 aa, Giardia lamblia
KENE

SEQ ID NO: 3056262 - protein, 27 aa, Giardia lamblia
KENMEKKDEISEISGEDVEPPSLGEYE

SEQ ID NO: 3056263 - protein, 8 aa, Giardia lamblia
KENQQDYE

SEQ ID NO: 3056264 - protein, 8 aa, Giardia lamblia
KENRNPVS

SEQ ID NO: 3056265 - protein, 7 aa, Giardia lamblia
KENYPDV

SEQ ID NO: 3056266 - protein, 11 aa, Giardia lamblia
KEPDKQPYKRK

SEQ ID NO: 3056267 - protein, 13 aa, Giardia lamblia
KEPDLTISDTSTD

SEQ ID NO: 3056268 - protein, 7 aa, Giardia lamblia
KEPDTEE

SEQ ID NO: 3056269 - protein, 4 aa, Giardia lamblia
KEPS

SEQ ID NO: 3056270 - protein, 7 aa, Giardia lamblia
KEPSRTE

SEQ ID NO: 3056271 - protein, 7 aa, Giardia lamblia
KEPTDEE

SEQ ID NO: 3056272 - protein, 7 aa, Giardia lamblia
KEPTPRN

SEQ ID NO: 3056273 - protein, 4 aa, Giardia lamblia
KEPV

SEQ ID NO: 3056274 - protein, 25 aa, Giardia lamblia
KEPVKRESKQLSAPVSKPQPEARGS

SEQ ID NO: 3056275 - protein, 10 aa, Giardia lamblia
KEPVSDFPKG

SEQ ID NO: 3056276 - protein, 5 aa, Giardia lamblia
KEQMT

SEQ ID NO: 3056277 - protein, 18 aa, Giardia lamblia
KEQSRPSSTCDSVSKDKR

SEQ ID NO: 3056278 - protein, 6 aa, Giardia lamblia
KEQTRR

SEQ ID NO: 3056279 - protein, 4 aa, Giardia lamblia
KEQW

SEQ ID NO: 3056280 - protein, 6 aa, Giardia lamblia
KERGAL

SEQ ID NO: 3056281 - protein, 4 aa, Giardia lamblia
KERK

SEQ ID NO: 3056282 - protein, 9 aa, Giardia lamblia
KERLEQTEG

SEQ ID NO: 3056283 - protein, 10 aa, Giardia lamblia
KERLEQTTRP

SEQ ID NO: 3056284 - protein, 7 aa, Giardia lamblia
KERMTRE

SEQ ID NO: 3056285 - protein, 4 aa, Giardia lamblia
KERN

SEQ ID NO: 3056286 - protein, 14 aa, Giardia lamblia
KERPDEIKKEREAH

SEQ ID NO: 3056287 - protein, 9 aa, Giardia lamblia
KERSGDSSV

SEQ ID NO: 3056288 - protein, 15 aa, Giardia lamblia
KERSQLGSISSHTGA

SEQ ID NO: 3056289 - protein, 9 aa, Giardia lamblia
KESGLHTNK

SEQ ID NO: 3056290 - protein, 10 aa, Giardia lamblia
KESNSQNIAG

SEQ ID NO: 3056291 - protein, 37 aa, Giardia lamblia
KESPTHQASTKTQAQSTVDDARSSTSVNSASGASVLS

SEQ ID NO: 3056292 - protein, 7 aa, Giardia lamblia
KESSEEN

SEQ ID NO: 3056293 - protein, 20 aa, Giardia lamblia
KESTASTGAKEVNDDSTRAA

SEQ ID NO: 3056294 - protein, 11 aa, Giardia lamblia
KESTHSRDAED

SEQ ID NO: 3056295 - protein, 6 aa, Giardia lamblia
KESVAS

SEQ ID NO: 3056296 - protein, 13 aa, Giardia lamblia
KETCSHEASEDEV

SEQ ID NO: 3056297 - protein, 4 aa, Giardia lamblia
KETD

SEQ ID NO: 3056298 - protein, 15 aa, Giardia lamblia
KETDEEVTLALERRH

SEQ ID NO: 3056299 - protein, 14 aa, Giardia lamblia
KETDSAGKPTERSF

SEQ ID NO: 3056300 - protein, 6 aa, Giardia lamblia
KETGVD

SEQ ID NO: 3056301 - protein, 6 aa, Giardia lamblia
KETKLR

SEQ ID NO: 3056302 - protein, 7 aa, Giardia lamblia
KETPALQ

SEQ ID NO: 3056303 - protein, 4 aa, Giardia lamblia
KETQ

SEQ ID NO: 3056304 - protein, 27 aa, Giardia lamblia
KETQSTIPTGMSASSVNKIKNNSQAQR

SEQ ID NO: 3056305 - protein, 4 aa, Giardia lamblia
KETS

SEQ ID NO: 3056306 - protein, 7 aa, Giardia lamblia
KEVEGDT

SEQ ID NO: 3056307 - protein, 14 aa, Giardia lamblia
KEVEGNEQRLLRAK

SEQ ID NO: 3056308 - protein, 6 aa, Giardia lamblia
KEVEYD

SEQ ID NO: 3056309 - protein, 4 aa, Giardia lamblia
KEVP

SEQ ID NO: 3056310 - protein, 12 aa, Giardia lamblia
KEVPASANPPMT

SEQ ID NO: 3056311 - protein, 11 aa, Giardia lamblia
KEVPQAASAFS

SEQ ID NO: 3056312 - protein, 8 aa, Giardia lamblia
KEVTPESV

SEQ ID NO: 3056313 - protein, 9 aa, Giardia lamblia
KEYPAPNTL

SEQ ID NO: 3056314 - protein, 8 aa, Giardia lamblia
KEYSDQAA

SEQ ID NO: 3056315 - protein, 7 aa, Giardia lamblia
KFDGTAN

SEQ ID NO: 3056316 - protein, 8 aa, Giardia lamblia
KFDQNTAS

SEQ ID NO: 3056317 - protein, 11 aa, Giardia lamblia
KFEENLSGTIR

SEQ ID NO: 3056318 - protein, 7 aa, Giardia lamblia
KFEQAQE

SEQ ID NO: 3056319 - protein, 12 aa, Giardia lamblia
KFGRNDSEIQTG

SEQ ID NO: 3056320 - protein, 8 aa, Giardia lamblia
KFKSGSSI

SEQ ID NO: 3056321 - protein, 6 aa, Giardia lamblia
KFNSGS

SEQ ID NO: 3056322 - protein, 10 aa, Giardia lamblia
KFSGADDENT

SEQ ID NO: 3056323 - protein, 17 aa, Giardia lamblia
KFSRNNRAQFSPFPPSD

SEQ ID NO: 3056324 - protein, 11 aa, Giardia lamblia
KFSYNPKSNTY

SEQ ID NO: 3056325 - protein, 24 aa, Giardia lamblia
KFTGPNPGKQVAYEEPQEHSEEDA

SEQ ID NO: 3056326 - protein, 5 aa, Giardia lamblia
KFTPQ

SEQ ID NO: 3056327 - protein, 5 aa, Giardia lamblia
KGAGD

SEQ ID NO: 3056328 - protein, 7 aa, Giardia lamblia
KGAGSSH

SEQ ID NO: 3056329 - protein, 9 aa, Giardia lamblia
KGAIEVSNS

SEQ ID NO: 3056330 - protein, 12 aa, Giardia lamblia
KGAKDTEKKTAL

SEQ ID NO: 3056331 - protein, 5 aa, Giardia lamblia
KGALS

SEQ ID NO: 3056332 - protein, 8 aa, Giardia lamblia
KGATAGTA

SEQ ID NO: 3056333 - protein, 4 aa, Giardia lamblia
KGAY

SEQ ID NO: 3056334 - protein, 8 aa, Giardia lamblia
KGDANKVK

SEQ ID NO: 3056335 - protein, 7 aa, Giardia lamblia
KGDASEA

SEQ ID NO: 3056336 - protein, 8 aa, Giardia lamblia
KGDFRTGK

SEQ ID NO: 3056337 - protein, 5 aa, Giardia lamblia
KGDSW

SEQ ID NO: 3056338 - protein, 13 aa, Giardia lamblia
KGDTYQDSTGNTF

SEQ ID NO: 3056339 - protein, 5 aa, Giardia lamblia
KGDVC

SEQ ID NO: 3056340 - protein, 7 aa, Giardia lamblia
KGEAHAE

SEQ ID NO: 3056341 - protein, 7 aa, Giardia lamblia
KGEFSDH

SEQ ID NO: 3056342 - protein, 4 aa, Giardia lamblia
KGEH

SEQ ID NO: 3056343 - protein, 4 aa, Giardia lamblia
KGEK

SEQ ID NO: 3056344 - protein, 17 aa, Giardia lamblia
KGEKEEIGKEPRGSPAI

SEQ ID NO: 3056345 - protein, 8 aa, Giardia lamblia
KGEQCRTV

SEQ ID NO: 3056346 - protein, 6 aa, Giardia lamblia
KGGHSS

SEQ ID NO: 3056347 - protein, 6 aa, Giardia lamblia
KGGSFN

SEQ ID NO: 3056348 - protein, 5 aa, Giardia lamblia
KGGYG

SEQ ID NO: 3056349 - protein, 4 aa, Giardia lamblia
KGHA

SEQ ID NO: 3056350 - protein, 7 aa, Giardia lamblia
KGHTSRV

SEQ ID NO: 3056351 - protein, 6 aa, Giardia lamblia
KGIDTA

SEQ ID NO: 3056352 - protein, 11 aa, Giardia lamblia
KGIKDKDGHTA

SEQ ID NO: 3056353 - protein, 10 aa, Giardia lamblia
KGIQAHDGST

SEQ ID NO: 3056354 - protein, 6 aa, Giardia lamblia
KGISGN

SEQ ID NO: 3056355 - protein, 7 aa, Giardia lamblia
KGISSSE

SEQ ID NO: 3056356 - protein, 15 aa, Giardia lamblia
KGKHGTGSLSLQSAT

SEQ ID NO: 3056357 - protein, 39 aa, Giardia lamblia
KGKKPTLATRSGCTQERNSFDSEKKDEADKSSEEVLPSR

SEQ ID NO: 3056358 - protein, 16 aa, Giardia lamblia
KGKPPENSNVITSKGP

SEQ ID NO: 3056359 - protein, 6 aa, Giardia lamblia
KGKSTR

SEQ ID NO: 3056360 - protein, 8 aa, Giardia lamblia
KGKTGLSW

SEQ ID NO: 3056361 - protein, 22 aa, Giardia lamblia
KGKTKTPLPDERLDSERASPCH

SEQ ID NO: 3056362 - protein, 7 aa, Giardia lamblia
KGKTQYE

SEQ ID NO: 3056363 - protein, 12 aa, Giardia lamblia
KGKWKDSNADFS

SEQ ID NO: 3056364 - protein, 9 aa, Giardia lamblia
KGLATGSGE

SEQ ID NO: 3056365 - protein, 4 aa, Giardia lamblia
KGLE

SEQ ID NO: 3056366 - protein, 6 aa, Giardia lamblia
KGLGKE

SEQ ID NO: 3056367 - protein, 10 aa, Giardia lamblia
KGLGSSAIAD

SEQ ID NO: 3056368 - protein, 7 aa, Giardia lamblia
KGLNSSS

SEQ ID NO: 3056369 - protein, 5 aa, Giardia lamblia
KGLPR

SEQ ID NO: 3056370 - protein, 4 aa, Giardia lamblia
KGLV

SEQ ID NO: 3056371 - protein, 6 aa, Giardia lamblia
KGNAKH

SEQ ID NO: 3056372 - protein, 9 aa, Giardia lamblia
KGNANEAHT

SEQ ID NO: 3056373 - protein, 13 aa, Giardia lamblia
KGNCTESLATSSL

SEQ ID NO: 3056374 - protein, 6 aa, Giardia lamblia
KGNPMW

SEQ ID NO: 3056375 - protein, 10 aa, Giardia lamblia
KGNTNYQAAR

SEQ ID NO: 3056376 - protein, 5 aa, Giardia lamblia
KGPEE

SEQ ID NO: 3056377 - protein, 6 aa, Giardia lamblia
KGPGPM

SEQ ID NO: 3056378 - protein, 30 aa, Giardia lamblia
KGPMKKSPRRRFHPDETSTSLLSQDYGSSM

SEQ ID NO: 3056379 - protein, 11 aa, Giardia lamblia
KGPNGRWNPEV

SEQ ID NO: 3056380 - protein, 5 aa, Giardia lamblia
KGPVR

SEQ ID NO: 3056381 - protein, 5 aa, Giardia lamblia
KGPVS

SEQ ID NO: 3056382 - protein, 7 aa, Giardia lamblia
KGQEQEL

SEQ ID NO: 3056383 - protein, 8 aa, Giardia lamblia
KGQGYTYS

SEQ ID NO: 3056384 - protein, 13 aa, Giardia lamblia
KGQKSFSRTGSNG

SEQ ID NO: 3056385 - protein, 5 aa, Giardia lamblia
KGQKT

SEQ ID NO: 3056386 - protein, 8 aa, Giardia lamblia
KGQSFSAD

SEQ ID NO: 3056387 - protein, 5 aa, Giardia lamblia
KGRDA

SEQ ID NO: 3056388 - protein, 6 aa, Giardia lamblia
KGREGQ

SEQ ID NO: 3056389 - protein, 9 aa, Giardia lamblia
KGRGQLETH

SEQ ID NO: 3056390 - protein, 9 aa, Giardia lamblia
KGRKPKHNL

SEQ ID NO: 3056391 - protein, 5 aa, Giardia lamblia
KGRSH

SEQ ID NO: 3056392 - protein, 6 aa, Giardia lamblia
KGRTKN

SEQ ID NO: 3056393 - protein, 6 aa, Giardia lamblia
KGRTVR

SEQ ID NO: 3056394 - protein, 7 aa, Giardia lamblia
KGRYKQY

SEQ ID NO: 3056395 - protein, 10 aa, Giardia lamblia
KGSDQHPKSI

SEQ ID NO: 3056396 - protein, 26 aa, Giardia lamblia
KGSDQSAHHKEASASQLTKSVPAATD

SEQ ID NO: 3056397 - protein, 6 aa, Giardia lamblia
KGSERR

SEQ ID NO: 3056398 - protein, 9 aa, Giardia lamblia
KGSGSSAPE

SEQ ID NO: 3056399 - protein, 9 aa, Giardia lamblia
KGSKSSSLS

SEQ ID NO: 3056400 - protein, 7 aa, Giardia lamblia
KGSLAEV

SEQ ID NO: 3056401 - protein, 5 aa, Giardia lamblia
KGSLE

SEQ ID NO: 3056402 - protein, 14 aa, Giardia lamblia
KGSLSGCASDTPRW

SEQ ID NO: 3056403 - protein, 5 aa, Giardia lamblia
KGSMG

SEQ ID NO: 3056404 - protein, 6 aa, Giardia lamblia
KGSPVK

SEQ ID NO: 3056405 - protein, 10 aa, Giardia lamblia
KGSRTTSGGY

SEQ ID NO: 3056406 - protein, 5 aa, Giardia lamblia
KGSSC

SEQ ID NO: 3056407 - protein, 18 aa, Giardia lamblia
KGSSDGNVSAYNGTFSAK

SEQ ID NO: 3056408 - protein, 9 aa, Giardia lamblia
KGSSETLSA

SEQ ID NO: 3056409 - protein, 6 aa, Giardia lamblia
KGSSIG

SEQ ID NO: 3056410 - protein, 21 aa, Giardia lamblia
KGSSSDAATDESQKTGRATRQ

SEQ ID NO: 3056411 - protein, 7 aa, Giardia lamblia
KGSSYAN

SEQ ID NO: 3056412 - protein, 5 aa, Giardia lamblia
KGSTQ

SEQ ID NO: 3056413 - protein, 4 aa, Giardia lamblia
KGSV

SEQ ID NO: 3056414 - protein, 5 aa, Giardia lamblia
KGSVE

SEQ ID NO: 3056415 - protein, 4 aa, Giardia lamblia
KGSY

SEQ ID NO: 3056416 - protein, 8 aa, Giardia lamblia
KGTATGGI

SEQ ID NO: 3056417 - protein, 8 aa, Giardia lamblia
KGTATGSL

SEQ ID NO: 3056418 - protein, 8 aa, Giardia lamblia
KGTKQDNK

SEQ ID NO: 3056419 - protein, 10 aa, Giardia lamblia
KGTPGSDRYI

SEQ ID NO: 3056420 - protein, 6 aa, Giardia lamblia
KGTTRH

SEQ ID NO: 3056421 - protein, 6 aa, Giardia lamblia
KGVTKL

SEQ ID NO: 3056422 - protein, 12 aa, Giardia lamblia
KGWQESKENPSG

SEQ ID NO: 3056423 - protein, 10 aa, Giardia lamblia
KGYDDTNQGL

SEQ ID NO: 3056424 - protein, 20 aa, Giardia lamblia
KGYMGTTAYPKFSSKCSSQT

SEQ ID NO: 3056425 - protein, 4 aa, Giardia lamblia
KGYS

SEQ ID NO: 3056426 - protein, 7 aa, Giardia lamblia
KGYSATD

SEQ ID NO: 3056427 - protein, 13 aa, Giardia lamblia
KHAITTAETQCTE

SEQ ID NO: 3056428 - protein, 6 aa, Giardia lamblia
KHAPET

SEQ ID NO: 3056429 - protein, 11 aa, Giardia lamblia
KHDAREGNAYT

SEQ ID NO: 3056430 - protein, 8 aa, Giardia lamblia
KHDSNGTT

SEQ ID NO: 3056431 - protein, 4 aa, Giardia lamblia
KHDT

SEQ ID NO: 3056432 - protein, 7 aa, Giardia lamblia
KHDTARK

SEQ ID NO: 3056433 - protein, 12 aa, Giardia lamblia
KHESSLPSGLTS

SEQ ID NO: 3056434 - protein, 12 aa, Giardia lamblia
KHGGSPCHSSTN

SEQ ID NO: 3056435 - protein, 6 aa, Giardia lamblia
KHGPQL

SEQ ID NO: 3056436 - protein, 8 aa, Giardia lamblia
KHHDEQNF

SEQ ID NO: 3056437 - protein, 6 aa, Giardia lamblia
KHHDTL

SEQ ID NO: 3056438 - protein, 37 aa, Giardia lamblia
KHKCQPSEATESKKNSCDTRPIHKGREEDYEKSDKVE

SEQ ID NO: 3056439 - protein, 10 aa, Giardia lamblia
KHKQSGTFPD

SEQ ID NO: 3056440 - protein, 13 aa, Giardia lamblia
KHKRHRNDTTRMG

SEQ ID NO: 3056441 - protein, 10 aa, Giardia lamblia
KHKYEEKLNE

SEQ ID NO: 3056442 - protein, 6 aa, Giardia lamblia
KHNDNA

SEQ ID NO: 3056443 - protein, 8 aa, Giardia lamblia
KHNKRDQR

SEQ ID NO: 3056444 - protein, 6 aa, Giardia lamblia
KHNPGT

SEQ ID NO: 3056445 - protein, 11 aa, Giardia lamblia
KHPGRLPPDSI

SEQ ID NO: 3056446 - protein, 15 aa, Giardia lamblia
KHQTKPEDEYVGSDP

SEQ ID NO: 3056447 - protein, 9 aa, Giardia lamblia
KHRGGTMTN

SEQ ID NO: 3056448 - protein, 5 aa, Giardia lamblia
KHSGT

SEQ ID NO: 3056449 - protein, 9 aa, Giardia lamblia
KHSKPEALD

SEQ ID NO: 3056450 - protein, 6 aa, Giardia lamblia
KHSPQD

SEQ ID NO: 3056451 - protein, 8 aa, Giardia lamblia
KHSSDADF

SEQ ID NO: 3056452 - protein, 8 aa, Giardia lamblia
KHSTSPDV

SEQ ID NO: 3056453 - protein, 10 aa, Giardia lamblia
KHTENNSLSP

SEQ ID NO: 3056454 - protein, 5 aa, Giardia lamblia
KHTQA

SEQ ID NO: 3056455 - protein, 6 aa, Giardia lamblia
KHTTDF

SEQ ID NO: 3056456 - protein, 6 aa, Giardia lamblia
KHYGVS

SEQ ID NO: 3056457 - protein, 10 aa, Giardia lamblia
KIAESSTISE

SEQ ID NO: 3056458 - protein, 16 aa, Giardia lamblia
KICNGGGQCTGEGSSA

SEQ ID NO: 3056459 - protein, 8 aa, Giardia lamblia
KIDANEKS

SEQ ID NO: 3056460 - protein, 8 aa, Giardia lamblia
KIDVGTSS

SEQ ID NO: 3056461 - protein, 8 aa, Giardia lamblia
KIERPQAQ

SEQ ID NO: 3056462 - protein, 11 aa, Giardia lamblia
KIETQAGAADH

SEQ ID NO: 3056463 - protein, 6 aa, Giardia lamblia
KIGGEE

SEQ ID NO: 3056464 - protein, 11 aa, Giardia lamblia
KIGGKKSRDAY

SEQ ID NO: 3056465 - protein, 13 aa, Giardia lamblia
KIGSDEMTGSPRI

SEQ ID NO: 3056466 - protein, 5 aa, Giardia lamblia
KIGSG

SEQ ID NO: 3056467 - protein, 7 aa, Giardia lamblia
KIKGEER

SEQ ID NO: 3056468 - protein, 6 aa, Giardia lamblia
KIKHRQ

SEQ ID NO: 3056469 - protein, 4 aa, Giardia lamblia
KIKQ

SEQ ID NO: 3056470 - protein, 6 aa, Giardia lamblia
KILSTS

SEQ ID NO: 3056471 - protein, 10 aa, Giardia lamblia
KINQEREDQS

SEQ ID NO: 3056472 - protein, 5 aa, Giardia lamblia
KIPAR

SEQ ID NO: 3056473 - protein, 6 aa, Giardia lamblia
KIPDKS

SEQ ID NO: 3056474 - protein, 7 aa, Giardia lamblia
KIPPTVQ

SEQ ID NO: 3056475 - protein, 6 aa, Giardia lamblia
KIQAQG

SEQ ID NO: 3056476 - protein, 9 aa, Giardia lamblia
KIQDSDGRT

SEQ ID NO: 3056477 - protein, 7 aa, Giardia lamblia
KIQGRKS

SEQ ID NO: 3056478 - protein, 13 aa, Giardia lamblia
KIRQETKAIRPGN

SEQ ID NO: 3056479 - protein, 5 aa, Giardia lamblia
KIRRK

SEQ ID NO: 3056480 - protein, 6 aa, Giardia lamblia
KISEEM

SEQ ID NO: 3056481 - protein, 5 aa, Giardia lamblia
KIYSD

SEQ ID NO: 3056482 - protein, 7 aa, Giardia lamblia
KKAADYD

SEQ ID NO: 3056483 - protein, 9 aa, Giardia lamblia
KKADSDKSI

SEQ ID NO: 3056484 - protein, 6 aa, Giardia lamblia
KKAQGV

SEQ ID NO: 3056485 - protein, 13 aa, Giardia lamblia
KKASGAATGGCVD

SEQ ID NO: 3056486 - protein, 34 aa, Giardia lamblia
KKASKAQQQDEGDSDGIENDSASDIPVHFAERIF

SEQ ID NO: 3056487 - protein, 14 aa, Giardia lamblia
KKAVEDTLSQTRQD

SEQ ID NO: 3056488 - protein, 11 aa, Giardia lamblia
KKDAPPGHPDN

SEQ ID NO: 3056489 - protein, 8 aa, Giardia lamblia
KKDASGGM

SEQ ID NO: 3056490 - protein, 6 aa, Giardia lamblia
KKDDRL

SEQ ID NO: 3056491 - protein, 23 aa, Giardia lamblia
KKDEADELRREQESYSNLETETQ

SEQ ID NO: 3056492 - protein, 6 aa, Giardia lamblia
KKDETK

SEQ ID NO: 3056493 - protein, 5 aa, Giardia lamblia
KKDNT

SEQ ID NO: 3056494 - protein, 7 aa, Giardia lamblia
KKDQSLC

SEQ ID NO: 3056495 - protein, 14 aa, Giardia lamblia
KKDRSRKSENTSLH

SEQ ID NO: 3056496 - protein, 6 aa, Giardia lamblia
KKDSGA

SEQ ID NO: 3056497 - protein, 7 aa, Giardia lamblia
KKDSPIH

SEQ ID NO: 3056498 - protein, 27 aa, Giardia lamblia
KKDTDGPLSNCNNENSSIPTENQQSQQ

SEQ ID NO: 3056499 - protein, 9 aa, Giardia lamblia
KKDTPLTKT

SEQ ID NO: 3056500 - protein, 5 aa, Giardia lamblia
KKEAR

SEQ ID NO: 3056501 - protein, 7 aa, Giardia lamblia
KKECEKE

SEQ ID NO: 3056502 - protein, 7 aa, Giardia lamblia
KKEDIEK

SEQ ID NO: 3056503 - protein, 9 aa, Giardia lamblia
KKEGTTSYG

SEQ ID NO: 3056504 - protein, 13 aa, Giardia lamblia
KKEGVNSQQEEAL

SEQ ID NO: 3056505 - protein, 8 aa, Giardia lamblia
KKEKPGGL

SEQ ID NO: 3056506 - protein, 7 aa, Giardia lamblia
KKEKSVV

SEQ ID NO: 3056507 - protein, 6 aa, Giardia lamblia
KKENAL

SEQ ID NO: 3056508 - protein, 8 aa, Giardia lamblia
KKENGGVL

SEQ ID NO: 3056509 - protein, 8 aa, Giardia lamblia
KKEQNPDI

SEQ ID NO: 3056510 - protein, 21 aa, Giardia lamblia
KKEREEKELKRQIKEAKRRGK

SEQ ID NO: 3056511 - protein, 7 aa, Giardia lamblia
KKETEKA

SEQ ID NO: 3056512 - protein, 7 aa, Giardia lamblia
KKEYKTT

SEQ ID NO: 3056513 - protein, 6 aa, Giardia lamblia
KKFAQT

SEQ ID NO: 3056514 - protein, 6 aa, Giardia lamblia
KKFSRG

SEQ ID NO: 3056515 - protein, 6 aa, Giardia lamblia
KKGAAT

SEQ ID NO: 3056516 - protein, 15 aa, Giardia lamblia
KKGDKRAADNKAHAM

SEQ ID NO: 3056517 - protein, 5 aa, Giardia lamblia
KKGDP

SEQ ID NO: 3056518 - protein, 7 aa, Giardia lamblia
KKGEPIP

SEQ ID NO: 3056519 - protein, 5 aa, Giardia lamblia
KKGGG

SEQ ID NO: 3056520 - protein, 8 aa, Giardia lamblia
KKGGPPIQ

SEQ ID NO: 3056521 - protein, 6 aa, Giardia lamblia
KKGMAK

SEQ ID NO: 3056522 - protein, 19 aa, Giardia lamblia
KKGQAAQKGRRGKSYSGRK

SEQ ID NO: 3056523 - protein, 19 aa, Giardia lamblia
KKGQGDLKRHKSKHASTSR

SEQ ID NO: 3056524 - protein, 7 aa, Giardia lamblia
KKGQREA

SEQ ID NO: 3056525 - protein, 8 aa, Giardia lamblia
KKGRAKLS

SEQ ID NO: 3056526 - protein, 9 aa, Giardia lamblia
KKGSPVPVS

SEQ ID NO: 3056527 - protein, 6 aa, Giardia lamblia
KKGSTL

SEQ ID NO: 3056528 - protein, 7 aa, Giardia lamblia
KKGTDPQ

SEQ ID NO: 3056529 - protein, 13 aa, Giardia lamblia
KKGTKVNGKRVSD

SEQ ID NO: 3056530 - protein, 7 aa, Giardia lamblia
KKHGDRS

SEQ ID NO: 3056531 - protein, 8 aa, Giardia lamblia
KKHGKKID

SEQ ID NO: 3056532 - protein, 9 aa, Giardia lamblia
KKHSNDSSD

SEQ ID NO: 3056533 - protein, 5 aa, Giardia lamblia
KKITK

SEQ ID NO: 3056534 - protein, 10 aa, Giardia lamblia
KKKDGNEGYE

SEQ ID NO: 3056535 - protein, 10 aa, Giardia lamblia
KKKDKSGGYK

SEQ ID NO: 3056536 - protein, 7 aa, Giardia lamblia
KKKEVDD

SEQ ID NO: 3056537 - protein, 18 aa, Giardia lamblia
KKKGSSSNSGAAATDEYE

SEQ ID NO: 3056538 - protein, 11 aa, Giardia lamblia
KKKIQATYEPT

SEQ ID NO: 3056539 - protein, 14 aa, Giardia lamblia
KKKLDKKAREKPST

SEQ ID NO: 3056540 - protein, 42 aa, Giardia lamblia
KKKRTPKKSPPKTAKRDSESTDPKQSPKKASAVNKPAQEKRK

SEQ ID NO: 3056541 - protein, 17 aa, Giardia lamblia
KKKSASFERSRSLVISK

SEQ ID NO: 3056542 - protein, 8 aa, Giardia lamblia
KKKVSTLP

SEQ ID NO: 3056543 - protein, 15 aa, Giardia lamblia
KKLEHDKASNPPIKT

SEQ ID NO: 3056544 - protein, 7 aa, Giardia lamblia
KKLRPDV

SEQ ID NO: 3056545 - protein, 6 aa, Giardia lamblia
KKLRSE

SEQ ID NO: 3056546 - protein, 9 aa, Giardia lamblia
KKLSEKALA

SEQ ID NO: 3056547 - protein, 35 aa, Giardia lamblia
KKNSKQKNGGKPDATDPPSSVEMSPATGTLSIPTI

SEQ ID NO: 3056548 - protein, 9 aa, Giardia lamblia
KKPDNTNRK

SEQ ID NO: 3056549 - protein, 8 aa, Giardia lamblia
KKPETNIK

SEQ ID NO: 3056550 - protein, 8 aa, Giardia lamblia
KKPGASKY

SEQ ID NO: 3056551 - protein, 10 aa, Giardia lamblia
KKPKSKSGKL

SEQ ID NO: 3056552 - protein, 7 aa, Giardia lamblia
KKPLALD

SEQ ID NO: 3056553 - protein, 6 aa, Giardia lamblia
KKPQSL

SEQ ID NO: 3056554 - protein, 9 aa, Giardia lamblia
KKPVERRKD

SEQ ID NO: 3056555 - protein, 12 aa, Giardia lamblia
KKPVGCTDPPVP

SEQ ID NO: 3056556 - protein, 5 aa, Giardia lamblia
KKQID

SEQ ID NO: 3056557 - protein, 11 aa, Giardia lamblia
KKQQEKEQSLT

SEQ ID NO: 3056558 - protein, 7 aa, Giardia lamblia
KKQTANP

SEQ ID NO: 3056559 - protein, 5 aa, Giardia lamblia
KKQVS

SEQ ID NO: 3056560 - protein, 5 aa, Giardia lamblia
KKRAE

SEQ ID NO: 3056561 - protein, 6 aa, Giardia lamblia
KKRAEI

SEQ ID NO: 3056562 - protein, 9 aa, Giardia lamblia
KKRSSEALV

SEQ ID NO: 3056563 - protein, 29 aa, Giardia lamblia
KKSDSGAKVEDTNADVAEAIEDSHSDPNL

SEQ ID NO: 3056564 - protein, 4 aa, Giardia lamblia
KKSI

SEQ ID NO: 3056565 - protein, 7 aa, Giardia lamblia
KKSLLQG

SEQ ID NO: 3056566 - protein, 6 aa, Giardia lamblia
KKSLPD

SEQ ID NO: 3056567 - protein, 9 aa, Giardia lamblia
KKSMSSKLT

SEQ ID NO: 3056568 - protein, 4 aa, Giardia lamblia
KKSP

SEQ ID NO: 3056569 - protein, 14 aa, Giardia lamblia
KKSRPPPGTAQRGA

SEQ ID NO: 3056570 - protein, 9 aa, Giardia lamblia
KKSSELGSV

SEQ ID NO: 3056571 - protein, 7 aa, Giardia lamblia
KKSSKRI

SEQ ID NO: 3056572 - protein, 5 aa, Giardia lamblia
KKSSL

SEQ ID NO: 3056573 - protein, 7 aa, Giardia lamblia
KKSYDAF

SEQ ID NO: 3056574 - protein, 7 aa, Giardia lamblia
KKTGQLR

SEQ ID NO: 3056575 - protein, 6 aa, Giardia lamblia
KKTINP

SEQ ID NO: 3056576 - protein, 6 aa, Giardia lamblia
KKTLSE

SEQ ID NO: 3056577 - protein, 40 aa, Giardia lamblia
KKTTQDSKVDSRDLSSSTCTTEDTNLHGSSSTDSIRSSTD

SEQ ID NO: 3056578 - protein, 5 aa, Giardia lamblia
KKVAA

SEQ ID NO: 3056579 - protein, 11 aa, Giardia lamblia
KKVETGEPKHL

SEQ ID NO: 3056580 - protein, 20 aa, Giardia lamblia
KKVPNLNTGTTNGTTPTGIK

SEQ ID NO: 3056581 - protein, 6 aa, Giardia lamblia
KKVQPG

SEQ ID NO: 3056582 - protein, 6 aa, Giardia lamblia
KKYAHK

SEQ ID NO: 3056583 - protein, 7 aa, Giardia lamblia
KKYHGPS

SEQ ID NO: 3056584 - protein, 14 aa, Giardia lamblia
KKYQNATLSTSGQR

SEQ ID NO: 3056585 - protein, 10 aa, Giardia lamblia
KKYTSDPNFT

SEQ ID NO: 3056586 - protein, 9 aa, Giardia lamblia
KKYTTSSDF

SEQ ID NO: 3056587 - protein, 5 aa, Giardia lamblia
KLADA

SEQ ID NO: 3056588 - protein, 15 aa, Giardia lamblia
KLAEGATSTGIPTTG

SEQ ID NO: 3056589 - protein, 9 aa, Giardia lamblia
KLAGPGAPK

SEQ ID NO: 3056590 - protein, 17 aa, Giardia lamblia
KLAQSSSGMNTSSPQIN

SEQ ID NO: 3056591 - protein, 5 aa, Giardia lamblia
KLDGA

SEQ ID NO: 3056592 - protein, 13 aa, Giardia lamblia
KLDVTGSATIPSI

SEQ ID NO: 3056593 - protein, 11 aa, Giardia lamblia
KLEDTDPATEE

SEQ ID NO: 3056594 - protein, 6 aa, Giardia lamblia
KLEHRE

SEQ ID NO: 3056595 - protein, 8 aa, Giardia lamblia
KLENNASD

SEQ ID NO: 3056596 - protein, 5 aa, Giardia lamblia
KLGDP

SEQ ID NO: 3056597 - protein, 4 aa, Giardia lamblia
KLGH

SEQ ID NO: 3056598 - protein, 8 aa, Giardia lamblia
KLGPGDAK

SEQ ID NO: 3056599 - protein, 8 aa, Giardia lamblia
KLGPSKSG

SEQ ID NO: 3056600 - protein, 15 aa, Giardia lamblia
KLGSKSKKDMAKGTR

SEQ ID NO: 3056601 - protein, 5 aa, Giardia lamblia
KLKGY

SEQ ID NO: 3056602 - protein, 10 aa, Giardia lamblia
KLKGYAQQIP

SEQ ID NO: 3056603 - protein, 8 aa, Giardia lamblia
KLKSTTKM

SEQ ID NO: 3056604 - protein, 8 aa, Giardia lamblia
KLNEDEAA

SEQ ID NO: 3056605 - protein, 7 aa, Giardia lamblia
KLNNSIT

SEQ ID NO: 3056606 - protein, 8 aa, Giardia lamblia
KLPADTYS

SEQ ID NO: 3056607 - protein, 7 aa, Giardia lamblia
KLPDSEL

SEQ ID NO: 3056608 - protein, 5 aa, Giardia lamblia
KLPKK

SEQ ID NO: 3056609 - protein, 4 aa, Giardia lamblia
KLPN

SEQ ID NO: 3056610 - protein, 4 aa, Giardia lamblia
KLPP

SEQ ID NO: 3056611 - protein, 8 aa, Giardia lamblia
KLPPQSPY

SEQ ID NO: 3056612 - protein, 9 aa, Giardia lamblia
KLQKETSQT

SEQ ID NO: 3056613 - protein, 7 aa, Giardia lamblia
KLREGTG

SEQ ID NO: 3056614 - protein, 13 aa, Giardia lamblia
KLRGRRTKHITTG

SEQ ID NO: 3056615 - protein, 40 aa, Giardia lamblia
KLRQPTQDASPHGRGQGCSRGRGSDDSDGSYIPQARSSMQ

SEQ ID NO: 3056616 - protein, 7 aa, Giardia lamblia
KLRTQLP

SEQ ID NO: 3056617 - protein, 10 aa, Giardia lamblia
KLSDKSSKVI

SEQ ID NO: 3056618 - protein, 6 aa, Giardia lamblia
KLSEEE

SEQ ID NO: 3056619 - protein, 6 aa, Giardia lamblia
KLSGSA

SEQ ID NO: 3056620 - protein, 10 aa, Giardia lamblia
KLSKGRISHQ

SEQ ID NO: 3056621 - protein, 6 aa, Giardia lamblia
KLSKND

SEQ ID NO: 3056622 - protein, 7 aa, Giardia lamblia
KLSKSDP

SEQ ID NO: 3056623 - protein, 25 aa, Giardia lamblia
KLSPEEADAPAQDVEGSRARPSEGE

SEQ ID NO: 3056624 - protein, 8 aa, Giardia lamblia
KLSPTDET

SEQ ID NO: 3056625 - protein, 10 aa, Giardia lamblia
KLSRGEQSGC

SEQ ID NO: 3056626 - protein, 9 aa, Giardia lamblia
KLSRNERTA

SEQ ID NO: 3056627 - protein, 6 aa, Giardia lamblia
KLSSDS

SEQ ID NO: 3056628 - protein, 8 aa, Giardia lamblia
KLSSKGVT

SEQ ID NO: 3056629 - protein, 10 aa, Giardia lamblia
KLSSKTQLEG

SEQ ID NO: 3056630 - protein, 9 aa, Giardia lamblia
KLSSNASLK

SEQ ID NO: 3056631 - protein, 6 aa, Giardia lamblia
KLSSST

SEQ ID NO: 3056632 - protein, 21 aa, Giardia lamblia
KLSTRSHDSVASISDTSVTTR

SEQ ID NO: 3056633 - protein, 13 aa, Giardia lamblia
KLSTTDSSGPMNR

SEQ ID NO: 3056634 - protein, 4 aa, Giardia lamblia
KLTA

SEQ ID NO: 3056635 - protein, 12 aa, Giardia lamblia
KLTEKNVQRSSG

SEQ ID NO: 3056636 - protein, 6 aa, Giardia lamblia
KLTETK

SEQ ID NO: 3056637 - protein, 6 aa, Giardia lamblia
KLTKQE

SEQ ID NO: 3056638 - protein, 9 aa, Giardia lamblia
KLTPPSDED

SEQ ID NO: 3056639 - protein, 6 aa, Giardia lamblia
KLTSRD

SEQ ID NO: 3056640 - protein, 69 aa, Giardia lamblia
KLTSVKGLTSTGNTPGPISRPITRPPPRAQSQPKNAYQSSSHRGSLSTHEPDNLSSRTTGSVSGSGVVG

SEQ ID NO: 3056641 - protein, 12 aa, Giardia lamblia
KMANQQAKTTRL

SEQ ID NO: 3056642 - protein, 10 aa, Giardia lamblia
KMENDEQSNL

SEQ ID NO: 3056643 - protein, 8 aa, Giardia lamblia
KMKDASSK

SEQ ID NO: 3056644 - protein, 18 aa, Giardia lamblia
KMKNKKDSYGRASSDVYT

SEQ ID NO: 3056645 - protein, 7 aa, Giardia lamblia
KMKPNDH

SEQ ID NO: 3056646 - protein, 4 aa, Giardia lamblia
KMNP

SEQ ID NO: 3056647 - protein, 7 aa, Giardia lamblia
KMPKTNS

SEQ ID NO: 3056648 - protein, 8 aa, Giardia lamblia
KMRDKEKL

SEQ ID NO: 3056649 - protein, 11 aa, Giardia lamblia
KMRSSSRASFH

SEQ ID NO: 3056650 - protein, 5 aa, Giardia lamblia
KMSGN

SEQ ID NO: 3056651 - protein, 5 aa, Giardia lamblia
KMSTS

SEQ ID NO: 3056652 - protein, 7 aa, Giardia lamblia
KMTNEEL

SEQ ID NO: 3056653 - protein, 5 aa, Giardia lamblia
KNAAQ

SEQ ID NO: 3056654 - protein, 4 aa, Giardia lamblia
KNAD

SEQ ID NO: 3056655 - protein, 8 aa, Giardia lamblia
KNADYQKI

SEQ ID NO: 3056656 - protein, 9 aa, Giardia lamblia
KNANPQTKL

SEQ ID NO: 3056657 - protein, 13 aa, Giardia lamblia
KNASISEASITTG

SEQ ID NO: 3056658 - protein, 10 aa, Giardia lamblia
KNASPATVSR

SEQ ID NO: 3056659 - protein, 6 aa, Giardia lamblia
KNATRD

SEQ ID NO: 3056660 - protein, 8 aa, Giardia lamblia
KNDETNPT

SEQ ID NO: 3056661 - protein, 7 aa, Giardia lamblia
KNDKALQ

SEQ ID NO: 3056662 - protein, 4 aa, Giardia lamblia
KNDL

SEQ ID NO: 3056663 - protein, 5 aa, Giardia lamblia
KNDSL

SEQ ID NO: 3056664 - protein, 15 aa, Giardia lamblia
KNDSYISSPYSHASN

SEQ ID NO: 3056665 - protein, 8 aa, Giardia lamblia
KNDTEPTF

SEQ ID NO: 3056666 - protein, 11 aa, Giardia lamblia
KNELKYSPKRG

SEQ ID NO: 3056667 - protein, 8 aa, Giardia lamblia
KNEQPPFT

SEQ ID NO: 3056668 - protein, 6 aa, Giardia lamblia
KNETYK

SEQ ID NO: 3056669 - protein, 5 aa, Giardia lamblia
KNFPD

SEQ ID NO: 3056670 - protein, 10 aa, Giardia lamblia
KNFRSNVPEG

SEQ ID NO: 3056671 - protein, 9 aa, Giardia lamblia
KNGDNTGSY

SEQ ID NO: 3056672 - protein, 8 aa, Giardia lamblia
KNGGADEI

SEQ ID NO: 3056673 - protein, 18 aa, Giardia lamblia
KNGNGGNTSFSNAVGGYS

SEQ ID NO: 3056674 - protein, 16 aa, Giardia lamblia
KNGQCSSYNGATCDEG

SEQ ID NO: 3056675 - protein, 20 aa, Giardia lamblia
KNGQPSDVCGGEDDTLRATK

SEQ ID NO: 3056676 - protein, 5 aa, Giardia lamblia
KNGRT

SEQ ID NO: 3056677 - protein, 10 aa, Giardia lamblia
KNGSTIADSY

SEQ ID NO: 3056678 - protein, 8 aa, Giardia lamblia
KNGTDEEK

SEQ ID NO: 3056679 - protein, 7 aa, Giardia lamblia
KNGTGVY

SEQ ID NO: 3056680 - protein, 8 aa, Giardia lamblia
KNGVGYPT

SEQ ID NO: 3056681 - protein, 11 aa, Giardia lamblia
KNIEGQQEPYN

SEQ ID NO: 3056682 - protein, 11 aa, Giardia lamblia
KNIKGEQEQYN

SEQ ID NO: 3056683 - protein, 6 aa, Giardia lamblia
KNINPE

SEQ ID NO: 3056684 - protein, 7 aa, Giardia lamblia
KNKNNAG

SEQ ID NO: 3056685 - protein, 21 aa, Giardia lamblia
KNKNRRKQKRKGKTAFPKKAL

SEQ ID NO: 3056686 - protein, 6 aa, Giardia lamblia
KNKPPK

SEQ ID NO: 3056687 - protein, 14 aa, Giardia lamblia
KNKRVTALRQGPND

SEQ ID NO: 3056688 - protein, 9 aa, Giardia lamblia
KNKTGASPM

SEQ ID NO: 3056689 - protein, 6 aa, Giardia lamblia
KNLGDS

SEQ ID NO: 3056690 - protein, 6 aa, Giardia lamblia
KNLGNA

SEQ ID NO: 3056691 - protein, 8 aa, Giardia lamblia
KNLPGQNG

SEQ ID NO: 3056692 - protein, 8 aa, Giardia lamblia
KNLPNKTA

SEQ ID NO: 3056693 - protein, 6 aa, Giardia lamblia
KNLRPN

SEQ ID NO: 3056694 - protein, 7 aa, Giardia lamblia
KNNDSDH

SEQ ID NO: 3056695 - protein, 15 aa, Giardia lamblia
KNNDSSSVSVDKSSQ

SEQ ID NO: 3056696 - protein, 7 aa, Giardia lamblia
KNNEVES

SEQ ID NO: 3056697 - protein, 8 aa, Giardia lamblia
KNNGDVDS

SEQ ID NO: 3056698 - protein, 5 aa, Giardia lamblia
KNNGK

SEQ ID NO: 3056699 - protein, 16 aa, Giardia lamblia
KNNHADASVSLDTSTG

SEQ ID NO: 3056700 - protein, 4 aa, Giardia lamblia
KNNK

SEQ ID NO: 3056701 - protein, 7 aa, Giardia lamblia
KNNLNSL

SEQ ID NO: 3056702 - protein, 6 aa, Giardia lamblia
KNNLTE

SEQ ID NO: 3056703 - protein, 5 aa, Giardia lamblia
KNNNT

SEQ ID NO: 3056704 - protein, 7 aa, Giardia lamblia
KNNRNKA

SEQ ID NO: 3056705 - protein, 5 aa, Giardia lamblia
KNNSP

SEQ ID NO: 3056706 - protein, 16 aa, Giardia lamblia
KNNSQTPGIASGGVQR

SEQ ID NO: 3056707 - protein, 7 aa, Giardia lamblia
KNNSTEL

SEQ ID NO: 3056708 - protein, 4 aa, Giardia lamblia
KNNY

SEQ ID NO: 3056709 - protein, 4 aa, Giardia lamblia
KNPA

SEQ ID NO: 3056710 - protein, 5 aa, Giardia lamblia
KNPER

SEQ ID NO: 3056711 - protein, 7 aa, Giardia lamblia
KNPETPA

SEQ ID NO: 3056712 - protein, 5 aa, Giardia lamblia
KNPGI

SEQ ID NO: 3056713 - protein, 6 aa, Giardia lamblia
KNPKFE

SEQ ID NO: 3056714 - protein, 5 aa, Giardia lamblia
KNPKG

SEQ ID NO: 3056715 - protein, 6 aa, Giardia lamblia
KNPLTT

SEQ ID NO: 3056716 - protein, 7 aa, Giardia lamblia
KNPNSAV

SEQ ID NO: 3056717 - protein, 6 aa, Giardia lamblia
KNPRPQ

SEQ ID NO: 3056718 - protein, 7 aa, Giardia lamblia
KNPRSTG

SEQ ID NO: 3056719 - protein, 10 aa, Giardia lamblia
KNPSAGPSAT

SEQ ID NO: 3056720 - protein, 43 aa, Giardia lamblia
KNPYGVERTPGERKDSTASAPSTGSSKLDGKSQTEKSKTTLTV

SEQ ID NO: 3056721 - protein, 6 aa, Giardia lamblia
KNQHPT

SEQ ID NO: 3056722 - protein, 6 aa, Giardia lamblia
KNQKPE

SEQ ID NO: 3056723 - protein, 7 aa, Giardia lamblia
KNQNAPI

SEQ ID NO: 3056724 - protein, 6 aa, Giardia lamblia
KNQQDE

SEQ ID NO: 3056725 - protein, 17 aa, Giardia lamblia
KNQVSDETSENGKNNDL

SEQ ID NO: 3056726 - protein, 8 aa, Giardia lamblia
KNREPGID

SEQ ID NO: 3056727 - protein, 6 aa, Giardia lamblia
KNRERD

SEQ ID NO: 3056728 - protein, 15 aa, Giardia lamblia
KNRPRVTEKTDAPMP

SEQ ID NO: 3056729 - protein, 9 aa, Giardia lamblia
KNRRKPVAL

SEQ ID NO: 3056730 - protein, 10 aa, Giardia lamblia
KNRRTRAYGS

SEQ ID NO: 3056731 - protein, 6 aa, Giardia lamblia
KNRTRL

SEQ ID NO: 3056732 - protein, 7 aa, Giardia lamblia
KNRTSEL

SEQ ID NO: 3056733 - protein, 4 aa, Giardia lamblia
KNSA

SEQ ID NO: 3056734 - protein, 14 aa, Giardia lamblia
KNSASSSEEMQQPS

SEQ ID NO: 3056735 - protein, 6 aa, Giardia lamblia
KNSDTV

SEQ ID NO: 3056736 - protein, 4 aa, Giardia lamblia
KNSF

SEQ ID NO: 3056737 - protein, 17 aa, Giardia lamblia
KNSGSLNREPSLFRPLS

SEQ ID NO: 3056738 - protein, 9 aa, Giardia lamblia
KNSIGQHSY

SEQ ID NO: 3056739 - protein, 8 aa, Giardia lamblia
KNSKIDQT

SEQ ID NO: 3056740 - protein, 8 aa, Giardia lamblia
KNSLQSEA

SEQ ID NO: 3056741 - protein, 6 aa, Giardia lamblia
KNSPEK

SEQ ID NO: 3056742 - protein, 8 aa, Giardia lamblia
KNSQGQVG

SEQ ID NO: 3056743 - protein, 6 aa, Giardia lamblia
KNSRRL

SEQ ID NO: 3056744 - protein, 4 aa, Giardia lamblia
KNSY

SEQ ID NO: 3056745 - protein, 9 aa, Giardia lamblia
KNTDEAAAS

SEQ ID NO: 3056746 - protein, 7 aa, Giardia lamblia
KNTDEKK

SEQ ID NO: 3056747 - protein, 9 aa, Giardia lamblia
KNTHAKDSL

SEQ ID NO: 3056748 - protein, 7 aa, Giardia lamblia
KNTIDSS

SEQ ID NO: 3056749 - protein, 8 aa, Giardia lamblia
KNTRTYTT

SEQ ID NO: 3056750 - protein, 7 aa, Giardia lamblia
KNTSLKK

SEQ ID NO: 3056751 - protein, 8 aa, Giardia lamblia
KNTYKEHA

SEQ ID NO: 3056752 - protein, 8 aa, Giardia lamblia
KNVGGESA

SEQ ID NO: 3056753 - protein, 6 aa, Giardia lamblia
KNYDPI

SEQ ID NO: 3056754 - protein, 11 aa, Giardia lamblia
KNYPPPPSDFD

SEQ ID NO: 3056755 - protein, 8 aa, Giardia lamblia
KPAAAANL

SEQ ID NO: 3056756 - protein, 7 aa, Giardia lamblia
KPADPPW

SEQ ID NO: 3056757 - protein, 16 aa, Giardia lamblia
KPALQKSTGSIKGDSF

SEQ ID NO: 3056758 - protein, 6 aa, Giardia lamblia
KPAPLR

SEQ ID NO: 3056759 - protein, 8 aa, Giardia lamblia
KPASTTHE

SEQ ID NO: 3056760 - protein, 17 aa, Giardia lamblia
KPATEKLSTSATGRSIE

SEQ ID NO: 3056761 - protein, 12 aa, Giardia lamblia
KPATGNLDLTDS

SEQ ID NO: 3056762 - protein, 10 aa, Giardia lamblia
KPCKKFSGGM

SEQ ID NO: 3056763 - protein, 6 aa, Giardia lamblia
KPDDNA

SEQ ID NO: 3056764 - protein, 8 aa, Giardia lamblia
KPDGQSKK

SEQ ID NO: 3056765 - protein, 7 aa, Giardia lamblia
KPDWDSA

SEQ ID NO: 3056766 - protein, 5 aa, Giardia lamblia
KPEAE

SEQ ID NO: 3056767 - protein, 8 aa, Giardia lamblia
KPEEKGRD

SEQ ID NO: 3056768 - protein, 4 aa, Giardia lamblia
KPEF

SEQ ID NO: 3056769 - protein, 5 aa, Giardia lamblia
KPEFK

SEQ ID NO: 3056770 - protein, 14 aa, Giardia lamblia
KPEGSEVHSSSREL

SEQ ID NO: 3056771 - protein, 4 aa, Giardia lamblia
KPEN

SEQ ID NO: 3056772 - protein, 6 aa, Giardia lamblia
KPENDE

SEQ ID NO: 3056773 - protein, 6 aa, Giardia lamblia
KPFEDA

SEQ ID NO: 3056774 - protein, 4 aa, Giardia lamblia
KPFK

SEQ ID NO: 3056775 - protein, 9 aa, Giardia lamblia
KPGAGGQSY

SEQ ID NO: 3056776 - protein, 32 aa, Giardia lamblia
KPGAKSKAGAAREDEHIDNQEGDKSLSCTEEA

SEQ ID NO: 3056777 - protein, 22 aa, Giardia lamblia
KPGEDASVKKRDPKKDPPPPLN

SEQ ID NO: 3056778 - protein, 7 aa, Giardia lamblia
KPGNEEK

SEQ ID NO: 3056779 - protein, 9 aa, Giardia lamblia
KPGRKFSTS

SEQ ID NO: 3056780 - protein, 5 aa, Giardia lamblia
KPGTP

SEQ ID NO: 3056781 - protein, 25 aa, Giardia lamblia
KPHDQKGNGHTEHQSTKSRSSAVSG

SEQ ID NO: 3056782 - protein, 10 aa, Giardia lamblia
KPHKNSPFAP

SEQ ID NO: 3056783 - protein, 6 aa, Giardia lamblia
KPHSEE

SEQ ID NO: 3056784 - protein, 8 aa, Giardia lamblia
KPHTPEEK

SEQ ID NO: 3056785 - protein, 11 aa, Giardia lamblia
KPIAGNKCDGI

SEQ ID NO: 3056786 - protein, 17 aa, Giardia lamblia
KPIKSSYYSDSSDEDDF

SEQ ID NO: 3056787 - protein, 4 aa, Giardia lamblia
KPIP

SEQ ID NO: 3056788 - protein, 16 aa, Giardia lamblia
KPISLSSPDSAKPDAH

SEQ ID NO: 3056789 - protein, 17 aa, Giardia lamblia
KPKDTHTSKLSAKSQGL

SEQ ID NO: 3056790 - protein, 6 aa, Giardia lamblia
KPKDYR

SEQ ID NO: 3056791 - protein, 4 aa, Giardia lamblia
KPKM

SEQ ID NO: 3056792 - protein, 9 aa, Giardia lamblia
KPKNSTEPF

SEQ ID NO: 3056793 - protein, 8 aa, Giardia lamblia
KPKVNPNK

SEQ ID NO: 3056794 - protein, 11 aa, Giardia lamblia
KPLPPPDGNTF

SEQ ID NO: 3056795 - protein, 5 aa, Giardia lamblia
KPLRQ

SEQ ID NO: 3056796 - protein, 5 aa, Giardia lamblia
KPLSG

SEQ ID NO: 3056797 - protein, 8 aa, Giardia lamblia
KPMDNTSE

SEQ ID NO: 3056798 - protein, 6 aa, Giardia lamblia
KPNSDW

SEQ ID NO: 3056799 - protein, 13 aa, Giardia lamblia
KPPAEDSEHRDSW

SEQ ID NO: 3056800 - protein, 7 aa, Giardia lamblia
KPPAPYE

SEQ ID NO: 3056801 - protein, 22 aa, Giardia lamblia
KPPGIQATPEGMPAAKATTSPA

SEQ ID NO: 3056802 - protein, 4 aa, Giardia lamblia
KPPK

SEQ ID NO: 3056803 - protein, 5 aa, Giardia lamblia
KPPPF

SEQ ID NO: 3056804 - protein, 15 aa, Giardia lamblia
KPPPLLPPSKDLSQP

SEQ ID NO: 3056805 - protein, 4 aa, Giardia lamblia
KPPQ

SEQ ID NO: 3056806 - protein, 6 aa, Giardia lamblia
KPPRSL

SEQ ID NO: 3056807 - protein, 5 aa, Giardia lamblia
KPPSI

SEQ ID NO: 3056808 - protein, 25 aa, Giardia lamblia
KPPTSVGSGQDTAPEEPKLKRTRAK

SEQ ID NO: 3056809 - protein, 10 aa, Giardia lamblia
KPQAMSENKI

SEQ ID NO: 3056810 - protein, 7 aa, Giardia lamblia
KPQGTTY

SEQ ID NO: 3056811 - protein, 18 aa, Giardia lamblia
KPQPATPDASRCSSQTDR

SEQ ID NO: 3056812 - protein, 11 aa, Giardia lamblia
KPRKGLAAKGV

SEQ ID NO: 3056813 - protein, 10 aa, Giardia lamblia
KPRRPADPSI

SEQ ID NO: 3056814 - protein, 6 aa, Giardia lamblia
KPSAAM

SEQ ID NO: 3056815 - protein, 13 aa, Giardia lamblia
KPSALGATKERRW

SEQ ID NO: 3056816 - protein, 13 aa, Giardia lamblia
KPSGGNRSGLNKE

SEQ ID NO: 3056817 - protein, 11 aa, Giardia lamblia
KPSKIPTPTFT

SEQ ID NO: 3056818 - protein, 31 aa, Giardia lamblia
KPSLNSLNDEKTNVANRKPKRKDSKKPQFSS

SEQ ID NO: 3056819 - protein, 14 aa, Giardia lamblia
KPSLQGQPSLSLPR

SEQ ID NO: 3056820 - protein, 13 aa, Giardia lamblia
KPSQSSQNRSIEG

SEQ ID NO: 3056821 - protein, 6 aa, Giardia lamblia
KPSRLE

SEQ ID NO: 3056822 - protein, 9 aa, Giardia lamblia
KPSSTIRAY

SEQ ID NO: 3056823 - protein, 21 aa, Giardia lamblia
KPSTIPSSTRAGTMKDTASVD

SEQ ID NO: 3056824 - protein, 4 aa, Giardia lamblia
KPTA

SEQ ID NO: 3056825 - protein, 6 aa, Giardia lamblia
KPTANA

SEQ ID NO: 3056826 - protein, 9 aa, Giardia lamblia
KPTDPARQT

SEQ ID NO: 3056827 - protein, 6 aa, Giardia lamblia
KPTEKL

SEQ ID NO: 3056828 - protein, 16 aa, Giardia lamblia
KPTMSQTDKERREKPN

SEQ ID NO: 3056829 - protein, 6 aa, Giardia lamblia
KPTSNG

SEQ ID NO: 3056830 - protein, 6 aa, Giardia lamblia
KPTTET

SEQ ID NO: 3056831 - protein, 8 aa, Giardia lamblia
KPTTSTVE

SEQ ID NO: 3056832 - protein, 7 aa, Giardia lamblia
KPVEGTL

SEQ ID NO: 3056833 - protein, 5 aa, Giardia lamblia
KPVFT

SEQ ID NO: 3056834 - protein, 11 aa, Giardia lamblia
KPVPDKKYSSY

SEQ ID NO: 3056835 - protein, 6 aa, Giardia lamblia
KPVTGS

SEQ ID NO: 3056836 - protein, 4 aa, Giardia lamblia
KPYP

SEQ ID NO: 3056837 - protein, 5 aa, Giardia lamblia
KPYSK

SEQ ID NO: 3056838 - protein, 15 aa, Giardia lamblia
KPYTDLGGSSSTKIK

SEQ ID NO: 3056839 - protein, 5 aa, Giardia lamblia
KPYYS

SEQ ID NO: 3056840 - protein, 7 aa, Giardia lamblia
KQAGEKE

SEQ ID NO: 3056841 - protein, 17 aa, Giardia lamblia
KQAPGGEGGLYSASGAT

SEQ ID NO: 3056842 - protein, 10 aa, Giardia lamblia
KQASAQATFG

SEQ ID NO: 3056843 - protein, 8 aa, Giardia lamblia
KQASPKMR

SEQ ID NO: 3056844 - protein, 4 aa, Giardia lamblia
KQCK

SEQ ID NO: 3056845 - protein, 10 aa, Giardia lamblia
KQCSGGSQRR

SEQ ID NO: 3056846 - protein, 8 aa, Giardia lamblia
KQDECSEK

SEQ ID NO: 3056847 - protein, 8 aa, Giardia lamblia
KQDGEVPI

SEQ ID NO: 3056848 - protein, 10 aa, Giardia lamblia
KQDGSTDEQN

SEQ ID NO: 3056849 - protein, 9 aa, Giardia lamblia
KQDNTYPQG

SEQ ID NO: 3056850 - protein, 5 aa, Giardia lamblia
KQDSQ

SEQ ID NO: 3056851 - protein, 7 aa, Giardia lamblia
KQDSYGV

SEQ ID NO: 3056852 - protein, 7 aa, Giardia lamblia
KQDYSGD

SEQ ID NO: 3056853 - protein, 7 aa, Giardia lamblia
KQEALTR

SEQ ID NO: 3056854 - protein, 7 aa, Giardia lamblia
KQEAQGT

SEQ ID NO: 3056855 - protein, 23 aa, Giardia lamblia
KQEELNRAAEENGLTEIPQAKDK

SEQ ID NO: 3056856 - protein, 4 aa, Giardia lamblia
KQEL

SEQ ID NO: 3056857 - protein, 7 aa, Giardia lamblia
KQELPSD

SEQ ID NO: 3056858 - protein, 8 aa, Giardia lamblia
KQERKEQN

SEQ ID NO: 3056859 - protein, 7 aa, Giardia lamblia
KQESRTP

SEQ ID NO: 3056860 - protein, 15 aa, Giardia lamblia
KQETQRSQSSTSSHF

SEQ ID NO: 3056861 - protein, 7 aa, Giardia lamblia
KQGAASH

SEQ ID NO: 3056862 - protein, 5 aa, Giardia lamblia
KQGCS

SEQ ID NO: 3056863 - protein, 4 aa, Giardia lamblia
KQGE

SEQ ID NO: 3056864 - protein, 8 aa, Giardia lamblia
KQGEGGTD

SEQ ID NO: 3056865 - protein, 9 aa, Giardia lamblia
KQGPYESCS

SEQ ID NO: 3056866 - protein, 4 aa, Giardia lamblia
KQGV

SEQ ID NO: 3056867 - protein, 8 aa, Giardia lamblia
KQHDERGE

SEQ ID NO: 3056868 - protein, 7 aa, Giardia lamblia
KQHGDSA

SEQ ID NO: 3056869 - protein, 8 aa, Giardia lamblia
KQHNDPDC

SEQ ID NO: 3056870 - protein, 8 aa, Giardia lamblia
KQHSQTRN

SEQ ID NO: 3056871 - protein, 6 aa, Giardia lamblia
KQHVPS

SEQ ID NO: 3056872 - protein, 6 aa, Giardia lamblia
KQITEL

SEQ ID NO: 3056873 - protein, 4 aa, Giardia lamblia
KQKA

SEQ ID NO: 3056874 - protein, 12 aa, Giardia lamblia
KQKAKASKVATY

SEQ ID NO: 3056875 - protein, 23 aa, Giardia lamblia
KQKGDSAVTTSGCKKEDGTGLAE

SEQ ID NO: 3056876 - protein, 15 aa, Giardia lamblia
KQKKRGNAEEAARDV

SEQ ID NO: 3056877 - protein, 8 aa, Giardia lamblia
KQKTGDVT

SEQ ID NO: 3056878 - protein, 9 aa, Giardia lamblia
KQKTPEEVE

SEQ ID NO: 3056879 - protein, 8 aa, Giardia lamblia
KQKTVPKS

SEQ ID NO: 3056880 - protein, 6 aa, Giardia lamblia
KQLAKG

SEQ ID NO: 3056881 - protein, 18 aa, Giardia lamblia
KQLGSEVSTGSPHPEPFT

SEQ ID NO: 3056882 - protein, 6 aa, Giardia lamblia
KQLRAG

SEQ ID NO: 3056883 - protein, 7 aa, Giardia lamblia
KQNLEEL

SEQ ID NO: 3056884 - protein, 6 aa, Giardia lamblia
KQNNAT

SEQ ID NO: 3056885 - protein, 4 aa, Giardia lamblia
KQNS

SEQ ID NO: 3056886 - protein, 8 aa, Giardia lamblia
KQNTFSES

SEQ ID NO: 3056887 - protein, 4 aa, Giardia lamblia
KQNY

SEQ ID NO: 3056888 - protein, 11 aa, Giardia lamblia
KQPAGGAKEPL

SEQ ID NO: 3056889 - protein, 8 aa, Giardia lamblia
KQPAPHAG

SEQ ID NO: 3056890 - protein, 10 aa, Giardia lamblia
KQPEAISSTE

SEQ ID NO: 3056891 - protein, 7 aa, Giardia lamblia
KQPGGLD

SEQ ID NO: 3056892 - protein, 8 aa, Giardia lamblia
KQPGGLDA

SEQ ID NO: 3056893 - protein, 10 aa, Giardia lamblia
KQPGSSEPIS

SEQ ID NO: 3056894 - protein, 7 aa, Giardia lamblia
KQPHNST

SEQ ID NO: 3056895 - protein, 5 aa, Giardia lamblia
KQPPP

SEQ ID NO: 3056896 - protein, 7 aa, Giardia lamblia
KQPPSSL

SEQ ID NO: 3056897 - protein, 10 aa, Giardia lamblia
KQPQQPDNYA

SEQ ID NO: 3056898 - protein, 6 aa, Giardia lamblia
KQPTKF

SEQ ID NO: 3056899 - protein, 6 aa, Giardia lamblia
KQQGLT

SEQ ID NO: 3056900 - protein, 13 aa, Giardia lamblia
KQQRGVPNSYATM

SEQ ID NO: 3056901 - protein, 18 aa, Giardia lamblia
KQRESTSINKQLDEKNIT

SEQ ID NO: 3056902 - protein, 9 aa, Giardia lamblia
KQRKADNTT

SEQ ID NO: 3056903 - protein, 10 aa, Giardia lamblia
KQSDRHFSKD

SEQ ID NO: 3056904 - protein, 8 aa, Giardia lamblia
KQSGDNKA

SEQ ID NO: 3056905 - protein, 8 aa, Giardia lamblia
KQSLDGFT

SEQ ID NO: 3056906 - protein, 5 aa, Giardia lamblia
KQSQI

SEQ ID NO: 3056907 - protein, 8 aa, Giardia lamblia
KQSQIPQE

SEQ ID NO: 3056908 - protein, 6 aa, Giardia lamblia
KQSQNS

SEQ ID NO: 3056909 - protein, 13 aa, Giardia lamblia
KQSSILQSSNQSV

SEQ ID NO: 3056910 - protein, 6 aa, Giardia lamblia
KQSSRI

SEQ ID NO: 3056911 - protein, 7 aa, Giardia lamblia
KQSSSMD

SEQ ID NO: 3056912 - protein, 16 aa, Giardia lamblia
KQSTDGGSLPTPGDSI

SEQ ID NO: 3056913 - protein, 13 aa, Giardia lamblia
KQSTFTPKSQQSL

SEQ ID NO: 3056914 - protein, 7 aa, Giardia lamblia
KQTAAGM

SEQ ID NO: 3056915 - protein, 8 aa, Giardia lamblia
KQTEETRQ

SEQ ID NO: 3056916 - protein, 7 aa, Giardia lamblia
KQTGEPV

SEQ ID NO: 3056917 - protein, 23 aa, Giardia lamblia
KQTGSRSSSPAKSLSKPAALPKT

SEQ ID NO: 3056918 - protein, 5 aa, Giardia lamblia
KQTIT

SEQ ID NO: 3056919 - protein, 9 aa, Giardia lamblia
KQTMKKTTR

SEQ ID NO: 3056920 - protein, 7 aa, Giardia lamblia
KQTPTRI

SEQ ID NO: 3056921 - protein, 6 aa, Giardia lamblia
KQTRKG

SEQ ID NO: 3056922 - protein, 6 aa, Giardia lamblia
KQTSVG

SEQ ID NO: 3056923 - protein, 12 aa, Giardia lamblia
KQTTLDAARAAA

SEQ ID NO: 3056924 - protein, 5 aa, Giardia lamblia
KQTVK

SEQ ID NO: 3056925 - protein, 24 aa, Giardia lamblia
KQVQDTHSNEDKSNKRHHSTGTPD

SEQ ID NO: 3056926 - protein, 4 aa, Giardia lamblia
KQWY

SEQ ID NO: 3056927 - protein, 10 aa, Giardia lamblia
KRAAKDLSGG

SEQ ID NO: 3056928 - protein, 12 aa, Giardia lamblia
KRAAVDGASVGN

SEQ ID NO: 3056929 - protein, 10 aa, Giardia lamblia
KRACRKKERA

SEQ ID NO: 3056930 - protein, 17 aa, Giardia lamblia
KRAPRGPDGGYGFTPSS

SEQ ID NO: 3056931 - protein, 5 aa, Giardia lamblia
KRAQK

SEQ ID NO: 3056932 - protein, 12 aa, Giardia lamblia
KRARSRADRTPL

SEQ ID NO: 3056933 - protein, 11 aa, Giardia lamblia
KRASDAAETFT

SEQ ID NO: 3056934 - protein, 18 aa, Giardia lamblia
KRASSHEGIPASNKVTPR

SEQ ID NO: 3056935 - protein, 13 aa, Giardia lamblia
KRDAYKKAGITNA

SEQ ID NO: 3056936 - protein, 8 aa, Giardia lamblia
KRDGNSWA

SEQ ID NO: 3056937 - protein, 6 aa, Giardia lamblia
KRDHER

SEQ ID NO: 3056938 - protein, 9 aa, Giardia lamblia
KRDNLDPSL

SEQ ID NO: 3056939 - protein, 12 aa, Giardia lamblia
KRDNPQHQDTDK

SEQ ID NO: 3056940 - protein, 4 aa, Giardia lamblia
KRDP

SEQ ID NO: 3056941 - protein, 7 aa, Giardia lamblia
KRDQLQQ

SEQ ID NO: 3056942 - protein, 10 aa, Giardia lamblia
KRDRGAAAAD

SEQ ID NO: 3056943 - protein, 8 aa, Giardia lamblia
KRDSARRT

SEQ ID NO: 3056944 - protein, 9 aa, Giardia lamblia
KREDGNPEY

SEQ ID NO: 3056945 - protein, 5 aa, Giardia lamblia
KRERY

SEQ ID NO: 3056946 - protein, 6 aa, Giardia lamblia
KRESTT

SEQ ID NO: 3056947 - protein, 14 aa, Giardia lamblia
KREYQAARATRREL

SEQ ID NO: 3056948 - protein, 11 aa, Giardia lamblia
KRFSSQQDNFR

SEQ ID NO: 3056949 - protein, 25 aa, Giardia lamblia
KRGDGVALDSDPSTIPPASPGNDND

SEQ ID NO: 3056950 - protein, 13 aa, Giardia lamblia
KRGRDHGAEAEHK

SEQ ID NO: 3056951 - protein, 8 aa, Giardia lamblia
KRGRTDSV

SEQ ID NO: 3056952 - protein, 10 aa, Giardia lamblia
KRGSSSGSTC

SEQ ID NO: 3056953 - protein, 12 aa, Giardia lamblia
KRHASSGSHVTE

SEQ ID NO: 3056954 - protein, 7 aa, Giardia lamblia
KRHPTDR

SEQ ID NO: 3056955 - protein, 5 aa, Giardia lamblia
KRIAS

SEQ ID NO: 3056956 - protein, 7 aa, Giardia lamblia
KRIDGST

SEQ ID NO: 3056957 - protein, 13 aa, Giardia lamblia
KRIPTTASITTPL

SEQ ID NO: 3056958 - protein, 5 aa, Giardia lamblia
KRIRA

SEQ ID NO: 3056959 - protein, 21 aa, Giardia lamblia
KRKRQEGHADANKSTAPSTRN

SEQ ID NO: 3056960 - protein, 14 aa, Giardia lamblia
KRKSKRKPARRKSR

SEQ ID NO: 3056961 - protein, 7 aa, Giardia lamblia
KRLNPES

SEQ ID NO: 3056962 - protein, 17 aa, Giardia lamblia
KRLRSKNASQHKADPEF

SEQ ID NO: 3056963 - protein, 8 aa, Giardia lamblia
KRLSTRGS

SEQ ID NO: 3056964 - protein, 28 aa, Giardia lamblia
KRLTASANSEKRLSSKNTVGNRQSPNMG

SEQ ID NO: 3056965 - protein, 8 aa, Giardia lamblia
KRLTPSGN

SEQ ID NO: 3056966 - protein, 26 aa, Giardia lamblia
KRMQEKVGGQIGSDDSSSSDDTNAIE

SEQ ID NO: 3056967 - protein, 4 aa, Giardia lamblia
KRMR

SEQ ID NO: 3056968 - protein, 6 aa, Giardia lamblia
KRNDTL

SEQ ID NO: 3056969 - protein, 6 aa, Giardia lamblia
KRNDVD

SEQ ID NO: 3056970 - protein, 5 aa, Giardia lamblia
KRNGT

SEQ ID NO: 3056971 - protein, 21 aa, Giardia lamblia
KRNPRYHSPTNIQQSGTSSNL

SEQ ID NO: 3056972 - protein, 8 aa, Giardia lamblia
KRNPSNTK

SEQ ID NO: 3056973 - protein, 8 aa, Giardia lamblia
KRNQPEPT

SEQ ID NO: 3056974 - protein, 25 aa, Giardia lamblia
KRPARASQPNSRSTSKSDPKSHKKT

SEQ ID NO: 3056975 - protein, 8 aa, Giardia lamblia
KRPEGTRY

SEQ ID NO: 3056976 - protein, 5 aa, Giardia lamblia
KRPEL

SEQ ID NO: 3056977 - protein, 12 aa, Giardia lamblia
KRPGTLPTSADF

SEQ ID NO: 3056978 - protein, 23 aa, Giardia lamblia
KRPPTAPVQGSGKDSKGKTQQVA

SEQ ID NO: 3056979 - protein, 4 aa, Giardia lamblia
KRPR

SEQ ID NO: 3056980 - protein, 14 aa, Giardia lamblia
KRPSSALKKNPSVD

SEQ ID NO: 3056981 - protein, 7 aa, Giardia lamblia
KRPTLRR

SEQ ID NO: 3056982 - protein, 6 aa, Giardia lamblia
KRPVDS

SEQ ID NO: 3056983 - protein, 17 aa, Giardia lamblia
KRPVRKSTAPYQRNAER

SEQ ID NO: 3056984 - protein, 8 aa, Giardia lamblia
KRPVSQQS

SEQ ID NO: 3056985 - protein, 8 aa, Giardia lamblia
KRQDDVGR

SEQ ID NO: 3056986 - protein, 19 aa, Giardia lamblia
KRQDSVSGVANKHPSKDLH

SEQ ID NO: 3056987 - protein, 8 aa, Giardia lamblia
KRQGGPKY

SEQ ID NO: 3056988 - protein, 6 aa, Giardia lamblia
KRQRRE

SEQ ID NO: 3056989 - protein, 8 aa, Giardia lamblia
KRREGYAG

SEQ ID NO: 3056990 - protein, 6 aa, Giardia lamblia
KRRQTG

SEQ ID NO: 3056991 - protein, 5 aa, Giardia lamblia
KRSAS

SEQ ID NO: 3056992 - protein, 10 aa, Giardia lamblia
KRSATSEDVK

SEQ ID NO: 3056993 - protein, 19 aa, Giardia lamblia
KRSDMSSRNSERNSKSSLS

SEQ ID NO: 3056994 - protein, 6 aa, Giardia lamblia
KRSETI

SEQ ID NO: 3056995 - protein, 14 aa, Giardia lamblia
KRSGERVGSVPKAL

SEQ ID NO: 3056996 - protein, 6 aa, Giardia lamblia
KRSPTG

SEQ ID NO: 3056997 - protein, 9 aa, Giardia lamblia
KRSRNEIGE

SEQ ID NO: 3056998 - protein, 7 aa, Giardia lamblia
KRSSNEP

SEQ ID NO: 3056999 - protein, 9 aa, Giardia lamblia
KRSSNQKDA

SEQ ID NO: 3057000 - protein, 6 aa, Giardia lamblia
KRSTHI

SEQ ID NO: 3057001 - protein, 7 aa, Giardia lamblia
KRSTTPL

SEQ ID NO: 3057002 - protein, 16 aa, Giardia lamblia
KRSYQQTVANKETQLD

SEQ ID NO: 3057003 - protein, 10 aa, Giardia lamblia
KRTAERRPKR

SEQ ID NO: 3057004 - protein, 8 aa, Giardia lamblia
KRTDMSPH

SEQ ID NO: 3057005 - protein, 7 aa, Giardia lamblia
KRTGRKS

SEQ ID NO: 3057006 - protein, 6 aa, Giardia lamblia
KRTHEG

SEQ ID NO: 3057007 - protein, 10 aa, Giardia lamblia
KRTKSTFSSS

SEQ ID NO: 3057008 - protein, 5 aa, Giardia lamblia
KRTMD

SEQ ID NO: 3057009 - protein, 4 aa, Giardia lamblia
KRTQ

SEQ ID NO: 3057010 - protein, 14 aa, Giardia lamblia
KRTQTNADAAQKID

SEQ ID NO: 3057011 - protein, 11 aa, Giardia lamblia
KRTSGATTGSC

SEQ ID NO: 3057012 - protein, 15 aa, Giardia lamblia
KRTSVKDTSQVDPAE

SEQ ID NO: 3057013 - protein, 16 aa, Giardia lamblia
KRTTNTTKKDKHTDTA

SEQ ID NO: 3057014 - protein, 5 aa, Giardia lamblia
KRVTA

SEQ ID NO: 3057015 - protein, 4 aa, Giardia lamblia
KRVY

SEQ ID NO: 3057016 - protein, 12 aa, Giardia lamblia
KRWGRKGDCERE

SEQ ID NO: 3057017 - protein, 6 aa, Giardia lamblia
KRYGRA

SEQ ID NO: 3057018 - protein, 4 aa, Giardia lamblia
KSAA

SEQ ID NO: 3057019 - protein, 5 aa, Giardia lamblia
KSAAE

SEQ ID NO: 3057020 - protein, 7 aa, Giardia lamblia
KSAAPTL

SEQ ID NO: 3057021 - protein, 13 aa, Giardia lamblia
KSADSNFCVNNVN

SEQ ID NO: 3057022 - protein, 8 aa, Giardia lamblia
KSAGASNY

SEQ ID NO: 3057023 - protein, 9 aa, Giardia lamblia
KSAGPGAKP

SEQ ID NO: 3057024 - protein, 8 aa, Giardia lamblia
KSAKQLER

SEQ ID NO: 3057025 - protein, 7 aa, Giardia lamblia
KSALGRV

SEQ ID NO: 3057026 - protein, 8 aa, Giardia lamblia
KSALSSGI

SEQ ID NO: 3057027 - protein, 9 aa, Giardia lamblia
KSAMAASGS

SEQ ID NO: 3057028 - protein, 7 aa, Giardia lamblia
KSANPKW

SEQ ID NO: 3057029 - protein, 18 aa, Giardia lamblia
KSARSRASSALGQSEVAN

SEQ ID NO: 3057030 - protein, 17 aa, Giardia lamblia
KSASLIDQSPVDENEKR

SEQ ID NO: 3057031 - protein, 9 aa, Giardia lamblia
KSASPTTHR

SEQ ID NO: 3057032 - protein, 7 aa, Giardia lamblia
KSATFTN

SEQ ID NO: 3057033 - protein, 6 aa, Giardia lamblia
KSATKD

SEQ ID NO: 3057034 - protein, 12 aa, Giardia lamblia
KSATNTLSDSAL

SEQ ID NO: 3057035 - protein, 40 aa, Giardia lamblia
KSATSSPSNASTFTYETTNTQMSPTSKQSNKDPSVSISSS

SEQ ID NO: 3057036 - protein, 7 aa, Giardia lamblia
KSCPHRA

SEQ ID NO: 3057037 - protein, 18 aa, Giardia lamblia
KSCTQTCDEHDSQATKCK

SEQ ID NO: 3057038 - protein, 9 aa, Giardia lamblia
KSCTSECPL

SEQ ID NO: 3057039 - protein, 13 aa, Giardia lamblia
KSDAYDKQLSYTT

SEQ ID NO: 3057040 - protein, 17 aa, Giardia lamblia
KSDEKFAAEQKKEQEKA

SEQ ID NO: 3057041 - protein, 6 aa, Giardia lamblia
KSDESL

SEQ ID NO: 3057042 - protein, 10 aa, Giardia lamblia
KSDFYEEPTQ

SEQ ID NO: 3057043 - protein, 5 aa, Giardia lamblia
KSDGE

SEQ ID NO: 3057044 - protein, 5 aa, Giardia lamblia
KSDLD

SEQ ID NO: 3057045 - protein, 6 aa, Giardia lamblia
KSDLTT

SEQ ID NO: 3057046 - protein, 17 aa, Giardia lamblia
KSDPSPVPSAVSQNNTH

SEQ ID NO: 3057047 - protein, 7 aa, Giardia lamblia
KSDQKRV

SEQ ID NO: 3057048 - protein, 8 aa, Giardia lamblia
KSDSQTVY

SEQ ID NO: 3057049 - protein, 6 aa, Giardia lamblia
KSDTCE

SEQ ID NO: 3057050 - protein, 14 aa, Giardia lamblia
KSDTSSDDEQPISM

SEQ ID NO: 3057051 - protein, 10 aa, Giardia lamblia
KSDVSGNRSV

SEQ ID NO: 3057052 - protein, 5 aa, Giardia lamblia
KSEAA

SEQ ID NO: 3057053 - protein, 6 aa, Giardia lamblia
KSEARE

SEQ ID NO: 3057054 - protein, 4 aa, Giardia lamblia
KSEE

SEQ ID NO: 3057055 - protein, 7 aa, Giardia lamblia
KSEESGA

SEQ ID NO: 3057056 - protein, 7 aa, Giardia lamblia
KSEGPWS

SEQ ID NO: 3057057 - protein, 5 aa, Giardia lamblia
KSELE

SEQ ID NO: 3057058 - protein, 6 aa, Giardia lamblia
KSELGD

SEQ ID NO: 3057059 - protein, 12 aa, Giardia lamblia
KSELRQADRGPV

SEQ ID NO: 3057060 - protein, 6 aa, Giardia lamblia
KSEWPG

SEQ ID NO: 3057061 - protein, 16 aa, Giardia lamblia
KSFSSDAIKEATAQEL

SEQ ID NO: 3057062 - protein, 12 aa, Giardia lamblia
KSFSSDPTEFDA

SEQ ID NO: 3057063 - protein, 16 aa, Giardia lamblia
KSFTSSYKQSERNRNI

SEQ ID NO: 3057064 - protein, 10 aa, Giardia lamblia
KSGAVPPSYM

SEQ ID NO: 3057065 - protein, 6 aa, Giardia lamblia
KSGDAF

SEQ ID NO: 3057066 - protein, 7 aa, Giardia lamblia
KSGDQAV

SEQ ID NO: 3057067 - protein, 13 aa, Giardia lamblia
KSGETVQDPTDGL

SEQ ID NO: 3057068 - protein, 7 aa, Giardia lamblia
KSGFSST

SEQ ID NO: 3057069 - protein, 16 aa, Giardia lamblia
KSGGARSRSAPRRKLK

SEQ ID NO: 3057070 - protein, 6 aa, Giardia lamblia
KSGGIF

SEQ ID NO: 3057071 - protein, 6 aa, Giardia lamblia
KSGIGS

SEQ ID NO: 3057072 - protein, 5 aa, Giardia lamblia
KSGIS

SEQ ID NO: 3057073 - protein, 7 aa, Giardia lamblia
KSGLRNK

SEQ ID NO: 3057074 - protein, 7 aa, Giardia lamblia
KSGNTQR

SEQ ID NO: 3057075 - protein, 15 aa, Giardia lamblia
KSGQLSNNGDCWDFR

SEQ ID NO: 3057076 - protein, 5 aa, Giardia lamblia
KSGVL

SEQ ID NO: 3057077 - protein, 10 aa, Giardia lamblia
KSGVPNGTCT

SEQ ID NO: 3057078 - protein, 8 aa, Giardia lamblia
KSHADGNV

SEQ ID NO: 3057079 - protein, 5 aa, Giardia lamblia
KSHAK

SEQ ID NO: 3057080 - protein, 7 aa, Giardia lamblia
KSHDKTR

SEQ ID NO: 3057081 - protein, 9 aa, Giardia lamblia
KSHKHNTPD

SEQ ID NO: 3057082 - protein, 17 aa, Giardia lamblia
KSHPAPDPQFRAPKSVQ

SEQ ID NO: 3057083 - protein, 11 aa, Giardia lamblia
KSHRRPSSSSY

SEQ ID NO: 3057084 - protein, 12 aa, Giardia lamblia
KSHSDSQVSYEP

SEQ ID NO: 3057085 - protein, 7 aa, Giardia lamblia
KSHYNQQ

SEQ ID NO: 3057086 - protein, 6 aa, Giardia lamblia
KSIDPN

SEQ ID NO: 3057087 - protein, 4 aa, Giardia lamblia
KSIK

SEQ ID NO: 3057088 - protein, 19 aa, Giardia lamblia
KSINTSTYITSSEAARMRQ

SEQ ID NO: 3057089 - protein, 6 aa, Giardia lamblia
KSIQDS

SEQ ID NO: 3057090 - protein, 6 aa, Giardia lamblia
KSISPS

SEQ ID NO: 3057091 - protein, 6 aa, Giardia lamblia
KSITTR

SEQ ID NO: 3057092 - protein, 12 aa, Giardia lamblia
KSKAEAEQSSTL

SEQ ID NO: 3057093 - protein, 6 aa, Giardia lamblia
KSKDFA

SEQ ID NO: 3057094 - protein, 12 aa, Giardia lamblia
KSKGFRPTRSEV

SEQ ID NO: 3057095 - protein, 9 aa, Giardia lamblia
KSKISRDDK

SEQ ID NO: 3057096 - protein, 18 aa, Giardia lamblia
KSKKAVGGPQVSPPLQQP

SEQ ID NO: 3057097 - protein, 6 aa, Giardia lamblia
KSKPAA

SEQ ID NO: 3057098 - protein, 7 aa, Giardia lamblia
KSKQALE

SEQ ID NO: 3057099 - protein, 15 aa, Giardia lamblia
KSKRAEALEVEDMST

SEQ ID NO: 3057100 - protein, 9 aa, Giardia lamblia
KSKRLRPEH

SEQ ID NO: 3057101 - protein, 6 aa, Giardia lamblia
KSKTGV

SEQ ID NO: 3057102 - protein, 9 aa, Giardia lamblia
KSLAPSSAL

SEQ ID NO: 3057103 - protein, 7 aa, Giardia lamblia
KSLEKAD

SEQ ID NO: 3057104 - protein, 12 aa, Giardia lamblia
KSLERGYTSGER

SEQ ID NO: 3057105 - protein, 8 aa, Giardia lamblia
KSLGIPDD

SEQ ID NO: 3057106 - protein, 7 aa, Giardia lamblia
KSLNTSK

SEQ ID NO: 3057107 - protein, 7 aa, Giardia lamblia
KSLPEAE

SEQ ID NO: 3057108 - protein, 15 aa, Giardia lamblia
KSLPPPPPLPPSSIP

SEQ ID NO: 3057109 - protein, 24 aa, Giardia lamblia
KSLREQDTSNTTSQPDERSRSDDY

SEQ ID NO: 3057110 - protein, 10 aa, Giardia lamblia
KSLSDNASDI

SEQ ID NO: 3057111 - protein, 7 aa, Giardia lamblia
KSLSSSI

SEQ ID NO: 3057112 - protein, 4 aa, Giardia lamblia
KSMN

SEQ ID NO: 3057113 - protein, 6 aa, Giardia lamblia
KSMQNP

SEQ ID NO: 3057114 - protein, 7 aa, Giardia lamblia
KSNGPDF

SEQ ID NO: 3057115 - protein, 5 aa, Giardia lamblia
KSNGR

SEQ ID NO: 3057116 - protein, 8 aa, Giardia lamblia
KSNLPTMD

SEQ ID NO: 3057117 - protein, 5 aa, Giardia lamblia
KSNNA

SEQ ID NO: 3057118 - protein, 13 aa, Giardia lamblia
KSNQTDIAGYTGS

SEQ ID NO: 3057119 - protein, 13 aa, Giardia lamblia
KSNYRKEGTNPVK

SEQ ID NO: 3057120 - protein, 6 aa, Giardia lamblia
KSPAQL

SEQ ID NO: 3057121 - protein, 7 aa, Giardia lamblia
KSPDNLI

SEQ ID NO: 3057122 - protein, 5 aa, Giardia lamblia
KSPDT

SEQ ID NO: 3057123 - protein, 5 aa, Giardia lamblia
KSPDY

SEQ ID NO: 3057124 - protein, 14 aa, Giardia lamblia
KSPFGEPKESLVSI

SEQ ID NO: 3057125 - protein, 4 aa, Giardia lamblia
KSPG

SEQ ID NO: 3057126 - protein, 6 aa, Giardia lamblia
KSPGSM

SEQ ID NO: 3057127 - protein, 6 aa, Giardia lamblia
KSPLDG

SEQ ID NO: 3057128 - protein, 6 aa, Giardia lamblia
KSPREL

SEQ ID NO: 3057129 - protein, 5 aa, Giardia lamblia
KSPRL

SEQ ID NO: 3057130 - protein, 6 aa, Giardia lamblia
KSPSDV

SEQ ID NO: 3057131 - protein, 10 aa, Giardia lamblia
KSPSKKANVQ

SEQ ID NO: 3057132 - protein, 11 aa, Giardia lamblia
KSPSKKDASVL

SEQ ID NO: 3057133 - protein, 9 aa, Giardia lamblia
KSPSKRQLT

SEQ ID NO: 3057134 - protein, 7 aa, Giardia lamblia
KSPSVGA

SEQ ID NO: 3057135 - protein, 4 aa, Giardia lamblia
KSPT

SEQ ID NO: 3057136 - protein, 10 aa, Giardia lamblia
KSPTECTRAA

SEQ ID NO: 3057137 - protein, 7 aa, Giardia lamblia
KSPTEGL

SEQ ID NO: 3057138 - protein, 7 aa, Giardia lamblia
KSPTRDY

SEQ ID NO: 3057139 - protein, 4 aa, Giardia lamblia
KSQD

SEQ ID NO: 3057140 - protein, 26 aa, Giardia lamblia
KSQFNPDSDVKDTADIATDMESPSAI

SEQ ID NO: 3057141 - protein, 6 aa, Giardia lamblia
KSQIDP

SEQ ID NO: 3057142 - protein, 8 aa, Giardia lamblia
KSQNGEDA

SEQ ID NO: 3057143 - protein, 5 aa, Giardia lamblia
KSQPI

SEQ ID NO: 3057144 - protein, 10 aa, Giardia lamblia
KSQQGEPTPY

SEQ ID NO: 3057145 - protein, 20 aa, Giardia lamblia
KSQRSSPKQSPSRSISPTVT

SEQ ID NO: 3057146 - protein, 10 aa, Giardia lamblia
KSQRSTVTAD

SEQ ID NO: 3057147 - protein, 5 aa, Giardia lamblia
KSQSE

SEQ ID NO: 3057148 - protein, 5 aa, Giardia lamblia
KSQSL

SEQ ID NO: 3057149 - protein, 11 aa, Giardia lamblia
KSQSSSPEGIA

SEQ ID NO: 3057150 - protein, 7 aa, Giardia lamblia
KSRAPAL

SEQ ID NO: 3057151 - protein, 5 aa, Giardia lamblia
KSREC

SEQ ID NO: 3057152 - protein, 6 aa, Giardia lamblia
KSRIEG

SEQ ID NO: 3057153 - protein, 4 aa, Giardia lamblia
KSRK

SEQ ID NO: 3057154 - protein, 7 aa, Giardia lamblia
KSRKPSL

SEQ ID NO: 3057155 - protein, 6 aa, Giardia lamblia
KSRPDV

SEQ ID NO: 3057156 - protein, 8 aa, Giardia lamblia
KSRPTENP

SEQ ID NO: 3057157 - protein, 13 aa, Giardia lamblia
KSRSANVKGLGSD

SEQ ID NO: 3057158 - protein, 16 aa, Giardia lamblia
KSRSDDVFPSSSLPGM

SEQ ID NO: 3057159 - protein, 7 aa, Giardia lamblia
KSRSLHD

SEQ ID NO: 3057160 - protein, 8 aa, Giardia lamblia
KSRSRSHC

SEQ ID NO: 3057161 - protein, 6 aa, Giardia lamblia
KSRTSE

SEQ ID NO: 3057162 - protein, 7 aa, Giardia lamblia
KSRYPQA

SEQ ID NO: 3057163 - protein, 6 aa, Giardia lamblia
KSSAEN

SEQ ID NO: 3057164 - protein, 9 aa, Giardia lamblia
KSSANTVSP

SEQ ID NO: 3057165 - protein, 9 aa, Giardia lamblia
KSSAPIPVN

SEQ ID NO: 3057166 - protein, 34 aa, Giardia lamblia
KSSARSLSRGITNQSVDRSSHSMKRKRSASTGHL

SEQ ID NO: 3057167 - protein, 6 aa, Giardia lamblia
KSSFSS

SEQ ID NO: 3057168 - protein, 7 aa, Giardia lamblia
KSSFYDD

SEQ ID NO: 3057169 - protein, 7 aa, Giardia lamblia
KSSGTQR

SEQ ID NO: 3057170 - protein, 6 aa, Giardia lamblia
KSSISK

SEQ ID NO: 3057171 - protein, 35 aa, Giardia lamblia
KSSKIASSEASEDHKTEHSDIGKQTSDADTNATTA

SEQ ID NO: 3057172 - protein, 32 aa, Giardia lamblia
KSSKPIHHDRSEKTLGKAFQSTSLENVDASEG

SEQ ID NO: 3057173 - protein, 11 aa, Giardia lamblia
KSSKYRSNSAQ

SEQ ID NO: 3057174 - protein, 12 aa, Giardia lamblia
KSSLKKSPTKDI

SEQ ID NO: 3057175 - protein, 4 aa, Giardia lamblia
KSSM

SEQ ID NO: 3057176 - protein, 11 aa, Giardia lamblia
KSSNGTVNQSR

SEQ ID NO: 3057177 - protein, 16 aa, Giardia lamblia
KSSPLDPTNSDSPSTY

SEQ ID NO: 3057178 - protein, 20 aa, Giardia lamblia
KSSRDRSETGNYSAATPSSV

SEQ ID NO: 3057179 - protein, 7 aa, Giardia lamblia
KSSSAVG

SEQ ID NO: 3057180 - protein, 18 aa, Giardia lamblia
KSSTTDPSGWDDTRSSKF

SEQ ID NO: 3057181 - protein, 5 aa, Giardia lamblia
KSSVL

SEQ ID NO: 3057182 - protein, 8 aa, Giardia lamblia
KSTDLSSL

SEQ ID NO: 3057183 - protein, 7 aa, Giardia lamblia
KSTDNSL

SEQ ID NO: 3057184 - protein, 7 aa, Giardia lamblia
KSTDPGL

SEQ ID NO: 3057185 - protein, 6 aa, Giardia lamblia
KSTEGL

SEQ ID NO: 3057186 - protein, 11 aa, Giardia lamblia
KSTESEYMSSS

SEQ ID NO: 3057187 - protein, 9 aa, Giardia lamblia
KSTGDITPC

SEQ ID NO: 3057188 - protein, 8 aa, Giardia lamblia
KSTGGHAQ

SEQ ID NO: 3057189 - protein, 9 aa, Giardia lamblia
KSTGNEPFT

SEQ ID NO: 3057190 - protein, 5 aa, Giardia lamblia
KSTGT

SEQ ID NO: 3057191 - protein, 7 aa, Giardia lamblia
KSTIDSS

SEQ ID NO: 3057192 - protein, 16 aa, Giardia lamblia
KSTISTSTNCPSEPQY

SEQ ID NO: 3057193 - protein, 8 aa, Giardia lamblia
KSTLSRAE

SEQ ID NO: 3057194 - protein, 7 aa, Giardia lamblia
KSTPTQL

SEQ ID NO: 3057195 - protein, 5 aa, Giardia lamblia
KSTRM

SEQ ID NO: 3057196 - protein, 15 aa, Giardia lamblia
KSTSKVKDDMQKKDA

SEQ ID NO: 3057197 - protein, 7 aa, Giardia lamblia
KSTSSEH

SEQ ID NO: 3057198 - protein, 8 aa, Giardia lamblia
KSVAEKQH

SEQ ID NO: 3057199 - protein, 6 aa, Giardia lamblia
KSVEDI

SEQ ID NO: 3057200 - protein, 6 aa, Giardia lamblia
KSVESN

SEQ ID NO: 3057201 - protein, 8 aa, Giardia lamblia
KSVGKEGT

SEQ ID NO: 3057202 - protein, 12 aa, Giardia lamblia
KSVTPLSRSREL

SEQ ID NO: 3057203 - protein, 7 aa, Giardia lamblia
KSWGRPA

SEQ ID NO: 3057204 - protein, 17 aa, Giardia lamblia
KSYAKSSLQSAGIHRPQ

SEQ ID NO: 3057205 - protein, 8 aa, Giardia lamblia
KTAAGEVC

SEQ ID NO: 3057206 - protein, 14 aa, Giardia lamblia
KTACGSPSYASPEM

SEQ ID NO: 3057207 - protein, 9 aa, Giardia lamblia
KTADEASEY

SEQ ID NO: 3057208 - protein, 9 aa, Giardia lamblia
KTAKDLKAV

SEQ ID NO: 3057209 - protein, 15 aa, Giardia lamblia
KTAKTSGTATNTGRR

SEQ ID NO: 3057210 - protein, 14 aa, Giardia lamblia
KTANARGDNDSIHG

SEQ ID NO: 3057211 - protein, 4 aa, Giardia lamblia
KTAP

SEQ ID NO: 3057212 - protein, 5 aa, Giardia lamblia
KTATI

SEQ ID NO: 3057213 - protein, 8 aa, Giardia lamblia
KTATRTHS

SEQ ID NO: 3057214 - protein, 8 aa, Giardia lamblia
KTAVDPNA

SEQ ID NO: 3057215 - protein, 9 aa, Giardia lamblia
KTCGGGTEN

SEQ ID NO: 3057216 - protein, 12 aa, Giardia lamblia
KTCNGAGGRCTS

SEQ ID NO: 3057217 - protein, 9 aa, Giardia lamblia
KTCRRQNTT

SEQ ID NO: 3057218 - protein, 7 aa, Giardia lamblia
KTCSACS

SEQ ID NO: 3057219 - protein, 14 aa, Giardia lamblia
KTDASPRRSSSTSR

SEQ ID NO: 3057220 - protein, 5 aa, Giardia lamblia
KTDGT

SEQ ID NO: 3057221 - protein, 5 aa, Giardia lamblia
KTDLC

SEQ ID NO: 3057222 - protein, 5 aa, Giardia lamblia
KTDNV

SEQ ID NO: 3057223 - protein, 7 aa, Giardia lamblia
KTDSQNV

SEQ ID NO: 3057224 - protein, 9 aa, Giardia lamblia
KTDTGPGDD

SEQ ID NO: 3057225 - protein, 16 aa, Giardia lamblia
KTDVKDGFKPAASANN

SEQ ID NO: 3057226 - protein, 6 aa, Giardia lamblia
KTDYPT

SEQ ID NO: 3057227 - protein, 11 aa, Giardia lamblia
KTEGNNETDMD

SEQ ID NO: 3057228 - protein, 5 aa, Giardia lamblia
KTEHD

SEQ ID NO: 3057229 - protein, 7 aa, Giardia lamblia
KTEHEEL

SEQ ID NO: 3057230 - protein, 9 aa, Giardia lamblia
KTEIPSEEW

SEQ ID NO: 3057231 - protein, 5 aa, Giardia lamblia
KTEMD

SEQ ID NO: 3057232 - protein, 22 aa, Giardia lamblia
KTEPTGSSHRRKRPRKLTSIGA

SEQ ID NO: 3057233 - protein, 4 aa, Giardia lamblia
KTEQ

SEQ ID NO: 3057234 - protein, 10 aa, Giardia lamblia
KTESFDSSSM

SEQ ID NO: 3057235 - protein, 7 aa, Giardia lamblia
KTESKGY

SEQ ID NO: 3057236 - protein, 6 aa, Giardia lamblia
KTESTV

SEQ ID NO: 3057237 - protein, 8 aa, Giardia lamblia
KTFKARSG

SEQ ID NO: 3057238 - protein, 6 aa, Giardia lamblia
KTGAGL

SEQ ID NO: 3057239 - protein, 10 aa, Giardia lamblia
KTGEETAGKL

SEQ ID NO: 3057240 - protein, 5 aa, Giardia lamblia
KTGIP

SEQ ID NO: 3057241 - protein, 14 aa, Giardia lamblia
KTGISADNSGGAGV

SEQ ID NO: 3057242 - protein, 7 aa, Giardia lamblia
KTGPDAV

SEQ ID NO: 3057243 - protein, 5 aa, Giardia lamblia
KTGRC

SEQ ID NO: 3057244 - protein, 13 aa, Giardia lamblia
KTGRHTLDENSQE

SEQ ID NO: 3057245 - protein, 4 aa, Giardia lamblia
KTGS

SEQ ID NO: 3057246 - protein, 15 aa, Giardia lamblia
KTGSRESVGTGEAIK

SEQ ID NO: 3057247 - protein, 6 aa, Giardia lamblia
KTGSVT

SEQ ID NO: 3057248 - protein, 4 aa, Giardia lamblia
KTGT

SEQ ID NO: 3057249 - protein, 8 aa, Giardia lamblia
KTGTAGTF

SEQ ID NO: 3057250 - protein, 7 aa, Giardia lamblia
KTGTITA

SEQ ID NO: 3057251 - protein, 6 aa, Giardia lamblia
KTGTLT

SEQ ID NO: 3057252 - protein, 7 aa, Giardia lamblia
KTGTLTK

SEQ ID NO: 3057253 - protein, 7 aa, Giardia lamblia
KTGTLTR

SEQ ID NO: 3057254 - protein, 7 aa, Giardia lamblia
KTGTLTS

SEQ ID NO: 3057255 - protein, 5 aa, Giardia lamblia
KTHAS

SEQ ID NO: 3057256 - protein, 5 aa, Giardia lamblia
KTHNN

SEQ ID NO: 3057257 - protein, 6 aa, Giardia lamblia
KTIGKR

SEQ ID NO: 3057258 - protein, 5 aa, Giardia lamblia
KTIRS

SEQ ID NO: 3057259 - protein, 6 aa, Giardia lamblia
KTITES

SEQ ID NO: 3057260 - protein, 33 aa, Giardia lamblia
KTKATSSEISEKVKEAKITEENINKAREQYRPV

SEQ ID NO: 3057261 - protein, 4 aa, Giardia lamblia
KTKE

SEQ ID NO: 3057262 - protein, 7 aa, Giardia lamblia
KTKESSR

SEQ ID NO: 3057263 - protein, 14 aa, Giardia lamblia
KTKHFSENINNNGE

SEQ ID NO: 3057264 - protein, 9 aa, Giardia lamblia
KTKKETPTH

SEQ ID NO: 3057265 - protein, 5 aa, Giardia lamblia
KTKNA

SEQ ID NO: 3057266 - protein, 20 aa, Giardia lamblia
KTKNSDLSTQLSKADKQIGE

SEQ ID NO: 3057267 - protein, 7 aa, Giardia lamblia
KTKPPAI

SEQ ID NO: 3057268 - protein, 14 aa, Giardia lamblia
KTKRYYDPQPSMKR

SEQ ID NO: 3057269 - protein, 4 aa, Giardia lamblia
KTLA

SEQ ID NO: 3057270 - protein, 11 aa, Giardia lamblia
KTLKDSSLSMG

SEQ ID NO: 3057271 - protein, 5 aa, Giardia lamblia
KTLNS

SEQ ID NO: 3057272 - protein, 8 aa, Giardia lamblia
KTLQKPSL

SEQ ID NO: 3057273 - protein, 29 aa, Giardia lamblia
KTLSKDKEQEESDSSESNDTADNLEQAKK

SEQ ID NO: 3057274 - protein, 6 aa, Giardia lamblia
KTLSKP

SEQ ID NO: 3057275 - protein, 5 aa, Giardia lamblia
KTLSS

SEQ ID NO: 3057276 - protein, 8 aa, Giardia lamblia
KTLSSTEQ

SEQ ID NO: 3057277 - protein, 6 aa, Giardia lamblia
KTLSVS

SEQ ID NO: 3057278 - protein, 7 aa, Giardia lamblia
KTNAAAA

SEQ ID NO: 3057279 - protein, 7 aa, Giardia lamblia
KTNAEYK

SEQ ID NO: 3057280 - protein, 4 aa, Giardia lamblia
KTNH

SEQ ID NO: 3057281 - protein, 21 aa, Giardia lamblia
KTNHATSSEAEPTSDQGDVQR

SEQ ID NO: 3057282 - protein, 24 aa, Giardia lamblia
KTNKVNMPPKLSSNSSIVSSRIGL

SEQ ID NO: 3057283 - protein, 18 aa, Giardia lamblia
KTNPCGPATSYTGLHEPK

SEQ ID NO: 3057284 - protein, 9 aa, Giardia lamblia
KTNTANIES

SEQ ID NO: 3057285 - protein, 6 aa, Giardia lamblia
KTPAQQ

SEQ ID NO: 3057286 - protein, 5 aa, Giardia lamblia
KTPCY

SEQ ID NO: 3057287 - protein, 16 aa, Giardia lamblia
KTPEEAALDDTPKVRE

SEQ ID NO: 3057288 - protein, 6 aa, Giardia lamblia
KTPGVC

SEQ ID NO: 3057289 - protein, 15 aa, Giardia lamblia
KTPLEPKARNGDAVS

SEQ ID NO: 3057290 - protein, 6 aa, Giardia lamblia
KTPQIH

SEQ ID NO: 3057291 - protein, 7 aa, Giardia lamblia
KTPRPLS

SEQ ID NO: 3057292 - protein, 6 aa, Giardia lamblia
KTPSAD

SEQ ID NO: 3057293 - protein, 20 aa, Giardia lamblia
KTPSAQSKQGKNVHDDTPEF

SEQ ID NO: 3057294 - protein, 7 aa, Giardia lamblia
KTPSDAY

SEQ ID NO: 3057295 - protein, 28 aa, Giardia lamblia
KTPSRCVDGSPTKDSSDTPHGCTPTTSI

SEQ ID NO: 3057296 - protein, 27 aa, Giardia lamblia
KTPTTLTTVGSSGSLSSNSQTAAANLT

SEQ ID NO: 3057297 - protein, 7 aa, Giardia lamblia
KTPVSDR

SEQ ID NO: 3057298 - protein, 4 aa, Giardia lamblia
KTPY

SEQ ID NO: 3057299 - protein, 5 aa, Giardia lamblia
KTPYT

SEQ ID NO: 3057300 - protein, 7 aa, Giardia lamblia
KTQDKMD

SEQ ID NO: 3057301 - protein, 8 aa, Giardia lamblia
KTQDYPKA

SEQ ID NO: 3057302 - protein, 18 aa, Giardia lamblia
KTQESVKNNLETKKTYGN

SEQ ID NO: 3057303 - protein, 7 aa, Giardia lamblia
KTQGSSC

SEQ ID NO: 3057304 - protein, 5 aa, Giardia lamblia
KTQRM

SEQ ID NO: 3057305 - protein, 6 aa, Giardia lamblia
KTQSKT

SEQ ID NO: 3057306 - protein, 6 aa, Giardia lamblia
KTQTRI

SEQ ID NO: 3057307 - protein, 8 aa, Giardia lamblia
KTRATRTG

SEQ ID NO: 3057308 - protein, 5 aa, Giardia lamblia
KTRDN

SEQ ID NO: 3057309 - protein, 9 aa, Giardia lamblia
KTRGERDSY

SEQ ID NO: 3057310 - protein, 10 aa, Giardia lamblia
KTRPKNPKKP

SEQ ID NO: 3057311 - protein, 6 aa, Giardia lamblia
KTRPRN

SEQ ID NO: 3057312 - protein, 14 aa, Giardia lamblia
KTRQISKSTSMSEN

SEQ ID NO: 3057313 - protein, 4 aa, Giardia lamblia
KTRS

SEQ ID NO: 3057314 - protein, 6 aa, Giardia lamblia
KTRTRE

SEQ ID NO: 3057315 - protein, 10 aa, Giardia lamblia
KTRVNPDDTI

SEQ ID NO: 3057316 - protein, 8 aa, Giardia lamblia
KTSADPAL

SEQ ID NO: 3057317 - protein, 5 aa, Giardia lamblia
KTSAP

SEQ ID NO: 3057318 - protein, 10 aa, Giardia lamblia
KTSDPETLSI

SEQ ID NO: 3057319 - protein, 5 aa, Giardia lamblia
KTSEE

SEQ ID NO: 3057320 - protein, 6 aa, Giardia lamblia
KTSGRE

SEQ ID NO: 3057321 - protein, 7 aa, Giardia lamblia
KTSISSE

SEQ ID NO: 3057322 - protein, 4 aa, Giardia lamblia
KTSL

SEQ ID NO: 3057323 - protein, 20 aa, Giardia lamblia
KTSLKKSDIDAKSPYCGTGY

SEQ ID NO: 3057324 - protein, 11 aa, Giardia lamblia
KTSNPPGTPAS

SEQ ID NO: 3057325 - protein, 10 aa, Giardia lamblia
KTSNPSDSNA

SEQ ID NO: 3057326 - protein, 10 aa, Giardia lamblia
KTSNSKELYT

SEQ ID NO: 3057327 - protein, 7 aa, Giardia lamblia
KTSPVGL

SEQ ID NO: 3057328 - protein, 12 aa, Giardia lamblia
KTSQASKQSTEN

SEQ ID NO: 3057329 - protein, 4 aa, Giardia lamblia
KTSR

SEQ ID NO: 3057330 - protein, 6 aa, Giardia lamblia
KTSRNH

SEQ ID NO: 3057331 - protein, 5 aa, Giardia lamblia
KTSRQ

SEQ ID NO: 3057332 - protein, 6 aa, Giardia lamblia
KTSSDI

SEQ ID NO: 3057333 - protein, 8 aa, Giardia lamblia
KTSSDLSG

SEQ ID NO: 3057334 - protein, 8 aa, Giardia lamblia
KTSSDNVT

SEQ ID NO: 3057335 - protein, 9 aa, Giardia lamblia
KTSSEEKDL

SEQ ID NO: 3057336 - protein, 7 aa, Giardia lamblia
KTSSTMG

SEQ ID NO: 3057337 - protein, 7 aa, Giardia lamblia
KTSYAAS

SEQ ID NO: 3057338 - protein, 6 aa, Giardia lamblia
KTTAQQ

SEQ ID NO: 3057339 - protein, 10 aa, Giardia lamblia
KTTDGPGSEI

SEQ ID NO: 3057340 - protein, 6 aa, Giardia lamblia
KTTDNK

SEQ ID NO: 3057341 - protein, 7 aa, Giardia lamblia
KTTDTAD

SEQ ID NO: 3057342 - protein, 9 aa, Giardia lamblia
KTTKAYTQS

SEQ ID NO: 3057343 - protein, 4 aa, Giardia lamblia
KTTL

SEQ ID NO: 3057344 - protein, 6 aa, Giardia lamblia
KTTNGT

SEQ ID NO: 3057345 - protein, 8 aa, Giardia lamblia
KTTNYSQD

SEQ ID NO: 3057346 - protein, 7 aa, Giardia lamblia
KTTSENI

SEQ ID NO: 3057347 - protein, 5 aa, Giardia lamblia
KTTSI

SEQ ID NO: 3057348 - protein, 9 aa, Giardia lamblia
KTTSSAQIN

SEQ ID NO: 3057349 - protein, 12 aa, Giardia lamblia
KTTSTSELPHPS

SEQ ID NO: 3057350 - protein, 9 aa, Giardia lamblia
KTVGNKERK

SEQ ID NO: 3057351 - protein, 12 aa, Giardia lamblia
KTVRRKSDVQSV

SEQ ID NO: 3057352 - protein, 6 aa, Giardia lamblia
KTVTEE

SEQ ID NO: 3057353 - protein, 6 aa, Giardia lamblia
KTYRKA

SEQ ID NO: 3057354 - protein, 16 aa, Giardia lamblia
KVCNGGGECTGEGSSA

SEQ ID NO: 3057355 - protein, 14 aa, Giardia lamblia
KVCNGGGTCSGEGF

SEQ ID NO: 3057356 - protein, 17 aa, Giardia lamblia
KVDGDRKEGATMEDGTV

SEQ ID NO: 3057357 - protein, 7 aa, Giardia lamblia
KVDNPAE

SEQ ID NO: 3057358 - protein, 7 aa, Giardia lamblia
KVDSGIG

SEQ ID NO: 3057359 - protein, 7 aa, Giardia lamblia
KVEAKVG

SEQ ID NO: 3057360 - protein, 8 aa, Giardia lamblia
KVEEGKEH

SEQ ID NO: 3057361 - protein, 8 aa, Giardia lamblia
KVEPRPPK

SEQ ID NO: 3057362 - protein, 10 aa, Giardia lamblia
KVEQTETKER

SEQ ID NO: 3057363 - protein, 6 aa, Giardia lamblia
KVEREL

SEQ ID NO: 3057364 - protein, 8 aa, Giardia lamblia
KVESDKVT

SEQ ID NO: 3057365 - protein, 22 aa, Giardia lamblia
KVGCTGGGQYEARRRASEKDGP

SEQ ID NO: 3057366 - protein, 5 aa, Giardia lamblia
KVGTK

SEQ ID NO: 3057367 - protein, 9 aa, Giardia lamblia
KVKEAAQKT

SEQ ID NO: 3057368 - protein, 5 aa, Giardia lamblia
KVNQR

SEQ ID NO: 3057369 - protein, 5 aa, Giardia lamblia
KVPGS

SEQ ID NO: 3057370 - protein, 8 aa, Giardia lamblia
KVPPKAPL

SEQ ID NO: 3057371 - protein, 7 aa, Giardia lamblia
KVPRDTS

SEQ ID NO: 3057372 - protein, 6 aa, Giardia lamblia
KVPTDQ

SEQ ID NO: 3057373 - protein, 7 aa, Giardia lamblia
KVQGTTT

SEQ ID NO: 3057374 - protein, 4 aa, Giardia lamblia
KVQT

SEQ ID NO: 3057375 - protein, 5 aa, Giardia lamblia
KVRAD

SEQ ID NO: 3057376 - protein, 7 aa, Giardia lamblia
KVRTSNV

SEQ ID NO: 3057377 - protein, 7 aa, Giardia lamblia
KVSDELA

SEQ ID NO: 3057378 - protein, 7 aa, Giardia lamblia
KVSDPNL

SEQ ID NO: 3057379 - protein, 8 aa, Giardia lamblia
KVSPDTQG

SEQ ID NO: 3057380 - protein, 7 aa, Giardia lamblia
KVSQNDT

SEQ ID NO: 3057381 - protein, 6 aa, Giardia lamblia
KVSRGS

SEQ ID NO: 3057382 - protein, 7 aa, Giardia lamblia
KVSSEEL

SEQ ID NO: 3057383 - protein, 8 aa, Giardia lamblia
KVSSQSVT

SEQ ID NO: 3057384 - protein, 9 aa, Giardia lamblia
KVTDEQGVT

SEQ ID NO: 3057385 - protein, 11 aa, Giardia lamblia
KVTEDAPRTAF

SEQ ID NO: 3057386 - protein, 4 aa, Giardia lamblia
KVTN

SEQ ID NO: 3057387 - protein, 17 aa, Giardia lamblia
KVTNPGSAAFDSKKGMR

SEQ ID NO: 3057388 - protein, 10 aa, Giardia lamblia
KVTTDSEPTR

SEQ ID NO: 3057389 - protein, 10 aa, Giardia lamblia
KVTTSKPRRK

SEQ ID NO: 3057390 - protein, 7 aa, Giardia lamblia
KVVASDG

SEQ ID NO: 3057391 - protein, 11 aa, Giardia lamblia
KVVGQNSNGKD

SEQ ID NO: 3057392 - protein, 11 aa, Giardia lamblia
KWNSDKNIEEM

SEQ ID NO: 3057393 - protein, 6 aa, Giardia lamblia
KWTQES

SEQ ID NO: 3057394 - protein, 7 aa, Giardia lamblia
KYAAVGG

SEQ ID NO: 3057395 - protein, 5 aa, Giardia lamblia
KYAKS

SEQ ID NO: 3057396 - protein, 5 aa, Giardia lamblia
KYAQQ

SEQ ID NO: 3057397 - protein, 27 aa, Giardia lamblia
KYASTNATDQASLDAKQRPNSNTDSKM

SEQ ID NO: 3057398 - protein, 7 aa, Giardia lamblia
KYCGGDS

SEQ ID NO: 3057399 - protein, 8 aa, Giardia lamblia
KYDKRTQI

SEQ ID NO: 3057400 - protein, 7 aa, Giardia lamblia
KYDNPDR

SEQ ID NO: 3057401 - protein, 4 aa, Giardia lamblia
KYDT

SEQ ID NO: 3057402 - protein, 7 aa, Giardia lamblia
KYEDGIK

SEQ ID NO: 3057403 - protein, 5 aa, Giardia lamblia
KYEDQ

SEQ ID NO: 3057404 - protein, 6 aa, Giardia lamblia
KYESAP

SEQ ID NO: 3057405 - protein, 8 aa, Giardia lamblia
KYGAPETL

SEQ ID NO: 3057406 - protein, 8 aa, Giardia lamblia
KYGDPDVN

SEQ ID NO: 3057407 - protein, 4 aa, Giardia lamblia
KYGE

SEQ ID NO: 3057408 - protein, 12 aa, Giardia lamblia
KYGQKPIQSQRA

SEQ ID NO: 3057409 - protein, 6 aa, Giardia lamblia
KYGSTE

SEQ ID NO: 3057410 - protein, 5 aa, Giardia lamblia
KYGVT

SEQ ID NO: 3057411 - protein, 8 aa, Giardia lamblia
KYHGKGTL

SEQ ID NO: 3057412 - protein, 7 aa, Giardia lamblia
KYHQGSK

SEQ ID NO: 3057413 - protein, 16 aa, Giardia lamblia
KYKAGGRRRPEKTYPA

SEQ ID NO: 3057414 - protein, 8 aa, Giardia lamblia
KYKPGKAS

SEQ ID NO: 3057415 - protein, 9 aa, Giardia lamblia
KYNATGAIN

SEQ ID NO: 3057416 - protein, 5 aa, Giardia lamblia
KYNEP

SEQ ID NO: 3057417 - protein, 4 aa, Giardia lamblia
KYNS

SEQ ID NO: 3057418 - protein, 5 aa, Giardia lamblia
KYPRL

SEQ ID NO: 3057419 - protein, 18 aa, Giardia lamblia
KYQDTRSNAVDEDDRNMD

SEQ ID NO: 3057420 - protein, 4 aa, Giardia lamblia
KYQQ

SEQ ID NO: 3057421 - protein, 6 aa, Giardia lamblia
KYQSQA

SEQ ID NO: 3057422 - protein, 5 aa, Giardia lamblia
KYREN

SEQ ID NO: 3057423 - protein, 9 aa, Giardia lamblia
KYRKDPARC

SEQ ID NO: 3057424 - protein, 4 aa, Giardia lamblia
KYRS

SEQ ID NO: 3057425 - protein, 12 aa, Giardia lamblia
KYSAGEQLADGT

SEQ ID NO: 3057426 - protein, 7 aa, Giardia lamblia
KYSETPM

SEQ ID NO: 3057427 - protein, 6 aa, Giardia lamblia
KYSGDT

SEQ ID NO: 3057428 - protein, 20 aa, Giardia lamblia
KYSKDRHKYYTSDRSRGIYR

SEQ ID NO: 3057429 - protein, 6 aa, Giardia lamblia
KYSKHG

SEQ ID NO: 3057430 - protein, 33 aa, Giardia lamblia
KYSNHPTDTLDAASADTEELGSESSSDYLESPP

SEQ ID NO: 3057431 - protein, 6 aa, Giardia lamblia
KYTEAI

SEQ ID NO: 3057432 - protein, 10 aa, Giardia lamblia
KYTSQQDALQ

SEQ ID NO: 3057433 - protein, 5 aa, Giardia lamblia
KYYEA

SEQ ID NO: 3057434 - protein, 9 aa, Giardia lamblia
LAADEPPLK

SEQ ID NO: 3057435 - protein, 9 aa, Giardia lamblia
LAAENQCNY

SEQ ID NO: 3057436 - protein, 9 aa, Giardia lamblia
LAAERSANA

SEQ ID NO: 3057437 - protein, 27 aa, Giardia lamblia
LAANSGLLDSPDEQSVNGGLSDLRDML

SEQ ID NO: 3057438 - protein, 7 aa, Giardia lamblia
LAARPGY

SEQ ID NO: 3057439 - protein, 9 aa, Giardia lamblia
LAASNISKS

SEQ ID NO: 3057440 - protein, 7 aa, Giardia lamblia
LAASSGL

SEQ ID NO: 3057441 - protein, 43 aa, Giardia lamblia
LAASSQNDICTEASSVDPPTNTDEANKTKNIVDEQHSGKGALS

SEQ ID NO: 3057442 - protein, 8 aa, Giardia lamblia
LAATDKQL

SEQ ID NO: 3057443 - protein, 13 aa, Giardia lamblia
LAATTSKEAPPTS

SEQ ID NO: 3057444 - protein, 4 aa, Giardia lamblia
LADK

SEQ ID NO: 3057445 - protein, 5 aa, Giardia lamblia
LADKT

SEQ ID NO: 3057446 - protein, 4 aa, Giardia lamblia
LAEG

SEQ ID NO: 3057447 - protein, 8 aa, Giardia lamblia
LAESARAA

SEQ ID NO: 3057448 - protein, 8 aa, Giardia lamblia
LAESTKDV

SEQ ID NO: 3057449 - protein, 15 aa, Giardia lamblia
LAETHTGKTRNNDVK

SEQ ID NO: 3057450 - protein, 6 aa, Giardia lamblia
LAGPYA

SEQ ID NO: 3057451 - protein, 8 aa, Giardia lamblia
LAGSTTGF

SEQ ID NO: 3057452 - protein, 13 aa, Giardia lamblia
LAGTGQPAKISPA

SEQ ID NO: 3057453 - protein, 8 aa, Giardia lamblia
LAGTGVQT

SEQ ID NO: 3057454 - protein, 8 aa, Giardia lamblia
LAGTYAQK

SEQ ID NO: 3057455 - protein, 11 aa, Giardia lamblia
LAHGDKTKTVA

SEQ ID NO: 3057456 - protein, 10 aa, Giardia lamblia
LAKASGNSLG

SEQ ID NO: 3057457 - protein, 7 aa, Giardia lamblia
LAKDNKS

SEQ ID NO: 3057458 - protein, 13 aa, Giardia lamblia
LAKKRTAAIAGGT

SEQ ID NO: 3057459 - protein, 7 aa, Giardia lamblia
LAKRTVG

SEQ ID NO: 3057460 - protein, 11 aa, Giardia lamblia
LAKSPTSQDPI

SEQ ID NO: 3057461 - protein, 8 aa, Giardia lamblia
LALQSGKE

SEQ ID NO: 3057462 - protein, 8 aa, Giardia lamblia
LANDDNQT

SEQ ID NO: 3057463 - protein, 4 aa, Giardia lamblia
LANQ

SEQ ID NO: 3057464 - protein, 11 aa, Giardia lamblia
LANTPELRPSS

SEQ ID NO: 3057465 - protein, 6 aa, Giardia lamblia
LANTRP

SEQ ID NO: 3057466 - protein, 7 aa, Giardia lamblia
LANTSHR

SEQ ID NO: 3057467 - protein, 6 aa, Giardia lamblia
LAPDNF

SEQ ID NO: 3057468 - protein, 11 aa, Giardia lamblia
LAPDSSVEEIK

SEQ ID NO: 3057469 - protein, 6 aa, Giardia lamblia
LAPEAQ

SEQ ID NO: 3057470 - protein, 6 aa, Giardia lamblia
LAPERG

SEQ ID NO: 3057471 - protein, 7 aa, Giardia lamblia
LAPEYAD

SEQ ID NO: 3057472 - protein, 8 aa, Giardia lamblia
LAPGDEQI

SEQ ID NO: 3057473 - protein, 12 aa, Giardia lamblia
LAPGEALAAGAR

SEQ ID NO: 3057474 - protein, 8 aa, Giardia lamblia
LAPGSCKS

SEQ ID NO: 3057475 - protein, 6 aa, Giardia lamblia
LAPPEG

SEQ ID NO: 3057476 - protein, 9 aa, Giardia lamblia
LAPPGTDGG

SEQ ID NO: 3057477 - protein, 8 aa, Giardia lamblia
LAPQDIQT

SEQ ID NO: 3057478 - protein, 7 aa, Giardia lamblia
LAQDTDD

SEQ ID NO: 3057479 - protein, 7 aa, Giardia lamblia
LAQKGTD

SEQ ID NO: 3057480 - protein, 14 aa, Giardia lamblia
LAQKSQASSTTPWS

SEQ ID NO: 3057481 - protein, 18 aa, Giardia lamblia
LAQPGGPGLAAAPEASAR

SEQ ID NO: 3057482 - protein, 5 aa, Giardia lamblia
LAQSS

SEQ ID NO: 3057483 - protein, 8 aa, Giardia lamblia
LAQTDSDD

SEQ ID NO: 3057484 - protein, 44 aa, Giardia lamblia
LARSKSDKAKDTYINKSQNKPFSVASSSHSQQASATNTVPTTGV

SEQ ID NO: 3057485 - protein, 8 aa, Giardia lamblia
LARSRTRD

SEQ ID NO: 3057486 - protein, 15 aa, Giardia lamblia
LASAKSTSIAHPTPS

SEQ ID NO: 3057487 - protein, 7 aa, Giardia lamblia
LASDDPA

SEQ ID NO: 3057488 - protein, 7 aa, Giardia lamblia
LASDGPA

SEQ ID NO: 3057489 - protein, 6 aa, Giardia lamblia
LASDTY

SEQ ID NO: 3057490 - protein, 15 aa, Giardia lamblia
LASEQGYGPGRSRLQ

SEQ ID NO: 3057491 - protein, 4 aa, Giardia lamblia
LASG

SEQ ID NO: 3057492 - protein, 6 aa, Giardia lamblia
LASGDI

SEQ ID NO: 3057493 - protein, 9 aa, Giardia lamblia
LASGENPIS

SEQ ID NO: 3057494 - protein, 8 aa, Giardia lamblia
LASGGADG

SEQ ID NO: 3057495 - protein, 5 aa, Giardia lamblia
LASMN

SEQ ID NO: 3057496 - protein, 13 aa, Giardia lamblia
LASPSLDSRPPLS

SEQ ID NO: 3057497 - protein, 9 aa, Giardia lamblia
LASPSSSVC

SEQ ID NO: 3057498 - protein, 12 aa, Giardia lamblia
LASSEKTTLRDF

SEQ ID NO: 3057499 - protein, 19 aa, Giardia lamblia
LASSSSFAEDTDSLEKQTD

SEQ ID NO: 3057500 - protein, 8 aa, Giardia lamblia
LASTDSQN

SEQ ID NO: 3057501 - protein, 31 aa, Giardia lamblia
LASTRSTAAGKTRDATPDTGKRDTPKDPVAS

SEQ ID NO: 3057502 - protein, 8 aa, Giardia lamblia
LASTTTNE

SEQ ID NO: 3057503 - protein, 6 aa, Giardia lamblia
LATPEE

SEQ ID NO: 3057504 - protein, 7 aa, Giardia lamblia
LATPQPA

SEQ ID NO: 3057505 - protein, 11 aa, Giardia lamblia
LATPSSEPDMT

SEQ ID NO: 3057506 - protein, 15 aa, Giardia lamblia
LATPTAGDQRGSPLP

SEQ ID NO: 3057507 - protein, 9 aa, Giardia lamblia
LATQQNATP

SEQ ID NO: 3057508 - protein, 8 aa, Giardia lamblia
LATSGNHE

SEQ ID NO: 3057509 - protein, 12 aa, Giardia lamblia
LATTSEESLFDD

SEQ ID NO: 3057510 - protein, 8 aa, Giardia lamblia
LCDDPSSV

SEQ ID NO: 3057511 - protein, 21 aa, Giardia lamblia
LDADPPEGCSPFTRGSSPALG

SEQ ID NO: 3057512 - protein, 10 aa, Giardia lamblia
LDAPASPSKL

SEQ ID NO: 3057513 - protein, 7 aa, Giardia lamblia
LDAPGSE

SEQ ID NO: 3057514 - protein, 8 aa, Giardia lamblia
LDATGRTL

SEQ ID NO: 3057515 - protein, 12 aa, Giardia lamblia
LDDEPWEDGGLD

SEQ ID NO: 3057516 - protein, 10 aa, Giardia lamblia
LDDGDNRIDA

SEQ ID NO: 3057517 - protein, 6 aa, Giardia lamblia
LDDSEA

SEQ ID NO: 3057518 - protein, 7 aa, Giardia lamblia
LDDTECT

SEQ ID NO: 3057519 - protein, 31 aa, Giardia lamblia
LDDTPNDQEPTPQLPEGKLNEQADEESRKDV

SEQ ID NO: 3057520 - protein, 4 aa, Giardia lamblia
LDEE

SEQ ID NO: 3057521 - protein, 10 aa, Giardia lamblia
LDEKSTPTEI

SEQ ID NO: 3057522 - protein, 17 aa, Giardia lamblia
LDENSRPAGTVDTGTPI

SEQ ID NO: 3057523 - protein, 5 aa, Giardia lamblia
LDEST

SEQ ID NO: 3057524 - protein, 13 aa, Giardia lamblia
LDETAPSKKSWSS

SEQ ID NO: 3057525 - protein, 12 aa, Giardia lamblia
LDGDEDKTTVVG

SEQ ID NO: 3057526 - protein, 4 aa, Giardia lamblia
LDGE

SEQ ID NO: 3057527 - protein, 6 aa, Giardia lamblia
LDGEDS

SEQ ID NO: 3057528 - protein, 10 aa, Giardia lamblia
LDGEGPAKKP

SEQ ID NO: 3057529 - protein, 9 aa, Giardia lamblia
LDGQDAKTM

SEQ ID NO: 3057530 - protein, 10 aa, Giardia lamblia
LDGSNKASAR

SEQ ID NO: 3057531 - protein, 11 aa, Giardia lamblia
LDGTAGKTSSI

SEQ ID NO: 3057532 - protein, 4 aa, Giardia lamblia
LDHA

SEQ ID NO: 3057533 - protein, 5 aa, Giardia lamblia
LDKAI

SEQ ID NO: 3057534 - protein, 13 aa, Giardia lamblia
LDKHGSSLSTIPG

SEQ ID NO: 3057535 - protein, 6 aa, Giardia lamblia
LDKRGY

SEQ ID NO: 3057536 - protein, 11 aa, Giardia lamblia
LDKSSNKNGSC

SEQ ID NO: 3057537 - protein, 34 aa, Giardia lamblia
LDNDNDESDSNNSSYSYSDDESCHEPIEADSEEE

SEQ ID NO: 3057538 - protein, 53 aa, Giardia lamblia
LDNEDLPDFKSNPSEPTDKQESAGLDAEEKAVEDPSSDAHHSDRASSKSSQPS

SEQ ID NO: 3057539 - protein, 6 aa, Giardia lamblia
LDNTTT

SEQ ID NO: 3057540 - protein, 4 aa, Giardia lamblia
LDPE

SEQ ID NO: 3057541 - protein, 5 aa, Giardia lamblia
LDPED

SEQ ID NO: 3057542 - protein, 9 aa, Giardia lamblia
LDPNKSDYQ

SEQ ID NO: 3057543 - protein, 8 aa, Giardia lamblia
LDPPPKGW

SEQ ID NO: 3057544 - protein, 5 aa, Giardia lamblia
LDPST

SEQ ID NO: 3057545 - protein, 9 aa, Giardia lamblia
LDPSYEPIS

SEQ ID NO: 3057546 - protein, 7 aa, Giardia lamblia
LDPTAKY

SEQ ID NO: 3057547 - protein, 9 aa, Giardia lamblia
LDPTDDRGV

SEQ ID NO: 3057548 - protein, 4 aa, Giardia lamblia
LDQG

SEQ ID NO: 3057549 - protein, 8 aa, Giardia lamblia
LDQGNRAQ

SEQ ID NO: 3057550 - protein, 15 aa, Giardia lamblia
LDQNSPGRKDVATNE

SEQ ID NO: 3057551 - protein, 11 aa, Giardia lamblia
LDQQRETLSSE

SEQ ID NO: 3057552 - protein, 9 aa, Giardia lamblia
LDQSNTRSC

SEQ ID NO: 3057553 - protein, 4 aa, Giardia lamblia
LDQT

SEQ ID NO: 3057554 - protein, 8 aa, Giardia lamblia
LDRADEAD

SEQ ID NO: 3057555 - protein, 6 aa, Giardia lamblia
LDREAQ

SEQ ID NO: 3057556 - protein, 16 aa, Giardia lamblia
LDREIGDGLGSKSRAI

SEQ ID NO: 3057557 - protein, 4 aa, Giardia lamblia
LDRQ

SEQ ID NO: 3057558 - protein, 12 aa, Giardia lamblia
LDRQDRAKRNRR

SEQ ID NO: 3057559 - protein, 11 aa, Giardia lamblia
LDRQNTNKVQR

SEQ ID NO: 3057560 - protein, 16 aa, Giardia lamblia
LDRRNALKGAEEGFSA

SEQ ID NO: 3057561 - protein, 4 aa, Giardia lamblia
LDRS

SEQ ID NO: 3057562 - protein, 8 aa, Giardia lamblia
LDRTTDSL

SEQ ID NO: 3057563 - protein, 10 aa, Giardia lamblia
LDSDSAPSSV

SEQ ID NO: 3057564 - protein, 14 aa, Giardia lamblia
LDSEDLTQKKTITN

SEQ ID NO: 3057565 - protein, 8 aa, Giardia lamblia
LDSETQTY

SEQ ID NO: 3057566 - protein, 8 aa, Giardia lamblia
LDSKSDYS

SEQ ID NO: 3057567 - protein, 11 aa, Giardia lamblia
LDSNTKQCNPV

SEQ ID NO: 3057568 - protein, 12 aa, Giardia lamblia
LDSPSSADTTEQ

SEQ ID NO: 3057569 - protein, 6 aa, Giardia lamblia
LDSQEV

SEQ ID NO: 3057570 - protein, 13 aa, Giardia lamblia
LDSSSKLAHSEQA

SEQ ID NO: 3057571 - protein, 4 aa, Giardia lamblia
LDST

SEQ ID NO: 3057572 - protein, 15 aa, Giardia lamblia
LDSTVPESTTDPSSY

SEQ ID NO: 3057573 - protein, 7 aa, Giardia lamblia
LDTEEES

SEQ ID NO: 3057574 - protein, 7 aa, Giardia lamblia
LDTETQN

SEQ ID NO: 3057575 - protein, 8 aa, Giardia lamblia
LDTKKDNE

SEQ ID NO: 3057576 - protein, 22 aa, Giardia lamblia
LDTKNKIKRQDNTSSSQDESES

SEQ ID NO: 3057577 - protein, 7 aa, Giardia lamblia
LDTQQLP

SEQ ID NO: 3057578 - protein, 4 aa, Giardia lamblia
LDTS

SEQ ID NO: 3057579 - protein, 8 aa, Giardia lamblia
LDTSNEQI

SEQ ID NO: 3057580 - protein, 17 aa, Giardia lamblia
LDTSTVPINTHKPSNMG

SEQ ID NO: 3057581 - protein, 16 aa, Giardia lamblia
LDTTANAGHSAPSKAA

SEQ ID NO: 3057582 - protein, 18 aa, Giardia lamblia
LDTTNYSNAYAEKSRNKR

SEQ ID NO: 3057583 - protein, 14 aa, Giardia lamblia
LDTTPTSKARTSPP

SEQ ID NO: 3057584 - protein, 7 aa, Giardia lamblia
LDTTQSK

SEQ ID NO: 3057585 - protein, 5 aa, Giardia lamblia
LDYSP

SEQ ID NO: 3057586 - protein, 11 aa, Giardia lamblia
LEACKDDEQRV

SEQ ID NO: 3057587 - protein, 11 aa, Giardia lamblia
LEAERSEWNRT

SEQ ID NO: 3057588 - protein, 8 aa, Giardia lamblia
LEAESAAL

SEQ ID NO: 3057589 - protein, 7 aa, Giardia lamblia
LEAGGTV

SEQ ID NO: 3057590 - protein, 6 aa, Giardia lamblia
LEDADT

SEQ ID NO: 3057591 - protein, 8 aa, Giardia lamblia
LEDEASEE

SEQ ID NO: 3057592 - protein, 13 aa, Giardia lamblia
LEDNGSGEGCRDT

SEQ ID NO: 3057593 - protein, 8 aa, Giardia lamblia
LEDNTLQS

SEQ ID NO: 3057594 - protein, 9 aa, Giardia lamblia
LEDPNSSDF

SEQ ID NO: 3057595 - protein, 4 aa, Giardia lamblia
LEDR

SEQ ID NO: 3057596 - protein, 13 aa, Giardia lamblia
LEDSEASDSDTVI

SEQ ID NO: 3057597 - protein, 9 aa, Giardia lamblia
LEDSEIETE

SEQ ID NO: 3057598 - protein, 8 aa, Giardia lamblia
LEDSERQV

SEQ ID NO: 3057599 - protein, 6 aa, Giardia lamblia
LEDSNI

SEQ ID NO: 3057600 - protein, 16 aa, Giardia lamblia
LEEAGKAALSQDPSYL

SEQ ID NO: 3057601 - protein, 9 aa, Giardia lamblia
LEEDSSNRD

SEQ ID NO: 3057602 - protein, 8 aa, Giardia lamblia
LEEGESKW

SEQ ID NO: 3057603 - protein, 6 aa, Giardia lamblia
LEEKDA

SEQ ID NO: 3057604 - protein, 19 aa, Giardia lamblia
LEEKGQSSAQVDSPESLSE

SEQ ID NO: 3057605 - protein, 10 aa, Giardia lamblia
LEEQDEGNTT

SEQ ID NO: 3057606 - protein, 12 aa, Giardia lamblia
LEERKRRRFDGD

SEQ ID NO: 3057607 - protein, 9 aa, Giardia lamblia
LEERSGHQI

SEQ ID NO: 3057608 - protein, 13 aa, Giardia lamblia
LEESATTDTRRRE

SEQ ID NO: 3057609 - protein, 9 aa, Giardia lamblia
LEESSDVGL

SEQ ID NO: 3057610 - protein, 6 aa, Giardia lamblia
LEETRS

SEQ ID NO: 3057611 - protein, 18 aa, Giardia lamblia
LEGAGKITYGNNGRMGDA

SEQ ID NO: 3057612 - protein, 5 aa, Giardia lamblia
LEGEH

SEQ ID NO: 3057613 - protein, 8 aa, Giardia lamblia
LEGQSPEH

SEQ ID NO: 3057614 - protein, 4 aa, Giardia lamblia
LEGS

SEQ ID NO: 3057615 - protein, 6 aa, Giardia lamblia
LEGSPA

SEQ ID NO: 3057616 - protein, 7 aa, Giardia lamblia
LEGSTHA

SEQ ID NO: 3057617 - protein, 10 aa, Giardia lamblia
LEGVGGESTL

SEQ ID NO: 3057618 - protein, 4 aa, Giardia lamblia
LEGW

SEQ ID NO: 3057619 - protein, 10 aa, Giardia lamblia
LEHPSSATQL

SEQ ID NO: 3057620 - protein, 27 aa, Giardia lamblia
LEKAGLSGRDLNKAVSEKIPEDAGLGP

SEQ ID NO: 3057621 - protein, 5 aa, Giardia lamblia
LEKGA

SEQ ID NO: 3057622 - protein, 11 aa, Giardia lamblia
LEKKRQDVSKY

SEQ ID NO: 3057623 - protein, 7 aa, Giardia lamblia
LEKNPSR

SEQ ID NO: 3057624 - protein, 8 aa, Giardia lamblia
LEKPSTRA

SEQ ID NO: 3057625 - protein, 6 aa, Giardia lamblia
LEKRRK

SEQ ID NO: 3057626 - protein, 14 aa, Giardia lamblia
LEKSHKQTFTAPET

SEQ ID NO: 3057627 - protein, 6 aa, Giardia lamblia
LELGSD

SEQ ID NO: 3057628 - protein, 9 aa, Giardia lamblia
LENEDGELN

SEQ ID NO: 3057629 - protein, 11 aa, Giardia lamblia
LENGQSDTSAE

SEQ ID NO: 3057630 - protein, 7 aa, Giardia lamblia
LENGTKK

SEQ ID NO: 3057631 - protein, 8 aa, Giardia lamblia
LENRDGET

SEQ ID NO: 3057632 - protein, 20 aa, Giardia lamblia
LENRPSEADALGQEPRLKTT

SEQ ID NO: 3057633 - protein, 6 aa, Giardia lamblia
LENRRP

SEQ ID NO: 3057634 - protein, 8 aa, Giardia lamblia
LEPAADNP

SEQ ID NO: 3057635 - protein, 21 aa, Giardia lamblia
LEPDALDSAKTGQGQSVESRH

SEQ ID NO: 3057636 - protein, 5 aa, Giardia lamblia
LEPDL

SEQ ID NO: 3057637 - protein, 5 aa, Giardia lamblia
LEPDT

SEQ ID NO: 3057638 - protein, 9 aa, Giardia lamblia
LEPIQPPKI

SEQ ID NO: 3057639 - protein, 7 aa, Giardia lamblia
LEPPEGP

SEQ ID NO: 3057640 - protein, 5 aa, Giardia lamblia
LEPST

SEQ ID NO: 3057641 - protein, 12 aa, Giardia lamblia
LEQAAGAPAVGK

SEQ ID NO: 3057642 - protein, 10 aa, Giardia lamblia
LEQGGYDPLY

SEQ ID NO: 3057643 - protein, 17 aa, Giardia lamblia
LEQGNTKLEKTEEDVSE

SEQ ID NO: 3057644 - protein, 10 aa, Giardia lamblia
LEQKSLESDC

SEQ ID NO: 3057645 - protein, 21 aa, Giardia lamblia
LEQNGGTLEAPSEEYPEPDMT

SEQ ID NO: 3057646 - protein, 4 aa, Giardia lamblia
LEQR

SEQ ID NO: 3057647 - protein, 6 aa, Giardia lamblia
LERDNA

SEQ ID NO: 3057648 - protein, 24 aa, Giardia lamblia
LERGKPVALETKKKNHKKWKPGEK

SEQ ID NO: 3057649 - protein, 7 aa, Giardia lamblia
LERQSGR

SEQ ID NO: 3057650 - protein, 4 aa, Giardia lamblia
LERR

SEQ ID NO: 3057651 - protein, 7 aa, Giardia lamblia
LERRADK

SEQ ID NO: 3057652 - protein, 13 aa, Giardia lamblia
LERSTASNTTLDD

SEQ ID NO: 3057653 - protein, 10 aa, Giardia lamblia
LESGLQDSDG

SEQ ID NO: 3057654 - protein, 6 aa, Giardia lamblia
LESGPE

SEQ ID NO: 3057655 - protein, 6 aa, Giardia lamblia
LESGST

SEQ ID NO: 3057656 - protein, 17 aa, Giardia lamblia
LESKKDKIKDDLEAAKD

SEQ ID NO: 3057657 - protein, 10 aa, Giardia lamblia
LESPTGTGKT

SEQ ID NO: 3057658 - protein, 9 aa, Giardia lamblia
LESQSSAGT

SEQ ID NO: 3057659 - protein, 25 aa, Giardia lamblia
LESRPSEANALGQEPRVKTTGIGTL

SEQ ID NO: 3057660 - protein, 16 aa, Giardia lamblia
LESRQSKIDSLGQEPR

SEQ ID NO: 3057661 - protein, 4 aa, Giardia lamblia
LESS

SEQ ID NO: 3057662 - protein, 5 aa, Giardia lamblia
LESSD

SEQ ID NO: 3057663 - protein, 16 aa, Giardia lamblia
LESSDETLTRANAEDG

SEQ ID NO: 3057664 - protein, 9 aa, Giardia lamblia
LESSPPSAC

SEQ ID NO: 3057665 - protein, 26 aa, Giardia lamblia
LESSSATTKPYSTQSPCKDPATSSSF

SEQ ID NO: 3057666 - protein, 27 aa, Giardia lamblia
LESSSPSAVASSGRECSQTGGISPRKW

SEQ ID NO: 3057667 - protein, 5 aa, Giardia lamblia
LESVQ

SEQ ID NO: 3057668 - protein, 11 aa, Giardia lamblia
LETARQSISDL

SEQ ID NO: 3057669 - protein, 6 aa, Giardia lamblia
LETGAF

SEQ ID NO: 3057670 - protein, 14 aa, Giardia lamblia
LETGERVSYDDSSL

SEQ ID NO: 3057671 - protein, 4 aa, Giardia lamblia
LETH

SEQ ID NO: 3057672 - protein, 4 aa, Giardia lamblia
LETL

SEQ ID NO: 3057673 - protein, 5 aa, Giardia lamblia
LETPQ

SEQ ID NO: 3057674 - protein, 9 aa, Giardia lamblia
LETRKPKDI

SEQ ID NO: 3057675 - protein, 23 aa, Giardia lamblia
LETSTGDPDTEASSVVSDNSEDQ

SEQ ID NO: 3057676 - protein, 4 aa, Giardia lamblia
LFPT

SEQ ID NO: 3057677 - protein, 13 aa, Giardia lamblia
LGAGSNNPGAKDL

SEQ ID NO: 3057678 - protein, 7 aa, Giardia lamblia
LGAKPPI

SEQ ID NO: 3057679 - protein, 7 aa, Giardia lamblia
LGATPRE

SEQ ID NO: 3057680 - protein, 23 aa, Giardia lamblia
LGAVSRGTSNDDTDPSSPPSHRD

SEQ ID NO: 3057681 - protein, 5 aa, Giardia lamblia
LGDDK

SEQ ID NO: 3057682 - protein, 7 aa, Giardia lamblia
LGDEEPV

SEQ ID NO: 3057683 - protein, 7 aa, Giardia lamblia
LGDNRDD

SEQ ID NO: 3057684 - protein, 9 aa, Giardia lamblia
LGDNRLGSL

SEQ ID NO: 3057685 - protein, 18 aa, Giardia lamblia
LGDQSKEPAESSSGVSRT

SEQ ID NO: 3057686 - protein, 9 aa, Giardia lamblia
LGDRGQSSI

SEQ ID NO: 3057687 - protein, 9 aa, Giardia lamblia
LGDSPTSGF

SEQ ID NO: 3057688 - protein, 9 aa, Giardia lamblia
LGDSVQAGE

SEQ ID NO: 3057689 - protein, 4 aa, Giardia lamblia
LGEA

SEQ ID NO: 3057690 - protein, 7 aa, Giardia lamblia
LGEDQKT

SEQ ID NO: 3057691 - protein, 5 aa, Giardia lamblia
LGELT

SEQ ID NO: 3057692 - protein, 8 aa, Giardia lamblia
LGERSEKT

SEQ ID NO: 3057693 - protein, 7 aa, Giardia lamblia
LGESHYK

SEQ ID NO: 3057694 - protein, 6 aa, Giardia lamblia
LGEYGS

SEQ ID NO: 3057695 - protein, 11 aa, Giardia lamblia
LGGATLPQAAP

SEQ ID NO: 3057696 - protein, 4 aa, Giardia lamblia
LGGD

SEQ ID NO: 3057697 - protein, 12 aa, Giardia lamblia
LGGDEADVPEKR

SEQ ID NO: 3057698 - protein, 4 aa, Giardia lamblia
LGGE

SEQ ID NO: 3057699 - protein, 6 aa, Giardia lamblia
LGGFSG

SEQ ID NO: 3057700 - protein, 14 aa, Giardia lamblia
LGGHSSPDRRALAA

SEQ ID NO: 3057701 - protein, 16 aa, Giardia lamblia
LGGKTEAENTSSATDA

SEQ ID NO: 3057702 - protein, 9 aa, Giardia lamblia
LGGPDSFSK

SEQ ID NO: 3057703 - protein, 4 aa, Giardia lamblia
LGGV

SEQ ID NO: 3057704 - protein, 4 aa, Giardia lamblia
LGGY

SEQ ID NO: 3057705 - protein, 13 aa, Giardia lamblia
LGIDPRSLAPSDN

SEQ ID NO: 3057706 - protein, 9 aa, Giardia lamblia
LGKASTTEV

SEQ ID NO: 3057707 - protein, 11 aa, Giardia lamblia
LGKDNSTPSDA

SEQ ID NO: 3057708 - protein, 8 aa, Giardia lamblia
LGNDEDNR

SEQ ID NO: 3057709 - protein, 14 aa, Giardia lamblia
LGNTSEGYEGSEIH

SEQ ID NO: 3057710 - protein, 26 aa, Giardia lamblia
LGPDLKGDTQANSQSANADDKNKKQD

SEQ ID NO: 3057711 - protein, 4 aa, Giardia lamblia
LGPK

SEQ ID NO: 3057712 - protein, 12 aa, Giardia lamblia
LGPKGSDSISQD

SEQ ID NO: 3057713 - protein, 10 aa, Giardia lamblia
LGPLPDPGAL

SEQ ID NO: 3057714 - protein, 10 aa, Giardia lamblia
LGPPKGKDSM

SEQ ID NO: 3057715 - protein, 5 aa, Giardia lamblia
LGPSN

SEQ ID NO: 3057716 - protein, 13 aa, Giardia lamblia
LGPTLKSTSGDII

SEQ ID NO: 3057717 - protein, 10 aa, Giardia lamblia
LGQGQEKFAE

SEQ ID NO: 3057718 - protein, 8 aa, Giardia lamblia
LGQQSSTF

SEQ ID NO: 3057719 - protein, 9 aa, Giardia lamblia
LGQTSKSKF

SEQ ID NO: 3057720 - protein, 9 aa, Giardia lamblia
LGRGTSYDQ

SEQ ID NO: 3057721 - protein, 4 aa, Giardia lamblia
LGRP

SEQ ID NO: 3057722 - protein, 18 aa, Giardia lamblia
LGRSKTQSHTKRSYSSRV

SEQ ID NO: 3057723 - protein, 7 aa, Giardia lamblia
LGRSRAE

SEQ ID NO: 3057724 - protein, 9 aa, Giardia lamblia
LGRSTLPGK

SEQ ID NO: 3057725 - protein, 11 aa, Giardia lamblia
LGRVGSPQQPY

SEQ ID NO: 3057726 - protein, 33 aa, Giardia lamblia
LGSATKPGSRSSSRPVDSPDDTSSNTSRSQGRT

SEQ ID NO: 3057727 - protein, 6 aa, Giardia lamblia
LGSEGS

SEQ ID NO: 3057728 - protein, 6 aa, Giardia lamblia
LGSEYS

SEQ ID NO: 3057729 - protein, 5 aa, Giardia lamblia
LGSGK

SEQ ID NO: 3057730 - protein, 5 aa, Giardia lamblia
LGSLE

SEQ ID NO: 3057731 - protein, 5 aa, Giardia lamblia
LGSNS

SEQ ID NO: 3057732 - protein, 12 aa, Giardia lamblia
LGSNSGHSFKKP

SEQ ID NO: 3057733 - protein, 16 aa, Giardia lamblia
LGSNSSLKKNAHKADE

SEQ ID NO: 3057734 - protein, 5 aa, Giardia lamblia
LGSQT

SEQ ID NO: 3057735 - protein, 22 aa, Giardia lamblia
LGSTSAAHSLESQQADAMANAT

SEQ ID NO: 3057736 - protein, 4 aa, Giardia lamblia
LGTA

SEQ ID NO: 3057737 - protein, 5 aa, Giardia lamblia
LGTMS

SEQ ID NO: 3057738 - protein, 8 aa, Giardia lamblia
LGTPTSFD

SEQ ID NO: 3057739 - protein, 15 aa, Giardia lamblia
LGTPYYTSKKRSSHI

SEQ ID NO: 3057740 - protein, 4 aa, Giardia lamblia
LGTR

SEQ ID NO: 3057741 - protein, 9 aa, Giardia lamblia
LGTSGRVAD

SEQ ID NO: 3057742 - protein, 6 aa, Giardia lamblia
LGTTQN

SEQ ID NO: 3057743 - protein, 40 aa, Giardia lamblia
LGVSPGRKPLPSACTSARQTQRMGSQGTQLDKDVNGTNHS

SEQ ID NO: 3057744 - protein, 6 aa, Giardia lamblia
LGYAQN

SEQ ID NO: 3057745 - protein, 6 aa, Giardia lamblia
LHDADR

SEQ ID NO: 3057746 - protein, 11 aa, Giardia lamblia
LHEDDAAGSDL

SEQ ID NO: 3057747 - protein, 5 aa, Giardia lamblia
LHGDP

SEQ ID NO: 3057748 - protein, 6 aa, Giardia lamblia
LHNKEQ

SEQ ID NO: 3057749 - protein, 4 aa, Giardia lamblia
LHNS

SEQ ID NO: 3057750 - protein, 10 aa, Giardia lamblia
LHRSSSSNHI

SEQ ID NO: 3057751 - protein, 8 aa, Giardia lamblia
LHSESQRA

SEQ ID NO: 3057752 - protein, 7 aa, Giardia lamblia
LHSGPHS

SEQ ID NO: 3057753 - protein, 23 aa, Giardia lamblia
LHTPEDQEKVSAKESSQHPAEAL

SEQ ID NO: 3057754 - protein, 11 aa, Giardia lamblia
LIEENGPSNLL

SEQ ID NO: 3057755 - protein, 15 aa, Giardia lamblia
LIPDGQGLEYQDSEE

SEQ ID NO: 3057756 - protein, 11 aa, Giardia lamblia
LIPPPSGQTIS

SEQ ID NO: 3057757 - protein, 7 aa, Giardia lamblia
LKADTAR

SEQ ID NO: 3057758 - protein, 8 aa, Giardia lamblia
LKAEQENR

SEQ ID NO: 3057759 - protein, 31 aa, Giardia lamblia
LKASSTALGGSLDPDATDTVKDPLHASAAAP

SEQ ID NO: 3057760 - protein, 5 aa, Giardia lamblia
LKDND

SEQ ID NO: 3057761 - protein, 21 aa, Giardia lamblia
LKDPDPPVDPNQPSDPTYIDQ

SEQ ID NO: 3057762 - protein, 17 aa, Giardia lamblia
LKEGTDPTLLDDPEANI

SEQ ID NO: 3057763 - protein, 7 aa, Giardia lamblia
LKEPETL

SEQ ID NO: 3057764 - protein, 7 aa, Giardia lamblia
LKEQYDD

SEQ ID NO: 3057765 - protein, 4 aa, Giardia lamblia
LKET

SEQ ID NO: 3057766 - protein, 4 aa, Giardia lamblia
LKEV

SEQ ID NO: 3057767 - protein, 7 aa, Giardia lamblia
LKGATSH

SEQ ID NO: 3057768 - protein, 9 aa, Giardia lamblia
LKGEEDGLT

SEQ ID NO: 3057769 - protein, 7 aa, Giardia lamblia
LKGEPED

SEQ ID NO: 3057770 - protein, 8 aa, Giardia lamblia
LKGGEKRL

SEQ ID NO: 3057771 - protein, 6 aa, Giardia lamblia
LKGGGT

SEQ ID NO: 3057772 - protein, 7 aa, Giardia lamblia
LKGSPEF

SEQ ID NO: 3057773 - protein, 11 aa, Giardia lamblia
LKGSRKKAKSI

SEQ ID NO: 3057774 - protein, 8 aa, Giardia lamblia
LKGSSASL

SEQ ID NO: 3057775 - protein, 12 aa, Giardia lamblia
LKGTGKGDVCTS

SEQ ID NO: 3057776 - protein, 10 aa, Giardia lamblia
LKKEGTTSYG

SEQ ID NO: 3057777 - protein, 17 aa, Giardia lamblia
LKKGKKSHASKSHEYYP

SEQ ID NO: 3057778 - protein, 57 aa, Giardia lamblia
LKKSGGAVEGRPAWQSKKSSTGSTPSNTGSTTCSTPKTTFETVSTPTPITPSTSLSS

SEQ ID NO: 3057779 - protein, 7 aa, Giardia lamblia
LKNAREE

SEQ ID NO: 3057780 - protein, 12 aa, Giardia lamblia
LKNASSDETNPN

SEQ ID NO: 3057781 - protein, 10 aa, Giardia lamblia
LKNTQDSQID

SEQ ID NO: 3057782 - protein, 7 aa, Giardia lamblia
LKPEDID

SEQ ID NO: 3057783 - protein, 8 aa, Giardia lamblia
LKPHEDHR

SEQ ID NO: 3057784 - protein, 24 aa, Giardia lamblia
LKPKDKGSVPEKKGDSSAADPTVS

SEQ ID NO: 3057785 - protein, 8 aa, Giardia lamblia
LKPLSAGD

SEQ ID NO: 3057786 - protein, 15 aa, Giardia lamblia
LKPSVSTKTLATDSN

SEQ ID NO: 3057787 - protein, 8 aa, Giardia lamblia
LKQADTDI

SEQ ID NO: 3057788 - protein, 17 aa, Giardia lamblia
LKQEKQEKKARPKAKRP

SEQ ID NO: 3057789 - protein, 12 aa, Giardia lamblia
LKRTQDASMGSP

SEQ ID NO: 3057790 - protein, 18 aa, Giardia lamblia
LKSAQGPLTASGTTLQTD

SEQ ID NO: 3057791 - protein, 14 aa, Giardia lamblia
LKSDGSTTAESPTC

SEQ ID NO: 3057792 - protein, 10 aa, Giardia lamblia
LKSEEERLSN

SEQ ID NO: 3057793 - protein, 12 aa, Giardia lamblia
LKSKRREESFAT

SEQ ID NO: 3057794 - protein, 6 aa, Giardia lamblia
LKSKRT

SEQ ID NO: 3057795 - protein, 8 aa, Giardia lamblia
LKSNPDEV

SEQ ID NO: 3057796 - protein, 8 aa, Giardia lamblia
LKSPSTPY

SEQ ID NO: 3057797 - protein, 7 aa, Giardia lamblia
LKSSPGV

SEQ ID NO: 3057798 - protein, 11 aa, Giardia lamblia
LKSSQNKGPLL

SEQ ID NO: 3057799 - protein, 11 aa, Giardia lamblia
LKTAQESLSMD

SEQ ID NO: 3057800 - protein, 13 aa, Giardia lamblia
LKTEATQQGRTTI

SEQ ID NO: 3057801 - protein, 6 aa, Giardia lamblia
LKTGSP

SEQ ID NO: 3057802 - protein, 4 aa, Giardia lamblia
LKTP

SEQ ID NO: 3057803 - protein, 6 aa, Giardia lamblia
LKTPGK

SEQ ID NO: 3057804 - protein, 9 aa, Giardia lamblia
LKTPQGSRL

SEQ ID NO: 3057805 - protein, 9 aa, Giardia lamblia
LKTSAQATS

SEQ ID NO: 3057806 - protein, 8 aa, Giardia lamblia
LKTSNSTL

SEQ ID NO: 3057807 - protein, 6 aa, Giardia lamblia
LKTSSD

SEQ ID NO: 3057808 - protein, 8 aa, Giardia lamblia
LKVTGPAR

SEQ ID NO: 3057809 - protein, 14 aa, Giardia lamblia
LLAPESDALTPTLK

SEQ ID NO: 3057810 - protein, 6 aa, Giardia lamblia
LLDSST

SEQ ID NO: 3057811 - protein, 9 aa, Giardia lamblia
LLGNGANRR

SEQ ID NO: 3057812 - protein, 4 aa, Giardia lamblia
LLPT

SEQ ID NO: 3057813 - protein, 5 aa, Giardia lamblia
LLPTT

SEQ ID NO: 3057814 - protein, 28 aa, Giardia lamblia
LLSPPAAAPPSSTKDAKKAVSQPPPKSS

SEQ ID NO: 3057815 - protein, 7 aa, Giardia lamblia
LMPPGAP

SEQ ID NO: 3057816 - protein, 11 aa, Giardia lamblia
LNASTDGSKKL

SEQ ID NO: 3057817 - protein, 5 aa, Giardia lamblia
LNDGT

SEQ ID NO: 3057818 - protein, 10 aa, Giardia lamblia
LNDKNTRVRS

SEQ ID NO: 3057819 - protein, 21 aa, Giardia lamblia
LNDPGREGSAELSSGSESSTL

SEQ ID NO: 3057820 - protein, 10 aa, Giardia lamblia
LNDPTKASTL

SEQ ID NO: 3057821 - protein, 35 aa, Giardia lamblia
LNDTDSAPMESNSRTIRPLSSATSQRSAMSPKTIA

SEQ ID NO: 3057822 - protein, 6 aa, Giardia lamblia
LNDTSA

SEQ ID NO: 3057823 - protein, 9 aa, Giardia lamblia
LNEDSRTAR

SEQ ID NO: 3057824 - protein, 23 aa, Giardia lamblia
LNESSQSASINADPHSKDLTFPG

SEQ ID NO: 3057825 - protein, 5 aa, Giardia lamblia
LNGNL

SEQ ID NO: 3057826 - protein, 8 aa, Giardia lamblia
LNGRGKTI

SEQ ID NO: 3057827 - protein, 6 aa, Giardia lamblia
LNGSDK

SEQ ID NO: 3057828 - protein, 12 aa, Giardia lamblia
LNGSNGGSCTQC

SEQ ID NO: 3057829 - protein, 22 aa, Giardia lamblia
LNGTDVSYNGTGTRDQTDPSYR

SEQ ID NO: 3057830 - protein, 15 aa, Giardia lamblia
LNGTSASYSITSPTA

SEQ ID NO: 3057831 - protein, 16 aa, Giardia lamblia
LNIETSDKALTRPQET

SEQ ID NO: 3057832 - protein, 8 aa, Giardia lamblia
LNIPGTDA

SEQ ID NO: 3057833 - protein, 5 aa, Giardia lamblia
LNKEP

SEQ ID NO: 3057834 - protein, 13 aa, Giardia lamblia
LNKPTLQGQKRQN

SEQ ID NO: 3057835 - protein, 5 aa, Giardia lamblia
LNNAN

SEQ ID NO: 3057836 - protein, 14 aa, Giardia lamblia
LNNGAMGDPVRDET

SEQ ID NO: 3057837 - protein, 8 aa, Giardia lamblia
LNNPYRKG

SEQ ID NO: 3057838 - protein, 10 aa, Giardia lamblia
LNNSDEAQMY

SEQ ID NO: 3057839 - protein, 8 aa, Giardia lamblia
LNNTDEKL

SEQ ID NO: 3057840 - protein, 11 aa, Giardia lamblia
LNPATSSFGRP

SEQ ID NO: 3057841 - protein, 7 aa, Giardia lamblia
LNPENDS

SEQ ID NO: 3057842 - protein, 6 aa, Giardia lamblia
LNPEQN

SEQ ID NO: 3057843 - protein, 9 aa, Giardia lamblia
LNPGTTDGG

SEQ ID NO: 3057844 - protein, 7 aa, Giardia lamblia
LNPLKPA

SEQ ID NO: 3057845 - protein, 10 aa, Giardia lamblia
LNPLPNTSKY

SEQ ID NO: 3057846 - protein, 6 aa, Giardia lamblia
LNPQPS

SEQ ID NO: 3057847 - protein, 8 aa, Giardia lamblia
LNPQQTRR

SEQ ID NO: 3057848 - protein, 22 aa, Giardia lamblia
LNPSNGPRDSQKGPEGKVTRGS

SEQ ID NO: 3057849 - protein, 12 aa, Giardia lamblia
LNPSNSNSHPDG

SEQ ID NO: 3057850 - protein, 5 aa, Giardia lamblia
LNQPP

SEQ ID NO: 3057851 - protein, 11 aa, Giardia lamblia
LNQSDEAHKNT

SEQ ID NO: 3057852 - protein, 9 aa, Giardia lamblia
LNRNRKQKY

SEQ ID NO: 3057853 - protein, 6 aa, Giardia lamblia
LNSTAN

SEQ ID NO: 3057854 - protein, 4 aa, Giardia lamblia
LNTE

SEQ ID NO: 3057855 - protein, 6 aa, Giardia lamblia
LNTSES

SEQ ID NO: 3057856 - protein, 13 aa, Giardia lamblia
LNTSSKDASASSE

SEQ ID NO: 3057857 - protein, 13 aa, Giardia lamblia
LNYNEGEQSIRSQ

SEQ ID NO: 3057858 - protein, 32 aa, Giardia lamblia
LPAAPSSVVDEPPLQEPLPESVQPITTPPVPQ

SEQ ID NO: 3057859 - protein, 11 aa, Giardia lamblia
LPAEDLSDRAN

SEQ ID NO: 3057860 - protein, 12 aa, Giardia lamblia
LPAIKGSGSITQ

SEQ ID NO: 3057861 - protein, 5 aa, Giardia lamblia
LPAKP

SEQ ID NO: 3057862 - protein, 10 aa, Giardia lamblia
LPANSTGPNM

SEQ ID NO: 3057863 - protein, 8 aa, Giardia lamblia
LPAPRSGC

SEQ ID NO: 3057864 - protein, 13 aa, Giardia lamblia
LPASEAGSEEIES

SEQ ID NO: 3057865 - protein, 10 aa, Giardia lamblia
LPASGDNSSN

SEQ ID NO: 3057866 - protein, 8 aa, Giardia lamblia
LPASRSAA

SEQ ID NO: 3057867 - protein, 9 aa, Giardia lamblia
LPDDQKDYS

SEQ ID NO: 3057868 - protein, 17 aa, Giardia lamblia
LPDGEDQNNGTNTTSSY

SEQ ID NO: 3057869 - protein, 9 aa, Giardia lamblia
LPDGTHEVE

SEQ ID NO: 3057870 - protein, 16 aa, Giardia lamblia
LPDNAPALADDSKASV

SEQ ID NO: 3057871 - protein, 6 aa, Giardia lamblia
LPDPRT

SEQ ID NO: 3057872 - protein, 17 aa, Giardia lamblia
LPDQVSSSSGVQNNTRQ

SEQ ID NO: 3057873 - protein, 7 aa, Giardia lamblia
LPDSPNL

SEQ ID NO: 3057874 - protein, 8 aa, Giardia lamblia
LPDSSLKE

SEQ ID NO: 3057875 - protein, 4 aa, Giardia lamblia
LPDT

SEQ ID NO: 3057876 - protein, 7 aa, Giardia lamblia
LPDTDDH

SEQ ID NO: 3057877 - protein, 6 aa, Giardia lamblia
LPDVKT

SEQ ID NO: 3057878 - protein, 8 aa, Giardia lamblia
LPDVPAEN

SEQ ID NO: 3057879 - protein, 6 aa, Giardia lamblia
LPEAPK

SEQ ID NO: 3057880 - protein, 14 aa, Giardia lamblia
LPEDAGALTNQDDN

SEQ ID NO: 3057881 - protein, 11 aa, Giardia lamblia
LPEGHDPSAVS

SEQ ID NO: 3057882 - protein, 5 aa, Giardia lamblia
LPEGS

SEQ ID NO: 3057883 - protein, 12 aa, Giardia lamblia
LPEKCGPKQDGS

SEQ ID NO: 3057884 - protein, 20 aa, Giardia lamblia
LPEPSRSVTSQGPGSPTHYR

SEQ ID NO: 3057885 - protein, 8 aa, Giardia lamblia
LPETEQFT

SEQ ID NO: 3057886 - protein, 24 aa, Giardia lamblia
LPGDSNSAVGAPNERANKARPMSG

SEQ ID NO: 3057887 - protein, 6 aa, Giardia lamblia
LPGFGT

SEQ ID NO: 3057888 - protein, 6 aa, Giardia lamblia
LPGISE

SEQ ID NO: 3057889 - protein, 5 aa, Giardia lamblia
LPGKS

SEQ ID NO: 3057890 - protein, 5 aa, Giardia lamblia
LPGNP

SEQ ID NO: 3057891 - protein, 11 aa, Giardia lamblia
LPGPDQAVQSA

SEQ ID NO: 3057892 - protein, 14 aa, Giardia lamblia
LPGPISNKLTGSDE

SEQ ID NO: 3057893 - protein, 6 aa, Giardia lamblia
LPGQGP

SEQ ID NO: 3057894 - protein, 22 aa, Giardia lamblia
LPGSKDKKKPGAHEAKESPLET

SEQ ID NO: 3057895 - protein, 18 aa, Giardia lamblia
LPGSSLSSNSSTSSSSHH

SEQ ID NO: 3057896 - protein, 4 aa, Giardia lamblia
LPGT

SEQ ID NO: 3057897 - protein, 23 aa, Giardia lamblia
LPGTTTEIKKGGKARTKGRAPKR

SEQ ID NO: 3057898 - protein, 13 aa, Giardia lamblia
LPHGDGTLSFGDG

SEQ ID NO: 3057899 - protein, 4 aa, Giardia lamblia
LPHV

SEQ ID NO: 3057900 - protein, 8 aa, Giardia lamblia
LPIRPSST

SEQ ID NO: 3057901 - protein, 15 aa, Giardia lamblia
LPKARVSEDAQAEAN

SEQ ID NO: 3057902 - protein, 5 aa, Giardia lamblia
LPKDP

SEQ ID NO: 3057903 - protein, 17 aa, Giardia lamblia
LPKGGEKALSKGVSSKS

SEQ ID NO: 3057904 - protein, 27 aa, Giardia lamblia
LPKKEVSSTSQEDGEQSQRKVPAETAI

SEQ ID NO: 3057905 - protein, 5 aa, Giardia lamblia
LPKNA

SEQ ID NO: 3057906 - protein, 6 aa, Giardia lamblia
LPKTIK

SEQ ID NO: 3057907 - protein, 7 aa, Giardia lamblia
LPKTSSY

SEQ ID NO: 3057908 - protein, 4 aa, Giardia lamblia
LPLP

SEQ ID NO: 3057909 - protein, 8 aa, Giardia lamblia
LPLPPGNR

SEQ ID NO: 3057910 - protein, 9 aa, Giardia lamblia
LPNDGIDSA

SEQ ID NO: 3057911 - protein, 4 aa, Giardia lamblia
LPNE

SEQ ID NO: 3057912 - protein, 4 aa, Giardia lamblia
LPNG

SEQ ID NO: 3057913 - protein, 5 aa, Giardia lamblia
LPNGE

SEQ ID NO: 3057914 - protein, 10 aa, Giardia lamblia
LPNGQRNSLA

SEQ ID NO: 3057915 - protein, 5 aa, Giardia lamblia
LPNGR

SEQ ID NO: 3057916 - protein, 8 aa, Giardia lamblia
LPNPLRTE

SEQ ID NO: 3057917 - protein, 16 aa, Giardia lamblia
LPNQVEGQRLGSVSEV

SEQ ID NO: 3057918 - protein, 16 aa, Giardia lamblia
LPNREEKDKKYLGGTV

SEQ ID NO: 3057919 - protein, 7 aa, Giardia lamblia
LPNSISE

SEQ ID NO: 3057920 - protein, 7 aa, Giardia lamblia
LPNTPQI

SEQ ID NO: 3057921 - protein, 4 aa, Giardia lamblia
LPNV

SEQ ID NO: 3057922 - protein, 17 aa, Giardia lamblia
LPPADREKMRPPRTPAK

SEQ ID NO: 3057923 - protein, 7 aa, Giardia lamblia
LPPCPES

SEQ ID NO: 3057924 - protein, 4 aa, Giardia lamblia
LPPE

SEQ ID NO: 3057925 - protein, 5 aa, Giardia lamblia
LPPGE

SEQ ID NO: 3057926 - protein, 18 aa, Giardia lamblia
LPPGNGSSASSSTSGPAV

SEQ ID NO: 3057927 - protein, 6 aa, Giardia lamblia
LPPGSN

SEQ ID NO: 3057928 - protein, 7 aa, Giardia lamblia
LPPNNRS

SEQ ID NO: 3057929 - protein, 7 aa, Giardia lamblia
LPPPEDG

SEQ ID NO: 3057930 - protein, 40 aa, Giardia lamblia
LPPPSDSVYPQGAYDSGSLTGTDTYTGFGSSPTASDSHST

SEQ ID NO: 3057931 - protein, 20 aa, Giardia lamblia
LPPQARPVGEHRSSSSAIPL

SEQ ID NO: 3057932 - protein, 10 aa, Giardia lamblia
LPPRKEATNR

SEQ ID NO: 3057933 - protein, 9 aa, Giardia lamblia
LPPRPSTAL

SEQ ID NO: 3057934 - protein, 38 aa, Giardia lamblia
LPPRPVPLEESDHSSRHSHSQLSSQQTDEELKSELQGE

SEQ ID NO: 3057935 - protein, 20 aa, Giardia lamblia
LPPSEKQIQPPDTASPTVNP

SEQ ID NO: 3057936 - protein, 26 aa, Giardia lamblia
LPPSKFTNSPAPGLGAEPSGFTPPAT

SEQ ID NO: 3057937 - protein, 4 aa, Giardia lamblia
LPPT

SEQ ID NO: 3057938 - protein, 13 aa, Giardia lamblia
LPPTDKANAPPDC

SEQ ID NO: 3057939 - protein, 11 aa, Giardia lamblia
LPPTRGSSSCC

SEQ ID NO: 3057940 - protein, 5 aa, Giardia lamblia
LPPVS

SEQ ID NO: 3057941 - protein, 8 aa, Giardia lamblia
LPQAPSVA

SEQ ID NO: 3057942 - protein, 4 aa, Giardia lamblia
LPQE

SEQ ID NO: 3057943 - protein, 4 aa, Giardia lamblia
LPQG

SEQ ID NO: 3057944 - protein, 9 aa, Giardia lamblia
LPQNPPKGA

SEQ ID NO: 3057945 - protein, 4 aa, Giardia lamblia
LPQP

SEQ ID NO: 3057946 - protein, 9 aa, Giardia lamblia
LPQPQGPRM

SEQ ID NO: 3057947 - protein, 4 aa, Giardia lamblia
LPQQ

SEQ ID NO: 3057948 - protein, 17 aa, Giardia lamblia
LPQQSSESAPKKKQSKC

SEQ ID NO: 3057949 - protein, 20 aa, Giardia lamblia
LPRGCRSDEAESGTEAPMRA

SEQ ID NO: 3057950 - protein, 19 aa, Giardia lamblia
LPRPSERENSDPVHGEPSI

SEQ ID NO: 3057951 - protein, 6 aa, Giardia lamblia
LPRSPV

SEQ ID NO: 3057952 - protein, 9 aa, Giardia lamblia
LPSEGQQPI

SEQ ID NO: 3057953 - protein, 13 aa, Giardia lamblia
LPSEGSTTARADV

SEQ ID NO: 3057954 - protein, 6 aa, Giardia lamblia
LPSETS

SEQ ID NO: 3057955 - protein, 9 aa, Giardia lamblia
LPSGTSAPT

SEQ ID NO: 3057956 - protein, 5 aa, Giardia lamblia
LPSHT

SEQ ID NO: 3057957 - protein, 12 aa, Giardia lamblia
LPSIPAGSTHRS

SEQ ID NO: 3057958 - protein, 7 aa, Giardia lamblia
LPSKGTI

SEQ ID NO: 3057959 - protein, 5 aa, Giardia lamblia
LPSPA

SEQ ID NO: 3057960 - protein, 5 aa, Giardia lamblia
LPSPE

SEQ ID NO: 3057961 - protein, 6 aa, Giardia lamblia
LPSPYG

SEQ ID NO: 3057962 - protein, 25 aa, Giardia lamblia
LPSSSSSDAADGTSNGDNGSEAAHF

SEQ ID NO: 3057963 - protein, 22 aa, Giardia lamblia
LPSSTKSSEDSNQQDIPPVQRR

SEQ ID NO: 3057964 - protein, 8 aa, Giardia lamblia
LPSTPGPV

SEQ ID NO: 3057965 - protein, 9 aa, Giardia lamblia
LPTAPGPNA

SEQ ID NO: 3057966 - protein, 14 aa, Giardia lamblia
LPTEKRHTTEDGRT

SEQ ID NO: 3057967 - protein, 5 aa, Giardia lamblia
LPTGS

SEQ ID NO: 3057968 - protein, 26 aa, Giardia lamblia
LPTGSRQPPGTRLTNERGDLPEGKPR

SEQ ID NO: 3057969 - protein, 8 aa, Giardia lamblia
LPTPDPSF

SEQ ID NO: 3057970 - protein, 8 aa, Giardia lamblia
LPTPSESA

SEQ ID NO: 3057971 - protein, 6 aa, Giardia lamblia
LPTPTY

SEQ ID NO: 3057972 - protein, 11 aa, Giardia lamblia
LPTQESKAYTK

SEQ ID NO: 3057973 - protein, 5 aa, Giardia lamblia
LPTSE

SEQ ID NO: 3057974 - protein, 16 aa, Giardia lamblia
LPTSEQAEAALALGPT

SEQ ID NO: 3057975 - protein, 5 aa, Giardia lamblia
LPTST

SEQ ID NO: 3057976 - protein, 10 aa, Giardia lamblia
LQAESAEKNI

SEQ ID NO: 3057977 - protein, 6 aa, Giardia lamblia
LQAKST

SEQ ID NO: 3057978 - protein, 20 aa, Giardia lamblia
LQANYSETQGRNGLTDKPAR

SEQ ID NO: 3057979 - protein, 9 aa, Giardia lamblia
LQAQGGACG

SEQ ID NO: 3057980 - protein, 8 aa, Giardia lamblia
LQASPTLE

SEQ ID NO: 3057981 - protein, 26 aa, Giardia lamblia
LQASTATPSMDASMTTDREGEAASGM

SEQ ID NO: 3057982 - protein, 12 aa, Giardia lamblia
LQATAKQKQPVE

SEQ ID NO: 3057983 - protein, 26 aa, Giardia lamblia
LQATEHASNDASGGDSMNGEDSPDLD

SEQ ID NO: 3057984 - protein, 16 aa, Giardia lamblia
LQATTSPPSRSCSQGL

SEQ ID NO: 3057985 - protein, 4 aa, Giardia lamblia
LQDI

SEQ ID NO: 3057986 - protein, 10 aa, Giardia lamblia
LQDPPTDRTR

SEQ ID NO: 3057987 - protein, 15 aa, Giardia lamblia
LQDTHKPSGDPEEAS

SEQ ID NO: 3057988 - protein, 7 aa, Giardia lamblia
LQEMGEE

SEQ ID NO: 3057989 - protein, 8 aa, Giardia lamblia
LQESAPTL

SEQ ID NO: 3057990 - protein, 8 aa, Giardia lamblia
LQESRASQ

SEQ ID NO: 3057991 - protein, 7 aa, Giardia lamblia
LQGDGSL

SEQ ID NO: 3057992 - protein, 7 aa, Giardia lamblia
LQGGDTE

SEQ ID NO: 3057993 - protein, 11 aa, Giardia lamblia
LQGKGTTTLPK

SEQ ID NO: 3057994 - protein, 7 aa, Giardia lamblia
LQGNETV

SEQ ID NO: 3057995 - protein, 9 aa, Giardia lamblia
LQGNSSADP

SEQ ID NO: 3057996 - protein, 8 aa, Giardia lamblia
LQGTPNKR

SEQ ID NO: 3057997 - protein, 4 aa, Giardia lamblia
LQKE

SEQ ID NO: 3057998 - protein, 16 aa, Giardia lamblia
LQKQSHAGVKEPSQDV

SEQ ID NO: 3057999 - protein, 11 aa, Giardia lamblia
LQKTERDTAMG

SEQ ID NO: 3058000 - protein, 16 aa, Giardia lamblia
LQNAENGLSPFTPTPA

SEQ ID NO: 3058001 - protein, 8 aa, Giardia lamblia
LQNESTDV

SEQ ID NO: 3058002 - protein, 6 aa, Giardia lamblia
LQNKQA

SEQ ID NO: 3058003 - protein, 8 aa, Giardia lamblia
LQNPNKQI

SEQ ID NO: 3058004 - protein, 5 aa, Giardia lamblia
LQNSH

SEQ ID NO: 3058005 - protein, 16 aa, Giardia lamblia
LQPDQAFSSAPSTSQV

SEQ ID NO: 3058006 - protein, 4 aa, Giardia lamblia
LQPE

SEQ ID NO: 3058007 - protein, 10 aa, Giardia lamblia
LQPEDSEDRF

SEQ ID NO: 3058008 - protein, 5 aa, Giardia lamblia
LQPPG

SEQ ID NO: 3058009 - protein, 7 aa, Giardia lamblia
LQPPNSY

SEQ ID NO: 3058010 - protein, 8 aa, Giardia lamblia
LQPPTNGR

SEQ ID NO: 3058011 - protein, 8 aa, Giardia lamblia
LQQPPPRV

SEQ ID NO: 3058012 - protein, 8 aa, Giardia lamblia
LQQRDPCS

SEQ ID NO: 3058013 - protein, 9 aa, Giardia lamblia
LQQSHGPRD

SEQ ID NO: 3058014 - protein, 5 aa, Giardia lamblia
LQQSN

SEQ ID NO: 3058015 - protein, 4 aa, Giardia lamblia
LQRG

SEQ ID NO: 3058016 - protein, 5 aa, Giardia lamblia
LQSAY

SEQ ID NO: 3058017 - protein, 8 aa, Giardia lamblia
LQSDGDAI

SEQ ID NO: 3058018 - protein, 5 aa, Giardia lamblia
LQSGA

SEQ ID NO: 3058019 - protein, 15 aa, Giardia lamblia
LQSKETASIIPTSDD

SEQ ID NO: 3058020 - protein, 10 aa, Giardia lamblia
LQSNNVNTRL

SEQ ID NO: 3058021 - protein, 7 aa, Giardia lamblia
LQSNNVV

SEQ ID NO: 3058022 - protein, 4 aa, Giardia lamblia
LQSP

SEQ ID NO: 3058023 - protein, 22 aa, Giardia lamblia
LQTETSTLKTQLTEAGNRHSSV

SEQ ID NO: 3058024 - protein, 10 aa, Giardia lamblia
LQTGDPSTYP

SEQ ID NO: 3058025 - protein, 8 aa, Giardia lamblia
LQTGKTRR

SEQ ID NO: 3058026 - protein, 6 aa, Giardia lamblia
LQTGQL

SEQ ID NO: 3058027 - protein, 5 aa, Giardia lamblia
LQTKH

SEQ ID NO: 3058028 - protein, 9 aa, Giardia lamblia
LQTKQGIKA

SEQ ID NO: 3058029 - protein, 21 aa, Giardia lamblia
LQTNTPPEDPEATGDRTSETH

SEQ ID NO: 3058030 - protein, 4 aa, Giardia lamblia
LQTP

SEQ ID NO: 3058031 - protein, 6 aa, Giardia lamblia
LQTPRR

SEQ ID NO: 3058032 - protein, 4 aa, Giardia lamblia
LRAP

SEQ ID NO: 3058033 - protein, 7 aa, Giardia lamblia
LRARKET

SEQ ID NO: 3058034 - protein, 7 aa, Giardia lamblia
LRDDGSA

SEQ ID NO: 3058035 - protein, 9 aa, Giardia lamblia
LRDDKAAGT

SEQ ID NO: 3058036 - protein, 7 aa, Giardia lamblia
LRDDTTD

SEQ ID NO: 3058037 - protein, 6 aa, Giardia lamblia
LRDKCG

SEQ ID NO: 3058038 - protein, 6 aa, Giardia lamblia
LRDPAT

SEQ ID NO: 3058039 - protein, 4 aa, Giardia lamblia
LRDS

SEQ ID NO: 3058040 - protein, 6 aa, Giardia lamblia
LRDSRK

SEQ ID NO: 3058041 - protein, 10 aa, Giardia lamblia
LRDSTQDALD

SEQ ID NO: 3058042 - protein, 5 aa, Giardia lamblia
LRDTT

SEQ ID NO: 3058043 - protein, 9 aa, Giardia lamblia
LREDDGSVS

SEQ ID NO: 3058044 - protein, 7 aa, Giardia lamblia
LREPGKE

SEQ ID NO: 3058045 - protein, 5 aa, Giardia lamblia
LRGKP

SEQ ID NO: 3058046 - protein, 10 aa, Giardia lamblia
LRGPNSSSSI

SEQ ID NO: 3058047 - protein, 8 aa, Giardia lamblia
LRGSQDNV

SEQ ID NO: 3058048 - protein, 4 aa, Giardia lamblia
LRHG

SEQ ID NO: 3058049 - protein, 8 aa, Giardia lamblia
LRKTARNV

SEQ ID NO: 3058050 - protein, 9 aa, Giardia lamblia
LRNDPPASG

SEQ ID NO: 3058051 - protein, 25 aa, Giardia lamblia
LRNSKNISETSEVTESSNDDRYSDN

SEQ ID NO: 3058052 - protein, 10 aa, Giardia lamblia
LRPDAQQYAS

SEQ ID NO: 3058053 - protein, 6 aa, Giardia lamblia
LRPDQG

SEQ ID NO: 3058054 - protein, 12 aa, Giardia lamblia
LRPGSQANINNQ

SEQ ID NO: 3058055 - protein, 4 aa, Giardia lamblia
LRPP

SEQ ID NO: 3058056 - protein, 6 aa, Giardia lamblia
LRPQHS

SEQ ID NO: 3058057 - protein, 7 aa, Giardia lamblia
LRPTASL

SEQ ID NO: 3058058 - protein, 7 aa, Giardia lamblia
LRQPPTY

SEQ ID NO: 3058059 - protein, 4 aa, Giardia lamblia
LRQQ

SEQ ID NO: 3058060 - protein, 12 aa, Giardia lamblia
LRRAGSASTKDR

SEQ ID NO: 3058061 - protein, 6 aa, Giardia lamblia
LRREKK

SEQ ID NO: 3058062 - protein, 17 aa, Giardia lamblia
LRRNKNRKSSSPDHDSL

SEQ ID NO: 3058063 - protein, 7 aa, Giardia lamblia
LRRSTEA

SEQ ID NO: 3058064 - protein, 17 aa, Giardia lamblia
LRSGSTRTTATSRGRPV

SEQ ID NO: 3058065 - protein, 7 aa, Giardia lamblia
LRSKDSD

SEQ ID NO: 3058066 - protein, 25 aa, Giardia lamblia
LRSNPKNVKEGTMSTGNSDYTIEES

SEQ ID NO: 3058067 - protein, 11 aa, Giardia lamblia
LRSNSQPQNYA

SEQ ID NO: 3058068 - protein, 5 aa, Giardia lamblia
LRSQG

SEQ ID NO: 3058069 - protein, 6 aa, Giardia lamblia
LRSQSK

SEQ ID NO: 3058070 - protein, 15 aa, Giardia lamblia
LRSRAPSATGSAHNL

SEQ ID NO: 3058071 - protein, 5 aa, Giardia lamblia
LRSRE

SEQ ID NO: 3058072 - protein, 7 aa, Giardia lamblia
LRSRETV

SEQ ID NO: 3058073 - protein, 6 aa, Giardia lamblia
LRSSAD

SEQ ID NO: 3058074 - protein, 13 aa, Giardia lamblia
LRSTSPSRSPLQP

SEQ ID NO: 3058075 - protein, 7 aa, Giardia lamblia
LRTGEAA

SEQ ID NO: 3058076 - protein, 6 aa, Giardia lamblia
LRTPST

SEQ ID NO: 3058077 - protein, 7 aa, Giardia lamblia
LRTQSAR

SEQ ID NO: 3058078 - protein, 7 aa, Giardia lamblia
LRTQYPG

SEQ ID NO: 3058079 - protein, 6 aa, Giardia lamblia
LSAAPY

SEQ ID NO: 3058080 - protein, 11 aa, Giardia lamblia
LSAGQPCAYDS

SEQ ID NO: 3058081 - protein, 8 aa, Giardia lamblia
LSAKAGIE

SEQ ID NO: 3058082 - protein, 6 aa, Giardia lamblia
LSAKSL

SEQ ID NO: 3058083 - protein, 7 aa, Giardia lamblia
LSANPAQ

SEQ ID NO: 3058084 - protein, 8 aa, Giardia lamblia
LSAPGTYD

SEQ ID NO: 3058085 - protein, 25 aa, Giardia lamblia
LSAPHQPPTLSQPHTLSSPKEPETV

SEQ ID NO: 3058086 - protein, 11 aa, Giardia lamblia
LSAPPNVNSST

SEQ ID NO: 3058087 - protein, 15 aa, Giardia lamblia
LSAPTPCPKYEATEQ

SEQ ID NO: 3058088 - protein, 15 aa, Giardia lamblia
LSAPVSATISSESEN

SEQ ID NO: 3058089 - protein, 15 aa, Giardia lamblia
LSAQASTQPDTPWST

SEQ ID NO: 3058090 - protein, 18 aa, Giardia lamblia
LSAQNRQTSTAQGSPDKC

SEQ ID NO: 3058091 - protein, 12 aa, Giardia lamblia
LSASAMKSGMNS

SEQ ID NO: 3058092 - protein, 5 aa, Giardia lamblia
LSATH

SEQ ID NO: 3058093 - protein, 6 aa, Giardia lamblia
LSATST

SEQ ID NO: 3058094 - protein, 13 aa, Giardia lamblia
LSDATDSPKDTIQ

SEQ ID NO: 3058095 - protein, 4 aa, Giardia lamblia
LSDD

SEQ ID NO: 3058096 - protein, 8 aa, Giardia lamblia
LSDDSQTE

SEQ ID NO: 3058097 - protein, 5 aa, Giardia lamblia
LSDES

SEQ ID NO: 3058098 - protein, 12 aa, Giardia lamblia
LSDETGASDLTN

SEQ ID NO: 3058099 - protein, 19 aa, Giardia lamblia
LSDGDSLSVQSGISGFTSQ

SEQ ID NO: 3058100 - protein, 18 aa, Giardia lamblia
LSDGPYCPPHDPAKRSQI

SEQ ID NO: 3058101 - protein, 10 aa, Giardia lamblia
LSDGSSGATC

SEQ ID NO: 3058102 - protein, 15 aa, Giardia lamblia
LSDPDPSSAPAFPLA

SEQ ID NO: 3058103 - protein, 10 aa, Giardia lamblia
LSDPDYADNA

SEQ ID NO: 3058104 - protein, 8 aa, Giardia lamblia
LSDPESSI

SEQ ID NO: 3058105 - protein, 8 aa, Giardia lamblia
LSDPPAKP

SEQ ID NO: 3058106 - protein, 15 aa, Giardia lamblia
LSDRRSSSTATYSPS

SEQ ID NO: 3058107 - protein, 9 aa, Giardia lamblia
LSDSAGNTA

SEQ ID NO: 3058108 - protein, 11 aa, Giardia lamblia
LSDSSAPLNGG

SEQ ID NO: 3058109 - protein, 5 aa, Giardia lamblia
LSEAV

SEQ ID NO: 3058110 - protein, 21 aa, Giardia lamblia
LSEDPSNTGNSRQPSLASTTV

SEQ ID NO: 3058111 - protein, 7 aa, Giardia lamblia
LSEEASK

SEQ ID NO: 3058112 - protein, 14 aa, Giardia lamblia
LSEEAVPSSRALPV

SEQ ID NO: 3058113 - protein, 10 aa, Giardia lamblia
LSEEEKEAQC

SEQ ID NO: 3058114 - protein, 10 aa, Giardia lamblia
LSEKKPPTAP

SEQ ID NO: 3058115 - protein, 4 aa, Giardia lamblia
LSEP

SEQ ID NO: 3058116 - protein, 5 aa, Giardia lamblia
LSERG

SEQ ID NO: 3058117 - protein, 8 aa, Giardia lamblia
LSESATVP

SEQ ID NO: 3058118 - protein, 8 aa, Giardia lamblia
LSESPTTL

SEQ ID NO: 3058119 - protein, 18 aa, Giardia lamblia
LSESSSSTTTTADSEGDR

SEQ ID NO: 3058120 - protein, 5 aa, Giardia lamblia
LSETR

SEQ ID NO: 3058121 - protein, 8 aa, Giardia lamblia
LSETTSMT

SEQ ID NO: 3058122 - protein, 8 aa, Giardia lamblia
LSFRQPEK

SEQ ID NO: 3058123 - protein, 23 aa, Giardia lamblia
LSGASANSQQRGSSALTEDSIEM

SEQ ID NO: 3058124 - protein, 19 aa, Giardia lamblia
LSGDKKLQRSQSATGPGTV

SEQ ID NO: 3058125 - protein, 8 aa, Giardia lamblia
LSGEAEST

SEQ ID NO: 3058126 - protein, 20 aa, Giardia lamblia
LSGEQERQTLSPGSPRTVAG

SEQ ID NO: 3058127 - protein, 6 aa, Giardia lamblia
LSGGGV

SEQ ID NO: 3058128 - protein, 5 aa, Giardia lamblia
LSGGL

SEQ ID NO: 3058129 - protein, 12 aa, Giardia lamblia
LSGGNANVTSNK

SEQ ID NO: 3058130 - protein, 12 aa, Giardia lamblia
LSGKPSASHSSM

SEQ ID NO: 3058131 - protein, 11 aa, Giardia lamblia
LSGNPSSNQSI

SEQ ID NO: 3058132 - protein, 10 aa, Giardia lamblia
LSGNQHPTAR

SEQ ID NO: 3058133 - protein, 6 aa, Giardia lamblia
LSGPDL

SEQ ID NO: 3058134 - protein, 14 aa, Giardia lamblia
LSGPSKPASQSSRP

SEQ ID NO: 3058135 - protein, 7 aa, Giardia lamblia
LSGPSSV

SEQ ID NO: 3058136 - protein, 4 aa, Giardia lamblia
LSGR

SEQ ID NO: 3058137 - protein, 8 aa, Giardia lamblia
LSGSGKTT

SEQ ID NO: 3058138 - protein, 5 aa, Giardia lamblia
LSGSL

SEQ ID NO: 3058139 - protein, 11 aa, Giardia lamblia
LSGSSDTKGTT

SEQ ID NO: 3058140 - protein, 21 aa, Giardia lamblia
LSGSYAEQGGVLPPDSSSSNV

SEQ ID NO: 3058141 - protein, 12 aa, Giardia lamblia
LSGTDRSTQRSE

SEQ ID NO: 3058142 - protein, 9 aa, Giardia lamblia
LSGTGDATI

SEQ ID NO: 3058143 - protein, 9 aa, Giardia lamblia
LSGTGVSGS

SEQ ID NO: 3058144 - protein, 5 aa, Giardia lamblia
LSGVE

SEQ ID NO: 3058145 - protein, 5 aa, Giardia lamblia
LSITS

SEQ ID NO: 3058146 - protein, 15 aa, Giardia lamblia
LSKAEASAFSGKKDS

SEQ ID NO: 3058147 - protein, 8 aa, Giardia lamblia
LSKGTEKM

SEQ ID NO: 3058148 - protein, 5 aa, Giardia lamblia
LSKGY

SEQ ID NO: 3058149 - protein, 14 aa, Giardia lamblia
LSKKQNRKIPGTTL

SEQ ID NO: 3058150 - protein, 4 aa, Giardia lamblia
LSKP

SEQ ID NO: 3058151 - protein, 8 aa, Giardia lamblia
LSKPTDTS

SEQ ID NO: 3058152 - protein, 7 aa, Giardia lamblia
LSKRGAF

SEQ ID NO: 3058153 - protein, 15 aa, Giardia lamblia
LSKSGLGDTPANQEV

SEQ ID NO: 3058154 - protein, 10 aa, Giardia lamblia
LSKTRKNGTS

SEQ ID NO: 3058155 - protein, 6 aa, Giardia lamblia
LSLRPD

SEQ ID NO: 3058156 - protein, 5 aa, Giardia lamblia
LSNAE

SEQ ID NO: 3058157 - protein, 5 aa, Giardia lamblia
LSNAI

SEQ ID NO: 3058158 - protein, 29 aa, Giardia lamblia
LSNDSDIRHDEPKRPDPNSVDAHGKKDSA

SEQ ID NO: 3058159 - protein, 8 aa, Giardia lamblia
LSNGRDVT

SEQ ID NO: 3058160 - protein, 17 aa, Giardia lamblia
LSNKNTKGSLRQQPELS

SEQ ID NO: 3058161 - protein, 9 aa, Giardia lamblia
LSNMPNGIS

SEQ ID NO: 3058162 - protein, 16 aa, Giardia lamblia
LSNPKLVEGTENDEKR

SEQ ID NO: 3058163 - protein, 8 aa, Giardia lamblia
LSNPRDSD

SEQ ID NO: 3058164 - protein, 5 aa, Giardia lamblia
LSNPS

SEQ ID NO: 3058165 - protein, 8 aa, Giardia lamblia
LSNQNGDI

SEQ ID NO: 3058166 - protein, 7 aa, Giardia lamblia
LSNRAKE

SEQ ID NO: 3058167 - protein, 6 aa, Giardia lamblia
LSNRTI

SEQ ID NO: 3058168 - protein, 12 aa, Giardia lamblia
LSNSARTDITDM

SEQ ID NO: 3058169 - protein, 11 aa, Giardia lamblia
LSNSNSSAESL

SEQ ID NO: 3058170 - protein, 4 aa, Giardia lamblia
LSPA

SEQ ID NO: 3058171 - protein, 7 aa, Giardia lamblia
LSPAEKK

SEQ ID NO: 3058172 - protein, 10 aa, Giardia lamblia
LSPDATATST

SEQ ID NO: 3058173 - protein, 9 aa, Giardia lamblia
LSPDEQASM

SEQ ID NO: 3058174 - protein, 12 aa, Giardia lamblia
LSPDSVAKTIDQ

SEQ ID NO: 3058175 - protein, 7 aa, Giardia lamblia
LSPEETR

SEQ ID NO: 3058176 - protein, 6 aa, Giardia lamblia
LSPEKK

SEQ ID NO: 3058177 - protein, 4 aa, Giardia lamblia
LSPG

SEQ ID NO: 3058178 - protein, 6 aa, Giardia lamblia
LSPGKR

SEQ ID NO: 3058179 - protein, 23 aa, Giardia lamblia
LSPGNAAGSQQRHRSKLSTTDIQ

SEQ ID NO: 3058180 - protein, 15 aa, Giardia lamblia
LSPGSSRSSSGTPVS

SEQ ID NO: 3058181 - protein, 6 aa, Giardia lamblia
LSPGVS

SEQ ID NO: 3058182 - protein, 4 aa, Giardia lamblia
LSPH

SEQ ID NO: 3058183 - protein, 6 aa, Giardia lamblia
LSPRRP

SEQ ID NO: 3058184 - protein, 7 aa, Giardia lamblia
LSPSGDL

SEQ ID NO: 3058185 - protein, 9 aa, Giardia lamblia
LSPSNTIGG

SEQ ID NO: 3058186 - protein, 17 aa, Giardia lamblia
LSPSSSQIPPKFKSSGQ

SEQ ID NO: 3058187 - protein, 5 aa, Giardia lamblia
LSPTA

SEQ ID NO: 3058188 - protein, 8 aa, Giardia lamblia
LSPTDKDD

SEQ ID NO: 3058189 - protein, 6 aa, Giardia lamblia
LSQDKK

SEQ ID NO: 3058190 - protein, 9 aa, Giardia lamblia
LSQDLSDDE

SEQ ID NO: 3058191 - protein, 6 aa, Giardia lamblia
LSQESV

SEQ ID NO: 3058192 - protein, 35 aa, Giardia lamblia
LSQHPSQPPPLPPPPRSAGPPAPAPTSVPAPAPPF

SEQ ID NO: 3058193 - protein, 4 aa, Giardia lamblia
LSQK

SEQ ID NO: 3058194 - protein, 13 aa, Giardia lamblia
LSQPPSSQFPHGK

SEQ ID NO: 3058195 - protein, 7 aa, Giardia lamblia
LSQREDY

SEQ ID NO: 3058196 - protein, 8 aa, Giardia lamblia
LSQSGKTL

SEQ ID NO: 3058197 - protein, 7 aa, Giardia lamblia
LSQTSQD

SEQ ID NO: 3058198 - protein, 9 aa, Giardia lamblia
LSRAGPQHY

SEQ ID NO: 3058199 - protein, 31 aa, Giardia lamblia
LSRHSRKDRAIKESKKKRSHPKLTRSELKDV

SEQ ID NO: 3058200 - protein, 9 aa, Giardia lamblia
LSRPSTGRV

SEQ ID NO: 3058201 - protein, 14 aa, Giardia lamblia
LSRPVSSRSAQRPL

SEQ ID NO: 3058202 - protein, 8 aa, Giardia lamblia
LSRQEAES

SEQ ID NO: 3058203 - protein, 10 aa, Giardia lamblia
LSRQTAKRGV

SEQ ID NO: 3058204 - protein, 5 aa, Giardia lamblia
LSRRG

SEQ ID NO: 3058205 - protein, 10 aa, Giardia lamblia
LSRRQDQQGI

SEQ ID NO: 3058206 - protein, 9 aa, Giardia lamblia
LSRTDSSNI

SEQ ID NO: 3058207 - protein, 20 aa, Giardia lamblia
LSSAATNFEAARGSTLPPLT

SEQ ID NO: 3058208 - protein, 11 aa, Giardia lamblia
LSSADDAGTHR

SEQ ID NO: 3058209 - protein, 25 aa, Giardia lamblia
LSSADVPGHSRISAEDDLPQQGREA

SEQ ID NO: 3058210 - protein, 12 aa, Giardia lamblia
LSSDEDESNNAD

SEQ ID NO: 3058211 - protein, 10 aa, Giardia lamblia
LSSEAAKGSV

SEQ ID NO: 3058212 - protein, 10 aa, Giardia lamblia
LSSEQEQKFT

SEQ ID NO: 3058213 - protein, 16 aa, Giardia lamblia
LSSKEGAANNGPCHRG

SEQ ID NO: 3058214 - protein, 4 aa, Giardia lamblia
LSSL

SEQ ID NO: 3058215 - protein, 11 aa, Giardia lamblia
LSSLSEEALSD

SEQ ID NO: 3058216 - protein, 7 aa, Giardia lamblia
LSSLSTR

SEQ ID NO: 3058217 - protein, 7 aa, Giardia lamblia
LSSNAQE

SEQ ID NO: 3058218 - protein, 4 aa, Giardia lamblia
LSSP

SEQ ID NO: 3058219 - protein, 7 aa, Giardia lamblia
LSSPGFE

SEQ ID NO: 3058220 - protein, 18 aa, Giardia lamblia
LSSPTSSTQHASSKAEEL

SEQ ID NO: 3058221 - protein, 10 aa, Giardia lamblia
LSSQSSGDYM

SEQ ID NO: 3058222 - protein, 4 aa, Giardia lamblia
LSSS

SEQ ID NO: 3058223 - protein, 12 aa, Giardia lamblia
LSSSDRNYNEST

SEQ ID NO: 3058224 - protein, 19 aa, Giardia lamblia
LSSSQTAGEMSDKQRHEST

SEQ ID NO: 3058225 - protein, 6 aa, Giardia lamblia
LSSSSK

SEQ ID NO: 3058226 - protein, 6 aa, Giardia lamblia
LSSSSV

SEQ ID NO: 3058227 - protein, 18 aa, Giardia lamblia
LSSTDNNACTSQDYPDGT

SEQ ID NO: 3058228 - protein, 9 aa, Giardia lamblia
LSSTGRSTN

SEQ ID NO: 3058229 - protein, 22 aa, Giardia lamblia
LSSTQLGSQQDTDSSAPQHHDL

SEQ ID NO: 3058230 - protein, 10 aa, Giardia lamblia
LSSVNPGPGS

SEQ ID NO: 3058231 - protein, 16 aa, Giardia lamblia
LSSVSGQHQSEASALG

SEQ ID NO: 3058232 - protein, 11 aa, Giardia lamblia
LSTAEETPETS

SEQ ID NO: 3058233 - protein, 6 aa, Giardia lamblia
LSTDDT

SEQ ID NO: 3058234 - protein, 10 aa, Giardia lamblia
LSTDEEKEEA

SEQ ID NO: 3058235 - protein, 18 aa, Giardia lamblia
LSTDENTDAKPKASQRPF

SEQ ID NO: 3058236 - protein, 13 aa, Giardia lamblia
LSTDVKDDVESRK

SEQ ID NO: 3058237 - protein, 4 aa, Giardia lamblia
LSTE

SEQ ID NO: 3058238 - protein, 9 aa, Giardia lamblia
LSTEATPAY

SEQ ID NO: 3058239 - protein, 9 aa, Giardia lamblia
LSTEQGVDA

SEQ ID NO: 3058240 - protein, 7 aa, Giardia lamblia
LSTESDL

SEQ ID NO: 3058241 - protein, 16 aa, Giardia lamblia
LSTETSSQKRSDPGRL

SEQ ID NO: 3058242 - protein, 4 aa, Giardia lamblia
LSTG

SEQ ID NO: 3058243 - protein, 7 aa, Giardia lamblia
LSTGTKA

SEQ ID NO: 3058244 - protein, 8 aa, Giardia lamblia
LSTNDESL

SEQ ID NO: 3058245 - protein, 11 aa, Giardia lamblia
LSTPSTTSQSA

SEQ ID NO: 3058246 - protein, 4 aa, Giardia lamblia
LSTQ

SEQ ID NO: 3058247 - protein, 10 aa, Giardia lamblia
LSTQSADPAK

SEQ ID NO: 3058248 - protein, 9 aa, Giardia lamblia
LSTQSSKET

SEQ ID NO: 3058249 - protein, 6 aa, Giardia lamblia
LSTRNT

SEQ ID NO: 3058250 - protein, 7 aa, Giardia lamblia
LSTSDDE

SEQ ID NO: 3058251 - protein, 5 aa, Giardia lamblia
LSTSG

SEQ ID NO: 3058252 - protein, 9 aa, Giardia lamblia
LSTSQNSIN

SEQ ID NO: 3058253 - protein, 9 aa, Giardia lamblia
LSTSSNQTS

SEQ ID NO: 3058254 - protein, 12 aa, Giardia lamblia
LSTSSTTTSSAT

SEQ ID NO: 3058255 - protein, 6 aa, Giardia lamblia
LSTTPL

SEQ ID NO: 3058256 - protein, 12 aa, Giardia lamblia
LSTTTNSCTPCD

SEQ ID NO: 3058257 - protein, 17 aa, Giardia lamblia
LSVGGAGNTFSITGGPV

SEQ ID NO: 3058258 - protein, 5 aa, Giardia lamblia
LTADG

SEQ ID NO: 3058259 - protein, 5 aa, Giardia lamblia
LTAEN

SEQ ID NO: 3058260 - protein, 7 aa, Giardia lamblia
LTAQKEE

SEQ ID NO: 3058261 - protein, 29 aa, Giardia lamblia
LTARESGQKASVSRPSSKLSNRPSSTRNL

SEQ ID NO: 3058262 - protein, 18 aa, Giardia lamblia
LTATNNKKHTEHAQADSE

SEQ ID NO: 3058263 - protein, 26 aa, Giardia lamblia
LTATPSQPTEKVGSRPTTGSDGGSAV

SEQ ID NO: 3058264 - protein, 4 aa, Giardia lamblia
LTCQ

SEQ ID NO: 3058265 - protein, 22 aa, Giardia lamblia
LTDAEAKVKTQKEKLKNSIEGS

SEQ ID NO: 3058266 - protein, 19 aa, Giardia lamblia
LTDDPTNSLCPSSETTLSM

SEQ ID NO: 3058267 - protein, 6 aa, Giardia lamblia
LTDDSL

SEQ ID NO: 3058268 - protein, 6 aa, Giardia lamblia
LTDGAS

SEQ ID NO: 3058269 - protein, 9 aa, Giardia lamblia
LTDGVGTPA

SEQ ID NO: 3058270 - protein, 5 aa, Giardia lamblia
LTDKQ

SEQ ID NO: 3058271 - protein, 11 aa, Giardia lamblia
LTDNSSAQEYS

SEQ ID NO: 3058272 - protein, 7 aa, Giardia lamblia
LTEIGEK

SEQ ID NO: 3058273 - protein, 4 aa, Giardia lamblia
LTEK

SEQ ID NO: 3058274 - protein, 8 aa, Giardia lamblia
LTENEYRR

SEQ ID NO: 3058275 - protein, 9 aa, Giardia lamblia
LTEPTSSGA

SEQ ID NO: 3058276 - protein, 21 aa, Giardia lamblia
LTERSKRVTNYPGNTTRPNLS

SEQ ID NO: 3058277 - protein, 8 aa, Giardia lamblia
LTESGFSS

SEQ ID NO: 3058278 - protein, 4 aa, Giardia lamblia
LTET

SEQ ID NO: 3058279 - protein, 8 aa, Giardia lamblia
LTETPTYT

SEQ ID NO: 3058280 - protein, 7 aa, Giardia lamblia
LTETQSE

SEQ ID NO: 3058281 - protein, 6 aa, Giardia lamblia
LTETSA

SEQ ID NO: 3058282 - protein, 7 aa, Giardia lamblia
LTGATSL

SEQ ID NO: 3058283 - protein, 4 aa, Giardia lamblia
LTGE

SEQ ID NO: 3058284 - protein, 10 aa, Giardia lamblia
LTGPPGEATQ

SEQ ID NO: 3058285 - protein, 5 aa, Giardia lamblia
LTGQG

SEQ ID NO: 3058286 - protein, 8 aa, Giardia lamblia
LTGSLASS

SEQ ID NO: 3058287 - protein, 7 aa, Giardia lamblia
LTGSSDS

SEQ ID NO: 3058288 - protein, 19 aa, Giardia lamblia
LTGTDKNALQQASTSTNSF

SEQ ID NO: 3058289 - protein, 13 aa, Giardia lamblia
LTGTPGKKDKEKD

SEQ ID NO: 3058290 - protein, 24 aa, Giardia lamblia
LTGTRGEPSLPNAAGSGVLGTGRK

SEQ ID NO: 3058291 - protein, 5 aa, Giardia lamblia
LTHGN

SEQ ID NO: 3058292 - protein, 16 aa, Giardia lamblia
LTKGDGRVIESTPDPA

SEQ ID NO: 3058293 - protein, 8 aa, Giardia lamblia
LTKGEMTT

SEQ ID NO: 3058294 - protein, 10 aa, Giardia lamblia
LTKSTGPTAS

SEQ ID NO: 3058295 - protein, 8 aa, Giardia lamblia
LTKTGSLT

SEQ ID NO: 3058296 - protein, 11 aa, Giardia lamblia
LTLPSSSQDLH

SEQ ID NO: 3058297 - protein, 15 aa, Giardia lamblia
LTMPGSLQPKEENTL

SEQ ID NO: 3058298 - protein, 9 aa, Giardia lamblia
LTNGTSSGL

SEQ ID NO: 3058299 - protein, 9 aa, Giardia lamblia
LTNPDDGDK

SEQ ID NO: 3058300 - protein, 5 aa, Giardia lamblia
LTNPQ

SEQ ID NO: 3058301 - protein, 9 aa, Giardia lamblia
LTNRNSAEV

SEQ ID NO: 3058302 - protein, 6 aa, Giardia lamblia
LTNSAS

SEQ ID NO: 3058303 - protein, 14 aa, Giardia lamblia
LTPEELKQAEEEDI

SEQ ID NO: 3058304 - protein, 6 aa, Giardia lamblia
LTPEEQ

SEQ ID NO: 3058305 - protein, 15 aa, Giardia lamblia
LTPGSPPRQSYSDEG

SEQ ID NO: 3058306 - protein, 17 aa, Giardia lamblia
LTPGSTDKIEGPRPPRR

SEQ ID NO: 3058307 - protein, 4 aa, Giardia lamblia
LTPN

SEQ ID NO: 3058308 - protein, 16 aa, Giardia lamblia
LTPNITANRSSPLASD

SEQ ID NO: 3058309 - protein, 5 aa, Giardia lamblia
LTPPE

SEQ ID NO: 3058310 - protein, 39 aa, Giardia lamblia
LTPSEEDARSNESTYATDNSDDTSPTSNHNSSQNSIQQT

SEQ ID NO: 3058311 - protein, 6 aa, Giardia lamblia
LTPSND

SEQ ID NO: 3058312 - protein, 9 aa, Giardia lamblia
LTPSNHSNL

SEQ ID NO: 3058313 - protein, 6 aa, Giardia lamblia
LTPSQS

SEQ ID NO: 3058314 - protein, 11 aa, Giardia lamblia
LTPSRNKPTRT

SEQ ID NO: 3058315 - protein, 6 aa, Giardia lamblia
LTPSVQ

SEQ ID NO: 3058316 - protein, 4 aa, Giardia lamblia
LTQE

SEQ ID NO: 3058317 - protein, 13 aa, Giardia lamblia
LTQEQKVRKRAGK

SEQ ID NO: 3058318 - protein, 8 aa, Giardia lamblia
LTQESSAS

SEQ ID NO: 3058319 - protein, 8 aa, Giardia lamblia
LTQSESIG

SEQ ID NO: 3058320 - protein, 7 aa, Giardia lamblia
LTSASNL

SEQ ID NO: 3058321 - protein, 12 aa, Giardia lamblia
LTSDPSESQKLP

SEQ ID NO: 3058322 - protein, 9 aa, Giardia lamblia
LTSERENTY

SEQ ID NO: 3058323 - protein, 4 aa, Giardia lamblia
LTSG

SEQ ID NO: 3058324 - protein, 8 aa, Giardia lamblia
LTSGPFGP

SEQ ID NO: 3058325 - protein, 10 aa, Giardia lamblia
LTSGRGATQR

SEQ ID NO: 3058326 - protein, 4 aa, Giardia lamblia
LTSI

SEQ ID NO: 3058327 - protein, 5 aa, Giardia lamblia
LTSNW

SEQ ID NO: 3058328 - protein, 7 aa, Giardia lamblia
LTSPPLC

SEQ ID NO: 3058329 - protein, 9 aa, Giardia lamblia
LTSPPSVPR

SEQ ID NO: 3058330 - protein, 9 aa, Giardia lamblia
LTSRDDRYS

SEQ ID NO: 3058331 - protein, 6 aa, Giardia lamblia
LTSRDV

SEQ ID NO: 3058332 - protein, 37 aa, Giardia lamblia
LTSRPPSYGAHTPNANEHDLPEVTTSRSTARGKTPLK

SEQ ID NO: 3058333 - protein, 16 aa, Giardia lamblia
LTSSKHKQEYKTKIGR

SEQ ID NO: 3058334 - protein, 5 aa, Giardia lamblia
LTSSS

SEQ ID NO: 3058335 - protein, 6 aa, Giardia lamblia
LTSTDE

SEQ ID NO: 3058336 - protein, 12 aa, Giardia lamblia
LTSTDKISHGGT

SEQ ID NO: 3058337 - protein, 11 aa, Giardia lamblia
LTTDGQKYVPS

SEQ ID NO: 3058338 - protein, 4 aa, Giardia lamblia
LTTG

SEQ ID NO: 3058339 - protein, 9 aa, Giardia lamblia
LTTKSTSAV

SEQ ID NO: 3058340 - protein, 7 aa, Giardia lamblia
LTTNESV

SEQ ID NO: 3058341 - protein, 13 aa, Giardia lamblia
LTTNGKSTQGDKY

SEQ ID NO: 3058342 - protein, 8 aa, Giardia lamblia
LTTPRSEQ

SEQ ID NO: 3058343 - protein, 5 aa, Giardia lamblia
LTTQG

SEQ ID NO: 3058344 - protein, 6 aa, Giardia lamblia
LTTSLP

SEQ ID NO: 3058345 - protein, 8 aa, Giardia lamblia
LTTSTDEH

SEQ ID NO: 3058346 - protein, 17 aa, Giardia lamblia
LTTTGESLANSQNTAAI

SEQ ID NO: 3058347 - protein, 8 aa, Giardia lamblia
LTTVNENE

SEQ ID NO: 3058348 - protein, 5 aa, Giardia lamblia
LTYGN

SEQ ID NO: 3058349 - protein, 11 aa, Giardia lamblia
LVDNNSRTYKE

SEQ ID NO: 3058350 - protein, 17 aa, Giardia lamblia
LVGSTENSSFPSQPRSM

SEQ ID NO: 3058351 - protein, 7 aa, Giardia lamblia
LVPGDQN

SEQ ID NO: 3058352 - protein, 9 aa, Giardia lamblia
LVSPGGTQQ

SEQ ID NO: 3058353 - protein, 5 aa, Giardia lamblia
LVSPN

SEQ ID NO: 3058354 - protein, 4 aa, Giardia lamblia
LVSS

SEQ ID NO: 3058355 - protein, 10 aa, Giardia lamblia
LVSSESRKSF

SEQ ID NO: 3058356 - protein, 6 aa, Giardia lamblia
LVTPQT

SEQ ID NO: 3058357 - protein, 5 aa, Giardia lamblia
LVTSS

SEQ ID NO: 3058358 - protein, 7 aa, Giardia lamblia
LYERSGE

SEQ ID NO: 3058359 - protein, 18 aa, Giardia lamblia
LYGPADNHETVDSDDPER

SEQ ID NO: 3058360 - protein, 10 aa, Giardia lamblia
LYSKSSRDSI

SEQ ID NO: 3058361 - protein, 18 aa, Giardia lamblia
LYTQDGGNARESSTDITP

SEQ ID NO: 3058362 - protein, 9 aa, Giardia lamblia
LYTSTSTIE

SEQ ID NO: 3058363 - protein, 11 aa, Giardia lamblia
MAAPTSAPVPV

SEQ ID NO: 3058364 - protein, 10 aa, Giardia lamblia
MADGTDSIDQ

SEQ ID NO: 3058365 - protein, 31 aa, Giardia lamblia
MAESGEQVGTLEGSKDDIQRSNRPASGADAA

SEQ ID NO: 3058366 - protein, 8 aa, Giardia lamblia
MANEEQCR

SEQ ID NO: 3058367 - protein, 7 aa, Giardia lamblia
MANGSTL

SEQ ID NO: 3058368 - protein, 14 aa, Giardia lamblia
MANPSGKSDTGAGI

SEQ ID NO: 3058369 - protein, 13 aa, Giardia lamblia
MAPKSSSSKGDHV

SEQ ID NO: 3058370 - protein, 7 aa, Giardia lamblia
MAPPKAY

SEQ ID NO: 3058371 - protein, 9 aa, Giardia lamblia
MAPRNAGKR

SEQ ID NO: 3058372 - protein, 4 aa, Giardia lamblia
MASD

SEQ ID NO: 3058373 - protein, 12 aa, Giardia lamblia
MASTAAENGSLT

SEQ ID NO: 3058374 - protein, 8 aa, Giardia lamblia
MASTTTRS

SEQ ID NO: 3058375 - protein, 9 aa, Giardia lamblia
MATKSTTNL

SEQ ID NO: 3058376 - protein, 6 aa, Giardia lamblia
MCDPTS

SEQ ID NO: 3058377 - protein, 21 aa, Giardia lamblia
MDHDSDDSDTYEHQESAQKDF

SEQ ID NO: 3058378 - protein, 7 aa, Giardia lamblia
MDNDGQY

SEQ ID NO: 3058379 - protein, 7 aa, Giardia lamblia
MDPALPQ

SEQ ID NO: 3058380 - protein, 4 aa, Giardia lamblia
MDPR

SEQ ID NO: 3058381 - protein, 8 aa, Giardia lamblia
MDPSNEHS

SEQ ID NO: 3058382 - protein, 9 aa, Giardia lamblia
MDRTEGSAA

SEQ ID NO: 3058383 - protein, 4 aa, Giardia lamblia
MDSH

SEQ ID NO: 3058384 - protein, 7 aa, Giardia lamblia
MDSRSNI

SEQ ID NO: 3058385 - protein, 5 aa, Giardia lamblia
MDSSA

SEQ ID NO: 3058386 - protein, 27 aa, Giardia lamblia
MDSSGVTSGSGSFSIKSTATGVPPSTL

SEQ ID NO: 3058387 - protein, 20 aa, Giardia lamblia
MDSSPTGSDVKADGPADPLM

SEQ ID NO: 3058388 - protein, 10 aa, Giardia lamblia
MDSTSDRSQL

SEQ ID NO: 3058389 - protein, 6 aa, Giardia lamblia
MDTEDT

SEQ ID NO: 3058390 - protein, 8 aa, Giardia lamblia
MDTSGNGM

SEQ ID NO: 3058391 - protein, 5 aa, Giardia lamblia
MDTSQ

SEQ ID NO: 3058392 - protein, 22 aa, Giardia lamblia
MEAEDIRPGCQKGNTNGNSLTN

SEQ ID NO: 3058393 - protein, 8 aa, Giardia lamblia
MEASNSSA

SEQ ID NO: 3058394 - protein, 7 aa, Giardia lamblia
MEDSDNR

SEQ ID NO: 3058395 - protein, 24 aa, Giardia lamblia
MEERTRSPTQHTQASPILTDNGDE

SEQ ID NO: 3058396 - protein, 19 aa, Giardia lamblia
MEGDPDDDDDRLSTVTSAT

SEQ ID NO: 3058397 - protein, 4 aa, Giardia lamblia
MEGS

SEQ ID NO: 3058398 - protein, 7 aa, Giardia lamblia
MEGSEPR

SEQ ID NO: 3058399 - protein, 9 aa, Giardia lamblia
MEGTVESSG

SEQ ID NO: 3058400 - protein, 10 aa, Giardia lamblia
MEKDPNATTE

SEQ ID NO: 3058401 - protein, 8 aa, Giardia lamblia
MEKENRAD

SEQ ID NO: 3058402 - protein, 11 aa, Giardia lamblia
MEKSKQEKLED

SEQ ID NO: 3058403 - protein, 9 aa, Giardia lamblia
MENRSQSIS

SEQ ID NO: 3058404 - protein, 8 aa, Giardia lamblia
MEPGGSTI

SEQ ID NO: 3058405 - protein, 25 aa, Giardia lamblia
MEQSGGGYEGSEEAPQASDKGGTQK

SEQ ID NO: 3058406 - protein, 7 aa, Giardia lamblia
MEQTSSK

SEQ ID NO: 3058407 - protein, 10 aa, Giardia lamblia
MESSPEAHAD

SEQ ID NO: 3058408 - protein, 4 aa, Giardia lamblia
MGAS

SEQ ID NO: 3058409 - protein, 10 aa, Giardia lamblia
MGASKGSPHL

SEQ ID NO: 3058410 - protein, 5 aa, Giardia lamblia
MGDEK

SEQ ID NO: 3058411 - protein, 13 aa, Giardia lamblia
MGDKGKRKAGHHN

SEQ ID NO: 3058412 - protein, 5 aa, Giardia lamblia
MGDPT

SEQ ID NO: 3058413 - protein, 6 aa, Giardia lamblia
MGETPD

SEQ ID NO: 3058414 - protein, 9 aa, Giardia lamblia
MGGEGSADF

SEQ ID NO: 3058415 - protein, 8 aa, Giardia lamblia
MGIEKNEA

SEQ ID NO: 3058416 - protein, 22 aa, Giardia lamblia
MGPAKSVHKSARSEGAETPASL

SEQ ID NO: 3058417 - protein, 11 aa, Giardia lamblia
MGSESSAKSIR

SEQ ID NO: 3058418 - protein, 5 aa, Giardia lamblia
MGSSI

SEQ ID NO: 3058419 - protein, 8 aa, Giardia lamblia
MGSTTAKP

SEQ ID NO: 3058420 - protein, 8 aa, Giardia lamblia
MGTGNQGA

SEQ ID NO: 3058421 - protein, 5 aa, Giardia lamblia
MGTVG

SEQ ID NO: 3058422 - protein, 18 aa, Giardia lamblia
MHASTGTAQSCSEYSVST

SEQ ID NO: 3058423 - protein, 10 aa, Giardia lamblia
MHNDNSSEAI

SEQ ID NO: 3058424 - protein, 44 aa, Giardia lamblia
MKAKKNDEKIEKEQEESSSYSSDGDETSDMNSMANSAKSSMFDG

SEQ ID NO: 3058425 - protein, 8 aa, Giardia lamblia
MKATPSQQ

SEQ ID NO: 3058426 - protein, 6 aa, Giardia lamblia
MKDAAG

SEQ ID NO: 3058427 - protein, 8 aa, Giardia lamblia
MKEGTQVE

SEQ ID NO: 3058428 - protein, 28 aa, Giardia lamblia
MKENAGASPYTPFPGNSIDTVSRSSSEL

SEQ ID NO: 3058429 - protein, 12 aa, Giardia lamblia
MKGKEQATPQAT

SEQ ID NO: 3058430 - protein, 8 aa, Giardia lamblia
MKNGTTFT

SEQ ID NO: 3058431 - protein, 11 aa, Giardia lamblia
MKPGESPHTLT

SEQ ID NO: 3058432 - protein, 10 aa, Giardia lamblia
MKPGPDQQLS

SEQ ID NO: 3058433 - protein, 9 aa, Giardia lamblia
MKPLDDGMK

SEQ ID NO: 3058434 - protein, 13 aa, Giardia lamblia
MKPSKKSRTQIIY

SEQ ID NO: 3058435 - protein, 9 aa, Giardia lamblia
MKQKQRMET

SEQ ID NO: 3058436 - protein, 12 aa, Giardia lamblia
MKRSDSSVSSDT

SEQ ID NO: 3058437 - protein, 16 aa, Giardia lamblia
MKSNTKDGSIDGGTIE

SEQ ID NO: 3058438 - protein, 10 aa, Giardia lamblia
MLNPDGSPLT

SEQ ID NO: 3058439 - protein, 9 aa, Giardia lamblia
MLPSNSEHA

SEQ ID NO: 3058440 - protein, 7 aa, Giardia lamblia
MLPSTES

SEQ ID NO: 3058441 - protein, 9 aa, Giardia lamblia
MLPTPDGTA

SEQ ID NO: 3058442 - protein, 7 aa, Giardia lamblia
MNGKPRT

SEQ ID NO: 3058443 - protein, 21 aa, Giardia lamblia
MNGPYDTPGEDDYDRTARTPF

SEQ ID NO: 3058444 - protein, 6 aa, Giardia lamblia
MNGRTD

SEQ ID NO: 3058445 - protein, 11 aa, Giardia lamblia
MNKRSKSDLER

SEQ ID NO: 3058446 - protein, 16 aa, Giardia lamblia
MNQASSNSDTVSMKSE

SEQ ID NO: 3058447 - protein, 12 aa, Giardia lamblia
MNQGRSDGHSQS

SEQ ID NO: 3058448 - protein, 12 aa, Giardia lamblia
MNSNAKSMANEA

SEQ ID NO: 3058449 - protein, 20 aa, Giardia lamblia
MNYPNGSTYTGPYKEDLRSG

SEQ ID NO: 3058450 - protein, 23 aa, Giardia lamblia
MPEQKPTIAQESAEIANRRESCS

SEQ ID NO: 3058451 - protein, 13 aa, Giardia lamblia
MPFPSTVSESTSM

SEQ ID NO: 3058452 - protein, 34 aa, Giardia lamblia
MPGTSLPHPSSSSIVPGDDSAPSTMGPGSPSINV

SEQ ID NO: 3058453 - protein, 6 aa, Giardia lamblia
MPKRRL

SEQ ID NO: 3058454 - protein, 5 aa, Giardia lamblia
MPNTE

SEQ ID NO: 3058455 - protein, 6 aa, Giardia lamblia
MPPSAA

SEQ ID NO: 3058456 - protein, 30 aa, Giardia lamblia
MPSETPDDETQSFDTSQVPNPYTSMGEDSM

SEQ ID NO: 3058457 - protein, 8 aa, Giardia lamblia
MPSETSPY

SEQ ID NO: 3058458 - protein, 8 aa, Giardia lamblia
MPSTHSTT

SEQ ID NO: 3058459 - protein, 12 aa, Giardia lamblia
MPTAPDANPSFS

SEQ ID NO: 3058460 - protein, 4 aa, Giardia lamblia
MPTH

SEQ ID NO: 3058461 - protein, 4 aa, Giardia lamblia
MPTP

SEQ ID NO: 3058462 - protein, 10 aa, Giardia lamblia
MPTSDANPRT

SEQ ID NO: 3058463 - protein, 4 aa, Giardia lamblia
MPVS

SEQ ID NO: 3058464 - protein, 29 aa, Giardia lamblia
MQADDTPPFTTEAATSTPMREELPTNPKP

SEQ ID NO: 3058465 - protein, 5 aa, Giardia lamblia
MQDRT

SEQ ID NO: 3058466 - protein, 9 aa, Giardia lamblia
MQDSSGRTA

SEQ ID NO: 3058467 - protein, 11 aa, Giardia lamblia
MQGGSRSIQKG

SEQ ID NO: 3058468 - protein, 5 aa, Giardia lamblia
MQKKT

SEQ ID NO: 3058469 - protein, 11 aa, Giardia lamblia
MQKTGDPSSMD

SEQ ID NO: 3058470 - protein, 8 aa, Giardia lamblia
MQNKEGRT

SEQ ID NO: 3058471 - protein, 7 aa, Giardia lamblia
MQNSATY

SEQ ID NO: 3058472 - protein, 8 aa, Giardia lamblia
MQPEKANK

SEQ ID NO: 3058473 - protein, 9 aa, Giardia lamblia
MQPNGGNAS

SEQ ID NO: 3058474 - protein, 6 aa, Giardia lamblia
MQPSPY

SEQ ID NO: 3058475 - protein, 5 aa, Giardia lamblia
MQSDR

SEQ ID NO: 3058476 - protein, 19 aa, Giardia lamblia
MQSGTEDTAAAHGSSSMSR

SEQ ID NO: 3058477 - protein, 8 aa, Giardia lamblia
MRATDGST

SEQ ID NO: 3058478 - protein, 8 aa, Giardia lamblia
MRDARGKT

SEQ ID NO: 3058479 - protein, 18 aa, Giardia lamblia
MRERTRTQALADTYNKST

SEQ ID NO: 3058480 - protein, 11 aa, Giardia lamblia
MRKEKERALPC

SEQ ID NO: 3058481 - protein, 12 aa, Giardia lamblia
MRKGVSDEERRA

SEQ ID NO: 3058482 - protein, 15 aa, Giardia lamblia
MRPDGSSPVTSPKNS

SEQ ID NO: 3058483 - protein, 9 aa, Giardia lamblia
MRPPSSPSV

SEQ ID NO: 3058484 - protein, 12 aa, Giardia lamblia
MRSESSNTSSAV

SEQ ID NO: 3058485 - protein, 5 aa, Giardia lamblia
MRSEY

SEQ ID NO: 3058486 - protein, 10 aa, Giardia lamblia
MRSSKDDADI

SEQ ID NO: 3058487 - protein, 8 aa, Giardia lamblia
MRSSNSGV

SEQ ID NO: 3058488 - protein, 5 aa, Giardia lamblia
MRTQP

SEQ ID NO: 3058489 - protein, 4 aa, Giardia lamblia
MRTR

SEQ ID NO: 3058490 - protein, 8 aa, Giardia lamblia
MSAAGASE

SEQ ID NO: 3058491 - protein, 19 aa, Giardia lamblia
MSAGATPSIQSRHTRGVPS

SEQ ID NO: 3058492 - protein, 9 aa, Giardia lamblia
MSAQGNKDT

SEQ ID NO: 3058493 - protein, 34 aa, Giardia lamblia
MSASAEVDRATGSPAGPGAVQNPKADPEEEPLVI

SEQ ID NO: 3058494 - protein, 6 aa, Giardia lamblia
MSASPA

SEQ ID NO: 3058495 - protein, 7 aa, Giardia lamblia
MSASRGM

SEQ ID NO: 3058496 - protein, 9 aa, Giardia lamblia
MSATSPSQM

SEQ ID NO: 3058497 - protein, 9 aa, Giardia lamblia
MSDNRKADV

SEQ ID NO: 3058498 - protein, 21 aa, Giardia lamblia
MSEGTNEGGHTSKAPKLDSID

SEQ ID NO: 3058499 - protein, 6 aa, Giardia lamblia
MSEKDA

SEQ ID NO: 3058500 - protein, 6 aa, Giardia lamblia
MSEPNT

SEQ ID NO: 3058501 - protein, 8 aa, Giardia lamblia
MSESNLSQ

SEQ ID NO: 3058502 - protein, 9 aa, Giardia lamblia
MSGDSAQTV

SEQ ID NO: 3058503 - protein, 11 aa, Giardia lamblia
MSGGTSGVARN

SEQ ID NO: 3058504 - protein, 11 aa, Giardia lamblia
MSGSGGYADTP

SEQ ID NO: 3058505 - protein, 5 aa, Giardia lamblia
MSNPI

SEQ ID NO: 3058506 - protein, 12 aa, Giardia lamblia
MSPDAKKDAAAT

SEQ ID NO: 3058507 - protein, 9 aa, Giardia lamblia
MSPDGIPTM

SEQ ID NO: 3058508 - protein, 4 aa, Giardia lamblia
MSPE

SEQ ID NO: 3058509 - protein, 12 aa, Giardia lamblia
MSPGSTNAPQVE

SEQ ID NO: 3058510 - protein, 10 aa, Giardia lamblia
MSPPDNTCVS

SEQ ID NO: 3058511 - protein, 30 aa, Giardia lamblia
MSPTARLGDDGYNKLEQNQSDTQAASSPHP

SEQ ID NO: 3058512 - protein, 7 aa, Giardia lamblia
MSPTQGY

SEQ ID NO: 3058513 - protein, 14 aa, Giardia lamblia
MSPVSKEMDQQSAD

SEQ ID NO: 3058514 - protein, 9 aa, Giardia lamblia
MSQKSDERV

SEQ ID NO: 3058515 - protein, 13 aa, Giardia lamblia
MSSEQQTGTNDLN

SEQ ID NO: 3058516 - protein, 7 aa, Giardia lamblia
MSSGDTK

SEQ ID NO: 3058517 - protein, 5 aa, Giardia lamblia
MSSKD

SEQ ID NO: 3058518 - protein, 9 aa, Giardia lamblia
MSSKRTSIS

SEQ ID NO: 3058519 - protein, 20 aa, Giardia lamblia
MSSNHDNRNVVNSRSDNQLT

SEQ ID NO: 3058520 - protein, 10 aa, Giardia lamblia
MSSSDMDTDV

SEQ ID NO: 3058521 - protein, 18 aa, Giardia lamblia
MSSSIRSTDQLNSSTETM

SEQ ID NO: 3058522 - protein, 5 aa, Giardia lamblia
MSTNP

SEQ ID NO: 3058523 - protein, 13 aa, Giardia lamblia
MSTPNISDFPGTE

SEQ ID NO: 3058524 - protein, 12 aa, Giardia lamblia
MTAPQNGGRHGR

SEQ ID NO: 3058525 - protein, 5 aa, Giardia lamblia
MTDEI

SEQ ID NO: 3058526 - protein, 7 aa, Giardia lamblia
MTDNSEP

SEQ ID NO: 3058527 - protein, 9 aa, Giardia lamblia
MTEGKPYAP

SEQ ID NO: 3058528 - protein, 10 aa, Giardia lamblia
MTGPGGSRDV

SEQ ID NO: 3058529 - protein, 19 aa, Giardia lamblia
MTGRDEDKLEAGVTKRVDT

SEQ ID NO: 3058530 - protein, 4 aa, Giardia lamblia
MTKR

SEQ ID NO: 3058531 - protein, 12 aa, Giardia lamblia
MTLSGTDDSAPM

SEQ ID NO: 3058532 - protein, 6 aa, Giardia lamblia
MTNSNV

SEQ ID NO: 3058533 - protein, 12 aa, Giardia lamblia
MTPEEQKAPPCT

SEQ ID NO: 3058534 - protein, 14 aa, Giardia lamblia
MTPKKKKMAGNNIE

SEQ ID NO: 3058535 - protein, 4 aa, Giardia lamblia
MTRD

SEQ ID NO: 3058536 - protein, 4 aa, Giardia lamblia
MTRT

SEQ ID NO: 3058537 - protein, 8 aa, Giardia lamblia
MTRTGDPR

SEQ ID NO: 3058538 - protein, 7 aa, Giardia lamblia
MTSSGKT

SEQ ID NO: 3058539 - protein, 31 aa, Giardia lamblia
MTSSSYYSQSSSDEDSTDRRYTKSLESDDDI

SEQ ID NO: 3058540 - protein, 5 aa, Giardia lamblia
MTTDQ

SEQ ID NO: 3058541 - protein, 9 aa, Giardia lamblia
MVDADGQSA

SEQ ID NO: 3058542 - protein, 4 aa, Giardia lamblia
MYDA

SEQ ID NO: 3058543 - protein, 13 aa, Giardia lamblia
NAAKPGALTPEQL

SEQ ID NO: 3058544 - protein, 23 aa, Giardia lamblia
NAANSSKKDSALSSGQEKRSSYM

SEQ ID NO: 3058545 - protein, 8 aa, Giardia lamblia
NAAPASMS

SEQ ID NO: 3058546 - protein, 12 aa, Giardia lamblia
NAAQNSKPPDHD

SEQ ID NO: 3058547 - protein, 6 aa, Giardia lamblia
NAAVPE

SEQ ID NO: 3058548 - protein, 17 aa, Giardia lamblia
NADAAEAIKTEISDSNS

SEQ ID NO: 3058549 - protein, 19 aa, Giardia lamblia
NADASDASTDDESTTENQV

SEQ ID NO: 3058550 - protein, 8 aa, Giardia lamblia
NADEQDPL

SEQ ID NO: 3058551 - protein, 4 aa, Giardia lamblia
NADN

SEQ ID NO: 3058552 - protein, 10 aa, Giardia lamblia
NADNAPATMN

SEQ ID NO: 3058553 - protein, 8 aa, Giardia lamblia
NADPISAT

SEQ ID NO: 3058554 - protein, 19 aa, Giardia lamblia
NADSAQLAAPSSADGTDLK

SEQ ID NO: 3058555 - protein, 9 aa, Giardia lamblia
NAEEARDKL

SEQ ID NO: 3058556 - protein, 8 aa, Giardia lamblia
NAEPPKYT

SEQ ID NO: 3058557 - protein, 6 aa, Giardia lamblia
NAEQNT

SEQ ID NO: 3058558 - protein, 12 aa, Giardia lamblia
NAERRRLDSPNN

SEQ ID NO: 3058559 - protein, 7 aa, Giardia lamblia
NAESTSI

SEQ ID NO: 3058560 - protein, 8 aa, Giardia lamblia
NAETGGRF

SEQ ID NO: 3058561 - protein, 8 aa, Giardia lamblia
NAGHVDES

SEQ ID NO: 3058562 - protein, 4 aa, Giardia lamblia
NAGP

SEQ ID NO: 3058563 - protein, 6 aa, Giardia lamblia
NAHDHD

SEQ ID NO: 3058564 - protein, 7 aa, Giardia lamblia
NAIPDED

SEQ ID NO: 3058565 - protein, 8 aa, Giardia lamblia
NAKSASDN

SEQ ID NO: 3058566 - protein, 6 aa, Giardia lamblia
NAKSIS

SEQ ID NO: 3058567 - protein, 7 aa, Giardia lamblia
NALQNYQ

SEQ ID NO: 3058568 - protein, 10 aa, Giardia lamblia
NALSAPTSRK

SEQ ID NO: 3058569 - protein, 8 aa, Giardia lamblia
NALSPGAI

SEQ ID NO: 3058570 - protein, 5 aa, Giardia lamblia
NAMET

SEQ ID NO: 3058571 - protein, 11 aa, Giardia lamblia
NANDPPASTTR

SEQ ID NO: 3058572 - protein, 8 aa, Giardia lamblia
NANEHPGS

SEQ ID NO: 3058573 - protein, 4 aa, Giardia lamblia
NANV

SEQ ID NO: 3058574 - protein, 6 aa, Giardia lamblia
NAPDPV

SEQ ID NO: 3058575 - protein, 7 aa, Giardia lamblia
NAPENDV

SEQ ID NO: 3058576 - protein, 6 aa, Giardia lamblia
NAPERL

SEQ ID NO: 3058577 - protein, 7 aa, Giardia lamblia
NAPERRT

SEQ ID NO: 3058578 - protein, 16 aa, Giardia lamblia
NAPLNAPSNEYSSTEV

SEQ ID NO: 3058579 - protein, 7 aa, Giardia lamblia
NAPLSNI

SEQ ID NO: 3058580 - protein, 7 aa, Giardia lamblia
NAPRKLK

SEQ ID NO: 3058581 - protein, 8 aa, Giardia lamblia
NAPSNSYN

SEQ ID NO: 3058582 - protein, 11 aa, Giardia lamblia
NAPTPGSKDTT

SEQ ID NO: 3058583 - protein, 8 aa, Giardia lamblia
NAPTTRSS

SEQ ID NO: 3058584 - protein, 7 aa, Giardia lamblia
NAPYSSP

SEQ ID NO: 3058585 - protein, 6 aa, Giardia lamblia
NAQAAQ

SEQ ID NO: 3058586 - protein, 4 aa, Giardia lamblia
NAQG

SEQ ID NO: 3058587 - protein, 10 aa, Giardia lamblia
NAQHNNSLTQ

SEQ ID NO: 3058588 - protein, 7 aa, Giardia lamblia
NAQNSPL

SEQ ID NO: 3058589 - protein, 9 aa, Giardia lamblia
NAQQSKQLN

SEQ ID NO: 3058590 - protein, 5 aa, Giardia lamblia
NAQTD

SEQ ID NO: 3058591 - protein, 8 aa, Giardia lamblia
NAQTRSLT

SEQ ID NO: 3058592 - protein, 39 aa, Giardia lamblia
NARDTKSPKAKRGIEKSSTDQVSRENAPLKDSGSNDEIV

SEQ ID NO: 3058593 - protein, 8 aa, Giardia lamblia
NARLPSRR

SEQ ID NO: 3058594 - protein, 4 aa, Giardia lamblia
NARP

SEQ ID NO: 3058595 - protein, 8 aa, Giardia lamblia
NARRHPED

SEQ ID NO: 3058596 - protein, 4 aa, Giardia lamblia
NART

SEQ ID NO: 3058597 - protein, 22 aa, Giardia lamblia
NASAAQYELEEEEAATCNPEED

SEQ ID NO: 3058598 - protein, 5 aa, Giardia lamblia
NASDA

SEQ ID NO: 3058599 - protein, 14 aa, Giardia lamblia
NASDYQSSASGYGN

SEQ ID NO: 3058600 - protein, 8 aa, Giardia lamblia
NASESAGQ

SEQ ID NO: 3058601 - protein, 5 aa, Giardia lamblia
NASFP

SEQ ID NO: 3058602 - protein, 8 aa, Giardia lamblia
NASGTESP

SEQ ID NO: 3058603 - protein, 7 aa, Giardia lamblia
NASHQEL

SEQ ID NO: 3058604 - protein, 9 aa, Giardia lamblia
NASITSSIS

SEQ ID NO: 3058605 - protein, 7 aa, Giardia lamblia
NASLGVR

SEQ ID NO: 3058606 - protein, 8 aa, Giardia lamblia
NASNEAEY

SEQ ID NO: 3058607 - protein, 7 aa, Giardia lamblia
NASNQSY

SEQ ID NO: 3058608 - protein, 10 aa, Giardia lamblia
NASPGPEGGP

SEQ ID NO: 3058609 - protein, 20 aa, Giardia lamblia
NASPLTPGPEPRDRTSTVGP

SEQ ID NO: 3058610 - protein, 7 aa, Giardia lamblia
NASPRDR

SEQ ID NO: 3058611 - protein, 8 aa, Giardia lamblia
NASPTERQ

SEQ ID NO: 3058612 - protein, 5 aa, Giardia lamblia
NASQD

SEQ ID NO: 3058613 - protein, 6 aa, Giardia lamblia
NASSLT

SEQ ID NO: 3058614 - protein, 6 aa, Giardia lamblia
NATAGY

SEQ ID NO: 3058615 - protein, 17 aa, Giardia lamblia
NATAIAEGKCDSPAGTN

SEQ ID NO: 3058616 - protein, 10 aa, Giardia lamblia
NATASDQPRV

SEQ ID NO: 3058617 - protein, 7 aa, Giardia lamblia
NATATSV

SEQ ID NO: 3058618 - protein, 11 aa, Giardia lamblia
NATDTSRTGIP

SEQ ID NO: 3058619 - protein, 7 aa, Giardia lamblia
NATEDDL

SEQ ID NO: 3058620 - protein, 5 aa, Giardia lamblia
NATEE

SEQ ID NO: 3058621 - protein, 6 aa, Giardia lamblia
NATEGL

SEQ ID NO: 3058622 - protein, 4 aa, Giardia lamblia
NATG

SEQ ID NO: 3058623 - protein, 15 aa, Giardia lamblia
NATPDKQLPDAGTEV

SEQ ID NO: 3058624 - protein, 5 aa, Giardia lamblia
NATTH

SEQ ID NO: 3058625 - protein, 7 aa, Giardia lamblia
NATTLNA

SEQ ID NO: 3058626 - protein, 24 aa, Giardia lamblia
NAVATDDTRDKPYGHSSKTPSTKC

SEQ ID NO: 3058627 - protein, 11 aa, Giardia lamblia
NAVGSKDTELE

SEQ ID NO: 3058628 - protein, 5 aa, Giardia lamblia
NAVSD

SEQ ID NO: 3058629 - protein, 12 aa, Giardia lamblia
NAWKTSGSGEIR

SEQ ID NO: 3058630 - protein, 6 aa, Giardia lamblia
NAYRPE

SEQ ID NO: 3058631 - protein, 4 aa, Giardia lamblia
NAYS

SEQ ID NO: 3058632 - protein, 5 aa, Giardia lamblia
NCACT

SEQ ID NO: 3058633 - protein, 9 aa, Giardia lamblia
NCDENSTED

SEQ ID NO: 3058634 - protein, 6 aa, Giardia lamblia
NCERCD

SEQ ID NO: 3058635 - protein, 5 aa, Giardia lamblia
NCGQS

SEQ ID NO: 3058636 - protein, 22 aa, Giardia lamblia
NCGRSTQDDDCGGSTVANNPSC

SEQ ID NO: 3058637 - protein, 10 aa, Giardia lamblia
NCNANRAGGV

SEQ ID NO: 3058638 - protein, 5 aa, Giardia lamblia
NCQEC

SEQ ID NO: 3058639 - protein, 10 aa, Giardia lamblia
NCQNKSPEQL

SEQ ID NO: 3058640 - protein, 8 aa, Giardia lamblia
NCSKDAAK

SEQ ID NO: 3058641 - protein, 10 aa, Giardia lamblia
NCSNTTADNG

SEQ ID NO: 3058642 - protein, 21 aa, Giardia lamblia
NCSTQNSDDNHYYGDSATGAC

SEQ ID NO: 3058643 - protein, 4 aa, Giardia lamblia
NCTA

SEQ ID NO: 3058644 - protein, 23 aa, Giardia lamblia
NCTTDSACAHGGSCDKSFGSSYG

SEQ ID NO: 3058645 - protein, 4 aa, Giardia lamblia
NCYE

SEQ ID NO: 3058646 - protein, 6 aa, Giardia lamblia
NDAGDT

SEQ ID NO: 3058647 - protein, 4 aa, Giardia lamblia
NDDA

SEQ ID NO: 3058648 - protein, 22 aa, Giardia lamblia
NDDSTGDNTGGSTNKSGLSTGA

SEQ ID NO: 3058649 - protein, 5 aa, Giardia lamblia
NDDTA

SEQ ID NO: 3058650 - protein, 11 aa, Giardia lamblia
NDDVSEPEDGF

SEQ ID NO: 3058651 - protein, 9 aa, Giardia lamblia
NDEERQRGV

SEQ ID NO: 3058652 - protein, 11 aa, Giardia lamblia
NDENNGEADYS

SEQ ID NO: 3058653 - protein, 7 aa, Giardia lamblia
NDESIYT

SEQ ID NO: 3058654 - protein, 6 aa, Giardia lamblia
NDGNSV

SEQ ID NO: 3058655 - protein, 9 aa, Giardia lamblia
NDGPACNSP

SEQ ID NO: 3058656 - protein, 7 aa, Giardia lamblia
NDGPIEE

SEQ ID NO: 3058657 - protein, 5 aa, Giardia lamblia
NDGRK

SEQ ID NO: 3058658 - protein, 6 aa, Giardia lamblia
NDGRNA

SEQ ID NO: 3058659 - protein, 21 aa, Giardia lamblia
NDHDQESCTVSEETNSHEEQA

SEQ ID NO: 3058660 - protein, 19 aa, Giardia lamblia
NDHQDSDDESESSSSSSLS

SEQ ID NO: 3058661 - protein, 6 aa, Giardia lamblia
NDIGPD

SEQ ID NO: 3058662 - protein, 8 aa, Giardia lamblia
NDKERGSK

SEQ ID NO: 3058663 - protein, 8 aa, Giardia lamblia
NDKSRSIV

SEQ ID NO: 3058664 - protein, 7 aa, Giardia lamblia
NDLDRAS

SEQ ID NO: 3058665 - protein, 9 aa, Giardia lamblia
NDLKATSGY

SEQ ID NO: 3058666 - protein, 7 aa, Giardia lamblia
NDNDGGY

SEQ ID NO: 3058667 - protein, 8 aa, Giardia lamblia
NDNVENKK

SEQ ID NO: 3058668 - protein, 8 aa, Giardia lamblia
NDPCTSDG

SEQ ID NO: 3058669 - protein, 7 aa, Giardia lamblia
NDPDSPF

SEQ ID NO: 3058670 - protein, 7 aa, Giardia lamblia
NDPDSVR

SEQ ID NO: 3058671 - protein, 13 aa, Giardia lamblia
NDPGAPDEEAGVP

SEQ ID NO: 3058672 - protein, 8 aa, Giardia lamblia
NDPGIDGG

SEQ ID NO: 3058673 - protein, 6 aa, Giardia lamblia
NDPGSH

SEQ ID NO: 3058674 - protein, 5 aa, Giardia lamblia
NDPIY

SEQ ID NO: 3058675 - protein, 48 aa, Giardia lamblia
NDPKSGASTLARTTSKATDSTPSPHTHQDVSATNLSTSRRLANPARIP

SEQ ID NO: 3058676 - protein, 7 aa, Giardia lamblia
NDPLENA

SEQ ID NO: 3058677 - protein, 4 aa, Giardia lamblia
NDPN

SEQ ID NO: 3058678 - protein, 15 aa, Giardia lamblia
NDPNQYQQAYNSSSI

SEQ ID NO: 3058679 - protein, 5 aa, Giardia lamblia
NDPPA

SEQ ID NO: 3058680 - protein, 8 aa, Giardia lamblia
NDPTNTNY

SEQ ID NO: 3058681 - protein, 15 aa, Giardia lamblia
NDPTSSDVPRYPEKV

SEQ ID NO: 3058682 - protein, 9 aa, Giardia lamblia
NDPYPPRQP

SEQ ID NO: 3058683 - protein, 8 aa, Giardia lamblia
NDQEYGSA

SEQ ID NO: 3058684 - protein, 9 aa, Giardia lamblia
NDQGCGNNQ

SEQ ID NO: 3058685 - protein, 12 aa, Giardia lamblia
NDQLAKQKEEEV

SEQ ID NO: 3058686 - protein, 9 aa, Giardia lamblia
NDQNTTRQN

SEQ ID NO: 3058687 - protein, 24 aa, Giardia lamblia
NDQRSSVAQSAAYTDKEAVILTIN

SEQ ID NO: 3058688 - protein, 4 aa, Giardia lamblia
NDRA

SEQ ID NO: 3058689 - protein, 9 aa, Giardia lamblia
NDRDSSFPA

SEQ ID NO: 3058690 - protein, 17 aa, Giardia lamblia
NDRGTCRDDGPDNATCD

SEQ ID NO: 3058691 - protein, 8 aa, Giardia lamblia
NDRSGEKV

SEQ ID NO: 3058692 - protein, 8 aa, Giardia lamblia
NDRTSCPA

SEQ ID NO: 3058693 - protein, 5 aa, Giardia lamblia
NDSAF

SEQ ID NO: 3058694 - protein, 19 aa, Giardia lamblia
NDSARLPEYSGGVSASSQS

SEQ ID NO: 3058695 - protein, 9 aa, Giardia lamblia
NDSASPQDI

SEQ ID NO: 3058696 - protein, 15 aa, Giardia lamblia
NDSDSEDSPDKQQTR

SEQ ID NO: 3058697 - protein, 6 aa, Giardia lamblia
NDSGTS

SEQ ID NO: 3058698 - protein, 8 aa, Giardia lamblia
NDSPDSAT

SEQ ID NO: 3058699 - protein, 10 aa, Giardia lamblia
NDSPKKKGLC

SEQ ID NO: 3058700 - protein, 4 aa, Giardia lamblia
NDSR

SEQ ID NO: 3058701 - protein, 17 aa, Giardia lamblia
NDSSDDRSIDTPINNGG

SEQ ID NO: 3058702 - protein, 5 aa, Giardia lamblia
NDSSV

SEQ ID NO: 3058703 - protein, 13 aa, Giardia lamblia
NDSVTEKSSAPKV

SEQ ID NO: 3058704 - protein, 7 aa, Giardia lamblia
NDTDMSD

SEQ ID NO: 3058705 - protein, 5 aa, Giardia lamblia
NDTFS

SEQ ID NO: 3058706 - protein, 11 aa, Giardia lamblia
NDTKTNEKTKR

SEQ ID NO: 3058707 - protein, 5 aa, Giardia lamblia
NDTLG

SEQ ID NO: 3058708 - protein, 4 aa, Giardia lamblia
NDTN

SEQ ID NO: 3058709 - protein, 7 aa, Giardia lamblia
NDTPCPP

SEQ ID NO: 3058710 - protein, 9 aa, Giardia lamblia
NDTQSTVAT

SEQ ID NO: 3058711 - protein, 9 aa, Giardia lamblia
NDTSASGTF

SEQ ID NO: 3058712 - protein, 11 aa, Giardia lamblia
NDTSDSQDTAT

SEQ ID NO: 3058713 - protein, 10 aa, Giardia lamblia
NDTSGKLPKI

SEQ ID NO: 3058714 - protein, 10 aa, Giardia lamblia
NDVEKLDGDY

SEQ ID NO: 3058715 - protein, 5 aa, Giardia lamblia
NDVEP

SEQ ID NO: 3058716 - protein, 9 aa, Giardia lamblia
NDVHPSPSL

SEQ ID NO: 3058717 - protein, 7 aa, Giardia lamblia
NDVQARI

SEQ ID NO: 3058718 - protein, 11 aa, Giardia lamblia
NDVTTEASTLP

SEQ ID NO: 3058719 - protein, 25 aa, Giardia lamblia
NDYDPRAQSKTKRLTGTTGATYQTR

SEQ ID NO: 3058720 - protein, 6 aa, Giardia lamblia
NEADTH

SEQ ID NO: 3058721 - protein, 4 aa, Giardia lamblia
NEAG

SEQ ID NO: 3058722 - protein, 4 aa, Giardia lamblia
NEAL

SEQ ID NO: 3058723 - protein, 8 aa, Giardia lamblia
NEATRRTY

SEQ ID NO: 3058724 - protein, 13 aa, Giardia lamblia
NECEPKDTCTGCK

SEQ ID NO: 3058725 - protein, 4 aa, Giardia lamblia
NECP

SEQ ID NO: 3058726 - protein, 16 aa, Giardia lamblia
NEDDVSSGQRLGKQRR

SEQ ID NO: 3058727 - protein, 4 aa, Giardia lamblia
NEDG

SEQ ID NO: 3058728 - protein, 4 aa, Giardia lamblia
NEDS

SEQ ID NO: 3058729 - protein, 5 aa, Giardia lamblia
NEDSQ

SEQ ID NO: 3058730 - protein, 8 aa, Giardia lamblia
NEDVSQDD

SEQ ID NO: 3058731 - protein, 4 aa, Giardia lamblia
NEEA

SEQ ID NO: 3058732 - protein, 13 aa, Giardia lamblia
NEEESSNENTLEG

SEQ ID NO: 3058733 - protein, 4 aa, Giardia lamblia
NEEG

SEQ ID NO: 3058734 - protein, 13 aa, Giardia lamblia
NEEGKSTKAGAQQ

SEQ ID NO: 3058735 - protein, 8 aa, Giardia lamblia
NEENSIEG

SEQ ID NO: 3058736 - protein, 7 aa, Giardia lamblia
NEERVGS

SEQ ID NO: 3058737 - protein, 6 aa, Giardia lamblia
NEESSH

SEQ ID NO: 3058738 - protein, 12 aa, Giardia lamblia
NEETGLQGKPLT

SEQ ID NO: 3058739 - protein, 6 aa, Giardia lamblia
NEETGY

SEQ ID NO: 3058740 - protein, 5 aa, Giardia lamblia
NEFTS

SEQ ID NO: 3058741 - protein, 5 aa, Giardia lamblia
NEGNV

SEQ ID NO: 3058742 - protein, 6 aa, Giardia lamblia
NEGPGA

SEQ ID NO: 3058743 - protein, 14 aa, Giardia lamblia
NEGSTSESADDKEL

SEQ ID NO: 3058744 - protein, 11 aa, Giardia lamblia
NEGVDSPHKDT

SEQ ID NO: 3058745 - protein, 9 aa, Giardia lamblia
NEHNSESEI

SEQ ID NO: 3058746 - protein, 13 aa, Giardia lamblia
NEISSSGDRADDT

SEQ ID NO: 3058747 - protein, 7 aa, Giardia lamblia
NEKAKNL

SEQ ID NO: 3058748 - protein, 20 aa, Giardia lamblia
NEKEMLPGGPSQPESSNESI

SEQ ID NO: 3058749 - protein, 23 aa, Giardia lamblia
NEKEREVQKERTALRNEKMSNDR

SEQ ID NO: 3058750 - protein, 7 aa, Giardia lamblia
NEKRDLS

SEQ ID NO: 3058751 - protein, 5 aa, Giardia lamblia
NEKYG

SEQ ID NO: 3058752 - protein, 4 aa, Giardia lamblia
NELD

SEQ ID NO: 3058753 - protein, 6 aa, Giardia lamblia
NELTAA

SEQ ID NO: 3058754 - protein, 4 aa, Giardia lamblia
NEMR

SEQ ID NO: 3058755 - protein, 4 aa, Giardia lamblia
NENC

SEQ ID NO: 3058756 - protein, 8 aa, Giardia lamblia
NENGEPIT

SEQ ID NO: 3058757 - protein, 5 aa, Giardia lamblia
NENGI

SEQ ID NO: 3058758 - protein, 5 aa, Giardia lamblia
NENMR

SEQ ID NO: 3058759 - protein, 11 aa, Giardia lamblia
NEPALDSTPPL

SEQ ID NO: 3058760 - protein, 5 aa, Giardia lamblia
NEPME

SEQ ID NO: 3058761 - protein, 8 aa, Giardia lamblia
NEPPRGIK

SEQ ID NO: 3058762 - protein, 8 aa, Giardia lamblia
NEPQDTAL

SEQ ID NO: 3058763 - protein, 5 aa, Giardia lamblia
NEPSF

SEQ ID NO: 3058764 - protein, 12 aa, Giardia lamblia
NEPSLKSGQAIS

SEQ ID NO: 3058765 - protein, 12 aa, Giardia lamblia
NEPVTESQRTYP

SEQ ID NO: 3058766 - protein, 10 aa, Giardia lamblia
NEQEPNEDGC

SEQ ID NO: 3058767 - protein, 4 aa, Giardia lamblia
NEQS

SEQ ID NO: 3058768 - protein, 8 aa, Giardia lamblia
NEQSIERK

SEQ ID NO: 3058769 - protein, 21 aa, Giardia lamblia
NEQSRTSANAQAPAPVPVPPS

SEQ ID NO: 3058770 - protein, 9 aa, Giardia lamblia
NEQTGATGT

SEQ ID NO: 3058771 - protein, 7 aa, Giardia lamblia
NEQTQDV

SEQ ID NO: 3058772 - protein, 11 aa, Giardia lamblia
NERDSDGGPWS

SEQ ID NO: 3058773 - protein, 6 aa, Giardia lamblia
NERGQT

SEQ ID NO: 3058774 - protein, 14 aa, Giardia lamblia
NERRISQSYSSNTN

SEQ ID NO: 3058775 - protein, 4 aa, Giardia lamblia
NERS

SEQ ID NO: 3058776 - protein, 9 aa, Giardia lamblia
NERSKKQGI

SEQ ID NO: 3058777 - protein, 8 aa, Giardia lamblia
NESAASAL

SEQ ID NO: 3058778 - protein, 6 aa, Giardia lamblia
NESCTC

SEQ ID NO: 3058779 - protein, 15 aa, Giardia lamblia
NESDYVPQTLKTTRN

SEQ ID NO: 3058780 - protein, 8 aa, Giardia lamblia
NESEPCSN

SEQ ID NO: 3058781 - protein, 5 aa, Giardia lamblia
NESLS

SEQ ID NO: 3058782 - protein, 7 aa, Giardia lamblia
NESNPSL

SEQ ID NO: 3058783 - protein, 8 aa, Giardia lamblia
NESPAGTV

SEQ ID NO: 3058784 - protein, 9 aa, Giardia lamblia
NESPNLRSS

SEQ ID NO: 3058785 - protein, 8 aa, Giardia lamblia
NESPTATI

SEQ ID NO: 3058786 - protein, 6 aa, Giardia lamblia
NETEGA

SEQ ID NO: 3058787 - protein, 5 aa, Giardia lamblia
NETHN

SEQ ID NO: 3058788 - protein, 6 aa, Giardia lamblia
NETHPE

SEQ ID NO: 3058789 - protein, 8 aa, Giardia lamblia
NETLPEPA

SEQ ID NO: 3058790 - protein, 6 aa, Giardia lamblia
NETRVS

SEQ ID NO: 3058791 - protein, 9 aa, Giardia lamblia
NETSSPVAH

SEQ ID NO: 3058792 - protein, 5 aa, Giardia lamblia
NETYA

SEQ ID NO: 3058793 - protein, 12 aa, Giardia lamblia
NEVDAAKPVSPL

SEQ ID NO: 3058794 - protein, 4 aa, Giardia lamblia
NEVQ

SEQ ID NO: 3058795 - protein, 6 aa, Giardia lamblia
NEYGEN

SEQ ID NO: 3058796 - protein, 4 aa, Giardia lamblia
NEYP

SEQ ID NO: 3058797 - protein, 7 aa, Giardia lamblia
NEYRDQV

SEQ ID NO: 3058798 - protein, 7 aa, Giardia lamblia
NFDPSTE

SEQ ID NO: 3058799 - protein, 5 aa, Giardia lamblia
NFPYG

SEQ ID NO: 3058800 - protein, 16 aa, Giardia lamblia
NFQNSQADTKAAHEQK

SEQ ID NO: 3058801 - protein, 10 aa, Giardia lamblia
NFREKSDGQY

SEQ ID NO: 3058802 - protein, 13 aa, Giardia lamblia
NFTTENADETYNM

SEQ ID NO: 3058803 - protein, 16 aa, Giardia lamblia
NFVPPSPAAPSSPRRK

SEQ ID NO: 3058804 - protein, 4 aa, Giardia lamblia
NGAG

SEQ ID NO: 3058805 - protein, 6 aa, Giardia lamblia
NGALTE

SEQ ID NO: 3058806 - protein, 6 aa, Giardia lamblia
NGANTR

SEQ ID NO: 3058807 - protein, 7 aa, Giardia lamblia
NGARTAM

SEQ ID NO: 3058808 - protein, 6 aa, Giardia lamblia
NGCGKS

SEQ ID NO: 3058809 - protein, 5 aa, Giardia lamblia
NGCPE

SEQ ID NO: 3058810 - protein, 9 aa, Giardia lamblia
NGDEPWPSY

SEQ ID NO: 3058811 - protein, 5 aa, Giardia lamblia
NGDNQ

SEQ ID NO: 3058812 - protein, 10 aa, Giardia lamblia
NGDPNAAPGT

SEQ ID NO: 3058813 - protein, 6 aa, Giardia lamblia
NGDRTE

SEQ ID NO: 3058814 - protein, 4 aa, Giardia lamblia
NGDS

SEQ ID NO: 3058815 - protein, 7 aa, Giardia lamblia
NGDVTNI

SEQ ID NO: 3058816 - protein, 8 aa, Giardia lamblia
NGEPSQFA

SEQ ID NO: 3058817 - protein, 5 aa, Giardia lamblia
NGESS

SEQ ID NO: 3058818 - protein, 13 aa, Giardia lamblia
NGEYRTDHAASST

SEQ ID NO: 3058819 - protein, 5 aa, Giardia lamblia
NGGAV

SEQ ID NO: 3058820 - protein, 7 aa, Giardia lamblia
NGGGSCS

SEQ ID NO: 3058821 - protein, 7 aa, Giardia lamblia
NGGGSIE

SEQ ID NO: 3058822 - protein, 7 aa, Giardia lamblia
NGGGTCS

SEQ ID NO: 3058823 - protein, 12 aa, Giardia lamblia
NGGHQRDLGDSM

SEQ ID NO: 3058824 - protein, 5 aa, Giardia lamblia
NGGIS

SEQ ID NO: 3058825 - protein, 10 aa, Giardia lamblia
NGGKKPFPAI

SEQ ID NO: 3058826 - protein, 7 aa, Giardia lamblia
NGGLKKR

SEQ ID NO: 3058827 - protein, 20 aa, Giardia lamblia
NGGNCFGGGGGSKPKRGKAI

SEQ ID NO: 3058828 - protein, 7 aa, Giardia lamblia
NGHDESV

SEQ ID NO: 3058829 - protein, 17 aa, Giardia lamblia
NGHDRPQLSGTLGKSSY

SEQ ID NO: 3058830 - protein, 5 aa, Giardia lamblia
NGHGQ

SEQ ID NO: 3058831 - protein, 4 aa, Giardia lamblia
NGHT

SEQ ID NO: 3058832 - protein, 7 aa, Giardia lamblia
NGIDTAG

SEQ ID NO: 3058833 - protein, 27 aa, Giardia lamblia
NGITDKDDRGDRNDTPADNDNSNTVVD

SEQ ID NO: 3058834 - protein, 11 aa, Giardia lamblia
NGKDSYGGSTT

SEQ ID NO: 3058835 - protein, 6 aa, Giardia lamblia
NGKGPE

SEQ ID NO: 3058836 - protein, 14 aa, Giardia lamblia
NGKKVKTELDGTTT

SEQ ID NO: 3058837 - protein, 7 aa, Giardia lamblia
NGKSPSM

SEQ ID NO: 3058838 - protein, 9 aa, Giardia lamblia
NGKSYGTPL

SEQ ID NO: 3058839 - protein, 6 aa, Giardia lamblia
NGLESE

SEQ ID NO: 3058840 - protein, 8 aa, Giardia lamblia
NGLGGSDC

SEQ ID NO: 3058841 - protein, 8 aa, Giardia lamblia
NGLKPHPQ

SEQ ID NO: 3058842 - protein, 20 aa, Giardia lamblia
NGLTTNANSRDENIPSARSA

SEQ ID NO: 3058843 - protein, 4 aa, Giardia lamblia
NGNA

SEQ ID NO: 3058844 - protein, 10 aa, Giardia lamblia
NGNCETGQRE

SEQ ID NO: 3058845 - protein, 16 aa, Giardia lamblia
NGNDRGLDEEAAASFD

SEQ ID NO: 3058846 - protein, 6 aa, Giardia lamblia
NGNGAD

SEQ ID NO: 3058847 - protein, 5 aa, Giardia lamblia
NGNVM

SEQ ID NO: 3058848 - protein, 4 aa, Giardia lamblia
NGPA

SEQ ID NO: 3058849 - protein, 5 aa, Giardia lamblia
NGPDL

SEQ ID NO: 3058850 - protein, 9 aa, Giardia lamblia
NGPDRENVS

SEQ ID NO: 3058851 - protein, 7 aa, Giardia lamblia
NGPGASD

SEQ ID NO: 3058852 - protein, 6 aa, Giardia lamblia
NGPGTT

SEQ ID NO: 3058853 - protein, 10 aa, Giardia lamblia
NGPKEGSKLE

SEQ ID NO: 3058854 - protein, 5 aa, Giardia lamblia
NGPLP

SEQ ID NO: 3058855 - protein, 8 aa, Giardia lamblia
NGQATVAA

SEQ ID NO: 3058856 - protein, 7 aa, Giardia lamblia
NGQKNYQ

SEQ ID NO: 3058857 - protein, 5 aa, Giardia lamblia
NGQPA

SEQ ID NO: 3058858 - protein, 12 aa, Giardia lamblia
NGQPLSHASKQS

SEQ ID NO: 3058859 - protein, 4 aa, Giardia lamblia
NGRI

SEQ ID NO: 3058860 - protein, 5 aa, Giardia lamblia
NGRLS

SEQ ID NO: 3058861 - protein, 4 aa, Giardia lamblia
NGRN

SEQ ID NO: 3058862 - protein, 6 aa, Giardia lamblia
NGRSGI

SEQ ID NO: 3058863 - protein, 4 aa, Giardia lamblia
NGRV

SEQ ID NO: 3058864 - protein, 5 aa, Giardia lamblia
NGRYG

SEQ ID NO: 3058865 - protein, 15 aa, Giardia lamblia
NGSCRSLPGGETGDD

SEQ ID NO: 3058866 - protein, 12 aa, Giardia lamblia
NGSDVQVQTGGV

SEQ ID NO: 3058867 - protein, 8 aa, Giardia lamblia
NGSFSGDI

SEQ ID NO: 3058868 - protein, 5 aa, Giardia lamblia
NGSGD

SEQ ID NO: 3058869 - protein, 6 aa, Giardia lamblia
NGSGKS

SEQ ID NO: 3058870 - protein, 6 aa, Giardia lamblia
NGSQDV

SEQ ID NO: 3058871 - protein, 27 aa, Giardia lamblia
NGSSAQPDSAPSNAMPQGSASLGNETI

SEQ ID NO: 3058872 - protein, 6 aa, Giardia lamblia
NGSSLS

SEQ ID NO: 3058873 - protein, 8 aa, Giardia lamblia
NGSSNHHD

SEQ ID NO: 3058874 - protein, 9 aa, Giardia lamblia
NGSTLPKNT

SEQ ID NO: 3058875 - protein, 5 aa, Giardia lamblia
NGSTQ

SEQ ID NO: 3058876 - protein, 16 aa, Giardia lamblia
NGTATKPCTKFKPKAT

SEQ ID NO: 3058877 - protein, 6 aa, Giardia lamblia
NGTCAS

SEQ ID NO: 3058878 - protein, 4 aa, Giardia lamblia
NGTE

SEQ ID NO: 3058879 - protein, 6 aa, Giardia lamblia
NGTGLS

SEQ ID NO: 3058880 - protein, 10 aa, Giardia lamblia
NGTLDSRAAR

SEQ ID NO: 3058881 - protein, 13 aa, Giardia lamblia
NGTLDSTVNPLTS

SEQ ID NO: 3058882 - protein, 6 aa, Giardia lamblia
NGTLTE

SEQ ID NO: 3058883 - protein, 6 aa, Giardia lamblia
NGTREI

SEQ ID NO: 3058884 - protein, 11 aa, Giardia lamblia
NGTSGGPEQAS

SEQ ID NO: 3058885 - protein, 9 aa, Giardia lamblia
NGTSTSPLK

SEQ ID NO: 3058886 - protein, 4 aa, Giardia lamblia
NGTT

SEQ ID NO: 3058887 - protein, 4 aa, Giardia lamblia
NGTY

SEQ ID NO: 3058888 - protein, 10 aa, Giardia lamblia
NGVASSGENQ

SEQ ID NO: 3058889 - protein, 5 aa, Giardia lamblia
NGWAQ

SEQ ID NO: 3058890 - protein, 6 aa, Giardia lamblia
NGYAVD

SEQ ID NO: 3058891 - protein, 10 aa, Giardia lamblia
NGYKGASGCS

SEQ ID NO: 3058892 - protein, 5 aa, Giardia lamblia
NGYND

SEQ ID NO: 3058893 - protein, 6 aa, Giardia lamblia
NHAAPT

SEQ ID NO: 3058894 - protein, 6 aa, Giardia lamblia
NHATAG

SEQ ID NO: 3058895 - protein, 8 aa, Giardia lamblia
NHDAPSDT

SEQ ID NO: 3058896 - protein, 15 aa, Giardia lamblia
NHEASRTKAKVKAPK

SEQ ID NO: 3058897 - protein, 7 aa, Giardia lamblia
NHESRQV

SEQ ID NO: 3058898 - protein, 9 aa, Giardia lamblia
NHHDDNNKN

SEQ ID NO: 3058899 - protein, 10 aa, Giardia lamblia
NHPIRGGVPD

SEQ ID NO: 3058900 - protein, 7 aa, Giardia lamblia
NHPSRAV

SEQ ID NO: 3058901 - protein, 10 aa, Giardia lamblia
NHQNQTITQD

SEQ ID NO: 3058902 - protein, 9 aa, Giardia lamblia
NHQSYCGNS

SEQ ID NO: 3058903 - protein, 6 aa, Giardia lamblia
NHRSTA

SEQ ID NO: 3058904 - protein, 10 aa, Giardia lamblia
NHSGPTSSAL

SEQ ID NO: 3058905 - protein, 14 aa, Giardia lamblia
NHSRSSCSRSSASF

SEQ ID NO: 3058906 - protein, 5 aa, Giardia lamblia
NHTSF

SEQ ID NO: 3058907 - protein, 5 aa, Giardia lamblia
NIAPE

SEQ ID NO: 3058908 - protein, 28 aa, Giardia lamblia
NIEQSKREALTKESETNEDSTPTRLSKK

SEQ ID NO: 3058909 - protein, 21 aa, Giardia lamblia
NIERGGSAEETSSSQKIGTDG

SEQ ID NO: 3058910 - protein, 14 aa, Giardia lamblia
NIERGLSRAQQEVS

SEQ ID NO: 3058911 - protein, 6 aa, Giardia lamblia
NIESKA

SEQ ID NO: 3058912 - protein, 9 aa, Giardia lamblia
NIKAKQEEY

SEQ ID NO: 3058913 - protein, 8 aa, Giardia lamblia
NINDSNTH

SEQ ID NO: 3058914 - protein, 5 aa, Giardia lamblia
NINEE

SEQ ID NO: 3058915 - protein, 6 aa, Giardia lamblia
NINPVP

SEQ ID NO: 3058916 - protein, 5 aa, Giardia lamblia
NINRT

SEQ ID NO: 3058917 - protein, 9 aa, Giardia lamblia
NISEGSARM

SEQ ID NO: 3058918 - protein, 33 aa, Giardia lamblia
NISEKRSKRELGADPVTQRPKSYVQPTNPLTDE

SEQ ID NO: 3058919 - protein, 4 aa, Giardia lamblia
NISG

SEQ ID NO: 3058920 - protein, 7 aa, Giardia lamblia
NISGPTG

SEQ ID NO: 3058921 - protein, 19 aa, Giardia lamblia
NISHSSRSSLSQNHPSESF

SEQ ID NO: 3058922 - protein, 12 aa, Giardia lamblia
NISNSSGEYDQS

SEQ ID NO: 3058923 - protein, 9 aa, Giardia lamblia
NISQRNNPH

SEQ ID NO: 3058924 - protein, 4 aa, Giardia lamblia
NITD

SEQ ID NO: 3058925 - protein, 10 aa, Giardia lamblia
NITSDKTGTL

SEQ ID NO: 3058926 - protein, 8 aa, Giardia lamblia
NKAEENHR

SEQ ID NO: 3058927 - protein, 9 aa, Giardia lamblia
NKAFSGKHG

SEQ ID NO: 3058928 - protein, 8 aa, Giardia lamblia
NKAGLSTQ

SEQ ID NO: 3058929 - protein, 5 aa, Giardia lamblia
NKAKY

SEQ ID NO: 3058930 - protein, 8 aa, Giardia lamblia
NKAVPGRV

SEQ ID NO: 3058931 - protein, 13 aa, Giardia lamblia
NKCEKLQSNPKRC

SEQ ID NO: 3058932 - protein, 5 aa, Giardia lamblia
NKDEI

SEQ ID NO: 3058933 - protein, 4 aa, Giardia lamblia
NKDG

SEQ ID NO: 3058934 - protein, 8 aa, Giardia lamblia
NKDGTLLT

SEQ ID NO: 3058935 - protein, 5 aa, Giardia lamblia
NKDGV

SEQ ID NO: 3058936 - protein, 12 aa, Giardia lamblia
NKDPESSPNLAK

SEQ ID NO: 3058937 - protein, 15 aa, Giardia lamblia
NKDPLEDEEELSDED

SEQ ID NO: 3058938 - protein, 15 aa, Giardia lamblia
NKDSDVQDKKSYVPK

SEQ ID NO: 3058939 - protein, 9 aa, Giardia lamblia
NKDSSEICE

SEQ ID NO: 3058940 - protein, 25 aa, Giardia lamblia
NKDTEEQANEAKGESGDDDDDLARG

SEQ ID NO: 3058941 - protein, 11 aa, Giardia lamblia
NKDVSNEYSPK

SEQ ID NO: 3058942 - protein, 9 aa, Giardia lamblia
NKEKKSKHY

SEQ ID NO: 3058943 - protein, 10 aa, Giardia lamblia
NKENRVNPDE

SEQ ID NO: 3058944 - protein, 5 aa, Giardia lamblia
NKERQ

SEQ ID NO: 3058945 - protein, 18 aa, Giardia lamblia
NKERSSAGEGTAMSSRSL

SEQ ID NO: 3058946 - protein, 9 aa, Giardia lamblia
NKESDIPVD

SEQ ID NO: 3058947 - protein, 8 aa, Giardia lamblia
NKESKDIG

SEQ ID NO: 3058948 - protein, 38 aa, Giardia lamblia
NKETESNDSLTNSSQSTTSGVASNTFSTTSPNKAYPDI

SEQ ID NO: 3058949 - protein, 7 aa, Giardia lamblia
NKEVDRI

SEQ ID NO: 3058950 - protein, 4 aa, Giardia lamblia
NKGG

SEQ ID NO: 3058951 - protein, 4 aa, Giardia lamblia
NKGK

SEQ ID NO: 3058952 - protein, 10 aa, Giardia lamblia
NKGKDLPDQD

SEQ ID NO: 3058953 - protein, 6 aa, Giardia lamblia
NKGKHT

SEQ ID NO: 3058954 - protein, 9 aa, Giardia lamblia
NKGLPESKA

SEQ ID NO: 3058955 - protein, 14 aa, Giardia lamblia
NKGQSEGNCSEITR

SEQ ID NO: 3058956 - protein, 6 aa, Giardia lamblia
NKGSLM

SEQ ID NO: 3058957 - protein, 6 aa, Giardia lamblia
NKHKDK

SEQ ID NO: 3058958 - protein, 35 aa, Giardia lamblia
NKHQPSSSHERDKKGQSRTGSQNLASKQSPGNSAK

SEQ ID NO: 3058959 - protein, 11 aa, Giardia lamblia
NKIDSSTFNTV

SEQ ID NO: 3058960 - protein, 4 aa, Giardia lamblia
NKIP

SEQ ID NO: 3058961 - protein, 7 aa, Giardia lamblia
NKIRPQG

SEQ ID NO: 3058962 - protein, 6 aa, Giardia lamblia
NKISKS

SEQ ID NO: 3058963 - protein, 9 aa, Giardia lamblia
NKKGPVIDG

SEQ ID NO: 3058964 - protein, 8 aa, Giardia lamblia
NKKNHQPS

SEQ ID NO: 3058965 - protein, 8 aa, Giardia lamblia
NKKRLADY

SEQ ID NO: 3058966 - protein, 16 aa, Giardia lamblia
NKKRPSSDSLENAPTI

SEQ ID NO: 3058967 - protein, 7 aa, Giardia lamblia
NKKTGEL

SEQ ID NO: 3058968 - protein, 9 aa, Giardia lamblia
NKLSDIETQ

SEQ ID NO: 3058969 - protein, 8 aa, Giardia lamblia
NKLVDDTE

SEQ ID NO: 3058970 - protein, 6 aa, Giardia lamblia
NKNGGS

SEQ ID NO: 3058971 - protein, 9 aa, Giardia lamblia
NKNGISEET

SEQ ID NO: 3058972 - protein, 7 aa, Giardia lamblia
NKNNSLE

SEQ ID NO: 3058973 - protein, 9 aa, Giardia lamblia
NKNTETSQV

SEQ ID NO: 3058974 - protein, 7 aa, Giardia lamblia
NKNTPSI

SEQ ID NO: 3058975 - protein, 4 aa, Giardia lamblia
NKNY

SEQ ID NO: 3058976 - protein, 7 aa, Giardia lamblia
NKPALSS

SEQ ID NO: 3058977 - protein, 10 aa, Giardia lamblia
NKPARGSGKA

SEQ ID NO: 3058978 - protein, 7 aa, Giardia lamblia
NKPFGAL

SEQ ID NO: 3058979 - protein, 4 aa, Giardia lamblia
NKPG

SEQ ID NO: 3058980 - protein, 6 aa, Giardia lamblia
NKPHNT

SEQ ID NO: 3058981 - protein, 15 aa, Giardia lamblia
NKPSEITSQTCGPQV

SEQ ID NO: 3058982 - protein, 9 aa, Giardia lamblia
NKQAFAPGA

SEQ ID NO: 3058983 - protein, 5 aa, Giardia lamblia
NKQGW

SEQ ID NO: 3058984 - protein, 18 aa, Giardia lamblia
NKQHSSYNLTSGHSSCPS

SEQ ID NO: 3058985 - protein, 19 aa, Giardia lamblia
NKQYSENTVARTKEPAKPI

SEQ ID NO: 3058986 - protein, 30 aa, Giardia lamblia
NKRERSHMSSTPRTSRPSRHSSARSKSNVL

SEQ ID NO: 3058987 - protein, 6 aa, Giardia lamblia
NKRGSG

SEQ ID NO: 3058988 - protein, 5 aa, Giardia lamblia
NKRGY

SEQ ID NO: 3058989 - protein, 8 aa, Giardia lamblia
NKRPQKLG

SEQ ID NO: 3058990 - protein, 8 aa, Giardia lamblia
NKRQRTNV

SEQ ID NO: 3058991 - protein, 8 aa, Giardia lamblia
NKRSKGSI

SEQ ID NO: 3058992 - protein, 17 aa, Giardia lamblia
NKRSSANTSRSSTVKPP

SEQ ID NO: 3058993 - protein, 7 aa, Giardia lamblia
NKSANTL

SEQ ID NO: 3058994 - protein, 14 aa, Giardia lamblia
NKSGTGHGTALNTK

SEQ ID NO: 3058995 - protein, 11 aa, Giardia lamblia
NKSHNTSIENG

SEQ ID NO: 3058996 - protein, 8 aa, Giardia lamblia
NKSIPSTA

SEQ ID NO: 3058997 - protein, 4 aa, Giardia lamblia
NKSL

SEQ ID NO: 3058998 - protein, 7 aa, Giardia lamblia
NKSPGDV

SEQ ID NO: 3058999 - protein, 6 aa, Giardia lamblia
NKSQAV

SEQ ID NO: 3059000 - protein, 10 aa, Giardia lamblia
NKSQKDSSLS

SEQ ID NO: 3059001 - protein, 7 aa, Giardia lamblia
NKSRPSP

SEQ ID NO: 3059002 - protein, 8 aa, Giardia lamblia
NKSRSSDN

SEQ ID NO: 3059003 - protein, 7 aa, Giardia lamblia
NKSRYKK

SEQ ID NO: 3059004 - protein, 12 aa, Giardia lamblia
NKSSSSSGGPDS

SEQ ID NO: 3059005 - protein, 6 aa, Giardia lamblia
NKSSYV

SEQ ID NO: 3059006 - protein, 6 aa, Giardia lamblia
NKSTQA

SEQ ID NO: 3059007 - protein, 9 aa, Giardia lamblia
NKSVNPMTE

SEQ ID NO: 3059008 - protein, 4 aa, Giardia lamblia
NKTD

SEQ ID NO: 3059009 - protein, 5 aa, Giardia lamblia
NKTEG

SEQ ID NO: 3059010 - protein, 4 aa, Giardia lamblia
NKTG

SEQ ID NO: 3059011 - protein, 5 aa, Giardia lamblia
NKTIN

SEQ ID NO: 3059012 - protein, 9 aa, Giardia lamblia
NKTLQPNDY

SEQ ID NO: 3059013 - protein, 17 aa, Giardia lamblia
NKTPFDIDSTRNKSPSF

SEQ ID NO: 3059014 - protein, 9 aa, Giardia lamblia
NKTQPKKKR

SEQ ID NO: 3059015 - protein, 10 aa, Giardia lamblia
NKTRARQAAA

SEQ ID NO: 3059016 - protein, 33 aa, Giardia lamblia
NKTRMRGETITTPGQGAHQTKSQLTPTRGGAQT

SEQ ID NO: 3059017 - protein, 62 aa, Giardia lamblia
NKTSTSQLNNPTDRAFSRTSGASAYPLPAGPSTYPKTGTLNPPNFNGSMPTDGTSNPPTTLD

SEQ ID NO: 3059018 - protein, 7 aa, Giardia lamblia
NKTSYGK

SEQ ID NO: 3059019 - protein, 14 aa, Giardia lamblia
NKYKSSQDSPIPRT

SEQ ID NO: 3059020 - protein, 6 aa, Giardia lamblia
NKYKTY

SEQ ID NO: 3059021 - protein, 19 aa, Giardia lamblia
NLAAGSAIGSAKSLSGHRG

SEQ ID NO: 3059022 - protein, 6 aa, Giardia lamblia
NLAERQ

SEQ ID NO: 3059023 - protein, 21 aa, Giardia lamblia
NLAPRSSVSADPMQAYPGLRM

SEQ ID NO: 3059024 - protein, 5 aa, Giardia lamblia
NLAQT

SEQ ID NO: 3059025 - protein, 16 aa, Giardia lamblia
NLASAGTPKTTSRARL

SEQ ID NO: 3059026 - protein, 11 aa, Giardia lamblia
NLDGETDYKSR

SEQ ID NO: 3059027 - protein, 7 aa, Giardia lamblia
NLDGQNG

SEQ ID NO: 3059028 - protein, 13 aa, Giardia lamblia
NLDPEKLSKQARE

SEQ ID NO: 3059029 - protein, 18 aa, Giardia lamblia
NLDSSETLSEPDMPQGRT

SEQ ID NO: 3059030 - protein, 5 aa, Giardia lamblia
NLEGE

SEQ ID NO: 3059031 - protein, 5 aa, Giardia lamblia
NLEGP

SEQ ID NO: 3059032 - protein, 10 aa, Giardia lamblia
NLESSDKVRT

SEQ ID NO: 3059033 - protein, 6 aa, Giardia lamblia
NLGPDI

SEQ ID NO: 3059034 - protein, 8 aa, Giardia lamblia
NLGSQGID

SEQ ID NO: 3059035 - protein, 8 aa, Giardia lamblia
NLKPDTRE

SEQ ID NO: 3059036 - protein, 12 aa, Giardia lamblia
NLKQEKKTLEKE

SEQ ID NO: 3059037 - protein, 10 aa, Giardia lamblia
NLKRVGSSNI

SEQ ID NO: 3059038 - protein, 16 aa, Giardia lamblia
NLKSATPKPNITAQED

SEQ ID NO: 3059039 - protein, 9 aa, Giardia lamblia
NLKSEQQQG

SEQ ID NO: 3059040 - protein, 4 aa, Giardia lamblia
NLKT

SEQ ID NO: 3059041 - protein, 9 aa, Giardia lamblia
NLNATGTEL

SEQ ID NO: 3059042 - protein, 11 aa, Giardia lamblia
NLNGQHHAAPP

SEQ ID NO: 3059043 - protein, 20 aa, Giardia lamblia
NLPDPERPRSYQEVLEVVKD

SEQ ID NO: 3059044 - protein, 10 aa, Giardia lamblia
NLPENDYPRG

SEQ ID NO: 3059045 - protein, 15 aa, Giardia lamblia
NLPNSSYHASKPPEL

SEQ ID NO: 3059046 - protein, 16 aa, Giardia lamblia
NLPPEESSGPTADTSL

SEQ ID NO: 3059047 - protein, 5 aa, Giardia lamblia
NLPPN

SEQ ID NO: 3059048 - protein, 21 aa, Giardia lamblia
NLQAEGKETQTRAVGDADGPL

SEQ ID NO: 3059049 - protein, 12 aa, Giardia lamblia
NLQHPASADQIK

SEQ ID NO: 3059050 - protein, 5 aa, Giardia lamblia
NLSGV

SEQ ID NO: 3059051 - protein, 15 aa, Giardia lamblia
NLSKRGKQAKPSSLF

SEQ ID NO: 3059052 - protein, 8 aa, Giardia lamblia
NLSPTGKS

SEQ ID NO: 3059053 - protein, 9 aa, Giardia lamblia
NLSQKPPIK

SEQ ID NO: 3059054 - protein, 5 aa, Giardia lamblia
NLSSD

SEQ ID NO: 3059055 - protein, 12 aa, Giardia lamblia
NLSSTRPRATDL

SEQ ID NO: 3059056 - protein, 17 aa, Giardia lamblia
NLSTSNTRTVGFDSSDQ

SEQ ID NO: 3059057 - protein, 12 aa, Giardia lamblia
NLTHKSTKRRDT

SEQ ID NO: 3059058 - protein, 4 aa, Giardia lamblia
NLTN

SEQ ID NO: 3059059 - protein, 4 aa, Giardia lamblia
NLTP

SEQ ID NO: 3059060 - protein, 5 aa, Giardia lamblia
NLTPK

SEQ ID NO: 3059061 - protein, 4 aa, Giardia lamblia
NLTR

SEQ ID NO: 3059062 - protein, 7 aa, Giardia lamblia
NLTSTSE

SEQ ID NO: 3059063 - protein, 7 aa, Giardia lamblia
NLTTSSA

SEQ ID NO: 3059064 - protein, 6 aa, Giardia lamblia
NLVDSK

SEQ ID NO: 3059065 - protein, 8 aa, Giardia lamblia
NMDPRERN

SEQ ID NO: 3059066 - protein, 5 aa, Giardia lamblia
NMDQN

SEQ ID NO: 3059067 - protein, 16 aa, Giardia lamblia
NMKGSTGSGIDESTLR

SEQ ID NO: 3059068 - protein, 6 aa, Giardia lamblia
NMNEPE

SEQ ID NO: 3059069 - protein, 12 aa, Giardia lamblia
NMPTRENDASNR

SEQ ID NO: 3059070 - protein, 8 aa, Giardia lamblia
NMSTQTRG

SEQ ID NO: 3059071 - protein, 8 aa, Giardia lamblia
NMTSEDQR

SEQ ID NO: 3059072 - protein, 6 aa, Giardia lamblia
NMTSTY

SEQ ID NO: 3059073 - protein, 6 aa, Giardia lamblia
NNAADQ

SEQ ID NO: 3059074 - protein, 9 aa, Giardia lamblia
NNAAQSNLP

SEQ ID NO: 3059075 - protein, 5 aa, Giardia lamblia
NNAAT

SEQ ID NO: 3059076 - protein, 18 aa, Giardia lamblia
NNADTSAEAPSLSKLSGY

SEQ ID NO: 3059077 - protein, 7 aa, Giardia lamblia
NNASPTV

SEQ ID NO: 3059078 - protein, 6 aa, Giardia lamblia
NNATAA

SEQ ID NO: 3059079 - protein, 12 aa, Giardia lamblia
NNATPVSPIETP

SEQ ID NO: 3059080 - protein, 19 aa, Giardia lamblia
NNDGDYSGQEATKAPCNGR

SEQ ID NO: 3059081 - protein, 6 aa, Giardia lamblia
NNDPAR

SEQ ID NO: 3059082 - protein, 8 aa, Giardia lamblia
NNDPATAL

SEQ ID NO: 3059083 - protein, 7 aa, Giardia lamblia
NNDPCEN

SEQ ID NO: 3059084 - protein, 19 aa, Giardia lamblia
NNDVSQNPAVKASGTERIG

SEQ ID NO: 3059085 - protein, 6 aa, Giardia lamblia
NNEGKT

SEQ ID NO: 3059086 - protein, 4 aa, Giardia lamblia
NNEP

SEQ ID NO: 3059087 - protein, 4 aa, Giardia lamblia
NNEQ

SEQ ID NO: 3059088 - protein, 4 aa, Giardia lamblia
NNER

SEQ ID NO: 3059089 - protein, 12 aa, Giardia lamblia
NNETQDAGSFQE

SEQ ID NO: 3059090 - protein, 15 aa, Giardia lamblia
NNGTCEADASGSTYS

SEQ ID NO: 3059091 - protein, 8 aa, Giardia lamblia
NNGTDSGA

SEQ ID NO: 3059092 - protein, 5 aa, Giardia lamblia
NNHGR

SEQ ID NO: 3059093 - protein, 8 aa, Giardia lamblia
NNIKQGRG

SEQ ID NO: 3059094 - protein, 11 aa, Giardia lamblia
NNITDPSPSIR

SEQ ID NO: 3059095 - protein, 5 aa, Giardia lamblia
NNKHL

SEQ ID NO: 3059096 - protein, 17 aa, Giardia lamblia
NNKPARPAALGKPSNRQ

SEQ ID NO: 3059097 - protein, 12 aa, Giardia lamblia
NNKYKAERENDP

SEQ ID NO: 3059098 - protein, 6 aa, Giardia lamblia
NNLDDK

SEQ ID NO: 3059099 - protein, 10 aa, Giardia lamblia
NNLKKDSSVF

SEQ ID NO: 3059100 - protein, 11 aa, Giardia lamblia
NNLPPNPGYSL

SEQ ID NO: 3059101 - protein, 4 aa, Giardia lamblia
NNNG

SEQ ID NO: 3059102 - protein, 11 aa, Giardia lamblia
NNNNKPNLAGS

SEQ ID NO: 3059103 - protein, 12 aa, Giardia lamblia
NNNPSSTTTVDG

SEQ ID NO: 3059104 - protein, 6 aa, Giardia lamblia
NNPAAA

SEQ ID NO: 3059105 - protein, 7 aa, Giardia lamblia
NNPATGT

SEQ ID NO: 3059106 - protein, 6 aa, Giardia lamblia
NNPDRC

SEQ ID NO: 3059107 - protein, 5 aa, Giardia lamblia
NNPNI

SEQ ID NO: 3059108 - protein, 7 aa, Giardia lamblia
NNPPALP

SEQ ID NO: 3059109 - protein, 6 aa, Giardia lamblia
NNPSRR

SEQ ID NO: 3059110 - protein, 6 aa, Giardia lamblia
NNQAPE

SEQ ID NO: 3059111 - protein, 9 aa, Giardia lamblia
NNQGCGKDQ

SEQ ID NO: 3059112 - protein, 7 aa, Giardia lamblia
NNQNNCA

SEQ ID NO: 3059113 - protein, 6 aa, Giardia lamblia
NNRGET

SEQ ID NO: 3059114 - protein, 11 aa, Giardia lamblia
NNRGPKSKPSN

SEQ ID NO: 3059115 - protein, 7 aa, Giardia lamblia
NNRHNQM

SEQ ID NO: 3059116 - protein, 11 aa, Giardia lamblia
NNRNSSESSMD

SEQ ID NO: 3059117 - protein, 8 aa, Giardia lamblia
NNRPGHSL

SEQ ID NO: 3059118 - protein, 16 aa, Giardia lamblia
NNRTDHISSGVGNSLT

SEQ ID NO: 3059119 - protein, 9 aa, Giardia lamblia
NNSAREING

SEQ ID NO: 3059120 - protein, 7 aa, Giardia lamblia
NNSEDQN

SEQ ID NO: 3059121 - protein, 5 aa, Giardia lamblia
NNSEE

SEQ ID NO: 3059122 - protein, 8 aa, Giardia lamblia
NNSGGTSE

SEQ ID NO: 3059123 - protein, 4 aa, Giardia lamblia
NNSI

SEQ ID NO: 3059124 - protein, 7 aa, Giardia lamblia
NNSINRS

SEQ ID NO: 3059125 - protein, 6 aa, Giardia lamblia
NNSLGT

SEQ ID NO: 3059126 - protein, 8 aa, Giardia lamblia
NNSPSFNG

SEQ ID NO: 3059127 - protein, 9 aa, Giardia lamblia
NNSTATSTK

SEQ ID NO: 3059128 - protein, 5 aa, Giardia lamblia
NNSVS

SEQ ID NO: 3059129 - protein, 8 aa, Giardia lamblia
NNTAHGHS

SEQ ID NO: 3059130 - protein, 6 aa, Giardia lamblia
NNTAPE

SEQ ID NO: 3059131 - protein, 5 aa, Giardia lamblia
NNTDS

SEQ ID NO: 3059132 - protein, 5 aa, Giardia lamblia
NNTDV

SEQ ID NO: 3059133 - protein, 15 aa, Giardia lamblia
NNTPAVPSGDSYTCP

SEQ ID NO: 3059134 - protein, 7 aa, Giardia lamblia
NNTTASA

SEQ ID NO: 3059135 - protein, 14 aa, Giardia lamblia
NNTTTRQTSIAGSH

SEQ ID NO: 3059136 - protein, 4 aa, Giardia lamblia
NNVE

SEQ ID NO: 3059137 - protein, 4 aa, Giardia lamblia
NNVQ

SEQ ID NO: 3059138 - protein, 13 aa, Giardia lamblia
NNVSKSDEPEETL

SEQ ID NO: 3059139 - protein, 5 aa, Giardia lamblia
NNVSN

SEQ ID NO: 3059140 - protein, 9 aa, Giardia lamblia
NPAAFPSHP

SEQ ID NO: 3059141 - protein, 5 aa, Giardia lamblia
NPAAI

SEQ ID NO: 3059142 - protein, 10 aa, Giardia lamblia
NPAAPPGSKA

SEQ ID NO: 3059143 - protein, 11 aa, Giardia lamblia
NPAAPPGSKAC

SEQ ID NO: 3059144 - protein, 17 aa, Giardia lamblia
NPAAQPEHPVDPADSQT

SEQ ID NO: 3059145 - protein, 5 aa, Giardia lamblia
NPADF

SEQ ID NO: 3059146 - protein, 7 aa, Giardia lamblia
NPAEPQR

SEQ ID NO: 3059147 - protein, 5 aa, Giardia lamblia
NPAFD

SEQ ID NO: 3059148 - protein, 15 aa, Giardia lamblia
NPAGDYGKKELSPAM

SEQ ID NO: 3059149 - protein, 4 aa, Giardia lamblia
NPAL

SEQ ID NO: 3059150 - protein, 50 aa, Giardia lamblia
NPAPQQEPLRSEPGAQNEQQEVPEAPTLAAEPDAIAGQKEVDANATQAPV

SEQ ID NO: 3059151 - protein, 8 aa, Giardia lamblia
NPASSSSA

SEQ ID NO: 3059152 - protein, 11 aa, Giardia lamblia
NPASSYQPEQC

SEQ ID NO: 3059153 - protein, 13 aa, Giardia lamblia
NPATIEKGMSSNK

SEQ ID NO: 3059154 - protein, 5 aa, Giardia lamblia
NPAYV

SEQ ID NO: 3059155 - protein, 5 aa, Giardia lamblia
NPCSN

SEQ ID NO: 3059156 - protein, 13 aa, Giardia lamblia
NPDGSGARVVESG

SEQ ID NO: 3059157 - protein, 8 aa, Giardia lamblia
NPDGSYNQ

SEQ ID NO: 3059158 - protein, 7 aa, Giardia lamblia
NPDKRWA

SEQ ID NO: 3059159 - protein, 6 aa, Giardia lamblia
NPDQEV

SEQ ID NO: 3059160 - protein, 7 aa, Giardia lamblia
NPDVTPM

SEQ ID NO: 3059161 - protein, 4 aa, Giardia lamblia
NPED

SEQ ID NO: 3059162 - protein, 10 aa, Giardia lamblia
NPEDSESIDR

SEQ ID NO: 3059163 - protein, 21 aa, Giardia lamblia
NPEISDEGEESSTASDKQEQA

SEQ ID NO: 3059164 - protein, 17 aa, Giardia lamblia
NPERDPVNESSSPARQV

SEQ ID NO: 3059165 - protein, 5 aa, Giardia lamblia
NPEVK

SEQ ID NO: 3059166 - protein, 4 aa, Giardia lamblia
NPGA

SEQ ID NO: 3059167 - protein, 8 aa, Giardia lamblia
NPGAQAQY

SEQ ID NO: 3059168 - protein, 20 aa, Giardia lamblia
NPGDAPRGCSESSAKSRTIS

SEQ ID NO: 3059169 - protein, 4 aa, Giardia lamblia
NPGI

SEQ ID NO: 3059170 - protein, 14 aa, Giardia lamblia
NPGSDVGKKDLPPT

SEQ ID NO: 3059171 - protein, 8 aa, Giardia lamblia
NPGYSNET

SEQ ID NO: 3059172 - protein, 4 aa, Giardia lamblia
NPHG

SEQ ID NO: 3059173 - protein, 6 aa, Giardia lamblia
NPHRTR

SEQ ID NO: 3059174 - protein, 5 aa, Giardia lamblia
NPHTL

SEQ ID NO: 3059175 - protein, 5 aa, Giardia lamblia
NPIPN

SEQ ID NO: 3059176 - protein, 4 aa, Giardia lamblia
NPIT

SEQ ID NO: 3059177 - protein, 7 aa, Giardia lamblia
NPKTGQK

SEQ ID NO: 3059178 - protein, 7 aa, Giardia lamblia
NPKTHTR

SEQ ID NO: 3059179 - protein, 13 aa, Giardia lamblia
NPLQENNSPLGTC

SEQ ID NO: 3059180 - protein, 6 aa, Giardia lamblia
NPLQKS

SEQ ID NO: 3059181 - protein, 7 aa, Giardia lamblia
NPLSDTP

SEQ ID NO: 3059182 - protein, 9 aa, Giardia lamblia
NPLTEAAAG

SEQ ID NO: 3059183 - protein, 5 aa, Giardia lamblia
NPLTS

SEQ ID NO: 3059184 - protein, 7 aa, Giardia lamblia
NPMPADE

SEQ ID NO: 3059185 - protein, 5 aa, Giardia lamblia
NPNAK

SEQ ID NO: 3059186 - protein, 8 aa, Giardia lamblia
NPNETAEE

SEQ ID NO: 3059187 - protein, 4 aa, Giardia lamblia
NPNH

SEQ ID NO: 3059188 - protein, 10 aa, Giardia lamblia
NPNPSTAPKP

SEQ ID NO: 3059189 - protein, 8 aa, Giardia lamblia
NPNTTAQE

SEQ ID NO: 3059190 - protein, 10 aa, Giardia lamblia
NPNVPVPESL

SEQ ID NO: 3059191 - protein, 7 aa, Giardia lamblia
NPPAPKC

SEQ ID NO: 3059192 - protein, 18 aa, Giardia lamblia
NPPGASITTETGDSKSYA

SEQ ID NO: 3059193 - protein, 9 aa, Giardia lamblia
NPPGKSSYL

SEQ ID NO: 3059194 - protein, 6 aa, Giardia lamblia
NPPLVG

SEQ ID NO: 3059195 - protein, 4 aa, Giardia lamblia
NPPQ

SEQ ID NO: 3059196 - protein, 4 aa, Giardia lamblia
NPPT

SEQ ID NO: 3059197 - protein, 9 aa, Giardia lamblia
NPPTDAGRS

SEQ ID NO: 3059198 - protein, 4 aa, Giardia lamblia
NPQE

SEQ ID NO: 3059199 - protein, 12 aa, Giardia lamblia
NPQLDRSKVQPL

SEQ ID NO: 3059200 - protein, 15 aa, Giardia lamblia
NPQPWDSTPSTATTI

SEQ ID NO: 3059201 - protein, 13 aa, Giardia lamblia
NPQTASDTTRTNG

SEQ ID NO: 3059202 - protein, 4 aa, Giardia lamblia
NPQY

SEQ ID NO: 3059203 - protein, 4 aa, Giardia lamblia
NPRC

SEQ ID NO: 3059204 - protein, 5 aa, Giardia lamblia
NPRDA

SEQ ID NO: 3059205 - protein, 4 aa, Giardia lamblia
NPRT

SEQ ID NO: 3059206 - protein, 5 aa, Giardia lamblia
NPSAV

SEQ ID NO: 3059207 - protein, 13 aa, Giardia lamblia
NPSDKTPTTPTTR

SEQ ID NO: 3059208 - protein, 6 aa, Giardia lamblia
NPSDPE

SEQ ID NO: 3059209 - protein, 9 aa, Giardia lamblia
NPSDTTQTL

SEQ ID NO: 3059210 - protein, 7 aa, Giardia lamblia
NPSDYEG

SEQ ID NO: 3059211 - protein, 5 aa, Giardia lamblia
NPSEF

SEQ ID NO: 3059212 - protein, 4 aa, Giardia lamblia
NPSF

SEQ ID NO: 3059213 - protein, 10 aa, Giardia lamblia
NPSPSGEQDT

SEQ ID NO: 3059214 - protein, 12 aa, Giardia lamblia
NPSSLRPLNHAC

SEQ ID NO: 3059215 - protein, 7 aa, Giardia lamblia
NPSSYPS

SEQ ID NO: 3059216 - protein, 7 aa, Giardia lamblia
NPSTATN

SEQ ID NO: 3059217 - protein, 10 aa, Giardia lamblia
NPSTGTKTDQ

SEQ ID NO: 3059218 - protein, 19 aa, Giardia lamblia
NPSYRIKGSRSDARDPKTI

SEQ ID NO: 3059219 - protein, 5 aa, Giardia lamblia
NPTAI

SEQ ID NO: 3059220 - protein, 5 aa, Giardia lamblia
NPTKS

SEQ ID NO: 3059221 - protein, 4 aa, Giardia lamblia
NPTN

SEQ ID NO: 3059222 - protein, 8 aa, Giardia lamblia
NPTNPRLN

SEQ ID NO: 3059223 - protein, 6 aa, Giardia lamblia
NPTQDT

SEQ ID NO: 3059224 - protein, 6 aa, Giardia lamblia
NPTQET

SEQ ID NO: 3059225 - protein, 5 aa, Giardia lamblia
NPTSN

SEQ ID NO: 3059226 - protein, 6 aa, Giardia lamblia
NPTYND

SEQ ID NO: 3059227 - protein, 5 aa, Giardia lamblia
NPVDK

SEQ ID NO: 3059228 - protein, 5 aa, Giardia lamblia
NPVGS

SEQ ID NO: 3059229 - protein, 5 aa, Giardia lamblia
NPVGT

SEQ ID NO: 3059230 - protein, 4 aa, Giardia lamblia
NPVT

SEQ ID NO: 3059231 - protein, 11 aa, Giardia lamblia
NPYNPNKSTNR

SEQ ID NO: 3059232 - protein, 5 aa, Giardia lamblia
NPYRT

SEQ ID NO: 3059233 - protein, 6 aa, Giardia lamblia
NPYSGS

SEQ ID NO: 3059234 - protein, 20 aa, Giardia lamblia
NPYSKNLPPKQWYDGVMEIE

SEQ ID NO: 3059235 - protein, 6 aa, Giardia lamblia
NPYYNS

SEQ ID NO: 3059236 - protein, 17 aa, Giardia lamblia
NQAPGGASSMKKTTKVG

SEQ ID NO: 3059237 - protein, 8 aa, Giardia lamblia
NQAPVQEK

SEQ ID NO: 3059238 - protein, 17 aa, Giardia lamblia
NQASDVDVAQSQGSPRF

SEQ ID NO: 3059239 - protein, 11 aa, Giardia lamblia
NQATVSTANLD

SEQ ID NO: 3059240 - protein, 5 aa, Giardia lamblia
NQDAT

SEQ ID NO: 3059241 - protein, 17 aa, Giardia lamblia
NQDGYTDNPKKSSTTQS

SEQ ID NO: 3059242 - protein, 21 aa, Giardia lamblia
NQDPIGATAPLRGGPMPPGVT

SEQ ID NO: 3059243 - protein, 18 aa, Giardia lamblia
NQDQESLEDADRGDLSSS

SEQ ID NO: 3059244 - protein, 6 aa, Giardia lamblia
NQDRSQ

SEQ ID NO: 3059245 - protein, 8 aa, Giardia lamblia
NQDTVGKA

SEQ ID NO: 3059246 - protein, 6 aa, Giardia lamblia
NQEANS

SEQ ID NO: 3059247 - protein, 7 aa, Giardia lamblia
NQEGEYD

SEQ ID NO: 3059248 - protein, 22 aa, Giardia lamblia
NQEPKRAEDSLGALGSSAGPIA

SEQ ID NO: 3059249 - protein, 6 aa, Giardia lamblia
NQFPRL

SEQ ID NO: 3059250 - protein, 24 aa, Giardia lamblia
NQGRSRPVSGISSHSHASRLTRNP

SEQ ID NO: 3059251 - protein, 14 aa, Giardia lamblia
NQGVQSAARCEEDD

SEQ ID NO: 3059252 - protein, 8 aa, Giardia lamblia
NQHITSNS

SEQ ID NO: 3059253 - protein, 7 aa, Giardia lamblia
NQHTGNP

SEQ ID NO: 3059254 - protein, 16 aa, Giardia lamblia
NQKKEAPLNGECTEAA

SEQ ID NO: 3059255 - protein, 29 aa, Giardia lamblia
NQKMSEESAVSRESTESDSGDQEPINTYT

SEQ ID NO: 3059256 - protein, 14 aa, Giardia lamblia
NQKVETLSGGQKRR

SEQ ID NO: 3059257 - protein, 16 aa, Giardia lamblia
NQLEQKQKEERASLAR

SEQ ID NO: 3059258 - protein, 6 aa, Giardia lamblia
NQNSPI

SEQ ID NO: 3059259 - protein, 4 aa, Giardia lamblia
NQPR

SEQ ID NO: 3059260 - protein, 6 aa, Giardia lamblia
NQPRFG

SEQ ID NO: 3059261 - protein, 5 aa, Giardia lamblia
NQPRH

SEQ ID NO: 3059262 - protein, 8 aa, Giardia lamblia
NQPSIAAK

SEQ ID NO: 3059263 - protein, 8 aa, Giardia lamblia
NQQATNCE

SEQ ID NO: 3059264 - protein, 54 aa, Giardia lamblia
NQQLTRKPQHQSSITTQSKPPALQSPSSKGLGGISSRRGDAGTVASCNTNRTAR

SEQ ID NO: 3059265 - protein, 9 aa, Giardia lamblia
NQQQDTPEG

SEQ ID NO: 3059266 - protein, 18 aa, Giardia lamblia
NQQSGKGINGSKSADADQ

SEQ ID NO: 3059267 - protein, 4 aa, Giardia lamblia
NQRD

SEQ ID NO: 3059268 - protein, 8 aa, Giardia lamblia
NQRGTTIN

SEQ ID NO: 3059269 - protein, 9 aa, Giardia lamblia
NQRSDDSRS

SEQ ID NO: 3059270 - protein, 7 aa, Giardia lamblia
NQRTRAP

SEQ ID NO: 3059271 - protein, 8 aa, Giardia lamblia
NQSAQTSR

SEQ ID NO: 3059272 - protein, 4 aa, Giardia lamblia
NQSD

SEQ ID NO: 3059273 - protein, 10 aa, Giardia lamblia
NQSDTTGSVC

SEQ ID NO: 3059274 - protein, 8 aa, Giardia lamblia
NQSKTDIT

SEQ ID NO: 3059275 - protein, 8 aa, Giardia lamblia
NQSNKKPI

SEQ ID NO: 3059276 - protein, 24 aa, Giardia lamblia
NQSPAFTAHASSTKAEKVEPSKAL

SEQ ID NO: 3059277 - protein, 8 aa, Giardia lamblia
NQSPTGNK

SEQ ID NO: 3059278 - protein, 10 aa, Giardia lamblia
NQSSATVTSK

SEQ ID NO: 3059279 - protein, 9 aa, Giardia lamblia
NQSSYKGNS

SEQ ID NO: 3059280 - protein, 7 aa, Giardia lamblia
NQSTTYQ

SEQ ID NO: 3059281 - protein, 7 aa, Giardia lamblia
NQTDAEN

SEQ ID NO: 3059282 - protein, 5 aa, Giardia lamblia
NQTGI

SEQ ID NO: 3059283 - protein, 7 aa, Giardia lamblia
NQTRGDC

SEQ ID NO: 3059284 - protein, 4 aa, Giardia lamblia
NQYE

SEQ ID NO: 3059285 - protein, 7 aa, Giardia lamblia
NRAEPYT

SEQ ID NO: 3059286 - protein, 11 aa, Giardia lamblia
NRAQPGSRDYT

SEQ ID NO: 3059287 - protein, 8 aa, Giardia lamblia
NRARSNES

SEQ ID NO: 3059288 - protein, 24 aa, Giardia lamblia
NRARTSETWERYSSGEYPTGNTAA

SEQ ID NO: 3059289 - protein, 5 aa, Giardia lamblia
NRARY

SEQ ID NO: 3059290 - protein, 8 aa, Giardia lamblia
NRASSLKD

SEQ ID NO: 3059291 - protein, 4 aa, Giardia lamblia
NRCA

SEQ ID NO: 3059292 - protein, 8 aa, Giardia lamblia
NRDRELSN

SEQ ID NO: 3059293 - protein, 7 aa, Giardia lamblia
NREDQSD

SEQ ID NO: 3059294 - protein, 6 aa, Giardia lamblia
NREDWS

SEQ ID NO: 3059295 - protein, 10 aa, Giardia lamblia
NRESKSYQKQ

SEQ ID NO: 3059296 - protein, 10 aa, Giardia lamblia
NRETPYNSSP

SEQ ID NO: 3059297 - protein, 9 aa, Giardia lamblia
NRFAATDEV

SEQ ID NO: 3059298 - protein, 9 aa, Giardia lamblia
NRGDVAPDD

SEQ ID NO: 3059299 - protein, 5 aa, Giardia lamblia
NRGEA

SEQ ID NO: 3059300 - protein, 11 aa, Giardia lamblia
NRGEVSSPNGV

SEQ ID NO: 3059301 - protein, 7 aa, Giardia lamblia
NRGLSGS

SEQ ID NO: 3059302 - protein, 8 aa, Giardia lamblia
NRGQNPQI

SEQ ID NO: 3059303 - protein, 8 aa, Giardia lamblia
NRKGEDSL

SEQ ID NO: 3059304 - protein, 8 aa, Giardia lamblia
NRKGVDEG

SEQ ID NO: 3059305 - protein, 13 aa, Giardia lamblia
NRLSRASPAMKDT

SEQ ID NO: 3059306 - protein, 6 aa, Giardia lamblia
NRMSET

SEQ ID NO: 3059307 - protein, 10 aa, Giardia lamblia
NRNPDTGDIS

SEQ ID NO: 3059308 - protein, 17 aa, Giardia lamblia
NRPDSIVEKDGKTKQDL

SEQ ID NO: 3059309 - protein, 10 aa, Giardia lamblia
NRPGSSSFAA

SEQ ID NO: 3059310 - protein, 10 aa, Giardia lamblia
NRPKNSANPW

SEQ ID NO: 3059311 - protein, 6 aa, Giardia lamblia
NRPLTQ

SEQ ID NO: 3059312 - protein, 25 aa, Giardia lamblia
NRPSQKNFADQDISPNEHELPGHSV

SEQ ID NO: 3059313 - protein, 5 aa, Giardia lamblia
NRQQY

SEQ ID NO: 3059314 - protein, 8 aa, Giardia lamblia
NRQRLSGA

SEQ ID NO: 3059315 - protein, 4 aa, Giardia lamblia
NRRS

SEQ ID NO: 3059316 - protein, 13 aa, Giardia lamblia
NRRTSKPVTTNGV

SEQ ID NO: 3059317 - protein, 5 aa, Giardia lamblia
NRSGV

SEQ ID NO: 3059318 - protein, 5 aa, Giardia lamblia
NRSHR

SEQ ID NO: 3059319 - protein, 7 aa, Giardia lamblia
NRSNSSA

SEQ ID NO: 3059320 - protein, 9 aa, Giardia lamblia
NRSQPEDKR

SEQ ID NO: 3059321 - protein, 5 aa, Giardia lamblia
NRSRG

SEQ ID NO: 3059322 - protein, 15 aa, Giardia lamblia
NRSSLNDNSVESDPV

SEQ ID NO: 3059323 - protein, 10 aa, Giardia lamblia
NRSSSDRFVN

SEQ ID NO: 3059324 - protein, 9 aa, Giardia lamblia
NRSSTTPNL

SEQ ID NO: 3059325 - protein, 14 aa, Giardia lamblia
NRSTDELKTTTRSL

SEQ ID NO: 3059326 - protein, 8 aa, Giardia lamblia
NRSVEDGL

SEQ ID NO: 3059327 - protein, 4 aa, Giardia lamblia
NRSY

SEQ ID NO: 3059328 - protein, 4 aa, Giardia lamblia
NRTA

SEQ ID NO: 3059329 - protein, 10 aa, Giardia lamblia
NRTGGCGSRP

SEQ ID NO: 3059330 - protein, 5 aa, Giardia lamblia
NRTGT

SEQ ID NO: 3059331 - protein, 7 aa, Giardia lamblia
NRTKDGV

SEQ ID NO: 3059332 - protein, 10 aa, Giardia lamblia
NRTNGKAPQA

SEQ ID NO: 3059333 - protein, 7 aa, Giardia lamblia
NRTRRPE

SEQ ID NO: 3059334 - protein, 9 aa, Giardia lamblia
NRTSTDYIG

SEQ ID NO: 3059335 - protein, 4 aa, Giardia lamblia
NRYG

SEQ ID NO: 3059336 - protein, 37 aa, Giardia lamblia
NSAGQRKEGTSQADAHTPSDATDKKQLLSDSSSDDGD

SEQ ID NO: 3059337 - protein, 9 aa, Giardia lamblia
NSAGTGSCT

SEQ ID NO: 3059338 - protein, 7 aa, Giardia lamblia
NSAGTNA

SEQ ID NO: 3059339 - protein, 4 aa, Giardia lamblia
NSAH

SEQ ID NO: 3059340 - protein, 4 aa, Giardia lamblia
NSAN

SEQ ID NO: 3059341 - protein, 7 aa, Giardia lamblia
NSAPDTG

SEQ ID NO: 3059342 - protein, 9 aa, Giardia lamblia
NSAQNTLDA

SEQ ID NO: 3059343 - protein, 5 aa, Giardia lamblia
NSARY

SEQ ID NO: 3059344 - protein, 10 aa, Giardia lamblia
NSASARATLN

SEQ ID NO: 3059345 - protein, 7 aa, Giardia lamblia
NSASDDG

SEQ ID NO: 3059346 - protein, 17 aa, Giardia lamblia
NSASDGRTASASPQISN

SEQ ID NO: 3059347 - protein, 6 aa, Giardia lamblia
NSASGV

SEQ ID NO: 3059348 - protein, 11 aa, Giardia lamblia
NSASPSPMPQG

SEQ ID NO: 3059349 - protein, 11 aa, Giardia lamblia
NSASSERGHLS

SEQ ID NO: 3059350 - protein, 14 aa, Giardia lamblia
NSATGGSGTATCEA

SEQ ID NO: 3059351 - protein, 6 aa, Giardia lamblia
NSAVPH

SEQ ID NO: 3059352 - protein, 6 aa, Giardia lamblia
NSAYAN

SEQ ID NO: 3059353 - protein, 8 aa, Giardia lamblia
NSAYGGRN

SEQ ID NO: 3059354 - protein, 7 aa, Giardia lamblia
NSCGSDN

SEQ ID NO: 3059355 - protein, 26 aa, Giardia lamblia
NSDGANNAGSEKDAGAPSEDIETSSL

SEQ ID NO: 3059356 - protein, 16 aa, Giardia lamblia
NSDHRDIAKDRKSRQM

SEQ ID NO: 3059357 - protein, 4 aa, Giardia lamblia
NSDI

SEQ ID NO: 3059358 - protein, 7 aa, Giardia lamblia
NSDINTD

SEQ ID NO: 3059359 - protein, 8 aa, Giardia lamblia
NSDKCLSA

SEQ ID NO: 3059360 - protein, 4 aa, Giardia lamblia
NSDL

SEQ ID NO: 3059361 - protein, 10 aa, Giardia lamblia
NSDLSTTLEG

SEQ ID NO: 3059362 - protein, 6 aa, Giardia lamblia
NSDPEL

SEQ ID NO: 3059363 - protein, 8 aa, Giardia lamblia
NSDPTTKA

SEQ ID NO: 3059364 - protein, 24 aa, Giardia lamblia
NSDSMATLEEDQQNQDLDEPQTAP

SEQ ID NO: 3059365 - protein, 6 aa, Giardia lamblia
NSEAYM

SEQ ID NO: 3059366 - protein, 11 aa, Giardia lamblia
NSEDASINPCS

SEQ ID NO: 3059367 - protein, 7 aa, Giardia lamblia
NSEDDAV

SEQ ID NO: 3059368 - protein, 8 aa, Giardia lamblia
NSEDDRAN

SEQ ID NO: 3059369 - protein, 5 aa, Giardia lamblia
NSEDG

SEQ ID NO: 3059370 - protein, 9 aa, Giardia lamblia
NSEEQNRYQ

SEQ ID NO: 3059371 - protein, 53 aa, Giardia lamblia
NSELPPSTHAPPRPAPQAPPHPPLYPAPSTLQAASANTKAPDAPALSSTTTDY

SEQ ID NO: 3059372 - protein, 4 aa, Giardia lamblia
NSEP

SEQ ID NO: 3059373 - protein, 9 aa, Giardia lamblia
NSEPDFPYS

SEQ ID NO: 3059374 - protein, 4 aa, Giardia lamblia
NSEQ

SEQ ID NO: 3059375 - protein, 4 aa, Giardia lamblia
NSER

SEQ ID NO: 3059376 - protein, 7 aa, Giardia lamblia
NSFQNSH

SEQ ID NO: 3059377 - protein, 9 aa, Giardia lamblia
NSFTGRREV

SEQ ID NO: 3059378 - protein, 6 aa, Giardia lamblia
NSGAAI

SEQ ID NO: 3059379 - protein, 17 aa, Giardia lamblia
NSGAGGAQEDVNSPGHE

SEQ ID NO: 3059380 - protein, 6 aa, Giardia lamblia
NSGTTG

SEQ ID NO: 3059381 - protein, 6 aa, Giardia lamblia
NSGWDN

SEQ ID NO: 3059382 - protein, 9 aa, Giardia lamblia
NSIASPSTH

SEQ ID NO: 3059383 - protein, 10 aa, Giardia lamblia
NSIDSQLSSS

SEQ ID NO: 3059384 - protein, 9 aa, Giardia lamblia
NSIGTQTDL

SEQ ID NO: 3059385 - protein, 8 aa, Giardia lamblia
NSINEEPD

SEQ ID NO: 3059386 - protein, 6 aa, Giardia lamblia
NSISSA

SEQ ID NO: 3059387 - protein, 16 aa, Giardia lamblia
NSITSSTAPGSNTHAS

SEQ ID NO: 3059388 - protein, 6 aa, Giardia lamblia
NSKLTA

SEQ ID NO: 3059389 - protein, 8 aa, Giardia lamblia
NSKPDGQG

SEQ ID NO: 3059390 - protein, 7 aa, Giardia lamblia
NSKQSPL

SEQ ID NO: 3059391 - protein, 11 aa, Giardia lamblia
NSKRQKLPDET

SEQ ID NO: 3059392 - protein, 12 aa, Giardia lamblia
NSKSSASSSQPG

SEQ ID NO: 3059393 - protein, 9 aa, Giardia lamblia
NSKVSTQAH

SEQ ID NO: 3059394 - protein, 6 aa, Giardia lamblia
NSLAQE

SEQ ID NO: 3059395 - protein, 4 aa, Giardia lamblia
NSLD

SEQ ID NO: 3059396 - protein, 4 aa, Giardia lamblia
NSLE

SEQ ID NO: 3059397 - protein, 6 aa, Giardia lamblia
NSLEKA

SEQ ID NO: 3059398 - protein, 9 aa, Giardia lamblia
NSLGGQASS

SEQ ID NO: 3059399 - protein, 6 aa, Giardia lamblia
NSLNGS

SEQ ID NO: 3059400 - protein, 13 aa, Giardia lamblia
NSLPESDRVAGTT

SEQ ID NO: 3059401 - protein, 8 aa, Giardia lamblia
NSLPIRSG

SEQ ID NO: 3059402 - protein, 14 aa, Giardia lamblia
NSLTEDNTGDARAT

SEQ ID NO: 3059403 - protein, 6 aa, Giardia lamblia
NSLTKS

SEQ ID NO: 3059404 - protein, 7 aa, Giardia lamblia
NSLTQEQ

SEQ ID NO: 3059405 - protein, 5 aa, Giardia lamblia
NSNAS

SEQ ID NO: 3059406 - protein, 7 aa, Giardia lamblia
NSNGDPV

SEQ ID NO: 3059407 - protein, 8 aa, Giardia lamblia
NSNGQLPV

SEQ ID NO: 3059408 - protein, 7 aa, Giardia lamblia
NSNGRLD

SEQ ID NO: 3059409 - protein, 5 aa, Giardia lamblia
NSNKY

SEQ ID NO: 3059410 - protein, 12 aa, Giardia lamblia
NSNLRNTLSEAQ

SEQ ID NO: 3059411 - protein, 5 aa, Giardia lamblia
NSNSN

SEQ ID NO: 3059412 - protein, 6 aa, Giardia lamblia
NSNSSA

SEQ ID NO: 3059413 - protein, 8 aa, Giardia lamblia
NSPALPAR

SEQ ID NO: 3059414 - protein, 7 aa, Giardia lamblia
NSPDIPR

SEQ ID NO: 3059415 - protein, 17 aa, Giardia lamblia
NSPGNISISPEGDSHQS

SEQ ID NO: 3059416 - protein, 15 aa, Giardia lamblia
NSPGSASDSQKETIN

SEQ ID NO: 3059417 - protein, 12 aa, Giardia lamblia
NSPGSGPSIATS

SEQ ID NO: 3059418 - protein, 6 aa, Giardia lamblia
NSPNRL

SEQ ID NO: 3059419 - protein, 6 aa, Giardia lamblia
NSPRNV

SEQ ID NO: 3059420 - protein, 23 aa, Giardia lamblia
NSPSSSSLRGIQDSEENSSRPLR

SEQ ID NO: 3059421 - protein, 5 aa, Giardia lamblia
NSPWT

SEQ ID NO: 3059422 - protein, 11 aa, Giardia lamblia
NSPYTPSSDKK

SEQ ID NO: 3059423 - protein, 5 aa, Giardia lamblia
NSQDI

SEQ ID NO: 3059424 - protein, 5 aa, Giardia lamblia
NSQIP

SEQ ID NO: 3059425 - protein, 6 aa, Giardia lamblia
NSQIST

SEQ ID NO: 3059426 - protein, 4 aa, Giardia lamblia
NSQN

SEQ ID NO: 3059427 - protein, 19 aa, Giardia lamblia
NSQNISAESKLSSAAAGGF

SEQ ID NO: 3059428 - protein, 4 aa, Giardia lamblia
NSQP

SEQ ID NO: 3059429 - protein, 11 aa, Giardia lamblia
NSRQDTGEPVT

SEQ ID NO: 3059430 - protein, 18 aa, Giardia lamblia
NSRQKQESVTSTNTLSTF

SEQ ID NO: 3059431 - protein, 7 aa, Giardia lamblia
NSRSHRD

SEQ ID NO: 3059432 - protein, 9 aa, Giardia lamblia
NSRSLGSGN

SEQ ID NO: 3059433 - protein, 13 aa, Giardia lamblia
NSRTLADRDMEPH

SEQ ID NO: 3059434 - protein, 47 aa, Giardia lamblia
NSSAHEAKPSQISCSKPPGHDTNLTPKDLDNPIEKDPVHRGASSAVP

SEQ ID NO: 3059435 - protein, 5 aa, Giardia lamblia
NSSAN

SEQ ID NO: 3059436 - protein, 8 aa, Giardia lamblia
NSSAPQSK

SEQ ID NO: 3059437 - protein, 5 aa, Giardia lamblia
NSSAQ

SEQ ID NO: 3059438 - protein, 13 aa, Giardia lamblia
NSSEVPHNGNCGP

SEQ ID NO: 3059439 - protein, 9 aa, Giardia lamblia
NSSGTCTPC

SEQ ID NO: 3059440 - protein, 5 aa, Giardia lamblia
NSSGV

SEQ ID NO: 3059441 - protein, 6 aa, Giardia lamblia
NSSGYK

SEQ ID NO: 3059442 - protein, 5 aa, Giardia lamblia
NSSIK

SEQ ID NO: 3059443 - protein, 8 aa, Giardia lamblia
NSSPNEGR

SEQ ID NO: 3059444 - protein, 11 aa, Giardia lamblia
NSSQRSESEYE

SEQ ID NO: 3059445 - protein, 17 aa, Giardia lamblia
NSSSPNGCSNPVREPTI

SEQ ID NO: 3059446 - protein, 21 aa, Giardia lamblia
NSSSSSPNTDGYTDNQGSQDH

SEQ ID NO: 3059447 - protein, 18 aa, Giardia lamblia
NSSSYTATTLSSNTRSVE

SEQ ID NO: 3059448 - protein, 6 aa, Giardia lamblia
NSSTEF

SEQ ID NO: 3059449 - protein, 5 aa, Giardia lamblia
NSTAE

SEQ ID NO: 3059450 - protein, 7 aa, Giardia lamblia
NSTAPAV

SEQ ID NO: 3059451 - protein, 10 aa, Giardia lamblia
NSTNKQSNVD

SEQ ID NO: 3059452 - protein, 7 aa, Giardia lamblia
NSTPDRH

SEQ ID NO: 3059453 - protein, 5 aa, Giardia lamblia
NSTQD

SEQ ID NO: 3059454 - protein, 8 aa, Giardia lamblia
NSTRSSQF

SEQ ID NO: 3059455 - protein, 6 aa, Giardia lamblia
NSTRTP

SEQ ID NO: 3059456 - protein, 14 aa, Giardia lamblia
NSTTWKNPSKLTAA

SEQ ID NO: 3059457 - protein, 14 aa, Giardia lamblia
NSVARTGASGVRNT

SEQ ID NO: 3059458 - protein, 12 aa, Giardia lamblia
NSVASQPQTDVI

SEQ ID NO: 3059459 - protein, 6 aa, Giardia lamblia
NSVATE

SEQ ID NO: 3059460 - protein, 8 aa, Giardia lamblia
NSVDKSDT

SEQ ID NO: 3059461 - protein, 21 aa, Giardia lamblia
NSVESEADKGKCNPRSCQDSD

SEQ ID NO: 3059462 - protein, 12 aa, Giardia lamblia
NSVIDKSGLKEK

SEQ ID NO: 3059463 - protein, 18 aa, Giardia lamblia
NSVPGQKRKLRKETASYG

SEQ ID NO: 3059464 - protein, 11 aa, Giardia lamblia
NSVPSTTSATI

SEQ ID NO: 3059465 - protein, 24 aa, Giardia lamblia
NSVQDEEDGYTNESLTERTQPQTL

SEQ ID NO: 3059466 - protein, 6 aa, Giardia lamblia
NSVRDI

SEQ ID NO: 3059467 - protein, 14 aa, Giardia lamblia
NSVSKPQEPQEFSN

SEQ ID NO: 3059468 - protein, 20 aa, Giardia lamblia
NSVSRRASANKEGTPGRGGT

SEQ ID NO: 3059469 - protein, 4 aa, Giardia lamblia
NSYP

SEQ ID NO: 3059470 - protein, 26 aa, Giardia lamblia
NSYSKGGTSTCQQCPSGNRWPTGKSG

SEQ ID NO: 3059471 - protein, 13 aa, Giardia lamblia
NSYSSSKVRYPGI

SEQ ID NO: 3059472 - protein, 15 aa, Giardia lamblia
NSYTSPDNSEQPTPI

SEQ ID NO: 3059473 - protein, 11 aa, Giardia lamblia
NTADAINEEIK

SEQ ID NO: 3059474 - protein, 13 aa, Giardia lamblia
NTAEDNAEYEQTH

SEQ ID NO: 3059475 - protein, 16 aa, Giardia lamblia
NTASTGVVDTKSRDVT

SEQ ID NO: 3059476 - protein, 27 aa, Giardia lamblia
NTCESSPISRTKSSTFLSQKESQAKEK

SEQ ID NO: 3059477 - protein, 6 aa, Giardia lamblia
NTCSTY

SEQ ID NO: 3059478 - protein, 4 aa, Giardia lamblia
NTDE

SEQ ID NO: 3059479 - protein, 7 aa, Giardia lamblia
NTDPKSI

SEQ ID NO: 3059480 - protein, 4 aa, Giardia lamblia
NTDT

SEQ ID NO: 3059481 - protein, 9 aa, Giardia lamblia
NTDVEDDSD

SEQ ID NO: 3059482 - protein, 6 aa, Giardia lamblia
NTEASQ

SEQ ID NO: 3059483 - protein, 22 aa, Giardia lamblia
NTEDSEGRTRNAMEESTDDEGD

SEQ ID NO: 3059484 - protein, 5 aa, Giardia lamblia
NTEET

SEQ ID NO: 3059485 - protein, 7 aa, Giardia lamblia
NTEPGKR

SEQ ID NO: 3059486 - protein, 8 aa, Giardia lamblia
NTERRPPA

SEQ ID NO: 3059487 - protein, 5 aa, Giardia lamblia
NTESA

SEQ ID NO: 3059488 - protein, 8 aa, Giardia lamblia
NTETSSGM

SEQ ID NO: 3059489 - protein, 5 aa, Giardia lamblia
NTEYE

SEQ ID NO: 3059490 - protein, 12 aa, Giardia lamblia
NTGASGPTFPAN

SEQ ID NO: 3059491 - protein, 18 aa, Giardia lamblia
NTGDYSDQEATKAPCNGR

SEQ ID NO: 3059492 - protein, 5 aa, Giardia lamblia
NTGLP

SEQ ID NO: 3059493 - protein, 7 aa, Giardia lamblia
NTGNSAD

SEQ ID NO: 3059494 - protein, 7 aa, Giardia lamblia
NTGQRDV

SEQ ID NO: 3059495 - protein, 5 aa, Giardia lamblia
NTGSL

SEQ ID NO: 3059496 - protein, 18 aa, Giardia lamblia
NTGTSSSNISKAPGDIDG

SEQ ID NO: 3059497 - protein, 7 aa, Giardia lamblia
NTGTTHS

SEQ ID NO: 3059498 - protein, 6 aa, Giardia lamblia
NTHDNG

SEQ ID NO: 3059499 - protein, 29 aa, Giardia lamblia
NTIEQNAGQLATSADAFKSEAKRVEKAAK

SEQ ID NO: 3059500 - protein, 4 aa, Giardia lamblia
NTIN

SEQ ID NO: 3059501 - protein, 8 aa, Giardia lamblia
NTKARQSL

SEQ ID NO: 3059502 - protein, 6 aa, Giardia lamblia
NTKGAY

SEQ ID NO: 3059503 - protein, 9 aa, Giardia lamblia
NTKLESESP

SEQ ID NO: 3059504 - protein, 10 aa, Giardia lamblia
NTKMNTTCGG

SEQ ID NO: 3059505 - protein, 7 aa, Giardia lamblia
NTKPQTL

SEQ ID NO: 3059506 - protein, 9 aa, Giardia lamblia
NTKQYTYPA

SEQ ID NO: 3059507 - protein, 5 aa, Giardia lamblia
NTKSL

SEQ ID NO: 3059508 - protein, 7 aa, Giardia lamblia
NTLGNAE

SEQ ID NO: 3059509 - protein, 9 aa, Giardia lamblia
NTLPSTQDE

SEQ ID NO: 3059510 - protein, 10 aa, Giardia lamblia
NTLSTTAPSA

SEQ ID NO: 3059511 - protein, 4 aa, Giardia lamblia
NTNA

SEQ ID NO: 3059512 - protein, 9 aa, Giardia lamblia
NTNDPSTYT

SEQ ID NO: 3059513 - protein, 7 aa, Giardia lamblia
NTNGTDT

SEQ ID NO: 3059514 - protein, 9 aa, Giardia lamblia
NTNKVPGNS

SEQ ID NO: 3059515 - protein, 10 aa, Giardia lamblia
NTNPDADPLL

SEQ ID NO: 3059516 - protein, 12 aa, Giardia lamblia
NTNRISGVQSSL

SEQ ID NO: 3059517 - protein, 8 aa, Giardia lamblia
NTPAPYRC

SEQ ID NO: 3059518 - protein, 13 aa, Giardia lamblia
NTPARRHQPSQSC

SEQ ID NO: 3059519 - protein, 6 aa, Giardia lamblia
NTPDYR

SEQ ID NO: 3059520 - protein, 4 aa, Giardia lamblia
NTPE

SEQ ID NO: 3059521 - protein, 5 aa, Giardia lamblia
NTPGE

SEQ ID NO: 3059522 - protein, 6 aa, Giardia lamblia
NTPGFK

SEQ ID NO: 3059523 - protein, 6 aa, Giardia lamblia
NTPGYE

SEQ ID NO: 3059524 - protein, 6 aa, Giardia lamblia
NTPGYN

SEQ ID NO: 3059525 - protein, 4 aa, Giardia lamblia
NTPK

SEQ ID NO: 3059526 - protein, 15 aa, Giardia lamblia
NTPKIQQSTQPKARL

SEQ ID NO: 3059527 - protein, 4 aa, Giardia lamblia
NTPL

SEQ ID NO: 3059528 - protein, 17 aa, Giardia lamblia
NTPLGGELSPGNSNAVR

SEQ ID NO: 3059529 - protein, 13 aa, Giardia lamblia
NTPLQSGSQSTAI

SEQ ID NO: 3059530 - protein, 5 aa, Giardia lamblia
NTPNV

SEQ ID NO: 3059531 - protein, 6 aa, Giardia lamblia
NTPTDV

SEQ ID NO: 3059532 - protein, 6 aa, Giardia lamblia
NTPVHT

SEQ ID NO: 3059533 - protein, 12 aa, Giardia lamblia
NTPYAGPHPDSA

SEQ ID NO: 3059534 - protein, 8 aa, Giardia lamblia
NTQGQSQM

SEQ ID NO: 3059535 - protein, 19 aa, Giardia lamblia
NTQKDAYCTSTANGTCTTC

SEQ ID NO: 3059536 - protein, 9 aa, Giardia lamblia
NTQNEGSVS

SEQ ID NO: 3059537 - protein, 4 aa, Giardia lamblia
NTQR

SEQ ID NO: 3059538 - protein, 7 aa, Giardia lamblia
NTQSSLT

SEQ ID NO: 3059539 - protein, 6 aa, Giardia lamblia
NTQVSS

SEQ ID NO: 3059540 - protein, 6 aa, Giardia lamblia
NTRHKR

SEQ ID NO: 3059541 - protein, 13 aa, Giardia lamblia
NTRNETSEPGREL

SEQ ID NO: 3059542 - protein, 6 aa, Giardia lamblia
NTRNQR

SEQ ID NO: 3059543 - protein, 9 aa, Giardia lamblia
NTRTAERIK

SEQ ID NO: 3059544 - protein, 37 aa, Giardia lamblia
NTRTTPQEARRPKSKEPRGVSRDTISPGPNRSRSTER

SEQ ID NO: 3059545 - protein, 6 aa, Giardia lamblia
NTSCND

SEQ ID NO: 3059546 - protein, 29 aa, Giardia lamblia
NTSEAPDQGNCKKHSEQNKCTKSSTGSCS

SEQ ID NO: 3059547 - protein, 7 aa, Giardia lamblia
NTSERAY

SEQ ID NO: 3059548 - protein, 6 aa, Giardia lamblia
NTSGTK

SEQ ID NO: 3059549 - protein, 9 aa, Giardia lamblia
NTSKDTCDE

SEQ ID NO: 3059550 - protein, 8 aa, Giardia lamblia
NTSPESQK

SEQ ID NO: 3059551 - protein, 6 aa, Giardia lamblia
NTSPFI

SEQ ID NO: 3059552 - protein, 9 aa, Giardia lamblia
NTSSANNVD

SEQ ID NO: 3059553 - protein, 11 aa, Giardia lamblia
NTSTASAGSNI

SEQ ID NO: 3059554 - protein, 7 aa, Giardia lamblia
NTSTASG

SEQ ID NO: 3059555 - protein, 7 aa, Giardia lamblia
NTSTGAT

SEQ ID NO: 3059556 - protein, 7 aa, Giardia lamblia
NTSTRDL

SEQ ID NO: 3059557 - protein, 6 aa, Giardia lamblia
NTSTTP

SEQ ID NO: 3059558 - protein, 13 aa, Giardia lamblia
NTSVPASSNTPVF

SEQ ID NO: 3059559 - protein, 9 aa, Giardia lamblia
NTSYSDNST

SEQ ID NO: 3059560 - protein, 4 aa, Giardia lamblia
NTTC

SEQ ID NO: 3059561 - protein, 11 aa, Giardia lamblia
NTTCAAEEGTC

SEQ ID NO: 3059562 - protein, 6 aa, Giardia lamblia
NTTERM

SEQ ID NO: 3059563 - protein, 14 aa, Giardia lamblia
NTTHNISSSSSNIS

SEQ ID NO: 3059564 - protein, 10 aa, Giardia lamblia
NTTHSNDPAA

SEQ ID NO: 3059565 - protein, 4 aa, Giardia lamblia
NTTL

SEQ ID NO: 3059566 - protein, 5 aa, Giardia lamblia
NTTLN

SEQ ID NO: 3059567 - protein, 14 aa, Giardia lamblia
NTTLSSKAHASTQS

SEQ ID NO: 3059568 - protein, 7 aa, Giardia lamblia
NTTNPRP

SEQ ID NO: 3059569 - protein, 8 aa, Giardia lamblia
NTTPHAQE

SEQ ID NO: 3059570 - protein, 7 aa, Giardia lamblia
NTTREDA

SEQ ID NO: 3059571 - protein, 14 aa, Giardia lamblia
NTTRPIKGHTYPPD

SEQ ID NO: 3059572 - protein, 7 aa, Giardia lamblia
NTTSKQM

SEQ ID NO: 3059573 - protein, 7 aa, Giardia lamblia
NTTTAEE

SEQ ID NO: 3059574 - protein, 6 aa, Giardia lamblia
NTTTPV

SEQ ID NO: 3059575 - protein, 12 aa, Giardia lamblia
NTTTSPTDDAFP

SEQ ID NO: 3059576 - protein, 6 aa, Giardia lamblia
NTTTTS

SEQ ID NO: 3059577 - protein, 6 aa, Giardia lamblia
NTTYSG

SEQ ID NO: 3059578 - protein, 19 aa, Giardia lamblia
NTVPASGPAKGKSQGYATG

SEQ ID NO: 3059579 - protein, 7 aa, Giardia lamblia
NTVPPRE

SEQ ID NO: 3059580 - protein, 9 aa, Giardia lamblia
NTVSSDKNI

SEQ ID NO: 3059581 - protein, 4 aa, Giardia lamblia
NTYA

SEQ ID NO: 3059582 - protein, 11 aa, Giardia lamblia
NTYRNSDGAPL

SEQ ID NO: 3059583 - protein, 8 aa, Giardia lamblia
NVAGSDQS

SEQ ID NO: 3059584 - protein, 9 aa, Giardia lamblia
NVCTSDGKT

SEQ ID NO: 3059585 - protein, 20 aa, Giardia lamblia
NVDKKSGAAVDKKGDSLPPA

SEQ ID NO: 3059586 - protein, 7 aa, Giardia lamblia
NVDNDPI

SEQ ID NO: 3059587 - protein, 12 aa, Giardia lamblia
NVESDDSTHSAT

SEQ ID NO: 3059588 - protein, 9 aa, Giardia lamblia
NVETNPSKL

SEQ ID NO: 3059589 - protein, 12 aa, Giardia lamblia
NVETSEESEQSE

SEQ ID NO: 3059590 - protein, 16 aa, Giardia lamblia
NVGSPIAASSAAAEVT

SEQ ID NO: 3059591 - protein, 7 aa, Giardia lamblia
NVNDLSR

SEQ ID NO: 3059592 - protein, 18 aa, Giardia lamblia
NVPGSTPDDDNEDNAAYT

SEQ ID NO: 3059593 - protein, 8 aa, Giardia lamblia
NVPVSRRQ

SEQ ID NO: 3059594 - protein, 5 aa, Giardia lamblia
NVQGA

SEQ ID NO: 3059595 - protein, 32 aa, Giardia lamblia
NVQQEGADAKYDVQSGVSQDIQSAGPPPTGVS

SEQ ID NO: 3059596 - protein, 9 aa, Giardia lamblia
NVQSSSALQ

SEQ ID NO: 3059597 - protein, 9 aa, Giardia lamblia
NVRKKGRPT

SEQ ID NO: 3059598 - protein, 4 aa, Giardia lamblia
NVSA

SEQ ID NO: 3059599 - protein, 11 aa, Giardia lamblia
NVSDSSKSYVP

SEQ ID NO: 3059600 - protein, 7 aa, Giardia lamblia
NVSPTDS

SEQ ID NO: 3059601 - protein, 11 aa, Giardia lamblia
NVSQQAGKITG

SEQ ID NO: 3059602 - protein, 7 aa, Giardia lamblia
NVSSQNE

SEQ ID NO: 3059603 - protein, 18 aa, Giardia lamblia
NVSTARDRSEQEQEQSHD

SEQ ID NO: 3059604 - protein, 10 aa, Giardia lamblia
NVSTDADGTV

SEQ ID NO: 3059605 - protein, 12 aa, Giardia lamblia
NVSTEANPNSVG

SEQ ID NO: 3059606 - protein, 8 aa, Giardia lamblia
NVSTPSVK

SEQ ID NO: 3059607 - protein, 4 aa, Giardia lamblia
NVTT

SEQ ID NO: 3059608 - protein, 9 aa, Giardia lamblia
NVTTEYGDS

SEQ ID NO: 3059609 - protein, 7 aa, Giardia lamblia
NYADDNP

SEQ ID NO: 3059610 - protein, 14 aa, Giardia lamblia
NYANSSSQRSNPLD

SEQ ID NO: 3059611 - protein, 9 aa, Giardia lamblia
NYASAADEN

SEQ ID NO: 3059612 - protein, 7 aa, Giardia lamblia
NYDPSQQ

SEQ ID NO: 3059613 - protein, 6 aa, Giardia lamblia
NYDTSE

SEQ ID NO: 3059614 - protein, 4 aa, Giardia lamblia
NYEG

SEQ ID NO: 3059615 - protein, 5 aa, Giardia lamblia
NYERE

SEQ ID NO: 3059616 - protein, 4 aa, Giardia lamblia
NYGE

SEQ ID NO: 3059617 - protein, 5 aa, Giardia lamblia
NYGGF

SEQ ID NO: 3059618 - protein, 6 aa, Giardia lamblia
NYGKEG

SEQ ID NO: 3059619 - protein, 9 aa, Giardia lamblia
NYGRGSTQI

SEQ ID NO: 3059620 - protein, 5 aa, Giardia lamblia
NYHNS

SEQ ID NO: 3059621 - protein, 7 aa, Giardia lamblia
NYKGREG

SEQ ID NO: 3059622 - protein, 9 aa, Giardia lamblia
NYKNKDSVQ

SEQ ID NO: 3059623 - protein, 5 aa, Giardia lamblia
NYNES

SEQ ID NO: 3059624 - protein, 6 aa, Giardia lamblia
NYNTRE

SEQ ID NO: 3059625 - protein, 10 aa, Giardia lamblia
NYPPGRPVSE

SEQ ID NO: 3059626 - protein, 11 aa, Giardia lamblia
NYRKERANLET

SEQ ID NO: 3059627 - protein, 11 aa, Giardia lamblia
NYRTAEGSCSP

SEQ ID NO: 3059628 - protein, 15 aa, Giardia lamblia
NYSDYSDDGYDDYDD

SEQ ID NO: 3059629 - protein, 4 aa, Giardia lamblia
NYSE

SEQ ID NO: 3059630 - protein, 8 aa, Giardia lamblia
NYSGYYEA

SEQ ID NO: 3059631 - protein, 4 aa, Giardia lamblia
NYSK

SEQ ID NO: 3059632 - protein, 4 aa, Giardia lamblia
NYTA

SEQ ID NO: 3059633 - protein, 13 aa, Giardia lamblia
NYTPSGDIKPPLQ

SEQ ID NO: 3059634 - protein, 6 aa, Giardia lamblia
NYTQMA

SEQ ID NO: 3059635 - protein, 5 aa, Giardia lamblia
NYTSE

SEQ ID NO: 3059636 - protein, 14 aa, Giardia lamblia
NYTSSSGSFNKPKN

SEQ ID NO: 3059637 - protein, 6 aa, Giardia lamblia
NYVPPG

SEQ ID NO: 3059638 - protein, 15 aa, Giardia lamblia
NYYTTDRKQFGATKT

SEQ ID NO: 3059639 - protein, 11 aa, Giardia lamblia
PAAAREAASFG

SEQ ID NO: 3059640 - protein, 4 aa, Giardia lamblia
PAAE

SEQ ID NO: 3059641 - protein, 14 aa, Giardia lamblia
PAAELRAQPGSRAA

SEQ ID NO: 3059642 - protein, 13 aa, Giardia lamblia
PAAENTADGGFGA

SEQ ID NO: 3059643 - protein, 9 aa, Giardia lamblia
PAAPPDVAN

SEQ ID NO: 3059644 - protein, 6 aa, Giardia lamblia
PAASKA

SEQ ID NO: 3059645 - protein, 10 aa, Giardia lamblia
PACNQPAAYD

SEQ ID NO: 3059646 - protein, 5 aa, Giardia lamblia
PADAN

SEQ ID NO: 3059647 - protein, 17 aa, Giardia lamblia
PADFPDALTTKQRQELR

SEQ ID NO: 3059648 - protein, 8 aa, Giardia lamblia
PADFPGKH

SEQ ID NO: 3059649 - protein, 5 aa, Giardia lamblia
PADHS

SEQ ID NO: 3059650 - protein, 5 aa, Giardia lamblia
PADIS

SEQ ID NO: 3059651 - protein, 13 aa, Giardia lamblia
PADLGKNKPSFYG

SEQ ID NO: 3059652 - protein, 6 aa, Giardia lamblia
PADPTI

SEQ ID NO: 3059653 - protein, 22 aa, Giardia lamblia
PADQGAADQSPTPSRGPEATSY

SEQ ID NO: 3059654 - protein, 4 aa, Giardia lamblia
PADS

SEQ ID NO: 3059655 - protein, 7 aa, Giardia lamblia
PADSSTM

SEQ ID NO: 3059656 - protein, 10 aa, Giardia lamblia
PAEAGQSDYF

SEQ ID NO: 3059657 - protein, 9 aa, Giardia lamblia
PAEANPDGY

SEQ ID NO: 3059658 - protein, 7 aa, Giardia lamblia
PAEARRV

SEQ ID NO: 3059659 - protein, 9 aa, Giardia lamblia
PAEESPRTT

SEQ ID NO: 3059660 - protein, 14 aa, Giardia lamblia
PAEHNGDKAPPLQP

SEQ ID NO: 3059661 - protein, 9 aa, Giardia lamblia
PAENNTYTK

SEQ ID NO: 3059662 - protein, 4 aa, Giardia lamblia
PAES

SEQ ID NO: 3059663 - protein, 4 aa, Giardia lamblia
PAET

SEQ ID NO: 3059664 - protein, 11 aa, Giardia lamblia
PAFDETPTAAK

SEQ ID NO: 3059665 - protein, 5 aa, Giardia lamblia
PAFQK

SEQ ID NO: 3059666 - protein, 10 aa, Giardia lamblia
PAFSTNSDDA

SEQ ID NO: 3059667 - protein, 6 aa, Giardia lamblia
PAGAPS

SEQ ID NO: 3059668 - protein, 8 aa, Giardia lamblia
PAGEVSAN

SEQ ID NO: 3059669 - protein, 4 aa, Giardia lamblia
PAGN

SEQ ID NO: 3059670 - protein, 14 aa, Giardia lamblia
PAGSASAMRNFFSL

SEQ ID NO: 3059671 - protein, 25 aa, Giardia lamblia
PAGSDLTDCSRKGCGSDTPQCSGNG

SEQ ID NO: 3059672 - protein, 7 aa, Giardia lamblia
PAGSGKT

SEQ ID NO: 3059673 - protein, 8 aa, Giardia lamblia
PAGSGKTS

SEQ ID NO: 3059674 - protein, 6 aa, Giardia lamblia
PAGSSC

SEQ ID NO: 3059675 - protein, 8 aa, Giardia lamblia
PAGSTSLS

SEQ ID NO: 3059676 - protein, 9 aa, Giardia lamblia
PAGTYADNI

SEQ ID NO: 3059677 - protein, 20 aa, Giardia lamblia
PAHAEKLGDTLQATDAPSTA

SEQ ID NO: 3059678 - protein, 12 aa, Giardia lamblia
PAHPSAYSRRGA

SEQ ID NO: 3059679 - protein, 6 aa, Giardia lamblia
PAISGP

SEQ ID NO: 3059680 - protein, 7 aa, Giardia lamblia
PAITSSH

SEQ ID NO: 3059681 - protein, 4 aa, Giardia lamblia
PAKN

SEQ ID NO: 3059682 - protein, 4 aa, Giardia lamblia
PAKS

SEQ ID NO: 3059683 - protein, 10 aa, Giardia lamblia
PAKSGVPSAN

SEQ ID NO: 3059684 - protein, 17 aa, Giardia lamblia
PAKSIASRETCNSPASS

SEQ ID NO: 3059685 - protein, 5 aa, Giardia lamblia
PALGP

SEQ ID NO: 3059686 - protein, 11 aa, Giardia lamblia
PALPTNNPTSV

SEQ ID NO: 3059687 - protein, 4 aa, Giardia lamblia
PALQ

SEQ ID NO: 3059688 - protein, 5 aa, Giardia lamblia
PANAS

SEQ ID NO: 3059689 - protein, 17 aa, Giardia lamblia
PANATTFEHSGSRVTSD

SEQ ID NO: 3059690 - protein, 6 aa, Giardia lamblia
PANDGM

SEQ ID NO: 3059691 - protein, 4 aa, Giardia lamblia
PANG

SEQ ID NO: 3059692 - protein, 20 aa, Giardia lamblia
PANNSAMDHDKNDDSNDSNA

SEQ ID NO: 3059693 - protein, 5 aa, Giardia lamblia
PANPF

SEQ ID NO: 3059694 - protein, 7 aa, Giardia lamblia
PAPATSY

SEQ ID NO: 3059695 - protein, 4 aa, Giardia lamblia
PAPD

SEQ ID NO: 3059696 - protein, 16 aa, Giardia lamblia
PAPDKSGCVPAPECPP

SEQ ID NO: 3059697 - protein, 7 aa, Giardia lamblia
PAPGETN

SEQ ID NO: 3059698 - protein, 17 aa, Giardia lamblia
PAPQDQESVDQDSRGIK

SEQ ID NO: 3059699 - protein, 19 aa, Giardia lamblia
PAPRPTAAGDGRPPAAAAP

SEQ ID NO: 3059700 - protein, 13 aa, Giardia lamblia
PAPSKKSSAGTTA

SEQ ID NO: 3059701 - protein, 13 aa, Giardia lamblia
PAPSNKSSAGTTA

SEQ ID NO: 3059702 - protein, 17 aa, Giardia lamblia
PAPSQRPAAGSPNKCEC

SEQ ID NO: 3059703 - protein, 6 aa, Giardia lamblia
PAPTTE

SEQ ID NO: 3059704 - protein, 4 aa, Giardia lamblia
PAPV

SEQ ID NO: 3059705 - protein, 5 aa, Giardia lamblia
PAQAS

SEQ ID NO: 3059706 - protein, 7 aa, Giardia lamblia
PAQCSSN

SEQ ID NO: 3059707 - protein, 10 aa, Giardia lamblia
PAQKGTTDHK

SEQ ID NO: 3059708 - protein, 25 aa, Giardia lamblia
PAQQEKDPPEITTQSTPKLSQQKFP

SEQ ID NO: 3059709 - protein, 7 aa, Giardia lamblia
PAQQLDV

SEQ ID NO: 3059710 - protein, 5 aa, Giardia lamblia
PAQRK

SEQ ID NO: 3059711 - protein, 20 aa, Giardia lamblia
PAQSPHSSQTPQSSQDTFPS

SEQ ID NO: 3059712 - protein, 11 aa, Giardia lamblia
PARASETKQPE

SEQ ID NO: 3059713 - protein, 4 aa, Giardia lamblia
PARE

SEQ ID NO: 3059714 - protein, 7 aa, Giardia lamblia
PARKPRF

SEQ ID NO: 3059715 - protein, 9 aa, Giardia lamblia
PARPNRSSQ

SEQ ID NO: 3059716 - protein, 4 aa, Giardia lamblia
PASA

SEQ ID NO: 3059717 - protein, 5 aa, Giardia lamblia
PASAP

SEQ ID NO: 3059718 - protein, 16 aa, Giardia lamblia
PASASNKSAGTFPPGT

SEQ ID NO: 3059719 - protein, 6 aa, Giardia lamblia
PASEDI

SEQ ID NO: 3059720 - protein, 6 aa, Giardia lamblia
PASESA

SEQ ID NO: 3059721 - protein, 4 aa, Giardia lamblia
PASF

SEQ ID NO: 3059722 - protein, 5 aa, Giardia lamblia
PASGH

SEQ ID NO: 3059723 - protein, 8 aa, Giardia lamblia
PASGHKET

SEQ ID NO: 3059724 - protein, 7 aa, Giardia lamblia
PASGTYQ

SEQ ID NO: 3059725 - protein, 15 aa, Giardia lamblia
PASKSLKANNAQKNT

SEQ ID NO: 3059726 - protein, 7 aa, Giardia lamblia
PASLPKK

SEQ ID NO: 3059727 - protein, 13 aa, Giardia lamblia
PASLYTNQTGASG

SEQ ID NO: 3059728 - protein, 13 aa, Giardia lamblia
PASPIDAQRTSAV

SEQ ID NO: 3059729 - protein, 5 aa, Giardia lamblia
PASRL

SEQ ID NO: 3059730 - protein, 7 aa, Giardia lamblia
PATEKAE

SEQ ID NO: 3059731 - protein, 11 aa, Giardia lamblia
PATGVQVEREN

SEQ ID NO: 3059732 - protein, 5 aa, Giardia lamblia
PATLD

SEQ ID NO: 3059733 - protein, 6 aa, Giardia lamblia
PATLQS

SEQ ID NO: 3059734 - protein, 8 aa, Giardia lamblia
PATPTEID

SEQ ID NO: 3059735 - protein, 15 aa, Giardia lamblia
PATQQAGRANGTTLG

SEQ ID NO: 3059736 - protein, 7 aa, Giardia lamblia
PATRHPK

SEQ ID NO: 3059737 - protein, 10 aa, Giardia lamblia
PATRSPQSGD

SEQ ID NO: 3059738 - protein, 20 aa, Giardia lamblia
PATSDRKKDQIPADDSSRLV

SEQ ID NO: 3059739 - protein, 11 aa, Giardia lamblia
PATSKNSSDIR

SEQ ID NO: 3059740 - protein, 5 aa, Giardia lamblia
PATTM

SEQ ID NO: 3059741 - protein, 5 aa, Giardia lamblia
PATTN

SEQ ID NO: 3059742 - protein, 17 aa, Giardia lamblia
PAVEENTQGYVSTAPDL

SEQ ID NO: 3059743 - protein, 6 aa, Giardia lamblia
PAVLTT

SEQ ID NO: 3059744 - protein, 22 aa, Giardia lamblia
PAVPPGLSPRLPPQAGQGGLPL

SEQ ID NO: 3059745 - protein, 4 aa, Giardia lamblia
PAVV

SEQ ID NO: 3059746 - protein, 11 aa, Giardia lamblia
PAYSQSSPMGM

SEQ ID NO: 3059747 - protein, 4 aa, Giardia lamblia
PAYT

SEQ ID NO: 3059748 - protein, 11 aa, Giardia lamblia
PCDTQKDRYNE

SEQ ID NO: 3059749 - protein, 10 aa, Giardia lamblia
PCGDTGYECG

SEQ ID NO: 3059750 - protein, 8 aa, Giardia lamblia
PCGTGPAC

SEQ ID NO: 3059751 - protein, 13 aa, Giardia lamblia
PCPAGTASKAGSV

SEQ ID NO: 3059752 - protein, 5 aa, Giardia lamblia
PCPRS

SEQ ID NO: 3059753 - protein, 4 aa, Giardia lamblia
PCQQ

SEQ ID NO: 3059754 - protein, 8 aa, Giardia lamblia
PCSGSTSK

SEQ ID NO: 3059755 - protein, 21 aa, Giardia lamblia
PCSNPSTSSSLLPSEPLTQAA

SEQ ID NO: 3059756 - protein, 4 aa, Giardia lamblia
PCTA

SEQ ID NO: 3059757 - protein, 4 aa, Giardia lamblia
PCTT

SEQ ID NO: 3059758 - protein, 5 aa, Giardia lamblia
PCYGT

SEQ ID NO: 3059759 - protein, 8 aa, Giardia lamblia
PDADTKQH

SEQ ID NO: 3059760 - protein, 7 aa, Giardia lamblia
PDAEGGD

SEQ ID NO: 3059761 - protein, 22 aa, Giardia lamblia
PDAKDSQKGPAYALPPSLSSSR

SEQ ID NO: 3059762 - protein, 6 aa, Giardia lamblia
PDALPQ

SEQ ID NO: 3059763 - protein, 9 aa, Giardia lamblia
PDAPFQPKD

SEQ ID NO: 3059764 - protein, 4 aa, Giardia lamblia
PDAT

SEQ ID NO: 3059765 - protein, 5 aa, Giardia lamblia
PDATA

SEQ ID NO: 3059766 - protein, 11 aa, Giardia lamblia
PDCKNNTGTTS

SEQ ID NO: 3059767 - protein, 10 aa, Giardia lamblia
PDDASSPTRC

SEQ ID NO: 3059768 - protein, 4 aa, Giardia lamblia
PDDG

SEQ ID NO: 3059769 - protein, 8 aa, Giardia lamblia
PDDIPKSL

SEQ ID NO: 3059770 - protein, 4 aa, Giardia lamblia
PDDL

SEQ ID NO: 3059771 - protein, 8 aa, Giardia lamblia
PDDQGGCV

SEQ ID NO: 3059772 - protein, 9 aa, Giardia lamblia
PDDQTYQTA

SEQ ID NO: 3059773 - protein, 10 aa, Giardia lamblia
PDDRPSASDI

SEQ ID NO: 3059774 - protein, 9 aa, Giardia lamblia
PDDRTPLDK

SEQ ID NO: 3059775 - protein, 9 aa, Giardia lamblia
PDDSDFSRR

SEQ ID NO: 3059776 - protein, 6 aa, Giardia lamblia
PDDSGR

SEQ ID NO: 3059777 - protein, 12 aa, Giardia lamblia
PDDSLHQKPLPY

SEQ ID NO: 3059778 - protein, 12 aa, Giardia lamblia
PDDSTENDVGSV

SEQ ID NO: 3059779 - protein, 5 aa, Giardia lamblia
PDEEI

SEQ ID NO: 3059780 - protein, 6 aa, Giardia lamblia
PDEQKT

SEQ ID NO: 3059781 - protein, 4 aa, Giardia lamblia
PDER

SEQ ID NO: 3059782 - protein, 6 aa, Giardia lamblia
PDERPL

SEQ ID NO: 3059783 - protein, 5 aa, Giardia lamblia
PDETL

SEQ ID NO: 3059784 - protein, 13 aa, Giardia lamblia
PDFDDGDGTGHAV

SEQ ID NO: 3059785 - protein, 5 aa, Giardia lamblia
PDFDK

SEQ ID NO: 3059786 - protein, 6 aa, Giardia lamblia
PDFNPT

SEQ ID NO: 3059787 - protein, 7 aa, Giardia lamblia
PDGEQRI

SEQ ID NO: 3059788 - protein, 10 aa, Giardia lamblia
PDGNMPSPQA

SEQ ID NO: 3059789 - protein, 10 aa, Giardia lamblia
PDGQGDEVAK

SEQ ID NO: 3059790 - protein, 5 aa, Giardia lamblia
PDGTL

SEQ ID NO: 3059791 - protein, 8 aa, Giardia lamblia
PDGTLSDP

SEQ ID NO: 3059792 - protein, 4 aa, Giardia lamblia
PDGY

SEQ ID NO: 3059793 - protein, 6 aa, Giardia lamblia
PDGYPG

SEQ ID NO: 3059794 - protein, 17 aa, Giardia lamblia
PDHEQQHPHPHPHPQQS

SEQ ID NO: 3059795 - protein, 29 aa, Giardia lamblia
PDIGDRTDECDSDSNEVGKQSGVSMSSKV

SEQ ID NO: 3059796 - protein, 16 aa, Giardia lamblia
PDITDGSVDLSESGSH

SEQ ID NO: 3059797 - protein, 11 aa, Giardia lamblia
PDKDSRKEKSV

SEQ ID NO: 3059798 - protein, 14 aa, Giardia lamblia
PDKIKTRPQKGEES

SEQ ID NO: 3059799 - protein, 6 aa, Giardia lamblia
PDKQCK

SEQ ID NO: 3059800 - protein, 7 aa, Giardia lamblia
PDKQSMN

SEQ ID NO: 3059801 - protein, 4 aa, Giardia lamblia
PDKV

SEQ ID NO: 3059802 - protein, 10 aa, Giardia lamblia
PDLDSGGLAA

SEQ ID NO: 3059803 - protein, 7 aa, Giardia lamblia
PDLTEDA

SEQ ID NO: 3059804 - protein, 5 aa, Giardia lamblia
PDMTD

SEQ ID NO: 3059805 - protein, 7 aa, Giardia lamblia
PDNAQEF

SEQ ID NO: 3059806 - protein, 8 aa, Giardia lamblia
PDNASYSN

SEQ ID NO: 3059807 - protein, 5 aa, Giardia lamblia
PDNGL

SEQ ID NO: 3059808 - protein, 5 aa, Giardia lamblia
PDNPQ

SEQ ID NO: 3059809 - protein, 12 aa, Giardia lamblia
PDNSAQDTAPAS

SEQ ID NO: 3059810 - protein, 9 aa, Giardia lamblia
PDNSGGGDA

SEQ ID NO: 3059811 - protein, 16 aa, Giardia lamblia
PDPASAPKEAEPAEPP

SEQ ID NO: 3059812 - protein, 4 aa, Giardia lamblia
PDPK

SEQ ID NO: 3059813 - protein, 6 aa, Giardia lamblia
PDPKDR

SEQ ID NO: 3059814 - protein, 5 aa, Giardia lamblia
PDPNS

SEQ ID NO: 3059815 - protein, 9 aa, Giardia lamblia
PDPQAPSYS

SEQ ID NO: 3059816 - protein, 6 aa, Giardia lamblia
PDPQDN

SEQ ID NO: 3059817 - protein, 14 aa, Giardia lamblia
PDPRSESSNSLSVS

SEQ ID NO: 3059818 - protein, 11 aa, Giardia lamblia
PDPSSPAASKL

SEQ ID NO: 3059819 - protein, 11 aa, Giardia lamblia
PDPSVRPSASA

SEQ ID NO: 3059820 - protein, 5 aa, Giardia lamblia
PDPTF

SEQ ID NO: 3059821 - protein, 7 aa, Giardia lamblia
PDQAEQQ

SEQ ID NO: 3059822 - protein, 15 aa, Giardia lamblia
PDQDTQQEEGMQESE

SEQ ID NO: 3059823 - protein, 7 aa, Giardia lamblia
PDQEYKD

SEQ ID NO: 3059824 - protein, 5 aa, Giardia lamblia
PDQGC

SEQ ID NO: 3059825 - protein, 17 aa, Giardia lamblia
PDQKSGWTGTTVPSASV

SEQ ID NO: 3059826 - protein, 10 aa, Giardia lamblia
PDQTKGRANL

SEQ ID NO: 3059827 - protein, 6 aa, Giardia lamblia
PDRNPN

SEQ ID NO: 3059828 - protein, 8 aa, Giardia lamblia
PDRSKGAS

SEQ ID NO: 3059829 - protein, 5 aa, Giardia lamblia
PDSAD

SEQ ID NO: 3059830 - protein, 5 aa, Giardia lamblia
PDSAR

SEQ ID NO: 3059831 - protein, 4 aa, Giardia lamblia
PDSE

SEQ ID NO: 3059832 - protein, 6 aa, Giardia lamblia
PDSMST

SEQ ID NO: 3059833 - protein, 4 aa, Giardia lamblia
PDSS

SEQ ID NO: 3059834 - protein, 7 aa, Giardia lamblia
PDSSDDP

SEQ ID NO: 3059835 - protein, 8 aa, Giardia lamblia
PDSSVNMD

SEQ ID NO: 3059836 - protein, 8 aa, Giardia lamblia
PDSVTTED

SEQ ID NO: 3059837 - protein, 7 aa, Giardia lamblia
PDSYSSD

SEQ ID NO: 3059838 - protein, 12 aa, Giardia lamblia
PDTAGGDYSYSS

SEQ ID NO: 3059839 - protein, 12 aa, Giardia lamblia
PDTATKQKTDSV

SEQ ID NO: 3059840 - protein, 4 aa, Giardia lamblia
PDTC

SEQ ID NO: 3059841 - protein, 7 aa, Giardia lamblia
PDTDYNS

SEQ ID NO: 3059842 - protein, 6 aa, Giardia lamblia
PDTGEY

SEQ ID NO: 3059843 - protein, 5 aa, Giardia lamblia
PDTGT

SEQ ID NO: 3059844 - protein, 4 aa, Giardia lamblia
PDTK

SEQ ID NO: 3059845 - protein, 4 aa, Giardia lamblia
PDTL

SEQ ID NO: 3059846 - protein, 8 aa, Giardia lamblia
PDTLDGTV

SEQ ID NO: 3059847 - protein, 10 aa, Giardia lamblia
PDTLTSPKNP

SEQ ID NO: 3059848 - protein, 8 aa, Giardia lamblia
PDTSLRPS

SEQ ID NO: 3059849 - protein, 9 aa, Giardia lamblia
PDTSNLSAS

SEQ ID NO: 3059850 - protein, 10 aa, Giardia lamblia
PDTTSPGERY

SEQ ID NO: 3059851 - protein, 7 aa, Giardia lamblia
PDTTTSL

SEQ ID NO: 3059852 - protein, 7 aa, Giardia lamblia
PDTYEGK

SEQ ID NO: 3059853 - protein, 6 aa, Giardia lamblia
PDVGAA

SEQ ID NO: 3059854 - protein, 22 aa, Giardia lamblia
PDWPKNDNYSSTDEKKLQEDVN

SEQ ID NO: 3059855 - protein, 5 aa, Giardia lamblia
PDYSP

SEQ ID NO: 3059856 - protein, 4 aa, Giardia lamblia
PDYT

SEQ ID NO: 3059857 - protein, 9 aa, Giardia lamblia
PEADPNVPH

SEQ ID NO: 3059858 - protein, 5 aa, Giardia lamblia
PEAGK

SEQ ID NO: 3059859 - protein, 5 aa, Giardia lamblia
PEAGS

SEQ ID NO: 3059860 - protein, 8 aa, Giardia lamblia
PEAKMTDE

SEQ ID NO: 3059861 - protein, 7 aa, Giardia lamblia
PEARYGA

SEQ ID NO: 3059862 - protein, 16 aa, Giardia lamblia
PEASGTVDSEEQSRAL

SEQ ID NO: 3059863 - protein, 16 aa, Giardia lamblia
PECDGGSRKNQLNRAS

SEQ ID NO: 3059864 - protein, 13 aa, Giardia lamblia
PEDDNRASETSEL

SEQ ID NO: 3059865 - protein, 5 aa, Giardia lamblia
PEDIA

SEQ ID NO: 3059866 - protein, 4 aa, Giardia lamblia
PEDQ

SEQ ID NO: 3059867 - protein, 4 aa, Giardia lamblia
PEEA

SEQ ID NO: 3059868 - protein, 12 aa, Giardia lamblia
PEEDSSSHPKKQ

SEQ ID NO: 3059869 - protein, 6 aa, Giardia lamblia
PEEEEN

SEQ ID NO: 3059870 - protein, 7 aa, Giardia lamblia
PEEKETY

SEQ ID NO: 3059871 - protein, 6 aa, Giardia lamblia
PEERDY

SEQ ID NO: 3059872 - protein, 6 aa, Giardia lamblia
PEESHK

SEQ ID NO: 3059873 - protein, 5 aa, Giardia lamblia
PEEYT

SEQ ID NO: 3059874 - protein, 4 aa, Giardia lamblia
PEGE

SEQ ID NO: 3059875 - protein, 6 aa, Giardia lamblia
PEGEDG

SEQ ID NO: 3059876 - protein, 9 aa, Giardia lamblia
PEGKTETEM

SEQ ID NO: 3059877 - protein, 5 aa, Giardia lamblia
PEGKV

SEQ ID NO: 3059878 - protein, 6 aa, Giardia lamblia
PEGLKK

SEQ ID NO: 3059879 - protein, 15 aa, Giardia lamblia
PEGRWKRTEDDANTF

SEQ ID NO: 3059880 - protein, 7 aa, Giardia lamblia
PEGSTEL

SEQ ID NO: 3059881 - protein, 10 aa, Giardia lamblia
PEGTTGQDLT

SEQ ID NO: 3059882 - protein, 9 aa, Giardia lamblia
PEGTTPSQN

SEQ ID NO: 3059883 - protein, 5 aa, Giardia lamblia
PEIAS

SEQ ID NO: 3059884 - protein, 6 aa, Giardia lamblia
PEIPTS

SEQ ID NO: 3059885 - protein, 10 aa, Giardia lamblia
PEIRSAGAKS

SEQ ID NO: 3059886 - protein, 5 aa, Giardia lamblia
PEKAE

SEQ ID NO: 3059887 - protein, 22 aa, Giardia lamblia
PEKESVNKPRKTSTMDKDAEPE

SEQ ID NO: 3059888 - protein, 25 aa, Giardia lamblia
PEKHTETNGSKPSDQNIPDNDGEKK

SEQ ID NO: 3059889 - protein, 10 aa, Giardia lamblia
PEKSESIDGT

SEQ ID NO: 3059890 - protein, 4 aa, Giardia lamblia
PELK

SEQ ID NO: 3059891 - protein, 12 aa, Giardia lamblia
PELNASTPESGA

SEQ ID NO: 3059892 - protein, 9 aa, Giardia lamblia
PENINNSGE

SEQ ID NO: 3059893 - protein, 15 aa, Giardia lamblia
PENPEPKELAEATEA

SEQ ID NO: 3059894 - protein, 4 aa, Giardia lamblia
PENR

SEQ ID NO: 3059895 - protein, 10 aa, Giardia lamblia
PENRGTTVTG

SEQ ID NO: 3059896 - protein, 7 aa, Giardia lamblia
PENRPTA

SEQ ID NO: 3059897 - protein, 5 aa, Giardia lamblia
PENSQ

SEQ ID NO: 3059898 - protein, 6 aa, Giardia lamblia
PEPGSS

SEQ ID NO: 3059899 - protein, 16 aa, Giardia lamblia
PEPGSSSKDPATRPFG

SEQ ID NO: 3059900 - protein, 13 aa, Giardia lamblia
PEPLMSDPSTTFS

SEQ ID NO: 3059901 - protein, 13 aa, Giardia lamblia
PEPPAEHEQEKKL

SEQ ID NO: 3059902 - protein, 10 aa, Giardia lamblia
PEPVTGRRRS

SEQ ID NO: 3059903 - protein, 4 aa, Giardia lamblia
PEPY

SEQ ID NO: 3059904 - protein, 5 aa, Giardia lamblia
PEQED

SEQ ID NO: 3059905 - protein, 5 aa, Giardia lamblia
PEQEG

SEQ ID NO: 3059906 - protein, 6 aa, Giardia lamblia
PEQGDE

SEQ ID NO: 3059907 - protein, 8 aa, Giardia lamblia
PERARTAS

SEQ ID NO: 3059908 - protein, 30 aa, Giardia lamblia
PERDTSEEGAGNPTEPSEMDDEGSVDENGV

SEQ ID NO: 3059909 - protein, 4 aa, Giardia lamblia
PERI

SEQ ID NO: 3059910 - protein, 13 aa, Giardia lamblia
PERKGPAPGDEAL

SEQ ID NO: 3059911 - protein, 12 aa, Giardia lamblia
PERSTTGETSIT

SEQ ID NO: 3059912 - protein, 6 aa, Giardia lamblia
PERTSA

SEQ ID NO: 3059913 - protein, 4 aa, Giardia lamblia
PERY

SEQ ID NO: 3059914 - protein, 6 aa, Giardia lamblia
PESKNP

SEQ ID NO: 3059915 - protein, 10 aa, Giardia lamblia
PESKRSQTSL

SEQ ID NO: 3059916 - protein, 5 aa, Giardia lamblia
PESLS

SEQ ID NO: 3059917 - protein, 8 aa, Giardia lamblia
PESLSYPN

SEQ ID NO: 3059918 - protein, 12 aa, Giardia lamblia
PESNPLRYPTTT

SEQ ID NO: 3059919 - protein, 4 aa, Giardia lamblia
PESS

SEQ ID NO: 3059920 - protein, 5 aa, Giardia lamblia
PESTK

SEQ ID NO: 3059921 - protein, 5 aa, Giardia lamblia
PESWS

SEQ ID NO: 3059922 - protein, 5 aa, Giardia lamblia
PETDK

SEQ ID NO: 3059923 - protein, 12 aa, Giardia lamblia
PETGMQSSNGST

SEQ ID NO: 3059924 - protein, 4 aa, Giardia lamblia
PETH

SEQ ID NO: 3059925 - protein, 9 aa, Giardia lamblia
PETKKEKVT

SEQ ID NO: 3059926 - protein, 5 aa, Giardia lamblia
PETLD

SEQ ID NO: 3059927 - protein, 5 aa, Giardia lamblia
PETNT

SEQ ID NO: 3059928 - protein, 5 aa, Giardia lamblia
PETPY

SEQ ID NO: 3059929 - protein, 4 aa, Giardia lamblia
PETV

SEQ ID NO: 3059930 - protein, 4 aa, Giardia lamblia
PETY

SEQ ID NO: 3059931 - protein, 4 aa, Giardia lamblia
PEVP

SEQ ID NO: 3059932 - protein, 7 aa, Giardia lamblia
PEYGNPA

SEQ ID NO: 3059933 - protein, 12 aa, Giardia lamblia
PFASAPEQTTEA

SEQ ID NO: 3059934 - protein, 13 aa, Giardia lamblia
PFATKRESLANPT

SEQ ID NO: 3059935 - protein, 30 aa, Giardia lamblia
PFDGQRLGDAQREPSAGADSHMSSGASSYS

SEQ ID NO: 3059936 - protein, 11 aa, Giardia lamblia
PFGAAYGSSSF

SEQ ID NO: 3059937 - protein, 13 aa, Giardia lamblia
PFKGTKKNALQSK

SEQ ID NO: 3059938 - protein, 9 aa, Giardia lamblia
PFPATTPQY

SEQ ID NO: 3059939 - protein, 12 aa, Giardia lamblia
PFPKRQADHPTV

SEQ ID NO: 3059940 - protein, 13 aa, Giardia lamblia
PFPQESPHGLTKT

SEQ ID NO: 3059941 - protein, 4 aa, Giardia lamblia
PFQQ

SEQ ID NO: 3059942 - protein, 7 aa, Giardia lamblia
PFSDDGA

SEQ ID NO: 3059943 - protein, 8 aa, Giardia lamblia
PFSGEEDD

SEQ ID NO: 3059944 - protein, 10 aa, Giardia lamblia
PFSGPQNQSI

SEQ ID NO: 3059945 - protein, 17 aa, Giardia lamblia
PFSPPSEQRDKGTVADS

SEQ ID NO: 3059946 - protein, 18 aa, Giardia lamblia
PFSYASSTSTHGGNARSE

SEQ ID NO: 3059947 - protein, 10 aa, Giardia lamblia
PGAERSDDDG

SEQ ID NO: 3059948 - protein, 5 aa, Giardia lamblia
PGAEY

SEQ ID NO: 3059949 - protein, 5 aa, Giardia lamblia
PGAPL

SEQ ID NO: 3059950 - protein, 7 aa, Giardia lamblia
PGAQPGK

SEQ ID NO: 3059951 - protein, 10 aa, Giardia lamblia
PGARAGTAND

SEQ ID NO: 3059952 - protein, 13 aa, Giardia lamblia
PGATERVRQASES

SEQ ID NO: 3059953 - protein, 16 aa, Giardia lamblia
PGATGTSNENKLPKNV

SEQ ID NO: 3059954 - protein, 7 aa, Giardia lamblia
PGCDTKS

SEQ ID NO: 3059955 - protein, 10 aa, Giardia lamblia
PGDARSLAGP

SEQ ID NO: 3059956 - protein, 6 aa, Giardia lamblia
PGDKYG

SEQ ID NO: 3059957 - protein, 8 aa, Giardia lamblia
PGEARSLA

SEQ ID NO: 3059958 - protein, 5 aa, Giardia lamblia
PGEGQ

SEQ ID NO: 3059959 - protein, 7 aa, Giardia lamblia
PGETPLP

SEQ ID NO: 3059960 - protein, 15 aa, Giardia lamblia
PGETTTDKVGATSRE

SEQ ID NO: 3059961 - protein, 16 aa, Giardia lamblia
PGGAYSAAYTAENPNI

SEQ ID NO: 3059962 - protein, 4 aa, Giardia lamblia
PGGS

SEQ ID NO: 3059963 - protein, 6 aa, Giardia lamblia
PGHSAG

SEQ ID NO: 3059964 - protein, 7 aa, Giardia lamblia
PGIGANA

SEQ ID NO: 3059965 - protein, 6 aa, Giardia lamblia
PGKAPH

SEQ ID NO: 3059966 - protein, 7 aa, Giardia lamblia
PGKCKQK

SEQ ID NO: 3059967 - protein, 5 aa, Giardia lamblia
PGKED

SEQ ID NO: 3059968 - protein, 12 aa, Giardia lamblia
PGKEGSLPDSQV

SEQ ID NO: 3059969 - protein, 8 aa, Giardia lamblia
PGKGTKYA

SEQ ID NO: 3059970 - protein, 12 aa, Giardia lamblia
PGKLPKDRSWKA

SEQ ID NO: 3059971 - protein, 13 aa, Giardia lamblia
PGLDDPGNFTADE

SEQ ID NO: 3059972 - protein, 7 aa, Giardia lamblia
PGLPPLQ

SEQ ID NO: 3059973 - protein, 16 aa, Giardia lamblia
PGMGDTRGLEKDAENI

SEQ ID NO: 3059974 - protein, 4 aa, Giardia lamblia
PGMP

SEQ ID NO: 3059975 - protein, 10 aa, Giardia lamblia
PGMPSLSAGA

SEQ ID NO: 3059976 - protein, 7 aa, Giardia lamblia
PGMRDSD

SEQ ID NO: 3059977 - protein, 4 aa, Giardia lamblia
PGNE

SEQ ID NO: 3059978 - protein, 7 aa, Giardia lamblia
PGNPATL

SEQ ID NO: 3059979 - protein, 8 aa, Giardia lamblia
PGPATTGY

SEQ ID NO: 3059980 - protein, 14 aa, Giardia lamblia
PGPITNLDGTTEHR

SEQ ID NO: 3059981 - protein, 25 aa, Giardia lamblia
PGPPDRDANCSNCSQPSIKSASFQD

SEQ ID NO: 3059982 - protein, 8 aa, Giardia lamblia
PGPRAYSY

SEQ ID NO: 3059983 - protein, 4 aa, Giardia lamblia
PGPS

SEQ ID NO: 3059984 - protein, 5 aa, Giardia lamblia
PGPSE

SEQ ID NO: 3059985 - protein, 6 aa, Giardia lamblia
PGQGRY

SEQ ID NO: 3059986 - protein, 4 aa, Giardia lamblia
PGQK

SEQ ID NO: 3059987 - protein, 7 aa, Giardia lamblia
PGQSSTL

SEQ ID NO: 3059988 - protein, 4 aa, Giardia lamblia
PGRL

SEQ ID NO: 3059989 - protein, 5 aa, Giardia lamblia
PGRLP

SEQ ID NO: 3059990 - protein, 12 aa, Giardia lamblia
PGRMGSGGSGTL

SEQ ID NO: 3059991 - protein, 10 aa, Giardia lamblia
PGRNPKTIGE

SEQ ID NO: 3059992 - protein, 6 aa, Giardia lamblia
PGRSRI

SEQ ID NO: 3059993 - protein, 8 aa, Giardia lamblia
PGSGENSW

SEQ ID NO: 3059994 - protein, 10 aa, Giardia lamblia
PGSGKSTSLS

SEQ ID NO: 3059995 - protein, 10 aa, Giardia lamblia
PGSIGQQKNT

SEQ ID NO: 3059996 - protein, 7 aa, Giardia lamblia
PGSPANP

SEQ ID NO: 3059997 - protein, 6 aa, Giardia lamblia
PGSPKT

SEQ ID NO: 3059998 - protein, 9 aa, Giardia lamblia
PGSPSIKSS

SEQ ID NO: 3059999 - protein, 5 aa, Giardia lamblia
PGSQT

SEQ ID NO: 3060000 - protein, 8 aa, Giardia lamblia
PGSRGQQT

SEQ ID NO: 3060001 - protein, 6 aa, Giardia lamblia
PGSSEL

SEQ ID NO: 3060002 - protein, 10 aa, Giardia lamblia
PGSSTSSGHA

SEQ ID NO: 3060003 - protein, 5 aa, Giardia lamblia
PGSTG

SEQ ID NO: 3060004 - protein, 9 aa, Giardia lamblia
PGSTVSSGT

SEQ ID NO: 3060005 - protein, 8 aa, Giardia lamblia
PGTESSSK

SEQ ID NO: 3060006 - protein, 5 aa, Giardia lamblia
PGTGA

SEQ ID NO: 3060007 - protein, 4 aa, Giardia lamblia
PGTI

SEQ ID NO: 3060008 - protein, 7 aa, Giardia lamblia
PGTPPRL

SEQ ID NO: 3060009 - protein, 9 aa, Giardia lamblia
PGTSTCNGC

SEQ ID NO: 3060010 - protein, 8 aa, Giardia lamblia
PGTSVNSS

SEQ ID NO: 3060011 - protein, 19 aa, Giardia lamblia
PGTTKSKTPTAVSSSDPQV

SEQ ID NO: 3060012 - protein, 20 aa, Giardia lamblia
PGVEYSKAPDNITAAGVSNE

SEQ ID NO: 3060013 - protein, 4 aa, Giardia lamblia
PGVG

SEQ ID NO: 3060014 - protein, 4 aa, Giardia lamblia
PGVN

SEQ ID NO: 3060015 - protein, 5 aa, Giardia lamblia
PGVRP

SEQ ID NO: 3060016 - protein, 4 aa, Giardia lamblia
PGVT

SEQ ID NO: 3060017 - protein, 14 aa, Giardia lamblia
PGWTRSSPSSTCDT

SEQ ID NO: 3060018 - protein, 15 aa, Giardia lamblia
PGYDVADDEPTEASG

SEQ ID NO: 3060019 - protein, 7 aa, Giardia lamblia
PGYEGPQ

SEQ ID NO: 3060020 - protein, 6 aa, Giardia lamblia
PGYSGP

SEQ ID NO: 3060021 - protein, 8 aa, Giardia lamblia
PGYSPTNG

SEQ ID NO: 3060022 - protein, 9 aa, Giardia lamblia
PGYYNASGT

SEQ ID NO: 3060023 - protein, 6 aa, Giardia lamblia
PGYYNN

SEQ ID NO: 3060024 - protein, 4 aa, Giardia lamblia
PHAR

SEQ ID NO: 3060025 - protein, 4 aa, Giardia lamblia
PHAS

SEQ ID NO: 3060026 - protein, 8 aa, Giardia lamblia
PHDGKSCT

SEQ ID NO: 3060027 - protein, 5 aa, Giardia lamblia
PHDGT

SEQ ID NO: 3060028 - protein, 6 aa, Giardia lamblia
PHDSCT

SEQ ID NO: 3060029 - protein, 4 aa, Giardia lamblia
PHEM

SEQ ID NO: 3060030 - protein, 5 aa, Giardia lamblia
PHERP

SEQ ID NO: 3060031 - protein, 4 aa, Giardia lamblia
PHES

SEQ ID NO: 3060032 - protein, 5 aa, Giardia lamblia
PHESG

SEQ ID NO: 3060033 - protein, 13 aa, Giardia lamblia
PHGPYGPLNPENM

SEQ ID NO: 3060034 - protein, 4 aa, Giardia lamblia
PHGS

SEQ ID NO: 3060035 - protein, 11 aa, Giardia lamblia
PHNSGEGDGKR

SEQ ID NO: 3060036 - protein, 12 aa, Giardia lamblia
PHPEFAPTKSSK

SEQ ID NO: 3060037 - protein, 16 aa, Giardia lamblia
PHPPLQSPGSPAQPEH

SEQ ID NO: 3060038 - protein, 5 aa, Giardia lamblia
PHPRY

SEQ ID NO: 3060039 - protein, 4 aa, Giardia lamblia
PHPS

SEQ ID NO: 3060040 - protein, 17 aa, Giardia lamblia
PHQAPSTDSSDAGPGQL

SEQ ID NO: 3060041 - protein, 9 aa, Giardia lamblia
PHQQDEKDV

SEQ ID NO: 3060042 - protein, 7 aa, Giardia lamblia
PHRDTPS

SEQ ID NO: 3060043 - protein, 5 aa, Giardia lamblia
PHRGR

SEQ ID NO: 3060044 - protein, 10 aa, Giardia lamblia
PHRNHSQQMP

SEQ ID NO: 3060045 - protein, 7 aa, Giardia lamblia
PHRPSEN

SEQ ID NO: 3060046 - protein, 7 aa, Giardia lamblia
PHSGKAY

SEQ ID NO: 3060047 - protein, 5 aa, Giardia lamblia
PHSGY

SEQ ID NO: 3060048 - protein, 9 aa, Giardia lamblia
PHTPSQTTF

SEQ ID NO: 3060049 - protein, 6 aa, Giardia lamblia
PHTQSG

SEQ ID NO: 3060050 - protein, 20 aa, Giardia lamblia
PHTQSTSKHSSYTEDSGYQY

SEQ ID NO: 3060051 - protein, 11 aa, Giardia lamblia
PHTRYDKPQGY

SEQ ID NO: 3060052 - protein, 9 aa, Giardia lamblia
PHTTKRVPQ

SEQ ID NO: 3060053 - protein, 6 aa, Giardia lamblia
PIAAKT

SEQ ID NO: 3060054 - protein, 8 aa, Giardia lamblia
PIAPHSNS

SEQ ID NO: 3060055 - protein, 6 aa, Giardia lamblia
PIASLG

SEQ ID NO: 3060056 - protein, 6 aa, Giardia lamblia
PIATHT

SEQ ID NO: 3060057 - protein, 4 aa, Giardia lamblia
PIDG

SEQ ID NO: 3060058 - protein, 5 aa, Giardia lamblia
PIEGS

SEQ ID NO: 3060059 - protein, 10 aa, Giardia lamblia
PIGGRAAHSD

SEQ ID NO: 3060060 - protein, 8 aa, Giardia lamblia
PINDPNLK

SEQ ID NO: 3060061 - protein, 7 aa, Giardia lamblia
PINPPVS

SEQ ID NO: 3060062 - protein, 6 aa, Giardia lamblia
PINPRL

SEQ ID NO: 3060063 - protein, 33 aa, Giardia lamblia
PINTEQAPPPDERKAEGKKARRSPNSDPPPSFN

SEQ ID NO: 3060064 - protein, 18 aa, Giardia lamblia
PIPDEPLTNNKSSAGISS

SEQ ID NO: 3060065 - protein, 4 aa, Giardia lamblia
PIPG

SEQ ID NO: 3060066 - protein, 5 aa, Giardia lamblia
PIPHD

SEQ ID NO: 3060067 - protein, 11 aa, Giardia lamblia
PIPPSGREPPH

SEQ ID NO: 3060068 - protein, 4 aa, Giardia lamblia
PIQE

SEQ ID NO: 3060069 - protein, 4 aa, Giardia lamblia
PIQS

SEQ ID NO: 3060070 - protein, 7 aa, Giardia lamblia
PIRKPVT

SEQ ID NO: 3060071 - protein, 18 aa, Giardia lamblia
PISDPSSLQSNATQQDDQ

SEQ ID NO: 3060072 - protein, 5 aa, Giardia lamblia
PISET

SEQ ID NO: 3060073 - protein, 12 aa, Giardia lamblia
PISTEAKESELA

SEQ ID NO: 3060074 - protein, 6 aa, Giardia lamblia
PISTGS

SEQ ID NO: 3060075 - protein, 12 aa, Giardia lamblia
PITAPDGTSTSC

SEQ ID NO: 3060076 - protein, 8 aa, Giardia lamblia
PITPDTSV

SEQ ID NO: 3060077 - protein, 12 aa, Giardia lamblia
PITPSGGQESRR

SEQ ID NO: 3060078 - protein, 21 aa, Giardia lamblia
PITSNAKPTSQTEPDSQPPVS

SEQ ID NO: 3060079 - protein, 23 aa, Giardia lamblia
PIVSKKDDTEKPVGGTGGDLNLE

SEQ ID NO: 3060080 - protein, 5 aa, Giardia lamblia
PIYTS

SEQ ID NO: 3060081 - protein, 26 aa, Giardia lamblia
PKAAKRSKLSGDAAGLKAPAGDLSSG

SEQ ID NO: 3060082 - protein, 8 aa, Giardia lamblia
PKADPQKA

SEQ ID NO: 3060083 - protein, 13 aa, Giardia lamblia
PKAESASLPGGGL

SEQ ID NO: 3060084 - protein, 8 aa, Giardia lamblia
PKAHSECR

SEQ ID NO: 3060085 - protein, 9 aa, Giardia lamblia
PKARNWKEQ

SEQ ID NO: 3060086 - protein, 19 aa, Giardia lamblia
PKASATPPLSESTSSLEKE

SEQ ID NO: 3060087 - protein, 7 aa, Giardia lamblia
PKDATKI

SEQ ID NO: 3060088 - protein, 20 aa, Giardia lamblia
PKDSCSMEENTDAGTCQFGG

SEQ ID NO: 3060089 - protein, 5 aa, Giardia lamblia
PKDSF

SEQ ID NO: 3060090 - protein, 5 aa, Giardia lamblia
PKDSL

SEQ ID NO: 3060091 - protein, 8 aa, Giardia lamblia
PKDTESYG

SEQ ID NO: 3060092 - protein, 7 aa, Giardia lamblia
PKDTSLR

SEQ ID NO: 3060093 - protein, 25 aa, Giardia lamblia
PKEETQQHTDPAHPGRQGPDTQPNP

SEQ ID NO: 3060094 - protein, 4 aa, Giardia lamblia
PKEG

SEQ ID NO: 3060095 - protein, 7 aa, Giardia lamblia
PKEGYRD

SEQ ID NO: 3060096 - protein, 11 aa, Giardia lamblia
PKESGTGIPTK

SEQ ID NO: 3060097 - protein, 13 aa, Giardia lamblia
PKFSAANDVSEAS

SEQ ID NO: 3060098 - protein, 8 aa, Giardia lamblia
PKGKHTTL

SEQ ID NO: 3060099 - protein, 8 aa, Giardia lamblia
PKGSLGKG

SEQ ID NO: 3060100 - protein, 4 aa, Giardia lamblia
PKHN

SEQ ID NO: 3060101 - protein, 12 aa, Giardia lamblia
PKIASDPAPKPA

SEQ ID NO: 3060102 - protein, 12 aa, Giardia lamblia
PKIASDPTPKPA

SEQ ID NO: 3060103 - protein, 4 aa, Giardia lamblia
PKIE

SEQ ID NO: 3060104 - protein, 6 aa, Giardia lamblia
PKIPSN

SEQ ID NO: 3060105 - protein, 13 aa, Giardia lamblia
PKISTNTSSTYKP

SEQ ID NO: 3060106 - protein, 15 aa, Giardia lamblia
PKKAAPSSKGQPAEE

SEQ ID NO: 3060107 - protein, 9 aa, Giardia lamblia
PKKDENGET

SEQ ID NO: 3060108 - protein, 78 aa, Giardia lamblia
PKKPSTQASLNDSDPTLGKTPVNTSNASNASQKSDPLSSPEKPKTPQHASGKAGARSGTPAKMKTPVRSVQSQPPQII

SEQ ID NO: 3060109 - protein, 4 aa, Giardia lamblia
PKKR

SEQ ID NO: 3060110 - protein, 5 aa, Giardia lamblia
PKLKP

SEQ ID NO: 3060111 - protein, 16 aa, Giardia lamblia
PKLNEEDNASDQITPG

SEQ ID NO: 3060112 - protein, 8 aa, Giardia lamblia
PKLQRTYK

SEQ ID NO: 3060113 - protein, 12 aa, Giardia lamblia
PKLSDKSGCHTS

SEQ ID NO: 3060114 - protein, 8 aa, Giardia lamblia
PKLTPKPQ

SEQ ID NO: 3060115 - protein, 19 aa, Giardia lamblia
PKNCPNEKHAQGKSEPERP

SEQ ID NO: 3060116 - protein, 4 aa, Giardia lamblia
PKNN

SEQ ID NO: 3060117 - protein, 5 aa, Giardia lamblia
PKNPW

SEQ ID NO: 3060118 - protein, 4 aa, Giardia lamblia
PKNT

SEQ ID NO: 3060119 - protein, 5 aa, Giardia lamblia
PKPDS

SEQ ID NO: 3060120 - protein, 9 aa, Giardia lamblia
PKPEEGEEP

SEQ ID NO: 3060121 - protein, 7 aa, Giardia lamblia
PKPGSMD

SEQ ID NO: 3060122 - protein, 6 aa, Giardia lamblia
PKPQTG

SEQ ID NO: 3060123 - protein, 19 aa, Giardia lamblia
PKPTYSRQPYDITSDATST

SEQ ID NO: 3060124 - protein, 10 aa, Giardia lamblia
PKQFSSTSSS

SEQ ID NO: 3060125 - protein, 8 aa, Giardia lamblia
PKQRRTPV

SEQ ID NO: 3060126 - protein, 7 aa, Giardia lamblia
PKSDTEN

SEQ ID NO: 3060127 - protein, 7 aa, Giardia lamblia
PKSGSQY

SEQ ID NO: 3060128 - protein, 4 aa, Giardia lamblia
PKSH

SEQ ID NO: 3060129 - protein, 4 aa, Giardia lamblia
PKSI

SEQ ID NO: 3060130 - protein, 10 aa, Giardia lamblia
PKSISGKAEA

SEQ ID NO: 3060131 - protein, 29 aa, Giardia lamblia
PKSPSIEYSSTNDSCTESLPETPKSAASH

SEQ ID NO: 3060132 - protein, 7 aa, Giardia lamblia
PKSQSRA

SEQ ID NO: 3060133 - protein, 20 aa, Giardia lamblia
PKSSCQSRDNQSTGSSRPLS

SEQ ID NO: 3060134 - protein, 5 aa, Giardia lamblia
PKSTL

SEQ ID NO: 3060135 - protein, 16 aa, Giardia lamblia
PKTCKTSASPLKRQSG

SEQ ID NO: 3060136 - protein, 4 aa, Giardia lamblia
PKTL

SEQ ID NO: 3060137 - protein, 7 aa, Giardia lamblia
PKTSDSQ

SEQ ID NO: 3060138 - protein, 11 aa, Giardia lamblia
PKTSPDELMTP

SEQ ID NO: 3060139 - protein, 8 aa, Giardia lamblia
PKVAGSLS

SEQ ID NO: 3060140 - protein, 6 aa, Giardia lamblia
PKVAPE

SEQ ID NO: 3060141 - protein, 5 aa, Giardia lamblia
PKVTS

SEQ ID NO: 3060142 - protein, 8 aa, Giardia lamblia
PKWNAGGD

SEQ ID NO: 3060143 - protein, 7 aa, Giardia lamblia
PKYTPTN

SEQ ID NO: 3060144 - protein, 20 aa, Giardia lamblia
PLADSQSAIEKEQNNTFSQH

SEQ ID NO: 3060145 - protein, 6 aa, Giardia lamblia
PLASTN

SEQ ID NO: 3060146 - protein, 6 aa, Giardia lamblia
PLDSSD

SEQ ID NO: 3060147 - protein, 4 aa, Giardia lamblia
PLDT

SEQ ID NO: 3060148 - protein, 8 aa, Giardia lamblia
PLDTDDSL

SEQ ID NO: 3060149 - protein, 7 aa, Giardia lamblia
PLEDPSE

SEQ ID NO: 3060150 - protein, 24 aa, Giardia lamblia
PLEETCSDERDQLNTTRSVANSKR

SEQ ID NO: 3060151 - protein, 4 aa, Giardia lamblia
PLEP

SEQ ID NO: 3060152 - protein, 16 aa, Giardia lamblia
PLEPQAPSQSIKDEPY

SEQ ID NO: 3060153 - protein, 23 aa, Giardia lamblia
PLEQNTAAQIEQKQLEQKRRQAS

SEQ ID NO: 3060154 - protein, 23 aa, Giardia lamblia
PLEQNTAAQIEQKQREQIKSRAA

SEQ ID NO: 3060155 - protein, 4 aa, Giardia lamblia
PLES

SEQ ID NO: 3060156 - protein, 9 aa, Giardia lamblia
PLGAGNEVG

SEQ ID NO: 3060157 - protein, 10 aa, Giardia lamblia
PLGEKDTKEV

SEQ ID NO: 3060158 - protein, 7 aa, Giardia lamblia
PLGEPEE

SEQ ID NO: 3060159 - protein, 9 aa, Giardia lamblia
PLGPQGKAY

SEQ ID NO: 3060160 - protein, 7 aa, Giardia lamblia
PLKDTRY

SEQ ID NO: 3060161 - protein, 6 aa, Giardia lamblia
PLKEKA

SEQ ID NO: 3060162 - protein, 5 aa, Giardia lamblia
PLKQP

SEQ ID NO: 3060163 - protein, 4 aa, Giardia lamblia
PLNL

SEQ ID NO: 3060164 - protein, 21 aa, Giardia lamblia
PLNPSEASVELNGGEEPADNL

SEQ ID NO: 3060165 - protein, 5 aa, Giardia lamblia
PLPAD

SEQ ID NO: 3060166 - protein, 6 aa, Giardia lamblia
PLPADH

SEQ ID NO: 3060167 - protein, 7 aa, Giardia lamblia
PLPDRVD

SEQ ID NO: 3060168 - protein, 10 aa, Giardia lamblia
PLPDSAPNAV

SEQ ID NO: 3060169 - protein, 22 aa, Giardia lamblia
PLPKESKNIDENDAVQKPSDAV

SEQ ID NO: 3060170 - protein, 7 aa, Giardia lamblia
PLPKGSS

SEQ ID NO: 3060171 - protein, 16 aa, Giardia lamblia
PLPPRSHHSNIKSDST

SEQ ID NO: 3060172 - protein, 4 aa, Giardia lamblia
PLPQ

SEQ ID NO: 3060173 - protein, 20 aa, Giardia lamblia
PLPQDSENPEKEDALPNTPV

SEQ ID NO: 3060174 - protein, 13 aa, Giardia lamblia
PLPQPDEFGDTKP

SEQ ID NO: 3060175 - protein, 10 aa, Giardia lamblia
PLPSAMTPNS

SEQ ID NO: 3060176 - protein, 6 aa, Giardia lamblia
PLPSKA

SEQ ID NO: 3060177 - protein, 21 aa, Giardia lamblia
PLQEEGDTKAVKNDVEKKPGN

SEQ ID NO: 3060178 - protein, 7 aa, Giardia lamblia
PLQEGAQ

SEQ ID NO: 3060179 - protein, 10 aa, Giardia lamblia
PLQGSTTTLA

SEQ ID NO: 3060180 - protein, 6 aa, Giardia lamblia
PLQGTP

SEQ ID NO: 3060181 - protein, 12 aa, Giardia lamblia
PLQPKISRKNER

SEQ ID NO: 3060182 - protein, 6 aa, Giardia lamblia
PLRSGS

SEQ ID NO: 3060183 - protein, 5 aa, Giardia lamblia
PLRTN

SEQ ID NO: 3060184 - protein, 7 aa, Giardia lamblia
PLSARNP

SEQ ID NO: 3060185 - protein, 16 aa, Giardia lamblia
PLSDQNEVDDAETSAG

SEQ ID NO: 3060186 - protein, 21 aa, Giardia lamblia
PLSDQQAQDAHSDAIETIGED

SEQ ID NO: 3060187 - protein, 5 aa, Giardia lamblia
PLSDT

SEQ ID NO: 3060188 - protein, 5 aa, Giardia lamblia
PLSEQ

SEQ ID NO: 3060189 - protein, 13 aa, Giardia lamblia
PLSHTTEQRPAAP

SEQ ID NO: 3060190 - protein, 5 aa, Giardia lamblia
PLSPA

SEQ ID NO: 3060191 - protein, 7 aa, Giardia lamblia
PLSPATQ

SEQ ID NO: 3060192 - protein, 8 aa, Giardia lamblia
PLSPEDEA

SEQ ID NO: 3060193 - protein, 5 aa, Giardia lamblia
PLSPL

SEQ ID NO: 3060194 - protein, 4 aa, Giardia lamblia
PLSR

SEQ ID NO: 3060195 - protein, 19 aa, Giardia lamblia
PLSSSSYSKARAKNNTKRI

SEQ ID NO: 3060196 - protein, 6 aa, Giardia lamblia
PLSTNR

SEQ ID NO: 3060197 - protein, 23 aa, Giardia lamblia
PLTAQRGVDADQSTDDEQETSSI

SEQ ID NO: 3060198 - protein, 4 aa, Giardia lamblia
PLTD

SEQ ID NO: 3060199 - protein, 24 aa, Giardia lamblia
PLTDKAKRLKGVGPTLKPETKTND

SEQ ID NO: 3060200 - protein, 9 aa, Giardia lamblia
PLTDKGTIR

SEQ ID NO: 3060201 - protein, 10 aa, Giardia lamblia
PLTGGTSTAT

SEQ ID NO: 3060202 - protein, 34 aa, Giardia lamblia
PLTTDKTNRKGKKTGNKSTTQSSDTFEGESKDDE

SEQ ID NO: 3060203 - protein, 14 aa, Giardia lamblia
PLTTETESDKTNST

SEQ ID NO: 3060204 - protein, 4 aa, Giardia lamblia
PLVE

SEQ ID NO: 3060205 - protein, 7 aa, Giardia lamblia
PLVTDSQ

SEQ ID NO: 3060206 - protein, 12 aa, Giardia lamblia
PLYGSAGKPWSI

SEQ ID NO: 3060207 - protein, 13 aa, Giardia lamblia
PMEPISSSKSQLT

SEQ ID NO: 3060208 - protein, 12 aa, Giardia lamblia
PMKDSTGSFDME

SEQ ID NO: 3060209 - protein, 7 aa, Giardia lamblia
PMKHPKQ

SEQ ID NO: 3060210 - protein, 8 aa, Giardia lamblia
PMKTRYST

SEQ ID NO: 3060211 - protein, 4 aa, Giardia lamblia
PMQM

SEQ ID NO: 3060212 - protein, 9 aa, Giardia lamblia
PMSQPEPGA

SEQ ID NO: 3060213 - protein, 4 aa, Giardia lamblia
PMSS

SEQ ID NO: 3060214 - protein, 13 aa, Giardia lamblia
PMTSESSQTRSSA

SEQ ID NO: 3060215 - protein, 11 aa, Giardia lamblia
PNACGDGYYAD

SEQ ID NO: 3060216 - protein, 5 aa, Giardia lamblia
PNACN

SEQ ID NO: 3060217 - protein, 11 aa, Giardia lamblia
PNAETDEADIA

SEQ ID NO: 3060218 - protein, 9 aa, Giardia lamblia
PNAPKEQQI

SEQ ID NO: 3060219 - protein, 10 aa, Giardia lamblia
PNASKPRAPI

SEQ ID NO: 3060220 - protein, 7 aa, Giardia lamblia
PNDESFP

SEQ ID NO: 3060221 - protein, 6 aa, Giardia lamblia
PNDETH

SEQ ID NO: 3060222 - protein, 12 aa, Giardia lamblia
PNDHGMGEQSSR

SEQ ID NO: 3060223 - protein, 12 aa, Giardia lamblia
PNDISNNSDAMT

SEQ ID NO: 3060224 - protein, 7 aa, Giardia lamblia
PNDSNNH

SEQ ID NO: 3060225 - protein, 8 aa, Giardia lamblia
PNDSPGYK

SEQ ID NO: 3060226 - protein, 7 aa, Giardia lamblia
PNDSQSL

SEQ ID NO: 3060227 - protein, 5 aa, Giardia lamblia
PNDTR

SEQ ID NO: 3060228 - protein, 6 aa, Giardia lamblia
PNDVAD

SEQ ID NO: 3060229 - protein, 12 aa, Giardia lamblia
PNEPTDTPSGIP

SEQ ID NO: 3060230 - protein, 14 aa, Giardia lamblia
PNETLGTYQDSPNV

SEQ ID NO: 3060231 - protein, 5 aa, Giardia lamblia
PNFPS

SEQ ID NO: 3060232 - protein, 5 aa, Giardia lamblia
PNGDA

SEQ ID NO: 3060233 - protein, 6 aa, Giardia lamblia
PNGNRM

SEQ ID NO: 3060234 - protein, 10 aa, Giardia lamblia
PNGTDLGTKS

SEQ ID NO: 3060235 - protein, 6 aa, Giardia lamblia
PNGTLY

SEQ ID NO: 3060236 - protein, 5 aa, Giardia lamblia
PNGTN

SEQ ID NO: 3060237 - protein, 10 aa, Giardia lamblia
PNITPGNRAG

SEQ ID NO: 3060238 - protein, 20 aa, Giardia lamblia
PNKESAKGHSTYKPSSKKSS

SEQ ID NO: 3060239 - protein, 8 aa, Giardia lamblia
PNKSAQEP

SEQ ID NO: 3060240 - protein, 4 aa, Giardia lamblia
PNLE

SEQ ID NO: 3060241 - protein, 4 aa, Giardia lamblia
PNNM

SEQ ID NO: 3060242 - protein, 5 aa, Giardia lamblia
PNPCD

SEQ ID NO: 3060243 - protein, 5 aa, Giardia lamblia
PNPDG

SEQ ID NO: 3060244 - protein, 9 aa, Giardia lamblia
PNPGFGERE

SEQ ID NO: 3060245 - protein, 10 aa, Giardia lamblia
PNPHYSPEIQ

SEQ ID NO: 3060246 - protein, 5 aa, Giardia lamblia
PNQGI

SEQ ID NO: 3060247 - protein, 15 aa, Giardia lamblia
PNQSFSASGSASTEA

SEQ ID NO: 3060248 - protein, 5 aa, Giardia lamblia
PNSCE

SEQ ID NO: 3060249 - protein, 4 aa, Giardia lamblia
PNSG

SEQ ID NO: 3060250 - protein, 5 aa, Giardia lamblia
PNSMQ

SEQ ID NO: 3060251 - protein, 16 aa, Giardia lamblia
PNSQQTSYSNRAGNNP

SEQ ID NO: 3060252 - protein, 5 aa, Giardia lamblia
PNSSY

SEQ ID NO: 3060253 - protein, 5 aa, Giardia lamblia
PNTAD

SEQ ID NO: 3060254 - protein, 4 aa, Giardia lamblia
PNTE

SEQ ID NO: 3060255 - protein, 4 aa, Giardia lamblia
PNTI

SEQ ID NO: 3060256 - protein, 4 aa, Giardia lamblia
PNTK

SEQ ID NO: 3060257 - protein, 7 aa, Giardia lamblia
PNTKPIP

SEQ ID NO: 3060258 - protein, 4 aa, Giardia lamblia
PNTN

SEQ ID NO: 3060259 - protein, 4 aa, Giardia lamblia
PNTQ

SEQ ID NO: 3060260 - protein, 19 aa, Giardia lamblia
PNTQKDAYCTSKANGACTA

SEQ ID NO: 3060261 - protein, 6 aa, Giardia lamblia
PNTTAN

SEQ ID NO: 3060262 - protein, 5 aa, Giardia lamblia
PNTYD

SEQ ID NO: 3060263 - protein, 4 aa, Giardia lamblia
PNYH

SEQ ID NO: 3060264 - protein, 11 aa, Giardia lamblia
PPAAAPGGRRD

SEQ ID NO: 3060265 - protein, 7 aa, Giardia lamblia
PPAADVG

SEQ ID NO: 3060266 - protein, 9 aa, Giardia lamblia
PPAAGTTAL

SEQ ID NO: 3060267 - protein, 4 aa, Giardia lamblia
PPAC

SEQ ID NO: 3060268 - protein, 15 aa, Giardia lamblia
PPADGKEKPGSSSSA

SEQ ID NO: 3060269 - protein, 12 aa, Giardia lamblia
PPAETSNPTVNI

SEQ ID NO: 3060270 - protein, 6 aa, Giardia lamblia
PPALTP

SEQ ID NO: 3060271 - protein, 8 aa, Giardia lamblia
PPAPCTGK

SEQ ID NO: 3060272 - protein, 11 aa, Giardia lamblia
PPAPVVEPQPS

SEQ ID NO: 3060273 - protein, 25 aa, Giardia lamblia
PPAQSAPAAPPPSKETEKAPRKKQM

SEQ ID NO: 3060274 - protein, 23 aa, Giardia lamblia
PPARLQTPQDQQRQRMPPDTKQQ

SEQ ID NO: 3060275 - protein, 4 aa, Giardia lamblia
PPAS

SEQ ID NO: 3060276 - protein, 7 aa, Giardia lamblia
PPASNAR

SEQ ID NO: 3060277 - protein, 34 aa, Giardia lamblia
PPASTIKQDEAKQLSGAASKEKETRFSPSDDSLD

SEQ ID NO: 3060278 - protein, 8 aa, Giardia lamblia
PPCTDEAS

SEQ ID NO: 3060279 - protein, 6 aa, Giardia lamblia
PPDLDK

SEQ ID NO: 3060280 - protein, 10 aa, Giardia lamblia
PPDRESSSRS

SEQ ID NO: 3060281 - protein, 6 aa, Giardia lamblia
PPDRRG

SEQ ID NO: 3060282 - protein, 6 aa, Giardia lamblia
PPDSDN

SEQ ID NO: 3060283 - protein, 8 aa, Giardia lamblia
PPDSPHYE

SEQ ID NO: 3060284 - protein, 7 aa, Giardia lamblia
PPEDGLD

SEQ ID NO: 3060285 - protein, 4 aa, Giardia lamblia
PPEL

SEQ ID NO: 3060286 - protein, 7 aa, Giardia lamblia
PPEPSSQ

SEQ ID NO: 3060287 - protein, 4 aa, Giardia lamblia
PPES

SEQ ID NO: 3060288 - protein, 4 aa, Giardia lamblia
PPET

SEQ ID NO: 3060289 - protein, 10 aa, Giardia lamblia
PPETDHCEET

SEQ ID NO: 3060290 - protein, 5 aa, Giardia lamblia
PPFAT

SEQ ID NO: 3060291 - protein, 5 aa, Giardia lamblia
PPFDE

SEQ ID NO: 3060292 - protein, 5 aa, Giardia lamblia
PPFGT

SEQ ID NO: 3060293 - protein, 5 aa, Giardia lamblia
PPFPW

SEQ ID NO: 3060294 - protein, 5 aa, Giardia lamblia
PPGFA

SEQ ID NO: 3060295 - protein, 7 aa, Giardia lamblia
PPGGSRY

SEQ ID NO: 3060296 - protein, 11 aa, Giardia lamblia
PPGLTQPLPPI

SEQ ID NO: 3060297 - protein, 21 aa, Giardia lamblia
PPGPHDTEVRHTDSPKAESRP

SEQ ID NO: 3060298 - protein, 5 aa, Giardia lamblia
PPGQS

SEQ ID NO: 3060299 - protein, 5 aa, Giardia lamblia
PPGTN

SEQ ID NO: 3060300 - protein, 7 aa, Giardia lamblia
PPGTSHC

SEQ ID NO: 3060301 - protein, 11 aa, Giardia lamblia
PPHLTDPSITS

SEQ ID NO: 3060302 - protein, 4 aa, Giardia lamblia
PPIS

SEQ ID NO: 3060303 - protein, 12 aa, Giardia lamblia
PPKDSMPHEGQA

SEQ ID NO: 3060304 - protein, 4 aa, Giardia lamblia
PPKF

SEQ ID NO: 3060305 - protein, 8 aa, Giardia lamblia
PPKPPYYN

SEQ ID NO: 3060306 - protein, 12 aa, Giardia lamblia
PPKRPKSSQHKG

SEQ ID NO: 3060307 - protein, 4 aa, Giardia lamblia
PPKS

SEQ ID NO: 3060308 - protein, 6 aa, Giardia lamblia
PPLGDS

SEQ ID NO: 3060309 - protein, 25 aa, Giardia lamblia
PPLPGPSVSHAAKQTSSSPNLPQLG

SEQ ID NO: 3060310 - protein, 21 aa, Giardia lamblia
PPLSNNGSHHDGPDSTDSTDS

SEQ ID NO: 3060311 - protein, 25 aa, Giardia lamblia
PPLTTGPLAKQSSRTSSAIKEQTNH

SEQ ID NO: 3060312 - protein, 11 aa, Giardia lamblia
PPMGTQNRGFS

SEQ ID NO: 3060313 - protein, 6 aa, Giardia lamblia
PPMNSS

SEQ ID NO: 3060314 - protein, 14 aa, Giardia lamblia
PPMPSNGNSSKKKG

SEQ ID NO: 3060315 - protein, 18 aa, Giardia lamblia
PPNDSVHSPLTDGGFENS

SEQ ID NO: 3060316 - protein, 12 aa, Giardia lamblia
PPNDVGPNSNVR

SEQ ID NO: 3060317 - protein, 9 aa, Giardia lamblia
PPNFDPDAE

SEQ ID NO: 3060318 - protein, 10 aa, Giardia lamblia
PPNGNYRTQK

SEQ ID NO: 3060319 - protein, 5 aa, Giardia lamblia
PPNIS

SEQ ID NO: 3060320 - protein, 5 aa, Giardia lamblia
PPNTE

SEQ ID NO: 3060321 - protein, 8 aa, Giardia lamblia
PPPADTVS

SEQ ID NO: 3060322 - protein, 8 aa, Giardia lamblia
PPPDFDSL

SEQ ID NO: 3060323 - protein, 8 aa, Giardia lamblia
PPPDVSSS

SEQ ID NO: 3060324 - protein, 15 aa, Giardia lamblia
PPPEPTVTAYGNRTE

SEQ ID NO: 3060325 - protein, 7 aa, Giardia lamblia
PPPGLQP

SEQ ID NO: 3060326 - protein, 6 aa, Giardia lamblia
PPPMPA

SEQ ID NO: 3060327 - protein, 5 aa, Giardia lamblia
PPPNP

SEQ ID NO: 3060328 - protein, 12 aa, Giardia lamblia
PPPPPPPPAKLG

SEQ ID NO: 3060329 - protein, 6 aa, Giardia lamblia
PPPPYD

SEQ ID NO: 3060330 - protein, 4 aa, Giardia lamblia
PPQA

SEQ ID NO: 3060331 - protein, 8 aa, Giardia lamblia
PPQALSPA

SEQ ID NO: 3060332 - protein, 30 aa, Giardia lamblia
PPQVRSQSNQSAARSNSVGAPGSASEKGSM

SEQ ID NO: 3060333 - protein, 7 aa, Giardia lamblia
PPRDLKK

SEQ ID NO: 3060334 - protein, 20 aa, Giardia lamblia
PPRKKSRPAPHTASSDSHYQ

SEQ ID NO: 3060335 - protein, 7 aa, Giardia lamblia
PPRPGKP

SEQ ID NO: 3060336 - protein, 4 aa, Giardia lamblia
PPRR

SEQ ID NO: 3060337 - protein, 10 aa, Giardia lamblia
PPRSLGGGEW

SEQ ID NO: 3060338 - protein, 13 aa, Giardia lamblia
PPRSLGGGEWGAA

SEQ ID NO: 3060339 - protein, 12 aa, Giardia lamblia
PPRSLGGGEWSA

SEQ ID NO: 3060340 - protein, 28 aa, Giardia lamblia
PPRSLGGGEWSAATSTCTRDSKSNKYTN

SEQ ID NO: 3060341 - protein, 4 aa, Giardia lamblia
PPSA

SEQ ID NO: 3060342 - protein, 9 aa, Giardia lamblia
PPSAQTGQM

SEQ ID NO: 3060343 - protein, 7 aa, Giardia lamblia
PPSNGTI

SEQ ID NO: 3060344 - protein, 5 aa, Giardia lamblia
PPSPL

SEQ ID NO: 3060345 - protein, 10 aa, Giardia lamblia
PPSQFDSEAE

SEQ ID NO: 3060346 - protein, 12 aa, Giardia lamblia
PPSSLTSSSSDF

SEQ ID NO: 3060347 - protein, 14 aa, Giardia lamblia
PPSSSLSGSASNAA

SEQ ID NO: 3060348 - protein, 11 aa, Giardia lamblia
PPSTPNGTLSN

SEQ ID NO: 3060349 - protein, 4 aa, Giardia lamblia
PPSV

SEQ ID NO: 3060350 - protein, 4 aa, Giardia lamblia
PPTA

SEQ ID NO: 3060351 - protein, 9 aa, Giardia lamblia
PPTARGPAD

SEQ ID NO: 3060352 - protein, 4 aa, Giardia lamblia
PPTF

SEQ ID NO: 3060353 - protein, 4 aa, Giardia lamblia
PPTH

SEQ ID NO: 3060354 - protein, 10 aa, Giardia lamblia
PPTIPSVGSP

SEQ ID NO: 3060355 - protein, 6 aa, Giardia lamblia
PPTKYR

SEQ ID NO: 3060356 - protein, 13 aa, Giardia lamblia
PPTQDASQAPSIN

SEQ ID NO: 3060357 - protein, 4 aa, Giardia lamblia
PPTS

SEQ ID NO: 3060358 - protein, 8 aa, Giardia lamblia
PPTSEHPE

SEQ ID NO: 3060359 - protein, 4 aa, Giardia lamblia
PPTT

SEQ ID NO: 3060360 - protein, 18 aa, Giardia lamblia
PPVQAPSAKEQEADSILS

SEQ ID NO: 3060361 - protein, 14 aa, Giardia lamblia
PPVYNTSPQEPQNI

SEQ ID NO: 3060362 - protein, 11 aa, Giardia lamblia
PPYSSSQSLGG

SEQ ID NO: 3060363 - protein, 8 aa, Giardia lamblia
PQAPQSQD

SEQ ID NO: 3060364 - protein, 7 aa, Giardia lamblia
PQDECTH

SEQ ID NO: 3060365 - protein, 15 aa, Giardia lamblia
PQDENIPARDAEKIA

SEQ ID NO: 3060366 - protein, 4 aa, Giardia lamblia
PQDF

SEQ ID NO: 3060367 - protein, 27 aa, Giardia lamblia
PQDNDGQEDSDEAERNEIARLVKPVSW

SEQ ID NO: 3060368 - protein, 5 aa, Giardia lamblia
PQDPE

SEQ ID NO: 3060369 - protein, 15 aa, Giardia lamblia
PQDSIPLEEHAARSV

SEQ ID NO: 3060370 - protein, 42 aa, Giardia lamblia
PQDSSSDESNGDGVDTAKLKSGAADDGQDASAQQPFNEASSN

SEQ ID NO: 3060371 - protein, 14 aa, Giardia lamblia
PQEISAEKEEELPT

SEQ ID NO: 3060372 - protein, 6 aa, Giardia lamblia
PQEPRK

SEQ ID NO: 3060373 - protein, 4 aa, Giardia lamblia
PQET

SEQ ID NO: 3060374 - protein, 6 aa, Giardia lamblia
PQETPL

SEQ ID NO: 3060375 - protein, 5 aa, Giardia lamblia
PQFNA

SEQ ID NO: 3060376 - protein, 4 aa, Giardia lamblia
PQFT

SEQ ID NO: 3060377 - protein, 16 aa, Giardia lamblia
PQGAAQASEDGDTSVQ

SEQ ID NO: 3060378 - protein, 5 aa, Giardia lamblia
PQGDP

SEQ ID NO: 3060379 - protein, 13 aa, Giardia lamblia
PQGIDAPQTFDSP

SEQ ID NO: 3060380 - protein, 4 aa, Giardia lamblia
PQGL

SEQ ID NO: 3060381 - protein, 4 aa, Giardia lamblia
PQGR

SEQ ID NO: 3060382 - protein, 4 aa, Giardia lamblia
PQGV

SEQ ID NO: 3060383 - protein, 17 aa, Giardia lamblia
PQHKPTELPPDTPCPRS

SEQ ID NO: 3060384 - protein, 4 aa, Giardia lamblia
PQHN

SEQ ID NO: 3060385 - protein, 20 aa, Giardia lamblia
PQISDEVKEQGREAGLSDEA

SEQ ID NO: 3060386 - protein, 8 aa, Giardia lamblia
PQKRSSAA

SEQ ID NO: 3060387 - protein, 10 aa, Giardia lamblia
PQLEQQKQKV

SEQ ID NO: 3060388 - protein, 12 aa, Giardia lamblia
PQLQNEPKHQKI

SEQ ID NO: 3060389 - protein, 7 aa, Giardia lamblia
PQLQQTR

SEQ ID NO: 3060390 - protein, 20 aa, Giardia lamblia
PQLSKDSPGTPGKALSQPAC

SEQ ID NO: 3060391 - protein, 6 aa, Giardia lamblia
PQLTSR

SEQ ID NO: 3060392 - protein, 6 aa, Giardia lamblia
PQNATD

SEQ ID NO: 3060393 - protein, 5 aa, Giardia lamblia
PQNCP

SEQ ID NO: 3060394 - protein, 29 aa, Giardia lamblia
PQNDSQANNGGGKVPKDIKQTDDPVTRTS

SEQ ID NO: 3060395 - protein, 4 aa, Giardia lamblia
PQNF

SEQ ID NO: 3060396 - protein, 8 aa, Giardia lamblia
PQNKTLSN

SEQ ID NO: 3060397 - protein, 7 aa, Giardia lamblia
PQNMEDD

SEQ ID NO: 3060398 - protein, 8 aa, Giardia lamblia
PQNQCPQP

SEQ ID NO: 3060399 - protein, 7 aa, Giardia lamblia
PQNRASA

SEQ ID NO: 3060400 - protein, 19 aa, Giardia lamblia
PQPCTDLTGRSQKPIESQS

SEQ ID NO: 3060401 - protein, 7 aa, Giardia lamblia
PQPELHK

SEQ ID NO: 3060402 - protein, 5 aa, Giardia lamblia
PQPGT

SEQ ID NO: 3060403 - protein, 10 aa, Giardia lamblia
PQPPSVKIPP

SEQ ID NO: 3060404 - protein, 6 aa, Giardia lamblia
PQPQHI

SEQ ID NO: 3060405 - protein, 4 aa, Giardia lamblia
PQPS

SEQ ID NO: 3060406 - protein, 12 aa, Giardia lamblia
PQPSSTATKRRT

SEQ ID NO: 3060407 - protein, 5 aa, Giardia lamblia
PQRAQ

SEQ ID NO: 3060408 - protein, 11 aa, Giardia lamblia
PQRTPSISSAE

SEQ ID NO: 3060409 - protein, 5 aa, Giardia lamblia
PQSAG

SEQ ID NO: 3060410 - protein, 8 aa, Giardia lamblia
PQSATNGA

SEQ ID NO: 3060411 - protein, 9 aa, Giardia lamblia
PQSAYTSLS

SEQ ID NO: 3060412 - protein, 6 aa, Giardia lamblia
PQSCGR

SEQ ID NO: 3060413 - protein, 11 aa, Giardia lamblia
PQSEAGSYSAR

SEQ ID NO: 3060414 - protein, 5 aa, Giardia lamblia
PQSGC

SEQ ID NO: 3060415 - protein, 9 aa, Giardia lamblia
PQSGSGKIN

SEQ ID NO: 3060416 - protein, 8 aa, Giardia lamblia
PQSIDEQA

SEQ ID NO: 3060417 - protein, 11 aa, Giardia lamblia
PQSNEGNTSCD

SEQ ID NO: 3060418 - protein, 10 aa, Giardia lamblia
PQSSEKGSSL

SEQ ID NO: 3060419 - protein, 7 aa, Giardia lamblia
PQSSLPK

SEQ ID NO: 3060420 - protein, 4 aa, Giardia lamblia
PQST

SEQ ID NO: 3060421 - protein, 13 aa, Giardia lamblia
PQSTHNSADSYRS

SEQ ID NO: 3060422 - protein, 4 aa, Giardia lamblia
PQSW

SEQ ID NO: 3060423 - protein, 4 aa, Giardia lamblia
PQSY

SEQ ID NO: 3060424 - protein, 6 aa, Giardia lamblia
PQTAEK

SEQ ID NO: 3060425 - protein, 4 aa, Giardia lamblia
PQTG

SEQ ID NO: 3060426 - protein, 7 aa, Giardia lamblia
PQVPPAF

SEQ ID NO: 3060427 - protein, 10 aa, Giardia lamblia
PQVSKESSKS

SEQ ID NO: 3060428 - protein, 9 aa, Giardia lamblia
PQVTDGPYN

SEQ ID NO: 3060429 - protein, 5 aa, Giardia lamblia
PQYAG

SEQ ID NO: 3060430 - protein, 20 aa, Giardia lamblia
PQYDADPSTLVPDNASAGKL

SEQ ID NO: 3060431 - protein, 5 aa, Giardia lamblia
PRAGS

SEQ ID NO: 3060432 - protein, 14 aa, Giardia lamblia
PRAPLDSPFEPNDL

SEQ ID NO: 3060433 - protein, 7 aa, Giardia lamblia
PRARASS

SEQ ID NO: 3060434 - protein, 14 aa, Giardia lamblia
PRARQAIDKPSYSP

SEQ ID NO: 3060435 - protein, 9 aa, Giardia lamblia
PRASNEPLD

SEQ ID NO: 3060436 - protein, 21 aa, Giardia lamblia
PRAVASGCGGSAEAPLSTSAR

SEQ ID NO: 3060437 - protein, 4 aa, Giardia lamblia
PRCA

SEQ ID NO: 3060438 - protein, 6 aa, Giardia lamblia
PRDATK

SEQ ID NO: 3060439 - protein, 6 aa, Giardia lamblia
PRDQPL

SEQ ID NO: 3060440 - protein, 16 aa, Giardia lamblia
PRDRTAEDRKKGDNVS

SEQ ID NO: 3060441 - protein, 5 aa, Giardia lamblia
PRDSN

SEQ ID NO: 3060442 - protein, 4 aa, Giardia lamblia
PREL

SEQ ID NO: 3060443 - protein, 7 aa, Giardia lamblia
PRELETG

SEQ ID NO: 3060444 - protein, 4 aa, Giardia lamblia
PRET

SEQ ID NO: 3060445 - protein, 29 aa, Giardia lamblia
PRFPPDPSDTVPVPEADAPSTAKPGEAQQ

SEQ ID NO: 3060446 - protein, 11 aa, Giardia lamblia
PRGDLRSNYSE

SEQ ID NO: 3060447 - protein, 8 aa, Giardia lamblia
PRGDTPQS

SEQ ID NO: 3060448 - protein, 6 aa, Giardia lamblia
PRGGGG

SEQ ID NO: 3060449 - protein, 9 aa, Giardia lamblia
PRGGNSSSL

SEQ ID NO: 3060450 - protein, 4 aa, Giardia lamblia
PRGI

SEQ ID NO: 3060451 - protein, 22 aa, Giardia lamblia
PRGQARNKQRSAAVPNTTASTR

SEQ ID NO: 3060452 - protein, 6 aa, Giardia lamblia
PRGQRA

SEQ ID NO: 3060453 - protein, 4 aa, Giardia lamblia
PRGT

SEQ ID NO: 3060454 - protein, 12 aa, Giardia lamblia
PRHQTPAPVTTY

SEQ ID NO: 3060455 - protein, 4 aa, Giardia lamblia
PRKN

SEQ ID NO: 3060456 - protein, 16 aa, Giardia lamblia
PRKPANAEAANVASSN

SEQ ID NO: 3060457 - protein, 4 aa, Giardia lamblia
PRKS

SEQ ID NO: 3060458 - protein, 8 aa, Giardia lamblia
PRKTINPP

SEQ ID NO: 3060459 - protein, 8 aa, Giardia lamblia
PRLAPTRQ

SEQ ID NO: 3060460 - protein, 4 aa, Giardia lamblia
PRLE

SEQ ID NO: 3060461 - protein, 10 aa, Giardia lamblia
PRLSSEKSLN

SEQ ID NO: 3060462 - protein, 11 aa, Giardia lamblia
PRLTTTDTLET

SEQ ID NO: 3060463 - protein, 5 aa, Giardia lamblia
PRNAE

SEQ ID NO: 3060464 - protein, 5 aa, Giardia lamblia
PRNNS

SEQ ID NO: 3060465 - protein, 12 aa, Giardia lamblia
PRPCSPDPGMPS

SEQ ID NO: 3060466 - protein, 4 aa, Giardia lamblia
PRPG

SEQ ID NO: 3060467 - protein, 5 aa, Giardia lamblia
PRPHR

SEQ ID NO: 3060468 - protein, 4 aa, Giardia lamblia
PRPL

SEQ ID NO: 3060469 - protein, 19 aa, Giardia lamblia
PRQGSVPTLAAASADQSSH

SEQ ID NO: 3060470 - protein, 7 aa, Giardia lamblia
PRQMPSE

SEQ ID NO: 3060471 - protein, 7 aa, Giardia lamblia
PRRGETG

SEQ ID NO: 3060472 - protein, 16 aa, Giardia lamblia
PRRGQPHISRRVPDYF

SEQ ID NO: 3060473 - protein, 14 aa, Giardia lamblia
PRRHTSNKKTGSSF

SEQ ID NO: 3060474 - protein, 4 aa, Giardia lamblia
PRRN

SEQ ID NO: 3060475 - protein, 9 aa, Giardia lamblia
PRRSISEQD

SEQ ID NO: 3060476 - protein, 9 aa, Giardia lamblia
PRSDSSDDL

SEQ ID NO: 3060477 - protein, 14 aa, Giardia lamblia
PRSKSRKRSNNDLN

SEQ ID NO: 3060478 - protein, 22 aa, Giardia lamblia
PRSRSERSQSRYNADDQTRANN

SEQ ID NO: 3060479 - protein, 36 aa, Giardia lamblia
PRSSSSLPPQRSVSPYSRRHGAELPDRTGSPAQRRH

SEQ ID NO: 3060480 - protein, 10 aa, Giardia lamblia
PRTANDLSDS

SEQ ID NO: 3060481 - protein, 9 aa, Giardia lamblia
PRTAQDDEN

SEQ ID NO: 3060482 - protein, 10 aa, Giardia lamblia
PRTCSKPQRG

SEQ ID NO: 3060483 - protein, 5 aa, Giardia lamblia
PRTDW

SEQ ID NO: 3060484 - protein, 14 aa, Giardia lamblia
PRTLPYDGKNKGYL

SEQ ID NO: 3060485 - protein, 6 aa, Giardia lamblia
PRTPRM

SEQ ID NO: 3060486 - protein, 6 aa, Giardia lamblia
PRTPSY

SEQ ID NO: 3060487 - protein, 12 aa, Giardia lamblia
PRTQAREGRGSW

SEQ ID NO: 3060488 - protein, 5 aa, Giardia lamblia
PRTRQ

SEQ ID NO: 3060489 - protein, 9 aa, Giardia lamblia
PRTRTTGTS

SEQ ID NO: 3060490 - protein, 4 aa, Giardia lamblia
PRTS

SEQ ID NO: 3060491 - protein, 5 aa, Giardia lamblia
PRTVE

SEQ ID NO: 3060492 - protein, 10 aa, Giardia lamblia
PSADFPAPTP

SEQ ID NO: 3060493 - protein, 16 aa, Giardia lamblia
PSADIGANQTLGQLSS

SEQ ID NO: 3060494 - protein, 8 aa, Giardia lamblia
PSAELPNT

SEQ ID NO: 3060495 - protein, 5 aa, Giardia lamblia
PSAER

SEQ ID NO: 3060496 - protein, 9 aa, Giardia lamblia
PSAGGKSTT

SEQ ID NO: 3060497 - protein, 5 aa, Giardia lamblia
PSAHR

SEQ ID NO: 3060498 - protein, 16 aa, Giardia lamblia
PSAPCNPSDSASRTAT

SEQ ID NO: 3060499 - protein, 10 aa, Giardia lamblia
PSAPDAPQSL

SEQ ID NO: 3060500 - protein, 10 aa, Giardia lamblia
PSAPGDVEDD

SEQ ID NO: 3060501 - protein, 5 aa, Giardia lamblia
PSAQL

SEQ ID NO: 3060502 - protein, 9 aa, Giardia lamblia
PSARPQSER

SEQ ID NO: 3060503 - protein, 10 aa, Giardia lamblia
PSASAHKDAN

SEQ ID NO: 3060504 - protein, 8 aa, Giardia lamblia
PSASGRTA

SEQ ID NO: 3060505 - protein, 6 aa, Giardia lamblia
PSASIG

SEQ ID NO: 3060506 - protein, 8 aa, Giardia lamblia
PSASSTEL

SEQ ID NO: 3060507 - protein, 7 aa, Giardia lamblia
PSATRRS

SEQ ID NO: 3060508 - protein, 10 aa, Giardia lamblia
PSATVDPKEV

SEQ ID NO: 3060509 - protein, 12 aa, Giardia lamblia
PSCESLSSSIRP

SEQ ID NO: 3060510 - protein, 14 aa, Giardia lamblia
PSCGDCPSAPCDSD

SEQ ID NO: 3060511 - protein, 7 aa, Giardia lamblia
PSDALAP

SEQ ID NO: 3060512 - protein, 6 aa, Giardia lamblia
PSDAPL

SEQ ID NO: 3060513 - protein, 6 aa, Giardia lamblia
PSDEKS

SEQ ID NO: 3060514 - protein, 8 aa, Giardia lamblia
PSDGPLVR

SEQ ID NO: 3060515 - protein, 10 aa, Giardia lamblia
PSDIPSLPTN

SEQ ID NO: 3060516 - protein, 27 aa, Giardia lamblia
PSDLLGEDGQLKPTEEDEEASEEAQPA

SEQ ID NO: 3060517 - protein, 11 aa, Giardia lamblia
PSDMQSRSNDD

SEQ ID NO: 3060518 - protein, 9 aa, Giardia lamblia
PSDNATTES

SEQ ID NO: 3060519 - protein, 5 aa, Giardia lamblia
PSDTD

SEQ ID NO: 3060520 - protein, 11 aa, Giardia lamblia
PSDTSGCSRCD

SEQ ID NO: 3060521 - protein, 16 aa, Giardia lamblia
PSECGDGYYADTDSRS

SEQ ID NO: 3060522 - protein, 17 aa, Giardia lamblia
PSEDKDGYLSEGKSKTF

SEQ ID NO: 3060523 - protein, 11 aa, Giardia lamblia
PSEHEDTRSKL

SEQ ID NO: 3060524 - protein, 7 aa, Giardia lamblia
PSEISTD

SEQ ID NO: 3060525 - protein, 14 aa, Giardia lamblia
PSELSGSAQLSEQA

SEQ ID NO: 3060526 - protein, 5 aa, Giardia lamblia
PSESA

SEQ ID NO: 3060527 - protein, 18 aa, Giardia lamblia
PSESESGSASAATGTDEI

SEQ ID NO: 3060528 - protein, 7 aa, Giardia lamblia
PSETRQI

SEQ ID NO: 3060529 - protein, 10 aa, Giardia lamblia
PSETSEENSE

SEQ ID NO: 3060530 - protein, 10 aa, Giardia lamblia
PSFAPGSGER

SEQ ID NO: 3060531 - protein, 10 aa, Giardia lamblia
PSFDSVSQKD

SEQ ID NO: 3060532 - protein, 4 aa, Giardia lamblia
PSFG

SEQ ID NO: 3060533 - protein, 28 aa, Giardia lamblia
PSFPPLKTSQASSRPPPGIFPPTPSELP

SEQ ID NO: 3060534 - protein, 7 aa, Giardia lamblia
PSGDQFR

SEQ ID NO: 3060535 - protein, 4 aa, Giardia lamblia
PSGK

SEQ ID NO: 3060536 - protein, 7 aa, Giardia lamblia
PSGPTTV

SEQ ID NO: 3060537 - protein, 5 aa, Giardia lamblia
PSGQD

SEQ ID NO: 3060538 - protein, 5 aa, Giardia lamblia
PSGRV

SEQ ID NO: 3060539 - protein, 11 aa, Giardia lamblia
PSGSEKTMSKH

SEQ ID NO: 3060540 - protein, 9 aa, Giardia lamblia
PSGSTDDPS

SEQ ID NO: 3060541 - protein, 9 aa, Giardia lamblia
PSGTHDTGS

SEQ ID NO: 3060542 - protein, 6 aa, Giardia lamblia
PSGTLA

SEQ ID NO: 3060543 - protein, 4 aa, Giardia lamblia
PSHA

SEQ ID NO: 3060544 - protein, 16 aa, Giardia lamblia
PSHAGADKKAKDAQLI

SEQ ID NO: 3060545 - protein, 4 aa, Giardia lamblia
PSHL

SEQ ID NO: 3060546 - protein, 5 aa, Giardia lamblia
PSIAA

SEQ ID NO: 3060547 - protein, 11 aa, Giardia lamblia
PSINSPSRQQT

SEQ ID NO: 3060548 - protein, 6 aa, Giardia lamblia
PSIPSG

SEQ ID NO: 3060549 - protein, 7 aa, Giardia lamblia
PSKADTV

SEQ ID NO: 3060550 - protein, 10 aa, Giardia lamblia
PSKAEDKPVL

SEQ ID NO: 3060551 - protein, 6 aa, Giardia lamblia
PSKDSV

SEQ ID NO: 3060552 - protein, 12 aa, Giardia lamblia
PSKERADTPAYT

SEQ ID NO: 3060553 - protein, 14 aa, Giardia lamblia
PSKERVDTPASTSK

SEQ ID NO: 3060554 - protein, 12 aa, Giardia lamblia
PSKNSAPTATID

SEQ ID NO: 3060555 - protein, 4 aa, Giardia lamblia
PSKS

SEQ ID NO: 3060556 - protein, 7 aa, Giardia lamblia
PSKSKLN

SEQ ID NO: 3060557 - protein, 11 aa, Giardia lamblia
PSKTEERSLSG

SEQ ID NO: 3060558 - protein, 11 aa, Giardia lamblia
PSKTNIQSPRS

SEQ ID NO: 3060559 - protein, 10 aa, Giardia lamblia
PSLNNKELSN

SEQ ID NO: 3060560 - protein, 7 aa, Giardia lamblia
PSLPADS

SEQ ID NO: 3060561 - protein, 7 aa, Giardia lamblia
PSLSEEE

SEQ ID NO: 3060562 - protein, 6 aa, Giardia lamblia
PSLSKS

SEQ ID NO: 3060563 - protein, 11 aa, Giardia lamblia
PSLSSSINPNI

SEQ ID NO: 3060564 - protein, 7 aa, Giardia lamblia
PSLTACS

SEQ ID NO: 3060565 - protein, 5 aa, Giardia lamblia
PSNDR

SEQ ID NO: 3060566 - protein, 6 aa, Giardia lamblia
PSNESK

SEQ ID NO: 3060567 - protein, 13 aa, Giardia lamblia
PSNETGPAGSMPT

SEQ ID NO: 3060568 - protein, 11 aa, Giardia lamblia
PSNGLASPIDE

SEQ ID NO: 3060569 - protein, 11 aa, Giardia lamblia
PSNGTCPQDYS

SEQ ID NO: 3060570 - protein, 13 aa, Giardia lamblia
PSNKEDNEASSAL

SEQ ID NO: 3060571 - protein, 11 aa, Giardia lamblia
PSNKESARYPT

SEQ ID NO: 3060572 - protein, 6 aa, Giardia lamblia
PSNSPI

SEQ ID NO: 3060573 - protein, 6 aa, Giardia lamblia
PSPCPK

SEQ ID NO: 3060574 - protein, 14 aa, Giardia lamblia
PSPGAASDTPHSVG

SEQ ID NO: 3060575 - protein, 9 aa, Giardia lamblia
PSPGSRGSG

SEQ ID NO: 3060576 - protein, 6 aa, Giardia lamblia
PSPKRL

SEQ ID NO: 3060577 - protein, 13 aa, Giardia lamblia
PSPLRDPENCRNP

SEQ ID NO: 3060578 - protein, 5 aa, Giardia lamblia
PSPND

SEQ ID NO: 3060579 - protein, 6 aa, Giardia lamblia
PSPNLS

SEQ ID NO: 3060580 - protein, 7 aa, Giardia lamblia
PSPNVPD

SEQ ID NO: 3060581 - protein, 8 aa, Giardia lamblia
PSPPETFG

SEQ ID NO: 3060582 - protein, 12 aa, Giardia lamblia
PSPQHQTQTSNH

SEQ ID NO: 3060583 - protein, 6 aa, Giardia lamblia
PSPSHN

SEQ ID NO: 3060584 - protein, 9 aa, Giardia lamblia
PSPSKGLGL

SEQ ID NO: 3060585 - protein, 8 aa, Giardia lamblia
PSPSNRIT

SEQ ID NO: 3060586 - protein, 11 aa, Giardia lamblia
PSPSPAGGTMS

SEQ ID NO: 3060587 - protein, 7 aa, Giardia lamblia
PSPSSTI

SEQ ID NO: 3060588 - protein, 7 aa, Giardia lamblia
PSPTETN

SEQ ID NO: 3060589 - protein, 4 aa, Giardia lamblia
PSPV

SEQ ID NO: 3060590 - protein, 8 aa, Giardia lamblia
PSQKASNA

SEQ ID NO: 3060591 - protein, 11 aa, Giardia lamblia
PSQKCNDPKIG

SEQ ID NO: 3060592 - protein, 7 aa, Giardia lamblia
PSQPHQL

SEQ ID NO: 3060593 - protein, 5 aa, Giardia lamblia
PSQQK

SEQ ID NO: 3060594 - protein, 19 aa, Giardia lamblia
PSQRDTRLQTTRHRGGSYV

SEQ ID NO: 3060595 - protein, 6 aa, Giardia lamblia
PSQSGT

SEQ ID NO: 3060596 - protein, 35 aa, Giardia lamblia
PSQTEISTGTVQPTVREPSEASTWTAKDGNLDEST

SEQ ID NO: 3060597 - protein, 9 aa, Giardia lamblia
PSQTTDGNG

SEQ ID NO: 3060598 - protein, 7 aa, Giardia lamblia
PSRDSTL

SEQ ID NO: 3060599 - protein, 8 aa, Giardia lamblia
PSRGTLPP

SEQ ID NO: 3060600 - protein, 4 aa, Giardia lamblia
PSRH

SEQ ID NO: 3060601 - protein, 7 aa, Giardia lamblia
PSRPSHS

SEQ ID NO: 3060602 - protein, 46 aa, Giardia lamblia
PSRRDSSGRGSRDPTGKKNTAPSTKPVHGEQDNTNDNDDNDGPYDS

SEQ ID NO: 3060603 - protein, 12 aa, Giardia lamblia
PSRTDAARCEPC

SEQ ID NO: 3060604 - protein, 18 aa, Giardia lamblia
PSRTNANGPLYDYFLETL

SEQ ID NO: 3060605 - protein, 8 aa, Giardia lamblia
PSRYPSVK

SEQ ID NO: 3060606 - protein, 4 aa, Giardia lamblia
PSSA

SEQ ID NO: 3060607 - protein, 7 aa, Giardia lamblia
PSSANNL

SEQ ID NO: 3060608 - protein, 7 aa, Giardia lamblia
PSSAPGL

SEQ ID NO: 3060609 - protein, 13 aa, Giardia lamblia
PSSARSKRSVHND

SEQ ID NO: 3060610 - protein, 8 aa, Giardia lamblia
PSSDALKG

SEQ ID NO: 3060611 - protein, 23 aa, Giardia lamblia
PSSDNLAKSLSSAGSHEATEAMA

SEQ ID NO: 3060612 - protein, 6 aa, Giardia lamblia
PSSDSI

SEQ ID NO: 3060613 - protein, 12 aa, Giardia lamblia
PSSENPVQGLSR

SEQ ID NO: 3060614 - protein, 7 aa, Giardia lamblia
PSSGIQP

SEQ ID NO: 3060615 - protein, 7 aa, Giardia lamblia
PSSGLAR

SEQ ID NO: 3060616 - protein, 5 aa, Giardia lamblia
PSSGS

SEQ ID NO: 3060617 - protein, 7 aa, Giardia lamblia
PSSGVDD

SEQ ID NO: 3060618 - protein, 16 aa, Giardia lamblia
PSSIAKAANPPALPSP

SEQ ID NO: 3060619 - protein, 7 aa, Giardia lamblia
PSSLDSS

SEQ ID NO: 3060620 - protein, 8 aa, Giardia lamblia
PSSMGSKS

SEQ ID NO: 3060621 - protein, 4 aa, Giardia lamblia
PSSP

SEQ ID NO: 3060622 - protein, 4 aa, Giardia lamblia
PSSR

SEQ ID NO: 3060623 - protein, 5 aa, Giardia lamblia
PSSRI

SEQ ID NO: 3060624 - protein, 15 aa, Giardia lamblia
PSSRTEKPPQSSSTT

SEQ ID NO: 3060625 - protein, 6 aa, Giardia lamblia
PSSSDD

SEQ ID NO: 3060626 - protein, 12 aa, Giardia lamblia
PSSSDDSSITTK

SEQ ID NO: 3060627 - protein, 7 aa, Giardia lamblia
PSSSQAE

SEQ ID NO: 3060628 - protein, 5 aa, Giardia lamblia
PSSST

SEQ ID NO: 3060629 - protein, 8 aa, Giardia lamblia
PSSSVQKL

SEQ ID NO: 3060630 - protein, 19 aa, Giardia lamblia
PSSTTTDTSPQQGAKPSFS

SEQ ID NO: 3060631 - protein, 11 aa, Giardia lamblia
PSSVASPVSDK

SEQ ID NO: 3060632 - protein, 9 aa, Giardia lamblia
PSTAAVDND

SEQ ID NO: 3060633 - protein, 8 aa, Giardia lamblia
PSTASPSD

SEQ ID NO: 3060634 - protein, 8 aa, Giardia lamblia
PSTATVAS

SEQ ID NO: 3060635 - protein, 15 aa, Giardia lamblia
PSTCGQQASSSDGLE

SEQ ID NO: 3060636 - protein, 7 aa, Giardia lamblia
PSTEEIS

SEQ ID NO: 3060637 - protein, 10 aa, Giardia lamblia
PSTEKIGDRM

SEQ ID NO: 3060638 - protein, 7 aa, Giardia lamblia
PSTESEL

SEQ ID NO: 3060639 - protein, 15 aa, Giardia lamblia
PSTESRKAPTTPKRV

SEQ ID NO: 3060640 - protein, 10 aa, Giardia lamblia
PSTIPEASDL

SEQ ID NO: 3060641 - protein, 14 aa, Giardia lamblia
PSTITRSKDSSKRT

SEQ ID NO: 3060642 - protein, 4 aa, Giardia lamblia
PSTK

SEQ ID NO: 3060643 - protein, 18 aa, Giardia lamblia
PSTLETSNLTAPSGPLST

SEQ ID NO: 3060644 - protein, 7 aa, Giardia lamblia
PSTPHAI

SEQ ID NO: 3060645 - protein, 8 aa, Giardia lamblia
PSTPNRPS

SEQ ID NO: 3060646 - protein, 8 aa, Giardia lamblia
PSTQQGPV

SEQ ID NO: 3060647 - protein, 6 aa, Giardia lamblia
PSTSGI

SEQ ID NO: 3060648 - protein, 14 aa, Giardia lamblia
PSTSVAPSSLSPYS

SEQ ID NO: 3060649 - protein, 7 aa, Giardia lamblia
PSTSYSA

SEQ ID NO: 3060650 - protein, 5 aa, Giardia lamblia
PSTTY

SEQ ID NO: 3060651 - protein, 5 aa, Giardia lamblia
PSTVA

SEQ ID NO: 3060652 - protein, 10 aa, Giardia lamblia
PSTVSDVAGT

SEQ ID NO: 3060653 - protein, 4 aa, Giardia lamblia
PSTW

SEQ ID NO: 3060654 - protein, 4 aa, Giardia lamblia
PSVC

SEQ ID NO: 3060655 - protein, 9 aa, Giardia lamblia
PSVLGKQKD

SEQ ID NO: 3060656 - protein, 7 aa, Giardia lamblia
PSVPTPS

SEQ ID NO: 3060657 - protein, 5 aa, Giardia lamblia
PSVTE

SEQ ID NO: 3060658 - protein, 10 aa, Giardia lamblia
PSVTSQSQDP

SEQ ID NO: 3060659 - protein, 5 aa, Giardia lamblia
PSYAT

SEQ ID NO: 3060660 - protein, 4 aa, Giardia lamblia
PSYI

SEQ ID NO: 3060661 - protein, 5 aa, Giardia lamblia
PSYMP

SEQ ID NO: 3060662 - protein, 4 aa, Giardia lamblia
PSYQ

SEQ ID NO: 3060663 - protein, 7 aa, Giardia lamblia
PSYSQES

SEQ ID NO: 3060664 - protein, 5 aa, Giardia lamblia
PSYSW

SEQ ID NO: 3060665 - protein, 16 aa, Giardia lamblia
PTAETVAEARTQHTSA

SEQ ID NO: 3060666 - protein, 14 aa, Giardia lamblia
PTATITTQQKTVEI

SEQ ID NO: 3060667 - protein, 7 aa, Giardia lamblia
PTCNPPA

SEQ ID NO: 3060668 - protein, 12 aa, Giardia lamblia
PTDAAPRLEKAQ

SEQ ID NO: 3060669 - protein, 19 aa, Giardia lamblia
PTDCPEGDSCSEESSPVAG

SEQ ID NO: 3060670 - protein, 4 aa, Giardia lamblia
PTDD

SEQ ID NO: 3060671 - protein, 20 aa, Giardia lamblia
PTDEQAEELGVDPESVPQTK

SEQ ID NO: 3060672 - protein, 20 aa, Giardia lamblia
PTDEQAEELGVDPESVPQTQ

SEQ ID NO: 3060673 - protein, 6 aa, Giardia lamblia
PTDGAS

SEQ ID NO: 3060674 - protein, 14 aa, Giardia lamblia
PTDGCGVDGSTDIG

SEQ ID NO: 3060675 - protein, 7 aa, Giardia lamblia
PTDNSGI

SEQ ID NO: 3060676 - protein, 8 aa, Giardia lamblia
PTDQSESI

SEQ ID NO: 3060677 - protein, 10 aa, Giardia lamblia
PTDTTVSRTT

SEQ ID NO: 3060678 - protein, 6 aa, Giardia lamblia
PTEDTV

SEQ ID NO: 3060679 - protein, 6 aa, Giardia lamblia
PTEGQY

SEQ ID NO: 3060680 - protein, 5 aa, Giardia lamblia
PTERP

SEQ ID NO: 3060681 - protein, 4 aa, Giardia lamblia
PTEY

SEQ ID NO: 3060682 - protein, 6 aa, Giardia lamblia
PTFPGI

SEQ ID NO: 3060683 - protein, 13 aa, Giardia lamblia
PTFQQNKKPVNFQ

SEQ ID NO: 3060684 - protein, 7 aa, Giardia lamblia
PTGCTSS

SEQ ID NO: 3060685 - protein, 7 aa, Giardia lamblia
PTGDTSY

SEQ ID NO: 3060686 - protein, 10 aa, Giardia lamblia
PTGEPHSYKS

SEQ ID NO: 3060687 - protein, 4 aa, Giardia lamblia
PTGL

SEQ ID NO: 3060688 - protein, 5 aa, Giardia lamblia
PTGLT

SEQ ID NO: 3060689 - protein, 8 aa, Giardia lamblia
PTGYTGND

SEQ ID NO: 3060690 - protein, 4 aa, Giardia lamblia
PTHV

SEQ ID NO: 3060691 - protein, 9 aa, Giardia lamblia
PTIETPGKL

SEQ ID NO: 3060692 - protein, 4 aa, Giardia lamblia
PTIN

SEQ ID NO: 3060693 - protein, 7 aa, Giardia lamblia
PTKAGVP

SEQ ID NO: 3060694 - protein, 8 aa, Giardia lamblia
PTKAPPFA

SEQ ID NO: 3060695 - protein, 4 aa, Giardia lamblia
PTKG

SEQ ID NO: 3060696 - protein, 8 aa, Giardia lamblia
PTKHSRHR

SEQ ID NO: 3060697 - protein, 8 aa, Giardia lamblia
PTKPLQPS

SEQ ID NO: 3060698 - protein, 10 aa, Giardia lamblia
PTKRSSSVLT

SEQ ID NO: 3060699 - protein, 11 aa, Giardia lamblia
PTKSAESCYDS

SEQ ID NO: 3060700 - protein, 12 aa, Giardia lamblia
PTLESTSAGSQL

SEQ ID NO: 3060701 - protein, 16 aa, Giardia lamblia
PTLLTTSSDSHGTPLT

SEQ ID NO: 3060702 - protein, 4 aa, Giardia lamblia
PTLP

SEQ ID NO: 3060703 - protein, 9 aa, Giardia lamblia
PTLPSKSNR

SEQ ID NO: 3060704 - protein, 11 aa, Giardia lamblia
PTLPSNSTHTN

SEQ ID NO: 3060705 - protein, 5 aa, Giardia lamblia
PTLRP

SEQ ID NO: 3060706 - protein, 7 aa, Giardia lamblia
PTLSTQT

SEQ ID NO: 3060707 - protein, 4 aa, Giardia lamblia
PTLT

SEQ ID NO: 3060708 - protein, 9 aa, Giardia lamblia
PTMNTPEAY

SEQ ID NO: 3060709 - protein, 33 aa, Giardia lamblia
PTNAQIPETFGEPTTGPKTCTNQSSLATTESLE

SEQ ID NO: 3060710 - protein, 4 aa, Giardia lamblia
PTNG

SEQ ID NO: 3060711 - protein, 10 aa, Giardia lamblia
PTNIPGTSDA

SEQ ID NO: 3060712 - protein, 4 aa, Giardia lamblia
PTNN

SEQ ID NO: 3060713 - protein, 6 aa, Giardia lamblia
PTNPRF

SEQ ID NO: 3060714 - protein, 13 aa, Giardia lamblia
PTNPSRQRSARSK

SEQ ID NO: 3060715 - protein, 8 aa, Giardia lamblia
PTNSDARK

SEQ ID NO: 3060716 - protein, 8 aa, Giardia lamblia
PTNSTGNQ

SEQ ID NO: 3060717 - protein, 5 aa, Giardia lamblia
PTNWA

SEQ ID NO: 3060718 - protein, 15 aa, Giardia lamblia
PTPAPAPAPSSTRKT

SEQ ID NO: 3060719 - protein, 13 aa, Giardia lamblia
PTPAPISAYSATG

SEQ ID NO: 3060720 - protein, 10 aa, Giardia lamblia
PTPASTDSLD

SEQ ID NO: 3060721 - protein, 13 aa, Giardia lamblia
PTPCRSPADSLQQ

SEQ ID NO: 3060722 - protein, 6 aa, Giardia lamblia
PTPGST

SEQ ID NO: 3060723 - protein, 25 aa, Giardia lamblia
PTPKPGPDPVPDPVPAPAPSSARKT

SEQ ID NO: 3060724 - protein, 6 aa, Giardia lamblia
PTPPEP

SEQ ID NO: 3060725 - protein, 5 aa, Giardia lamblia
PTPSG

SEQ ID NO: 3060726 - protein, 8 aa, Giardia lamblia
PTPSLPAE

SEQ ID NO: 3060727 - protein, 6 aa, Giardia lamblia
PTPSVT

SEQ ID NO: 3060728 - protein, 24 aa, Giardia lamblia
PTPTCTGTDEVDSNTGSDRAYPVQ

SEQ ID NO: 3060729 - protein, 4 aa, Giardia lamblia
PTQS

SEQ ID NO: 3060730 - protein, 10 aa, Giardia lamblia
PTQSYGRSQV

SEQ ID NO: 3060731 - protein, 14 aa, Giardia lamblia
PTRPLKQTAHSTGS

SEQ ID NO: 3060732 - protein, 4 aa, Giardia lamblia
PTRT

SEQ ID NO: 3060733 - protein, 7 aa, Giardia lamblia
PTSDISR

SEQ ID NO: 3060734 - protein, 12 aa, Giardia lamblia
PTSEKDIRIRGS

SEQ ID NO: 3060735 - protein, 9 aa, Giardia lamblia
PTSENDYKK

SEQ ID NO: 3060736 - protein, 7 aa, Giardia lamblia
PTSGCAG

SEQ ID NO: 3060737 - protein, 6 aa, Giardia lamblia
PTSGLD

SEQ ID NO: 3060738 - protein, 9 aa, Giardia lamblia
PTSGLDPIS

SEQ ID NO: 3060739 - protein, 7 aa, Giardia lamblia
PTSGYTA

SEQ ID NO: 3060740 - protein, 4 aa, Giardia lamblia
PTSL

SEQ ID NO: 3060741 - protein, 24 aa, Giardia lamblia
PTSLNDPQNATSKRAAQSQLTPTL

SEQ ID NO: 3060742 - protein, 5 aa, Giardia lamblia
PTSPP

SEQ ID NO: 3060743 - protein, 13 aa, Giardia lamblia
PTSSASSSFPPGM

SEQ ID NO: 3060744 - protein, 8 aa, Giardia lamblia
PTSTYDSA

SEQ ID NO: 3060745 - protein, 4 aa, Giardia lamblia
PTSV

SEQ ID NO: 3060746 - protein, 5 aa, Giardia lamblia
PTSYD

SEQ ID NO: 3060747 - protein, 8 aa, Giardia lamblia
PTTAETSS

SEQ ID NO: 3060748 - protein, 9 aa, Giardia lamblia
PTTDAQGKK

SEQ ID NO: 3060749 - protein, 12 aa, Giardia lamblia
PTTEESKDPDLY

SEQ ID NO: 3060750 - protein, 10 aa, Giardia lamblia
PTTGYSEKEC

SEQ ID NO: 3060751 - protein, 5 aa, Giardia lamblia
PTTMP

SEQ ID NO: 3060752 - protein, 12 aa, Giardia lamblia
PTTQGPSMTKAP

SEQ ID NO: 3060753 - protein, 4 aa, Giardia lamblia
PTTR

SEQ ID NO: 3060754 - protein, 5 aa, Giardia lamblia
PTTRH

SEQ ID NO: 3060755 - protein, 4 aa, Giardia lamblia
PTTS

SEQ ID NO: 3060756 - protein, 10 aa, Giardia lamblia
PTTSAELGNS

SEQ ID NO: 3060757 - protein, 9 aa, Giardia lamblia
PTTTGYSDP

SEQ ID NO: 3060758 - protein, 8 aa, Giardia lamblia
PTTTSGVP

SEQ ID NO: 3060759 - protein, 15 aa, Giardia lamblia
PTTVETTEEDSDFQV

SEQ ID NO: 3060760 - protein, 7 aa, Giardia lamblia
PTVPEAQ

SEQ ID NO: 3060761 - protein, 7 aa, Giardia lamblia
PTYDGGY

SEQ ID NO: 3060762 - protein, 4 aa, Giardia lamblia
PTYK

SEQ ID NO: 3060763 - protein, 13 aa, Giardia lamblia
PTYNVSNSANIGS

SEQ ID NO: 3060764 - protein, 5 aa, Giardia lamblia
PTYVD

SEQ ID NO: 3060765 - protein, 4 aa, Giardia lamblia
PVAA

SEQ ID NO: 3060766 - protein, 8 aa, Giardia lamblia
PVAAQGEI

SEQ ID NO: 3060767 - protein, 4 aa, Giardia lamblia
PVAP

SEQ ID NO: 3060768 - protein, 14 aa, Giardia lamblia
PVASGRKSASASTR

SEQ ID NO: 3060769 - protein, 5 aa, Giardia lamblia
PVAST

SEQ ID NO: 3060770 - protein, 11 aa, Giardia lamblia
PVATSDSLASE

SEQ ID NO: 3060771 - protein, 5 aa, Giardia lamblia
PVDPT

SEQ ID NO: 3060772 - protein, 14 aa, Giardia lamblia
PVGPGKTAGKGRAA

SEQ ID NO: 3060773 - protein, 12 aa, Giardia lamblia
PVGPTAQKPGIS

SEQ ID NO: 3060774 - protein, 14 aa, Giardia lamblia
PVGTLTGTGSTAKA

SEQ ID NO: 3060775 - protein, 7 aa, Giardia lamblia
PVGTPST

SEQ ID NO: 3060776 - protein, 12 aa, Giardia lamblia
PVIGPADSGSVK

SEQ ID NO: 3060777 - protein, 5 aa, Giardia lamblia
PVKGR

SEQ ID NO: 3060778 - protein, 5 aa, Giardia lamblia
PVKSI

SEQ ID NO: 3060779 - protein, 9 aa, Giardia lamblia
PVKTDSASV

SEQ ID NO: 3060780 - protein, 26 aa, Giardia lamblia
PVPDGVGGADITKADSTKGTDSRSRS

SEQ ID NO: 3060781 - protein, 5 aa, Giardia lamblia
PVPGT

SEQ ID NO: 3060782 - protein, 4 aa, Giardia lamblia
PVPI

SEQ ID NO: 3060783 - protein, 6 aa, Giardia lamblia
PVPKRT

SEQ ID NO: 3060784 - protein, 7 aa, Giardia lamblia
PVPSAPS

SEQ ID NO: 3060785 - protein, 22 aa, Giardia lamblia
PVPSSLQESSQPSSVIQPETTV

SEQ ID NO: 3060786 - protein, 9 aa, Giardia lamblia
PVPTTSNHE

SEQ ID NO: 3060787 - protein, 4 aa, Giardia lamblia
PVPV

SEQ ID NO: 3060788 - protein, 4 aa, Giardia lamblia
PVQD

SEQ ID NO: 3060789 - protein, 13 aa, Giardia lamblia
PVQEDAETDTTKT

SEQ ID NO: 3060790 - protein, 14 aa, Giardia lamblia
PVQKSQQSKLIKNG

SEQ ID NO: 3060791 - protein, 8 aa, Giardia lamblia
PVQSDRRV

SEQ ID NO: 3060792 - protein, 4 aa, Giardia lamblia
PVRR

SEQ ID NO: 3060793 - protein, 5 aa, Giardia lamblia
PVSNH

SEQ ID NO: 3060794 - protein, 7 aa, Giardia lamblia
PVSSQPQ

SEQ ID NO: 3060795 - protein, 12 aa, Giardia lamblia
PVSTDGNQTITA

SEQ ID NO: 3060796 - protein, 11 aa, Giardia lamblia
PVTGSSSVRDS

SEQ ID NO: 3060797 - protein, 10 aa, Giardia lamblia
PVTPQKPGSE

SEQ ID NO: 3060798 - protein, 8 aa, Giardia lamblia
PVTPSTST

SEQ ID NO: 3060799 - protein, 8 aa, Giardia lamblia
PYAAKAGA

SEQ ID NO: 3060800 - protein, 4 aa, Giardia lamblia
PYAE

SEQ ID NO: 3060801 - protein, 10 aa, Giardia lamblia
PYASPGEIPF

SEQ ID NO: 3060802 - protein, 7 aa, Giardia lamblia
PYASSNC

SEQ ID NO: 3060803 - protein, 4 aa, Giardia lamblia
PYCN

SEQ ID NO: 3060804 - protein, 13 aa, Giardia lamblia
PYDEDEVDDKEDK

SEQ ID NO: 3060805 - protein, 5 aa, Giardia lamblia
PYEAK

SEQ ID NO: 3060806 - protein, 11 aa, Giardia lamblia
PYEYTDGDTDL

SEQ ID NO: 3060807 - protein, 4 aa, Giardia lamblia
PYGQ

SEQ ID NO: 3060808 - protein, 6 aa, Giardia lamblia
PYGSHR

SEQ ID NO: 3060809 - protein, 13 aa, Giardia lamblia
PYKQEDIVEFAVI

SEQ ID NO: 3060810 - protein, 10 aa, Giardia lamblia
PYKTEEPPDP

SEQ ID NO: 3060811 - protein, 11 aa, Giardia lamblia
PYMSNQNTPNL

SEQ ID NO: 3060812 - protein, 13 aa, Giardia lamblia
PYNSNDSLRRSGD

SEQ ID NO: 3060813 - protein, 6 aa, Giardia lamblia
PYPGLE

SEQ ID NO: 3060814 - protein, 7 aa, Giardia lamblia
PYPGSAS

SEQ ID NO: 3060815 - protein, 6 aa, Giardia lamblia
PYPPPV

SEQ ID NO: 3060816 - protein, 5 aa, Giardia lamblia
PYPPS

SEQ ID NO: 3060817 - protein, 7 aa, Giardia lamblia
PYPSLAP

SEQ ID NO: 3060818 - protein, 22 aa, Giardia lamblia
PYQQLEQESSGERASTLNEYSQ

SEQ ID NO: 3060819 - protein, 12 aa, Giardia lamblia
PYREKRNPIEAD

SEQ ID NO: 3060820 - protein, 7 aa, Giardia lamblia
PYRRQPL

SEQ ID NO: 3060821 - protein, 6 aa, Giardia lamblia
PYSAPE

SEQ ID NO: 3060822 - protein, 12 aa, Giardia lamblia
PYSERPAGPGDA

SEQ ID NO: 3060823 - protein, 5 aa, Giardia lamblia
PYSPE

SEQ ID NO: 3060824 - protein, 12 aa, Giardia lamblia
PYSRSSRSYSSQ

SEQ ID NO: 3060825 - protein, 10 aa, Giardia lamblia
PYSSSPSKVS

SEQ ID NO: 3060826 - protein, 11 aa, Giardia lamblia
PYSTKTPSPNF

SEQ ID NO: 3060827 - protein, 16 aa, Giardia lamblia
PYTLSGDNNASEPTAF

SEQ ID NO: 3060828 - protein, 6 aa, Giardia lamblia
PYTPSL

SEQ ID NO: 3060829 - protein, 5 aa, Giardia lamblia
PYTTD

SEQ ID NO: 3060830 - protein, 11 aa, Giardia lamblia
PYYNKSYARAT

SEQ ID NO: 3060831 - protein, 18 aa, Giardia lamblia
QAAENRKLKKPKEQAGVD

SEQ ID NO: 3060832 - protein, 25 aa, Giardia lamblia
QAAKGTVGTPRREAKSVGDRPAYQV

SEQ ID NO: 3060833 - protein, 24 aa, Giardia lamblia
QAAKNSSSGLSISTEKLTPSQVPS

SEQ ID NO: 3060834 - protein, 4 aa, Giardia lamblia
QAAN

SEQ ID NO: 3060835 - protein, 5 aa, Giardia lamblia
QAAPS

SEQ ID NO: 3060836 - protein, 6 aa, Giardia lamblia
QAAQKH

SEQ ID NO: 3060837 - protein, 8 aa, Giardia lamblia
QAARSPGL

SEQ ID NO: 3060838 - protein, 29 aa, Giardia lamblia
QAASHEAAPITSEADLAKADTDDAQTDKT

SEQ ID NO: 3060839 - protein, 6 aa, Giardia lamblia
QAASSN

SEQ ID NO: 3060840 - protein, 10 aa, Giardia lamblia
QAATHDDPAP

SEQ ID NO: 3060841 - protein, 7 aa, Giardia lamblia
QAATQYH

SEQ ID NO: 3060842 - protein, 12 aa, Giardia lamblia
QADECENNTKQA

SEQ ID NO: 3060843 - protein, 10 aa, Giardia lamblia
QADSQNRPSA

SEQ ID NO: 3060844 - protein, 9 aa, Giardia lamblia
QADTTGSVC

SEQ ID NO: 3060845 - protein, 7 aa, Giardia lamblia
QAEAAEN

SEQ ID NO: 3060846 - protein, 6 aa, Giardia lamblia
QAECDS

SEQ ID NO: 3060847 - protein, 9 aa, Giardia lamblia
QAEQSAHSP

SEQ ID NO: 3060848 - protein, 6 aa, Giardia lamblia
QAGQKD

SEQ ID NO: 3060849 - protein, 6 aa, Giardia lamblia
QAGSED

SEQ ID NO: 3060850 - protein, 6 aa, Giardia lamblia
QAGSTD

SEQ ID NO: 3060851 - protein, 20 aa, Giardia lamblia
QAGVATECGTGGVCESSGSQ

SEQ ID NO: 3060852 - protein, 14 aa, Giardia lamblia
QAHELTAKDSGKAV

SEQ ID NO: 3060853 - protein, 8 aa, Giardia lamblia
QAHSADTS

SEQ ID NO: 3060854 - protein, 37 aa, Giardia lamblia
QAHTGNDDYLPGGHAPNAHQSHKEQPLLEPNANASHG

SEQ ID NO: 3060855 - protein, 9 aa, Giardia lamblia
QAISSTSQS

SEQ ID NO: 3060856 - protein, 14 aa, Giardia lamblia
QAKDPPDSAANNGL

SEQ ID NO: 3060857 - protein, 5 aa, Giardia lamblia
QAKGA

SEQ ID NO: 3060858 - protein, 6 aa, Giardia lamblia
QAKLPD

SEQ ID NO: 3060859 - protein, 10 aa, Giardia lamblia
QAKTATKARK

SEQ ID NO: 3060860 - protein, 14 aa, Giardia lamblia
QALAERDSEKIDKA

SEQ ID NO: 3060861 - protein, 7 aa, Giardia lamblia
QALPGSL

SEQ ID NO: 3060862 - protein, 4 aa, Giardia lamblia
QALS

SEQ ID NO: 3060863 - protein, 23 aa, Giardia lamblia
QANDNSENTKTHGQDAIKAAPTI

SEQ ID NO: 3060864 - protein, 7 aa, Giardia lamblia
QANGGQS

SEQ ID NO: 3060865 - protein, 5 aa, Giardia lamblia
QANGT

SEQ ID NO: 3060866 - protein, 8 aa, Giardia lamblia
QANSDGQP

SEQ ID NO: 3060867 - protein, 11 aa, Giardia lamblia
QANSTSQYMPE

SEQ ID NO: 3060868 - protein, 5 aa, Giardia lamblia
QAPDG

SEQ ID NO: 3060869 - protein, 7 aa, Giardia lamblia
QAPDPRI

SEQ ID NO: 3060870 - protein, 14 aa, Giardia lamblia
QAPEDGLTRTSQPV

SEQ ID NO: 3060871 - protein, 17 aa, Giardia lamblia
QAPFDTPSAGVLGGAPA

SEQ ID NO: 3060872 - protein, 14 aa, Giardia lamblia
QAPPTGQAGAPTTY

SEQ ID NO: 3060873 - protein, 7 aa, Giardia lamblia
QAPSGSM

SEQ ID NO: 3060874 - protein, 5 aa, Giardia lamblia
QAPSY

SEQ ID NO: 3060875 - protein, 8 aa, Giardia lamblia
QAPTSSGT

SEQ ID NO: 3060876 - protein, 7 aa, Giardia lamblia
QAPTVSE

SEQ ID NO: 3060877 - protein, 12 aa, Giardia lamblia
QAQAPRPTEPSI

SEQ ID NO: 3060878 - protein, 9 aa, Giardia lamblia
QAQDGKCTK

SEQ ID NO: 3060879 - protein, 8 aa, Giardia lamblia
QAQEQKAR

SEQ ID NO: 3060880 - protein, 14 aa, Giardia lamblia
QAQKPSKDDTDSAS

SEQ ID NO: 3060881 - protein, 18 aa, Giardia lamblia
QAQQQQQQQGSSSPSMSL

SEQ ID NO: 3060882 - protein, 15 aa, Giardia lamblia
QAQSAPANKDSVPLE

SEQ ID NO: 3060883 - protein, 5 aa, Giardia lamblia
QAQSR

SEQ ID NO: 3060884 - protein, 6 aa, Giardia lamblia
QAQSSL

SEQ ID NO: 3060885 - protein, 7 aa, Giardia lamblia
QARAPST

SEQ ID NO: 3060886 - protein, 6 aa, Giardia lamblia
QARAQL

SEQ ID NO: 3060887 - protein, 6 aa, Giardia lamblia
QARDME

SEQ ID NO: 3060888 - protein, 8 aa, Giardia lamblia
QARQLSGG

SEQ ID NO: 3060889 - protein, 6 aa, Giardia lamblia
QARSVP

SEQ ID NO: 3060890 - protein, 9 aa, Giardia lamblia
QASAGTGPL

SEQ ID NO: 3060891 - protein, 7 aa, Giardia lamblia
QASASIE

SEQ ID NO: 3060892 - protein, 6 aa, Giardia lamblia
QASCPQ

SEQ ID NO: 3060893 - protein, 8 aa, Giardia lamblia
QASDGTCI

SEQ ID NO: 3060894 - protein, 11 aa, Giardia lamblia
QASRDSEDSLD

SEQ ID NO: 3060895 - protein, 5 aa, Giardia lamblia
QASSA

SEQ ID NO: 3060896 - protein, 6 aa, Giardia lamblia
QASTDT

SEQ ID NO: 3060897 - protein, 13 aa, Giardia lamblia
QATAGSVQVDGSR

SEQ ID NO: 3060898 - protein, 5 aa, Giardia lamblia
QATAH

SEQ ID NO: 3060899 - protein, 7 aa, Giardia lamblia
QATPQTC

SEQ ID NO: 3060900 - protein, 4 aa, Giardia lamblia
QATR

SEQ ID NO: 3060901 - protein, 12 aa, Giardia lamblia
QATRAQKELPPF

SEQ ID NO: 3060902 - protein, 6 aa, Giardia lamblia
QATRNT

SEQ ID NO: 3060903 - protein, 8 aa, Giardia lamblia
QATSSRCT

SEQ ID NO: 3060904 - protein, 6 aa, Giardia lamblia
QAYEQN

SEQ ID NO: 3060905 - protein, 11 aa, Giardia lamblia
QCDESSEALSS

SEQ ID NO: 3060906 - protein, 13 aa, Giardia lamblia
QCENNTSSSFTRT

SEQ ID NO: 3060907 - protein, 13 aa, Giardia lamblia
QCEQSPNSVQKQL

SEQ ID NO: 3060908 - protein, 14 aa, Giardia lamblia
QCNGPNQQPDGSGR

SEQ ID NO: 3060909 - protein, 39 aa, Giardia lamblia
QCSAGPMAPGTADPRNDSGGGSKTVQEGSVKSATESTIE

SEQ ID NO: 3060910 - protein, 7 aa, Giardia lamblia
QCSRGVD

SEQ ID NO: 3060911 - protein, 7 aa, Giardia lamblia
QCSSSSF

SEQ ID NO: 3060912 - protein, 5 aa, Giardia lamblia
QCSST

SEQ ID NO: 3060913 - protein, 14 aa, Giardia lamblia
QCTAPTAPSEGGMT

SEQ ID NO: 3060914 - protein, 21 aa, Giardia lamblia
QCTSDSDCTSMAANGKTLTGR

SEQ ID NO: 3060915 - protein, 7 aa, Giardia lamblia
QDAETID

SEQ ID NO: 3060916 - protein, 5 aa, Giardia lamblia
QDALN

SEQ ID NO: 3060917 - protein, 10 aa, Giardia lamblia
QDDDQEPQAE

SEQ ID NO: 3060918 - protein, 7 aa, Giardia lamblia
QDDGASA

SEQ ID NO: 3060919 - protein, 9 aa, Giardia lamblia
QDDGNQDGA

SEQ ID NO: 3060920 - protein, 6 aa, Giardia lamblia
QDDGSH

SEQ ID NO: 3060921 - protein, 5 aa, Giardia lamblia
QDDHG

SEQ ID NO: 3060922 - protein, 4 aa, Giardia lamblia
QDDI

SEQ ID NO: 3060923 - protein, 11 aa, Giardia lamblia
QDDQEIEQTQS

SEQ ID NO: 3060924 - protein, 19 aa, Giardia lamblia
QDEAERRKAQEVGEASTAD

SEQ ID NO: 3060925 - protein, 11 aa, Giardia lamblia
QDETAHGAPFD

SEQ ID NO: 3060926 - protein, 13 aa, Giardia lamblia
QDETIDGEEPPID

SEQ ID NO: 3060927 - protein, 5 aa, Giardia lamblia
QDGHK

SEQ ID NO: 3060928 - protein, 5 aa, Giardia lamblia
QDGNH

SEQ ID NO: 3060929 - protein, 4 aa, Giardia lamblia
QDGV

SEQ ID NO: 3060930 - protein, 18 aa, Giardia lamblia
QDHQGTSVQQKPDTEDRL

SEQ ID NO: 3060931 - protein, 4 aa, Giardia lamblia
QDIQ

SEQ ID NO: 3060932 - protein, 5 aa, Giardia lamblia
QDKCN

SEQ ID NO: 3060933 - protein, 4 aa, Giardia lamblia
QDKI

SEQ ID NO: 3060934 - protein, 11 aa, Giardia lamblia
QDKKHQAKKPI

SEQ ID NO: 3060935 - protein, 9 aa, Giardia lamblia
QDKRGPNDD

SEQ ID NO: 3060936 - protein, 7 aa, Giardia lamblia
QDMAQQK

SEQ ID NO: 3060937 - protein, 4 aa, Giardia lamblia
QDNE

SEQ ID NO: 3060938 - protein, 7 aa, Giardia lamblia
QDNELGN

SEQ ID NO: 3060939 - protein, 7 aa, Giardia lamblia
QDNQGKT

SEQ ID NO: 3060940 - protein, 6 aa, Giardia lamblia
QDNTDS

SEQ ID NO: 3060941 - protein, 5 aa, Giardia lamblia
QDNYE

SEQ ID NO: 3060942 - protein, 4 aa, Giardia lamblia
QDPD

SEQ ID NO: 3060943 - protein, 6 aa, Giardia lamblia
QDPFSS

SEQ ID NO: 3060944 - protein, 8 aa, Giardia lamblia
QDPPPPMR

SEQ ID NO: 3060945 - protein, 5 aa, Giardia lamblia
QDPSL

SEQ ID NO: 3060946 - protein, 4 aa, Giardia lamblia
QDPV

SEQ ID NO: 3060947 - protein, 10 aa, Giardia lamblia
QDQADCPARA

SEQ ID NO: 3060948 - protein, 8 aa, Giardia lamblia
QDQEHGKD

SEQ ID NO: 3060949 - protein, 4 aa, Giardia lamblia
QDQN

SEQ ID NO: 3060950 - protein, 12 aa, Giardia lamblia
QDQPGDQSAKNR

SEQ ID NO: 3060951 - protein, 9 aa, Giardia lamblia
QDQPLPPTV

SEQ ID NO: 3060952 - protein, 5 aa, Giardia lamblia
QDRDN

SEQ ID NO: 3060953 - protein, 4 aa, Giardia lamblia
QDRI

SEQ ID NO: 3060954 - protein, 4 aa, Giardia lamblia
QDRR

SEQ ID NO: 3060955 - protein, 7 aa, Giardia lamblia
QDRSKSI

SEQ ID NO: 3060956 - protein, 8 aa, Giardia lamblia
QDRSTDKD

SEQ ID NO: 3060957 - protein, 11 aa, Giardia lamblia
QDRTATPRKDL

SEQ ID NO: 3060958 - protein, 8 aa, Giardia lamblia
QDSDEKVN

SEQ ID NO: 3060959 - protein, 13 aa, Giardia lamblia
QDSKDPSAKSEDW

SEQ ID NO: 3060960 - protein, 8 aa, Giardia lamblia
QDSKGKTA

SEQ ID NO: 3060961 - protein, 16 aa, Giardia lamblia
QDSNGPSSGPRIRPGS

SEQ ID NO: 3060962 - protein, 6 aa, Giardia lamblia
QDSPVT

SEQ ID NO: 3060963 - protein, 4 aa, Giardia lamblia
QDTI

SEQ ID NO: 3060964 - protein, 8 aa, Giardia lamblia
QDTPIEVE

SEQ ID NO: 3060965 - protein, 8 aa, Giardia lamblia
QDTSSSNF

SEQ ID NO: 3060966 - protein, 8 aa, Giardia lamblia
QDTTPVDE

SEQ ID NO: 3060967 - protein, 9 aa, Giardia lamblia
QDTVPSSIT

SEQ ID NO: 3060968 - protein, 4 aa, Giardia lamblia
QDVS

SEQ ID NO: 3060969 - protein, 8 aa, Giardia lamblia
QDVSGCGD

SEQ ID NO: 3060970 - protein, 5 aa, Giardia lamblia
QDWGN

SEQ ID NO: 3060971 - protein, 5 aa, Giardia lamblia
QEAAA

SEQ ID NO: 3060972 - protein, 8 aa, Giardia lamblia
QEAAANQP

SEQ ID NO: 3060973 - protein, 4 aa, Giardia lamblia
QEAD

SEQ ID NO: 3060974 - protein, 4 aa, Giardia lamblia
QEAE

SEQ ID NO: 3060975 - protein, 9 aa, Giardia lamblia
QEAESNGSI

SEQ ID NO: 3060976 - protein, 7 aa, Giardia lamblia
QEAPSLP

SEQ ID NO: 3060977 - protein, 8 aa, Giardia lamblia
QEATRSED

SEQ ID NO: 3060978 - protein, 18 aa, Giardia lamblia
QECDSGATTCKTCQPGYA

SEQ ID NO: 3060979 - protein, 8 aa, Giardia lamblia
QECGGDSS

SEQ ID NO: 3060980 - protein, 6 aa, Giardia lamblia
QECTSS

SEQ ID NO: 3060981 - protein, 9 aa, Giardia lamblia
QEDDEMPTD

SEQ ID NO: 3060982 - protein, 19 aa, Giardia lamblia
QEDELKRAKAQAHAALETG

SEQ ID NO: 3060983 - protein, 5 aa, Giardia lamblia
QEDGG

SEQ ID NO: 3060984 - protein, 7 aa, Giardia lamblia
QEDHENC

SEQ ID NO: 3060985 - protein, 7 aa, Giardia lamblia
QEDPVGS

SEQ ID NO: 3060986 - protein, 5 aa, Giardia lamblia
QEDQA

SEQ ID NO: 3060987 - protein, 9 aa, Giardia lamblia
QEDRTGGGF

SEQ ID NO: 3060988 - protein, 18 aa, Giardia lamblia
QEDTDTDATTDATETMTE

SEQ ID NO: 3060989 - protein, 13 aa, Giardia lamblia
QEEASANETTKIA

SEQ ID NO: 3060990 - protein, 10 aa, Giardia lamblia
QEEDEQTPLQ

SEQ ID NO: 3060991 - protein, 8 aa, Giardia lamblia
QEEDSPLK

SEQ ID NO: 3060992 - protein, 11 aa, Giardia lamblia
QEEPDRNGYYP

SEQ ID NO: 3060993 - protein, 9 aa, Giardia lamblia
QEEPLAPSE

SEQ ID NO: 3060994 - protein, 4 aa, Giardia lamblia
QEEQ

SEQ ID NO: 3060995 - protein, 13 aa, Giardia lamblia
QEERRSEKNEAEY

SEQ ID NO: 3060996 - protein, 4 aa, Giardia lamblia
QEFA

SEQ ID NO: 3060997 - protein, 42 aa, Giardia lamblia
QEFTGDDSDTSDEGLDLQSTDEESESDGVAENPEESDPNEKL

SEQ ID NO: 3060998 - protein, 14 aa, Giardia lamblia
QEGGPSSSSANELA

SEQ ID NO: 3060999 - protein, 6 aa, Giardia lamblia
QEGLID

SEQ ID NO: 3061000 - protein, 22 aa, Giardia lamblia
QEGQAVSRQLGRPAQNKPKITT

SEQ ID NO: 3061001 - protein, 10 aa, Giardia lamblia
QEGTAEFRTG

SEQ ID NO: 3061002 - protein, 11 aa, Giardia lamblia
QEHGPSSLNHE

SEQ ID NO: 3061003 - protein, 9 aa, Giardia lamblia
QEIDADPQI

SEQ ID NO: 3061004 - protein, 6 aa, Giardia lamblia
QEIEEG

SEQ ID NO: 3061005 - protein, 14 aa, Giardia lamblia
QEIEQRGYDSVETV

SEQ ID NO: 3061006 - protein, 7 aa, Giardia lamblia
QEKGEGI

SEQ ID NO: 3061007 - protein, 8 aa, Giardia lamblia
QEKPGASD

SEQ ID NO: 3061008 - protein, 5 aa, Giardia lamblia
QEKQL

SEQ ID NO: 3061009 - protein, 9 aa, Giardia lamblia
QEKTQTDEN

SEQ ID NO: 3061010 - protein, 9 aa, Giardia lamblia
QEKTTTKET

SEQ ID NO: 3061011 - protein, 15 aa, Giardia lamblia
QELEKAYKKASEETS

SEQ ID NO: 3061012 - protein, 4 aa, Giardia lamblia
QENA

SEQ ID NO: 3061013 - protein, 6 aa, Giardia lamblia
QENEKL

SEQ ID NO: 3061014 - protein, 6 aa, Giardia lamblia
QEPEEV

SEQ ID NO: 3061015 - protein, 5 aa, Giardia lamblia
QEPND

SEQ ID NO: 3061016 - protein, 9 aa, Giardia lamblia
QEPPSDSLT

SEQ ID NO: 3061017 - protein, 9 aa, Giardia lamblia
QEPQNTDIP

SEQ ID NO: 3061018 - protein, 7 aa, Giardia lamblia
QEPSDRS

SEQ ID NO: 3061019 - protein, 13 aa, Giardia lamblia
QEPTGFATSYSTA

SEQ ID NO: 3061020 - protein, 8 aa, Giardia lamblia
QEPTRDTV

SEQ ID NO: 3061021 - protein, 6 aa, Giardia lamblia
QEPTRT

SEQ ID NO: 3061022 - protein, 13 aa, Giardia lamblia
QEQPSSGSAEASL

SEQ ID NO: 3061023 - protein, 16 aa, Giardia lamblia
QEQSYSDSIESMSKEL

SEQ ID NO: 3061024 - protein, 4 aa, Giardia lamblia
QEQT

SEQ ID NO: 3061025 - protein, 5 aa, Giardia lamblia
QEQYK

SEQ ID NO: 3061026 - protein, 9 aa, Giardia lamblia
QERDGYVKP

SEQ ID NO: 3061027 - protein, 6 aa, Giardia lamblia
QERDKH

SEQ ID NO: 3061028 - protein, 6 aa, Giardia lamblia
QERNED

SEQ ID NO: 3061029 - protein, 14 aa, Giardia lamblia
QESAIRTAAAKERQ

SEQ ID NO: 3061030 - protein, 7 aa, Giardia lamblia
QESCPGG

SEQ ID NO: 3061031 - protein, 13 aa, Giardia lamblia
QESDAIKKDNATD

SEQ ID NO: 3061032 - protein, 15 aa, Giardia lamblia
QESGLSTASEDSHTM

SEQ ID NO: 3061033 - protein, 6 aa, Giardia lamblia
QESGNS

SEQ ID NO: 3061034 - protein, 7 aa, Giardia lamblia
QESMTPT

SEQ ID NO: 3061035 - protein, 7 aa, Giardia lamblia
QESNERG

SEQ ID NO: 3061036 - protein, 17 aa, Giardia lamblia
QESSDDKVLKPANTATR

SEQ ID NO: 3061037 - protein, 9 aa, Giardia lamblia
QESTGEALP

SEQ ID NO: 3061038 - protein, 4 aa, Giardia lamblia
QESV

SEQ ID NO: 3061039 - protein, 8 aa, Giardia lamblia
QETCTRRG

SEQ ID NO: 3061040 - protein, 7 aa, Giardia lamblia
QETKRAH

SEQ ID NO: 3061041 - protein, 5 aa, Giardia lamblia
QETPD

SEQ ID NO: 3061042 - protein, 25 aa, Giardia lamblia
QETRQQEDELNKKRSVFDRSKGPTL

SEQ ID NO: 3061043 - protein, 5 aa, Giardia lamblia
QETVG

SEQ ID NO: 3061044 - protein, 6 aa, Giardia lamblia
QEVAET

SEQ ID NO: 3061045 - protein, 15 aa, Giardia lamblia
QEWEDLNDPDAKAEM

SEQ ID NO: 3061046 - protein, 9 aa, Giardia lamblia
QGATVSDEA

SEQ ID NO: 3061047 - protein, 6 aa, Giardia lamblia
QGDGLQ

SEQ ID NO: 3061048 - protein, 7 aa, Giardia lamblia
QGDKRQW

SEQ ID NO: 3061049 - protein, 9 aa, Giardia lamblia
QGDKSSALS

SEQ ID NO: 3061050 - protein, 4 aa, Giardia lamblia
QGDP

SEQ ID NO: 3061051 - protein, 8 aa, Giardia lamblia
QGDPTDEY

SEQ ID NO: 3061052 - protein, 13 aa, Giardia lamblia
QGECPPEETIEGA

SEQ ID NO: 3061053 - protein, 4 aa, Giardia lamblia
QGEI

SEQ ID NO: 3061054 - protein, 13 aa, Giardia lamblia
QGEQLSKTSAPLG

SEQ ID NO: 3061055 - protein, 8 aa, Giardia lamblia
QGESPDEI

SEQ ID NO: 3061056 - protein, 9 aa, Giardia lamblia
QGESPDLQK

SEQ ID NO: 3061057 - protein, 4 aa, Giardia lamblia
QGEV

SEQ ID NO: 3061058 - protein, 5 aa, Giardia lamblia
QGFPG

SEQ ID NO: 3061059 - protein, 10 aa, Giardia lamblia
QGFPPPPSDA

SEQ ID NO: 3061060 - protein, 4 aa, Giardia lamblia
QGFQ

SEQ ID NO: 3061061 - protein, 17 aa, Giardia lamblia
QGHGSGRGRISSSNKSY

SEQ ID NO: 3061062 - protein, 4 aa, Giardia lamblia
QGHS

SEQ ID NO: 3061063 - protein, 6 aa, Giardia lamblia
QGHYGA

SEQ ID NO: 3061064 - protein, 8 aa, Giardia lamblia
QGIDAPQS

SEQ ID NO: 3061065 - protein, 18 aa, Giardia lamblia
QGIPDSSTVSVPNSQHGE

SEQ ID NO: 3061066 - protein, 13 aa, Giardia lamblia
QGISDNQSPICEG

SEQ ID NO: 3061067 - protein, 5 aa, Giardia lamblia
QGISP

SEQ ID NO: 3061068 - protein, 7 aa, Giardia lamblia
QGKCTQW

SEQ ID NO: 3061069 - protein, 9 aa, Giardia lamblia
QGKEYLSSS

SEQ ID NO: 3061070 - protein, 10 aa, Giardia lamblia
QGLADTGVTE

SEQ ID NO: 3061071 - protein, 7 aa, Giardia lamblia
QGLGPQQ

SEQ ID NO: 3061072 - protein, 10 aa, Giardia lamblia
QGLNSKMPNR

SEQ ID NO: 3061073 - protein, 8 aa, Giardia lamblia
QGLPGTLA

SEQ ID NO: 3061074 - protein, 13 aa, Giardia lamblia
QGLQQSLKPSSTT

SEQ ID NO: 3061075 - protein, 5 aa, Giardia lamblia
QGLSD

SEQ ID NO: 3061076 - protein, 6 aa, Giardia lamblia
QGLTPT

SEQ ID NO: 3061077 - protein, 14 aa, Giardia lamblia
QGMRTGNSPLPCQE

SEQ ID NO: 3061078 - protein, 7 aa, Giardia lamblia
QGNCEEV

SEQ ID NO: 3061079 - protein, 11 aa, Giardia lamblia
QGNKEKGSIPC

SEQ ID NO: 3061080 - protein, 7 aa, Giardia lamblia
QGNSLQT

SEQ ID NO: 3061081 - protein, 5 aa, Giardia lamblia
QGPEI

SEQ ID NO: 3061082 - protein, 7 aa, Giardia lamblia
QGPKTAH

SEQ ID NO: 3061083 - protein, 5 aa, Giardia lamblia
QGPVS

SEQ ID NO: 3061084 - protein, 4 aa, Giardia lamblia
QGQA

SEQ ID NO: 3061085 - protein, 8 aa, Giardia lamblia
QGQAPVAR

SEQ ID NO: 3061086 - protein, 13 aa, Giardia lamblia
QGQDSKSCNSPTS

SEQ ID NO: 3061087 - protein, 9 aa, Giardia lamblia
QGQEEPADV

SEQ ID NO: 3061088 - protein, 10 aa, Giardia lamblia
QGRASEPYAL

SEQ ID NO: 3061089 - protein, 7 aa, Giardia lamblia
QGRDAQT

SEQ ID NO: 3061090 - protein, 19 aa, Giardia lamblia
QGRETEHAPRRYTPPPVPA

SEQ ID NO: 3061091 - protein, 6 aa, Giardia lamblia
QGRRTS

SEQ ID NO: 3061092 - protein, 9 aa, Giardia lamblia
QGRSDQTIR

SEQ ID NO: 3061093 - protein, 5 aa, Giardia lamblia
QGRSR

SEQ ID NO: 3061094 - protein, 10 aa, Giardia lamblia
QGSCKETTTG

SEQ ID NO: 3061095 - protein, 8 aa, Giardia lamblia
QGSINEAT

SEQ ID NO: 3061096 - protein, 7 aa, Giardia lamblia
QGSIPPS

SEQ ID NO: 3061097 - protein, 6 aa, Giardia lamblia
QGSLRE

SEQ ID NO: 3061098 - protein, 10 aa, Giardia lamblia
QGSLSSAASD

SEQ ID NO: 3061099 - protein, 8 aa, Giardia lamblia
QGSNYGAG

SEQ ID NO: 3061100 - protein, 5 aa, Giardia lamblia
QGSPP

SEQ ID NO: 3061101 - protein, 6 aa, Giardia lamblia
QGSPSN

SEQ ID NO: 3061102 - protein, 8 aa, Giardia lamblia
QGSPSNTH

SEQ ID NO: 3061103 - protein, 8 aa, Giardia lamblia
QGSSGDFF

SEQ ID NO: 3061104 - protein, 10 aa, Giardia lamblia
QGSSGEQPAF

SEQ ID NO: 3061105 - protein, 11 aa, Giardia lamblia
QGSSPRQFTNK

SEQ ID NO: 3061106 - protein, 19 aa, Giardia lamblia
QGSVTEQGHADIKRPKENN

SEQ ID NO: 3061107 - protein, 11 aa, Giardia lamblia
QGSYGAKSPVE

SEQ ID NO: 3061108 - protein, 8 aa, Giardia lamblia
QGSYKSAN

SEQ ID NO: 3061109 - protein, 7 aa, Giardia lamblia
QGTCRDT

SEQ ID NO: 3061110 - protein, 9 aa, Giardia lamblia
QGTECSGNG

SEQ ID NO: 3061111 - protein, 6 aa, Giardia lamblia
QGTGSA

SEQ ID NO: 3061112 - protein, 10 aa, Giardia lamblia
QGTNAGNFGG

SEQ ID NO: 3061113 - protein, 10 aa, Giardia lamblia
QGTPPAANKY

SEQ ID NO: 3061114 - protein, 10 aa, Giardia lamblia
QGTQKSKTKQ

SEQ ID NO: 3061115 - protein, 8 aa, Giardia lamblia
QGTRDSLL

SEQ ID NO: 3061116 - protein, 15 aa, Giardia lamblia
QGTRDSTDSSDPDNC

SEQ ID NO: 3061117 - protein, 5 aa, Giardia lamblia
QGVDH

SEQ ID NO: 3061118 - protein, 7 aa, Giardia lamblia
QGYNEKS

SEQ ID NO: 3061119 - protein, 12 aa, Giardia lamblia
QGYTESGADVQD

SEQ ID NO: 3061120 - protein, 13 aa, Giardia lamblia
QGYYNKQGQCAPC

SEQ ID NO: 3061121 - protein, 29 aa, Giardia lamblia
QGYYSTQSSVSAPSDCRPCDDATSQNGFT

SEQ ID NO: 3061122 - protein, 6 aa, Giardia lamblia
QHAGTG

SEQ ID NO: 3061123 - protein, 20 aa, Giardia lamblia
QHAKAPLISPEAADDSITPR

SEQ ID NO: 3061124 - protein, 9 aa, Giardia lamblia
QHAPTEDSY

SEQ ID NO: 3061125 - protein, 4 aa, Giardia lamblia
QHEG

SEQ ID NO: 3061126 - protein, 7 aa, Giardia lamblia
QHGSMDT

SEQ ID NO: 3061127 - protein, 34 aa, Giardia lamblia
QHHQSQKQSSSGLLNQESNDGDLYTTTGLGSTSE

SEQ ID NO: 3061128 - protein, 23 aa, Giardia lamblia
QHPPPQSSYEEDGRRPPTQPAHT

SEQ ID NO: 3061129 - protein, 7 aa, Giardia lamblia
QHQDNYN

SEQ ID NO: 3061130 - protein, 10 aa, Giardia lamblia
QHQQTKYVSQ

SEQ ID NO: 3061131 - protein, 9 aa, Giardia lamblia
QHRSGSLDG

SEQ ID NO: 3061132 - protein, 22 aa, Giardia lamblia
QHSDQDSEEDQAKQLVPQKTNT

SEQ ID NO: 3061133 - protein, 13 aa, Giardia lamblia
QHSEESESSDKSL

SEQ ID NO: 3061134 - protein, 9 aa, Giardia lamblia
QHSSTSPYV

SEQ ID NO: 3061135 - protein, 5 aa, Giardia lamblia
QHTGN

SEQ ID NO: 3061136 - protein, 11 aa, Giardia lamblia
QHTNTQGSLQQ

SEQ ID NO: 3061137 - protein, 6 aa, Giardia lamblia
QHTSEK

SEQ ID NO: 3061138 - protein, 4 aa, Giardia lamblia
QHYD

SEQ ID NO: 3061139 - protein, 15 aa, Giardia lamblia
QIDPNACGSCSSGRF

SEQ ID NO: 3061140 - protein, 4 aa, Giardia lamblia
QIHP

SEQ ID NO: 3061141 - protein, 8 aa, Giardia lamblia
QIKESPGK

SEQ ID NO: 3061142 - protein, 6 aa, Giardia lamblia
QINEYS

SEQ ID NO: 3061143 - protein, 7 aa, Giardia lamblia
QINPESR

SEQ ID NO: 3061144 - protein, 8 aa, Giardia lamblia
QINPSTQE

SEQ ID NO: 3061145 - protein, 5 aa, Giardia lamblia
QIPAD

SEQ ID NO: 3061146 - protein, 18 aa, Giardia lamblia
QIPASNADTSISFTDDEN

SEQ ID NO: 3061147 - protein, 6 aa, Giardia lamblia
QIPTQS

SEQ ID NO: 3061148 - protein, 14 aa, Giardia lamblia
QIQDSEAIQAWLSE

SEQ ID NO: 3061149 - protein, 5 aa, Giardia lamblia
QIRAG

SEQ ID NO: 3061150 - protein, 15 aa, Giardia lamblia
QIRKKSSSKAVTSKT

SEQ ID NO: 3061151 - protein, 7 aa, Giardia lamblia
QIRPQSA

SEQ ID NO: 3061152 - protein, 6 aa, Giardia lamblia
QISGSL

SEQ ID NO: 3061153 - protein, 10 aa, Giardia lamblia
QISNSGSNTI

SEQ ID NO: 3061154 - protein, 12 aa, Giardia lamblia
QISPPQQSKDKE

SEQ ID NO: 3061155 - protein, 10 aa, Giardia lamblia
QISPSEAKTT

SEQ ID NO: 3061156 - protein, 7 aa, Giardia lamblia
QISSTRR

SEQ ID NO: 3061157 - protein, 8 aa, Giardia lamblia
QISTGTRS

SEQ ID NO: 3061158 - protein, 11 aa, Giardia lamblia
QITSTDTSVPA

SEQ ID NO: 3061159 - protein, 5 aa, Giardia lamblia
QKAAH

SEQ ID NO: 3061160 - protein, 8 aa, Giardia lamblia
QKANTSYP

SEQ ID NO: 3061161 - protein, 6 aa, Giardia lamblia
QKAPDS

SEQ ID NO: 3061162 - protein, 6 aa, Giardia lamblia
QKDAEV

SEQ ID NO: 3061163 - protein, 8 aa, Giardia lamblia
QKDEENNA

SEQ ID NO: 3061164 - protein, 31 aa, Giardia lamblia
QKDEGDSTDTTSDTSGSDMPPSSKEPDHPVP

SEQ ID NO: 3061165 - protein, 10 aa, Giardia lamblia
QKDKSGPKQE

SEQ ID NO: 3061166 - protein, 8 aa, Giardia lamblia
QKDNQQAS

SEQ ID NO: 3061167 - protein, 6 aa, Giardia lamblia
QKDSEV

SEQ ID NO: 3061168 - protein, 7 aa, Giardia lamblia
QKDTCAT

SEQ ID NO: 3061169 - protein, 29 aa, Giardia lamblia
QKEELEREKAEQKAAEGSKCCSCGSCGCG

SEQ ID NO: 3061170 - protein, 8 aa, Giardia lamblia
QKEMPEKS

SEQ ID NO: 3061171 - protein, 17 aa, Giardia lamblia
QKENDTISKPAKPKSAC

SEQ ID NO: 3061172 - protein, 5 aa, Giardia lamblia
QKESR

SEQ ID NO: 3061173 - protein, 5 aa, Giardia lamblia
QKETV

SEQ ID NO: 3061174 - protein, 11 aa, Giardia lamblia
QKEVQKQIEKQ

SEQ ID NO: 3061175 - protein, 7 aa, Giardia lamblia
QKFSTTS

SEQ ID NO: 3061176 - protein, 15 aa, Giardia lamblia
QKGADGCTSTDKTTS

SEQ ID NO: 3061177 - protein, 7 aa, Giardia lamblia
QKGDTDL

SEQ ID NO: 3061178 - protein, 4 aa, Giardia lamblia
QKGE

SEQ ID NO: 3061179 - protein, 7 aa, Giardia lamblia
QKGEAQL

SEQ ID NO: 3061180 - protein, 7 aa, Giardia lamblia
QKGHIDE

SEQ ID NO: 3061181 - protein, 11 aa, Giardia lamblia
QKGKGSLAQIP

SEQ ID NO: 3061182 - protein, 18 aa, Giardia lamblia
QKGPAKQKMQRPETPLGA

SEQ ID NO: 3061183 - protein, 8 aa, Giardia lamblia
QKGRDTKS

SEQ ID NO: 3061184 - protein, 27 aa, Giardia lamblia
QKGSSEPHHNSQEESSGAHASSGEQVD

SEQ ID NO: 3061185 - protein, 16 aa, Giardia lamblia
QKGTSPKNKSSAHSGI

SEQ ID NO: 3061186 - protein, 4 aa, Giardia lamblia
QKGY

SEQ ID NO: 3061187 - protein, 9 aa, Giardia lamblia
QKHKATSPF

SEQ ID NO: 3061188 - protein, 6 aa, Giardia lamblia
QKHLPE

SEQ ID NO: 3061189 - protein, 15 aa, Giardia lamblia
QKIEPDAAPKAKKEV

SEQ ID NO: 3061190 - protein, 10 aa, Giardia lamblia
QKIKETPSVM

SEQ ID NO: 3061191 - protein, 7 aa, Giardia lamblia
QKKKTGI

SEQ ID NO: 3061192 - protein, 9 aa, Giardia lamblia
QKKNRSQVS

SEQ ID NO: 3061193 - protein, 7 aa, Giardia lamblia
QKKQENV

SEQ ID NO: 3061194 - protein, 10 aa, Giardia lamblia
QKKQSQYGYN

SEQ ID NO: 3061195 - protein, 9 aa, Giardia lamblia
QKKSKRAYT

SEQ ID NO: 3061196 - protein, 4 aa, Giardia lamblia
QKKT

SEQ ID NO: 3061197 - protein, 36 aa, Giardia lamblia
QKLGGASRGSSPTKKTGPHASNAAKGQNSGHTQVKP

SEQ ID NO: 3061198 - protein, 6 aa, Giardia lamblia
QKLSED

SEQ ID NO: 3061199 - protein, 5 aa, Giardia lamblia
QKMQR

SEQ ID NO: 3061200 - protein, 9 aa, Giardia lamblia
QKNEGKDSC

SEQ ID NO: 3061201 - protein, 20 aa, Giardia lamblia
QKNMEPTSVDTNPECVEYET

SEQ ID NO: 3061202 - protein, 5 aa, Giardia lamblia
QKPFE

SEQ ID NO: 3061203 - protein, 13 aa, Giardia lamblia
QKPNISPDRERIE

SEQ ID NO: 3061204 - protein, 11 aa, Giardia lamblia
QKQLNSRPPRI

SEQ ID NO: 3061205 - protein, 4 aa, Giardia lamblia
QKRA

SEQ ID NO: 3061206 - protein, 4 aa, Giardia lamblia
QKRN

SEQ ID NO: 3061207 - protein, 30 aa, Giardia lamblia
QKRQKAAKQSATDEEGHSDNSLNSTTSPTC

SEQ ID NO: 3061208 - protein, 29 aa, Giardia lamblia
QKRSSAPIKPNSGILQPEGTSLLSTPGSF

SEQ ID NO: 3061209 - protein, 12 aa, Giardia lamblia
QKRYDDSENTDE

SEQ ID NO: 3061210 - protein, 25 aa, Giardia lamblia
QKSEGAPTDDSESTPFTSKGAKAIY

SEQ ID NO: 3061211 - protein, 13 aa, Giardia lamblia
QKSEINEHEYPQD

SEQ ID NO: 3061212 - protein, 8 aa, Giardia lamblia
QKSETGYP

SEQ ID NO: 3061213 - protein, 11 aa, Giardia lamblia
QKSGVSAEANS

SEQ ID NO: 3061214 - protein, 5 aa, Giardia lamblia
QKSIR

SEQ ID NO: 3061215 - protein, 12 aa, Giardia lamblia
QKSLKTAWKNAG

SEQ ID NO: 3061216 - protein, 8 aa, Giardia lamblia
QKSNYAKQ

SEQ ID NO: 3061217 - protein, 7 aa, Giardia lamblia
QKSPEMA

SEQ ID NO: 3061218 - protein, 8 aa, Giardia lamblia
QKSPSGGI

SEQ ID NO: 3061219 - protein, 6 aa, Giardia lamblia
QKSSGF

SEQ ID NO: 3061220 - protein, 12 aa, Giardia lamblia
QKSSRNNPHTSF

SEQ ID NO: 3061221 - protein, 15 aa, Giardia lamblia
QKTPGKTKKLGGPMS

SEQ ID NO: 3061222 - protein, 8 aa, Giardia lamblia
QKTSMKDS

SEQ ID NO: 3061223 - protein, 12 aa, Giardia lamblia
QKTSQDSSPSLF

SEQ ID NO: 3061224 - protein, 6 aa, Giardia lamblia
QKTYQG

SEQ ID NO: 3061225 - protein, 7 aa, Giardia lamblia
QKVDGEA

SEQ ID NO: 3061226 - protein, 21 aa, Giardia lamblia
QKYPGASSPPCTPDDPASPTR

SEQ ID NO: 3061227 - protein, 21 aa, Giardia lamblia
QKYPGASSSPCTPDDPASPTR

SEQ ID NO: 3061228 - protein, 9 aa, Giardia lamblia
QLAEGSDQV

SEQ ID NO: 3061229 - protein, 9 aa, Giardia lamblia
QLAGGGSVG

SEQ ID NO: 3061230 - protein, 9 aa, Giardia lamblia
QLAPQGADA

SEQ ID NO: 3061231 - protein, 6 aa, Giardia lamblia
QLCGGS

SEQ ID NO: 3061232 - protein, 7 aa, Giardia lamblia
QLDGETD

SEQ ID NO: 3061233 - protein, 13 aa, Giardia lamblia
QLEEERAKASAFE

SEQ ID NO: 3061234 - protein, 13 aa, Giardia lamblia
QLEEQTGKLSKSV

SEQ ID NO: 3061235 - protein, 8 aa, Giardia lamblia
QLEPDDPG

SEQ ID NO: 3061236 - protein, 5 aa, Giardia lamblia
QLESE

SEQ ID NO: 3061237 - protein, 12 aa, Giardia lamblia
QLGDGSSTLPLG

SEQ ID NO: 3061238 - protein, 4 aa, Giardia lamblia
QLGG

SEQ ID NO: 3061239 - protein, 5 aa, Giardia lamblia
QLGNE

SEQ ID NO: 3061240 - protein, 8 aa, Giardia lamblia
QLGSQDAY

SEQ ID NO: 3061241 - protein, 7 aa, Giardia lamblia
QLKGSPS

SEQ ID NO: 3061242 - protein, 15 aa, Giardia lamblia
QLKSPTSALQKAHQS

SEQ ID NO: 3061243 - protein, 13 aa, Giardia lamblia
QLNGERNYNSTRA

SEQ ID NO: 3061244 - protein, 6 aa, Giardia lamblia
QLPDEF

SEQ ID NO: 3061245 - protein, 10 aa, Giardia lamblia
QLPPDNPRSV

SEQ ID NO: 3061246 - protein, 8 aa, Giardia lamblia
QLPPEVES

SEQ ID NO: 3061247 - protein, 13 aa, Giardia lamblia
QLPQTADVSTNHL

SEQ ID NO: 3061248 - protein, 12 aa, Giardia lamblia
QLPSEFTETHPN

SEQ ID NO: 3061249 - protein, 5 aa, Giardia lamblia
QLPTY

SEQ ID NO: 3061250 - protein, 8 aa, Giardia lamblia
QLQADNDA

SEQ ID NO: 3061251 - protein, 12 aa, Giardia lamblia
QLQDNVKDTIQS

SEQ ID NO: 3061252 - protein, 7 aa, Giardia lamblia
QLQRSER

SEQ ID NO: 3061253 - protein, 11 aa, Giardia lamblia
QLRNDKGASSK

SEQ ID NO: 3061254 - protein, 9 aa, Giardia lamblia
QLRSPRQDL

SEQ ID NO: 3061255 - protein, 5 aa, Giardia lamblia
QLSAR

SEQ ID NO: 3061256 - protein, 4 aa, Giardia lamblia
QLSG

SEQ ID NO: 3061257 - protein, 14 aa, Giardia lamblia
QLSGGSCAPCPDDS

SEQ ID NO: 3061258 - protein, 4 aa, Giardia lamblia
QLSH

SEQ ID NO: 3061259 - protein, 4 aa, Giardia lamblia
QLSK

SEQ ID NO: 3061260 - protein, 9 aa, Giardia lamblia
QLSPPPPRI

SEQ ID NO: 3061261 - protein, 5 aa, Giardia lamblia
QLSPS

SEQ ID NO: 3061262 - protein, 24 aa, Giardia lamblia
QLSPSERASMAKGYTKSMNRTKSA

SEQ ID NO: 3061263 - protein, 10 aa, Giardia lamblia
QLSTNTKLET

SEQ ID NO: 3061264 - protein, 9 aa, Giardia lamblia
QLSYDADGY

SEQ ID NO: 3061265 - protein, 24 aa, Giardia lamblia
QLTDEGRCEPCPEGTSGNNCRQKQ

SEQ ID NO: 3061266 - protein, 10 aa, Giardia lamblia
QLTDSSGSDM

SEQ ID NO: 3061267 - protein, 13 aa, Giardia lamblia
QLTGSRRKGIDPE

SEQ ID NO: 3061268 - protein, 8 aa, Giardia lamblia
QLTKSTIE

SEQ ID NO: 3061269 - protein, 14 aa, Giardia lamblia
QLTSDSGSGTMDGM

SEQ ID NO: 3061270 - protein, 15 aa, Giardia lamblia
QLYSGNDHGHEHKDT

SEQ ID NO: 3061271 - protein, 5 aa, Giardia lamblia
QMAAS

SEQ ID NO: 3061272 - protein, 12 aa, Giardia lamblia
QMATTSNTKRPL

SEQ ID NO: 3061273 - protein, 6 aa, Giardia lamblia
QMDPTQ

SEQ ID NO: 3061274 - protein, 10 aa, Giardia lamblia
QMTNSNKESS

SEQ ID NO: 3061275 - protein, 13 aa, Giardia lamblia
QNAATKANLGEHR

SEQ ID NO: 3061276 - protein, 5 aa, Giardia lamblia
QNAQT

SEQ ID NO: 3061277 - protein, 21 aa, Giardia lamblia
QNASSKESEKVATARAAKVAS

SEQ ID NO: 3061278 - protein, 5 aa, Giardia lamblia
QNDIG

SEQ ID NO: 3061279 - protein, 5 aa, Giardia lamblia
QNDSH

SEQ ID NO: 3061280 - protein, 8 aa, Giardia lamblia
QNEASSGM

SEQ ID NO: 3061281 - protein, 33 aa, Giardia lamblia
QNEEPLGSKELENSNGNIASSTDNQKPPSTSDR

SEQ ID NO: 3061282 - protein, 6 aa, Giardia lamblia
QNENRL

SEQ ID NO: 3061283 - protein, 17 aa, Giardia lamblia
QNERNANADPGVEGTAD

SEQ ID NO: 3061284 - protein, 6 aa, Giardia lamblia
QNFASN

SEQ ID NO: 3061285 - protein, 12 aa, Giardia lamblia
QNFEEDSKNDVE

SEQ ID NO: 3061286 - protein, 7 aa, Giardia lamblia
QNFSDSR

SEQ ID NO: 3061287 - protein, 9 aa, Giardia lamblia
QNGAGKSTS

SEQ ID NO: 3061288 - protein, 7 aa, Giardia lamblia
QNGKDVD

SEQ ID NO: 3061289 - protein, 15 aa, Giardia lamblia
QNGPNKVPEPKKPNG

SEQ ID NO: 3061290 - protein, 6 aa, Giardia lamblia
QNIAEE

SEQ ID NO: 3061291 - protein, 6 aa, Giardia lamblia
QNINPG

SEQ ID NO: 3061292 - protein, 8 aa, Giardia lamblia
QNKKAVSY

SEQ ID NO: 3061293 - protein, 7 aa, Giardia lamblia
QNKTSYA

SEQ ID NO: 3061294 - protein, 25 aa, Giardia lamblia
QNLSSASTKELNSVKKQSDIETQQV

SEQ ID NO: 3061295 - protein, 8 aa, Giardia lamblia
QNNNGDTA

SEQ ID NO: 3061296 - protein, 4 aa, Giardia lamblia
QNPD

SEQ ID NO: 3061297 - protein, 8 aa, Giardia lamblia
QNPDSSVS

SEQ ID NO: 3061298 - protein, 7 aa, Giardia lamblia
QNPEDPL

SEQ ID NO: 3061299 - protein, 13 aa, Giardia lamblia
QNPEERATADELA

SEQ ID NO: 3061300 - protein, 6 aa, Giardia lamblia
QNPQAI

SEQ ID NO: 3061301 - protein, 4 aa, Giardia lamblia
QNPS

SEQ ID NO: 3061302 - protein, 10 aa, Giardia lamblia
QNPSGSYAGR

SEQ ID NO: 3061303 - protein, 15 aa, Giardia lamblia
QNSAASLSQEALGTT

SEQ ID NO: 3061304 - protein, 9 aa, Giardia lamblia
QNSAATPTV

SEQ ID NO: 3061305 - protein, 5 aa, Giardia lamblia
QNSAK

SEQ ID NO: 3061306 - protein, 10 aa, Giardia lamblia
QNSDCGGATG

SEQ ID NO: 3061307 - protein, 18 aa, Giardia lamblia
QNSHPPLAKTTAKDVQHS

SEQ ID NO: 3061308 - protein, 5 aa, Giardia lamblia
QNSIS

SEQ ID NO: 3061309 - protein, 10 aa, Giardia lamblia
QNSLDTAKES

SEQ ID NO: 3061310 - protein, 7 aa, Giardia lamblia
QNSLPSN

SEQ ID NO: 3061311 - protein, 9 aa, Giardia lamblia
QNSRADLES

SEQ ID NO: 3061312 - protein, 8 aa, Giardia lamblia
QNSTSNAY

SEQ ID NO: 3061313 - protein, 17 aa, Giardia lamblia
QNTGSIEAREKTVAGDA

SEQ ID NO: 3061314 - protein, 7 aa, Giardia lamblia
QNTNPRD

SEQ ID NO: 3061315 - protein, 7 aa, Giardia lamblia
QNTQSTL

SEQ ID NO: 3061316 - protein, 16 aa, Giardia lamblia
QNTRPNACGNGTVSSM

SEQ ID NO: 3061317 - protein, 6 aa, Giardia lamblia
QNVTSQ

SEQ ID NO: 3061318 - protein, 4 aa, Giardia lamblia
QNYR

SEQ ID NO: 3061319 - protein, 8 aa, Giardia lamblia
QPAAINSP

SEQ ID NO: 3061320 - protein, 4 aa, Giardia lamblia
QPAI

SEQ ID NO: 3061321 - protein, 18 aa, Giardia lamblia
QPALESDDNESSSNESIA

SEQ ID NO: 3061322 - protein, 9 aa, Giardia lamblia
QPAQSNVPE

SEQ ID NO: 3061323 - protein, 18 aa, Giardia lamblia
QPATAAGDAQGDDDDPAV

SEQ ID NO: 3061324 - protein, 7 aa, Giardia lamblia
QPATDGK

SEQ ID NO: 3061325 - protein, 4 aa, Giardia lamblia
QPDA

SEQ ID NO: 3061326 - protein, 5 aa, Giardia lamblia
QPDAK

SEQ ID NO: 3061327 - protein, 4 aa, Giardia lamblia
QPDE

SEQ ID NO: 3061328 - protein, 4 aa, Giardia lamblia
QPDF

SEQ ID NO: 3061329 - protein, 6 aa, Giardia lamblia
QPDFNT

SEQ ID NO: 3061330 - protein, 5 aa, Giardia lamblia
QPDGA

SEQ ID NO: 3061331 - protein, 27 aa, Giardia lamblia
QPEDSSHPGSNFDTVTSSNKSDPTIQP

SEQ ID NO: 3061332 - protein, 4 aa, Giardia lamblia
QPEG

SEQ ID NO: 3061333 - protein, 4 aa, Giardia lamblia
QPEM

SEQ ID NO: 3061334 - protein, 7 aa, Giardia lamblia
QPEQTSI

SEQ ID NO: 3061335 - protein, 12 aa, Giardia lamblia
QPESSFKKVSPE

SEQ ID NO: 3061336 - protein, 4 aa, Giardia lamblia
QPEY

SEQ ID NO: 3061337 - protein, 4 aa, Giardia lamblia
QPFS

SEQ ID NO: 3061338 - protein, 5 aa, Giardia lamblia
QPGEF

SEQ ID NO: 3061339 - protein, 10 aa, Giardia lamblia
QPGHPGGSAA

SEQ ID NO: 3061340 - protein, 9 aa, Giardia lamblia
QPGQERRMS

SEQ ID NO: 3061341 - protein, 11 aa, Giardia lamblia
QPGRGSSRGPS

SEQ ID NO: 3061342 - protein, 7 aa, Giardia lamblia
QPGSAGK

SEQ ID NO: 3061343 - protein, 6 aa, Giardia lamblia
QPGSTH

SEQ ID NO: 3061344 - protein, 7 aa, Giardia lamblia
QPGTKNY

SEQ ID NO: 3061345 - protein, 4 aa, Giardia lamblia
QPHT

SEQ ID NO: 3061346 - protein, 5 aa, Giardia lamblia
QPISL

SEQ ID NO: 3061347 - protein, 8 aa, Giardia lamblia
QPKAKDLK

SEQ ID NO: 3061348 - protein, 7 aa, Giardia lamblia
QPKHREK

SEQ ID NO: 3061349 - protein, 16 aa, Giardia lamblia
QPKKGEKLPRTPAEDF

SEQ ID NO: 3061350 - protein, 7 aa, Giardia lamblia
QPKLTPD

SEQ ID NO: 3061351 - protein, 6 aa, Giardia lamblia
QPKSYY

SEQ ID NO: 3061352 - protein, 6 aa, Giardia lamblia
QPKYSV

SEQ ID NO: 3061353 - protein, 5 aa, Giardia lamblia
QPLPN

SEQ ID NO: 3061354 - protein, 16 aa, Giardia lamblia
QPLSDDSEYKSTQSPI

SEQ ID NO: 3061355 - protein, 6 aa, Giardia lamblia
QPLTNS

SEQ ID NO: 3061356 - protein, 8 aa, Giardia lamblia
QPNAQQPV

SEQ ID NO: 3061357 - protein, 10 aa, Giardia lamblia
QPPAPQDPQV

SEQ ID NO: 3061358 - protein, 6 aa, Giardia lamblia
QPPDGH

SEQ ID NO: 3061359 - protein, 7 aa, Giardia lamblia
QPPIQPA

SEQ ID NO: 3061360 - protein, 6 aa, Giardia lamblia
QPPTSY

SEQ ID NO: 3061361 - protein, 7 aa, Giardia lamblia
QPPVPDR

SEQ ID NO: 3061362 - protein, 11 aa, Giardia lamblia
QPQAGQRTVGG

SEQ ID NO: 3061363 - protein, 5 aa, Giardia lamblia
QPQLS

SEQ ID NO: 3061364 - protein, 24 aa, Giardia lamblia
QPRLSDPRTSLQNDNEDVGSPPRC

SEQ ID NO: 3061365 - protein, 5 aa, Giardia lamblia
QPRMR

SEQ ID NO: 3061366 - protein, 7 aa, Giardia lamblia
QPRVSHT

SEQ ID NO: 3061367 - protein, 10 aa, Giardia lamblia
QPRYATEPDW

SEQ ID NO: 3061368 - protein, 9 aa, Giardia lamblia
QPSEPPSRR

SEQ ID NO: 3061369 - protein, 5 aa, Giardia lamblia
QPSGL

SEQ ID NO: 3061370 - protein, 40 aa, Giardia lamblia
QPSIASRDDDASLSHQPGNSTLSSQTPIKETNDTTKQARA

SEQ ID NO: 3061371 - protein, 15 aa, Giardia lamblia
QPSKDPEVSVASAPT

SEQ ID NO: 3061372 - protein, 5 aa, Giardia lamblia
QPSKG

SEQ ID NO: 3061373 - protein, 6 aa, Giardia lamblia
QPSLDQ

SEQ ID NO: 3061374 - protein, 18 aa, Giardia lamblia
QPSNPTVRGSGMSAGQTA

SEQ ID NO: 3061375 - protein, 14 aa, Giardia lamblia
QPSPFDNQQSPPVG

SEQ ID NO: 3061376 - protein, 6 aa, Giardia lamblia
QPSPKA

SEQ ID NO: 3061377 - protein, 5 aa, Giardia lamblia
QPSPV

SEQ ID NO: 3061378 - protein, 9 aa, Giardia lamblia
QPSQSEHET

SEQ ID NO: 3061379 - protein, 11 aa, Giardia lamblia
QPSQVGTHVQS

SEQ ID NO: 3061380 - protein, 8 aa, Giardia lamblia
QPSSSAIE

SEQ ID NO: 3061381 - protein, 5 aa, Giardia lamblia
QPSTI

SEQ ID NO: 3061382 - protein, 10 aa, Giardia lamblia
QPTDSRGTEY

SEQ ID NO: 3061383 - protein, 7 aa, Giardia lamblia
QPTHPSV

SEQ ID NO: 3061384 - protein, 8 aa, Giardia lamblia
QPTLKSEA

SEQ ID NO: 3061385 - protein, 5 aa, Giardia lamblia
QPTND

SEQ ID NO: 3061386 - protein, 5 aa, Giardia lamblia
QPTSI

SEQ ID NO: 3061387 - protein, 12 aa, Giardia lamblia
QPVGVQGNAGSK

SEQ ID NO: 3061388 - protein, 4 aa, Giardia lamblia
QPVM

SEQ ID NO: 3061389 - protein, 7 aa, Giardia lamblia
QPVPSTE

SEQ ID NO: 3061390 - protein, 14 aa, Giardia lamblia
QPVRSKQQATRRPV

SEQ ID NO: 3061391 - protein, 9 aa, Giardia lamblia
QPVTGGKTT

SEQ ID NO: 3061392 - protein, 7 aa, Giardia lamblia
QPYAQTV

SEQ ID NO: 3061393 - protein, 5 aa, Giardia lamblia
QPYGG

SEQ ID NO: 3061394 - protein, 4 aa, Giardia lamblia
QPYN

SEQ ID NO: 3061395 - protein, 7 aa, Giardia lamblia
QPYNKGD

SEQ ID NO: 3061396 - protein, 9 aa, Giardia lamblia
QQAAAYDSG

SEQ ID NO: 3061397 - protein, 6 aa, Giardia lamblia
QQAQAG

SEQ ID NO: 3061398 - protein, 23 aa, Giardia lamblia
QQASPPSESNTEVALSPSALSSM

SEQ ID NO: 3061399 - protein, 10 aa, Giardia lamblia
QQASSGTQRV

SEQ ID NO: 3061400 - protein, 16 aa, Giardia lamblia
QQATPMHTSSGLGESA

SEQ ID NO: 3061401 - protein, 19 aa, Giardia lamblia
QQDNRPEERLDDGTVAPTD

SEQ ID NO: 3061402 - protein, 14 aa, Giardia lamblia
QQDPQAPAAKDARR

SEQ ID NO: 3061403 - protein, 10 aa, Giardia lamblia
QQDSTNNQFT

SEQ ID NO: 3061404 - protein, 9 aa, Giardia lamblia
QQEAGQDRA

SEQ ID NO: 3061405 - protein, 5 aa, Giardia lamblia
QQENC

SEQ ID NO: 3061406 - protein, 10 aa, Giardia lamblia
QQETGSSEPA

SEQ ID NO: 3061407 - protein, 5 aa, Giardia lamblia
QQEVT

SEQ ID NO: 3061408 - protein, 14 aa, Giardia lamblia
QQGGPLAVSAPTPS

SEQ ID NO: 3061409 - protein, 7 aa, Giardia lamblia
QQGHGGP

SEQ ID NO: 3061410 - protein, 17 aa, Giardia lamblia
QQGHKQTVNTADISSQD

SEQ ID NO: 3061411 - protein, 9 aa, Giardia lamblia
QQGQITTDG

SEQ ID NO: 3061412 - protein, 7 aa, Giardia lamblia
QQGTKDE

SEQ ID NO: 3061413 - protein, 6 aa, Giardia lamblia
QQHAPE

SEQ ID NO: 3061414 - protein, 4 aa, Giardia lamblia
QQIN

SEQ ID NO: 3061415 - protein, 6 aa, Giardia lamblia
QQKKVD

SEQ ID NO: 3061416 - protein, 5 aa, Giardia lamblia
QQLEQ

SEQ ID NO: 3061417 - protein, 8 aa, Giardia lamblia
QQLPSARY

SEQ ID NO: 3061418 - protein, 7 aa, Giardia lamblia
QQLRQQS

SEQ ID NO: 3061419 - protein, 8 aa, Giardia lamblia
QQLSTKEA

SEQ ID NO: 3061420 - protein, 11 aa, Giardia lamblia
QQNDGAVHQGL

SEQ ID NO: 3061421 - protein, 7 aa, Giardia lamblia
QQNEAAS

SEQ ID NO: 3061422 - protein, 11 aa, Giardia lamblia
QQNEKYTDRST

SEQ ID NO: 3061423 - protein, 5 aa, Giardia lamblia
QQNEN

SEQ ID NO: 3061424 - protein, 12 aa, Giardia lamblia
QQNKQQGSYSSR

SEQ ID NO: 3061425 - protein, 5 aa, Giardia lamblia
QQNLN

SEQ ID NO: 3061426 - protein, 13 aa, Giardia lamblia
QQNPEVDEHTESA

SEQ ID NO: 3061427 - protein, 9 aa, Giardia lamblia
QQPDTQKKL

SEQ ID NO: 3061428 - protein, 12 aa, Giardia lamblia
QQPGQAAPSDDL

SEQ ID NO: 3061429 - protein, 36 aa, Giardia lamblia
QQPKTEASSSSSDGSSNLLSGSSSACYTSSSLGDMQ

SEQ ID NO: 3061430 - protein, 11 aa, Giardia lamblia
QQPNNDNTGWS

SEQ ID NO: 3061431 - protein, 14 aa, Giardia lamblia
QQPPQVRQTAEQNE

SEQ ID NO: 3061432 - protein, 6 aa, Giardia lamblia
QQQDDS

SEQ ID NO: 3061433 - protein, 7 aa, Giardia lamblia
QQQDLRP

SEQ ID NO: 3061434 - protein, 15 aa, Giardia lamblia
QQQGSSGGAQGEGGK

SEQ ID NO: 3061435 - protein, 14 aa, Giardia lamblia
QQQIDSNIATSSMG

SEQ ID NO: 3061436 - protein, 18 aa, Giardia lamblia
QQQKAAKRRPDRAGSALR

SEQ ID NO: 3061437 - protein, 20 aa, Giardia lamblia
QQQNAEARGGPRLRSGRFDP

SEQ ID NO: 3061438 - protein, 11 aa, Giardia lamblia
QQQPPDPQPSL

SEQ ID NO: 3061439 - protein, 38 aa, Giardia lamblia
QQQPYAQAKPQDMEKLEQPSSQASSSKPAPQKQTRMQP

SEQ ID NO: 3061440 - protein, 35 aa, Giardia lamblia
QQQQQPDDQHASKKASTMARASSTINLGAQSSANI

SEQ ID NO: 3061441 - protein, 6 aa, Giardia lamblia
QQQQRS

SEQ ID NO: 3061442 - protein, 24 aa, Giardia lamblia
QQQRREKRKQQRAEKKRKAKESQI

SEQ ID NO: 3061443 - protein, 14 aa, Giardia lamblia
QQRAKGEKVDISAY

SEQ ID NO: 3061444 - protein, 13 aa, Giardia lamblia
QQRKSSDATSTEA

SEQ ID NO: 3061445 - protein, 4 aa, Giardia lamblia
QQSA

SEQ ID NO: 3061446 - protein, 13 aa, Giardia lamblia
QQSAAENAEQDRR

SEQ ID NO: 3061447 - protein, 9 aa, Giardia lamblia
QQSDPSSIQ

SEQ ID NO: 3061448 - protein, 35 aa, Giardia lamblia
QQSFEEQVAGGSRQSFTDRDDSLTQPSDSFSKTDE

SEQ ID NO: 3061449 - protein, 8 aa, Giardia lamblia
QQSGSADL

SEQ ID NO: 3061450 - protein, 31 aa, Giardia lamblia
QQSKGHSSDGSITAEPTDAPLDPIASEDTLG

SEQ ID NO: 3061451 - protein, 4 aa, Giardia lamblia
QQSN

SEQ ID NO: 3061452 - protein, 10 aa, Giardia lamblia
QQSNGACQKC

SEQ ID NO: 3061453 - protein, 8 aa, Giardia lamblia
QQSNTSMG

SEQ ID NO: 3061454 - protein, 13 aa, Giardia lamblia
QQSNVPSPTDNRC

SEQ ID NO: 3061455 - protein, 9 aa, Giardia lamblia
QQSPSDNAV

SEQ ID NO: 3061456 - protein, 19 aa, Giardia lamblia
QQSTLPDSEESQPHPGTSG

SEQ ID NO: 3061457 - protein, 21 aa, Giardia lamblia
QQSTLQISQRSKEKPKTSSLP

SEQ ID NO: 3061458 - protein, 7 aa, Giardia lamblia
QQSTQSG

SEQ ID NO: 3061459 - protein, 4 aa, Giardia lamblia
QQTA

SEQ ID NO: 3061460 - protein, 5 aa, Giardia lamblia
QQTEA

SEQ ID NO: 3061461 - protein, 11 aa, Giardia lamblia
QQTNAPDHIST

SEQ ID NO: 3061462 - protein, 8 aa, Giardia lamblia
QQTPSRIS

SEQ ID NO: 3061463 - protein, 8 aa, Giardia lamblia
QQTTAGQT

SEQ ID NO: 3061464 - protein, 7 aa, Giardia lamblia
QQTTDVT

SEQ ID NO: 3061465 - protein, 49 aa, Giardia lamblia
QQTTPQSTATPRDPEESGHGSETLATAEQKSHNNEQPTPQASPPSGPIS

SEQ ID NO: 3061466 - protein, 5 aa, Giardia lamblia
QQVQN

SEQ ID NO: 3061467 - protein, 8 aa, Giardia lamblia
QQYSTDRS

SEQ ID NO: 3061468 - protein, 5 aa, Giardia lamblia
QRAEE

SEQ ID NO: 3061469 - protein, 16 aa, Giardia lamblia
QRAEFNKSKDAGDFDE

SEQ ID NO: 3061470 - protein, 8 aa, Giardia lamblia
QRAHGGYR

SEQ ID NO: 3061471 - protein, 8 aa, Giardia lamblia
QRAKQELD

SEQ ID NO: 3061472 - protein, 9 aa, Giardia lamblia
QRAPSNNSF

SEQ ID NO: 3061473 - protein, 20 aa, Giardia lamblia
QRASEVSEYTEARLGNNGHA

SEQ ID NO: 3061474 - protein, 11 aa, Giardia lamblia
QRASNNHISEQ

SEQ ID NO: 3061475 - protein, 5 aa, Giardia lamblia
QRDAR

SEQ ID NO: 3061476 - protein, 4 aa, Giardia lamblia
QRDN

SEQ ID NO: 3061477 - protein, 5 aa, Giardia lamblia
QRDNV

SEQ ID NO: 3061478 - protein, 8 aa, Giardia lamblia
QRDSSDQA

SEQ ID NO: 3061479 - protein, 5 aa, Giardia lamblia
QRDVS

SEQ ID NO: 3061480 - protein, 8 aa, Giardia lamblia
QREDPVDQ

SEQ ID NO: 3061481 - protein, 7 aa, Giardia lamblia
QREGGPC

SEQ ID NO: 3061482 - protein, 7 aa, Giardia lamblia
QREPSTL

SEQ ID NO: 3061483 - protein, 6 aa, Giardia lamblia
QRESGI

SEQ ID NO: 3061484 - protein, 9 aa, Giardia lamblia
QRFRPRTRQ

SEQ ID NO: 3061485 - protein, 13 aa, Giardia lamblia
QRGASWTGEVEPE

SEQ ID NO: 3061486 - protein, 6 aa, Giardia lamblia
QRGCST

SEQ ID NO: 3061487 - protein, 15 aa, Giardia lamblia
QRGGEKAVIEYIRSK

SEQ ID NO: 3061488 - protein, 4 aa, Giardia lamblia
QRGR

SEQ ID NO: 3061489 - protein, 8 aa, Giardia lamblia
QRGSEGGL

SEQ ID NO: 3061490 - protein, 8 aa, Giardia lamblia
QRGSGKSR

SEQ ID NO: 3061491 - protein, 7 aa, Giardia lamblia
QRGTDGT

SEQ ID NO: 3061492 - protein, 12 aa, Giardia lamblia
QRHTKARPCDPE

SEQ ID NO: 3061493 - protein, 4 aa, Giardia lamblia
QRHV

SEQ ID NO: 3061494 - protein, 4 aa, Giardia lamblia
QRIA

SEQ ID NO: 3061495 - protein, 4 aa, Giardia lamblia
QRKE

SEQ ID NO: 3061496 - protein, 6 aa, Giardia lamblia
QRKITQ

SEQ ID NO: 3061497 - protein, 7 aa, Giardia lamblia
QRKSKDV

SEQ ID NO: 3061498 - protein, 5 aa, Giardia lamblia
QRKYA

SEQ ID NO: 3061499 - protein, 6 aa, Giardia lamblia
QRLPTD

SEQ ID NO: 3061500 - protein, 6 aa, Giardia lamblia
QRLSEG

SEQ ID NO: 3061501 - protein, 6 aa, Giardia lamblia
QRMPGD

SEQ ID NO: 3061502 - protein, 9 aa, Giardia lamblia
QRNPEQDIG

SEQ ID NO: 3061503 - protein, 4 aa, Giardia lamblia
QRNT

SEQ ID NO: 3061504 - protein, 12 aa, Giardia lamblia
QRNTSKETGAYD

SEQ ID NO: 3061505 - protein, 14 aa, Giardia lamblia
QRPDDESDSEGDSI

SEQ ID NO: 3061506 - protein, 17 aa, Giardia lamblia
QRPPEPTLAEGSHPPLI

SEQ ID NO: 3061507 - protein, 8 aa, Giardia lamblia
QRPQASTI

SEQ ID NO: 3061508 - protein, 7 aa, Giardia lamblia
QRPQVYE

SEQ ID NO: 3061509 - protein, 9 aa, Giardia lamblia
QRPTEDDAS

SEQ ID NO: 3061510 - protein, 15 aa, Giardia lamblia
QRQDTRASHGCRGCS

SEQ ID NO: 3061511 - protein, 5 aa, Giardia lamblia
QRQHD

SEQ ID NO: 3061512 - protein, 7 aa, Giardia lamblia
QRQLPNE

SEQ ID NO: 3061513 - protein, 11 aa, Giardia lamblia
QRQSQHKTRKL

SEQ ID NO: 3061514 - protein, 6 aa, Giardia lamblia
QRRDEF

SEQ ID NO: 3061515 - protein, 9 aa, Giardia lamblia
QRRENGKAA

SEQ ID NO: 3061516 - protein, 7 aa, Giardia lamblia
QRRSLPP

SEQ ID NO: 3061517 - protein, 13 aa, Giardia lamblia
QRRTKHRGKDGDI

SEQ ID NO: 3061518 - protein, 4 aa, Giardia lamblia
QRSA

SEQ ID NO: 3061519 - protein, 8 aa, Giardia lamblia
QRSQSTAA

SEQ ID NO: 3061520 - protein, 8 aa, Giardia lamblia
QRSSSINV

SEQ ID NO: 3061521 - protein, 11 aa, Giardia lamblia
QRSTSVSAEQR

SEQ ID NO: 3061522 - protein, 6 aa, Giardia lamblia
QRTGRE

SEQ ID NO: 3061523 - protein, 26 aa, Giardia lamblia
QRTHLSTPAVTLSGSRQEVDTDEHSY

SEQ ID NO: 3061524 - protein, 7 aa, Giardia lamblia
QRTREMN

SEQ ID NO: 3061525 - protein, 9 aa, Giardia lamblia
QRVTPEDKE

SEQ ID NO: 3061526 - protein, 17 aa, Giardia lamblia
QRYASKHPEQSVPLPGS

SEQ ID NO: 3061527 - protein, 9 aa, Giardia lamblia
QSAIPDEDG

SEQ ID NO: 3061528 - protein, 7 aa, Giardia lamblia
QSAPLSK

SEQ ID NO: 3061529 - protein, 46 aa, Giardia lamblia
QSASESASSSGVSSAKAQQQVGPASVKGRSDVSHDSKKAQKRNSKA

SEQ ID NO: 3061530 - protein, 7 aa, Giardia lamblia
QSASPSR

SEQ ID NO: 3061531 - protein, 28 aa, Giardia lamblia
QSASSKKASKRSSAKASRGSSKRESTVI

SEQ ID NO: 3061532 - protein, 8 aa, Giardia lamblia
QSATDEGL

SEQ ID NO: 3061533 - protein, 5 aa, Giardia lamblia
QSAYS

SEQ ID NO: 3061534 - protein, 12 aa, Giardia lamblia
QSCGTSALSPRE

SEQ ID NO: 3061535 - protein, 5 aa, Giardia lamblia
QSCPT

SEQ ID NO: 3061536 - protein, 9 aa, Giardia lamblia
QSDDEVPTR

SEQ ID NO: 3061537 - protein, 7 aa, Giardia lamblia
QSDEKGQ

SEQ ID NO: 3061538 - protein, 6 aa, Giardia lamblia
QSDESL

SEQ ID NO: 3061539 - protein, 17 aa, Giardia lamblia
QSDGATHEEVKSEAPHA

SEQ ID NO: 3061540 - protein, 6 aa, Giardia lamblia
QSDHDI

SEQ ID NO: 3061541 - protein, 4 aa, Giardia lamblia
QSDL

SEQ ID NO: 3061542 - protein, 19 aa, Giardia lamblia
QSDPNPAAMASPAKTDTEA

SEQ ID NO: 3061543 - protein, 7 aa, Giardia lamblia
QSDPPPR

SEQ ID NO: 3061544 - protein, 44 aa, Giardia lamblia
QSDQQQQEQCGEGSETFRNGKDDSGVSRDRYASMGQSMEQSRPI

SEQ ID NO: 3061545 - protein, 6 aa, Giardia lamblia
QSDREA

SEQ ID NO: 3061546 - protein, 6 aa, Giardia lamblia
QSDRLP

SEQ ID NO: 3061547 - protein, 31 aa, Giardia lamblia
QSDTETSDERGDGSGCYKDEDNNDSNDYEYE

SEQ ID NO: 3061548 - protein, 9 aa, Giardia lamblia
QSDTHGKQG

SEQ ID NO: 3061549 - protein, 9 aa, Giardia lamblia
QSDTPASQL

SEQ ID NO: 3061550 - protein, 6 aa, Giardia lamblia
QSEETA

SEQ ID NO: 3061551 - protein, 9 aa, Giardia lamblia
QSEPNDHNP

SEQ ID NO: 3061552 - protein, 18 aa, Giardia lamblia
QSESEYQSMATSDRDSTS

SEQ ID NO: 3061553 - protein, 7 aa, Giardia lamblia
QSEYPLK

SEQ ID NO: 3061554 - protein, 10 aa, Giardia lamblia
QSGAQSRLSN

SEQ ID NO: 3061555 - protein, 8 aa, Giardia lamblia
QSGDAQNV

SEQ ID NO: 3061556 - protein, 5 aa, Giardia lamblia
QSGEL

SEQ ID NO: 3061557 - protein, 7 aa, Giardia lamblia
QSGGASR

SEQ ID NO: 3061558 - protein, 9 aa, Giardia lamblia
QSGGSVPGE

SEQ ID NO: 3061559 - protein, 9 aa, Giardia lamblia
QSGIPNGDD

SEQ ID NO: 3061560 - protein, 8 aa, Giardia lamblia
QSGLATAA

SEQ ID NO: 3061561 - protein, 8 aa, Giardia lamblia
QSGSSNGI

SEQ ID NO: 3061562 - protein, 12 aa, Giardia lamblia
QSHASAASRVGE

SEQ ID NO: 3061563 - protein, 7 aa, Giardia lamblia
QSHGEAN

SEQ ID NO: 3061564 - protein, 9 aa, Giardia lamblia
QSHKGDKEF

SEQ ID NO: 3061565 - protein, 29 aa, Giardia lamblia
QSHPISGDRSVSAYEQRVQRSAERREAQR

SEQ ID NO: 3061566 - protein, 10 aa, Giardia lamblia
QSHSGKKSNE

SEQ ID NO: 3061567 - protein, 4 aa, Giardia lamblia
QSIA

SEQ ID NO: 3061568 - protein, 16 aa, Giardia lamblia
QSIDETKRQVPDASKT

SEQ ID NO: 3061569 - protein, 6 aa, Giardia lamblia
QSINPA

SEQ ID NO: 3061570 - protein, 6 aa, Giardia lamblia
QSIPGL

SEQ ID NO: 3061571 - protein, 17 aa, Giardia lamblia
QSIRSTSQIKGEKTSPT

SEQ ID NO: 3061572 - protein, 11 aa, Giardia lamblia
QSKDPQDSRDL

SEQ ID NO: 3061573 - protein, 4 aa, Giardia lamblia
QSKQ

SEQ ID NO: 3061574 - protein, 15 aa, Giardia lamblia
QSKQGKEPREMNEVA

SEQ ID NO: 3061575 - protein, 5 aa, Giardia lamblia
QSLAG

SEQ ID NO: 3061576 - protein, 4 aa, Giardia lamblia
QSLD

SEQ ID NO: 3061577 - protein, 9 aa, Giardia lamblia
QSLEKDPES

SEQ ID NO: 3061578 - protein, 12 aa, Giardia lamblia
QSLGAKQSNIDG

SEQ ID NO: 3061579 - protein, 14 aa, Giardia lamblia
QSLHESKKNKINPE

SEQ ID NO: 3061580 - protein, 12 aa, Giardia lamblia
QSLNNPAEEELR

SEQ ID NO: 3061581 - protein, 10 aa, Giardia lamblia
QSLRQNTATA

SEQ ID NO: 3061582 - protein, 4 aa, Giardia lamblia
QSLS

SEQ ID NO: 3061583 - protein, 25 aa, Giardia lamblia
QSLTSQKGASSDSGSVVHTQDKEPL

SEQ ID NO: 3061584 - protein, 5 aa, Giardia lamblia
QSMTA

SEQ ID NO: 3061585 - protein, 4 aa, Giardia lamblia
QSNE

SEQ ID NO: 3061586 - protein, 9 aa, Giardia lamblia
QSNGPSETL

SEQ ID NO: 3061587 - protein, 11 aa, Giardia lamblia
QSNKSGKLPSM

SEQ ID NO: 3061588 - protein, 4 aa, Giardia lamblia
QSNL

SEQ ID NO: 3061589 - protein, 6 aa, Giardia lamblia
QSNNTT

SEQ ID NO: 3061590 - protein, 10 aa, Giardia lamblia
QSNQGSSRLQ

SEQ ID NO: 3061591 - protein, 12 aa, Giardia lamblia
QSNQSDGTPPVS

SEQ ID NO: 3061592 - protein, 13 aa, Giardia lamblia
QSNTDKTVDQKEF

SEQ ID NO: 3061593 - protein, 7 aa, Giardia lamblia
QSPDEPV

SEQ ID NO: 3061594 - protein, 11 aa, Giardia lamblia
QSPDEVRSSPK

SEQ ID NO: 3061595 - protein, 5 aa, Giardia lamblia
QSPDI

SEQ ID NO: 3061596 - protein, 7 aa, Giardia lamblia
QSPDSLS

SEQ ID NO: 3061597 - protein, 5 aa, Giardia lamblia
QSPEF

SEQ ID NO: 3061598 - protein, 14 aa, Giardia lamblia
QSPEKLQTKPSIRI

SEQ ID NO: 3061599 - protein, 6 aa, Giardia lamblia
QSPNKS

SEQ ID NO: 3061600 - protein, 12 aa, Giardia lamblia
QSPNVEGNSTCD

SEQ ID NO: 3061601 - protein, 9 aa, Giardia lamblia
QSPQSQPLA

SEQ ID NO: 3061602 - protein, 8 aa, Giardia lamblia
QSPSADKI

SEQ ID NO: 3061603 - protein, 9 aa, Giardia lamblia
QSPSAETLE

SEQ ID NO: 3061604 - protein, 6 aa, Giardia lamblia
QSPSAN

SEQ ID NO: 3061605 - protein, 5 aa, Giardia lamblia
QSPTD

SEQ ID NO: 3061606 - protein, 6 aa, Giardia lamblia
QSPTGR

SEQ ID NO: 3061607 - protein, 7 aa, Giardia lamblia
QSPVQAS

SEQ ID NO: 3061608 - protein, 31 aa, Giardia lamblia
QSQKQVSERPSSDAKGADAAQGAATAQESET

SEQ ID NO: 3061609 - protein, 10 aa, Giardia lamblia
QSQRSMGKTI

SEQ ID NO: 3061610 - protein, 6 aa, Giardia lamblia
QSQSSV

SEQ ID NO: 3061611 - protein, 5 aa, Giardia lamblia
QSQTA

SEQ ID NO: 3061612 - protein, 9 aa, Giardia lamblia
QSRDSHISN

SEQ ID NO: 3061613 - protein, 7 aa, Giardia lamblia
QSRGKDI

SEQ ID NO: 3061614 - protein, 9 aa, Giardia lamblia
QSRKENEAL

SEQ ID NO: 3061615 - protein, 9 aa, Giardia lamblia
QSRKRTTDR

SEQ ID NO: 3061616 - protein, 11 aa, Giardia lamblia
QSRPVPNYQAA

SEQ ID NO: 3061617 - protein, 8 aa, Giardia lamblia
QSRSSYQE

SEQ ID NO: 3061618 - protein, 5 aa, Giardia lamblia
QSRTA

SEQ ID NO: 3061619 - protein, 11 aa, Giardia lamblia
QSSATAKGGRV

SEQ ID NO: 3061620 - protein, 15 aa, Giardia lamblia
QSSDGTDGHTCSGGS

SEQ ID NO: 3061621 - protein, 29 aa, Giardia lamblia
QSSDGTDGHTCSGGSCTACSTKQTADGTP

SEQ ID NO: 3061622 - protein, 8 aa, Giardia lamblia
QSSDTKKL

SEQ ID NO: 3061623 - protein, 5 aa, Giardia lamblia
QSSGI

SEQ ID NO: 3061624 - protein, 10 aa, Giardia lamblia
QSSHGQRKSI

SEQ ID NO: 3061625 - protein, 9 aa, Giardia lamblia
QSSKDIEPD

SEQ ID NO: 3061626 - protein, 7 aa, Giardia lamblia
QSSKPGY

SEQ ID NO: 3061627 - protein, 4 aa, Giardia lamblia
QSSL

SEQ ID NO: 3061628 - protein, 6 aa, Giardia lamblia
QSSLQE

SEQ ID NO: 3061629 - protein, 4 aa, Giardia lamblia
QSSN

SEQ ID NO: 3061630 - protein, 7 aa, Giardia lamblia
QSSNGTT

SEQ ID NO: 3061631 - protein, 8 aa, Giardia lamblia
QSSNTPGK

SEQ ID NO: 3061632 - protein, 4 aa, Giardia lamblia
QSSP

SEQ ID NO: 3061633 - protein, 4 aa, Giardia lamblia
QSSQ

SEQ ID NO: 3061634 - protein, 10 aa, Giardia lamblia
QSSQEDLEEN

SEQ ID NO: 3061635 - protein, 15 aa, Giardia lamblia
QSSQSILPASADEQL

SEQ ID NO: 3061636 - protein, 4 aa, Giardia lamblia
QSSR

SEQ ID NO: 3061637 - protein, 12 aa, Giardia lamblia
QSSRSSSDRDGV

SEQ ID NO: 3061638 - protein, 9 aa, Giardia lamblia
QSSSDESDP

SEQ ID NO: 3061639 - protein, 8 aa, Giardia lamblia
QSSSGTAH

SEQ ID NO: 3061640 - protein, 7 aa, Giardia lamblia
QSSSIAK

SEQ ID NO: 3061641 - protein, 11 aa, Giardia lamblia
QSSSSNPHRIR

SEQ ID NO: 3061642 - protein, 8 aa, Giardia lamblia
QSSSSYAS

SEQ ID NO: 3061643 - protein, 8 aa, Giardia lamblia
QSSSTGRY

SEQ ID NO: 3061644 - protein, 7 aa, Giardia lamblia
QSSTTAN

SEQ ID NO: 3061645 - protein, 4 aa, Giardia lamblia
QSSV

SEQ ID NO: 3061646 - protein, 5 aa, Giardia lamblia
QSSVA

SEQ ID NO: 3061647 - protein, 9 aa, Giardia lamblia
QSTAHTPMG

SEQ ID NO: 3061648 - protein, 5 aa, Giardia lamblia
QSTGT

SEQ ID NO: 3061649 - protein, 6 aa, Giardia lamblia
QSTIGS

SEQ ID NO: 3061650 - protein, 31 aa, Giardia lamblia
QSTKNTKGSGDQSDTASQARAAVKKSKPTRG

SEQ ID NO: 3061651 - protein, 4 aa, Giardia lamblia
QSTN

SEQ ID NO: 3061652 - protein, 12 aa, Giardia lamblia
QSTNGDADSSIN

SEQ ID NO: 3061653 - protein, 6 aa, Giardia lamblia
QSTPSS

SEQ ID NO: 3061654 - protein, 7 aa, Giardia lamblia
QSTSPTG

SEQ ID NO: 3061655 - protein, 5 aa, Giardia lamblia
QSTSV

SEQ ID NO: 3061656 - protein, 8 aa, Giardia lamblia
QSTTPKHE

SEQ ID NO: 3061657 - protein, 6 aa, Giardia lamblia
QSTVGS

SEQ ID NO: 3061658 - protein, 16 aa, Giardia lamblia
QSVDGVSGQEAATTRS

SEQ ID NO: 3061659 - protein, 19 aa, Giardia lamblia
QSVEETSAEPRDSGADVPN

SEQ ID NO: 3061660 - protein, 7 aa, Giardia lamblia
QSVNDRR

SEQ ID NO: 3061661 - protein, 5 aa, Giardia lamblia
QSVQA

SEQ ID NO: 3061662 - protein, 7 aa, Giardia lamblia
QSVSGEY

SEQ ID NO: 3061663 - protein, 32 aa, Giardia lamblia
QSVSQSASSVTKSAPINEELERNKQKLASSPM

SEQ ID NO: 3061664 - protein, 6 aa, Giardia lamblia
QSVTLS

SEQ ID NO: 3061665 - protein, 9 aa, Giardia lamblia
QSYASRNNL

SEQ ID NO: 3061666 - protein, 39 aa, Giardia lamblia
QSYPAGSGTYTFQSSGHAKQQGSSRPGSASAAGPNSALR

SEQ ID NO: 3061667 - protein, 12 aa, Giardia lamblia
QTADVKSGDTQL

SEQ ID NO: 3061668 - protein, 7 aa, Giardia lamblia
QTAGPHD

SEQ ID NO: 3061669 - protein, 9 aa, Giardia lamblia
QTAKHAKTI

SEQ ID NO: 3061670 - protein, 5 aa, Giardia lamblia
QTANL

SEQ ID NO: 3061671 - protein, 5 aa, Giardia lamblia
QTAPP

SEQ ID NO: 3061672 - protein, 5 aa, Giardia lamblia
QTAQR

SEQ ID NO: 3061673 - protein, 8 aa, Giardia lamblia
QTARSQVH

SEQ ID NO: 3061674 - protein, 7 aa, Giardia lamblia
QTASRGI

SEQ ID NO: 3061675 - protein, 8 aa, Giardia lamblia
QTASSVRQ

SEQ ID NO: 3061676 - protein, 13 aa, Giardia lamblia
QTAWRSAPQTPVT

SEQ ID NO: 3061677 - protein, 4 aa, Giardia lamblia
QTCR

SEQ ID NO: 3061678 - protein, 7 aa, Giardia lamblia
QTDAEKA

SEQ ID NO: 3061679 - protein, 7 aa, Giardia lamblia
QTDAETV

SEQ ID NO: 3061680 - protein, 6 aa, Giardia lamblia
QTDDNT

SEQ ID NO: 3061681 - protein, 9 aa, Giardia lamblia
QTDGNGVTS

SEQ ID NO: 3061682 - protein, 9 aa, Giardia lamblia
QTDPSTCDR

SEQ ID NO: 3061683 - protein, 5 aa, Giardia lamblia
QTDVD

SEQ ID NO: 3061684 - protein, 33 aa, Giardia lamblia
QTDYDRDSLTTSDTTRSARSSSHVSTGALEDAS

SEQ ID NO: 3061685 - protein, 17 aa, Giardia lamblia
QTEAGDDPALSGTGVTA

SEQ ID NO: 3061686 - protein, 7 aa, Giardia lamblia
QTEDNGD

SEQ ID NO: 3061687 - protein, 8 aa, Giardia lamblia
QTEGSALY

SEQ ID NO: 3061688 - protein, 7 aa, Giardia lamblia
QTEGTTL

SEQ ID NO: 3061689 - protein, 6 aa, Giardia lamblia
QTEPSV

SEQ ID NO: 3061690 - protein, 4 aa, Giardia lamblia
QTES

SEQ ID NO: 3061691 - protein, 5 aa, Giardia lamblia
QTESE

SEQ ID NO: 3061692 - protein, 5 aa, Giardia lamblia
QTFSS

SEQ ID NO: 3061693 - protein, 7 aa, Giardia lamblia
QTGAGNQ

SEQ ID NO: 3061694 - protein, 7 aa, Giardia lamblia
QTGAVQT

SEQ ID NO: 3061695 - protein, 4 aa, Giardia lamblia
QTGE

SEQ ID NO: 3061696 - protein, 22 aa, Giardia lamblia
QTGKIQQRASSLSRTPQQQPHR

SEQ ID NO: 3061697 - protein, 7 aa, Giardia lamblia
QTGNDDT

SEQ ID NO: 3061698 - protein, 20 aa, Giardia lamblia
QTGNDSHRPTLSTEEELSTD

SEQ ID NO: 3061699 - protein, 6 aa, Giardia lamblia
QTGPQE

SEQ ID NO: 3061700 - protein, 7 aa, Giardia lamblia
QTGPYRR

SEQ ID NO: 3061701 - protein, 6 aa, Giardia lamblia
QTGSFG

SEQ ID NO: 3061702 - protein, 11 aa, Giardia lamblia
QTGTLGNSVEE

SEQ ID NO: 3061703 - protein, 6 aa, Giardia lamblia
QTHTGT

SEQ ID NO: 3061704 - protein, 7 aa, Giardia lamblia
QTIAAKG

SEQ ID NO: 3061705 - protein, 7 aa, Giardia lamblia
QTIGKTA

SEQ ID NO: 3061706 - protein, 18 aa, Giardia lamblia
QTIGQQIKDRKKTATPFS

SEQ ID NO: 3061707 - protein, 8 aa, Giardia lamblia
QTIPTLSS

SEQ ID NO: 3061708 - protein, 14 aa, Giardia lamblia
QTISTPTGKSIPSS

SEQ ID NO: 3061709 - protein, 8 aa, Giardia lamblia
QTITAKDE

SEQ ID NO: 3061710 - protein, 8 aa, Giardia lamblia
QTKEGTEL

SEQ ID NO: 3061711 - protein, 7 aa, Giardia lamblia
QTKGVPT

SEQ ID NO: 3061712 - protein, 13 aa, Giardia lamblia
QTKKTVTTDKPTM

SEQ ID NO: 3061713 - protein, 6 aa, Giardia lamblia
QTKNNP

SEQ ID NO: 3061714 - protein, 4 aa, Giardia lamblia
QTKP

SEQ ID NO: 3061715 - protein, 6 aa, Giardia lamblia
QTKTNV

SEQ ID NO: 3061716 - protein, 9 aa, Giardia lamblia
QTKVDYDDA

SEQ ID NO: 3061717 - protein, 7 aa, Giardia lamblia
QTLDTPE

SEQ ID NO: 3061718 - protein, 4 aa, Giardia lamblia
QTLG

SEQ ID NO: 3061719 - protein, 4 aa, Giardia lamblia
QTLQ

SEQ ID NO: 3061720 - protein, 10 aa, Giardia lamblia
QTLSNGSAPL

SEQ ID NO: 3061721 - protein, 18 aa, Giardia lamblia
QTLSSVSGQHQSEASALG

SEQ ID NO: 3061722 - protein, 6 aa, Giardia lamblia
QTLSTS

SEQ ID NO: 3061723 - protein, 4 aa, Giardia lamblia
QTLT

SEQ ID NO: 3061724 - protein, 6 aa, Giardia lamblia
QTNKER

SEQ ID NO: 3061725 - protein, 7 aa, Giardia lamblia
QTNPSSI

SEQ ID NO: 3061726 - protein, 12 aa, Giardia lamblia
QTNQGGFAGRNN

SEQ ID NO: 3061727 - protein, 7 aa, Giardia lamblia
QTNSSSS

SEQ ID NO: 3061728 - protein, 17 aa, Giardia lamblia
QTNVRQSKRTTPGQAGR

SEQ ID NO: 3061729 - protein, 17 aa, Giardia lamblia
QTPDAKDSNLSSSPPLS

SEQ ID NO: 3061730 - protein, 4 aa, Giardia lamblia
QTPE

SEQ ID NO: 3061731 - protein, 5 aa, Giardia lamblia
QTPLT

SEQ ID NO: 3061732 - protein, 11 aa, Giardia lamblia
QTPPESSEQSV

SEQ ID NO: 3061733 - protein, 5 aa, Giardia lamblia
QTPPK

SEQ ID NO: 3061734 - protein, 11 aa, Giardia lamblia
QTPTAYSRKKL

SEQ ID NO: 3061735 - protein, 10 aa, Giardia lamblia
QTPVQTPADV

SEQ ID NO: 3061736 - protein, 6 aa, Giardia lamblia
QTQDTI

SEQ ID NO: 3061737 - protein, 7 aa, Giardia lamblia
QTQEESI

SEQ ID NO: 3061738 - protein, 18 aa, Giardia lamblia
QTQKNSCSLTNNTDTLYS

SEQ ID NO: 3061739 - protein, 7 aa, Giardia lamblia
QTQPSYT

SEQ ID NO: 3061740 - protein, 5 aa, Giardia lamblia
QTQQL

SEQ ID NO: 3061741 - protein, 5 aa, Giardia lamblia
QTRQK

SEQ ID NO: 3061742 - protein, 20 aa, Giardia lamblia
QTRSNFDRRRPKGAGSSSDI

SEQ ID NO: 3061743 - protein, 6 aa, Giardia lamblia
QTSADE

SEQ ID NO: 3061744 - protein, 5 aa, Giardia lamblia
QTSAN

SEQ ID NO: 3061745 - protein, 8 aa, Giardia lamblia
QTSESYAA

SEQ ID NO: 3061746 - protein, 10 aa, Giardia lamblia
QTSNRVSERM

SEQ ID NO: 3061747 - protein, 6 aa, Giardia lamblia
QTSNSV

SEQ ID NO: 3061748 - protein, 6 aa, Giardia lamblia
QTSSNK

SEQ ID NO: 3061749 - protein, 10 aa, Giardia lamblia
QTSSPMTNGA

SEQ ID NO: 3061750 - protein, 11 aa, Giardia lamblia
QTSTKHDRRTL

SEQ ID NO: 3061751 - protein, 7 aa, Giardia lamblia
QTSTNGI

SEQ ID NO: 3061752 - protein, 6 aa, Giardia lamblia
QTSYKH

SEQ ID NO: 3061753 - protein, 13 aa, Giardia lamblia
QTTAKSSKEQSQN

SEQ ID NO: 3061754 - protein, 8 aa, Giardia lamblia
QTTFGSTS

SEQ ID NO: 3061755 - protein, 4 aa, Giardia lamblia
QTTL

SEQ ID NO: 3061756 - protein, 6 aa, Giardia lamblia
QTTLPQ

SEQ ID NO: 3061757 - protein, 15 aa, Giardia lamblia
QTTLSEEAAAKSAIT

SEQ ID NO: 3061758 - protein, 5 aa, Giardia lamblia
QTTND

SEQ ID NO: 3061759 - protein, 4 aa, Giardia lamblia
QTTS

SEQ ID NO: 3061760 - protein, 9 aa, Giardia lamblia
QTTSLPDHN

SEQ ID NO: 3061761 - protein, 5 aa, Giardia lamblia
QTVPP

SEQ ID NO: 3061762 - protein, 4 aa, Giardia lamblia
QTVR

SEQ ID NO: 3061763 - protein, 5 aa, Giardia lamblia
QTYKS

SEQ ID NO: 3061764 - protein, 5 aa, Giardia lamblia
QVAAQ

SEQ ID NO: 3061765 - protein, 8 aa, Giardia lamblia
QVDAGTRA

SEQ ID NO: 3061766 - protein, 12 aa, Giardia lamblia
QVEQSKEEEEQD

SEQ ID NO: 3061767 - protein, 11 aa, Giardia lamblia
QVGDGASAGTE

SEQ ID NO: 3061768 - protein, 5 aa, Giardia lamblia
QVGYE

SEQ ID NO: 3061769 - protein, 20 aa, Giardia lamblia
QVPSGNTCVDPPKKSVSKMS

SEQ ID NO: 3061770 - protein, 9 aa, Giardia lamblia
QVQAEASSC

SEQ ID NO: 3061771 - protein, 8 aa, Giardia lamblia
QVQEKDED

SEQ ID NO: 3061772 - protein, 10 aa, Giardia lamblia
QVQKYDKTSF

SEQ ID NO: 3061773 - protein, 4 aa, Giardia lamblia
QVRS

SEQ ID NO: 3061774 - protein, 10 aa, Giardia lamblia
QVSDSGKSEL

SEQ ID NO: 3061775 - protein, 6 aa, Giardia lamblia
QVSPSS

SEQ ID NO: 3061776 - protein, 6 aa, Giardia lamblia
QVSPSV

SEQ ID NO: 3061777 - protein, 4 aa, Giardia lamblia
QVSQ

SEQ ID NO: 3061778 - protein, 24 aa, Giardia lamblia
QVSQTPDDKPIPPTNPPSPTPPPY

SEQ ID NO: 3061779 - protein, 4 aa, Giardia lamblia
QVST

SEQ ID NO: 3061780 - protein, 4 aa, Giardia lamblia
QVTT

SEQ ID NO: 3061781 - protein, 24 aa, Giardia lamblia
QWKPGSDGEEEAPSCGDDDPTRQY

SEQ ID NO: 3061782 - protein, 12 aa, Giardia lamblia
QYEESTPNHQQA

SEQ ID NO: 3061783 - protein, 8 aa, Giardia lamblia
QYGAQNEL

SEQ ID NO: 3061784 - protein, 10 aa, Giardia lamblia
QYGDDPASPL

SEQ ID NO: 3061785 - protein, 4 aa, Giardia lamblia
QYGQ

SEQ ID NO: 3061786 - protein, 5 aa, Giardia lamblia
QYGRK

SEQ ID NO: 3061787 - protein, 8 aa, Giardia lamblia
QYKESDYS

SEQ ID NO: 3061788 - protein, 13 aa, Giardia lamblia
QYNAASPRKDASV

SEQ ID NO: 3061789 - protein, 5 aa, Giardia lamblia
QYNDA

SEQ ID NO: 3061790 - protein, 15 aa, Giardia lamblia
QYNGDLSNQTSLGQA

SEQ ID NO: 3061791 - protein, 29 aa, Giardia lamblia
QYNPTEFATGGNAVSPHDPVTTDLEPELS

SEQ ID NO: 3061792 - protein, 5 aa, Giardia lamblia
QYNPY

SEQ ID NO: 3061793 - protein, 17 aa, Giardia lamblia
QYQNNKASDKRGSTNAG

SEQ ID NO: 3061794 - protein, 8 aa, Giardia lamblia
QYQPSQGQ

SEQ ID NO: 3061795 - protein, 11 aa, Giardia lamblia
QYQRRTDNEGR

SEQ ID NO: 3061796 - protein, 7 aa, Giardia lamblia
QYSKPSI

SEQ ID NO: 3061797 - protein, 4 aa, Giardia lamblia
QYSQ

SEQ ID NO: 3061798 - protein, 6 aa, Giardia lamblia
QYTGDY

SEQ ID NO: 3061799 - protein, 7 aa, Giardia lamblia
QYTNGET

SEQ ID NO: 3061800 - protein, 6 aa, Giardia lamblia
QYVPPQ

SEQ ID NO: 3061801 - protein, 7 aa, Giardia lamblia
RAAASLP

SEQ ID NO: 3061802 - protein, 4 aa, Giardia lamblia
RAAD

SEQ ID NO: 3061803 - protein, 8 aa, Giardia lamblia
RAAEEYAN

SEQ ID NO: 3061804 - protein, 6 aa, Giardia lamblia
RAAKPV

SEQ ID NO: 3061805 - protein, 7 aa, Giardia lamblia
RAARSTD

SEQ ID NO: 3061806 - protein, 11 aa, Giardia lamblia
RAASSSPALLG

SEQ ID NO: 3061807 - protein, 4 aa, Giardia lamblia
RAAT

SEQ ID NO: 3061808 - protein, 9 aa, Giardia lamblia
RAAYTSGPV

SEQ ID NO: 3061809 - protein, 12 aa, Giardia lamblia
RACQDPDGTVCS

SEQ ID NO: 3061810 - protein, 11 aa, Giardia lamblia
RACRGDTGKKG

SEQ ID NO: 3061811 - protein, 11 aa, Giardia lamblia
RADATEKGTPI

SEQ ID NO: 3061812 - protein, 13 aa, Giardia lamblia
RADCTAQPAAQNQ

SEQ ID NO: 3061813 - protein, 6 aa, Giardia lamblia
RADDVS

SEQ ID NO: 3061814 - protein, 9 aa, Giardia lamblia
RADGGCGHA

SEQ ID NO: 3061815 - protein, 7 aa, Giardia lamblia
RADITDE

SEQ ID NO: 3061816 - protein, 25 aa, Giardia lamblia
RADQDEQDLDQEDSARQAGNPNDDP

SEQ ID NO: 3061817 - protein, 11 aa, Giardia lamblia
RADSTDSIEPT

SEQ ID NO: 3061818 - protein, 14 aa, Giardia lamblia
RADTGAIAEEKSIS

SEQ ID NO: 3061819 - protein, 8 aa, Giardia lamblia
RAEARDKV

SEQ ID NO: 3061820 - protein, 5 aa, Giardia lamblia
RAEGQ

SEQ ID NO: 3061821 - protein, 9 aa, Giardia lamblia
RAEKRKTDF

SEQ ID NO: 3061822 - protein, 20 aa, Giardia lamblia
RAEMPSVSSQIQGQKSKLRT

SEQ ID NO: 3061823 - protein, 16 aa, Giardia lamblia
RAEPKRPNKRPGSSLD

SEQ ID NO: 3061824 - protein, 4 aa, Giardia lamblia
RAEQ

SEQ ID NO: 3061825 - protein, 9 aa, Giardia lamblia
RAEQQESLT

SEQ ID NO: 3061826 - protein, 10 aa, Giardia lamblia
RAERRGSDAQ

SEQ ID NO: 3061827 - protein, 4 aa, Giardia lamblia
RAGE

SEQ ID NO: 3061828 - protein, 10 aa, Giardia lamblia
RAGRPSFDTN

SEQ ID NO: 3061829 - protein, 6 aa, Giardia lamblia
RAGRQD

SEQ ID NO: 3061830 - protein, 28 aa, Giardia lamblia
RAGSASSASLRKTTKSAKQDLSSATPVP

SEQ ID NO: 3061831 - protein, 12 aa, Giardia lamblia
RAGSKDSSMGPL

SEQ ID NO: 3061832 - protein, 5 aa, Giardia lamblia
RAGTS

SEQ ID NO: 3061833 - protein, 11 aa, Giardia lamblia
RAKAQKAAKKK

SEQ ID NO: 3061834 - protein, 10 aa, Giardia lamblia
RAKAQTNQIE

SEQ ID NO: 3061835 - protein, 32 aa, Giardia lamblia
RAKDSKQIASDHDSDLGSAPAPMPSADSSLGE

SEQ ID NO: 3061836 - protein, 6 aa, Giardia lamblia
RAKGAS

SEQ ID NO: 3061837 - protein, 5 aa, Giardia lamblia
RAKGS

SEQ ID NO: 3061838 - protein, 4 aa, Giardia lamblia
RAKL

SEQ ID NO: 3061839 - protein, 5 aa, Giardia lamblia
RAKNS

SEQ ID NO: 3061840 - protein, 20 aa, Giardia lamblia
RAKSSIASQGIASAARNVTE

SEQ ID NO: 3061841 - protein, 19 aa, Giardia lamblia
RAKTAPSKKQTEGAYTKKA

SEQ ID NO: 3061842 - protein, 24 aa, Giardia lamblia
RALEEGSARQELPSFSPPPSQTQL

SEQ ID NO: 3061843 - protein, 17 aa, Giardia lamblia
RALPAYSTGHKEDPLNH

SEQ ID NO: 3061844 - protein, 9 aa, Giardia lamblia
RALQKQTSA

SEQ ID NO: 3061845 - protein, 4 aa, Giardia lamblia
RALR

SEQ ID NO: 3061846 - protein, 10 aa, Giardia lamblia
RANGYASGQV

SEQ ID NO: 3061847 - protein, 9 aa, Giardia lamblia
RANKKRVPE

SEQ ID NO: 3061848 - protein, 6 aa, Giardia lamblia
RANMNA

SEQ ID NO: 3061849 - protein, 6 aa, Giardia lamblia
RANNDN

SEQ ID NO: 3061850 - protein, 8 aa, Giardia lamblia
RAPDSAKT

SEQ ID NO: 3061851 - protein, 7 aa, Giardia lamblia
RAPEAGI

SEQ ID NO: 3061852 - protein, 7 aa, Giardia lamblia
RAPELES

SEQ ID NO: 3061853 - protein, 4 aa, Giardia lamblia
RAPG

SEQ ID NO: 3061854 - protein, 32 aa, Giardia lamblia
RAPGKSKSTTKVPDNSLGKHAEDEHKKTLPLS

SEQ ID NO: 3061855 - protein, 5 aa, Giardia lamblia
RAPQE

SEQ ID NO: 3061856 - protein, 5 aa, Giardia lamblia
RAPQL

SEQ ID NO: 3061857 - protein, 12 aa, Giardia lamblia
RAPSSSSSLQTT

SEQ ID NO: 3061858 - protein, 13 aa, Giardia lamblia
RAPTINQYTTRET

SEQ ID NO: 3061859 - protein, 6 aa, Giardia lamblia
RAPTLE

SEQ ID NO: 3061860 - protein, 11 aa, Giardia lamblia
RAPVPDDSELD

SEQ ID NO: 3061861 - protein, 7 aa, Giardia lamblia
RAQARTS

SEQ ID NO: 3061862 - protein, 14 aa, Giardia lamblia
RAQDGTCKEPKDLY

SEQ ID NO: 3061863 - protein, 15 aa, Giardia lamblia
RAQDGTCKKPKDLYT

SEQ ID NO: 3061864 - protein, 4 aa, Giardia lamblia
RAQE

SEQ ID NO: 3061865 - protein, 17 aa, Giardia lamblia
RAQRPSSAQTPPNPAAK

SEQ ID NO: 3061866 - protein, 20 aa, Giardia lamblia
RAQSQTASRQTSSTSSKIPG

SEQ ID NO: 3061867 - protein, 26 aa, Giardia lamblia
RAREDAVSPTFTGDDGSSDEDDAAVA

SEQ ID NO: 3061868 - protein, 8 aa, Giardia lamblia
RARERRYR

SEQ ID NO: 3061869 - protein, 7 aa, Giardia lamblia
RARGSTT

SEQ ID NO: 3061870 - protein, 11 aa, Giardia lamblia
RARRDKLVNSG

SEQ ID NO: 3061871 - protein, 12 aa, Giardia lamblia
RARRDKSVNSGK

SEQ ID NO: 3061872 - protein, 23 aa, Giardia lamblia
RARSDAASTQKEKGQKQAFSRAK

SEQ ID NO: 3061873 - protein, 7 aa, Giardia lamblia
RARTSRL

SEQ ID NO: 3061874 - protein, 10 aa, Giardia lamblia
RASEETPRAF

SEQ ID NO: 3061875 - protein, 12 aa, Giardia lamblia
RASGAATGSCVD

SEQ ID NO: 3061876 - protein, 19 aa, Giardia lamblia
RASGAATGSCVDPGACGDG

SEQ ID NO: 3061877 - protein, 12 aa, Giardia lamblia
RASGATTGSCVD

SEQ ID NO: 3061878 - protein, 35 aa, Giardia lamblia
RASGSLTTSSESSDIFTGDSDGAESTSKPTISTED

SEQ ID NO: 3061879 - protein, 15 aa, Giardia lamblia
RASGTIKSLDSTGTR

SEQ ID NO: 3061880 - protein, 6 aa, Giardia lamblia
RASNGR

SEQ ID NO: 3061881 - protein, 8 aa, Giardia lamblia
RASPRKSP

SEQ ID NO: 3061882 - protein, 15 aa, Giardia lamblia
RASPTQTSPASPSLS

SEQ ID NO: 3061883 - protein, 7 aa, Giardia lamblia
RASRAAY

SEQ ID NO: 3061884 - protein, 5 aa, Giardia lamblia
RASSL

SEQ ID NO: 3061885 - protein, 10 aa, Giardia lamblia
RASSSASVDR

SEQ ID NO: 3061886 - protein, 5 aa, Giardia lamblia
RASSV

SEQ ID NO: 3061887 - protein, 44 aa, Giardia lamblia
RASSVERTSRASKVDTPSRIAQGEASRRSQVNRYPKSAKAAKMP

SEQ ID NO: 3061888 - protein, 8 aa, Giardia lamblia
RASTAANT

SEQ ID NO: 3061889 - protein, 7 aa, Giardia lamblia
RASTNNV

SEQ ID NO: 3061890 - protein, 11 aa, Giardia lamblia
RASVEADTSEI

SEQ ID NO: 3061891 - protein, 15 aa, Giardia lamblia
RASYDKVKESLANTI

SEQ ID NO: 3061892 - protein, 15 aa, Giardia lamblia
RATAEELLSGGKLMH

SEQ ID NO: 3061893 - protein, 5 aa, Giardia lamblia
RATDD

SEQ ID NO: 3061894 - protein, 7 aa, Giardia lamblia
RATDTGL

SEQ ID NO: 3061895 - protein, 14 aa, Giardia lamblia
RATTQSLSEVEGEE

SEQ ID NO: 3061896 - protein, 20 aa, Giardia lamblia
RAVASGCGGSVGAPLSTSAR

SEQ ID NO: 3061897 - protein, 8 aa, Giardia lamblia
RAVQSDEN

SEQ ID NO: 3061898 - protein, 12 aa, Giardia lamblia
RAVSDQRPLAHP

SEQ ID NO: 3061899 - protein, 22 aa, Giardia lamblia
RAYRSRSNKSQSKVTTATAAPE

SEQ ID NO: 3061900 - protein, 14 aa, Giardia lamblia
RCAKPTKKTTPVRV

SEQ ID NO: 3061901 - protein, 24 aa, Giardia lamblia
RCAPDGGCRDLPDKATGACSKQNQ

SEQ ID NO: 3061902 - protein, 16 aa, Giardia lamblia
RCDANDVNDTASKPTT

SEQ ID NO: 3061903 - protein, 7 aa, Giardia lamblia
RCGPNGC

SEQ ID NO: 3061904 - protein, 6 aa, Giardia lamblia
RCGSGQ

SEQ ID NO: 3061905 - protein, 8 aa, Giardia lamblia
RCPKDNPE

SEQ ID NO: 3061906 - protein, 7 aa, Giardia lamblia
RCSSDTS

SEQ ID NO: 3061907 - protein, 4 aa, Giardia lamblia
RCTE

SEQ ID NO: 3061908 - protein, 20 aa, Giardia lamblia
RCTKSDGTALTSSDTTCGKC

SEQ ID NO: 3061909 - protein, 17 aa, Giardia lamblia
RCTQTCDEHDSQATKCK

SEQ ID NO: 3061910 - protein, 9 aa, Giardia lamblia
RCTSTNSNV

SEQ ID NO: 3061911 - protein, 21 aa, Giardia lamblia
RCTSTNSNVCTPQTQQNDTCA

SEQ ID NO: 3061912 - protein, 7 aa, Giardia lamblia
RDAAGKT

SEQ ID NO: 3061913 - protein, 4 aa, Giardia lamblia
RDAD

SEQ ID NO: 3061914 - protein, 8 aa, Giardia lamblia
RDAEATPV

SEQ ID NO: 3061915 - protein, 17 aa, Giardia lamblia
RDANRAGYSIAKGQSRN

SEQ ID NO: 3061916 - protein, 18 aa, Giardia lamblia
RDASNSERTVSSADAYKR

SEQ ID NO: 3061917 - protein, 5 aa, Giardia lamblia
RDATV

SEQ ID NO: 3061918 - protein, 13 aa, Giardia lamblia
RDCANGGTCNTDT

SEQ ID NO: 3061919 - protein, 5 aa, Giardia lamblia
RDCSA

SEQ ID NO: 3061920 - protein, 8 aa, Giardia lamblia
RDEDAAFD

SEQ ID NO: 3061921 - protein, 7 aa, Giardia lamblia
RDEDPAI

SEQ ID NO: 3061922 - protein, 20 aa, Giardia lamblia
RDEESQDRSIPESSDRSVSQ

SEQ ID NO: 3061923 - protein, 10 aa, Giardia lamblia
RDEGQANGYQ

SEQ ID NO: 3061924 - protein, 8 aa, Giardia lamblia
RDEGTGIE

SEQ ID NO: 3061925 - protein, 7 aa, Giardia lamblia
RDEQTTH

SEQ ID NO: 3061926 - protein, 22 aa, Giardia lamblia
RDESDQAAAESSYADHRNRATN

SEQ ID NO: 3061927 - protein, 8 aa, Giardia lamblia
RDFGTKGC

SEQ ID NO: 3061928 - protein, 5 aa, Giardia lamblia
RDGGQ

SEQ ID NO: 3061929 - protein, 5 aa, Giardia lamblia
RDGGT

SEQ ID NO: 3061930 - protein, 6 aa, Giardia lamblia
RDGKET

SEQ ID NO: 3061931 - protein, 9 aa, Giardia lamblia
RDGKSTMST

SEQ ID NO: 3061932 - protein, 4 aa, Giardia lamblia
RDGP

SEQ ID NO: 3061933 - protein, 9 aa, Giardia lamblia
RDGSDSRRL

SEQ ID NO: 3061934 - protein, 10 aa, Giardia lamblia
RDGTASPGSA

SEQ ID NO: 3061935 - protein, 7 aa, Giardia lamblia
RDGTGAF

SEQ ID NO: 3061936 - protein, 19 aa, Giardia lamblia
RDHDERQLQSSSETSTEAV

SEQ ID NO: 3061937 - protein, 16 aa, Giardia lamblia
RDHEAATSCSLALRYT

SEQ ID NO: 3061938 - protein, 7 aa, Giardia lamblia
RDHSGKT

SEQ ID NO: 3061939 - protein, 4 aa, Giardia lamblia
RDIE

SEQ ID NO: 3061940 - protein, 7 aa, Giardia lamblia
RDIPASR

SEQ ID NO: 3061941 - protein, 12 aa, Giardia lamblia
RDISDKKGGRVE

SEQ ID NO: 3061942 - protein, 5 aa, Giardia lamblia
RDIVG

SEQ ID NO: 3061943 - protein, 22 aa, Giardia lamblia
RDKAPDPERPRTYEETVEVASR

SEQ ID NO: 3061944 - protein, 11 aa, Giardia lamblia
RDKDGKSDDGV

SEQ ID NO: 3061945 - protein, 4 aa, Giardia lamblia
RDKE

SEQ ID NO: 3061946 - protein, 18 aa, Giardia lamblia
RDKPTGLVKSPSLPEIPY

SEQ ID NO: 3061947 - protein, 9 aa, Giardia lamblia
RDKTASPRY

SEQ ID NO: 3061948 - protein, 7 aa, Giardia lamblia
RDMAGKI

SEQ ID NO: 3061949 - protein, 7 aa, Giardia lamblia
RDNAARN

SEQ ID NO: 3061950 - protein, 6 aa, Giardia lamblia
RDNPEI

SEQ ID NO: 3061951 - protein, 9 aa, Giardia lamblia
RDNSCATAC

SEQ ID NO: 3061952 - protein, 6 aa, Giardia lamblia
RDNTTL

SEQ ID NO: 3061953 - protein, 7 aa, Giardia lamblia
RDPDGFS

SEQ ID NO: 3061954 - protein, 6 aa, Giardia lamblia
RDPEGS

SEQ ID NO: 3061955 - protein, 4 aa, Giardia lamblia
RDPP

SEQ ID NO: 3061956 - protein, 7 aa, Giardia lamblia
RDPPDDN

SEQ ID NO: 3061957 - protein, 7 aa, Giardia lamblia
RDPREQQ

SEQ ID NO: 3061958 - protein, 5 aa, Giardia lamblia
RDPSE

SEQ ID NO: 3061959 - protein, 5 aa, Giardia lamblia
RDPSM

SEQ ID NO: 3061960 - protein, 27 aa, Giardia lamblia
RDPSTSTPAVSNATQEGSGREGAPVDH

SEQ ID NO: 3061961 - protein, 7 aa, Giardia lamblia
RDPTDDL

SEQ ID NO: 3061962 - protein, 5 aa, Giardia lamblia
RDQGS

SEQ ID NO: 3061963 - protein, 6 aa, Giardia lamblia
RDQKNM

SEQ ID NO: 3061964 - protein, 8 aa, Giardia lamblia
RDQNGRTG

SEQ ID NO: 3061965 - protein, 5 aa, Giardia lamblia
RDQTK

SEQ ID NO: 3061966 - protein, 12 aa, Giardia lamblia
RDRAREESEGAV

SEQ ID NO: 3061967 - protein, 4 aa, Giardia lamblia
RDRE

SEQ ID NO: 3061968 - protein, 6 aa, Giardia lamblia
RDRGKG

SEQ ID NO: 3061969 - protein, 25 aa, Giardia lamblia
RDRKEPTNISKDDQAHQDSSTDLEP

SEQ ID NO: 3061970 - protein, 5 aa, Giardia lamblia
RDRLG

SEQ ID NO: 3061971 - protein, 6 aa, Giardia lamblia
RDRQRR

SEQ ID NO: 3061972 - protein, 6 aa, Giardia lamblia
RDRSGR

SEQ ID NO: 3061973 - protein, 6 aa, Giardia lamblia
RDRTNS

SEQ ID NO: 3061974 - protein, 10 aa, Giardia lamblia
RDRTTGATSP

SEQ ID NO: 3061975 - protein, 5 aa, Giardia lamblia
RDSAE

SEQ ID NO: 3061976 - protein, 9 aa, Giardia lamblia
RDSCDAGRS

SEQ ID NO: 3061977 - protein, 4 aa, Giardia lamblia
RDSE

SEQ ID NO: 3061978 - protein, 5 aa, Giardia lamblia
RDSHV

SEQ ID NO: 3061979 - protein, 4 aa, Giardia lamblia
RDSI

SEQ ID NO: 3061980 - protein, 7 aa, Giardia lamblia
RDSLPIR

SEQ ID NO: 3061981 - protein, 11 aa, Giardia lamblia
RDSNDHDTRTK

SEQ ID NO: 3061982 - protein, 15 aa, Giardia lamblia
RDSNSEPETGEQTAA

SEQ ID NO: 3061983 - protein, 7 aa, Giardia lamblia
RDSRGRT

SEQ ID NO: 3061984 - protein, 10 aa, Giardia lamblia
RDSSENPTVR

SEQ ID NO: 3061985 - protein, 7 aa, Giardia lamblia
RDSSGIN

SEQ ID NO: 3061986 - protein, 6 aa, Giardia lamblia
RDSSSS

SEQ ID NO: 3061987 - protein, 20 aa, Giardia lamblia
RDTEPLTDDKPEKSENSAYG

SEQ ID NO: 3061988 - protein, 5 aa, Giardia lamblia
RDTHN

SEQ ID NO: 3061989 - protein, 5 aa, Giardia lamblia
RDTLT

SEQ ID NO: 3061990 - protein, 7 aa, Giardia lamblia
RDTNRQK

SEQ ID NO: 3061991 - protein, 10 aa, Giardia lamblia
RDTPEEPSEL

SEQ ID NO: 3061992 - protein, 18 aa, Giardia lamblia
RDTSQAHDSSETLTTNSS

SEQ ID NO: 3061993 - protein, 8 aa, Giardia lamblia
RDTSSKEV

SEQ ID NO: 3061994 - protein, 10 aa, Giardia lamblia
RDTSSPMNDY

SEQ ID NO: 3061995 - protein, 6 aa, Giardia lamblia
RDTTRH

SEQ ID NO: 3061996 - protein, 9 aa, Giardia lamblia
RDVAPGTEQ

SEQ ID NO: 3061997 - protein, 11 aa, Giardia lamblia
RDVKGKPITTN

SEQ ID NO: 3061998 - protein, 5 aa, Giardia lamblia
RDVNG

SEQ ID NO: 3061999 - protein, 4 aa, Giardia lamblia
RDYP

SEQ ID NO: 3062000 - protein, 5 aa, Giardia lamblia
REAPL

SEQ ID NO: 3062001 - protein, 6 aa, Giardia lamblia
REAPSC

SEQ ID NO: 3062002 - protein, 7 aa, Giardia lamblia
REAPSEI

SEQ ID NO: 3062003 - protein, 7 aa, Giardia lamblia
REARNAP

SEQ ID NO: 3062004 - protein, 7 aa, Giardia lamblia
REARSDA

SEQ ID NO: 3062005 - protein, 5 aa, Giardia lamblia
REART

SEQ ID NO: 3062006 - protein, 6 aa, Giardia lamblia
REASIS

SEQ ID NO: 3062007 - protein, 8 aa, Giardia lamblia
REASRQNL

SEQ ID NO: 3062008 - protein, 6 aa, Giardia lamblia
REATDN

SEQ ID NO: 3062009 - protein, 5 aa, Giardia lamblia
REDAP

SEQ ID NO: 3062010 - protein, 6 aa, Giardia lamblia
REDGDI

SEQ ID NO: 3062011 - protein, 5 aa, Giardia lamblia
REDSR

SEQ ID NO: 3062012 - protein, 12 aa, Giardia lamblia
REDTQSDRSLND

SEQ ID NO: 3062013 - protein, 9 aa, Giardia lamblia
REDVRPGRR

SEQ ID NO: 3062014 - protein, 10 aa, Giardia lamblia
REEAAAGDQS

SEQ ID NO: 3062015 - protein, 4 aa, Giardia lamblia
REED

SEQ ID NO: 3062016 - protein, 48 aa, Giardia lamblia
REEEVEVESEPEKKDDEKKEDEKKEDEVHEASDDEEKKEEKKKTVKKE

SEQ ID NO: 3062017 - protein, 11 aa, Giardia lamblia
REEKMQDTHGN

SEQ ID NO: 3062018 - protein, 7 aa, Giardia lamblia
REEKSRL

SEQ ID NO: 3062019 - protein, 10 aa, Giardia lamblia
REERAKEREA

SEQ ID NO: 3062020 - protein, 10 aa, Giardia lamblia
REERRKEEER

SEQ ID NO: 3062021 - protein, 5 aa, Giardia lamblia
REESN

SEQ ID NO: 3062022 - protein, 9 aa, Giardia lamblia
REGGQTPDL

SEQ ID NO: 3062023 - protein, 8 aa, Giardia lamblia
REGGVTSP

SEQ ID NO: 3062024 - protein, 7 aa, Giardia lamblia
REGQRSR

SEQ ID NO: 3062025 - protein, 13 aa, Giardia lamblia
REGSQLTSSGYSN

SEQ ID NO: 3062026 - protein, 13 aa, Giardia lamblia
REKNQKKQCPPDA

SEQ ID NO: 3062027 - protein, 8 aa, Giardia lamblia
REKNTALT

SEQ ID NO: 3062028 - protein, 9 aa, Giardia lamblia
REKPPSSVF

SEQ ID NO: 3062029 - protein, 9 aa, Giardia lamblia
REKTFTERA

SEQ ID NO: 3062030 - protein, 6 aa, Giardia lamblia
RELEDS

SEQ ID NO: 3062031 - protein, 17 aa, Giardia lamblia
RELGGDSVRKATDRPEH

SEQ ID NO: 3062032 - protein, 7 aa, Giardia lamblia
RELQSQT

SEQ ID NO: 3062033 - protein, 5 aa, Giardia lamblia
RELRD

SEQ ID NO: 3062034 - protein, 7 aa, Giardia lamblia
RELSGGM

SEQ ID NO: 3062035 - protein, 4 aa, Giardia lamblia
REMD

SEQ ID NO: 3062036 - protein, 11 aa, Giardia lamblia
RENGSASTADV

SEQ ID NO: 3062037 - protein, 7 aa, Giardia lamblia
RENITRN

SEQ ID NO: 3062038 - protein, 8 aa, Giardia lamblia
RENPGKPL

SEQ ID NO: 3062039 - protein, 13 aa, Giardia lamblia
RENPTSASSDREL

SEQ ID NO: 3062040 - protein, 5 aa, Giardia lamblia
RENRE

SEQ ID NO: 3062041 - protein, 7 aa, Giardia lamblia
RENSPVR

SEQ ID NO: 3062042 - protein, 5 aa, Giardia lamblia
RENSS

SEQ ID NO: 3062043 - protein, 14 aa, Giardia lamblia
REPIPKKSLYTPNL

SEQ ID NO: 3062044 - protein, 10 aa, Giardia lamblia
REQDKSVPHL

SEQ ID NO: 3062045 - protein, 12 aa, Giardia lamblia
REQESTAPQSIR

SEQ ID NO: 3062046 - protein, 4 aa, Giardia lamblia
REQG

SEQ ID NO: 3062047 - protein, 7 aa, Giardia lamblia
REQKQQL

SEQ ID NO: 3062048 - protein, 5 aa, Giardia lamblia
REQLA

SEQ ID NO: 3062049 - protein, 12 aa, Giardia lamblia
REQSSTDHSPQS

SEQ ID NO: 3062050 - protein, 7 aa, Giardia lamblia
REQTETE

SEQ ID NO: 3062051 - protein, 10 aa, Giardia lamblia
REQYSSESAP

SEQ ID NO: 3062052 - protein, 6 aa, Giardia lamblia
REQYTN

SEQ ID NO: 3062053 - protein, 10 aa, Giardia lamblia
RERKYNKEDV

SEQ ID NO: 3062054 - protein, 11 aa, Giardia lamblia
RERSNAKASFG

SEQ ID NO: 3062055 - protein, 5 aa, Giardia lamblia
RERSQ

SEQ ID NO: 3062056 - protein, 7 aa, Giardia lamblia
RESDGDV

SEQ ID NO: 3062057 - protein, 6 aa, Giardia lamblia
RESGEK

SEQ ID NO: 3062058 - protein, 4 aa, Giardia lamblia
RESI

SEQ ID NO: 3062059 - protein, 8 aa, Giardia lamblia
RESIESKK

SEQ ID NO: 3062060 - protein, 7 aa, Giardia lamblia
RESMGPV

SEQ ID NO: 3062061 - protein, 5 aa, Giardia lamblia
RESPR

SEQ ID NO: 3062062 - protein, 5 aa, Giardia lamblia
RESRT

SEQ ID NO: 3062063 - protein, 8 aa, Giardia lamblia
RESSETQS

SEQ ID NO: 3062064 - protein, 13 aa, Giardia lamblia
RESSKDLLNPEGE

SEQ ID NO: 3062065 - protein, 5 aa, Giardia lamblia
RESSS

SEQ ID NO: 3062066 - protein, 8 aa, Giardia lamblia
RESSSHYT

SEQ ID NO: 3062067 - protein, 26 aa, Giardia lamblia
RESSSLKQLSEQSISRLGTGRQSIDE

SEQ ID NO: 3062068 - protein, 6 aa, Giardia lamblia
RESTGH

SEQ ID NO: 3062069 - protein, 6 aa, Giardia lamblia
RESTMR

SEQ ID NO: 3062070 - protein, 5 aa, Giardia lamblia
RESVL

SEQ ID NO: 3062071 - protein, 7 aa, Giardia lamblia
RETADID

SEQ ID NO: 3062072 - protein, 5 aa, Giardia lamblia
RETAV

SEQ ID NO: 3062073 - protein, 5 aa, Giardia lamblia
RETEH

SEQ ID NO: 3062074 - protein, 11 aa, Giardia lamblia
RETIESRSKEL

SEQ ID NO: 3062075 - protein, 8 aa, Giardia lamblia
RETPSTDD

SEQ ID NO: 3062076 - protein, 5 aa, Giardia lamblia
RETQN

SEQ ID NO: 3062077 - protein, 4 aa, Giardia lamblia
RETS

SEQ ID NO: 3062078 - protein, 4 aa, Giardia lamblia
REVD

SEQ ID NO: 3062079 - protein, 13 aa, Giardia lamblia
REVSPDATAEERA

SEQ ID NO: 3062080 - protein, 4 aa, Giardia lamblia
REYE

SEQ ID NO: 3062081 - protein, 9 aa, Giardia lamblia
RFAGKNPTL

SEQ ID NO: 3062082 - protein, 6 aa, Giardia lamblia
RFAGTN

SEQ ID NO: 3062083 - protein, 9 aa, Giardia lamblia
RFDAQQGNF

SEQ ID NO: 3062084 - protein, 6 aa, Giardia lamblia
RFGGPK

SEQ ID NO: 3062085 - protein, 6 aa, Giardia lamblia
RFGRSK

SEQ ID NO: 3062086 - protein, 5 aa, Giardia lamblia
RFNAR

SEQ ID NO: 3062087 - protein, 5 aa, Giardia lamblia
RFNET

SEQ ID NO: 3062088 - protein, 24 aa, Giardia lamblia
RFRRGQGEQTFSPSVSARTPVGET

SEQ ID NO: 3062089 - protein, 6 aa, Giardia lamblia
RFSGKT

SEQ ID NO: 3062090 - protein, 8 aa, Giardia lamblia
RGAADEQR

SEQ ID NO: 3062091 - protein, 7 aa, Giardia lamblia
RGANAHS

SEQ ID NO: 3062092 - protein, 9 aa, Giardia lamblia
RGANPPSMA

SEQ ID NO: 3062093 - protein, 16 aa, Giardia lamblia
RGDAAKKLASKQNQCT

SEQ ID NO: 3062094 - protein, 4 aa, Giardia lamblia
RGDC

SEQ ID NO: 3062095 - protein, 12 aa, Giardia lamblia
RGDEDSLDPDPI

SEQ ID NO: 3062096 - protein, 7 aa, Giardia lamblia
RGDLSPD

SEQ ID NO: 3062097 - protein, 4 aa, Giardia lamblia
RGEE

SEQ ID NO: 3062098 - protein, 4 aa, Giardia lamblia
RGEK

SEQ ID NO: 3062099 - protein, 13 aa, Giardia lamblia
RGELTSAANTAIR

SEQ ID NO: 3062100 - protein, 4 aa, Giardia lamblia
RGEQ

SEQ ID NO: 3062101 - protein, 7 aa, Giardia lamblia
RGESAAG

SEQ ID NO: 3062102 - protein, 13 aa, Giardia lamblia
RGESSPCLNQPVD

SEQ ID NO: 3062103 - protein, 5 aa, Giardia lamblia
RGGPC

SEQ ID NO: 3062104 - protein, 5 aa, Giardia lamblia
RGGSI

SEQ ID NO: 3062105 - protein, 10 aa, Giardia lamblia
RGGTKSSNSL

SEQ ID NO: 3062106 - protein, 15 aa, Giardia lamblia
RGHTAQAVKRSNPAL

SEQ ID NO: 3062107 - protein, 6 aa, Giardia lamblia
RGIEPE

SEQ ID NO: 3062108 - protein, 9 aa, Giardia lamblia
RGIKQGNPT

SEQ ID NO: 3062109 - protein, 6 aa, Giardia lamblia
RGIRGQ

SEQ ID NO: 3062110 - protein, 5 aa, Giardia lamblia
RGKEI

SEQ ID NO: 3062111 - protein, 13 aa, Giardia lamblia
RGKETTCNSTQSQ

SEQ ID NO: 3062112 - protein, 8 aa, Giardia lamblia
RGKFSGLG

SEQ ID NO: 3062113 - protein, 10 aa, Giardia lamblia
RGKRGPTGVS

SEQ ID NO: 3062114 - protein, 14 aa, Giardia lamblia
RGKRQAVEGAATSA

SEQ ID NO: 3062115 - protein, 5 aa, Giardia lamblia
RGLAQ

SEQ ID NO: 3062116 - protein, 6 aa, Giardia lamblia
RGLNGQ

SEQ ID NO: 3062117 - protein, 4 aa, Giardia lamblia
RGLP

SEQ ID NO: 3062118 - protein, 6 aa, Giardia lamblia
RGLSTG

SEQ ID NO: 3062119 - protein, 7 aa, Giardia lamblia
RGNDDGA

SEQ ID NO: 3062120 - protein, 9 aa, Giardia lamblia
RGNENSLDV

SEQ ID NO: 3062121 - protein, 4 aa, Giardia lamblia
RGNF

SEQ ID NO: 3062122 - protein, 10 aa, Giardia lamblia
RGNKDRASIP

SEQ ID NO: 3062123 - protein, 7 aa, Giardia lamblia
RGQDNTN

SEQ ID NO: 3062124 - protein, 12 aa, Giardia lamblia
RGRDSRPSYTVT

SEQ ID NO: 3062125 - protein, 23 aa, Giardia lamblia
RGRGNAKDGDTSDGNESTNSGMT

SEQ ID NO: 3062126 - protein, 5 aa, Giardia lamblia
RGRTE

SEQ ID NO: 3062127 - protein, 6 aa, Giardia lamblia
RGRTHT

SEQ ID NO: 3062128 - protein, 8 aa, Giardia lamblia
RGSAKVTD

SEQ ID NO: 3062129 - protein, 4 aa, Giardia lamblia
RGSD

SEQ ID NO: 3062130 - protein, 8 aa, Giardia lamblia
RGSEDPCT

SEQ ID NO: 3062131 - protein, 5 aa, Giardia lamblia
RGSEL

SEQ ID NO: 3062132 - protein, 15 aa, Giardia lamblia
RGSGFGGSRDMLTSR

SEQ ID NO: 3062133 - protein, 6 aa, Giardia lamblia
RGSGRS

SEQ ID NO: 3062134 - protein, 8 aa, Giardia lamblia
RGSGTRAF

SEQ ID NO: 3062135 - protein, 12 aa, Giardia lamblia
RGSIPIKDANDL

SEQ ID NO: 3062136 - protein, 17 aa, Giardia lamblia
RGSKDTLASSAANLKDC

SEQ ID NO: 3062137 - protein, 5 aa, Giardia lamblia
RGSKI

SEQ ID NO: 3062138 - protein, 5 aa, Giardia lamblia
RGTAD

SEQ ID NO: 3062139 - protein, 13 aa, Giardia lamblia
RGTCSYDESSDSF

SEQ ID NO: 3062140 - protein, 6 aa, Giardia lamblia
RGTDAN

SEQ ID NO: 3062141 - protein, 7 aa, Giardia lamblia
RGTDEQT

SEQ ID NO: 3062142 - protein, 6 aa, Giardia lamblia
RGTEGY

SEQ ID NO: 3062143 - protein, 9 aa, Giardia lamblia
RGTPAKRNI

SEQ ID NO: 3062144 - protein, 5 aa, Giardia lamblia
RGTSA

SEQ ID NO: 3062145 - protein, 14 aa, Giardia lamblia
RGVSSSYAENTAPV

SEQ ID NO: 3062146 - protein, 8 aa, Giardia lamblia
RGWNNGTT

SEQ ID NO: 3062147 - protein, 6 aa, Giardia lamblia
RGYSQE

SEQ ID NO: 3062148 - protein, 5 aa, Giardia lamblia
RHDGK

SEQ ID NO: 3062149 - protein, 5 aa, Giardia lamblia
RHEKP

SEQ ID NO: 3062150 - protein, 35 aa, Giardia lamblia
RHETDPSTRLNSSDAGLEGSDDAHQSRTNLSKRDR

SEQ ID NO: 3062151 - protein, 4 aa, Giardia lamblia
RHGP

SEQ ID NO: 3062152 - protein, 7 aa, Giardia lamblia
RHGTSEP

SEQ ID NO: 3062153 - protein, 10 aa, Giardia lamblia
RHKSLPSQRL

SEQ ID NO: 3062154 - protein, 6 aa, Giardia lamblia
RHKTER

SEQ ID NO: 3062155 - protein, 4 aa, Giardia lamblia
RHNG

SEQ ID NO: 3062156 - protein, 25 aa, Giardia lamblia
RHNNNSNSSNSKAHYSTEVAKSTQP

SEQ ID NO: 3062157 - protein, 7 aa, Giardia lamblia
RHPTSER

SEQ ID NO: 3062158 - protein, 13 aa, Giardia lamblia
RHRGEKEPQDKTY

SEQ ID NO: 3062159 - protein, 8 aa, Giardia lamblia
RHRTSGGY

SEQ ID NO: 3062160 - protein, 5 aa, Giardia lamblia
RHSAA

SEQ ID NO: 3062161 - protein, 7 aa, Giardia lamblia
RHSTDKA

SEQ ID NO: 3062162 - protein, 7 aa, Giardia lamblia
RHTGSEP

SEQ ID NO: 3062163 - protein, 16 aa, Giardia lamblia
RHTQTTDKAFPQVPPR

SEQ ID NO: 3062164 - protein, 13 aa, Giardia lamblia
RHTSSLSRTEKHS

SEQ ID NO: 3062165 - protein, 7 aa, Giardia lamblia
RHTSSPE

SEQ ID NO: 3062166 - protein, 7 aa, Giardia lamblia
RHVEKES

SEQ ID NO: 3062167 - protein, 4 aa, Giardia lamblia
RIAA

SEQ ID NO: 3062168 - protein, 15 aa, Giardia lamblia
RIDDAATDMNNRKRQ

SEQ ID NO: 3062169 - protein, 6 aa, Giardia lamblia
RIDESG

SEQ ID NO: 3062170 - protein, 4 aa, Giardia lamblia
RIDP

SEQ ID NO: 3062171 - protein, 6 aa, Giardia lamblia
RIDPAA

SEQ ID NO: 3062172 - protein, 11 aa, Giardia lamblia
RIDRPKPESIR

SEQ ID NO: 3062173 - protein, 10 aa, Giardia lamblia
RIEESTSASC

SEQ ID NO: 3062174 - protein, 16 aa, Giardia lamblia
RIGASPSTTALVRPKS

SEQ ID NO: 3062175 - protein, 47 aa, Giardia lamblia
RIPDIQNESPYNPVKSKSRSSSNYSAHGTRSMGSTTASSLSTGPVGI

SEQ ID NO: 3062176 - protein, 13 aa, Giardia lamblia
RIPHTDDDDEVGY

SEQ ID NO: 3062177 - protein, 5 aa, Giardia lamblia
RIPTG

SEQ ID NO: 3062178 - protein, 5 aa, Giardia lamblia
RIPTY

SEQ ID NO: 3062179 - protein, 10 aa, Giardia lamblia
RIQNEKGQTS

SEQ ID NO: 3062180 - protein, 8 aa, Giardia lamblia
RIQNTEGY

SEQ ID NO: 3062181 - protein, 15 aa, Giardia lamblia
RIREDGVDHESSECD

SEQ ID NO: 3062182 - protein, 15 aa, Giardia lamblia
RIRPTATEALQNPKF

SEQ ID NO: 3062183 - protein, 8 aa, Giardia lamblia
RISEETKR

SEQ ID NO: 3062184 - protein, 6 aa, Giardia lamblia
RISKRD

SEQ ID NO: 3062185 - protein, 13 aa, Giardia lamblia
RISPTRGSSPKRL

SEQ ID NO: 3062186 - protein, 9 aa, Giardia lamblia
RKADGSEDT

SEQ ID NO: 3062187 - protein, 20 aa, Giardia lamblia
RKAENSEKVESHATVQQSEV

SEQ ID NO: 3062188 - protein, 5 aa, Giardia lamblia
RKAFS

SEQ ID NO: 3062189 - protein, 6 aa, Giardia lamblia
RKAGPL

SEQ ID NO: 3062190 - protein, 16 aa, Giardia lamblia
RKAKQAQGKELASSSL

SEQ ID NO: 3062191 - protein, 8 aa, Giardia lamblia
RKAPTGGI

SEQ ID NO: 3062192 - protein, 7 aa, Giardia lamblia
RKARQDV

SEQ ID NO: 3062193 - protein, 24 aa, Giardia lamblia
RKASATPLDATAGSATEPEQRSTT

SEQ ID NO: 3062194 - protein, 11 aa, Giardia lamblia
RKASPAKKKTL

SEQ ID NO: 3062195 - protein, 7 aa, Giardia lamblia
RKATEEH

SEQ ID NO: 3062196 - protein, 8 aa, Giardia lamblia
RKAYTTPK

SEQ ID NO: 3062197 - protein, 5 aa, Giardia lamblia
RKCQT

SEQ ID NO: 3062198 - protein, 11 aa, Giardia lamblia
RKDAPPGHPDN

SEQ ID NO: 3062199 - protein, 11 aa, Giardia lamblia
RKDAPPRHPDN

SEQ ID NO: 3062200 - protein, 7 aa, Giardia lamblia
RKDDYSY

SEQ ID NO: 3062201 - protein, 42 aa, Giardia lamblia
RKDKASPIDNPRPVQTNPNHSDTAQSSTPSFYGTSSGANTIT

SEQ ID NO: 3062202 - protein, 17 aa, Giardia lamblia
RKDSQDTGRLSNKASIG

SEQ ID NO: 3062203 - protein, 6 aa, Giardia lamblia
RKDTHS

SEQ ID NO: 3062204 - protein, 14 aa, Giardia lamblia
RKESETLKRNEKNR

SEQ ID NO: 3062205 - protein, 37 aa, Giardia lamblia
RKETQAQPFSGLPDSTGDGFSKHPKGASTSSNTQLTQ

SEQ ID NO: 3062206 - protein, 13 aa, Giardia lamblia
RKETSLEGDEHIA

SEQ ID NO: 3062207 - protein, 16 aa, Giardia lamblia
RKGCSELNGRTAMAQN

SEQ ID NO: 3062208 - protein, 4 aa, Giardia lamblia
RKGI

SEQ ID NO: 3062209 - protein, 6 aa, Giardia lamblia
RKGKAK

SEQ ID NO: 3062210 - protein, 6 aa, Giardia lamblia
RKGLTP

SEQ ID NO: 3062211 - protein, 11 aa, Giardia lamblia
RKGRDSRSAGS

SEQ ID NO: 3062212 - protein, 4 aa, Giardia lamblia
RKGY

SEQ ID NO: 3062213 - protein, 5 aa, Giardia lamblia
RKITV

SEQ ID NO: 3062214 - protein, 8 aa, Giardia lamblia
RKKASRPF

SEQ ID NO: 3062215 - protein, 7 aa, Giardia lamblia
RKKGCGG

SEQ ID NO: 3062216 - protein, 5 aa, Giardia lamblia
RKKQQ

SEQ ID NO: 3062217 - protein, 4 aa, Giardia lamblia
RKKY

SEQ ID NO: 3062218 - protein, 11 aa, Giardia lamblia
RKLSKDSRKSM

SEQ ID NO: 3062219 - protein, 7 aa, Giardia lamblia
RKNESRS

SEQ ID NO: 3062220 - protein, 4 aa, Giardia lamblia
RKNG

SEQ ID NO: 3062221 - protein, 10 aa, Giardia lamblia
RKNHTKQING

SEQ ID NO: 3062222 - protein, 7 aa, Giardia lamblia
RKNMQRK

SEQ ID NO: 3062223 - protein, 8 aa, Giardia lamblia
RKNRPSAL

SEQ ID NO: 3062224 - protein, 9 aa, Giardia lamblia
RKPADSSTV

SEQ ID NO: 3062225 - protein, 5 aa, Giardia lamblia
RKPFN

SEQ ID NO: 3062226 - protein, 5 aa, Giardia lamblia
RKPNV

SEQ ID NO: 3062227 - protein, 4 aa, Giardia lamblia
RKPP

SEQ ID NO: 3062228 - protein, 19 aa, Giardia lamblia
RKPPKDTIQNAENCSRATG

SEQ ID NO: 3062229 - protein, 7 aa, Giardia lamblia
RKPRFNS

SEQ ID NO: 3062230 - protein, 9 aa, Giardia lamblia
RKPSSAQEL

SEQ ID NO: 3062231 - protein, 4 aa, Giardia lamblia
RKPT

SEQ ID NO: 3062232 - protein, 5 aa, Giardia lamblia
RKQFR

SEQ ID NO: 3062233 - protein, 7 aa, Giardia lamblia
RKQLEEE

SEQ ID NO: 3062234 - protein, 25 aa, Giardia lamblia
RKQLQSDSFKAAGLNKDCNKGGTVV

SEQ ID NO: 3062235 - protein, 21 aa, Giardia lamblia
RKQNSDPSMDDEHSDPRLDSD

SEQ ID NO: 3062236 - protein, 5 aa, Giardia lamblia
RKQQP

SEQ ID NO: 3062237 - protein, 7 aa, Giardia lamblia
RKRDREA

SEQ ID NO: 3062238 - protein, 9 aa, Giardia lamblia
RKREDEDGG

SEQ ID NO: 3062239 - protein, 8 aa, Giardia lamblia
RKRGPTGK

SEQ ID NO: 3062240 - protein, 17 aa, Giardia lamblia
RKRHTCKREPVPSTEPK

SEQ ID NO: 3062241 - protein, 19 aa, Giardia lamblia
RKRKKQKQAADLDSSVTSV

SEQ ID NO: 3062242 - protein, 7 aa, Giardia lamblia
RKRQLSR

SEQ ID NO: 3062243 - protein, 14 aa, Giardia lamblia
RKRSDAADTGQDQL

SEQ ID NO: 3062244 - protein, 11 aa, Giardia lamblia
RKRSIRPRTVS

SEQ ID NO: 3062245 - protein, 5 aa, Giardia lamblia
RKRST

SEQ ID NO: 3062246 - protein, 6 aa, Giardia lamblia
RKRTDS

SEQ ID NO: 3062247 - protein, 8 aa, Giardia lamblia
RKRTEADV

SEQ ID NO: 3062248 - protein, 21 aa, Giardia lamblia
RKRTSEDDSKKSKKGTKESKG

SEQ ID NO: 3062249 - protein, 34 aa, Giardia lamblia
RKRTSKAGSSRNSRHEETEGEMSGSRTTEKSAAN

SEQ ID NO: 3062250 - protein, 4 aa, Giardia lamblia
RKSC

SEQ ID NO: 3062251 - protein, 8 aa, Giardia lamblia
RKSGEKGQ

SEQ ID NO: 3062252 - protein, 8 aa, Giardia lamblia
RKSIYTPD

SEQ ID NO: 3062253 - protein, 10 aa, Giardia lamblia
RKSKQTIEKE

SEQ ID NO: 3062254 - protein, 7 aa, Giardia lamblia
RKSPYAE

SEQ ID NO: 3062255 - protein, 9 aa, Giardia lamblia
RKSSGSNSN

SEQ ID NO: 3062256 - protein, 13 aa, Giardia lamblia
RKSSQKNKGNGLS

SEQ ID NO: 3062257 - protein, 15 aa, Giardia lamblia
RKSTGSTSPNSRSVK

SEQ ID NO: 3062258 - protein, 12 aa, Giardia lamblia
RKTADSRRKNSL

SEQ ID NO: 3062259 - protein, 6 aa, Giardia lamblia
RKTEIA

SEQ ID NO: 3062260 - protein, 5 aa, Giardia lamblia
RKTGG

SEQ ID NO: 3062261 - protein, 5 aa, Giardia lamblia
RKTLE

SEQ ID NO: 3062262 - protein, 11 aa, Giardia lamblia
RKTSRKDAAPF

SEQ ID NO: 3062263 - protein, 7 aa, Giardia lamblia
RKTSTEG

SEQ ID NO: 3062264 - protein, 22 aa, Giardia lamblia
RKTSTKKKTEDDKQSEEPSSIN

SEQ ID NO: 3062265 - protein, 20 aa, Giardia lamblia
RKTTKHGLSTNPVTLTTMVS

SEQ ID NO: 3062266 - protein, 8 aa, Giardia lamblia
RKYLATQS

SEQ ID NO: 3062267 - protein, 6 aa, Giardia lamblia
RKYRES

SEQ ID NO: 3062268 - protein, 6 aa, Giardia lamblia
RKYRPK

SEQ ID NO: 3062269 - protein, 11 aa, Giardia lamblia
RKYSLEEEMPA

SEQ ID NO: 3062270 - protein, 10 aa, Giardia lamblia
RLAEEDPDNV

SEQ ID NO: 3062271 - protein, 23 aa, Giardia lamblia
RLAGSSDSEEDELSSSTSITEST

SEQ ID NO: 3062272 - protein, 7 aa, Giardia lamblia
RLAPTGT

SEQ ID NO: 3062273 - protein, 6 aa, Giardia lamblia
RLAQEN

SEQ ID NO: 3062274 - protein, 4 aa, Giardia lamblia
RLDS

SEQ ID NO: 3062275 - protein, 10 aa, Giardia lamblia
RLDSSDSVIP

SEQ ID NO: 3062276 - protein, 7 aa, Giardia lamblia
RLDTTTA

SEQ ID NO: 3062277 - protein, 7 aa, Giardia lamblia
RLEEQGE

SEQ ID NO: 3062278 - protein, 11 aa, Giardia lamblia
RLGGPSATEDE

SEQ ID NO: 3062279 - protein, 8 aa, Giardia lamblia
RLGNSKED

SEQ ID NO: 3062280 - protein, 10 aa, Giardia lamblia
RLKEKGGVAR

SEQ ID NO: 3062281 - protein, 9 aa, Giardia lamblia
RLKTEQGRK

SEQ ID NO: 3062282 - protein, 6 aa, Giardia lamblia
RLNEDN

SEQ ID NO: 3062283 - protein, 17 aa, Giardia lamblia
RLNSPGQKQDLGLRDKR

SEQ ID NO: 3062284 - protein, 14 aa, Giardia lamblia
RLPESSSQPPDPEE

SEQ ID NO: 3062285 - protein, 9 aa, Giardia lamblia
RLPGQTDDF

SEQ ID NO: 3062286 - protein, 6 aa, Giardia lamblia
RLPNAS

SEQ ID NO: 3062287 - protein, 8 aa, Giardia lamblia
RLPPLSKK

SEQ ID NO: 3062288 - protein, 4 aa, Giardia lamblia
RLPS

SEQ ID NO: 3062289 - protein, 4 aa, Giardia lamblia
RLPT

SEQ ID NO: 3062290 - protein, 10 aa, Giardia lamblia
RLQDRNGRTA

SEQ ID NO: 3062291 - protein, 5 aa, Giardia lamblia
RLQGV

SEQ ID NO: 3062292 - protein, 10 aa, Giardia lamblia
RLQPGAAGDS

SEQ ID NO: 3062293 - protein, 7 aa, Giardia lamblia
RLQRQDG

SEQ ID NO: 3062294 - protein, 8 aa, Giardia lamblia
RLSGGDPA

SEQ ID NO: 3062295 - protein, 4 aa, Giardia lamblia
RLSS

SEQ ID NO: 3062296 - protein, 5 aa, Giardia lamblia
RLSSD

SEQ ID NO: 3062297 - protein, 7 aa, Giardia lamblia
RLSSSNR

SEQ ID NO: 3062298 - protein, 6 aa, Giardia lamblia
RLTEEY

SEQ ID NO: 3062299 - protein, 10 aa, Giardia lamblia
RLTEQKEDGL

SEQ ID NO: 3062300 - protein, 8 aa, Giardia lamblia
RLTGRRKI

SEQ ID NO: 3062301 - protein, 16 aa, Giardia lamblia
RLYDESAAKMEQQYSR

SEQ ID NO: 3062302 - protein, 6 aa, Giardia lamblia
RMGPTS

SEQ ID NO: 3062303 - protein, 8 aa, Giardia lamblia
RMKGSQSR

SEQ ID NO: 3062304 - protein, 7 aa, Giardia lamblia
RMNGDSA

SEQ ID NO: 3062305 - protein, 5 aa, Giardia lamblia
RMQTS

SEQ ID NO: 3062306 - protein, 6 aa, Giardia lamblia
RMSEPP

SEQ ID NO: 3062307 - protein, 4 aa, Giardia lamblia
RMSY

SEQ ID NO: 3062308 - protein, 8 aa, Giardia lamblia
RNAGETIG

SEQ ID NO: 3062309 - protein, 7 aa, Giardia lamblia
RNAPTGD

SEQ ID NO: 3062310 - protein, 8 aa, Giardia lamblia
RNAQFTPS

SEQ ID NO: 3062311 - protein, 10 aa, Giardia lamblia
RNAQSSGRSC

SEQ ID NO: 3062312 - protein, 7 aa, Giardia lamblia
RNARSLD

SEQ ID NO: 3062313 - protein, 16 aa, Giardia lamblia
RNDDSLPGRLSTHNND

SEQ ID NO: 3062314 - protein, 14 aa, Giardia lamblia
RNDPDSKKKIQKAI

SEQ ID NO: 3062315 - protein, 12 aa, Giardia lamblia
RNDQAANDAGSQ

SEQ ID NO: 3062316 - protein, 23 aa, Giardia lamblia
RNEASVRSALDNRQHSDRKTTMD

SEQ ID NO: 3062317 - protein, 9 aa, Giardia lamblia
RNEDPQQTP

SEQ ID NO: 3062318 - protein, 5 aa, Giardia lamblia
RNGAG

SEQ ID NO: 3062319 - protein, 5 aa, Giardia lamblia
RNGET

SEQ ID NO: 3062320 - protein, 6 aa, Giardia lamblia
RNGGGY

SEQ ID NO: 3062321 - protein, 6 aa, Giardia lamblia
RNGGQR

SEQ ID NO: 3062322 - protein, 27 aa, Giardia lamblia
RNGNDLDASTDKANSPEAVAANETTNG

SEQ ID NO: 3062323 - protein, 10 aa, Giardia lamblia
RNGPKTTQVA

SEQ ID NO: 3062324 - protein, 6 aa, Giardia lamblia
RNGPNK

SEQ ID NO: 3062325 - protein, 6 aa, Giardia lamblia
RNGQSC

SEQ ID NO: 3062326 - protein, 7 aa, Giardia lamblia
RNGRSYS

SEQ ID NO: 3062327 - protein, 6 aa, Giardia lamblia
RNGSNL

SEQ ID NO: 3062328 - protein, 9 aa, Giardia lamblia
RNKAGANSL

SEQ ID NO: 3062329 - protein, 12 aa, Giardia lamblia
RNKTEASHENSC

SEQ ID NO: 3062330 - protein, 7 aa, Giardia lamblia
RNNASLR

SEQ ID NO: 3062331 - protein, 8 aa, Giardia lamblia
RNNGGYTG

SEQ ID NO: 3062332 - protein, 5 aa, Giardia lamblia
RNNNA

SEQ ID NO: 3062333 - protein, 11 aa, Giardia lamblia
RNNPHIARSGS

SEQ ID NO: 3062334 - protein, 4 aa, Giardia lamblia
RNNT

SEQ ID NO: 3062335 - protein, 7 aa, Giardia lamblia
RNPAAVG

SEQ ID NO: 3062336 - protein, 6 aa, Giardia lamblia
RNPAYM

SEQ ID NO: 3062337 - protein, 12 aa, Giardia lamblia
RNPGAALKGSHI

SEQ ID NO: 3062338 - protein, 6 aa, Giardia lamblia
RNPKSV

SEQ ID NO: 3062339 - protein, 11 aa, Giardia lamblia
RNPSASSSATS

SEQ ID NO: 3062340 - protein, 21 aa, Giardia lamblia
RNPSGEQVVEPEDSSDLEMST

SEQ ID NO: 3062341 - protein, 6 aa, Giardia lamblia
RNQGKC

SEQ ID NO: 3062342 - protein, 5 aa, Giardia lamblia
RNRRP

SEQ ID NO: 3062343 - protein, 4 aa, Giardia lamblia
RNRS

SEQ ID NO: 3062344 - protein, 4 aa, Giardia lamblia
RNRY

SEQ ID NO: 3062345 - protein, 8 aa, Giardia lamblia
RNSAGSTD

SEQ ID NO: 3062346 - protein, 14 aa, Giardia lamblia
RNSGERGKFTAGGV

SEQ ID NO: 3062347 - protein, 10 aa, Giardia lamblia
RNSISSKSGS

SEQ ID NO: 3062348 - protein, 4 aa, Giardia lamblia
RNSR

SEQ ID NO: 3062349 - protein, 10 aa, Giardia lamblia
RNSSNPRDNE

SEQ ID NO: 3062350 - protein, 6 aa, Giardia lamblia
RNSTAY

SEQ ID NO: 3062351 - protein, 10 aa, Giardia lamblia
RNTAGRPDGL

SEQ ID NO: 3062352 - protein, 6 aa, Giardia lamblia
RNTDEP

SEQ ID NO: 3062353 - protein, 5 aa, Giardia lamblia
RNTDI

SEQ ID NO: 3062354 - protein, 12 aa, Giardia lamblia
RNTKQPSSINPD

SEQ ID NO: 3062355 - protein, 4 aa, Giardia lamblia
RNTN

SEQ ID NO: 3062356 - protein, 7 aa, Giardia lamblia
RNTRKGV

SEQ ID NO: 3062357 - protein, 4 aa, Giardia lamblia
RNYL

SEQ ID NO: 3062358 - protein, 6 aa, Giardia lamblia
RNYTPA

SEQ ID NO: 3062359 - protein, 5 aa, Giardia lamblia
RPAEM

SEQ ID NO: 3062360 - protein, 7 aa, Giardia lamblia
RPAGVGT

SEQ ID NO: 3062361 - protein, 6 aa, Giardia lamblia
RPAPEL

SEQ ID NO: 3062362 - protein, 6 aa, Giardia lamblia
RPAPIS

SEQ ID NO: 3062363 - protein, 27 aa, Giardia lamblia
RPAPSASSVTQLADKPTALIPQDNDAE

SEQ ID NO: 3062364 - protein, 4 aa, Giardia lamblia
RPDL

SEQ ID NO: 3062365 - protein, 5 aa, Giardia lamblia
RPDLQ

SEQ ID NO: 3062366 - protein, 17 aa, Giardia lamblia
RPDPSKPNSSLPEPPRL

SEQ ID NO: 3062367 - protein, 8 aa, Giardia lamblia
RPDPTVPS

SEQ ID NO: 3062368 - protein, 10 aa, Giardia lamblia
RPEAPPPGVP

SEQ ID NO: 3062369 - protein, 5 aa, Giardia lamblia
RPERV

SEQ ID NO: 3062370 - protein, 5 aa, Giardia lamblia
RPETI

SEQ ID NO: 3062371 - protein, 12 aa, Giardia lamblia
RPGASPTLTPDT

SEQ ID NO: 3062372 - protein, 5 aa, Giardia lamblia
RPGNE

SEQ ID NO: 3062373 - protein, 6 aa, Giardia lamblia
RPGVSA

SEQ ID NO: 3062374 - protein, 20 aa, Giardia lamblia
RPHTSAPEVDTEIPEDSSAR

SEQ ID NO: 3062375 - protein, 4 aa, Giardia lamblia
RPIS

SEQ ID NO: 3062376 - protein, 15 aa, Giardia lamblia
RPKASGKQQGKDDTQ

SEQ ID NO: 3062377 - protein, 9 aa, Giardia lamblia
RPKDSRTGR

SEQ ID NO: 3062378 - protein, 4 aa, Giardia lamblia
RPKL

SEQ ID NO: 3062379 - protein, 6 aa, Giardia lamblia
RPKTAL

SEQ ID NO: 3062380 - protein, 4 aa, Giardia lamblia
RPLE

SEQ ID NO: 3062381 - protein, 26 aa, Giardia lamblia
RPLGPKHKELPDYASTKEPKRSASRK

SEQ ID NO: 3062382 - protein, 28 aa, Giardia lamblia
RPLQKSPSLPPKPHGSKYGESPKSPRHE

SEQ ID NO: 3062383 - protein, 6 aa, Giardia lamblia
RPLSKA

SEQ ID NO: 3062384 - protein, 4 aa, Giardia lamblia
RPND

SEQ ID NO: 3062385 - protein, 17 aa, Giardia lamblia
RPNEEKKEPISPPSEAV

SEQ ID NO: 3062386 - protein, 6 aa, Giardia lamblia
RPNEPQ

SEQ ID NO: 3062387 - protein, 7 aa, Giardia lamblia
RPNSTQK

SEQ ID NO: 3062388 - protein, 7 aa, Giardia lamblia
RPPGASH

SEQ ID NO: 3062389 - protein, 6 aa, Giardia lamblia
RPPGSR

SEQ ID NO: 3062390 - protein, 4 aa, Giardia lamblia
RPPL

SEQ ID NO: 3062391 - protein, 21 aa, Giardia lamblia
RPPNDKTAHTCSDTSARGIPG

SEQ ID NO: 3062392 - protein, 5 aa, Giardia lamblia
RPPPG

SEQ ID NO: 3062393 - protein, 5 aa, Giardia lamblia
RPPRS

SEQ ID NO: 3062394 - protein, 6 aa, Giardia lamblia
RPPSAE

SEQ ID NO: 3062395 - protein, 6 aa, Giardia lamblia
RPPTTI

SEQ ID NO: 3062396 - protein, 29 aa, Giardia lamblia
RPQGKADGSVRSISTPVQTRSSAVGGNGI

SEQ ID NO: 3062397 - protein, 6 aa, Giardia lamblia
RPQPPL

SEQ ID NO: 3062398 - protein, 11 aa, Giardia lamblia
RPQSTLDSERL

SEQ ID NO: 3062399 - protein, 33 aa, Giardia lamblia
RPRASSVADYNSGSDRQEIGSSPERSSSTSPQY

SEQ ID NO: 3062400 - protein, 8 aa, Giardia lamblia
RPRPRNTH

SEQ ID NO: 3062401 - protein, 6 aa, Giardia lamblia
RPRPRQ

SEQ ID NO: 3062402 - protein, 9 aa, Giardia lamblia
RPRPSDEKL

SEQ ID NO: 3062403 - protein, 4 aa, Giardia lamblia
RPRR

SEQ ID NO: 3062404 - protein, 6 aa, Giardia lamblia
RPRTTM

SEQ ID NO: 3062405 - protein, 9 aa, Giardia lamblia
RPSAGDPAI

SEQ ID NO: 3062406 - protein, 8 aa, Giardia lamblia
RPSDAEKA

SEQ ID NO: 3062407 - protein, 5 aa, Giardia lamblia
RPSEM

SEQ ID NO: 3062408 - protein, 6 aa, Giardia lamblia
RPSEQE

SEQ ID NO: 3062409 - protein, 11 aa, Giardia lamblia
RPSGKADGLPG

SEQ ID NO: 3062410 - protein, 7 aa, Giardia lamblia
RPSKPVQ

SEQ ID NO: 3062411 - protein, 9 aa, Giardia lamblia
RPSKSVEPL

SEQ ID NO: 3062412 - protein, 5 aa, Giardia lamblia
RPSLA

SEQ ID NO: 3062413 - protein, 6 aa, Giardia lamblia
RPSLND

SEQ ID NO: 3062414 - protein, 5 aa, Giardia lamblia
RPSND

SEQ ID NO: 3062415 - protein, 4 aa, Giardia lamblia
RPSR

SEQ ID NO: 3062416 - protein, 10 aa, Giardia lamblia
RPSSASTALA

SEQ ID NO: 3062417 - protein, 9 aa, Giardia lamblia
RPSSNGGIN

SEQ ID NO: 3062418 - protein, 9 aa, Giardia lamblia
RPSSSTRPR

SEQ ID NO: 3062419 - protein, 13 aa, Giardia lamblia
RPSTALSSYTRGL

SEQ ID NO: 3062420 - protein, 5 aa, Giardia lamblia
RPTAI

SEQ ID NO: 3062421 - protein, 8 aa, Giardia lamblia
RPTASEQY

SEQ ID NO: 3062422 - protein, 8 aa, Giardia lamblia
RPTASTAS

SEQ ID NO: 3062423 - protein, 5 aa, Giardia lamblia
RPTDD

SEQ ID NO: 3062424 - protein, 4 aa, Giardia lamblia
RPTF

SEQ ID NO: 3062425 - protein, 5 aa, Giardia lamblia
RPTME

SEQ ID NO: 3062426 - protein, 6 aa, Giardia lamblia
RPTPSK

SEQ ID NO: 3062427 - protein, 8 aa, Giardia lamblia
RPTRSGYD

SEQ ID NO: 3062428 - protein, 5 aa, Giardia lamblia
RPVNN

SEQ ID NO: 3062429 - protein, 25 aa, Giardia lamblia
RPVQDPSGCDNTVPAQHGEAHGNTA

SEQ ID NO: 3062430 - protein, 4 aa, Giardia lamblia
RPYP

SEQ ID NO: 3062431 - protein, 6 aa, Giardia lamblia
RPYPYE

SEQ ID NO: 3062432 - protein, 11 aa, Giardia lamblia
RQANIESSKTT

SEQ ID NO: 3062433 - protein, 7 aa, Giardia lamblia
RQARQDK

SEQ ID NO: 3062434 - protein, 7 aa, Giardia lamblia
RQATIPD

SEQ ID NO: 3062435 - protein, 5 aa, Giardia lamblia
RQDKT

SEQ ID NO: 3062436 - protein, 5 aa, Giardia lamblia
RQDLP

SEQ ID NO: 3062437 - protein, 4 aa, Giardia lamblia
RQDP

SEQ ID NO: 3062438 - protein, 14 aa, Giardia lamblia
RQEGRPLAGSTTEE

SEQ ID NO: 3062439 - protein, 7 aa, Giardia lamblia
RQEMKQS

SEQ ID NO: 3062440 - protein, 21 aa, Giardia lamblia
RQEQTIPAPDKSEAFTARGRI

SEQ ID NO: 3062441 - protein, 15 aa, Giardia lamblia
RQETNQTNDPVGGVD

SEQ ID NO: 3062442 - protein, 5 aa, Giardia lamblia
RQEVS

SEQ ID NO: 3062443 - protein, 6 aa, Giardia lamblia
RQGDTK

SEQ ID NO: 3062444 - protein, 8 aa, Giardia lamblia
RQGGPGKC

SEQ ID NO: 3062445 - protein, 8 aa, Giardia lamblia
RQGKTGSM

SEQ ID NO: 3062446 - protein, 5 aa, Giardia lamblia
RQGSM

SEQ ID NO: 3062447 - protein, 4 aa, Giardia lamblia
RQIS

SEQ ID NO: 3062448 - protein, 10 aa, Giardia lamblia
RQKGKRTLRM

SEQ ID NO: 3062449 - protein, 9 aa, Giardia lamblia
RQKSEDKGG

SEQ ID NO: 3062450 - protein, 6 aa, Giardia lamblia
RQKSIS

SEQ ID NO: 3062451 - protein, 9 aa, Giardia lamblia
RQKSKPRNA

SEQ ID NO: 3062452 - protein, 7 aa, Giardia lamblia
RQLGEKR

SEQ ID NO: 3062453 - protein, 25 aa, Giardia lamblia
RQLSGSVDQTCATSTSPGAGDTVSR

SEQ ID NO: 3062454 - protein, 23 aa, Giardia lamblia
RQNASSLSSHHGEQLSKTTGSTF

SEQ ID NO: 3062455 - protein, 10 aa, Giardia lamblia
RQNASSSSYD

SEQ ID NO: 3062456 - protein, 8 aa, Giardia lamblia
RQNKEANI

SEQ ID NO: 3062457 - protein, 11 aa, Giardia lamblia
RQNSDPNSAYD

SEQ ID NO: 3062458 - protein, 6 aa, Giardia lamblia
RQNSYS

SEQ ID NO: 3062459 - protein, 7 aa, Giardia lamblia
RQNTSTY

SEQ ID NO: 3062460 - protein, 29 aa, Giardia lamblia
RQPKRIGDDVSEVGSTLRRNAAGMSATTS

SEQ ID NO: 3062461 - protein, 17 aa, Giardia lamblia
RQPLSSSDIAGPDTHLT

SEQ ID NO: 3062462 - protein, 6 aa, Giardia lamblia
RQPQSL

SEQ ID NO: 3062463 - protein, 9 aa, Giardia lamblia
RQQASFDAD

SEQ ID NO: 3062464 - protein, 10 aa, Giardia lamblia
RQQDAGSQEG

SEQ ID NO: 3062465 - protein, 4 aa, Giardia lamblia
RQQS

SEQ ID NO: 3062466 - protein, 10 aa, Giardia lamblia
RQQSADQSDW

SEQ ID NO: 3062467 - protein, 18 aa, Giardia lamblia
RQQSEPDLSRGSEKLGGP

SEQ ID NO: 3062468 - protein, 9 aa, Giardia lamblia
RQRDPADKQ

SEQ ID NO: 3062469 - protein, 7 aa, Giardia lamblia
RQREAEN

SEQ ID NO: 3062470 - protein, 7 aa, Giardia lamblia
RQRESEE

SEQ ID NO: 3062471 - protein, 9 aa, Giardia lamblia
RQRHKQKQE

SEQ ID NO: 3062472 - protein, 5 aa, Giardia lamblia
RQRKC

SEQ ID NO: 3062473 - protein, 14 aa, Giardia lamblia
RQRLSAEEQKAARL

SEQ ID NO: 3062474 - protein, 7 aa, Giardia lamblia
RQRQAAS

SEQ ID NO: 3062475 - protein, 15 aa, Giardia lamblia
RQRQANKSPYTPRSL

SEQ ID NO: 3062476 - protein, 23 aa, Giardia lamblia
RQRQQQQQQQQKSSSEGRQSDHT

SEQ ID NO: 3062477 - protein, 10 aa, Giardia lamblia
RQSDGACQQC

SEQ ID NO: 3062478 - protein, 10 aa, Giardia lamblia
RQSSTFSASS

SEQ ID NO: 3062479 - protein, 10 aa, Giardia lamblia
RQSSVTENNL

SEQ ID NO: 3062480 - protein, 4 aa, Giardia lamblia
RQSY

SEQ ID NO: 3062481 - protein, 6 aa, Giardia lamblia
RQTMDG

SEQ ID NO: 3062482 - protein, 7 aa, Giardia lamblia
RQYGEAE

SEQ ID NO: 3062483 - protein, 21 aa, Giardia lamblia
RQYYDPSLANPGCKSGCSGGV

SEQ ID NO: 3062484 - protein, 15 aa, Giardia lamblia
RRAAKEQERRQQRMS

SEQ ID NO: 3062485 - protein, 6 aa, Giardia lamblia
RRADAA

SEQ ID NO: 3062486 - protein, 6 aa, Giardia lamblia
RRADPG

SEQ ID NO: 3062487 - protein, 16 aa, Giardia lamblia
RRAERAGNQLPHPPGR

SEQ ID NO: 3062488 - protein, 27 aa, Giardia lamblia
RRAGALKDRKASAENVDSPGPSVPIPE

SEQ ID NO: 3062489 - protein, 12 aa, Giardia lamblia
RRAKKATDTPFK

SEQ ID NO: 3062490 - protein, 13 aa, Giardia lamblia
RRAKNKSHRGVHN

SEQ ID NO: 3062491 - protein, 10 aa, Giardia lamblia
RRATDPTYDP

SEQ ID NO: 3062492 - protein, 6 aa, Giardia lamblia
RRCKTQ

SEQ ID NO: 3062493 - protein, 5 aa, Giardia lamblia
RRDAE

SEQ ID NO: 3062494 - protein, 5 aa, Giardia lamblia
RRDDR

SEQ ID NO: 3062495 - protein, 18 aa, Giardia lamblia
RRDGPESRQELPSEGEEY

SEQ ID NO: 3062496 - protein, 6 aa, Giardia lamblia
RRDKNG

SEQ ID NO: 3062497 - protein, 8 aa, Giardia lamblia
RRDNSKNA

SEQ ID NO: 3062498 - protein, 14 aa, Giardia lamblia
RRDPLGNAENIQRA

SEQ ID NO: 3062499 - protein, 7 aa, Giardia lamblia
RRDPSEI

SEQ ID NO: 3062500 - protein, 7 aa, Giardia lamblia
RREDSAP

SEQ ID NO: 3062501 - protein, 11 aa, Giardia lamblia
RREEDSQKEAL

SEQ ID NO: 3062502 - protein, 9 aa, Giardia lamblia
RRENKGSQN

SEQ ID NO: 3062503 - protein, 11 aa, Giardia lamblia
RREQADGPSAS

SEQ ID NO: 3062504 - protein, 24 aa, Giardia lamblia
RREQGGTQTGTGMQQTATNKTLDT

SEQ ID NO: 3062505 - protein, 8 aa, Giardia lamblia
RRERNTKC

SEQ ID NO: 3062506 - protein, 15 aa, Giardia lamblia
RRERTGGTADSSYGD

SEQ ID NO: 3062507 - protein, 8 aa, Giardia lamblia
RRETRGSY

SEQ ID NO: 3062508 - protein, 12 aa, Giardia lamblia
RRETRKHELDGH

SEQ ID NO: 3062509 - protein, 7 aa, Giardia lamblia
RRGGPLR

SEQ ID NO: 3062510 - protein, 27 aa, Giardia lamblia
RRGGPLRERAPRKPPGLPKPQLTHNSS

SEQ ID NO: 3062511 - protein, 6 aa, Giardia lamblia
RRGGTG

SEQ ID NO: 3062512 - protein, 14 aa, Giardia lamblia
RRGLDTTTCSADSA

SEQ ID NO: 3062513 - protein, 8 aa, Giardia lamblia
RRGNTRSA

SEQ ID NO: 3062514 - protein, 22 aa, Giardia lamblia
RRGPKSLSTMAGSRRLAGTVDE

SEQ ID NO: 3062515 - protein, 6 aa, Giardia lamblia
RRGRAI

SEQ ID NO: 3062516 - protein, 6 aa, Giardia lamblia
RRGSSG

SEQ ID NO: 3062517 - protein, 4 aa, Giardia lamblia
RRGT

SEQ ID NO: 3062518 - protein, 7 aa, Giardia lamblia
RRGTKQA

SEQ ID NO: 3062519 - protein, 13 aa, Giardia lamblia
RRHGAGKAFSAGS

SEQ ID NO: 3062520 - protein, 6 aa, Giardia lamblia
RRHQQL

SEQ ID NO: 3062521 - protein, 4 aa, Giardia lamblia
RRIN

SEQ ID NO: 3062522 - protein, 6 aa, Giardia lamblia
RRKGIP

SEQ ID NO: 3062523 - protein, 14 aa, Giardia lamblia
RRKKSKNDNSEDKE

SEQ ID NO: 3062524 - protein, 11 aa, Giardia lamblia
RRKPDNSAVAQ

SEQ ID NO: 3062525 - protein, 17 aa, Giardia lamblia
RRKPSEKCTKCTTGDPV

SEQ ID NO: 3062526 - protein, 22 aa, Giardia lamblia
RRKRGPKPHKDAASSAVELSDE

SEQ ID NO: 3062527 - protein, 8 aa, Giardia lamblia
RRKSGNHR

SEQ ID NO: 3062528 - protein, 9 aa, Giardia lamblia
RRKSSESYY

SEQ ID NO: 3062529 - protein, 13 aa, Giardia lamblia
RRKTPSIDTAESM

SEQ ID NO: 3062530 - protein, 7 aa, Giardia lamblia
RRKVESR

SEQ ID NO: 3062531 - protein, 7 aa, Giardia lamblia
RRLSSEG

SEQ ID NO: 3062532 - protein, 5 aa, Giardia lamblia
RRNCG

SEQ ID NO: 3062533 - protein, 8 aa, Giardia lamblia
RRNDPLTK

SEQ ID NO: 3062534 - protein, 12 aa, Giardia lamblia
RRNSVSESNPAQ

SEQ ID NO: 3062535 - protein, 18 aa, Giardia lamblia
RRPHNNLTNAAATSAEFS

SEQ ID NO: 3062536 - protein, 5 aa, Giardia lamblia
RRPKD

SEQ ID NO: 3062537 - protein, 10 aa, Giardia lamblia
RRPKDRPNFD

SEQ ID NO: 3062538 - protein, 5 aa, Giardia lamblia
RRPSR

SEQ ID NO: 3062539 - protein, 8 aa, Giardia lamblia
RRPSSSAH

SEQ ID NO: 3062540 - protein, 6 aa, Giardia lamblia
RRPSTR

SEQ ID NO: 3062541 - protein, 10 aa, Giardia lamblia
RRPTSTTQLT

SEQ ID NO: 3062542 - protein, 6 aa, Giardia lamblia
RRPVSR

SEQ ID NO: 3062543 - protein, 5 aa, Giardia lamblia
RRQAQ

SEQ ID NO: 3062544 - protein, 6 aa, Giardia lamblia
RRQAST

SEQ ID NO: 3062545 - protein, 9 aa, Giardia lamblia
RRQKGESDF

SEQ ID NO: 3062546 - protein, 14 aa, Giardia lamblia
RRQQYSPAGSPQMN

SEQ ID NO: 3062547 - protein, 4 aa, Giardia lamblia
RRQS

SEQ ID NO: 3062548 - protein, 5 aa, Giardia lamblia
RRQSD

SEQ ID NO: 3062549 - protein, 15 aa, Giardia lamblia
RRQSGSANHSDELIL

SEQ ID NO: 3062550 - protein, 5 aa, Giardia lamblia
RRRLS

SEQ ID NO: 3062551 - protein, 20 aa, Giardia lamblia
RRRPRASTESEAAPLTGHDY

SEQ ID NO: 3062552 - protein, 13 aa, Giardia lamblia
RRRSAEKNTKLTD

SEQ ID NO: 3062553 - protein, 6 aa, Giardia lamblia
RRRSPR

SEQ ID NO: 3062554 - protein, 10 aa, Giardia lamblia
RRSAGNTGNF

SEQ ID NO: 3062555 - protein, 5 aa, Giardia lamblia
RRSAP

SEQ ID NO: 3062556 - protein, 11 aa, Giardia lamblia
RRSASDTGSEF

SEQ ID NO: 3062557 - protein, 4 aa, Giardia lamblia
RRSE

SEQ ID NO: 3062558 - protein, 5 aa, Giardia lamblia
RRSEF

SEQ ID NO: 3062559 - protein, 4 aa, Giardia lamblia
RRSI

SEQ ID NO: 3062560 - protein, 7 aa, Giardia lamblia
RRSRHLP

SEQ ID NO: 3062561 - protein, 14 aa, Giardia lamblia
RRSSPVTPTEKEDL

SEQ ID NO: 3062562 - protein, 9 aa, Giardia lamblia
RRTAHDVDA

SEQ ID NO: 3062563 - protein, 5 aa, Giardia lamblia
RRTAR

SEQ ID NO: 3062564 - protein, 9 aa, Giardia lamblia
RRTASSSNT

SEQ ID NO: 3062565 - protein, 7 aa, Giardia lamblia
RRTGEAC

SEQ ID NO: 3062566 - protein, 7 aa, Giardia lamblia
RRTLASH

SEQ ID NO: 3062567 - protein, 6 aa, Giardia lamblia
RRTRER

SEQ ID NO: 3062568 - protein, 9 aa, Giardia lamblia
RRTRSAEQY

SEQ ID NO: 3062569 - protein, 7 aa, Giardia lamblia
RRTTAEL

SEQ ID NO: 3062570 - protein, 25 aa, Giardia lamblia
RRVSSNSDDNAYNDNPEDQHNEIDV

SEQ ID NO: 3062571 - protein, 5 aa, Giardia lamblia
RRYES

SEQ ID NO: 3062572 - protein, 7 aa, Giardia lamblia
RRYPGSK

SEQ ID NO: 3062573 - protein, 8 aa, Giardia lamblia
RSAAQDDA

SEQ ID NO: 3062574 - protein, 4 aa, Giardia lamblia
RSAH

SEQ ID NO: 3062575 - protein, 64 aa, Giardia lamblia
RSAQHKNQLDDEIEAATNNNKNSNLNSTLNGTEREASGVRDRLSGQPPTPEAPRSSPGTSVGKQ

SEQ ID NO: 3062576 - protein, 5 aa, Giardia lamblia
RSAQS

SEQ ID NO: 3062577 - protein, 11 aa, Giardia lamblia
RSARSSRLTPA

SEQ ID NO: 3062578 - protein, 9 aa, Giardia lamblia
RSASTEQCR

SEQ ID NO: 3062579 - protein, 8 aa, Giardia lamblia
RSATGTYG

SEQ ID NO: 3062580 - protein, 4 aa, Giardia lamblia
RSDA

SEQ ID NO: 3062581 - protein, 7 aa, Giardia lamblia
RSDAGGI

SEQ ID NO: 3062582 - protein, 5 aa, Giardia lamblia
RSDAT

SEQ ID NO: 3062583 - protein, 6 aa, Giardia lamblia
RSDEEL

SEQ ID NO: 3062584 - protein, 9 aa, Giardia lamblia
RSDEEPLTR

SEQ ID NO: 3062585 - protein, 4 aa, Giardia lamblia
RSDM

SEQ ID NO: 3062586 - protein, 6 aa, Giardia lamblia
RSDPKE

SEQ ID NO: 3062587 - protein, 8 aa, Giardia lamblia
RSDSDIPR

SEQ ID NO: 3062588 - protein, 7 aa, Giardia lamblia
RSDSNEI

SEQ ID NO: 3062589 - protein, 5 aa, Giardia lamblia
RSDSS

SEQ ID NO: 3062590 - protein, 4 aa, Giardia lamblia
RSEA

SEQ ID NO: 3062591 - protein, 14 aa, Giardia lamblia
RSEAKSAGIPETRE

SEQ ID NO: 3062592 - protein, 8 aa, Giardia lamblia
RSEAPSLN

SEQ ID NO: 3062593 - protein, 5 aa, Giardia lamblia
RSEEV

SEQ ID NO: 3062594 - protein, 17 aa, Giardia lamblia
RSEGSSMVSDRSSIEIN

SEQ ID NO: 3062595 - protein, 8 aa, Giardia lamblia
RSESSTGA

SEQ ID NO: 3062596 - protein, 9 aa, Giardia lamblia
RSFDRRDTD

SEQ ID NO: 3062597 - protein, 6 aa, Giardia lamblia
RSFDSL

SEQ ID NO: 3062598 - protein, 12 aa, Giardia lamblia
RSGAEKTGHQDS

SEQ ID NO: 3062599 - protein, 7 aa, Giardia lamblia
RSGDGYT

SEQ ID NO: 3062600 - protein, 8 aa, Giardia lamblia
RSGEQCSA

SEQ ID NO: 3062601 - protein, 4 aa, Giardia lamblia
RSGG

SEQ ID NO: 3062602 - protein, 9 aa, Giardia lamblia
RSGGSMSSL

SEQ ID NO: 3062603 - protein, 7 aa, Giardia lamblia
RSGIGKS

SEQ ID NO: 3062604 - protein, 10 aa, Giardia lamblia
RSGIRSTSPW

SEQ ID NO: 3062605 - protein, 10 aa, Giardia lamblia
RSGKTCESGP

SEQ ID NO: 3062606 - protein, 4 aa, Giardia lamblia
RSGL

SEQ ID NO: 3062607 - protein, 10 aa, Giardia lamblia
RSGRGTQQAG

SEQ ID NO: 3062608 - protein, 7 aa, Giardia lamblia
RSGRQGT

SEQ ID NO: 3062609 - protein, 11 aa, Giardia lamblia
RSGSFSAQASL

SEQ ID NO: 3062610 - protein, 8 aa, Giardia lamblia
RSGSPANV

SEQ ID NO: 3062611 - protein, 5 aa, Giardia lamblia
RSGTT

SEQ ID NO: 3062612 - protein, 24 aa, Giardia lamblia
RSHKSLDTLETKPVQSLSKESAKD

SEQ ID NO: 3062613 - protein, 12 aa, Giardia lamblia
RSHSSTTPQTMP

SEQ ID NO: 3062614 - protein, 5 aa, Giardia lamblia
RSIQK

SEQ ID NO: 3062615 - protein, 15 aa, Giardia lamblia
RSIQPSYDYDPDSDD

SEQ ID NO: 3062616 - protein, 5 aa, Giardia lamblia
RSKAA

SEQ ID NO: 3062617 - protein, 6 aa, Giardia lamblia
RSKAQL

SEQ ID NO: 3062618 - protein, 26 aa, Giardia lamblia
RSKDPSQQVQPKGHLRTSSKQPRPSD

SEQ ID NO: 3062619 - protein, 6 aa, Giardia lamblia
RSKGNK

SEQ ID NO: 3062620 - protein, 24 aa, Giardia lamblia
RSKKASRPSSTKSPAKSAPTEAAT

SEQ ID NO: 3062621 - protein, 6 aa, Giardia lamblia
RSKQAY

SEQ ID NO: 3062622 - protein, 5 aa, Giardia lamblia
RSKSS

SEQ ID NO: 3062623 - protein, 11 aa, Giardia lamblia
RSKSSNGASTF

SEQ ID NO: 3062624 - protein, 9 aa, Giardia lamblia
RSKYSDETK

SEQ ID NO: 3062625 - protein, 21 aa, Giardia lamblia
RSLEAKKSHVHSTTGPKIPGE

SEQ ID NO: 3062626 - protein, 10 aa, Giardia lamblia
RSLEEASEAD

SEQ ID NO: 3062627 - protein, 22 aa, Giardia lamblia
RSLGSALGGSSDATASSRPTKP

SEQ ID NO: 3062628 - protein, 9 aa, Giardia lamblia
RSLKQAKTY

SEQ ID NO: 3062629 - protein, 16 aa, Giardia lamblia
RSLSHRKTRDAVNSIP

SEQ ID NO: 3062630 - protein, 16 aa, Giardia lamblia
RSLTNEKAGLTEPPKT

SEQ ID NO: 3062631 - protein, 10 aa, Giardia lamblia
RSMGSTLPNT

SEQ ID NO: 3062632 - protein, 11 aa, Giardia lamblia
RSMKKTNAKKD

SEQ ID NO: 3062633 - protein, 5 aa, Giardia lamblia
RSNAE

SEQ ID NO: 3062634 - protein, 5 aa, Giardia lamblia
RSNPI

SEQ ID NO: 3062635 - protein, 7 aa, Giardia lamblia
RSNSHTE

SEQ ID NO: 3062636 - protein, 12 aa, Giardia lamblia
RSNSSSGTPSSV

SEQ ID NO: 3062637 - protein, 5 aa, Giardia lamblia
RSNTI

SEQ ID NO: 3062638 - protein, 5 aa, Giardia lamblia
RSPEI

SEQ ID NO: 3062639 - protein, 8 aa, Giardia lamblia
RSPEQNPI

SEQ ID NO: 3062640 - protein, 28 aa, Giardia lamblia
RSPLGTPSSSSSTGTSSMQTVTSPNGTS

SEQ ID NO: 3062641 - protein, 6 aa, Giardia lamblia
RSPPYS

SEQ ID NO: 3062642 - protein, 5 aa, Giardia lamblia
RSPSY

SEQ ID NO: 3062643 - protein, 9 aa, Giardia lamblia
RSPTGAVSA

SEQ ID NO: 3062644 - protein, 5 aa, Giardia lamblia
RSPTQ

SEQ ID NO: 3062645 - protein, 15 aa, Giardia lamblia
RSPTQRLPDIPANPS

SEQ ID NO: 3062646 - protein, 5 aa, Giardia lamblia
RSPVA

SEQ ID NO: 3062647 - protein, 18 aa, Giardia lamblia
RSQDEASISAKKAGNVSP

SEQ ID NO: 3062648 - protein, 5 aa, Giardia lamblia
RSQDK

SEQ ID NO: 3062649 - protein, 4 aa, Giardia lamblia
RSQE

SEQ ID NO: 3062650 - protein, 8 aa, Giardia lamblia
RSQEKQHV

SEQ ID NO: 3062651 - protein, 13 aa, Giardia lamblia
RSQGTDSKTGPTI

SEQ ID NO: 3062652 - protein, 4 aa, Giardia lamblia
RSQS

SEQ ID NO: 3062653 - protein, 7 aa, Giardia lamblia
RSQSHPT

SEQ ID NO: 3062654 - protein, 5 aa, Giardia lamblia
RSQSR

SEQ ID NO: 3062655 - protein, 39 aa, Giardia lamblia
RSQSTLESWNDPTRGTVYSKTPDFTEQDASFDPSTTCSR

SEQ ID NO: 3062656 - protein, 10 aa, Giardia lamblia
RSQTSSEQAH

SEQ ID NO: 3062657 - protein, 10 aa, Giardia lamblia
RSRADARSIA

SEQ ID NO: 3062658 - protein, 4 aa, Giardia lamblia
RSRE

SEQ ID NO: 3062659 - protein, 6 aa, Giardia lamblia
RSREGE

SEQ ID NO: 3062660 - protein, 7 aa, Giardia lamblia
RSRHGEH

SEQ ID NO: 3062661 - protein, 10 aa, Giardia lamblia
RSRKQRSMRQ

SEQ ID NO: 3062662 - protein, 6 aa, Giardia lamblia
RSRQTE

SEQ ID NO: 3062663 - protein, 6 aa, Giardia lamblia
RSRRST

SEQ ID NO: 3062664 - protein, 36 aa, Giardia lamblia
RSRSEVTSGVSHTGTANPSQADSQTTSSSGTRRQKT

SEQ ID NO: 3062665 - protein, 7 aa, Giardia lamblia
RSRTNNA

SEQ ID NO: 3062666 - protein, 6 aa, Giardia lamblia
RSSAPD

SEQ ID NO: 3062667 - protein, 7 aa, Giardia lamblia
RSSAPLT

SEQ ID NO: 3062668 - protein, 10 aa, Giardia lamblia
RSSCKADSSF

SEQ ID NO: 3062669 - protein, 9 aa, Giardia lamblia
RSSDDTGTC

SEQ ID NO: 3062670 - protein, 4 aa, Giardia lamblia
RSSF

SEQ ID NO: 3062671 - protein, 9 aa, Giardia lamblia
RSSGDTGTC

SEQ ID NO: 3062672 - protein, 6 aa, Giardia lamblia
RSSGKC

SEQ ID NO: 3062673 - protein, 11 aa, Giardia lamblia
RSSGTTEGPAN

SEQ ID NO: 3062674 - protein, 11 aa, Giardia lamblia
RSSKDTTPYSQ

SEQ ID NO: 3062675 - protein, 10 aa, Giardia lamblia
RSSKHSNRLS

SEQ ID NO: 3062676 - protein, 15 aa, Giardia lamblia
RSSKRTSSASGDKQN

SEQ ID NO: 3062677 - protein, 12 aa, Giardia lamblia
RSSLNRTSSSVR

SEQ ID NO: 3062678 - protein, 25 aa, Giardia lamblia
RSSLPSSSHSDSVKPLKQSHSRKGN

SEQ ID NO: 3062679 - protein, 6 aa, Giardia lamblia
RSSPST

SEQ ID NO: 3062680 - protein, 6 aa, Giardia lamblia
RSSRAQ

SEQ ID NO: 3062681 - protein, 42 aa, Giardia lamblia
RSSRTTNSKQAKGQQETHTQSQPSTAPDATQELRKQATSKRD

SEQ ID NO: 3062682 - protein, 8 aa, Giardia lamblia
RSSSYQSY

SEQ ID NO: 3062683 - protein, 4 aa, Giardia lamblia
RSST

SEQ ID NO: 3062684 - protein, 7 aa, Giardia lamblia
RSSVDAS

SEQ ID NO: 3062685 - protein, 5 aa, Giardia lamblia
RSSYT

SEQ ID NO: 3062686 - protein, 10 aa, Giardia lamblia
RSTAGNKPLK

SEQ ID NO: 3062687 - protein, 9 aa, Giardia lamblia
RSTEYDKES

SEQ ID NO: 3062688 - protein, 13 aa, Giardia lamblia
RSTGSCDSNGNEG

SEQ ID NO: 3062689 - protein, 11 aa, Giardia lamblia
RSTKAKQGAAE

SEQ ID NO: 3062690 - protein, 7 aa, Giardia lamblia
RSTKEPK

SEQ ID NO: 3062691 - protein, 9 aa, Giardia lamblia
RSTKGAHKS

SEQ ID NO: 3062692 - protein, 8 aa, Giardia lamblia
RSTNYRAN

SEQ ID NO: 3062693 - protein, 13 aa, Giardia lamblia
RSTSANSQRSNYD

SEQ ID NO: 3062694 - protein, 13 aa, Giardia lamblia
RSTSGGLENDDDY

SEQ ID NO: 3062695 - protein, 8 aa, Giardia lamblia
RSTSSDVS

SEQ ID NO: 3062696 - protein, 8 aa, Giardia lamblia
RSTSSEMG

SEQ ID NO: 3062697 - protein, 4 aa, Giardia lamblia
RSTT

SEQ ID NO: 3062698 - protein, 9 aa, Giardia lamblia
RSTTDQSGA

SEQ ID NO: 3062699 - protein, 21 aa, Giardia lamblia
RSTTNSSWRPPGLEKSDQTAC

SEQ ID NO: 3062700 - protein, 8 aa, Giardia lamblia
RSVDSFNN

SEQ ID NO: 3062701 - protein, 14 aa, Giardia lamblia
RSVSLSTKDQNPMK

SEQ ID NO: 3062702 - protein, 16 aa, Giardia lamblia
RSVSQHGASGSKDTSF

SEQ ID NO: 3062703 - protein, 8 aa, Giardia lamblia
RSVSRAPR

SEQ ID NO: 3062704 - protein, 13 aa, Giardia lamblia
RSVTQGEPSTEAY

SEQ ID NO: 3062705 - protein, 9 aa, Giardia lamblia
RSVTSSQNL

SEQ ID NO: 3062706 - protein, 12 aa, Giardia lamblia
RSYASGDSVNLA

SEQ ID NO: 3062707 - protein, 7 aa, Giardia lamblia
RSYDGPA

SEQ ID NO: 3062708 - protein, 5 aa, Giardia lamblia
RSYET

SEQ ID NO: 3062709 - protein, 9 aa, Giardia lamblia
RSYKSSATV

SEQ ID NO: 3062710 - protein, 11 aa, Giardia lamblia
RSYRRPSSSSY

SEQ ID NO: 3062711 - protein, 4 aa, Giardia lamblia
RTAA

SEQ ID NO: 3062712 - protein, 5 aa, Giardia lamblia
RTADY

SEQ ID NO: 3062713 - protein, 7 aa, Giardia lamblia
RTAEAYR

SEQ ID NO: 3062714 - protein, 7 aa, Giardia lamblia
RTAEEHN

SEQ ID NO: 3062715 - protein, 7 aa, Giardia lamblia
RTAIPST

SEQ ID NO: 3062716 - protein, 7 aa, Giardia lamblia
RTAKDKK

SEQ ID NO: 3062717 - protein, 5 aa, Giardia lamblia
RTANA

SEQ ID NO: 3062718 - protein, 11 aa, Giardia lamblia
RTAQSATPTAL

SEQ ID NO: 3062719 - protein, 19 aa, Giardia lamblia
RTARSSSGDELGSGKKDFT

SEQ ID NO: 3062720 - protein, 15 aa, Giardia lamblia
RTCAEGCGARASSNQ

SEQ ID NO: 3062721 - protein, 9 aa, Giardia lamblia
RTCSGPEES

SEQ ID NO: 3062722 - protein, 5 aa, Giardia lamblia
RTDDE

SEQ ID NO: 3062723 - protein, 8 aa, Giardia lamblia
RTDPVGTK

SEQ ID NO: 3062724 - protein, 12 aa, Giardia lamblia
RTDSGKAESQDV

SEQ ID NO: 3062725 - protein, 9 aa, Giardia lamblia
RTDSRTGKS

SEQ ID NO: 3062726 - protein, 8 aa, Giardia lamblia
RTEEGQRR

SEQ ID NO: 3062727 - protein, 4 aa, Giardia lamblia
RTEH

SEQ ID NO: 3062728 - protein, 5 aa, Giardia lamblia
RTEHT

SEQ ID NO: 3062729 - protein, 7 aa, Giardia lamblia
RTENEHV

SEQ ID NO: 3062730 - protein, 8 aa, Giardia lamblia
RTEQTAHE

SEQ ID NO: 3062731 - protein, 4 aa, Giardia lamblia
RTGA

SEQ ID NO: 3062732 - protein, 8 aa, Giardia lamblia
RTGAGKSS

SEQ ID NO: 3062733 - protein, 10 aa, Giardia lamblia
RTGAGKSSIT

SEQ ID NO: 3062734 - protein, 9 aa, Giardia lamblia
RTGATRNEI

SEQ ID NO: 3062735 - protein, 7 aa, Giardia lamblia
RTGHRGG

SEQ ID NO: 3062736 - protein, 8 aa, Giardia lamblia
RTGNESNR

SEQ ID NO: 3062737 - protein, 6 aa, Giardia lamblia
RTGNTV

SEQ ID NO: 3062738 - protein, 4 aa, Giardia lamblia
RTGP

SEQ ID NO: 3062739 - protein, 4 aa, Giardia lamblia
RTGR

SEQ ID NO: 3062740 - protein, 6 aa, Giardia lamblia
RTGTKH

SEQ ID NO: 3062741 - protein, 11 aa, Giardia lamblia
RTHHPGEKRGM

SEQ ID NO: 3062742 - protein, 7 aa, Giardia lamblia
RTIGTGR

SEQ ID NO: 3062743 - protein, 7 aa, Giardia lamblia
RTISGQS

SEQ ID NO: 3062744 - protein, 10 aa, Giardia lamblia
RTKATDDLSP

SEQ ID NO: 3062745 - protein, 9 aa, Giardia lamblia
RTKNSSDTF

SEQ ID NO: 3062746 - protein, 8 aa, Giardia lamblia
RTKNSSMY

SEQ ID NO: 3062747 - protein, 9 aa, Giardia lamblia
RTKTGKSAL

SEQ ID NO: 3062748 - protein, 8 aa, Giardia lamblia
RTKYGYRQ

SEQ ID NO: 3062749 - protein, 7 aa, Giardia lamblia
RTLESMG

SEQ ID NO: 3062750 - protein, 11 aa, Giardia lamblia
RTLGPQEGDIV

SEQ ID NO: 3062751 - protein, 18 aa, Giardia lamblia
RTLSSSPESAKGSNPFDR

SEQ ID NO: 3062752 - protein, 7 aa, Giardia lamblia
RTNEYTR

SEQ ID NO: 3062753 - protein, 5 aa, Giardia lamblia
RTNKE

SEQ ID NO: 3062754 - protein, 10 aa, Giardia lamblia
RTNPEENAET

SEQ ID NO: 3062755 - protein, 4 aa, Giardia lamblia
RTNQ

SEQ ID NO: 3062756 - protein, 5 aa, Giardia lamblia
RTNRI

SEQ ID NO: 3062757 - protein, 7 aa, Giardia lamblia
RTPAGET

SEQ ID NO: 3062758 - protein, 6 aa, Giardia lamblia
RTPRRR

SEQ ID NO: 3062759 - protein, 12 aa, Giardia lamblia
RTPVPESPGELK

SEQ ID NO: 3062760 - protein, 5 aa, Giardia lamblia
RTPWA

SEQ ID NO: 3062761 - protein, 7 aa, Giardia lamblia
RTPYGNK

SEQ ID NO: 3062762 - protein, 4 aa, Giardia lamblia
RTQS

SEQ ID NO: 3062763 - protein, 17 aa, Giardia lamblia
RTQSQVSREPHTDRYSQ

SEQ ID NO: 3062764 - protein, 12 aa, Giardia lamblia
RTRDEAAKDPAR

SEQ ID NO: 3062765 - protein, 17 aa, Giardia lamblia
RTREYQDSQQPEAQPKM

SEQ ID NO: 3062766 - protein, 19 aa, Giardia lamblia
RTRGVQSAKYNTKSSTTTL

SEQ ID NO: 3062767 - protein, 10 aa, Giardia lamblia
RTRPSNLSST

SEQ ID NO: 3062768 - protein, 7 aa, Giardia lamblia
RTRSFPE

SEQ ID NO: 3062769 - protein, 6 aa, Giardia lamblia
RTSAAA

SEQ ID NO: 3062770 - protein, 11 aa, Giardia lamblia
RTSAPSNATSI

SEQ ID NO: 3062771 - protein, 10 aa, Giardia lamblia
RTSATQQQKV

SEQ ID NO: 3062772 - protein, 6 aa, Giardia lamblia
RTSDGG

SEQ ID NO: 3062773 - protein, 16 aa, Giardia lamblia
RTSDTTSSRLNTQERS

SEQ ID NO: 3062774 - protein, 15 aa, Giardia lamblia
RTSGEDSEPRQDDSY

SEQ ID NO: 3062775 - protein, 5 aa, Giardia lamblia
RTSNP

SEQ ID NO: 3062776 - protein, 13 aa, Giardia lamblia
RTSQNNLNDNTRM

SEQ ID NO: 3062777 - protein, 8 aa, Giardia lamblia
RTSRADAY

SEQ ID NO: 3062778 - protein, 31 aa, Giardia lamblia
RTSSGGDNDSNNYDPGSDVTSNIDATSDTCT

SEQ ID NO: 3062779 - protein, 7 aa, Giardia lamblia
RTSTGRT

SEQ ID NO: 3062780 - protein, 6 aa, Giardia lamblia
RTTDKV

SEQ ID NO: 3062781 - protein, 4 aa, Giardia lamblia
RTTI

SEQ ID NO: 3062782 - protein, 7 aa, Giardia lamblia
RTTPDQK

SEQ ID NO: 3062783 - protein, 10 aa, Giardia lamblia
RTTPPSSCNS

SEQ ID NO: 3062784 - protein, 20 aa, Giardia lamblia
RTTRPQSALSHTGRPTTSLR

SEQ ID NO: 3062785 - protein, 6 aa, Giardia lamblia
RTTSEN

SEQ ID NO: 3062786 - protein, 10 aa, Giardia lamblia
RTTTASGLEH

SEQ ID NO: 3062787 - protein, 10 aa, Giardia lamblia
RTTTTTTRTT

SEQ ID NO: 3062788 - protein, 6 aa, Giardia lamblia
RTVEAS

SEQ ID NO: 3062789 - protein, 4 aa, Giardia lamblia
RTVP

SEQ ID NO: 3062790 - protein, 13 aa, Giardia lamblia
RTVSQGRKLTTSS

SEQ ID NO: 3062791 - protein, 9 aa, Giardia lamblia
RVANKKEVN

SEQ ID NO: 3062792 - protein, 8 aa, Giardia lamblia
RVASRSDS

SEQ ID NO: 3062793 - protein, 10 aa, Giardia lamblia
RVDENASVHS

SEQ ID NO: 3062794 - protein, 15 aa, Giardia lamblia
RVDTAPGDDWTNTDS

SEQ ID NO: 3062795 - protein, 16 aa, Giardia lamblia
RVEDGQAQDGISGSVD

SEQ ID NO: 3062796 - protein, 6 aa, Giardia lamblia
RVEGGM

SEQ ID NO: 3062797 - protein, 10 aa, Giardia lamblia
RVENASVRNK

SEQ ID NO: 3062798 - protein, 5 aa, Giardia lamblia
RVGQD

SEQ ID NO: 3062799 - protein, 8 aa, Giardia lamblia
RVGSGKSS

SEQ ID NO: 3062800 - protein, 26 aa, Giardia lamblia
RVGSPAKSTDSRQSSSRLKSGSPSKR

SEQ ID NO: 3062801 - protein, 5 aa, Giardia lamblia
RVKDG

SEQ ID NO: 3062802 - protein, 15 aa, Giardia lamblia
RVKPEEVARHKEASA

SEQ ID NO: 3062803 - protein, 17 aa, Giardia lamblia
RVNKARSPKSLSGTHPR

SEQ ID NO: 3062804 - protein, 4 aa, Giardia lamblia
RVNT

SEQ ID NO: 3062805 - protein, 11 aa, Giardia lamblia
RVPGANAYTDM

SEQ ID NO: 3062806 - protein, 26 aa, Giardia lamblia
RVPKTTLSSLNESRLTAAQREKIRSL

SEQ ID NO: 3062807 - protein, 6 aa, Giardia lamblia
RVQMTG

SEQ ID NO: 3062808 - protein, 4 aa, Giardia lamblia
RVQS

SEQ ID NO: 3062809 - protein, 14 aa, Giardia lamblia
RVRVDDDSSGPESE

SEQ ID NO: 3062810 - protein, 6 aa, Giardia lamblia
RVSAGG

SEQ ID NO: 3062811 - protein, 4 aa, Giardia lamblia
RVSF

SEQ ID NO: 3062812 - protein, 14 aa, Giardia lamblia
RVTGKAKKRPSSPF

SEQ ID NO: 3062813 - protein, 11 aa, Giardia lamblia
RVTQGSNDDHE

SEQ ID NO: 3062814 - protein, 8 aa, Giardia lamblia
RYARPSKN

SEQ ID NO: 3062815 - protein, 9 aa, Giardia lamblia
RYASGESIE

SEQ ID NO: 3062816 - protein, 11 aa, Giardia lamblia
RYDHQATCTTR

SEQ ID NO: 3062817 - protein, 13 aa, Giardia lamblia
RYDPAGAVREAPP

SEQ ID NO: 3062818 - protein, 7 aa, Giardia lamblia
RYDPTEQ

SEQ ID NO: 3062819 - protein, 11 aa, Giardia lamblia
RYGAKNTVTTM

SEQ ID NO: 3062820 - protein, 6 aa, Giardia lamblia
RYGGKS

SEQ ID NO: 3062821 - protein, 10 aa, Giardia lamblia
RYKESGNAYP

SEQ ID NO: 3062822 - protein, 7 aa, Giardia lamblia
RYKESKT

SEQ ID NO: 3062823 - protein, 14 aa, Giardia lamblia
RYLKPESAAGQSGA

SEQ ID NO: 3062824 - protein, 7 aa, Giardia lamblia
RYNDGEN

SEQ ID NO: 3062825 - protein, 15 aa, Giardia lamblia
RYNEPCNGASAVGAS

SEQ ID NO: 3062826 - protein, 4 aa, Giardia lamblia
RYPG

SEQ ID NO: 3062827 - protein, 7 aa, Giardia lamblia
RYPNEPY

SEQ ID NO: 3062828 - protein, 6 aa, Giardia lamblia
RYPPNS

SEQ ID NO: 3062829 - protein, 4 aa, Giardia lamblia
RYPT

SEQ ID NO: 3062830 - protein, 7 aa, Giardia lamblia
RYQETTV

SEQ ID NO: 3062831 - protein, 9 aa, Giardia lamblia
RYSAGASTD

SEQ ID NO: 3062832 - protein, 5 aa, Giardia lamblia
RYSES

SEQ ID NO: 3062833 - protein, 7 aa, Giardia lamblia
RYSGKTT

SEQ ID NO: 3062834 - protein, 9 aa, Giardia lamblia
RYSREPHRH

SEQ ID NO: 3062835 - protein, 17 aa, Giardia lamblia
RYSRRSFQAGRTKEPRL

SEQ ID NO: 3062836 - protein, 10 aa, Giardia lamblia
RYSTDDTTVY

SEQ ID NO: 3062837 - protein, 21 aa, Giardia lamblia
RYTNALSTAPYKVEPSAVETQ

SEQ ID NO: 3062838 - protein, 5 aa, Giardia lamblia
RYTPT

SEQ ID NO: 3062839 - protein, 8 aa, Giardia lamblia
RYTSPYQH

SEQ ID NO: 3062840 - protein, 7 aa, Giardia lamblia
RYYSQDD

SEQ ID NO: 3062841 - protein, 6 aa, Giardia lamblia
SAAASH

SEQ ID NO: 3062842 - protein, 7 aa, Giardia lamblia
SAAASLA

SEQ ID NO: 3062843 - protein, 10 aa, Giardia lamblia
SAAEKKKAIK

SEQ ID NO: 3062844 - protein, 17 aa, Giardia lamblia
SAAEKPRERAESKKNAA

SEQ ID NO: 3062845 - protein, 5 aa, Giardia lamblia
SAAGA

SEQ ID NO: 3062846 - protein, 4 aa, Giardia lamblia
SAAN

SEQ ID NO: 3062847 - protein, 8 aa, Giardia lamblia
SAAPEADA

SEQ ID NO: 3062848 - protein, 10 aa, Giardia lamblia
SAAPTHADQF

SEQ ID NO: 3062849 - protein, 14 aa, Giardia lamblia
SAARAYDPISPEEA

SEQ ID NO: 3062850 - protein, 26 aa, Giardia lamblia
SAASASRARDSEEKVSVDSHRTTGSI

SEQ ID NO: 3062851 - protein, 19 aa, Giardia lamblia
SAASASSCTATEQSVDEVA

SEQ ID NO: 3062852 - protein, 9 aa, Giardia lamblia
SAASNRPSC

SEQ ID NO: 3062853 - protein, 14 aa, Giardia lamblia
SAASPQSAESEGQQ

SEQ ID NO: 3062854 - protein, 12 aa, Giardia lamblia
SAASQRRKKAAR

SEQ ID NO: 3062855 - protein, 9 aa, Giardia lamblia
SAASTITTA

SEQ ID NO: 3062856 - protein, 12 aa, Giardia lamblia
SACSRNSERAVD

SEQ ID NO: 3062857 - protein, 6 aa, Giardia lamblia
SADADG

SEQ ID NO: 3062858 - protein, 18 aa, Giardia lamblia
SADADPEEPGTQAVAGQR

SEQ ID NO: 3062859 - protein, 8 aa, Giardia lamblia
SADGGKVG

SEQ ID NO: 3062860 - protein, 7 aa, Giardia lamblia
SADGHCT

SEQ ID NO: 3062861 - protein, 11 aa, Giardia lamblia
SADGRTPSRDD

SEQ ID NO: 3062862 - protein, 10 aa, Giardia lamblia
SADGSPSAHA

SEQ ID NO: 3062863 - protein, 5 aa, Giardia lamblia
SADGT

SEQ ID NO: 3062864 - protein, 12 aa, Giardia lamblia
SADKCTSCQSGY

SEQ ID NO: 3062865 - protein, 8 aa, Giardia lamblia
SADKQDKF

SEQ ID NO: 3062866 - protein, 4 aa, Giardia lamblia
SADN

SEQ ID NO: 3062867 - protein, 13 aa, Giardia lamblia
SADQKQTGNTSPY

SEQ ID NO: 3062868 - protein, 6 aa, Giardia lamblia
SADQVS

SEQ ID NO: 3062869 - protein, 13 aa, Giardia lamblia
SADRPNSDSAISP

SEQ ID NO: 3062870 - protein, 4 aa, Giardia lamblia
SADS

SEQ ID NO: 3062871 - protein, 8 aa, Giardia lamblia
SADSKPTL

SEQ ID NO: 3062872 - protein, 7 aa, Giardia lamblia
SADSSEL

SEQ ID NO: 3062873 - protein, 6 aa, Giardia lamblia
SADSTA

SEQ ID NO: 3062874 - protein, 5 aa, Giardia lamblia
SADTV

SEQ ID NO: 3062875 - protein, 12 aa, Giardia lamblia
SADYSDLSSNQN

SEQ ID NO: 3062876 - protein, 10 aa, Giardia lamblia
SAEANSYCSP

SEQ ID NO: 3062877 - protein, 5 aa, Giardia lamblia
SAEAT

SEQ ID NO: 3062878 - protein, 4 aa, Giardia lamblia
SAEC

SEQ ID NO: 3062879 - protein, 7 aa, Giardia lamblia
SAEGDDL

SEQ ID NO: 3062880 - protein, 14 aa, Giardia lamblia
SAEGGRCTVPGESG

SEQ ID NO: 3062881 - protein, 6 aa, Giardia lamblia
SAEGWS

SEQ ID NO: 3062882 - protein, 4 aa, Giardia lamblia
SAEI

SEQ ID NO: 3062883 - protein, 7 aa, Giardia lamblia
SAEIGGR

SEQ ID NO: 3062884 - protein, 12 aa, Giardia lamblia
SAEKDYNPDTAI

SEQ ID NO: 3062885 - protein, 7 aa, Giardia lamblia
SAENENT

SEQ ID NO: 3062886 - protein, 7 aa, Giardia lamblia
SAEPDKY

SEQ ID NO: 3062887 - protein, 11 aa, Giardia lamblia
SAEQDSASYRS

SEQ ID NO: 3062888 - protein, 5 aa, Giardia lamblia
SAEQS

SEQ ID NO: 3062889 - protein, 8 aa, Giardia lamblia
SAERITQS

SEQ ID NO: 3062890 - protein, 23 aa, Giardia lamblia
SAERNRLAQPPRGSNDANTSSIC

SEQ ID NO: 3062891 - protein, 26 aa, Giardia lamblia
SAERTSVTDGDRERSTLKKATSTPLR

SEQ ID NO: 3062892 - protein, 8 aa, Giardia lamblia
SAESGSTE

SEQ ID NO: 3062893 - protein, 6 aa, Giardia lamblia
SAESLT

SEQ ID NO: 3062894 - protein, 12 aa, Giardia lamblia
SAESPGSKKRLK

SEQ ID NO: 3062895 - protein, 6 aa, Giardia lamblia
SAESQV

SEQ ID NO: 3062896 - protein, 9 aa, Giardia lamblia
SAETAQPSG

SEQ ID NO: 3062897 - protein, 7 aa, Giardia lamblia
SAEYTTR

SEQ ID NO: 3062898 - protein, 12 aa, Giardia lamblia
SAFDQQNSSFSG

SEQ ID NO: 3062899 - protein, 8 aa, Giardia lamblia
SAFPDAGE

SEQ ID NO: 3062900 - protein, 12 aa, Giardia lamblia
SAGADPNDQGIA

SEQ ID NO: 3062901 - protein, 7 aa, Giardia lamblia
SAGARRD

SEQ ID NO: 3062902 - protein, 15 aa, Giardia lamblia
SAGASGVGSTASTTV

SEQ ID NO: 3062903 - protein, 4 aa, Giardia lamblia
SAGD

SEQ ID NO: 3062904 - protein, 5 aa, Giardia lamblia
SAGDA

SEQ ID NO: 3062905 - protein, 6 aa, Giardia lamblia
SAGEEV

SEQ ID NO: 3062906 - protein, 7 aa, Giardia lamblia
SAGGGHE

SEQ ID NO: 3062907 - protein, 5 aa, Giardia lamblia
SAGGL

SEQ ID NO: 3062908 - protein, 6 aa, Giardia lamblia
SAGGPL

SEQ ID NO: 3062909 - protein, 4 aa, Giardia lamblia
SAGI

SEQ ID NO: 3062910 - protein, 5 aa, Giardia lamblia
SAGIS

SEQ ID NO: 3062911 - protein, 5 aa, Giardia lamblia
SAGIT

SEQ ID NO: 3062912 - protein, 5 aa, Giardia lamblia
SAGMG

SEQ ID NO: 3062913 - protein, 9 aa, Giardia lamblia
SAGNGYALS

SEQ ID NO: 3062914 - protein, 6 aa, Giardia lamblia
SAGNKE

SEQ ID NO: 3062915 - protein, 9 aa, Giardia lamblia
SAGRQATEP

SEQ ID NO: 3062916 - protein, 11 aa, Giardia lamblia
SAGSERTKYDS

SEQ ID NO: 3062917 - protein, 6 aa, Giardia lamblia
SAGSMA

SEQ ID NO: 3062918 - protein, 28 aa, Giardia lamblia
SAGSSNIGSMSATTVTSTGQLKSSFCQC

SEQ ID NO: 3062919 - protein, 6 aa, Giardia lamblia
SAGSVD

SEQ ID NO: 3062920 - protein, 7 aa, Giardia lamblia
SAGTHGR

SEQ ID NO: 3062921 - protein, 8 aa, Giardia lamblia
SAGWQSTE

SEQ ID NO: 3062922 - protein, 11 aa, Giardia lamblia
SAHEQTTFATA

SEQ ID NO: 3062923 - protein, 5 aa, Giardia lamblia
SAHPR

SEQ ID NO: 3062924 - protein, 4 aa, Giardia lamblia
SAHR

SEQ ID NO: 3062925 - protein, 20 aa, Giardia lamblia
SAHRRSVDRTQSSSESNPSI

SEQ ID NO: 3062926 - protein, 7 aa, Giardia lamblia
SAHSGAQ

SEQ ID NO: 3062927 - protein, 9 aa, Giardia lamblia
SAIGSSAHR

SEQ ID NO: 3062928 - protein, 6 aa, Giardia lamblia
SAIGTD

SEQ ID NO: 3062929 - protein, 5 aa, Giardia lamblia
SAINN

SEQ ID NO: 3062930 - protein, 6 aa, Giardia lamblia
SAINSE

SEQ ID NO: 3062931 - protein, 18 aa, Giardia lamblia
SAINTTDPDPKEAPQPRR

SEQ ID NO: 3062932 - protein, 12 aa, Giardia lamblia
SAISSSDERRAD

SEQ ID NO: 3062933 - protein, 7 aa, Giardia lamblia
SAISSTQ

SEQ ID NO: 3062934 - protein, 6 aa, Giardia lamblia
SAITSD

SEQ ID NO: 3062935 - protein, 10 aa, Giardia lamblia
SAKANDDSAR

SEQ ID NO: 3062936 - protein, 15 aa, Giardia lamblia
SAKAPAQRYTAYTGE

SEQ ID NO: 3062937 - protein, 9 aa, Giardia lamblia
SAKAPPGTI

SEQ ID NO: 3062938 - protein, 11 aa, Giardia lamblia
SAKASDKARVT

SEQ ID NO: 3062939 - protein, 10 aa, Giardia lamblia
SAKAVRGQKG

SEQ ID NO: 3062940 - protein, 7 aa, Giardia lamblia
SAKELRD

SEQ ID NO: 3062941 - protein, 5 aa, Giardia lamblia
SAKER

SEQ ID NO: 3062942 - protein, 7 aa, Giardia lamblia
SAKGLDL

SEQ ID NO: 3062943 - protein, 7 aa, Giardia lamblia
SAKKLGV

SEQ ID NO: 3062944 - protein, 12 aa, Giardia lamblia
SAKPTDGSTAGG

SEQ ID NO: 3062945 - protein, 8 aa, Giardia lamblia
SAKRSDLE

SEQ ID NO: 3062946 - protein, 5 aa, Giardia lamblia
SAKSA

SEQ ID NO: 3062947 - protein, 7 aa, Giardia lamblia
SAKSSTI

SEQ ID NO: 3062948 - protein, 17 aa, Giardia lamblia
SAKTEPVSTKASKEIDT

SEQ ID NO: 3062949 - protein, 12 aa, Giardia lamblia
SAKYSENRDSSG

SEQ ID NO: 3062950 - protein, 10 aa, Giardia lamblia
SALEASSPPD

SEQ ID NO: 3062951 - protein, 8 aa, Giardia lamblia
SALPTTRL

SEQ ID NO: 3062952 - protein, 14 aa, Giardia lamblia
SALRKRAEALSGGM

SEQ ID NO: 3062953 - protein, 10 aa, Giardia lamblia
SALSAEKDSM

SEQ ID NO: 3062954 - protein, 10 aa, Giardia lamblia
SALSDKNKAI

SEQ ID NO: 3062955 - protein, 14 aa, Giardia lamblia
SALSQTASGDSSGI

SEQ ID NO: 3062956 - protein, 28 aa, Giardia lamblia
SALSSQTKDTDSLTSNLRTANQKPALDV

SEQ ID NO: 3062957 - protein, 14 aa, Giardia lamblia
SAMDNNKDLQSKPN

SEQ ID NO: 3062958 - protein, 15 aa, Giardia lamblia
SAMDNNKDLQSKPNW

SEQ ID NO: 3062959 - protein, 6 aa, Giardia lamblia
SANDAA

SEQ ID NO: 3062960 - protein, 9 aa, Giardia lamblia
SANDAQGNV

SEQ ID NO: 3062961 - protein, 11 aa, Giardia lamblia
SANDKAPIDGR

SEQ ID NO: 3062962 - protein, 9 aa, Giardia lamblia
SANEKTSIG

SEQ ID NO: 3062963 - protein, 8 aa, Giardia lamblia
SANGTENI

SEQ ID NO: 3062964 - protein, 12 aa, Giardia lamblia
SANNGESKQQTT

SEQ ID NO: 3062965 - protein, 9 aa, Giardia lamblia
SANNLSPLG

SEQ ID NO: 3062966 - protein, 7 aa, Giardia lamblia
SANPENP

SEQ ID NO: 3062967 - protein, 9 aa, Giardia lamblia
SANPNGGLS

SEQ ID NO: 3062968 - protein, 13 aa, Giardia lamblia
SANPSSIENSTSM

SEQ ID NO: 3062969 - protein, 6 aa, Giardia lamblia
SANQED

SEQ ID NO: 3062970 - protein, 8 aa, Giardia lamblia
SANQKPIQ

SEQ ID NO: 3062971 - protein, 19 aa, Giardia lamblia
SANRAHGNMPNKRSTNPIL

SEQ ID NO: 3062972 - protein, 8 aa, Giardia lamblia
SANSGPLS

SEQ ID NO: 3062973 - protein, 6 aa, Giardia lamblia
SANSTE

SEQ ID NO: 3062974 - protein, 5 aa, Giardia lamblia
SAPIN

SEQ ID NO: 3062975 - protein, 14 aa, Giardia lamblia
SAPLSPVPVQSPSL

SEQ ID NO: 3062976 - protein, 9 aa, Giardia lamblia
SAPLYSPRT

SEQ ID NO: 3062977 - protein, 42 aa, Giardia lamblia
SAPMKNESGDEIDEESGSKKKKQRLRKTKKGSAKSTSALKEN

SEQ ID NO: 3062978 - protein, 6 aa, Giardia lamblia
SAPPGL

SEQ ID NO: 3062979 - protein, 8 aa, Giardia lamblia
SAPQNPVT

SEQ ID NO: 3062980 - protein, 13 aa, Giardia lamblia
SAPQYDREAHTEE

SEQ ID NO: 3062981 - protein, 19 aa, Giardia lamblia
SAPRHSETISYNSSQHRAD

SEQ ID NO: 3062982 - protein, 5 aa, Giardia lamblia
SAPRT

SEQ ID NO: 3062983 - protein, 8 aa, Giardia lamblia
SAPTAVSN

SEQ ID NO: 3062984 - protein, 6 aa, Giardia lamblia
SAPTKD

SEQ ID NO: 3062985 - protein, 6 aa, Giardia lamblia
SAPTMR

SEQ ID NO: 3062986 - protein, 26 aa, Giardia lamblia
SAPTSAKHTSSSGAGTHGTEQSLPPA

SEQ ID NO: 3062987 - protein, 15 aa, Giardia lamblia
SAPYGYPLRHYGLME

SEQ ID NO: 3062988 - protein, 13 aa, Giardia lamblia
SAQADLDASAERL

SEQ ID NO: 3062989 - protein, 5 aa, Giardia lamblia
SAQAQ

SEQ ID NO: 3062990 - protein, 21 aa, Giardia lamblia
SAQDSRRGYNTSTKSAGETDT

SEQ ID NO: 3062991 - protein, 8 aa, Giardia lamblia
SAQEAKQL

SEQ ID NO: 3062992 - protein, 9 aa, Giardia lamblia
SAQNGRKPE

SEQ ID NO: 3062993 - protein, 5 aa, Giardia lamblia
SAQNT

SEQ ID NO: 3062994 - protein, 6 aa, Giardia lamblia
SAQPAK

SEQ ID NO: 3062995 - protein, 31 aa, Giardia lamblia
SAQPNNEPDDKNKQNASSSSSNAPKGPKARA

SEQ ID NO: 3062996 - protein, 8 aa, Giardia lamblia
SAQPPVDT

SEQ ID NO: 3062997 - protein, 7 aa, Giardia lamblia
SAQPVTA

SEQ ID NO: 3062998 - protein, 10 aa, Giardia lamblia
SAQSSPKVDQ

SEQ ID NO: 3062999 - protein, 4 aa, Giardia lamblia
SARA

SEQ ID NO: 3063000 - protein, 34 aa, Giardia lamblia
SARASSDTDGCGSPSGPTLSPAPNTITASTSLDI

SEQ ID NO: 3063001 - protein, 21 aa, Giardia lamblia
SAREPLGKKNSSKHGSTASSM

SEQ ID NO: 3063002 - protein, 5 aa, Giardia lamblia
SAREY

SEQ ID NO: 3063003 - protein, 5 aa, Giardia lamblia
SARFA

SEQ ID NO: 3063004 - protein, 4 aa, Giardia lamblia
SARG

SEQ ID NO: 3063005 - protein, 8 aa, Giardia lamblia
SARGDWSQ

SEQ ID NO: 3063006 - protein, 12 aa, Giardia lamblia
SARGEAASNDRD

SEQ ID NO: 3063007 - protein, 7 aa, Giardia lamblia
SARGLSS

SEQ ID NO: 3063008 - protein, 9 aa, Giardia lamblia
SARHQETSL

SEQ ID NO: 3063009 - protein, 15 aa, Giardia lamblia
SARRKPNSSVLKEDA

SEQ ID NO: 3063010 - protein, 11 aa, Giardia lamblia
SASATSDLPNY

SEQ ID NO: 3063011 - protein, 9 aa, Giardia lamblia
SASEARTSA

SEQ ID NO: 3063012 - protein, 5 aa, Giardia lamblia
SASEK

SEQ ID NO: 3063013 - protein, 36 aa, Giardia lamblia
SASEMGYSSSISGTADHSGSRGQDALEGPDEKLSQG

SEQ ID NO: 3063014 - protein, 8 aa, Giardia lamblia
SASEPQLD

SEQ ID NO: 3063015 - protein, 8 aa, Giardia lamblia
SASEPQVA

SEQ ID NO: 3063016 - protein, 5 aa, Giardia lamblia
SASGV

SEQ ID NO: 3063017 - protein, 16 aa, Giardia lamblia
SASHSRESDTRTRQQY

SEQ ID NO: 3063018 - protein, 6 aa, Giardia lamblia
SASIGS

SEQ ID NO: 3063019 - protein, 8 aa, Giardia lamblia
SASKQTTR

SEQ ID NO: 3063020 - protein, 7 aa, Giardia lamblia
SASKRPC

SEQ ID NO: 3063021 - protein, 6 aa, Giardia lamblia
SASLNT

SEQ ID NO: 3063022 - protein, 15 aa, Giardia lamblia
SASLSKQLASAAPGL

SEQ ID NO: 3063023 - protein, 16 aa, Giardia lamblia
SASPEVNNDPKESSLT

SEQ ID NO: 3063024 - protein, 5 aa, Giardia lamblia
SASQN

SEQ ID NO: 3063025 - protein, 6 aa, Giardia lamblia
SASQNA

SEQ ID NO: 3063026 - protein, 8 aa, Giardia lamblia
SASQTRIR

SEQ ID NO: 3063027 - protein, 11 aa, Giardia lamblia
SASSAGPKAGL

SEQ ID NO: 3063028 - protein, 20 aa, Giardia lamblia
SASSPGCIDPTQNPDGEYEC

SEQ ID NO: 3063029 - protein, 20 aa, Giardia lamblia
SASSPLSDLATSGSISCTSR

SEQ ID NO: 3063030 - protein, 7 aa, Giardia lamblia
SASSSVS

SEQ ID NO: 3063031 - protein, 5 aa, Giardia lamblia
SASTS

SEQ ID NO: 3063032 - protein, 10 aa, Giardia lamblia
SASTTLGTNG

SEQ ID NO: 3063033 - protein, 5 aa, Giardia lamblia
SASTY

SEQ ID NO: 3063034 - protein, 20 aa, Giardia lamblia
SASYDTKKAELNAKRDQRAS

SEQ ID NO: 3063035 - protein, 7 aa, Giardia lamblia
SASYGAS

SEQ ID NO: 3063036 - protein, 8 aa, Giardia lamblia
SATAAEAS

SEQ ID NO: 3063037 - protein, 7 aa, Giardia lamblia
SATAAGN

SEQ ID NO: 3063038 - protein, 12 aa, Giardia lamblia
SATAASAPPDNT

SEQ ID NO: 3063039 - protein, 8 aa, Giardia lamblia
SATAPSEA

SEQ ID NO: 3063040 - protein, 5 aa, Giardia lamblia
SATAS

SEQ ID NO: 3063041 - protein, 16 aa, Giardia lamblia
SATASAPDKHASGECA

SEQ ID NO: 3063042 - protein, 12 aa, Giardia lamblia
SATATPPNTGTG

SEQ ID NO: 3063043 - protein, 16 aa, Giardia lamblia
SATDEQSIQGAQDSHD

SEQ ID NO: 3063044 - protein, 7 aa, Giardia lamblia
SATDGHA

SEQ ID NO: 3063045 - protein, 25 aa, Giardia lamblia
SATDNIAYGQPRKLPGSHAEEEQRR

SEQ ID NO: 3063046 - protein, 7 aa, Giardia lamblia
SATEEDL

SEQ ID NO: 3063047 - protein, 7 aa, Giardia lamblia
SATGAQI

SEQ ID NO: 3063048 - protein, 11 aa, Giardia lamblia
SATGGPSPAQL

SEQ ID NO: 3063049 - protein, 5 aa, Giardia lamblia
SATKN

SEQ ID NO: 3063050 - protein, 8 aa, Giardia lamblia
SATPFNSR

SEQ ID NO: 3063051 - protein, 9 aa, Giardia lamblia
SATPSQTLN

SEQ ID NO: 3063052 - protein, 37 aa, Giardia lamblia
SATQGANCPLPTGHTSKASTTPKTGCETPKELPLTPN

SEQ ID NO: 3063053 - protein, 7 aa, Giardia lamblia
SATRHDW

SEQ ID NO: 3063054 - protein, 5 aa, Giardia lamblia
SATSF

SEQ ID NO: 3063055 - protein, 7 aa, Giardia lamblia
SATSKPT

SEQ ID NO: 3063056 - protein, 9 aa, Giardia lamblia
SATSKQSID

SEQ ID NO: 3063057 - protein, 14 aa, Giardia lamblia
SATSPGQGTSLDGN

SEQ ID NO: 3063058 - protein, 8 aa, Giardia lamblia
SATSTPVT

SEQ ID NO: 3063059 - protein, 8 aa, Giardia lamblia
SATSTSWE

SEQ ID NO: 3063060 - protein, 11 aa, Giardia lamblia
SATSTYTNAET

SEQ ID NO: 3063061 - protein, 12 aa, Giardia lamblia
SATTVPAISSQA

SEQ ID NO: 3063062 - protein, 8 aa, Giardia lamblia
SATVEEEI

SEQ ID NO: 3063063 - protein, 12 aa, Giardia lamblia
SATVSGSLGKGD

SEQ ID NO: 3063064 - protein, 15 aa, Giardia lamblia
SAVDDSTTSLHERPG

SEQ ID NO: 3063065 - protein, 5 aa, Giardia lamblia
SAVGG

SEQ ID NO: 3063066 - protein, 4 aa, Giardia lamblia
SAVN

SEQ ID NO: 3063067 - protein, 8 aa, Giardia lamblia
SAVPGVSQ

SEQ ID NO: 3063068 - protein, 4 aa, Giardia lamblia
SAVT

SEQ ID NO: 3063069 - protein, 5 aa, Giardia lamblia
SAYDS

SEQ ID NO: 3063070 - protein, 8 aa, Giardia lamblia
SAYPPLPS

SEQ ID NO: 3063071 - protein, 8 aa, Giardia lamblia
SAYSETKK

SEQ ID NO: 3063072 - protein, 8 aa, Giardia lamblia
SAYSPDTT

SEQ ID NO: 3063073 - protein, 4 aa, Giardia lamblia
SAYT

SEQ ID NO: 3063074 - protein, 16 aa, Giardia lamblia
SAYTSLSSHGQPAFSE

SEQ ID NO: 3063075 - protein, 8 aa, Giardia lamblia
SCAGQTSC

SEQ ID NO: 3063076 - protein, 8 aa, Giardia lamblia
SCAGRTSC

SEQ ID NO: 3063077 - protein, 11 aa, Giardia lamblia
SCDSESDPHLP

SEQ ID NO: 3063078 - protein, 8 aa, Giardia lamblia
SCDSHGSP

SEQ ID NO: 3063079 - protein, 7 aa, Giardia lamblia
SCDSKTA

SEQ ID NO: 3063080 - protein, 5 aa, Giardia lamblia
SCEEG

SEQ ID NO: 3063081 - protein, 18 aa, Giardia lamblia
SCEGNTSGQCMANQVTRL

SEQ ID NO: 3063082 - protein, 7 aa, Giardia lamblia
SCEPEDR

SEQ ID NO: 3063083 - protein, 6 aa, Giardia lamblia
SCGGNG

SEQ ID NO: 3063084 - protein, 40 aa, Giardia lamblia
SCGGSSSATILDTSSTPASADSCEKPHQDSTKKPVNSSQH

SEQ ID NO: 3063085 - protein, 14 aa, Giardia lamblia
SCGGSTYPDEDLGE

SEQ ID NO: 3063086 - protein, 6 aa, Giardia lamblia
SCGGTL

SEQ ID NO: 3063087 - protein, 5 aa, Giardia lamblia
SCGPR

SEQ ID NO: 3063088 - protein, 8 aa, Giardia lamblia
SCGRPSLS

SEQ ID NO: 3063089 - protein, 5 aa, Giardia lamblia
SCGSH

SEQ ID NO: 3063090 - protein, 10 aa, Giardia lamblia
SCGSQQASPL

SEQ ID NO: 3063091 - protein, 7 aa, Giardia lamblia
SCGTTGK

SEQ ID NO: 3063092 - protein, 6 aa, Giardia lamblia
SCHKGS

SEQ ID NO: 3063093 - protein, 37 aa, Giardia lamblia
SCIRGTDASHTPLASTSTASKGRDDQNSGTTEPDAAA

SEQ ID NO: 3063094 - protein, 4 aa, Giardia lamblia
SCLN

SEQ ID NO: 3063095 - protein, 19 aa, Giardia lamblia
SCNDSIKKKATSDLGSAIN

SEQ ID NO: 3063096 - protein, 5 aa, Giardia lamblia
SCNEA

SEQ ID NO: 3063097 - protein, 8 aa, Giardia lamblia
SCNGGPLL

SEQ ID NO: 3063098 - protein, 5 aa, Giardia lamblia
SCNPK

SEQ ID NO: 3063099 - protein, 4 aa, Giardia lamblia
SCNT

SEQ ID NO: 3063100 - protein, 13 aa, Giardia lamblia
SCPANNPGRCDEN

SEQ ID NO: 3063101 - protein, 15 aa, Giardia lamblia
SCQALSEGAVPDSCP

SEQ ID NO: 3063102 - protein, 5 aa, Giardia lamblia
SCRAT

SEQ ID NO: 3063103 - protein, 22 aa, Giardia lamblia
SCRNKDKNSHGGIDESQRDTGI

SEQ ID NO: 3063104 - protein, 27 aa, Giardia lamblia
SCRRGSKDNATKEDFDANPLLPDQSCE

SEQ ID NO: 3063105 - protein, 11 aa, Giardia lamblia
SCSADDKAPID

SEQ ID NO: 3063106 - protein, 9 aa, Giardia lamblia
SCSGSSENQ

SEQ ID NO: 3063107 - protein, 6 aa, Giardia lamblia
SCSGYT

SEQ ID NO: 3063108 - protein, 16 aa, Giardia lamblia
SCSPPSCDTSSSDDYL

SEQ ID NO: 3063109 - protein, 20 aa, Giardia lamblia
SCSQPPVTEVSDQAVQQTVA

SEQ ID NO: 3063110 - protein, 5 aa, Giardia lamblia
SCSSK

SEQ ID NO: 3063111 - protein, 12 aa, Giardia lamblia
SCSSTAASACTS

SEQ ID NO: 3063112 - protein, 22 aa, Giardia lamblia
SCTDGDSTVECGGSQFGTCDNT

SEQ ID NO: 3063113 - protein, 9 aa, Giardia lamblia
SCTDNTTEV

SEQ ID NO: 3063114 - protein, 7 aa, Giardia lamblia
SCTDSTK

SEQ ID NO: 3063115 - protein, 8 aa, Giardia lamblia
SCTECTPG

SEQ ID NO: 3063116 - protein, 7 aa, Giardia lamblia
SCTERTA

SEQ ID NO: 3063117 - protein, 12 aa, Giardia lamblia
SCTNETTCTSCT

SEQ ID NO: 3063118 - protein, 5 aa, Giardia lamblia
SCTQC

SEQ ID NO: 3063119 - protein, 13 aa, Giardia lamblia
SCTSGADTEPRAS

SEQ ID NO: 3063120 - protein, 12 aa, Giardia lamblia
SCTTETYGNTCK

SEQ ID NO: 3063121 - protein, 7 aa, Giardia lamblia
SCTTIAP

SEQ ID NO: 3063122 - protein, 18 aa, Giardia lamblia
SDAAENKTDLSELGNGPL

SEQ ID NO: 3063123 - protein, 6 aa, Giardia lamblia
SDAARS

SEQ ID NO: 3063124 - protein, 17 aa, Giardia lamblia
SDAASRSSDINGDDSYS

SEQ ID NO: 3063125 - protein, 10 aa, Giardia lamblia
SDAATPPRCL

SEQ ID NO: 3063126 - protein, 7 aa, Giardia lamblia
SDACESE

SEQ ID NO: 3063127 - protein, 5 aa, Giardia lamblia
SDADM

SEQ ID NO: 3063128 - protein, 15 aa, Giardia lamblia
SDAEASDKSERQVTA

SEQ ID NO: 3063129 - protein, 7 aa, Giardia lamblia
SDAEGSV

SEQ ID NO: 3063130 - protein, 8 aa, Giardia lamblia
SDAEKEEY

SEQ ID NO: 3063131 - protein, 10 aa, Giardia lamblia
SDAEQASKSS

SEQ ID NO: 3063132 - protein, 10 aa, Giardia lamblia
SDAGEYPVDG

SEQ ID NO: 3063133 - protein, 6 aa, Giardia lamblia
SDAGQS

SEQ ID NO: 3063134 - protein, 9 aa, Giardia lamblia
SDAIPTNES

SEQ ID NO: 3063135 - protein, 16 aa, Giardia lamblia
SDANSNAHSRGKAATE

SEQ ID NO: 3063136 - protein, 7 aa, Giardia lamblia
SDAPTVD

SEQ ID NO: 3063137 - protein, 7 aa, Giardia lamblia
SDAQEQY

SEQ ID NO: 3063138 - protein, 21 aa, Giardia lamblia
SDAQINPQSSRPSSAGSAEAQ

SEQ ID NO: 3063139 - protein, 6 aa, Giardia lamblia
SDASLT

SEQ ID NO: 3063140 - protein, 6 aa, Giardia lamblia
SDASSL

SEQ ID NO: 3063141 - protein, 9 aa, Giardia lamblia
SDASSSTYQ

SEQ ID NO: 3063142 - protein, 11 aa, Giardia lamblia
SDATGNVSENV

SEQ ID NO: 3063143 - protein, 10 aa, Giardia lamblia
SDATSACHTG

SEQ ID NO: 3063144 - protein, 6 aa, Giardia lamblia
SDCNRS

SEQ ID NO: 3063145 - protein, 5 aa, Giardia lamblia
SDCSR

SEQ ID NO: 3063146 - protein, 13 aa, Giardia lamblia
SDDDDDESKPALQ

SEQ ID NO: 3063147 - protein, 45 aa, Giardia lamblia
SDDGVEKRQENSRGHSRHVSTSDCSYGGSEAKGSGDKGSETIESD

SEQ ID NO: 3063148 - protein, 6 aa, Giardia lamblia
SDDGYS

SEQ ID NO: 3063149 - protein, 5 aa, Giardia lamblia
SDDTL

SEQ ID NO: 3063150 - protein, 9 aa, Giardia lamblia
SDEAGSLGA

SEQ ID NO: 3063151 - protein, 7 aa, Giardia lamblia
SDEATAT

SEQ ID NO: 3063152 - protein, 10 aa, Giardia lamblia
SDEEGKNGYV

SEQ ID NO: 3063153 - protein, 5 aa, Giardia lamblia
SDEEN

SEQ ID NO: 3063154 - protein, 8 aa, Giardia lamblia
SDEGHTDA

SEQ ID NO: 3063155 - protein, 6 aa, Giardia lamblia
SDEGQV

SEQ ID NO: 3063156 - protein, 8 aa, Giardia lamblia
SDEPDLPE

SEQ ID NO: 3063157 - protein, 11 aa, Giardia lamblia
SDESDASSAYE

SEQ ID NO: 3063158 - protein, 4 aa, Giardia lamblia
SDEV

SEQ ID NO: 3063159 - protein, 6 aa, Giardia lamblia
SDEVTG

SEQ ID NO: 3063160 - protein, 8 aa, Giardia lamblia
SDFQAEKV

SEQ ID NO: 3063161 - protein, 8 aa, Giardia lamblia
SDGATTNS

SEQ ID NO: 3063162 - protein, 4 aa, Giardia lamblia
SDGD

SEQ ID NO: 3063163 - protein, 9 aa, Giardia lamblia
SDGDDEDED

SEQ ID NO: 3063164 - protein, 8 aa, Giardia lamblia
SDGDKVGT

SEQ ID NO: 3063165 - protein, 7 aa, Giardia lamblia
SDGGDIG

SEQ ID NO: 3063166 - protein, 9 aa, Giardia lamblia
SDGHHPAMQ

SEQ ID NO: 3063167 - protein, 22 aa, Giardia lamblia
SDGIESSGAPKCSDKSGASGKV

SEQ ID NO: 3063168 - protein, 8 aa, Giardia lamblia
SDGQKMSK

SEQ ID NO: 3063169 - protein, 4 aa, Giardia lamblia
SDGS

SEQ ID NO: 3063170 - protein, 9 aa, Giardia lamblia
SDGSDPKAI

SEQ ID NO: 3063171 - protein, 10 aa, Giardia lamblia
SDGSDSKAIC

SEQ ID NO: 3063172 - protein, 8 aa, Giardia lamblia
SDGSEDEF

SEQ ID NO: 3063173 - protein, 13 aa, Giardia lamblia
SDGSGRDQNPDTS

SEQ ID NO: 3063174 - protein, 11 aa, Giardia lamblia
SDGSICKNGGP

SEQ ID NO: 3063175 - protein, 8 aa, Giardia lamblia
SDGSSYPF

SEQ ID NO: 3063176 - protein, 7 aa, Giardia lamblia
SDGTSGC

SEQ ID NO: 3063177 - protein, 9 aa, Giardia lamblia
SDGVQSGTV

SEQ ID NO: 3063178 - protein, 19 aa, Giardia lamblia
SDHGDEDAGQYYQDSNGRA

SEQ ID NO: 3063179 - protein, 7 aa, Giardia lamblia
SDHRPQL

SEQ ID NO: 3063180 - protein, 9 aa, Giardia lamblia
SDHTGTRSK

SEQ ID NO: 3063181 - protein, 9 aa, Giardia lamblia
SDHTYSATT

SEQ ID NO: 3063182 - protein, 9 aa, Giardia lamblia
SDIASRDSR

SEQ ID NO: 3063183 - protein, 4 aa, Giardia lamblia
SDIC

SEQ ID NO: 3063184 - protein, 5 aa, Giardia lamblia
SDIHG

SEQ ID NO: 3063185 - protein, 4 aa, Giardia lamblia
SDIN

SEQ ID NO: 3063186 - protein, 10 aa, Giardia lamblia
SDISEGNHRR

SEQ ID NO: 3063187 - protein, 4 aa, Giardia lamblia
SDKD

SEQ ID NO: 3063188 - protein, 10 aa, Giardia lamblia
SDKDQLPPDY

SEQ ID NO: 3063189 - protein, 10 aa, Giardia lamblia
SDKEFTRQEE

SEQ ID NO: 3063190 - protein, 6 aa, Giardia lamblia
SDKIST

SEQ ID NO: 3063191 - protein, 4 aa, Giardia lamblia
SDKK

SEQ ID NO: 3063192 - protein, 7 aa, Giardia lamblia
SDKPYGI

SEQ ID NO: 3063193 - protein, 12 aa, Giardia lamblia
SDKRESCKNGGT

SEQ ID NO: 3063194 - protein, 5 aa, Giardia lamblia
SDKSL

SEQ ID NO: 3063195 - protein, 7 aa, Giardia lamblia
SDKVRQA

SEQ ID NO: 3063196 - protein, 6 aa, Giardia lamblia
SDLDGN

SEQ ID NO: 3063197 - protein, 6 aa, Giardia lamblia
SDLGPT

SEQ ID NO: 3063198 - protein, 5 aa, Giardia lamblia
SDLPD

SEQ ID NO: 3063199 - protein, 16 aa, Giardia lamblia
SDLQETKNKLNREQAS

SEQ ID NO: 3063200 - protein, 22 aa, Giardia lamblia
SDLSDASVKTSSGLKNPEPLPG

SEQ ID NO: 3063201 - protein, 11 aa, Giardia lamblia
SDLSPEATKDL

SEQ ID NO: 3063202 - protein, 5 aa, Giardia lamblia
SDLSS

SEQ ID NO: 3063203 - protein, 6 aa, Giardia lamblia
SDLTPP

SEQ ID NO: 3063204 - protein, 6 aa, Giardia lamblia
SDLYST

SEQ ID NO: 3063205 - protein, 9 aa, Giardia lamblia
SDMSQEDRE

SEQ ID NO: 3063206 - protein, 10 aa, Giardia lamblia
SDNDTAKKAD

SEQ ID NO: 3063207 - protein, 8 aa, Giardia lamblia
SDNGRADT

SEQ ID NO: 3063208 - protein, 7 aa, Giardia lamblia
SDNKTDV

SEQ ID NO: 3063209 - protein, 5 aa, Giardia lamblia
SDNLS

SEQ ID NO: 3063210 - protein, 8 aa, Giardia lamblia
SDNPLVSK

SEQ ID NO: 3063211 - protein, 22 aa, Giardia lamblia
SDNPTATQDQAKKPSGTSPTKT

SEQ ID NO: 3063212 - protein, 19 aa, Giardia lamblia
SDNQESCKNGGTCVKSDGE

SEQ ID NO: 3063213 - protein, 4 aa, Giardia lamblia
SDNR

SEQ ID NO: 3063214 - protein, 5 aa, Giardia lamblia
SDNSA

SEQ ID NO: 3063215 - protein, 13 aa, Giardia lamblia
SDNTESEPPAHPL

SEQ ID NO: 3063216 - protein, 9 aa, Giardia lamblia
SDPETYPGV

SEQ ID NO: 3063217 - protein, 4 aa, Giardia lamblia
SDPF

SEQ ID NO: 3063218 - protein, 6 aa, Giardia lamblia
SDPIPS

SEQ ID NO: 3063219 - protein, 9 aa, Giardia lamblia
SDPKSAGPF

SEQ ID NO: 3063220 - protein, 26 aa, Giardia lamblia
SDPNVAQIEDSRKTAATGKQLSEAKP

SEQ ID NO: 3063221 - protein, 12 aa, Giardia lamblia
SDPPAEIGPERE

SEQ ID NO: 3063222 - protein, 6 aa, Giardia lamblia
SDPPAL

SEQ ID NO: 3063223 - protein, 10 aa, Giardia lamblia
SDPQAQGNKF

SEQ ID NO: 3063224 - protein, 6 aa, Giardia lamblia
SDPQLA

SEQ ID NO: 3063225 - protein, 7 aa, Giardia lamblia
SDPQTKE

SEQ ID NO: 3063226 - protein, 6 aa, Giardia lamblia
SDPQTS

SEQ ID NO: 3063227 - protein, 17 aa, Giardia lamblia
SDPRSPPGVPSQCNSDS

SEQ ID NO: 3063228 - protein, 5 aa, Giardia lamblia
SDPSF

SEQ ID NO: 3063229 - protein, 11 aa, Giardia lamblia
SDPSQQHETQN

SEQ ID NO: 3063230 - protein, 15 aa, Giardia lamblia
SDPSTPGDAIRPGSV

SEQ ID NO: 3063231 - protein, 4 aa, Giardia lamblia
SDPV

SEQ ID NO: 3063232 - protein, 7 aa, Giardia lamblia
SDPVKPQ

SEQ ID NO: 3063233 - protein, 5 aa, Giardia lamblia
SDPYK

SEQ ID NO: 3063234 - protein, 7 aa, Giardia lamblia
SDQELPD

SEQ ID NO: 3063235 - protein, 6 aa, Giardia lamblia
SDQGAQ

SEQ ID NO: 3063236 - protein, 7 aa, Giardia lamblia
SDQGMQS

SEQ ID NO: 3063237 - protein, 9 aa, Giardia lamblia
SDQLSNKSN

SEQ ID NO: 3063238 - protein, 23 aa, Giardia lamblia
SDQPGISDENACGRTAAELQKSE

SEQ ID NO: 3063239 - protein, 7 aa, Giardia lamblia
SDQTADA

SEQ ID NO: 3063240 - protein, 9 aa, Giardia lamblia
SDQTRSATL

SEQ ID NO: 3063241 - protein, 21 aa, Giardia lamblia
SDQVSEDYNGPTSSEASFSSN

SEQ ID NO: 3063242 - protein, 10 aa, Giardia lamblia
SDQYDPIPEP

SEQ ID NO: 3063243 - protein, 7 aa, Giardia lamblia
SDQYELQ

SEQ ID NO: 3063244 - protein, 13 aa, Giardia lamblia
SDRATDEEGSTNK

SEQ ID NO: 3063245 - protein, 4 aa, Giardia lamblia
SDRD

SEQ ID NO: 3063246 - protein, 6 aa, Giardia lamblia
SDRDDE

SEQ ID NO: 3063247 - protein, 22 aa, Giardia lamblia
SDREDANAEGTGSNGLTSEGST

SEQ ID NO: 3063248 - protein, 7 aa, Giardia lamblia
SDREETV

SEQ ID NO: 3063249 - protein, 7 aa, Giardia lamblia
SDRGKCG

SEQ ID NO: 3063250 - protein, 7 aa, Giardia lamblia
SDRGKLG

SEQ ID NO: 3063251 - protein, 7 aa, Giardia lamblia
SDRGRMY

SEQ ID NO: 3063252 - protein, 6 aa, Giardia lamblia
SDRHSP

SEQ ID NO: 3063253 - protein, 4 aa, Giardia lamblia
SDRK

SEQ ID NO: 3063254 - protein, 7 aa, Giardia lamblia
SDRPELT

SEQ ID NO: 3063255 - protein, 6 aa, Giardia lamblia
SDRPPL

SEQ ID NO: 3063256 - protein, 5 aa, Giardia lamblia
SDRST

SEQ ID NO: 3063257 - protein, 13 aa, Giardia lamblia
SDRTERTEAATKI

SEQ ID NO: 3063258 - protein, 45 aa, Giardia lamblia
SDRTTKRTAQADALGDRQGESLANRDTTGLTPVSTEFSGTSLKGT

SEQ ID NO: 3063259 - protein, 9 aa, Giardia lamblia
SDSANGGIQ

SEQ ID NO: 3063260 - protein, 8 aa, Giardia lamblia
SDSAVDGA

SEQ ID NO: 3063261 - protein, 14 aa, Giardia lamblia
SDSDLTTSSTVDSK

SEQ ID NO: 3063262 - protein, 10 aa, Giardia lamblia
SDSDPSTSSN

SEQ ID NO: 3063263 - protein, 37 aa, Giardia lamblia
SDSDSADNTRAADTQNLQPPRAPTTGQPSQPHPKTGW

SEQ ID NO: 3063264 - protein, 8 aa, Giardia lamblia
SDSEMSAA

SEQ ID NO: 3063265 - protein, 4 aa, Giardia lamblia
SDSF

SEQ ID NO: 3063266 - protein, 7 aa, Giardia lamblia
SDSGGYV

SEQ ID NO: 3063267 - protein, 19 aa, Giardia lamblia
SDSIPRSGTGGVAGESNQR

SEQ ID NO: 3063268 - protein, 5 aa, Giardia lamblia
SDSIT

SEQ ID NO: 3063269 - protein, 8 aa, Giardia lamblia
SDSKAYRK

SEQ ID NO: 3063270 - protein, 4 aa, Giardia lamblia
SDSL

SEQ ID NO: 3063271 - protein, 8 aa, Giardia lamblia
SDSLNKAE

SEQ ID NO: 3063272 - protein, 14 aa, Giardia lamblia
SDSLPVHTTKPANA

SEQ ID NO: 3063273 - protein, 9 aa, Giardia lamblia
SDSPDIREA

SEQ ID NO: 3063274 - protein, 7 aa, Giardia lamblia
SDSPDLQ

SEQ ID NO: 3063275 - protein, 9 aa, Giardia lamblia
SDSQTSLGM

SEQ ID NO: 3063276 - protein, 9 aa, Giardia lamblia
SDSSGSAKI

SEQ ID NO: 3063277 - protein, 23 aa, Giardia lamblia
SDSSSDDSSSMTLESTDRSEHRP

SEQ ID NO: 3063278 - protein, 9 aa, Giardia lamblia
SDSSSSLPF

SEQ ID NO: 3063279 - protein, 5 aa, Giardia lamblia
SDSST

SEQ ID NO: 3063280 - protein, 9 aa, Giardia lamblia
SDSSTRTNE

SEQ ID NO: 3063281 - protein, 9 aa, Giardia lamblia
SDSTEDTNL

SEQ ID NO: 3063282 - protein, 6 aa, Giardia lamblia
SDSTGL

SEQ ID NO: 3063283 - protein, 8 aa, Giardia lamblia
SDSTIDDA

SEQ ID NO: 3063284 - protein, 5 aa, Giardia lamblia
SDSTN

SEQ ID NO: 3063285 - protein, 9 aa, Giardia lamblia
SDSTNDAIQ

SEQ ID NO: 3063286 - protein, 6 aa, Giardia lamblia
SDSTQN

SEQ ID NO: 3063287 - protein, 10 aa, Giardia lamblia
SDSTTSPPTI

SEQ ID NO: 3063288 - protein, 7 aa, Giardia lamblia
SDSYPSD

SEQ ID NO: 3063289 - protein, 8 aa, Giardia lamblia
SDTAAFAK

SEQ ID NO: 3063290 - protein, 8 aa, Giardia lamblia
SDTACDAC

SEQ ID NO: 3063291 - protein, 7 aa, Giardia lamblia
SDTARAV

SEQ ID NO: 3063292 - protein, 8 aa, Giardia lamblia
SDTARQGI

SEQ ID NO: 3063293 - protein, 11 aa, Giardia lamblia
SDTDMEKQEDI

SEQ ID NO: 3063294 - protein, 8 aa, Giardia lamblia
SDTDPEEC

SEQ ID NO: 3063295 - protein, 4 aa, Giardia lamblia
SDTI

SEQ ID NO: 3063296 - protein, 4 aa, Giardia lamblia
SDTL

SEQ ID NO: 3063297 - protein, 8 aa, Giardia lamblia
SDTNSESL

SEQ ID NO: 3063298 - protein, 5 aa, Giardia lamblia
SDTNV

SEQ ID NO: 3063299 - protein, 4 aa, Giardia lamblia
SDTP

SEQ ID NO: 3063300 - protein, 8 aa, Giardia lamblia
SDTQPATQ

SEQ ID NO: 3063301 - protein, 9 aa, Giardia lamblia
SDTSGKDSW

SEQ ID NO: 3063302 - protein, 15 aa, Giardia lamblia
SDTSQSDRSCNNYTS

SEQ ID NO: 3063303 - protein, 7 aa, Giardia lamblia
SDTSTAK

SEQ ID NO: 3063304 - protein, 10 aa, Giardia lamblia
SDTSVPLTDA

SEQ ID NO: 3063305 - protein, 9 aa, Giardia lamblia
SDTTEDEEL

SEQ ID NO: 3063306 - protein, 10 aa, Giardia lamblia
SDTTNGGHEG

SEQ ID NO: 3063307 - protein, 8 aa, Giardia lamblia
SDTWAKGT

SEQ ID NO: 3063308 - protein, 4 aa, Giardia lamblia
SDTY

SEQ ID NO: 3063309 - protein, 5 aa, Giardia lamblia
SDTYD

SEQ ID NO: 3063310 - protein, 12 aa, Giardia lamblia
SDVAGKPGRTPI

SEQ ID NO: 3063311 - protein, 4 aa, Giardia lamblia
SDVE

SEQ ID NO: 3063312 - protein, 19 aa, Giardia lamblia
SDVSAESKRAKCATKGFNE

SEQ ID NO: 3063313 - protein, 5 aa, Giardia lamblia
SDVTD

SEQ ID NO: 3063314 - protein, 14 aa, Giardia lamblia
SDVTDSKKKKSQAI

SEQ ID NO: 3063315 - protein, 9 aa, Giardia lamblia
SDYARPAAL

SEQ ID NO: 3063316 - protein, 12 aa, Giardia lamblia
SDYASKQPNGPL

SEQ ID NO: 3063317 - protein, 8 aa, Giardia lamblia
SDYASSAI

SEQ ID NO: 3063318 - protein, 7 aa, Giardia lamblia
SDYPEEL

SEQ ID NO: 3063319 - protein, 5 aa, Giardia lamblia
SDYYE

SEQ ID NO: 3063320 - protein, 7 aa, Giardia lamblia
SEADRVR

SEQ ID NO: 3063321 - protein, 4 aa, Giardia lamblia
SEAE

SEQ ID NO: 3063322 - protein, 9 aa, Giardia lamblia
SEAESAVKE

SEQ ID NO: 3063323 - protein, 12 aa, Giardia lamblia
SEAGAQDESGAT

SEQ ID NO: 3063324 - protein, 13 aa, Giardia lamblia
SEAGKVDCKGETA

SEQ ID NO: 3063325 - protein, 5 aa, Giardia lamblia
SEAHK

SEQ ID NO: 3063326 - protein, 5 aa, Giardia lamblia
SEAKE

SEQ ID NO: 3063327 - protein, 22 aa, Giardia lamblia
SEAKSRDVKSDIPGKMKDELDQ

SEQ ID NO: 3063328 - protein, 8 aa, Giardia lamblia
SEANRATF

SEQ ID NO: 3063329 - protein, 7 aa, Giardia lamblia
SEANTQV

SEQ ID NO: 3063330 - protein, 5 aa, Giardia lamblia
SEAPP

SEQ ID NO: 3063331 - protein, 6 aa, Giardia lamblia
SEAQIK

SEQ ID NO: 3063332 - protein, 17 aa, Giardia lamblia
SEASSTDASVAAQSSLG

SEQ ID NO: 3063333 - protein, 14 aa, Giardia lamblia
SEASTKDADDSKLS

SEQ ID NO: 3063334 - protein, 9 aa, Giardia lamblia
SECENASDC

SEQ ID NO: 3063335 - protein, 4 aa, Giardia lamblia
SEDA

SEQ ID NO: 3063336 - protein, 11 aa, Giardia lamblia
SEDEDKLGATR

SEQ ID NO: 3063337 - protein, 24 aa, Giardia lamblia
SEDFTEDEQSQIEADSKGFSRSTE

SEQ ID NO: 3063338 - protein, 7 aa, Giardia lamblia
SEDGASV

SEQ ID NO: 3063339 - protein, 7 aa, Giardia lamblia
SEDGFST

SEQ ID NO: 3063340 - protein, 10 aa, Giardia lamblia
SEDGISQEDR

SEQ ID NO: 3063341 - protein, 5 aa, Giardia lamblia
SEDGK

SEQ ID NO: 3063342 - protein, 9 aa, Giardia lamblia
SEDGSTCSC

SEQ ID NO: 3063343 - protein, 7 aa, Giardia lamblia
SEDGYTG

SEQ ID NO: 3063344 - protein, 4 aa, Giardia lamblia
SEDI

SEQ ID NO: 3063345 - protein, 27 aa, Giardia lamblia
SEDKDKGKDTSKDIDGAHEDPHASYSS

SEQ ID NO: 3063346 - protein, 8 aa, Giardia lamblia
SEDKDNGC

SEQ ID NO: 3063347 - protein, 5 aa, Giardia lamblia
SEDKY

SEQ ID NO: 3063348 - protein, 10 aa, Giardia lamblia
SEDNAKTAPA

SEQ ID NO: 3063349 - protein, 8 aa, Giardia lamblia
SEDQPSPL

SEQ ID NO: 3063350 - protein, 8 aa, Giardia lamblia
SEDSAASE

SEQ ID NO: 3063351 - protein, 6 aa, Giardia lamblia
SEDSDC

SEQ ID NO: 3063352 - protein, 13 aa, Giardia lamblia
SEDSSTTNPKHAT

SEQ ID NO: 3063353 - protein, 6 aa, Giardia lamblia
SEDTAL

SEQ ID NO: 3063354 - protein, 11 aa, Giardia lamblia
SEDTDSDSKIS

SEQ ID NO: 3063355 - protein, 8 aa, Giardia lamblia
SEDTRAAH

SEQ ID NO: 3063356 - protein, 4 aa, Giardia lamblia
SEDV

SEQ ID NO: 3063357 - protein, 13 aa, Giardia lamblia
SEEAQSESRKTIT

SEQ ID NO: 3063358 - protein, 5 aa, Giardia lamblia
SEEDA

SEQ ID NO: 3063359 - protein, 8 aa, Giardia lamblia
SEEDPEAL

SEQ ID NO: 3063360 - protein, 8 aa, Giardia lamblia
SEEEQRCG

SEQ ID NO: 3063361 - protein, 8 aa, Giardia lamblia
SEENECGS

SEQ ID NO: 3063362 - protein, 15 aa, Giardia lamblia
SEENKCGQCGGDYKL

SEQ ID NO: 3063363 - protein, 5 aa, Giardia lamblia
SEENP

SEQ ID NO: 3063364 - protein, 5 aa, Giardia lamblia
SEEPG

SEQ ID NO: 3063365 - protein, 5 aa, Giardia lamblia
SEEPL

SEQ ID NO: 3063366 - protein, 8 aa, Giardia lamblia
SEEPLTPE

SEQ ID NO: 3063367 - protein, 11 aa, Giardia lamblia
SEERAKQLRNN

SEQ ID NO: 3063368 - protein, 23 aa, Giardia lamblia
SEESEEPDIDAYDTTDDNESMTY

SEQ ID NO: 3063369 - protein, 19 aa, Giardia lamblia
SEESGAPQPSADAPESQSI

SEQ ID NO: 3063370 - protein, 16 aa, Giardia lamblia
SEESYGNGNAGSPSPS

SEQ ID NO: 3063371 - protein, 9 aa, Giardia lamblia
SEESYLRTT

SEQ ID NO: 3063372 - protein, 5 aa, Giardia lamblia
SEETL

SEQ ID NO: 3063373 - protein, 19 aa, Giardia lamblia
SEFNTNAQQSNSLESYSSG

SEQ ID NO: 3063374 - protein, 6 aa, Giardia lamblia
SEGADP

SEQ ID NO: 3063375 - protein, 9 aa, Giardia lamblia
SEGASASDC

SEQ ID NO: 3063376 - protein, 5 aa, Giardia lamblia
SEGEI

SEQ ID NO: 3063377 - protein, 8 aa, Giardia lamblia
SEGGGTCS

SEQ ID NO: 3063378 - protein, 14 aa, Giardia lamblia
SEGGHDSPERKSSV

SEQ ID NO: 3063379 - protein, 9 aa, Giardia lamblia
SEGIQTQGY

SEQ ID NO: 3063380 - protein, 5 aa, Giardia lamblia
SEGLG

SEQ ID NO: 3063381 - protein, 6 aa, Giardia lamblia
SEGLRS

SEQ ID NO: 3063382 - protein, 9 aa, Giardia lamblia
SEGSASLSD

SEQ ID NO: 3063383 - protein, 6 aa, Giardia lamblia
SEGSRP

SEQ ID NO: 3063384 - protein, 18 aa, Giardia lamblia
SEHEASSHSTEEHNRPKR

SEQ ID NO: 3063385 - protein, 9 aa, Giardia lamblia
SEHGVPPAC

SEQ ID NO: 3063386 - protein, 29 aa, Giardia lamblia
SEHLSESRSFRSSKSNRYSSSRSSVSGIS

SEQ ID NO: 3063387 - protein, 59 aa, Giardia lamblia
SEHPGRSQTAGRQRHASGITRYPADRSFEPSPGHRGTHHSHGQYSMPDGYGSNRHRDYH

SEQ ID NO: 3063388 - protein, 13 aa, Giardia lamblia
SEHPLDKGRKAAL

SEQ ID NO: 3063389 - protein, 8 aa, Giardia lamblia
SEHPRTAA

SEQ ID NO: 3063390 - protein, 6 aa, Giardia lamblia
SEHSSS

SEQ ID NO: 3063391 - protein, 4 aa, Giardia lamblia
SEIS

SEQ ID NO: 3063392 - protein, 6 aa, Giardia lamblia
SEISSA

SEQ ID NO: 3063393 - protein, 7 aa, Giardia lamblia
SEKEPTL

SEQ ID NO: 3063394 - protein, 29 aa, Giardia lamblia
SEKGSRNATKLNTPTKATRPRKESLAPSD

SEQ ID NO: 3063395 - protein, 5 aa, Giardia lamblia
SEKIS

SEQ ID NO: 3063396 - protein, 5 aa, Giardia lamblia
SEKIT

SEQ ID NO: 3063397 - protein, 7 aa, Giardia lamblia
SEKPPEY

SEQ ID NO: 3063398 - protein, 10 aa, Giardia lamblia
SEKQKELTKA

SEQ ID NO: 3063399 - protein, 13 aa, Giardia lamblia
SEKRSTPKKEKSI

SEQ ID NO: 3063400 - protein, 8 aa, Giardia lamblia
SEKSAEKM

SEQ ID NO: 3063401 - protein, 7 aa, Giardia lamblia
SEKSPKH

SEQ ID NO: 3063402 - protein, 7 aa, Giardia lamblia
SEKTIVN

SEQ ID NO: 3063403 - protein, 8 aa, Giardia lamblia
SELAEAEP

SEQ ID NO: 3063404 - protein, 9 aa, Giardia lamblia
SELNNTNAS

SEQ ID NO: 3063405 - protein, 6 aa, Giardia lamblia
SELPGG

SEQ ID NO: 3063406 - protein, 7 aa, Giardia lamblia
SELPKSS

SEQ ID NO: 3063407 - protein, 5 aa, Giardia lamblia
SELPP

SEQ ID NO: 3063408 - protein, 8 aa, Giardia lamblia
SELRETGN

SEQ ID NO: 3063409 - protein, 8 aa, Giardia lamblia
SELSSDVR

SEQ ID NO: 3063410 - protein, 6 aa, Giardia lamblia
SELSTQ

SEQ ID NO: 3063411 - protein, 10 aa, Giardia lamblia
SELTSQGRRL

SEQ ID NO: 3063412 - protein, 4 aa, Giardia lamblia
SEME

SEQ ID NO: 3063413 - protein, 6 aa, Giardia lamblia
SEMEQS

SEQ ID NO: 3063414 - protein, 6 aa, Giardia lamblia
SEMTEK

SEQ ID NO: 3063415 - protein, 8 aa, Giardia lamblia
SENASSIY

SEQ ID NO: 3063416 - protein, 9 aa, Giardia lamblia
SENATSVGN

SEQ ID NO: 3063417 - protein, 6 aa, Giardia lamblia
SENPVY

SEQ ID NO: 3063418 - protein, 7 aa, Giardia lamblia
SENQGNV

SEQ ID NO: 3063419 - protein, 9 aa, Giardia lamblia
SENSPAYSI

SEQ ID NO: 3063420 - protein, 8 aa, Giardia lamblia
SENYGIRP

SEQ ID NO: 3063421 - protein, 6 aa, Giardia lamblia
SEPECY

SEQ ID NO: 3063422 - protein, 14 aa, Giardia lamblia
SEPEQVDRLPSPKL

SEQ ID NO: 3063423 - protein, 14 aa, Giardia lamblia
SEPESLTSHNTDTI

SEQ ID NO: 3063424 - protein, 7 aa, Giardia lamblia
SEPGDFR

SEQ ID NO: 3063425 - protein, 5 aa, Giardia lamblia
SEPIT

SEQ ID NO: 3063426 - protein, 25 aa, Giardia lamblia
SEPKGFKAEALDPEPAHEVDRDEVT

SEQ ID NO: 3063427 - protein, 9 aa, Giardia lamblia
SEPKMGSEN

SEQ ID NO: 3063428 - protein, 6 aa, Giardia lamblia
SEPLSQ

SEQ ID NO: 3063429 - protein, 5 aa, Giardia lamblia
SEPNW

SEQ ID NO: 3063430 - protein, 14 aa, Giardia lamblia
SEPNYVSTSSGYTS

SEQ ID NO: 3063431 - protein, 5 aa, Giardia lamblia
SEPPI

SEQ ID NO: 3063432 - protein, 11 aa, Giardia lamblia
SEPSKSLDREL

SEQ ID NO: 3063433 - protein, 12 aa, Giardia lamblia
SEPSPQAPVEQP

SEQ ID NO: 3063434 - protein, 7 aa, Giardia lamblia
SEPSSHE

SEQ ID NO: 3063435 - protein, 7 aa, Giardia lamblia
SEPVHTS

SEQ ID NO: 3063436 - protein, 6 aa, Giardia lamblia
SEQDQQ

SEQ ID NO: 3063437 - protein, 15 aa, Giardia lamblia
SEQDTCSADRGSSSN

SEQ ID NO: 3063438 - protein, 25 aa, Giardia lamblia
SEQEVGEKLQPRDVANSRRRQRGLG

SEQ ID NO: 3063439 - protein, 4 aa, Giardia lamblia
SEQI

SEQ ID NO: 3063440 - protein, 8 aa, Giardia lamblia
SEQLSQQD

SEQ ID NO: 3063441 - protein, 8 aa, Giardia lamblia
SEQPDEQY

SEQ ID NO: 3063442 - protein, 6 aa, Giardia lamblia
SEQRAK

SEQ ID NO: 3063443 - protein, 36 aa, Giardia lamblia
SEQRSESSPESQSHLKQGKTNAEAKEPQKQDRSPSE

SEQ ID NO: 3063444 - protein, 8 aa, Giardia lamblia
SERFEGDP

SEQ ID NO: 3063445 - protein, 5 aa, Giardia lamblia
SERRT

SEQ ID NO: 3063446 - protein, 6 aa, Giardia lamblia
SERSPV

SEQ ID NO: 3063447 - protein, 12 aa, Giardia lamblia
SERTPSTSGQGR

SEQ ID NO: 3063448 - protein, 9 aa, Giardia lamblia
SERTVSSAK

SEQ ID NO: 3063449 - protein, 5 aa, Giardia lamblia
SESAD

SEQ ID NO: 3063450 - protein, 7 aa, Giardia lamblia
SESARTL

SEQ ID NO: 3063451 - protein, 6 aa, Giardia lamblia
SESDSI

SEQ ID NO: 3063452 - protein, 9 aa, Giardia lamblia
SESEDDGPS

SEQ ID NO: 3063453 - protein, 6 aa, Giardia lamblia
SESEEF

SEQ ID NO: 3063454 - protein, 7 aa, Giardia lamblia
SESGGGL

SEQ ID NO: 3063455 - protein, 14 aa, Giardia lamblia
SESIASKDRANTPT

SEQ ID NO: 3063456 - protein, 9 aa, Giardia lamblia
SESKDPELK

SEQ ID NO: 3063457 - protein, 13 aa, Giardia lamblia
SESKTRLNTNAPR

SEQ ID NO: 3063458 - protein, 4 aa, Giardia lamblia
SESL

SEQ ID NO: 3063459 - protein, 5 aa, Giardia lamblia
SESNK

SEQ ID NO: 3063460 - protein, 8 aa, Giardia lamblia
SESPMSTG

SEQ ID NO: 3063461 - protein, 8 aa, Giardia lamblia
SESQDDIY

SEQ ID NO: 3063462 - protein, 8 aa, Giardia lamblia
SESQEYAP

SEQ ID NO: 3063463 - protein, 23 aa, Giardia lamblia
SESQNNNSDRPSDKEKKTKTAIQ

SEQ ID NO: 3063464 - protein, 10 aa, Giardia lamblia
SESQPGHGWA

SEQ ID NO: 3063465 - protein, 6 aa, Giardia lamblia
SESREG

SEQ ID NO: 3063466 - protein, 5 aa, Giardia lamblia
SESSA

SEQ ID NO: 3063467 - protein, 9 aa, Giardia lamblia
SESSATRSY

SEQ ID NO: 3063468 - protein, 8 aa, Giardia lamblia
SESSLDDD

SEQ ID NO: 3063469 - protein, 33 aa, Giardia lamblia
SESSSSFRASNSTKNSEKRAALSTVKKNKSQLS

SEQ ID NO: 3063470 - protein, 8 aa, Giardia lamblia
SESSSSGS

SEQ ID NO: 3063471 - protein, 8 aa, Giardia lamblia
SESSTPSV

SEQ ID NO: 3063472 - protein, 19 aa, Giardia lamblia
SESSVVDSESEVLDSSTGV

SEQ ID NO: 3063473 - protein, 5 aa, Giardia lamblia
SESTG

SEQ ID NO: 3063474 - protein, 8 aa, Giardia lamblia
SESTYPNG

SEQ ID NO: 3063475 - protein, 5 aa, Giardia lamblia
SETDT

SEQ ID NO: 3063476 - protein, 7 aa, Giardia lamblia
SETDTAA

SEQ ID NO: 3063477 - protein, 16 aa, Giardia lamblia
SETEDYEDDKIASGSW

SEQ ID NO: 3063478 - protein, 21 aa, Giardia lamblia
SETEISSSQLQNRQYGATKGY

SEQ ID NO: 3063479 - protein, 8 aa, Giardia lamblia
SETGRMPV

SEQ ID NO: 3063480 - protein, 7 aa, Giardia lamblia
SETGSSA

SEQ ID NO: 3063481 - protein, 16 aa, Giardia lamblia
SETNTIDSSEPYRNGF

SEQ ID NO: 3063482 - protein, 6 aa, Giardia lamblia
SETPSL

SEQ ID NO: 3063483 - protein, 10 aa, Giardia lamblia
SETPSTPLST

SEQ ID NO: 3063484 - protein, 8 aa, Giardia lamblia
SETSMDGE

SEQ ID NO: 3063485 - protein, 41 aa, Giardia lamblia
SETSSSSGSSCSGTTTPSKCDGIPDRERQSLRKSTASKSLR

SEQ ID NO: 3063486 - protein, 33 aa, Giardia lamblia
SETSSVPNSVPSSLHSTPTQKRTLDTTDTHTPL

SEQ ID NO: 3063487 - protein, 14 aa, Giardia lamblia
SETSTSEGTPQSNF

SEQ ID NO: 3063488 - protein, 7 aa, Giardia lamblia
SETTADR

SEQ ID NO: 3063489 - protein, 13 aa, Giardia lamblia
SETYSSHNNLRTE

SEQ ID NO: 3063490 - protein, 13 aa, Giardia lamblia
SEVADGKLSSIGK

SEQ ID NO: 3063491 - protein, 9 aa, Giardia lamblia
SEVAEPPYK

SEQ ID NO: 3063492 - protein, 6 aa, Giardia lamblia
SEVCSQ

SEQ ID NO: 3063493 - protein, 7 aa, Giardia lamblia
SEVDEDN

SEQ ID NO: 3063494 - protein, 21 aa, Giardia lamblia
SEVREIGDDSTNSVGSSGAER

SEQ ID NO: 3063495 - protein, 6 aa, Giardia lamblia
SEVRSV

SEQ ID NO: 3063496 - protein, 5 aa, Giardia lamblia
SEVSY

SEQ ID NO: 3063497 - protein, 7 aa, Giardia lamblia
SEWGTEA

SEQ ID NO: 3063498 - protein, 4 aa, Giardia lamblia
SEYK

SEQ ID NO: 3063499 - protein, 8 aa, Giardia lamblia
SEYRPSEY

SEQ ID NO: 3063500 - protein, 9 aa, Giardia lamblia
SFADTADYS

SEQ ID NO: 3063501 - protein, 7 aa, Giardia lamblia
SFAPNQP

SEQ ID NO: 3063502 - protein, 10 aa, Giardia lamblia
SFASHSKERK

SEQ ID NO: 3063503 - protein, 12 aa, Giardia lamblia
SFDQNETTPRPH

SEQ ID NO: 3063504 - protein, 4 aa, Giardia lamblia
SFGE

SEQ ID NO: 3063505 - protein, 7 aa, Giardia lamblia
SFGPRAR

SEQ ID NO: 3063506 - protein, 31 aa, Giardia lamblia
SFHTAETSSTTAIADTPASEQSCRASTDGDS

SEQ ID NO: 3063507 - protein, 5 aa, Giardia lamblia
SFKDA

SEQ ID NO: 3063508 - protein, 11 aa, Giardia lamblia
SFPAPDGKRAS

SEQ ID NO: 3063509 - protein, 11 aa, Giardia lamblia
SFPAPDGKRTG

SEQ ID NO: 3063510 - protein, 19 aa, Giardia lamblia
SFPFTPPSRSLSSSGVTSP

SEQ ID NO: 3063511 - protein, 8 aa, Giardia lamblia
SFPPNKKM

SEQ ID NO: 3063512 - protein, 13 aa, Giardia lamblia
SFPQENPDTGNKC

SEQ ID NO: 3063513 - protein, 9 aa, Giardia lamblia
SFQEGQQNL

SEQ ID NO: 3063514 - protein, 5 aa, Giardia lamblia
SFQSR

SEQ ID NO: 3063515 - protein, 14 aa, Giardia lamblia
SFRPTDSGAPAADI

SEQ ID NO: 3063516 - protein, 7 aa, Giardia lamblia
SFSDDST

SEQ ID NO: 3063517 - protein, 20 aa, Giardia lamblia
SFSGPTDSISSSASAGSELR

SEQ ID NO: 3063518 - protein, 7 aa, Giardia lamblia
SFSITTP

SEQ ID NO: 3063519 - protein, 10 aa, Giardia lamblia
SFSNASDAVN

SEQ ID NO: 3063520 - protein, 13 aa, Giardia lamblia
SFSSPLSASFTYR

SEQ ID NO: 3063521 - protein, 8 aa, Giardia lamblia
SFSSPTMP

SEQ ID NO: 3063522 - protein, 4 aa, Giardia lamblia
SFSV

SEQ ID NO: 3063523 - protein, 6 aa, Giardia lamblia
SFTPGD

SEQ ID NO: 3063524 - protein, 4 aa, Giardia lamblia
SFYE

SEQ ID NO: 3063525 - protein, 5 aa, Giardia lamblia
SGAAD

SEQ ID NO: 3063526 - protein, 11 aa, Giardia lamblia
SGAADSDFKSS

SEQ ID NO: 3063527 - protein, 5 aa, Giardia lamblia
SGADK

SEQ ID NO: 3063528 - protein, 6 aa, Giardia lamblia
SGADNT

SEQ ID NO: 3063529 - protein, 19 aa, Giardia lamblia
SGAEDVDAVTRGSTEGHRS

SEQ ID NO: 3063530 - protein, 6 aa, Giardia lamblia
SGAEHA

SEQ ID NO: 3063531 - protein, 6 aa, Giardia lamblia
SGAIDR

SEQ ID NO: 3063532 - protein, 5 aa, Giardia lamblia
SGALA

SEQ ID NO: 3063533 - protein, 6 aa, Giardia lamblia
SGAMPN

SEQ ID NO: 3063534 - protein, 8 aa, Giardia lamblia
SGARRSHS

SEQ ID NO: 3063535 - protein, 4 aa, Giardia lamblia
SGAS

SEQ ID NO: 3063536 - protein, 11 aa, Giardia lamblia
SGASFSTSADS

SEQ ID NO: 3063537 - protein, 9 aa, Giardia lamblia
SGASLTDSA

SEQ ID NO: 3063538 - protein, 6 aa, Giardia lamblia
SGASTY

SEQ ID NO: 3063539 - protein, 4 aa, Giardia lamblia
SGAT

SEQ ID NO: 3063540 - protein, 9 aa, Giardia lamblia
SGATASDTA

SEQ ID NO: 3063541 - protein, 16 aa, Giardia lamblia
SGATEQCSCNPNTVPV

SEQ ID NO: 3063542 - protein, 6 aa, Giardia lamblia
SGAYSA

SEQ ID NO: 3063543 - protein, 5 aa, Giardia lamblia
SGCQD

SEQ ID NO: 3063544 - protein, 5 aa, Giardia lamblia
SGCSG

SEQ ID NO: 3063545 - protein, 6 aa, Giardia lamblia
SGCTQT

SEQ ID NO: 3063546 - protein, 5 aa, Giardia lamblia
SGDAD

SEQ ID NO: 3063547 - protein, 18 aa, Giardia lamblia
SGDASGPCRPCSDTTPMD

SEQ ID NO: 3063548 - protein, 61 aa, Giardia lamblia
SGDFSDNSSAARGDLEERSQQQKGTKRGPSRRGRANEKKDKPCPAKETPCRKPKSRAEPSY

SEQ ID NO: 3063549 - protein, 7 aa, Giardia lamblia
SGDGAHN

SEQ ID NO: 3063550 - protein, 7 aa, Giardia lamblia
SGDGYTG

SEQ ID NO: 3063551 - protein, 25 aa, Giardia lamblia
SGDLPTPDTPSTQSTTNSPDSDGHH

SEQ ID NO: 3063552 - protein, 7 aa, Giardia lamblia
SGDNVNK

SEQ ID NO: 3063553 - protein, 6 aa, Giardia lamblia
SGDRRR

SEQ ID NO: 3063554 - protein, 7 aa, Giardia lamblia
SGDSERI

SEQ ID NO: 3063555 - protein, 12 aa, Giardia lamblia
SGDSSRKDDTSG

SEQ ID NO: 3063556 - protein, 6 aa, Giardia lamblia
SGDVAG

SEQ ID NO: 3063557 - protein, 7 aa, Giardia lamblia
SGDVSSA

SEQ ID NO: 3063558 - protein, 5 aa, Giardia lamblia
SGDVV

SEQ ID NO: 3063559 - protein, 4 aa, Giardia lamblia
SGDW

SEQ ID NO: 3063560 - protein, 9 aa, Giardia lamblia
SGDYEKDEV

SEQ ID NO: 3063561 - protein, 19 aa, Giardia lamblia
SGEADASTITDSYTRSNLS

SEQ ID NO: 3063562 - protein, 8 aa, Giardia lamblia
SGEAPENA

SEQ ID NO: 3063563 - protein, 9 aa, Giardia lamblia
SGEEHLPHD

SEQ ID NO: 3063564 - protein, 6 aa, Giardia lamblia
SGEETF

SEQ ID NO: 3063565 - protein, 7 aa, Giardia lamblia
SGEGATK

SEQ ID NO: 3063566 - protein, 5 aa, Giardia lamblia
SGEKE

SEQ ID NO: 3063567 - protein, 4 aa, Giardia lamblia
SGEL

SEQ ID NO: 3063568 - protein, 27 aa, Giardia lamblia
SGELQTEEYTYKGEFSDGQQTGQGRIE

SEQ ID NO: 3063569 - protein, 9 aa, Giardia lamblia
SGELTTDGQ

SEQ ID NO: 3063570 - protein, 6 aa, Giardia lamblia
SGEMRS

SEQ ID NO: 3063571 - protein, 20 aa, Giardia lamblia
SGERNDTSGGASGAGASLTK

SEQ ID NO: 3063572 - protein, 23 aa, Giardia lamblia
SGETRKLGYNSKNDVRKHSTPAS

SEQ ID NO: 3063573 - protein, 4 aa, Giardia lamblia
SGEV

SEQ ID NO: 3063574 - protein, 21 aa, Giardia lamblia
SGFRDAGLSNSAALSAKIKAT

SEQ ID NO: 3063575 - protein, 5 aa, Giardia lamblia
SGFSQ

SEQ ID NO: 3063576 - protein, 5 aa, Giardia lamblia
SGGDR

SEQ ID NO: 3063577 - protein, 8 aa, Giardia lamblia
SGGEKTLS

SEQ ID NO: 3063578 - protein, 10 aa, Giardia lamblia
SGGEPSNRDV

SEQ ID NO: 3063579 - protein, 15 aa, Giardia lamblia
SGGFSGVGSSYDTTV

SEQ ID NO: 3063580 - protein, 5 aa, Giardia lamblia
SGGLE

SEQ ID NO: 3063581 - protein, 4 aa, Giardia lamblia
SGGM

SEQ ID NO: 3063582 - protein, 5 aa, Giardia lamblia
SGGNR

SEQ ID NO: 3063583 - protein, 5 aa, Giardia lamblia
SGGNY

SEQ ID NO: 3063584 - protein, 4 aa, Giardia lamblia
SGGP

SEQ ID NO: 3063585 - protein, 16 aa, Giardia lamblia
SGGSVSSSLASDPVST

SEQ ID NO: 3063586 - protein, 10 aa, Giardia lamblia
SGGTVEDSQS

SEQ ID NO: 3063587 - protein, 5 aa, Giardia lamblia
SGGYA

SEQ ID NO: 3063588 - protein, 5 aa, Giardia lamblia
SGHAE

SEQ ID NO: 3063589 - protein, 4 aa, Giardia lamblia
SGHD

SEQ ID NO: 3063590 - protein, 7 aa, Giardia lamblia
SGHEDCP

SEQ ID NO: 3063591 - protein, 16 aa, Giardia lamblia
SGHGKCKGSKNTGYSC

SEQ ID NO: 3063592 - protein, 10 aa, Giardia lamblia
SGHGSCSSEN

SEQ ID NO: 3063593 - protein, 4 aa, Giardia lamblia
SGHI

SEQ ID NO: 3063594 - protein, 5 aa, Giardia lamblia
SGHIP

SEQ ID NO: 3063595 - protein, 5 aa, Giardia lamblia
SGHQI

SEQ ID NO: 3063596 - protein, 4 aa, Giardia lamblia
SGHS

SEQ ID NO: 3063597 - protein, 5 aa, Giardia lamblia
SGIGQ

SEQ ID NO: 3063598 - protein, 5 aa, Giardia lamblia
SGIRT

SEQ ID NO: 3063599 - protein, 10 aa, Giardia lamblia
SGISKERPYS

SEQ ID NO: 3063600 - protein, 6 aa, Giardia lamblia
SGKAAA

SEQ ID NO: 3063601 - protein, 8 aa, Giardia lamblia
SGKAADVS

SEQ ID NO: 3063602 - protein, 13 aa, Giardia lamblia
SGKCNDDPCSSNN

SEQ ID NO: 3063603 - protein, 6 aa, Giardia lamblia
SGKETQ

SEQ ID NO: 3063604 - protein, 4 aa, Giardia lamblia
SGKI

SEQ ID NO: 3063605 - protein, 7 aa, Giardia lamblia
SGKIEDR

SEQ ID NO: 3063606 - protein, 5 aa, Giardia lamblia
SGKLT

SEQ ID NO: 3063607 - protein, 6 aa, Giardia lamblia
SGKSTY

SEQ ID NO: 3063608 - protein, 11 aa, Giardia lamblia
SGLEPNESLDN

SEQ ID NO: 3063609 - protein, 8 aa, Giardia lamblia
SGLKASTA

SEQ ID NO: 3063610 - protein, 7 aa, Giardia lamblia
SGLNPNK

SEQ ID NO: 3063611 - protein, 7 aa, Giardia lamblia
SGLQPGR

SEQ ID NO: 3063612 - protein, 7 aa, Giardia lamblia
SGLRDTH

SEQ ID NO: 3063613 - protein, 5 aa, Giardia lamblia
SGLRT

SEQ ID NO: 3063614 - protein, 4 aa, Giardia lamblia
SGLS

SEQ ID NO: 3063615 - protein, 15 aa, Giardia lamblia
SGLSSNIKAPAPPRL

SEQ ID NO: 3063616 - protein, 5 aa, Giardia lamblia
SGMDG

SEQ ID NO: 3063617 - protein, 6 aa, Giardia lamblia
SGMPAA

SEQ ID NO: 3063618 - protein, 6 aa, Giardia lamblia
SGMSDN

SEQ ID NO: 3063619 - protein, 6 aa, Giardia lamblia
SGNASK

SEQ ID NO: 3063620 - protein, 4 aa, Giardia lamblia
SGNL

SEQ ID NO: 3063621 - protein, 5 aa, Giardia lamblia
SGNLT

SEQ ID NO: 3063622 - protein, 15 aa, Giardia lamblia
SGNQGKQPVKRAPRR

SEQ ID NO: 3063623 - protein, 5 aa, Giardia lamblia
SGNRE

SEQ ID NO: 3063624 - protein, 8 aa, Giardia lamblia
SGNSCTEC

SEQ ID NO: 3063625 - protein, 14 aa, Giardia lamblia
SGNSLGTSTTQSSS

SEQ ID NO: 3063626 - protein, 5 aa, Giardia lamblia
SGNTD

SEQ ID NO: 3063627 - protein, 5 aa, Giardia lamblia
SGNTF

SEQ ID NO: 3063628 - protein, 5 aa, Giardia lamblia
SGNTI

SEQ ID NO: 3063629 - protein, 9 aa, Giardia lamblia
SGNTKNLTT

SEQ ID NO: 3063630 - protein, 8 aa, Giardia lamblia
SGNTQQDH

SEQ ID NO: 3063631 - protein, 22 aa, Giardia lamblia
SGNTVDAATSSILPSTKFSSRT

SEQ ID NO: 3063632 - protein, 8 aa, Giardia lamblia
SGNYKSRF

SEQ ID NO: 3063633 - protein, 8 aa, Giardia lamblia
SGNYTTQN

SEQ ID NO: 3063634 - protein, 7 aa, Giardia lamblia
SGPAGAL

SEQ ID NO: 3063635 - protein, 7 aa, Giardia lamblia
SGPGESD

SEQ ID NO: 3063636 - protein, 5 aa, Giardia lamblia
SGPKC

SEQ ID NO: 3063637 - protein, 7 aa, Giardia lamblia
SGPKKAD

SEQ ID NO: 3063638 - protein, 5 aa, Giardia lamblia
SGPLV

SEQ ID NO: 3063639 - protein, 7 aa, Giardia lamblia
SGPMSAQ

SEQ ID NO: 3063640 - protein, 8 aa, Giardia lamblia
SGPNWYSS

SEQ ID NO: 3063641 - protein, 9 aa, Giardia lamblia
SGPPSLTTP

SEQ ID NO: 3063642 - protein, 7 aa, Giardia lamblia
SGPPSTV

SEQ ID NO: 3063643 - protein, 8 aa, Giardia lamblia
SGPRGNEF

SEQ ID NO: 3063644 - protein, 6 aa, Giardia lamblia
SGPRRS

SEQ ID NO: 3063645 - protein, 4 aa, Giardia lamblia
SGPS

SEQ ID NO: 3063646 - protein, 4 aa, Giardia lamblia
SGPT

SEQ ID NO: 3063647 - protein, 6 aa, Giardia lamblia
SGPTED

SEQ ID NO: 3063648 - protein, 5 aa, Giardia lamblia
SGPYP

SEQ ID NO: 3063649 - protein, 59 aa, Giardia lamblia
SGQEANSTEKPVEQPNEEVSEPSRSSGPQKDDDAIQSEESSSEKKDGDEQQYEGGTGQM

SEQ ID NO: 3063650 - protein, 4 aa, Giardia lamblia
SGQK

SEQ ID NO: 3063651 - protein, 5 aa, Giardia lamblia
SGQPF

SEQ ID NO: 3063652 - protein, 5 aa, Giardia lamblia
SGQPS

SEQ ID NO: 3063653 - protein, 6 aa, Giardia lamblia
SGQSPA

SEQ ID NO: 3063654 - protein, 12 aa, Giardia lamblia
SGQTEISTDTSS

SEQ ID NO: 3063655 - protein, 23 aa, Giardia lamblia
SGQTKINPSTPREGKGASGDGYA

SEQ ID NO: 3063656 - protein, 7 aa, Giardia lamblia
SGRCGPS

SEQ ID NO: 3063657 - protein, 6 aa, Giardia lamblia
SGRDCS

SEQ ID NO: 3063658 - protein, 4 aa, Giardia lamblia
SGRF

SEQ ID NO: 3063659 - protein, 11 aa, Giardia lamblia
SGRGTCSVDEK

SEQ ID NO: 3063660 - protein, 7 aa, Giardia lamblia
SGRSKTE

SEQ ID NO: 3063661 - protein, 6 aa, Giardia lamblia
SGSAAV

SEQ ID NO: 3063662 - protein, 36 aa, Giardia lamblia
SGSACESAASLEGSSLPTDAQHQQPTPTAKTTRKHL

SEQ ID NO: 3063663 - protein, 9 aa, Giardia lamblia
SGSATKPLD

SEQ ID NO: 3063664 - protein, 10 aa, Giardia lamblia
SGSCTSDRST

SEQ ID NO: 3063665 - protein, 9 aa, Giardia lamblia
SGSDVARDA

SEQ ID NO: 3063666 - protein, 4 aa, Giardia lamblia
SGSE

SEQ ID NO: 3063667 - protein, 7 aa, Giardia lamblia
SGSEQVE

SEQ ID NO: 3063668 - protein, 24 aa, Giardia lamblia
SGSESGIQRSAAGGLSGLNTRPTH

SEQ ID NO: 3063669 - protein, 4 aa, Giardia lamblia
SGSF

SEQ ID NO: 3063670 - protein, 7 aa, Giardia lamblia
SGSGKSV

SEQ ID NO: 3063671 - protein, 5 aa, Giardia lamblia
SGSGQ

SEQ ID NO: 3063672 - protein, 17 aa, Giardia lamblia
SGSGTCTKAPEVSGKLP

SEQ ID NO: 3063673 - protein, 6 aa, Giardia lamblia
SGSKED

SEQ ID NO: 3063674 - protein, 25 aa, Giardia lamblia
SGSKENLLASTSGAPTSTAGSMTPN

SEQ ID NO: 3063675 - protein, 43 aa, Giardia lamblia
SGSNGNQPADGTASVVQQKTPKRPQASPLKGQSLRSQLANNSM

SEQ ID NO: 3063676 - protein, 9 aa, Giardia lamblia
SGSPNKTIA

SEQ ID NO: 3063677 - protein, 12 aa, Giardia lamblia
SGSSECSAHSAL

SEQ ID NO: 3063678 - protein, 13 aa, Giardia lamblia
SGSSGNPKGVTHT

SEQ ID NO: 3063679 - protein, 33 aa, Giardia lamblia
SGSSLGESGTVGSGSTSGNSTPRGRGWESSSNP

SEQ ID NO: 3063680 - protein, 14 aa, Giardia lamblia
SGSSNDAKAPGANV

SEQ ID NO: 3063681 - protein, 8 aa, Giardia lamblia
SGSSQINA

SEQ ID NO: 3063682 - protein, 7 aa, Giardia lamblia
SGSTCTG

SEQ ID NO: 3063683 - protein, 5 aa, Giardia lamblia
SGSTI

SEQ ID NO: 3063684 - protein, 7 aa, Giardia lamblia
SGSTRAQ

SEQ ID NO: 3063685 - protein, 15 aa, Giardia lamblia
SGSTSVAAQKSPVLS

SEQ ID NO: 3063686 - protein, 24 aa, Giardia lamblia
SGSTSVCGGSTVGTCTKGQGEDHY

SEQ ID NO: 3063687 - protein, 5 aa, Giardia lamblia
SGSVQ

SEQ ID NO: 3063688 - protein, 7 aa, Giardia lamblia
SGSVTTD

SEQ ID NO: 3063689 - protein, 7 aa, Giardia lamblia
SGTADLL

SEQ ID NO: 3063690 - protein, 7 aa, Giardia lamblia
SGTAGTC

SEQ ID NO: 3063691 - protein, 10 aa, Giardia lamblia
SGTAKSGSTI

SEQ ID NO: 3063692 - protein, 7 aa, Giardia lamblia
SGTAYPQ

SEQ ID NO: 3063693 - protein, 6 aa, Giardia lamblia
SGTCTG

SEQ ID NO: 3063694 - protein, 9 aa, Giardia lamblia
SGTDGCKEV

SEQ ID NO: 3063695 - protein, 6 aa, Giardia lamblia
SGTDSF

SEQ ID NO: 3063696 - protein, 6 aa, Giardia lamblia
SGTEES

SEQ ID NO: 3063697 - protein, 8 aa, Giardia lamblia
SGTEEVSN

SEQ ID NO: 3063698 - protein, 4 aa, Giardia lamblia
SGTG

SEQ ID NO: 3063699 - protein, 33 aa, Giardia lamblia
SGTGEPHCHGPAASAIKGVPSTLGDGASSASAL

SEQ ID NO: 3063700 - protein, 5 aa, Giardia lamblia
SGTGN

SEQ ID NO: 3063701 - protein, 39 aa, Giardia lamblia
SGTGRMKSSSLGKSTSNMSLSRSTSHFGNASADNISLMA

SEQ ID NO: 3063702 - protein, 4 aa, Giardia lamblia
SGTI

SEQ ID NO: 3063703 - protein, 4 aa, Giardia lamblia
SGTL

SEQ ID NO: 3063704 - protein, 6 aa, Giardia lamblia
SGTLEG

SEQ ID NO: 3063705 - protein, 8 aa, Giardia lamblia
SGTNCPAP

SEQ ID NO: 3063706 - protein, 7 aa, Giardia lamblia
SGTNTLR

SEQ ID NO: 3063707 - protein, 15 aa, Giardia lamblia
SGTPEQGAPGLPEGL

SEQ ID NO: 3063708 - protein, 7 aa, Giardia lamblia
SGTPNEY

SEQ ID NO: 3063709 - protein, 8 aa, Giardia lamblia
SGTPYGRS

SEQ ID NO: 3063710 - protein, 12 aa, Giardia lamblia
SGTQNRSHLDGN

SEQ ID NO: 3063711 - protein, 12 aa, Giardia lamblia
SGTRNLQNEPQS

SEQ ID NO: 3063712 - protein, 9 aa, Giardia lamblia
SGTSAMSEE

SEQ ID NO: 3063713 - protein, 7 aa, Giardia lamblia
SGTSASI

SEQ ID NO: 3063714 - protein, 10 aa, Giardia lamblia
SGTSGNPKGV

SEQ ID NO: 3063715 - protein, 5 aa, Giardia lamblia
SGTVR

SEQ ID NO: 3063716 - protein, 14 aa, Giardia lamblia
SGTYLDTGTSNCEA

SEQ ID NO: 3063717 - protein, 9 aa, Giardia lamblia
SGVDPGSKE

SEQ ID NO: 3063718 - protein, 7 aa, Giardia lamblia
SGVGKST

SEQ ID NO: 3063719 - protein, 7 aa, Giardia lamblia
SGVKPGH

SEQ ID NO: 3063720 - protein, 7 aa, Giardia lamblia
SGVPSEN

SEQ ID NO: 3063721 - protein, 10 aa, Giardia lamblia
SGVSTNQGVV

SEQ ID NO: 3063722 - protein, 5 aa, Giardia lamblia
SGVSV

SEQ ID NO: 3063723 - protein, 17 aa, Giardia lamblia
SGYAKSSAQMHQQTHGD

SEQ ID NO: 3063724 - protein, 13 aa, Giardia lamblia
SGYKNIDDTSAGY

SEQ ID NO: 3063725 - protein, 6 aa, Giardia lamblia
SGYKTV

SEQ ID NO: 3063726 - protein, 6 aa, Giardia lamblia
SGYRAK

SEQ ID NO: 3063727 - protein, 7 aa, Giardia lamblia
SGYSGDD

SEQ ID NO: 3063728 - protein, 7 aa, Giardia lamblia
SGYTASG

SEQ ID NO: 3063729 - protein, 7 aa, Giardia lamblia
SGYTTGS

SEQ ID NO: 3063730 - protein, 13 aa, Giardia lamblia
SHAGTSSGAATCG

SEQ ID NO: 3063731 - protein, 20 aa, Giardia lamblia
SHAPANDSVDAKRRQEEQTV

SEQ ID NO: 3063732 - protein, 7 aa, Giardia lamblia
SHASQPA

SEQ ID NO: 3063733 - protein, 11 aa, Giardia lamblia
SHDASQASSLS

SEQ ID NO: 3063734 - protein, 10 aa, Giardia lamblia
SHDDESEMSV

SEQ ID NO: 3063735 - protein, 4 aa, Giardia lamblia
SHDE

SEQ ID NO: 3063736 - protein, 15 aa, Giardia lamblia
SHDETDKGKTAPSTA

SEQ ID NO: 3063737 - protein, 4 aa, Giardia lamblia
SHEE

SEQ ID NO: 3063738 - protein, 12 aa, Giardia lamblia
SHEPAKNSNLDT

SEQ ID NO: 3063739 - protein, 8 aa, Giardia lamblia
SHESSESA

SEQ ID NO: 3063740 - protein, 7 aa, Giardia lamblia
SHGTNAQ

SEQ ID NO: 3063741 - protein, 7 aa, Giardia lamblia
SHHGAPF

SEQ ID NO: 3063742 - protein, 26 aa, Giardia lamblia
SHHPSTQSSYGTYAPLGATDTSERAI

SEQ ID NO: 3063743 - protein, 6 aa, Giardia lamblia
SHLPQS

SEQ ID NO: 3063744 - protein, 7 aa, Giardia lamblia
SHLSSPD

SEQ ID NO: 3063745 - protein, 5 aa, Giardia lamblia
SHPRI

SEQ ID NO: 3063746 - protein, 9 aa, Giardia lamblia
SHPSAPKLN

SEQ ID NO: 3063747 - protein, 7 aa, Giardia lamblia
SHPSAPS

SEQ ID NO: 3063748 - protein, 8 aa, Giardia lamblia
SHPSPKNL

SEQ ID NO: 3063749 - protein, 7 aa, Giardia lamblia
SHPSSTV

SEQ ID NO: 3063750 - protein, 9 aa, Giardia lamblia
SHPTQRSNR

SEQ ID NO: 3063751 - protein, 12 aa, Giardia lamblia
SHPTSSYAAGPT

SEQ ID NO: 3063752 - protein, 4 aa, Giardia lamblia
SHQA

SEQ ID NO: 3063753 - protein, 9 aa, Giardia lamblia
SHQCPSNSK

SEQ ID NO: 3063754 - protein, 20 aa, Giardia lamblia
SHRASLSARSASGRSSTTLN

SEQ ID NO: 3063755 - protein, 12 aa, Giardia lamblia
SHRENAKEVVTE

SEQ ID NO: 3063756 - protein, 5 aa, Giardia lamblia
SHRSG

SEQ ID NO: 3063757 - protein, 7 aa, Giardia lamblia
SHSDDSQ

SEQ ID NO: 3063758 - protein, 5 aa, Giardia lamblia
SHSLS

SEQ ID NO: 3063759 - protein, 7 aa, Giardia lamblia
SHSNPGL

SEQ ID NO: 3063760 - protein, 9 aa, Giardia lamblia
SHSPQPSYL

SEQ ID NO: 3063761 - protein, 4 aa, Giardia lamblia
SHTE

SEQ ID NO: 3063762 - protein, 6 aa, Giardia lamblia
SHTGDS

SEQ ID NO: 3063763 - protein, 8 aa, Giardia lamblia
SHTGRLTP

SEQ ID NO: 3063764 - protein, 8 aa, Giardia lamblia
SHTKPMPD

SEQ ID NO: 3063765 - protein, 11 aa, Giardia lamblia
SHTPSNTEARS

SEQ ID NO: 3063766 - protein, 5 aa, Giardia lamblia
SHTVS

SEQ ID NO: 3063767 - protein, 8 aa, Giardia lamblia
SHVTETGA

SEQ ID NO: 3063768 - protein, 10 aa, Giardia lamblia
SIAEKDSGRF

SEQ ID NO: 3063769 - protein, 19 aa, Giardia lamblia
SIAESKSAGPSELGSTAAS

SEQ ID NO: 3063770 - protein, 5 aa, Giardia lamblia
SIAQT

SEQ ID NO: 3063771 - protein, 8 aa, Giardia lamblia
SIDDPTAL

SEQ ID NO: 3063772 - protein, 5 aa, Giardia lamblia
SIDDS

SEQ ID NO: 3063773 - protein, 6 aa, Giardia lamblia
SIDGSP

SEQ ID NO: 3063774 - protein, 6 aa, Giardia lamblia
SIDKQA

SEQ ID NO: 3063775 - protein, 8 aa, Giardia lamblia
SIDNPALR

SEQ ID NO: 3063776 - protein, 8 aa, Giardia lamblia
SIDPDVKT

SEQ ID NO: 3063777 - protein, 4 aa, Giardia lamblia
SIDQ

SEQ ID NO: 3063778 - protein, 8 aa, Giardia lamblia
SIDTAGRG

SEQ ID NO: 3063779 - protein, 9 aa, Giardia lamblia
SIDTPTLPT

SEQ ID NO: 3063780 - protein, 9 aa, Giardia lamblia
SIEAQQRAS

SEQ ID NO: 3063781 - protein, 5 aa, Giardia lamblia
SIEDS

SEQ ID NO: 3063782 - protein, 7 aa, Giardia lamblia
SIEEAER

SEQ ID NO: 3063783 - protein, 6 aa, Giardia lamblia
SIEEKN

SEQ ID NO: 3063784 - protein, 5 aa, Giardia lamblia
SIEPC

SEQ ID NO: 3063785 - protein, 6 aa, Giardia lamblia
SIEQGD

SEQ ID NO: 3063786 - protein, 20 aa, Giardia lamblia
SIEQPDGTLKDQLNSHSTNY

SEQ ID NO: 3063787 - protein, 7 aa, Giardia lamblia
SIEQTPK

SEQ ID NO: 3063788 - protein, 4 aa, Giardia lamblia
SIER

SEQ ID NO: 3063789 - protein, 6 aa, Giardia lamblia
SIETSM

SEQ ID NO: 3063790 - protein, 7 aa, Giardia lamblia
SIGGEGE

SEQ ID NO: 3063791 - protein, 18 aa, Giardia lamblia
SIGGRADRASSSSGRRLS

SEQ ID NO: 3063792 - protein, 7 aa, Giardia lamblia
SIGSTSA

SEQ ID NO: 3063793 - protein, 7 aa, Giardia lamblia
SIGTEKM

SEQ ID NO: 3063794 - protein, 6 aa, Giardia lamblia
SIIDQE

SEQ ID NO: 3063795 - protein, 7 aa, Giardia lamblia
SIKDTAG

SEQ ID NO: 3063796 - protein, 11 aa, Giardia lamblia
SIKPEASDPIC

SEQ ID NO: 3063797 - protein, 6 aa, Giardia lamblia
SINEET

SEQ ID NO: 3063798 - protein, 5 aa, Giardia lamblia
SINPS

SEQ ID NO: 3063799 - protein, 5 aa, Giardia lamblia
SINSG

SEQ ID NO: 3063800 - protein, 11 aa, Giardia lamblia
SINSQKQELTP

SEQ ID NO: 3063801 - protein, 10 aa, Giardia lamblia
SINSQPGNKR

SEQ ID NO: 3063802 - protein, 4 aa, Giardia lamblia
SINT

SEQ ID NO: 3063803 - protein, 13 aa, Giardia lamblia
SINTDNLQEKHEE

SEQ ID NO: 3063804 - protein, 6 aa, Giardia lamblia
SINTSS

SEQ ID NO: 3063805 - protein, 4 aa, Giardia lamblia
SIPH

SEQ ID NO: 3063806 - protein, 4 aa, Giardia lamblia
SIPN

SEQ ID NO: 3063807 - protein, 7 aa, Giardia lamblia
SIPPENV

SEQ ID NO: 3063808 - protein, 8 aa, Giardia lamblia
SIPQSSSD

SEQ ID NO: 3063809 - protein, 7 aa, Giardia lamblia
SIPSSDL

SEQ ID NO: 3063810 - protein, 7 aa, Giardia lamblia
SIPSYTE

SEQ ID NO: 3063811 - protein, 5 aa, Giardia lamblia
SIPTP

SEQ ID NO: 3063812 - protein, 6 aa, Giardia lamblia
SIPTPI

SEQ ID NO: 3063813 - protein, 11 aa, Giardia lamblia
SIQDGETPEEF

SEQ ID NO: 3063814 - protein, 4 aa, Giardia lamblia
SIQI

SEQ ID NO: 3063815 - protein, 10 aa, Giardia lamblia
SIRNSTATTS

SEQ ID NO: 3063816 - protein, 7 aa, Giardia lamblia
SIRTENE

SEQ ID NO: 3063817 - protein, 18 aa, Giardia lamblia
SIRTETQDTQARQQGSTL

SEQ ID NO: 3063818 - protein, 6 aa, Giardia lamblia
SISAGT

SEQ ID NO: 3063819 - protein, 5 aa, Giardia lamblia
SISAT

SEQ ID NO: 3063820 - protein, 4 aa, Giardia lamblia
SISD

SEQ ID NO: 3063821 - protein, 5 aa, Giardia lamblia
SISDT

SEQ ID NO: 3063822 - protein, 26 aa, Giardia lamblia
SISEGKRAADGKHTSEHHHSKKRSDH

SEQ ID NO: 3063823 - protein, 9 aa, Giardia lamblia
SISGPNQQR

SEQ ID NO: 3063824 - protein, 5 aa, Giardia lamblia
SISNS

SEQ ID NO: 3063825 - protein, 6 aa, Giardia lamblia
SISSET

SEQ ID NO: 3063826 - protein, 10 aa, Giardia lamblia
SISSPLKNEN

SEQ ID NO: 3063827 - protein, 14 aa, Giardia lamblia
SISTTSNTNPVTQK

SEQ ID NO: 3063828 - protein, 10 aa, Giardia lamblia
SITDAPSSRR

SEQ ID NO: 3063829 - protein, 8 aa, Giardia lamblia
SITDDGGH

SEQ ID NO: 3063830 - protein, 6 aa, Giardia lamblia
SITDKE

SEQ ID NO: 3063831 - protein, 6 aa, Giardia lamblia
SITNGI

SEQ ID NO: 3063832 - protein, 4 aa, Giardia lamblia
SITP

SEQ ID NO: 3063833 - protein, 20 aa, Giardia lamblia
SITSDASSVTSSNVSLNDSA

SEQ ID NO: 3063834 - protein, 4 aa, Giardia lamblia
SITT

SEQ ID NO: 3063835 - protein, 7 aa, Giardia lamblia
SIYTQEP

SEQ ID NO: 3063836 - protein, 27 aa, Giardia lamblia
SKAASPSSSRPQSSGMSATASSADKSV

SEQ ID NO: 3063837 - protein, 8 aa, Giardia lamblia
SKADEKNV

SEQ ID NO: 3063838 - protein, 9 aa, Giardia lamblia
SKADLTESS

SEQ ID NO: 3063839 - protein, 10 aa, Giardia lamblia
SKADNGIEGC

SEQ ID NO: 3063840 - protein, 10 aa, Giardia lamblia
SKAERARRKK

SEQ ID NO: 3063841 - protein, 7 aa, Giardia lamblia
SKAESVK

SEQ ID NO: 3063842 - protein, 6 aa, Giardia lamblia
SKAEYK

SEQ ID NO: 3063843 - protein, 8 aa, Giardia lamblia
SKAGETAL

SEQ ID NO: 3063844 - protein, 7 aa, Giardia lamblia
SKAPGSH

SEQ ID NO: 3063845 - protein, 7 aa, Giardia lamblia
SKASENI

SEQ ID NO: 3063846 - protein, 7 aa, Giardia lamblia
SKASQDI

SEQ ID NO: 3063847 - protein, 7 aa, Giardia lamblia
SKASTLS

SEQ ID NO: 3063848 - protein, 14 aa, Giardia lamblia
SKATLKATSNSAGK

SEQ ID NO: 3063849 - protein, 8 aa, Giardia lamblia
SKATLSAT

SEQ ID NO: 3063850 - protein, 17 aa, Giardia lamblia
SKCATSGSSTLVPTSDG

SEQ ID NO: 3063851 - protein, 8 aa, Giardia lamblia
SKCGQYDS

SEQ ID NO: 3063852 - protein, 8 aa, Giardia lamblia
SKCSSSGK

SEQ ID NO: 3063853 - protein, 4 aa, Giardia lamblia
SKDA

SEQ ID NO: 3063854 - protein, 5 aa, Giardia lamblia
SKDAG

SEQ ID NO: 3063855 - protein, 6 aa, Giardia lamblia
SKDAPV

SEQ ID NO: 3063856 - protein, 11 aa, Giardia lamblia
SKDDCDKCRAN

SEQ ID NO: 3063857 - protein, 7 aa, Giardia lamblia
SKDGLST

SEQ ID NO: 3063858 - protein, 9 aa, Giardia lamblia
SKDGPRATV

SEQ ID NO: 3063859 - protein, 12 aa, Giardia lamblia
SKDHGPESAEPS

SEQ ID NO: 3063860 - protein, 6 aa, Giardia lamblia
SKDKKL

SEQ ID NO: 3063861 - protein, 12 aa, Giardia lamblia
SKDPDADPASLQ

SEQ ID NO: 3063862 - protein, 16 aa, Giardia lamblia
SKDPIVDPKTSKTSIA

SEQ ID NO: 3063863 - protein, 5 aa, Giardia lamblia
SKDQE

SEQ ID NO: 3063864 - protein, 12 aa, Giardia lamblia
SKDTTRKISSEE

SEQ ID NO: 3063865 - protein, 6 aa, Giardia lamblia
SKEERK

SEQ ID NO: 3063866 - protein, 4 aa, Giardia lamblia
SKEG

SEQ ID NO: 3063867 - protein, 10 aa, Giardia lamblia
SKEKGSQRNA

SEQ ID NO: 3063868 - protein, 5 aa, Giardia lamblia
SKEKQ

SEQ ID NO: 3063869 - protein, 5 aa, Giardia lamblia
SKELN

SEQ ID NO: 3063870 - protein, 7 aa, Giardia lamblia
SKELQTL

SEQ ID NO: 3063871 - protein, 13 aa, Giardia lamblia
SKELSRANFSASQ

SEQ ID NO: 3063872 - protein, 4 aa, Giardia lamblia
SKEP

SEQ ID NO: 3063873 - protein, 7 aa, Giardia lamblia
SKEQANR

SEQ ID NO: 3063874 - protein, 9 aa, Giardia lamblia
SKERPDAAK

SEQ ID NO: 3063875 - protein, 4 aa, Giardia lamblia
SKES

SEQ ID NO: 3063876 - protein, 7 aa, Giardia lamblia
SKESGSR

SEQ ID NO: 3063877 - protein, 5 aa, Giardia lamblia
SKFSP

SEQ ID NO: 3063878 - protein, 7 aa, Giardia lamblia
SKGANKT

SEQ ID NO: 3063879 - protein, 8 aa, Giardia lamblia
SKGDYSGL

SEQ ID NO: 3063880 - protein, 9 aa, Giardia lamblia
SKGGGIGTV

SEQ ID NO: 3063881 - protein, 6 aa, Giardia lamblia
SKGGTQ

SEQ ID NO: 3063882 - protein, 7 aa, Giardia lamblia
SKGLDTT

SEQ ID NO: 3063883 - protein, 7 aa, Giardia lamblia
SKGLNKN

SEQ ID NO: 3063884 - protein, 6 aa, Giardia lamblia
SKGNLE

SEQ ID NO: 3063885 - protein, 8 aa, Giardia lamblia
SKGSCDFK

SEQ ID NO: 3063886 - protein, 6 aa, Giardia lamblia
SKGSEI

SEQ ID NO: 3063887 - protein, 5 aa, Giardia lamblia
SKGSN

SEQ ID NO: 3063888 - protein, 7 aa, Giardia lamblia
SKGSNMA

SEQ ID NO: 3063889 - protein, 10 aa, Giardia lamblia
SKGSQSSSLY

SEQ ID NO: 3063890 - protein, 7 aa, Giardia lamblia
SKGSVGC

SEQ ID NO: 3063891 - protein, 6 aa, Giardia lamblia
SKGSYY

SEQ ID NO: 3063892 - protein, 10 aa, Giardia lamblia
SKGTHQRGRI

SEQ ID NO: 3063893 - protein, 17 aa, Giardia lamblia
SKGTVSTTDKAAPRSTV

SEQ ID NO: 3063894 - protein, 14 aa, Giardia lamblia
SKGVGRGAIGQRGA

SEQ ID NO: 3063895 - protein, 5 aa, Giardia lamblia
SKGVN

SEQ ID NO: 3063896 - protein, 7 aa, Giardia lamblia
SKGVQGD

SEQ ID NO: 3063897 - protein, 14 aa, Giardia lamblia
SKGVQGDDSTIKRR

SEQ ID NO: 3063898 - protein, 5 aa, Giardia lamblia
SKGVT

SEQ ID NO: 3063899 - protein, 7 aa, Giardia lamblia
SKGYQKI

SEQ ID NO: 3063900 - protein, 5 aa, Giardia lamblia
SKHAY

SEQ ID NO: 3063901 - protein, 6 aa, Giardia lamblia
SKHGGN

SEQ ID NO: 3063902 - protein, 4 aa, Giardia lamblia
SKHH

SEQ ID NO: 3063903 - protein, 14 aa, Giardia lamblia
SKIAKSGKCAEDGC

SEQ ID NO: 3063904 - protein, 9 aa, Giardia lamblia
SKIETPPLN

SEQ ID NO: 3063905 - protein, 5 aa, Giardia lamblia
SKIPA

SEQ ID NO: 3063906 - protein, 19 aa, Giardia lamblia
SKIPDEDVATHEASSRRTK

SEQ ID NO: 3063907 - protein, 8 aa, Giardia lamblia
SKIPRPDG

SEQ ID NO: 3063908 - protein, 9 aa, Giardia lamblia
SKISQKDAE

SEQ ID NO: 3063909 - protein, 7 aa, Giardia lamblia
SKISSRD

SEQ ID NO: 3063910 - protein, 8 aa, Giardia lamblia
SKKAKKGL

SEQ ID NO: 3063911 - protein, 5 aa, Giardia lamblia
SKKAP

SEQ ID NO: 3063912 - protein, 15 aa, Giardia lamblia
SKKDAQQVDGHSDDS

SEQ ID NO: 3063913 - protein, 17 aa, Giardia lamblia
SKKDMSGAESKHTSPHA

SEQ ID NO: 3063914 - protein, 7 aa, Giardia lamblia
SKKDRQM

SEQ ID NO: 3063915 - protein, 8 aa, Giardia lamblia
SKKEYNQY

SEQ ID NO: 3063916 - protein, 14 aa, Giardia lamblia
SKKHQYGKSMEDYS

SEQ ID NO: 3063917 - protein, 14 aa, Giardia lamblia
SKKHSTATVRSPEE

SEQ ID NO: 3063918 - protein, 6 aa, Giardia lamblia
SKKIHT

SEQ ID NO: 3063919 - protein, 11 aa, Giardia lamblia
SKKKGSAPAEM

SEQ ID NO: 3063920 - protein, 7 aa, Giardia lamblia
SKKKTGF

SEQ ID NO: 3063921 - protein, 6 aa, Giardia lamblia
SKKLPN

SEQ ID NO: 3063922 - protein, 8 aa, Giardia lamblia
SKKLSDGD

SEQ ID NO: 3063923 - protein, 9 aa, Giardia lamblia
SKKSETIQQ

SEQ ID NO: 3063924 - protein, 8 aa, Giardia lamblia
SKKSNPWQ

SEQ ID NO: 3063925 - protein, 16 aa, Giardia lamblia
SKLDGAEIHKDASRQV

SEQ ID NO: 3063926 - protein, 9 aa, Giardia lamblia
SKLKDSVTS

SEQ ID NO: 3063927 - protein, 5 aa, Giardia lamblia
SKLSN

SEQ ID NO: 3063928 - protein, 16 aa, Giardia lamblia
SKLSSDTETYLTDESA

SEQ ID NO: 3063929 - protein, 11 aa, Giardia lamblia
SKMSAPDGSSD

SEQ ID NO: 3063930 - protein, 19 aa, Giardia lamblia
SKNDVGQEFREAADENGVI

SEQ ID NO: 3063931 - protein, 7 aa, Giardia lamblia
SKNGSSN

SEQ ID NO: 3063932 - protein, 14 aa, Giardia lamblia
SKNLGSAEDEKPKA

SEQ ID NO: 3063933 - protein, 6 aa, Giardia lamblia
SKNPYA

SEQ ID NO: 3063934 - protein, 9 aa, Giardia lamblia
SKNQTTTGL

SEQ ID NO: 3063935 - protein, 49 aa, Giardia lamblia
SKNSSATQNESFDSDDTESSNESELEVSSDSGDTSIADDARDGSGNHPS

SEQ ID NO: 3063936 - protein, 9 aa, Giardia lamblia
SKNSVPKER

SEQ ID NO: 3063937 - protein, 7 aa, Giardia lamblia
SKPANWN

SEQ ID NO: 3063938 - protein, 6 aa, Giardia lamblia
SKPFFT

SEQ ID NO: 3063939 - protein, 7 aa, Giardia lamblia
SKPGAKF

SEQ ID NO: 3063940 - protein, 5 aa, Giardia lamblia
SKPGE

SEQ ID NO: 3063941 - protein, 5 aa, Giardia lamblia
SKPLR

SEQ ID NO: 3063942 - protein, 14 aa, Giardia lamblia
SKPQEAGLSSDNTV

SEQ ID NO: 3063943 - protein, 8 aa, Giardia lamblia
SKPRDLQE

SEQ ID NO: 3063944 - protein, 14 aa, Giardia lamblia
SKPRKDGVRTQSQP

SEQ ID NO: 3063945 - protein, 7 aa, Giardia lamblia
SKPRTGW

SEQ ID NO: 3063946 - protein, 12 aa, Giardia lamblia
SKQGRSKTDNTV

SEQ ID NO: 3063947 - protein, 5 aa, Giardia lamblia
SKQIE

SEQ ID NO: 3063948 - protein, 6 aa, Giardia lamblia
SKQPAL

SEQ ID NO: 3063949 - protein, 18 aa, Giardia lamblia
SKQPDRPMQVTGTNAADT

SEQ ID NO: 3063950 - protein, 5 aa, Giardia lamblia
SKQYK

SEQ ID NO: 3063951 - protein, 12 aa, Giardia lamblia
SKRAATAPSNRI

SEQ ID NO: 3063952 - protein, 6 aa, Giardia lamblia
SKRADQ

SEQ ID NO: 3063953 - protein, 14 aa, Giardia lamblia
SKRAEQLQEKHQRE

SEQ ID NO: 3063954 - protein, 4 aa, Giardia lamblia
SKRE

SEQ ID NO: 3063955 - protein, 10 aa, Giardia lamblia
SKREESTSFS

SEQ ID NO: 3063956 - protein, 7 aa, Giardia lamblia
SKRESRN

SEQ ID NO: 3063957 - protein, 32 aa, Giardia lamblia
SKRGKRKASPVSKLPSPNPNAPTKHRSKRPGF

SEQ ID NO: 3063958 - protein, 8 aa, Giardia lamblia
SKRKRTGY

SEQ ID NO: 3063959 - protein, 46 aa, Giardia lamblia
SKRLEDKSDGPSSKNSDSFDTTSTSAAAISPRDQRASDIKSSQVPS

SEQ ID NO: 3063960 - protein, 4 aa, Giardia lamblia
SKRP

SEQ ID NO: 3063961 - protein, 15 aa, Giardia lamblia
SKRQANLEDNERVRT

SEQ ID NO: 3063962 - protein, 5 aa, Giardia lamblia
SKRQS

SEQ ID NO: 3063963 - protein, 7 aa, Giardia lamblia
SKRRSLS

SEQ ID NO: 3063964 - protein, 38 aa, Giardia lamblia
SKRYPHSGSVSDYGASPRDSDTPSSPSGTTTPELRSKA

SEQ ID NO: 3063965 - protein, 7 aa, Giardia lamblia
SKSCSAY

SEQ ID NO: 3063966 - protein, 12 aa, Giardia lamblia
SKSDPNGTDPTD

SEQ ID NO: 3063967 - protein, 8 aa, Giardia lamblia
SKSEPGLD

SEQ ID NO: 3063968 - protein, 20 aa, Giardia lamblia
SKSGGNPDEENVDETGDGVV

SEQ ID NO: 3063969 - protein, 12 aa, Giardia lamblia
SKSGTTPMNQGN

SEQ ID NO: 3063970 - protein, 6 aa, Giardia lamblia
SKSHGL

SEQ ID NO: 3063971 - protein, 12 aa, Giardia lamblia
SKSKNANPQTHR

SEQ ID NO: 3063972 - protein, 4 aa, Giardia lamblia
SKSL

SEQ ID NO: 3063973 - protein, 25 aa, Giardia lamblia
SKSNFSGAFSTGRTDIASRHTASSH

SEQ ID NO: 3063974 - protein, 21 aa, Giardia lamblia
SKSPHDATEKQVKQLPEENSN

SEQ ID NO: 3063975 - protein, 4 aa, Giardia lamblia
SKSR

SEQ ID NO: 3063976 - protein, 7 aa, Giardia lamblia
SKSSSLG

SEQ ID NO: 3063977 - protein, 23 aa, Giardia lamblia
SKSTAEALQRSSQEKERLRGKSK

SEQ ID NO: 3063978 - protein, 7 aa, Giardia lamblia
SKSTEQL

SEQ ID NO: 3063979 - protein, 9 aa, Giardia lamblia
SKSTISNQD

SEQ ID NO: 3063980 - protein, 22 aa, Giardia lamblia
SKSTRRLPEERVKERPGAHPNS

SEQ ID NO: 3063981 - protein, 6 aa, Giardia lamblia
SKTDSQ

SEQ ID NO: 3063982 - protein, 7 aa, Giardia lamblia
SKTEAGH

SEQ ID NO: 3063983 - protein, 15 aa, Giardia lamblia
SKTEPDRTCDASDKS

SEQ ID NO: 3063984 - protein, 10 aa, Giardia lamblia
SKTETKRTAP

SEQ ID NO: 3063985 - protein, 8 aa, Giardia lamblia
SKTKPCRP

SEQ ID NO: 3063986 - protein, 5 aa, Giardia lamblia
SKTKV

SEQ ID NO: 3063987 - protein, 5 aa, Giardia lamblia
SKTLE

SEQ ID NO: 3063988 - protein, 8 aa, Giardia lamblia
SKTNRIQR

SEQ ID NO: 3063989 - protein, 11 aa, Giardia lamblia
SKTNSSSLSAT

SEQ ID NO: 3063990 - protein, 5 aa, Giardia lamblia
SKTPL

SEQ ID NO: 3063991 - protein, 7 aa, Giardia lamblia
SKTQGVS

SEQ ID NO: 3063992 - protein, 11 aa, Giardia lamblia
SKTRENQAKLE

SEQ ID NO: 3063993 - protein, 12 aa, Giardia lamblia
SKTRRSRSYQRG

SEQ ID NO: 3063994 - protein, 11 aa, Giardia lamblia
SKTSDPKTTSL

SEQ ID NO: 3063995 - protein, 10 aa, Giardia lamblia
SKTSGAESLS

SEQ ID NO: 3063996 - protein, 4 aa, Giardia lamblia
SKTT

SEQ ID NO: 3063997 - protein, 8 aa, Giardia lamblia
SKTTSSEV

SEQ ID NO: 3063998 - protein, 4 aa, Giardia lamblia
SKTV

SEQ ID NO: 3063999 - protein, 10 aa, Giardia lamblia
SKVGPYDSEP

SEQ ID NO: 3064000 - protein, 10 aa, Giardia lamblia
SKVGRGDLTQ

SEQ ID NO: 3064001 - protein, 6 aa, Giardia lamblia
SKVKEQ

SEQ ID NO: 3064002 - protein, 8 aa, Giardia lamblia
SKVSSRVS

SEQ ID NO: 3064003 - protein, 8 aa, Giardia lamblia
SKVSTDTV

SEQ ID NO: 3064004 - protein, 6 aa, Giardia lamblia
SKVYED

SEQ ID NO: 3064005 - protein, 10 aa, Giardia lamblia
SKWTKSPGEF

SEQ ID NO: 3064006 - protein, 7 aa, Giardia lamblia
SKYDPRV

SEQ ID NO: 3064007 - protein, 10 aa, Giardia lamblia
SKYERTTRSL

SEQ ID NO: 3064008 - protein, 5 aa, Giardia lamblia
SKYGR

SEQ ID NO: 3064009 - protein, 9 aa, Giardia lamblia
SLAASAADY

SEQ ID NO: 3064010 - protein, 17 aa, Giardia lamblia
SLAATGSPRGDEPHAPD

SEQ ID NO: 3064011 - protein, 6 aa, Giardia lamblia
SLAEGT

SEQ ID NO: 3064012 - protein, 7 aa, Giardia lamblia
SLAGPYA

SEQ ID NO: 3064013 - protein, 18 aa, Giardia lamblia
SLAGRSNQKLSPDGRVSR

SEQ ID NO: 3064014 - protein, 8 aa, Giardia lamblia
SLANRAAT

SEQ ID NO: 3064015 - protein, 14 aa, Giardia lamblia
SLANTPTKYAPTIG

SEQ ID NO: 3064016 - protein, 6 aa, Giardia lamblia
SLAPGK

SEQ ID NO: 3064017 - protein, 8 aa, Giardia lamblia
SLDDQSEA

SEQ ID NO: 3064018 - protein, 7 aa, Giardia lamblia
SLDGQNG

SEQ ID NO: 3064019 - protein, 13 aa, Giardia lamblia
SLDKQDDIKNSLS

SEQ ID NO: 3064020 - protein, 11 aa, Giardia lamblia
SLDKQQPPVQD

SEQ ID NO: 3064021 - protein, 4 aa, Giardia lamblia
SLDN

SEQ ID NO: 3064022 - protein, 5 aa, Giardia lamblia
SLDPD

SEQ ID NO: 3064023 - protein, 7 aa, Giardia lamblia
SLDPDNF

SEQ ID NO: 3064024 - protein, 16 aa, Giardia lamblia
SLDSAHSPTSPTKRAS

SEQ ID NO: 3064025 - protein, 5 aa, Giardia lamblia
SLDSR

SEQ ID NO: 3064026 - protein, 10 aa, Giardia lamblia
SLDTDSSNKL

SEQ ID NO: 3064027 - protein, 7 aa, Giardia lamblia
SLEATTE

SEQ ID NO: 3064028 - protein, 12 aa, Giardia lamblia
SLEDSADSLDAK

SEQ ID NO: 3064029 - protein, 5 aa, Giardia lamblia
SLEER

SEQ ID NO: 3064030 - protein, 7 aa, Giardia lamblia
SLEGQTS

SEQ ID NO: 3064031 - protein, 13 aa, Giardia lamblia
SLEPKTKAAPDLA

SEQ ID NO: 3064032 - protein, 9 aa, Giardia lamblia
SLERTTTEF

SEQ ID NO: 3064033 - protein, 12 aa, Giardia lamblia
SLESSGKTLKAE

SEQ ID NO: 3064034 - protein, 22 aa, Giardia lamblia
SLESSKASTQLTGMDGDGREGD

SEQ ID NO: 3064035 - protein, 7 aa, Giardia lamblia
SLEVSEK

SEQ ID NO: 3064036 - protein, 13 aa, Giardia lamblia
SLGATQTSSLSEG

SEQ ID NO: 3064037 - protein, 4 aa, Giardia lamblia
SLGE

SEQ ID NO: 3064038 - protein, 4 aa, Giardia lamblia
SLGG

SEQ ID NO: 3064039 - protein, 5 aa, Giardia lamblia
SLGGG

SEQ ID NO: 3064040 - protein, 7 aa, Giardia lamblia
SLGGPTV

SEQ ID NO: 3064041 - protein, 7 aa, Giardia lamblia
SLGNNKD

SEQ ID NO: 3064042 - protein, 4 aa, Giardia lamblia
SLGQ

SEQ ID NO: 3064043 - protein, 9 aa, Giardia lamblia
SLGSDTCPA

SEQ ID NO: 3064044 - protein, 5 aa, Giardia lamblia
SLGSI

SEQ ID NO: 3064045 - protein, 5 aa, Giardia lamblia
SLGSP

SEQ ID NO: 3064046 - protein, 11 aa, Giardia lamblia
SLGSTKSSAKR

SEQ ID NO: 3064047 - protein, 13 aa, Giardia lamblia
SLGSTTTSSIEQA

SEQ ID NO: 3064048 - protein, 6 aa, Giardia lamblia
SLGTSG

SEQ ID NO: 3064049 - protein, 6 aa, Giardia lamblia
SLGTYD

SEQ ID NO: 3064050 - protein, 16 aa, Giardia lamblia
SLIPDQQSDQSTMDQT

SEQ ID NO: 3064051 - protein, 10 aa, Giardia lamblia
SLKAAAPSIN

SEQ ID NO: 3064052 - protein, 7 aa, Giardia lamblia
SLKDEGR

SEQ ID NO: 3064053 - protein, 9 aa, Giardia lamblia
SLKGSTGWR

SEQ ID NO: 3064054 - protein, 7 aa, Giardia lamblia
SLKKESE

SEQ ID NO: 3064055 - protein, 4 aa, Giardia lamblia
SLKS

SEQ ID NO: 3064056 - protein, 8 aa, Giardia lamblia
SLKSAGKR

SEQ ID NO: 3064057 - protein, 6 aa, Giardia lamblia
SLLGPS

SEQ ID NO: 3064058 - protein, 10 aa, Giardia lamblia
SLLSSPSKAD

SEQ ID NO: 3064059 - protein, 12 aa, Giardia lamblia
SLNAPTTQGHAP

SEQ ID NO: 3064060 - protein, 10 aa, Giardia lamblia
SLNESTAKRA

SEQ ID NO: 3064061 - protein, 10 aa, Giardia lamblia
SLNGLEDDKS

SEQ ID NO: 3064062 - protein, 17 aa, Giardia lamblia
SLNKSSHSANNRSSVRG

SEQ ID NO: 3064063 - protein, 4 aa, Giardia lamblia
SLNP

SEQ ID NO: 3064064 - protein, 4 aa, Giardia lamblia
SLNS

SEQ ID NO: 3064065 - protein, 5 aa, Giardia lamblia
SLNSS

SEQ ID NO: 3064066 - protein, 13 aa, Giardia lamblia
SLNYETSSADLPA

SEQ ID NO: 3064067 - protein, 4 aa, Giardia lamblia
SLPA

SEQ ID NO: 3064068 - protein, 6 aa, Giardia lamblia
SLPADA

SEQ ID NO: 3064069 - protein, 13 aa, Giardia lamblia
SLPADGLEAQEHG

SEQ ID NO: 3064070 - protein, 8 aa, Giardia lamblia
SLPASDTS

SEQ ID NO: 3064071 - protein, 10 aa, Giardia lamblia
SLPASGGGLK

SEQ ID NO: 3064072 - protein, 4 aa, Giardia lamblia
SLPD

SEQ ID NO: 3064073 - protein, 6 aa, Giardia lamblia
SLPDCS

SEQ ID NO: 3064074 - protein, 8 aa, Giardia lamblia
SLPDDEKQ

SEQ ID NO: 3064075 - protein, 8 aa, Giardia lamblia
SLPENNRP

SEQ ID NO: 3064076 - protein, 7 aa, Giardia lamblia
SLPEPYS

SEQ ID NO: 3064077 - protein, 5 aa, Giardia lamblia
SLPGT

SEQ ID NO: 3064078 - protein, 4 aa, Giardia lamblia
SLPK

SEQ ID NO: 3064079 - protein, 31 aa, Giardia lamblia
SLPKKEKERGRNKGKKEQKETQDQKTAESIE

SEQ ID NO: 3064080 - protein, 5 aa, Giardia lamblia
SLPKM

SEQ ID NO: 3064081 - protein, 6 aa, Giardia lamblia
SLPNNS

SEQ ID NO: 3064082 - protein, 36 aa, Giardia lamblia
SLPPAQQKLGPDTAPWKGSASQRNNSAGSRRSSSAF

SEQ ID NO: 3064083 - protein, 6 aa, Giardia lamblia
SLPPPR

SEQ ID NO: 3064084 - protein, 7 aa, Giardia lamblia
SLPPSAL

SEQ ID NO: 3064085 - protein, 6 aa, Giardia lamblia
SLPPSV

SEQ ID NO: 3064086 - protein, 7 aa, Giardia lamblia
SLPRTRR

SEQ ID NO: 3064087 - protein, 4 aa, Giardia lamblia
SLPS

SEQ ID NO: 3064088 - protein, 5 aa, Giardia lamblia
SLPSD

SEQ ID NO: 3064089 - protein, 26 aa, Giardia lamblia
SLPSDSSTLEQDTLSSNSGASFRSTR

SEQ ID NO: 3064090 - protein, 15 aa, Giardia lamblia
SLPSKFGSKKTTAVT

SEQ ID NO: 3064091 - protein, 9 aa, Giardia lamblia
SLPSTLSEA

SEQ ID NO: 3064092 - protein, 7 aa, Giardia lamblia
SLPSTSR

SEQ ID NO: 3064093 - protein, 5 aa, Giardia lamblia
SLPTI

SEQ ID NO: 3064094 - protein, 19 aa, Giardia lamblia
SLPTKGSRISSAPHQLEGD

SEQ ID NO: 3064095 - protein, 9 aa, Giardia lamblia
SLPTPASMT

SEQ ID NO: 3064096 - protein, 8 aa, Giardia lamblia
SLPTPTAS

SEQ ID NO: 3064097 - protein, 10 aa, Giardia lamblia
SLQDDKDARF

SEQ ID NO: 3064098 - protein, 12 aa, Giardia lamblia
SLQDSGAVEENI

SEQ ID NO: 3064099 - protein, 13 aa, Giardia lamblia
SLQGSSNNSKLPP

SEQ ID NO: 3064100 - protein, 5 aa, Giardia lamblia
SLQPD

SEQ ID NO: 3064101 - protein, 9 aa, Giardia lamblia
SLQQPDDDV

SEQ ID NO: 3064102 - protein, 6 aa, Giardia lamblia
SLQQST

SEQ ID NO: 3064103 - protein, 9 aa, Giardia lamblia
SLRANGNKT

SEQ ID NO: 3064104 - protein, 5 aa, Giardia lamblia
SLRGD

SEQ ID NO: 3064105 - protein, 9 aa, Giardia lamblia
SLRGSPVQP

SEQ ID NO: 3064106 - protein, 8 aa, Giardia lamblia
SLRKEARN

SEQ ID NO: 3064107 - protein, 10 aa, Giardia lamblia
SLRNRSLSTT

SEQ ID NO: 3064108 - protein, 12 aa, Giardia lamblia
SLSAPAAKISYE

SEQ ID NO: 3064109 - protein, 15 aa, Giardia lamblia
SLSATSVSTSQASAL

SEQ ID NO: 3064110 - protein, 6 aa, Giardia lamblia
SLSERP

SEQ ID NO: 3064111 - protein, 14 aa, Giardia lamblia
SLSEVEKTGRTPEH

SEQ ID NO: 3064112 - protein, 11 aa, Giardia lamblia
SLSEYTSTSQG

SEQ ID NO: 3064113 - protein, 4 aa, Giardia lamblia
SLSG

SEQ ID NO: 3064114 - protein, 9 aa, Giardia lamblia
SLSGAAGNP

SEQ ID NO: 3064115 - protein, 6 aa, Giardia lamblia
SLSGDA

SEQ ID NO: 3064116 - protein, 9 aa, Giardia lamblia
SLSKRSDFE

SEQ ID NO: 3064117 - protein, 14 aa, Giardia lamblia
SLSLTETESVPKAI

SEQ ID NO: 3064118 - protein, 6 aa, Giardia lamblia
SLSNYA

SEQ ID NO: 3064119 - protein, 5 aa, Giardia lamblia
SLSPG

SEQ ID NO: 3064120 - protein, 10 aa, Giardia lamblia
SLSPQGPNNT

SEQ ID NO: 3064121 - protein, 8 aa, Giardia lamblia
SLSQGEKN

SEQ ID NO: 3064122 - protein, 21 aa, Giardia lamblia
SLSRSRSRSKSRDRDYDDYGR

SEQ ID NO: 3064123 - protein, 5 aa, Giardia lamblia
SLSSA

SEQ ID NO: 3064124 - protein, 7 aa, Giardia lamblia
SLSSEPS

SEQ ID NO: 3064125 - protein, 7 aa, Giardia lamblia
SLSSMNA

SEQ ID NO: 3064126 - protein, 11 aa, Giardia lamblia
SLSSNDGSAVG

SEQ ID NO: 3064127 - protein, 10 aa, Giardia lamblia
SLSTKGYTSS

SEQ ID NO: 3064128 - protein, 8 aa, Giardia lamblia
SLSTPTSL

SEQ ID NO: 3064129 - protein, 5 aa, Giardia lamblia
SLSTS

SEQ ID NO: 3064130 - protein, 24 aa, Giardia lamblia
SLSVQPSKSLEVAQGKSQHMRSRS

SEQ ID NO: 3064131 - protein, 11 aa, Giardia lamblia
SLTATQPSKKV

SEQ ID NO: 3064132 - protein, 4 aa, Giardia lamblia
SLTD

SEQ ID NO: 3064133 - protein, 6 aa, Giardia lamblia
SLTEAK

SEQ ID NO: 3064134 - protein, 8 aa, Giardia lamblia
SLTESPTA

SEQ ID NO: 3064135 - protein, 14 aa, Giardia lamblia
SLTNERNKGGGKGF

SEQ ID NO: 3064136 - protein, 29 aa, Giardia lamblia
SLTNHSSLKESYANVNSTTVSSSSGISYG

SEQ ID NO: 3064137 - protein, 6 aa, Giardia lamblia
SLTPEE

SEQ ID NO: 3064138 - protein, 13 aa, Giardia lamblia
SLTPGKQTQQPMQ

SEQ ID NO: 3064139 - protein, 13 aa, Giardia lamblia
SLTPKNKVSSPYL

SEQ ID NO: 3064140 - protein, 6 aa, Giardia lamblia
SLTQPS

SEQ ID NO: 3064141 - protein, 10 aa, Giardia lamblia
SLTSNKHRTY

SEQ ID NO: 3064142 - protein, 13 aa, Giardia lamblia
SLTSTSVTQTTDP

SEQ ID NO: 3064143 - protein, 9 aa, Giardia lamblia
SLVKPGSAV

SEQ ID NO: 3064144 - protein, 4 aa, Giardia lamblia
SMAA

SEQ ID NO: 3064145 - protein, 5 aa, Giardia lamblia
SMATR

SEQ ID NO: 3064146 - protein, 9 aa, Giardia lamblia
SMDGKYSAQ

SEQ ID NO: 3064147 - protein, 8 aa, Giardia lamblia
SMDSSSRV

SEQ ID NO: 3064148 - protein, 11 aa, Giardia lamblia
SMEEGSSTQQV

SEQ ID NO: 3064149 - protein, 16 aa, Giardia lamblia
SMEEKEPEDDGNRPTA

SEQ ID NO: 3064150 - protein, 9 aa, Giardia lamblia
SMGGPPDEA

SEQ ID NO: 3064151 - protein, 6 aa, Giardia lamblia
SMGSDA

SEQ ID NO: 3064152 - protein, 6 aa, Giardia lamblia
SMGTQE

SEQ ID NO: 3064153 - protein, 6 aa, Giardia lamblia
SMGTQS

SEQ ID NO: 3064154 - protein, 69 aa, Giardia lamblia
SMISDSSDVDSSTSSHDSAISPEDALEEQDSDDSDVTDGSDIKQLPDSPVSSQQESTAHSDDPATGTFS

SEQ ID NO: 3064155 - protein, 7 aa, Giardia lamblia
SMPDEAL

SEQ ID NO: 3064156 - protein, 22 aa, Giardia lamblia
SMPPEPPQQSGQPPAARISQEG

SEQ ID NO: 3064157 - protein, 7 aa, Giardia lamblia
SMPPRNL

SEQ ID NO: 3064158 - protein, 5 aa, Giardia lamblia
SMPYA

SEQ ID NO: 3064159 - protein, 6 aa, Giardia lamblia
SMQKAS

SEQ ID NO: 3064160 - protein, 4 aa, Giardia lamblia
SMRD

SEQ ID NO: 3064161 - protein, 23 aa, Giardia lamblia
SMREQQKKVAKEIEAKTAQAIKN

SEQ ID NO: 3064162 - protein, 5 aa, Giardia lamblia
SMSNC

SEQ ID NO: 3064163 - protein, 8 aa, Giardia lamblia
SMTDKEAT

SEQ ID NO: 3064164 - protein, 13 aa, Giardia lamblia
SMTSDKSSMPREL

SEQ ID NO: 3064165 - protein, 6 aa, Giardia lamblia
SMTSVD

SEQ ID NO: 3064166 - protein, 17 aa, Giardia lamblia
SNAAQAHKEGKITYTER

SEQ ID NO: 3064167 - protein, 11 aa, Giardia lamblia
SNAATQLPPTT

SEQ ID NO: 3064168 - protein, 4 aa, Giardia lamblia
SNAD

SEQ ID NO: 3064169 - protein, 6 aa, Giardia lamblia
SNADSA

SEQ ID NO: 3064170 - protein, 8 aa, Giardia lamblia
SNAENQVV

SEQ ID NO: 3064171 - protein, 9 aa, Giardia lamblia
SNAHSTTDN

SEQ ID NO: 3064172 - protein, 4 aa, Giardia lamblia
SNAN

SEQ ID NO: 3064173 - protein, 8 aa, Giardia lamblia
SNANMGPG

SEQ ID NO: 3064174 - protein, 9 aa, Giardia lamblia
SNANSNSAK

SEQ ID NO: 3064175 - protein, 10 aa, Giardia lamblia
SNANYNPQQL

SEQ ID NO: 3064176 - protein, 9 aa, Giardia lamblia
SNANYNTQQ

SEQ ID NO: 3064177 - protein, 7 aa, Giardia lamblia
SNAQGQT

SEQ ID NO: 3064178 - protein, 11 aa, Giardia lamblia
SNASDKGDNSL

SEQ ID NO: 3064179 - protein, 6 aa, Giardia lamblia
SNASES

SEQ ID NO: 3064180 - protein, 7 aa, Giardia lamblia
SNASRAS

SEQ ID NO: 3064181 - protein, 4 aa, Giardia lamblia
SNAV

SEQ ID NO: 3064182 - protein, 8 aa, Giardia lamblia
SNAVAPSP

SEQ ID NO: 3064183 - protein, 8 aa, Giardia lamblia
SNCEDAER

SEQ ID NO: 3064184 - protein, 6 aa, Giardia lamblia
SNCEGR

SEQ ID NO: 3064185 - protein, 8 aa, Giardia lamblia
SNCESNKL

SEQ ID NO: 3064186 - protein, 7 aa, Giardia lamblia
SNCSPEE

SEQ ID NO: 3064187 - protein, 20 aa, Giardia lamblia
SNCTKQADDAEAERLESTPF

SEQ ID NO: 3064188 - protein, 5 aa, Giardia lamblia
SNCTS

SEQ ID NO: 3064189 - protein, 15 aa, Giardia lamblia
SNDANTATDLTADQQ

SEQ ID NO: 3064190 - protein, 7 aa, Giardia lamblia
SNDDCED

SEQ ID NO: 3064191 - protein, 17 aa, Giardia lamblia
SNDDNGADPNSESNQVD

SEQ ID NO: 3064192 - protein, 7 aa, Giardia lamblia
SNDEQTR

SEQ ID NO: 3064193 - protein, 7 aa, Giardia lamblia
SNDKTSV

SEQ ID NO: 3064194 - protein, 5 aa, Giardia lamblia
SNDMT

SEQ ID NO: 3064195 - protein, 8 aa, Giardia lamblia
SNDPSLSV

SEQ ID NO: 3064196 - protein, 7 aa, Giardia lamblia
SNDSTRA

SEQ ID NO: 3064197 - protein, 7 aa, Giardia lamblia
SNDTQQE

SEQ ID NO: 3064198 - protein, 11 aa, Giardia lamblia
SNEDDDSPSQK

SEQ ID NO: 3064199 - protein, 5 aa, Giardia lamblia
SNEDR

SEQ ID NO: 3064200 - protein, 7 aa, Giardia lamblia
SNEKNKV

SEQ ID NO: 3064201 - protein, 6 aa, Giardia lamblia
SNENTH

SEQ ID NO: 3064202 - protein, 6 aa, Giardia lamblia
SNENTS

SEQ ID NO: 3064203 - protein, 7 aa, Giardia lamblia
SNEPGLL

SEQ ID NO: 3064204 - protein, 5 aa, Giardia lamblia
SNERH

SEQ ID NO: 3064205 - protein, 5 aa, Giardia lamblia
SNESF

SEQ ID NO: 3064206 - protein, 13 aa, Giardia lamblia
SNEVEGEVDPNYS

SEQ ID NO: 3064207 - protein, 4 aa, Giardia lamblia
SNFA

SEQ ID NO: 3064208 - protein, 13 aa, Giardia lamblia
SNFSFQDRNDTAY

SEQ ID NO: 3064209 - protein, 19 aa, Giardia lamblia
SNFSSARDLSNEDFGSAQL

SEQ ID NO: 3064210 - protein, 4 aa, Giardia lamblia
SNFT

SEQ ID NO: 3064211 - protein, 4 aa, Giardia lamblia
SNGA

SEQ ID NO: 3064212 - protein, 10 aa, Giardia lamblia
SNGAGKSTTI

SEQ ID NO: 3064213 - protein, 9 aa, Giardia lamblia
SNGDEMPAG

SEQ ID NO: 3064214 - protein, 6 aa, Giardia lamblia
SNGESP

SEQ ID NO: 3064215 - protein, 6 aa, Giardia lamblia
SNGETC

SEQ ID NO: 3064216 - protein, 14 aa, Giardia lamblia
SNGFAGPSQDSTIG

SEQ ID NO: 3064217 - protein, 5 aa, Giardia lamblia
SNGKL

SEQ ID NO: 3064218 - protein, 8 aa, Giardia lamblia
SNGQAEID

SEQ ID NO: 3064219 - protein, 7 aa, Giardia lamblia
SNGQLAE

SEQ ID NO: 3064220 - protein, 11 aa, Giardia lamblia
SNGSLYTTARG

SEQ ID NO: 3064221 - protein, 7 aa, Giardia lamblia
SNGSNLK

SEQ ID NO: 3064222 - protein, 8 aa, Giardia lamblia
SNGSPAAI

SEQ ID NO: 3064223 - protein, 9 aa, Giardia lamblia
SNGSQTSLG

SEQ ID NO: 3064224 - protein, 14 aa, Giardia lamblia
SNGSTTSDSNESYF

SEQ ID NO: 3064225 - protein, 7 aa, Giardia lamblia
SNGTKAS

SEQ ID NO: 3064226 - protein, 5 aa, Giardia lamblia
SNGVS

SEQ ID NO: 3064227 - protein, 5 aa, Giardia lamblia
SNGYE

SEQ ID NO: 3064228 - protein, 15 aa, Giardia lamblia
SNGYEGHHHKPPASV

SEQ ID NO: 3064229 - protein, 16 aa, Giardia lamblia
SNHDGLGNCSAGSSVK

SEQ ID NO: 3064230 - protein, 23 aa, Giardia lamblia
SNHNVQPSKRSCASGCPSGSESV

SEQ ID NO: 3064231 - protein, 4 aa, Giardia lamblia
SNHP

SEQ ID NO: 3064232 - protein, 20 aa, Giardia lamblia
SNHSDARSQSDTDPVLSKPT

SEQ ID NO: 3064233 - protein, 4 aa, Giardia lamblia
SNIE

SEQ ID NO: 3064234 - protein, 23 aa, Giardia lamblia
SNIKDKEKKEPSVKQLPSEPHEA

SEQ ID NO: 3064235 - protein, 11 aa, Giardia lamblia
SNIPDVPGKGL

SEQ ID NO: 3064236 - protein, 12 aa, Giardia lamblia
SNISTPNTRSFA

SEQ ID NO: 3064237 - protein, 5 aa, Giardia lamblia
SNITL

SEQ ID NO: 3064238 - protein, 20 aa, Giardia lamblia
SNKAKSPLCSHEEDSDLPIP

SEQ ID NO: 3064239 - protein, 7 aa, Giardia lamblia
SNKCENG

SEQ ID NO: 3064240 - protein, 10 aa, Giardia lamblia
SNKCQQKCSH

SEQ ID NO: 3064241 - protein, 8 aa, Giardia lamblia
SNKIDPAK

SEQ ID NO: 3064242 - protein, 12 aa, Giardia lamblia
SNKKSSSPSPPI

SEQ ID NO: 3064243 - protein, 9 aa, Giardia lamblia
SNKNVTDGC

SEQ ID NO: 3064244 - protein, 8 aa, Giardia lamblia
SNKPARAV

SEQ ID NO: 3064245 - protein, 8 aa, Giardia lamblia
SNKPTTSF

SEQ ID NO: 3064246 - protein, 6 aa, Giardia lamblia
SNKQSI

SEQ ID NO: 3064247 - protein, 10 aa, Giardia lamblia
SNKQSSCTNK

SEQ ID NO: 3064248 - protein, 8 aa, Giardia lamblia
SNKSPGDV

SEQ ID NO: 3064249 - protein, 7 aa, Giardia lamblia
SNKSVTA

SEQ ID NO: 3064250 - protein, 4 aa, Giardia lamblia
SNKV

SEQ ID NO: 3064251 - protein, 8 aa, Giardia lamblia
SNKYPSRH

SEQ ID NO: 3064252 - protein, 6 aa, Giardia lamblia
SNLSLG

SEQ ID NO: 3064253 - protein, 6 aa, Giardia lamblia
SNMNEQ

SEQ ID NO: 3064254 - protein, 7 aa, Giardia lamblia
SNNARAV

SEQ ID NO: 3064255 - protein, 27 aa, Giardia lamblia
SNNDEKADTDSNPQGGQLGAPSLPLQS

SEQ ID NO: 3064256 - protein, 6 aa, Giardia lamblia
SNNIEA

SEQ ID NO: 3064257 - protein, 10 aa, Giardia lamblia
SNNLDPSKPV

SEQ ID NO: 3064258 - protein, 7 aa, Giardia lamblia
SNNLNNN

SEQ ID NO: 3064259 - protein, 7 aa, Giardia lamblia
SNNNLAK

SEQ ID NO: 3064260 - protein, 5 aa, Giardia lamblia
SNNRQ

SEQ ID NO: 3064261 - protein, 18 aa, Giardia lamblia
SNNSIGTTSRAQKGEGPA

SEQ ID NO: 3064262 - protein, 9 aa, Giardia lamblia
SNNTESTKR

SEQ ID NO: 3064263 - protein, 16 aa, Giardia lamblia
SNNTMTDEAKGRAENN

SEQ ID NO: 3064264 - protein, 5 aa, Giardia lamblia
SNPAK

SEQ ID NO: 3064265 - protein, 7 aa, Giardia lamblia
SNPAKAQ

SEQ ID NO: 3064266 - protein, 10 aa, Giardia lamblia
SNPDSKSFDS

SEQ ID NO: 3064267 - protein, 5 aa, Giardia lamblia
SNPES

SEQ ID NO: 3064268 - protein, 5 aa, Giardia lamblia
SNPIT

SEQ ID NO: 3064269 - protein, 26 aa, Giardia lamblia
SNPNSAHSSPITSGNADALPGKPNAL

SEQ ID NO: 3064270 - protein, 17 aa, Giardia lamblia
SNPPDDAYEPESPVNYR

SEQ ID NO: 3064271 - protein, 4 aa, Giardia lamblia
SNPQ

SEQ ID NO: 3064272 - protein, 7 aa, Giardia lamblia
SNPQVQY

SEQ ID NO: 3064273 - protein, 13 aa, Giardia lamblia
SNPRDELQRSKPH

SEQ ID NO: 3064274 - protein, 4 aa, Giardia lamblia
SNPS

SEQ ID NO: 3064275 - protein, 10 aa, Giardia lamblia
SNPSPWASEQ

SEQ ID NO: 3064276 - protein, 5 aa, Giardia lamblia
SNPSR

SEQ ID NO: 3064277 - protein, 10 aa, Giardia lamblia
SNPSSQNLAD

SEQ ID NO: 3064278 - protein, 4 aa, Giardia lamblia
SNPT

SEQ ID NO: 3064279 - protein, 6 aa, Giardia lamblia
SNPTRK

SEQ ID NO: 3064280 - protein, 6 aa, Giardia lamblia
SNPVSE

SEQ ID NO: 3064281 - protein, 4 aa, Giardia lamblia
SNQA

SEQ ID NO: 3064282 - protein, 5 aa, Giardia lamblia
SNQAE

SEQ ID NO: 3064283 - protein, 7 aa, Giardia lamblia
SNQKYSE

SEQ ID NO: 3064284 - protein, 17 aa, Giardia lamblia
SNQPPPITSSLPDTAYS

SEQ ID NO: 3064285 - protein, 11 aa, Giardia lamblia
SNQRREAETPR

SEQ ID NO: 3064286 - protein, 6 aa, Giardia lamblia
SNQSPV

SEQ ID NO: 3064287 - protein, 14 aa, Giardia lamblia
SNQVTKHATSSSQS

SEQ ID NO: 3064288 - protein, 4 aa, Giardia lamblia
SNRA

SEQ ID NO: 3064289 - protein, 5 aa, Giardia lamblia
SNRAC

SEQ ID NO: 3064290 - protein, 6 aa, Giardia lamblia
SNREQD

SEQ ID NO: 3064291 - protein, 8 aa, Giardia lamblia
SNRPLPSA

SEQ ID NO: 3064292 - protein, 8 aa, Giardia lamblia
SNRSQTRT

SEQ ID NO: 3064293 - protein, 9 aa, Giardia lamblia
SNRSSTRRL

SEQ ID NO: 3064294 - protein, 6 aa, Giardia lamblia
SNRVKT

SEQ ID NO: 3064295 - protein, 5 aa, Giardia lamblia
SNRYE

SEQ ID NO: 3064296 - protein, 9 aa, Giardia lamblia
SNSATNEVC

SEQ ID NO: 3064297 - protein, 7 aa, Giardia lamblia
SNSDNMD

SEQ ID NO: 3064298 - protein, 6 aa, Giardia lamblia
SNSERA

SEQ ID NO: 3064299 - protein, 20 aa, Giardia lamblia
SNSESKECKSSTCKASSKSP

SEQ ID NO: 3064300 - protein, 5 aa, Giardia lamblia
SNSFR

SEQ ID NO: 3064301 - protein, 4 aa, Giardia lamblia
SNSI

SEQ ID NO: 3064302 - protein, 5 aa, Giardia lamblia
SNSIS

SEQ ID NO: 3064303 - protein, 6 aa, Giardia lamblia
SNSLTQ

SEQ ID NO: 3064304 - protein, 7 aa, Giardia lamblia
SNSLTSQ

SEQ ID NO: 3064305 - protein, 9 aa, Giardia lamblia
SNSNDDPPV

SEQ ID NO: 3064306 - protein, 6 aa, Giardia lamblia
SNSQIV

SEQ ID NO: 3064307 - protein, 9 aa, Giardia lamblia
SNSQTNAQR

SEQ ID NO: 3064308 - protein, 8 aa, Giardia lamblia
SNSQTNTG

SEQ ID NO: 3064309 - protein, 10 aa, Giardia lamblia
SNSRVSTELS

SEQ ID NO: 3064310 - protein, 10 aa, Giardia lamblia
SNSSAPGTVA

SEQ ID NO: 3064311 - protein, 8 aa, Giardia lamblia
SNSVDTSI

SEQ ID NO: 3064312 - protein, 4 aa, Giardia lamblia
SNTA

SEQ ID NO: 3064313 - protein, 16 aa, Giardia lamblia
SNTATEESSFTASSRR

SEQ ID NO: 3064314 - protein, 6 aa, Giardia lamblia
SNTATR

SEQ ID NO: 3064315 - protein, 4 aa, Giardia lamblia
SNTC

SEQ ID NO: 3064316 - protein, 8 aa, Giardia lamblia
SNTEKANL

SEQ ID NO: 3064317 - protein, 5 aa, Giardia lamblia
SNTFH

SEQ ID NO: 3064318 - protein, 7 aa, Giardia lamblia
SNTGTIG

SEQ ID NO: 3064319 - protein, 6 aa, Giardia lamblia
SNTHAS

SEQ ID NO: 3064320 - protein, 4 aa, Giardia lamblia
SNTS

SEQ ID NO: 3064321 - protein, 10 aa, Giardia lamblia
SNTSAGGIQG

SEQ ID NO: 3064322 - protein, 30 aa, Giardia lamblia
SNTSEHGSEASTTETITDDLQTSSANLAKG

SEQ ID NO: 3064323 - protein, 7 aa, Giardia lamblia
SNTTAYV

SEQ ID NO: 3064324 - protein, 7 aa, Giardia lamblia
SNTTGNL

SEQ ID NO: 3064325 - protein, 14 aa, Giardia lamblia
SNTVNATETSSSYA

SEQ ID NO: 3064326 - protein, 8 aa, Giardia lamblia
SNTYPGTS

SEQ ID NO: 3064327 - protein, 7 aa, Giardia lamblia
SNVEQRS

SEQ ID NO: 3064328 - protein, 7 aa, Giardia lamblia
SNVIGNT

SEQ ID NO: 3064329 - protein, 11 aa, Giardia lamblia
SNVKETPISDT

SEQ ID NO: 3064330 - protein, 7 aa, Giardia lamblia
SNVPGKM

SEQ ID NO: 3064331 - protein, 13 aa, Giardia lamblia
SNVTTVSGTGPGS

SEQ ID NO: 3064332 - protein, 6 aa, Giardia lamblia
SNVVPS

SEQ ID NO: 3064333 - protein, 6 aa, Giardia lamblia
SNVYGE

SEQ ID NO: 3064334 - protein, 6 aa, Giardia lamblia
SNYADD

SEQ ID NO: 3064335 - protein, 6 aa, Giardia lamblia
SNYART

SEQ ID NO: 3064336 - protein, 5 aa, Giardia lamblia
SNYGS

SEQ ID NO: 3064337 - protein, 5 aa, Giardia lamblia
SNYKN

SEQ ID NO: 3064338 - protein, 6 aa, Giardia lamblia
SNYNEQ

SEQ ID NO: 3064339 - protein, 18 aa, Giardia lamblia
SNYTAAPAAQSGNCTSPA

SEQ ID NO: 3064340 - protein, 5 aa, Giardia lamblia
SNYTQ

SEQ ID NO: 3064341 - protein, 7 aa, Giardia lamblia
SPAALSN

SEQ ID NO: 3064342 - protein, 6 aa, Giardia lamblia
SPADAD

SEQ ID NO: 3064343 - protein, 14 aa, Giardia lamblia
SPADCNGQKCDSET

SEQ ID NO: 3064344 - protein, 13 aa, Giardia lamblia
SPAEAQKLDDPSG

SEQ ID NO: 3064345 - protein, 9 aa, Giardia lamblia
SPAGDTENT

SEQ ID NO: 3064346 - protein, 9 aa, Giardia lamblia
SPAGSNSQA

SEQ ID NO: 3064347 - protein, 15 aa, Giardia lamblia
SPAKTSSGSGSRRSF

SEQ ID NO: 3064348 - protein, 6 aa, Giardia lamblia
SPAKVD

SEQ ID NO: 3064349 - protein, 4 aa, Giardia lamblia
SPAL

SEQ ID NO: 3064350 - protein, 12 aa, Giardia lamblia
SPALPAPPPPKF

SEQ ID NO: 3064351 - protein, 28 aa, Giardia lamblia
SPALRPSSRASTASKATLRGISAGASSL

SEQ ID NO: 3064352 - protein, 10 aa, Giardia lamblia
SPANDEDTVS

SEQ ID NO: 3064353 - protein, 5 aa, Giardia lamblia
SPAPI

SEQ ID NO: 3064354 - protein, 21 aa, Giardia lamblia
SPAQAYKTPFTRSTGSQKKHD

SEQ ID NO: 3064355 - protein, 7 aa, Giardia lamblia
SPASALA

SEQ ID NO: 3064356 - protein, 7 aa, Giardia lamblia
SPASCDR

SEQ ID NO: 3064357 - protein, 7 aa, Giardia lamblia
SPASDKV

SEQ ID NO: 3064358 - protein, 12 aa, Giardia lamblia
SPASGASVSQTI

SEQ ID NO: 3064359 - protein, 10 aa, Giardia lamblia
SPASSADPRT

SEQ ID NO: 3064360 - protein, 6 aa, Giardia lamblia
SPASSD

SEQ ID NO: 3064361 - protein, 5 aa, Giardia lamblia
SPASV

SEQ ID NO: 3064362 - protein, 6 aa, Giardia lamblia
SPATAT

SEQ ID NO: 3064363 - protein, 5 aa, Giardia lamblia
SPATL

SEQ ID NO: 3064364 - protein, 8 aa, Giardia lamblia
SPAVKTTK

SEQ ID NO: 3064365 - protein, 6 aa, Giardia lamblia
SPAYPG

SEQ ID NO: 3064366 - protein, 14 aa, Giardia lamblia
SPCPETDSYGCSPD

SEQ ID NO: 3064367 - protein, 9 aa, Giardia lamblia
SPCPTPDPK

SEQ ID NO: 3064368 - protein, 7 aa, Giardia lamblia
SPCSTSG

SEQ ID NO: 3064369 - protein, 4 aa, Giardia lamblia
SPDA

SEQ ID NO: 3064370 - protein, 6 aa, Giardia lamblia
SPDASH

SEQ ID NO: 3064371 - protein, 9 aa, Giardia lamblia
SPDDSTIQI

SEQ ID NO: 3064372 - protein, 14 aa, Giardia lamblia
SPDGPEGKGGLPSV

SEQ ID NO: 3064373 - protein, 5 aa, Giardia lamblia
SPDIR

SEQ ID NO: 3064374 - protein, 4 aa, Giardia lamblia
SPDK

SEQ ID NO: 3064375 - protein, 13 aa, Giardia lamblia
SPDLGEADSAPHK

SEQ ID NO: 3064376 - protein, 7 aa, Giardia lamblia
SPDLTTK

SEQ ID NO: 3064377 - protein, 7 aa, Giardia lamblia
SPDMGEG

SEQ ID NO: 3064378 - protein, 6 aa, Giardia lamblia
SPDTGM

SEQ ID NO: 3064379 - protein, 11 aa, Giardia lamblia
SPDTKDMSANS

SEQ ID NO: 3064380 - protein, 9 aa, Giardia lamblia
SPDYKDLSP

SEQ ID NO: 3064381 - protein, 5 aa, Giardia lamblia
SPEAA

SEQ ID NO: 3064382 - protein, 57 aa, Giardia lamblia
SPEAPVNDYNDYKGDASKKRPRNRGDSSHRKESSSSDILDDDQEIASQISEPRSEDD

SEQ ID NO: 3064383 - protein, 5 aa, Giardia lamblia
SPEAS

SEQ ID NO: 3064384 - protein, 7 aa, Giardia lamblia
SPEDYSL

SEQ ID NO: 3064385 - protein, 5 aa, Giardia lamblia
SPEEM

SEQ ID NO: 3064386 - protein, 7 aa, Giardia lamblia
SPEEQAT

SEQ ID NO: 3064387 - protein, 9 aa, Giardia lamblia
SPEGTRGTM

SEQ ID NO: 3064388 - protein, 8 aa, Giardia lamblia
SPEKGQGF

SEQ ID NO: 3064389 - protein, 22 aa, Giardia lamblia
SPEPGNKEKDKGKQAAQVPEQK

SEQ ID NO: 3064390 - protein, 9 aa, Giardia lamblia
SPEQDDVPD

SEQ ID NO: 3064391 - protein, 26 aa, Giardia lamblia
SPERQPGAADPPSPGRDERVEQSTKQ

SEQ ID NO: 3064392 - protein, 5 aa, Giardia lamblia
SPERS

SEQ ID NO: 3064393 - protein, 18 aa, Giardia lamblia
SPERYRRQDAQKALESSP

SEQ ID NO: 3064394 - protein, 8 aa, Giardia lamblia
SPESGKSS

SEQ ID NO: 3064395 - protein, 5 aa, Giardia lamblia
SPESK

SEQ ID NO: 3064396 - protein, 5 aa, Giardia lamblia
SPESL

SEQ ID NO: 3064397 - protein, 4 aa, Giardia lamblia
SPEV

SEQ ID NO: 3064398 - protein, 6 aa, Giardia lamblia
SPEVQS

SEQ ID NO: 3064399 - protein, 5 aa, Giardia lamblia
SPEYK

SEQ ID NO: 3064400 - protein, 13 aa, Giardia lamblia
SPFDNKSTSPHVA

SEQ ID NO: 3064401 - protein, 5 aa, Giardia lamblia
SPFTT

SEQ ID NO: 3064402 - protein, 5 aa, Giardia lamblia
SPGAD

SEQ ID NO: 3064403 - protein, 4 aa, Giardia lamblia
SPGD

SEQ ID NO: 3064404 - protein, 4 aa, Giardia lamblia
SPGG

SEQ ID NO: 3064405 - protein, 6 aa, Giardia lamblia
SPGIHK

SEQ ID NO: 3064406 - protein, 10 aa, Giardia lamblia
SPGKDGDQLV

SEQ ID NO: 3064407 - protein, 5 aa, Giardia lamblia
SPGPG

SEQ ID NO: 3064408 - protein, 7 aa, Giardia lamblia
SPGQRQS

SEQ ID NO: 3064409 - protein, 5 aa, Giardia lamblia
SPGRR

SEQ ID NO: 3064410 - protein, 5 aa, Giardia lamblia
SPGSG

SEQ ID NO: 3064411 - protein, 6 aa, Giardia lamblia
SPGTNE

SEQ ID NO: 3064412 - protein, 9 aa, Giardia lamblia
SPGYAPKAL

SEQ ID NO: 3064413 - protein, 31 aa, Giardia lamblia
SPHVKAPKKGGQKNALGTESLTRKKAPSFPQ

SEQ ID NO: 3064414 - protein, 4 aa, Giardia lamblia
SPIG

SEQ ID NO: 3064415 - protein, 8 aa, Giardia lamblia
SPIPLEPK

SEQ ID NO: 3064416 - protein, 10 aa, Giardia lamblia
SPIQDDTHQA

SEQ ID NO: 3064417 - protein, 5 aa, Giardia lamblia
SPITE

SEQ ID NO: 3064418 - protein, 6 aa, Giardia lamblia
SPKAEK

SEQ ID NO: 3064419 - protein, 17 aa, Giardia lamblia
SPKEFEKGLSDDGQTRE

SEQ ID NO: 3064420 - protein, 7 aa, Giardia lamblia
SPKNPKV

SEQ ID NO: 3064421 - protein, 14 aa, Giardia lamblia
SPKRPGSASRKDNG

SEQ ID NO: 3064422 - protein, 6 aa, Giardia lamblia
SPKSGF

SEQ ID NO: 3064423 - protein, 11 aa, Giardia lamblia
SPKTKPKKTSF

SEQ ID NO: 3064424 - protein, 9 aa, Giardia lamblia
SPKTKTEMG

SEQ ID NO: 3064425 - protein, 6 aa, Giardia lamblia
SPKYHG

SEQ ID NO: 3064426 - protein, 9 aa, Giardia lamblia
SPLDSTATV

SEQ ID NO: 3064427 - protein, 5 aa, Giardia lamblia
SPLGR

SEQ ID NO: 3064428 - protein, 6 aa, Giardia lamblia
SPLGSS

SEQ ID NO: 3064429 - protein, 4 aa, Giardia lamblia
SPLS

SEQ ID NO: 3064430 - protein, 6 aa, Giardia lamblia
SPLTGT

SEQ ID NO: 3064431 - protein, 8 aa, Giardia lamblia
SPLTPETD

SEQ ID NO: 3064432 - protein, 6 aa, Giardia lamblia
SPNAAR

SEQ ID NO: 3064433 - protein, 5 aa, Giardia lamblia
SPNDV

SEQ ID NO: 3064434 - protein, 5 aa, Giardia lamblia
SPNEH

SEQ ID NO: 3064435 - protein, 8 aa, Giardia lamblia
SPNESSLY

SEQ ID NO: 3064436 - protein, 7 aa, Giardia lamblia
SPNKYRI

SEQ ID NO: 3064437 - protein, 4 aa, Giardia lamblia
SPNN

SEQ ID NO: 3064438 - protein, 6 aa, Giardia lamblia
SPNPTC

SEQ ID NO: 3064439 - protein, 9 aa, Giardia lamblia
SPNSDEDGF

SEQ ID NO: 3064440 - protein, 4 aa, Giardia lamblia
SPNT

SEQ ID NO: 3064441 - protein, 8 aa, Giardia lamblia
SPNTQETQ

SEQ ID NO: 3064442 - protein, 10 aa, Giardia lamblia
SPPGPLSTQS

SEQ ID NO: 3064443 - protein, 12 aa, Giardia lamblia
SPPGTAEYNKVR

SEQ ID NO: 3064444 - protein, 5 aa, Giardia lamblia
SPPIE

SEQ ID NO: 3064445 - protein, 5 aa, Giardia lamblia
SPPKI

SEQ ID NO: 3064446 - protein, 10 aa, Giardia lamblia
SPPLSSARKS

SEQ ID NO: 3064447 - protein, 6 aa, Giardia lamblia
SPPPDC

SEQ ID NO: 3064448 - protein, 12 aa, Giardia lamblia
SPPSAAAEANAN

SEQ ID NO: 3064449 - protein, 34 aa, Giardia lamblia
SPPSEADANVPRSPLPKTPARLSSSTTSIRSPLA

SEQ ID NO: 3064450 - protein, 8 aa, Giardia lamblia
SPPVSPRV

SEQ ID NO: 3064451 - protein, 7 aa, Giardia lamblia
SPQGNDI

SEQ ID NO: 3064452 - protein, 4 aa, Giardia lamblia
SPQH

SEQ ID NO: 3064453 - protein, 5 aa, Giardia lamblia
SPQNC

SEQ ID NO: 3064454 - protein, 7 aa, Giardia lamblia
SPQPDKD

SEQ ID NO: 3064455 - protein, 5 aa, Giardia lamblia
SPQQK

SEQ ID NO: 3064456 - protein, 24 aa, Giardia lamblia
SPQRNRCKAQPSISGETRSSIGST

SEQ ID NO: 3064457 - protein, 4 aa, Giardia lamblia
SPQS

SEQ ID NO: 3064458 - protein, 4 aa, Giardia lamblia
SPQT

SEQ ID NO: 3064459 - protein, 5 aa, Giardia lamblia
SPQTV

SEQ ID NO: 3064460 - protein, 6 aa, Giardia lamblia
SPRAAG

SEQ ID NO: 3064461 - protein, 8 aa, Giardia lamblia
SPRAANDR

SEQ ID NO: 3064462 - protein, 11 aa, Giardia lamblia
SPRESTPGLPK

SEQ ID NO: 3064463 - protein, 5 aa, Giardia lamblia
SPRHY

SEQ ID NO: 3064464 - protein, 9 aa, Giardia lamblia
SPRIGNKSV

SEQ ID NO: 3064465 - protein, 23 aa, Giardia lamblia
SPRKPAEQTSATCTSESQIDSIQ

SEQ ID NO: 3064466 - protein, 11 aa, Giardia lamblia
SPRKSTKSVSL

SEQ ID NO: 3064467 - protein, 11 aa, Giardia lamblia
SPRLDAASEAL

SEQ ID NO: 3064468 - protein, 26 aa, Giardia lamblia
SPRLQPPEMPKLDPDDLKGEQQYKQS

SEQ ID NO: 3064469 - protein, 9 aa, Giardia lamblia
SPRTLDGES

SEQ ID NO: 3064470 - protein, 7 aa, Giardia lamblia
SPRTRLG

SEQ ID NO: 3064471 - protein, 4 aa, Giardia lamblia
SPRW

SEQ ID NO: 3064472 - protein, 4 aa, Giardia lamblia
SPSA

SEQ ID NO: 3064473 - protein, 12 aa, Giardia lamblia
SPSAGASSRATL

SEQ ID NO: 3064474 - protein, 7 aa, Giardia lamblia
SPSDRYP

SEQ ID NO: 3064475 - protein, 7 aa, Giardia lamblia
SPSEIRG

SEQ ID NO: 3064476 - protein, 6 aa, Giardia lamblia
SPSELN

SEQ ID NO: 3064477 - protein, 18 aa, Giardia lamblia
SPSELPRTDDGEVAGKDT

SEQ ID NO: 3064478 - protein, 13 aa, Giardia lamblia
SPSENARSSTSLD

SEQ ID NO: 3064479 - protein, 4 aa, Giardia lamblia
SPSF

SEQ ID NO: 3064480 - protein, 5 aa, Giardia lamblia
SPSID

SEQ ID NO: 3064481 - protein, 5 aa, Giardia lamblia
SPSIR

SEQ ID NO: 3064482 - protein, 6 aa, Giardia lamblia
SPSKAK

SEQ ID NO: 3064483 - protein, 6 aa, Giardia lamblia
SPSKTW

SEQ ID NO: 3064484 - protein, 4 aa, Giardia lamblia
SPSL

SEQ ID NO: 3064485 - protein, 19 aa, Giardia lamblia
SPSLGSQTENLATYAPQDH

SEQ ID NO: 3064486 - protein, 9 aa, Giardia lamblia
SPSNASPSI

SEQ ID NO: 3064487 - protein, 15 aa, Giardia lamblia
SPSNRQEQPIYGPDN

SEQ ID NO: 3064488 - protein, 6 aa, Giardia lamblia
SPSPRD

SEQ ID NO: 3064489 - protein, 19 aa, Giardia lamblia
SPSPVDEDHELPRESSAGY

SEQ ID NO: 3064490 - protein, 26 aa, Giardia lamblia
SPSRFSTVSSPSPHSTSSGSLKTKDP

SEQ ID NO: 3064491 - protein, 6 aa, Giardia lamblia
SPSRLP

SEQ ID NO: 3064492 - protein, 6 aa, Giardia lamblia
SPSSFR

SEQ ID NO: 3064493 - protein, 10 aa, Giardia lamblia
SPSSVTSSSS

SEQ ID NO: 3064494 - protein, 9 aa, Giardia lamblia
SPSTQRRLS

SEQ ID NO: 3064495 - protein, 6 aa, Giardia lamblia
SPSTRR

SEQ ID NO: 3064496 - protein, 5 aa, Giardia lamblia
SPSTS

SEQ ID NO: 3064497 - protein, 5 aa, Giardia lamblia
SPSVA

SEQ ID NO: 3064498 - protein, 7 aa, Giardia lamblia
SPSVESA

SEQ ID NO: 3064499 - protein, 8 aa, Giardia lamblia
SPSVPRRA

SEQ ID NO: 3064500 - protein, 5 aa, Giardia lamblia
SPSVS

SEQ ID NO: 3064501 - protein, 5 aa, Giardia lamblia
SPTAG

SEQ ID NO: 3064502 - protein, 11 aa, Giardia lamblia
SPTCTTETPAK

SEQ ID NO: 3064503 - protein, 4 aa, Giardia lamblia
SPTD

SEQ ID NO: 3064504 - protein, 8 aa, Giardia lamblia
SPTDAEKL

SEQ ID NO: 3064505 - protein, 12 aa, Giardia lamblia
SPTEEPNSSLQK

SEQ ID NO: 3064506 - protein, 10 aa, Giardia lamblia
SPTESPASFD

SEQ ID NO: 3064507 - protein, 6 aa, Giardia lamblia
SPTGNT

SEQ ID NO: 3064508 - protein, 5 aa, Giardia lamblia
SPTHS

SEQ ID NO: 3064509 - protein, 5 aa, Giardia lamblia
SPTMG

SEQ ID NO: 3064510 - protein, 11 aa, Giardia lamblia
SPTRSKSASSC

SEQ ID NO: 3064511 - protein, 16 aa, Giardia lamblia
SPTSDLGLNPPSIHSG

SEQ ID NO: 3064512 - protein, 7 aa, Giardia lamblia
SPTVERS

SEQ ID NO: 3064513 - protein, 6 aa, Giardia lamblia
SPTVHP

SEQ ID NO: 3064514 - protein, 8 aa, Giardia lamblia
SPTVTGET

SEQ ID NO: 3064515 - protein, 6 aa, Giardia lamblia
SPTWGK

SEQ ID NO: 3064516 - protein, 4 aa, Giardia lamblia
SPTY

SEQ ID NO: 3064517 - protein, 5 aa, Giardia lamblia
SPTYN

SEQ ID NO: 3064518 - protein, 6 aa, Giardia lamblia
SPTYPG

SEQ ID NO: 3064519 - protein, 6 aa, Giardia lamblia
SPVAEN

SEQ ID NO: 3064520 - protein, 4 aa, Giardia lamblia
SPVN

SEQ ID NO: 3064521 - protein, 4 aa, Giardia lamblia
SPVS

SEQ ID NO: 3064522 - protein, 23 aa, Giardia lamblia
SPVSSGLSSRSSVIQSSGNDSKI

SEQ ID NO: 3064523 - protein, 5 aa, Giardia lamblia
SPVYA

SEQ ID NO: 3064524 - protein, 20 aa, Giardia lamblia
SPYEAPEVASGGEHNKNSDV

SEQ ID NO: 3064525 - protein, 25 aa, Giardia lamblia
SPYGPSSRAAYTDDDDVSANDKAKR

SEQ ID NO: 3064526 - protein, 5 aa, Giardia lamblia
SPYPD

SEQ ID NO: 3064527 - protein, 12 aa, Giardia lamblia
SPYSAESTETVR

SEQ ID NO: 3064528 - protein, 15 aa, Giardia lamblia
SQADDQHTSKPLGTY

SEQ ID NO: 3064529 - protein, 8 aa, Giardia lamblia
SQADKTRK

SEQ ID NO: 3064530 - protein, 12 aa, Giardia lamblia
SQAEDEDPFTRD

SEQ ID NO: 3064531 - protein, 11 aa, Giardia lamblia
SQAHPSFTGKK

SEQ ID NO: 3064532 - protein, 12 aa, Giardia lamblia
SQAPGPNTPTEK

SEQ ID NO: 3064533 - protein, 5 aa, Giardia lamblia
SQAQA

SEQ ID NO: 3064534 - protein, 10 aa, Giardia lamblia
SQAQSAKAGA

SEQ ID NO: 3064535 - protein, 8 aa, Giardia lamblia
SQASEASY

SEQ ID NO: 3064536 - protein, 7 aa, Giardia lamblia
SQCQNCD

SEQ ID NO: 3064537 - protein, 30 aa, Giardia lamblia
SQCQSQTSVPVNGECKSQATRASECSRYSK

SEQ ID NO: 3064538 - protein, 9 aa, Giardia lamblia
SQDAAVPGA

SEQ ID NO: 3064539 - protein, 7 aa, Giardia lamblia
SQDMSSE

SEQ ID NO: 3064540 - protein, 8 aa, Giardia lamblia
SQDTLSNE

SEQ ID NO: 3064541 - protein, 15 aa, Giardia lamblia
SQEDVGKNNDRTVSA

SEQ ID NO: 3064542 - protein, 4 aa, Giardia lamblia
SQEQ

SEQ ID NO: 3064543 - protein, 6 aa, Giardia lamblia
SQETGL

SEQ ID NO: 3064544 - protein, 5 aa, Giardia lamblia
SQFGD

SEQ ID NO: 3064545 - protein, 4 aa, Giardia lamblia
SQFT

SEQ ID NO: 3064546 - protein, 13 aa, Giardia lamblia
SQGLPSDLTSTDN

SEQ ID NO: 3064547 - protein, 11 aa, Giardia lamblia
SQGPASSEVGL

SEQ ID NO: 3064548 - protein, 10 aa, Giardia lamblia
SQGQSLQQAI

SEQ ID NO: 3064549 - protein, 23 aa, Giardia lamblia
SQGSNNQASSDTSGQTNDTTDTE

SEQ ID NO: 3064550 - protein, 12 aa, Giardia lamblia
SQGSNSIEQQSP

SEQ ID NO: 3064551 - protein, 12 aa, Giardia lamblia
SQGSPGASGSGE

SEQ ID NO: 3064552 - protein, 37 aa, Giardia lamblia
SQHLDSDDNEEESGYYSQSNNGDSNTNLNSDRSRDFG

SEQ ID NO: 3064553 - protein, 16 aa, Giardia lamblia
SQHSSSTNTQASNITK

SEQ ID NO: 3064554 - protein, 11 aa, Giardia lamblia
SQIEAKAPVQE

SEQ ID NO: 3064555 - protein, 18 aa, Giardia lamblia
SQIPPDHDEYTDDSTTDF

SEQ ID NO: 3064556 - protein, 9 aa, Giardia lamblia
SQITSTEQL

SEQ ID NO: 3064557 - protein, 6 aa, Giardia lamblia
SQIVEK

SEQ ID NO: 3064558 - protein, 7 aa, Giardia lamblia
SQIVEKG

SEQ ID NO: 3064559 - protein, 19 aa, Giardia lamblia
SQKAHASTTDKTGNVSEQS

SEQ ID NO: 3064560 - protein, 8 aa, Giardia lamblia
SQKASDHL

SEQ ID NO: 3064561 - protein, 8 aa, Giardia lamblia
SQKDSSLS

SEQ ID NO: 3064562 - protein, 10 aa, Giardia lamblia
SQKESELDKY

SEQ ID NO: 3064563 - protein, 11 aa, Giardia lamblia
SQKGMKDDQGM

SEQ ID NO: 3064564 - protein, 17 aa, Giardia lamblia
SQKGPSHEAGLRPSSLR

SEQ ID NO: 3064565 - protein, 4 aa, Giardia lamblia
SQKK

SEQ ID NO: 3064566 - protein, 7 aa, Giardia lamblia
SQKNDET

SEQ ID NO: 3064567 - protein, 9 aa, Giardia lamblia
SQKSEDVQE

SEQ ID NO: 3064568 - protein, 9 aa, Giardia lamblia
SQKYDPSRL

SEQ ID NO: 3064569 - protein, 5 aa, Giardia lamblia
SQLDR

SEQ ID NO: 3064570 - protein, 10 aa, Giardia lamblia
SQLGEASTLG

SEQ ID NO: 3064571 - protein, 21 aa, Giardia lamblia
SQLNSGNTSDGRGDTRPESTS

SEQ ID NO: 3064572 - protein, 8 aa, Giardia lamblia
SQLQSESG

SEQ ID NO: 3064573 - protein, 13 aa, Giardia lamblia
SQLVGESTPWKET

SEQ ID NO: 3064574 - protein, 13 aa, Giardia lamblia
SQMDEESQTSSTH

SEQ ID NO: 3064575 - protein, 14 aa, Giardia lamblia
SQMQGQSGDAQSAL

SEQ ID NO: 3064576 - protein, 10 aa, Giardia lamblia
SQMSSAPPTR

SEQ ID NO: 3064577 - protein, 9 aa, Giardia lamblia
SQNAETDDC

SEQ ID NO: 3064578 - protein, 5 aa, Giardia lamblia
SQNDF

SEQ ID NO: 3064579 - protein, 8 aa, Giardia lamblia
SQNKHGRT

SEQ ID NO: 3064580 - protein, 5 aa, Giardia lamblia
SQNSD

SEQ ID NO: 3064581 - protein, 9 aa, Giardia lamblia
SQNSSLAEG

SEQ ID NO: 3064582 - protein, 4 aa, Giardia lamblia
SQNT

SEQ ID NO: 3064583 - protein, 6 aa, Giardia lamblia
SQPAVQ

SEQ ID NO: 3064584 - protein, 5 aa, Giardia lamblia
SQPDA

SEQ ID NO: 3064585 - protein, 14 aa, Giardia lamblia
SQPDIADTSPVHSS

SEQ ID NO: 3064586 - protein, 15 aa, Giardia lamblia
SQPEPPRTQLRKSGL

SEQ ID NO: 3064587 - protein, 8 aa, Giardia lamblia
SQPGADHY

SEQ ID NO: 3064588 - protein, 12 aa, Giardia lamblia
SQPKADADTDSS

SEQ ID NO: 3064589 - protein, 15 aa, Giardia lamblia
SQPKSERIGSTGASV

SEQ ID NO: 3064590 - protein, 8 aa, Giardia lamblia
SQPSLPAP

SEQ ID NO: 3064591 - protein, 14 aa, Giardia lamblia
SQPYNPTKKSDSKF

SEQ ID NO: 3064592 - protein, 7 aa, Giardia lamblia
SQPYPAP

SEQ ID NO: 3064593 - protein, 7 aa, Giardia lamblia
SQPYRPP

SEQ ID NO: 3064594 - protein, 13 aa, Giardia lamblia
SQQCTDRKTPLEG

SEQ ID NO: 3064595 - protein, 12 aa, Giardia lamblia
SQQEKGAEGAKV

SEQ ID NO: 3064596 - protein, 4 aa, Giardia lamblia
SQQG

SEQ ID NO: 3064597 - protein, 13 aa, Giardia lamblia
SQQGAPSLGGSSC

SEQ ID NO: 3064598 - protein, 11 aa, Giardia lamblia
SQQRPRSTNDV

SEQ ID NO: 3064599 - protein, 8 aa, Giardia lamblia
SQQTLDPQ

SEQ ID NO: 3064600 - protein, 12 aa, Giardia lamblia
SQRDRKTKDGRT

SEQ ID NO: 3064601 - protein, 8 aa, Giardia lamblia
SQREEDGR

SEQ ID NO: 3064602 - protein, 5 aa, Giardia lamblia
SQRNF

SEQ ID NO: 3064603 - protein, 12 aa, Giardia lamblia
SQRRAQYAEQTM

SEQ ID NO: 3064604 - protein, 15 aa, Giardia lamblia
SQRSSNKFRSSPYTP

SEQ ID NO: 3064605 - protein, 7 aa, Giardia lamblia
SQRYSSY

SEQ ID NO: 3064606 - protein, 15 aa, Giardia lamblia
SQSAEADEKPSIDVK

SEQ ID NO: 3064607 - protein, 21 aa, Giardia lamblia
SQSAENDDGQSLEDPLNEHPG

SEQ ID NO: 3064608 - protein, 8 aa, Giardia lamblia
SQSATNDL

SEQ ID NO: 3064609 - protein, 5 aa, Giardia lamblia
SQSCA

SEQ ID NO: 3064610 - protein, 16 aa, Giardia lamblia
SQSDQHEKVPDTIPDK

SEQ ID NO: 3064611 - protein, 6 aa, Giardia lamblia
SQSEHA

SEQ ID NO: 3064612 - protein, 19 aa, Giardia lamblia
SQSFTPTQQNKVGIPPDAL

SEQ ID NO: 3064613 - protein, 6 aa, Giardia lamblia
SQSGES

SEQ ID NO: 3064614 - protein, 5 aa, Giardia lamblia
SQSIG

SEQ ID NO: 3064615 - protein, 9 aa, Giardia lamblia
SQSKQTQSC

SEQ ID NO: 3064616 - protein, 7 aa, Giardia lamblia
SQSLPQA

SEQ ID NO: 3064617 - protein, 10 aa, Giardia lamblia
SQSNSRDGRL

SEQ ID NO: 3064618 - protein, 6 aa, Giardia lamblia
SQSPAV

SEQ ID NO: 3064619 - protein, 10 aa, Giardia lamblia
SQSPGNAKGI

SEQ ID NO: 3064620 - protein, 7 aa, Giardia lamblia
SQSPIDS

SEQ ID NO: 3064621 - protein, 6 aa, Giardia lamblia
SQSPLY

SEQ ID NO: 3064622 - protein, 12 aa, Giardia lamblia
SQSSNGVQDGVT

SEQ ID NO: 3064623 - protein, 7 aa, Giardia lamblia
SQSTVGH

SEQ ID NO: 3064624 - protein, 10 aa, Giardia lamblia
SQSYQDGGSW

SEQ ID NO: 3064625 - protein, 8 aa, Giardia lamblia
SQTDAESL

SEQ ID NO: 3064626 - protein, 7 aa, Giardia lamblia
SQTKTAM

SEQ ID NO: 3064627 - protein, 4 aa, Giardia lamblia
SQTL

SEQ ID NO: 3064628 - protein, 4 aa, Giardia lamblia
SQTR

SEQ ID NO: 3064629 - protein, 38 aa, Giardia lamblia
SQTSGQPSVAAPSTDPSVSASASARGELNKDAQEDSLS

SEQ ID NO: 3064630 - protein, 8 aa, Giardia lamblia
SQTSTIKE

SEQ ID NO: 3064631 - protein, 6 aa, Giardia lamblia
SQTTIG

SEQ ID NO: 3064632 - protein, 6 aa, Giardia lamblia
SQTTNS

SEQ ID NO: 3064633 - protein, 13 aa, Giardia lamblia
SQTVNNSTQFDEK

SEQ ID NO: 3064634 - protein, 6 aa, Giardia lamblia
SQTVSD

SEQ ID NO: 3064635 - protein, 9 aa, Giardia lamblia
SQVEETSVD

SEQ ID NO: 3064636 - protein, 5 aa, Giardia lamblia
SQVND

SEQ ID NO: 3064637 - protein, 7 aa, Giardia lamblia
SQVTATE

SEQ ID NO: 3064638 - protein, 6 aa, Giardia lamblia
SQYAKG

SEQ ID NO: 3064639 - protein, 4 aa, Giardia lamblia
SQYK

SEQ ID NO: 3064640 - protein, 13 aa, Giardia lamblia
SRAAARREEREKE

SEQ ID NO: 3064641 - protein, 5 aa, Giardia lamblia
SRAAM

SEQ ID NO: 3064642 - protein, 8 aa, Giardia lamblia
SRAATAEK

SEQ ID NO: 3064643 - protein, 5 aa, Giardia lamblia
SRACS

SEQ ID NO: 3064644 - protein, 9 aa, Giardia lamblia
SRADCSETS

SEQ ID NO: 3064645 - protein, 7 aa, Giardia lamblia
SRADKQG

SEQ ID NO: 3064646 - protein, 5 aa, Giardia lamblia
SRAGA

SEQ ID NO: 3064647 - protein, 10 aa, Giardia lamblia
SRAGPRYANE

SEQ ID NO: 3064648 - protein, 7 aa, Giardia lamblia
SRAKSTS

SEQ ID NO: 3064649 - protein, 4 aa, Giardia lamblia
SRAR

SEQ ID NO: 3064650 - protein, 9 aa, Giardia lamblia
SRARDGCGA

SEQ ID NO: 3064651 - protein, 28 aa, Giardia lamblia
SRAREPTSRVDPVSSSINSLTNTSPDPH

SEQ ID NO: 3064652 - protein, 12 aa, Giardia lamblia
SRARKHASKNSF

SEQ ID NO: 3064653 - protein, 4 aa, Giardia lamblia
SRAS

SEQ ID NO: 3064654 - protein, 7 aa, Giardia lamblia
SRASLSS

SEQ ID NO: 3064655 - protein, 9 aa, Giardia lamblia
SRASSLSSG

SEQ ID NO: 3064656 - protein, 15 aa, Giardia lamblia
SRASTKMSLEEEEKN

SEQ ID NO: 3064657 - protein, 9 aa, Giardia lamblia
SRATATKAS

SEQ ID NO: 3064658 - protein, 9 aa, Giardia lamblia
SRATLTHPT

SEQ ID NO: 3064659 - protein, 8 aa, Giardia lamblia
SRAYSPTE

SEQ ID NO: 3064660 - protein, 10 aa, Giardia lamblia
SRCTSGYAGD

SEQ ID NO: 3064661 - protein, 10 aa, Giardia lamblia
SRDNQANIQD

SEQ ID NO: 3064662 - protein, 7 aa, Giardia lamblia
SRDRAAL

SEQ ID NO: 3064663 - protein, 22 aa, Giardia lamblia
SRDSASSSSTSGLTHPTQPSNM

SEQ ID NO: 3064664 - protein, 5 aa, Giardia lamblia
SRDSL

SEQ ID NO: 3064665 - protein, 20 aa, Giardia lamblia
SRDSSFAKNNRTDESHSKKR

SEQ ID NO: 3064666 - protein, 12 aa, Giardia lamblia
SRDTDQCDSAIP

SEQ ID NO: 3064667 - protein, 5 aa, Giardia lamblia
SREAL

SEQ ID NO: 3064668 - protein, 6 aa, Giardia lamblia
SREGKI

SEQ ID NO: 3064669 - protein, 7 aa, Giardia lamblia
SRELPKP

SEQ ID NO: 3064670 - protein, 7 aa, Giardia lamblia
SRENSLE

SEQ ID NO: 3064671 - protein, 4 aa, Giardia lamblia
SREP

SEQ ID NO: 3064672 - protein, 7 aa, Giardia lamblia
SREPLSA

SEQ ID NO: 3064673 - protein, 5 aa, Giardia lamblia
SRESN

SEQ ID NO: 3064674 - protein, 4 aa, Giardia lamblia
SRFD

SEQ ID NO: 3064675 - protein, 20 aa, Giardia lamblia
SRFKTSGVDVESPAAAQYAD

SEQ ID NO: 3064676 - protein, 7 aa, Giardia lamblia
SRGAQGV

SEQ ID NO: 3064677 - protein, 9 aa, Giardia lamblia
SRGDSIDGI

SEQ ID NO: 3064678 - protein, 7 aa, Giardia lamblia
SRGDTRV

SEQ ID NO: 3064679 - protein, 9 aa, Giardia lamblia
SRGEDLSQK

SEQ ID NO: 3064680 - protein, 6 aa, Giardia lamblia
SRGEGL

SEQ ID NO: 3064681 - protein, 9 aa, Giardia lamblia
SRGETVCST

SEQ ID NO: 3064682 - protein, 7 aa, Giardia lamblia
SRGGNSD

SEQ ID NO: 3064683 - protein, 13 aa, Giardia lamblia
SRGGSCAKKMSRP

SEQ ID NO: 3064684 - protein, 4 aa, Giardia lamblia
SRGH

SEQ ID NO: 3064685 - protein, 6 aa, Giardia lamblia
SRGKAK

SEQ ID NO: 3064686 - protein, 8 aa, Giardia lamblia
SRGNNNLA

SEQ ID NO: 3064687 - protein, 8 aa, Giardia lamblia
SRGPGYGA

SEQ ID NO: 3064688 - protein, 13 aa, Giardia lamblia
SRGPRSRPQSESF

SEQ ID NO: 3064689 - protein, 23 aa, Giardia lamblia
SRGPSALPPGRNSVSGSRSVSTN

SEQ ID NO: 3064690 - protein, 17 aa, Giardia lamblia
SRGPYSKTYSKGNASSA

SEQ ID NO: 3064691 - protein, 10 aa, Giardia lamblia
SRGSSGKATL

SEQ ID NO: 3064692 - protein, 10 aa, Giardia lamblia
SRGSSTPSMA

SEQ ID NO: 3064693 - protein, 6 aa, Giardia lamblia
SRHGLT

SEQ ID NO: 3064694 - protein, 30 aa, Giardia lamblia
SRHPVTARPGMGGPEFNTGQTQPPTVAPPT

SEQ ID NO: 3064695 - protein, 15 aa, Giardia lamblia
SRHSGLSTSQPSNLS

SEQ ID NO: 3064696 - protein, 4 aa, Giardia lamblia
SRIE

SEQ ID NO: 3064697 - protein, 10 aa, Giardia lamblia
SRIGSSDVSQ

SEQ ID NO: 3064698 - protein, 5 aa, Giardia lamblia
SRIPP

SEQ ID NO: 3064699 - protein, 4 aa, Giardia lamblia
SRIR

SEQ ID NO: 3064700 - protein, 8 aa, Giardia lamblia
SRITEPVR

SEQ ID NO: 3064701 - protein, 9 aa, Giardia lamblia
SRKANGKVE

SEQ ID NO: 3064702 - protein, 8 aa, Giardia lamblia
SRKDPSPL

SEQ ID NO: 3064703 - protein, 8 aa, Giardia lamblia
SRKDQNSM

SEQ ID NO: 3064704 - protein, 8 aa, Giardia lamblia
SRKEASTM

SEQ ID NO: 3064705 - protein, 9 aa, Giardia lamblia
SRKGVRKRT

SEQ ID NO: 3064706 - protein, 5 aa, Giardia lamblia
SRKQM

SEQ ID NO: 3064707 - protein, 14 aa, Giardia lamblia
SRKQNSHKNVDEDT

SEQ ID NO: 3064708 - protein, 20 aa, Giardia lamblia
SRKRASQVSNQATDTQAHPN

SEQ ID NO: 3064709 - protein, 18 aa, Giardia lamblia
SRKRTAAENIKLMGSVDE

SEQ ID NO: 3064710 - protein, 9 aa, Giardia lamblia
SRKSTPDSF

SEQ ID NO: 3064711 - protein, 13 aa, Giardia lamblia
SRKYDEKAHTRDS

SEQ ID NO: 3064712 - protein, 18 aa, Giardia lamblia
SRLNEPDDRSSTSTQEYD

SEQ ID NO: 3064713 - protein, 22 aa, Giardia lamblia
SRLPHGSSSLSSSARGSTDKSF

SEQ ID NO: 3064714 - protein, 10 aa, Giardia lamblia
SRLPTEEEYG

SEQ ID NO: 3064715 - protein, 5 aa, Giardia lamblia
SRLRS

SEQ ID NO: 3064716 - protein, 6 aa, Giardia lamblia
SRLRSD

SEQ ID NO: 3064717 - protein, 24 aa, Giardia lamblia
SRMASSRKGLRPGNLTDHESSTQM

SEQ ID NO: 3064718 - protein, 12 aa, Giardia lamblia
SRMTDQDAKGVP

SEQ ID NO: 3064719 - protein, 6 aa, Giardia lamblia
SRNAKT

SEQ ID NO: 3064720 - protein, 5 aa, Giardia lamblia
SRNEF

SEQ ID NO: 3064721 - protein, 10 aa, Giardia lamblia
SRNTDTSNYT

SEQ ID NO: 3064722 - protein, 4 aa, Giardia lamblia
SRNV

SEQ ID NO: 3064723 - protein, 9 aa, Giardia lamblia
SRPADPLER

SEQ ID NO: 3064724 - protein, 21 aa, Giardia lamblia
SRPGEGRLPEGSTNSVMDSDS

SEQ ID NO: 3064725 - protein, 13 aa, Giardia lamblia
SRPKSSKSRTRQS

SEQ ID NO: 3064726 - protein, 4 aa, Giardia lamblia
SRPN

SEQ ID NO: 3064727 - protein, 7 aa, Giardia lamblia
SRPNNPV

SEQ ID NO: 3064728 - protein, 6 aa, Giardia lamblia
SRPRSV

SEQ ID NO: 3064729 - protein, 6 aa, Giardia lamblia
SRPSFE

SEQ ID NO: 3064730 - protein, 9 aa, Giardia lamblia
SRPTEDDFR

SEQ ID NO: 3064731 - protein, 6 aa, Giardia lamblia
SRPTTD

SEQ ID NO: 3064732 - protein, 5 aa, Giardia lamblia
SRPVS

SEQ ID NO: 3064733 - protein, 10 aa, Giardia lamblia
SRQARAAGST

SEQ ID NO: 3064734 - protein, 5 aa, Giardia lamblia
SRQGT

SEQ ID NO: 3064735 - protein, 11 aa, Giardia lamblia
SRQKRRDRRMR

SEQ ID NO: 3064736 - protein, 8 aa, Giardia lamblia
SRQLPAEA

SEQ ID NO: 3064737 - protein, 18 aa, Giardia lamblia
SRQPQSVKVTTGSKKQVE

SEQ ID NO: 3064738 - protein, 5 aa, Giardia lamblia
SRQRE

SEQ ID NO: 3064739 - protein, 7 aa, Giardia lamblia
SRQTGHR

SEQ ID NO: 3064740 - protein, 5 aa, Giardia lamblia
SRRAA

SEQ ID NO: 3064741 - protein, 6 aa, Giardia lamblia
SRRETV

SEQ ID NO: 3064742 - protein, 16 aa, Giardia lamblia
SRRKGMPSQTHSTDNL

SEQ ID NO: 3064743 - protein, 13 aa, Giardia lamblia
SRRKKLERDNALT

SEQ ID NO: 3064744 - protein, 5 aa, Giardia lamblia
SRRNR

SEQ ID NO: 3064745 - protein, 19 aa, Giardia lamblia
SRRPNLKKSEEKDANAEEV

SEQ ID NO: 3064746 - protein, 7 aa, Giardia lamblia
SRRQTAQ

SEQ ID NO: 3064747 - protein, 6 aa, Giardia lamblia
SRRSAR

SEQ ID NO: 3064748 - protein, 10 aa, Giardia lamblia
SRRSLKSRDK

SEQ ID NO: 3064749 - protein, 6 aa, Giardia lamblia
SRRSPS

SEQ ID NO: 3064750 - protein, 8 aa, Giardia lamblia
SRRTRGAL

SEQ ID NO: 3064751 - protein, 9 aa, Giardia lamblia
SRSADSMGH

SEQ ID NO: 3064752 - protein, 7 aa, Giardia lamblia
SRSDEIK

SEQ ID NO: 3064753 - protein, 6 aa, Giardia lamblia
SRSGIQ

SEQ ID NO: 3064754 - protein, 12 aa, Giardia lamblia
SRSGLEQQYQQK

SEQ ID NO: 3064755 - protein, 10 aa, Giardia lamblia
SRSKQGGRDD

SEQ ID NO: 3064756 - protein, 16 aa, Giardia lamblia
SRSLASTVAANEAPVD

SEQ ID NO: 3064757 - protein, 9 aa, Giardia lamblia
SRSNPQAEA

SEQ ID NO: 3064758 - protein, 7 aa, Giardia lamblia
SRSPNVD

SEQ ID NO: 3064759 - protein, 8 aa, Giardia lamblia
SRSPTPFV

SEQ ID NO: 3064760 - protein, 5 aa, Giardia lamblia
SRSSI

SEQ ID NO: 3064761 - protein, 8 aa, Giardia lamblia
SRSSSISG

SEQ ID NO: 3064762 - protein, 8 aa, Giardia lamblia
SRSSSSLG

SEQ ID NO: 3064763 - protein, 20 aa, Giardia lamblia
SRSTEAEDLKHKSKKYKDGY

SEQ ID NO: 3064764 - protein, 8 aa, Giardia lamblia
SRSTTAPT

SEQ ID NO: 3064765 - protein, 8 aa, Giardia lamblia
SRTASGSA

SEQ ID NO: 3064766 - protein, 6 aa, Giardia lamblia
SRTATN

SEQ ID NO: 3064767 - protein, 7 aa, Giardia lamblia
SRTAVES

SEQ ID NO: 3064768 - protein, 8 aa, Giardia lamblia
SRTDRSVS

SEQ ID NO: 3064769 - protein, 7 aa, Giardia lamblia
SRTGASV

SEQ ID NO: 3064770 - protein, 12 aa, Giardia lamblia
SRTGLSGEPPAL

SEQ ID NO: 3064771 - protein, 8 aa, Giardia lamblia
SRTGSGAN

SEQ ID NO: 3064772 - protein, 5 aa, Giardia lamblia
SRTIS

SEQ ID NO: 3064773 - protein, 18 aa, Giardia lamblia
SRTITEEDITKPNDSLTD

SEQ ID NO: 3064774 - protein, 18 aa, Giardia lamblia
SRTLPEKEKPLSTQFSPE

SEQ ID NO: 3064775 - protein, 7 aa, Giardia lamblia
SRTPVIG

SEQ ID NO: 3064776 - protein, 25 aa, Giardia lamblia
SRTSVSADYPDNSHAARSQSTSSTR

SEQ ID NO: 3064777 - protein, 4 aa, Giardia lamblia
SRTT

SEQ ID NO: 3064778 - protein, 6 aa, Giardia lamblia
SRTTIA

SEQ ID NO: 3064779 - protein, 8 aa, Giardia lamblia
SRTTYDTA

SEQ ID NO: 3064780 - protein, 12 aa, Giardia lamblia
SRTVGGESLASN

SEQ ID NO: 3064781 - protein, 16 aa, Giardia lamblia
SRVKEGEATDSEERMI

SEQ ID NO: 3064782 - protein, 11 aa, Giardia lamblia
SRVSDKKSPIK

SEQ ID NO: 3064783 - protein, 6 aa, Giardia lamblia
SRVSGE

SEQ ID NO: 3064784 - protein, 4 aa, Giardia lamblia
SRWT

SEQ ID NO: 3064785 - protein, 5 aa, Giardia lamblia
SRYAP

SEQ ID NO: 3064786 - protein, 11 aa, Giardia lamblia
SRYRTDKKTGQ

SEQ ID NO: 3064787 - protein, 9 aa, Giardia lamblia
SRYSGENNL

SEQ ID NO: 3064788 - protein, 18 aa, Giardia lamblia
SRYSTKTAGGATSVSEEA

SEQ ID NO: 3064789 - protein, 11 aa, Giardia lamblia
SRYTDTPQGPY

SEQ ID NO: 3064790 - protein, 8 aa, Giardia lamblia
SSAAERGE

SEQ ID NO: 3064791 - protein, 9 aa, Giardia lamblia
SSAANRGLP

SEQ ID NO: 3064792 - protein, 10 aa, Giardia lamblia
SSAAQASPMA

SEQ ID NO: 3064793 - protein, 8 aa, Giardia lamblia
SSAASAGK

SEQ ID NO: 3064794 - protein, 10 aa, Giardia lamblia
SSADAKNCKI

SEQ ID NO: 3064795 - protein, 9 aa, Giardia lamblia
SSADDAPVQ

SEQ ID NO: 3064796 - protein, 6 aa, Giardia lamblia
SSADDL

SEQ ID NO: 3064797 - protein, 8 aa, Giardia lamblia
SSADGAVA

SEQ ID NO: 3064798 - protein, 6 aa, Giardia lamblia
SSADVS

SEQ ID NO: 3064799 - protein, 9 aa, Giardia lamblia
SSAEKRDAV

SEQ ID NO: 3064800 - protein, 46 aa, Giardia lamblia
SSAEYGVPTGASAGSLRAAPGKAAAKDKSIKPYKAKSGSNSRSSDH

SEQ ID NO: 3064801 - protein, 6 aa, Giardia lamblia
SSAFSN

SEQ ID NO: 3064802 - protein, 13 aa, Giardia lamblia
SSAGQPNQAPSPI

SEQ ID NO: 3064803 - protein, 11 aa, Giardia lamblia
SSAGVSSELEE

SEQ ID NO: 3064804 - protein, 19 aa, Giardia lamblia
SSAGVTPGFSHATLDAKGD

SEQ ID NO: 3064805 - protein, 9 aa, Giardia lamblia
SSAGYTANT

SEQ ID NO: 3064806 - protein, 8 aa, Giardia lamblia
SSAHPARK

SEQ ID NO: 3064807 - protein, 6 aa, Giardia lamblia
SSAHPT

SEQ ID NO: 3064808 - protein, 8 aa, Giardia lamblia
SSAHSTTG

SEQ ID NO: 3064809 - protein, 16 aa, Giardia lamblia
SSALRSAKEKANAEEV

SEQ ID NO: 3064810 - protein, 4 aa, Giardia lamblia
SSAN

SEQ ID NO: 3064811 - protein, 29 aa, Giardia lamblia
SSANNGKCTSCTNGQTADKNSGSCPACPD

SEQ ID NO: 3064812 - protein, 4 aa, Giardia lamblia
SSAP

SEQ ID NO: 3064813 - protein, 10 aa, Giardia lamblia
SSAPGEIPED

SEQ ID NO: 3064814 - protein, 14 aa, Giardia lamblia
SSAQASEGASKGYL

SEQ ID NO: 3064815 - protein, 8 aa, Giardia lamblia
SSAQASEL

SEQ ID NO: 3064816 - protein, 6 aa, Giardia lamblia
SSAQDL

SEQ ID NO: 3064817 - protein, 12 aa, Giardia lamblia
SSAQGAEGRTKE

SEQ ID NO: 3064818 - protein, 9 aa, Giardia lamblia
SSAQGNPTH

SEQ ID NO: 3064819 - protein, 6 aa, Giardia lamblia
SSARRT

SEQ ID NO: 3064820 - protein, 4 aa, Giardia lamblia
SSAS

SEQ ID NO: 3064821 - protein, 8 aa, Giardia lamblia
SSASISGI

SEQ ID NO: 3064822 - protein, 7 aa, Giardia lamblia
SSASNGV

SEQ ID NO: 3064823 - protein, 5 aa, Giardia lamblia
SSATA

SEQ ID NO: 3064824 - protein, 11 aa, Giardia lamblia
SSATDRPLEPR

SEQ ID NO: 3064825 - protein, 8 aa, Giardia lamblia
SSATGDIL

SEQ ID NO: 3064826 - protein, 8 aa, Giardia lamblia
SSATGTNL

SEQ ID NO: 3064827 - protein, 29 aa, Giardia lamblia
SSATNGKCTSCTNGQTADKNSGSCPACPD

SEQ ID NO: 3064828 - protein, 7 aa, Giardia lamblia
SSATRDA

SEQ ID NO: 3064829 - protein, 7 aa, Giardia lamblia
SSATSQL

SEQ ID NO: 3064830 - protein, 6 aa, Giardia lamblia
SSATSR

SEQ ID NO: 3064831 - protein, 4 aa, Giardia lamblia
SSAV

SEQ ID NO: 3064832 - protein, 8 aa, Giardia lamblia
SSAVEDGE

SEQ ID NO: 3064833 - protein, 13 aa, Giardia lamblia
SSAVYGAGSECTV

SEQ ID NO: 3064834 - protein, 4 aa, Giardia lamblia
SSAY

SEQ ID NO: 3064835 - protein, 6 aa, Giardia lamblia
SSCNPN

SEQ ID NO: 3064836 - protein, 17 aa, Giardia lamblia
SSCPEDGNCGVEDGASL

SEQ ID NO: 3064837 - protein, 8 aa, Giardia lamblia
SSCPHQAR

SEQ ID NO: 3064838 - protein, 13 aa, Giardia lamblia
SSCPNGKSTCSSC

SEQ ID NO: 3064839 - protein, 13 aa, Giardia lamblia
SSCSSAHSLPPRQ

SEQ ID NO: 3064840 - protein, 10 aa, Giardia lamblia
SSCSSTNRMG

SEQ ID NO: 3064841 - protein, 8 aa, Giardia lamblia
SSDAPVQK

SEQ ID NO: 3064842 - protein, 9 aa, Giardia lamblia
SSDATTLER

SEQ ID NO: 3064843 - protein, 13 aa, Giardia lamblia
SSDDPTTACGGSS

SEQ ID NO: 3064844 - protein, 13 aa, Giardia lamblia
SSDDYQALTTDKQ

SEQ ID NO: 3064845 - protein, 8 aa, Giardia lamblia
SSDEEELV

SEQ ID NO: 3064846 - protein, 12 aa, Giardia lamblia
SSDFSSSVASSM

SEQ ID NO: 3064847 - protein, 6 aa, Giardia lamblia
SSDGSY

SEQ ID NO: 3064848 - protein, 9 aa, Giardia lamblia
SSDHDLASK

SEQ ID NO: 3064849 - protein, 6 aa, Giardia lamblia
SSDIDA

SEQ ID NO: 3064850 - protein, 4 aa, Giardia lamblia
SSDK

SEQ ID NO: 3064851 - protein, 5 aa, Giardia lamblia
SSDLI

SEQ ID NO: 3064852 - protein, 9 aa, Giardia lamblia
SSDNLKPTI

SEQ ID NO: 3064853 - protein, 45 aa, Giardia lamblia
SSDNTAEEVDSKIESRRDDVGSTTLEENSVTPSSFPSNEDHPVAS

SEQ ID NO: 3064854 - protein, 10 aa, Giardia lamblia
SSDNYQPYGS

SEQ ID NO: 3064855 - protein, 9 aa, Giardia lamblia
SSDPDNSEI

SEQ ID NO: 3064856 - protein, 7 aa, Giardia lamblia
SSDPHDI

SEQ ID NO: 3064857 - protein, 4 aa, Giardia lamblia
SSDQ

SEQ ID NO: 3064858 - protein, 5 aa, Giardia lamblia
SSDRS

SEQ ID NO: 3064859 - protein, 12 aa, Giardia lamblia
SSDRSIDSYQEK

SEQ ID NO: 3064860 - protein, 4 aa, Giardia lamblia
SSDS

SEQ ID NO: 3064861 - protein, 15 aa, Giardia lamblia
SSDSDLSDSSNCTAN

SEQ ID NO: 3064862 - protein, 8 aa, Giardia lamblia
SSDSSLNP

SEQ ID NO: 3064863 - protein, 8 aa, Giardia lamblia
SSDTGSSQ

SEQ ID NO: 3064864 - protein, 7 aa, Giardia lamblia
SSDTSLS

SEQ ID NO: 3064865 - protein, 5 aa, Giardia lamblia
SSDVS

SEQ ID NO: 3064866 - protein, 14 aa, Giardia lamblia
SSEAGNKSSLSAGA

SEQ ID NO: 3064867 - protein, 9 aa, Giardia lamblia
SSEAKASSI

SEQ ID NO: 3064868 - protein, 5 aa, Giardia lamblia
SSEDV

SEQ ID NO: 3064869 - protein, 5 aa, Giardia lamblia
SSEEK

SEQ ID NO: 3064870 - protein, 5 aa, Giardia lamblia
SSEEL

SEQ ID NO: 3064871 - protein, 4 aa, Giardia lamblia
SSEG

SEQ ID NO: 3064872 - protein, 5 aa, Giardia lamblia
SSEGH

SEQ ID NO: 3064873 - protein, 8 aa, Giardia lamblia
SSEGHSPE

SEQ ID NO: 3064874 - protein, 6 aa, Giardia lamblia
SSEHDA

SEQ ID NO: 3064875 - protein, 7 aa, Giardia lamblia
SSEHPEL

SEQ ID NO: 3064876 - protein, 7 aa, Giardia lamblia
SSEHSSD

SEQ ID NO: 3064877 - protein, 5 aa, Giardia lamblia
SSEIN

SEQ ID NO: 3064878 - protein, 5 aa, Giardia lamblia
SSELA

SEQ ID NO: 3064879 - protein, 8 aa, Giardia lamblia
SSEMDSKA

SEQ ID NO: 3064880 - protein, 6 aa, Giardia lamblia
SSENPG

SEQ ID NO: 3064881 - protein, 10 aa, Giardia lamblia
SSENTQSYET

SEQ ID NO: 3064882 - protein, 9 aa, Giardia lamblia
SSENVPKQD

SEQ ID NO: 3064883 - protein, 4 aa, Giardia lamblia
SSEP

SEQ ID NO: 3064884 - protein, 5 aa, Giardia lamblia
SSEPV

SEQ ID NO: 3064885 - protein, 4 aa, Giardia lamblia
SSER

SEQ ID NO: 3064886 - protein, 6 aa, Giardia lamblia
SSERCS

SEQ ID NO: 3064887 - protein, 7 aa, Giardia lamblia
SSERHKV

SEQ ID NO: 3064888 - protein, 4 aa, Giardia lamblia
SSES

SEQ ID NO: 3064889 - protein, 12 aa, Giardia lamblia
SSESAEKDNAGE

SEQ ID NO: 3064890 - protein, 6 aa, Giardia lamblia
SSESAS

SEQ ID NO: 3064891 - protein, 9 aa, Giardia lamblia
SSESEGARL

SEQ ID NO: 3064892 - protein, 9 aa, Giardia lamblia
SSESEIKSC

SEQ ID NO: 3064893 - protein, 15 aa, Giardia lamblia
SSESGEDKATSWKSS

SEQ ID NO: 3064894 - protein, 8 aa, Giardia lamblia
SSESGMLP

SEQ ID NO: 3064895 - protein, 7 aa, Giardia lamblia
SSESNAL

SEQ ID NO: 3064896 - protein, 8 aa, Giardia lamblia
SSESSADY

SEQ ID NO: 3064897 - protein, 10 aa, Giardia lamblia
SSESSSTMDK

SEQ ID NO: 3064898 - protein, 4 aa, Giardia lamblia
SSET

SEQ ID NO: 3064899 - protein, 5 aa, Giardia lamblia
SSETG

SEQ ID NO: 3064900 - protein, 7 aa, Giardia lamblia
SSETHKT

SEQ ID NO: 3064901 - protein, 15 aa, Giardia lamblia
SSEYPSDSHLSSGTC

SEQ ID NO: 3064902 - protein, 8 aa, Giardia lamblia
SSFAGTPI

SEQ ID NO: 3064903 - protein, 12 aa, Giardia lamblia
SSFDGADAITSS

SEQ ID NO: 3064904 - protein, 5 aa, Giardia lamblia
SSFED

SEQ ID NO: 3064905 - protein, 6 aa, Giardia lamblia
SSFPAD

SEQ ID NO: 3064906 - protein, 5 aa, Giardia lamblia
SSFRP

SEQ ID NO: 3064907 - protein, 5 aa, Giardia lamblia
SSFSA

SEQ ID NO: 3064908 - protein, 14 aa, Giardia lamblia
SSFSDDVSTHHDPD

SEQ ID NO: 3064909 - protein, 6 aa, Giardia lamblia
SSFSGE

SEQ ID NO: 3064910 - protein, 7 aa, Giardia lamblia
SSFTGSG

SEQ ID NO: 3064911 - protein, 9 aa, Giardia lamblia
SSGAETDTP

SEQ ID NO: 3064912 - protein, 5 aa, Giardia lamblia
SSGAG

SEQ ID NO: 3064913 - protein, 4 aa, Giardia lamblia
SSGE

SEQ ID NO: 3064914 - protein, 7 aa, Giardia lamblia
SSGELSE

SEQ ID NO: 3064915 - protein, 23 aa, Giardia lamblia
SSGESHSSDSNDTDDVVDQEPYT

SEQ ID NO: 3064916 - protein, 12 aa, Giardia lamblia
SSGFPARSTYTK

SEQ ID NO: 3064917 - protein, 5 aa, Giardia lamblia
SSGHS

SEQ ID NO: 3064918 - protein, 5 aa, Giardia lamblia
SSGKF

SEQ ID NO: 3064919 - protein, 23 aa, Giardia lamblia
SSGKRGAASEAGEGTKDKSHIPD

SEQ ID NO: 3064920 - protein, 7 aa, Giardia lamblia
SSGLSKA

SEQ ID NO: 3064921 - protein, 9 aa, Giardia lamblia
SSGNAQNSS

SEQ ID NO: 3064922 - protein, 7 aa, Giardia lamblia
SSGPPQA

SEQ ID NO: 3064923 - protein, 12 aa, Giardia lamblia
SSGPRLQNTDRK

SEQ ID NO: 3064924 - protein, 26 aa, Giardia lamblia
SSGPSMSTSATESVITSSGESSDSEV

SEQ ID NO: 3064925 - protein, 15 aa, Giardia lamblia
SSGPTTDNNKNSCAD

SEQ ID NO: 3064926 - protein, 8 aa, Giardia lamblia
SSGQGSST

SEQ ID NO: 3064927 - protein, 8 aa, Giardia lamblia
SSGQGVDP

SEQ ID NO: 3064928 - protein, 26 aa, Giardia lamblia
SSGQVRSSSQEKCTRDSPLENSDSNR

SEQ ID NO: 3064929 - protein, 7 aa, Giardia lamblia
SSGRISY

SEQ ID NO: 3064930 - protein, 10 aa, Giardia lamblia
SSGSDPKIEK

SEQ ID NO: 3064931 - protein, 8 aa, Giardia lamblia
SSGSSNST

SEQ ID NO: 3064932 - protein, 4 aa, Giardia lamblia
SSGT

SEQ ID NO: 3064933 - protein, 6 aa, Giardia lamblia
SSGTAR

SEQ ID NO: 3064934 - protein, 5 aa, Giardia lamblia
SSGTS

SEQ ID NO: 3064935 - protein, 9 aa, Giardia lamblia
SSGYAGPTC

SEQ ID NO: 3064936 - protein, 23 aa, Giardia lamblia
SSHDMSASKPEPTLASAKRENLV

SEQ ID NO: 3064937 - protein, 5 aa, Giardia lamblia
SSHEN

SEQ ID NO: 3064938 - protein, 8 aa, Giardia lamblia
SSHGRDGN

SEQ ID NO: 3064939 - protein, 5 aa, Giardia lamblia
SSHNP

SEQ ID NO: 3064940 - protein, 23 aa, Giardia lamblia
SSHNVQPSKRSCASGCPSGSESV

SEQ ID NO: 3064941 - protein, 23 aa, Giardia lamblia
SSHNVQPSKRSCASGCPSGSQSV

SEQ ID NO: 3064942 - protein, 6 aa, Giardia lamblia
SSHPIS

SEQ ID NO: 3064943 - protein, 16 aa, Giardia lamblia
SSHSRSLDEYAPRRRK

SEQ ID NO: 3064944 - protein, 10 aa, Giardia lamblia
SSHTSPEDNR

SEQ ID NO: 3064945 - protein, 8 aa, Giardia lamblia
SSIATQSR

SEQ ID NO: 3064946 - protein, 16 aa, Giardia lamblia
SSIAVDPDPNLKTAEE

SEQ ID NO: 3064947 - protein, 6 aa, Giardia lamblia
SSIDGL

SEQ ID NO: 3064948 - protein, 8 aa, Giardia lamblia
SSIDPEKP

SEQ ID NO: 3064949 - protein, 5 aa, Giardia lamblia
SSIGG

SEQ ID NO: 3064950 - protein, 6 aa, Giardia lamblia
SSIKNQ

SEQ ID NO: 3064951 - protein, 16 aa, Giardia lamblia
SSIKSTAEEANDAQTC

SEQ ID NO: 3064952 - protein, 8 aa, Giardia lamblia
SSIPAGQK

SEQ ID NO: 3064953 - protein, 10 aa, Giardia lamblia
SSIPGKLSNQ

SEQ ID NO: 3064954 - protein, 15 aa, Giardia lamblia
SSIPPESDSVSPNAP

SEQ ID NO: 3064955 - protein, 5 aa, Giardia lamblia
SSIRG

SEQ ID NO: 3064956 - protein, 4 aa, Giardia lamblia
SSIS

SEQ ID NO: 3064957 - protein, 20 aa, Giardia lamblia
SSISLSSHDNTANSESEAAS

SEQ ID NO: 3064958 - protein, 9 aa, Giardia lamblia
SSISQTSFS

SEQ ID NO: 3064959 - protein, 5 aa, Giardia lamblia
SSISS

SEQ ID NO: 3064960 - protein, 7 aa, Giardia lamblia
SSISTAA

SEQ ID NO: 3064961 - protein, 4 aa, Giardia lamblia
SSIT

SEQ ID NO: 3064962 - protein, 11 aa, Giardia lamblia
SSITGASPSEI

SEQ ID NO: 3064963 - protein, 7 aa, Giardia lamblia
SSITKSK

SEQ ID NO: 3064964 - protein, 11 aa, Giardia lamblia
SSITSASTMTE

SEQ ID NO: 3064965 - protein, 5 aa, Giardia lamblia
SSKAG

SEQ ID NO: 3064966 - protein, 10 aa, Giardia lamblia
SSKAKTKLQD

SEQ ID NO: 3064967 - protein, 13 aa, Giardia lamblia
SSKASSRPSRASA

SEQ ID NO: 3064968 - protein, 7 aa, Giardia lamblia
SSKDKDV

SEQ ID NO: 3064969 - protein, 16 aa, Giardia lamblia
SSKEDNATDKIRTTPY

SEQ ID NO: 3064970 - protein, 8 aa, Giardia lamblia
SSKESAIH

SEQ ID NO: 3064971 - protein, 7 aa, Giardia lamblia
SSKFGEA

SEQ ID NO: 3064972 - protein, 7 aa, Giardia lamblia
SSKGEDV

SEQ ID NO: 3064973 - protein, 6 aa, Giardia lamblia
SSKGID

SEQ ID NO: 3064974 - protein, 9 aa, Giardia lamblia
SSKGVSSSG

SEQ ID NO: 3064975 - protein, 9 aa, Giardia lamblia
SSKKNNFDG

SEQ ID NO: 3064976 - protein, 24 aa, Giardia lamblia
SSKPEAHTSVTQNGGTNSPHPDTL

SEQ ID NO: 3064977 - protein, 5 aa, Giardia lamblia
SSKQA

SEQ ID NO: 3064978 - protein, 7 aa, Giardia lamblia
SSKQQAA

SEQ ID NO: 3064979 - protein, 6 aa, Giardia lamblia
SSKRNL

SEQ ID NO: 3064980 - protein, 4 aa, Giardia lamblia
SSKS

SEQ ID NO: 3064981 - protein, 6 aa, Giardia lamblia
SSKSDL

SEQ ID NO: 3064982 - protein, 25 aa, Giardia lamblia
SSKTDNSIGAGAERKRSFRSSSASV

SEQ ID NO: 3064983 - protein, 9 aa, Giardia lamblia
SSKTELDTT

SEQ ID NO: 3064984 - protein, 7 aa, Giardia lamblia
SSKTPYV

SEQ ID NO: 3064985 - protein, 8 aa, Giardia lamblia
SSKTSTYE

SEQ ID NO: 3064986 - protein, 17 aa, Giardia lamblia
SSKTVGPVPFSSQSTPL

SEQ ID NO: 3064987 - protein, 9 aa, Giardia lamblia
SSKTYAPHA

SEQ ID NO: 3064988 - protein, 6 aa, Giardia lamblia
SSKYEE

SEQ ID NO: 3064989 - protein, 7 aa, Giardia lamblia
SSKYSKW

SEQ ID NO: 3064990 - protein, 9 aa, Giardia lamblia
SSLAASGAM

SEQ ID NO: 3064991 - protein, 11 aa, Giardia lamblia
SSLAAYDPDLG

SEQ ID NO: 3064992 - protein, 5 aa, Giardia lamblia
SSLAT

SEQ ID NO: 3064993 - protein, 13 aa, Giardia lamblia
SSLATKPLSAGGS

SEQ ID NO: 3064994 - protein, 9 aa, Giardia lamblia
SSLATSATK

SEQ ID NO: 3064995 - protein, 8 aa, Giardia lamblia
SSLATTVT

SEQ ID NO: 3064996 - protein, 5 aa, Giardia lamblia
SSLDD

SEQ ID NO: 3064997 - protein, 7 aa, Giardia lamblia
SSLDGKA

SEQ ID NO: 3064998 - protein, 7 aa, Giardia lamblia
SSLDNEP

SEQ ID NO: 3064999 - protein, 10 aa, Giardia lamblia
SSLDQIGATS

SEQ ID NO: 3065000 - protein, 6 aa, Giardia lamblia
SSLERS

SEQ ID NO: 3065001 - protein, 25 aa, Giardia lamblia
SSLNTSLDDQDDELDPTLDGQGQEL

SEQ ID NO: 3065002 - protein, 7 aa, Giardia lamblia
SSLPAAQ

SEQ ID NO: 3065003 - protein, 6 aa, Giardia lamblia
SSLPDN

SEQ ID NO: 3065004 - protein, 6 aa, Giardia lamblia
SSLPHP

SEQ ID NO: 3065005 - protein, 6 aa, Giardia lamblia
SSLPSR

SEQ ID NO: 3065006 - protein, 6 aa, Giardia lamblia
SSLPTL

SEQ ID NO: 3065007 - protein, 7 aa, Giardia lamblia
SSLQSGP

SEQ ID NO: 3065008 - protein, 12 aa, Giardia lamblia
SSLRETPKRRVR

SEQ ID NO: 3065009 - protein, 18 aa, Giardia lamblia
SSLRGGPSSNSKHDYEDA

SEQ ID NO: 3065010 - protein, 35 aa, Giardia lamblia
SSLRKDDAAVGSAEKGASTSQKKTQQSSNSDNTSS

SEQ ID NO: 3065011 - protein, 6 aa, Giardia lamblia
SSLRTT

SEQ ID NO: 3065012 - protein, 30 aa, Giardia lamblia
SSLSDQKSHLGQKDYASTQSLTSSCESALR

SEQ ID NO: 3065013 - protein, 9 aa, Giardia lamblia
SSLSGTGLD

SEQ ID NO: 3065014 - protein, 5 aa, Giardia lamblia
SSLSP

SEQ ID NO: 3065015 - protein, 6 aa, Giardia lamblia
SSLSPA

SEQ ID NO: 3065016 - protein, 8 aa, Giardia lamblia
SSLTGEQN

SEQ ID NO: 3065017 - protein, 6 aa, Giardia lamblia
SSLTGQ

SEQ ID NO: 3065018 - protein, 15 aa, Giardia lamblia
SSLTSESASGFSART

SEQ ID NO: 3065019 - protein, 6 aa, Giardia lamblia
SSMDNM

SEQ ID NO: 3065020 - protein, 5 aa, Giardia lamblia
SSMDR

SEQ ID NO: 3065021 - protein, 9 aa, Giardia lamblia
SSMRNKSST

SEQ ID NO: 3065022 - protein, 18 aa, Giardia lamblia
SSMVDDGHGEMVSSTKAK

SEQ ID NO: 3065023 - protein, 7 aa, Giardia lamblia
SSNDEAA

SEQ ID NO: 3065024 - protein, 9 aa, Giardia lamblia
SSNDTLDEN

SEQ ID NO: 3065025 - protein, 8 aa, Giardia lamblia
SSNEALKS

SEQ ID NO: 3065026 - protein, 9 aa, Giardia lamblia
SSNEPADTF

SEQ ID NO: 3065027 - protein, 10 aa, Giardia lamblia
SSNFDIPDNQ

SEQ ID NO: 3065028 - protein, 4 aa, Giardia lamblia
SSNG

SEQ ID NO: 3065029 - protein, 15 aa, Giardia lamblia
SSNIERPRSASATHR

SEQ ID NO: 3065030 - protein, 4 aa, Giardia lamblia
SSNL

SEQ ID NO: 3065031 - protein, 9 aa, Giardia lamblia
SSNLAPAES

SEQ ID NO: 3065032 - protein, 6 aa, Giardia lamblia
SSNLDK

SEQ ID NO: 3065033 - protein, 7 aa, Giardia lamblia
SSNLEDQ

SEQ ID NO: 3065034 - protein, 9 aa, Giardia lamblia
SSNQDDREV

SEQ ID NO: 3065035 - protein, 15 aa, Giardia lamblia
SSNSSHLKKKYGTGY

SEQ ID NO: 3065036 - protein, 19 aa, Giardia lamblia
SSNTKTQHNSIASTRKSPS

SEQ ID NO: 3065037 - protein, 4 aa, Giardia lamblia
SSNV

SEQ ID NO: 3065038 - protein, 20 aa, Giardia lamblia
SSNVNERWSGSSSRRSELAA

SEQ ID NO: 3065039 - protein, 4 aa, Giardia lamblia
SSNY

SEQ ID NO: 3065040 - protein, 12 aa, Giardia lamblia
SSPAEKSTASRC

SEQ ID NO: 3065041 - protein, 7 aa, Giardia lamblia
SSPALES

SEQ ID NO: 3065042 - protein, 6 aa, Giardia lamblia
SSPAMR

SEQ ID NO: 3065043 - protein, 12 aa, Giardia lamblia
SSPATEDQIEAS

SEQ ID NO: 3065044 - protein, 11 aa, Giardia lamblia
SSPDASAIGQD

SEQ ID NO: 3065045 - protein, 10 aa, Giardia lamblia
SSPDRSDRPT

SEQ ID NO: 3065046 - protein, 6 aa, Giardia lamblia
SSPDTH

SEQ ID NO: 3065047 - protein, 5 aa, Giardia lamblia
SSPEI

SEQ ID NO: 3065048 - protein, 7 aa, Giardia lamblia
SSPHKTM

SEQ ID NO: 3065049 - protein, 8 aa, Giardia lamblia
SSPHNPKG

SEQ ID NO: 3065050 - protein, 9 aa, Giardia lamblia
SSPIRSKSI

SEQ ID NO: 3065051 - protein, 7 aa, Giardia lamblia
SSPKDDL

SEQ ID NO: 3065052 - protein, 24 aa, Giardia lamblia
SSPKVQHASAKVPSPYALTPTSIK

SEQ ID NO: 3065053 - protein, 6 aa, Giardia lamblia
SSPLDA

SEQ ID NO: 3065054 - protein, 28 aa, Giardia lamblia
SSPLEAKELQEGLSDELNPNQSSDSVRE

SEQ ID NO: 3065055 - protein, 7 aa, Giardia lamblia
SSPLTNP

SEQ ID NO: 3065056 - protein, 10 aa, Giardia lamblia
SSPNKKANRI

SEQ ID NO: 3065057 - protein, 6 aa, Giardia lamblia
SSPNRV

SEQ ID NO: 3065058 - protein, 10 aa, Giardia lamblia
SSPPDSSHVP

SEQ ID NO: 3065059 - protein, 6 aa, Giardia lamblia
SSPPLS

SEQ ID NO: 3065060 - protein, 6 aa, Giardia lamblia
SSPQPW

SEQ ID NO: 3065061 - protein, 4 aa, Giardia lamblia
SSPR

SEQ ID NO: 3065062 - protein, 5 aa, Giardia lamblia
SSPRP

SEQ ID NO: 3065063 - protein, 4 aa, Giardia lamblia
SSPS

SEQ ID NO: 3065064 - protein, 9 aa, Giardia lamblia
SSPSGSSTE

SEQ ID NO: 3065065 - protein, 15 aa, Giardia lamblia
SSPSISTGTQPEGPD

SEQ ID NO: 3065066 - protein, 10 aa, Giardia lamblia
SSPSNNKPAN

SEQ ID NO: 3065067 - protein, 7 aa, Giardia lamblia
SSPTDYR

SEQ ID NO: 3065068 - protein, 6 aa, Giardia lamblia
SSPVYA

SEQ ID NO: 3065069 - protein, 4 aa, Giardia lamblia
SSPY

SEQ ID NO: 3065070 - protein, 4 aa, Giardia lamblia
SSQD

SEQ ID NO: 3065071 - protein, 8 aa, Giardia lamblia
SSQEEANA

SEQ ID NO: 3065072 - protein, 11 aa, Giardia lamblia
SSQEEASEPCQ

SEQ ID NO: 3065073 - protein, 32 aa, Giardia lamblia
SSQESPGESRRRARSKLTQYRTRNASPPTVPI

SEQ ID NO: 3065074 - protein, 8 aa, Giardia lamblia
SSQGDGSL

SEQ ID NO: 3065075 - protein, 7 aa, Giardia lamblia
SSQGDQQ

SEQ ID NO: 3065076 - protein, 9 aa, Giardia lamblia
SSQGEIETG

SEQ ID NO: 3065077 - protein, 7 aa, Giardia lamblia
SSQGKIG

SEQ ID NO: 3065078 - protein, 32 aa, Giardia lamblia
SSQHLRKADASLNSALSAADSKGKMAGEKSFG

SEQ ID NO: 3065079 - protein, 5 aa, Giardia lamblia
SSQIN

SEQ ID NO: 3065080 - protein, 15 aa, Giardia lamblia
SSQKKPTDKGQNLAS

SEQ ID NO: 3065081 - protein, 7 aa, Giardia lamblia
SSQKTME

SEQ ID NO: 3065082 - protein, 4 aa, Giardia lamblia
SSQL

SEQ ID NO: 3065083 - protein, 22 aa, Giardia lamblia
SSQLATESSNNEHQDPSECPDP

SEQ ID NO: 3065084 - protein, 6 aa, Giardia lamblia
SSQLES

SEQ ID NO: 3065085 - protein, 5 aa, Giardia lamblia
SSQLS

SEQ ID NO: 3065086 - protein, 10 aa, Giardia lamblia
SSQNKELETV

SEQ ID NO: 3065087 - protein, 8 aa, Giardia lamblia
SSQPGGFA

SEQ ID NO: 3065088 - protein, 5 aa, Giardia lamblia
SSQPP

SEQ ID NO: 3065089 - protein, 27 aa, Giardia lamblia
SSQPPCASKNPKKAPVHAQNASAIDPF

SEQ ID NO: 3065090 - protein, 7 aa, Giardia lamblia
SSQPVAS

SEQ ID NO: 3065091 - protein, 13 aa, Giardia lamblia
SSQQDQQTSPEKR

SEQ ID NO: 3065092 - protein, 5 aa, Giardia lamblia
SSQRI

SEQ ID NO: 3065093 - protein, 6 aa, Giardia lamblia
SSQRNA

SEQ ID NO: 3065094 - protein, 8 aa, Giardia lamblia
SSQSPRVD

SEQ ID NO: 3065095 - protein, 12 aa, Giardia lamblia
SSQSRIDNNTKA

SEQ ID NO: 3065096 - protein, 7 aa, Giardia lamblia
SSQTDAA

SEQ ID NO: 3065097 - protein, 14 aa, Giardia lamblia
SSQTSLGLRQSSSE

SEQ ID NO: 3065098 - protein, 8 aa, Giardia lamblia
SSQTSPDD

SEQ ID NO: 3065099 - protein, 7 aa, Giardia lamblia
SSQYGPK

SEQ ID NO: 3065100 - protein, 7 aa, Giardia lamblia
SSQYGSQ

SEQ ID NO: 3065101 - protein, 4 aa, Giardia lamblia
SSRA

SEQ ID NO: 3065102 - protein, 7 aa, Giardia lamblia
SSRCGSG

SEQ ID NO: 3065103 - protein, 5 aa, Giardia lamblia
SSREE

SEQ ID NO: 3065104 - protein, 6 aa, Giardia lamblia
SSRELT

SEQ ID NO: 3065105 - protein, 5 aa, Giardia lamblia
SSRET

SEQ ID NO: 3065106 - protein, 7 aa, Giardia lamblia
SSRHSNS

SEQ ID NO: 3065107 - protein, 8 aa, Giardia lamblia
SSRISSET

SEQ ID NO: 3065108 - protein, 9 aa, Giardia lamblia
SSRKVREEA

SEQ ID NO: 3065109 - protein, 9 aa, Giardia lamblia
SSRNTRAAS

SEQ ID NO: 3065110 - protein, 14 aa, Giardia lamblia
SSRPRTDPPSSAKT

SEQ ID NO: 3065111 - protein, 7 aa, Giardia lamblia
SSRPSVT

SEQ ID NO: 3065112 - protein, 6 aa, Giardia lamblia
SSRQSE

SEQ ID NO: 3065113 - protein, 9 aa, Giardia lamblia
SSRQTVNQQ

SEQ ID NO: 3065114 - protein, 8 aa, Giardia lamblia
SSRRKREA

SEQ ID NO: 3065115 - protein, 6 aa, Giardia lamblia
SSRSAG

SEQ ID NO: 3065116 - protein, 16 aa, Giardia lamblia
SSRSIDSVDTSKGSVM

SEQ ID NO: 3065117 - protein, 5 aa, Giardia lamblia
SSRSP

SEQ ID NO: 3065118 - protein, 14 aa, Giardia lamblia
SSRSVGERSAADKA

SEQ ID NO: 3065119 - protein, 6 aa, Giardia lamblia
SSRSYE

SEQ ID NO: 3065120 - protein, 15 aa, Giardia lamblia
SSRTPTGERKDPRAF

SEQ ID NO: 3065121 - protein, 8 aa, Giardia lamblia
SSRTSTYP

SEQ ID NO: 3065122 - protein, 7 aa, Giardia lamblia
SSRVSEG

SEQ ID NO: 3065123 - protein, 6 aa, Giardia lamblia
SSRYAP

SEQ ID NO: 3065124 - protein, 5 aa, Giardia lamblia
SSRYE

SEQ ID NO: 3065125 - protein, 8 aa, Giardia lamblia
SSSAIGDQ

SEQ ID NO: 3065126 - protein, 7 aa, Giardia lamblia
SSSANYS

SEQ ID NO: 3065127 - protein, 7 aa, Giardia lamblia
SSSAPNA

SEQ ID NO: 3065128 - protein, 6 aa, Giardia lamblia
SSSATC

SEQ ID NO: 3065129 - protein, 6 aa, Giardia lamblia
SSSATY

SEQ ID NO: 3065130 - protein, 5 aa, Giardia lamblia
SSSCF

SEQ ID NO: 3065131 - protein, 6 aa, Giardia lamblia
SSSCGD

SEQ ID NO: 3065132 - protein, 25 aa, Giardia lamblia
SSSDAGRDAASSMSLSQGKRSVSAS

SEQ ID NO: 3065133 - protein, 6 aa, Giardia lamblia
SSSDEC

SEQ ID NO: 3065134 - protein, 20 aa, Giardia lamblia
SSSDEDDDALDPGVDAEEAL

SEQ ID NO: 3065135 - protein, 9 aa, Giardia lamblia
SSSDESDVQ

SEQ ID NO: 3065136 - protein, 9 aa, Giardia lamblia
SSSDGSDSI

SEQ ID NO: 3065137 - protein, 11 aa, Giardia lamblia
SSSDNSSISPI

SEQ ID NO: 3065138 - protein, 10 aa, Giardia lamblia
SSSDPDIDAT

SEQ ID NO: 3065139 - protein, 22 aa, Giardia lamblia
SSSEAKSKMESENLPSSYGVSQ

SEQ ID NO: 3065140 - protein, 9 aa, Giardia lamblia
SSSEGSGGF

SEQ ID NO: 3065141 - protein, 8 aa, Giardia lamblia
SSSESNDV

SEQ ID NO: 3065142 - protein, 6 aa, Giardia lamblia
SSSETS

SEQ ID NO: 3065143 - protein, 4 aa, Giardia lamblia
SSSF

SEQ ID NO: 3065144 - protein, 5 aa, Giardia lamblia
SSSFR

SEQ ID NO: 3065145 - protein, 5 aa, Giardia lamblia
SSSGF

SEQ ID NO: 3065146 - protein, 6 aa, Giardia lamblia
SSSGLT

SEQ ID NO: 3065147 - protein, 4 aa, Giardia lamblia
SSSI

SEQ ID NO: 3065148 - protein, 20 aa, Giardia lamblia
SSSIADSSQQRGEDKYRNTS

SEQ ID NO: 3065149 - protein, 13 aa, Giardia lamblia
SSSIPRDASHTAY

SEQ ID NO: 3065150 - protein, 7 aa, Giardia lamblia
SSSITPS

SEQ ID NO: 3065151 - protein, 9 aa, Giardia lamblia
SSSKAHPSF

SEQ ID NO: 3065152 - protein, 30 aa, Giardia lamblia
SSSKSPPPPPPPLSQPQQFDKKENRTQRLP

SEQ ID NO: 3065153 - protein, 4 aa, Giardia lamblia
SSSL

SEQ ID NO: 3065154 - protein, 5 aa, Giardia lamblia
SSSLD

SEQ ID NO: 3065155 - protein, 10 aa, Giardia lamblia
SSSLSEDHSP

SEQ ID NO: 3065156 - protein, 10 aa, Giardia lamblia
SSSNPDTAAM

SEQ ID NO: 3065157 - protein, 7 aa, Giardia lamblia
SSSNVKP

SEQ ID NO: 3065158 - protein, 9 aa, Giardia lamblia
SSSNWSNPQ

SEQ ID NO: 3065159 - protein, 15 aa, Giardia lamblia
SSSPAGTSSRSSLSV

SEQ ID NO: 3065160 - protein, 8 aa, Giardia lamblia
SSSPGNYA

SEQ ID NO: 3065161 - protein, 17 aa, Giardia lamblia
SSSPGVSKALSSVKPNN

SEQ ID NO: 3065162 - protein, 7 aa, Giardia lamblia
SSSPKYL

SEQ ID NO: 3065163 - protein, 9 aa, Giardia lamblia
SSSPNVATQ

SEQ ID NO: 3065164 - protein, 7 aa, Giardia lamblia
SSSPPSA

SEQ ID NO: 3065165 - protein, 6 aa, Giardia lamblia
SSSPPT

SEQ ID NO: 3065166 - protein, 8 aa, Giardia lamblia
SSSPSENR

SEQ ID NO: 3065167 - protein, 10 aa, Giardia lamblia
SSSPSQSSDM

SEQ ID NO: 3065168 - protein, 9 aa, Giardia lamblia
SSSPSTPVM

SEQ ID NO: 3065169 - protein, 5 aa, Giardia lamblia
SSSRD

SEQ ID NO: 3065170 - protein, 9 aa, Giardia lamblia
SSSRKTEVS

SEQ ID NO: 3065171 - protein, 8 aa, Giardia lamblia
SSSRLPGS

SEQ ID NO: 3065172 - protein, 10 aa, Giardia lamblia
SSSRMTNPVK

SEQ ID NO: 3065173 - protein, 9 aa, Giardia lamblia
SSSRNSAKM

SEQ ID NO: 3065174 - protein, 20 aa, Giardia lamblia
SSSRSSPTDSILPDTQNPVY

SEQ ID NO: 3065175 - protein, 9 aa, Giardia lamblia
SSSSDHNKA

SEQ ID NO: 3065176 - protein, 9 aa, Giardia lamblia
SSSSFANAP

SEQ ID NO: 3065177 - protein, 8 aa, Giardia lamblia
SSSSIDET

SEQ ID NO: 3065178 - protein, 8 aa, Giardia lamblia
SSSSQKAA

SEQ ID NO: 3065179 - protein, 8 aa, Giardia lamblia
SSSSSAAP

SEQ ID NO: 3065180 - protein, 6 aa, Giardia lamblia
SSSSTM

SEQ ID NO: 3065181 - protein, 9 aa, Giardia lamblia
SSSSTQGLC

SEQ ID NO: 3065182 - protein, 23 aa, Giardia lamblia
SSSSVSASTSQNDSGTIPPFSSD

SEQ ID NO: 3065183 - protein, 8 aa, Giardia lamblia
SSSTALTS

SEQ ID NO: 3065184 - protein, 7 aa, Giardia lamblia
SSSTELR

SEQ ID NO: 3065185 - protein, 12 aa, Giardia lamblia
SSSTLGVDGHND

SEQ ID NO: 3065186 - protein, 11 aa, Giardia lamblia
SSSTNISKQSV

SEQ ID NO: 3065187 - protein, 7 aa, Giardia lamblia
SSSTNSM

SEQ ID NO: 3065188 - protein, 13 aa, Giardia lamblia
SSSTSNTSKRPVT

SEQ ID NO: 3065189 - protein, 10 aa, Giardia lamblia
SSSTTATTSD

SEQ ID NO: 3065190 - protein, 13 aa, Giardia lamblia
SSSTTQNYNPGTI

SEQ ID NO: 3065191 - protein, 10 aa, Giardia lamblia
SSSTTYSSDE

SEQ ID NO: 3065192 - protein, 8 aa, Giardia lamblia
SSSVPQNI

SEQ ID NO: 3065193 - protein, 23 aa, Giardia lamblia
SSSVQSGDPLSQSEQSLQSTDSL

SEQ ID NO: 3065194 - protein, 7 aa, Giardia lamblia
SSSVQTR

SEQ ID NO: 3065195 - protein, 4 aa, Giardia lamblia
SSSY

SEQ ID NO: 3065196 - protein, 9 aa, Giardia lamblia
SSTAPKEKL

SEQ ID NO: 3065197 - protein, 18 aa, Giardia lamblia
SSTAQRISPHPPLEDGTP

SEQ ID NO: 3065198 - protein, 8 aa, Giardia lamblia
SSTASGVS

SEQ ID NO: 3065199 - protein, 7 aa, Giardia lamblia
SSTASQD

SEQ ID NO: 3065200 - protein, 7 aa, Giardia lamblia
SSTDTAP

SEQ ID NO: 3065201 - protein, 7 aa, Giardia lamblia
SSTENPA

SEQ ID NO: 3065202 - protein, 7 aa, Giardia lamblia
SSTEPME

SEQ ID NO: 3065203 - protein, 15 aa, Giardia lamblia
SSTEVSCSEDEFQEN

SEQ ID NO: 3065204 - protein, 11 aa, Giardia lamblia
SSTEVTYETPL

SEQ ID NO: 3065205 - protein, 7 aa, Giardia lamblia
SSTGCTT

SEQ ID NO: 3065206 - protein, 7 aa, Giardia lamblia
SSTGESA

SEQ ID NO: 3065207 - protein, 15 aa, Giardia lamblia
SSTHTASLGPSVSVG

SEQ ID NO: 3065208 - protein, 6 aa, Giardia lamblia
SSTIES

SEQ ID NO: 3065209 - protein, 10 aa, Giardia lamblia
SSTKTQCAAR

SEQ ID NO: 3065210 - protein, 9 aa, Giardia lamblia
SSTLKSANS

SEQ ID NO: 3065211 - protein, 16 aa, Giardia lamblia
SSTLRTNPCPSGQQNF

SEQ ID NO: 3065212 - protein, 4 aa, Giardia lamblia
SSTM

SEQ ID NO: 3065213 - protein, 11 aa, Giardia lamblia
SSTNDATVNNE

SEQ ID NO: 3065214 - protein, 7 aa, Giardia lamblia
SSTNDPN

SEQ ID NO: 3065215 - protein, 6 aa, Giardia lamblia
SSTNFA

SEQ ID NO: 3065216 - protein, 6 aa, Giardia lamblia
SSTNKL

SEQ ID NO: 3065217 - protein, 9 aa, Giardia lamblia
SSTNQGTDH

SEQ ID NO: 3065218 - protein, 7 aa, Giardia lamblia
SSTPERR

SEQ ID NO: 3065219 - protein, 9 aa, Giardia lamblia
SSTPGKTEP

SEQ ID NO: 3065220 - protein, 5 aa, Giardia lamblia
SSTPL

SEQ ID NO: 3065221 - protein, 8 aa, Giardia lamblia
SSTPSGQF

SEQ ID NO: 3065222 - protein, 6 aa, Giardia lamblia
SSTQAL

SEQ ID NO: 3065223 - protein, 16 aa, Giardia lamblia
SSTQPKEVTDVRSQSR

SEQ ID NO: 3065224 - protein, 11 aa, Giardia lamblia
SSTQSGSTFTG

SEQ ID NO: 3065225 - protein, 9 aa, Giardia lamblia
SSTRKVTSV

SEQ ID NO: 3065226 - protein, 5 aa, Giardia lamblia
SSTRV

SEQ ID NO: 3065227 - protein, 4 aa, Giardia lamblia
SSTS

SEQ ID NO: 3065228 - protein, 25 aa, Giardia lamblia
SSTSESSEYSAADSNVDCKNEGNVS

SEQ ID NO: 3065229 - protein, 7 aa, Giardia lamblia
SSTSKGI

SEQ ID NO: 3065230 - protein, 8 aa, Giardia lamblia
SSTSPHKK

SEQ ID NO: 3065231 - protein, 6 aa, Giardia lamblia
SSTSPV

SEQ ID NO: 3065232 - protein, 9 aa, Giardia lamblia
SSTSRTVCS

SEQ ID NO: 3065233 - protein, 7 aa, Giardia lamblia
SSTSTPS

SEQ ID NO: 3065234 - protein, 4 aa, Giardia lamblia
SSTT

SEQ ID NO: 3065235 - protein, 14 aa, Giardia lamblia
SSTTGTRPLARSNS

SEQ ID NO: 3065236 - protein, 25 aa, Giardia lamblia
SSTTLNNENASTREENSRGSPTEET

SEQ ID NO: 3065237 - protein, 4 aa, Giardia lamblia
SSTV

SEQ ID NO: 3065238 - protein, 5 aa, Giardia lamblia
SSTVE

SEQ ID NO: 3065239 - protein, 10 aa, Giardia lamblia
SSVAGGSASV

SEQ ID NO: 3065240 - protein, 7 aa, Giardia lamblia
SSVASSS

SEQ ID NO: 3065241 - protein, 19 aa, Giardia lamblia
SSVEPPLKQSKTPSNPRNE

SEQ ID NO: 3065242 - protein, 23 aa, Giardia lamblia
SSVESTNDEDFSDAQAGTPSKAL

SEQ ID NO: 3065243 - protein, 7 aa, Giardia lamblia
SSVGKTE

SEQ ID NO: 3065244 - protein, 23 aa, Giardia lamblia
SSVGSTSSALSTQNTHTSEGTSV

SEQ ID NO: 3065245 - protein, 9 aa, Giardia lamblia
SSVKKGTSE

SEQ ID NO: 3065246 - protein, 11 aa, Giardia lamblia
SSVKKKMQRSC

SEQ ID NO: 3065247 - protein, 8 aa, Giardia lamblia
SSVNTSVR

SEQ ID NO: 3065248 - protein, 7 aa, Giardia lamblia
SSVPRTS

SEQ ID NO: 3065249 - protein, 6 aa, Giardia lamblia
SSVPSI

SEQ ID NO: 3065250 - protein, 10 aa, Giardia lamblia
SSVPSPQRLE

SEQ ID NO: 3065251 - protein, 4 aa, Giardia lamblia
SSVQ

SEQ ID NO: 3065252 - protein, 12 aa, Giardia lamblia
SSVSAPSASSVP

SEQ ID NO: 3065253 - protein, 7 aa, Giardia lamblia
SSVSEET

SEQ ID NO: 3065254 - protein, 12 aa, Giardia lamblia
SSVSNTAANEAS

SEQ ID NO: 3065255 - protein, 5 aa, Giardia lamblia
SSVSS

SEQ ID NO: 3065256 - protein, 12 aa, Giardia lamblia
SSVTASVGKESA

SEQ ID NO: 3065257 - protein, 7 aa, Giardia lamblia
SSVTETE

SEQ ID NO: 3065258 - protein, 6 aa, Giardia lamblia
SSYAEL

SEQ ID NO: 3065259 - protein, 25 aa, Giardia lamblia
SSYAGYGGKRANGTDCTVDEAESMA

SEQ ID NO: 3065260 - protein, 7 aa, Giardia lamblia
SSYAKRA

SEQ ID NO: 3065261 - protein, 5 aa, Giardia lamblia
SSYEQ

SEQ ID NO: 3065262 - protein, 6 aa, Giardia lamblia
SSYEQS

SEQ ID NO: 3065263 - protein, 7 aa, Giardia lamblia
SSYKETS

SEQ ID NO: 3065264 - protein, 27 aa, Giardia lamblia
SSYMANSSTVDAAPEKSSSKGKQTSLR

SEQ ID NO: 3065265 - protein, 8 aa, Giardia lamblia
SSYPHQSI

SEQ ID NO: 3065266 - protein, 12 aa, Giardia lamblia
SSYPTTSTGFPN

SEQ ID NO: 3065267 - protein, 12 aa, Giardia lamblia
SSYRTTLGGRCS

SEQ ID NO: 3065268 - protein, 9 aa, Giardia lamblia
SSYSDEANA

SEQ ID NO: 3065269 - protein, 6 aa, Giardia lamblia
SSYSRV

SEQ ID NO: 3065270 - protein, 5 aa, Giardia lamblia
SSYSS

SEQ ID NO: 3065271 - protein, 40 aa, Giardia lamblia
SSYTKHNPASLHRDSAYDATYDVPEDDGISKNYGTRRSSA

SEQ ID NO: 3065272 - protein, 7 aa, Giardia lamblia
SSYTTYS

SEQ ID NO: 3065273 - protein, 6 aa, Giardia lamblia
STAARE

SEQ ID NO: 3065274 - protein, 9 aa, Giardia lamblia
STAATEEGQ

SEQ ID NO: 3065275 - protein, 11 aa, Giardia lamblia
STAAYKANSAV

SEQ ID NO: 3065276 - protein, 6 aa, Giardia lamblia
STADHA

SEQ ID NO: 3065277 - protein, 15 aa, Giardia lamblia
STAEPSSNGTTTTIQ

SEQ ID NO: 3065278 - protein, 5 aa, Giardia lamblia
STAGG

SEQ ID NO: 3065279 - protein, 7 aa, Giardia lamblia
STAGGTF

SEQ ID NO: 3065280 - protein, 9 aa, Giardia lamblia
STAGTSSPL

SEQ ID NO: 3065281 - protein, 6 aa, Giardia lamblia
STAHQA

SEQ ID NO: 3065282 - protein, 9 aa, Giardia lamblia
STAKPGLRT

SEQ ID NO: 3065283 - protein, 41 aa, Giardia lamblia
STALTESRLKRNSTMTRSRASGFYGADDDDDRLSSVSQSGF

SEQ ID NO: 3065284 - protein, 9 aa, Giardia lamblia
STANQTNIT

SEQ ID NO: 3065285 - protein, 6 aa, Giardia lamblia
STAPGS

SEQ ID NO: 3065286 - protein, 12 aa, Giardia lamblia
STAQSNGATMSN

SEQ ID NO: 3065287 - protein, 4 aa, Giardia lamblia
STAS

SEQ ID NO: 3065288 - protein, 7 aa, Giardia lamblia
STASHDS

SEQ ID NO: 3065289 - protein, 7 aa, Giardia lamblia
STASNGV

SEQ ID NO: 3065290 - protein, 10 aa, Giardia lamblia
STASQGTTDH

SEQ ID NO: 3065291 - protein, 6 aa, Giardia lamblia
STATDV

SEQ ID NO: 3065292 - protein, 6 aa, Giardia lamblia
STATSV

SEQ ID NO: 3065293 - protein, 9 aa, Giardia lamblia
STCASAGDN

SEQ ID NO: 3065294 - protein, 14 aa, Giardia lamblia
STCGGTPSDSGTYC

SEQ ID NO: 3065295 - protein, 11 aa, Giardia lamblia
STCNDGSSAGC

SEQ ID NO: 3065296 - protein, 11 aa, Giardia lamblia
STCNDGSSTGC

SEQ ID NO: 3065297 - protein, 11 aa, Giardia lamblia
STCNNGSSTGC

SEQ ID NO: 3065298 - protein, 18 aa, Giardia lamblia
STCNTTGENAPAEQVDSN

SEQ ID NO: 3065299 - protein, 7 aa, Giardia lamblia
STCSGPS

SEQ ID NO: 3065300 - protein, 5 aa, Giardia lamblia
STCSP

SEQ ID NO: 3065301 - protein, 7 aa, Giardia lamblia
STCSSRE

SEQ ID NO: 3065302 - protein, 4 aa, Giardia lamblia
STCT

SEQ ID NO: 3065303 - protein, 9 aa, Giardia lamblia
STCTGAGDS

SEQ ID NO: 3065304 - protein, 6 aa, Giardia lamblia
STCTSC

SEQ ID NO: 3065305 - protein, 4 aa, Giardia lamblia
STCV

SEQ ID NO: 3065306 - protein, 14 aa, Giardia lamblia
STCVPDDTSSPTRC

SEQ ID NO: 3065307 - protein, 30 aa, Giardia lamblia
STDAPAPCYKSSNDALTYPSNSSSEDSPNL

SEQ ID NO: 3065308 - protein, 5 aa, Giardia lamblia
STDDK

SEQ ID NO: 3065309 - protein, 14 aa, Giardia lamblia
STDDVEKAEYAAAT

SEQ ID NO: 3065310 - protein, 13 aa, Giardia lamblia
STDDVERPEHTDT

SEQ ID NO: 3065311 - protein, 4 aa, Giardia lamblia
STDE

SEQ ID NO: 3065312 - protein, 5 aa, Giardia lamblia
STDEF

SEQ ID NO: 3065313 - protein, 6 aa, Giardia lamblia
STDGAQ

SEQ ID NO: 3065314 - protein, 5 aa, Giardia lamblia
STDGF

SEQ ID NO: 3065315 - protein, 10 aa, Giardia lamblia
STDGILPKPD

SEQ ID NO: 3065316 - protein, 10 aa, Giardia lamblia
STDGTIPPSD

SEQ ID NO: 3065317 - protein, 7 aa, Giardia lamblia
STDGTPS

SEQ ID NO: 3065318 - protein, 8 aa, Giardia lamblia
STDPTKSY

SEQ ID NO: 3065319 - protein, 15 aa, Giardia lamblia
STDQDQSPATDGYDE

SEQ ID NO: 3065320 - protein, 6 aa, Giardia lamblia
STDRPV

SEQ ID NO: 3065321 - protein, 13 aa, Giardia lamblia
STDRRSKCQITGS

SEQ ID NO: 3065322 - protein, 4 aa, Giardia lamblia
STDS

SEQ ID NO: 3065323 - protein, 7 aa, Giardia lamblia
STDSAGS

SEQ ID NO: 3065324 - protein, 8 aa, Giardia lamblia
STDTDLSA

SEQ ID NO: 3065325 - protein, 6 aa, Giardia lamblia
STECST

SEQ ID NO: 3065326 - protein, 4 aa, Giardia lamblia
STEE

SEQ ID NO: 3065327 - protein, 10 aa, Giardia lamblia
STEETSDLQI

SEQ ID NO: 3065328 - protein, 10 aa, Giardia lamblia
STEGTEPPYC

SEQ ID NO: 3065329 - protein, 5 aa, Giardia lamblia
STEGV

SEQ ID NO: 3065330 - protein, 5 aa, Giardia lamblia
STEIT

SEQ ID NO: 3065331 - protein, 7 aa, Giardia lamblia
STEKYTD

SEQ ID NO: 3065332 - protein, 9 aa, Giardia lamblia
STELATDND

SEQ ID NO: 3065333 - protein, 14 aa, Giardia lamblia
STELTKRSRSLESP

SEQ ID NO: 3065334 - protein, 10 aa, Giardia lamblia
STESGGRLSS

SEQ ID NO: 3065335 - protein, 4 aa, Giardia lamblia
STET

SEQ ID NO: 3065336 - protein, 6 aa, Giardia lamblia
STETRY

SEQ ID NO: 3065337 - protein, 13 aa, Giardia lamblia
STETSVSQKKPVT

SEQ ID NO: 3065338 - protein, 7 aa, Giardia lamblia
STEVDER

SEQ ID NO: 3065339 - protein, 8 aa, Giardia lamblia
STEVSEQS

SEQ ID NO: 3065340 - protein, 17 aa, Giardia lamblia
STEYTVQDDSLPSTDTY

SEQ ID NO: 3065341 - protein, 15 aa, Giardia lamblia
STFGSPSCGNNASNN

SEQ ID NO: 3065342 - protein, 5 aa, Giardia lamblia
STFST

SEQ ID NO: 3065343 - protein, 8 aa, Giardia lamblia
STGAGQPN

SEQ ID NO: 3065344 - protein, 16 aa, Giardia lamblia
STGANQYASTDDCSGC

SEQ ID NO: 3065345 - protein, 19 aa, Giardia lamblia
STGAPPENGKCPAATPGCH

SEQ ID NO: 3065346 - protein, 8 aa, Giardia lamblia
STGARKNV

SEQ ID NO: 3065347 - protein, 12 aa, Giardia lamblia
STGDDTLSTAND

SEQ ID NO: 3065348 - protein, 9 aa, Giardia lamblia
STGDEASKQ

SEQ ID NO: 3065349 - protein, 5 aa, Giardia lamblia
STGEA

SEQ ID NO: 3065350 - protein, 6 aa, Giardia lamblia
STGGET

SEQ ID NO: 3065351 - protein, 6 aa, Giardia lamblia
STGGLS

SEQ ID NO: 3065352 - protein, 5 aa, Giardia lamblia
STGIA

SEQ ID NO: 3065353 - protein, 24 aa, Giardia lamblia
STGISSDHEGSKDSPNDKSGLPSA

SEQ ID NO: 3065354 - protein, 14 aa, Giardia lamblia
STGKASGSDKLPAP

SEQ ID NO: 3065355 - protein, 11 aa, Giardia lamblia
STGKGRDRERK

SEQ ID NO: 3065356 - protein, 7 aa, Giardia lamblia
STGLDPI

SEQ ID NO: 3065357 - protein, 6 aa, Giardia lamblia
STGNFG

SEQ ID NO: 3065358 - protein, 5 aa, Giardia lamblia
STGQV

SEQ ID NO: 3065359 - protein, 8 aa, Giardia lamblia
STGREQAY

SEQ ID NO: 3065360 - protein, 5 aa, Giardia lamblia
STGRN

SEQ ID NO: 3065361 - protein, 36 aa, Giardia lamblia
STGSLSKSSSFSKSKSSLPPLTTSTVPNDGATTQQT

SEQ ID NO: 3065362 - protein, 12 aa, Giardia lamblia
STGSPSKQSNVA

SEQ ID NO: 3065363 - protein, 6 aa, Giardia lamblia
STGSTN

SEQ ID NO: 3065364 - protein, 10 aa, Giardia lamblia
STGTSLEGQF

SEQ ID NO: 3065365 - protein, 5 aa, Giardia lamblia
STGYK

SEQ ID NO: 3065366 - protein, 4 aa, Giardia lamblia
STHA

SEQ ID NO: 3065367 - protein, 6 aa, Giardia lamblia
STHAAD

SEQ ID NO: 3065368 - protein, 13 aa, Giardia lamblia
STHARRRKSHATA

SEQ ID NO: 3065369 - protein, 4 aa, Giardia lamblia
STHP

SEQ ID NO: 3065370 - protein, 22 aa, Giardia lamblia
STHSTEPQKSPVRSQSQVTHSN

SEQ ID NO: 3065371 - protein, 7 aa, Giardia lamblia
STIDQPA

SEQ ID NO: 3065372 - protein, 7 aa, Giardia lamblia
STINESS

SEQ ID NO: 3065373 - protein, 7 aa, Giardia lamblia
STISANS

SEQ ID NO: 3065374 - protein, 9 aa, Giardia lamblia
STISGPLKG

SEQ ID NO: 3065375 - protein, 5 aa, Giardia lamblia
STISR

SEQ ID NO: 3065376 - protein, 9 aa, Giardia lamblia
STISVTSTG

SEQ ID NO: 3065377 - protein, 6 aa, Giardia lamblia
STITDL

SEQ ID NO: 3065378 - protein, 7 aa, Giardia lamblia
STKAANV

SEQ ID NO: 3065379 - protein, 7 aa, Giardia lamblia
STKAEMR

SEQ ID NO: 3065380 - protein, 22 aa, Giardia lamblia
STKASSTRLTDSTLGNSKLNKP

SEQ ID NO: 3065381 - protein, 13 aa, Giardia lamblia
STKEQSVAPRITS

SEQ ID NO: 3065382 - protein, 10 aa, Giardia lamblia
STKERKQSRF

SEQ ID NO: 3065383 - protein, 7 aa, Giardia lamblia
STKERQG

SEQ ID NO: 3065384 - protein, 10 aa, Giardia lamblia
STKHTKATVS

SEQ ID NO: 3065385 - protein, 4 aa, Giardia lamblia
STKI

SEQ ID NO: 3065386 - protein, 9 aa, Giardia lamblia
STKNGDSSL

SEQ ID NO: 3065387 - protein, 7 aa, Giardia lamblia
STKPPNE

SEQ ID NO: 3065388 - protein, 4 aa, Giardia lamblia
STKQ

SEQ ID NO: 3065389 - protein, 23 aa, Giardia lamblia
STKQQAKPGSADIRAPEQSTMSQ

SEQ ID NO: 3065390 - protein, 9 aa, Giardia lamblia
STKSSHGRL

SEQ ID NO: 3065391 - protein, 36 aa, Giardia lamblia
STKSTAEGTKQLPRGRDSSSTSASRYKDVSSNSATL

SEQ ID NO: 3065392 - protein, 7 aa, Giardia lamblia
STKVQPH

SEQ ID NO: 3065393 - protein, 16 aa, Giardia lamblia
STKVSESVKPQEDGKI

SEQ ID NO: 3065394 - protein, 8 aa, Giardia lamblia
STKWGTRP

SEQ ID NO: 3065395 - protein, 7 aa, Giardia lamblia
STKYERP

SEQ ID NO: 3065396 - protein, 12 aa, Giardia lamblia
STLDQDKEAYTS

SEQ ID NO: 3065397 - protein, 16 aa, Giardia lamblia
STLETSKPTESDKAQW

SEQ ID NO: 3065398 - protein, 17 aa, Giardia lamblia
STLKPIPKRDVDAHDNE

SEQ ID NO: 3065399 - protein, 5 aa, Giardia lamblia
STLKS

SEQ ID NO: 3065400 - protein, 14 aa, Giardia lamblia
STLPEGDSTICGGP

SEQ ID NO: 3065401 - protein, 4 aa, Giardia lamblia
STLS

SEQ ID NO: 3065402 - protein, 6 aa, Giardia lamblia
STLSEI

SEQ ID NO: 3065403 - protein, 13 aa, Giardia lamblia
STLSSASASSEKN

SEQ ID NO: 3065404 - protein, 6 aa, Giardia lamblia
STLSTL

SEQ ID NO: 3065405 - protein, 5 aa, Giardia lamblia
STMKD

SEQ ID NO: 3065406 - protein, 10 aa, Giardia lamblia
STMPSKPAIL

SEQ ID NO: 3065407 - protein, 13 aa, Giardia lamblia
STMSSTDKQDLRD

SEQ ID NO: 3065408 - protein, 9 aa, Giardia lamblia
STNAQQQQN

SEQ ID NO: 3065409 - protein, 8 aa, Giardia lamblia
STNATLSG

SEQ ID NO: 3065410 - protein, 8 aa, Giardia lamblia
STNDAAAR

SEQ ID NO: 3065411 - protein, 7 aa, Giardia lamblia
STNEGGT

SEQ ID NO: 3065412 - protein, 8 aa, Giardia lamblia
STNEITSD

SEQ ID NO: 3065413 - protein, 8 aa, Giardia lamblia
STNGGATD

SEQ ID NO: 3065414 - protein, 7 aa, Giardia lamblia
STNGINQ

SEQ ID NO: 3065415 - protein, 8 aa, Giardia lamblia
STNGPQEL

SEQ ID NO: 3065416 - protein, 12 aa, Giardia lamblia
STNGYSAPSNIS

SEQ ID NO: 3065417 - protein, 4 aa, Giardia lamblia
STNH

SEQ ID NO: 3065418 - protein, 6 aa, Giardia lamblia
STNIKS

SEQ ID NO: 3065419 - protein, 6 aa, Giardia lamblia
STNKFQ

SEQ ID NO: 3065420 - protein, 17 aa, Giardia lamblia
STNLNRTDKSGTTDDTD

SEQ ID NO: 3065421 - protein, 6 aa, Giardia lamblia
STNLST

SEQ ID NO: 3065422 - protein, 7 aa, Giardia lamblia
STNNYKD

SEQ ID NO: 3065423 - protein, 5 aa, Giardia lamblia
STNPA

SEQ ID NO: 3065424 - protein, 9 aa, Giardia lamblia
STNPDAHES

SEQ ID NO: 3065425 - protein, 4 aa, Giardia lamblia
STNS

SEQ ID NO: 3065426 - protein, 13 aa, Giardia lamblia
STNSMSDPSAFSK

SEQ ID NO: 3065427 - protein, 9 aa, Giardia lamblia
STNSTDSRT

SEQ ID NO: 3065428 - protein, 15 aa, Giardia lamblia
STNTADTFRPSATEQ

SEQ ID NO: 3065429 - protein, 8 aa, Giardia lamblia
STNTIGSA

SEQ ID NO: 3065430 - protein, 8 aa, Giardia lamblia
STNTPTNY

SEQ ID NO: 3065431 - protein, 7 aa, Giardia lamblia
STNTSNY

SEQ ID NO: 3065432 - protein, 5 aa, Giardia lamblia
STPAA

SEQ ID NO: 3065433 - protein, 9 aa, Giardia lamblia
STPAEDPQT

SEQ ID NO: 3065434 - protein, 15 aa, Giardia lamblia
STPASRQKAERMAEG

SEQ ID NO: 3065435 - protein, 9 aa, Giardia lamblia
STPDDEARY

SEQ ID NO: 3065436 - protein, 10 aa, Giardia lamblia
STPDMYGDTS

SEQ ID NO: 3065437 - protein, 24 aa, Giardia lamblia
STPDTGSPAVEAEESPQRQTREEK

SEQ ID NO: 3065438 - protein, 5 aa, Giardia lamblia
STPET

SEQ ID NO: 3065439 - protein, 7 aa, Giardia lamblia
STPGRPI

SEQ ID NO: 3065440 - protein, 5 aa, Giardia lamblia
STPIA

SEQ ID NO: 3065441 - protein, 5 aa, Giardia lamblia
STPID

SEQ ID NO: 3065442 - protein, 5 aa, Giardia lamblia
STPIN

SEQ ID NO: 3065443 - protein, 13 aa, Giardia lamblia
STPITDAPHSRVP

SEQ ID NO: 3065444 - protein, 7 aa, Giardia lamblia
STPKEPY

SEQ ID NO: 3065445 - protein, 9 aa, Giardia lamblia
STPKSQSPI

SEQ ID NO: 3065446 - protein, 7 aa, Giardia lamblia
STPLDNP

SEQ ID NO: 3065447 - protein, 7 aa, Giardia lamblia
STPLTPD

SEQ ID NO: 3065448 - protein, 12 aa, Giardia lamblia
STPNHYTSEPET

SEQ ID NO: 3065449 - protein, 8 aa, Giardia lamblia
STPPQNAS

SEQ ID NO: 3065450 - protein, 4 aa, Giardia lamblia
STPS

SEQ ID NO: 3065451 - protein, 7 aa, Giardia lamblia
STPSAEN

SEQ ID NO: 3065452 - protein, 5 aa, Giardia lamblia
STPSG

SEQ ID NO: 3065453 - protein, 13 aa, Giardia lamblia
STPSLYKASPDAK

SEQ ID NO: 3065454 - protein, 14 aa, Giardia lamblia
STPSSGASSQTEPV

SEQ ID NO: 3065455 - protein, 5 aa, Giardia lamblia
STPTS

SEQ ID NO: 3065456 - protein, 16 aa, Giardia lamblia
STPYRGSSPSTAQHTP

SEQ ID NO: 3065457 - protein, 9 aa, Giardia lamblia
STQDSSQYA

SEQ ID NO: 3065458 - protein, 8 aa, Giardia lamblia
STQEEAGP

SEQ ID NO: 3065459 - protein, 6 aa, Giardia lamblia
STQHGE

SEQ ID NO: 3065460 - protein, 21 aa, Giardia lamblia
STQPPSPPDDTAISEASYKNI

SEQ ID NO: 3065461 - protein, 17 aa, Giardia lamblia
STQPQNETGSRSNATGI

SEQ ID NO: 3065462 - protein, 14 aa, Giardia lamblia
STQRTGEGLYAPSD

SEQ ID NO: 3065463 - protein, 4 aa, Giardia lamblia
STQT

SEQ ID NO: 3065464 - protein, 5 aa, Giardia lamblia
STRAM

SEQ ID NO: 3065465 - protein, 23 aa, Giardia lamblia
STRDKWKRADQTSKNRADESQSA

SEQ ID NO: 3065466 - protein, 5 aa, Giardia lamblia
STRDL

SEQ ID NO: 3065467 - protein, 6 aa, Giardia lamblia
STRGFQ

SEQ ID NO: 3065468 - protein, 10 aa, Giardia lamblia
STRKSSCPDR

SEQ ID NO: 3065469 - protein, 8 aa, Giardia lamblia
STRLSPSW

SEQ ID NO: 3065470 - protein, 6 aa, Giardia lamblia
STRMSS

SEQ ID NO: 3065471 - protein, 5 aa, Giardia lamblia
STRNA

SEQ ID NO: 3065472 - protein, 6 aa, Giardia lamblia
STRNDY

SEQ ID NO: 3065473 - protein, 5 aa, Giardia lamblia
STRPL

SEQ ID NO: 3065474 - protein, 7 aa, Giardia lamblia
STRPPYA

SEQ ID NO: 3065475 - protein, 15 aa, Giardia lamblia
STRSKHYDTDLPEDQ

SEQ ID NO: 3065476 - protein, 5 aa, Giardia lamblia
STRSY

SEQ ID NO: 3065477 - protein, 7 aa, Giardia lamblia
STRTGQT

SEQ ID NO: 3065478 - protein, 10 aa, Giardia lamblia
STRTNGSPSY

SEQ ID NO: 3065479 - protein, 7 aa, Giardia lamblia
STRTPFV

SEQ ID NO: 3065480 - protein, 9 aa, Giardia lamblia
STRTSEDTQ

SEQ ID NO: 3065481 - protein, 9 aa, Giardia lamblia
STSAASAIS

SEQ ID NO: 3065482 - protein, 13 aa, Giardia lamblia
STSAGDGSLPPNN

SEQ ID NO: 3065483 - protein, 6 aa, Giardia lamblia
STSASC

SEQ ID NO: 3065484 - protein, 10 aa, Giardia lamblia
STSATGSVEV

SEQ ID NO: 3065485 - protein, 9 aa, Giardia lamblia
STSDGAPMN

SEQ ID NO: 3065486 - protein, 6 aa, Giardia lamblia
STSDNN

SEQ ID NO: 3065487 - protein, 7 aa, Giardia lamblia
STSDPKL

SEQ ID NO: 3065488 - protein, 6 aa, Giardia lamblia
STSEAF

SEQ ID NO: 3065489 - protein, 19 aa, Giardia lamblia
STSEGKGYTYQGRTNSSTH

SEQ ID NO: 3065490 - protein, 7 aa, Giardia lamblia
STSEQEC

SEQ ID NO: 3065491 - protein, 7 aa, Giardia lamblia
STSGGTN

SEQ ID NO: 3065492 - protein, 6 aa, Giardia lamblia
STSHTP

SEQ ID NO: 3065493 - protein, 5 aa, Giardia lamblia
STSID

SEQ ID NO: 3065494 - protein, 11 aa, Giardia lamblia
STSIKAQEKNK

SEQ ID NO: 3065495 - protein, 9 aa, Giardia lamblia
STSIPPNTI

SEQ ID NO: 3065496 - protein, 5 aa, Giardia lamblia
STSIT

SEQ ID NO: 3065497 - protein, 43 aa, Giardia lamblia
STSKANLSSSSQAFGNTHTSSGHGMSKPSSDHCHSNSTTVSPV

SEQ ID NO: 3065498 - protein, 10 aa, Giardia lamblia
STSKTRPTPC

SEQ ID NO: 3065499 - protein, 4 aa, Giardia lamblia
STSL

SEQ ID NO: 3065500 - protein, 7 aa, Giardia lamblia
STSLPLR

SEQ ID NO: 3065501 - protein, 7 aa, Giardia lamblia
STSLPSD

SEQ ID NO: 3065502 - protein, 4 aa, Giardia lamblia
STSN

SEQ ID NO: 3065503 - protein, 29 aa, Giardia lamblia
STSNDYPHTDLKEESDKCNTRSDAPRAGS

SEQ ID NO: 3065504 - protein, 9 aa, Giardia lamblia
STSNNLCSS

SEQ ID NO: 3065505 - protein, 8 aa, Giardia lamblia
STSNPGAA

SEQ ID NO: 3065506 - protein, 7 aa, Giardia lamblia
STSPEQL

SEQ ID NO: 3065507 - protein, 16 aa, Giardia lamblia
STSQTIKESTSQPASV

SEQ ID NO: 3065508 - protein, 4 aa, Giardia lamblia
STSR

SEQ ID NO: 3065509 - protein, 40 aa, Giardia lamblia
STSRGGHTESAASGSHAAVNNRSKSMRSASARQATAQQAY

SEQ ID NO: 3065510 - protein, 7 aa, Giardia lamblia
STSRSKV

SEQ ID NO: 3065511 - protein, 8 aa, Giardia lamblia
STSSEYAT

SEQ ID NO: 3065512 - protein, 7 aa, Giardia lamblia
STSSNQF

SEQ ID NO: 3065513 - protein, 6 aa, Giardia lamblia
STSSSD

SEQ ID NO: 3065514 - protein, 10 aa, Giardia lamblia
STSSSSDSAH

SEQ ID NO: 3065515 - protein, 7 aa, Giardia lamblia
STSTASS

SEQ ID NO: 3065516 - protein, 5 aa, Giardia lamblia
STSTL

SEQ ID NO: 3065517 - protein, 8 aa, Giardia lamblia
STSTNQKR

SEQ ID NO: 3065518 - protein, 16 aa, Giardia lamblia
STSTQQDTTIPETQAR

SEQ ID NO: 3065519 - protein, 6 aa, Giardia lamblia
STSTVK

SEQ ID NO: 3065520 - protein, 11 aa, Giardia lamblia
STSVGDPKAVS

SEQ ID NO: 3065521 - protein, 14 aa, Giardia lamblia
STSVLQGTKGTGLT

SEQ ID NO: 3065522 - protein, 11 aa, Giardia lamblia
STSVPDKDRPS

SEQ ID NO: 3065523 - protein, 4 aa, Giardia lamblia
STTA

SEQ ID NO: 3065524 - protein, 8 aa, Giardia lamblia
STTALPID

SEQ ID NO: 3065525 - protein, 15 aa, Giardia lamblia
STTCQRSCPSGAAVR

SEQ ID NO: 3065526 - protein, 4 aa, Giardia lamblia
STTD

SEQ ID NO: 3065527 - protein, 5 aa, Giardia lamblia
STTEN

SEQ ID NO: 3065528 - protein, 8 aa, Giardia lamblia
STTETNGY

SEQ ID NO: 3065529 - protein, 10 aa, Giardia lamblia
STTGQTTGAK

SEQ ID NO: 3065530 - protein, 7 aa, Giardia lamblia
STTKKDL

SEQ ID NO: 3065531 - protein, 11 aa, Giardia lamblia
STTKQTLAASE

SEQ ID NO: 3065532 - protein, 9 aa, Giardia lamblia
STTNNTLST

SEQ ID NO: 3065533 - protein, 4 aa, Giardia lamblia
STTP

SEQ ID NO: 3065534 - protein, 6 aa, Giardia lamblia
STTPDT

SEQ ID NO: 3065535 - protein, 9 aa, Giardia lamblia
STTPQQPQQ

SEQ ID NO: 3065536 - protein, 6 aa, Giardia lamblia
STTRKL

SEQ ID NO: 3065537 - protein, 4 aa, Giardia lamblia
STTS

SEQ ID NO: 3065538 - protein, 8 aa, Giardia lamblia
STTSAGTV

SEQ ID NO: 3065539 - protein, 14 aa, Giardia lamblia
STTSPPSGSGTDSA

SEQ ID NO: 3065540 - protein, 12 aa, Giardia lamblia
STTSSYGTDAPQ

SEQ ID NO: 3065541 - protein, 9 aa, Giardia lamblia
STTTGGFKG

SEQ ID NO: 3065542 - protein, 6 aa, Giardia lamblia
STTTIS

SEQ ID NO: 3065543 - protein, 5 aa, Giardia lamblia
STTVA

SEQ ID NO: 3065544 - protein, 7 aa, Giardia lamblia
STTVDST

SEQ ID NO: 3065545 - protein, 12 aa, Giardia lamblia
STVDKNKKFKTP

SEQ ID NO: 3065546 - protein, 4 aa, Giardia lamblia
STVE

SEQ ID NO: 3065547 - protein, 8 aa, Giardia lamblia
STVEEDSA

SEQ ID NO: 3065548 - protein, 9 aa, Giardia lamblia
STVKTSSEA

SEQ ID NO: 3065549 - protein, 10 aa, Giardia lamblia
STVPASQGSG

SEQ ID NO: 3065550 - protein, 19 aa, Giardia lamblia
STVQNQPSTQGLPNRQQQE

SEQ ID NO: 3065551 - protein, 13 aa, Giardia lamblia
STVSGKDNTTSTM

SEQ ID NO: 3065552 - protein, 10 aa, Giardia lamblia
STWPATPNPL

SEQ ID NO: 3065553 - protein, 6 aa, Giardia lamblia
STYARQ

SEQ ID NO: 3065554 - protein, 5 aa, Giardia lamblia
STYDI

SEQ ID NO: 3065555 - protein, 41 aa, Giardia lamblia
STYEETQGTAIDPPRTSKQASLGLRPERSESSSSSVHIVTE

SEQ ID NO: 3065556 - protein, 7 aa, Giardia lamblia
STYEQTS

SEQ ID NO: 3065557 - protein, 4 aa, Giardia lamblia
STYG

SEQ ID NO: 3065558 - protein, 11 aa, Giardia lamblia
STYGKSSSELA

SEQ ID NO: 3065559 - protein, 4 aa, Giardia lamblia
STYQ

SEQ ID NO: 3065560 - protein, 11 aa, Giardia lamblia
SVADQKSSIQE

SEQ ID NO: 3065561 - protein, 8 aa, Giardia lamblia
SVAEATQS

SEQ ID NO: 3065562 - protein, 6 aa, Giardia lamblia
SVAGET

SEQ ID NO: 3065563 - protein, 11 aa, Giardia lamblia
SVAHSGNNMHD

SEQ ID NO: 3065564 - protein, 6 aa, Giardia lamblia
SVAKTK

SEQ ID NO: 3065565 - protein, 10 aa, Giardia lamblia
SVAPSDTVAR

SEQ ID NO: 3065566 - protein, 10 aa, Giardia lamblia
SVAPSQQQNY

SEQ ID NO: 3065567 - protein, 8 aa, Giardia lamblia
SVAPTAAK

SEQ ID NO: 3065568 - protein, 5 aa, Giardia lamblia
SVATS

SEQ ID NO: 3065569 - protein, 11 aa, Giardia lamblia
SVATSSSTTLP

SEQ ID NO: 3065570 - protein, 4 aa, Giardia lamblia
SVDP

SEQ ID NO: 3065571 - protein, 12 aa, Giardia lamblia
SVDQTADSLRTH

SEQ ID NO: 3065572 - protein, 9 aa, Giardia lamblia
SVDREGSLP

SEQ ID NO: 3065573 - protein, 6 aa, Giardia lamblia
SVDSEE

SEQ ID NO: 3065574 - protein, 6 aa, Giardia lamblia
SVDSEV

SEQ ID NO: 3065575 - protein, 17 aa, Giardia lamblia
SVEAPTSPRAHQHAGST

SEQ ID NO: 3065576 - protein, 5 aa, Giardia lamblia
SVEKQ

SEQ ID NO: 3065577 - protein, 12 aa, Giardia lamblia
SVEPVKKNEYAL

SEQ ID NO: 3065578 - protein, 4 aa, Giardia lamblia
SVEQ

SEQ ID NO: 3065579 - protein, 5 aa, Giardia lamblia
SVEQA

SEQ ID NO: 3065580 - protein, 9 aa, Giardia lamblia
SVEQGPSGV

SEQ ID NO: 3065581 - protein, 10 aa, Giardia lamblia
SVERHTGTTR

SEQ ID NO: 3065582 - protein, 12 aa, Giardia lamblia
SVESSGELDTEH

SEQ ID NO: 3065583 - protein, 4 aa, Giardia lamblia
SVET

SEQ ID NO: 3065584 - protein, 8 aa, Giardia lamblia
SVETATSD

SEQ ID NO: 3065585 - protein, 12 aa, Giardia lamblia
SVETSQDTRITS

SEQ ID NO: 3065586 - protein, 7 aa, Giardia lamblia
SVFTPDS

SEQ ID NO: 3065587 - protein, 4 aa, Giardia lamblia
SVGD

SEQ ID NO: 3065588 - protein, 19 aa, Giardia lamblia
SVGPADDNSERVRLMPSAS

SEQ ID NO: 3065589 - protein, 14 aa, Giardia lamblia
SVGPETAGGGFAGR

SEQ ID NO: 3065590 - protein, 4 aa, Giardia lamblia
SVGR

SEQ ID NO: 3065591 - protein, 9 aa, Giardia lamblia
SVGSERISK

SEQ ID NO: 3065592 - protein, 15 aa, Giardia lamblia
SVGYSRTLDPSTDDG

SEQ ID NO: 3065593 - protein, 24 aa, Giardia lamblia
SVKDKGQDSGQNFGDSIDESTNQD

SEQ ID NO: 3065594 - protein, 20 aa, Giardia lamblia
SVKKDAASKDRTQSSSSTLI

SEQ ID NO: 3065595 - protein, 9 aa, Giardia lamblia
SVKPRIPQN

SEQ ID NO: 3065596 - protein, 5 aa, Giardia lamblia
SVKQR

SEQ ID NO: 3065597 - protein, 8 aa, Giardia lamblia
SVKSSAGV

SEQ ID NO: 3065598 - protein, 6 aa, Giardia lamblia
SVLDSN

SEQ ID NO: 3065599 - protein, 8 aa, Giardia lamblia
SVLNSTQA

SEQ ID NO: 3065600 - protein, 4 aa, Giardia lamblia
SVLP

SEQ ID NO: 3065601 - protein, 6 aa, Giardia lamblia
SVNATG

SEQ ID NO: 3065602 - protein, 9 aa, Giardia lamblia
SVNDSPDNF

SEQ ID NO: 3065603 - protein, 13 aa, Giardia lamblia
SVNQSASFTTPIG

SEQ ID NO: 3065604 - protein, 6 aa, Giardia lamblia
SVNRTG

SEQ ID NO: 3065605 - protein, 13 aa, Giardia lamblia
SVPASAASKRAAG

SEQ ID NO: 3065606 - protein, 37 aa, Giardia lamblia
SVPDDHQGAPQHSTSARSTMSKPAIPRHGNSARQSLD

SEQ ID NO: 3065607 - protein, 5 aa, Giardia lamblia
SVPDE

SEQ ID NO: 3065608 - protein, 6 aa, Giardia lamblia
SVPDKT

SEQ ID NO: 3065609 - protein, 12 aa, Giardia lamblia
SVPEKTGSQDDK

SEQ ID NO: 3065610 - protein, 4 aa, Giardia lamblia
SVPG

SEQ ID NO: 3065611 - protein, 13 aa, Giardia lamblia
SVPHGQKSSPGVA

SEQ ID NO: 3065612 - protein, 7 aa, Giardia lamblia
SVPPAET

SEQ ID NO: 3065613 - protein, 17 aa, Giardia lamblia
SVPPATRRLIERYTLIS

SEQ ID NO: 3065614 - protein, 6 aa, Giardia lamblia
SVPPVV

SEQ ID NO: 3065615 - protein, 8 aa, Giardia lamblia
SVPSSTSK

SEQ ID NO: 3065616 - protein, 10 aa, Giardia lamblia
SVPSTGGAEP

SEQ ID NO: 3065617 - protein, 4 aa, Giardia lamblia
SVPT

SEQ ID NO: 3065618 - protein, 5 aa, Giardia lamblia
SVPVD

SEQ ID NO: 3065619 - protein, 8 aa, Giardia lamblia
SVPVSKAT

SEQ ID NO: 3065620 - protein, 19 aa, Giardia lamblia
SVQNPAEAGPVRKESTDSY

SEQ ID NO: 3065621 - protein, 4 aa, Giardia lamblia
SVQP

SEQ ID NO: 3065622 - protein, 8 aa, Giardia lamblia
SVQPDTGS

SEQ ID NO: 3065623 - protein, 7 aa, Giardia lamblia
SVQRSNA

SEQ ID NO: 3065624 - protein, 10 aa, Giardia lamblia
SVQSGKATIE

SEQ ID NO: 3065625 - protein, 13 aa, Giardia lamblia
SVQTSAAASPLPS

SEQ ID NO: 3065626 - protein, 17 aa, Giardia lamblia
SVRGTSMSKKEHSMDKE

SEQ ID NO: 3065627 - protein, 7 aa, Giardia lamblia
SVRQPND

SEQ ID NO: 3065628 - protein, 8 aa, Giardia lamblia
SVRSDGDP

SEQ ID NO: 3065629 - protein, 4 aa, Giardia lamblia
SVSD

SEQ ID NO: 3065630 - protein, 15 aa, Giardia lamblia
SVSDEKLEAERPEKL

SEQ ID NO: 3065631 - protein, 17 aa, Giardia lamblia
SVSDSFSPTGTSADAAT

SEQ ID NO: 3065632 - protein, 7 aa, Giardia lamblia
SVSEASH

SEQ ID NO: 3065633 - protein, 7 aa, Giardia lamblia
SVSERPI

SEQ ID NO: 3065634 - protein, 7 aa, Giardia lamblia
SVSPEYN

SEQ ID NO: 3065635 - protein, 6 aa, Giardia lamblia
SVSPSV

SEQ ID NO: 3065636 - protein, 20 aa, Giardia lamblia
SVSSGTAQKLTSDARPSQIE

SEQ ID NO: 3065637 - protein, 7 aa, Giardia lamblia
SVSSSTI

SEQ ID NO: 3065638 - protein, 12 aa, Giardia lamblia
SVTDCSQSRANT

SEQ ID NO: 3065639 - protein, 5 aa, Giardia lamblia
SVTDE

SEQ ID NO: 3065640 - protein, 6 aa, Giardia lamblia
SVTDKY

SEQ ID NO: 3065641 - protein, 6 aa, Giardia lamblia
SVTNSQ

SEQ ID NO: 3065642 - protein, 9 aa, Giardia lamblia
SVTPTEQTT

SEQ ID NO: 3065643 - protein, 14 aa, Giardia lamblia
SVTSDKKECGGNGR

SEQ ID NO: 3065644 - protein, 8 aa, Giardia lamblia
SVTSNATP

SEQ ID NO: 3065645 - protein, 9 aa, Giardia lamblia
SVTSPNAEA

SEQ ID NO: 3065646 - protein, 10 aa, Giardia lamblia
SVTSSRPGPV

SEQ ID NO: 3065647 - protein, 6 aa, Giardia lamblia
SVTSTK

SEQ ID NO: 3065648 - protein, 4 aa, Giardia lamblia
SVTT

SEQ ID NO: 3065649 - protein, 10 aa, Giardia lamblia
SVTTNGSPLR

SEQ ID NO: 3065650 - protein, 9 aa, Giardia lamblia
SVVEENTET

SEQ ID NO: 3065651 - protein, 20 aa, Giardia lamblia
SVVQDNDKVDGTGDITDDAT

SEQ ID NO: 3065652 - protein, 5 aa, Giardia lamblia
SVYGE

SEQ ID NO: 3065653 - protein, 8 aa, Giardia lamblia
SVYSAPPE

SEQ ID NO: 3065654 - protein, 10 aa, Giardia lamblia
SWKGAQSPCE

SEQ ID NO: 3065655 - protein, 19 aa, Giardia lamblia
SWPSGDHDSCDPEGDEQQS

SEQ ID NO: 3065656 - protein, 5 aa, Giardia lamblia
SWYNP

SEQ ID NO: 3065657 - protein, 8 aa, Giardia lamblia
SYADTSNS

SEQ ID NO: 3065658 - protein, 5 aa, Giardia lamblia
SYAEK

SEQ ID NO: 3065659 - protein, 6 aa, Giardia lamblia
SYAGNT

SEQ ID NO: 3065660 - protein, 20 aa, Giardia lamblia
SYAPSNDGTLCEPTKPCPQY

SEQ ID NO: 3065661 - protein, 4 aa, Giardia lamblia
SYAR

SEQ ID NO: 3065662 - protein, 8 aa, Giardia lamblia
SYDKTQDN

SEQ ID NO: 3065663 - protein, 5 aa, Giardia lamblia
SYDLE

SEQ ID NO: 3065664 - protein, 8 aa, Giardia lamblia
SYDPKQVS

SEQ ID NO: 3065665 - protein, 6 aa, Giardia lamblia
SYDRER

SEQ ID NO: 3065666 - protein, 6 aa, Giardia lamblia
SYDSQT

SEQ ID NO: 3065667 - protein, 7 aa, Giardia lamblia
SYDTDNS

SEQ ID NO: 3065668 - protein, 4 aa, Giardia lamblia
SYEI

SEQ ID NO: 3065669 - protein, 5 aa, Giardia lamblia
SYELP

SEQ ID NO: 3065670 - protein, 5 aa, Giardia lamblia
SYESG

SEQ ID NO: 3065671 - protein, 5 aa, Giardia lamblia
SYGAK

SEQ ID NO: 3065672 - protein, 7 aa, Giardia lamblia
SYGERQD

SEQ ID NO: 3065673 - protein, 4 aa, Giardia lamblia
SYGI

SEQ ID NO: 3065674 - protein, 16 aa, Giardia lamblia
SYGISPAASYTSPATS

SEQ ID NO: 3065675 - protein, 6 aa, Giardia lamblia
SYGSSI

SEQ ID NO: 3065676 - protein, 15 aa, Giardia lamblia
SYIDKGRDKHSSSQM

SEQ ID NO: 3065677 - protein, 4 aa, Giardia lamblia
SYIG

SEQ ID NO: 3065678 - protein, 13 aa, Giardia lamblia
SYKAGSKSTSNLL

SEQ ID NO: 3065679 - protein, 11 aa, Giardia lamblia
SYKASETATPS

SEQ ID NO: 3065680 - protein, 10 aa, Giardia lamblia
SYKGRRTLPK

SEQ ID NO: 3065681 - protein, 6 aa, Giardia lamblia
SYKNYQ

SEQ ID NO: 3065682 - protein, 12 aa, Giardia lamblia
SYKPGGRTQAEE

SEQ ID NO: 3065683 - protein, 7 aa, Giardia lamblia
SYKPPQS

SEQ ID NO: 3065684 - protein, 17 aa, Giardia lamblia
SYKTDSASNKDPGSAIA

SEQ ID NO: 3065685 - protein, 7 aa, Giardia lamblia
SYNDSRT

SEQ ID NO: 3065686 - protein, 8 aa, Giardia lamblia
SYNGGQSL

SEQ ID NO: 3065687 - protein, 9 aa, Giardia lamblia
SYNGTTPHP

SEQ ID NO: 3065688 - protein, 9 aa, Giardia lamblia
SYNKAGYTA

SEQ ID NO: 3065689 - protein, 6 aa, Giardia lamblia
SYNSEK

SEQ ID NO: 3065690 - protein, 6 aa, Giardia lamblia
SYNTHT

SEQ ID NO: 3065691 - protein, 6 aa, Giardia lamblia
SYPTEN

SEQ ID NO: 3065692 - protein, 5 aa, Giardia lamblia
SYPTP

SEQ ID NO: 3065693 - protein, 8 aa, Giardia lamblia
SYRGSEDS

SEQ ID NO: 3065694 - protein, 18 aa, Giardia lamblia
SYRKKKESIDASKGTQLR

SEQ ID NO: 3065695 - protein, 12 aa, Giardia lamblia
SYRTQEDGSVLS

SEQ ID NO: 3065696 - protein, 5 aa, Giardia lamblia
SYSDS

SEQ ID NO: 3065697 - protein, 12 aa, Giardia lamblia
SYSHTGNAETGY

SEQ ID NO: 3065698 - protein, 21 aa, Giardia lamblia
SYSKQTPGSVLSTDQSQLQSG

SEQ ID NO: 3065699 - protein, 10 aa, Giardia lamblia
SYSNEEKQEA

SEQ ID NO: 3065700 - protein, 10 aa, Giardia lamblia
SYSSSPSSLQ

SEQ ID NO: 3065701 - protein, 10 aa, Giardia lamblia
SYSSTNGPEL

SEQ ID NO: 3065702 - protein, 11 aa, Giardia lamblia
SYTDAKNPISF

SEQ ID NO: 3065703 - protein, 10 aa, Giardia lamblia
SYTEESAKQY

SEQ ID NO: 3065704 - protein, 6 aa, Giardia lamblia
SYTGQN

SEQ ID NO: 3065705 - protein, 5 aa, Giardia lamblia
SYTGT

SEQ ID NO: 3065706 - protein, 4 aa, Giardia lamblia
SYTN

SEQ ID NO: 3065707 - protein, 5 aa, Giardia lamblia
SYTNT

SEQ ID NO: 3065708 - protein, 10 aa, Giardia lamblia
SYTQSTKESS

SEQ ID NO: 3065709 - protein, 12 aa, Giardia lamblia
SYTSPDQQLPSS

SEQ ID NO: 3065710 - protein, 5 aa, Giardia lamblia
SYTST

SEQ ID NO: 3065711 - protein, 11 aa, Giardia lamblia
SYTTETENDRS

SEQ ID NO: 3065712 - protein, 6 aa, Giardia lamblia
TAAAKT

SEQ ID NO: 3065713 - protein, 26 aa, Giardia lamblia
TAAAQQDQGTSPGYFQSEESIRQDMA

SEQ ID NO: 3065714 - protein, 52 aa, Giardia lamblia
TAADAISRSPTESAGSATEISTAHENVSSDDLSSGADNKQSQEGTKSTEYSY

SEQ ID NO: 3065715 - protein, 10 aa, Giardia lamblia
TAADGKCTKC

SEQ ID NO: 3065716 - protein, 8 aa, Giardia lamblia
TAAGDAGI

SEQ ID NO: 3065717 - protein, 15 aa, Giardia lamblia
TAAGLKDEQTGLPIQ

SEQ ID NO: 3065718 - protein, 7 aa, Giardia lamblia
TAAGSLE

SEQ ID NO: 3065719 - protein, 8 aa, Giardia lamblia
TAAGYGGS

SEQ ID NO: 3065720 - protein, 5 aa, Giardia lamblia
TAAIR

SEQ ID NO: 3065721 - protein, 6 aa, Giardia lamblia
TAANSR

SEQ ID NO: 3065722 - protein, 26 aa, Giardia lamblia
TAAQNKGQCQTCANGQSPAGGKCPAC

SEQ ID NO: 3065723 - protein, 9 aa, Giardia lamblia
TAASNLTNQ

SEQ ID NO: 3065724 - protein, 40 aa, Giardia lamblia
TAASSAGSAGSVATTKPGLCGTQEQPATVSTVDSPTPSLP

SEQ ID NO: 3065725 - protein, 5 aa, Giardia lamblia
TAAST

SEQ ID NO: 3065726 - protein, 5 aa, Giardia lamblia
TAATA

SEQ ID NO: 3065727 - protein, 9 aa, Giardia lamblia
TAATKEPTL

SEQ ID NO: 3065728 - protein, 6 aa, Giardia lamblia
TAATLS

SEQ ID NO: 3065729 - protein, 13 aa, Giardia lamblia
TAATPSSPSPFTE

SEQ ID NO: 3065730 - protein, 4 aa, Giardia lamblia
TAAY

SEQ ID NO: 3065731 - protein, 6 aa, Giardia lamblia
TACQPN

SEQ ID NO: 3065732 - protein, 4 aa, Giardia lamblia
TACS

SEQ ID NO: 3065733 - protein, 10 aa, Giardia lamblia
TADDDASTPL

SEQ ID NO: 3065734 - protein, 10 aa, Giardia lamblia
TADDTRVSGN

SEQ ID NO: 3065735 - protein, 6 aa, Giardia lamblia
TADGNT

SEQ ID NO: 3065736 - protein, 7 aa, Giardia lamblia
TADKTSG

SEQ ID NO: 3065737 - protein, 4 aa, Giardia lamblia
TADN

SEQ ID NO: 3065738 - protein, 11 aa, Giardia lamblia
TADNMRTESHQ

SEQ ID NO: 3065739 - protein, 7 aa, Giardia lamblia
TADNRAS

SEQ ID NO: 3065740 - protein, 4 aa, Giardia lamblia
TADQ

SEQ ID NO: 3065741 - protein, 8 aa, Giardia lamblia
TADTTLTK

SEQ ID NO: 3065742 - protein, 11 aa, Giardia lamblia
TAEAGNSANVS

SEQ ID NO: 3065743 - protein, 6 aa, Giardia lamblia
TAEAQN

SEQ ID NO: 3065744 - protein, 8 aa, Giardia lamblia
TAEGEGDW

SEQ ID NO: 3065745 - protein, 11 aa, Giardia lamblia
TAEPPEQDPMP

SEQ ID NO: 3065746 - protein, 7 aa, Giardia lamblia
TAERNSF

SEQ ID NO: 3065747 - protein, 5 aa, Giardia lamblia
TAESD

SEQ ID NO: 3065748 - protein, 6 aa, Giardia lamblia
TAESNR

SEQ ID NO: 3065749 - protein, 14 aa, Giardia lamblia
TAESSKKDLRPATP

SEQ ID NO: 3065750 - protein, 7 aa, Giardia lamblia
TAETEFE

SEQ ID NO: 3065751 - protein, 5 aa, Giardia lamblia
TAETN

SEQ ID NO: 3065752 - protein, 6 aa, Giardia lamblia
TAETSS

SEQ ID NO: 3065753 - protein, 5 aa, Giardia lamblia
TAEYS

SEQ ID NO: 3065754 - protein, 6 aa, Giardia lamblia
TAFDPG

SEQ ID NO: 3065755 - protein, 14 aa, Giardia lamblia
TAFPSNESIAGSIA

SEQ ID NO: 3065756 - protein, 10 aa, Giardia lamblia
TAFSSEAKQY

SEQ ID NO: 3065757 - protein, 5 aa, Giardia lamblia
TAGAL

SEQ ID NO: 3065758 - protein, 7 aa, Giardia lamblia
TAGASLA

SEQ ID NO: 3065759 - protein, 8 aa, Giardia lamblia
TAGEGPER

SEQ ID NO: 3065760 - protein, 4 aa, Giardia lamblia
TAGN

SEQ ID NO: 3065761 - protein, 16 aa, Giardia lamblia
TAGTKNSTISRSSAEQ

SEQ ID NO: 3065762 - protein, 9 aa, Giardia lamblia
TAHDPGKSL

SEQ ID NO: 3065763 - protein, 6 aa, Giardia lamblia
TAHTRR

SEQ ID NO: 3065764 - protein, 7 aa, Giardia lamblia
TAISRND

SEQ ID NO: 3065765 - protein, 15 aa, Giardia lamblia
TAITNQSNISQDTSY

SEQ ID NO: 3065766 - protein, 6 aa, Giardia lamblia
TAKDTF

SEQ ID NO: 3065767 - protein, 10 aa, Giardia lamblia
TAKHQQIDTR

SEQ ID NO: 3065768 - protein, 8 aa, Giardia lamblia
TAKSEAAA

SEQ ID NO: 3065769 - protein, 4 aa, Giardia lamblia
TALP

SEQ ID NO: 3065770 - protein, 22 aa, Giardia lamblia
TALSSSGNTSQNTQRRRSPIAT

SEQ ID NO: 3065771 - protein, 8 aa, Giardia lamblia
TANDNRQV

SEQ ID NO: 3065772 - protein, 10 aa, Giardia lamblia
TANDSSATSF

SEQ ID NO: 3065773 - protein, 17 aa, Giardia lamblia
TANEALDDRQKHIDDAE

SEQ ID NO: 3065774 - protein, 7 aa, Giardia lamblia
TANEGGL

SEQ ID NO: 3065775 - protein, 6 aa, Giardia lamblia
TANGGI

SEQ ID NO: 3065776 - protein, 4 aa, Giardia lamblia
TANM

SEQ ID NO: 3065777 - protein, 4 aa, Giardia lamblia
TANR

SEQ ID NO: 3065778 - protein, 5 aa, Giardia lamblia
TAPAV

SEQ ID NO: 3065779 - protein, 11 aa, Giardia lamblia
TAPDNIKKDAG

SEQ ID NO: 3065780 - protein, 4 aa, Giardia lamblia
TAPE

SEQ ID NO: 3065781 - protein, 12 aa, Giardia lamblia
TAPGPGRCTRCP

SEQ ID NO: 3065782 - protein, 6 aa, Giardia lamblia
TAPQTS

SEQ ID NO: 3065783 - protein, 15 aa, Giardia lamblia
TAPSQIDPDDQDVAK

SEQ ID NO: 3065784 - protein, 10 aa, Giardia lamblia
TAPSRGGKMS

SEQ ID NO: 3065785 - protein, 13 aa, Giardia lamblia
TAPTGSSKSQADS

SEQ ID NO: 3065786 - protein, 10 aa, Giardia lamblia
TAPTNPEPHG

SEQ ID NO: 3065787 - protein, 6 aa, Giardia lamblia
TAQDRN

SEQ ID NO: 3065788 - protein, 7 aa, Giardia lamblia
TAQDTRD

SEQ ID NO: 3065789 - protein, 5 aa, Giardia lamblia
TAQHN

SEQ ID NO: 3065790 - protein, 10 aa, Giardia lamblia
TAQPDDDVQA

SEQ ID NO: 3065791 - protein, 5 aa, Giardia lamblia
TAQPR

SEQ ID NO: 3065792 - protein, 9 aa, Giardia lamblia
TAQQPDGTE

SEQ ID NO: 3065793 - protein, 7 aa, Giardia lamblia
TAQSDVE

SEQ ID NO: 3065794 - protein, 5 aa, Giardia lamblia
TAQSS

SEQ ID NO: 3065795 - protein, 10 aa, Giardia lamblia
TAQVDRENDR

SEQ ID NO: 3065796 - protein, 6 aa, Giardia lamblia
TAREEA

SEQ ID NO: 3065797 - protein, 6 aa, Giardia lamblia
TAREKD

SEQ ID NO: 3065798 - protein, 13 aa, Giardia lamblia
TAREMNNASKDAN

SEQ ID NO: 3065799 - protein, 19 aa, Giardia lamblia
TARQCSSSMADTLSSGGDL

SEQ ID NO: 3065800 - protein, 23 aa, Giardia lamblia
TARSDTDQSPSVSNTTDSTKNTL

SEQ ID NO: 3065801 - protein, 7 aa, Giardia lamblia
TARSMST

SEQ ID NO: 3065802 - protein, 36 aa, Giardia lamblia
TARTQKTAIEANASHQDGSEAAHYSSSSKAKRARAS

SEQ ID NO: 3065803 - protein, 7 aa, Giardia lamblia
TASEHNK

SEQ ID NO: 3065804 - protein, 6 aa, Giardia lamblia
TASGGA

SEQ ID NO: 3065805 - protein, 13 aa, Giardia lamblia
TASGNTDAAQSIQ

SEQ ID NO: 3065806 - protein, 7 aa, Giardia lamblia
TASGNYS

SEQ ID NO: 3065807 - protein, 6 aa, Giardia lamblia
TASINK

SEQ ID NO: 3065808 - protein, 5 aa, Giardia lamblia
TASIT

SEQ ID NO: 3065809 - protein, 21 aa, Giardia lamblia
TASITRTSSITTIGSDHSTES

SEQ ID NO: 3065810 - protein, 8 aa, Giardia lamblia
TASKQTTY

SEQ ID NO: 3065811 - protein, 4 aa, Giardia lamblia
TASN

SEQ ID NO: 3065812 - protein, 5 aa, Giardia lamblia
TASPG

SEQ ID NO: 3065813 - protein, 6 aa, Giardia lamblia
TASPHA

SEQ ID NO: 3065814 - protein, 7 aa, Giardia lamblia
TASRPKK

SEQ ID NO: 3065815 - protein, 12 aa, Giardia lamblia
TASSASSPSTCT

SEQ ID NO: 3065816 - protein, 11 aa, Giardia lamblia
TASSGNNNQIT

SEQ ID NO: 3065817 - protein, 14 aa, Giardia lamblia
TASSTAQQHEADSD

SEQ ID NO: 3065818 - protein, 7 aa, Giardia lamblia
TASSTEH

SEQ ID NO: 3065819 - protein, 22 aa, Giardia lamblia
TASSYQITKGSGSSSTSASQAT

SEQ ID NO: 3065820 - protein, 7 aa, Giardia lamblia
TASSYYS

SEQ ID NO: 3065821 - protein, 9 aa, Giardia lamblia
TASTGDTYI

SEQ ID NO: 3065822 - protein, 8 aa, Giardia lamblia
TASTGSQK

SEQ ID NO: 3065823 - protein, 5 aa, Giardia lamblia
TASVP

SEQ ID NO: 3065824 - protein, 21 aa, Giardia lamblia
TATDEAHMQSRPGMQGPSKTN

SEQ ID NO: 3065825 - protein, 10 aa, Giardia lamblia
TATDGTEISQ

SEQ ID NO: 3065826 - protein, 6 aa, Giardia lamblia
TATDSY

SEQ ID NO: 3065827 - protein, 8 aa, Giardia lamblia
TATEKPLS

SEQ ID NO: 3065828 - protein, 10 aa, Giardia lamblia
TATGDAGRYS

SEQ ID NO: 3065829 - protein, 6 aa, Giardia lamblia
TATGKT

SEQ ID NO: 3065830 - protein, 6 aa, Giardia lamblia
TATHGY

SEQ ID NO: 3065831 - protein, 7 aa, Giardia lamblia
TATNQFS

SEQ ID NO: 3065832 - protein, 7 aa, Giardia lamblia
TATPNRI

SEQ ID NO: 3065833 - protein, 15 aa, Giardia lamblia
TATRATGVNPEDTSD

SEQ ID NO: 3065834 - protein, 9 aa, Giardia lamblia
TATRTDKDA

SEQ ID NO: 3065835 - protein, 5 aa, Giardia lamblia
TATRY

SEQ ID NO: 3065836 - protein, 6 aa, Giardia lamblia
TATSAT

SEQ ID NO: 3065837 - protein, 18 aa, Giardia lamblia
TATSLQVPPKVNPPIDDT

SEQ ID NO: 3065838 - protein, 4 aa, Giardia lamblia
TATT

SEQ ID NO: 3065839 - protein, 6 aa, Giardia lamblia
TATTFS

SEQ ID NO: 3065840 - protein, 29 aa, Giardia lamblia
TAVPTREQNGAYTGESKGIRTNVTHSRKL

SEQ ID NO: 3065841 - protein, 4 aa, Giardia lamblia
TAYG

SEQ ID NO: 3065842 - protein, 9 aa, Giardia lamblia
TCAASRCNK

SEQ ID NO: 3065843 - protein, 7 aa, Giardia lamblia
TCDAENR

SEQ ID NO: 3065844 - protein, 14 aa, Giardia lamblia
TCEDPTACGGTSGA

SEQ ID NO: 3065845 - protein, 5 aa, Giardia lamblia
TCEPS

SEQ ID NO: 3065846 - protein, 4 aa, Giardia lamblia
TCGE

SEQ ID NO: 3065847 - protein, 11 aa, Giardia lamblia
TCGNGGGGSLL

SEQ ID NO: 3065848 - protein, 13 aa, Giardia lamblia
TCKCGTEYAGERC

SEQ ID NO: 3065849 - protein, 11 aa, Giardia lamblia
TCKGPSDDQDL

SEQ ID NO: 3065850 - protein, 19 aa, Giardia lamblia
TCNQEPSLHGTQASTELAK

SEQ ID NO: 3065851 - protein, 7 aa, Giardia lamblia
TCNSKAI

SEQ ID NO: 3065852 - protein, 7 aa, Giardia lamblia
TCNSTNR

SEQ ID NO: 3065853 - protein, 19 aa, Giardia lamblia
TCPGDESEQPAELSRRQPK

SEQ ID NO: 3065854 - protein, 13 aa, Giardia lamblia
TCPGYTDPASQVI

SEQ ID NO: 3065855 - protein, 13 aa, Giardia lamblia
TCPKQTTNALAAP

SEQ ID NO: 3065856 - protein, 17 aa, Giardia lamblia
TCPSDATGCSNCSASGE

SEQ ID NO: 3065857 - protein, 17 aa, Giardia lamblia
TCPSDATGCSSCNTNGE

SEQ ID NO: 3065858 - protein, 17 aa, Giardia lamblia
TCPSDATGCSSCSASGE

SEQ ID NO: 3065859 - protein, 8 aa, Giardia lamblia
TCQGPQST

SEQ ID NO: 3065860 - protein, 10 aa, Giardia lamblia
TCSATNGDKR

SEQ ID NO: 3065861 - protein, 14 aa, Giardia lamblia
TCSGAGQCTSNGCQ

SEQ ID NO: 3065862 - protein, 10 aa, Giardia lamblia
TCSPGADGQE

SEQ ID NO: 3065863 - protein, 8 aa, Giardia lamblia
TCSPQDGQ

SEQ ID NO: 3065864 - protein, 11 aa, Giardia lamblia
TCSPTNGSECT

SEQ ID NO: 3065865 - protein, 5 aa, Giardia lamblia
TCSQC

SEQ ID NO: 3065866 - protein, 14 aa, Giardia lamblia
TCSTPGSTSSERPT

SEQ ID NO: 3065867 - protein, 11 aa, Giardia lamblia
TCTDSSNSKIC

SEQ ID NO: 3065868 - protein, 9 aa, Giardia lamblia
TCTGERPED

SEQ ID NO: 3065869 - protein, 8 aa, Giardia lamblia
TCTGGTER

SEQ ID NO: 3065870 - protein, 7 aa, Giardia lamblia
TCTNTGQ

SEQ ID NO: 3065871 - protein, 17 aa, Giardia lamblia
TCTPSQTLEPEQLNASP

SEQ ID NO: 3065872 - protein, 5 aa, Giardia lamblia
TCTRA

SEQ ID NO: 3065873 - protein, 12 aa, Giardia lamblia
TCTSGKSAQVGD

SEQ ID NO: 3065874 - protein, 8 aa, Giardia lamblia
TCTSGTAQ

SEQ ID NO: 3065875 - protein, 15 aa, Giardia lamblia
TCTTSNSSDLERPNA

SEQ ID NO: 3065876 - protein, 9 aa, Giardia lamblia
TCVEGPVAG

SEQ ID NO: 3065877 - protein, 10 aa, Giardia lamblia
TCVETEEGEY

SEQ ID NO: 3065878 - protein, 4 aa, Giardia lamblia
TDAA

SEQ ID NO: 3065879 - protein, 11 aa, Giardia lamblia
TDAAKPLPRAR

SEQ ID NO: 3065880 - protein, 18 aa, Giardia lamblia
TDADSGSLEITGKQGTPL

SEQ ID NO: 3065881 - protein, 27 aa, Giardia lamblia
TDAEETDTAKEQTEETKEETEKQTLGT

SEQ ID NO: 3065882 - protein, 6 aa, Giardia lamblia
TDAPEA

SEQ ID NO: 3065883 - protein, 6 aa, Giardia lamblia
TDASGI

SEQ ID NO: 3065884 - protein, 5 aa, Giardia lamblia
TDASN

SEQ ID NO: 3065885 - protein, 9 aa, Giardia lamblia
TDASSTEAQ

SEQ ID NO: 3065886 - protein, 17 aa, Giardia lamblia
TDATLQNTSPTSQSNKA

SEQ ID NO: 3065887 - protein, 6 aa, Giardia lamblia
TDCGKD

SEQ ID NO: 3065888 - protein, 5 aa, Giardia lamblia
TDDAT

SEQ ID NO: 3065889 - protein, 5 aa, Giardia lamblia
TDDDM

SEQ ID NO: 3065890 - protein, 32 aa, Giardia lamblia
TDDEKQTINPEEDTFEDTREEATTPSLPASGT

SEQ ID NO: 3065891 - protein, 5 aa, Giardia lamblia
TDDGQ

SEQ ID NO: 3065892 - protein, 8 aa, Giardia lamblia
TDDGRKRI

SEQ ID NO: 3065893 - protein, 15 aa, Giardia lamblia
TDDSDESGVKITGAP

SEQ ID NO: 3065894 - protein, 26 aa, Giardia lamblia
TDDTLRPSAEIPDSDLNPLSDSSLKK

SEQ ID NO: 3065895 - protein, 14 aa, Giardia lamblia
TDDTSEYSAQTKHT

SEQ ID NO: 3065896 - protein, 4 aa, Giardia lamblia
TDEA

SEQ ID NO: 3065897 - protein, 5 aa, Giardia lamblia
TDEDP

SEQ ID NO: 3065898 - protein, 6 aa, Giardia lamblia
TDEDSG

SEQ ID NO: 3065899 - protein, 14 aa, Giardia lamblia
TDEETIRRQGREKE

SEQ ID NO: 3065900 - protein, 13 aa, Giardia lamblia
TDEHSSYCDAESG

SEQ ID NO: 3065901 - protein, 6 aa, Giardia lamblia
TDERRT

SEQ ID NO: 3065902 - protein, 8 aa, Giardia lamblia
TDESPNPN

SEQ ID NO: 3065903 - protein, 8 aa, Giardia lamblia
TDESRSKI

SEQ ID NO: 3065904 - protein, 19 aa, Giardia lamblia
TDESSVEDGFEDEPPRDMT

SEQ ID NO: 3065905 - protein, 7 aa, Giardia lamblia
TDESYSS

SEQ ID NO: 3065906 - protein, 4 aa, Giardia lamblia
TDFS

SEQ ID NO: 3065907 - protein, 10 aa, Giardia lamblia
TDGANEHSTC

SEQ ID NO: 3065908 - protein, 22 aa, Giardia lamblia
TDGAREDSPAEVERTNQHAAAD

SEQ ID NO: 3065909 - protein, 19 aa, Giardia lamblia
TDGDNTGGSVNKSGLSTGA

SEQ ID NO: 3065910 - protein, 29 aa, Giardia lamblia
TDGETPDDSPLPSTSTEDVIPTNTNYTNG

SEQ ID NO: 3065911 - protein, 7 aa, Giardia lamblia
TDGITSE

SEQ ID NO: 3065912 - protein, 15 aa, Giardia lamblia
TDGITTNGPSCNTNT

SEQ ID NO: 3065913 - protein, 4 aa, Giardia lamblia
TDGL

SEQ ID NO: 3065914 - protein, 11 aa, Giardia lamblia
TDGLTKSTKYY

SEQ ID NO: 3065915 - protein, 9 aa, Giardia lamblia
TDGSNASTE

SEQ ID NO: 3065916 - protein, 8 aa, Giardia lamblia
TDGTTCTQ

SEQ ID NO: 3065917 - protein, 5 aa, Giardia lamblia
TDGVS

SEQ ID NO: 3065918 - protein, 8 aa, Giardia lamblia
TDHINQQD

SEQ ID NO: 3065919 - protein, 4 aa, Giardia lamblia
TDHR

SEQ ID NO: 3065920 - protein, 4 aa, Giardia lamblia
TDHY

SEQ ID NO: 3065921 - protein, 5 aa, Giardia lamblia
TDIST

SEQ ID NO: 3065922 - protein, 7 aa, Giardia lamblia
TDKAHPY

SEQ ID NO: 3065923 - protein, 13 aa, Giardia lamblia
TDKAKAASGTTAM

SEQ ID NO: 3065924 - protein, 28 aa, Giardia lamblia
TDKKKKLKKERKPKEPKKPRKIKKPETF

SEQ ID NO: 3065925 - protein, 9 aa, Giardia lamblia
TDKPPSRGF

SEQ ID NO: 3065926 - protein, 16 aa, Giardia lamblia
TDKTATSDCQTNLTGS

SEQ ID NO: 3065927 - protein, 7 aa, Giardia lamblia
TDKVSQM

SEQ ID NO: 3065928 - protein, 6 aa, Giardia lamblia
TDLEAS

SEQ ID NO: 3065929 - protein, 14 aa, Giardia lamblia
TDMQGSYTEDNRQK

SEQ ID NO: 3065930 - protein, 15 aa, Giardia lamblia
TDNRRHPAECGGHGE

SEQ ID NO: 3065931 - protein, 7 aa, Giardia lamblia
TDNSSTM

SEQ ID NO: 3065932 - protein, 6 aa, Giardia lamblia
TDPDMK

SEQ ID NO: 3065933 - protein, 13 aa, Giardia lamblia
TDPDVCSKTPGPG

SEQ ID NO: 3065934 - protein, 4 aa, Giardia lamblia
TDPE

SEQ ID NO: 3065935 - protein, 14 aa, Giardia lamblia
TDPNRANPSTLQSS

SEQ ID NO: 3065936 - protein, 5 aa, Giardia lamblia
TDPQQ

SEQ ID NO: 3065937 - protein, 16 aa, Giardia lamblia
TDPRYETAEEFEERNP

SEQ ID NO: 3065938 - protein, 6 aa, Giardia lamblia
TDPSLC

SEQ ID NO: 3065939 - protein, 7 aa, Giardia lamblia
TDPSLGD

SEQ ID NO: 3065940 - protein, 7 aa, Giardia lamblia
TDPTEAM

SEQ ID NO: 3065941 - protein, 7 aa, Giardia lamblia
TDPTRPF

SEQ ID NO: 3065942 - protein, 9 aa, Giardia lamblia
TDQAEEERD

SEQ ID NO: 3065943 - protein, 10 aa, Giardia lamblia
TDQAPGSPTI

SEQ ID NO: 3065944 - protein, 6 aa, Giardia lamblia
TDQDFN

SEQ ID NO: 3065945 - protein, 7 aa, Giardia lamblia
TDQDRRY

SEQ ID NO: 3065946 - protein, 11 aa, Giardia lamblia
TDQQDTATQAN

SEQ ID NO: 3065947 - protein, 6 aa, Giardia lamblia
TDQSSF

SEQ ID NO: 3065948 - protein, 11 aa, Giardia lamblia
TDQVSNSVNPA

SEQ ID NO: 3065949 - protein, 10 aa, Giardia lamblia
TDRDRRDVSD

SEQ ID NO: 3065950 - protein, 9 aa, Giardia lamblia
TDREGNTAL

SEQ ID NO: 3065951 - protein, 5 aa, Giardia lamblia
TDRGA

SEQ ID NO: 3065952 - protein, 17 aa, Giardia lamblia
TDRGFRSESVADSNGFS

SEQ ID NO: 3065953 - protein, 14 aa, Giardia lamblia
TDRKGSGDTIAKTS

SEQ ID NO: 3065954 - protein, 9 aa, Giardia lamblia
TDRSSQYID

SEQ ID NO: 3065955 - protein, 8 aa, Giardia lamblia
TDRTGTTG

SEQ ID NO: 3065956 - protein, 5 aa, Giardia lamblia
TDSAT

SEQ ID NO: 3065957 - protein, 9 aa, Giardia lamblia
TDSATGTCR

SEQ ID NO: 3065958 - protein, 7 aa, Giardia lamblia
TDSEDEV

SEQ ID NO: 3065959 - protein, 8 aa, Giardia lamblia
TDSEDYGN

SEQ ID NO: 3065960 - protein, 25 aa, Giardia lamblia
TDSEQDEDKGVFTSKGSGDLSPAEH

SEQ ID NO: 3065961 - protein, 5 aa, Giardia lamblia
TDSGA

SEQ ID NO: 3065962 - protein, 7 aa, Giardia lamblia
TDSGSYM

SEQ ID NO: 3065963 - protein, 7 aa, Giardia lamblia
TDSLNEY

SEQ ID NO: 3065964 - protein, 5 aa, Giardia lamblia
TDSMT

SEQ ID NO: 3065965 - protein, 8 aa, Giardia lamblia
TDSNGRLT

SEQ ID NO: 3065966 - protein, 9 aa, Giardia lamblia
TDSNKENPA

SEQ ID NO: 3065967 - protein, 5 aa, Giardia lamblia
TDSNP

SEQ ID NO: 3065968 - protein, 17 aa, Giardia lamblia
TDSPLQKASQSNNDVDN

SEQ ID NO: 3065969 - protein, 7 aa, Giardia lamblia
TDSQQSQ

SEQ ID NO: 3065970 - protein, 11 aa, Giardia lamblia
TDSSGKRVAQT

SEQ ID NO: 3065971 - protein, 19 aa, Giardia lamblia
TDSSSEGDDYSDGYSSDGD

SEQ ID NO: 3065972 - protein, 5 aa, Giardia lamblia
TDSTI

SEQ ID NO: 3065973 - protein, 11 aa, Giardia lamblia
TDSTPTPGSCS

SEQ ID NO: 3065974 - protein, 11 aa, Giardia lamblia
TDSTTCTKGSV

SEQ ID NO: 3065975 - protein, 7 aa, Giardia lamblia
TDSTTTC

SEQ ID NO: 3065976 - protein, 6 aa, Giardia lamblia
TDTADN

SEQ ID NO: 3065977 - protein, 7 aa, Giardia lamblia
TDTATSS

SEQ ID NO: 3065978 - protein, 8 aa, Giardia lamblia
TDTDASVS

SEQ ID NO: 3065979 - protein, 25 aa, Giardia lamblia
TDTDYEAWSSNDDVPESKEVTDPLS

SEQ ID NO: 3065980 - protein, 6 aa, Giardia lamblia
TDTEAS

SEQ ID NO: 3065981 - protein, 8 aa, Giardia lamblia
TDTEDDTF

SEQ ID NO: 3065982 - protein, 6 aa, Giardia lamblia
TDTEPM

SEQ ID NO: 3065983 - protein, 15 aa, Giardia lamblia
TDTGSLANAATKSTL

SEQ ID NO: 3065984 - protein, 9 aa, Giardia lamblia
TDTKKDSAK

SEQ ID NO: 3065985 - protein, 7 aa, Giardia lamblia
TDTQPST

SEQ ID NO: 3065986 - protein, 11 aa, Giardia lamblia
TDTSANPSQPI

SEQ ID NO: 3065987 - protein, 8 aa, Giardia lamblia
TDTSSGDR

SEQ ID NO: 3065988 - protein, 11 aa, Giardia lamblia
TDTSSIKGQRV

SEQ ID NO: 3065989 - protein, 7 aa, Giardia lamblia
TDTSTSV

SEQ ID NO: 3065990 - protein, 7 aa, Giardia lamblia
TDVADEA

SEQ ID NO: 3065991 - protein, 6 aa, Giardia lamblia
TDVKPT

SEQ ID NO: 3065992 - protein, 17 aa, Giardia lamblia
TDYANRNPNGNEKQTYE

SEQ ID NO: 3065993 - protein, 8 aa, Giardia lamblia
TDYPQSKL

SEQ ID NO: 3065994 - protein, 16 aa, Giardia lamblia
TDYTDEPRSPGEPSIP

SEQ ID NO: 3065995 - protein, 6 aa, Giardia lamblia
TEAEFT

SEQ ID NO: 3065996 - protein, 12 aa, Giardia lamblia
TEAGMRDSTGRT

SEQ ID NO: 3065997 - protein, 6 aa, Giardia lamblia
TEANSE

SEQ ID NO: 3065998 - protein, 4 aa, Giardia lamblia
TEAP

SEQ ID NO: 3065999 - protein, 4 aa, Giardia lamblia
TEAS

SEQ ID NO: 3066000 - protein, 16 aa, Giardia lamblia
TEASREEATGTPHASQ

SEQ ID NO: 3066001 - protein, 15 aa, Giardia lamblia
TEASVTEDPLSLSPS

SEQ ID NO: 3066002 - protein, 9 aa, Giardia lamblia
TECDTKRTE

SEQ ID NO: 3066003 - protein, 13 aa, Giardia lamblia
TECGADKYADKKT

SEQ ID NO: 3066004 - protein, 41 aa, Giardia lamblia
TECPPGQKPDEKKERCQCSEGTVPKSDWSGCEHEGNCPASA

SEQ ID NO: 3066005 - protein, 5 aa, Giardia lamblia
TECQS

SEQ ID NO: 3066006 - protein, 16 aa, Giardia lamblia
TEDDVDESSETDDDPM

SEQ ID NO: 3066007 - protein, 12 aa, Giardia lamblia
TEDHNQRRTLRD

SEQ ID NO: 3066008 - protein, 23 aa, Giardia lamblia
TEDHRVNATTPCSAKNDPSYSTS

SEQ ID NO: 3066009 - protein, 4 aa, Giardia lamblia
TEDN

SEQ ID NO: 3066010 - protein, 9 aa, Giardia lamblia
TEDNQTNQS

SEQ ID NO: 3066011 - protein, 7 aa, Giardia lamblia
TEDPNFK

SEQ ID NO: 3066012 - protein, 11 aa, Giardia lamblia
TEEANAQLAQG

SEQ ID NO: 3066013 - protein, 7 aa, Giardia lamblia
TEEELTN

SEQ ID NO: 3066014 - protein, 5 aa, Giardia lamblia
TEEEQ

SEQ ID NO: 3066015 - protein, 9 aa, Giardia lamblia
TEEERERAF

SEQ ID NO: 3066016 - protein, 5 aa, Giardia lamblia
TEEGF

SEQ ID NO: 3066017 - protein, 8 aa, Giardia lamblia
TEEGTSTV

SEQ ID NO: 3066018 - protein, 8 aa, Giardia lamblia
TEEHTGSE

SEQ ID NO: 3066019 - protein, 12 aa, Giardia lamblia
TEEKAAEDGVSA

SEQ ID NO: 3066020 - protein, 5 aa, Giardia lamblia
TEEKT

SEQ ID NO: 3066021 - protein, 12 aa, Giardia lamblia
TEENTPQKPPNC

SEQ ID NO: 3066022 - protein, 5 aa, Giardia lamblia
TEEPV

SEQ ID NO: 3066023 - protein, 10 aa, Giardia lamblia
TEEQPRAITR

SEQ ID NO: 3066024 - protein, 6 aa, Giardia lamblia
TEFTPE

SEQ ID NO: 3066025 - protein, 9 aa, Giardia lamblia
TEGEGSGKC

SEQ ID NO: 3066026 - protein, 9 aa, Giardia lamblia
TEGETPVTA

SEQ ID NO: 3066027 - protein, 14 aa, Giardia lamblia
TEGIQADDPISDST

SEQ ID NO: 3066028 - protein, 9 aa, Giardia lamblia
TEGQASETN

SEQ ID NO: 3066029 - protein, 17 aa, Giardia lamblia
TEGRAKGYITGPPGNMD

SEQ ID NO: 3066030 - protein, 14 aa, Giardia lamblia
TEGSDGSIDEPEPH

SEQ ID NO: 3066031 - protein, 7 aa, Giardia lamblia
TEGTARD

SEQ ID NO: 3066032 - protein, 25 aa, Giardia lamblia
TEHETGLAKRTNLTRARRQGLSQIP

SEQ ID NO: 3066033 - protein, 4 aa, Giardia lamblia
TEHP

SEQ ID NO: 3066034 - protein, 8 aa, Giardia lamblia
TEHPTPEE

SEQ ID NO: 3066035 - protein, 4 aa, Giardia lamblia
TEHR

SEQ ID NO: 3066036 - protein, 17 aa, Giardia lamblia
TEHSSPESSSSNEGSVQ

SEQ ID NO: 3066037 - protein, 7 aa, Giardia lamblia
TEHYPGS

SEQ ID NO: 3066038 - protein, 9 aa, Giardia lamblia
TEIQDSSED

SEQ ID NO: 3066039 - protein, 5 aa, Giardia lamblia
TEISG

SEQ ID NO: 3066040 - protein, 11 aa, Giardia lamblia
TEKEQGTSSIK

SEQ ID NO: 3066041 - protein, 9 aa, Giardia lamblia
TEKHSGKLG

SEQ ID NO: 3066042 - protein, 10 aa, Giardia lamblia
TEKNPASGDK

SEQ ID NO: 3066043 - protein, 14 aa, Giardia lamblia
TEKPEDVRVSPSPM

SEQ ID NO: 3066044 - protein, 27 aa, Giardia lamblia
TEKPEIKEQESNEAKREEQNELPQHTN

SEQ ID NO: 3066045 - protein, 8 aa, Giardia lamblia
TEKTTGHP

SEQ ID NO: 3066046 - protein, 4 aa, Giardia lamblia
TELE

SEQ ID NO: 3066047 - protein, 7 aa, Giardia lamblia
TELGSPV

SEQ ID NO: 3066048 - protein, 8 aa, Giardia lamblia
TELKPSAA

SEQ ID NO: 3066049 - protein, 7 aa, Giardia lamblia
TELPTAR

SEQ ID NO: 3066050 - protein, 9 aa, Giardia lamblia
TELPTSTGV

SEQ ID NO: 3066051 - protein, 13 aa, Giardia lamblia
TELSAGKKANDEH

SEQ ID NO: 3066052 - protein, 10 aa, Giardia lamblia
TEMPTSGHDQ

SEQ ID NO: 3066053 - protein, 10 aa, Giardia lamblia
TEMSSSAAHA

SEQ ID NO: 3066054 - protein, 6 aa, Giardia lamblia
TENDVP

SEQ ID NO: 3066055 - protein, 9 aa, Giardia lamblia
TENKDETKL

SEQ ID NO: 3066056 - protein, 17 aa, Giardia lamblia
TENSNPSTVVQSSPKKL

SEQ ID NO: 3066057 - protein, 7 aa, Giardia lamblia
TENTQSV

SEQ ID NO: 3066058 - protein, 5 aa, Giardia lamblia
TEPEQ

SEQ ID NO: 3066059 - protein, 5 aa, Giardia lamblia
TEPIA

SEQ ID NO: 3066060 - protein, 8 aa, Giardia lamblia
TEPISDKA

SEQ ID NO: 3066061 - protein, 11 aa, Giardia lamblia
TEPKVGSAPEY

SEQ ID NO: 3066062 - protein, 4 aa, Giardia lamblia
TEPL

SEQ ID NO: 3066063 - protein, 26 aa, Giardia lamblia
TEPLDTSTTFSSKSNNYPSKSKYLRK

SEQ ID NO: 3066064 - protein, 6 aa, Giardia lamblia
TEPPLK

SEQ ID NO: 3066065 - protein, 5 aa, Giardia lamblia
TEPSK

SEQ ID NO: 3066066 - protein, 7 aa, Giardia lamblia
TEPTQGI

SEQ ID NO: 3066067 - protein, 5 aa, Giardia lamblia
TEPVG

SEQ ID NO: 3066068 - protein, 4 aa, Giardia lamblia
TEQD

SEQ ID NO: 3066069 - protein, 5 aa, Giardia lamblia
TEQDI

SEQ ID NO: 3066070 - protein, 4 aa, Giardia lamblia
TEQQ

SEQ ID NO: 3066071 - protein, 8 aa, Giardia lamblia
TEQQAGSE

SEQ ID NO: 3066072 - protein, 7 aa, Giardia lamblia
TEQQATT

SEQ ID NO: 3066073 - protein, 9 aa, Giardia lamblia
TEQQTQYEN

SEQ ID NO: 3066074 - protein, 10 aa, Giardia lamblia
TEQSSRTEES

SEQ ID NO: 3066075 - protein, 12 aa, Giardia lamblia
TEQTSKEERQTD

SEQ ID NO: 3066076 - protein, 4 aa, Giardia lamblia
TERG

SEQ ID NO: 3066077 - protein, 14 aa, Giardia lamblia
TERGQPKRSAGQGD

SEQ ID NO: 3066078 - protein, 10 aa, Giardia lamblia
TERKERSLNR

SEQ ID NO: 3066079 - protein, 6 aa, Giardia lamblia
TERPSA

SEQ ID NO: 3066080 - protein, 6 aa, Giardia lamblia
TERQTR

SEQ ID NO: 3066081 - protein, 10 aa, Giardia lamblia
TERSLSESGL

SEQ ID NO: 3066082 - protein, 7 aa, Giardia lamblia
TESEKRL

SEQ ID NO: 3066083 - protein, 5 aa, Giardia lamblia
TESEL

SEQ ID NO: 3066084 - protein, 10 aa, Giardia lamblia
TESGISSIPT

SEQ ID NO: 3066085 - protein, 5 aa, Giardia lamblia
TESIP

SEQ ID NO: 3066086 - protein, 7 aa, Giardia lamblia
TESNPLS

SEQ ID NO: 3066087 - protein, 5 aa, Giardia lamblia
TESPE

SEQ ID NO: 3066088 - protein, 9 aa, Giardia lamblia
TESPLAQEL

SEQ ID NO: 3066089 - protein, 5 aa, Giardia lamblia
TESPM

SEQ ID NO: 3066090 - protein, 4 aa, Giardia lamblia
TESS

SEQ ID NO: 3066091 - protein, 9 aa, Giardia lamblia
TESSPAQTI

SEQ ID NO: 3066092 - protein, 17 aa, Giardia lamblia
TESTCDTRPLSASSAPL

SEQ ID NO: 3066093 - protein, 7 aa, Giardia lamblia
TESYTKH

SEQ ID NO: 3066094 - protein, 5 aa, Giardia lamblia
TETAN

SEQ ID NO: 3066095 - protein, 4 aa, Giardia lamblia
TETM

SEQ ID NO: 3066096 - protein, 4 aa, Giardia lamblia
TETN

SEQ ID NO: 3066097 - protein, 7 aa, Giardia lamblia
TETQEIK

SEQ ID NO: 3066098 - protein, 7 aa, Giardia lamblia
TETQEKE

SEQ ID NO: 3066099 - protein, 5 aa, Giardia lamblia
TETSS

SEQ ID NO: 3066100 - protein, 9 aa, Giardia lamblia
TETSSGDQQ

SEQ ID NO: 3066101 - protein, 7 aa, Giardia lamblia
TEVAKEA

SEQ ID NO: 3066102 - protein, 14 aa, Giardia lamblia
TEVDSGEWGAETDG

SEQ ID NO: 3066103 - protein, 13 aa, Giardia lamblia
TEVETRKSPSDTV

SEQ ID NO: 3066104 - protein, 6 aa, Giardia lamblia
TEVSTK

SEQ ID NO: 3066105 - protein, 8 aa, Giardia lamblia
TEYDEHGN

SEQ ID NO: 3066106 - protein, 6 aa, Giardia lamblia
TEYGTT

SEQ ID NO: 3066107 - protein, 11 aa, Giardia lamblia
TEYKDSYRETY

SEQ ID NO: 3066108 - protein, 13 aa, Giardia lamblia
TEYSSTEDDIHEQ

SEQ ID NO: 3066109 - protein, 16 aa, Giardia lamblia
TEYTGSASSGKKFSSQ

SEQ ID NO: 3066110 - protein, 4 aa, Giardia lamblia
TEYY

SEQ ID NO: 3066111 - protein, 6 aa, Giardia lamblia
TFDPSA

SEQ ID NO: 3066112 - protein, 8 aa, Giardia lamblia
TFDSDKTW

SEQ ID NO: 3066113 - protein, 6 aa, Giardia lamblia
TFEDTE

SEQ ID NO: 3066114 - protein, 5 aa, Giardia lamblia
TFKPP

SEQ ID NO: 3066115 - protein, 4 aa, Giardia lamblia
TFPS

SEQ ID NO: 3066116 - protein, 4 aa, Giardia lamblia
TFQD

SEQ ID NO: 3066117 - protein, 5 aa, Giardia lamblia
TFQDP

SEQ ID NO: 3066118 - protein, 12 aa, Giardia lamblia
TFQGARGAHSGK

SEQ ID NO: 3066119 - protein, 6 aa, Giardia lamblia
TFQGSS

SEQ ID NO: 3066120 - protein, 6 aa, Giardia lamblia
TFSATS

SEQ ID NO: 3066121 - protein, 6 aa, Giardia lamblia
TFSPDV

SEQ ID NO: 3066122 - protein, 5 aa, Giardia lamblia
TFTKE

SEQ ID NO: 3066123 - protein, 7 aa, Giardia lamblia
TFTTANA

SEQ ID NO: 3066124 - protein, 20 aa, Giardia lamblia
TGAAAENSNSSYRGDKLPKN

SEQ ID NO: 3066125 - protein, 9 aa, Giardia lamblia
TGADKDTFS

SEQ ID NO: 3066126 - protein, 6 aa, Giardia lamblia
TGAEKA

SEQ ID NO: 3066127 - protein, 11 aa, Giardia lamblia
TGAEKANLDST

SEQ ID NO: 3066128 - protein, 4 aa, Giardia lamblia
TGAG

SEQ ID NO: 3066129 - protein, 14 aa, Giardia lamblia
TGAISEDDLKSQPV

SEQ ID NO: 3066130 - protein, 19 aa, Giardia lamblia
TGAKPSNEFNGKIQQRDSL

SEQ ID NO: 3066131 - protein, 13 aa, Giardia lamblia
TGALDSPRHRGGT

SEQ ID NO: 3066132 - protein, 6 aa, Giardia lamblia
TGANGE

SEQ ID NO: 3066133 - protein, 7 aa, Giardia lamblia
TGAQSPL

SEQ ID NO: 3066134 - protein, 4 aa, Giardia lamblia
TGAR

SEQ ID NO: 3066135 - protein, 7 aa, Giardia lamblia
TGARQST

SEQ ID NO: 3066136 - protein, 10 aa, Giardia lamblia
TGATNGYTGI

SEQ ID NO: 3066137 - protein, 10 aa, Giardia lamblia
TGATNGYTGV

SEQ ID NO: 3066138 - protein, 7 aa, Giardia lamblia
TGATQLQ

SEQ ID NO: 3066139 - protein, 4 aa, Giardia lamblia
TGDC

SEQ ID NO: 3066140 - protein, 9 aa, Giardia lamblia
TGDDRTKKK

SEQ ID NO: 3066141 - protein, 6 aa, Giardia lamblia
TGDESA

SEQ ID NO: 3066142 - protein, 18 aa, Giardia lamblia
TGDIVGPEDRRTLSGPRS

SEQ ID NO: 3066143 - protein, 10 aa, Giardia lamblia
TGDKGGNTCA

SEQ ID NO: 3066144 - protein, 17 aa, Giardia lamblia
TGDLSGQEATKAPCNGR

SEQ ID NO: 3066145 - protein, 17 aa, Giardia lamblia
TGDLSGQEATKPPCNGR

SEQ ID NO: 3066146 - protein, 14 aa, Giardia lamblia
TGDSSSSISGDGLN

SEQ ID NO: 3066147 - protein, 17 aa, Giardia lamblia
TGDYSDQEATKAPCNGR

SEQ ID NO: 3066148 - protein, 17 aa, Giardia lamblia
TGEDVSSKIIAKWIDMH

SEQ ID NO: 3066149 - protein, 8 aa, Giardia lamblia
TGEEDSMD

SEQ ID NO: 3066150 - protein, 6 aa, Giardia lamblia
TGEESI

SEQ ID NO: 3066151 - protein, 4 aa, Giardia lamblia
TGEG

SEQ ID NO: 3066152 - protein, 4 aa, Giardia lamblia
TGEL

SEQ ID NO: 3066153 - protein, 8 aa, Giardia lamblia
TGEQSNRQ

SEQ ID NO: 3066154 - protein, 10 aa, Giardia lamblia
TGERVDQGLQ

SEQ ID NO: 3066155 - protein, 5 aa, Giardia lamblia
TGESA

SEQ ID NO: 3066156 - protein, 6 aa, Giardia lamblia
TGESLE

SEQ ID NO: 3066157 - protein, 11 aa, Giardia lamblia
TGESTGECSCN

SEQ ID NO: 3066158 - protein, 7 aa, Giardia lamblia
TGEYDSS

SEQ ID NO: 3066159 - protein, 6 aa, Giardia lamblia
TGEYYP

SEQ ID NO: 3066160 - protein, 6 aa, Giardia lamblia
TGGDPN

SEQ ID NO: 3066161 - protein, 7 aa, Giardia lamblia
TGGDTRD

SEQ ID NO: 3066162 - protein, 6 aa, Giardia lamblia
TGGKCT

SEQ ID NO: 3066163 - protein, 14 aa, Giardia lamblia
TGGPDNPDEACSGH

SEQ ID NO: 3066164 - protein, 9 aa, Giardia lamblia
TGGPREKPR

SEQ ID NO: 3066165 - protein, 7 aa, Giardia lamblia
TGGSHSI

SEQ ID NO: 3066166 - protein, 5 aa, Giardia lamblia
TGGSI

SEQ ID NO: 3066167 - protein, 12 aa, Giardia lamblia
TGGSSPMSRSPS

SEQ ID NO: 3066168 - protein, 4 aa, Giardia lamblia
TGGV

SEQ ID NO: 3066169 - protein, 10 aa, Giardia lamblia
TGGVSADGTC

SEQ ID NO: 3066170 - protein, 30 aa, Giardia lamblia
TGHQAGKPVDATASTSSLKQTEMSSNDASS

SEQ ID NO: 3066171 - protein, 12 aa, Giardia lamblia
TGHSVSAKQVDY

SEQ ID NO: 3066172 - protein, 7 aa, Giardia lamblia
TGHYSNN

SEQ ID NO: 3066173 - protein, 7 aa, Giardia lamblia
TGIAPDD

SEQ ID NO: 3066174 - protein, 8 aa, Giardia lamblia
TGIDPKAI

SEQ ID NO: 3066175 - protein, 5 aa, Giardia lamblia
TGIGK

SEQ ID NO: 3066176 - protein, 5 aa, Giardia lamblia
TGIGP

SEQ ID NO: 3066177 - protein, 4 aa, Giardia lamblia
TGIL

SEQ ID NO: 3066178 - protein, 4 aa, Giardia lamblia
TGIS

SEQ ID NO: 3066179 - protein, 10 aa, Giardia lamblia
TGITSSNPST

SEQ ID NO: 3066180 - protein, 9 aa, Giardia lamblia
TGKQPTYVD

SEQ ID NO: 3066181 - protein, 10 aa, Giardia lamblia
TGKRSKSAGA

SEQ ID NO: 3066182 - protein, 15 aa, Giardia lamblia
TGKSSYETLTEDDYG

SEQ ID NO: 3066183 - protein, 9 aa, Giardia lamblia
TGLATSNSQ

SEQ ID NO: 3066184 - protein, 4 aa, Giardia lamblia
TGLD

SEQ ID NO: 3066185 - protein, 9 aa, Giardia lamblia
TGLGPSTHI

SEQ ID NO: 3066186 - protein, 5 aa, Giardia lamblia
TGLPQ

SEQ ID NO: 3066187 - protein, 5 aa, Giardia lamblia
TGLQP

SEQ ID NO: 3066188 - protein, 5 aa, Giardia lamblia
TGLQS

SEQ ID NO: 3066189 - protein, 7 aa, Giardia lamblia
TGLSRTD

SEQ ID NO: 3066190 - protein, 10 aa, Giardia lamblia
TGLSSLTKQP

SEQ ID NO: 3066191 - protein, 5 aa, Giardia lamblia
TGMPS

SEQ ID NO: 3066192 - protein, 4 aa, Giardia lamblia
TGNA

SEQ ID NO: 3066193 - protein, 6 aa, Giardia lamblia
TGNAGV

SEQ ID NO: 3066194 - protein, 4 aa, Giardia lamblia
TGND

SEQ ID NO: 3066195 - protein, 15 aa, Giardia lamblia
TGNISKLADSPSYSA

SEQ ID NO: 3066196 - protein, 6 aa, Giardia lamblia
TGNLEA

SEQ ID NO: 3066197 - protein, 5 aa, Giardia lamblia
TGNPG

SEQ ID NO: 3066198 - protein, 5 aa, Giardia lamblia
TGNPN

SEQ ID NO: 3066199 - protein, 17 aa, Giardia lamblia
TGNRADTTGNKANSIGN

SEQ ID NO: 3066200 - protein, 8 aa, Giardia lamblia
TGPATNKT

SEQ ID NO: 3066201 - protein, 6 aa, Giardia lamblia
TGPGKK

SEQ ID NO: 3066202 - protein, 9 aa, Giardia lamblia
TGPKVNGKE

SEQ ID NO: 3066203 - protein, 7 aa, Giardia lamblia
TGPLVSE

SEQ ID NO: 3066204 - protein, 5 aa, Giardia lamblia
TGPPE

SEQ ID NO: 3066205 - protein, 25 aa, Giardia lamblia
TGPTDRDRLERARKVSSSQLSIPGY

SEQ ID NO: 3066206 - protein, 4 aa, Giardia lamblia
TGPV

SEQ ID NO: 3066207 - protein, 5 aa, Giardia lamblia
TGQCR

SEQ ID NO: 3066208 - protein, 8 aa, Giardia lamblia
TGQDGPLL

SEQ ID NO: 3066209 - protein, 5 aa, Giardia lamblia
TGQEA

SEQ ID NO: 3066210 - protein, 7 aa, Giardia lamblia
TGQGDGT

SEQ ID NO: 3066211 - protein, 5 aa, Giardia lamblia
TGQGT

SEQ ID NO: 3066212 - protein, 6 aa, Giardia lamblia
TGQKNK

SEQ ID NO: 3066213 - protein, 25 aa, Giardia lamblia
TGQNPTSSTVMSPTAASTPGGFTSS

SEQ ID NO: 3066214 - protein, 6 aa, Giardia lamblia
TGQQAS

SEQ ID NO: 3066215 - protein, 4 aa, Giardia lamblia
TGQS

SEQ ID NO: 3066216 - protein, 8 aa, Giardia lamblia
TGRDSTDW

SEQ ID NO: 3066217 - protein, 8 aa, Giardia lamblia
TGREAGTC

SEQ ID NO: 3066218 - protein, 7 aa, Giardia lamblia
TGRGVNK

SEQ ID NO: 3066219 - protein, 6 aa, Giardia lamblia
TGRHTE

SEQ ID NO: 3066220 - protein, 5 aa, Giardia lamblia
TGRNS

SEQ ID NO: 3066221 - protein, 9 aa, Giardia lamblia
TGSAKGKDL

SEQ ID NO: 3066222 - protein, 41 aa, Giardia lamblia
TGSAPHCNTSRTTEEKQELEGPASYHNPDTTSEAQLDSAHA

SEQ ID NO: 3066223 - protein, 15 aa, Giardia lamblia
TGSDVASAVHSSPAE

SEQ ID NO: 3066224 - protein, 10 aa, Giardia lamblia
TGSEMKPPLP

SEQ ID NO: 3066225 - protein, 9 aa, Giardia lamblia
TGSGVSGSL

SEQ ID NO: 3066226 - protein, 4 aa, Giardia lamblia
TGSK

SEQ ID NO: 3066227 - protein, 7 aa, Giardia lamblia
TGSLSPQ

SEQ ID NO: 3066228 - protein, 6 aa, Giardia lamblia
TGSNGD

SEQ ID NO: 3066229 - protein, 8 aa, Giardia lamblia
TGSPQPTA

SEQ ID NO: 3066230 - protein, 4 aa, Giardia lamblia
TGSS

SEQ ID NO: 3066231 - protein, 4 aa, Giardia lamblia
TGST

SEQ ID NO: 3066232 - protein, 13 aa, Giardia lamblia
TGSVRNSSFSQLT

SEQ ID NO: 3066233 - protein, 5 aa, Giardia lamblia
TGTAV

SEQ ID NO: 3066234 - protein, 9 aa, Giardia lamblia
TGTGSSTRL

SEQ ID NO: 3066235 - protein, 4 aa, Giardia lamblia
TGTL

SEQ ID NO: 3066236 - protein, 5 aa, Giardia lamblia
TGTSE

SEQ ID NO: 3066237 - protein, 7 aa, Giardia lamblia
TGTSTSL

SEQ ID NO: 3066238 - protein, 15 aa, Giardia lamblia
TGTVGNDGDSGLNMP

SEQ ID NO: 3066239 - protein, 9 aa, Giardia lamblia
TGTVRPAAA

SEQ ID NO: 3066240 - protein, 5 aa, Giardia lamblia
TGTYN

SEQ ID NO: 3066241 - protein, 9 aa, Giardia lamblia
TGTYNPNDL

SEQ ID NO: 3066242 - protein, 4 aa, Giardia lamblia
TGVA

SEQ ID NO: 3066243 - protein, 9 aa, Giardia lamblia
TGVEDKLQE

SEQ ID NO: 3066244 - protein, 6 aa, Giardia lamblia
TGVPEY

SEQ ID NO: 3066245 - protein, 4 aa, Giardia lamblia
TGVT

SEQ ID NO: 3066246 - protein, 4 aa, Giardia lamblia
TGVY

SEQ ID NO: 3066247 - protein, 11 aa, Giardia lamblia
TGWNDVGEKQR

SEQ ID NO: 3066248 - protein, 8 aa, Giardia lamblia
THDSAKDP

SEQ ID NO: 3066249 - protein, 5 aa, Giardia lamblia
THGAS

SEQ ID NO: 3066250 - protein, 4 aa, Giardia lamblia
THGD

SEQ ID NO: 3066251 - protein, 13 aa, Giardia lamblia
THGESTGSQYPSV

SEQ ID NO: 3066252 - protein, 11 aa, Giardia lamblia
THGGSVKVRPN

SEQ ID NO: 3066253 - protein, 12 aa, Giardia lamblia
THHGTDSNFTAN

SEQ ID NO: 3066254 - protein, 11 aa, Giardia lamblia
THKDSTEVRAE

SEQ ID NO: 3066255 - protein, 13 aa, Giardia lamblia
THKTEVSAHQEKL

SEQ ID NO: 3066256 - protein, 5 aa, Giardia lamblia
THKYE

SEQ ID NO: 3066257 - protein, 7 aa, Giardia lamblia
THNQNKS

SEQ ID NO: 3066258 - protein, 9 aa, Giardia lamblia
THNSTHSSH

SEQ ID NO: 3066259 - protein, 6 aa, Giardia lamblia
THPTAK

SEQ ID NO: 3066260 - protein, 14 aa, Giardia lamblia
THPVSGSTGGRDSG

SEQ ID NO: 3066261 - protein, 7 aa, Giardia lamblia
THQGETA

SEQ ID NO: 3066262 - protein, 4 aa, Giardia lamblia
THRI

SEQ ID NO: 3066263 - protein, 14 aa, Giardia lamblia
THSASSKIETTADG

SEQ ID NO: 3066264 - protein, 10 aa, Giardia lamblia
THSGDIQETN

SEQ ID NO: 3066265 - protein, 23 aa, Giardia lamblia
THSGLKETGLKGPYISSSRSVNQ

SEQ ID NO: 3066266 - protein, 8 aa, Giardia lamblia
THSGSQCG

SEQ ID NO: 3066267 - protein, 12 aa, Giardia lamblia
THSHSSSKSEDL

SEQ ID NO: 3066268 - protein, 8 aa, Giardia lamblia
THSLPTSN

SEQ ID NO: 3066269 - protein, 4 aa, Giardia lamblia
THSM

SEQ ID NO: 3066270 - protein, 6 aa, Giardia lamblia
THSSQQ

SEQ ID NO: 3066271 - protein, 4 aa, Giardia lamblia
THST

SEQ ID NO: 3066272 - protein, 6 aa, Giardia lamblia
THSTDY

SEQ ID NO: 3066273 - protein, 5 aa, Giardia lamblia
THSYS

SEQ ID NO: 3066274 - protein, 6 aa, Giardia lamblia
THTRDL

SEQ ID NO: 3066275 - protein, 4 aa, Giardia lamblia
THWR

SEQ ID NO: 3066276 - protein, 12 aa, Giardia lamblia
TIAAPDRPLSND

SEQ ID NO: 3066277 - protein, 9 aa, Giardia lamblia
TIATQESTF

SEQ ID NO: 3066278 - protein, 44 aa, Giardia lamblia
TIDPEKSAIPATKSVTSSSTKSSVYRDRTTSRSRSRSPTSPSLT

SEQ ID NO: 3066279 - protein, 5 aa, Giardia lamblia
TIDPS

SEQ ID NO: 3066280 - protein, 9 aa, Giardia lamblia
TIDSTKETA

SEQ ID NO: 3066281 - protein, 7 aa, Giardia lamblia
TIDTPAT

SEQ ID NO: 3066282 - protein, 4 aa, Giardia lamblia
TIED

SEQ ID NO: 3066283 - protein, 22 aa, Giardia lamblia
TIEKESTSSRKIPNQQSPVRAN

SEQ ID NO: 3066284 - protein, 5 aa, Giardia lamblia
TIEPR

SEQ ID NO: 3066285 - protein, 12 aa, Giardia lamblia
TIEQPDITRPDL

SEQ ID NO: 3066286 - protein, 13 aa, Giardia lamblia
TIEYSTDNELSDT

SEQ ID NO: 3066287 - protein, 7 aa, Giardia lamblia
TIGDDGN

SEQ ID NO: 3066288 - protein, 6 aa, Giardia lamblia
TIHAST

SEQ ID NO: 3066289 - protein, 4 aa, Giardia lamblia
TIKE

SEQ ID NO: 3066290 - protein, 6 aa, Giardia lamblia
TIKEKI

SEQ ID NO: 3066291 - protein, 26 aa, Giardia lamblia
TIPEEGSKKTSLSGGNPATKTPRRAS

SEQ ID NO: 3066292 - protein, 5 aa, Giardia lamblia
TIPEQ

SEQ ID NO: 3066293 - protein, 15 aa, Giardia lamblia
TIPSSDRLTNSNEKD

SEQ ID NO: 3066294 - protein, 6 aa, Giardia lamblia
TIPSTL

SEQ ID NO: 3066295 - protein, 7 aa, Giardia lamblia
TIQATSS

SEQ ID NO: 3066296 - protein, 7 aa, Giardia lamblia
TIQQEEA

SEQ ID NO: 3066297 - protein, 9 aa, Giardia lamblia
TIQTKEAEC

SEQ ID NO: 3066298 - protein, 7 aa, Giardia lamblia
TIRDDGV

SEQ ID NO: 3066299 - protein, 4 aa, Giardia lamblia
TIRQ

SEQ ID NO: 3066300 - protein, 7 aa, Giardia lamblia
TISESEV

SEQ ID NO: 3066301 - protein, 9 aa, Giardia lamblia
TISNRKDHP

SEQ ID NO: 3066302 - protein, 9 aa, Giardia lamblia
TISPSAVSG

SEQ ID NO: 3066303 - protein, 5 aa, Giardia lamblia
TISQA

SEQ ID NO: 3066304 - protein, 15 aa, Giardia lamblia
TISQTPKTKTTSATV

SEQ ID NO: 3066305 - protein, 26 aa, Giardia lamblia
TISSDSNSGMAHDDDDDNDTTVDADD

SEQ ID NO: 3066306 - protein, 9 aa, Giardia lamblia
TISSEGHAK

SEQ ID NO: 3066307 - protein, 24 aa, Giardia lamblia
TISSERENELKREGPNLKKDLEDG

SEQ ID NO: 3066308 - protein, 7 aa, Giardia lamblia
TISSTQD

SEQ ID NO: 3066309 - protein, 6 aa, Giardia lamblia
TISYDN

SEQ ID NO: 3066310 - protein, 14 aa, Giardia lamblia
TITASSSSSDPRYG

SEQ ID NO: 3066311 - protein, 5 aa, Giardia lamblia
TITDD

SEQ ID NO: 3066312 - protein, 9 aa, Giardia lamblia
TITETVAST

SEQ ID NO: 3066313 - protein, 7 aa, Giardia lamblia
TITNTDE

SEQ ID NO: 3066314 - protein, 5 aa, Giardia lamblia
TITQG

SEQ ID NO: 3066315 - protein, 19 aa, Giardia lamblia
TKAAQETNQPPGASATGQS

SEQ ID NO: 3066316 - protein, 4 aa, Giardia lamblia
TKAC

SEQ ID NO: 3066317 - protein, 10 aa, Giardia lamblia
TKADGAVECP

SEQ ID NO: 3066318 - protein, 9 aa, Giardia lamblia
TKADPGLAN

SEQ ID NO: 3066319 - protein, 8 aa, Giardia lamblia
TKANDSAY

SEQ ID NO: 3066320 - protein, 15 aa, Giardia lamblia
TKAQDDAVISSNPQD

SEQ ID NO: 3066321 - protein, 5 aa, Giardia lamblia
TKARE

SEQ ID NO: 3066322 - protein, 37 aa, Giardia lamblia
TKASGAFASISPADQHGALDSSSSQKERGWRTRGTAA

SEQ ID NO: 3066323 - protein, 10 aa, Giardia lamblia
TKATTPPAAP

SEQ ID NO: 3066324 - protein, 7 aa, Giardia lamblia
TKCGSCT

SEQ ID NO: 3066325 - protein, 6 aa, Giardia lamblia
TKDEEA

SEQ ID NO: 3066326 - protein, 8 aa, Giardia lamblia
TKDFPGSN

SEQ ID NO: 3066327 - protein, 7 aa, Giardia lamblia
TKDGQTA

SEQ ID NO: 3066328 - protein, 14 aa, Giardia lamblia
TKDPLDKAEEPKDF

SEQ ID NO: 3066329 - protein, 7 aa, Giardia lamblia
TKDPTKG

SEQ ID NO: 3066330 - protein, 8 aa, Giardia lamblia
TKDPTKGL

SEQ ID NO: 3066331 - protein, 7 aa, Giardia lamblia
TKDQQRQ

SEQ ID NO: 3066332 - protein, 9 aa, Giardia lamblia
TKDRRPSYK

SEQ ID NO: 3066333 - protein, 7 aa, Giardia lamblia
TKDTSDF

SEQ ID NO: 3066334 - protein, 4 aa, Giardia lamblia
TKEH

SEQ ID NO: 3066335 - protein, 9 aa, Giardia lamblia
TKEKNSAVA

SEQ ID NO: 3066336 - protein, 10 aa, Giardia lamblia
TKERAPGTSI

SEQ ID NO: 3066337 - protein, 7 aa, Giardia lamblia
TKEVYQP

SEQ ID NO: 3066338 - protein, 6 aa, Giardia lamblia
TKGAPE

SEQ ID NO: 3066339 - protein, 6 aa, Giardia lamblia
TKGEKG

SEQ ID NO: 3066340 - protein, 10 aa, Giardia lamblia
TKGGEPLTKI

SEQ ID NO: 3066341 - protein, 7 aa, Giardia lamblia
TKGKEHN

SEQ ID NO: 3066342 - protein, 8 aa, Giardia lamblia
TKGKTLDE

SEQ ID NO: 3066343 - protein, 11 aa, Giardia lamblia
TKGQDGTSTFK

SEQ ID NO: 3066344 - protein, 5 aa, Giardia lamblia
TKGQH

SEQ ID NO: 3066345 - protein, 13 aa, Giardia lamblia
TKGRRSEKKSTYN

SEQ ID NO: 3066346 - protein, 6 aa, Giardia lamblia
TKGSVG

SEQ ID NO: 3066347 - protein, 4 aa, Giardia lamblia
TKGT

SEQ ID NO: 3066348 - protein, 8 aa, Giardia lamblia
TKGTVSDV

SEQ ID NO: 3066349 - protein, 19 aa, Giardia lamblia
TKHGVSPRRVANRGPRDRP

SEQ ID NO: 3066350 - protein, 7 aa, Giardia lamblia
TKITAGY

SEQ ID NO: 3066351 - protein, 16 aa, Giardia lamblia
TKKIGPKYDNRDSRPL

SEQ ID NO: 3066352 - protein, 5 aa, Giardia lamblia
TKKKF

SEQ ID NO: 3066353 - protein, 9 aa, Giardia lamblia
TKKKTDRKV

SEQ ID NO: 3066354 - protein, 9 aa, Giardia lamblia
TKKPKAKMS

SEQ ID NO: 3066355 - protein, 6 aa, Giardia lamblia
TKKPTM

SEQ ID NO: 3066356 - protein, 15 aa, Giardia lamblia
TKKRSRKRGKQMSVS

SEQ ID NO: 3066357 - protein, 10 aa, Giardia lamblia
TKKSTGSDGA

SEQ ID NO: 3066358 - protein, 7 aa, Giardia lamblia
TKKTTPL

SEQ ID NO: 3066359 - protein, 7 aa, Giardia lamblia
TKLAPQD

SEQ ID NO: 3066360 - protein, 9 aa, Giardia lamblia
TKLKQSAEQ

SEQ ID NO: 3066361 - protein, 5 aa, Giardia lamblia
TKLPR

SEQ ID NO: 3066362 - protein, 22 aa, Giardia lamblia
TKLRPSSRRNRGSTSAQRGTVS

SEQ ID NO: 3066363 - protein, 9 aa, Giardia lamblia
TKMKKDADN

SEQ ID NO: 3066364 - protein, 4 aa, Giardia lamblia
TKNC

SEQ ID NO: 3066365 - protein, 7 aa, Giardia lamblia
TKNDHGT

SEQ ID NO: 3066366 - protein, 7 aa, Giardia lamblia
TKNEMTS

SEQ ID NO: 3066367 - protein, 9 aa, Giardia lamblia
TKNGSSYCT

SEQ ID NO: 3066368 - protein, 5 aa, Giardia lamblia
TKNHP

SEQ ID NO: 3066369 - protein, 19 aa, Giardia lamblia
TKNIATPGHSSLTANFGDS

SEQ ID NO: 3066370 - protein, 9 aa, Giardia lamblia
TKNSAKVGG

SEQ ID NO: 3066371 - protein, 7 aa, Giardia lamblia
TKNSNDA

SEQ ID NO: 3066372 - protein, 10 aa, Giardia lamblia
TKNSNPVHPS

SEQ ID NO: 3066373 - protein, 8 aa, Giardia lamblia
TKNTCPDG

SEQ ID NO: 3066374 - protein, 8 aa, Giardia lamblia
TKNTIRSR

SEQ ID NO: 3066375 - protein, 12 aa, Giardia lamblia
TKNTRLSEDGEP

SEQ ID NO: 3066376 - protein, 4 aa, Giardia lamblia
TKPG

SEQ ID NO: 3066377 - protein, 5 aa, Giardia lamblia
TKPGT

SEQ ID NO: 3066378 - protein, 10 aa, Giardia lamblia
TKPHRAPARK

SEQ ID NO: 3066379 - protein, 11 aa, Giardia lamblia
TKPHSVSTATT

SEQ ID NO: 3066380 - protein, 9 aa, Giardia lamblia
TKPKGTDDV

SEQ ID NO: 3066381 - protein, 10 aa, Giardia lamblia
TKPKSTQATD

SEQ ID NO: 3066382 - protein, 4 aa, Giardia lamblia
TKPL

SEQ ID NO: 3066383 - protein, 6 aa, Giardia lamblia
TKPPLK

SEQ ID NO: 3066384 - protein, 4 aa, Giardia lamblia
TKPS

SEQ ID NO: 3066385 - protein, 8 aa, Giardia lamblia
TKPSAPEV

SEQ ID NO: 3066386 - protein, 6 aa, Giardia lamblia
TKPSKR

SEQ ID NO: 3066387 - protein, 16 aa, Giardia lamblia
TKPSRSSKGPSKRGFD

SEQ ID NO: 3066388 - protein, 9 aa, Giardia lamblia
TKPSTCPDS

SEQ ID NO: 3066389 - protein, 9 aa, Giardia lamblia
TKPSVKTIS

SEQ ID NO: 3066390 - protein, 6 aa, Giardia lamblia
TKPTHA

SEQ ID NO: 3066391 - protein, 7 aa, Giardia lamblia
TKPTTQN

SEQ ID NO: 3066392 - protein, 6 aa, Giardia lamblia
TKQAEE

SEQ ID NO: 3066393 - protein, 8 aa, Giardia lamblia
TKQDEGKG

SEQ ID NO: 3066394 - protein, 6 aa, Giardia lamblia
TKQDSQ

SEQ ID NO: 3066395 - protein, 8 aa, Giardia lamblia
TKQIAKEK

SEQ ID NO: 3066396 - protein, 4 aa, Giardia lamblia
TKQL

SEQ ID NO: 3066397 - protein, 8 aa, Giardia lamblia
TKQNTEHC

SEQ ID NO: 3066398 - protein, 9 aa, Giardia lamblia
TKQQTNQGY

SEQ ID NO: 3066399 - protein, 8 aa, Giardia lamblia
TKQRNASV

SEQ ID NO: 3066400 - protein, 9 aa, Giardia lamblia
TKQTADNTP

SEQ ID NO: 3066401 - protein, 7 aa, Giardia lamblia
TKQTITG

SEQ ID NO: 3066402 - protein, 7 aa, Giardia lamblia
TKQTSAK

SEQ ID NO: 3066403 - protein, 19 aa, Giardia lamblia
TKRGASVSRETSGDDTEYS

SEQ ID NO: 3066404 - protein, 17 aa, Giardia lamblia
TKRKERDSSAGNGPQAL

SEQ ID NO: 3066405 - protein, 7 aa, Giardia lamblia
TKRLSEA

SEQ ID NO: 3066406 - protein, 6 aa, Giardia lamblia
TKRLSP

SEQ ID NO: 3066407 - protein, 6 aa, Giardia lamblia
TKRNAR

SEQ ID NO: 3066408 - protein, 15 aa, Giardia lamblia
TKRPPRGDRKEPKEN

SEQ ID NO: 3066409 - protein, 7 aa, Giardia lamblia
TKRPTDD

SEQ ID NO: 3066410 - protein, 9 aa, Giardia lamblia
TKRRQRKFE

SEQ ID NO: 3066411 - protein, 7 aa, Giardia lamblia
TKRTAIT

SEQ ID NO: 3066412 - protein, 11 aa, Giardia lamblia
TKSADAAGTPM

SEQ ID NO: 3066413 - protein, 8 aa, Giardia lamblia
TKSAGVTE

SEQ ID NO: 3066414 - protein, 5 aa, Giardia lamblia
TKSEL

SEQ ID NO: 3066415 - protein, 17 aa, Giardia lamblia
TKSGLNPDGLSKQEQSL

SEQ ID NO: 3066416 - protein, 10 aa, Giardia lamblia
TKSLSPPDKL

SEQ ID NO: 3066417 - protein, 7 aa, Giardia lamblia
TKSNSNV

SEQ ID NO: 3066418 - protein, 7 aa, Giardia lamblia
TKSQVDP

SEQ ID NO: 3066419 - protein, 9 aa, Giardia lamblia
TKSRNNSSL

SEQ ID NO: 3066420 - protein, 5 aa, Giardia lamblia
TKSRQ

SEQ ID NO: 3066421 - protein, 7 aa, Giardia lamblia
TKSSDGD

SEQ ID NO: 3066422 - protein, 7 aa, Giardia lamblia
TKSSGTE

SEQ ID NO: 3066423 - protein, 11 aa, Giardia lamblia
TKSVKRDGSIV

SEQ ID NO: 3066424 - protein, 14 aa, Giardia lamblia
TKSVQNNTSEVATK

SEQ ID NO: 3066425 - protein, 5 aa, Giardia lamblia
TKSYM

SEQ ID NO: 3066426 - protein, 8 aa, Giardia lamblia
TKTAYGAR

SEQ ID NO: 3066427 - protein, 8 aa, Giardia lamblia
TKTDLDQD

SEQ ID NO: 3066428 - protein, 6 aa, Giardia lamblia
TKTDYS

SEQ ID NO: 3066429 - protein, 6 aa, Giardia lamblia
TKTEAF

SEQ ID NO: 3066430 - protein, 7 aa, Giardia lamblia
TKTERKK

SEQ ID NO: 3066431 - protein, 29 aa, Giardia lamblia
TKTGTGDTTTITEAEVKTNKVTTQVASNS

SEQ ID NO: 3066432 - protein, 23 aa, Giardia lamblia
TKTLENRKAREEEAALQRKESQL

SEQ ID NO: 3066433 - protein, 6 aa, Giardia lamblia
TKTPES

SEQ ID NO: 3066434 - protein, 8 aa, Giardia lamblia
TKTPISTI

SEQ ID NO: 3066435 - protein, 5 aa, Giardia lamblia
TKTQF

SEQ ID NO: 3066436 - protein, 8 aa, Giardia lamblia
TKTRKSGH

SEQ ID NO: 3066437 - protein, 7 aa, Giardia lamblia
TKTSRSA

SEQ ID NO: 3066438 - protein, 13 aa, Giardia lamblia
TKTSSRGKKQPRS

SEQ ID NO: 3066439 - protein, 14 aa, Giardia lamblia
TKTSSSTEQSSSFD

SEQ ID NO: 3066440 - protein, 7 aa, Giardia lamblia
TKTSTVG

SEQ ID NO: 3066441 - protein, 8 aa, Giardia lamblia
TKTSVGKD

SEQ ID NO: 3066442 - protein, 9 aa, Giardia lamblia
TKVGSEGNH

SEQ ID NO: 3066443 - protein, 4 aa, Giardia lamblia
TKVP

SEQ ID NO: 3066444 - protein, 5 aa, Giardia lamblia
TKVRG

SEQ ID NO: 3066445 - protein, 11 aa, Giardia lamblia
TKVTSTARTFD

SEQ ID NO: 3066446 - protein, 7 aa, Giardia lamblia
TLAATTN

SEQ ID NO: 3066447 - protein, 10 aa, Giardia lamblia
TLAGPEAPEY

SEQ ID NO: 3066448 - protein, 14 aa, Giardia lamblia
TLAPLRTNSEENAS

SEQ ID NO: 3066449 - protein, 6 aa, Giardia lamblia
TLARQG

SEQ ID NO: 3066450 - protein, 5 aa, Giardia lamblia
TLASA

SEQ ID NO: 3066451 - protein, 8 aa, Giardia lamblia
TLASESTQ

SEQ ID NO: 3066452 - protein, 13 aa, Giardia lamblia
TLCGGNGDCQLSD

SEQ ID NO: 3066453 - protein, 26 aa, Giardia lamblia
TLCGGNGDCQLSDGGSCSCRSGYETV

SEQ ID NO: 3066454 - protein, 17 aa, Giardia lamblia
TLCGGNGNCPLSTDSTC

SEQ ID NO: 3066455 - protein, 33 aa, Giardia lamblia
TLDHTSPSNIDNKLPNQGSSALGEDQQLPQHAT

SEQ ID NO: 3066456 - protein, 45 aa, Giardia lamblia
TLDPEDCKTTPSHSDDDGGDLQGKTSRVSETDSEYSDGKDPDEKL

SEQ ID NO: 3066457 - protein, 7 aa, Giardia lamblia
TLDPSNL

SEQ ID NO: 3066458 - protein, 13 aa, Giardia lamblia
TLDPYSSKLTEDE

SEQ ID NO: 3066459 - protein, 4 aa, Giardia lamblia
TLDS

SEQ ID NO: 3066460 - protein, 11 aa, Giardia lamblia
TLDTSTISEED

SEQ ID NO: 3066461 - protein, 4 aa, Giardia lamblia
TLEG

SEQ ID NO: 3066462 - protein, 10 aa, Giardia lamblia
TLEGGQPELS

SEQ ID NO: 3066463 - protein, 7 aa, Giardia lamblia
TLEGSGI

SEQ ID NO: 3066464 - protein, 10 aa, Giardia lamblia
TLENETEEPV

SEQ ID NO: 3066465 - protein, 10 aa, Giardia lamblia
TLENGTPADM

SEQ ID NO: 3066466 - protein, 7 aa, Giardia lamblia
TLENTQD

SEQ ID NO: 3066467 - protein, 21 aa, Giardia lamblia
TLEPESTSAPHSPSSLPADST

SEQ ID NO: 3066468 - protein, 8 aa, Giardia lamblia
TLEPSAND

SEQ ID NO: 3066469 - protein, 4 aa, Giardia lamblia
TLEQ

SEQ ID NO: 3066470 - protein, 6 aa, Giardia lamblia
TLEQAQ

SEQ ID NO: 3066471 - protein, 10 aa, Giardia lamblia
TLETEGAIET

SEQ ID NO: 3066472 - protein, 5 aa, Giardia lamblia
TLETR

SEQ ID NO: 3066473 - protein, 11 aa, Giardia lamblia
TLGKSATDQIE

SEQ ID NO: 3066474 - protein, 12 aa, Giardia lamblia
TLGNKPPATPSY

SEQ ID NO: 3066475 - protein, 8 aa, Giardia lamblia
TLGQSKGY

SEQ ID NO: 3066476 - protein, 8 aa, Giardia lamblia
TLGSSSSK

SEQ ID NO: 3066477 - protein, 9 aa, Giardia lamblia
TLKESPTKV

SEQ ID NO: 3066478 - protein, 11 aa, Giardia lamblia
TLKGEDGVSAT

SEQ ID NO: 3066479 - protein, 13 aa, Giardia lamblia
TLKSPSSTTDHER

SEQ ID NO: 3066480 - protein, 4 aa, Giardia lamblia
TLND

SEQ ID NO: 3066481 - protein, 12 aa, Giardia lamblia
TLNNHGGGSKQA

SEQ ID NO: 3066482 - protein, 6 aa, Giardia lamblia
TLNTKD

SEQ ID NO: 3066483 - protein, 10 aa, Giardia lamblia
TLPCSSTPSY

SEQ ID NO: 3066484 - protein, 5 aa, Giardia lamblia
TLPDE

SEQ ID NO: 3066485 - protein, 18 aa, Giardia lamblia
TLPENDKFANPNDPASKN

SEQ ID NO: 3066486 - protein, 39 aa, Giardia lamblia
TLPGGASPDKISYASESSVRADNGHQKRPREDPEDRDVN

SEQ ID NO: 3066487 - protein, 17 aa, Giardia lamblia
TLPNTSTSTVAASSSVN

SEQ ID NO: 3066488 - protein, 8 aa, Giardia lamblia
TLPPEYPY

SEQ ID NO: 3066489 - protein, 5 aa, Giardia lamblia
TLPPG

SEQ ID NO: 3066490 - protein, 13 aa, Giardia lamblia
TLPPTVPSFPSPI

SEQ ID NO: 3066491 - protein, 5 aa, Giardia lamblia
TLPSR

SEQ ID NO: 3066492 - protein, 7 aa, Giardia lamblia
TLPSSTT

SEQ ID NO: 3066493 - protein, 21 aa, Giardia lamblia
TLPSTSALSDTSKTDTISSTS

SEQ ID NO: 3066494 - protein, 31 aa, Giardia lamblia
TLPSVSSNDPFSNKPSFGSHVGPSATPDNEL

SEQ ID NO: 3066495 - protein, 9 aa, Giardia lamblia
TLQPSKSRA

SEQ ID NO: 3066496 - protein, 9 aa, Giardia lamblia
TLRDDTSEL

SEQ ID NO: 3066497 - protein, 6 aa, Giardia lamblia
TLRDKP

SEQ ID NO: 3066498 - protein, 4 aa, Giardia lamblia
TLRP

SEQ ID NO: 3066499 - protein, 5 aa, Giardia lamblia
TLRPA

SEQ ID NO: 3066500 - protein, 6 aa, Giardia lamblia
TLRPSQ

SEQ ID NO: 3066501 - protein, 11 aa, Giardia lamblia
TLSAEGKGAIV

SEQ ID NO: 3066502 - protein, 10 aa, Giardia lamblia
TLSASGNGVY

SEQ ID NO: 3066503 - protein, 9 aa, Giardia lamblia
TLSGGQKAR

SEQ ID NO: 3066504 - protein, 7 aa, Giardia lamblia
TLSKTHQ

SEQ ID NO: 3066505 - protein, 8 aa, Giardia lamblia
TLSNNSIS

SEQ ID NO: 3066506 - protein, 15 aa, Giardia lamblia
TLSNPNTSNMQKASI

SEQ ID NO: 3066507 - protein, 10 aa, Giardia lamblia
TLSNPSKEGF

SEQ ID NO: 3066508 - protein, 4 aa, Giardia lamblia
TLSP

SEQ ID NO: 3066509 - protein, 14 aa, Giardia lamblia
TLSRSSTSSSSSDK

SEQ ID NO: 3066510 - protein, 9 aa, Giardia lamblia
TLSSSDGKL

SEQ ID NO: 3066511 - protein, 5 aa, Giardia lamblia
TLSST

SEQ ID NO: 3066512 - protein, 6 aa, Giardia lamblia
TLSSTP

SEQ ID NO: 3066513 - protein, 9 aa, Giardia lamblia
TLSTDHASL

SEQ ID NO: 3066514 - protein, 8 aa, Giardia lamblia
TLTDSDGM

SEQ ID NO: 3066515 - protein, 7 aa, Giardia lamblia
TLTPDRA

SEQ ID NO: 3066516 - protein, 11 aa, Giardia lamblia
TLTPERTQKDV

SEQ ID NO: 3066517 - protein, 12 aa, Giardia lamblia
TLTRTNTSGLTA

SEQ ID NO: 3066518 - protein, 10 aa, Giardia lamblia
TLTVSDNTGN

SEQ ID NO: 3066519 - protein, 8 aa, Giardia lamblia
TMADNKTR

SEQ ID NO: 3066520 - protein, 4 aa, Giardia lamblia
TMDS

SEQ ID NO: 3066521 - protein, 33 aa, Giardia lamblia
TMPGAGLGAASSPEESFNPENYEDSLPQGGDAH

SEQ ID NO: 3066522 - protein, 4 aa, Giardia lamblia
TMPQ

SEQ ID NO: 3066523 - protein, 5 aa, Giardia lamblia
TMSPA

SEQ ID NO: 3066524 - protein, 6 aa, Giardia lamblia
TMSTSD

SEQ ID NO: 3066525 - protein, 7 aa, Giardia lamblia
TMTRTSG

SEQ ID NO: 3066526 - protein, 5 aa, Giardia lamblia
TNAAV

SEQ ID NO: 3066527 - protein, 11 aa, Giardia lamblia
TNAERQDKTRL

SEQ ID NO: 3066528 - protein, 5 aa, Giardia lamblia
TNAET

SEQ ID NO: 3066529 - protein, 7 aa, Giardia lamblia
TNAHESE

SEQ ID NO: 3066530 - protein, 11 aa, Giardia lamblia
TNAKIPETGGE

SEQ ID NO: 3066531 - protein, 10 aa, Giardia lamblia
TNARKDRTDT

SEQ ID NO: 3066532 - protein, 5 aa, Giardia lamblia
TNASG

SEQ ID NO: 3066533 - protein, 8 aa, Giardia lamblia
TNASRDEL

SEQ ID NO: 3066534 - protein, 8 aa, Giardia lamblia
TNATHKAA

SEQ ID NO: 3066535 - protein, 6 aa, Giardia lamblia
TNATKR

SEQ ID NO: 3066536 - protein, 20 aa, Giardia lamblia
TNCNGDHRQRKCPGSSKRGC

SEQ ID NO: 3066537 - protein, 6 aa, Giardia lamblia
TNCPAS

SEQ ID NO: 3066538 - protein, 11 aa, Giardia lamblia
TNCPSGDRNNT

SEQ ID NO: 3066539 - protein, 24 aa, Giardia lamblia
TNDEESLTDTNEAYSTAYNETHGA

SEQ ID NO: 3066540 - protein, 10 aa, Giardia lamblia
TNDGTPQCTT

SEQ ID NO: 3066541 - protein, 9 aa, Giardia lamblia
TNDSGGVAE

SEQ ID NO: 3066542 - protein, 13 aa, Giardia lamblia
TNDTSSSSATQNY

SEQ ID NO: 3066543 - protein, 14 aa, Giardia lamblia
TNEADTTKAIPPSF

SEQ ID NO: 3066544 - protein, 4 aa, Giardia lamblia
TNED

SEQ ID NO: 3066545 - protein, 5 aa, Giardia lamblia
TNEGE

SEQ ID NO: 3066546 - protein, 8 aa, Giardia lamblia
TNEPTQLS

SEQ ID NO: 3066547 - protein, 7 aa, Giardia lamblia
TNESAQD

SEQ ID NO: 3066548 - protein, 8 aa, Giardia lamblia
TNETKAEF

SEQ ID NO: 3066549 - protein, 6 aa, Giardia lamblia
TNEVSS

SEQ ID NO: 3066550 - protein, 8 aa, Giardia lamblia
TNFPGKEG

SEQ ID NO: 3066551 - protein, 8 aa, Giardia lamblia
TNGAGKSS

SEQ ID NO: 3066552 - protein, 5 aa, Giardia lamblia
TNGDA

SEQ ID NO: 3066553 - protein, 6 aa, Giardia lamblia
TNGGIS

SEQ ID NO: 3066554 - protein, 7 aa, Giardia lamblia
TNGGSQI

SEQ ID NO: 3066555 - protein, 8 aa, Giardia lamblia
TNGTNENP

SEQ ID NO: 3066556 - protein, 6 aa, Giardia lamblia
TNHRAN

SEQ ID NO: 3066557 - protein, 4 aa, Giardia lamblia
TNIR

SEQ ID NO: 3066558 - protein, 14 aa, Giardia lamblia
TNISHSSSNVSNDY

SEQ ID NO: 3066559 - protein, 9 aa, Giardia lamblia
TNKKEAPAN

SEQ ID NO: 3066560 - protein, 7 aa, Giardia lamblia
TNKPKLT

SEQ ID NO: 3066561 - protein, 9 aa, Giardia lamblia
TNKPPEDQW

SEQ ID NO: 3066562 - protein, 6 aa, Giardia lamblia
TNLAGQ

SEQ ID NO: 3066563 - protein, 9 aa, Giardia lamblia
TNLDNNPSN

SEQ ID NO: 3066564 - protein, 4 aa, Giardia lamblia
TNLQ

SEQ ID NO: 3066565 - protein, 11 aa, Giardia lamblia
TNLQATKNNMT

SEQ ID NO: 3066566 - protein, 14 aa, Giardia lamblia
TNLQGASASQYSHE

SEQ ID NO: 3066567 - protein, 5 aa, Giardia lamblia
TNLTE

SEQ ID NO: 3066568 - protein, 11 aa, Giardia lamblia
TNMQSKMSEEI

SEQ ID NO: 3066569 - protein, 11 aa, Giardia lamblia
TNNEATQANEV

SEQ ID NO: 3066570 - protein, 7 aa, Giardia lamblia
TNNEGNT

SEQ ID NO: 3066571 - protein, 14 aa, Giardia lamblia
TNNFKTNSRHNELA

SEQ ID NO: 3066572 - protein, 5 aa, Giardia lamblia
TNNGT

SEQ ID NO: 3066573 - protein, 10 aa, Giardia lamblia
TNNLPNPATA

SEQ ID NO: 3066574 - protein, 5 aa, Giardia lamblia
TNNMH

SEQ ID NO: 3066575 - protein, 7 aa, Giardia lamblia
TNNNGIQ

SEQ ID NO: 3066576 - protein, 4 aa, Giardia lamblia
TNNP

SEQ ID NO: 3066577 - protein, 4 aa, Giardia lamblia
TNPA

SEQ ID NO: 3066578 - protein, 5 aa, Giardia lamblia
TNPDI

SEQ ID NO: 3066579 - protein, 5 aa, Giardia lamblia
TNPDK

SEQ ID NO: 3066580 - protein, 7 aa, Giardia lamblia
TNPDTDC

SEQ ID NO: 3066581 - protein, 5 aa, Giardia lamblia
TNPEE

SEQ ID NO: 3066582 - protein, 7 aa, Giardia lamblia
TNPLTQE

SEQ ID NO: 3066583 - protein, 8 aa, Giardia lamblia
TNPNLSPD

SEQ ID NO: 3066584 - protein, 9 aa, Giardia lamblia
TNPNYDQQN

SEQ ID NO: 3066585 - protein, 7 aa, Giardia lamblia
TNPPPEA

SEQ ID NO: 3066586 - protein, 6 aa, Giardia lamblia
TNPSSA

SEQ ID NO: 3066587 - protein, 8 aa, Giardia lamblia
TNPTASDM

SEQ ID NO: 3066588 - protein, 9 aa, Giardia lamblia
TNPTTPTRI

SEQ ID NO: 3066589 - protein, 5 aa, Giardia lamblia
TNPTV

SEQ ID NO: 3066590 - protein, 6 aa, Giardia lamblia
TNPVYK

SEQ ID NO: 3066591 - protein, 6 aa, Giardia lamblia
TNQDPE

SEQ ID NO: 3066592 - protein, 9 aa, Giardia lamblia
TNQNIDPED

SEQ ID NO: 3066593 - protein, 8 aa, Giardia lamblia
TNQPIKRS

SEQ ID NO: 3066594 - protein, 10 aa, Giardia lamblia
TNQQRTPPIV

SEQ ID NO: 3066595 - protein, 8 aa, Giardia lamblia
TNQQTSSY

SEQ ID NO: 3066596 - protein, 11 aa, Giardia lamblia
TNQSPSSFERE

SEQ ID NO: 3066597 - protein, 4 aa, Giardia lamblia
TNRE

SEQ ID NO: 3066598 - protein, 17 aa, Giardia lamblia
TNREVGGTVDKNVNEEK

SEQ ID NO: 3066599 - protein, 6 aa, Giardia lamblia
TNRKTT

SEQ ID NO: 3066600 - protein, 4 aa, Giardia lamblia
TNRL

SEQ ID NO: 3066601 - protein, 5 aa, Giardia lamblia
TNRPP

SEQ ID NO: 3066602 - protein, 10 aa, Giardia lamblia
TNRPSSRRDL

SEQ ID NO: 3066603 - protein, 12 aa, Giardia lamblia
TNRRGSYEDLQT

SEQ ID NO: 3066604 - protein, 6 aa, Giardia lamblia
TNRRGW

SEQ ID NO: 3066605 - protein, 8 aa, Giardia lamblia
TNRRRQKY

SEQ ID NO: 3066606 - protein, 11 aa, Giardia lamblia
TNRSESSDSLS

SEQ ID NO: 3066607 - protein, 9 aa, Giardia lamblia
TNSAKSESF

SEQ ID NO: 3066608 - protein, 5 aa, Giardia lamblia
TNSAY

SEQ ID NO: 3066609 - protein, 9 aa, Giardia lamblia
TNSDESITK

SEQ ID NO: 3066610 - protein, 9 aa, Giardia lamblia
TNSDSTAKE

SEQ ID NO: 3066611 - protein, 12 aa, Giardia lamblia
TNSKAKPKHRPA

SEQ ID NO: 3066612 - protein, 11 aa, Giardia lamblia
TNSKAKTKDAK

SEQ ID NO: 3066613 - protein, 6 aa, Giardia lamblia
TNSTGM

SEQ ID NO: 3066614 - protein, 6 aa, Giardia lamblia
TNSTNP

SEQ ID NO: 3066615 - protein, 8 aa, Giardia lamblia
TNSTPTGL

SEQ ID NO: 3066616 - protein, 6 aa, Giardia lamblia
TNSTTV

SEQ ID NO: 3066617 - protein, 6 aa, Giardia lamblia
TNTGRM

SEQ ID NO: 3066618 - protein, 12 aa, Giardia lamblia
TNTHTKPASNNI

SEQ ID NO: 3066619 - protein, 10 aa, Giardia lamblia
TNTKHQFSKT

SEQ ID NO: 3066620 - protein, 7 aa, Giardia lamblia
TNTNEHE

SEQ ID NO: 3066621 - protein, 9 aa, Giardia lamblia
TNTPDNVPN

SEQ ID NO: 3066622 - protein, 11 aa, Giardia lamblia
TNTQQAPSGTV

SEQ ID NO: 3066623 - protein, 4 aa, Giardia lamblia
TNTS

SEQ ID NO: 3066624 - protein, 5 aa, Giardia lamblia
TNTSS

SEQ ID NO: 3066625 - protein, 5 aa, Giardia lamblia
TNYGS

SEQ ID NO: 3066626 - protein, 6 aa, Giardia lamblia
TNYKPG

SEQ ID NO: 3066627 - protein, 11 aa, Giardia lamblia
TNYLDKENNKN

SEQ ID NO: 3066628 - protein, 7 aa, Giardia lamblia
TNYRPDG

SEQ ID NO: 3066629 - protein, 11 aa, Giardia lamblia
TNYSDLPEKSV

SEQ ID NO: 3066630 - protein, 9 aa, Giardia lamblia
TNYSQTSNY

SEQ ID NO: 3066631 - protein, 6 aa, Giardia lamblia
TPAEKL

SEQ ID NO: 3066632 - protein, 9 aa, Giardia lamblia
TPANASNKR

SEQ ID NO: 3066633 - protein, 14 aa, Giardia lamblia
TPAPDQAIASANDT

SEQ ID NO: 3066634 - protein, 13 aa, Giardia lamblia
TPAPPDSHRPNYK

SEQ ID NO: 3066635 - protein, 8 aa, Giardia lamblia
TPARISED

SEQ ID NO: 3066636 - protein, 8 aa, Giardia lamblia
TPATDEDN

SEQ ID NO: 3066637 - protein, 9 aa, Giardia lamblia
TPATSTVYS

SEQ ID NO: 3066638 - protein, 4 aa, Giardia lamblia
TPAY

SEQ ID NO: 3066639 - protein, 28 aa, Giardia lamblia
TPAYPSSNSTHLGPVASADSSHLSDPQH

SEQ ID NO: 3066640 - protein, 20 aa, Giardia lamblia
TPDAKNVKDGTSANRKESQH

SEQ ID NO: 3066641 - protein, 8 aa, Giardia lamblia
TPDGSLDP

SEQ ID NO: 3066642 - protein, 6 aa, Giardia lamblia
TPDKSQ

SEQ ID NO: 3066643 - protein, 4 aa, Giardia lamblia
TPDN

SEQ ID NO: 3066644 - protein, 6 aa, Giardia lamblia
TPDNDL

SEQ ID NO: 3066645 - protein, 18 aa, Giardia lamblia
TPDRHQKSGLTQKNTKSL

SEQ ID NO: 3066646 - protein, 5 aa, Giardia lamblia
TPDTF

SEQ ID NO: 3066647 - protein, 9 aa, Giardia lamblia
TPEARQELA

SEQ ID NO: 3066648 - protein, 4 aa, Giardia lamblia
TPEC

SEQ ID NO: 3066649 - protein, 6 aa, Giardia lamblia
TPEDKE

SEQ ID NO: 3066650 - protein, 5 aa, Giardia lamblia
TPEEA

SEQ ID NO: 3066651 - protein, 8 aa, Giardia lamblia
TPEEARGG

SEQ ID NO: 3066652 - protein, 4 aa, Giardia lamblia
TPEG

SEQ ID NO: 3066653 - protein, 5 aa, Giardia lamblia
TPEQK

SEQ ID NO: 3066654 - protein, 9 aa, Giardia lamblia
TPERSKNDE

SEQ ID NO: 3066655 - protein, 5 aa, Giardia lamblia
TPEVP

SEQ ID NO: 3066656 - protein, 6 aa, Giardia lamblia
TPEYNP

SEQ ID NO: 3066657 - protein, 7 aa, Giardia lamblia
TPFSETS

SEQ ID NO: 3066658 - protein, 9 aa, Giardia lamblia
TPGADPGAL

SEQ ID NO: 3066659 - protein, 16 aa, Giardia lamblia
TPGAGASKQTSAGPRE

SEQ ID NO: 3066660 - protein, 6 aa, Giardia lamblia
TPGGRY

SEQ ID NO: 3066661 - protein, 6 aa, Giardia lamblia
TPGGYT

SEQ ID NO: 3066662 - protein, 27 aa, Giardia lamblia
TPGLANTPSAKKPQEGDPGVVDTRPED

SEQ ID NO: 3066663 - protein, 5 aa, Giardia lamblia
TPGLP

SEQ ID NO: 3066664 - protein, 8 aa, Giardia lamblia
TPGQGSSF

SEQ ID NO: 3066665 - protein, 5 aa, Giardia lamblia
TPGQH

SEQ ID NO: 3066666 - protein, 6 aa, Giardia lamblia
TPGSPE

SEQ ID NO: 3066667 - protein, 19 aa, Giardia lamblia
TPGSPSSPSTNKCTKCTDG

SEQ ID NO: 3066668 - protein, 7 aa, Giardia lamblia
TPGSTEA

SEQ ID NO: 3066669 - protein, 6 aa, Giardia lamblia
TPHYRD

SEQ ID NO: 3066670 - protein, 6 aa, Giardia lamblia
TPIDES

SEQ ID NO: 3066671 - protein, 6 aa, Giardia lamblia
TPIGTE

SEQ ID NO: 3066672 - protein, 5 aa, Giardia lamblia
TPIQN

SEQ ID NO: 3066673 - protein, 4 aa, Giardia lamblia
TPIR

SEQ ID NO: 3066674 - protein, 5 aa, Giardia lamblia
TPIST

SEQ ID NO: 3066675 - protein, 18 aa, Giardia lamblia
TPITSKSTGSTTKAVKEL

SEQ ID NO: 3066676 - protein, 12 aa, Giardia lamblia
TPKQSSSPQYSP

SEQ ID NO: 3066677 - protein, 5 aa, Giardia lamblia
TPKRW

SEQ ID NO: 3066678 - protein, 18 aa, Giardia lamblia
TPLEQSASTKGSGRGRAI

SEQ ID NO: 3066679 - protein, 30 aa, Giardia lamblia
TPLPTVSPQQAAVDHQQSPRTRSSDDTDVI

SEQ ID NO: 3066680 - protein, 11 aa, Giardia lamblia
TPLSSQLTTEQ

SEQ ID NO: 3066681 - protein, 7 aa, Giardia lamblia
TPLTSTS

SEQ ID NO: 3066682 - protein, 4 aa, Giardia lamblia
TPMS

SEQ ID NO: 3066683 - protein, 17 aa, Giardia lamblia
TPNCEQEESEELSMLSN

SEQ ID NO: 3066684 - protein, 4 aa, Giardia lamblia
TPNL

SEQ ID NO: 3066685 - protein, 7 aa, Giardia lamblia
TPNNDSA

SEQ ID NO: 3066686 - protein, 4 aa, Giardia lamblia
TPNS

SEQ ID NO: 3066687 - protein, 11 aa, Giardia lamblia
TPNSTSSGSLD

SEQ ID NO: 3066688 - protein, 5 aa, Giardia lamblia
TPNTI

SEQ ID NO: 3066689 - protein, 7 aa, Giardia lamblia
TPPAPNL

SEQ ID NO: 3066690 - protein, 7 aa, Giardia lamblia
TPPDSGL

SEQ ID NO: 3066691 - protein, 9 aa, Giardia lamblia
TPPETRDQR

SEQ ID NO: 3066692 - protein, 6 aa, Giardia lamblia
TPPGQA

SEQ ID NO: 3066693 - protein, 6 aa, Giardia lamblia
TPPKLQ

SEQ ID NO: 3066694 - protein, 5 aa, Giardia lamblia
TPPKV

SEQ ID NO: 3066695 - protein, 20 aa, Giardia lamblia
TPPPPDSHKPGYRRPQPLEG

SEQ ID NO: 3066696 - protein, 5 aa, Giardia lamblia
TPPSS

SEQ ID NO: 3066697 - protein, 9 aa, Giardia lamblia
TPPTSISSA

SEQ ID NO: 3066698 - protein, 4 aa, Giardia lamblia
TPPV

SEQ ID NO: 3066699 - protein, 17 aa, Giardia lamblia
TPPVGERQQTASVSDRK

SEQ ID NO: 3066700 - protein, 6 aa, Giardia lamblia
TPPVRN

SEQ ID NO: 3066701 - protein, 11 aa, Giardia lamblia
TPQEYEERKEE

SEQ ID NO: 3066702 - protein, 9 aa, Giardia lamblia
TPQIPEKNY

SEQ ID NO: 3066703 - protein, 4 aa, Giardia lamblia
TPQP

SEQ ID NO: 3066704 - protein, 5 aa, Giardia lamblia
TPQTF

SEQ ID NO: 3066705 - protein, 13 aa, Giardia lamblia
TPQVRRKSNKLQV

SEQ ID NO: 3066706 - protein, 6 aa, Giardia lamblia
TPRSYR

SEQ ID NO: 3066707 - protein, 4 aa, Giardia lamblia
TPRT

SEQ ID NO: 3066708 - protein, 28 aa, Giardia lamblia
TPRTTSGTAATTPRTQLSATSTPRFNPY

SEQ ID NO: 3066709 - protein, 4 aa, Giardia lamblia
TPSA

SEQ ID NO: 3066710 - protein, 8 aa, Giardia lamblia
TPSAGPRL

SEQ ID NO: 3066711 - protein, 5 aa, Giardia lamblia
TPSCT

SEQ ID NO: 3066712 - protein, 8 aa, Giardia lamblia
TPSGTEDA

SEQ ID NO: 3066713 - protein, 4 aa, Giardia lamblia
TPSI

SEQ ID NO: 3066714 - protein, 5 aa, Giardia lamblia
TPSIK

SEQ ID NO: 3066715 - protein, 8 aa, Giardia lamblia
TPSKEKPV

SEQ ID NO: 3066716 - protein, 9 aa, Giardia lamblia
TPSKNIPKT

SEQ ID NO: 3066717 - protein, 20 aa, Giardia lamblia
TPSLQKDEPLNSKTSSANIY

SEQ ID NO: 3066718 - protein, 22 aa, Giardia lamblia
TPSMKSPTTQTDPSKTPKGTNM

SEQ ID NO: 3066719 - protein, 20 aa, Giardia lamblia
TPSNKKLEQLSSEKAELEAT

SEQ ID NO: 3066720 - protein, 5 aa, Giardia lamblia
TPSNS

SEQ ID NO: 3066721 - protein, 9 aa, Giardia lamblia
TPSPDRAAG

SEQ ID NO: 3066722 - protein, 5 aa, Giardia lamblia
TPSPE

SEQ ID NO: 3066723 - protein, 8 aa, Giardia lamblia
TPSQSASC

SEQ ID NO: 3066724 - protein, 4 aa, Giardia lamblia
TPSS

SEQ ID NO: 3066725 - protein, 11 aa, Giardia lamblia
TPSSDGAEKCT

SEQ ID NO: 3066726 - protein, 8 aa, Giardia lamblia
TPSSPGPA

SEQ ID NO: 3066727 - protein, 21 aa, Giardia lamblia
TPSSSNPGSTPGSRPNTGRRL

SEQ ID NO: 3066728 - protein, 13 aa, Giardia lamblia
TPSTFSDPSSPIG

SEQ ID NO: 3066729 - protein, 4 aa, Giardia lamblia
TPSV

SEQ ID NO: 3066730 - protein, 9 aa, Giardia lamblia
TPTAAETVN

SEQ ID NO: 3066731 - protein, 13 aa, Giardia lamblia
TPTASRDPPGLGP

SEQ ID NO: 3066732 - protein, 14 aa, Giardia lamblia
TPTDNAPQKPSTPI

SEQ ID NO: 3066733 - protein, 4 aa, Giardia lamblia
TPTF

SEQ ID NO: 3066734 - protein, 5 aa, Giardia lamblia
TPTGC

SEQ ID NO: 3066735 - protein, 7 aa, Giardia lamblia
TPTGITD

SEQ ID NO: 3066736 - protein, 14 aa, Giardia lamblia
TPTGSVTCPNTADY

SEQ ID NO: 3066737 - protein, 7 aa, Giardia lamblia
TPTNRPD

SEQ ID NO: 3066738 - protein, 4 aa, Giardia lamblia
TPTS

SEQ ID NO: 3066739 - protein, 5 aa, Giardia lamblia
TPTSS

SEQ ID NO: 3066740 - protein, 29 aa, Giardia lamblia
TPTTKFPAGKTAADWGTESAVSVDTKTKQ

SEQ ID NO: 3066741 - protein, 5 aa, Giardia lamblia
TPTTV

SEQ ID NO: 3066742 - protein, 5 aa, Giardia lamblia
TPTVE

SEQ ID NO: 3066743 - protein, 16 aa, Giardia lamblia
TPVDKDSSDIKDKVGK

SEQ ID NO: 3066744 - protein, 5 aa, Giardia lamblia
TPVEY

SEQ ID NO: 3066745 - protein, 6 aa, Giardia lamblia
TPVIGA

SEQ ID NO: 3066746 - protein, 8 aa, Giardia lamblia
TPVPPSSD

SEQ ID NO: 3066747 - protein, 5 aa, Giardia lamblia
TPVSN

SEQ ID NO: 3066748 - protein, 9 aa, Giardia lamblia
TPVSTPAYP

SEQ ID NO: 3066749 - protein, 38 aa, Giardia lamblia
TPYTPGRSQSLNRGFSSEYRSTQSHSHQASSSYRSPLT

SEQ ID NO: 3066750 - protein, 5 aa, Giardia lamblia
TPYTQ

SEQ ID NO: 3066751 - protein, 7 aa, Giardia lamblia
TQACTGA

SEQ ID NO: 3066752 - protein, 12 aa, Giardia lamblia
TQAGKGRTNAVA

SEQ ID NO: 3066753 - protein, 8 aa, Giardia lamblia
TQAPSDDD

SEQ ID NO: 3066754 - protein, 9 aa, Giardia lamblia
TQAPSTSSA

SEQ ID NO: 3066755 - protein, 7 aa, Giardia lamblia
TQASGAH

SEQ ID NO: 3066756 - protein, 20 aa, Giardia lamblia
TQASRASPHAPPPVPQHGPN

SEQ ID NO: 3066757 - protein, 7 aa, Giardia lamblia
TQASSDP

SEQ ID NO: 3066758 - protein, 4 aa, Giardia lamblia
TQDD

SEQ ID NO: 3066759 - protein, 19 aa, Giardia lamblia
TQDPANPSEQYDNSAGQQL

SEQ ID NO: 3066760 - protein, 8 aa, Giardia lamblia
TQDPETDA

SEQ ID NO: 3066761 - protein, 8 aa, Giardia lamblia
TQDQREKV

SEQ ID NO: 3066762 - protein, 6 aa, Giardia lamblia
TQDSAA

SEQ ID NO: 3066763 - protein, 12 aa, Giardia lamblia
TQDSECGGAGGT

SEQ ID NO: 3066764 - protein, 8 aa, Giardia lamblia
TQDTNTTR

SEQ ID NO: 3066765 - protein, 11 aa, Giardia lamblia
TQEDSDSSARI

SEQ ID NO: 3066766 - protein, 15 aa, Giardia lamblia
TQEQTPTETSRQLQS

SEQ ID NO: 3066767 - protein, 5 aa, Giardia lamblia
TQGDN

SEQ ID NO: 3066768 - protein, 5 aa, Giardia lamblia
TQGGS

SEQ ID NO: 3066769 - protein, 5 aa, Giardia lamblia
TQGHE

SEQ ID NO: 3066770 - protein, 5 aa, Giardia lamblia
TQGNN

SEQ ID NO: 3066771 - protein, 19 aa, Giardia lamblia
TQGQNTKTSTSYLSECTPL

SEQ ID NO: 3066772 - protein, 25 aa, Giardia lamblia
TQGSEPLSGSDDAGQARAGASNQDT

SEQ ID NO: 3066773 - protein, 18 aa, Giardia lamblia
TQGSHGDTGKRPEKGVAQ

SEQ ID NO: 3066774 - protein, 6 aa, Giardia lamblia
TQGSRA

SEQ ID NO: 3066775 - protein, 14 aa, Giardia lamblia
TQHHDDEINKYEGD

SEQ ID NO: 3066776 - protein, 5 aa, Giardia lamblia
TQHSA

SEQ ID NO: 3066777 - protein, 12 aa, Giardia lamblia
TQHTSNVRNEAR

SEQ ID NO: 3066778 - protein, 24 aa, Giardia lamblia
TQIQEEKDKEDAEAKSHNKETGMY

SEQ ID NO: 3066779 - protein, 9 aa, Giardia lamblia
TQKLPGSSV

SEQ ID NO: 3066780 - protein, 8 aa, Giardia lamblia
TQKNMESE

SEQ ID NO: 3066781 - protein, 24 aa, Giardia lamblia
TQKSGILKGSQYSANMSDGVDGDS

SEQ ID NO: 3066782 - protein, 9 aa, Giardia lamblia
TQKSRDRQK

SEQ ID NO: 3066783 - protein, 5 aa, Giardia lamblia
TQLNP

SEQ ID NO: 3066784 - protein, 8 aa, Giardia lamblia
TQNPATTL

SEQ ID NO: 3066785 - protein, 7 aa, Giardia lamblia
TQNPDDA

SEQ ID NO: 3066786 - protein, 10 aa, Giardia lamblia
TQNPDSLSSW

SEQ ID NO: 3066787 - protein, 16 aa, Giardia lamblia
TQNPRSQGSGRKGLPQ

SEQ ID NO: 3066788 - protein, 7 aa, Giardia lamblia
TQPADPS

SEQ ID NO: 3066789 - protein, 9 aa, Giardia lamblia
TQPDISPSH

SEQ ID NO: 3066790 - protein, 7 aa, Giardia lamblia
TQPEKKA

SEQ ID NO: 3066791 - protein, 5 aa, Giardia lamblia
TQPFS

SEQ ID NO: 3066792 - protein, 15 aa, Giardia lamblia
TQPLYKGKQYEDEHN

SEQ ID NO: 3066793 - protein, 17 aa, Giardia lamblia
TQPQRKSETNCQDSSVL

SEQ ID NO: 3066794 - protein, 6 aa, Giardia lamblia
TQPRNV

SEQ ID NO: 3066795 - protein, 11 aa, Giardia lamblia
TQPWKTTEDGS

SEQ ID NO: 3066796 - protein, 6 aa, Giardia lamblia
TQPYGA

SEQ ID NO: 3066797 - protein, 5 aa, Giardia lamblia
TQQPN

SEQ ID NO: 3066798 - protein, 7 aa, Giardia lamblia
TQQSQTG

SEQ ID NO: 3066799 - protein, 4 aa, Giardia lamblia
TQRL

SEQ ID NO: 3066800 - protein, 25 aa, Giardia lamblia
TQRPISAEERYREQQATLGEVSTRS

SEQ ID NO: 3066801 - protein, 6 aa, Giardia lamblia
TQRPQA

SEQ ID NO: 3066802 - protein, 5 aa, Giardia lamblia
TQSGR

SEQ ID NO: 3066803 - protein, 8 aa, Giardia lamblia
TQSHETKR

SEQ ID NO: 3066804 - protein, 13 aa, Giardia lamblia
TQSPTPANTGDMS

SEQ ID NO: 3066805 - protein, 5 aa, Giardia lamblia
TQSPV

SEQ ID NO: 3066806 - protein, 5 aa, Giardia lamblia
TQSRG

SEQ ID NO: 3066807 - protein, 7 aa, Giardia lamblia
TQSRRTA

SEQ ID NO: 3066808 - protein, 6 aa, Giardia lamblia
TQSSEP

SEQ ID NO: 3066809 - protein, 8 aa, Giardia lamblia
TQSTFKGS

SEQ ID NO: 3066810 - protein, 7 aa, Giardia lamblia
TQSTSSD

SEQ ID NO: 3066811 - protein, 4 aa, Giardia lamblia
TQSW

SEQ ID NO: 3066812 - protein, 4 aa, Giardia lamblia
TQTD

SEQ ID NO: 3066813 - protein, 40 aa, Giardia lamblia
TQTDTITDPHSNSTALTAASTATAKTEKRGLSSTTHKSLE

SEQ ID NO: 3066814 - protein, 6 aa, Giardia lamblia
TQTEQS

SEQ ID NO: 3066815 - protein, 5 aa, Giardia lamblia
TQTIG

SEQ ID NO: 3066816 - protein, 5 aa, Giardia lamblia
TQTQR

SEQ ID NO: 3066817 - protein, 5 aa, Giardia lamblia
TQVTS

SEQ ID NO: 3066818 - protein, 5 aa, Giardia lamblia
TQWDK

SEQ ID NO: 3066819 - protein, 7 aa, Giardia lamblia
TQYDDNG

SEQ ID NO: 3066820 - protein, 18 aa, Giardia lamblia
TRADDGKCTTCNTGNSGK

SEQ ID NO: 3066821 - protein, 4 aa, Giardia lamblia
TRAN

SEQ ID NO: 3066822 - protein, 6 aa, Giardia lamblia
TRAPKT

SEQ ID NO: 3066823 - protein, 16 aa, Giardia lamblia
TRDGDMSTESTKPDCD

SEQ ID NO: 3066824 - protein, 7 aa, Giardia lamblia
TRDTPFD

SEQ ID NO: 3066825 - protein, 4 aa, Giardia lamblia
TREA

SEQ ID NO: 3066826 - protein, 4 aa, Giardia lamblia
TREG

SEQ ID NO: 3066827 - protein, 4 aa, Giardia lamblia
TREQ

SEQ ID NO: 3066828 - protein, 10 aa, Giardia lamblia
TRESPTRGSG

SEQ ID NO: 3066829 - protein, 4 aa, Giardia lamblia
TREY

SEQ ID NO: 3066830 - protein, 5 aa, Giardia lamblia
TREYR

SEQ ID NO: 3066831 - protein, 8 aa, Giardia lamblia
TRGANTLN

SEQ ID NO: 3066832 - protein, 8 aa, Giardia lamblia
TRGGPRAE

SEQ ID NO: 3066833 - protein, 6 aa, Giardia lamblia
TRGRGA

SEQ ID NO: 3066834 - protein, 4 aa, Giardia lamblia
TRGS

SEQ ID NO: 3066835 - protein, 12 aa, Giardia lamblia
TRGTQIDGYDST

SEQ ID NO: 3066836 - protein, 13 aa, Giardia lamblia
TRGTSMSSSSWTN

SEQ ID NO: 3066837 - protein, 4 aa, Giardia lamblia
TRGY

SEQ ID NO: 3066838 - protein, 26 aa, Giardia lamblia
TRHSPLSASTQKQASSSKLSKQGDEV

SEQ ID NO: 3066839 - protein, 10 aa, Giardia lamblia
TRIPRPQGMS

SEQ ID NO: 3066840 - protein, 8 aa, Giardia lamblia
TRISTSDR

SEQ ID NO: 3066841 - protein, 9 aa, Giardia lamblia
TRKAASTKR

SEQ ID NO: 3066842 - protein, 4 aa, Giardia lamblia
TRKN

SEQ ID NO: 3066843 - protein, 7 aa, Giardia lamblia
TRKNNKD

SEQ ID NO: 3066844 - protein, 4 aa, Giardia lamblia
TRKR

SEQ ID NO: 3066845 - protein, 6 aa, Giardia lamblia
TRLNGT

SEQ ID NO: 3066846 - protein, 11 aa, Giardia lamblia
TRLSSGSSSIQ

SEQ ID NO: 3066847 - protein, 15 aa, Giardia lamblia
TRNALSPKHIGSPRE

SEQ ID NO: 3066848 - protein, 6 aa, Giardia lamblia
TRNEAG

SEQ ID NO: 3066849 - protein, 11 aa, Giardia lamblia
TRNGEAPKKEN

SEQ ID NO: 3066850 - protein, 5 aa, Giardia lamblia
TRNPT

SEQ ID NO: 3066851 - protein, 18 aa, Giardia lamblia
TRNQSSTAEGVSEEDELK

SEQ ID NO: 3066852 - protein, 7 aa, Giardia lamblia
TRNTRLK

SEQ ID NO: 3066853 - protein, 8 aa, Giardia lamblia
TRNTTYSQ

SEQ ID NO: 3066854 - protein, 7 aa, Giardia lamblia
TRPAEFT

SEQ ID NO: 3066855 - protein, 10 aa, Giardia lamblia
TRPAPTPAYT

SEQ ID NO: 3066856 - protein, 6 aa, Giardia lamblia
TRPDYC

SEQ ID NO: 3066857 - protein, 7 aa, Giardia lamblia
TRPNTEV

SEQ ID NO: 3066858 - protein, 7 aa, Giardia lamblia
TRPPPAY

SEQ ID NO: 3066859 - protein, 4 aa, Giardia lamblia
TRPR

SEQ ID NO: 3066860 - protein, 13 aa, Giardia lamblia
TRPRNSTSLRNSR

SEQ ID NO: 3066861 - protein, 8 aa, Giardia lamblia
TRPSDSNL

SEQ ID NO: 3066862 - protein, 6 aa, Giardia lamblia
TRPTIA

SEQ ID NO: 3066863 - protein, 11 aa, Giardia lamblia
TRQKALESEGR

SEQ ID NO: 3066864 - protein, 8 aa, Giardia lamblia
TRQKNSCS

SEQ ID NO: 3066865 - protein, 9 aa, Giardia lamblia
TRQNSAAGN

SEQ ID NO: 3066866 - protein, 10 aa, Giardia lamblia
TRQNSTKVSR

SEQ ID NO: 3066867 - protein, 8 aa, Giardia lamblia
TRQSGDDI

SEQ ID NO: 3066868 - protein, 11 aa, Giardia lamblia
TRQTNAQTINT

SEQ ID NO: 3066869 - protein, 9 aa, Giardia lamblia
TRQTQRGET

SEQ ID NO: 3066870 - protein, 9 aa, Giardia lamblia
TRRPKDNPE

SEQ ID NO: 3066871 - protein, 10 aa, Giardia lamblia
TRRPKDNPEF

SEQ ID NO: 3066872 - protein, 4 aa, Giardia lamblia
TRRR

SEQ ID NO: 3066873 - protein, 11 aa, Giardia lamblia
TRRSEDSVHYP

SEQ ID NO: 3066874 - protein, 9 aa, Giardia lamblia
TRSASIPGI

SEQ ID NO: 3066875 - protein, 13 aa, Giardia lamblia
TRSGIGGGNYSNY

SEQ ID NO: 3066876 - protein, 26 aa, Giardia lamblia
TRSPAEVTDPYDGSTLTVSRAQLSTF

SEQ ID NO: 3066877 - protein, 9 aa, Giardia lamblia
TRSPTASLS

SEQ ID NO: 3066878 - protein, 21 aa, Giardia lamblia
TRSPTLAPGPGVSNSNAQSNG

SEQ ID NO: 3066879 - protein, 7 aa, Giardia lamblia
TRSSARN

SEQ ID NO: 3066880 - protein, 44 aa, Giardia lamblia
TRSSNKEREQPGYGAEVETDAGTNMAEGKSNSPSCDKSSWAGKK

SEQ ID NO: 3066881 - protein, 7 aa, Giardia lamblia
TRSTQSY

SEQ ID NO: 3066882 - protein, 7 aa, Giardia lamblia
TRTANRC

SEQ ID NO: 3066883 - protein, 13 aa, Giardia lamblia
TRTAPKTAQKPSV

SEQ ID NO: 3066884 - protein, 11 aa, Giardia lamblia
TRTGSAATTGF

SEQ ID NO: 3066885 - protein, 10 aa, Giardia lamblia
TRTKSAKHTK

SEQ ID NO: 3066886 - protein, 8 aa, Giardia lamblia
TRTKTTKY

SEQ ID NO: 3066887 - protein, 4 aa, Giardia lamblia
TRTL

SEQ ID NO: 3066888 - protein, 17 aa, Giardia lamblia
TRTPGPSADSQNDRNYS

SEQ ID NO: 3066889 - protein, 4 aa, Giardia lamblia
TRTQ

SEQ ID NO: 3066890 - protein, 7 aa, Giardia lamblia
TRTSDSR

SEQ ID NO: 3066891 - protein, 7 aa, Giardia lamblia
TRTSVSS

SEQ ID NO: 3066892 - protein, 7 aa, Giardia lamblia
TRVDTTR

SEQ ID NO: 3066893 - protein, 5 aa, Giardia lamblia
TRVGN

SEQ ID NO: 3066894 - protein, 6 aa, Giardia lamblia
TRVRGD

SEQ ID NO: 3066895 - protein, 40 aa, Giardia lamblia
TRVTDTPESSGNDTETDGIKTVGARERSSATNEDSASTSM

SEQ ID NO: 3066896 - protein, 14 aa, Giardia lamblia
TRWNAGKTSSDQNI

SEQ ID NO: 3066897 - protein, 18 aa, Giardia lamblia
TRYSGSQWQAPSATHPDI

SEQ ID NO: 3066898 - protein, 5 aa, Giardia lamblia
TSAAP

SEQ ID NO: 3066899 - protein, 9 aa, Giardia lamblia
TSAAVASGP

SEQ ID NO: 3066900 - protein, 4 aa, Giardia lamblia
TSAD

SEQ ID NO: 3066901 - protein, 16 aa, Giardia lamblia
TSAINDELEDDSHGTA

SEQ ID NO: 3066902 - protein, 9 aa, Giardia lamblia
TSAKPLSEP

SEQ ID NO: 3066903 - protein, 11 aa, Giardia lamblia
TSALDEETEKR

SEQ ID NO: 3066904 - protein, 8 aa, Giardia lamblia
TSANEVGT

SEQ ID NO: 3066905 - protein, 19 aa, Giardia lamblia
TSANKVDNAVDGASGGKRN

SEQ ID NO: 3066906 - protein, 7 aa, Giardia lamblia
TSAPEDL

SEQ ID NO: 3066907 - protein, 5 aa, Giardia lamblia
TSAQF

SEQ ID NO: 3066908 - protein, 6 aa, Giardia lamblia
TSAQKD

SEQ ID NO: 3066909 - protein, 10 aa, Giardia lamblia
TSARFDAETE

SEQ ID NO: 3066910 - protein, 10 aa, Giardia lamblia
TSASKADKNK

SEQ ID NO: 3066911 - protein, 9 aa, Giardia lamblia
TSATKGTNI

SEQ ID NO: 3066912 - protein, 15 aa, Giardia lamblia
TSAYNPENKQCEPNK

SEQ ID NO: 3066913 - protein, 10 aa, Giardia lamblia
TSCNEAQGYY

SEQ ID NO: 3066914 - protein, 8 aa, Giardia lamblia
TSCPSIST

SEQ ID NO: 3066915 - protein, 5 aa, Giardia lamblia
TSCSR

SEQ ID NO: 3066916 - protein, 20 aa, Giardia lamblia
TSCTGDNVQRKCPGNSERGC

SEQ ID NO: 3066917 - protein, 4 aa, Giardia lamblia
TSDA

SEQ ID NO: 3066918 - protein, 6 aa, Giardia lamblia
TSDAPY

SEQ ID NO: 3066919 - protein, 6 aa, Giardia lamblia
TSDAVE

SEQ ID NO: 3066920 - protein, 4 aa, Giardia lamblia
TSDG

SEQ ID NO: 3066921 - protein, 7 aa, Giardia lamblia
TSDGASC

SEQ ID NO: 3066922 - protein, 6 aa, Giardia lamblia
TSDGKQ

SEQ ID NO: 3066923 - protein, 21 aa, Giardia lamblia
TSDHEENELTTQQTQSKRDLE

SEQ ID NO: 3066924 - protein, 13 aa, Giardia lamblia
TSDHSNLSTIQIN

SEQ ID NO: 3066925 - protein, 11 aa, Giardia lamblia
TSDIVTDTKQN

SEQ ID NO: 3066926 - protein, 14 aa, Giardia lamblia
TSDKAKGKDAPVSQ

SEQ ID NO: 3066927 - protein, 9 aa, Giardia lamblia
TSDNADLQR

SEQ ID NO: 3066928 - protein, 9 aa, Giardia lamblia
TSDPRGNNC

SEQ ID NO: 3066929 - protein, 5 aa, Giardia lamblia
TSDPS

SEQ ID NO: 3066930 - protein, 6 aa, Giardia lamblia
TSDPTR

SEQ ID NO: 3066931 - protein, 14 aa, Giardia lamblia
TSDSGKKGANTCDS

SEQ ID NO: 3066932 - protein, 23 aa, Giardia lamblia
TSDTGGGSTASMQGRNRRSSGRH

SEQ ID NO: 3066933 - protein, 14 aa, Giardia lamblia
TSDTSAVPAAGAGS

SEQ ID NO: 3066934 - protein, 16 aa, Giardia lamblia
TSDTVQNATEAPNSSM

SEQ ID NO: 3066935 - protein, 8 aa, Giardia lamblia
TSEAKETT

SEQ ID NO: 3066936 - protein, 6 aa, Giardia lamblia
TSEAPF

SEQ ID NO: 3066937 - protein, 9 aa, Giardia lamblia
TSEGEHIST

SEQ ID NO: 3066938 - protein, 4 aa, Giardia lamblia
TSEK

SEQ ID NO: 3066939 - protein, 5 aa, Giardia lamblia
TSELY

SEQ ID NO: 3066940 - protein, 35 aa, Giardia lamblia
TSENDSQTRQAQDPAKSETDQHSKYISETSQASTS

SEQ ID NO: 3066941 - protein, 15 aa, Giardia lamblia
TSEPDPCAEDEFQEN

SEQ ID NO: 3066942 - protein, 13 aa, Giardia lamblia
TSEPVKNNLPASL

SEQ ID NO: 3066943 - protein, 5 aa, Giardia lamblia
TSERG

SEQ ID NO: 3066944 - protein, 5 aa, Giardia lamblia
TSESG

SEQ ID NO: 3066945 - protein, 9 aa, Giardia lamblia
TSESSSGNV

SEQ ID NO: 3066946 - protein, 4 aa, Giardia lamblia
TSET

SEQ ID NO: 3066947 - protein, 7 aa, Giardia lamblia
TSETKPW

SEQ ID NO: 3066948 - protein, 5 aa, Giardia lamblia
TSETR

SEQ ID NO: 3066949 - protein, 9 aa, Giardia lamblia
TSEVEAKQE

SEQ ID NO: 3066950 - protein, 7 aa, Giardia lamblia
TSEYEYD

SEQ ID NO: 3066951 - protein, 14 aa, Giardia lamblia
TSFPTKSTEPKSYY

SEQ ID NO: 3066952 - protein, 5 aa, Giardia lamblia
TSFSV

SEQ ID NO: 3066953 - protein, 8 aa, Giardia lamblia
TSFTNESN

SEQ ID NO: 3066954 - protein, 5 aa, Giardia lamblia
TSGAD

SEQ ID NO: 3066955 - protein, 11 aa, Giardia lamblia
TSGDTSGLQLS

SEQ ID NO: 3066956 - protein, 6 aa, Giardia lamblia
TSGEDK

SEQ ID NO: 3066957 - protein, 10 aa, Giardia lamblia
TSGGFHGTSG

SEQ ID NO: 3066958 - protein, 8 aa, Giardia lamblia
TSGGTPKR

SEQ ID NO: 3066959 - protein, 10 aa, Giardia lamblia
TSGHEESISP

SEQ ID NO: 3066960 - protein, 9 aa, Giardia lamblia
TSGHLTSGT

SEQ ID NO: 3066961 - protein, 22 aa, Giardia lamblia
TSGKTSADDSECSPMPDAEAIA

SEQ ID NO: 3066962 - protein, 5 aa, Giardia lamblia
TSGLT

SEQ ID NO: 3066963 - protein, 4 aa, Giardia lamblia
TSGN

SEQ ID NO: 3066964 - protein, 7 aa, Giardia lamblia
TSGNKTI

SEQ ID NO: 3066965 - protein, 10 aa, Giardia lamblia
TSGPNKGKTT

SEQ ID NO: 3066966 - protein, 14 aa, Giardia lamblia
TSGPQLSAADRTRL

SEQ ID NO: 3066967 - protein, 20 aa, Giardia lamblia
TSGQSVDPSMPSTSAPAPTL

SEQ ID NO: 3066968 - protein, 11 aa, Giardia lamblia
TSGRTTTDEAY

SEQ ID NO: 3066969 - protein, 6 aa, Giardia lamblia
TSGSAF

SEQ ID NO: 3066970 - protein, 5 aa, Giardia lamblia
TSGSS

SEQ ID NO: 3066971 - protein, 4 aa, Giardia lamblia
TSGT

SEQ ID NO: 3066972 - protein, 19 aa, Giardia lamblia
TSGTDGVTRECKTSPGSRR

SEQ ID NO: 3066973 - protein, 10 aa, Giardia lamblia
TSGTLDNANK

SEQ ID NO: 3066974 - protein, 26 aa, Giardia lamblia
TSGTQVKDKDDGTGNTNQKSDTDAKD

SEQ ID NO: 3066975 - protein, 10 aa, Giardia lamblia
TSGWQDDTDL

SEQ ID NO: 3066976 - protein, 5 aa, Giardia lamblia
TSHAN

SEQ ID NO: 3066977 - protein, 9 aa, Giardia lamblia
TSHAPKNGG

SEQ ID NO: 3066978 - protein, 10 aa, Giardia lamblia
TSHAPKNGGC

SEQ ID NO: 3066979 - protein, 8 aa, Giardia lamblia
TSHPRATI

SEQ ID NO: 3066980 - protein, 17 aa, Giardia lamblia
TSHQVSSRAAVRASGRS

SEQ ID NO: 3066981 - protein, 17 aa, Giardia lamblia
TSHTDDDRVQLDETKDR

SEQ ID NO: 3066982 - protein, 14 aa, Giardia lamblia
TSIASDSAEALRNT

SEQ ID NO: 3066983 - protein, 14 aa, Giardia lamblia
TSIHSSGNEPAISR

SEQ ID NO: 3066984 - protein, 8 aa, Giardia lamblia
TSIPKDGD

SEQ ID NO: 3066985 - protein, 12 aa, Giardia lamblia
TSIPTTVPTRKA

SEQ ID NO: 3066986 - protein, 6 aa, Giardia lamblia
TSIRGS

SEQ ID NO: 3066987 - protein, 5 aa, Giardia lamblia
TSISQ

SEQ ID NO: 3066988 - protein, 31 aa, Giardia lamblia
TSISSQHSRDSRDNPSTRSRAKEKKPSSVSA

SEQ ID NO: 3066989 - protein, 12 aa, Giardia lamblia
TSITPTEPETEP

SEQ ID NO: 3066990 - protein, 8 aa, Giardia lamblia
TSKANRDI

SEQ ID NO: 3066991 - protein, 5 aa, Giardia lamblia
TSKDV

SEQ ID NO: 3066992 - protein, 8 aa, Giardia lamblia
TSKINSTT

SEQ ID NO: 3066993 - protein, 8 aa, Giardia lamblia
TSKKCRKS

SEQ ID NO: 3066994 - protein, 10 aa, Giardia lamblia
TSKMTSASKA

SEQ ID NO: 3066995 - protein, 21 aa, Giardia lamblia
TSKPGHSKSKSFTGTSEDNSL

SEQ ID NO: 3066996 - protein, 8 aa, Giardia lamblia
TSKPSNVL

SEQ ID NO: 3066997 - protein, 8 aa, Giardia lamblia
TSKRSVSR

SEQ ID NO: 3066998 - protein, 6 aa, Giardia lamblia
TSKSYS

SEQ ID NO: 3066999 - protein, 10 aa, Giardia lamblia
TSKTDATNSL

SEQ ID NO: 3067000 - protein, 5 aa, Giardia lamblia
TSKTG

SEQ ID NO: 3067001 - protein, 8 aa, Giardia lamblia
TSLGPTST

SEQ ID NO: 3067002 - protein, 7 aa, Giardia lamblia
TSLGSDE

SEQ ID NO: 3067003 - protein, 12 aa, Giardia lamblia
TSLKDVDTRETP

SEQ ID NO: 3067004 - protein, 37 aa, Giardia lamblia
TSLKSSRTKRRTVPDVQKRSRSHDQSSDLKDIGNSHS

SEQ ID NO: 3067005 - protein, 4 aa, Giardia lamblia
TSLP

SEQ ID NO: 3067006 - protein, 18 aa, Giardia lamblia
TSLPGSPTSSQLRAPFSP

SEQ ID NO: 3067007 - protein, 7 aa, Giardia lamblia
TSLPKEA

SEQ ID NO: 3067008 - protein, 9 aa, Giardia lamblia
TSLQTSSER

SEQ ID NO: 3067009 - protein, 6 aa, Giardia lamblia
TSLRRS

SEQ ID NO: 3067010 - protein, 8 aa, Giardia lamblia
TSLSPAIR

SEQ ID NO: 3067011 - protein, 8 aa, Giardia lamblia
TSLSSLGT

SEQ ID NO: 3067012 - protein, 15 aa, Giardia lamblia
TSLTAEPRRGKESTT

SEQ ID NO: 3067013 - protein, 6 aa, Giardia lamblia
TSLTNT

SEQ ID NO: 3067014 - protein, 5 aa, Giardia lamblia
TSLVP

SEQ ID NO: 3067015 - protein, 6 aa, Giardia lamblia
TSLYNS

SEQ ID NO: 3067016 - protein, 5 aa, Giardia lamblia
TSMAN

SEQ ID NO: 3067017 - protein, 15 aa, Giardia lamblia
TSMEQPLSPKLTDRS

SEQ ID NO: 3067018 - protein, 5 aa, Giardia lamblia
TSMTR

SEQ ID NO: 3067019 - protein, 5 aa, Giardia lamblia
TSNCP

SEQ ID NO: 3067020 - protein, 5 aa, Giardia lamblia
TSNDQ

SEQ ID NO: 3067021 - protein, 4 aa, Giardia lamblia
TSNE

SEQ ID NO: 3067022 - protein, 6 aa, Giardia lamblia
TSNELS

SEQ ID NO: 3067023 - protein, 6 aa, Giardia lamblia
TSNNST

SEQ ID NO: 3067024 - protein, 7 aa, Giardia lamblia
TSNPQIR

SEQ ID NO: 3067025 - protein, 4 aa, Giardia lamblia
TSNR

SEQ ID NO: 3067026 - protein, 21 aa, Giardia lamblia
TSNSDAPEGTEPRDTKGNDNV

SEQ ID NO: 3067027 - protein, 13 aa, Giardia lamblia
TSNSGTDGNAITS

SEQ ID NO: 3067028 - protein, 6 aa, Giardia lamblia
TSNSKT

SEQ ID NO: 3067029 - protein, 12 aa, Giardia lamblia
TSNTAPKFNEGN

SEQ ID NO: 3067030 - protein, 8 aa, Giardia lamblia
TSNTDGTE

SEQ ID NO: 3067031 - protein, 8 aa, Giardia lamblia
TSNTKPVS

SEQ ID NO: 3067032 - protein, 5 aa, Giardia lamblia
TSNVS

SEQ ID NO: 3067033 - protein, 4 aa, Giardia lamblia
TSNY

SEQ ID NO: 3067034 - protein, 7 aa, Giardia lamblia
TSPDALT

SEQ ID NO: 3067035 - protein, 4 aa, Giardia lamblia
TSPG

SEQ ID NO: 3067036 - protein, 9 aa, Giardia lamblia
TSPGGTTSR

SEQ ID NO: 3067037 - protein, 10 aa, Giardia lamblia
TSPGTPVQNE

SEQ ID NO: 3067038 - protein, 10 aa, Giardia lamblia
TSPHKGQRTD

SEQ ID NO: 3067039 - protein, 6 aa, Giardia lamblia
TSPHRS

SEQ ID NO: 3067040 - protein, 5 aa, Giardia lamblia
TSPIQ

SEQ ID NO: 3067041 - protein, 8 aa, Giardia lamblia
TSPKEIPS

SEQ ID NO: 3067042 - protein, 5 aa, Giardia lamblia
TSPLE

SEQ ID NO: 3067043 - protein, 6 aa, Giardia lamblia
TSPLKE

SEQ ID NO: 3067044 - protein, 9 aa, Giardia lamblia
TSPPEGYEE

SEQ ID NO: 3067045 - protein, 6 aa, Giardia lamblia
TSPPHK

SEQ ID NO: 3067046 - protein, 8 aa, Giardia lamblia
TSPQAQGH

SEQ ID NO: 3067047 - protein, 5 aa, Giardia lamblia
TSPSA

SEQ ID NO: 3067048 - protein, 9 aa, Giardia lamblia
TSPSASEAE

SEQ ID NO: 3067049 - protein, 9 aa, Giardia lamblia
TSPSGSNSV

SEQ ID NO: 3067050 - protein, 4 aa, Giardia lamblia
TSPT

SEQ ID NO: 3067051 - protein, 7 aa, Giardia lamblia
TSPTAGL

SEQ ID NO: 3067052 - protein, 7 aa, Giardia lamblia
TSPTGVT

SEQ ID NO: 3067053 - protein, 6 aa, Giardia lamblia
TSQARN

SEQ ID NO: 3067054 - protein, 6 aa, Giardia lamblia
TSQDRT

SEQ ID NO: 3067055 - protein, 8 aa, Giardia lamblia
TSQGDDSL

SEQ ID NO: 3067056 - protein, 7 aa, Giardia lamblia
TSQGPVS

SEQ ID NO: 3067057 - protein, 10 aa, Giardia lamblia
TSQGQPKAFG

SEQ ID NO: 3067058 - protein, 21 aa, Giardia lamblia
TSQGTRSINSPETSTRTTEAV

SEQ ID NO: 3067059 - protein, 11 aa, Giardia lamblia
TSQKSHTFSET

SEQ ID NO: 3067060 - protein, 5 aa, Giardia lamblia
TSQLE

SEQ ID NO: 3067061 - protein, 8 aa, Giardia lamblia
TSQLSSCS

SEQ ID NO: 3067062 - protein, 11 aa, Giardia lamblia
TSQSKLDGLPA

SEQ ID NO: 3067063 - protein, 4 aa, Giardia lamblia
TSQT

SEQ ID NO: 3067064 - protein, 10 aa, Giardia lamblia
TSRDSSEASL

SEQ ID NO: 3067065 - protein, 6 aa, Giardia lamblia
TSRDTC

SEQ ID NO: 3067066 - protein, 5 aa, Giardia lamblia
TSRHL

SEQ ID NO: 3067067 - protein, 13 aa, Giardia lamblia
TSRKVKSLTKRYT

SEQ ID NO: 3067068 - protein, 5 aa, Giardia lamblia
TSRMK

SEQ ID NO: 3067069 - protein, 6 aa, Giardia lamblia
TSRPRF

SEQ ID NO: 3067070 - protein, 10 aa, Giardia lamblia
TSRRIQQSDS

SEQ ID NO: 3067071 - protein, 17 aa, Giardia lamblia
TSRSQQSKREESGEQAI

SEQ ID NO: 3067072 - protein, 6 aa, Giardia lamblia
TSRSSA

SEQ ID NO: 3067073 - protein, 6 aa, Giardia lamblia
TSRSTN

SEQ ID NO: 3067074 - protein, 8 aa, Giardia lamblia
TSRYPGSA

SEQ ID NO: 3067075 - protein, 8 aa, Giardia lamblia
TSSALGDS

SEQ ID NO: 3067076 - protein, 6 aa, Giardia lamblia
TSSAQQ

SEQ ID NO: 3067077 - protein, 4 aa, Giardia lamblia
TSSD

SEQ ID NO: 3067078 - protein, 9 aa, Giardia lamblia
TSSDESTLD

SEQ ID NO: 3067079 - protein, 5 aa, Giardia lamblia
TSSEE

SEQ ID NO: 3067080 - protein, 8 aa, Giardia lamblia
TSSEKATV

SEQ ID NO: 3067081 - protein, 9 aa, Giardia lamblia
TSSEPTEVA

SEQ ID NO: 3067082 - protein, 11 aa, Giardia lamblia
TSSFATNDRSM

SEQ ID NO: 3067083 - protein, 9 aa, Giardia lamblia
TSSGGSCTS

SEQ ID NO: 3067084 - protein, 7 aa, Giardia lamblia
TSSHDGT

SEQ ID NO: 3067085 - protein, 8 aa, Giardia lamblia
TSSHGTPQ

SEQ ID NO: 3067086 - protein, 6 aa, Giardia lamblia
TSSHPK

SEQ ID NO: 3067087 - protein, 5 aa, Giardia lamblia
TSSHY

SEQ ID NO: 3067088 - protein, 17 aa, Giardia lamblia
TSSKAPIYETDPGFSKT

SEQ ID NO: 3067089 - protein, 5 aa, Giardia lamblia
TSSLS

SEQ ID NO: 3067090 - protein, 6 aa, Giardia lamblia
TSSLSM

SEQ ID NO: 3067091 - protein, 6 aa, Giardia lamblia
TSSLTG

SEQ ID NO: 3067092 - protein, 16 aa, Giardia lamblia
TSSNCPPGIGGGINPD

SEQ ID NO: 3067093 - protein, 6 aa, Giardia lamblia
TSSNEE

SEQ ID NO: 3067094 - protein, 12 aa, Giardia lamblia
TSSNSSDKTSSL

SEQ ID NO: 3067095 - protein, 5 aa, Giardia lamblia
TSSPW

SEQ ID NO: 3067096 - protein, 13 aa, Giardia lamblia
TSSQTDNYLKPTS

SEQ ID NO: 3067097 - protein, 8 aa, Giardia lamblia
TSSSDRWT

SEQ ID NO: 3067098 - protein, 8 aa, Giardia lamblia
TSSSPSKA

SEQ ID NO: 3067099 - protein, 13 aa, Giardia lamblia
TSSSRSSSSDSVV

SEQ ID NO: 3067100 - protein, 20 aa, Giardia lamblia
TSSSSKSAQTLGTQGERSAD

SEQ ID NO: 3067101 - protein, 10 aa, Giardia lamblia
TSSSSLAGKD

SEQ ID NO: 3067102 - protein, 7 aa, Giardia lamblia
TSSTKFE

SEQ ID NO: 3067103 - protein, 8 aa, Giardia lamblia
TSSTPLAK

SEQ ID NO: 3067104 - protein, 10 aa, Giardia lamblia
TSSTRKDPAS

SEQ ID NO: 3067105 - protein, 20 aa, Giardia lamblia
TSSTSKKASANDSQAFPEPA

SEQ ID NO: 3067106 - protein, 12 aa, Giardia lamblia
TSSVSNINDEQK

SEQ ID NO: 3067107 - protein, 4 aa, Giardia lamblia
TSTA

SEQ ID NO: 3067108 - protein, 6 aa, Giardia lamblia
TSTADQ

SEQ ID NO: 3067109 - protein, 7 aa, Giardia lamblia
TSTDAEN

SEQ ID NO: 3067110 - protein, 10 aa, Giardia lamblia
TSTDTGPPDF

SEQ ID NO: 3067111 - protein, 6 aa, Giardia lamblia
TSTECP

SEQ ID NO: 3067112 - protein, 5 aa, Giardia lamblia
TSTGS

SEQ ID NO: 3067113 - protein, 15 aa, Giardia lamblia
TSTIRPQCSPSQSDY

SEQ ID NO: 3067114 - protein, 9 aa, Giardia lamblia
TSTKQPSLT

SEQ ID NO: 3067115 - protein, 7 aa, Giardia lamblia
TSTKTRS

SEQ ID NO: 3067116 - protein, 6 aa, Giardia lamblia
TSTLAE

SEQ ID NO: 3067117 - protein, 8 aa, Giardia lamblia
TSTLGSST

SEQ ID NO: 3067118 - protein, 4 aa, Giardia lamblia
TSTM

SEQ ID NO: 3067119 - protein, 25 aa, Giardia lamblia
TSTNGKPKTEEPAQQPSESSSWKEQ

SEQ ID NO: 3067120 - protein, 23 aa, Giardia lamblia
TSTQASEQVKASTQSPDATSTEL

SEQ ID NO: 3067121 - protein, 17 aa, Giardia lamblia
TSTRAYKRGRSSATEQV

SEQ ID NO: 3067122 - protein, 6 aa, Giardia lamblia
TSTRQL

SEQ ID NO: 3067123 - protein, 4 aa, Giardia lamblia
TSTS

SEQ ID NO: 3067124 - protein, 10 aa, Giardia lamblia
TSTSSTTGNI

SEQ ID NO: 3067125 - protein, 10 aa, Giardia lamblia
TSTSTYTTAR

SEQ ID NO: 3067126 - protein, 18 aa, Giardia lamblia
TSTTPSACNYTDSDQATG

SEQ ID NO: 3067127 - protein, 7 aa, Giardia lamblia
TSTTTSS

SEQ ID NO: 3067128 - protein, 9 aa, Giardia lamblia
TSTTVNPSE

SEQ ID NO: 3067129 - protein, 16 aa, Giardia lamblia
TSVDSRTERRDRDPAA

SEQ ID NO: 3067130 - protein, 8 aa, Giardia lamblia
TSVESAPS

SEQ ID NO: 3067131 - protein, 11 aa, Giardia lamblia
TSVGTGHPVPD

SEQ ID NO: 3067132 - protein, 7 aa, Giardia lamblia
TSVHSAE

SEQ ID NO: 3067133 - protein, 15 aa, Giardia lamblia
TSVKSKEASSEEVKQ

SEQ ID NO: 3067134 - protein, 13 aa, Giardia lamblia
TSVPDSKGVLSGE

SEQ ID NO: 3067135 - protein, 8 aa, Giardia lamblia
TSVSSDNL

SEQ ID NO: 3067136 - protein, 12 aa, Giardia lamblia
TSYKPNDSHGPI

SEQ ID NO: 3067137 - protein, 4 aa, Giardia lamblia
TSYP

SEQ ID NO: 3067138 - protein, 5 aa, Giardia lamblia
TSYPI

SEQ ID NO: 3067139 - protein, 5 aa, Giardia lamblia
TSYSS

SEQ ID NO: 3067140 - protein, 9 aa, Giardia lamblia
TSYVSKEAA

SEQ ID NO: 3067141 - protein, 9 aa, Giardia lamblia
TTAARTGPK

SEQ ID NO: 3067142 - protein, 8 aa, Giardia lamblia
TTADALPS

SEQ ID NO: 3067143 - protein, 8 aa, Giardia lamblia
TTAGASVS

SEQ ID NO: 3067144 - protein, 8 aa, Giardia lamblia
TTAGSDTV

SEQ ID NO: 3067145 - protein, 6 aa, Giardia lamblia
TTAHDY

SEQ ID NO: 3067146 - protein, 9 aa, Giardia lamblia
TTAKPNRYN

SEQ ID NO: 3067147 - protein, 12 aa, Giardia lamblia
TTAKTGSQKTGK

SEQ ID NO: 3067148 - protein, 6 aa, Giardia lamblia
TTAQDT

SEQ ID NO: 3067149 - protein, 5 aa, Giardia lamblia
TTAQQ

SEQ ID NO: 3067150 - protein, 19 aa, Giardia lamblia
TTASKTQQSAAAQDSSKPL

SEQ ID NO: 3067151 - protein, 10 aa, Giardia lamblia
TTATESSLEN

SEQ ID NO: 3067152 - protein, 5 aa, Giardia lamblia
TTCDS

SEQ ID NO: 3067153 - protein, 9 aa, Giardia lamblia
TTCREENGY

SEQ ID NO: 3067154 - protein, 12 aa, Giardia lamblia
TTCSTCGNTTNI

SEQ ID NO: 3067155 - protein, 6 aa, Giardia lamblia
TTDAMK

SEQ ID NO: 3067156 - protein, 6 aa, Giardia lamblia
TTDDQL

SEQ ID NO: 3067157 - protein, 7 aa, Giardia lamblia
TTDEDCN

SEQ ID NO: 3067158 - protein, 6 aa, Giardia lamblia
TTDEGQ

SEQ ID NO: 3067159 - protein, 7 aa, Giardia lamblia
TTDEQEK

SEQ ID NO: 3067160 - protein, 10 aa, Giardia lamblia
TTDETKRWTE

SEQ ID NO: 3067161 - protein, 7 aa, Giardia lamblia
TTDFGTG

SEQ ID NO: 3067162 - protein, 10 aa, Giardia lamblia
TTDKRSPHQI

SEQ ID NO: 3067163 - protein, 5 aa, Giardia lamblia
TTDKS

SEQ ID NO: 3067164 - protein, 4 aa, Giardia lamblia
TTDM

SEQ ID NO: 3067165 - protein, 8 aa, Giardia lamblia
TTDPAHKA

SEQ ID NO: 3067166 - protein, 5 aa, Giardia lamblia
TTDPL

SEQ ID NO: 3067167 - protein, 8 aa, Giardia lamblia
TTDPQGKK

SEQ ID NO: 3067168 - protein, 10 aa, Giardia lamblia
TTDSPPSVAA

SEQ ID NO: 3067169 - protein, 12 aa, Giardia lamblia
TTDSQGDQTTTG

SEQ ID NO: 3067170 - protein, 9 aa, Giardia lamblia
TTDSTGKVT

SEQ ID NO: 3067171 - protein, 10 aa, Giardia lamblia
TTDVGKDSFP

SEQ ID NO: 3067172 - protein, 7 aa, Giardia lamblia
TTEAQEQ

SEQ ID NO: 3067173 - protein, 5 aa, Giardia lamblia
TTEED

SEQ ID NO: 3067174 - protein, 18 aa, Giardia lamblia
TTEESETNFPGGTDTSGP

SEQ ID NO: 3067175 - protein, 6 aa, Giardia lamblia
TTEKQD

SEQ ID NO: 3067176 - protein, 13 aa, Giardia lamblia
TTELEKTYKTRRK

SEQ ID NO: 3067177 - protein, 4 aa, Giardia lamblia
TTEN

SEQ ID NO: 3067178 - protein, 9 aa, Giardia lamblia
TTEPPTGLR

SEQ ID NO: 3067179 - protein, 5 aa, Giardia lamblia
TTEQN

SEQ ID NO: 3067180 - protein, 6 aa, Giardia lamblia
TTEQRS

SEQ ID NO: 3067181 - protein, 5 aa, Giardia lamblia
TTESK

SEQ ID NO: 3067182 - protein, 4 aa, Giardia lamblia
TTET

SEQ ID NO: 3067183 - protein, 5 aa, Giardia lamblia
TTEVS

SEQ ID NO: 3067184 - protein, 5 aa, Giardia lamblia
TTFNQ

SEQ ID NO: 3067185 - protein, 12 aa, Giardia lamblia
TTGAQGMTSTDI

SEQ ID NO: 3067186 - protein, 6 aa, Giardia lamblia
TTGDTY

SEQ ID NO: 3067187 - protein, 5 aa, Giardia lamblia
TTGEI

SEQ ID NO: 3067188 - protein, 9 aa, Giardia lamblia
TTGESGNKN

SEQ ID NO: 3067189 - protein, 6 aa, Giardia lamblia
TTGFSG

SEQ ID NO: 3067190 - protein, 7 aa, Giardia lamblia
TTGFTSA

SEQ ID NO: 3067191 - protein, 4 aa, Giardia lamblia
TTGG

SEQ ID NO: 3067192 - protein, 9 aa, Giardia lamblia
TTGGARLGD

SEQ ID NO: 3067193 - protein, 5 aa, Giardia lamblia
TTGGK

SEQ ID NO: 3067194 - protein, 9 aa, Giardia lamblia
TTGHVGGTE

SEQ ID NO: 3067195 - protein, 10 aa, Giardia lamblia
TTGKASKKRQ

SEQ ID NO: 3067196 - protein, 12 aa, Giardia lamblia
TTGKDDKGIKAD

SEQ ID NO: 3067197 - protein, 9 aa, Giardia lamblia
TTGNLGPSL

SEQ ID NO: 3067198 - protein, 6 aa, Giardia lamblia
TTGPEF

SEQ ID NO: 3067199 - protein, 5 aa, Giardia lamblia
TTGRE

SEQ ID NO: 3067200 - protein, 7 aa, Giardia lamblia
TTGSATV

SEQ ID NO: 3067201 - protein, 5 aa, Giardia lamblia
TTGSE

SEQ ID NO: 3067202 - protein, 5 aa, Giardia lamblia
TTGSI

SEQ ID NO: 3067203 - protein, 5 aa, Giardia lamblia
TTGYP

SEQ ID NO: 3067204 - protein, 14 aa, Giardia lamblia
TTHQDKGKSANFEN

SEQ ID NO: 3067205 - protein, 19 aa, Giardia lamblia
TTIADSSNSTERPTSSITL

SEQ ID NO: 3067206 - protein, 10 aa, Giardia lamblia
TTIAKSNSNI

SEQ ID NO: 3067207 - protein, 4 aa, Giardia lamblia
TTIG

SEQ ID NO: 3067208 - protein, 14 aa, Giardia lamblia
TTINGGYVNYNAIK

SEQ ID NO: 3067209 - protein, 10 aa, Giardia lamblia
TTIPPTSGEF

SEQ ID NO: 3067210 - protein, 4 aa, Giardia lamblia
TTIS

SEQ ID NO: 3067211 - protein, 7 aa, Giardia lamblia
TTKDEAV

SEQ ID NO: 3067212 - protein, 5 aa, Giardia lamblia
TTKNT

SEQ ID NO: 3067213 - protein, 6 aa, Giardia lamblia
TTKPEQ

SEQ ID NO: 3067214 - protein, 14 aa, Giardia lamblia
TTKQPNQHDHLTSK

SEQ ID NO: 3067215 - protein, 5 aa, Giardia lamblia
TTKQR

SEQ ID NO: 3067216 - protein, 9 aa, Giardia lamblia
TTKSETALQ

SEQ ID NO: 3067217 - protein, 17 aa, Giardia lamblia
TTKSTKSDIADAQASTF

SEQ ID NO: 3067218 - protein, 26 aa, Giardia lamblia
TTLPERPRDNTCQESTQAVSAPSPFT

SEQ ID NO: 3067219 - protein, 9 aa, Giardia lamblia
TTLSGNTSS

SEQ ID NO: 3067220 - protein, 19 aa, Giardia lamblia
TTMTSSPSSHSQRSSSGPH

SEQ ID NO: 3067221 - protein, 13 aa, Giardia lamblia
TTNPDNIKRDAQM

SEQ ID NO: 3067222 - protein, 5 aa, Giardia lamblia
TTNRE

SEQ ID NO: 3067223 - protein, 4 aa, Giardia lamblia
TTNS

SEQ ID NO: 3067224 - protein, 6 aa, Giardia lamblia
TTPATY

SEQ ID NO: 3067225 - protein, 9 aa, Giardia lamblia
TTPDERNAS

SEQ ID NO: 3067226 - protein, 6 aa, Giardia lamblia
TTPDFE

SEQ ID NO: 3067227 - protein, 4 aa, Giardia lamblia
TTPE

SEQ ID NO: 3067228 - protein, 5 aa, Giardia lamblia
TTPEV

SEQ ID NO: 3067229 - protein, 5 aa, Giardia lamblia
TTPFS

SEQ ID NO: 3067230 - protein, 6 aa, Giardia lamblia
TTPGAS

SEQ ID NO: 3067231 - protein, 6 aa, Giardia lamblia
TTPGLA

SEQ ID NO: 3067232 - protein, 4 aa, Giardia lamblia
TTPL

SEQ ID NO: 3067233 - protein, 8 aa, Giardia lamblia
TTPPVSRA

SEQ ID NO: 3067234 - protein, 7 aa, Giardia lamblia
TTPQNRG

SEQ ID NO: 3067235 - protein, 13 aa, Giardia lamblia
TTPQPQDTSSPGI

SEQ ID NO: 3067236 - protein, 5 aa, Giardia lamblia
TTPQS

SEQ ID NO: 3067237 - protein, 5 aa, Giardia lamblia
TTPSR

SEQ ID NO: 3067238 - protein, 17 aa, Giardia lamblia
TTPTQTQAAGGSPTDKI

SEQ ID NO: 3067239 - protein, 12 aa, Giardia lamblia
TTPVAPSDGGMT

SEQ ID NO: 3067240 - protein, 6 aa, Giardia lamblia
TTPVTT

SEQ ID NO: 3067241 - protein, 10 aa, Giardia lamblia
TTQHKPEETY

SEQ ID NO: 3067242 - protein, 6 aa, Giardia lamblia
TTQPYP

SEQ ID NO: 3067243 - protein, 5 aa, Giardia lamblia
TTQQQ

SEQ ID NO: 3067244 - protein, 6 aa, Giardia lamblia
TTQTSS

SEQ ID NO: 3067245 - protein, 10 aa, Giardia lamblia
TTQVGTGSKL

SEQ ID NO: 3067246 - protein, 5 aa, Giardia lamblia
TTRKV

SEQ ID NO: 3067247 - protein, 4 aa, Giardia lamblia
TTRP

SEQ ID NO: 3067248 - protein, 4 aa, Giardia lamblia
TTRT

SEQ ID NO: 3067249 - protein, 11 aa, Giardia lamblia
TTSATLKSVED

SEQ ID NO: 3067250 - protein, 7 aa, Giardia lamblia
TTSAYET

SEQ ID NO: 3067251 - protein, 5 aa, Giardia lamblia
TTSDE

SEQ ID NO: 3067252 - protein, 8 aa, Giardia lamblia
TTSDKQKQ

SEQ ID NO: 3067253 - protein, 4 aa, Giardia lamblia
TTSE

SEQ ID NO: 3067254 - protein, 8 aa, Giardia lamblia
TTSEKCSP

SEQ ID NO: 3067255 - protein, 6 aa, Giardia lamblia
TTSFSG

SEQ ID NO: 3067256 - protein, 5 aa, Giardia lamblia
TTSGT

SEQ ID NO: 3067257 - protein, 13 aa, Giardia lamblia
TTSLKGLSSKDVP

SEQ ID NO: 3067258 - protein, 9 aa, Giardia lamblia
TTSLPQGAT

SEQ ID NO: 3067259 - protein, 14 aa, Giardia lamblia
TTSPQAYAKLGNSM

SEQ ID NO: 3067260 - protein, 7 aa, Giardia lamblia
TTSQSQR

SEQ ID NO: 3067261 - protein, 11 aa, Giardia lamblia
TTSQTATQKGL

SEQ ID NO: 3067262 - protein, 40 aa, Giardia lamblia
TTSSDEASKRSVEEGQAQTSAPNGPSVDQKTVNKNAPTQK

SEQ ID NO: 3067263 - protein, 5 aa, Giardia lamblia
TTSSP

SEQ ID NO: 3067264 - protein, 8 aa, Giardia lamblia
TTSSRDVK

SEQ ID NO: 3067265 - protein, 9 aa, Giardia lamblia
TTSTSQAVQ

SEQ ID NO: 3067266 - protein, 6 aa, Giardia lamblia
TTTADC

SEQ ID NO: 3067267 - protein, 9 aa, Giardia lamblia
TTTGASAGT

SEQ ID NO: 3067268 - protein, 11 aa, Giardia lamblia
TTTGSSLPRDI

SEQ ID NO: 3067269 - protein, 5 aa, Giardia lamblia
TTTGT

SEQ ID NO: 3067270 - protein, 11 aa, Giardia lamblia
TTTNSNASEEH

SEQ ID NO: 3067271 - protein, 17 aa, Giardia lamblia
TTTNTCTNTNSGTNITG

SEQ ID NO: 3067272 - protein, 20 aa, Giardia lamblia
TTTPSAEATEVDSEAQQAGQ

SEQ ID NO: 3067273 - protein, 7 aa, Giardia lamblia
TTTQDRN

SEQ ID NO: 3067274 - protein, 5 aa, Giardia lamblia
TTTQV

SEQ ID NO: 3067275 - protein, 4 aa, Giardia lamblia
TTTR

SEQ ID NO: 3067276 - protein, 14 aa, Giardia lamblia
TTTRAKLKKTQTPA

SEQ ID NO: 3067277 - protein, 7 aa, Giardia lamblia
TTTSACT

SEQ ID NO: 3067278 - protein, 13 aa, Giardia lamblia
TTTSADSSLPHSL

SEQ ID NO: 3067279 - protein, 5 aa, Giardia lamblia
TTTSE

SEQ ID NO: 3067280 - protein, 9 aa, Giardia lamblia
TTTSSGEAA

SEQ ID NO: 3067281 - protein, 4 aa, Giardia lamblia
TTTT

SEQ ID NO: 3067282 - protein, 9 aa, Giardia lamblia
TTTTLTTGA

SEQ ID NO: 3067283 - protein, 4 aa, Giardia lamblia
TTVA

SEQ ID NO: 3067284 - protein, 14 aa, Giardia lamblia
TTVPASSSCTDISG

SEQ ID NO: 3067285 - protein, 7 aa, Giardia lamblia
TTVRSTY

SEQ ID NO: 3067286 - protein, 11 aa, Giardia lamblia
TTYNDANQQPI

SEQ ID NO: 3067287 - protein, 4 aa, Giardia lamblia
TTYP

SEQ ID NO: 3067288 - protein, 6 aa, Giardia lamblia
TTYSDS

SEQ ID NO: 3067289 - protein, 10 aa, Giardia lamblia
TVADATPESV

SEQ ID NO: 3067290 - protein, 13 aa, Giardia lamblia
TVANDGTAGATIA

SEQ ID NO: 3067291 - protein, 11 aa, Giardia lamblia
TVANPDCGSYG

SEQ ID NO: 3067292 - protein, 13 aa, Giardia lamblia
TVAQSKASYEGYP

SEQ ID NO: 3067293 - protein, 6 aa, Giardia lamblia
TVASER

SEQ ID NO: 3067294 - protein, 13 aa, Giardia lamblia
TVEGSSLRRSTSK

SEQ ID NO: 3067295 - protein, 10 aa, Giardia lamblia
TVEKESCGVD

SEQ ID NO: 3067296 - protein, 4 aa, Giardia lamblia
TVEP

SEQ ID NO: 3067297 - protein, 5 aa, Giardia lamblia
TVEPN

SEQ ID NO: 3067298 - protein, 47 aa, Giardia lamblia
TVETSGNTQAAPQVSETSAIHTSRTQTSRTKEGKPDSRGPKPDPASP

SEQ ID NO: 3067299 - protein, 14 aa, Giardia lamblia
TVGSCTQDSNGNTY

SEQ ID NO: 3067300 - protein, 7 aa, Giardia lamblia
TVHGRDT

SEQ ID NO: 3067301 - protein, 9 aa, Giardia lamblia
TVHSTGTGL

SEQ ID NO: 3067302 - protein, 9 aa, Giardia lamblia
TVKPASELA

SEQ ID NO: 3067303 - protein, 23 aa, Giardia lamblia
TVNGSQESKKSAATSLSTKPSVS

SEQ ID NO: 3067304 - protein, 8 aa, Giardia lamblia
TVNTSPEH

SEQ ID NO: 3067305 - protein, 13 aa, Giardia lamblia
TVPAGSSSLQPDG

SEQ ID NO: 3067306 - protein, 6 aa, Giardia lamblia
TVPASD

SEQ ID NO: 3067307 - protein, 7 aa, Giardia lamblia
TVPDSPI

SEQ ID NO: 3067308 - protein, 20 aa, Giardia lamblia
TVPKNVSRGGGTDPVVSART

SEQ ID NO: 3067309 - protein, 8 aa, Giardia lamblia
TVPPIQSS

SEQ ID NO: 3067310 - protein, 6 aa, Giardia lamblia
TVPQGN

SEQ ID NO: 3067311 - protein, 5 aa, Giardia lamblia
TVPQS

SEQ ID NO: 3067312 - protein, 9 aa, Giardia lamblia
TVPQSSSDF

SEQ ID NO: 3067313 - protein, 7 aa, Giardia lamblia
TVPTKES

SEQ ID NO: 3067314 - protein, 6 aa, Giardia lamblia
TVQDER

SEQ ID NO: 3067315 - protein, 4 aa, Giardia lamblia
TVQG

SEQ ID NO: 3067316 - protein, 8 aa, Giardia lamblia
TVRKRNRQ

SEQ ID NO: 3067317 - protein, 80 aa, Giardia lamblia
TVSAHNSAFRANKSGKQLASTASNTMPSGEKERTRTLGTNKDLTEEDNKPKKISKKRSSKPSIDKARSSGTQKGKDTVKN

SEQ ID NO: 3067318 - protein, 9 aa, Giardia lamblia
TVSDGKCTQ

SEQ ID NO: 3067319 - protein, 19 aa, Giardia lamblia
TVSDPDSTSLLSTDMTNSL

SEQ ID NO: 3067320 - protein, 4 aa, Giardia lamblia
TVSG

SEQ ID NO: 3067321 - protein, 15 aa, Giardia lamblia
TVSGEKRMEKPKPKM

SEQ ID NO: 3067322 - protein, 9 aa, Giardia lamblia
TVSKAEGEV

SEQ ID NO: 3067323 - protein, 8 aa, Giardia lamblia
TVSKDSYS

SEQ ID NO: 3067324 - protein, 7 aa, Giardia lamblia
TVSLAPP

SEQ ID NO: 3067325 - protein, 10 aa, Giardia lamblia
TVSNTVNEMG

SEQ ID NO: 3067326 - protein, 5 aa, Giardia lamblia
TVSPT

SEQ ID NO: 3067327 - protein, 10 aa, Giardia lamblia
TVSSNTEPVP

SEQ ID NO: 3067328 - protein, 14 aa, Giardia lamblia
TVSSQRVKDGSLEG

SEQ ID NO: 3067329 - protein, 21 aa, Giardia lamblia
TVTDSSTDKIKLDPGGTITTN

SEQ ID NO: 3067330 - protein, 10 aa, Giardia lamblia
TVTGGEYDDT

SEQ ID NO: 3067331 - protein, 14 aa, Giardia lamblia
TVTGRGSAKVPSSA

SEQ ID NO: 3067332 - protein, 4 aa, Giardia lamblia
TVTI

SEQ ID NO: 3067333 - protein, 4 aa, Giardia lamblia
TVTS

SEQ ID NO: 3067334 - protein, 11 aa, Giardia lamblia
TWDHKTEQCTT

SEQ ID NO: 3067335 - protein, 4 aa, Giardia lamblia
TWLG

SEQ ID NO: 3067336 - protein, 18 aa, Giardia lamblia
TWRRDKKSVTKTLTNTEV

SEQ ID NO: 3067337 - protein, 12 aa, Giardia lamblia
TYAGKDATYTEK

SEQ ID NO: 3067338 - protein, 11 aa, Giardia lamblia
TYAGQSRRASL

SEQ ID NO: 3067339 - protein, 8 aa, Giardia lamblia
TYAGSPAY

SEQ ID NO: 3067340 - protein, 11 aa, Giardia lamblia
TYARTENGYSP

SEQ ID NO: 3067341 - protein, 7 aa, Giardia lamblia
TYDNGDN

SEQ ID NO: 3067342 - protein, 5 aa, Giardia lamblia
TYDPD

SEQ ID NO: 3067343 - protein, 18 aa, Giardia lamblia
TYDTGSFASSKSVLDNDD

SEQ ID NO: 3067344 - protein, 10 aa, Giardia lamblia
TYDTTKYSSP

SEQ ID NO: 3067345 - protein, 5 aa, Giardia lamblia
TYENE

SEQ ID NO: 3067346 - protein, 9 aa, Giardia lamblia
TYEREHKDD

SEQ ID NO: 3067347 - protein, 11 aa, Giardia lamblia
TYEVKGKGCQK

SEQ ID NO: 3067348 - protein, 4 aa, Giardia lamblia
TYGD

SEQ ID NO: 3067349 - protein, 11 aa, Giardia lamblia
TYGQESLGSSG

SEQ ID NO: 3067350 - protein, 7 aa, Giardia lamblia
TYGSNTM

SEQ ID NO: 3067351 - protein, 7 aa, Giardia lamblia
TYGTQQP

SEQ ID NO: 3067352 - protein, 19 aa, Giardia lamblia
TYHDSSAEHGTDSNPGTSL

SEQ ID NO: 3067353 - protein, 8 aa, Giardia lamblia
TYLSGDQT

SEQ ID NO: 3067354 - protein, 12 aa, Giardia lamblia
TYNGEDSARSFE

SEQ ID NO: 3067355 - protein, 4 aa, Giardia lamblia
TYPD

SEQ ID NO: 3067356 - protein, 5 aa, Giardia lamblia
TYPDT

SEQ ID NO: 3067357 - protein, 5 aa, Giardia lamblia
TYPGD

SEQ ID NO: 3067358 - protein, 6 aa, Giardia lamblia
TYPISS

SEQ ID NO: 3067359 - protein, 8 aa, Giardia lamblia
TYPSKTEY

SEQ ID NO: 3067360 - protein, 4 aa, Giardia lamblia
TYPT

SEQ ID NO: 3067361 - protein, 5 aa, Giardia lamblia
TYPTE

SEQ ID NO: 3067362 - protein, 8 aa, Giardia lamblia
TYPVSKGT

SEQ ID NO: 3067363 - protein, 5 aa, Giardia lamblia
TYQKR

SEQ ID NO: 3067364 - protein, 8 aa, Giardia lamblia
TYQPTGAY

SEQ ID NO: 3067365 - protein, 9 aa, Giardia lamblia
TYRDGSPIY

SEQ ID NO: 3067366 - protein, 8 aa, Giardia lamblia
TYRNDGRY

SEQ ID NO: 3067367 - protein, 12 aa, Giardia lamblia
TYRNGRRRGQGE

SEQ ID NO: 3067368 - protein, 5 aa, Giardia lamblia
TYRSD

SEQ ID NO: 3067369 - protein, 8 aa, Giardia lamblia
TYSATSAL

SEQ ID NO: 3067370 - protein, 10 aa, Giardia lamblia
TYSDTSSIGA

SEQ ID NO: 3067371 - protein, 10 aa, Giardia lamblia
TYSGKLSKTD

SEQ ID NO: 3067372 - protein, 7 aa, Giardia lamblia
TYSPAYT

SEQ ID NO: 3067373 - protein, 24 aa, Giardia lamblia
TYSPEEDGGLPDEEGDVSSEARYR

SEQ ID NO: 3067374 - protein, 7 aa, Giardia lamblia
TYSPNNG

SEQ ID NO: 3067375 - protein, 6 aa, Giardia lamblia
VAADSG

SEQ ID NO: 3067376 - protein, 8 aa, Giardia lamblia
VAANRTGA

SEQ ID NO: 3067377 - protein, 16 aa, Giardia lamblia
VAAPPTTDTAFRSGEV

SEQ ID NO: 3067378 - protein, 19 aa, Giardia lamblia
VADAATKLSLPTDDPLRSA

SEQ ID NO: 3067379 - protein, 8 aa, Giardia lamblia
VADDDTVN

SEQ ID NO: 3067380 - protein, 8 aa, Giardia lamblia
VADKDKPI

SEQ ID NO: 3067381 - protein, 13 aa, Giardia lamblia
VADNPQPAAKRSS

SEQ ID NO: 3067382 - protein, 8 aa, Giardia lamblia
VADPDPCS

SEQ ID NO: 3067383 - protein, 6 aa, Giardia lamblia
VADPTA

SEQ ID NO: 3067384 - protein, 8 aa, Giardia lamblia
VADQEGEL

SEQ ID NO: 3067385 - protein, 27 aa, Giardia lamblia
VAEGSRKTAQDSSTLAKQSGAPTSSYP

SEQ ID NO: 3067386 - protein, 8 aa, Giardia lamblia
VAEQSGLD

SEQ ID NO: 3067387 - protein, 17 aa, Giardia lamblia
VAEQYNTSFDSKTRTWS

SEQ ID NO: 3067388 - protein, 11 aa, Giardia lamblia
VAETSPESQSV

SEQ ID NO: 3067389 - protein, 5 aa, Giardia lamblia
VAGDP

SEQ ID NO: 3067390 - protein, 9 aa, Giardia lamblia
VAGDPNKCD

SEQ ID NO: 3067391 - protein, 4 aa, Giardia lamblia
VAGG

SEQ ID NO: 3067392 - protein, 17 aa, Giardia lamblia
VAGGVTNEPAASPTQIG

SEQ ID NO: 3067393 - protein, 9 aa, Giardia lamblia
VAGSQAALQ

SEQ ID NO: 3067394 - protein, 6 aa, Giardia lamblia
VAGTHD

SEQ ID NO: 3067395 - protein, 10 aa, Giardia lamblia
VAKHPTGISG

SEQ ID NO: 3067396 - protein, 5 aa, Giardia lamblia
VAKQP

SEQ ID NO: 3067397 - protein, 14 aa, Giardia lamblia
VAKRKTAAIAGGTV

SEQ ID NO: 3067398 - protein, 10 aa, Giardia lamblia
VANESTADYG

SEQ ID NO: 3067399 - protein, 11 aa, Giardia lamblia
VANRTSTAWNS

SEQ ID NO: 3067400 - protein, 17 aa, Giardia lamblia
VANTKGEVSSQTPNSEM

SEQ ID NO: 3067401 - protein, 4 aa, Giardia lamblia
VANY

SEQ ID NO: 3067402 - protein, 5 aa, Giardia lamblia
VAPAT

SEQ ID NO: 3067403 - protein, 4 aa, Giardia lamblia
VAPD

SEQ ID NO: 3067404 - protein, 16 aa, Giardia lamblia
VAPDPVAAATHEKRHG

SEQ ID NO: 3067405 - protein, 7 aa, Giardia lamblia
VAPMRES

SEQ ID NO: 3067406 - protein, 16 aa, Giardia lamblia
VAPPQQKAGSRSRAPS

SEQ ID NO: 3067407 - protein, 8 aa, Giardia lamblia
VAPPTPDL

SEQ ID NO: 3067408 - protein, 15 aa, Giardia lamblia
VAPQGHDANKQVTRD

SEQ ID NO: 3067409 - protein, 9 aa, Giardia lamblia
VAPSGNSKI

SEQ ID NO: 3067410 - protein, 5 aa, Giardia lamblia
VAQSA

SEQ ID NO: 3067411 - protein, 9 aa, Giardia lamblia
VAQSGRKAN

SEQ ID NO: 3067412 - protein, 11 aa, Giardia lamblia
VAQSQGGYTGR

SEQ ID NO: 3067413 - protein, 14 aa, Giardia lamblia
VARHPDSKDDSESE

SEQ ID NO: 3067414 - protein, 13 aa, Giardia lamblia
VARNEAKKIPHQG

SEQ ID NO: 3067415 - protein, 12 aa, Giardia lamblia
VARTSQQSEVDM

SEQ ID NO: 3067416 - protein, 12 aa, Giardia lamblia
VASAPPVASGAA

SEQ ID NO: 3067417 - protein, 8 aa, Giardia lamblia
VASARKNI

SEQ ID NO: 3067418 - protein, 6 aa, Giardia lamblia
VASDIK

SEQ ID NO: 3067419 - protein, 24 aa, Giardia lamblia
VASDKSLQQPAKPVNEQRDSREQR

SEQ ID NO: 3067420 - protein, 12 aa, Giardia lamblia
VASGQDDNCEAS

SEQ ID NO: 3067421 - protein, 7 aa, Giardia lamblia
VASGSFD

SEQ ID NO: 3067422 - protein, 8 aa, Giardia lamblia
VASGTADE

SEQ ID NO: 3067423 - protein, 9 aa, Giardia lamblia
VASGTRFSE

SEQ ID NO: 3067424 - protein, 19 aa, Giardia lamblia
VASKPTGFSPAPATHGQRE

SEQ ID NO: 3067425 - protein, 16 aa, Giardia lamblia
VASSDESNTAEPPLKA

SEQ ID NO: 3067426 - protein, 9 aa, Giardia lamblia
VATDDGHCT

SEQ ID NO: 3067427 - protein, 6 aa, Giardia lamblia
VATEAY

SEQ ID NO: 3067428 - protein, 7 aa, Giardia lamblia
VATGGIE

SEQ ID NO: 3067429 - protein, 7 aa, Giardia lamblia
VATNRSE

SEQ ID NO: 3067430 - protein, 14 aa, Giardia lamblia
VATPSLEQVAGKGY

SEQ ID NO: 3067431 - protein, 5 aa, Giardia lamblia
VATSP

SEQ ID NO: 3067432 - protein, 5 aa, Giardia lamblia
VCEPG

SEQ ID NO: 3067433 - protein, 8 aa, Giardia lamblia
VCESEDEY

SEQ ID NO: 3067434 - protein, 10 aa, Giardia lamblia
VCESPYHPSI

SEQ ID NO: 3067435 - protein, 7 aa, Giardia lamblia
VCGGPEA

SEQ ID NO: 3067436 - protein, 19 aa, Giardia lamblia
VCGSSTAGNASYSTASDDA

SEQ ID NO: 3067437 - protein, 5 aa, Giardia lamblia
VCSNN

SEQ ID NO: 3067438 - protein, 17 aa, Giardia lamblia
VDADASALTNPSITPSA

SEQ ID NO: 3067439 - protein, 10 aa, Giardia lamblia
VDADDKDTIE

SEQ ID NO: 3067440 - protein, 7 aa, Giardia lamblia
VDASEAQ

SEQ ID NO: 3067441 - protein, 6 aa, Giardia lamblia
VDASQD

SEQ ID NO: 3067442 - protein, 6 aa, Giardia lamblia
VDDGLQ

SEQ ID NO: 3067443 - protein, 9 aa, Giardia lamblia
VDDGPKHEP

SEQ ID NO: 3067444 - protein, 8 aa, Giardia lamblia
VDDNSDTE

SEQ ID NO: 3067445 - protein, 4 aa, Giardia lamblia
VDDP

SEQ ID NO: 3067446 - protein, 10 aa, Giardia lamblia
VDDPNQARSF

SEQ ID NO: 3067447 - protein, 8 aa, Giardia lamblia
VDDRGKEV

SEQ ID NO: 3067448 - protein, 9 aa, Giardia lamblia
VDDSDYEDI

SEQ ID NO: 3067449 - protein, 7 aa, Giardia lamblia
VDDTGRI

SEQ ID NO: 3067450 - protein, 9 aa, Giardia lamblia
VDEAQEAFS

SEQ ID NO: 3067451 - protein, 7 aa, Giardia lamblia
VDEDGNN

SEQ ID NO: 3067452 - protein, 12 aa, Giardia lamblia
VDEDTGASGTWS

SEQ ID NO: 3067453 - protein, 9 aa, Giardia lamblia
VDEEAGRDD

SEQ ID NO: 3067454 - protein, 7 aa, Giardia lamblia
VDEQGNY

SEQ ID NO: 3067455 - protein, 7 aa, Giardia lamblia
VDERGTP

SEQ ID NO: 3067456 - protein, 27 aa, Giardia lamblia
VDESSKPPKGIKRGKAAVAEEDGSSSI

SEQ ID NO: 3067457 - protein, 8 aa, Giardia lamblia
VDFNENSP

SEQ ID NO: 3067458 - protein, 4 aa, Giardia lamblia
VDFP

SEQ ID NO: 3067459 - protein, 10 aa, Giardia lamblia
VDGKSECASC

SEQ ID NO: 3067460 - protein, 11 aa, Giardia lamblia
VDGNSNKDINR

SEQ ID NO: 3067461 - protein, 8 aa, Giardia lamblia
VDGTSYKR

SEQ ID NO: 3067462 - protein, 10 aa, Giardia lamblia
VDKERPSSGV

SEQ ID NO: 3067463 - protein, 23 aa, Giardia lamblia
VDLDTSKAKLEAKYKEAEKRRNS

SEQ ID NO: 3067464 - protein, 5 aa, Giardia lamblia
VDLQG

SEQ ID NO: 3067465 - protein, 6 aa, Giardia lamblia
VDNDTS

SEQ ID NO: 3067466 - protein, 7 aa, Giardia lamblia
VDNEPGQ

SEQ ID NO: 3067467 - protein, 8 aa, Giardia lamblia
VDNEPGQK

SEQ ID NO: 3067468 - protein, 5 aa, Giardia lamblia
VDNEQ

SEQ ID NO: 3067469 - protein, 8 aa, Giardia lamblia
VDNSGSTA

SEQ ID NO: 3067470 - protein, 11 aa, Giardia lamblia
VDPAQDEKRHT

SEQ ID NO: 3067471 - protein, 6 aa, Giardia lamblia
VDPDAA

SEQ ID NO: 3067472 - protein, 9 aa, Giardia lamblia
VDPDPSSNL

SEQ ID NO: 3067473 - protein, 11 aa, Giardia lamblia
VDPEKGLTQEQ

SEQ ID NO: 3067474 - protein, 7 aa, Giardia lamblia
VDPGTNT

SEQ ID NO: 3067475 - protein, 5 aa, Giardia lamblia
VDPNS

SEQ ID NO: 3067476 - protein, 8 aa, Giardia lamblia
VDPPQTSS

SEQ ID NO: 3067477 - protein, 5 aa, Giardia lamblia
VDPVK

SEQ ID NO: 3067478 - protein, 14 aa, Giardia lamblia
VDQPTGAGEHPRSV

SEQ ID NO: 3067479 - protein, 5 aa, Giardia lamblia
VDQQE

SEQ ID NO: 3067480 - protein, 16 aa, Giardia lamblia
VDQQPNASFVSPPTNS

SEQ ID NO: 3067481 - protein, 4 aa, Giardia lamblia
VDRE

SEQ ID NO: 3067482 - protein, 9 aa, Giardia lamblia
VDRGAPKPK

SEQ ID NO: 3067483 - protein, 4 aa, Giardia lamblia
VDRR

SEQ ID NO: 3067484 - protein, 9 aa, Giardia lamblia
VDSAAEAAI

SEQ ID NO: 3067485 - protein, 20 aa, Giardia lamblia
VDSAAGSGETVSRNTRDTVR

SEQ ID NO: 3067486 - protein, 8 aa, Giardia lamblia
VDSAGASL

SEQ ID NO: 3067487 - protein, 11 aa, Giardia lamblia
VDSDRSPPAQF

SEQ ID NO: 3067488 - protein, 8 aa, Giardia lamblia
VDSEAPGW

SEQ ID NO: 3067489 - protein, 9 aa, Giardia lamblia
VDSENTTPF

SEQ ID NO: 3067490 - protein, 7 aa, Giardia lamblia
VDSNDST

SEQ ID NO: 3067491 - protein, 23 aa, Giardia lamblia
VDSPVDPPVEPSDCKAGEQLTDD

SEQ ID NO: 3067492 - protein, 6 aa, Giardia lamblia
VDSSNL

SEQ ID NO: 3067493 - protein, 11 aa, Giardia lamblia
VDSSPSGGFSD

SEQ ID NO: 3067494 - protein, 7 aa, Giardia lamblia
VDSVDNP

SEQ ID NO: 3067495 - protein, 11 aa, Giardia lamblia
VDTAKTRTARR

SEQ ID NO: 3067496 - protein, 37 aa, Giardia lamblia
VDTASDAASAAAEVEPKQTENHDEQDGNAEGTEEPEV

SEQ ID NO: 3067497 - protein, 4 aa, Giardia lamblia
VDTE

SEQ ID NO: 3067498 - protein, 4 aa, Giardia lamblia
VDTG

SEQ ID NO: 3067499 - protein, 7 aa, Giardia lamblia
VDTNGMN

SEQ ID NO: 3067500 - protein, 4 aa, Giardia lamblia
VDTT

SEQ ID NO: 3067501 - protein, 7 aa, Giardia lamblia
VDTTSFE

SEQ ID NO: 3067502 - protein, 5 aa, Giardia lamblia
VDTVP

SEQ ID NO: 3067503 - protein, 12 aa, Giardia lamblia
VDYKPNTNFEKE

SEQ ID NO: 3067504 - protein, 19 aa, Giardia lamblia
VDYQNNKTRMHAASSGSAT

SEQ ID NO: 3067505 - protein, 4 aa, Giardia lamblia
VDYS

SEQ ID NO: 3067506 - protein, 12 aa, Giardia lamblia
VEAGKKNSNGET

SEQ ID NO: 3067507 - protein, 9 aa, Giardia lamblia
VEAPPKDPV

SEQ ID NO: 3067508 - protein, 8 aa, Giardia lamblia
VECSHEPK

SEQ ID NO: 3067509 - protein, 17 aa, Giardia lamblia
VEDATKPLLTEDKSSTS

SEQ ID NO: 3067510 - protein, 9 aa, Giardia lamblia
VEDDTGNTI

SEQ ID NO: 3067511 - protein, 15 aa, Giardia lamblia
VEDGESAKCNCRPGR

SEQ ID NO: 3067512 - protein, 30 aa, Giardia lamblia
VEDKESSEDSQMAQARHSSQHKSSSSPPGA

SEQ ID NO: 3067513 - protein, 6 aa, Giardia lamblia
VEDNGT

SEQ ID NO: 3067514 - protein, 17 aa, Giardia lamblia
VEDPDYSKLASAYSAAR

SEQ ID NO: 3067515 - protein, 11 aa, Giardia lamblia
VEDSPVDVGTP

SEQ ID NO: 3067516 - protein, 14 aa, Giardia lamblia
VEDSSATDKDQQLN

SEQ ID NO: 3067517 - protein, 23 aa, Giardia lamblia
VEEDDNDEDLSDREEEAEQQNIK

SEQ ID NO: 3067518 - protein, 7 aa, Giardia lamblia
VEESTAG

SEQ ID NO: 3067519 - protein, 6 aa, Giardia lamblia
VEGDEK

SEQ ID NO: 3067520 - protein, 15 aa, Giardia lamblia
VEGEHPQSLEAPTYP

SEQ ID NO: 3067521 - protein, 6 aa, Giardia lamblia
VEGGAL

SEQ ID NO: 3067522 - protein, 11 aa, Giardia lamblia
VEGGSADSRQP

SEQ ID NO: 3067523 - protein, 7 aa, Giardia lamblia
VEGNNNT

SEQ ID NO: 3067524 - protein, 8 aa, Giardia lamblia
VEGNPYAL

SEQ ID NO: 3067525 - protein, 8 aa, Giardia lamblia
VEGNRADF

SEQ ID NO: 3067526 - protein, 7 aa, Giardia lamblia
VEGTGLS

SEQ ID NO: 3067527 - protein, 25 aa, Giardia lamblia
VEIDGGANEGKGLTNNVSSQDINGN

SEQ ID NO: 3067528 - protein, 7 aa, Giardia lamblia
VEISNSR

SEQ ID NO: 3067529 - protein, 11 aa, Giardia lamblia
VEKSASEEVGY

SEQ ID NO: 3067530 - protein, 5 aa, Giardia lamblia
VEPAS

SEQ ID NO: 3067531 - protein, 18 aa, Giardia lamblia
VEPKRQRLEAAKADLKEK

SEQ ID NO: 3067532 - protein, 8 aa, Giardia lamblia
VEPNADAQ

SEQ ID NO: 3067533 - protein, 8 aa, Giardia lamblia
VEPPPNGV

SEQ ID NO: 3067534 - protein, 12 aa, Giardia lamblia
VEPQAAPLENRD

SEQ ID NO: 3067535 - protein, 6 aa, Giardia lamblia
VEPSGS

SEQ ID NO: 3067536 - protein, 6 aa, Giardia lamblia
VEPSKG

SEQ ID NO: 3067537 - protein, 30 aa, Giardia lamblia
VEPTAVKGASYSSERSFTSEALSDDSTEDI

SEQ ID NO: 3067538 - protein, 7 aa, Giardia lamblia
VEPTSIS

SEQ ID NO: 3067539 - protein, 6 aa, Giardia lamblia
VEQGPP

SEQ ID NO: 3067540 - protein, 23 aa, Giardia lamblia
VEQGSTEQRVSHDKKYARRGTYE

SEQ ID NO: 3067541 - protein, 6 aa, Giardia lamblia
VEQPSH

SEQ ID NO: 3067542 - protein, 5 aa, Giardia lamblia
VEQTK

SEQ ID NO: 3067543 - protein, 14 aa, Giardia lamblia
VERESLAAEKQRLE

SEQ ID NO: 3067544 - protein, 8 aa, Giardia lamblia
VERPTITQ

SEQ ID NO: 3067545 - protein, 4 aa, Giardia lamblia
VERR

SEQ ID NO: 3067546 - protein, 69 aa, Giardia lamblia
VESAKKQMRPLSTKNQRSSAKGNRKSKPQVVTKEKRTRGQPKVQKRNRPDSNHSTGNKYTDSSVANSEK

SEQ ID NO: 3067547 - protein, 11 aa, Giardia lamblia
VESDTSEEKLA

SEQ ID NO: 3067548 - protein, 8 aa, Giardia lamblia
VESEKNFP

SEQ ID NO: 3067549 - protein, 9 aa, Giardia lamblia
VESGGTAFT

SEQ ID NO: 3067550 - protein, 11 aa, Giardia lamblia
VESGTRLQGSF

SEQ ID NO: 3067551 - protein, 9 aa, Giardia lamblia
VESNSTKFN

SEQ ID NO: 3067552 - protein, 6 aa, Giardia lamblia
VESPAV

SEQ ID NO: 3067553 - protein, 11 aa, Giardia lamblia
VESPTIPLTEE

SEQ ID NO: 3067554 - protein, 6 aa, Giardia lamblia
VESQKS

SEQ ID NO: 3067555 - protein, 9 aa, Giardia lamblia
VESQSNSKL

SEQ ID NO: 3067556 - protein, 12 aa, Giardia lamblia
VESRPGQAFPTG

SEQ ID NO: 3067557 - protein, 4 aa, Giardia lamblia
VESS

SEQ ID NO: 3067558 - protein, 7 aa, Giardia lamblia
VESSKGY

SEQ ID NO: 3067559 - protein, 7 aa, Giardia lamblia
VESSRRS

SEQ ID NO: 3067560 - protein, 12 aa, Giardia lamblia
VESSSKRRGVRE

SEQ ID NO: 3067561 - protein, 13 aa, Giardia lamblia
VESTTDPSADSLQ

SEQ ID NO: 3067562 - protein, 4 aa, Giardia lamblia
VETL

SEQ ID NO: 3067563 - protein, 4 aa, Giardia lamblia
VETQ

SEQ ID NO: 3067564 - protein, 10 aa, Giardia lamblia
VETSAKTAIT

SEQ ID NO: 3067565 - protein, 12 aa, Giardia lamblia
VETTESPQNTQV

SEQ ID NO: 3067566 - protein, 11 aa, Giardia lamblia
VETVNEDTTYS

SEQ ID NO: 3067567 - protein, 5 aa, Giardia lamblia
VEVAP

SEQ ID NO: 3067568 - protein, 6 aa, Giardia lamblia
VEVPNG

SEQ ID NO: 3067569 - protein, 13 aa, Giardia lamblia
VEYTKSKLGKQTV

SEQ ID NO: 3067570 - protein, 10 aa, Giardia lamblia
VFSSAESSID

SEQ ID NO: 3067571 - protein, 7 aa, Giardia lamblia
VGAGKTT

SEQ ID NO: 3067572 - protein, 11 aa, Giardia lamblia
VGAQTSLSASQ

SEQ ID NO: 3067573 - protein, 10 aa, Giardia lamblia
VGATGSTPFS

SEQ ID NO: 3067574 - protein, 9 aa, Giardia lamblia
VGATTDNSS

SEQ ID NO: 3067575 - protein, 4 aa, Giardia lamblia
VGDD

SEQ ID NO: 3067576 - protein, 9 aa, Giardia lamblia
VGDTPPNVS

SEQ ID NO: 3067577 - protein, 5 aa, Giardia lamblia
VGEED

SEQ ID NO: 3067578 - protein, 5 aa, Giardia lamblia
VGEGK

SEQ ID NO: 3067579 - protein, 9 aa, Giardia lamblia
VGEGSTSSH

SEQ ID NO: 3067580 - protein, 7 aa, Giardia lamblia
VGESRSA

SEQ ID NO: 3067581 - protein, 9 aa, Giardia lamblia
VGGPPNSPS

SEQ ID NO: 3067582 - protein, 30 aa, Giardia lamblia
VGGSESDSEPEPNNITTSSLQSRPVTTTVA

SEQ ID NO: 3067583 - protein, 8 aa, Giardia lamblia
VGGSQRVS

SEQ ID NO: 3067584 - protein, 11 aa, Giardia lamblia
VGGSTNVTEDT

SEQ ID NO: 3067585 - protein, 5 aa, Giardia lamblia
VGGYA

SEQ ID NO: 3067586 - protein, 5 aa, Giardia lamblia
VGGYS

SEQ ID NO: 3067587 - protein, 5 aa, Giardia lamblia
VGKAI

SEQ ID NO: 3067588 - protein, 14 aa, Giardia lamblia
VGLSGGTSKSSFAP

SEQ ID NO: 3067589 - protein, 12 aa, Giardia lamblia
VGNPRKKSEPLQ

SEQ ID NO: 3067590 - protein, 12 aa, Giardia lamblia
VGNSEETLYQES

SEQ ID NO: 3067591 - protein, 21 aa, Giardia lamblia
VGNTGAYQMSQAKGDNSQSAP

SEQ ID NO: 3067592 - protein, 7 aa, Giardia lamblia
VGNTSAV

SEQ ID NO: 3067593 - protein, 4 aa, Giardia lamblia
VGNV

SEQ ID NO: 3067594 - protein, 10 aa, Giardia lamblia
VGPDDPDSLL

SEQ ID NO: 3067595 - protein, 11 aa, Giardia lamblia
VGPLEQSKTPL

SEQ ID NO: 3067596 - protein, 9 aa, Giardia lamblia
VGPQGGEIP

SEQ ID NO: 3067597 - protein, 5 aa, Giardia lamblia
VGQPL

SEQ ID NO: 3067598 - protein, 27 aa, Giardia lamblia
VGQPSKENCGPDLPRESTQKSQRSAVD

SEQ ID NO: 3067599 - protein, 7 aa, Giardia lamblia
VGRRGES

SEQ ID NO: 3067600 - protein, 9 aa, Giardia lamblia
VGRRYGPVG

SEQ ID NO: 3067601 - protein, 16 aa, Giardia lamblia
VGSADACEEPAPKQFR

SEQ ID NO: 3067602 - protein, 8 aa, Giardia lamblia
VGSDHYSQ

SEQ ID NO: 3067603 - protein, 9 aa, Giardia lamblia
VGSEEGKCT

SEQ ID NO: 3067604 - protein, 8 aa, Giardia lamblia
VGSEPTQQ

SEQ ID NO: 3067605 - protein, 7 aa, Giardia lamblia
VGSGEQI

SEQ ID NO: 3067606 - protein, 6 aa, Giardia lamblia
VGSGKS

SEQ ID NO: 3067607 - protein, 4 aa, Giardia lamblia
VGSI

SEQ ID NO: 3067608 - protein, 8 aa, Giardia lamblia
VGSNPSRA

SEQ ID NO: 3067609 - protein, 6 aa, Giardia lamblia
VGSPDS

SEQ ID NO: 3067610 - protein, 6 aa, Giardia lamblia
VGSPRT

SEQ ID NO: 3067611 - protein, 7 aa, Giardia lamblia
VGSQSLS

SEQ ID NO: 3067612 - protein, 6 aa, Giardia lamblia
VGSTGC

SEQ ID NO: 3067613 - protein, 5 aa, Giardia lamblia
VGSTK

SEQ ID NO: 3067614 - protein, 4 aa, Giardia lamblia
VGSV

SEQ ID NO: 3067615 - protein, 4 aa, Giardia lamblia
VGTA

SEQ ID NO: 3067616 - protein, 10 aa, Giardia lamblia
VGTANTNTGL

SEQ ID NO: 3067617 - protein, 9 aa, Giardia lamblia
VGTAPNGPY

SEQ ID NO: 3067618 - protein, 10 aa, Giardia lamblia
VGTASDAKEL

SEQ ID NO: 3067619 - protein, 6 aa, Giardia lamblia
VGTATD

SEQ ID NO: 3067620 - protein, 7 aa, Giardia lamblia
VGTDSEL

SEQ ID NO: 3067621 - protein, 9 aa, Giardia lamblia
VGTGDKAKD

SEQ ID NO: 3067622 - protein, 15 aa, Giardia lamblia
VGTGENKKTAPGSFK

SEQ ID NO: 3067623 - protein, 12 aa, Giardia lamblia
VGTGSRSLRNAG

SEQ ID NO: 3067624 - protein, 5 aa, Giardia lamblia
VGTLR

SEQ ID NO: 3067625 - protein, 11 aa, Giardia lamblia
VGTSETKKEAM

SEQ ID NO: 3067626 - protein, 23 aa, Giardia lamblia
VGTTTEMGDANKTGDALDAEDGI

SEQ ID NO: 3067627 - protein, 4 aa, Giardia lamblia
VHGG

SEQ ID NO: 3067628 - protein, 5 aa, Giardia lamblia
VHPDS

SEQ ID NO: 3067629 - protein, 10 aa, Giardia lamblia
VHPPTTEDGI

SEQ ID NO: 3067630 - protein, 11 aa, Giardia lamblia
VHRQPGAKEYP

SEQ ID NO: 3067631 - protein, 13 aa, Giardia lamblia
VHRRSPAESTLKG

SEQ ID NO: 3067632 - protein, 12 aa, Giardia lamblia
VHSEPSNQEEPH

SEQ ID NO: 3067633 - protein, 6 aa, Giardia lamblia
VHSPQQ

SEQ ID NO: 3067634 - protein, 30 aa, Giardia lamblia
VHSSESHSEPRSRSRSRLNKQQAQHPEDLA

SEQ ID NO: 3067635 - protein, 5 aa, Giardia lamblia
VHSSS

SEQ ID NO: 3067636 - protein, 12 aa, Giardia lamblia
VHSTEESNQEGY

SEQ ID NO: 3067637 - protein, 13 aa, Giardia lamblia
VHSTKSSKSCNST

SEQ ID NO: 3067638 - protein, 6 aa, Giardia lamblia
VHTASD

SEQ ID NO: 3067639 - protein, 11 aa, Giardia lamblia
VHTESNANAGD

SEQ ID NO: 3067640 - protein, 8 aa, Giardia lamblia
VHTPQSRK

SEQ ID NO: 3067641 - protein, 5 aa, Giardia lamblia
VHTRT

SEQ ID NO: 3067642 - protein, 13 aa, Giardia lamblia
VIDTSKKSHRLPA

SEQ ID NO: 3067643 - protein, 8 aa, Giardia lamblia
VIGDPAPV

SEQ ID NO: 3067644 - protein, 10 aa, Giardia lamblia
VIKNKPTHSL

SEQ ID NO: 3067645 - protein, 9 aa, Giardia lamblia
VINSSSPAI

SEQ ID NO: 3067646 - protein, 16 aa, Giardia lamblia
VISGGGDKAKTLRGGR

SEQ ID NO: 3067647 - protein, 30 aa, Giardia lamblia
VKADLKPEPELEQKQESDNKAKTSSEGNIL

SEQ ID NO: 3067648 - protein, 4 aa, Giardia lamblia
VKAP

SEQ ID NO: 3067649 - protein, 10 aa, Giardia lamblia
VKATTAARTR

SEQ ID NO: 3067650 - protein, 24 aa, Giardia lamblia
VKDDNRSRLAARSGSSPSETTEGY

SEQ ID NO: 3067651 - protein, 11 aa, Giardia lamblia
VKDNPDKCSSI

SEQ ID NO: 3067652 - protein, 6 aa, Giardia lamblia
VKESND

SEQ ID NO: 3067653 - protein, 8 aa, Giardia lamblia
VKGDDNRY

SEQ ID NO: 3067654 - protein, 7 aa, Giardia lamblia
VKGDNPS

SEQ ID NO: 3067655 - protein, 4 aa, Giardia lamblia
VKGF

SEQ ID NO: 3067656 - protein, 4 aa, Giardia lamblia
VKGS

SEQ ID NO: 3067657 - protein, 4 aa, Giardia lamblia
VKKP

SEQ ID NO: 3067658 - protein, 8 aa, Giardia lamblia
VKKYKTAY

SEQ ID NO: 3067659 - protein, 8 aa, Giardia lamblia
VKNNSGID

SEQ ID NO: 3067660 - protein, 10 aa, Giardia lamblia
VKNPNKVTRK

SEQ ID NO: 3067661 - protein, 23 aa, Giardia lamblia
VKNTREDKLEGQLNSTSEPQLDS

SEQ ID NO: 3067662 - protein, 6 aa, Giardia lamblia
VKPEED

SEQ ID NO: 3067663 - protein, 10 aa, Giardia lamblia
VKPNKKMEEA

SEQ ID NO: 3067664 - protein, 15 aa, Giardia lamblia
VKPTKGPYQKRSAQK

SEQ ID NO: 3067665 - protein, 11 aa, Giardia lamblia
VKQKSSGTTNL

SEQ ID NO: 3067666 - protein, 7 aa, Giardia lamblia
VKQRTDD

SEQ ID NO: 3067667 - protein, 12 aa, Giardia lamblia
VKRDAPVTAYAP

SEQ ID NO: 3067668 - protein, 22 aa, Giardia lamblia
VKREEELGVQGSAPKDPADGEI

SEQ ID NO: 3067669 - protein, 8 aa, Giardia lamblia
VKRRDRWG

SEQ ID NO: 3067670 - protein, 4 aa, Giardia lamblia
VKRS

SEQ ID NO: 3067671 - protein, 33 aa, Giardia lamblia
VKSRTKKQKRETAQNRSGSEKLHANPEDAPRRV

SEQ ID NO: 3067672 - protein, 9 aa, Giardia lamblia
VKSSAATRA

SEQ ID NO: 3067673 - protein, 17 aa, Giardia lamblia
VKSTGYTKSPTQGVTPP

SEQ ID NO: 3067674 - protein, 13 aa, Giardia lamblia
VKTEPQQSVEQGS

SEQ ID NO: 3067675 - protein, 8 aa, Giardia lamblia
VKTGKESV

SEQ ID NO: 3067676 - protein, 6 aa, Giardia lamblia
VKTKTT

SEQ ID NO: 3067677 - protein, 6 aa, Giardia lamblia
VKTREP

SEQ ID NO: 3067678 - protein, 9 aa, Giardia lamblia
VKTRGVGST

SEQ ID NO: 3067679 - protein, 16 aa, Giardia lamblia
VKVSAGSAKVKKEQSD

SEQ ID NO: 3067680 - protein, 7 aa, Giardia lamblia
VLNNKEE

SEQ ID NO: 3067681 - protein, 11 aa, Giardia lamblia
VLPPNDDEGIQ

SEQ ID NO: 3067682 - protein, 10 aa, Giardia lamblia
VLPTDGSPNL

SEQ ID NO: 3067683 - protein, 5 aa, Giardia lamblia
VLSDT

SEQ ID NO: 3067684 - protein, 10 aa, Giardia lamblia
VLSTPEKTSR

SEQ ID NO: 3067685 - protein, 13 aa, Giardia lamblia
VLTEEDNPGCSPQ

SEQ ID NO: 3067686 - protein, 11 aa, Giardia lamblia
VMTSNSPLGLR

SEQ ID NO: 3067687 - protein, 7 aa, Giardia lamblia
VNAAGKT

SEQ ID NO: 3067688 - protein, 7 aa, Giardia lamblia
VNAPDSA

SEQ ID NO: 3067689 - protein, 9 aa, Giardia lamblia
VNAPKGLTG

SEQ ID NO: 3067690 - protein, 6 aa, Giardia lamblia
VNATRT

SEQ ID NO: 3067691 - protein, 9 aa, Giardia lamblia
VNDKTRKAY

SEQ ID NO: 3067692 - protein, 4 aa, Giardia lamblia
VNDS

SEQ ID NO: 3067693 - protein, 5 aa, Giardia lamblia
VNEET

SEQ ID NO: 3067694 - protein, 6 aa, Giardia lamblia
VNEGAY

SEQ ID NO: 3067695 - protein, 5 aa, Giardia lamblia
VNENA

SEQ ID NO: 3067696 - protein, 6 aa, Giardia lamblia
VNGDQG

SEQ ID NO: 3067697 - protein, 10 aa, Giardia lamblia
VNGGSGTPNK

SEQ ID NO: 3067698 - protein, 4 aa, Giardia lamblia
VNGI

SEQ ID NO: 3067699 - protein, 8 aa, Giardia lamblia
VNGKTYAN

SEQ ID NO: 3067700 - protein, 8 aa, Giardia lamblia
VNGSSASL

SEQ ID NO: 3067701 - protein, 5 aa, Giardia lamblia
VNGYP

SEQ ID NO: 3067702 - protein, 8 aa, Giardia lamblia
VNKDNGRM

SEQ ID NO: 3067703 - protein, 10 aa, Giardia lamblia
VNKTSQFSGR

SEQ ID NO: 3067704 - protein, 4 aa, Giardia lamblia
VNLT

SEQ ID NO: 3067705 - protein, 7 aa, Giardia lamblia
VNNGNNS

SEQ ID NO: 3067706 - protein, 7 aa, Giardia lamblia
VNNNPET

SEQ ID NO: 3067707 - protein, 5 aa, Giardia lamblia
VNNSA

SEQ ID NO: 3067708 - protein, 4 aa, Giardia lamblia
VNPD

SEQ ID NO: 3067709 - protein, 9 aa, Giardia lamblia
VNPDLSSSR

SEQ ID NO: 3067710 - protein, 7 aa, Giardia lamblia
VNPMDNG

SEQ ID NO: 3067711 - protein, 9 aa, Giardia lamblia
VNPQDTDAD

SEQ ID NO: 3067712 - protein, 23 aa, Giardia lamblia
VNPSTKSPAACTGTNCDTCADDG

SEQ ID NO: 3067713 - protein, 14 aa, Giardia lamblia
VNPSTKSPAACTSA

SEQ ID NO: 3067714 - protein, 15 aa, Giardia lamblia
VNPTAEHNLDSSGTM

SEQ ID NO: 3067715 - protein, 10 aa, Giardia lamblia
VNQELTSGAD

SEQ ID NO: 3067716 - protein, 4 aa, Giardia lamblia
VNRE

SEQ ID NO: 3067717 - protein, 7 aa, Giardia lamblia
VNRQRSE

SEQ ID NO: 3067718 - protein, 7 aa, Giardia lamblia
VNSAKET

SEQ ID NO: 3067719 - protein, 8 aa, Giardia lamblia
VNSDSNAL

SEQ ID NO: 3067720 - protein, 6 aa, Giardia lamblia
VNSGHQ

SEQ ID NO: 3067721 - protein, 5 aa, Giardia lamblia
VNSNQ

SEQ ID NO: 3067722 - protein, 6 aa, Giardia lamblia
VNSTDR

SEQ ID NO: 3067723 - protein, 5 aa, Giardia lamblia
VNTSW

SEQ ID NO: 3067724 - protein, 36 aa, Giardia lamblia
VNVSSDEDGDIGATGAVSQAADAPASSGQKDRPRTT

SEQ ID NO: 3067725 - protein, 8 aa, Giardia lamblia
VNVSSRSL

SEQ ID NO: 3067726 - protein, 9 aa, Giardia lamblia
VPADDAGGN

SEQ ID NO: 3067727 - protein, 8 aa, Giardia lamblia
VPAGSNSE

SEQ ID NO: 3067728 - protein, 14 aa, Giardia lamblia
VPAPLGKESTSAAD

SEQ ID NO: 3067729 - protein, 5 aa, Giardia lamblia
VPARG

SEQ ID NO: 3067730 - protein, 6 aa, Giardia lamblia
VPCNGR

SEQ ID NO: 3067731 - protein, 5 aa, Giardia lamblia
VPDAP

SEQ ID NO: 3067732 - protein, 5 aa, Giardia lamblia
VPDDL

SEQ ID NO: 3067733 - protein, 6 aa, Giardia lamblia
VPDEER

SEQ ID NO: 3067734 - protein, 10 aa, Giardia lamblia
VPDGSQENVP

SEQ ID NO: 3067735 - protein, 5 aa, Giardia lamblia
VPDGY

SEQ ID NO: 3067736 - protein, 5 aa, Giardia lamblia
VPDRY

SEQ ID NO: 3067737 - protein, 11 aa, Giardia lamblia
VPDSLSSKVPG

SEQ ID NO: 3067738 - protein, 9 aa, Giardia lamblia
VPDSSNGYT

SEQ ID NO: 3067739 - protein, 6 aa, Giardia lamblia
VPDSST

SEQ ID NO: 3067740 - protein, 9 aa, Giardia lamblia
VPEASRPSI

SEQ ID NO: 3067741 - protein, 5 aa, Giardia lamblia
VPEEA

SEQ ID NO: 3067742 - protein, 4 aa, Giardia lamblia
VPEK

SEQ ID NO: 3067743 - protein, 15 aa, Giardia lamblia
VPEKSDKGGDKKQSL

SEQ ID NO: 3067744 - protein, 10 aa, Giardia lamblia
VPESDPDKKL

SEQ ID NO: 3067745 - protein, 5 aa, Giardia lamblia
VPEST

SEQ ID NO: 3067746 - protein, 7 aa, Giardia lamblia
VPESTDQ

SEQ ID NO: 3067747 - protein, 5 aa, Giardia lamblia
VPETG

SEQ ID NO: 3067748 - protein, 8 aa, Giardia lamblia
VPETTTGD

SEQ ID NO: 3067749 - protein, 6 aa, Giardia lamblia
VPGEVN

SEQ ID NO: 3067750 - protein, 26 aa, Giardia lamblia
VPGGGADVQPTAPPEVAPSEGGAVGS

SEQ ID NO: 3067751 - protein, 6 aa, Giardia lamblia
VPGNVS

SEQ ID NO: 3067752 - protein, 11 aa, Giardia lamblia
VPGTPHTDSGL

SEQ ID NO: 3067753 - protein, 24 aa, Giardia lamblia
VPHGTGAADENSYEANSHGYTHRS

SEQ ID NO: 3067754 - protein, 4 aa, Giardia lamblia
VPHT

SEQ ID NO: 3067755 - protein, 5 aa, Giardia lamblia
VPIKP

SEQ ID NO: 3067756 - protein, 5 aa, Giardia lamblia
VPITQ

SEQ ID NO: 3067757 - protein, 6 aa, Giardia lamblia
VPKPID

SEQ ID NO: 3067758 - protein, 7 aa, Giardia lamblia
VPKQRDA

SEQ ID NO: 3067759 - protein, 6 aa, Giardia lamblia
VPKQYH

SEQ ID NO: 3067760 - protein, 6 aa, Giardia lamblia
VPLPTG

SEQ ID NO: 3067761 - protein, 7 aa, Giardia lamblia
VPNAGNL

SEQ ID NO: 3067762 - protein, 31 aa, Giardia lamblia
VPNAGSANITPGATNRPSKYSPRGDGSFEGV

SEQ ID NO: 3067763 - protein, 15 aa, Giardia lamblia
VPNPTASAPVTNYNR

SEQ ID NO: 3067764 - protein, 9 aa, Giardia lamblia
VPNSEDRSC

SEQ ID NO: 3067765 - protein, 4 aa, Giardia lamblia
VPNT

SEQ ID NO: 3067766 - protein, 29 aa, Giardia lamblia
VPNTQSRSRTRKRALKSRTRDQQTTSQTI

SEQ ID NO: 3067767 - protein, 9 aa, Giardia lamblia
VPPAPAQPS

SEQ ID NO: 3067768 - protein, 24 aa, Giardia lamblia
VPPNSAQSIDSLSGSRFTATSHSH

SEQ ID NO: 3067769 - protein, 7 aa, Giardia lamblia
VPPNTAL

SEQ ID NO: 3067770 - protein, 12 aa, Giardia lamblia
VPPPPITDTADE

SEQ ID NO: 3067771 - protein, 12 aa, Giardia lamblia
VPPRGTSRRGSK

SEQ ID NO: 3067772 - protein, 4 aa, Giardia lamblia
VPPS

SEQ ID NO: 3067773 - protein, 5 aa, Giardia lamblia
VPPSH

SEQ ID NO: 3067774 - protein, 8 aa, Giardia lamblia
VPPTTVDE

SEQ ID NO: 3067775 - protein, 6 aa, Giardia lamblia
VPQGGN

SEQ ID NO: 3067776 - protein, 7 aa, Giardia lamblia
VPQSGYD

SEQ ID NO: 3067777 - protein, 11 aa, Giardia lamblia
VPQVPGPSTHS

SEQ ID NO: 3067778 - protein, 8 aa, Giardia lamblia
VPRSGTSD

SEQ ID NO: 3067779 - protein, 6 aa, Giardia lamblia
VPSEAA

SEQ ID NO: 3067780 - protein, 9 aa, Giardia lamblia
VPSERPTYR

SEQ ID NO: 3067781 - protein, 5 aa, Giardia lamblia
VPSHS

SEQ ID NO: 3067782 - protein, 4 aa, Giardia lamblia
VPSN

SEQ ID NO: 3067783 - protein, 13 aa, Giardia lamblia
VPSNATVATAEPV

SEQ ID NO: 3067784 - protein, 12 aa, Giardia lamblia
VPSNKSSASTTA

SEQ ID NO: 3067785 - protein, 7 aa, Giardia lamblia
VPSPAED

SEQ ID NO: 3067786 - protein, 4 aa, Giardia lamblia
VPSS

SEQ ID NO: 3067787 - protein, 20 aa, Giardia lamblia
VPSSGASAHTKKLEDQPLSI

SEQ ID NO: 3067788 - protein, 13 aa, Giardia lamblia
VPTDIAADSGASM

SEQ ID NO: 3067789 - protein, 5 aa, Giardia lamblia
VPTEG

SEQ ID NO: 3067790 - protein, 9 aa, Giardia lamblia
VPTGNTPPL

SEQ ID NO: 3067791 - protein, 6 aa, Giardia lamblia
VPTPYH

SEQ ID NO: 3067792 - protein, 4 aa, Giardia lamblia
VPTR

SEQ ID NO: 3067793 - protein, 12 aa, Giardia lamblia
VPTTTKPSCFNT

SEQ ID NO: 3067794 - protein, 8 aa, Giardia lamblia
VPVDVGNK

SEQ ID NO: 3067795 - protein, 6 aa, Giardia lamblia
VPVGSG

SEQ ID NO: 3067796 - protein, 23 aa, Giardia lamblia
VPVNGPKSKASSSATPTSAVSQG

SEQ ID NO: 3067797 - protein, 7 aa, Giardia lamblia
VPVSEAN

SEQ ID NO: 3067798 - protein, 4 aa, Giardia lamblia
VPYD

SEQ ID NO: 3067799 - protein, 10 aa, Giardia lamblia
VQAGDSDEFL

SEQ ID NO: 3067800 - protein, 9 aa, Giardia lamblia
VQAPNSPNG

SEQ ID NO: 3067801 - protein, 20 aa, Giardia lamblia
VQAQEEATRDRATTSEPIDK

SEQ ID NO: 3067802 - protein, 8 aa, Giardia lamblia
VQATNQTL

SEQ ID NO: 3067803 - protein, 18 aa, Giardia lamblia
VQDDQESKPVVHDGSATV

SEQ ID NO: 3067804 - protein, 12 aa, Giardia lamblia
VQDGQKQAAGHV

SEQ ID NO: 3067805 - protein, 6 aa, Giardia lamblia
VQDNTD

SEQ ID NO: 3067806 - protein, 7 aa, Giardia lamblia
VQDRNGY

SEQ ID NO: 3067807 - protein, 11 aa, Giardia lamblia
VQEASAGTAAT

SEQ ID NO: 3067808 - protein, 9 aa, Giardia lamblia
VQEDRPGPF

SEQ ID NO: 3067809 - protein, 4 aa, Giardia lamblia
VQEG

SEQ ID NO: 3067810 - protein, 6 aa, Giardia lamblia
VQEKRK

SEQ ID NO: 3067811 - protein, 5 aa, Giardia lamblia
VQENG

SEQ ID NO: 3067812 - protein, 7 aa, Giardia lamblia
VQEPPDH

SEQ ID NO: 3067813 - protein, 10 aa, Giardia lamblia
VQEPSNITAD

SEQ ID NO: 3067814 - protein, 12 aa, Giardia lamblia
VQESPSRDADAN

SEQ ID NO: 3067815 - protein, 14 aa, Giardia lamblia
VQGAGTEPKDGSNA

SEQ ID NO: 3067816 - protein, 8 aa, Giardia lamblia
VQGGTQPN

SEQ ID NO: 3067817 - protein, 9 aa, Giardia lamblia
VQNKPNSEV

SEQ ID NO: 3067818 - protein, 4 aa, Giardia lamblia
VQPL

SEQ ID NO: 3067819 - protein, 5 aa, Giardia lamblia
VQPSK

SEQ ID NO: 3067820 - protein, 13 aa, Giardia lamblia
VQQEAQAKKTPFI

SEQ ID NO: 3067821 - protein, 5 aa, Giardia lamblia
VQQSM

SEQ ID NO: 3067822 - protein, 16 aa, Giardia lamblia
VQQSTTAAGCTCGVAP

SEQ ID NO: 3067823 - protein, 17 aa, Giardia lamblia
VQRPVTKEQDPRGDRGE

SEQ ID NO: 3067824 - protein, 7 aa, Giardia lamblia
VQSADGA

SEQ ID NO: 3067825 - protein, 15 aa, Giardia lamblia
VQSAGNTTAKSPSRI

SEQ ID NO: 3067826 - protein, 11 aa, Giardia lamblia
VQSDASTVGSE

SEQ ID NO: 3067827 - protein, 10 aa, Giardia lamblia
VQSEPAANEE

SEQ ID NO: 3067828 - protein, 5 aa, Giardia lamblia
VQSNT

SEQ ID NO: 3067829 - protein, 6 aa, Giardia lamblia
VQSPVR

SEQ ID NO: 3067830 - protein, 5 aa, Giardia lamblia
VQSQE

SEQ ID NO: 3067831 - protein, 23 aa, Giardia lamblia
VQSREAAMNSGAIQDEPLTAEQR

SEQ ID NO: 3067832 - protein, 8 aa, Giardia lamblia
VQSSSDTT

SEQ ID NO: 3067833 - protein, 4 aa, Giardia lamblia
VQTK

SEQ ID NO: 3067834 - protein, 13 aa, Giardia lamblia
VQTPADSVRDQAP

SEQ ID NO: 3067835 - protein, 11 aa, Giardia lamblia
VQTTRSPLRSP

SEQ ID NO: 3067836 - protein, 9 aa, Giardia lamblia
VQTTRSQQD

SEQ ID NO: 3067837 - protein, 12 aa, Giardia lamblia
VRDGKLPQDEAS

SEQ ID NO: 3067838 - protein, 6 aa, Giardia lamblia
VRDNPR

SEQ ID NO: 3067839 - protein, 12 aa, Giardia lamblia
VREEDSKNFLST

SEQ ID NO: 3067840 - protein, 5 aa, Giardia lamblia
VRHTN

SEQ ID NO: 3067841 - protein, 27 aa, Giardia lamblia
VRIPKDGQRGSMAPTSTKSKPKQPKDC

SEQ ID NO: 3067842 - protein, 4 aa, Giardia lamblia
VRKP

SEQ ID NO: 3067843 - protein, 4 aa, Giardia lamblia
VRPE

SEQ ID NO: 3067844 - protein, 4 aa, Giardia lamblia
VRPK

SEQ ID NO: 3067845 - protein, 19 aa, Giardia lamblia
VRPPTTMPAAPGAIPPPVA

SEQ ID NO: 3067846 - protein, 26 aa, Giardia lamblia
VRPSRNDIPGEPPSSLTTQEGRSTYG

SEQ ID NO: 3067847 - protein, 10 aa, Giardia lamblia
VRPTHSSASR

SEQ ID NO: 3067848 - protein, 8 aa, Giardia lamblia
VRQDKNTT

SEQ ID NO: 3067849 - protein, 4 aa, Giardia lamblia
VRQP

SEQ ID NO: 3067850 - protein, 5 aa, Giardia lamblia
VRREG

SEQ ID NO: 3067851 - protein, 9 aa, Giardia lamblia
VRRSSTMTE

SEQ ID NO: 3067852 - protein, 6 aa, Giardia lamblia
VRRTGK

SEQ ID NO: 3067853 - protein, 14 aa, Giardia lamblia
VRSDPAASSLAKKS

SEQ ID NO: 3067854 - protein, 7 aa, Giardia lamblia
VRSGAGV

SEQ ID NO: 3067855 - protein, 16 aa, Giardia lamblia
VRSKAGGETSRKKGKI

SEQ ID NO: 3067856 - protein, 13 aa, Giardia lamblia
VRSPDSKSAPQNY

SEQ ID NO: 3067857 - protein, 6 aa, Giardia lamblia
VRSPSQ

SEQ ID NO: 3067858 - protein, 11 aa, Giardia lamblia
VRSQTKSISKE

SEQ ID NO: 3067859 - protein, 25 aa, Giardia lamblia
VRSSQPSEKPKSNTLATSPSRDTSH

SEQ ID NO: 3067860 - protein, 6 aa, Giardia lamblia
VRSTET

SEQ ID NO: 3067861 - protein, 7 aa, Giardia lamblia
VRSTGEA

SEQ ID NO: 3067862 - protein, 8 aa, Giardia lamblia
VRSTRGSG

SEQ ID NO: 3067863 - protein, 7 aa, Giardia lamblia
VRSTSYG

SEQ ID NO: 3067864 - protein, 7 aa, Giardia lamblia
VRTGQAE

SEQ ID NO: 3067865 - protein, 11 aa, Giardia lamblia
VRTGTFNSKQY

SEQ ID NO: 3067866 - protein, 13 aa, Giardia lamblia
VRTRSRAQSITGS

SEQ ID NO: 3067867 - protein, 19 aa, Giardia lamblia
VRTSENRNQIRQAQEARAA

SEQ ID NO: 3067868 - protein, 4 aa, Giardia lamblia
VRTT

SEQ ID NO: 3067869 - protein, 11 aa, Giardia lamblia
VRYESTGTLGT

SEQ ID NO: 3067870 - protein, 8 aa, Giardia lamblia
VSADGETA

SEQ ID NO: 3067871 - protein, 10 aa, Giardia lamblia
VSADGTGCET

SEQ ID NO: 3067872 - protein, 8 aa, Giardia lamblia
VSAEASKV

SEQ ID NO: 3067873 - protein, 13 aa, Giardia lamblia
VSANKGATIEERE

SEQ ID NO: 3067874 - protein, 4 aa, Giardia lamblia
VSAQ

SEQ ID NO: 3067875 - protein, 10 aa, Giardia lamblia
VSARKKSGCW

SEQ ID NO: 3067876 - protein, 7 aa, Giardia lamblia
VSASEKD

SEQ ID NO: 3067877 - protein, 13 aa, Giardia lamblia
VSATPPDKKITSV

SEQ ID NO: 3067878 - protein, 8 aa, Giardia lamblia
VSATQAAD

SEQ ID NO: 3067879 - protein, 6 aa, Giardia lamblia
VSCTTD

SEQ ID NO: 3067880 - protein, 7 aa, Giardia lamblia
VSDEDLP

SEQ ID NO: 3067881 - protein, 4 aa, Giardia lamblia
VSDG

SEQ ID NO: 3067882 - protein, 9 aa, Giardia lamblia
VSDRDPSYI

SEQ ID NO: 3067883 - protein, 6 aa, Giardia lamblia
VSDSDG

SEQ ID NO: 3067884 - protein, 4 aa, Giardia lamblia
VSEA

SEQ ID NO: 3067885 - protein, 15 aa, Giardia lamblia
VSECTNDNCPTTGSS

SEQ ID NO: 3067886 - protein, 7 aa, Giardia lamblia
VSEDTPK

SEQ ID NO: 3067887 - protein, 7 aa, Giardia lamblia
VSEEEDV

SEQ ID NO: 3067888 - protein, 15 aa, Giardia lamblia
VSEELTNNKIKSPTD

SEQ ID NO: 3067889 - protein, 9 aa, Giardia lamblia
VSEGSKEGA

SEQ ID NO: 3067890 - protein, 4 aa, Giardia lamblia
VSEI

SEQ ID NO: 3067891 - protein, 6 aa, Giardia lamblia
VSEIDD

SEQ ID NO: 3067892 - protein, 44 aa, Giardia lamblia
VSEKAAKRAMEKKNARAAKREKKADKEKRAGKAEAKKLLEPSGS

SEQ ID NO: 3067893 - protein, 10 aa, Giardia lamblia
VSEPSPSNAN

SEQ ID NO: 3067894 - protein, 7 aa, Giardia lamblia
VSEPSTY

SEQ ID NO: 3067895 - protein, 20 aa, Giardia lamblia
VSEQTDANLPHSRQHSKRLS

SEQ ID NO: 3067896 - protein, 15 aa, Giardia lamblia
VSGAPLGPGAVKRPE

SEQ ID NO: 3067897 - protein, 7 aa, Giardia lamblia
VSGAPRT

SEQ ID NO: 3067898 - protein, 6 aa, Giardia lamblia
VSGDDT

SEQ ID NO: 3067899 - protein, 11 aa, Giardia lamblia
VSGDGSNDAPA

SEQ ID NO: 3067900 - protein, 5 aa, Giardia lamblia
VSGDS

SEQ ID NO: 3067901 - protein, 4 aa, Giardia lamblia
VSGE

SEQ ID NO: 3067902 - protein, 12 aa, Giardia lamblia
VSGGEDPTNPNT

SEQ ID NO: 3067903 - protein, 10 aa, Giardia lamblia
VSGGSSRRSR

SEQ ID NO: 3067904 - protein, 7 aa, Giardia lamblia
VSGKGTV

SEQ ID NO: 3067905 - protein, 17 aa, Giardia lamblia
VSGLTDPPGDVNYNSAG

SEQ ID NO: 3067906 - protein, 6 aa, Giardia lamblia
VSGPMG

SEQ ID NO: 3067907 - protein, 16 aa, Giardia lamblia
VSGPQEGKGKNKSTLM

SEQ ID NO: 3067908 - protein, 5 aa, Giardia lamblia
VSGPT

SEQ ID NO: 3067909 - protein, 106 aa, Giardia lamblia
VSGQANSRTPRKGPASNSIKSKRNTQVSDDSADEYSGEYSYTDYTYSDGEEETSYSTTDNVGSSQRSDQRTTGKRRIANAKERSSRSGRLSTRSEDQGSENRTEGY

SEQ ID NO: 3067910 - protein, 7 aa, Giardia lamblia
VSGRRDI

SEQ ID NO: 3067911 - protein, 9 aa, Giardia lamblia
VSGSEGAVG

SEQ ID NO: 3067912 - protein, 10 aa, Giardia lamblia
VSGSGKYEQY

SEQ ID NO: 3067913 - protein, 14 aa, Giardia lamblia
VSGSQEGVDHDAST

SEQ ID NO: 3067914 - protein, 9 aa, Giardia lamblia
VSGSTGTYN

SEQ ID NO: 3067915 - protein, 13 aa, Giardia lamblia
VSGTAGTKGSYSG

SEQ ID NO: 3067916 - protein, 5 aa, Giardia lamblia
VSGTK

SEQ ID NO: 3067917 - protein, 7 aa, Giardia lamblia
VSGVPSG

SEQ ID NO: 3067918 - protein, 7 aa, Giardia lamblia
VSGVTTP

SEQ ID NO: 3067919 - protein, 41 aa, Giardia lamblia
VSIPSGQNSRSSSKTRSASNKRSTSRSYSTRGRGASRRRNA

SEQ ID NO: 3067920 - protein, 10 aa, Giardia lamblia
VSKDKNGKTA

SEQ ID NO: 3067921 - protein, 15 aa, Giardia lamblia
VSKDPRSSSIPGAKS

SEQ ID NO: 3067922 - protein, 6 aa, Giardia lamblia
VSKHVS

SEQ ID NO: 3067923 - protein, 6 aa, Giardia lamblia
VSKPAS

SEQ ID NO: 3067924 - protein, 8 aa, Giardia lamblia
VSKRLSPD

SEQ ID NO: 3067925 - protein, 9 aa, Giardia lamblia
VSKRPKEKS

SEQ ID NO: 3067926 - protein, 6 aa, Giardia lamblia
VSLDPD

SEQ ID NO: 3067927 - protein, 7 aa, Giardia lamblia
VSLGRGS

SEQ ID NO: 3067928 - protein, 6 aa, Giardia lamblia
VSNERY

SEQ ID NO: 3067929 - protein, 20 aa, Giardia lamblia
VSNNNNNNKSQFSPRLNSTQ

SEQ ID NO: 3067930 - protein, 8 aa, Giardia lamblia
VSNPDQHS

SEQ ID NO: 3067931 - protein, 6 aa, Giardia lamblia
VSNQKS

SEQ ID NO: 3067932 - protein, 7 aa, Giardia lamblia
VSNQNAC

SEQ ID NO: 3067933 - protein, 8 aa, Giardia lamblia
VSNSGETD

SEQ ID NO: 3067934 - protein, 8 aa, Giardia lamblia
VSNTSNPI

SEQ ID NO: 3067935 - protein, 10 aa, Giardia lamblia
VSPANTQAST

SEQ ID NO: 3067936 - protein, 15 aa, Giardia lamblia
VSPAQRDPEESYSDT

SEQ ID NO: 3067937 - protein, 10 aa, Giardia lamblia
VSPASEPTKG

SEQ ID NO: 3067938 - protein, 15 aa, Giardia lamblia
VSPASESASKKKARA

SEQ ID NO: 3067939 - protein, 14 aa, Giardia lamblia
VSPATGLPKRKIGK

SEQ ID NO: 3067940 - protein, 7 aa, Giardia lamblia
VSPDTDV

SEQ ID NO: 3067941 - protein, 6 aa, Giardia lamblia
VSPHHR

SEQ ID NO: 3067942 - protein, 10 aa, Giardia lamblia
VSPLNPSTGL

SEQ ID NO: 3067943 - protein, 4 aa, Giardia lamblia
VSPN

SEQ ID NO: 3067944 - protein, 5 aa, Giardia lamblia
VSPPE

SEQ ID NO: 3067945 - protein, 24 aa, Giardia lamblia
VSPRSASHFSPRYASSRVTQPHAT

SEQ ID NO: 3067946 - protein, 5 aa, Giardia lamblia
VSPSA

SEQ ID NO: 3067947 - protein, 6 aa, Giardia lamblia
VSPSPI

SEQ ID NO: 3067948 - protein, 25 aa, Giardia lamblia
VSPSSDIDSKSDNTYGQNKDISPPN

SEQ ID NO: 3067949 - protein, 19 aa, Giardia lamblia
VSPTPVKELPSSANGTGGG

SEQ ID NO: 3067950 - protein, 7 aa, Giardia lamblia
VSPTSEE

SEQ ID NO: 3067951 - protein, 15 aa, Giardia lamblia
VSPTSSLKKPRSTKS

SEQ ID NO: 3067952 - protein, 11 aa, Giardia lamblia
VSQAERESTSF

SEQ ID NO: 3067953 - protein, 8 aa, Giardia lamblia
VSQASVQR

SEQ ID NO: 3067954 - protein, 10 aa, Giardia lamblia
VSQDNQDISD

SEQ ID NO: 3067955 - protein, 6 aa, Giardia lamblia
VSQGAL

SEQ ID NO: 3067956 - protein, 8 aa, Giardia lamblia
VSQNGGNV

SEQ ID NO: 3067957 - protein, 10 aa, Giardia lamblia
VSQPLKTNAS

SEQ ID NO: 3067958 - protein, 7 aa, Giardia lamblia
VSQSHDS

SEQ ID NO: 3067959 - protein, 13 aa, Giardia lamblia
VSQTRKAGSSSTT

SEQ ID NO: 3067960 - protein, 13 aa, Giardia lamblia
VSQTRKASSSSTT

SEQ ID NO: 3067961 - protein, 15 aa, Giardia lamblia
VSRAARDTVDDPSDL

SEQ ID NO: 3067962 - protein, 13 aa, Giardia lamblia
VSRATSKTASISY

SEQ ID NO: 3067963 - protein, 14 aa, Giardia lamblia
VSRPGSQAESQPSV

SEQ ID NO: 3067964 - protein, 14 aa, Giardia lamblia
VSRPQTNPSVEPPL

SEQ ID NO: 3067965 - protein, 9 aa, Giardia lamblia
VSRPTSSQI

SEQ ID NO: 3067966 - protein, 9 aa, Giardia lamblia
VSRSGSTSL

SEQ ID NO: 3067967 - protein, 10 aa, Giardia lamblia
VSRSNDHTLN

SEQ ID NO: 3067968 - protein, 10 aa, Giardia lamblia
VSRVDSGYTT

SEQ ID NO: 3067969 - protein, 6 aa, Giardia lamblia
VSSAQI

SEQ ID NO: 3067970 - protein, 8 aa, Giardia lamblia
VSSCKSNA

SEQ ID NO: 3067971 - protein, 7 aa, Giardia lamblia
VSSDEAQ

SEQ ID NO: 3067972 - protein, 5 aa, Giardia lamblia
VSSDN

SEQ ID NO: 3067973 - protein, 10 aa, Giardia lamblia
VSSDTSLSRS

SEQ ID NO: 3067974 - protein, 8 aa, Giardia lamblia
VSSEASGS

SEQ ID NO: 3067975 - protein, 7 aa, Giardia lamblia
VSSEGAL

SEQ ID NO: 3067976 - protein, 6 aa, Giardia lamblia
VSSEQD

SEQ ID NO: 3067977 - protein, 5 aa, Giardia lamblia
VSSNL

SEQ ID NO: 3067978 - protein, 5 aa, Giardia lamblia
VSSNN

SEQ ID NO: 3067979 - protein, 15 aa, Giardia lamblia
VSSRDSKVSTPNSRH

SEQ ID NO: 3067980 - protein, 11 aa, Giardia lamblia
VSSRNRQKRGV

SEQ ID NO: 3067981 - protein, 7 aa, Giardia lamblia
VSSRPAP

SEQ ID NO: 3067982 - protein, 7 aa, Giardia lamblia
VSSSEPL

SEQ ID NO: 3067983 - protein, 7 aa, Giardia lamblia
VSSSGSS

SEQ ID NO: 3067984 - protein, 9 aa, Giardia lamblia
VSSSSNCDI

SEQ ID NO: 3067985 - protein, 8 aa, Giardia lamblia
VSSSTMAD

SEQ ID NO: 3067986 - protein, 9 aa, Giardia lamblia
VSSSTSAET

SEQ ID NO: 3067987 - protein, 8 aa, Giardia lamblia
VSSTSQGS

SEQ ID NO: 3067988 - protein, 5 aa, Giardia lamblia
VSSTY

SEQ ID NO: 3067989 - protein, 5 aa, Giardia lamblia
VSSYS

SEQ ID NO: 3067990 - protein, 4 aa, Giardia lamblia
VSTE

SEQ ID NO: 3067991 - protein, 14 aa, Giardia lamblia
VSTEAKKASTSHAY

SEQ ID NO: 3067992 - protein, 5 aa, Giardia lamblia
VSTED

SEQ ID NO: 3067993 - protein, 10 aa, Giardia lamblia
VSTESEHEPL

SEQ ID NO: 3067994 - protein, 6 aa, Giardia lamblia
VSTETQ

SEQ ID NO: 3067995 - protein, 7 aa, Giardia lamblia
VSTGKTG

SEQ ID NO: 3067996 - protein, 9 aa, Giardia lamblia
VSTGQSTTQ

SEQ ID NO: 3067997 - protein, 8 aa, Giardia lamblia
VSTKPLTG

SEQ ID NO: 3067998 - protein, 8 aa, Giardia lamblia
VSTLASKG

SEQ ID NO: 3067999 - protein, 7 aa, Giardia lamblia
VSTLSGG

SEQ ID NO: 3068000 - protein, 11 aa, Giardia lamblia
VSTMPPNSNGT

SEQ ID NO: 3068001 - protein, 6 aa, Giardia lamblia
VSTNNS

SEQ ID NO: 3068002 - protein, 8 aa, Giardia lamblia
VSTSGQQI

SEQ ID NO: 3068003 - protein, 5 aa, Giardia lamblia
VSTSL

SEQ ID NO: 3068004 - protein, 5 aa, Giardia lamblia
VSTSR

SEQ ID NO: 3068005 - protein, 10 aa, Giardia lamblia
VSTSSTTSAT

SEQ ID NO: 3068006 - protein, 4 aa, Giardia lamblia
VSTT

SEQ ID NO: 3068007 - protein, 4 aa, Giardia lamblia
VSTY

SEQ ID NO: 3068008 - protein, 4 aa, Giardia lamblia
VSVE

SEQ ID NO: 3068009 - protein, 4 aa, Giardia lamblia
VSVP

SEQ ID NO: 3068010 - protein, 11 aa, Giardia lamblia
VTAEERSREAT

SEQ ID NO: 3068011 - protein, 12 aa, Giardia lamblia
VTAGATAALSNQ

SEQ ID NO: 3068012 - protein, 12 aa, Giardia lamblia
VTAKTDCGNTSS

SEQ ID NO: 3068013 - protein, 9 aa, Giardia lamblia
VTANNPRDM

SEQ ID NO: 3068014 - protein, 6 aa, Giardia lamblia
VTAPGL

SEQ ID NO: 3068015 - protein, 11 aa, Giardia lamblia
VTASEQTTQLS

SEQ ID NO: 3068016 - protein, 23 aa, Giardia lamblia
VTCSDKPESDDPAHTPNLNGAQA

SEQ ID NO: 3068017 - protein, 12 aa, Giardia lamblia
VTDASGTSSIPQ

SEQ ID NO: 3068018 - protein, 13 aa, Giardia lamblia
VTDDSMEDAERRM

SEQ ID NO: 3068019 - protein, 8 aa, Giardia lamblia
VTDKEADA

SEQ ID NO: 3068020 - protein, 13 aa, Giardia lamblia
VTDKEADAMRYID

SEQ ID NO: 3068021 - protein, 6 aa, Giardia lamblia
VTDKPS

SEQ ID NO: 3068022 - protein, 4 aa, Giardia lamblia
VTDN

SEQ ID NO: 3068023 - protein, 8 aa, Giardia lamblia
VTDSSAKP

SEQ ID NO: 3068024 - protein, 8 aa, Giardia lamblia
VTDSSDGY

SEQ ID NO: 3068025 - protein, 14 aa, Giardia lamblia
VTDTEKQKQSQCNR

SEQ ID NO: 3068026 - protein, 7 aa, Giardia lamblia
VTEAKDN

SEQ ID NO: 3068027 - protein, 10 aa, Giardia lamblia
VTEGSESIET

SEQ ID NO: 3068028 - protein, 4 aa, Giardia lamblia
VTEK

SEQ ID NO: 3068029 - protein, 5 aa, Giardia lamblia
VTENG

SEQ ID NO: 3068030 - protein, 10 aa, Giardia lamblia
VTESNSKATV

SEQ ID NO: 3068031 - protein, 6 aa, Giardia lamblia
VTGATE

SEQ ID NO: 3068032 - protein, 12 aa, Giardia lamblia
VTGATVGVGGAV

SEQ ID NO: 3068033 - protein, 14 aa, Giardia lamblia
VTGGPSGDSSNDSN

SEQ ID NO: 3068034 - protein, 12 aa, Giardia lamblia
VTGPKAEFPRQA

SEQ ID NO: 3068035 - protein, 8 aa, Giardia lamblia
VTGSAPPE

SEQ ID NO: 3068036 - protein, 5 aa, Giardia lamblia
VTGTI

SEQ ID NO: 3068037 - protein, 6 aa, Giardia lamblia
VTKDTV

SEQ ID NO: 3068038 - protein, 5 aa, Giardia lamblia
VTKPG

SEQ ID NO: 3068039 - protein, 10 aa, Giardia lamblia
VTLSGGQKAR

SEQ ID NO: 3068040 - protein, 6 aa, Giardia lamblia
VTNGNA

SEQ ID NO: 3068041 - protein, 20 aa, Giardia lamblia
VTNGSEETDPRTNTTEPELS

SEQ ID NO: 3068042 - protein, 4 aa, Giardia lamblia
VTNK

SEQ ID NO: 3068043 - protein, 10 aa, Giardia lamblia
VTNSDGVGNR

SEQ ID NO: 3068044 - protein, 16 aa, Giardia lamblia
VTNSRDYSMTNTDNFS

SEQ ID NO: 3068045 - protein, 5 aa, Giardia lamblia
VTNTS

SEQ ID NO: 3068046 - protein, 9 aa, Giardia lamblia
VTPAGDTAL

SEQ ID NO: 3068047 - protein, 10 aa, Giardia lamblia
VTPPEDQAAT

SEQ ID NO: 3068048 - protein, 10 aa, Giardia lamblia
VTPPGPPEGD

SEQ ID NO: 3068049 - protein, 6 aa, Giardia lamblia
VTPPGY

SEQ ID NO: 3068050 - protein, 9 aa, Giardia lamblia
VTPPQTQAF

SEQ ID NO: 3068051 - protein, 7 aa, Giardia lamblia
VTPQSIT

SEQ ID NO: 3068052 - protein, 6 aa, Giardia lamblia
VTPQTR

SEQ ID NO: 3068053 - protein, 7 aa, Giardia lamblia
VTPRKRR

SEQ ID NO: 3068054 - protein, 17 aa, Giardia lamblia
VTPTAQSCADSKSDPRT

SEQ ID NO: 3068055 - protein, 4 aa, Giardia lamblia
VTPV

SEQ ID NO: 3068056 - protein, 7 aa, Giardia lamblia
VTQEKSG

SEQ ID NO: 3068057 - protein, 6 aa, Giardia lamblia
VTQNSL

SEQ ID NO: 3068058 - protein, 28 aa, Giardia lamblia
VTQSTSHNASGSRKRTASARRRPAQSYD

SEQ ID NO: 3068059 - protein, 7 aa, Giardia lamblia
VTRPGME

SEQ ID NO: 3068060 - protein, 24 aa, Giardia lamblia
VTRSNPDISPLDETPETSSQPLQV

SEQ ID NO: 3068061 - protein, 10 aa, Giardia lamblia
VTRSQSEAHE

SEQ ID NO: 3068062 - protein, 11 aa, Giardia lamblia
VTRVTNPPISN

SEQ ID NO: 3068063 - protein, 5 aa, Giardia lamblia
VTSDL

SEQ ID NO: 3068064 - protein, 5 aa, Giardia lamblia
VTSDN

SEQ ID NO: 3068065 - protein, 4 aa, Giardia lamblia
VTSE

SEQ ID NO: 3068066 - protein, 6 aa, Giardia lamblia
VTSKTT

SEQ ID NO: 3068067 - protein, 7 aa, Giardia lamblia
VTSNGET

SEQ ID NO: 3068068 - protein, 5 aa, Giardia lamblia
VTSNP

SEQ ID NO: 3068069 - protein, 8 aa, Giardia lamblia
VTSPEPPV

SEQ ID NO: 3068070 - protein, 9 aa, Giardia lamblia
VTSPFSSGG

SEQ ID NO: 3068071 - protein, 62 aa, Giardia lamblia
VTSPGSSTPGHYPQNGSARSGGSTAGRPAGGSHPAGRSGGGRTRSSGGSGCNCGGAGGGGLA

SEQ ID NO: 3068072 - protein, 8 aa, Giardia lamblia
VTSPQKPD

SEQ ID NO: 3068073 - protein, 5 aa, Giardia lamblia
VTSPS

SEQ ID NO: 3068074 - protein, 8 aa, Giardia lamblia
VTSRSSQK

SEQ ID NO: 3068075 - protein, 10 aa, Giardia lamblia
VTSSLASASN

SEQ ID NO: 3068076 - protein, 6 aa, Giardia lamblia
VTSSNV

SEQ ID NO: 3068077 - protein, 6 aa, Giardia lamblia
VTSTAA

SEQ ID NO: 3068078 - protein, 9 aa, Giardia lamblia
VTSTSPDIN

SEQ ID NO: 3068079 - protein, 10 aa, Giardia lamblia
VTSTTSGSAF

SEQ ID NO: 3068080 - protein, 6 aa, Giardia lamblia
VTTKDD

SEQ ID NO: 3068081 - protein, 12 aa, Giardia lamblia
VTTKGAVSAGDS

SEQ ID NO: 3068082 - protein, 10 aa, Giardia lamblia
VTTQAAKDTL

SEQ ID NO: 3068083 - protein, 5 aa, Giardia lamblia
VTTRS

SEQ ID NO: 3068084 - protein, 11 aa, Giardia lamblia
VTTSVADTTAF

SEQ ID NO: 3068085 - protein, 12 aa, Giardia lamblia
VTTVTGKTTKRS

SEQ ID NO: 3068086 - protein, 5 aa, Giardia lamblia
VVPEG

SEQ ID NO: 3068087 - protein, 26 aa, Giardia lamblia
VVPSKSLAPDLGDAMNKSGTCSTSKA

SEQ ID NO: 3068088 - protein, 11 aa, Giardia lamblia
VVSESDDDAIA

SEQ ID NO: 3068089 - protein, 8 aa, Giardia lamblia
VYDENGNA

SEQ ID NO: 3068090 - protein, 4 aa, Giardia lamblia
VYEG

SEQ ID NO: 3068091 - protein, 8 aa, Giardia lamblia
VYKGKQPS

SEQ ID NO: 3068092 - protein, 34 aa, Giardia lamblia
VYQPGADKDLDRVETPKNADSEYCEAGQPSSTLA

SEQ ID NO: 3068093 - protein, 13 aa, Giardia lamblia
VYSDQNEAHGSSS

SEQ ID NO: 3068094 - protein, 16 aa, Giardia lamblia
VYSDTEPLKPNTPAPM

SEQ ID NO: 3068095 - protein, 4 aa, Giardia lamblia
VYSP

SEQ ID NO: 3068096 - protein, 11 aa, Giardia lamblia
VYSPTSPAGAT

SEQ ID NO: 3068097 - protein, 7 aa, Giardia lamblia
WAEEGRY

SEQ ID NO: 3068098 - protein, 5 aa, Giardia lamblia
WASEP

SEQ ID NO: 3068099 - protein, 6 aa, Giardia lamblia
WDLPAN

SEQ ID NO: 3068100 - protein, 4 aa, Giardia lamblia
WDRT

SEQ ID NO: 3068101 - protein, 24 aa, Giardia lamblia
WDTDNSQSDTSPAVREKTTPRTSD

SEQ ID NO: 3068102 - protein, 10 aa, Giardia lamblia
WDTEASDGCT

SEQ ID NO: 3068103 - protein, 27 aa, Giardia lamblia
WEAESTENSQGEGAESADLKEGNPDMS

SEQ ID NO: 3068104 - protein, 4 aa, Giardia lamblia
WGNS

SEQ ID NO: 3068105 - protein, 7 aa, Giardia lamblia
WGSSWGE

SEQ ID NO: 3068106 - protein, 5 aa, Giardia lamblia
WGTNT

SEQ ID NO: 3068107 - protein, 7 aa, Giardia lamblia
WKDEQTP

SEQ ID NO: 3068108 - protein, 7 aa, Giardia lamblia
WKDGEAG

SEQ ID NO: 3068109 - protein, 9 aa, Giardia lamblia
WKKENNDPI

SEQ ID NO: 3068110 - protein, 9 aa, Giardia lamblia
WNPTQDAQA

SEQ ID NO: 3068111 - protein, 10 aa, Giardia lamblia
WPEGSNPPAL

SEQ ID NO: 3068112 - protein, 9 aa, Giardia lamblia
WPEQQSEES

SEQ ID NO: 3068113 - protein, 8 aa, Giardia lamblia
WPERATPD

SEQ ID NO: 3068114 - protein, 11 aa, Giardia lamblia
WPGRTGSPLDT

SEQ ID NO: 3068115 - protein, 12 aa, Giardia lamblia
WPPSAGGDESCK

SEQ ID NO: 3068116 - protein, 8 aa, Giardia lamblia
WPRAADSA

SEQ ID NO: 3068117 - protein, 11 aa, Giardia lamblia
WPTKNGNECAC

SEQ ID NO: 3068118 - protein, 5 aa, Giardia lamblia
WPTQK

SEQ ID NO: 3068119 - protein, 10 aa, Giardia lamblia
WPTSGTSGET

SEQ ID NO: 3068120 - protein, 4 aa, Giardia lamblia
WPYT

SEQ ID NO: 3068121 - protein, 9 aa, Giardia lamblia
WQGSPAADV

SEQ ID NO: 3068122 - protein, 12 aa, Giardia lamblia
WSGSACDAAKPG

SEQ ID NO: 3068123 - protein, 11 aa, Giardia lamblia
WSGSKASKGMR

SEQ ID NO: 3068124 - protein, 6 aa, Giardia lamblia
WSNGPV

SEQ ID NO: 3068125 - protein, 17 aa, Giardia lamblia
WSPGDARLEDRYDPQEP

SEQ ID NO: 3068126 - protein, 5 aa, Giardia lamblia
WSRNP

SEQ ID NO: 3068127 - protein, 4 aa, Giardia lamblia
WSRS

SEQ ID NO: 3068128 - protein, 44 aa, Giardia lamblia
WSSQEQQDQTPTGKAKRKKGADMGTSKRISDLSEAGRQANDGST

SEQ ID NO: 3068129 - protein, 26 aa, Giardia lamblia
WSSSGVGRHKYDNELSEDEPGVSESS

SEQ ID NO: 3068130 - protein, 18 aa, Giardia lamblia
WSSTSNKAVYGSGTVPVK

SEQ ID NO: 3068131 - protein, 9 aa, Giardia lamblia
WSTSGEGYS

SEQ ID NO: 3068132 - protein, 4 aa, Giardia lamblia
WTGT

SEQ ID NO: 3068133 - protein, 27 aa, Giardia lamblia
WTGTPDSAPNTKDDAVSPVSGKQYSRA

SEQ ID NO: 3068134 - protein, 4 aa, Giardia lamblia
WTHT

SEQ ID NO: 3068135 - protein, 11 aa, Giardia lamblia
WTNKTNKYEGC

SEQ ID NO: 3068136 - protein, 10 aa, Giardia lamblia
WTNKTNKYTN

SEQ ID NO: 3068137 - protein, 11 aa, Giardia lamblia
WTPKARGGTCV

SEQ ID NO: 3068138 - protein, 10 aa, Giardia lamblia
WTPKARGRTC

SEQ ID NO: 3068139 - protein, 4 aa, Giardia lamblia
WTPQ

SEQ ID NO: 3068140 - protein, 5 aa, Giardia lamblia
WYTGE

SEQ ID NO: 3068141 - protein, 10 aa, Giardia lamblia
YAAGTDEPRC

SEQ ID NO: 3068142 - protein, 16 aa, Giardia lamblia
YAAKDSTGDEFDAEEN

SEQ ID NO: 3068143 - protein, 4 aa, Giardia lamblia
YADD

SEQ ID NO: 3068144 - protein, 15 aa, Giardia lamblia
YADDPSASTNDPTGN

SEQ ID NO: 3068145 - protein, 8 aa, Giardia lamblia
YADESAHR

SEQ ID NO: 3068146 - protein, 5 aa, Giardia lamblia
YAEPR

SEQ ID NO: 3068147 - protein, 13 aa, Giardia lamblia
YAGHGTHANHKHG

SEQ ID NO: 3068148 - protein, 14 aa, Giardia lamblia
YAKGSKTNSDPERA

SEQ ID NO: 3068149 - protein, 8 aa, Giardia lamblia
YAKHEPEL

SEQ ID NO: 3068150 - protein, 8 aa, Giardia lamblia
YAKTSTVS

SEQ ID NO: 3068151 - protein, 6 aa, Giardia lamblia
YAMPSS

SEQ ID NO: 3068152 - protein, 11 aa, Giardia lamblia
YANAAGPGDRF

SEQ ID NO: 3068153 - protein, 11 aa, Giardia lamblia
YANHDSSKSSI

SEQ ID NO: 3068154 - protein, 9 aa, Giardia lamblia
YANQQGLDT

SEQ ID NO: 3068155 - protein, 5 aa, Giardia lamblia
YAPEQ

SEQ ID NO: 3068156 - protein, 7 aa, Giardia lamblia
YAPNTSG

SEQ ID NO: 3068157 - protein, 7 aa, Giardia lamblia
YAPPRPK

SEQ ID NO: 3068158 - protein, 5 aa, Giardia lamblia
YAPQI

SEQ ID NO: 3068159 - protein, 5 aa, Giardia lamblia
YAPTP

SEQ ID NO: 3068160 - protein, 5 aa, Giardia lamblia
YAQSK

SEQ ID NO: 3068161 - protein, 10 aa, Giardia lamblia
YARQQEYGSL

SEQ ID NO: 3068162 - protein, 18 aa, Giardia lamblia
YASKSDKKGNSSDPQARF

SEQ ID NO: 3068163 - protein, 14 aa, Giardia lamblia
YASLSTDASPQPTA

SEQ ID NO: 3068164 - protein, 9 aa, Giardia lamblia
YASPATVSR

SEQ ID NO: 3068165 - protein, 19 aa, Giardia lamblia
YASPDISALSQSTSKPDVH

SEQ ID NO: 3068166 - protein, 5 aa, Giardia lamblia
YASSI

SEQ ID NO: 3068167 - protein, 21 aa, Giardia lamblia
YASTSDQGTTQTAEKLPAASR

SEQ ID NO: 3068168 - protein, 5 aa, Giardia lamblia
YASTT

SEQ ID NO: 3068169 - protein, 8 aa, Giardia lamblia
YASTTSKD

SEQ ID NO: 3068170 - protein, 27 aa, Giardia lamblia
YATAQPEGPQNRHQPSAPHTEATQITG

SEQ ID NO: 3068171 - protein, 23 aa, Giardia lamblia
YATEKDDRARGPCGGPGAGYIND

SEQ ID NO: 3068172 - protein, 6 aa, Giardia lamblia
YATPSG

SEQ ID NO: 3068173 - protein, 7 aa, Giardia lamblia
YATTGSY

SEQ ID NO: 3068174 - protein, 4 aa, Giardia lamblia
YATY

SEQ ID NO: 3068175 - protein, 6 aa, Giardia lamblia
YCKDEN

SEQ ID NO: 3068176 - protein, 6 aa, Giardia lamblia
YDDASD

SEQ ID NO: 3068177 - protein, 70 aa, Giardia lamblia
YDDDDSDSCWDDEAQKRGIELPKRDSKQRRANELEPPKADKPSDAYSSHGDSSFSDSSDLPRAPPATVPK

SEQ ID NO: 3068178 - protein, 18 aa, Giardia lamblia
YDDDVDDGAYDASPYDDY

SEQ ID NO: 3068179 - protein, 9 aa, Giardia lamblia
YDDGDASLF

SEQ ID NO: 3068180 - protein, 10 aa, Giardia lamblia
YDDRSRKETM

SEQ ID NO: 3068181 - protein, 12 aa, Giardia lamblia
YDDTEKLDADDS

SEQ ID NO: 3068182 - protein, 9 aa, Giardia lamblia
YDEESTASA

SEQ ID NO: 3068183 - protein, 6 aa, Giardia lamblia
YDEGAK

SEQ ID NO: 3068184 - protein, 4 aa, Giardia lamblia
YDEQ

SEQ ID NO: 3068185 - protein, 5 aa, Giardia lamblia
YDGEQ

SEQ ID NO: 3068186 - protein, 4 aa, Giardia lamblia
YDGK

SEQ ID NO: 3068187 - protein, 9 aa, Giardia lamblia
YDGPREKQS

SEQ ID NO: 3068188 - protein, 11 aa, Giardia lamblia
YDGQTSADDIS

SEQ ID NO: 3068189 - protein, 35 aa, Giardia lamblia
YDGYGAKKTEGGVEDSAKDGARGEPAPSNSNSVNV

SEQ ID NO: 3068190 - protein, 5 aa, Giardia lamblia
YDKDN

SEQ ID NO: 3068191 - protein, 6 aa, Giardia lamblia
YDKENH

SEQ ID NO: 3068192 - protein, 8 aa, Giardia lamblia
YDKGESVS

SEQ ID NO: 3068193 - protein, 9 aa, Giardia lamblia
YDNNDTEGQ

SEQ ID NO: 3068194 - protein, 12 aa, Giardia lamblia
YDNQPSKTNVRR

SEQ ID NO: 3068195 - protein, 5 aa, Giardia lamblia
YDPEG

SEQ ID NO: 3068196 - protein, 5 aa, Giardia lamblia
YDPEI

SEQ ID NO: 3068197 - protein, 9 aa, Giardia lamblia
YDPERASYH

SEQ ID NO: 3068198 - protein, 4 aa, Giardia lamblia
YDPR

SEQ ID NO: 3068199 - protein, 9 aa, Giardia lamblia
YDPRSKKKC

SEQ ID NO: 3068200 - protein, 6 aa, Giardia lamblia
YDPSDY

SEQ ID NO: 3068201 - protein, 11 aa, Giardia lamblia
YDRDDLDKQPF

SEQ ID NO: 3068202 - protein, 9 aa, Giardia lamblia
YDSNTNVGK

SEQ ID NO: 3068203 - protein, 9 aa, Giardia lamblia
YDSPQPESI

SEQ ID NO: 3068204 - protein, 8 aa, Giardia lamblia
YDSTVENT

SEQ ID NO: 3068205 - protein, 7 aa, Giardia lamblia
YDSTYTD

SEQ ID NO: 3068206 - protein, 5 aa, Giardia lamblia
YDTEQ

SEQ ID NO: 3068207 - protein, 4 aa, Giardia lamblia
YDTF

SEQ ID NO: 3068208 - protein, 11 aa, Giardia lamblia
YDTKGKGAKKT

SEQ ID NO: 3068209 - protein, 34 aa, Giardia lamblia
YDTSADHSTAQKQDKQHDSEQEDNQLTNVQAEAD

SEQ ID NO: 3068210 - protein, 7 aa, Giardia lamblia
YEAASGR

SEQ ID NO: 3068211 - protein, 20 aa, Giardia lamblia
YEADRGKKGFSEKRFVTFKD

SEQ ID NO: 3068212 - protein, 9 aa, Giardia lamblia
YEAGSQDNF

SEQ ID NO: 3068213 - protein, 6 aa, Giardia lamblia
YEAHGT

SEQ ID NO: 3068214 - protein, 12 aa, Giardia lamblia
YEEESSEKHTAV

SEQ ID NO: 3068215 - protein, 4 aa, Giardia lamblia
YEES

SEQ ID NO: 3068216 - protein, 11 aa, Giardia lamblia
YEETDELKKSH

SEQ ID NO: 3068217 - protein, 11 aa, Giardia lamblia
YEEVKEDSQLS

SEQ ID NO: 3068218 - protein, 8 aa, Giardia lamblia
YEGPPATD

SEQ ID NO: 3068219 - protein, 15 aa, Giardia lamblia
YEGPSDTVPTAESDF

SEQ ID NO: 3068220 - protein, 14 aa, Giardia lamblia
YEGRGGSAPGLVRP

SEQ ID NO: 3068221 - protein, 25 aa, Giardia lamblia
YEHDRNRVQEVTEPDTEEEETTHNI

SEQ ID NO: 3068222 - protein, 4 aa, Giardia lamblia
YEKA

SEQ ID NO: 3068223 - protein, 11 aa, Giardia lamblia
YEKGIKNKVGR

SEQ ID NO: 3068224 - protein, 17 aa, Giardia lamblia
YELSDKRNQDGNRDTCV

SEQ ID NO: 3068225 - protein, 9 aa, Giardia lamblia
YELSTNSQT

SEQ ID NO: 3068226 - protein, 17 aa, Giardia lamblia
YENDRQQSRRHSQKSVS

SEQ ID NO: 3068227 - protein, 9 aa, Giardia lamblia
YENGNEKDT

SEQ ID NO: 3068228 - protein, 40 aa, Giardia lamblia
YENPVSATASAEGSNASAAIGNATIEGGKACNTLSPDYSL

SEQ ID NO: 3068229 - protein, 4 aa, Giardia lamblia
YEPY

SEQ ID NO: 3068230 - protein, 11 aa, Giardia lamblia
YEQGSRTPDGL

SEQ ID NO: 3068231 - protein, 14 aa, Giardia lamblia
YEQRQSDRKTAHEA

SEQ ID NO: 3068232 - protein, 12 aa, Giardia lamblia
YERPGDDIRSKN

SEQ ID NO: 3068233 - protein, 9 aa, Giardia lamblia
YESDESASE

SEQ ID NO: 3068234 - protein, 12 aa, Giardia lamblia
YESENKNYPYNS

SEQ ID NO: 3068235 - protein, 19 aa, Giardia lamblia
YESGETAQHHERPDKTVQK

SEQ ID NO: 3068236 - protein, 11 aa, Giardia lamblia
YESGLQSAEGY

SEQ ID NO: 3068237 - protein, 5 aa, Giardia lamblia
YESKT

SEQ ID NO: 3068238 - protein, 10 aa, Giardia lamblia
YESSNDQVRG

SEQ ID NO: 3068239 - protein, 7 aa, Giardia lamblia
YETTTKE

SEQ ID NO: 3068240 - protein, 4 aa, Giardia lamblia
YFTG

SEQ ID NO: 3068241 - protein, 7 aa, Giardia lamblia
YGATTQN

SEQ ID NO: 3068242 - protein, 7 aa, Giardia lamblia
YGDAART

SEQ ID NO: 3068243 - protein, 9 aa, Giardia lamblia
YGDAPAVST

SEQ ID NO: 3068244 - protein, 4 aa, Giardia lamblia
YGDG

SEQ ID NO: 3068245 - protein, 4 aa, Giardia lamblia
YGDH

SEQ ID NO: 3068246 - protein, 9 aa, Giardia lamblia
YGDSAMSSE

SEQ ID NO: 3068247 - protein, 4 aa, Giardia lamblia
YGET

SEQ ID NO: 3068248 - protein, 9 aa, Giardia lamblia
YGETGKRMT

SEQ ID NO: 3068249 - protein, 7 aa, Giardia lamblia
YGEYPNC

SEQ ID NO: 3068250 - protein, 5 aa, Giardia lamblia
YGGKD

SEQ ID NO: 3068251 - protein, 28 aa, Giardia lamblia
YGGVPDHNNEYSTENARDLDSSTDDASD

SEQ ID NO: 3068252 - protein, 8 aa, Giardia lamblia
YGIESSPT

SEQ ID NO: 3068253 - protein, 7 aa, Giardia lamblia
YGKDEDD

SEQ ID NO: 3068254 - protein, 9 aa, Giardia lamblia
YGKEAEHLG

SEQ ID NO: 3068255 - protein, 6 aa, Giardia lamblia
YGKGEI

SEQ ID NO: 3068256 - protein, 9 aa, Giardia lamblia
YGKTIEQQQ

SEQ ID NO: 3068257 - protein, 15 aa, Giardia lamblia
YGLQTDKGKGYKKGH

SEQ ID NO: 3068258 - protein, 5 aa, Giardia lamblia
YGLTP

SEQ ID NO: 3068259 - protein, 19 aa, Giardia lamblia
YGNAGKRRNKDSYGQKEDD

SEQ ID NO: 3068260 - protein, 9 aa, Giardia lamblia
YGNKRACEY

SEQ ID NO: 3068261 - protein, 5 aa, Giardia lamblia
YGNQQ

SEQ ID NO: 3068262 - protein, 14 aa, Giardia lamblia
YGNVSEDEIHRLMK

SEQ ID NO: 3068263 - protein, 8 aa, Giardia lamblia
YGPARASQ

SEQ ID NO: 3068264 - protein, 6 aa, Giardia lamblia
YGPDPF

SEQ ID NO: 3068265 - protein, 14 aa, Giardia lamblia
YGPLSGSCTPCEST

SEQ ID NO: 3068266 - protein, 10 aa, Giardia lamblia
YGPLTDPEDI

SEQ ID NO: 3068267 - protein, 22 aa, Giardia lamblia
YGPNETGSCTPCPDGKGGPNCV

SEQ ID NO: 3068268 - protein, 6 aa, Giardia lamblia
YGPPPL

SEQ ID NO: 3068269 - protein, 29 aa, Giardia lamblia
YGPSRLGSSDLKQKTRRGQAGNGQIDQAY

SEQ ID NO: 3068270 - protein, 21 aa, Giardia lamblia
YGQASHNRAVAPGVKNRSSSN

SEQ ID NO: 3068271 - protein, 5 aa, Giardia lamblia
YGQGC

SEQ ID NO: 3068272 - protein, 11 aa, Giardia lamblia
YGQGCAGGTPF

SEQ ID NO: 3068273 - protein, 12 aa, Giardia lamblia
YGQPSETASGHD

SEQ ID NO: 3068274 - protein, 5 aa, Giardia lamblia
YGQTP

SEQ ID NO: 3068275 - protein, 4 aa, Giardia lamblia
YGSA

SEQ ID NO: 3068276 - protein, 10 aa, Giardia lamblia
YGSENRPNVS

SEQ ID NO: 3068277 - protein, 13 aa, Giardia lamblia
YGSESYGSVNPHE

SEQ ID NO: 3068278 - protein, 5 aa, Giardia lamblia
YGSIE

SEQ ID NO: 3068279 - protein, 14 aa, Giardia lamblia
YGSKHESETMSSAE

SEQ ID NO: 3068280 - protein, 14 aa, Giardia lamblia
YGSKSPRGSYEEGN

SEQ ID NO: 3068281 - protein, 10 aa, Giardia lamblia
YGSNQENYRQ

SEQ ID NO: 3068282 - protein, 8 aa, Giardia lamblia
YGSQTGYK

SEQ ID NO: 3068283 - protein, 5 aa, Giardia lamblia
YGSVY

SEQ ID NO: 3068284 - protein, 6 aa, Giardia lamblia
YGTTSS

SEQ ID NO: 3068285 - protein, 4 aa, Giardia lamblia
YGVP

SEQ ID NO: 3068286 - protein, 15 aa, Giardia lamblia
YGYKGGNSPDPLSTS

SEQ ID NO: 3068287 - protein, 4 aa, Giardia lamblia
YGYP

SEQ ID NO: 3068288 - protein, 8 aa, Giardia lamblia
YHDSNSIS

SEQ ID NO: 3068289 - protein, 9 aa, Giardia lamblia
YHGSGTLKT

SEQ ID NO: 3068290 - protein, 5 aa, Giardia lamblia
YHNPD

SEQ ID NO: 3068291 - protein, 6 aa, Giardia lamblia
YHPDDD

SEQ ID NO: 3068292 - protein, 14 aa, Giardia lamblia
YHTETDLKTNTPYA

SEQ ID NO: 3068293 - protein, 13 aa, Giardia lamblia
YIPESERSKEEHV

SEQ ID NO: 3068294 - protein, 9 aa, Giardia lamblia
YIPNSLPEN

SEQ ID NO: 3068295 - protein, 5 aa, Giardia lamblia
YISST

SEQ ID NO: 3068296 - protein, 10 aa, Giardia lamblia
YKATAKDGDL

SEQ ID NO: 3068297 - protein, 5 aa, Giardia lamblia
YKATE

SEQ ID NO: 3068298 - protein, 17 aa, Giardia lamblia
YKDKAQASKSTNEEVDP

SEQ ID NO: 3068299 - protein, 8 aa, Giardia lamblia
YKEHTNRR

SEQ ID NO: 3068300 - protein, 15 aa, Giardia lamblia
YKESTSPPSPSQSSQ

SEQ ID NO: 3068301 - protein, 4 aa, Giardia lamblia
YKET

SEQ ID NO: 3068302 - protein, 5 aa, Giardia lamblia
YKGDA

SEQ ID NO: 3068303 - protein, 14 aa, Giardia lamblia
YKGEYKEDKRCGSG

SEQ ID NO: 3068304 - protein, 8 aa, Giardia lamblia
YKIDRNNK

SEQ ID NO: 3068305 - protein, 8 aa, Giardia lamblia
YKKASSTC

SEQ ID NO: 3068306 - protein, 5 aa, Giardia lamblia
YKKKG

SEQ ID NO: 3068307 - protein, 13 aa, Giardia lamblia
YKKQEGYTQGAEQ

SEQ ID NO: 3068308 - protein, 5 aa, Giardia lamblia
YKLNQ

SEQ ID NO: 3068309 - protein, 17 aa, Giardia lamblia
YKLPTSVDGVENDGIAT

SEQ ID NO: 3068310 - protein, 4 aa, Giardia lamblia
YKNR

SEQ ID NO: 3068311 - protein, 28 aa, Giardia lamblia
YKNRSQQKDVGRTPGTAASVERDPHESV

SEQ ID NO: 3068312 - protein, 9 aa, Giardia lamblia
YKNSNQETI

SEQ ID NO: 3068313 - protein, 11 aa, Giardia lamblia
YKNTGKYTQGL

SEQ ID NO: 3068314 - protein, 8 aa, Giardia lamblia
YKPGDTLP

SEQ ID NO: 3068315 - protein, 6 aa, Giardia lamblia
YKPKNA

SEQ ID NO: 3068316 - protein, 7 aa, Giardia lamblia
YKPNDTR

SEQ ID NO: 3068317 - protein, 7 aa, Giardia lamblia
YKQERTS

SEQ ID NO: 3068318 - protein, 6 aa, Giardia lamblia
YKRDGS

SEQ ID NO: 3068319 - protein, 4 aa, Giardia lamblia
YKRE

SEQ ID NO: 3068320 - protein, 7 aa, Giardia lamblia
YKRHSDG

SEQ ID NO: 3068321 - protein, 15 aa, Giardia lamblia
YKRPSNTSAGTSALS

SEQ ID NO: 3068322 - protein, 4 aa, Giardia lamblia
YKSA

SEQ ID NO: 3068323 - protein, 4 aa, Giardia lamblia
YKSD

SEQ ID NO: 3068324 - protein, 7 aa, Giardia lamblia
YKSDEPG

SEQ ID NO: 3068325 - protein, 10 aa, Giardia lamblia
YKSDSSLTIS

SEQ ID NO: 3068326 - protein, 9 aa, Giardia lamblia
YKSESLNKY

SEQ ID NO: 3068327 - protein, 30 aa, Giardia lamblia
YKSNPTTASAKASLASADTALSKAKSFQTQ

SEQ ID NO: 3068328 - protein, 11 aa, Giardia lamblia
YKSTKDPDSSS

SEQ ID NO: 3068329 - protein, 6 aa, Giardia lamblia
YKTDHD

SEQ ID NO: 3068330 - protein, 8 aa, Giardia lamblia
YKTSERAG

SEQ ID NO: 3068331 - protein, 6 aa, Giardia lamblia
YKTSNP

SEQ ID NO: 3068332 - protein, 6 aa, Giardia lamblia
YKTTNE

SEQ ID NO: 3068333 - protein, 8 aa, Giardia lamblia
YKYGKGGS

SEQ ID NO: 3068334 - protein, 5 aa, Giardia lamblia
YLDGN

SEQ ID NO: 3068335 - protein, 15 aa, Giardia lamblia
YLERSDAEKELGAYQ

SEQ ID NO: 3068336 - protein, 12 aa, Giardia lamblia
YLGDANDWKRNA

SEQ ID NO: 3068337 - protein, 13 aa, Giardia lamblia
YLGTRTKRDSCGN

SEQ ID NO: 3068338 - protein, 6 aa, Giardia lamblia
YLKEPK

SEQ ID NO: 3068339 - protein, 8 aa, Giardia lamblia
YLPGGTSQ

SEQ ID NO: 3068340 - protein, 7 aa, Giardia lamblia
YLSESSD

SEQ ID NO: 3068341 - protein, 6 aa, Giardia lamblia
YLSSNR

SEQ ID NO: 3068342 - protein, 7 aa, Giardia lamblia
YLSTPKD

SEQ ID NO: 3068343 - protein, 9 aa, Giardia lamblia
YMTSSDSTA

SEQ ID NO: 3068344 - protein, 8 aa, Giardia lamblia
YNASTGAF

SEQ ID NO: 3068345 - protein, 4 aa, Giardia lamblia
YNDA

SEQ ID NO: 3068346 - protein, 29 aa, Giardia lamblia
YNDATGKPRCTNCGTNKTPRTTLDGTSTC

SEQ ID NO: 3068347 - protein, 16 aa, Giardia lamblia
YNETGPGGQPTNLSKT

SEQ ID NO: 3068348 - protein, 10 aa, Giardia lamblia
YNGSQGKGYE

SEQ ID NO: 3068349 - protein, 4 aa, Giardia lamblia
YNKD

SEQ ID NO: 3068350 - protein, 13 aa, Giardia lamblia
YNNQNTDRSKMEN

SEQ ID NO: 3068351 - protein, 5 aa, Giardia lamblia
YNNTE

SEQ ID NO: 3068352 - protein, 25 aa, Giardia lamblia
YNPDVPSCDESTSLFNSSGSECEDN

SEQ ID NO: 3068353 - protein, 8 aa, Giardia lamblia
YNPKGSAG

SEQ ID NO: 3068354 - protein, 9 aa, Giardia lamblia
YNPKTYPGN

SEQ ID NO: 3068355 - protein, 10 aa, Giardia lamblia
YNPPADKYNY

SEQ ID NO: 3068356 - protein, 6 aa, Giardia lamblia
YNQGDN

SEQ ID NO: 3068357 - protein, 6 aa, Giardia lamblia
YNRNGQ

SEQ ID NO: 3068358 - protein, 8 aa, Giardia lamblia
YNRSTNAI

SEQ ID NO: 3068359 - protein, 8 aa, Giardia lamblia
YNSCPSDA

SEQ ID NO: 3068360 - protein, 10 aa, Giardia lamblia
YNSGNGGTVT

SEQ ID NO: 3068361 - protein, 7 aa, Giardia lamblia
YNSPHRG

SEQ ID NO: 3068362 - protein, 6 aa, Giardia lamblia
YNSRGI

SEQ ID NO: 3068363 - protein, 7 aa, Giardia lamblia
YNSSTQQ

SEQ ID NO: 3068364 - protein, 7 aa, Giardia lamblia
YNSTPRS

SEQ ID NO: 3068365 - protein, 9 aa, Giardia lamblia
YNTAGSKQA

SEQ ID NO: 3068366 - protein, 9 aa, Giardia lamblia
YNTKTEPGS

SEQ ID NO: 3068367 - protein, 10 aa, Giardia lamblia
YNTTDPVGGT

SEQ ID NO: 3068368 - protein, 12 aa, Giardia lamblia
YNTTGAANYDES

SEQ ID NO: 3068369 - protein, 15 aa, Giardia lamblia
YNVPPKNCGDSYTID

SEQ ID NO: 3068370 - protein, 9 aa, Giardia lamblia
YNVSAKDTK

SEQ ID NO: 3068371 - protein, 7 aa, Giardia lamblia
YPAEPGV

SEQ ID NO: 3068372 - protein, 13 aa, Giardia lamblia
YPDCRSGSGHYVA

SEQ ID NO: 3068373 - protein, 9 aa, Giardia lamblia
YPDEDLDPT

SEQ ID NO: 3068374 - protein, 7 aa, Giardia lamblia
YPDEPPL

SEQ ID NO: 3068375 - protein, 5 aa, Giardia lamblia
YPEAL

SEQ ID NO: 3068376 - protein, 5 aa, Giardia lamblia
YPEDV

SEQ ID NO: 3068377 - protein, 13 aa, Giardia lamblia
YPEEEYLPKPISN

SEQ ID NO: 3068378 - protein, 4 aa, Giardia lamblia
YPEI

SEQ ID NO: 3068379 - protein, 7 aa, Giardia lamblia
YPENPAY

SEQ ID NO: 3068380 - protein, 4 aa, Giardia lamblia
YPGA

SEQ ID NO: 3068381 - protein, 23 aa, Giardia lamblia
YPGNPHLTPASSQSYNSRASRPE

SEQ ID NO: 3068382 - protein, 10 aa, Giardia lamblia
YPHDNTARHV

SEQ ID NO: 3068383 - protein, 5 aa, Giardia lamblia
YPKTD

SEQ ID NO: 3068384 - protein, 9 aa, Giardia lamblia
YPNANKRSS

SEQ ID NO: 3068385 - protein, 5 aa, Giardia lamblia
YPNSR

SEQ ID NO: 3068386 - protein, 5 aa, Giardia lamblia
YPPGA

SEQ ID NO: 3068387 - protein, 17 aa, Giardia lamblia
YPPSYYAGGKQTTKDAI

SEQ ID NO: 3068388 - protein, 6 aa, Giardia lamblia
YPQAPL

SEQ ID NO: 3068389 - protein, 5 aa, Giardia lamblia
YPQMV

SEQ ID NO: 3068390 - protein, 7 aa, Giardia lamblia
YPRDDPA

SEQ ID NO: 3068391 - protein, 5 aa, Giardia lamblia
YPRPL

SEQ ID NO: 3068392 - protein, 5 aa, Giardia lamblia
YPRSD

SEQ ID NO: 3068393 - protein, 4 aa, Giardia lamblia
YPRV

SEQ ID NO: 3068394 - protein, 8 aa, Giardia lamblia
YPSDEAHN

SEQ ID NO: 3068395 - protein, 6 aa, Giardia lamblia
YPSEAP

SEQ ID NO: 3068396 - protein, 6 aa, Giardia lamblia
YPSGNV

SEQ ID NO: 3068397 - protein, 5 aa, Giardia lamblia
YPSGS

SEQ ID NO: 3068398 - protein, 7 aa, Giardia lamblia
YPSHGQN

SEQ ID NO: 3068399 - protein, 7 aa, Giardia lamblia
YPSKSAL

SEQ ID NO: 3068400 - protein, 7 aa, Giardia lamblia
YPSNETL

SEQ ID NO: 3068401 - protein, 6 aa, Giardia lamblia
YPSPSW

SEQ ID NO: 3068402 - protein, 7 aa, Giardia lamblia
YPSQYEK

SEQ ID NO: 3068403 - protein, 9 aa, Giardia lamblia
YPSRASPQK

SEQ ID NO: 3068404 - protein, 22 aa, Giardia lamblia
YPSYQPSSPSAQDTVPGTGPLG

SEQ ID NO: 3068405 - protein, 5 aa, Giardia lamblia
YPTPA

SEQ ID NO: 3068406 - protein, 11 aa, Giardia lamblia
YPTQPRPNVTT

SEQ ID NO: 3068407 - protein, 15 aa, Giardia lamblia
YPVTTGSAKNSDGRF

SEQ ID NO: 3068408 - protein, 16 aa, Giardia lamblia
YPYAGTRVSDAKSPSM

SEQ ID NO: 3068409 - protein, 5 aa, Giardia lamblia
YPYTS

SEQ ID NO: 3068410 - protein, 12 aa, Giardia lamblia
YQADESDDIETR

SEQ ID NO: 3068411 - protein, 24 aa, Giardia lamblia
YQADPTPTSSQNDDTSPSQDSSYT

SEQ ID NO: 3068412 - protein, 11 aa, Giardia lamblia
YQASPDDNPYQ

SEQ ID NO: 3068413 - protein, 9 aa, Giardia lamblia
YQDPGADGV

SEQ ID NO: 3068414 - protein, 6 aa, Giardia lamblia
YQEPQA

SEQ ID NO: 3068415 - protein, 6 aa, Giardia lamblia
YQGLQG

SEQ ID NO: 3068416 - protein, 8 aa, Giardia lamblia
YQKSGALA

SEQ ID NO: 3068417 - protein, 7 aa, Giardia lamblia
YQPDPLT

SEQ ID NO: 3068418 - protein, 10 aa, Giardia lamblia
YQPSEEPGEL

SEQ ID NO: 3068419 - protein, 22 aa, Giardia lamblia
YQQPTLEDQRLPSTEQPSKASF

SEQ ID NO: 3068420 - protein, 7 aa, Giardia lamblia
YQRREDL

SEQ ID NO: 3068421 - protein, 9 aa, Giardia lamblia
YQSKTSSFE

SEQ ID NO: 3068422 - protein, 10 aa, Giardia lamblia
YQSNNYCQGG

SEQ ID NO: 3068423 - protein, 8 aa, Giardia lamblia
YQSNPTFK

SEQ ID NO: 3068424 - protein, 7 aa, Giardia lamblia
YQSPNQQ

SEQ ID NO: 3068425 - protein, 8 aa, Giardia lamblia
YQSQQDKT

SEQ ID NO: 3068426 - protein, 6 aa, Giardia lamblia
YQSTAY

SEQ ID NO: 3068427 - protein, 6 aa, Giardia lamblia
YQTNTT

SEQ ID NO: 3068428 - protein, 9 aa, Giardia lamblia
YQTQPTQSQ

SEQ ID NO: 3068429 - protein, 6 aa, Giardia lamblia
YQTSLG

SEQ ID NO: 3068430 - protein, 21 aa, Giardia lamblia
YQTSPQASLVGSGSGSSNPGY

SEQ ID NO: 3068431 - protein, 12 aa, Giardia lamblia
YQTSSRDSVEDV

SEQ ID NO: 3068432 - protein, 6 aa, Giardia lamblia
YQTVEN

SEQ ID NO: 3068433 - protein, 19 aa, Giardia lamblia
YRAAASNSLGSSNHEQHSN

SEQ ID NO: 3068434 - protein, 8 aa, Giardia lamblia
YRDELDNE

SEQ ID NO: 3068435 - protein, 6 aa, Giardia lamblia
YREHPK

SEQ ID NO: 3068436 - protein, 13 aa, Giardia lamblia
YRERQLSDPSETV

SEQ ID NO: 3068437 - protein, 5 aa, Giardia lamblia
YRERV

SEQ ID NO: 3068438 - protein, 4 aa, Giardia lamblia
YRGR

SEQ ID NO: 3068439 - protein, 4 aa, Giardia lamblia
YRHG

SEQ ID NO: 3068440 - protein, 8 aa, Giardia lamblia
YRKGEGGC

SEQ ID NO: 3068441 - protein, 6 aa, Giardia lamblia
YRKRPT

SEQ ID NO: 3068442 - protein, 9 aa, Giardia lamblia
YRNKTPQLH

SEQ ID NO: 3068443 - protein, 4 aa, Giardia lamblia
YRPA

SEQ ID NO: 3068444 - protein, 4 aa, Giardia lamblia
YRQP

SEQ ID NO: 3068445 - protein, 4 aa, Giardia lamblia
YRQR

SEQ ID NO: 3068446 - protein, 6 aa, Giardia lamblia
YRQREA

SEQ ID NO: 3068447 - protein, 6 aa, Giardia lamblia
YRQSGV

SEQ ID NO: 3068448 - protein, 12 aa, Giardia lamblia
YRRPGETTSAAA

SEQ ID NO: 3068449 - protein, 9 aa, Giardia lamblia
YRRTTPSKD

SEQ ID NO: 3068450 - protein, 7 aa, Giardia lamblia
YRSDPVY

SEQ ID NO: 3068451 - protein, 7 aa, Giardia lamblia
YRSGSTC

SEQ ID NO: 3068452 - protein, 15 aa, Giardia lamblia
YRSQADVSRDPDMSI

SEQ ID NO: 3068453 - protein, 8 aa, Giardia lamblia
YRSYDATT

SEQ ID NO: 3068454 - protein, 10 aa, Giardia lamblia
YRTDKKSGRC

SEQ ID NO: 3068455 - protein, 22 aa, Giardia lamblia
YRTRREERATEKAQALSAENHE

SEQ ID NO: 3068456 - protein, 7 aa, Giardia lamblia
YSAKDDE

SEQ ID NO: 3068457 - protein, 16 aa, Giardia lamblia
YSANSSGEDPEPANGL

SEQ ID NO: 3068458 - protein, 5 aa, Giardia lamblia
YSAPA

SEQ ID NO: 3068459 - protein, 23 aa, Giardia lamblia
YSAQRSTKDSTLHSDESSNYVDS

SEQ ID NO: 3068460 - protein, 13 aa, Giardia lamblia
YSARAGSGGPSEI

SEQ ID NO: 3068461 - protein, 12 aa, Giardia lamblia
YSASARNSNQEL

SEQ ID NO: 3068462 - protein, 9 aa, Giardia lamblia
YSASGKVTV

SEQ ID NO: 3068463 - protein, 6 aa, Giardia lamblia
YSDAED

SEQ ID NO: 3068464 - protein, 11 aa, Giardia lamblia
YSDDYASNTNT

SEQ ID NO: 3068465 - protein, 7 aa, Giardia lamblia
YSDEEHD

SEQ ID NO: 3068466 - protein, 10 aa, Giardia lamblia
YSDFPTADPK

SEQ ID NO: 3068467 - protein, 6 aa, Giardia lamblia
YSDGEL

SEQ ID NO: 3068468 - protein, 4 aa, Giardia lamblia
YSDN

SEQ ID NO: 3068469 - protein, 12 aa, Giardia lamblia
YSDQNKSFSSAS

SEQ ID NO: 3068470 - protein, 5 aa, Giardia lamblia
YSDSQ

SEQ ID NO: 3068471 - protein, 61 aa, Giardia lamblia
YSDSRSRTPAKATPSSANSASGPSTWSTGASEGTDDMSQTSSSEYKPDTPRRDREHRSRTA

SEQ ID NO: 3068472 - protein, 19 aa, Giardia lamblia
YSEDTSCLGTTSGGPGDSV

SEQ ID NO: 3068473 - protein, 9 aa, Giardia lamblia
YSGASGRVT

SEQ ID NO: 3068474 - protein, 10 aa, Giardia lamblia
YSGGNGTDRF

SEQ ID NO: 3068475 - protein, 15 aa, Giardia lamblia
YSGKQSLGIGDGAND

SEQ ID NO: 3068476 - protein, 8 aa, Giardia lamblia
YSGNTEGK

SEQ ID NO: 3068477 - protein, 8 aa, Giardia lamblia
YSGPDKGD

SEQ ID NO: 3068478 - protein, 11 aa, Giardia lamblia
YSGPETGCTTQ

SEQ ID NO: 3068479 - protein, 8 aa, Giardia lamblia
YSGQSQSL

SEQ ID NO: 3068480 - protein, 7 aa, Giardia lamblia
YSGSGLS

SEQ ID NO: 3068481 - protein, 4 aa, Giardia lamblia
YSHN

SEQ ID NO: 3068482 - protein, 8 aa, Giardia lamblia
YSHTRSAE

SEQ ID NO: 3068483 - protein, 8 aa, Giardia lamblia
YSKADGDF

SEQ ID NO: 3068484 - protein, 8 aa, Giardia lamblia
YSKAKSSS

SEQ ID NO: 3068485 - protein, 22 aa, Giardia lamblia
YSKDAHEDSCSPSRSPQRPAMS

SEQ ID NO: 3068486 - protein, 9 aa, Giardia lamblia
YSKNGVGNK

SEQ ID NO: 3068487 - protein, 11 aa, Giardia lamblia
YSKVDTETRAK

SEQ ID NO: 3068488 - protein, 12 aa, Giardia lamblia
YSLEEAEDGSVR

SEQ ID NO: 3068489 - protein, 14 aa, Giardia lamblia
YSNAESSLENSIEA

SEQ ID NO: 3068490 - protein, 4 aa, Giardia lamblia
YSNG

SEQ ID NO: 3068491 - protein, 9 aa, Giardia lamblia
YSNGDYYEG

SEQ ID NO: 3068492 - protein, 8 aa, Giardia lamblia
YSNIEPPK

SEQ ID NO: 3068493 - protein, 8 aa, Giardia lamblia
YSNQKTHT

SEQ ID NO: 3068494 - protein, 9 aa, Giardia lamblia
YSPESAPGN

SEQ ID NO: 3068495 - protein, 10 aa, Giardia lamblia
YSPETCTGSY

SEQ ID NO: 3068496 - protein, 9 aa, Giardia lamblia
YSPGTEPNR

SEQ ID NO: 3068497 - protein, 7 aa, Giardia lamblia
YSPMGSV

SEQ ID NO: 3068498 - protein, 22 aa, Giardia lamblia
YSPNETGSCTPCPDGKGGPNCV

SEQ ID NO: 3068499 - protein, 5 aa, Giardia lamblia
YSPPL

SEQ ID NO: 3068500 - protein, 4 aa, Giardia lamblia
YSPQ

SEQ ID NO: 3068501 - protein, 9 aa, Giardia lamblia
YSPSQSGGR

SEQ ID NO: 3068502 - protein, 6 aa, Giardia lamblia
YSPSSL

SEQ ID NO: 3068503 - protein, 8 aa, Giardia lamblia
YSPSTQTV

SEQ ID NO: 3068504 - protein, 14 aa, Giardia lamblia
YSQAARGETPQAMK

SEQ ID NO: 3068505 - protein, 11 aa, Giardia lamblia
YSQKKDSGELL

SEQ ID NO: 3068506 - protein, 5 aa, Giardia lamblia
YSQMP

SEQ ID NO: 3068507 - protein, 4 aa, Giardia lamblia
YSQP

SEQ ID NO: 3068508 - protein, 15 aa, Giardia lamblia
YSQQPEEKLQSSSHL

SEQ ID NO: 3068509 - protein, 6 aa, Giardia lamblia
YSQQTY

SEQ ID NO: 3068510 - protein, 5 aa, Giardia lamblia
YSQRS

SEQ ID NO: 3068511 - protein, 8 aa, Giardia lamblia
YSRGSDTG

SEQ ID NO: 3068512 - protein, 12 aa, Giardia lamblia
YSRKSNEVKIVF

SEQ ID NO: 3068513 - protein, 10 aa, Giardia lamblia
YSRNTNTRGY

SEQ ID NO: 3068514 - protein, 6 aa, Giardia lamblia
YSRSSS

SEQ ID NO: 3068515 - protein, 5 aa, Giardia lamblia
YSRTY

SEQ ID NO: 3068516 - protein, 12 aa, Giardia lamblia
YSSDGDSDDLAQ

SEQ ID NO: 3068517 - protein, 4 aa, Giardia lamblia
YSSE

SEQ ID NO: 3068518 - protein, 6 aa, Giardia lamblia
YSSEAD

SEQ ID NO: 3068519 - protein, 6 aa, Giardia lamblia
YSSEDM

SEQ ID NO: 3068520 - protein, 24 aa, Giardia lamblia
YSSESSAPVQNNTLEDGSGTDVQS

SEQ ID NO: 3068521 - protein, 5 aa, Giardia lamblia
YSSGR

SEQ ID NO: 3068522 - protein, 16 aa, Giardia lamblia
YSSGSKGSKSRGSRHQ

SEQ ID NO: 3068523 - protein, 8 aa, Giardia lamblia
YSSGTEDY

SEQ ID NO: 3068524 - protein, 11 aa, Giardia lamblia
YSSHTVKEESA

SEQ ID NO: 3068525 - protein, 9 aa, Giardia lamblia
YSSISGTDA

SEQ ID NO: 3068526 - protein, 7 aa, Giardia lamblia
YSSKGNP

SEQ ID NO: 3068527 - protein, 5 aa, Giardia lamblia
YSSNV

SEQ ID NO: 3068528 - protein, 4 aa, Giardia lamblia
YSSP

SEQ ID NO: 3068529 - protein, 11 aa, Giardia lamblia
YSSPEGDTGTA

SEQ ID NO: 3068530 - protein, 21 aa, Giardia lamblia
YSSPPPMGAQPPLKPVGSTAV

SEQ ID NO: 3068531 - protein, 10 aa, Giardia lamblia
YSSPSSSPLP

SEQ ID NO: 3068532 - protein, 9 aa, Giardia lamblia
YSSQNTNSM

SEQ ID NO: 3068533 - protein, 4 aa, Giardia lamblia
YSSS

SEQ ID NO: 3068534 - protein, 12 aa, Giardia lamblia
YSSSPPQSEEEL

SEQ ID NO: 3068535 - protein, 21 aa, Giardia lamblia
YSSSSVSSDTPQSNPPCNGKG

SEQ ID NO: 3068536 - protein, 5 aa, Giardia lamblia
YSSTA

SEQ ID NO: 3068537 - protein, 6 aa, Giardia lamblia
YSTAQV

SEQ ID NO: 3068538 - protein, 10 aa, Giardia lamblia
YSTEDPRFDP

SEQ ID NO: 3068539 - protein, 11 aa, Giardia lamblia
YSTNDQDLATM

SEQ ID NO: 3068540 - protein, 12 aa, Giardia lamblia
YSTNDTEYPYRG

SEQ ID NO: 3068541 - protein, 5 aa, Giardia lamblia
YSTPC

SEQ ID NO: 3068542 - protein, 5 aa, Giardia lamblia
YSTQL

SEQ ID NO: 3068543 - protein, 5 aa, Giardia lamblia
YSTSG

SEQ ID NO: 3068544 - protein, 14 aa, Giardia lamblia
YSTSPTPSSTFTPC

SEQ ID NO: 3068545 - protein, 4 aa, Giardia lamblia
YSTT

SEQ ID NO: 3068546 - protein, 11 aa, Giardia lamblia
YSTVSSAQGLD

SEQ ID NO: 3068547 - protein, 4 aa, Giardia lamblia
YSYK

SEQ ID NO: 3068548 - protein, 7 aa, Giardia lamblia
YTADSGM

SEQ ID NO: 3068549 - protein, 8 aa, Giardia lamblia
YTANTGAI

SEQ ID NO: 3068550 - protein, 7 aa, Giardia lamblia
YTAPSSA

SEQ ID NO: 3068551 - protein, 12 aa, Giardia lamblia
YTAQNDVRAGAT

SEQ ID NO: 3068552 - protein, 9 aa, Giardia lamblia
YTASTTGPF

SEQ ID NO: 3068553 - protein, 9 aa, Giardia lamblia
YTDPGYDNL

SEQ ID NO: 3068554 - protein, 10 aa, Giardia lamblia
YTDSSDEAPT

SEQ ID NO: 3068555 - protein, 4 aa, Giardia lamblia
YTEA

SEQ ID NO: 3068556 - protein, 7 aa, Giardia lamblia
YTENPEA

SEQ ID NO: 3068557 - protein, 5 aa, Giardia lamblia
YTGDN

SEQ ID NO: 3068558 - protein, 20 aa, Giardia lamblia
YTGEASTDIQKSDPEGLYNS

SEQ ID NO: 3068559 - protein, 11 aa, Giardia lamblia
YTGEQKPNALS

SEQ ID NO: 3068560 - protein, 7 aa, Giardia lamblia
YTGETYR

SEQ ID NO: 3068561 - protein, 5 aa, Giardia lamblia
YTGKE

SEQ ID NO: 3068562 - protein, 4 aa, Giardia lamblia
YTGP

SEQ ID NO: 3068563 - protein, 8 aa, Giardia lamblia
YTGPNPAN

SEQ ID NO: 3068564 - protein, 8 aa, Giardia lamblia
YTGYQDPS

SEQ ID NO: 3068565 - protein, 6 aa, Giardia lamblia
YTKGDT

SEQ ID NO: 3068566 - protein, 9 aa, Giardia lamblia
YTKNADSSR

SEQ ID NO: 3068567 - protein, 10 aa, Giardia lamblia
YTKQNNGIGP

SEQ ID NO: 3068568 - protein, 20 aa, Giardia lamblia
YTKSDPLENLGESKPNIRDR

SEQ ID NO: 3068569 - protein, 6 aa, Giardia lamblia
YTLDDR

SEQ ID NO: 3068570 - protein, 14 aa, Giardia lamblia
YTLDSSGQCTTSTC

SEQ ID NO: 3068571 - protein, 23 aa, Giardia lamblia
YTLSSGNTCEPNAPPANKTSGVA

SEQ ID NO: 3068572 - protein, 10 aa, Giardia lamblia
YTLSSPLPST

SEQ ID NO: 3068573 - protein, 11 aa, Giardia lamblia
YTNKGYSPESI

SEQ ID NO: 3068574 - protein, 6 aa, Giardia lamblia
YTPDGF

SEQ ID NO: 3068575 - protein, 6 aa, Giardia lamblia
YTPPAT

SEQ ID NO: 3068576 - protein, 30 aa, Giardia lamblia
YTPPNNAAPSPAANNASKQAGSSAEPSTQH

SEQ ID NO: 3068577 - protein, 5 aa, Giardia lamblia
YTPQE

SEQ ID NO: 3068578 - protein, 13 aa, Giardia lamblia
YTPSKDPDTTSVR

SEQ ID NO: 3068579 - protein, 4 aa, Giardia lamblia
YTQD

SEQ ID NO: 3068580 - protein, 4 aa, Giardia lamblia
YTQR

SEQ ID NO: 3068581 - protein, 9 aa, Giardia lamblia
YTQSKSVYN

SEQ ID NO: 3068582 - protein, 5 aa, Giardia lamblia
YTRAE

SEQ ID NO: 3068583 - protein, 8 aa, Giardia lamblia
YTRPPDTP

SEQ ID NO: 3068584 - protein, 5 aa, Giardia lamblia
YTRRG

SEQ ID NO: 3068585 - protein, 12 aa, Giardia lamblia
YTSAGSPVAPGD

SEQ ID NO: 3068586 - protein, 5 aa, Giardia lamblia
YTSDS

SEQ ID NO: 3068587 - protein, 5 aa, Giardia lamblia
YTSES

SEQ ID NO: 3068588 - protein, 14 aa, Giardia lamblia
YTSGKQGVTEASLS

SEQ ID NO: 3068589 - protein, 15 aa, Giardia lamblia
YTSGTPGPEIGDPVN

SEQ ID NO: 3068590 - protein, 4 aa, Giardia lamblia
YTSM

SEQ ID NO: 3068591 - protein, 6 aa, Giardia lamblia
YTSPAQ

SEQ ID NO: 3068592 - protein, 11 aa, Giardia lamblia
YTSPGCKVNTA

SEQ ID NO: 3068593 - protein, 7 aa, Giardia lamblia
YTSPNSD

SEQ ID NO: 3068594 - protein, 10 aa, Giardia lamblia
YTSPSSGGPL

SEQ ID NO: 3068595 - protein, 6 aa, Giardia lamblia
YTSSDS

SEQ ID NO: 3068596 - protein, 6 aa, Giardia lamblia
YTSSTS

SEQ ID NO: 3068597 - protein, 4 aa, Giardia lamblia
YTST

SEQ ID NO: 3068598 - protein, 8 aa, Giardia lamblia
YTTGGTRE

SEQ ID NO: 3068599 - protein, 7 aa, Giardia lamblia
YTTGSGN

SEQ ID NO: 3068600 - protein, 5 aa, Giardia lamblia
YTTLD

SEQ ID NO: 3068601 - protein, 8 aa, Giardia lamblia
YTTVTNNG

SEQ ID NO: 3068602 - protein, 18 aa, Giardia lamblia
YTYADQRQVDGAPQATSA

SEQ ID NO: 3068603 - protein, 6 aa, Giardia lamblia
YTYEDR

SEQ ID NO: 3068604 - protein, 6 aa, Giardia lamblia
YVGGED

SEQ ID NO: 3068605 - protein, 10 aa, Giardia lamblia
YVKGRSPHEC

SEQ ID NO: 3068606 - protein, 19 aa, Giardia lamblia
YVNGGTQTLTATGSFSTSA

SEQ ID NO: 3068607 - protein, 8 aa, Giardia lamblia
YVPAQSTT

SEQ ID NO: 3068608 - protein, 9 aa, Giardia lamblia
YVPTNPSDN

SEQ ID NO: 3068609 - protein, 7 aa, Giardia lamblia
YVSPGQT

SEQ ID NO: 3068610 - protein, 7 aa, Giardia lamblia
YVTSDSG

SEQ ID NO: 3068611 - protein, 12 aa, Giardia lamblia
YYAPPDRSSISD

SEQ ID NO: 3068612 - protein, 6 aa, Giardia lamblia
YYDEQR

SEQ ID NO: 3068613 - protein, 12 aa, Giardia lamblia
YYEPSGPGPVNP

SEQ ID NO: 3068614 - protein, 13 aa, Giardia lamblia
YYGDTNERKCKKC

SEQ ID NO: 3068615 - protein, 8 aa, Giardia lamblia
YYKAGSDV

SEQ ID NO: 3068616 - protein, 13 aa, Giardia lamblia
YYKENGDDTTDGL

SEQ ID NO: 3068617 - protein, 5 aa, Giardia lamblia
YYPSG

SEQ ID NO: 3068618 - protein, 9 aa, Giardia lamblia
YYQSTTGSA

SEQ ID NO: 3068619 - protein, 8 aa, Giardia lamblia
YYRSGSTC

SEQ ID NO: 3068620 - protein, 11 aa, Giardia lamblia
YYSNGGRCREC

SEQ ID NO: 3068621 - protein, 6 aa, Giardia lamblia
YYSPTS

SEQ ID NO: 3068622 - protein, 11 aa, Giardia lamblia
YYSSHSKREIT

SEQ ID NO: 3068623 - protein, 8 aa, Giardia lamblia
YYTTKDKA

SEQ ID NO: 3068624 - protein, 17 aa, Giardia lamblia
ADKCTKCDANGAAPYLK

SEQ ID NO: 3068625 - protein, 18 aa, Giardia lamblia
AKECKKCNAPCTACAGTA

SEQ ID NO: 3068626 - protein, 18 aa, Giardia lamblia
TACAGTADKCTKCDANGA

SEQ ID NO: 3068627 - protein, 23 aa, Giardia lamblia
KDQGLCGSCYEFTTIEVLENLML

SEQ ID NO: 3068628 - protein, 25 aa, Giardia lamblia
LVLAVAGFLVWWFVFRRGGRPKRGA

SEQ ID NO: 3068629 - protein, 21 aa, Giardia lamblia
PCDIANCRVCATGLKCESCAE

SEQ ID NO: 3068630 - protein, 25 aa, Giardia lamblia
YSASTLRLSVQFLLDNLIGGNYCNG

SEQ ID NO: 3068631 - protein, 20 aa, Giardia lamblia
ACLAEACGTGPACVNGDCAY

SEQ ID NO: 3068632 - protein, 20 aa, Giardia lamblia
CAECGITIDGSRYCTRCKDA

SEQ ID NO: 3068633 - protein, 17 aa, Giardia lamblia
CPDEVKLVINLDAEAIS

SEQ ID NO: 3068634 - protein, 24 aa, Giardia lamblia
CSNGFLKIGDMCYSYDCLPVGISD

SEQ ID NO: 3068635 - protein, 26 aa, Giardia lamblia
CTPGCKKCDSTGCKVCKDRFALRNNI

SEQ ID NO: 3068636 - protein, 19 aa, Giardia lamblia
DPILKRQIWAYVRALVTEG

SEQ ID NO: 3068637 - protein, 22 aa, Giardia lamblia
EIMSDYYLVFLLLLGSVIVAGR

SEQ ID NO: 3068638 - protein, 18 aa, Giardia lamblia
FRSIPAVIFQPGQHEAGS

SEQ ID NO: 3068639 - protein, 18 aa, Giardia lamblia
GGMLRRLALANATAGGPR

SEQ ID NO: 3068640 - protein, 19 aa, Giardia lamblia
IFLECILTLIFAAHFRGPF

SEQ ID NO: 3068641 - protein, 19 aa, Giardia lamblia
LPLLTLVLLFCKHEPGSQG

SEQ ID NO: 3068642 - protein, 18 aa, Giardia lamblia
RARLEDVFEHLLDGEDDA

SEQ ID NO: 3068643 - protein, 24 aa, Giardia lamblia
SASKKCRKSRCVWTDPYDQTEKTC

SEQ ID NO: 3068644 - protein, 17 aa, Giardia lamblia
TTIEVLENLMLVDADLY

SEQ ID NO: 3068645 - protein, 19 aa, Giardia lamblia
VEEAWRQGTEFTYDGSVMS

SEQ ID NO: 3068646 - protein, 35 aa, Giardia lamblia
VGYGAYKGRPVWILRNSWGTGWGVSGYYYIGRGSN

SEQ ID NO: 3068647 - protein, 18 aa, Giardia lamblia
VLLLRKIRVRQRIKDRTP

SEQ ID NO: 3068648 - protein, 18 aa, Giardia lamblia
VPAGSIFALLGANGAGKS

SEQ ID NO: 3068649 - protein, 18 aa, Giardia lamblia
VVVMAAVALFFSFEDRLQ

SEQ ID NO: 3068650 - protein, 19 aa, Giardia lamblia
WRQGTEFTYDGSVMSIPRR

SEQ ID NO: 3068651 - protein, 21 aa, Giardia lamblia
YMPVLRNAIGLSRISWGSLAL

SEQ ID NO: 3068652 - protein, 19 aa, Giardia lamblia
YSCDPCPDGFVSYEGECLP

SEQ ID NO: 3068653 - protein, 23 aa, Giardia lamblia
YVDELLKRLGLHDHAHKQASALS

SEQ ID NO: 3068654 - protein, 21 aa, Giardia lamblia
AAVALTCWFVLRRRRESRAAL

SEQ ID NO: 3068655 - protein, 20 aa, Giardia lamblia
ACVTDACKLDKSLAGPWAPE

SEQ ID NO: 3068656 - protein, 24 aa, Giardia lamblia
ADGQSSKCLACWDDTVGGVANCGG

SEQ ID NO: 3068657 - protein, 28 aa, Giardia lamblia
ALCLLQICFTCLYFFTSLVLHTGVLLLG

SEQ ID NO: 3068658 - protein, 24 aa, Giardia lamblia
ALLVAGLVFSCFFKESSAGVIARK

SEQ ID NO: 3068659 - protein, 18 aa, Giardia lamblia
AMGSLYCSRCALDDEWPI

SEQ ID NO: 3068660 - protein, 25 aa, Giardia lamblia
ARNSPLWLLFDFACTAVGAVVVPIY

SEQ ID NO: 3068661 - protein, 17 aa, Giardia lamblia
ASCSTNAETSCTACYPG

SEQ ID NO: 3068662 - protein, 23 aa, Giardia lamblia
ASEMRVVMVLILYFSIWTIIPTI

SEQ ID NO: 3068663 - protein, 26 aa, Giardia lamblia
ASLVKKAVFCLACKVKEYTEGSWIKT

SEQ ID NO: 3068664 - protein, 27 aa, Giardia lamblia
AYGDGAYFCQCRRGWAGAACDAPRAGF

SEQ ID NO: 3068665 - protein, 20 aa, Giardia lamblia
CAECGITIDGSRYCTRCKDS

SEQ ID NO: 3068666 - protein, 22 aa, Giardia lamblia
CEQWNSAFKWIFSKNGDNNKNG

SEQ ID NO: 3068667 - protein, 20 aa, Giardia lamblia
CLECPSGCSMCKQFSNNGRV

SEQ ID NO: 3068668 - protein, 24 aa, Giardia lamblia
CMQYYFCAPEYIFHSPLNLNLPHK

SEQ ID NO: 3068669 - protein, 25 aa, Giardia lamblia
CSSQSHLYGTLSPGRFVSSITDGTH

SEQ ID NO: 3068670 - protein, 18 aa, Giardia lamblia
CTSCASGYFLYNGGCYRK

SEQ ID NO: 3068671 - protein, 19 aa, Giardia lamblia
CVLCCCSCCCCGCCGCLDC

SEQ ID NO: 3068672 - protein, 17 aa, Giardia lamblia
CVPRKCIYVHSTLAEPK

SEQ ID NO: 3068673 - protein, 23 aa, Giardia lamblia
CWPPRELKLLFGVPTRVLADRAG

SEQ ID NO: 3068674 - protein, 22 aa, Giardia lamblia
DKESKCILCGDTSGSTWKGVDG

SEQ ID NO: 3068675 - protein, 24 aa, Giardia lamblia
DTDVLRFSCETDWVPGFGTEYAGM

SEQ ID NO: 3068676 - protein, 20 aa, Giardia lamblia
EAYVGLWLSGIPLMLFYMKK

SEQ ID NO: 3068677 - protein, 19 aa, Giardia lamblia
ECTRIFRTFISYPYHLARL

SEQ ID NO: 3068678 - protein, 17 aa, Giardia lamblia
EGMYCGACAIEGDVPID

SEQ ID NO: 3068679 - protein, 18 aa, Giardia lamblia
EGMYCGACAIEGDVPIDG

SEQ ID NO: 3068680 - protein, 19 aa, Giardia lamblia
EGYVECSGHGKCIGDHIVG

SEQ ID NO: 3068681 - protein, 19 aa, Giardia lamblia
ETQFSWYYIGVVGDASKVE

SEQ ID NO: 3068682 - protein, 23 aa, Giardia lamblia
FDNLRSLLIWVIMVIIYYSTRHY

SEQ ID NO: 3068683 - protein, 17 aa, Giardia lamblia
FKYTGVFANLLCFTCSN

SEQ ID NO: 3068684 - protein, 31 aa, Giardia lamblia
FRTFISYPYHLARLGASFSFTNSSSTGGVVV

SEQ ID NO: 3068685 - protein, 19 aa, Giardia lamblia
GAGACTRCASGAYLEGGYC

SEQ ID NO: 3068686 - protein, 25 aa, Giardia lamblia
GGPSCARWPILVRNLLVGVAHVAVH

SEQ ID NO: 3068687 - protein, 29 aa, Giardia lamblia
GGVRRCWCERGFLPALDRSGCVLPTECPP

SEQ ID NO: 3068688 - protein, 19 aa, Giardia lamblia
GLAGLPLQLFVSITVSVSQ

SEQ ID NO: 3068689 - protein, 22 aa, Giardia lamblia
GMIFRFGIILSGFGLVVNGAAP

SEQ ID NO: 3068690 - protein, 24 aa, Giardia lamblia
GQDACSWGSCTVMDGSLCSQCASS

SEQ ID NO: 3068691 - protein, 19 aa, Giardia lamblia
GSLVLASTCYGRLSEHIYF

SEQ ID NO: 3068692 - protein, 23 aa, Giardia lamblia
GTLPRLPLCRDLPGCTSQTVYLA

SEQ ID NO: 3068693 - protein, 21 aa, Giardia lamblia
GVARRAGLVVGLRVIAGLAVG

SEQ ID NO: 3068694 - protein, 19 aa, Giardia lamblia
GVGACVRNGAGYSCDCRGL

SEQ ID NO: 3068695 - protein, 20 aa, Giardia lamblia
HFCQCRRGWAGAACDAPRAG

SEQ ID NO: 3068696 - protein, 24 aa, Giardia lamblia
ILNLKTFFLWTFSGFIIAVVVFLL

SEQ ID NO: 3068697 - protein, 20 aa, Giardia lamblia
IPHCKSCKVSNGLLVCVACE

SEQ ID NO: 3068698 - protein, 19 aa, Giardia lamblia
ISLLEVFASLGVLLLRKIR

SEQ ID NO: 3068699 - protein, 18 aa, Giardia lamblia
IYGIWCSDLPTKSCKSNE

SEQ ID NO: 3068700 - protein, 18 aa, Giardia lamblia
KCFGSCLALGPGYYNASG

SEQ ID NO: 3068701 - protein, 22 aa, Giardia lamblia
KDSCGLKFLGLILGCIVAFVVI

SEQ ID NO: 3068702 - protein, 18 aa, Giardia lamblia
KKCAIKGEVPMDGRCIKG

SEQ ID NO: 3068703 - protein, 28 aa, Giardia lamblia
KPWADLVTEKVRRHWPKLNGVPTGPPPA

SEQ ID NO: 3068704 - protein, 19 aa, Giardia lamblia
KRGWHLAGDRCLACPSPCA

SEQ ID NO: 3068705 - protein, 22 aa, Giardia lamblia
LAIVIFFLGRYCMQYYFCAPEY

SEQ ID NO: 3068706 - protein, 23 aa, Giardia lamblia
LAIVIFFLGRYCMQYYFCAPEYI

SEQ ID NO: 3068707 - protein, 17 aa, Giardia lamblia
LENLMLVDADLYTRGKY

SEQ ID NO: 3068708 - protein, 20 aa, Giardia lamblia
LFKRACFGINCFINTVDDSG

SEQ ID NO: 3068709 - protein, 17 aa, Giardia lamblia
LGSCGPTGCVCDLGTKL

SEQ ID NO: 3068710 - protein, 21 aa, Giardia lamblia
LGVSEFCMYGLTFGTLLIANL

SEQ ID NO: 3068711 - protein, 17 aa, Giardia lamblia
LKACVTDACKLDKSLAG

SEQ ID NO: 3068712 - protein, 21 aa, Giardia lamblia
LKCESCAESAVPISPDVYHTA

SEQ ID NO: 3068713 - protein, 19 aa, Giardia lamblia
LKGYCNVLNGKYCSRCSLE

SEQ ID NO: 3068714 - protein, 25 aa, Giardia lamblia
LKNKELILLWFAYVFQIFCTQLPVA

SEQ ID NO: 3068715 - protein, 18 aa, Giardia lamblia
LPTKSCKSNEFLENGFCV

SEQ ID NO: 3068716 - protein, 23 aa, Giardia lamblia
MQYYFCAPEYIFHSPLNLNLPHK

SEQ ID NO: 3068717 - protein, 24 aa, Giardia lamblia
MVVGWEGVCGVILSLCVACPLAHV

SEQ ID NO: 3068718 - protein, 21 aa, Giardia lamblia
PAEHIKFFCNMRGVNYAEDLE

SEQ ID NO: 3068719 - protein, 19 aa, Giardia lamblia
PALCKDCLPGYKALSTGTE

SEQ ID NO: 3068720 - protein, 17 aa, Giardia lamblia
PGYTLKDSFACEADVAR

SEQ ID NO: 3068721 - protein, 18 aa, Giardia lamblia
PKICPPQCLCREQSIACI

SEQ ID NO: 3068722 - protein, 17 aa, Giardia lamblia
PNLKACVTDACKLDKSL

SEQ ID NO: 3068723 - protein, 19 aa, Giardia lamblia
PPLTGETSAECNWCQNEKY

SEQ ID NO: 3068724 - protein, 20 aa, Giardia lamblia
PSKCVYRRLLSDPTIACNGL

SEQ ID NO: 3068725 - protein, 24 aa, Giardia lamblia
QQRFGCACSEGFLAVSTGEQCVPR

SEQ ID NO: 3068726 - protein, 20 aa, Giardia lamblia
RCTECLPGYYLYDNLCVRCD

SEQ ID NO: 3068727 - protein, 24 aa, Giardia lamblia
RHLCADGACSNCYMTHIQHNGGCY

SEQ ID NO: 3068728 - protein, 17 aa, Giardia lamblia
RLACNPSSLQSCKLAMI

SEQ ID NO: 3068729 - protein, 18 aa, Giardia lamblia
RLNRKKRPGSLVLASTCY

SEQ ID NO: 3068730 - protein, 18 aa, Giardia lamblia
RNGAGYSCDCRGLATGDL

SEQ ID NO: 3068731 - protein, 23 aa, Giardia lamblia
RTQYRCFEYLRLLVAAAGHAFDA

SEQ ID NO: 3068732 - protein, 23 aa, Giardia lamblia
SASKKCRKSRCVWSDPYDQTEKT

SEQ ID NO: 3068733 - protein, 24 aa, Giardia lamblia
SCSPCTAAGCARCDGGVCTSCKRG

SEQ ID NO: 3068734 - protein, 22 aa, Giardia lamblia
SCTRCGPRFFLHAGGCYEIGRS

SEQ ID NO: 3068735 - protein, 23 aa, Giardia lamblia
SGTVCYPLGCLTLGTVCNGNGRC

SEQ ID NO: 3068736 - protein, 19 aa, Giardia lamblia
SRDAISRVALLLSTELGTL

SEQ ID NO: 3068737 - protein, 24 aa, Giardia lamblia
SSKCTACGSGYFMHRGICMRQESH

SEQ ID NO: 3068738 - protein, 18 aa, Giardia lamblia
STRCTSCVPEHIWNGEEC

SEQ ID NO: 3068739 - protein, 24 aa, Giardia lamblia
SVRLYRDKICMELRAPTAESSACT

SEQ ID NO: 3068740 - protein, 23 aa, Giardia lamblia
TAKYCGTCKLGFYISPDDQKCAK

SEQ ID NO: 3068741 - protein, 18 aa, Giardia lamblia
TCIKECTGDFMAHCKADG

SEQ ID NO: 3068742 - protein, 24 aa, Giardia lamblia
TCKSGYKTITFRGVVYPCVATECI

SEQ ID NO: 3068743 - protein, 19 aa, Giardia lamblia
TCRRCRPGYRHNKETLTCM

SEQ ID NO: 3068744 - protein, 18 aa, Giardia lamblia
TCYGRLSEHIYFLTEELT

SEQ ID NO: 3068745 - protein, 24 aa, Giardia lamblia
TFLDRGAPMSYIFLKQMGPYQASL

SEQ ID NO: 3068746 - protein, 19 aa, Giardia lamblia
TICKECANASYAPRNGACI

SEQ ID NO: 3068747 - protein, 19 aa, Giardia lamblia
TRSGDSYFCTCKSGYKTIT

SEQ ID NO: 3068748 - protein, 18 aa, Giardia lamblia
TVALILLVAFPFLILLEQ

SEQ ID NO: 3068749 - protein, 19 aa, Giardia lamblia
TVGPKIYGIWCSDLPTKSC

SEQ ID NO: 3068750 - protein, 20 aa, Giardia lamblia
VDGCRYCLPPLTGETSAECN

SEQ ID NO: 3068751 - protein, 20 aa, Giardia lamblia
VFASLGVLLLRKIRVRQRIK

SEQ ID NO: 3068752 - protein, 27 aa, Giardia lamblia
VGLAFTYYLPLCFIVLVSVGRELYDEL

SEQ ID NO: 3068753 - protein, 25 aa, Giardia lamblia
VLVAVAGFLVWWFVIRPRKSGELRE

SEQ ID NO: 3068754 - protein, 18 aa, Giardia lamblia
VNGDCAYGDGAYFCQCRR

SEQ ID NO: 3068755 - protein, 22 aa, Giardia lamblia
VPVCRCYPGYTLKDSFACEADV

SEQ ID NO: 3068756 - protein, 33 aa, Giardia lamblia
WMQISLPRWLSFRLNVIGAFFCGFIALISCVIA

SEQ ID NO: 3068757 - protein, 19 aa, Giardia lamblia
WYNYCGGVGDCIQKKDKSG

SEQ ID NO: 3068758 - protein, 19 aa, Giardia lamblia
YPEIYRITSRGSILNLKTF

SEQ ID NO: 3068759 - protein, 23 aa, Giardia lamblia
YSLWYSQEMMTWYAVKHPSPRTR

SEQ ID NO: 3068760 - protein, 22 aa, Giardia lamblia
YSYDCLPVGISDNIRNPDINVL

SEQ ID NO: 3068761 - protein, 28 aa, Giardia lamblia
YTARSLRGFISLCPQEWNNLWINLTVRE

SEQ ID NO: 3068762 - protein, 55 aa, Giardia lamblia
AAAAAFKLEIKFILTPGERFQLWILSCGLIFVVHIKTGFLLAALSIPNLIYCAYA

SEQ ID NO: 3068763 - protein, 23 aa, Giardia lamblia
AAAELRNATVLVGLFSACIAPDS

SEQ ID NO: 3068764 - protein, 19 aa, Giardia lamblia
AAAERIGMVVPRMTSSTYQ

SEQ ID NO: 3068765 - protein, 24 aa, Giardia lamblia
AAAFLYKPGPVFFALSEGNTHYIL

SEQ ID NO: 3068766 - protein, 18 aa, Giardia lamblia
AAALLCFGTIPPLFSDIN

SEQ ID NO: 3068767 - protein, 20 aa, Giardia lamblia
AAAPKRPEVPAKHRPHSNIR

SEQ ID NO: 3068768 - protein, 18 aa, Giardia lamblia
AAAYILTCLSSIKSTSDL

SEQ ID NO: 3068769 - protein, 18 aa, Giardia lamblia
AADACKWTNKTNKYEGCN

SEQ ID NO: 3068770 - protein, 18 aa, Giardia lamblia
AADACNWTNKTNKYTNCN

SEQ ID NO: 3068771 - protein, 29 aa, Giardia lamblia
AADVLYRVIKWLVTDARVKPEEVARHKEA

SEQ ID NO: 3068772 - protein, 25 aa, Giardia lamblia
AAEIPDLRLKYHIRRPSEQEIVRSC

SEQ ID NO: 3068773 - protein, 19 aa, Giardia lamblia
AAELGKYICDYRATNPQTH

SEQ ID NO: 3068774 - protein, 26 aa, Giardia lamblia
AAERLCSWPLYAMLESLVLLFVQEYS

SEQ ID NO: 3068775 - protein, 18 aa, Giardia lamblia
AAEYAWDWAADGINYRVI

SEQ ID NO: 3068776 - protein, 26 aa, Giardia lamblia
AAFGNAACIWLLFAEARLENRDGETA

SEQ ID NO: 3068777 - protein, 17 aa, Giardia lamblia
AAFQYLGIRSGDMVGLM

SEQ ID NO: 3068778 - protein, 17 aa, Giardia lamblia
AAFWMDVSLYRWLHFTT

SEQ ID NO: 3068779 - protein, 26 aa, Giardia lamblia
AAGKCVACSVLHCLTCNAANTCASCQ

SEQ ID NO: 3068780 - protein, 23 aa, Giardia lamblia
AAGNTCAMMAMPLTTEESETNFP

SEQ ID NO: 3068781 - protein, 24 aa, Giardia lamblia
AAHHLRFSRRGDLSPDFVGESVLW

SEQ ID NO: 3068782 - protein, 19 aa, Giardia lamblia
AAHNTCFSLLVRLCNVQSP

SEQ ID NO: 3068783 - protein, 17 aa, Giardia lamblia
AAIADGIFHDRGSFKIN

SEQ ID NO: 3068784 - protein, 27 aa, Giardia lamblia
AAIPTLLFCFPFANYELALGVSTGLIF

SEQ ID NO: 3068785 - protein, 25 aa, Giardia lamblia
AAIRETKLFFAPSFIPLQRFRLLYL

SEQ ID NO: 3068786 - protein, 25 aa, Giardia lamblia
AAIRRLAYYCSMVIKSSGYAKSSAQ

SEQ ID NO: 3068787 - protein, 24 aa, Giardia lamblia
AAISNSLFAVWSFLPSQKGMKDDQ

SEQ ID NO: 3068788 - protein, 23 aa, Giardia lamblia
AAKCTGCADGFYLAAEKCVACSV

SEQ ID NO: 3068789 - protein, 19 aa, Giardia lamblia
AAKCTGCADGFYLAAGKCV

SEQ ID NO: 3068790 - protein, 24 aa, Giardia lamblia
AAKDLSGGMLRRLALANATVSYPP

SEQ ID NO: 3068791 - protein, 20 aa, Giardia lamblia
AAKESCSWQKELLDLLQSLY

SEQ ID NO: 3068792 - protein, 24 aa, Giardia lamblia
AAKGMCLDCRKHNPGTTVFLYMGG

SEQ ID NO: 3068793 - protein, 19 aa, Giardia lamblia
AAKLRAKYARKLMNYNTAF

SEQ ID NO: 3068794 - protein, 21 aa, Giardia lamblia
AAKNFDLRAFLSITEEPTEIA

SEQ ID NO: 3068795 - protein, 25 aa, Giardia lamblia
AAKRSSLGMIIYRFLAISFPFYING

SEQ ID NO: 3068796 - protein, 23 aa, Giardia lamblia
AALFNCQESLYLVVNDCGIGLPK

SEQ ID NO: 3068797 - protein, 21 aa, Giardia lamblia
AALKHCLKLYLTLFQEELDNP

SEQ ID NO: 3068798 - protein, 21 aa, Giardia lamblia
AALKWQTDMLEYMDVMSGRAV

SEQ ID NO: 3068799 - protein, 19 aa, Giardia lamblia
AALLIKRYLSSKYFDLAKA

SEQ ID NO: 3068800 - protein, 18 aa, Giardia lamblia
AALPAPLVIVYHDGAPTS

SEQ ID NO: 3068801 - protein, 19 aa, Giardia lamblia
AAMVERCLLYGTTIEGIAM

SEQ ID NO: 3068802 - protein, 23 aa, Giardia lamblia
AANESLEAFTWLVDNTEEANAQL

SEQ ID NO: 3068803 - protein, 17 aa, Giardia lamblia
AANFLGVKNQLRSDVVE

SEQ ID NO: 3068804 - protein, 23 aa, Giardia lamblia
AANPIPATFLFDVEEKLSEAVER

SEQ ID NO: 3068805 - protein, 18 aa, Giardia lamblia
AANSPLWLISDLAIMARG

SEQ ID NO: 3068806 - protein, 25 aa, Giardia lamblia
AANVIKLLIDMACNYVAVTEHKTFN

SEQ ID NO: 3068807 - protein, 20 aa, Giardia lamblia
AAPFLSVYACGTALLCMLLG

SEQ ID NO: 3068808 - protein, 18 aa, Giardia lamblia
AAPLAIEGLDLYKSNGPD

SEQ ID NO: 3068809 - protein, 17 aa, Giardia lamblia
AAPRKPRSFPIHWLQTR

SEQ ID NO: 3068810 - protein, 20 aa, Giardia lamblia
AAQERPRVLRGPTIGSGAPV

SEQ ID NO: 3068811 - protein, 25 aa, Giardia lamblia
AAQGPWRFAQVFVAPGSRGQQTLHY

SEQ ID NO: 3068812 - protein, 20 aa, Giardia lamblia
AAQIVNRWKKIVYEVRHDTF

SEQ ID NO: 3068813 - protein, 23 aa, Giardia lamblia
AAQKWKDFNAWKGIDKMLSDVVP

SEQ ID NO: 3068814 - protein, 28 aa, Giardia lamblia
AAQLASKVSECWPCCMTTSSIVSSLHNA

SEQ ID NO: 3068815 - protein, 24 aa, Giardia lamblia
AAQQCTKCLPGFFKTSDTACDACG

SEQ ID NO: 3068816 - protein, 36 aa, Giardia lamblia
AAQVIMLVSFYFTRFLAVPRRVYVDFLPVPLGTSQP

SEQ ID NO: 3068817 - protein, 24 aa, Giardia lamblia
AARHIAINLLREFVGKLMKGQLTP

SEQ ID NO: 3068818 - protein, 26 aa, Giardia lamblia
AARPLKKICCLAGLRGSGRSVLLGDL

SEQ ID NO: 3068819 - protein, 17 aa, Giardia lamblia
AASARAGPIVTCSGCET

SEQ ID NO: 3068820 - protein, 22 aa, Giardia lamblia
AASDVLYKFSAVHLDSSTKTVY

SEQ ID NO: 3068821 - protein, 20 aa, Giardia lamblia
AASECDPCPIGFYNEEVGQV

SEQ ID NO: 3068822 - protein, 33 aa, Giardia lamblia
AASEKQLICHLIELTVSLALLFNFRQTANLYAS

SEQ ID NO: 3068823 - protein, 17 aa, Giardia lamblia
AASKRAAGFTSLLNSSY

SEQ ID NO: 3068824 - protein, 18 aa, Giardia lamblia
AASLPALYSLLYNGVQQD

SEQ ID NO: 3068825 - protein, 25 aa, Giardia lamblia
AASLSLSLQCFRVCGDTFLRHQIDK

SEQ ID NO: 3068826 - protein, 18 aa, Giardia lamblia
AASPRLVSSLSHAISGVQ

SEQ ID NO: 3068827 - protein, 25 aa, Giardia lamblia
AASYCMISSIPPLKCSVNLAEVNSD

SEQ ID NO: 3068828 - protein, 24 aa, Giardia lamblia
AATLGNILLVCFLVLLFYKRTNHS

SEQ ID NO: 3068829 - protein, 18 aa, Giardia lamblia
AATNYAYFDYITKQIIAK

SEQ ID NO: 3068830 - protein, 27 aa, Giardia lamblia
AATTRSTMRIVFFSLSFIVLAAVVAAL

SEQ ID NO: 3068831 - protein, 17 aa, Giardia lamblia
AATVLSYSLYGDSSGLV

SEQ ID NO: 3068832 - protein, 24 aa, Giardia lamblia
AATVRKWLAYGFVLFGRSSVYGPF

SEQ ID NO: 3068833 - protein, 17 aa, Giardia lamblia
AAVEGLGSFLLLSDVKV

SEQ ID NO: 3068834 - protein, 28 aa, Giardia lamblia
AAVFIHISWVLRLSWPGRFSEFPFFSKL

SEQ ID NO: 3068835 - protein, 25 aa, Giardia lamblia
AAVICTSIFLGLRQLLKLSLQTYSH

SEQ ID NO: 3068836 - protein, 18 aa, Giardia lamblia
AAVPEFIANSIAWALLIG

SEQ ID NO: 3068837 - protein, 18 aa, Giardia lamblia
AAVSLIPLLIYYFFFSGA

SEQ ID NO: 3068838 - protein, 20 aa, Giardia lamblia
AAVTIVCIFVLPLIVKATKS

SEQ ID NO: 3068839 - protein, 22 aa, Giardia lamblia
AAWQGAFLRPYIGVDRSLASLD

SEQ ID NO: 3068840 - protein, 25 aa, Giardia lamblia
AAYIDDFREAYAWLEHNTHPTAKVA

SEQ ID NO: 3068841 - protein, 26 aa, Giardia lamblia
AAYIVGYCEIDFTFVFNNDEEATLPN

SEQ ID NO: 3068842 - protein, 17 aa, Giardia lamblia
AAYKMLWYDDTVYDKLF

SEQ ID NO: 3068843 - protein, 21 aa, Giardia lamblia
AAYKTRRYIAGVTDTLEVFLL

SEQ ID NO: 3068844 - protein, 25 aa, Giardia lamblia
ACAASSLIASRVWNAIAFGRATKLH

SEQ ID NO: 3068845 - protein, 24 aa, Giardia lamblia
ACACALTLPAFILDAFRHKKYDAF

SEQ ID NO: 3068846 - protein, 17 aa, Giardia lamblia
ACACLLTPTYVVFVCSH

SEQ ID NO: 3068847 - protein, 17 aa, Giardia lamblia
ACAFKIKLPGPSIGLIT

SEQ ID NO: 3068848 - protein, 18 aa, Giardia lamblia
ACAHLDWEVVTASLDGVE

SEQ ID NO: 3068849 - protein, 17 aa, Giardia lamblia
ACANGFSNVDGRCVHSN

SEQ ID NO: 3068850 - protein, 20 aa, Giardia lamblia
ACDLWNFSKALELCRGNKKY

SEQ ID NO: 3068851 - protein, 31 aa, Giardia lamblia
ACDVENCRSCISAGVCGRCNTGYYLSGSRCS

SEQ ID NO: 3068852 - protein, 17 aa, Giardia lamblia
ACFAKRAREAHMGVWMG

SEQ ID NO: 3068853 - protein, 22 aa, Giardia lamblia
ACGGSSVAKCITAYDVCNCTVQ

SEQ ID NO: 3068854 - protein, 19 aa, Giardia lamblia
ACGSHIPFPSQEFEYDGKL

SEQ ID NO: 3068855 - protein, 30 aa, Giardia lamblia
ACGSSTMRSCCSRCALLWCVNVSLSRPVST

SEQ ID NO: 3068856 - protein, 24 aa, Giardia lamblia
ACGTTLCFWLMWFCTYAIQINPLI

SEQ ID NO: 3068857 - protein, 19 aa, Giardia lamblia
ACGVGYGMQGALCYPCTIS

SEQ ID NO: 3068858 - protein, 24 aa, Giardia lamblia
ACILCTIPNCLECKIEASQDIVYE

SEQ ID NO: 3068859 - protein, 23 aa, Giardia lamblia
ACILPAVFYLPAQNKILCLNGTG

SEQ ID NO: 3068860 - protein, 24 aa, Giardia lamblia
ACILPYINERVFRLFEPRIAAGVM

SEQ ID NO: 3068861 - protein, 17 aa, Giardia lamblia
ACKVKEYTEGSWIKTGT

SEQ ID NO: 3068862 - protein, 18 aa, Giardia lamblia
ACKVKEYTEGSWIKTGTL

SEQ ID NO: 3068863 - protein, 24 aa, Giardia lamblia
ACLDLPLPCLETIKSVIGLDYYDL

SEQ ID NO: 3068864 - protein, 21 aa, Giardia lamblia
ACLNLPVILVIATWTAIICDV

SEQ ID NO: 3068865 - protein, 23 aa, Giardia lamblia
ACLPCATPGCKTCGHASFCTECA

SEQ ID NO: 3068866 - protein, 18 aa, Giardia lamblia
ACNLEIPNPGFGEREPYI

SEQ ID NO: 3068867 - protein, 17 aa, Giardia lamblia
ACNRGFTLINSNYCAPS

SEQ ID NO: 3068868 - protein, 17 aa, Giardia lamblia
ACPASAKSFLFYGGCYD

SEQ ID NO: 3068869 - protein, 21 aa, Giardia lamblia
ACPQNPGLCYSNMIPFLQSSA

SEQ ID NO: 3068870 - protein, 22 aa, Giardia lamblia
ACQHLDFFASDLLNCREVVNCL

SEQ ID NO: 3068871 - protein, 21 aa, Giardia lamblia
ACRRPLCTYIDPFDGQAKICY

SEQ ID NO: 3068872 - protein, 17 aa, Giardia lamblia
ACSCNPPTDAGRSLLSE

SEQ ID NO: 3068873 - protein, 18 aa, Giardia lamblia
ACSIEGCNRCSASEHTKC

SEQ ID NO: 3068874 - protein, 20 aa, Giardia lamblia
ACSKDSATTCDACFEPLIMK

SEQ ID NO: 3068875 - protein, 18 aa, Giardia lamblia
ACSSGFMLFYGSCYSVDG

SEQ ID NO: 3068876 - protein, 28 aa, Giardia lamblia
ACTLSTLMTCCYVSLFLEYVHRKQSTDG

SEQ ID NO: 3068877 - protein, 20 aa, Giardia lamblia
ACTTNSWIYVSFPCGKTLTF

SEQ ID NO: 3068878 - protein, 19 aa, Giardia lamblia
ACVQCAAGFMLDNKECVPV

SEQ ID NO: 3068879 - protein, 20 aa, Giardia lamblia
ACVTDACKLDKTLAGPYAPD

SEQ ID NO: 3068880 - protein, 20 aa, Giardia lamblia
ACVTDACKLNKSLAGPYAPD

SEQ ID NO: 3068881 - protein, 19 aa, Giardia lamblia
ACVTNACKLDKKLAGPGAP

SEQ ID NO: 3068882 - protein, 28 aa, Giardia lamblia
ACYLKSLIWTLKIIRMVLYKRQIATETI

SEQ ID NO: 3068883 - protein, 24 aa, Giardia lamblia
ADAARPSGPISHLFSERYTPGIQL

SEQ ID NO: 3068884 - protein, 23 aa, Giardia lamblia
ADASGIFAHYEFSYQLHYQLARS

SEQ ID NO: 3068885 - protein, 23 aa, Giardia lamblia
ADCDARTSLMLAAEKNYMSLIPL

SEQ ID NO: 3068886 - protein, 29 aa, Giardia lamblia
ADCSTRLLEMPVYPSPFAMLKILAPIADI

SEQ ID NO: 3068887 - protein, 22 aa, Giardia lamblia
ADEKRTPLVFEHGITNAERQDK

SEQ ID NO: 3068888 - protein, 25 aa, Giardia lamblia
ADFESYLNYVAEIFCMLRQDVYIII

SEQ ID NO: 3068889 - protein, 18 aa, Giardia lamblia
ADFLCFVTGSSRIPPIGF

SEQ ID NO: 3068890 - protein, 18 aa, Giardia lamblia
ADFSYCLMALLNDNRTGG

SEQ ID NO: 3068891 - protein, 20 aa, Giardia lamblia
ADGHCTRCYKTHIFHLGGCF

SEQ ID NO: 3068892 - protein, 18 aa, Giardia lamblia
ADGIGSCTLVIFYEEGMS

SEQ ID NO: 3068893 - protein, 21 aa, Giardia lamblia
ADGQPKCLGCWDEAATGVANC

SEQ ID NO: 3068894 - protein, 17 aa, Giardia lamblia
ADGVFFFAGHGCGEAVL

SEQ ID NO: 3068895 - protein, 17 aa, Giardia lamblia
ADIGIIFVLVFSFPVVC

SEQ ID NO: 3068896 - protein, 24 aa, Giardia lamblia
ADISELPSTIFSKVQQFFSRATNY

SEQ ID NO: 3068897 - protein, 18 aa, Giardia lamblia
ADKCKTCATGYYKENGDD

SEQ ID NO: 3068898 - protein, 21 aa, Giardia lamblia
ADKLFKFTLGKLYTEGRAKGY

SEQ ID NO: 3068899 - protein, 25 aa, Giardia lamblia
ADKTSGLCQILYPRGEDIQALYTSV

SEQ ID NO: 3068900 - protein, 21 aa, Giardia lamblia
ADLCVETGVLIYGLYLDCGFF

SEQ ID NO: 3068901 - protein, 20 aa, Giardia lamblia
ADLLVYRAVIYQHKGISRED

SEQ ID NO: 3068902 - protein, 17 aa, Giardia lamblia
ADLTRILLQYEHYITDK

SEQ ID NO: 3068903 - protein, 22 aa, Giardia lamblia
ADLVSFTGLCDRSVCGQQAAAY

SEQ ID NO: 3068904 - protein, 25 aa, Giardia lamblia
ADMESFQAFLWRLLSHTKRFSSQQD

SEQ ID NO: 3068905 - protein, 25 aa, Giardia lamblia
ADNEGRTALMYALAYDHQGCYQFLF

SEQ ID NO: 3068906 - protein, 21 aa, Giardia lamblia
ADNRASVSFFHCILTHRVSRS

SEQ ID NO: 3068907 - protein, 19 aa, Giardia lamblia
ADPHCIDCHDGSEFCSVCE

SEQ ID NO: 3068908 - protein, 17 aa, Giardia lamblia
ADPPWALRILKQVISEG

SEQ ID NO: 3068909 - protein, 26 aa, Giardia lamblia
ADQLRRLQGILAPFVLRRVKGDVEKD

SEQ ID NO: 3068910 - protein, 26 aa, Giardia lamblia
ADQLRSWEALDSMMISMCSAKSDHVA

SEQ ID NO: 3068911 - protein, 19 aa, Giardia lamblia
ADRLMDIIANFKLVYTPLI

SEQ ID NO: 3068912 - protein, 21 aa, Giardia lamblia
ADSIFQFTVPVLQKLVKVLCA

SEQ ID NO: 3068913 - protein, 37 aa, Giardia lamblia
ADSPKSAFLLKFQDIVWTPSMIRLFALLFTSVSNGES

SEQ ID NO: 3068914 - protein, 21 aa, Giardia lamblia
ADSSLEFKHLIIAFSSQQVEA

SEQ ID NO: 3068915 - protein, 28 aa, Giardia lamblia
ADTFKLYLGEDVFLHLLRIYGSSVAVTE

SEQ ID NO: 3068916 - protein, 28 aa, Giardia lamblia
ADTISIMLHFSWETCLKTVIDPDGPSHS

SEQ ID NO: 3068917 - protein, 20 aa, Giardia lamblia
ADVFGRDIVMCYMESDRYDH

SEQ ID NO: 3068918 - protein, 17 aa, Giardia lamblia
ADVQCVVHALRAAIFNC

SEQ ID NO: 3068919 - protein, 24 aa, Giardia lamblia
ADVSCQVVRPAFRELVNGYSGQLY

SEQ ID NO: 3068920 - protein, 28 aa, Giardia lamblia
ADVSPNSICMVISFSNLFSVEASAEGSK

SEQ ID NO: 3068921 - protein, 31 aa, Giardia lamblia
ADYFHSLLFYKLCEFFPETISSFIVSVPSLT

SEQ ID NO: 3068922 - protein, 23 aa, Giardia lamblia
ADYLVCMGSLLAVFNSFRAEQRT

SEQ ID NO: 3068923 - protein, 24 aa, Giardia lamblia
ADYRDRVILYFGHLLRGYQSQQDK

SEQ ID NO: 3068924 - protein, 24 aa, Giardia lamblia
AEAASLHLALLCYIKVTEYKLIKD

SEQ ID NO: 3068925 - protein, 18 aa, Giardia lamblia
AEAGTCAFTGLQYQCSCN

SEQ ID NO: 3068926 - protein, 22 aa, Giardia lamblia
AEAKQLVGMELFEAIKRNLGLE

SEQ ID NO: 3068927 - protein, 19 aa, Giardia lamblia
AEALCNRISIMVAGQLKCI

SEQ ID NO: 3068928 - protein, 19 aa, Giardia lamblia
AEALLVAVSCELPSETSLL

SEQ ID NO: 3068929 - protein, 26 aa, Giardia lamblia
AEALSRIKTKVSALEFENRDLQHDVS

SEQ ID NO: 3068930 - protein, 19 aa, Giardia lamblia
AEAMQRFADDVVYISKNPH

SEQ ID NO: 3068931 - protein, 17 aa, Giardia lamblia
AEARRRTELFSRLGEAK

SEQ ID NO: 3068932 - protein, 19 aa, Giardia lamblia
AEAVLAAYRSSCRATGRIA

SEQ ID NO: 3068933 - protein, 21 aa, Giardia lamblia
AEAYEGAAFASLRKYFANYSF

SEQ ID NO: 3068934 - protein, 18 aa, Giardia lamblia
AECVGELFVSLDGQSCLE

SEQ ID NO: 3068935 - protein, 23 aa, Giardia lamblia
AEDIDSVWYWREKQSAIPDEDGF

SEQ ID NO: 3068936 - protein, 17 aa, Giardia lamblia
AEDSRVACRRLGITNDG

SEQ ID NO: 3068937 - protein, 26 aa, Giardia lamblia
AEDSVCLHHILVIRALYTKKIAECFY

SEQ ID NO: 3068938 - protein, 27 aa, Giardia lamblia
AEFAKHCARGMVSILIICQKLSCVMPT

SEQ ID NO: 3068939 - protein, 23 aa, Giardia lamblia
AEFEYPVVIVFAIIFALGNTGFA

SEQ ID NO: 3068940 - protein, 24 aa, Giardia lamblia
AEGELPRVVTFGAIVALGLLVLAA

SEQ ID NO: 3068941 - protein, 21 aa, Giardia lamblia
AEGGVWKLSDFTLVKPLADKK

SEQ ID NO: 3068942 - protein, 23 aa, Giardia lamblia
AEHELALLLLLTFDKLILIGDVL

SEQ ID NO: 3068943 - protein, 28 aa, Giardia lamblia
AEHIGSFSSALAMFGERRFTFFDISLSD

SEQ ID NO: 3068944 - protein, 27 aa, Giardia lamblia
AEIFCMLRQDVYIIISLLYILQGGGMA

SEQ ID NO: 3068945 - protein, 19 aa, Giardia lamblia
AEIKGCWHEDISLQASYGN

SEQ ID NO: 3068946 - protein, 17 aa, Giardia lamblia
AEIPTAIGTVFFSIEQI

SEQ ID NO: 3068947 - protein, 26 aa, Giardia lamblia
AEISFAAFFDRWRRFYPPLLSLSDAE

SEQ ID NO: 3068948 - protein, 19 aa, Giardia lamblia
AEISGCLLCPSPPACGTCL

SEQ ID NO: 3068949 - protein, 23 aa, Giardia lamblia
AEIVSFKYALSVYISGTAIEVSK

SEQ ID NO: 3068950 - protein, 18 aa, Giardia lamblia
AEKAEWLSTLSLRDDLML

SEQ ID NO: 3068951 - protein, 20 aa, Giardia lamblia
AEKCILCGDTAGFGSSVGID

SEQ ID NO: 3068952 - protein, 17 aa, Giardia lamblia
AEKCILCSDTVGFNGYK

SEQ ID NO: 3068953 - protein, 23 aa, Giardia lamblia
AELEELTILLGTCYPVFGKDFLM

SEQ ID NO: 3068954 - protein, 18 aa, Giardia lamblia
AELFCRRLFTSLEKTINI

SEQ ID NO: 3068955 - protein, 22 aa, Giardia lamblia
AELFQPALFALDFSEIDAGGNV

SEQ ID NO: 3068956 - protein, 19 aa, Giardia lamblia
AELFVKYMGTFAWISKEYE

SEQ ID NO: 3068957 - protein, 23 aa, Giardia lamblia
AELKDFPSGFTLAFHSTKDALER

SEQ ID NO: 3068958 - protein, 18 aa, Giardia lamblia
AELLEFQGSAILSTLFDL

SEQ ID NO: 3068959 - protein, 28 aa, Giardia lamblia
AELLGFIGSRLHAMFVVRPESVAHSGNN

SEQ ID NO: 3068960 - protein, 22 aa, Giardia lamblia
AELRRQLLPLFTYIANYEGKKL

SEQ ID NO: 3068961 - protein, 19 aa, Giardia lamblia
AELRVSMADSIRKHDYADY

SEQ ID NO: 3068962 - protein, 24 aa, Giardia lamblia
AELSRYDNILIRNSILMKQIESIS

SEQ ID NO: 3068963 - protein, 20 aa, Giardia lamblia
AELTGNVGFFAQLNMAQIYD

SEQ ID NO: 3068964 - protein, 24 aa, Giardia lamblia
AELVPFRLTALIAQLLGPTGIHGC

SEQ ID NO: 3068965 - protein, 19 aa, Giardia lamblia
AELYKSIQAQSRLESLYGT

SEQ ID NO: 3068966 - protein, 25 aa, Giardia lamblia
AEMNLYCIGVERCIEHREELAKKIA

SEQ ID NO: 3068967 - protein, 20 aa, Giardia lamblia
AEMVDLLTAFVADETGLYVE

SEQ ID NO: 3068968 - protein, 17 aa, Giardia lamblia
AENEFLRLECQSSISFF

SEQ ID NO: 3068969 - protein, 20 aa, Giardia lamblia
AENLFQQDICFKRESQEEFV

SEQ ID NO: 3068970 - protein, 25 aa, Giardia lamblia
AENRANLSMWRQLLGAVLNIVLDAI

SEQ ID NO: 3068971 - protein, 23 aa, Giardia lamblia
AENRLLEIYYWLHNIDIFITYYT

SEQ ID NO: 3068972 - protein, 21 aa, Giardia lamblia
AEPGWRRAREDALKKLQQYSL

SEQ ID NO: 3068973 - protein, 17 aa, Giardia lamblia
AERCILCSDTVGFGGYR

SEQ ID NO: 3068974 - protein, 21 aa, Giardia lamblia
AERCTACKSGYVLSPGEQCVS

SEQ ID NO: 3068975 - protein, 18 aa, Giardia lamblia
AEREFIFGYVLSGLLGVL

SEQ ID NO: 3068976 - protein, 38 aa, Giardia lamblia
AERIPYSSIRICLRYNILSVACSLILQNTLRYAWMTVQ

SEQ ID NO: 3068977 - protein, 30 aa, Giardia lamblia
AERKVCTYISAMKLWIYVHGKVELFYDPAL

SEQ ID NO: 3068978 - protein, 19 aa, Giardia lamblia
AESIPDIFGKLPDDIEGSA

SEQ ID NO: 3068979 - protein, 27 aa, Giardia lamblia
AESLVCVRLLLQRMVFQEEVLELSLSL

SEQ ID NO: 3068980 - protein, 24 aa, Giardia lamblia
AESRMKEIISLFANTECVLSAVRN

SEQ ID NO: 3068981 - protein, 24 aa, Giardia lamblia
AESSLRYLVGYSIIIIGDSSTKYM

SEQ ID NO: 3068982 - protein, 31 aa, Giardia lamblia
AESYLKSVCFPLSSWERIIVELCLDINTQAS

SEQ ID NO: 3068983 - protein, 20 aa, Giardia lamblia
AETISIGGVLGYLTGVEPAS

SEQ ID NO: 3068984 - protein, 20 aa, Giardia lamblia
AETVRKFMIAVFIVTILYST

SEQ ID NO: 3068985 - protein, 21 aa, Giardia lamblia
AEYIKECRKDIDFSAVGLSDL

SEQ ID NO: 3068986 - protein, 21 aa, Giardia lamblia
AEYLDHLIFIIGWEEDENGVA

SEQ ID NO: 3068987 - protein, 26 aa, Giardia lamblia
AFAEPLAAYCYTRINASSILSPVCQY

SEQ ID NO: 3068988 - protein, 26 aa, Giardia lamblia
AFARSKRLTVAAGRLRTIADSAVTRA

SEQ ID NO: 3068989 - protein, 23 aa, Giardia lamblia
AFDGSYLLACIKLQETASAINTL

SEQ ID NO: 3068990 - protein, 21 aa, Giardia lamblia
AFDIACFFLEFTGIDCEISAF

SEQ ID NO: 3068991 - protein, 26 aa, Giardia lamblia
AFELRRKRFKLLQTYLSHELRFLPTY

SEQ ID NO: 3068992 - protein, 22 aa, Giardia lamblia
AFEPHKFCSSIMNFSRSSQLSY

SEQ ID NO: 3068993 - protein, 23 aa, Giardia lamblia
AFFIICLIIDIQLLMLKQRQMMI

SEQ ID NO: 3068994 - protein, 26 aa, Giardia lamblia
AFFSNRPRYFYSLVFSDSQVLSRHNN

SEQ ID NO: 3068995 - protein, 17 aa, Giardia lamblia
AFFVLRSLESGKIAQNL

SEQ ID NO: 3068996 - protein, 19 aa, Giardia lamblia
AFGTEMRGYLSAKSLSVEK

SEQ ID NO: 3068997 - protein, 24 aa, Giardia lamblia
AFIKKYRFCSEVPQSGYDKVYRVE

SEQ ID NO: 3068998 - protein, 18 aa, Giardia lamblia
AFINVFYPLAIVRASLGY

SEQ ID NO: 3068999 - protein, 24 aa, Giardia lamblia
AFIRCFLVRKSVLAFRSLCIYFGL

SEQ ID NO: 3069000 - protein, 19 aa, Giardia lamblia
AFIRDFKYYQSFYANLSSK

SEQ ID NO: 3069001 - protein, 24 aa, Giardia lamblia
AFITHKKLSLAIFSPLVPMYVHTF

SEQ ID NO: 3069002 - protein, 21 aa, Giardia lamblia
AFKELCKQYLYSLTLYSDEGR

SEQ ID NO: 3069003 - protein, 28 aa, Giardia lamblia
AFKQYERFLRINIALNMFMNRAVDSLTV

SEQ ID NO: 3069004 - protein, 23 aa, Giardia lamblia
AFLLRTVCTYASAVPTLMPAQCS

SEQ ID NO: 3069005 - protein, 19 aa, Giardia lamblia
AFLNRFALESALFTAGGML

SEQ ID NO: 3069006 - protein, 19 aa, Giardia lamblia
AFLVCIFIAIISGWKAFLF

SEQ ID NO: 3069007 - protein, 17 aa, Giardia lamblia
AFMPCVTPRSYKFLLNL

SEQ ID NO: 3069008 - protein, 23 aa, Giardia lamblia
AFNRCYHETRGVYQSRLDIYNND

SEQ ID NO: 3069009 - protein, 25 aa, Giardia lamblia
AFQTCIRDGTLMPAISLYWSFFYFS

SEQ ID NO: 3069010 - protein, 24 aa, Giardia lamblia
AFRDEVGCLISSTRLLAASAASAS

SEQ ID NO: 3069011 - protein, 18 aa, Giardia lamblia
AFRGLPLDTIKAESVHPR

SEQ ID NO: 3069012 - protein, 24 aa, Giardia lamblia
AFRNMCIGCLVLAIVNAAQVVYNT

SEQ ID NO: 3069013 - protein, 19 aa, Giardia lamblia
AFRTRRLDGVFHLFINQQP

SEQ ID NO: 3069014 - protein, 17 aa, Giardia lamblia
AFRVLFPQLEMFRQAKI

SEQ ID NO: 3069015 - protein, 27 aa, Giardia lamblia
AFRVSKFRRLWHLGREIQVCMERMGSS

SEQ ID NO: 3069016 - protein, 26 aa, Giardia lamblia
AFSAMPFKQMHTAFIDEFIRARGYEL

SEQ ID NO: 3069017 - protein, 36 aa, Giardia lamblia
AFSKPRTGWRKVMLYLLPILIPWNMLVLVLSSLLNI

SEQ ID NO: 3069018 - protein, 23 aa, Giardia lamblia
AFSRLAVHGWPWMVVIIAAPMGV

SEQ ID NO: 3069019 - protein, 21 aa, Giardia lamblia
AFSVLCFVIIPFLILSHSDTK

SEQ ID NO: 3069020 - protein, 24 aa, Giardia lamblia
AFSVLLRLAVTLTITIDPATRHPK

SEQ ID NO: 3069021 - protein, 24 aa, Giardia lamblia
AFTCFPINEFISFLMQNNGVYIGS

SEQ ID NO: 3069022 - protein, 20 aa, Giardia lamblia
AFTFDGAVSNFVGWMIYHFL

SEQ ID NO: 3069023 - protein, 22 aa, Giardia lamblia
AFTGGMCGWTLYDVFRDKSPRL

SEQ ID NO: 3069024 - protein, 19 aa, Giardia lamblia
AFTPYSFGKLIGASAPIND

SEQ ID NO: 3069025 - protein, 19 aa, Giardia lamblia
AFVIRNMFADFELKQKNSY

SEQ ID NO: 3069026 - protein, 19 aa, Giardia lamblia
AFVKEEFLLAIGHLPDCII

SEQ ID NO: 3069027 - protein, 18 aa, Giardia lamblia
AFVKHLIWLFVANVVEFA

SEQ ID NO: 3069028 - protein, 17 aa, Giardia lamblia
AFVSVLIALAFVLGLTR

SEQ ID NO: 3069029 - protein, 32 aa, Giardia lamblia
AFYQLSRWFGFAKCMLRVSVLDARPVQDPSGC

SEQ ID NO: 3069030 - protein, 18 aa, Giardia lamblia
AFYRAFSWIDCLVGAITP

SEQ ID NO: 3069031 - protein, 25 aa, Giardia lamblia
AFYTKFPIEYRIRRLADLLLQCNLI

SEQ ID NO: 3069032 - protein, 19 aa, Giardia lamblia
AGAFFISFVSYIILFSYAL

SEQ ID NO: 3069033 - protein, 17 aa, Giardia lamblia
AGAFSRLAVALKTATEK

SEQ ID NO: 3069034 - protein, 26 aa, Giardia lamblia
AGAHYEALVLICPWLEEIFVTNKFLH

SEQ ID NO: 3069035 - protein, 24 aa, Giardia lamblia
AGALGTSMGYIFSDYTKYSLLFLR

SEQ ID NO: 3069036 - protein, 24 aa, Giardia lamblia
AGCAVCLEGSWKHAPFQDAGVQCT

SEQ ID NO: 3069037 - protein, 21 aa, Giardia lamblia
AGCIQCQRNSYSKGGTSTCQQ

SEQ ID NO: 3069038 - protein, 19 aa, Giardia lamblia
AGDAYKMIVGTYLYKERTA

SEQ ID NO: 3069039 - protein, 25 aa, Giardia lamblia
AGDPEGLAGAFLRVVHQALVLGRLE

SEQ ID NO: 3069040 - protein, 17 aa, Giardia lamblia
AGDRYLVLVSRLHDILG

SEQ ID NO: 3069041 - protein, 18 aa, Giardia lamblia
AGEFKYTGVFANLLCFTC

SEQ ID NO: 3069042 - protein, 24 aa, Giardia lamblia
AGETALMMAARFGFDGIVDLLLDR

SEQ ID NO: 3069043 - protein, 24 aa, Giardia lamblia
AGFGERVLGLAFRIIPDGKRSTTP

SEQ ID NO: 3069044 - protein, 31 aa, Giardia lamblia
AGFLTGYCLRLPIPMSCGRGIQGASGSIISM

SEQ ID NO: 3069045 - protein, 17 aa, Giardia lamblia
AGGALTLAVPKGSLGKG

SEQ ID NO: 3069046 - protein, 26 aa, Giardia lamblia
AGGIMMKLWHKFGLNLSYLSPASDKV

SEQ ID NO: 3069047 - protein, 20 aa, Giardia lamblia
AGGLRRKYGHLTEDVVLIRA

SEQ ID NO: 3069048 - protein, 24 aa, Giardia lamblia
AGGRCTSCAKGYFAQFMADDLNNY

SEQ ID NO: 3069049 - protein, 19 aa, Giardia lamblia
AGGYTYPFLDAGADGSTQI

SEQ ID NO: 3069050 - protein, 24 aa, Giardia lamblia
AGHADCVKLLIDVEAKMQDSSGRT

SEQ ID NO: 3069051 - protein, 19 aa, Giardia lamblia
AGHLMRLIIILFALFGLLT

SEQ ID NO: 3069052 - protein, 23 aa, Giardia lamblia
AGIRGKVCLVTNMGSEIPSFIME

SEQ ID NO: 3069053 - protein, 25 aa, Giardia lamblia
AGKCVACSVLHCLTCDAANTCASCQ

SEQ ID NO: 3069054 - protein, 21 aa, Giardia lamblia
AGKLRAAAFLAEQQRAKGEKV

SEQ ID NO: 3069055 - protein, 24 aa, Giardia lamblia
AGKRLELAALILLKLTGPSFVLGS

SEQ ID NO: 3069056 - protein, 26 aa, Giardia lamblia
AGLAVGRVARRFWVLGALLRVIVDGV

SEQ ID NO: 3069057 - protein, 18 aa, Giardia lamblia
AGLDVGALDSFSIRAESD

SEQ ID NO: 3069058 - protein, 21 aa, Giardia lamblia
AGLKNAFLNKVFAAYDVVLPY

SEQ ID NO: 3069059 - protein, 29 aa, Giardia lamblia
AGLLARRKALLAEWVETIFQYQLDHENQS

SEQ ID NO: 3069060 - protein, 20 aa, Giardia lamblia
AGLLLAAIHAFHFLVVDRAG

SEQ ID NO: 3069061 - protein, 35 aa, Giardia lamblia
AGLLRLCILEVRMLKLGFLPSIVIFFVAAMAVVAV

SEQ ID NO: 3069062 - protein, 25 aa, Giardia lamblia
AGLNHPKMAWGVLVLAIALLTLVIF

SEQ ID NO: 3069063 - protein, 24 aa, Giardia lamblia
AGMDLCVQLLIPWELGMVCSGGKT

SEQ ID NO: 3069064 - protein, 19 aa, Giardia lamblia
AGMGCYRAVHILAPLESGL

SEQ ID NO: 3069065 - protein, 27 aa, Giardia lamblia
AGNEVGRSCFILSYQRSGCSGSIMLDC

SEQ ID NO: 3069066 - protein, 25 aa, Giardia lamblia
AGNKEIVELLAPHECSFIRHDNMCA

SEQ ID NO: 3069067 - protein, 18 aa, Giardia lamblia
AGQKCTNGHCSMRCTNDQ

SEQ ID NO: 3069068 - protein, 27 aa, Giardia lamblia
AGQRLLRRAKLLQVLETLSLHWAAPVF

SEQ ID NO: 3069069 - protein, 17 aa, Giardia lamblia
AGQRLRITTPFKAPNPR

SEQ ID NO: 3069070 - protein, 27 aa, Giardia lamblia
AGQYRLFLKPLYLRRNGPKTTQVAREI

SEQ ID NO: 3069071 - protein, 25 aa, Giardia lamblia
AGRFRKGGSCYSMVDPSKSYLAVDY

SEQ ID NO: 3069072 - protein, 19 aa, Giardia lamblia
AGRILRGLYYVKTLLLAKT

SEQ ID NO: 3069073 - protein, 25 aa, Giardia lamblia
AGRPSCLLAAIYRAVLMAVKQEGLT

SEQ ID NO: 3069074 - protein, 22 aa, Giardia lamblia
AGRPTEFLLFLFFLWASILLIS

SEQ ID NO: 3069075 - protein, 25 aa, Giardia lamblia
AGSCRMGAEVVASWTRAKITLVDEV

SEQ ID NO: 3069076 - protein, 20 aa, Giardia lamblia
AGSGTGMYGVLGFKRDESLS

SEQ ID NO: 3069077 - protein, 21 aa, Giardia lamblia
AGSLCEKCILGASQVVENRCV

SEQ ID NO: 3069078 - protein, 22 aa, Giardia lamblia
AGSLFWRLGTTMSELNNRVGAL

SEQ ID NO: 3069079 - protein, 23 aa, Giardia lamblia
AGTDLSKLLGLCAANSDHRDIAK

SEQ ID NO: 3069080 - protein, 24 aa, Giardia lamblia
AGTHGRISALHAFRDALLQEQKAP

SEQ ID NO: 3069081 - protein, 25 aa, Giardia lamblia
AGTLKLPIISSRTLLGLLIFFVTQS

SEQ ID NO: 3069082 - protein, 23 aa, Giardia lamblia
AGVPGHSAGSLAIHQPRILEPQH

SEQ ID NO: 3069083 - protein, 28 aa, Giardia lamblia
AGVVNKFIRRQVGIFGYIRVGIPDESNN

SEQ ID NO: 3069084 - protein, 24 aa, Giardia lamblia
AGWVQTAGFLKHALLPLSDFNSDV

SEQ ID NO: 3069085 - protein, 17 aa, Giardia lamblia
AGYIFSRDFCDIIIDVI

SEQ ID NO: 3069086 - protein, 22 aa, Giardia lamblia
AHACYTRALALAREDRRLEITI

SEQ ID NO: 3069087 - protein, 24 aa, Giardia lamblia
AHAKHYAHILFGYRFRTADDDAYV

SEQ ID NO: 3069088 - protein, 19 aa, Giardia lamblia
AHALAGLIQHCRAFEKREG

SEQ ID NO: 3069089 - protein, 19 aa, Giardia lamblia
AHALAGLVQHCRAFEKREG

SEQ ID NO: 3069090 - protein, 20 aa, Giardia lamblia
AHATLSWHIITQMAVYFKHF

SEQ ID NO: 3069091 - protein, 23 aa, Giardia lamblia
AHAVVLALLPFFSYETDREGNTA

SEQ ID NO: 3069092 - protein, 17 aa, Giardia lamblia
AHDFKGFLGQDIMSTRA

SEQ ID NO: 3069093 - protein, 26 aa, Giardia lamblia
AHDLLLKRYTKVIAELSELQKVSHGT

SEQ ID NO: 3069094 - protein, 23 aa, Giardia lamblia
AHDSGCFKVVFHPLIADILATSS

SEQ ID NO: 3069095 - protein, 33 aa, Giardia lamblia
AHFQPVEYMRLLLSFFCPYLFYDSTTKKDLQIA

SEQ ID NO: 3069096 - protein, 32 aa, Giardia lamblia
AHGSRLKPWAPFTLEFWGCLATPAPPDSHRPN

SEQ ID NO: 3069097 - protein, 17 aa, Giardia lamblia
AHHKASFANSVPKHLNL

SEQ ID NO: 3069098 - protein, 28 aa, Giardia lamblia
AHIGLRAPESWSQAKINFIKAFVPLKEQ

SEQ ID NO: 3069099 - protein, 25 aa, Giardia lamblia
AHKYKVRLGSFLTVEQVNWLVSILE

SEQ ID NO: 3069100 - protein, 21 aa, Giardia lamblia
AHLHLHCPSQLAVFRAEINEA

SEQ ID NO: 3069101 - protein, 23 aa, Giardia lamblia
AHLKIITISVKWGALSKTCPAFS

SEQ ID NO: 3069102 - protein, 20 aa, Giardia lamblia
AHLLSALSYLHFSYKHGGEV

SEQ ID NO: 3069103 - protein, 19 aa, Giardia lamblia
AHLLYEFASNLSYSNIVES

SEQ ID NO: 3069104 - protein, 26 aa, Giardia lamblia
AHNAAWPALFPMIAHFPFDTKYETRF

SEQ ID NO: 3069105 - protein, 20 aa, Giardia lamblia
AHNYLILSFIEKILNFRRLI

SEQ ID NO: 3069106 - protein, 23 aa, Giardia lamblia
AHPCVYGSALFEVMAYHKLSFAS

SEQ ID NO: 3069107 - protein, 30 aa, Giardia lamblia
AHPEIRSKNLLSILFCEAIALYGVIMSIII

SEQ ID NO: 3069108 - protein, 28 aa, Giardia lamblia
AHPRLCPYIKRLLGPSVTIATFTYGGDP

SEQ ID NO: 3069109 - protein, 24 aa, Giardia lamblia
AHPSAYSRRGAAYLKLKNGALAID

SEQ ID NO: 3069110 - protein, 30 aa, Giardia lamblia
AHRKQLCLLKRACIYIAELKEALHVKSPTE

SEQ ID NO: 3069111 - protein, 24 aa, Giardia lamblia
AHSALGGALVFYVSLSKVEDASMW

SEQ ID NO: 3069112 - protein, 26 aa, Giardia lamblia
AHTRCFNCALQGCLNCDGYDSCEHCD

SEQ ID NO: 3069113 - protein, 18 aa, Giardia lamblia
AHTVPWMAFLEIVRRVSV

SEQ ID NO: 3069114 - protein, 25 aa, Giardia lamblia
AHVARRLWENCILGYLIRQKQKTVL

SEQ ID NO: 3069115 - protein, 25 aa, Giardia lamblia
AHYDVFRMFMELYILIEEIKNVYLR

SEQ ID NO: 3069116 - protein, 17 aa, Giardia lamblia
AIAARYRENNILDDESS

SEQ ID NO: 3069117 - protein, 18 aa, Giardia lamblia
AIADCLWSDPDIKSGWGR

SEQ ID NO: 3069118 - protein, 22 aa, Giardia lamblia
AIAEICGYSLVRINLSEQTDLS

SEQ ID NO: 3069119 - protein, 17 aa, Giardia lamblia
AIALERRLCFDTIIDYY

SEQ ID NO: 3069120 - protein, 18 aa, Giardia lamblia
AIALYGVIMSIIILTAIK

SEQ ID NO: 3069121 - protein, 26 aa, Giardia lamblia
AICAAIGIWKFLSVRKRIVNVKEELQ

SEQ ID NO: 3069122 - protein, 22 aa, Giardia lamblia
AICGLYRRWLQTNKMMHVDEDT

SEQ ID NO: 3069123 - protein, 17 aa, Giardia lamblia
AICYFSLTLTIEFFMPV

SEQ ID NO: 3069124 - protein, 24 aa, Giardia lamblia
AIDSVLLLSRFEPLLPNAYGQTPL

SEQ ID NO: 3069125 - protein, 18 aa, Giardia lamblia
AIEERFTRDWSRSTKCLE

SEQ ID NO: 3069126 - protein, 17 aa, Giardia lamblia
AIERCAAMLRQAIRLRK

SEQ ID NO: 3069127 - protein, 17 aa, Giardia lamblia
AIESNMRDIIGYFSKSM

SEQ ID NO: 3069128 - protein, 18 aa, Giardia lamblia
AIFAEVFYGLAVASETVY

SEQ ID NO: 3069129 - protein, 19 aa, Giardia lamblia
AIFERIRDGNALPLADPSK

SEQ ID NO: 3069130 - protein, 17 aa, Giardia lamblia
AIFLIWKFVIKPRSKSR

SEQ ID NO: 3069131 - protein, 32 aa, Giardia lamblia
AIFYLCKIAYSIRKSFLWELEKRFYTQTFKVF

SEQ ID NO: 3069132 - protein, 18 aa, Giardia lamblia
AIGHCTAFEGTLCTKCAY

SEQ ID NO: 3069133 - protein, 31 aa, Giardia lamblia
AIGPLPADHGKLWLCLAYMHFSVRTNLIRGY

SEQ ID NO: 3069134 - protein, 17 aa, Giardia lamblia
AIHAFHFLVVDRAGAIS

SEQ ID NO: 3069135 - protein, 24 aa, Giardia lamblia
AIIFPAIVILVIIKKNHGIVQHKY

SEQ ID NO: 3069136 - protein, 17 aa, Giardia lamblia
AIIHAIDVALSFLASVG

SEQ ID NO: 3069137 - protein, 18 aa, Giardia lamblia
AIIISSLFGIILVITLIL

SEQ ID NO: 3069138 - protein, 25 aa, Giardia lamblia
AIIMHLVCLPPVFTDIKSPLKRTMV

SEQ ID NO: 3069139 - protein, 17 aa, Giardia lamblia
AIIQAGRQLALRGLQGQ

SEQ ID NO: 3069140 - protein, 19 aa, Giardia lamblia
AIIQCLTMFLAVPALYYIC

SEQ ID NO: 3069141 - protein, 18 aa, Giardia lamblia
AIIRGMHARGHILKEKMH

SEQ ID NO: 3069142 - protein, 18 aa, Giardia lamblia
AIISRCSFGTHGWTSVYS

SEQ ID NO: 3069143 - protein, 22 aa, Giardia lamblia
AIKTRLTVILTLSHPGVLKHHQ

SEQ ID NO: 3069144 - protein, 24 aa, Giardia lamblia
AIKTSNQPSFCWGLREDSIIPPLL

SEQ ID NO: 3069145 - protein, 25 aa, Giardia lamblia
AIKTSNQPSFCWGLREDSIIPPLLD

SEQ ID NO: 3069146 - protein, 17 aa, Giardia lamblia
AILDLLGQITMAEFVRH

SEQ ID NO: 3069147 - protein, 23 aa, Giardia lamblia
AILMGVIIKVHYFYLAQDKTAVD

SEQ ID NO: 3069148 - protein, 23 aa, Giardia lamblia
AILNCRDSSFTICRIISGDLSMQ

SEQ ID NO: 3069149 - protein, 27 aa, Giardia lamblia
AILNCRRCTTAIPIVCLECDTLYALYQ

SEQ ID NO: 3069150 - protein, 28 aa, Giardia lamblia
AIMAEFGPLVPVLGCKPSIAQTNITLDI

SEQ ID NO: 3069151 - protein, 23 aa, Giardia lamblia
AIMKRVKLISVLDYYSMLQGANA

SEQ ID NO: 3069152 - protein, 21 aa, Giardia lamblia
AINLWKASLLHHIMAEHNGIF

SEQ ID NO: 3069153 - protein, 19 aa, Giardia lamblia
AIQACLLKRLSILSLCVSG

SEQ ID NO: 3069154 - protein, 25 aa, Giardia lamblia
AIQKRFTLFFCHLIVAILSIFYFTI

SEQ ID NO: 3069155 - protein, 22 aa, Giardia lamblia
AIQRAFPLVPFRNALLPITLPG

SEQ ID NO: 3069156 - protein, 17 aa, Giardia lamblia
AIQRIVLTTVVKDYDIN

SEQ ID NO: 3069157 - protein, 26 aa, Giardia lamblia
AIRFAGMSLGLPRYVSGGVGRHNVRK

SEQ ID NO: 3069158 - protein, 20 aa, Giardia lamblia
AISLYWSFFYFSLFSLTNNV

SEQ ID NO: 3069159 - protein, 17 aa, Giardia lamblia
AISPNNLRFCFTDDSEI

SEQ ID NO: 3069160 - protein, 22 aa, Giardia lamblia
AISPSGRIAACYTANRVTVYFD

SEQ ID NO: 3069161 - protein, 24 aa, Giardia lamblia
AISQYPRLCFNLLRDANNLKKDSS

SEQ ID NO: 3069162 - protein, 24 aa, Giardia lamblia
AISRVSPSLVKPGSAVTLSAPPNV

SEQ ID NO: 3069163 - protein, 19 aa, Giardia lamblia
AITFLLQHVGMFQLRSSSE

SEQ ID NO: 3069164 - protein, 23 aa, Giardia lamblia
AITKQRIVTTFLRTLMTNLASVF

SEQ ID NO: 3069165 - protein, 18 aa, Giardia lamblia
AITLAFALFTVFVHLFGR

SEQ ID NO: 3069166 - protein, 23 aa, Giardia lamblia
AITLPVHMPFAGVPGHSAGSLAI

SEQ ID NO: 3069167 - protein, 19 aa, Giardia lamblia
AIVALEFESRCRLGLEDTP

SEQ ID NO: 3069168 - protein, 20 aa, Giardia lamblia
AIVALVMNWDAFVFSLFSRR

SEQ ID NO: 3069169 - protein, 17 aa, Giardia lamblia
AIVCFESMCINIIDFMG

SEQ ID NO: 3069170 - protein, 18 aa, Giardia lamblia
AIVFCLVLAIPLLKRKPK

SEQ ID NO: 3069171 - protein, 19 aa, Giardia lamblia
AIVGVLVWKYVCKKKSSKR

SEQ ID NO: 3069172 - protein, 20 aa, Giardia lamblia
AIVKRYIKDAVLRYETAVAD

SEQ ID NO: 3069173 - protein, 26 aa, Giardia lamblia
AIVLVGTILICYYFGIGSTSNRWLTV

SEQ ID NO: 3069174 - protein, 17 aa, Giardia lamblia
AIVNIYLGGSSLYDCSM

SEQ ID NO: 3069175 - protein, 17 aa, Giardia lamblia
AIVPYLIIFLFGLVSFA

SEQ ID NO: 3069176 - protein, 17 aa, Giardia lamblia
AIYLDIAIRISGQIVSP

SEQ ID NO: 3069177 - protein, 24 aa, Giardia lamblia
AKAEPFISSSFCFSIIGSVNDCLV

SEQ ID NO: 3069178 - protein, 18 aa, Giardia lamblia
AKAIKLDAAAAMDALFKI

SEQ ID NO: 3069179 - protein, 22 aa, Giardia lamblia
AKARITRLISIFRSKMKRLSHN

SEQ ID NO: 3069180 - protein, 18 aa, Giardia lamblia
AKASFGISSLKQIPPSII

SEQ ID NO: 3069181 - protein, 24 aa, Giardia lamblia
AKAYRYTCIYNFFIFAQLFNEISS

SEQ ID NO: 3069182 - protein, 22 aa, Giardia lamblia
AKCVPSRCMYRPSAGDPAIECN

SEQ ID NO: 3069183 - protein, 18 aa, Giardia lamblia
AKDLLSRLSGDKKLQRSQ

SEQ ID NO: 3069184 - protein, 23 aa, Giardia lamblia
AKDLSGGMLRRLALANATAGYPA

SEQ ID NO: 3069185 - protein, 23 aa, Giardia lamblia
AKDLYCLLYRNPFLHHLAKGISI

SEQ ID NO: 3069186 - protein, 27 aa, Giardia lamblia
AKDYVILCSILRILEATEGLTYPKALL

SEQ ID NO: 3069187 - protein, 18 aa, Giardia lamblia
AKEALNLVDIADASDDQR

SEQ ID NO: 3069188 - protein, 17 aa, Giardia lamblia
AKERRLLDNNGRTALMY

SEQ ID NO: 3069189 - protein, 25 aa, Giardia lamblia
AKFSLRAHAYRALISLCHALQGSPS

SEQ ID NO: 3069190 - protein, 19 aa, Giardia lamblia
AKGLTGIWATVHAMNDEDH

SEQ ID NO: 3069191 - protein, 17 aa, Giardia lamblia
AKHIHILEAELALERQR

SEQ ID NO: 3069192 - protein, 18 aa, Giardia lamblia
AKHIWGAIYQEAREVLRG

SEQ ID NO: 3069193 - protein, 22 aa, Giardia lamblia
AKHPVLRRSLGFVIVTKNNTLM

SEQ ID NO: 3069194 - protein, 19 aa, Giardia lamblia
AKIAEGFADLVALCSENPE

SEQ ID NO: 3069195 - protein, 23 aa, Giardia lamblia
AKILKSRMLQSSTSFSLGATQTS

SEQ ID NO: 3069196 - protein, 25 aa, Giardia lamblia
AKINHIITYKFAFEVVMRNYSKIDK

SEQ ID NO: 3069197 - protein, 24 aa, Giardia lamblia
AKIRRLEASLATARQCSSSMADTL

SEQ ID NO: 3069198 - protein, 19 aa, Giardia lamblia
AKLDRACTLANILSLPKAI

SEQ ID NO: 3069199 - protein, 20 aa, Giardia lamblia
AKLKAGELVKNEEKTLTLKI

SEQ ID NO: 3069200 - protein, 21 aa, Giardia lamblia
AKLMMNPVLFAFILTAETFDH

SEQ ID NO: 3069201 - protein, 23 aa, Giardia lamblia
AKLPFEKAVKCQATLPKVSILVS

SEQ ID NO: 3069202 - protein, 19 aa, Giardia lamblia
AKLPNMSIANLFFYHCPVD

SEQ ID NO: 3069203 - protein, 23 aa, Giardia lamblia
AKLSVCLIGEAFSGKSTYIRAAE

SEQ ID NO: 3069204 - protein, 22 aa, Giardia lamblia
AKLYCLERPKYFLDPATEVVSW

SEQ ID NO: 3069205 - protein, 18 aa, Giardia lamblia
AKMLSGIPKYNEPIIKFE

SEQ ID NO: 3069206 - protein, 19 aa, Giardia lamblia
AKPGCWDSIVNKTCSGAGQ

SEQ ID NO: 3069207 - protein, 20 aa, Giardia lamblia
AKPLPRARDKFCVGLFHWYS

SEQ ID NO: 3069208 - protein, 20 aa, Giardia lamblia
AKPSLGLCLPIVPKLGSGKM

SEQ ID NO: 3069209 - protein, 17 aa, Giardia lamblia
AKRACPLALAVMNLSRP

SEQ ID NO: 3069210 - protein, 23 aa, Giardia lamblia
AKRLLRLTCYTLFDSTLYPIKDA

SEQ ID NO: 3069211 - protein, 18 aa, Giardia lamblia
AKRWKEWIQHEQPEREKL

SEQ ID NO: 3069212 - protein, 20 aa, Giardia lamblia
AKSGCLPIKHESMMQTLETL

SEQ ID NO: 3069213 - protein, 19 aa, Giardia lamblia
AKSKFRTWQYWKPYVLIAV

SEQ ID NO: 3069214 - protein, 29 aa, Giardia lamblia
AKSLTYYVELVFTLINWYKGAMESIKQEL

SEQ ID NO: 3069215 - protein, 19 aa, Giardia lamblia
AKSTSVCYVVTVIHVLLEF

SEQ ID NO: 3069216 - protein, 18 aa, Giardia lamblia
AKTAPAFCSRADSTDSIE

SEQ ID NO: 3069217 - protein, 18 aa, Giardia lamblia
AKTASFLNASSWNLQLGD

SEQ ID NO: 3069218 - protein, 20 aa, Giardia lamblia
AKTTHVFSCGHVFHHACLNE

SEQ ID NO: 3069219 - protein, 23 aa, Giardia lamblia
AKVITAWKKLLTVSFDIHGLVPV

SEQ ID NO: 3069220 - protein, 21 aa, Giardia lamblia
AKYALSNSISTVFQKLSVTER

SEQ ID NO: 3069221 - protein, 17 aa, Giardia lamblia
AKYPARLLISGYHINNI

SEQ ID NO: 3069222 - protein, 30 aa, Giardia lamblia
ALACVPIGEKLCILQLCLTNSCDGIAEMVA

SEQ ID NO: 3069223 - protein, 25 aa, Giardia lamblia
ALAGYEFLTPLFLFVIGSLFASKVF

SEQ ID NO: 3069224 - protein, 19 aa, Giardia lamblia
ALAHRVICVSRECEDNLRL

SEQ ID NO: 3069225 - protein, 29 aa, Giardia lamblia
ALANFSCICKFFFSEGFSNSIFWSDYDED

SEQ ID NO: 3069226 - protein, 31 aa, Giardia lamblia
ALAQLMLFLITIFKRMPFVLQDLLTYQANAN

SEQ ID NO: 3069227 - protein, 17 aa, Giardia lamblia
ALASPPAIIVYIATKGC

SEQ ID NO: 3069228 - protein, 23 aa, Giardia lamblia
ALCDKAKACRFLVASEKDCLLCD

SEQ ID NO: 3069229 - protein, 17 aa, Giardia lamblia
ALCDPVLLFRLSQSINY

SEQ ID NO: 3069230 - protein, 20 aa, Giardia lamblia
ALCSCFSGTHLAYFNKNIRN

SEQ ID NO: 3069231 - protein, 24 aa, Giardia lamblia
ALDEIMNFLKFLSRSLYALKYQIA

SEQ ID NO: 3069232 - protein, 26 aa, Giardia lamblia
ALDSFSIRAESDMILLDNRMREAPSE

SEQ ID NO: 3069233 - protein, 17 aa, Giardia lamblia
ALDVKRRAYSFDKLEPL

SEQ ID NO: 3069234 - protein, 25 aa, Giardia lamblia
ALEALRTFLGIEFWGTKVLLAVAPR

SEQ ID NO: 3069235 - protein, 20 aa, Giardia lamblia
ALEHFRKNLALLGAGHAQNL

SEQ ID NO: 3069236 - protein, 19 aa, Giardia lamblia
ALEKLRELQAVFELKIQPI

SEQ ID NO: 3069237 - protein, 19 aa, Giardia lamblia
ALEKRCLTDVRLLLEQTAK

SEQ ID NO: 3069238 - protein, 25 aa, Giardia lamblia
ALELELLGRFGILRITEPFMCRFLL

SEQ ID NO: 3069239 - protein, 22 aa, Giardia lamblia
ALEMAICVLLYEIGVLGLQRLA

SEQ ID NO: 3069240 - protein, 21 aa, Giardia lamblia
ALERRTRKLLVIRHSACCFLQ

SEQ ID NO: 3069241 - protein, 19 aa, Giardia lamblia
ALFLAYGFLTGWTLVCFVI

SEQ ID NO: 3069242 - protein, 23 aa, Giardia lamblia
ALFNRWGSGMISTLISSGTRNLQ

SEQ ID NO: 3069243 - protein, 22 aa, Giardia lamblia
ALFQRMLLWRAAVGLQVVSLLY

SEQ ID NO: 3069244 - protein, 17 aa, Giardia lamblia
ALGARIHIHCLFGAEKG

SEQ ID NO: 3069245 - protein, 25 aa, Giardia lamblia
ALGINTRLSLQLSFNLVDKPTEKLQ

SEQ ID NO: 3069246 - protein, 20 aa, Giardia lamblia
ALGLNVCYKYLLRGKLMEIL

SEQ ID NO: 3069247 - protein, 25 aa, Giardia lamblia
ALHCSSCTIINLLYRTSDPVAAHHG

SEQ ID NO: 3069248 - protein, 23 aa, Giardia lamblia
ALHDFLHLYLLKKENALLYFQEA

SEQ ID NO: 3069249 - protein, 20 aa, Giardia lamblia
ALHFRSILFIVIPNLIILLI

SEQ ID NO: 3069250 - protein, 21 aa, Giardia lamblia
ALHKLKIMVGYFTMRHLLVMP

SEQ ID NO: 3069251 - protein, 17 aa, Giardia lamblia
ALHKYSIFISILHHSAA

SEQ ID NO: 3069252 - protein, 24 aa, Giardia lamblia
ALHQFKQHWLIKAANDFLESQHLN

SEQ ID NO: 3069253 - protein, 19 aa, Giardia lamblia
ALHVLHVMYFKRPLNKLSK

SEQ ID NO: 3069254 - protein, 19 aa, Giardia lamblia
ALIHKSYLAVCALYSNPQL

SEQ ID NO: 3069255 - protein, 17 aa, Giardia lamblia
ALIKKSLLAQRLQAEDS

SEQ ID NO: 3069256 - protein, 17 aa, Giardia lamblia
ALIPKAQQVISLKSQQG

SEQ ID NO: 3069257 - protein, 21 aa, Giardia lamblia
ALISFCIKPPVKTVSAHRRSV

SEQ ID NO: 3069258 - protein, 28 aa, Giardia lamblia
ALKLPCMADAATIVWPYCVLLNERTVSI

SEQ ID NO: 3069259 - protein, 20 aa, Giardia lamblia
ALKYSVLIQLGLYLEEEHDA

SEQ ID NO: 3069260 - protein, 17 aa, Giardia lamblia
ALLAVLVLWTLLSNVYK

SEQ ID NO: 3069261 - protein, 19 aa, Giardia lamblia
ALLDLKRLLSITPVVFRIL

SEQ ID NO: 3069262 - protein, 19 aa, Giardia lamblia
ALLDPAAVVHLCKRLACLS

SEQ ID NO: 3069263 - protein, 27 aa, Giardia lamblia
ALLDRVRLQFAGSIEYTCCGELLNMVK

SEQ ID NO: 3069264 - protein, 24 aa, Giardia lamblia
ALLEIQEYILSLLIGITRNNIVAI

SEQ ID NO: 3069265 - protein, 20 aa, Giardia lamblia
ALLLKIGGVYLLDILIHRLC

SEQ ID NO: 3069266 - protein, 18 aa, Giardia lamblia
ALLNSGGYASLVSSSTSA

SEQ ID NO: 3069267 - protein, 24 aa, Giardia lamblia
ALLPIMIKLLQFVRLSIPKTILIV

SEQ ID NO: 3069268 - protein, 23 aa, Giardia lamblia
ALLRCGQCGSTIPHCLDCLDLDN

SEQ ID NO: 3069269 - protein, 17 aa, Giardia lamblia
ALLRQLPQTALTELGSQ

SEQ ID NO: 3069270 - protein, 22 aa, Giardia lamblia
ALLSLFLHKYWMPDAVAHVRQV

SEQ ID NO: 3069271 - protein, 19 aa, Giardia lamblia
ALLSLPFTIVRLGWVVALF

SEQ ID NO: 3069272 - protein, 17 aa, Giardia lamblia
ALLSRPSTGRVNLQNAL

SEQ ID NO: 3069273 - protein, 20 aa, Giardia lamblia
ALLVHFPMFFLPKYLSVRSR

SEQ ID NO: 3069274 - protein, 26 aa, Giardia lamblia
ALLYCIVRRTCRFICDTFVLSYRRTV

SEQ ID NO: 3069275 - protein, 26 aa, Giardia lamblia
ALLYKLYYWSCSDTCCAISTSGDMFL

SEQ ID NO: 3069276 - protein, 17 aa, Giardia lamblia
ALLYLLSQERPVYDRIE

SEQ ID NO: 3069277 - protein, 21 aa, Giardia lamblia
ALMALVLHWLLFYILNANLIA

SEQ ID NO: 3069278 - protein, 20 aa, Giardia lamblia
ALMIACRFRNYHAANILVKY

SEQ ID NO: 3069279 - protein, 24 aa, Giardia lamblia
ALMRRAPMRFLIGLLTCAASFVPV

SEQ ID NO: 3069280 - protein, 25 aa, Giardia lamblia
ALMSSFLFRIHSVGYAFLSMLATIV

SEQ ID NO: 3069281 - protein, 21 aa, Giardia lamblia
ALNAYGYRGGYRNLMNLSDPS

SEQ ID NO: 3069282 - protein, 38 aa, Giardia lamblia
ALNKYTANDCFLSFLILAAEYKYIWSNTVYLKARSSYA

SEQ ID NO: 3069283 - protein, 25 aa, Giardia lamblia
ALNLDKCRITSCLAGWETGAESMQL

SEQ ID NO: 3069284 - protein, 25 aa, Giardia lamblia
ALNTPRCALLYHCLNHYCIIVGYII

SEQ ID NO: 3069285 - protein, 24 aa, Giardia lamblia
ALNTYLYIEFCRLLQRQMTFLLFL

SEQ ID NO: 3069286 - protein, 21 aa, Giardia lamblia
ALPDFYICDVLATKDTLAILS

SEQ ID NO: 3069287 - protein, 32 aa, Giardia lamblia
ALPEESLAHWAFRPELYVNLGVTSTILQIINE

SEQ ID NO: 3069288 - protein, 26 aa, Giardia lamblia
ALPHELFIRVCLRSHINISKEVLCQF

SEQ ID NO: 3069289 - protein, 19 aa, Giardia lamblia
ALPSIKMPFTASVEIFSND

SEQ ID NO: 3069290 - protein, 21 aa, Giardia lamblia
ALPYICGFLLEGLAFIGDYNL

SEQ ID NO: 3069291 - protein, 24 aa, Giardia lamblia
ALQAELGLSFGISVSCPHIVPPSN

SEQ ID NO: 3069292 - protein, 19 aa, Giardia lamblia
ALQGHAFEGEMSRMEKGSV

SEQ ID NO: 3069293 - protein, 28 aa, Giardia lamblia
ALQMGLRRLRFISSLFYILVLHYFDQAT

SEQ ID NO: 3069294 - protein, 17 aa, Giardia lamblia
ALQMMRIPFIKKLQETR

SEQ ID NO: 3069295 - protein, 39 aa, Giardia lamblia
ALQPGMPLCTILFVMGCLLPPVLWLVGPILSASPTVHPD

SEQ ID NO: 3069296 - protein, 18 aa, Giardia lamblia
ALQRVRRSLLEKGPITKT

SEQ ID NO: 3069297 - protein, 24 aa, Giardia lamblia
ALSDSILWYLLSDMVSRFLGGTLD

SEQ ID NO: 3069298 - protein, 24 aa, Giardia lamblia
ALSECGRSVVAKPYMDIFDPVSRS

SEQ ID NO: 3069299 - protein, 23 aa, Giardia lamblia
ALSEYKRPTFIRQILTCLYKQWL

SEQ ID NO: 3069300 - protein, 18 aa, Giardia lamblia
ALSFAFALLHYAFCQKLP

SEQ ID NO: 3069301 - protein, 24 aa, Giardia lamblia
ALSIGFPIVILFSAIFNTATICAL

SEQ ID NO: 3069302 - protein, 25 aa, Giardia lamblia
ALSILPRFFGFYDYVYIKPDFTSVI

SEQ ID NO: 3069303 - protein, 31 aa, Giardia lamblia
ALSLRLEPGTGWSGLQFLDFFSVKDGEAYHL

SEQ ID NO: 3069304 - protein, 32 aa, Giardia lamblia
ALSNSFKCIRITASICLSGFMIGLSSTSTASS

SEQ ID NO: 3069305 - protein, 24 aa, Giardia lamblia
ALSRRVYEVPLWPGTDASDVLSML

SEQ ID NO: 3069306 - protein, 27 aa, Giardia lamblia
ALSSQFGRLNLALIRFLQPGPATTGYW

SEQ ID NO: 3069307 - protein, 24 aa, Giardia lamblia
ALSWNSERTYFWILAQFITGKGMS

SEQ ID NO: 3069308 - protein, 18 aa, Giardia lamblia
ALTELSVLLIIILVVAII

SEQ ID NO: 3069309 - protein, 19 aa, Giardia lamblia
ALTGPSGLLVRVSSKLLAM

SEQ ID NO: 3069310 - protein, 19 aa, Giardia lamblia
ALTKVFSVGLLIRCLFAGV

SEQ ID NO: 3069311 - protein, 26 aa, Giardia lamblia
ALTSRYIKRDIVFIVHPSKLRTQSAR

SEQ ID NO: 3069312 - protein, 21 aa, Giardia lamblia
ALVAAFCLSSFLLHVYGDEAQ

SEQ ID NO: 3069313 - protein, 25 aa, Giardia lamblia
ALVARASAPVSYWVDKVLLNMRPRG

SEQ ID NO: 3069314 - protein, 17 aa, Giardia lamblia
ALVKILVALLNYGLSLC

SEQ ID NO: 3069315 - protein, 26 aa, Giardia lamblia
ALVPFYPGKGALYFTKVCMLLGSKQL

SEQ ID NO: 3069316 - protein, 17 aa, Giardia lamblia
ALVTISLVLNNLGYVGT

SEQ ID NO: 3069317 - protein, 18 aa, Giardia lamblia
ALYFISSYSRIRGCFHRE

SEQ ID NO: 3069318 - protein, 25 aa, Giardia lamblia
ALYRLYSCNMFGPIEKLRILNLSMY

SEQ ID NO: 3069319 - protein, 17 aa, Giardia lamblia
ALYRTSDRQELEACFRL

SEQ ID NO: 3069320 - protein, 17 aa, Giardia lamblia
ALYYFLFQFQKKSICAI

SEQ ID NO: 3069321 - protein, 19 aa, Giardia lamblia
AMCDKCWRFMELAVPLLIL

SEQ ID NO: 3069322 - protein, 17 aa, Giardia lamblia
AMCRAPISLSSGLTPVY

SEQ ID NO: 3069323 - protein, 24 aa, Giardia lamblia
AMDKLDLFSLFQLSDCKLPTEVVL

SEQ ID NO: 3069324 - protein, 25 aa, Giardia lamblia
AMDYDIGWTVWPLALTVTVGILVTV

SEQ ID NO: 3069325 - protein, 20 aa, Giardia lamblia
AMFCKIPVVLFSVFSPIFNQ

SEQ ID NO: 3069326 - protein, 29 aa, Giardia lamblia
AMFPGFSLAAMMCLRPAKYTINIANGTLQ

SEQ ID NO: 3069327 - protein, 18 aa, Giardia lamblia
AMHAILILQMIFIVPLCN

SEQ ID NO: 3069328 - protein, 17 aa, Giardia lamblia
AMIDKKLLLYILFTLIY

SEQ ID NO: 3069329 - protein, 28 aa, Giardia lamblia
AMISGLSMCTWVIIKTHRLRSLKRKIIT

SEQ ID NO: 3069330 - protein, 20 aa, Giardia lamblia
AMMVIFDIWLRACTAKQGNI

SEQ ID NO: 3069331 - protein, 19 aa, Giardia lamblia
AMQVSYDFGKLVMAGSIKR

SEQ ID NO: 3069332 - protein, 24 aa, Giardia lamblia
AMRKLCLKTSLSVSRAARDTVDDP

SEQ ID NO: 3069333 - protein, 17 aa, Giardia lamblia
AMTSSVHSLTTWNNNTL

SEQ ID NO: 3069334 - protein, 23 aa, Giardia lamblia
AMVCKTGLRDSKYISLSISSETH

SEQ ID NO: 3069335 - protein, 19 aa, Giardia lamblia
AMVRHLRIMLLFPTEIIRR

SEQ ID NO: 3069336 - protein, 24 aa, Giardia lamblia
ANACLFCSMSPESKKVVIQYHSVY

SEQ ID NO: 3069337 - protein, 23 aa, Giardia lamblia
ANAGPCADILYPVEKYSSNVTSL

SEQ ID NO: 3069338 - protein, 20 aa, Giardia lamblia
ANAHSRCLLCKAKEIHNRLI

SEQ ID NO: 3069339 - protein, 17 aa, Giardia lamblia
ANALVYLGSTLDENALY

SEQ ID NO: 3069340 - protein, 17 aa, Giardia lamblia
ANAPLVFLSSNTPLGGE

SEQ ID NO: 3069341 - protein, 19 aa, Giardia lamblia
ANAPPDCQELLQALLSCRL

SEQ ID NO: 3069342 - protein, 22 aa, Giardia lamblia
ANARGGAEITNRMIKCERIIKI

SEQ ID NO: 3069343 - protein, 21 aa, Giardia lamblia
ANCARDVDDLISLALELATSG

SEQ ID NO: 3069344 - protein, 25 aa, Giardia lamblia
ANFIIRFLRHPNCFDDLACYDNLVS

SEQ ID NO: 3069345 - protein, 18 aa, Giardia lamblia
ANFLPEILTTYSMARFGC

SEQ ID NO: 3069346 - protein, 24 aa, Giardia lamblia
ANGGFPLFKSVLFGAKRQATIPDT

SEQ ID NO: 3069347 - protein, 27 aa, Giardia lamblia
ANGHIYRLYGLDFIRISVDGSVHIEPD

SEQ ID NO: 3069348 - protein, 26 aa, Giardia lamblia
ANGVCTRCAAGFFLFMGGCYDVSKAP

SEQ ID NO: 3069349 - protein, 17 aa, Giardia lamblia
ANICLRTTSGLSLHLPV

SEQ ID NO: 3069350 - protein, 19 aa, Giardia lamblia
ANISRLEFFKDLQKIPKLK

SEQ ID NO: 3069351 - protein, 25 aa, Giardia lamblia
ANIYCDRGRDCLMIAAKSVSVESLS

SEQ ID NO: 3069352 - protein, 25 aa, Giardia lamblia
ANLEYRINFLFLIFIVGIIQIMLTS

SEQ ID NO: 3069353 - protein, 24 aa, Giardia lamblia
ANLFSMTLGNRFLLNNRFTNLSCP

SEQ ID NO: 3069354 - protein, 23 aa, Giardia lamblia
ANLISGLFCIGRDHTHTEGDLEG

SEQ ID NO: 3069355 - protein, 25 aa, Giardia lamblia
ANLLEFLSLPLLEHVIYVDISQRDV

SEQ ID NO: 3069356 - protein, 22 aa, Giardia lamblia
ANLLRYRIQVSRMLFANQGLLP

SEQ ID NO: 3069357 - protein, 18 aa, Giardia lamblia
ANLTFKYTFFSTEKHYIP

SEQ ID NO: 3069358 - protein, 23 aa, Giardia lamblia
ANLYPALFCEYVLVQLPDAYKDE

SEQ ID NO: 3069359 - protein, 19 aa, Giardia lamblia
ANMKLHHGTGVIVLTPTRE

SEQ ID NO: 3069360 - protein, 18 aa, Giardia lamblia
ANMNAGGVLTTYRNDYDP

SEQ ID NO: 3069361 - protein, 17 aa, Giardia lamblia
ANNTISFCKAIHNTMAA

SEQ ID NO: 3069362 - protein, 30 aa, Giardia lamblia
ANPFLFWELLKLLVLSSINLRRVTGPKAEF

SEQ ID NO: 3069363 - protein, 23 aa, Giardia lamblia
ANQAYRYACEDIYVALQRPVMLN

SEQ ID NO: 3069364 - protein, 18 aa, Giardia lamblia
ANRLIAIGFLADSELVAS

SEQ ID NO: 3069365 - protein, 20 aa, Giardia lamblia
ANRTSTAWNSKSFAVIITPV

SEQ ID NO: 3069366 - protein, 17 aa, Giardia lamblia
ANSCHKGSVALDKVGTK

SEQ ID NO: 3069367 - protein, 22 aa, Giardia lamblia
ANSPALPARRSHLVQTIASNAR

SEQ ID NO: 3069368 - protein, 18 aa, Giardia lamblia
ANSYVCVLHHSLPEQEGY

SEQ ID NO: 3069369 - protein, 19 aa, Giardia lamblia
ANVLKQAFCIPLRSIMVMC

SEQ ID NO: 3069370 - protein, 24 aa, Giardia lamblia
ANYLLPFVVIVPMTIISARVAREY

SEQ ID NO: 3069371 - protein, 24 aa, Giardia lamblia
APAWFEFLLFLFLALMVILGGFGI

SEQ ID NO: 3069372 - protein, 22 aa, Giardia lamblia
APDFRGACTPCMGGRTGENCEY

SEQ ID NO: 3069373 - protein, 24 aa, Giardia lamblia
APEAIESWISWVCCELQEIHGIKS

SEQ ID NO: 3069374 - protein, 17 aa, Giardia lamblia
APEKLGLIGQPSIGIDG

SEQ ID NO: 3069375 - protein, 21 aa, Giardia lamblia
APENAVEFWGRYVCNEDSVLS

SEQ ID NO: 3069376 - protein, 26 aa, Giardia lamblia
APESLRAGLTPTICPEAIFVVHDSCA

SEQ ID NO: 3069377 - protein, 25 aa, Giardia lamblia
APESYRFSWQDLKASLGGLYEEPIL

SEQ ID NO: 3069378 - protein, 24 aa, Giardia lamblia
APETFLDNHLGCFQSIVHSLLSTV

SEQ ID NO: 3069379 - protein, 24 aa, Giardia lamblia
APEYCAAPSSLALHCTVGRDAAWQ

SEQ ID NO: 3069380 - protein, 20 aa, Giardia lamblia
APFSYARASFKVDYEESAEL

SEQ ID NO: 3069381 - protein, 19 aa, Giardia lamblia
APGALEFLRRRPLERQSGR

SEQ ID NO: 3069382 - protein, 19 aa, Giardia lamblia
APGDLCSSYLCSRAAGRAK

SEQ ID NO: 3069383 - protein, 18 aa, Giardia lamblia
APGGWSYTILERFPRARG

SEQ ID NO: 3069384 - protein, 20 aa, Giardia lamblia
APGMLRNILIVAFYQIAVIL

SEQ ID NO: 3069385 - protein, 28 aa, Giardia lamblia
APIPIWTIKAHKDWVTCLCLDTVTSNNS

SEQ ID NO: 3069386 - protein, 25 aa, Giardia lamblia
APKDKYRLVKRLKHYNHTVAATGDG

SEQ ID NO: 3069387 - protein, 25 aa, Giardia lamblia
APKSTGSVCKLMWSDYTERGKLFSE

SEQ ID NO: 3069388 - protein, 17 aa, Giardia lamblia
APLERRINDKFDDDCLI

SEQ ID NO: 3069389 - protein, 23 aa, Giardia lamblia
APLLRGWRILTLQAQRWHRTVIY

SEQ ID NO: 3069390 - protein, 17 aa, Giardia lamblia
APLPYRFKSNAEFMEYV

SEQ ID NO: 3069391 - protein, 17 aa, Giardia lamblia
APLQRHKIHVERFFLPF

SEQ ID NO: 3069392 - protein, 25 aa, Giardia lamblia
APLRLPEAFHPEGLCEAYGACDTSE

SEQ ID NO: 3069393 - protein, 20 aa, Giardia lamblia
APLRMHLGSALTAISTTSLP

SEQ ID NO: 3069394 - protein, 17 aa, Giardia lamblia
APMRARTGVIFQAAGIV

SEQ ID NO: 3069395 - protein, 28 aa, Giardia lamblia
APPEPLWNLAYAEFWDVFLSHDVADALD

SEQ ID NO: 3069396 - protein, 17 aa, Giardia lamblia
APPTCFIDLHSQPFATK

SEQ ID NO: 3069397 - protein, 20 aa, Giardia lamblia
APQKVRYELIGTISQDCLAV

SEQ ID NO: 3069398 - protein, 19 aa, Giardia lamblia
APRRRKHFDKKIIPDNINT

SEQ ID NO: 3069399 - protein, 17 aa, Giardia lamblia
APSCQFGSINVVIAQDS

SEQ ID NO: 3069400 - protein, 19 aa, Giardia lamblia
APSGVPCILALDSSSTELR

SEQ ID NO: 3069401 - protein, 17 aa, Giardia lamblia
APSLMRGVFSHKDIELI

SEQ ID NO: 3069402 - protein, 20 aa, Giardia lamblia
APSLRLPYLASSTEPMELSA

SEQ ID NO: 3069403 - protein, 35 aa, Giardia lamblia
APTLEGILFKCFRKTRVPQDLVFKMTERQLINRAS

SEQ ID NO: 3069404 - protein, 18 aa, Giardia lamblia
APTVKRSKSALLFSLLRI

SEQ ID NO: 3069405 - protein, 26 aa, Giardia lamblia
APVFKIYSDMYWELRVDIYQSVLGNI

SEQ ID NO: 3069406 - protein, 24 aa, Giardia lamblia
APVLAEIKGCWCEDISLQANYENL

SEQ ID NO: 3069407 - protein, 35 aa, Giardia lamblia
APVLTFLLLWGIFYSRLDYPLLPGKGTKYAVPALP

SEQ ID NO: 3069408 - protein, 26 aa, Giardia lamblia
APYLLDQLFFYQAFTSFWKVVYLNMH

SEQ ID NO: 3069409 - protein, 20 aa, Giardia lamblia
APYTRTAMRRAVAKGLTHKM

SEQ ID NO: 3069410 - protein, 21 aa, Giardia lamblia
AQALHKYTIIFALSQGMSLGD

SEQ ID NO: 3069411 - protein, 28 aa, Giardia lamblia
AQALKYISYWPVIAIFMASCLVLLATGP

SEQ ID NO: 3069412 - protein, 22 aa, Giardia lamblia
AQARAFLGHFFHAYIGLVHQEL

SEQ ID NO: 3069413 - protein, 23 aa, Giardia lamblia
AQDLYRYGIHTCPFPYICKCGKT

SEQ ID NO: 3069414 - protein, 17 aa, Giardia lamblia
AQDRCILLGSDQLCTQC

SEQ ID NO: 3069415 - protein, 20 aa, Giardia lamblia
AQGYRILSFAYRELESSDET

SEQ ID NO: 3069416 - protein, 23 aa, Giardia lamblia
AQHKCYFLPHIAFNIRHIKPEAL

SEQ ID NO: 3069417 - protein, 18 aa, Giardia lamblia
AQIIGFNLAIKRFRRAKQ

SEQ ID NO: 3069418 - protein, 22 aa, Giardia lamblia
AQLICCPLLLWASEFIGRRIIM

SEQ ID NO: 3069419 - protein, 22 aa, Giardia lamblia
AQLLSLVHRNHMLWKRDLDAAL

SEQ ID NO: 3069420 - protein, 27 aa, Giardia lamblia
AQLQELREVLGWSEGQACQSAYSLSME

SEQ ID NO: 3069421 - protein, 23 aa, Giardia lamblia
AQLRECLFCLTKEEIGQEYAYLG

SEQ ID NO: 3069422 - protein, 17 aa, Giardia lamblia
AQLSLKSMEEGSSTQQV

SEQ ID NO: 3069423 - protein, 20 aa, Giardia lamblia
AQNCFAGLLSRYRHRISPTL

SEQ ID NO: 3069424 - protein, 24 aa, Giardia lamblia
AQNELRRRLPLFLYTPPADGKEKP

SEQ ID NO: 3069425 - protein, 17 aa, Giardia lamblia
AQNIFRIISALASIENL

SEQ ID NO: 3069426 - protein, 18 aa, Giardia lamblia
AQPKRKSAPSSRRHSAAS

SEQ ID NO: 3069427 - protein, 28 aa, Giardia lamblia
AQRIITLYLFCLWLFIKHLKKDDPETLA

SEQ ID NO: 3069428 - protein, 17 aa, Giardia lamblia
AQRIYKKKSVIISLGNF

SEQ ID NO: 3069429 - protein, 25 aa, Giardia lamblia
AQSEARLSQYFEVHRNELALITNEV

SEQ ID NO: 3069430 - protein, 17 aa, Giardia lamblia
AQSRLESLYGTAYRLPA

SEQ ID NO: 3069431 - protein, 21 aa, Giardia lamblia
ARAAVPAVIGFLKILVVPVVI

SEQ ID NO: 3069432 - protein, 19 aa, Giardia lamblia
ARADKLLPCQLQVDLSSIV

SEQ ID NO: 3069433 - protein, 26 aa, Giardia lamblia
ARAHLYLYICMIVMPVVVMAAVALFF

SEQ ID NO: 3069434 - protein, 32 aa, Giardia lamblia
ARAKRLVFYFLTSIRLIYAFGSSFLLFYNAIQ

SEQ ID NO: 3069435 - protein, 25 aa, Giardia lamblia
ARALFKKMLRSIFRSPMSFFDTTPT

SEQ ID NO: 3069436 - protein, 18 aa, Giardia lamblia
ARASSALHVPDVCKETET

SEQ ID NO: 3069437 - protein, 24 aa, Giardia lamblia
ARCFSDQYLGLWSFTIAKDRHLKS

SEQ ID NO: 3069438 - protein, 23 aa, Giardia lamblia
ARCKARDQLQLKYDQAMQHADFF

SEQ ID NO: 3069439 - protein, 20 aa, Giardia lamblia
ARCQKCITGYRLSEDGSTCS

SEQ ID NO: 3069440 - protein, 23 aa, Giardia lamblia
ARDLASRARKEECAHKLGKAIVS

SEQ ID NO: 3069441 - protein, 20 aa, Giardia lamblia
ARDTVTCGGVFGHVFSSLDR

SEQ ID NO: 3069442 - protein, 29 aa, Giardia lamblia
ARDWSISRNRFWGCPIPIWMSADKTQLKV

SEQ ID NO: 3069443 - protein, 21 aa, Giardia lamblia
AREFTKLLVFMVSIFYLSMPM

SEQ ID NO: 3069444 - protein, 20 aa, Giardia lamblia
AREVSLMLLAEMSLCTDFWK

SEQ ID NO: 3069445 - protein, 38 aa, Giardia lamblia
ARFKTRCAGCSLCCNGCVVCWVSLFLMLFGIVAVVLQK

SEQ ID NO: 3069446 - protein, 17 aa, Giardia lamblia
ARFRSACASVVKRLTAN

SEQ ID NO: 3069447 - protein, 17 aa, Giardia lamblia
ARFRSAIRPGLLLEQCR

SEQ ID NO: 3069448 - protein, 17 aa, Giardia lamblia
ARFSYNLYNNGIYSSYE

SEQ ID NO: 3069449 - protein, 18 aa, Giardia lamblia
ARFYLKLKHRCKSTTAPV

SEQ ID NO: 3069450 - protein, 20 aa, Giardia lamblia
ARGAFARGPIMKWLVDSINL

SEQ ID NO: 3069451 - protein, 17 aa, Giardia lamblia
ARGGTCVQNATGAWTCQ

SEQ ID NO: 3069452 - protein, 21 aa, Giardia lamblia
ARHEIAIALFAHMHVLAVSKG

SEQ ID NO: 3069453 - protein, 41 aa, Giardia lamblia
ARIAAQIKMVLSYMLFKSAFCDEFKYLFLDFYNSYGSDFAK

SEQ ID NO: 3069454 - protein, 17 aa, Giardia lamblia
ARIAEGFSLESELAQDL

SEQ ID NO: 3069455 - protein, 20 aa, Giardia lamblia
ARIKTIVSFTELLTVTSVAL

SEQ ID NO: 3069456 - protein, 18 aa, Giardia lamblia
ARILKYLILTQVIITYTV

SEQ ID NO: 3069457 - protein, 21 aa, Giardia lamblia
ARIRTRLRLLQSRAERAILIA

SEQ ID NO: 3069458 - protein, 21 aa, Giardia lamblia
ARISKLVSRSNFQIMVSTMLI

SEQ ID NO: 3069459 - protein, 25 aa, Giardia lamblia
ARISMLRLPALCSVPIPECVARSPT

SEQ ID NO: 3069460 - protein, 19 aa, Giardia lamblia
ARITCGYGLTETCASGLCQ

SEQ ID NO: 3069461 - protein, 21 aa, Giardia lamblia
ARITCGYGLTETCLVGLRVLP

SEQ ID NO: 3069462 - protein, 19 aa, Giardia lamblia
ARIVLYFVMPLAWVTTQSR

SEQ ID NO: 3069463 - protein, 27 aa, Giardia lamblia
ARKKSGCWRRTTTCYYILQDLLFITFV

SEQ ID NO: 3069464 - protein, 22 aa, Giardia lamblia
ARKLRHWDKAFEFLKSALESKA

SEQ ID NO: 3069465 - protein, 24 aa, Giardia lamblia
ARKRMSIVLCEEGIEPSEHFTSMI

SEQ ID NO: 3069466 - protein, 29 aa, Giardia lamblia
ARKRQWKMRWCKKLTYIIIGVDYGLLLTY

SEQ ID NO: 3069467 - protein, 19 aa, Giardia lamblia
ARLDLDYLVKRIHTYILDQ

SEQ ID NO: 3069468 - protein, 17 aa, Giardia lamblia
ARLEIAATYEFVCSLSN

SEQ ID NO: 3069469 - protein, 20 aa, Giardia lamblia
ARLIDCFNTIYLARGSFPIV

SEQ ID NO: 3069470 - protein, 17 aa, Giardia lamblia
ARLPVRIPDTYPVSKGT

SEQ ID NO: 3069471 - protein, 22 aa, Giardia lamblia
ARLQMPAFKKWYFSEREKFTDL

SEQ ID NO: 3069472 - protein, 22 aa, Giardia lamblia
ARLSHTPSWRMFLLVVDSFARF

SEQ ID NO: 3069473 - protein, 21 aa, Giardia lamblia
ARLSMNVFLLSGYVYNQLSES

SEQ ID NO: 3069474 - protein, 20 aa, Giardia lamblia
ARLSRIATCQIVVTRGASPA

SEQ ID NO: 3069475 - protein, 21 aa, Giardia lamblia
ARLSRIATCQIVVTRGASPAP

SEQ ID NO: 3069476 - protein, 18 aa, Giardia lamblia
ARNQFKRAAGIIPSVNEI

SEQ ID NO: 3069477 - protein, 24 aa, Giardia lamblia
ARNRRLLSMRARYSKLLGAYNALA

SEQ ID NO: 3069478 - protein, 17 aa, Giardia lamblia
ARNVSSLGLIILNDLDP

SEQ ID NO: 3069479 - protein, 22 aa, Giardia lamblia
ARPDYLCVYQLTDFVRLADASA

SEQ ID NO: 3069480 - protein, 20 aa, Giardia lamblia
ARPSNILFAKVFISNYASIV

SEQ ID NO: 3069481 - protein, 20 aa, Giardia lamblia
ARQLHEIRSTISPNVISQLQ

SEQ ID NO: 3069482 - protein, 22 aa, Giardia lamblia
ARRCEFCRGGSYFLHEGGCYNV

SEQ ID NO: 3069483 - protein, 19 aa, Giardia lamblia
ARRLMDMSVYVSTFSATSK

SEQ ID NO: 3069484 - protein, 19 aa, Giardia lamblia
ARSAAEYIKRFPARTPLSA

SEQ ID NO: 3069485 - protein, 26 aa, Giardia lamblia
ARSRRSTRILLMISEYVSTHGLFTVP

SEQ ID NO: 3069486 - protein, 20 aa, Giardia lamblia
ARTAYGLSLTFGILSCISFS

SEQ ID NO: 3069487 - protein, 20 aa, Giardia lamblia
ARTLSNLRHIVWADYITVTA

SEQ ID NO: 3069488 - protein, 25 aa, Giardia lamblia
ARTQKKVICDWSLLQASLDRVFFNV

SEQ ID NO: 3069489 - protein, 20 aa, Giardia lamblia
ARVAMLSNYACRSSIYSFLK

SEQ ID NO: 3069490 - protein, 17 aa, Giardia lamblia
ARVCACGSHIPFPSQEF

SEQ ID NO: 3069491 - protein, 25 aa, Giardia lamblia
ARVPTYIFPLGWNLMLLLNIQFDTA

SEQ ID NO: 3069492 - protein, 20 aa, Giardia lamblia
ARYCSRCSQGFFPLDGRCVS

SEQ ID NO: 3069493 - protein, 25 aa, Giardia lamblia
ARYGCREVVGVLKGHEARIYCDTHW

SEQ ID NO: 3069494 - protein, 20 aa, Giardia lamblia
ARYKQVCKPLKTEATQQGRT

SEQ ID NO: 3069495 - protein, 17 aa, Giardia lamblia
ARYLMAIHRGIPILTET

SEQ ID NO: 3069496 - protein, 18 aa, Giardia lamblia
ARYTRIGIVLKDLQSLVL

SEQ ID NO: 3069497 - protein, 24 aa, Giardia lamblia
ASAFSGTLFSIFLILSGSLSMYPN

SEQ ID NO: 3069498 - protein, 21 aa, Giardia lamblia
ASALFPLPILTYLLAQMYIKV

SEQ ID NO: 3069499 - protein, 18 aa, Giardia lamblia
ASALLLFLIVRYSPSNAL

SEQ ID NO: 3069500 - protein, 21 aa, Giardia lamblia
ASALPIPLRFSGANKTLQQFV

SEQ ID NO: 3069501 - protein, 20 aa, Giardia lamblia
ASARCLFVAPLQRTTFQHVC

SEQ ID NO: 3069502 - protein, 17 aa, Giardia lamblia
ASARVAMLSNYACRSSI

SEQ ID NO: 3069503 - protein, 17 aa, Giardia lamblia
ASASLLLATPVVAAIRR

SEQ ID NO: 3069504 - protein, 19 aa, Giardia lamblia
ASCGAKAFLYKGGCYSNET

SEQ ID NO: 3069505 - protein, 20 aa, Giardia lamblia
ASCGAKAFLYKGGCYSNETS

SEQ ID NO: 3069506 - protein, 17 aa, Giardia lamblia
ASCITELNEYFSTLGED

SEQ ID NO: 3069507 - protein, 19 aa, Giardia lamblia
ASCMEEFNSLVVLDHLGQL

SEQ ID NO: 3069508 - protein, 17 aa, Giardia lamblia
ASCPAAIFRVYDSGAAD

SEQ ID NO: 3069509 - protein, 25 aa, Giardia lamblia
ASCPTSFRCSPTVVYSWKLFSLLSI

SEQ ID NO: 3069510 - protein, 27 aa, Giardia lamblia
ASCRALTLPYPMDWTIGQPFDRHFPLS

SEQ ID NO: 3069511 - protein, 17 aa, Giardia lamblia
ASCSARGLSSMKNSYYL

SEQ ID NO: 3069512 - protein, 20 aa, Giardia lamblia
ASDFSRYFVDALCKRILWNI

SEQ ID NO: 3069513 - protein, 23 aa, Giardia lamblia
ASDLPFHLRLNLRNMELVTIVLM

SEQ ID NO: 3069514 - protein, 23 aa, Giardia lamblia
ASDSFWECFERPYSRPWNWTFPL

SEQ ID NO: 3069515 - protein, 21 aa, Giardia lamblia
ASDTGIWIADWLKDTHSTSII

SEQ ID NO: 3069516 - protein, 26 aa, Giardia lamblia
ASEFDFRMMTNYAFPSNGLASPIDEV

SEQ ID NO: 3069517 - protein, 31 aa, Giardia lamblia
ASEGLRSSLALVFWLFSWVWILLLLVFAVVI

SEQ ID NO: 3069518 - protein, 20 aa, Giardia lamblia
ASEIITALVPFYPGKGALYF

SEQ ID NO: 3069519 - protein, 31 aa, Giardia lamblia
ASFGGYKLYGGRALIKLLLRVPSSGMEYTLG

SEQ ID NO: 3069520 - protein, 26 aa, Giardia lamblia
ASFLAEYLLYVSFRVHNRLVFERFDI

SEQ ID NO: 3069521 - protein, 20 aa, Giardia lamblia
ASFTAKFARQLHEIRSTISP

SEQ ID NO: 3069522 - protein, 26 aa, Giardia lamblia
ASGDSRSFLLWPIAMLGSRRIFCINE

SEQ ID NO: 3069523 - protein, 23 aa, Giardia lamblia
ASGELRKTCVLEKCISSKDKDVP

SEQ ID NO: 3069524 - protein, 17 aa, Giardia lamblia
ASGFSARTSLYKPEIYT

SEQ ID NO: 3069525 - protein, 19 aa, Giardia lamblia
ASGLCQLPHMPYVGSPTGS

SEQ ID NO: 3069526 - protein, 32 aa, Giardia lamblia
ASGTRFSESTIWRLAYGILKALAFMHTPSSSV

SEQ ID NO: 3069527 - protein, 21 aa, Giardia lamblia
ASHGCRGCSSAGLEMDSKGEP

SEQ ID NO: 3069528 - protein, 18 aa, Giardia lamblia
ASHVLSAVGTFFGNTASE

SEQ ID NO: 3069529 - protein, 17 aa, Giardia lamblia
ASILLPCFSDARSQHIL

SEQ ID NO: 3069530 - protein, 19 aa, Giardia lamblia
ASILVLRIISSIGLAMMLS

SEQ ID NO: 3069531 - protein, 20 aa, Giardia lamblia
ASKLSTLSCEEVIAHPYWYE

SEQ ID NO: 3069532 - protein, 17 aa, Giardia lamblia
ASLASCYTEKIYATPSG

SEQ ID NO: 3069533 - protein, 24 aa, Giardia lamblia
ASLCKKFGIHFTWNVDKGFGGGVV

SEQ ID NO: 3069534 - protein, 17 aa, Giardia lamblia
ASLKHALFTSFERYGQL

SEQ ID NO: 3069535 - protein, 17 aa, Giardia lamblia
ASLKHKLVELEKVTPPQ

SEQ ID NO: 3069536 - protein, 19 aa, Giardia lamblia
ASLLINFWTEQRLGLSTGG

SEQ ID NO: 3069537 - protein, 29 aa, Giardia lamblia
ASLLPAEVYTSFPLSYGFKDLTKKKTDRK

SEQ ID NO: 3069538 - protein, 30 aa, Giardia lamblia
ASLRLALSLRLKFIVGMVINITLGLVFPLL

SEQ ID NO: 3069539 - protein, 31 aa, Giardia lamblia
ASLTRFNPAFPFLDMLAIHFASTLCFLWLYF

SEQ ID NO: 3069540 - protein, 18 aa, Giardia lamblia
ASLVKLSLSTSCISFSIF

SEQ ID NO: 3069541 - protein, 21 aa, Giardia lamblia
ASLVTNIPCQFALFDQLITSC

SEQ ID NO: 3069542 - protein, 24 aa, Giardia lamblia
ASLWKDILATVIYMACRADDQTGD

SEQ ID NO: 3069543 - protein, 25 aa, Giardia lamblia
ASNANLRLGGFIGILENTAVAMHYT

SEQ ID NO: 3069544 - protein, 21 aa, Giardia lamblia
ASNFLPAVKVLAVLEAEHRTI

SEQ ID NO: 3069545 - protein, 20 aa, Giardia lamblia
ASNRPSCAFDSPTLLSSPRF

SEQ ID NO: 3069546 - protein, 19 aa, Giardia lamblia
ASNVIRRKMQLFNNQVSKY

SEQ ID NO: 3069547 - protein, 20 aa, Giardia lamblia
ASPAVLLMSIFWVIAGTTLL

SEQ ID NO: 3069548 - protein, 23 aa, Giardia lamblia
ASPILCFSRAVLEFINMPLNDDT

SEQ ID NO: 3069549 - protein, 21 aa, Giardia lamblia
ASPLESLLMTLEYLVHKKLIT

SEQ ID NO: 3069550 - protein, 31 aa, Giardia lamblia
ASPMLHFAMLYIRLFGLFARELTPVICSLFA

SEQ ID NO: 3069551 - protein, 22 aa, Giardia lamblia
ASPQQCSECLPGYYKSGDKCVK

SEQ ID NO: 3069552 - protein, 24 aa, Giardia lamblia
ASPQQCSGCFPGYYKSGDKCVKCD

SEQ ID NO: 3069553 - protein, 27 aa, Giardia lamblia
ASPRLTLTHLFPCFSLFTSPKAEKGWF

SEQ ID NO: 3069554 - protein, 27 aa, Giardia lamblia
ASPRYWRSVGWWVGIVVFVFGVIMDFV

SEQ ID NO: 3069555 - protein, 17 aa, Giardia lamblia
ASRFWEVLITVTSSCFR

SEQ ID NO: 3069556 - protein, 22 aa, Giardia lamblia
ASRLIDMLLYPAGPRVQQKEEA

SEQ ID NO: 3069557 - protein, 19 aa, Giardia lamblia
ASRPLLFFIGQEVISQVRR

SEQ ID NO: 3069558 - protein, 17 aa, Giardia lamblia
ASSCAKRSLLPDPRTLT

SEQ ID NO: 3069559 - protein, 21 aa, Giardia lamblia
ASSDPVLLCAGDYEADLLYHC

SEQ ID NO: 3069560 - protein, 24 aa, Giardia lamblia
ASSILCVVILLAIFGLLAAIIGKV

SEQ ID NO: 3069561 - protein, 17 aa, Giardia lamblia
ASSLILLSPYRRFKMNL

SEQ ID NO: 3069562 - protein, 19 aa, Giardia lamblia
ASSLKRLSLGSTLSKRQLE

SEQ ID NO: 3069563 - protein, 21 aa, Giardia lamblia
ASSPHPFTFLIHKLGIMPNYI

SEQ ID NO: 3069564 - protein, 27 aa, Giardia lamblia
ASSPTSDVAICICPALTFRRYLKQKGR

SEQ ID NO: 3069565 - protein, 25 aa, Giardia lamblia
ASSQLSGAIALFFRGSNRTKMISIP

SEQ ID NO: 3069566 - protein, 18 aa, Giardia lamblia
ASSRFMNLLVCMYEIPFA

SEQ ID NO: 3069567 - protein, 20 aa, Giardia lamblia
ASSTGGWVFLQNGHLARSWM

SEQ ID NO: 3069568 - protein, 20 aa, Giardia lamblia
ASSVFGTIFDMRWLTSALNY

SEQ ID NO: 3069569 - protein, 25 aa, Giardia lamblia
ASTCLFLACGYCCLTYDNCVYQALC

SEQ ID NO: 3069570 - protein, 20 aa, Giardia lamblia
ASTDDCSGCSKWTQESGTFF

SEQ ID NO: 3069571 - protein, 19 aa, Giardia lamblia
ASTFRLGNQYMINTLISHH

SEQ ID NO: 3069572 - protein, 20 aa, Giardia lamblia
ASTLDTFLMQSCTRQDPWNL

SEQ ID NO: 3069573 - protein, 19 aa, Giardia lamblia
ASTLMSGVVPDISEILADH

SEQ ID NO: 3069574 - protein, 19 aa, Giardia lamblia
ASTLPLITKMRAFKKLFTR

SEQ ID NO: 3069575 - protein, 17 aa, Giardia lamblia
ASTSRIGELLASTDELC

SEQ ID NO: 3069576 - protein, 17 aa, Giardia lamblia
ASTVIFYENDWNPTQDA

SEQ ID NO: 3069577 - protein, 24 aa, Giardia lamblia
ASTVRPRYILMKKLGSGGFSTVYK

SEQ ID NO: 3069578 - protein, 25 aa, Giardia lamblia
ASTYLRFSAIFLPQCHEHPELKSIY

SEQ ID NO: 3069579 - protein, 19 aa, Giardia lamblia
ASVLCDWSAMISRYNEAHK

SEQ ID NO: 3069580 - protein, 19 aa, Giardia lamblia
ASVYTYLSVRRFMRVINKL

SEQ ID NO: 3069581 - protein, 17 aa, Giardia lamblia
ASYAPRNGACILIKENP

SEQ ID NO: 3069582 - protein, 19 aa, Giardia lamblia
ASYCMRFIQLMPAPGRQST

SEQ ID NO: 3069583 - protein, 19 aa, Giardia lamblia
ASYLRLWALSLAHAQLSEV

SEQ ID NO: 3069584 - protein, 17 aa, Giardia lamblia
ASYTIDCVTDYREAQIR

SEQ ID NO: 3069585 - protein, 27 aa, Giardia lamblia
ATAAFKTRFEPFILVLLHIIKTNIQHS

SEQ ID NO: 3069586 - protein, 23 aa, Giardia lamblia
ATAAPEWKVIAATIDRWQERIVW

SEQ ID NO: 3069587 - protein, 23 aa, Giardia lamblia
ATAHIFRLLSVIFILMTALFSFS

SEQ ID NO: 3069588 - protein, 23 aa, Giardia lamblia
ATAKFVSCVDMFKNLGVPNTNML

SEQ ID NO: 3069589 - protein, 25 aa, Giardia lamblia
ATASCLRLMTIYLHIIFNSSNLVRD

SEQ ID NO: 3069590 - protein, 22 aa, Giardia lamblia
ATCGSFPKIAVIVAKQGIPDSS

SEQ ID NO: 3069591 - protein, 25 aa, Giardia lamblia
ATCLGDVRVSYCAWCPITTQGGSAC

SEQ ID NO: 3069592 - protein, 21 aa, Giardia lamblia
ATCRRYKRLSTNNCGFIAQTH

SEQ ID NO: 3069593 - protein, 19 aa, Giardia lamblia
ATCYPGWVADGNSLCAKYD

SEQ ID NO: 3069594 - protein, 24 aa, Giardia lamblia
ATEDFMFRLLIAFRPTTAETSSFI

SEQ ID NO: 3069595 - protein, 19 aa, Giardia lamblia
ATEDIKIMPHTGVYTNIIA

SEQ ID NO: 3069596 - protein, 22 aa, Giardia lamblia
ATEGLPHFMPSLSVLAAELVTR

SEQ ID NO: 3069597 - protein, 18 aa, Giardia lamblia
ATETSKCYVGGVVGGIVN

SEQ ID NO: 3069598 - protein, 21 aa, Giardia lamblia
ATEVVSWIAPASIGFTPASIP

SEQ ID NO: 3069599 - protein, 25 aa, Giardia lamblia
ATFAYRRYRVPQGQACTLEEIKKMY

SEQ ID NO: 3069600 - protein, 22 aa, Giardia lamblia
ATFCAKCGTPGFVPINGVCVPY

SEQ ID NO: 3069601 - protein, 20 aa, Giardia lamblia
ATFCVVECAVLSSKKAPLLL

SEQ ID NO: 3069602 - protein, 21 aa, Giardia lamblia
ATFEPRLKYASLLTKQLQAVF

SEQ ID NO: 3069603 - protein, 25 aa, Giardia lamblia
ATFGYKRSETIGGFFNASFLLSTAF

SEQ ID NO: 3069604 - protein, 24 aa, Giardia lamblia
ATFSYELLDSISLEGSTHASALLR

SEQ ID NO: 3069605 - protein, 18 aa, Giardia lamblia
ATGRPCLLFLDTMDPGTL

SEQ ID NO: 3069606 - protein, 24 aa, Giardia lamblia
ATHACTLMKAGIIPIVRDYNKCDL

SEQ ID NO: 3069607 - protein, 24 aa, Giardia lamblia
ATHSTCFFAALRMSSIAVYEITGL

SEQ ID NO: 3069608 - protein, 24 aa, Giardia lamblia
ATIDRWQERIVWQIVAQLVQGLAD

SEQ ID NO: 3069609 - protein, 17 aa, Giardia lamblia
ATIGQSLVHTLSLQILM

SEQ ID NO: 3069610 - protein, 18 aa, Giardia lamblia
ATIIGASKLSASAMKSGM

SEQ ID NO: 3069611 - protein, 31 aa, Giardia lamblia
ATILKPYLCLALALLFFFDFNTFNVLKNPST

SEQ ID NO: 3069612 - protein, 27 aa, Giardia lamblia
ATILLFVWTLLRACIIPRKPALGPHNF

SEQ ID NO: 3069613 - protein, 17 aa, Giardia lamblia
ATIRLLRSFPLPACCYV

SEQ ID NO: 3069614 - protein, 24 aa, Giardia lamblia
ATKERRWNYDKVWANSDDTFNHCP

SEQ ID NO: 3069615 - protein, 20 aa, Giardia lamblia
ATLEAERSELIAARQQIRHL

SEQ ID NO: 3069616 - protein, 19 aa, Giardia lamblia
ATLLKLVSIALHIGERTAT

SEQ ID NO: 3069617 - protein, 27 aa, Giardia lamblia
ATLVELCPCLKSFTVCSAYSGQSQSLV

SEQ ID NO: 3069618 - protein, 19 aa, Giardia lamblia
ATMPCVLFRLDNMERQGLM

SEQ ID NO: 3069619 - protein, 21 aa, Giardia lamblia
ATNIIDGFLWIGSVSVLRHAE

SEQ ID NO: 3069620 - protein, 17 aa, Giardia lamblia
ATNVALSITDLISFLQT

SEQ ID NO: 3069621 - protein, 22 aa, Giardia lamblia
ATNVGTAFAFVLKKDGTWLGQT

SEQ ID NO: 3069622 - protein, 18 aa, Giardia lamblia
ATPIKGMYIYQAASEVGF

SEQ ID NO: 3069623 - protein, 18 aa, Giardia lamblia
ATPLCFQYLHLLFTTTTI

SEQ ID NO: 3069624 - protein, 23 aa, Giardia lamblia
ATRLKLLSLKSVRSLKSALSSGI

SEQ ID NO: 3069625 - protein, 35 aa, Giardia lamblia
ATRLNLCKRMVSFLRLADFMIMDSLYDLAYLTLNT

SEQ ID NO: 3069626 - protein, 19 aa, Giardia lamblia
ATSAEFSHDSLLHMSDVDK

SEQ ID NO: 3069627 - protein, 19 aa, Giardia lamblia
ATSFFCYNCSTVSASEKDF

SEQ ID NO: 3069628 - protein, 19 aa, Giardia lamblia
ATSFKPAIEGFNHAKNRSQ

SEQ ID NO: 3069629 - protein, 19 aa, Giardia lamblia
ATSLAECPNLFYNVFEIFN

SEQ ID NO: 3069630 - protein, 24 aa, Giardia lamblia
ATSVAWTYSLDYAFPSSAVEDGEL

SEQ ID NO: 3069631 - protein, 18 aa, Giardia lamblia
ATSVPRLSSEKSLNNHLL

SEQ ID NO: 3069632 - protein, 17 aa, Giardia lamblia
ATSWGLGAVSARKKSGC

SEQ ID NO: 3069633 - protein, 24 aa, Giardia lamblia
ATSWKSSISAGFVGYAEYLQISNT

SEQ ID NO: 3069634 - protein, 26 aa, Giardia lamblia
ATVERCLRIPVLILDNVETGKDTGYF

SEQ ID NO: 3069635 - protein, 21 aa, Giardia lamblia
ATVKYAMLWLAPKQFVICTGS

SEQ ID NO: 3069636 - protein, 24 aa, Giardia lamblia
ATVPLRVQMALGRAILLVSEGIGV

SEQ ID NO: 3069637 - protein, 24 aa, Giardia lamblia
ATVPWLMDCGILRTLYEQSFSLCC

SEQ ID NO: 3069638 - protein, 21 aa, Giardia lamblia
ATVSSIEWPYFALPFASVGEE

SEQ ID NO: 3069639 - protein, 31 aa, Giardia lamblia
ATYPQMRMSFLLKRCEAISIAFLILWFIGDL

SEQ ID NO: 3069640 - protein, 17 aa, Giardia lamblia
ATYPRFLSKIGSSKSTF

SEQ ID NO: 3069641 - protein, 24 aa, Giardia lamblia
AVARKPKLFVVMLLTLVFGEALAL

SEQ ID NO: 3069642 - protein, 19 aa, Giardia lamblia
AVCACRRIVVIENQPALID

SEQ ID NO: 3069643 - protein, 23 aa, Giardia lamblia
AVCAHPLAAFLMLTNYADTSLLN

SEQ ID NO: 3069644 - protein, 18 aa, Giardia lamblia
AVCLYIASIFMPRLELII

SEQ ID NO: 3069645 - protein, 18 aa, Giardia lamblia
AVCNLTLPPETDHCEETD

SEQ ID NO: 3069646 - protein, 24 aa, Giardia lamblia
AVDPLRTSMFWFLEVLVLAAIGLA

SEQ ID NO: 3069647 - protein, 19 aa, Giardia lamblia
AVEILCEYEYTISTRTGQT

SEQ ID NO: 3069648 - protein, 20 aa, Giardia lamblia
AVEKCILCSDTVGFNGYKGA

SEQ ID NO: 3069649 - protein, 25 aa, Giardia lamblia
AVENRVALNFFRHLGSSFLFILFDY

SEQ ID NO: 3069650 - protein, 24 aa, Giardia lamblia
AVERCKRAGITVRMVTGDNKITAV

SEQ ID NO: 3069651 - protein, 48 aa, Giardia lamblia
AVFSMAPDLRGWRILRSTFYYYLVCCKVCVFKPPDVRSFTAEQLAERL

SEQ ID NO: 3069652 - protein, 27 aa, Giardia lamblia
AVHAGRRPRCPWMCVMRSRPVQLPASL

SEQ ID NO: 3069653 - protein, 23 aa, Giardia lamblia
AVHIKGTFTWGFAKHLQKPEILD

SEQ ID NO: 3069654 - protein, 19 aa, Giardia lamblia
AVHVLVSIMRGFRRFLMDR

SEQ ID NO: 3069655 - protein, 21 aa, Giardia lamblia
AVIIGCLVWFLLRRKNSGSLN

SEQ ID NO: 3069656 - protein, 17 aa, Giardia lamblia
AVKRVSHVVLFVQAPLY

SEQ ID NO: 3069657 - protein, 19 aa, Giardia lamblia
AVKVAKSLLARGIPIVITV

SEQ ID NO: 3069658 - protein, 17 aa, Giardia lamblia
AVLKSIDSATCLPFLSS

SEQ ID NO: 3069659 - protein, 17 aa, Giardia lamblia
AVLRGQTDVVCFLSQYE

SEQ ID NO: 3069660 - protein, 24 aa, Giardia lamblia
AVLRRMPLAFKRTRDFMHTDQQPV

SEQ ID NO: 3069661 - protein, 18 aa, Giardia lamblia
AVLSMPYRQASVAHVNPT

SEQ ID NO: 3069662 - protein, 19 aa, Giardia lamblia
AVMTTLAFYFLIKRQKRSS

SEQ ID NO: 3069663 - protein, 21 aa, Giardia lamblia
AVNIFERLRREASRQNLKPVL

SEQ ID NO: 3069664 - protein, 23 aa, Giardia lamblia
AVNNTCVPKMCYAPNPDGMMAVC

SEQ ID NO: 3069665 - protein, 19 aa, Giardia lamblia
AVPLVSSRIRFCISSGHTE

SEQ ID NO: 3069666 - protein, 21 aa, Giardia lamblia
AVPMTHIYSGPLIKEESSAVS

SEQ ID NO: 3069667 - protein, 30 aa, Giardia lamblia
AVPSKLIELCYCLLTVLLASGVLYMSSAQL

SEQ ID NO: 3069668 - protein, 21 aa, Giardia lamblia
AVQGCQACLKDSATTCDACFE

SEQ ID NO: 3069669 - protein, 19 aa, Giardia lamblia
AVQSLRFLVATTLVMVLHA

SEQ ID NO: 3069670 - protein, 24 aa, Giardia lamblia
AVRASIFCSDFIYVLASTWPVMLF

SEQ ID NO: 3069671 - protein, 19 aa, Giardia lamblia
AVRHRARLGSVVVGNTNFL

SEQ ID NO: 3069672 - protein, 18 aa, Giardia lamblia
AVRLTIHVDWTISKTSSD

SEQ ID NO: 3069673 - protein, 25 aa, Giardia lamblia
AVSAPHCKLSYALLSAFGPVEIADN

SEQ ID NO: 3069674 - protein, 24 aa, Giardia lamblia
AVSDIKTLAAIPWKTIVLDEAQLI

SEQ ID NO: 3069675 - protein, 25 aa, Giardia lamblia
AVSELRRLNTIGVFLAHLSQYKSDE

SEQ ID NO: 3069676 - protein, 27 aa, Giardia lamblia
AVSGISRCVCAQGFYSLDNQCVERHSN

SEQ ID NO: 3069677 - protein, 18 aa, Giardia lamblia
AVSNCASCEIDVKYCTEC

SEQ ID NO: 3069678 - protein, 19 aa, Giardia lamblia
AVSNCASCEIDVKYCTECI

SEQ ID NO: 3069679 - protein, 18 aa, Giardia lamblia
AVSYKYVSKYSVGLAATF

SEQ ID NO: 3069680 - protein, 19 aa, Giardia lamblia
AVTILFCNIVLPGIGTMFS

SEQ ID NO: 3069681 - protein, 18 aa, Giardia lamblia
AVTIVCIFVLPLIIKATK

SEQ ID NO: 3069682 - protein, 25 aa, Giardia lamblia
AVTRCACSIKYLVSCFLPLDLMFLV

SEQ ID NO: 3069683 - protein, 18 aa, Giardia lamblia
AVTRRAGIDGVFTLDFKN

SEQ ID NO: 3069684 - protein, 40 aa, Giardia lamblia
AVVHLCKRLACLSIPYTSLLPILWAFSQLYSLYLYSNVLT

SEQ ID NO: 3069685 - protein, 28 aa, Giardia lamblia
AVVTRARAGHALSVFVNPAFAQGRSDLV

SEQ ID NO: 3069686 - protein, 21 aa, Giardia lamblia
AVWMMRCVIEHFSVASSPFLV

SEQ ID NO: 3069687 - protein, 25 aa, Giardia lamblia
AVYLCILGALITPLLIRMGLIGKLS

SEQ ID NO: 3069688 - protein, 18 aa, Giardia lamblia
AVYPQWISETIFRSLSLD

SEQ ID NO: 3069689 - protein, 20 aa, Giardia lamblia
AWHRVAEVMYRQMPDNASYS

SEQ ID NO: 3069690 - protein, 20 aa, Giardia lamblia
AWKKRPTLRRNLKKSKRLRP

SEQ ID NO: 3069691 - protein, 21 aa, Giardia lamblia
AWVTRPGWFTDVVYYYPTDEQ

SEQ ID NO: 3069692 - protein, 17 aa, Giardia lamblia
AYASALAEWEKETAKKA

SEQ ID NO: 3069693 - protein, 17 aa, Giardia lamblia
AYCPLLIAHNAAWPALF

SEQ ID NO: 3069694 - protein, 18 aa, Giardia lamblia
AYCRQMKGSRTTSGGYTA

SEQ ID NO: 3069695 - protein, 36 aa, Giardia lamblia
AYDAVCLLHTIILLWYCETMMPLSLIYDITPEIDHV

SEQ ID NO: 3069696 - protein, 21 aa, Giardia lamblia
AYDHQGCYQFLFPAEGNVVDK

SEQ ID NO: 3069697 - protein, 18 aa, Giardia lamblia
AYGDCICAGFGNSDKCLS

SEQ ID NO: 3069698 - protein, 23 aa, Giardia lamblia
AYHPRMRRMYLSLADPYESLYLL

SEQ ID NO: 3069699 - protein, 25 aa, Giardia lamblia
AYIFSRIGFTLTFFIIPISLGISLY

SEQ ID NO: 3069700 - protein, 24 aa, Giardia lamblia
AYISDPILLLSCPSLRYDPEGRYL

SEQ ID NO: 3069701 - protein, 18 aa, Giardia lamblia
AYKSIDLVEDFASNANIR

SEQ ID NO: 3069702 - protein, 18 aa, Giardia lamblia
AYLFPREVYTGSKTMLSL

SEQ ID NO: 3069703 - protein, 20 aa, Giardia lamblia
AYLIVGCVFVYKSVLLTVRM

SEQ ID NO: 3069704 - protein, 21 aa, Giardia lamblia
AYLSLYKRLIPFLITTKDRDV

SEQ ID NO: 3069705 - protein, 18 aa, Giardia lamblia
AYLSRRTHLHVGIEGANK

SEQ ID NO: 3069706 - protein, 20 aa, Giardia lamblia
AYNMIRLPISVDFLTFTINI

SEQ ID NO: 3069707 - protein, 34 aa, Giardia lamblia
AYPQVVWDYGLDFDWQLLNGIRYTPLFTAQTLII

SEQ ID NO: 3069708 - protein, 18 aa, Giardia lamblia
AYRIPIISRDHREFLVFR

SEQ ID NO: 3069709 - protein, 29 aa, Giardia lamblia
AYRNSWHTSRLGGIIFWIADAVCLNNSED

SEQ ID NO: 3069710 - protein, 26 aa, Giardia lamblia
AYRSSCRATGRIAFRYQGEKYFELEN

SEQ ID NO: 3069711 - protein, 20 aa, Giardia lamblia
AYRTICDSIRAGLLSNCGKV

SEQ ID NO: 3069712 - protein, 29 aa, Giardia lamblia
AYSALLPFQVCNFQAYYALKQFSKLPPVS

SEQ ID NO: 3069713 - protein, 21 aa, Giardia lamblia
AYSCDPCPAGFVSYEDECLPR

SEQ ID NO: 3069714 - protein, 20 aa, Giardia lamblia
AYSCDPCPAGFVSYEGECLP

SEQ ID NO: 3069715 - protein, 25 aa, Giardia lamblia
AYSLCFRYTDMLILFSNASISVFLM

SEQ ID NO: 3069716 - protein, 27 aa, Giardia lamblia
AYSRLHTDLLFFKYLMQNVSQAVKLAN

SEQ ID NO: 3069717 - protein, 20 aa, Giardia lamblia
AYTAVFVYNMLGLVFVFMPL

SEQ ID NO: 3069718 - protein, 18 aa, Giardia lamblia
AYTLAHTVISVWILCVLF

SEQ ID NO: 3069719 - protein, 18 aa, Giardia lamblia
AYTYCSFAKAMMTSDSLP

SEQ ID NO: 3069720 - protein, 18 aa, Giardia lamblia
AYVCASKDASRCKYLCTY

SEQ ID NO: 3069721 - protein, 20 aa, Giardia lamblia
AYVKAHVGIMARVRDRDNKT

SEQ ID NO: 3069722 - protein, 23 aa, Giardia lamblia
AYVKAILGVGCIDLISSLSGTVI

SEQ ID NO: 3069723 - protein, 17 aa, Giardia lamblia
AYVKLLLFMKLYLSHIL

SEQ ID NO: 3069724 - protein, 19 aa, Giardia lamblia
AYWAPRLLGLTILSIVMGL

SEQ ID NO: 3069725 - protein, 17 aa, Giardia lamblia
AYYETLLPRQKHKATSP

SEQ ID NO: 3069726 - protein, 18 aa, Giardia lamblia
AYYIELLLNFQIIQMTRL

SEQ ID NO: 3069727 - protein, 18 aa, Giardia lamblia
AYYLSYTVVLQFVFYPFE

SEQ ID NO: 3069728 - protein, 21 aa, Giardia lamblia
CAAIISFCHLPIAFITLSLDT

SEQ ID NO: 3069729 - protein, 17 aa, Giardia lamblia
CACEFSGGLLADAEVNS

SEQ ID NO: 3069730 - protein, 23 aa, Giardia lamblia
CAECFPGYYWGGAFNRHCVPCAA

SEQ ID NO: 3069731 - protein, 18 aa, Giardia lamblia
CAEKCGVHRIAIDRYIPD

SEQ ID NO: 3069732 - protein, 21 aa, Giardia lamblia
CAGYYSYKSIVAKSLMHDLHL

SEQ ID NO: 3069733 - protein, 17 aa, Giardia lamblia
CAILMAKAIKLDAAAAM

SEQ ID NO: 3069734 - protein, 29 aa, Giardia lamblia
CAKGVCTQCAQGYFLYMGGCYKVASPPGN

SEQ ID NO: 3069735 - protein, 18 aa, Giardia lamblia
CALHTALLSEIFIQQQEK

SEQ ID NO: 3069736 - protein, 17 aa, Giardia lamblia
CALIPPYCAIQIQNALA

SEQ ID NO: 3069737 - protein, 26 aa, Giardia lamblia
CALYMIIKHLLKRESLYCPGDTAKGV

SEQ ID NO: 3069738 - protein, 25 aa, Giardia lamblia
CAQTCLFTRLNIRTHHSAPTEFDFP

SEQ ID NO: 3069739 - protein, 19 aa, Giardia lamblia
CARYRECRYTDLSVRLLVH

SEQ ID NO: 3069740 - protein, 18 aa, Giardia lamblia
CASPCKTCNGAGGRCTSC

SEQ ID NO: 3069741 - protein, 20 aa, Giardia lamblia
CATFSSVHAIVFVGTEQGRI

SEQ ID NO: 3069742 - protein, 17 aa, Giardia lamblia
CATKESFCTACKRSGAM

SEQ ID NO: 3069743 - protein, 17 aa, Giardia lamblia
CAVCKDGTLTGCQQCSP

SEQ ID NO: 3069744 - protein, 18 aa, Giardia lamblia
CAVCKDGTLTGCQQCSPG

SEQ ID NO: 3069745 - protein, 18 aa, Giardia lamblia
CAWCPITTQGGSACIYKF

SEQ ID NO: 3069746 - protein, 23 aa, Giardia lamblia
CCDSGKLYGYFTFPLNHEDRLAL

SEQ ID NO: 3069747 - protein, 25 aa, Giardia lamblia
CCFSINELIQYGGRCGRRGQPADYH

SEQ ID NO: 3069748 - protein, 36 aa, Giardia lamblia
CCGFPSQKASNAWIRLSVLYAFLPKLVGPWVAHFRK

SEQ ID NO: 3069749 - protein, 20 aa, Giardia lamblia
CCGLFWKTAPPLTIAIPAVV

SEQ ID NO: 3069750 - protein, 24 aa, Giardia lamblia
CCNPRCRCGAPKVGVLAIGDGGND

SEQ ID NO: 3069751 - protein, 37 aa, Giardia lamblia
CCSCCCCGCCGCLDCFLKYAFRIGVGVGYPSLADFLT

SEQ ID NO: 3069752 - protein, 19 aa, Giardia lamblia
CCSLMEFLGLTVPARLIAW

SEQ ID NO: 3069753 - protein, 17 aa, Giardia lamblia
CCSSEALASPPAIIVYI

SEQ ID NO: 3069754 - protein, 20 aa, Giardia lamblia
CCTISPFQRLFRSLPGLYQD

SEQ ID NO: 3069755 - protein, 17 aa, Giardia lamblia
CDARDSGICRICASRTF

SEQ ID NO: 3069756 - protein, 22 aa, Giardia lamblia
CDATYYRMCHTTSHLIRELPKS

SEQ ID NO: 3069757 - protein, 28 aa, Giardia lamblia
CDDSMLWCLSCRGPGACTECKAGYYLDY

SEQ ID NO: 3069758 - protein, 28 aa, Giardia lamblia
CDDSMLWCLSCRGPGACTECKVGYYLDH

SEQ ID NO: 3069759 - protein, 17 aa, Giardia lamblia
CDEGWKNVGTSLCSGFS

SEQ ID NO: 3069760 - protein, 17 aa, Giardia lamblia
CDELSYIDSLAMARNTR

SEQ ID NO: 3069761 - protein, 24 aa, Giardia lamblia
CDESGRCLLCVTSGHNVQVDQRTC

SEQ ID NO: 3069762 - protein, 18 aa, Giardia lamblia
CDINCGLESVSHSAVIKD

SEQ ID NO: 3069763 - protein, 27 aa, Giardia lamblia
CDIRPWLHVYKALRLLPLQPDGAVSAW

SEQ ID NO: 3069764 - protein, 23 aa, Giardia lamblia
CDKKLRTYCCNFATQSRGTVVLF

SEQ ID NO: 3069765 - protein, 27 aa, Giardia lamblia
CDLETIELRKGYGLNEFRDDLKTLFQK

SEQ ID NO: 3069766 - protein, 25 aa, Giardia lamblia
CDLKLLVNNLHLCFNTQTDLLLEAR

SEQ ID NO: 3069767 - protein, 21 aa, Giardia lamblia
CDMPRLQSRFAELSPTLRQVG

SEQ ID NO: 3069768 - protein, 24 aa, Giardia lamblia
CDNRGKCAIHYAAEYRQREASALL

SEQ ID NO: 3069769 - protein, 21 aa, Giardia lamblia
CDPDFLIACAFYVLDNKDEQG

SEQ ID NO: 3069770 - protein, 27 aa, Giardia lamblia
CDPTCLACTAPGPGRCTRCPSDKLLKR

SEQ ID NO: 3069771 - protein, 25 aa, Giardia lamblia
CDSHGSPVFGPCIVHSEHIYFTWLI

SEQ ID NO: 3069772 - protein, 19 aa, Giardia lamblia
CDYYMAAAWFVLAADFEHM

SEQ ID NO: 3069773 - protein, 21 aa, Giardia lamblia
CEDNLRLLRHISFQNPVDIIP

SEQ ID NO: 3069774 - protein, 26 aa, Giardia lamblia
CEELSHWKACPVDYFYDSTLRVSPRS

SEQ ID NO: 3069775 - protein, 23 aa, Giardia lamblia
CEFKCFPSPCPETDSYGCSPDGV

SEQ ID NO: 3069776 - protein, 21 aa, Giardia lamblia
CEGLAYPLMYLFVGDGETERA

SEQ ID NO: 3069777 - protein, 22 aa, Giardia lamblia
CEGSRVIYRLVYAVGRGAVKTH

SEQ ID NO: 3069778 - protein, 22 aa, Giardia lamblia
CEKCGDGYFLFMGGCYKTTDGP

SEQ ID NO: 3069779 - protein, 18 aa, Giardia lamblia
CEKDRLLELPALGDCIPE

SEQ ID NO: 3069780 - protein, 17 aa, Giardia lamblia
CEKRYFLQPARRICLHS

SEQ ID NO: 3069781 - protein, 17 aa, Giardia lamblia
CELIEYYRKAVVSNENT

SEQ ID NO: 3069782 - protein, 24 aa, Giardia lamblia
CELPVDPSALCLLSDVAPSPADAD

SEQ ID NO: 3069783 - protein, 17 aa, Giardia lamblia
CELWNIGSYAVFRPPND

SEQ ID NO: 3069784 - protein, 22 aa, Giardia lamblia
CENIIWKSFSFFRIDRGNGKEF

SEQ ID NO: 3069785 - protein, 17 aa, Giardia lamblia
CESCSGGLFLFNGGCYA

SEQ ID NO: 3069786 - protein, 19 aa, Giardia lamblia
CESSKAYLLGAVLFSVVAN

SEQ ID NO: 3069787 - protein, 25 aa, Giardia lamblia
CETSLECSVAIPAPVQPKRFSTSKI

SEQ ID NO: 3069788 - protein, 17 aa, Giardia lamblia
CEVSNCRACSGDAASCT

SEQ ID NO: 3069789 - protein, 18 aa, Giardia lamblia
CFFGGSISATAAEASVIG

SEQ ID NO: 3069790 - protein, 23 aa, Giardia lamblia
CFGEDARAGFLFLTEVGITSEEC

SEQ ID NO: 3069791 - protein, 19 aa, Giardia lamblia
CFHRECVGLPGAAVSLRED

SEQ ID NO: 3069792 - protein, 22 aa, Giardia lamblia
CFKERARINTQLNLFVVTFTKR

SEQ ID NO: 3069793 - protein, 18 aa, Giardia lamblia
CFLYELLTGDILFFDSDW

SEQ ID NO: 3069794 - protein, 18 aa, Giardia lamblia
CFSCSDANCERCDQNDVC

SEQ ID NO: 3069795 - protein, 17 aa, Giardia lamblia
CFSDARSQHILDVLDEM

SEQ ID NO: 3069796 - protein, 20 aa, Giardia lamblia
CFSREAWPKPMQVINTSFDN

SEQ ID NO: 3069797 - protein, 20 aa, Giardia lamblia
CFYIPIFFFLMIPRLQPVSS

SEQ ID NO: 3069798 - protein, 17 aa, Giardia lamblia
CGANCSCRCHTKTPESV

SEQ ID NO: 3069799 - protein, 34 aa, Giardia lamblia
CGCCGCLDCFLKYAFRIGVGVGYPSLMDFLTYLI

SEQ ID NO: 3069800 - protein, 18 aa, Giardia lamblia
CGCTYTLEKVFPKVINPD

SEQ ID NO: 3069801 - protein, 20 aa, Giardia lamblia
CGDCPSAPCDSDFDHLNQFG

SEQ ID NO: 3069802 - protein, 27 aa, Giardia lamblia
CGEGLRLLVAMNCLWPGAGSIQTLLCG

SEQ ID NO: 3069803 - protein, 19 aa, Giardia lamblia
CGETALIIACKEGFMEAIP

SEQ ID NO: 3069804 - protein, 30 aa, Giardia lamblia
CGGLLRLYAEENVGCAFAEICNILRLTETR

SEQ ID NO: 3069805 - protein, 19 aa, Giardia lamblia
CGGRGVCRANLLYTQYSCF

SEQ ID NO: 3069806 - protein, 20 aa, Giardia lamblia
CGIASALCFWSYYRSYYIPQ

SEQ ID NO: 3069807 - protein, 17 aa, Giardia lamblia
CGIRYDWHGSSNAREKT

SEQ ID NO: 3069808 - protein, 19 aa, Giardia lamblia
CGKVLAIGLSLIFKTALRM

SEQ ID NO: 3069809 - protein, 18 aa, Giardia lamblia
CGLVDIFLSTCTTDEDCN

SEQ ID NO: 3069810 - protein, 19 aa, Giardia lamblia
CGLYALTLIEIYSALWSGR

SEQ ID NO: 3069811 - protein, 22 aa, Giardia lamblia
CGRMSLCTMLPNIGLIRLPYDI

SEQ ID NO: 3069812 - protein, 24 aa, Giardia lamblia
CGSGYRAKHGRCISCNKQHCLEYI

SEQ ID NO: 3069813 - protein, 19 aa, Giardia lamblia
CGSHRTRYEPFFDLLVPYN

SEQ ID NO: 3069814 - protein, 17 aa, Giardia lamblia
CGSPDNLLLVTGYATQD

SEQ ID NO: 3069815 - protein, 17 aa, Giardia lamblia
CGSRILATLYSFFNHSI

SEQ ID NO: 3069816 - protein, 17 aa, Giardia lamblia
CGTLFYLPNIVDYSRIV

SEQ ID NO: 3069817 - protein, 19 aa, Giardia lamblia
CGTSKLFFFQRPEINEELL

SEQ ID NO: 3069818 - protein, 18 aa, Giardia lamblia
CGVTKLQMELSWETETLR

SEQ ID NO: 3069819 - protein, 26 aa, Giardia lamblia
CHSANIFMRSRWDVFMASNSEDGIML

SEQ ID NO: 3069820 - protein, 17 aa, Giardia lamblia
CHSRKVCHRDMKLENVL

SEQ ID NO: 3069821 - protein, 26 aa, Giardia lamblia
CHYRDISLLLHQGWIIERVDSNIIRA

SEQ ID NO: 3069822 - protein, 22 aa, Giardia lamblia
CIALLSEPCCIILGKDTSTGLH

SEQ ID NO: 3069823 - protein, 20 aa, Giardia lamblia
CIAMRQLWRRIGYLENNLAG

SEQ ID NO: 3069824 - protein, 17 aa, Giardia lamblia
CIARCSKQKKLAYICLI

SEQ ID NO: 3069825 - protein, 18 aa, Giardia lamblia
CIAYICPSNESLSTVHKI

SEQ ID NO: 3069826 - protein, 17 aa, Giardia lamblia
CICDFGYGLAENKNACM

SEQ ID NO: 3069827 - protein, 18 aa, Giardia lamblia
CIDLLYREIAAYGSVPTI

SEQ ID NO: 3069828 - protein, 33 aa, Giardia lamblia
CIDSLPGRLLRLCDIPSDQRCCSSEALASPPAI

SEQ ID NO: 3069829 - protein, 24 aa, Giardia lamblia
CIFVIACCCKYFRIRNEAELLEKD

SEQ ID NO: 3069830 - protein, 22 aa, Giardia lamblia
CIGIELRFLFSTSDDLPGSLTK

SEQ ID NO: 3069831 - protein, 19 aa, Giardia lamblia
CIGPGDAICDIPYVSTGTG

SEQ ID NO: 3069832 - protein, 17 aa, Giardia lamblia
CIGTKPLDVVLCDEVTT

SEQ ID NO: 3069833 - protein, 18 aa, Giardia lamblia
CIHKACLNPDLKGTTDET

SEQ ID NO: 3069834 - protein, 20 aa, Giardia lamblia
CIKHASSMLTRSFGLDSSTP

SEQ ID NO: 3069835 - protein, 21 aa, Giardia lamblia
CILANLFPGPSEELFGLHLPI

SEQ ID NO: 3069836 - protein, 17 aa, Giardia lamblia
CILCKVSSCALCTDNAD

SEQ ID NO: 3069837 - protein, 26 aa, Giardia lamblia
CILQNLKLYLTHVYWAIQRQLQRSPL

SEQ ID NO: 3069838 - protein, 22 aa, Giardia lamblia
CILQRRVFLRFFVMAASPAKVD

SEQ ID NO: 3069839 - protein, 18 aa, Giardia lamblia
CILSAGRLDNSACLHPLS

SEQ ID NO: 3069840 - protein, 23 aa, Giardia lamblia
CIPMPATSLVPFAARNCFSADAP

SEQ ID NO: 3069841 - protein, 36 aa, Giardia lamblia
CIQRYYRGWCVRWTLKRIAPSLAYLMLNRGFLRTTD

SEQ ID NO: 3069842 - protein, 22 aa, Giardia lamblia
CISGFLRIFLGHYDELLLFVEG

SEQ ID NO: 3069843 - protein, 18 aa, Giardia lamblia
CIYLRKNLCGGFVDCTEH

SEQ ID NO: 3069844 - protein, 20 aa, Giardia lamblia
CKAKIFTDMRKGMSVIMHNG

SEQ ID NO: 3069845 - protein, 18 aa, Giardia lamblia
CKALIEAGEAGRCTPAGI

SEQ ID NO: 3069846 - protein, 26 aa, Giardia lamblia
CKASKRALAVLSWITHVLFIQSSLVY

SEQ ID NO: 3069847 - protein, 18 aa, Giardia lamblia
CKDALWSGSTLMGIMAYV

SEQ ID NO: 3069848 - protein, 18 aa, Giardia lamblia
CKDDLVATFFKQFHADLC

SEQ ID NO: 3069849 - protein, 17 aa, Giardia lamblia
CKDEYFASFSFSGDASG

SEQ ID NO: 3069850 - protein, 19 aa, Giardia lamblia
CKEVLEVLGHAEGRNKIKY

SEQ ID NO: 3069851 - protein, 21 aa, Giardia lamblia
CKFNSGSTALMFAARFGQEEA

SEQ ID NO: 3069852 - protein, 21 aa, Giardia lamblia
CKGPGPMECLTCPTGGVSADG

SEQ ID NO: 3069853 - protein, 22 aa, Giardia lamblia
CKGRGVCIASLVAGQGMCQCSD

SEQ ID NO: 3069854 - protein, 23 aa, Giardia lamblia
CKGRGVCIASLVAGQGMCQCSDQ

SEQ ID NO: 3069855 - protein, 21 aa, Giardia lamblia
CKIKILQAFTIFSGKYNPALY

SEQ ID NO: 3069856 - protein, 20 aa, Giardia lamblia
CKLMHKFKSVDIVNILLRST

SEQ ID NO: 3069857 - protein, 19 aa, Giardia lamblia
CKLTNLAQIAEEYYFIYQS

SEQ ID NO: 3069858 - protein, 30 aa, Giardia lamblia
CKMLSRLPECCWIYLLLVRAMETPEQLEAC

SEQ ID NO: 3069859 - protein, 28 aa, Giardia lamblia
CKNYMPAKSLNCWDLLKEIRLQHYRNTL

SEQ ID NO: 3069860 - protein, 17 aa, Giardia lamblia
CKQCMPGYILDTDSSVC

SEQ ID NO: 3069861 - protein, 18 aa, Giardia lamblia
CKRCQKGYYVVGGRCARC

SEQ ID NO: 3069862 - protein, 20 aa, Giardia lamblia
CKRYKTLRYFFRTNVSKLLS

SEQ ID NO: 3069863 - protein, 19 aa, Giardia lamblia
CKSISAFSILGKRNARTFH

SEQ ID NO: 3069864 - protein, 17 aa, Giardia lamblia
CKSMASLYLSTQQSQTG

SEQ ID NO: 3069865 - protein, 19 aa, Giardia lamblia
CKSSFPGIVTCSRGVPVSK

SEQ ID NO: 3069866 - protein, 21 aa, Giardia lamblia
CKVCKDRFALRNNICIEECPV

SEQ ID NO: 3069867 - protein, 20 aa, Giardia lamblia
CKVCKDRFALRNNICTEECP

SEQ ID NO: 3069868 - protein, 19 aa, Giardia lamblia
CKVFFIFSQICSPRVTIEK

SEQ ID NO: 3069869 - protein, 19 aa, Giardia lamblia
CKVKSPGSMSVLLSSIQFI

SEQ ID NO: 3069870 - protein, 18 aa, Giardia lamblia
CLAMSRRGLAGSILATMN

SEQ ID NO: 3069871 - protein, 19 aa, Giardia lamblia
CLCRGDFQFVLGHGCVHPA

SEQ ID NO: 3069872 - protein, 17 aa, Giardia lamblia
CLCSLPYCTKCDINDGS

SEQ ID NO: 3069873 - protein, 20 aa, Giardia lamblia
CLDLLKFICESLAGASYTHH

SEQ ID NO: 3069874 - protein, 23 aa, Giardia lamblia
CLECTTIYYLLQYVLKVSPVSLI

SEQ ID NO: 3069875 - protein, 26 aa, Giardia lamblia
CLEDHGHAWLTLCANDLELHIGHGDY

SEQ ID NO: 3069876 - protein, 29 aa, Giardia lamblia
CLELDYKKRFTVPMIYDLIIGDHIKNTCY

SEQ ID NO: 3069877 - protein, 25 aa, Giardia lamblia
CLEYISTRVKNVWDISEAQKIKQIS

SEQ ID NO: 3069878 - protein, 19 aa, Giardia lamblia
CLFDFSYSLSPIVLVRLTT

SEQ ID NO: 3069879 - protein, 17 aa, Giardia lamblia
CLFLEHVVRHWAGSQFP

SEQ ID NO: 3069880 - protein, 21 aa, Giardia lamblia
CLFSSAYLPSLIINLYLPLSR

SEQ ID NO: 3069881 - protein, 18 aa, Giardia lamblia
CLHGCPDLKNGQCSSYNG

SEQ ID NO: 3069882 - protein, 18 aa, Giardia lamblia
CLKIVCMVIGLAVAAGVY

SEQ ID NO: 3069883 - protein, 26 aa, Giardia lamblia
CLLFLDFLSSLLLFYTMYFSKQYPIA

SEQ ID NO: 3069884 - protein, 21 aa, Giardia lamblia
CLLIIPAFVKHLIWLFVANVV

SEQ ID NO: 3069885 - protein, 20 aa, Giardia lamblia
CLLRLYEVIQSTELDKLLMI

SEQ ID NO: 3069886 - protein, 19 aa, Giardia lamblia
CLNRSDLKTALDMYKSGLV

SEQ ID NO: 3069887 - protein, 18 aa, Giardia lamblia
CLNRSVVRLSFSYDGLML

SEQ ID NO: 3069888 - protein, 19 aa, Giardia lamblia
CLPCPPMEGCITCKGTLSE

SEQ ID NO: 3069889 - protein, 20 aa, Giardia lamblia
CLPDDSGRWGCHCTGRYMTY

SEQ ID NO: 3069890 - protein, 21 aa, Giardia lamblia
CLPGETFVAGACVPNACISSL

SEQ ID NO: 3069891 - protein, 25 aa, Giardia lamblia
CLQCIERIEYILLVLLQPEYQLIID

SEQ ID NO: 3069892 - protein, 23 aa, Giardia lamblia
CLQKRFAEAALFLEASSNLAEAC

SEQ ID NO: 3069893 - protein, 19 aa, Giardia lamblia
CLQLLPLVVEILLYLFNIS

SEQ ID NO: 3069894 - protein, 19 aa, Giardia lamblia
CLQRNAIFCKLFAASQPKA

SEQ ID NO: 3069895 - protein, 17 aa, Giardia lamblia
CLSCPLGDPIAGTCATP

SEQ ID NO: 3069896 - protein, 17 aa, Giardia lamblia
CLSDVLPGNTFRNVECS

SEQ ID NO: 3069897 - protein, 22 aa, Giardia lamblia
CLSEGRLHCWNGVCRQKCAQAT

SEQ ID NO: 3069898 - protein, 21 aa, Giardia lamblia
CLSVLVMAGVLYRFLQEADRR

SEQ ID NO: 3069899 - protein, 32 aa, Giardia lamblia
CLTCSGEGATKCTLCASGKYLDGNNCVEASSC

SEQ ID NO: 3069900 - protein, 18 aa, Giardia lamblia
CLTCSGPGESDCLTCIKG

SEQ ID NO: 3069901 - protein, 26 aa, Giardia lamblia
CLTEYPWRGAARFCLDPILAIPPQHK

SEQ ID NO: 3069902 - protein, 19 aa, Giardia lamblia
CLTVSLGYVGLVAAVCLLN

SEQ ID NO: 3069903 - protein, 19 aa, Giardia lamblia
CLVSLCLSYIGLRRSLKTS

SEQ ID NO: 3069904 - protein, 19 aa, Giardia lamblia
CLYLKSKNAWECGSCPVGF

SEQ ID NO: 3069905 - protein, 18 aa, Giardia lamblia
CLYLRPLRTTHCRTCNCC

SEQ ID NO: 3069906 - protein, 18 aa, Giardia lamblia
CMAAYDIIYYYFVLSQYE

SEQ ID NO: 3069907 - protein, 20 aa, Giardia lamblia
CMADCFDGWLARSLSQESVL

SEQ ID NO: 3069908 - protein, 24 aa, Giardia lamblia
CMECSRTQCLRCKAGYAMPSSQCK

SEQ ID NO: 3069909 - protein, 25 aa, Giardia lamblia
CMHFIPRYIPLPVRVQHPMVCNITG

SEQ ID NO: 3069910 - protein, 26 aa, Giardia lamblia
CMLQSRCWPAFLFVREVLSNPLFKFD

SEQ ID NO: 3069911 - protein, 27 aa, Giardia lamblia
CMPILLDRLPHCFTILTYSMLQTTISA

SEQ ID NO: 3069912 - protein, 20 aa, Giardia lamblia
CMYFLTRFAISYNVTEMNGH

SEQ ID NO: 3069913 - protein, 25 aa, Giardia lamblia
CNACAIPNCVLCDPALTECLACQEA

SEQ ID NO: 3069914 - protein, 18 aa, Giardia lamblia
CNANRAGGVTFSMNDAVF

SEQ ID NO: 3069915 - protein, 22 aa, Giardia lamblia
CNDCRHVWRDSAIYKAFVAIVE

SEQ ID NO: 3069916 - protein, 25 aa, Giardia lamblia
CNDPKIGTCTAVSGISRCVCAQGFY

SEQ ID NO: 3069917 - protein, 24 aa, Giardia lamblia
CNFQAYLSFIIRYFLYLDDRIENA

SEQ ID NO: 3069918 - protein, 20 aa, Giardia lamblia
CNLITPYQCCIEACDEMTRA

SEQ ID NO: 3069919 - protein, 17 aa, Giardia lamblia
CNLIVPLELGFVPPVSI

SEQ ID NO: 3069920 - protein, 17 aa, Giardia lamblia
CNLIYRILATGAIKENP

SEQ ID NO: 3069921 - protein, 18 aa, Giardia lamblia
CNLLNGLLRYEPGNRYSA

SEQ ID NO: 3069922 - protein, 19 aa, Giardia lamblia
CNLLTMVANFLYPGSGENS

SEQ ID NO: 3069923 - protein, 33 aa, Giardia lamblia
CNMEYFMPFISGLRIFYCLQLKTPQTFNHTLRY

SEQ ID NO: 3069924 - protein, 23 aa, Giardia lamblia
CNNAMNWELFYSYVCMLLSSWHV

SEQ ID NO: 3069925 - protein, 20 aa, Giardia lamblia
CNNEEPWLSLSRQYGNVSED

SEQ ID NO: 3069926 - protein, 20 aa, Giardia lamblia
CNPIMASPVFDPSRHGTDVY

SEQ ID NO: 3069927 - protein, 18 aa, Giardia lamblia
CNQGFPGRTVFLYEGGCY

SEQ ID NO: 3069928 - protein, 19 aa, Giardia lamblia
CNSLPNFAPMCAETGSEAR

SEQ ID NO: 3069929 - protein, 19 aa, Giardia lamblia
CNYASGAVTCTRCSAGCLG

SEQ ID NO: 3069930 - protein, 19 aa, Giardia lamblia
CNYASGAVTCTRCSAGYLG

SEQ ID NO: 3069931 - protein, 20 aa, Giardia lamblia
CNYLYMIMWPMWKAYLYIFL

SEQ ID NO: 3069932 - protein, 26 aa, Giardia lamblia
CNYPPGRPVSEYSIAPVMNLSDSHTE

SEQ ID NO: 3069933 - protein, 18 aa, Giardia lamblia
CPDGRLGPECSLLKCGLK

SEQ ID NO: 3069934 - protein, 21 aa, Giardia lamblia
CPEDIIKVYMLFVRILANICA

SEQ ID NO: 3069935 - protein, 27 aa, Giardia lamblia
CPEIDQLGLACLVHLLRTLRDPPTIHH

SEQ ID NO: 3069936 - protein, 24 aa, Giardia lamblia
CPFDEFTCRGLAAEIVSFKYALSV

SEQ ID NO: 3069937 - protein, 21 aa, Giardia lamblia
CPISLKYSLLYTLSLSLPDLG

SEQ ID NO: 3069938 - protein, 24 aa, Giardia lamblia
CPKLYPDDIDIIYKRARDTTNTFS

SEQ ID NO: 3069939 - protein, 20 aa, Giardia lamblia
CPLDKIIVGSTCVLQKSIVI

SEQ ID NO: 3069940 - protein, 20 aa, Giardia lamblia
CPLMFFMYQEIMFYNRMVKD

SEQ ID NO: 3069941 - protein, 18 aa, Giardia lamblia
CPNLFYNVFEIFNELLYI

SEQ ID NO: 3069942 - protein, 21 aa, Giardia lamblia
CPQCGEGYFLHMNGCYKADQA

SEQ ID NO: 3069943 - protein, 20 aa, Giardia lamblia
CPTHVSYNWATWRQQKVASG

SEQ ID NO: 3069944 - protein, 19 aa, Giardia lamblia
CPTNFKLVEFIYGKNKGKH

SEQ ID NO: 3069945 - protein, 18 aa, Giardia lamblia
CPVPLCAYRIPIISRDHR

SEQ ID NO: 3069946 - protein, 22 aa, Giardia lamblia
CPYGGCFVIGLQACLFLEHVVR

SEQ ID NO: 3069947 - protein, 20 aa, Giardia lamblia
CPYSGVQLEAFLNSIFLTLN

SEQ ID NO: 3069948 - protein, 23 aa, Giardia lamblia
CQDCRDHWIIYLLLAGLLLVIII

SEQ ID NO: 3069949 - protein, 22 aa, Giardia lamblia
CQECKEMAALIDDYCRAFTEEE

SEQ ID NO: 3069950 - protein, 24 aa, Giardia lamblia
CQELLQALLSCRLIFSPNYMPSQV

SEQ ID NO: 3069951 - protein, 23 aa, Giardia lamblia
CQISLLLFLHLFSTIPFTQELAD

SEQ ID NO: 3069952 - protein, 23 aa, Giardia lamblia
CQKECIRGCYFADICAFGVCADG

SEQ ID NO: 3069953 - protein, 24 aa, Giardia lamblia
CQLCKGPEISNCILGFNGYRYDSY

SEQ ID NO: 3069954 - protein, 25 aa, Giardia lamblia
CQLCKGPEVSNCILGFNGYRYDSYK

SEQ ID NO: 3069955 - protein, 25 aa, Giardia lamblia
CQLSVYPAVFLCQALIVAAIVLIVQ

SEQ ID NO: 3069956 - protein, 20 aa, Giardia lamblia
CQQCPSGNRWPTGKSGVGCF

SEQ ID NO: 3069957 - protein, 18 aa, Giardia lamblia
CQQIFKRLKYVFNPSNSP

SEQ ID NO: 3069958 - protein, 21 aa, Giardia lamblia
CQQLKLVLHRGLVWISAVLVL

SEQ ID NO: 3069959 - protein, 20 aa, Giardia lamblia
CQRPALFKDLVLRRKDADID

SEQ ID NO: 3069960 - protein, 19 aa, Giardia lamblia
CQSMIEWLNAVVSYYKLAC

SEQ ID NO: 3069961 - protein, 18 aa, Giardia lamblia
CQTIFTLSVLQTYVFHVA

SEQ ID NO: 3069962 - protein, 18 aa, Giardia lamblia
CQTQHKIVPLELSLYALL

SEQ ID NO: 3069963 - protein, 23 aa, Giardia lamblia
CQVFADAVLSHFTRTDVESSLRP

SEQ ID NO: 3069964 - protein, 19 aa, Giardia lamblia
CQYEHRLRNRHGWTALMHA

SEQ ID NO: 3069965 - protein, 23 aa, Giardia lamblia
CRACSTSYCATCQQVDPYLCTKM

SEQ ID NO: 3069966 - protein, 17 aa, Giardia lamblia
CRATLLAHCSHVDSRLQ

SEQ ID NO: 3069967 - protein, 26 aa, Giardia lamblia
CRDPPNLTCLTWIGIDLAVAASQTDR

SEQ ID NO: 3069968 - protein, 19 aa, Giardia lamblia
CRDYFLPIHHPIASYLQGD

SEQ ID NO: 3069969 - protein, 18 aa, Giardia lamblia
CRFLVASEKDCLLCDGRD

SEQ ID NO: 3069970 - protein, 18 aa, Giardia lamblia
CRFYPYICYENETSERIT

SEQ ID NO: 3069971 - protein, 23 aa, Giardia lamblia
CRGRIRPPLYFKIMKTLHAGLAL

SEQ ID NO: 3069972 - protein, 18 aa, Giardia lamblia
CRHMKRKDQVVSQMFLLL

SEQ ID NO: 3069973 - protein, 23 aa, Giardia lamblia
CRHMLRRLLHIYFHVYFNHFGIV

SEQ ID NO: 3069974 - protein, 19 aa, Giardia lamblia
CRIAALDILKGVYRYVDYV

SEQ ID NO: 3069975 - protein, 18 aa, Giardia lamblia
CRKILHGSLFIDTPHLRF

SEQ ID NO: 3069976 - protein, 17 aa, Giardia lamblia
CRLMVIISYTKVFSAPY

SEQ ID NO: 3069977 - protein, 22 aa, Giardia lamblia
CRLPMRASPRWRRKQVHCRYCN

SEQ ID NO: 3069978 - protein, 25 aa, Giardia lamblia
CRLSSFRLLVRVAYALELKEFNLIC

SEQ ID NO: 3069979 - protein, 20 aa, Giardia lamblia
CRPALWHVVRDTLLCEDMNL

SEQ ID NO: 3069980 - protein, 25 aa, Giardia lamblia
CRPIEISTRYAVALMNEFWSLGDLM

SEQ ID NO: 3069981 - protein, 20 aa, Giardia lamblia
CRPSRPSLPPGVMLNKCELI

SEQ ID NO: 3069982 - protein, 20 aa, Giardia lamblia
CRQEDELKRAKAQAHAALET

SEQ ID NO: 3069983 - protein, 17 aa, Giardia lamblia
CRSIKPLISSLCAESGS

SEQ ID NO: 3069984 - protein, 22 aa, Giardia lamblia
CRSLEICWNPTLLGPYRFLRYN

SEQ ID NO: 3069985 - protein, 19 aa, Giardia lamblia
CRTFTRLALYTLLSGSSGT

SEQ ID NO: 3069986 - protein, 22 aa, Giardia lamblia
CRTLRGLHPAPWVLPMGVLAQH

SEQ ID NO: 3069987 - protein, 17 aa, Giardia lamblia
CRYKSASGVELFSYCAV

SEQ ID NO: 3069988 - protein, 17 aa, Giardia lamblia
CSACLTSMERHCPYCRK

SEQ ID NO: 3069989 - protein, 24 aa, Giardia lamblia
CSALPGLYPMKPIVLSLLDAVANN

SEQ ID NO: 3069990 - protein, 17 aa, Giardia lamblia
CSCKMTFKLTSSEEHAL

SEQ ID NO: 3069991 - protein, 17 aa, Giardia lamblia
CSCRAPFALVSGKCVSA

SEQ ID NO: 3069992 - protein, 23 aa, Giardia lamblia
CSCSQGWTPHGTLCYPSACVSGG

SEQ ID NO: 3069993 - protein, 26 aa, Giardia lamblia
CSDCRSAEISEHIALLLRDHVILMDV

SEQ ID NO: 3069994 - protein, 17 aa, Giardia lamblia
CSDENCLTCANDAAVCT

SEQ ID NO: 3069995 - protein, 17 aa, Giardia lamblia
CSEAFRSSSDGKAFKDS

SEQ ID NO: 3069996 - protein, 21 aa, Giardia lamblia
CSENMPCLSDNFLFDKGPHSK

SEQ ID NO: 3069997 - protein, 18 aa, Giardia lamblia
CSFEICRESFFSSPQLHG

SEQ ID NO: 3069998 - protein, 23 aa, Giardia lamblia
CSFREMLIRARHSFLHSPTCAEA

SEQ ID NO: 3069999 - protein, 17 aa, Giardia lamblia
CSFSCMLLSSLSAFSKQ

SEQ ID NO: 3070000 - protein, 25 aa, Giardia lamblia
CSGHKFGSSLSCFAGYAPITISLDQ

SEQ ID NO: 3070001 - protein, 23 aa, Giardia lamblia
CSHCVADLGCIWISNLHWTQSIG

SEQ ID NO: 3070002 - protein, 22 aa, Giardia lamblia
CSHEPKVSLDLMYLISQANACL

SEQ ID NO: 3070003 - protein, 25 aa, Giardia lamblia
CSIDPLRFFKALKIYNPDGSYNQEI

SEQ ID NO: 3070004 - protein, 20 aa, Giardia lamblia
CSKAHISVAMVTGDHYLTAQ

SEQ ID NO: 3070005 - protein, 25 aa, Giardia lamblia
CSKDFIKRFYSFVGNLNVDRFYVIL

SEQ ID NO: 3070006 - protein, 18 aa, Giardia lamblia
CSKDSATTCDTCFSPLVM

SEQ ID NO: 3070007 - protein, 23 aa, Giardia lamblia
CSKGVCTTCGNGYFLHYGSCYKF

SEQ ID NO: 3070008 - protein, 19 aa, Giardia lamblia
CSKNAQLMFSRAVRNALHQ

SEQ ID NO: 3070009 - protein, 17 aa, Giardia lamblia
CSLARGYATGLVVYTGK

SEQ ID NO: 3070010 - protein, 19 aa, Giardia lamblia
CSLCSNNNGFKCTDCKPNY

SEQ ID NO: 3070011 - protein, 20 aa, Giardia lamblia
CSLFYLTFTASSNWERLLAQ

SEQ ID NO: 3070012 - protein, 18 aa, Giardia lamblia
CSLGCPDNFIGVAGEMCR

SEQ ID NO: 3070013 - protein, 21 aa, Giardia lamblia
CSLKANVVVAEYLRVAEFEGM

SEQ ID NO: 3070014 - protein, 24 aa, Giardia lamblia
CSLKVPLVSVLYCMPINDRSAQIC

SEQ ID NO: 3070015 - protein, 32 aa, Giardia lamblia
CSLLNSYSCQEIRYVAALKFYYLSHIGKSKTI

SEQ ID NO: 3070016 - protein, 20 aa, Giardia lamblia
CSMDPWPIVYKMSVYAATVI

SEQ ID NO: 3070017 - protein, 20 aa, Giardia lamblia
CSMFLHKPLSLFTIDDINMK

SEQ ID NO: 3070018 - protein, 18 aa, Giardia lamblia
CSMIAAIVLILSEADQSL

SEQ ID NO: 3070019 - protein, 25 aa, Giardia lamblia
CSMLGILIYCGWVLTHAVVCFVAIE

SEQ ID NO: 3070020 - protein, 17 aa, Giardia lamblia
CSNCSQPSIKSASFQDS

SEQ ID NO: 3070021 - protein, 24 aa, Giardia lamblia
CSNGFFKIGDMCYSYDCLPVGIPD

SEQ ID NO: 3070022 - protein, 20 aa, Giardia lamblia
CSNLRTINRTRLRSNSQPQN

SEQ ID NO: 3070023 - protein, 26 aa, Giardia lamblia
CSNQFLKRYIVAMLIFEKYVIVILAL

SEQ ID NO: 3070024 - protein, 19 aa, Giardia lamblia
CSPCSSFAGDHCVLCSPSA

SEQ ID NO: 3070025 - protein, 17 aa, Giardia lamblia
CSPEFIRDYGWIGTEDA

SEQ ID NO: 3070026 - protein, 17 aa, Giardia lamblia
CSPEPLIPIKPYVKSTL

SEQ ID NO: 3070027 - protein, 20 aa, Giardia lamblia
CSPNILFSAVTPRTIAKLSE

SEQ ID NO: 3070028 - protein, 18 aa, Giardia lamblia
CSQFSGFSKSSAAICAAL

SEQ ID NO: 3070029 - protein, 19 aa, Giardia lamblia
CSQLLYKLICSVDLQVFFR

SEQ ID NO: 3070030 - protein, 29 aa, Giardia lamblia
CSQSDLVYTCFWTTDGIIMDRCMRQYYFF

SEQ ID NO: 3070031 - protein, 20 aa, Giardia lamblia
CSQYGQGCAGGYFEGVGLFA

SEQ ID NO: 3070032 - protein, 28 aa, Giardia lamblia
CSRDALGRTALMWACCNITTPEALDCAL

SEQ ID NO: 3070033 - protein, 30 aa, Giardia lamblia
CSRDYPILLTRLYVIFKRLINFKNGIKLDE

SEQ ID NO: 3070034 - protein, 17 aa, Giardia lamblia
CSRKFVLAVVLGQICAI

SEQ ID NO: 3070035 - protein, 19 aa, Giardia lamblia
CSRSMPLFYNVYVIMSVCQ

SEQ ID NO: 3070036 - protein, 23 aa, Giardia lamblia
CSSCSRGFVNLVENCIPPSCIED

SEQ ID NO: 3070037 - protein, 20 aa, Giardia lamblia
CSSLECAECGLLNTCTKCMS

SEQ ID NO: 3070038 - protein, 19 aa, Giardia lamblia
CSSPIPMSRYKAMEKSKQE

SEQ ID NO: 3070039 - protein, 20 aa, Giardia lamblia
CSSQLLSFFLSFFSIISKNV

SEQ ID NO: 3070040 - protein, 22 aa, Giardia lamblia
CSSRPILFHCISLALFSNSMVH

SEQ ID NO: 3070041 - protein, 18 aa, Giardia lamblia
CSSTIPDYLLHYINRGSL

SEQ ID NO: 3070042 - protein, 21 aa, Giardia lamblia
CSSTVRMNAILIGRLNGAVVL

SEQ ID NO: 3070043 - protein, 17 aa, Giardia lamblia
CSSVALKGLDLTQNIEK

SEQ ID NO: 3070044 - protein, 19 aa, Giardia lamblia
CSTCSGPSHFDCLTCRVGE

SEQ ID NO: 3070045 - protein, 19 aa, Giardia lamblia
CSTLPPLLRLETEGLHEMT

SEQ ID NO: 3070046 - protein, 18 aa, Giardia lamblia
CSTRKCWLTTRVNCLECS

SEQ ID NO: 3070047 - protein, 28 aa, Giardia lamblia
CSVETPLTAAICAPTIAITQPVAVKSKV

SEQ ID NO: 3070048 - protein, 22 aa, Giardia lamblia
CSVINKVYRWPDLYSTVYTPEN

SEQ ID NO: 3070049 - protein, 21 aa, Giardia lamblia
CSVPAQASRRYFFTNYYPIGG

SEQ ID NO: 3070050 - protein, 24 aa, Giardia lamblia
CSVYGADHQIVFVGYGYYKGTEAW

SEQ ID NO: 3070051 - protein, 26 aa, Giardia lamblia
CSYALGVLCALLFVIPGDQWEEYTKS

SEQ ID NO: 3070052 - protein, 26 aa, Giardia lamblia
CSYHAIKHLQCSKAYLKHLPNAVQFL

SEQ ID NO: 3070053 - protein, 24 aa, Giardia lamblia
CTACKNENCASCNIVTTCDECKPG

SEQ ID NO: 3070054 - protein, 17 aa, Giardia lamblia
CTACPASAKSFLFYGGC

SEQ ID NO: 3070055 - protein, 20 aa, Giardia lamblia
CTCCGPATITALWIVITVTG

SEQ ID NO: 3070056 - protein, 18 aa, Giardia lamblia
CTCYDGFYSPGPGLCYDL

SEQ ID NO: 3070057 - protein, 18 aa, Giardia lamblia
CTDFWKEVVNVNFLQIVD

SEQ ID NO: 3070058 - protein, 19 aa, Giardia lamblia
CTECISGFYLINPGTGATC

SEQ ID NO: 3070059 - protein, 24 aa, Giardia lamblia
CTECLPGYYKGAGDKCFKCTASSG

SEQ ID NO: 3070060 - protein, 17 aa, Giardia lamblia
CTGCAPTYFLWQNGCYP

SEQ ID NO: 3070061 - protein, 21 aa, Giardia lamblia
CTGCKEGRYLKPESAAGQSGA

SEQ ID NO: 3070062 - protein, 21 aa, Giardia lamblia
CTHLWWIDLHLTWGNVDTCTS

SEQ ID NO: 3070063 - protein, 22 aa, Giardia lamblia
CTIDKCKKCAILGSSPVCLECE

SEQ ID NO: 3070064 - protein, 20 aa, Giardia lamblia
CTIMGCDPMSFIQLTYRYQG

SEQ ID NO: 3070065 - protein, 20 aa, Giardia lamblia
CTKLLRGCEETLLFNSVVTY

SEQ ID NO: 3070066 - protein, 27 aa, Giardia lamblia
CTKMVCMRCYMHAYSVWNDPVLVFTKG

SEQ ID NO: 3070067 - protein, 20 aa, Giardia lamblia
CTLAKGSVTGLVIYTGKQVR

SEQ ID NO: 3070068 - protein, 17 aa, Giardia lamblia
CTLANILSLPKAILESL

SEQ ID NO: 3070069 - protein, 20 aa, Giardia lamblia
CTNSRVLCCYKLEDNEVDDD

SEQ ID NO: 3070070 - protein, 27 aa, Giardia lamblia
CTPQSCGRESFFSPFMCNCLHGCPDLK

SEQ ID NO: 3070071 - protein, 21 aa, Giardia lamblia
CTRPDVAIVALEFESRCRLGL

SEQ ID NO: 3070072 - protein, 21 aa, Giardia lamblia
CTSCAPEIFFQVFSMGKGMCK

SEQ ID NO: 3070073 - protein, 17 aa, Giardia lamblia
CTSECPLNSSPLYEYIC

SEQ ID NO: 3070074 - protein, 23 aa, Giardia lamblia
CTSRGRCLVGGLVSNTTHNISSS

SEQ ID NO: 3070075 - protein, 24 aa, Giardia lamblia
CTSSYHPLCLVLAGGGIWEEGFDT

SEQ ID NO: 3070076 - protein, 17 aa, Giardia lamblia
CTTCTGGYFLHYGSCYK

SEQ ID NO: 3070077 - protein, 20 aa, Giardia lamblia
CTTCYKQDYDFLVLVDMILR

SEQ ID NO: 3070078 - protein, 26 aa, Giardia lamblia
CTTHLKSPILSLLMRLVTNRKRSDAA

SEQ ID NO: 3070079 - protein, 20 aa, Giardia lamblia
CTVCEKGFYGPMCQPCGGNC

SEQ ID NO: 3070080 - protein, 21 aa, Giardia lamblia
CTVPNCKRCAQGKPAECEECN

SEQ ID NO: 3070081 - protein, 25 aa, Giardia lamblia
CTYLPHIRYLSGLYFMAPPPQALSP

SEQ ID NO: 3070082 - protein, 17 aa, Giardia lamblia
CTYRDAIIVRMNPYMQY

SEQ ID NO: 3070083 - protein, 18 aa, Giardia lamblia
CVACPLAHVIPGSDHGSL

SEQ ID NO: 3070084 - protein, 19 aa, Giardia lamblia
CVACPLAHVIPGSDHGSLE

SEQ ID NO: 3070085 - protein, 21 aa, Giardia lamblia
CVAGYRLSLFNGVNICVFPKS

SEQ ID NO: 3070086 - protein, 19 aa, Giardia lamblia
CVARACYKDGLVCSSAGDC

SEQ ID NO: 3070087 - protein, 28 aa, Giardia lamblia
CVDETLGVAAACFLEACKKQEAQGTLYY

SEQ ID NO: 3070088 - protein, 21 aa, Giardia lamblia
CVDPTCLLSCSPDGQCLYGCT

SEQ ID NO: 3070089 - protein, 19 aa, Giardia lamblia
CVECLPGYMLNRYTQRCLK

SEQ ID NO: 3070090 - protein, 20 aa, Giardia lamblia
CVFVYKSVLLTVRMYTKISA

SEQ ID NO: 3070091 - protein, 28 aa, Giardia lamblia
CVGPFPDYPLIVAEAFSALIPCTIAVSF

SEQ ID NO: 3070092 - protein, 21 aa, Giardia lamblia
CVITLIPSCGIFITMNPGYAG

SEQ ID NO: 3070093 - protein, 22 aa, Giardia lamblia
CVLCKVSGCAKCVSDPTICELC

SEQ ID NO: 3070094 - protein, 21 aa, Giardia lamblia
CVLEGLFAYRCKCHEGYEAHG

SEQ ID NO: 3070095 - protein, 19 aa, Giardia lamblia
CVLKWVISLFNGIKSGDAF

SEQ ID NO: 3070096 - protein, 24 aa, Giardia lamblia
CVLLEEYKQLLAAHMVHEATKPDD

SEQ ID NO: 3070097 - protein, 17 aa, Giardia lamblia
CVLTVFSKVSFELSLFV

SEQ ID NO: 3070098 - protein, 17 aa, Giardia lamblia
CVNTGCIDNGVYCGGDL

SEQ ID NO: 3070099 - protein, 18 aa, Giardia lamblia
CVPKCAVPSFGVSSSSKH

SEQ ID NO: 3070100 - protein, 17 aa, Giardia lamblia
CVQCAAGFMLDNKECVP

SEQ ID NO: 3070101 - protein, 18 aa, Giardia lamblia
CVQKLAAHEACIQNETGW

SEQ ID NO: 3070102 - protein, 26 aa, Giardia lamblia
CVQLLLKAEGMLKCPGGMTPVEYATH

SEQ ID NO: 3070103 - protein, 17 aa, Giardia lamblia
CVSQYLDSILGFFDAIS

SEQ ID NO: 3070104 - protein, 20 aa, Giardia lamblia
CVSSSRLLVQAGYLKETSEL

SEQ ID NO: 3070105 - protein, 41 aa, Giardia lamblia
CWDQIHSLFWPTCRWKVPPIDSLKGSTGWRTEVRCMEMQFS

SEQ ID NO: 3070106 - protein, 27 aa, Giardia lamblia
CWRFMELAVPLLILFCRVHGFNDYFFV

SEQ ID NO: 3070107 - protein, 19 aa, Giardia lamblia
CYACYKITSYMIVFLPTVI

SEQ ID NO: 3070108 - protein, 18 aa, Giardia lamblia
CYDGVCLACLPGYSSPAM

SEQ ID NO: 3070109 - protein, 17 aa, Giardia lamblia
CYHIYCELAGMFYAASR

SEQ ID NO: 3070110 - protein, 19 aa, Giardia lamblia
CYHLWVSTFCCIKRGCASQ

SEQ ID NO: 3070111 - protein, 17 aa, Giardia lamblia
CYISLQFQPQNQCPQPM

SEQ ID NO: 3070112 - protein, 19 aa, Giardia lamblia
CYITLAQAIGMYLGGAPAG

SEQ ID NO: 3070113 - protein, 29 aa, Giardia lamblia
CYLTQIFMFLWLEGCGPYAFYKLSGSLAL

SEQ ID NO: 3070114 - protein, 18 aa, Giardia lamblia
CYMYELIENPTLNNHGGG

SEQ ID NO: 3070115 - protein, 26 aa, Giardia lamblia
CYNINLIHELLRLCRQRMRDRKEPTN

SEQ ID NO: 3070116 - protein, 24 aa, Giardia lamblia
CYNLKEVSCASLVALADNKAFSGK

SEQ ID NO: 3070117 - protein, 20 aa, Giardia lamblia
CYPLECVSMTFYGVGQPSVC

SEQ ID NO: 3070118 - protein, 19 aa, Giardia lamblia
CYPSIELCSNCVAENEFLR

SEQ ID NO: 3070119 - protein, 21 aa, Giardia lamblia
CYQIKLCLDRYKTMLINLAHD

SEQ ID NO: 3070120 - protein, 30 aa, Giardia lamblia
CYTAYWIWLCIAMVIACILIFFDLSQQKVL

SEQ ID NO: 3070121 - protein, 17 aa, Giardia lamblia
CYTCDANATVARQVVPI

SEQ ID NO: 3070122 - protein, 19 aa, Giardia lamblia
CYTCKSQVLCYTPFAHVTR

SEQ ID NO: 3070123 - protein, 22 aa, Giardia lamblia
DAAEVSRLCARFLRETDRTGTT

SEQ ID NO: 3070124 - protein, 18 aa, Giardia lamblia
DAAIEKAKVPWSMRRAYF

SEQ ID NO: 3070125 - protein, 19 aa, Giardia lamblia
DAAVFPAIHMLVNTMEYKR

SEQ ID NO: 3070126 - protein, 25 aa, Giardia lamblia
DACLPCATPGCKACGHASFCTECAG

SEQ ID NO: 3070127 - protein, 24 aa, Giardia lamblia
DACLPCATPGCKTCGHASFCTECA

SEQ ID NO: 3070128 - protein, 25 aa, Giardia lamblia
DACLPCATPGCKTCGHASFCTECAG

SEQ ID NO: 3070129 - protein, 24 aa, Giardia lamblia
DACLPCATPGCKTCGHTSFCTECA

SEQ ID NO: 3070130 - protein, 19 aa, Giardia lamblia
DADALYKYVLRCSYDRGAP

SEQ ID NO: 3070131 - protein, 19 aa, Giardia lamblia
DAEDWISMMYIPRSILPGI

SEQ ID NO: 3070132 - protein, 24 aa, Giardia lamblia
DAEELLCTIMRCAEQSGYDKSYFI

SEQ ID NO: 3070133 - protein, 17 aa, Giardia lamblia
DAELLTFFLVVKQHVTR

SEQ ID NO: 3070134 - protein, 20 aa, Giardia lamblia
DAFCTKELIQTVRWNLAQFQ

SEQ ID NO: 3070135 - protein, 26 aa, Giardia lamblia
DAFRLRGIELLEVFLCVVLPHDTHWL

SEQ ID NO: 3070136 - protein, 17 aa, Giardia lamblia
DAFVCSSVALKGLDLTQ

SEQ ID NO: 3070137 - protein, 17 aa, Giardia lamblia
DAGFSIRFAEVLELTYN

SEQ ID NO: 3070138 - protein, 21 aa, Giardia lamblia
DAGHIPLLFNVDQYKAISNTH

SEQ ID NO: 3070139 - protein, 18 aa, Giardia lamblia
DAHACQRLLNLLKNLGMK

SEQ ID NO: 3070140 - protein, 19 aa, Giardia lamblia
DAHEKELKQEIGRLQNEST

SEQ ID NO: 3070141 - protein, 26 aa, Giardia lamblia
DAHVTRFGAIMWQRNAIKLSVSGSTG

SEQ ID NO: 3070142 - protein, 19 aa, Giardia lamblia
DAICGSCIDPQDGLLAFAK

SEQ ID NO: 3070143 - protein, 18 aa, Giardia lamblia
DAIFPGGYAICLPEAVYE

SEQ ID NO: 3070144 - protein, 24 aa, Giardia lamblia
DAIKPRWTIFMAGIFMTAGSLVIA

SEQ ID NO: 3070145 - protein, 30 aa, Giardia lamblia
DAILMRAFDRIWPRFLRTLVEQIKTHIGNI

SEQ ID NO: 3070146 - protein, 19 aa, Giardia lamblia
DAITPISLRQVIAVLVRDM

SEQ ID NO: 3070147 - protein, 43 aa, Giardia lamblia
DAIVSRTRLNSIFKQKMNWMMLGGLFLQIGLAAAFAYIPIFHV

SEQ ID NO: 3070148 - protein, 24 aa, Giardia lamblia
DAKSFYRLLDWLKQPPTFYNRVLF

SEQ ID NO: 3070149 - protein, 25 aa, Giardia lamblia
DALAMWINYFLSLIVHVLYLVHKSP

SEQ ID NO: 3070150 - protein, 19 aa, Giardia lamblia
DALLCSAYMLFSETDRLSE

SEQ ID NO: 3070151 - protein, 20 aa, Giardia lamblia
DALLEFVHYMMSPKCFYHAL

SEQ ID NO: 3070152 - protein, 25 aa, Giardia lamblia
DALLRIFLVSLIWLKGSSRVSEGIL

SEQ ID NO: 3070153 - protein, 17 aa, Giardia lamblia
DALMMYFPLAVATCDSF

SEQ ID NO: 3070154 - protein, 29 aa, Giardia lamblia
DALNCDIALCILRSIPLATGVLAILRLFH

SEQ ID NO: 3070155 - protein, 20 aa, Giardia lamblia
DALPLARPPLLRAVAVPPGF

SEQ ID NO: 3070156 - protein, 20 aa, Giardia lamblia
DALRNAGDFCRFYQESRRET

SEQ ID NO: 3070157 - protein, 21 aa, Giardia lamblia
DAMEHVCRISRIITTGDALLV

SEQ ID NO: 3070158 - protein, 25 aa, Giardia lamblia
DAQKFICGWIPAIKMLIDLLPLLSY

SEQ ID NO: 3070159 - protein, 26 aa, Giardia lamblia
DAREACYLCTLVHRGWPQKIKKYLRY

SEQ ID NO: 3070160 - protein, 27 aa, Giardia lamblia
DARELFWKKRIGHVISGRLELGLENLP

SEQ ID NO: 3070161 - protein, 25 aa, Giardia lamblia
DARFLRLVKEPGVRPYAMNSSLQTI

SEQ ID NO: 3070162 - protein, 22 aa, Giardia lamblia
DASGGMCAACNQGFPGRTVFLY

SEQ ID NO: 3070163 - protein, 26 aa, Giardia lamblia
DASGNLCAVKHSIVRSGDGYTLHESR

SEQ ID NO: 3070164 - protein, 18 aa, Giardia lamblia
DASSDWNERYGALTLMYC

SEQ ID NO: 3070165 - protein, 25 aa, Giardia lamblia
DATAKKTKKSWCKKKGGYKEDLNKF

SEQ ID NO: 3070166 - protein, 18 aa, Giardia lamblia
DATHWLHMHMCMQGRMMT

SEQ ID NO: 3070167 - protein, 18 aa, Giardia lamblia
DAVIPLPLGYTLGIILAS

SEQ ID NO: 3070168 - protein, 17 aa, Giardia lamblia
DAVKRYIPYQARMVAKL

SEQ ID NO: 3070169 - protein, 24 aa, Giardia lamblia
DAYDPTHCIECLDSAIGEPPDCID

SEQ ID NO: 3070170 - protein, 24 aa, Giardia lamblia
DAYTFSFRVLERYNAKVQEIDADP

SEQ ID NO: 3070171 - protein, 25 aa, Giardia lamblia
DCALQEIYDALAYLGSSARERMARL

SEQ ID NO: 3070172 - protein, 22 aa, Giardia lamblia
DCCVGGCLMKVYYVSLCTNLDP

SEQ ID NO: 3070173 - protein, 22 aa, Giardia lamblia
DCECLPSQFVLSHVSVSHPSST

SEQ ID NO: 3070174 - protein, 19 aa, Giardia lamblia
DCEVLRAFLDAPKEEDSQS

SEQ ID NO: 3070175 - protein, 20 aa, Giardia lamblia
DCHYVRIVSLCDVFSRSMTA

SEQ ID NO: 3070176 - protein, 19 aa, Giardia lamblia
DCISDLKLLTTARRADTAS

SEQ ID NO: 3070177 - protein, 20 aa, Giardia lamblia
DCPFPRLGKPSSEKNSIRKR

SEQ ID NO: 3070178 - protein, 18 aa, Giardia lamblia
DCRQVGKYGTRSMTPFPL

SEQ ID NO: 3070179 - protein, 21 aa, Giardia lamblia
DCSNIKLAIEYNLDKISKYIC

SEQ ID NO: 3070180 - protein, 17 aa, Giardia lamblia
DCTHIRLIFAPNRKIFQ

SEQ ID NO: 3070181 - protein, 17 aa, Giardia lamblia
DCWLKQRIDKASESHDH

SEQ ID NO: 3070182 - protein, 21 aa, Giardia lamblia
DDAAVCLAPLLTIDHEASHVT

SEQ ID NO: 3070183 - protein, 21 aa, Giardia lamblia
DDCKRILDTFSSFRNHRLTPY

SEQ ID NO: 3070184 - protein, 18 aa, Giardia lamblia
DDCTRFHSDIAIIASHYI

SEQ ID NO: 3070185 - protein, 27 aa, Giardia lamblia
DDDTCCGRHLLLWTVIVIMAILLLITF

SEQ ID NO: 3070186 - protein, 25 aa, Giardia lamblia
DDELHCRRMLHLAALYGSLISACTL

SEQ ID NO: 3070187 - protein, 24 aa, Giardia lamblia
DDESVLYFAEFVQLYTSGSVAYDF

SEQ ID NO: 3070188 - protein, 22 aa, Giardia lamblia
DDFDFLPSYLTWFICSNQSCID

SEQ ID NO: 3070189 - protein, 24 aa, Giardia lamblia
DDGDKCALFYAIIHGAKDVAELLF

SEQ ID NO: 3070190 - protein, 18 aa, Giardia lamblia
DDGWRIVQSPERYNMEKP

SEQ ID NO: 3070191 - protein, 27 aa, Giardia lamblia
DDHIAISIYISRVFARMKTAALRLCFK

SEQ ID NO: 3070192 - protein, 26 aa, Giardia lamblia
DDIFKGPKFRVISFIGNLFSYCNPLF

SEQ ID NO: 3070193 - protein, 23 aa, Giardia lamblia
DDISRFAAISVPFDGVGGYSMAG

SEQ ID NO: 3070194 - protein, 27 aa, Giardia lamblia
DDIYFLSTLLHFCRVSFAMYGCVGTKY

SEQ ID NO: 3070195 - protein, 27 aa, Giardia lamblia
DDKGWWSVGMTSLFMIFDYVGRSLPQI

SEQ ID NO: 3070196 - protein, 26 aa, Giardia lamblia
DDLEHAVNIAMARKHFDIVTYLNTVR

SEQ ID NO: 3070197 - protein, 24 aa, Giardia lamblia
DDLGRLNFLISRCDSIAKRILDLL

SEQ ID NO: 3070198 - protein, 20 aa, Giardia lamblia
DDLKRGCMCLITEATDDGTV

SEQ ID NO: 3070199 - protein, 25 aa, Giardia lamblia
DDLKSKRTGVLWQPYADTISIVTKD

SEQ ID NO: 3070200 - protein, 17 aa, Giardia lamblia
DDLNKFIWPIRISGNRH

SEQ ID NO: 3070201 - protein, 19 aa, Giardia lamblia
DDLPVGPAVYLGSDSSAYV

SEQ ID NO: 3070202 - protein, 19 aa, Giardia lamblia
DDRSKWAVDVWEIGQGMRL

SEQ ID NO: 3070203 - protein, 29 aa, Giardia lamblia
DDTHRCSLSPINVWCCSPTAPIVLFVSDG

SEQ ID NO: 3070204 - protein, 27 aa, Giardia lamblia
DDTPEFKRPFFARARVRCTVVPFNGTS

SEQ ID NO: 3070205 - protein, 20 aa, Giardia lamblia
DDYIRAYRALEEMETVNTSP

SEQ ID NO: 3070206 - protein, 23 aa, Giardia lamblia
DEACAVILAVFYSLYKELPATTM

SEQ ID NO: 3070207 - protein, 22 aa, Giardia lamblia
DEADMLLEYGFQQELEAILRML

SEQ ID NO: 3070208 - protein, 19 aa, Giardia lamblia
DEAGWPALFYAVVSGDSIS

SEQ ID NO: 3070209 - protein, 24 aa, Giardia lamblia
DEAQKGIDAWDCLTSDCEHGENSY

SEQ ID NO: 3070210 - protein, 24 aa, Giardia lamblia
DECHILITWAFLFKKDYIVVCKKA

SEQ ID NO: 3070211 - protein, 23 aa, Giardia lamblia
DECIPSKCVYRKSLDDPAIACNR

SEQ ID NO: 3070212 - protein, 23 aa, Giardia lamblia
DEDRLKNVIKICALETDLNSMAH

SEQ ID NO: 3070213 - protein, 25 aa, Giardia lamblia
DEEALRLKLEYSMLYCRLASIFTYS

SEQ ID NO: 3070214 - protein, 17 aa, Giardia lamblia
DEFAVAYMKFTGKGLHG

SEQ ID NO: 3070215 - protein, 21 aa, Giardia lamblia
DEFIRARGYELLFSEIADCKG

SEQ ID NO: 3070216 - protein, 23 aa, Giardia lamblia
DEGCELLNALLIFASNELDFDLA

SEQ ID NO: 3070217 - protein, 17 aa, Giardia lamblia
DEGFELTSLEEYTPIRY

SEQ ID NO: 3070218 - protein, 19 aa, Giardia lamblia
DEGNTALHYAVRANSVGAC

SEQ ID NO: 3070219 - protein, 25 aa, Giardia lamblia
DEHDPGWWSDFWRQIPVIDKDARTT

SEQ ID NO: 3070220 - protein, 23 aa, Giardia lamblia
DEIAARAGVVAVYPDISLSIKVP

SEQ ID NO: 3070221 - protein, 20 aa, Giardia lamblia
DEKCDIWSLGSVLYELCTLR

SEQ ID NO: 3070222 - protein, 25 aa, Giardia lamblia
DELEPRLGALDRSRTGEILRRGMAS

SEQ ID NO: 3070223 - protein, 20 aa, Giardia lamblia
DELFCGSSRVSGEDFWASRL

SEQ ID NO: 3070224 - protein, 33 aa, Giardia lamblia
DELIRYSPWYLRSVKLYGLMVARCTRVCIPRML

SEQ ID NO: 3070225 - protein, 20 aa, Giardia lamblia
DELKSSITGLAHLQEDQFSL

SEQ ID NO: 3070226 - protein, 17 aa, Giardia lamblia
DEMTFLLTTPVSYFDLE

SEQ ID NO: 3070227 - protein, 17 aa, Giardia lamblia
DEMTRASVYGMTTRTAN

SEQ ID NO: 3070228 - protein, 17 aa, Giardia lamblia
DENCLTCANDAAVCTGC

SEQ ID NO: 3070229 - protein, 20 aa, Giardia lamblia
DEPYHTLAFAAKNREPGIDI

SEQ ID NO: 3070230 - protein, 27 aa, Giardia lamblia
DERVIVLDLLFRCCAANPQELMPHAEP

SEQ ID NO: 3070231 - protein, 24 aa, Giardia lamblia
DESLYFYQCIHLFESTEFFMPEET

SEQ ID NO: 3070232 - protein, 19 aa, Giardia lamblia
DESTCLVCADGYILHQTDA

SEQ ID NO: 3070233 - protein, 26 aa, Giardia lamblia
DEVRSSPKLSILALLPYFYVGPDPQD

SEQ ID NO: 3070234 - protein, 25 aa, Giardia lamblia
DEYLWSLVIPDEIINLLIVLNNIYI

SEQ ID NO: 3070235 - protein, 17 aa, Giardia lamblia
DFAALTMELFRTPESLS

SEQ ID NO: 3070236 - protein, 23 aa, Giardia lamblia
DFAKATHLVKLFQFISQTNPSSI

SEQ ID NO: 3070237 - protein, 25 aa, Giardia lamblia
DFEDKRPSTTIVRLLVKYRDIREVT

SEQ ID NO: 3070238 - protein, 22 aa, Giardia lamblia
DFEHLKIVPLTVGQDMPVSTNP

SEQ ID NO: 3070239 - protein, 19 aa, Giardia lamblia
DFETGVFPQYLMLAKNGSD

SEQ ID NO: 3070240 - protein, 24 aa, Giardia lamblia
DFFCLTESMVPVSLSYHGIVAQAI

SEQ ID NO: 3070241 - protein, 20 aa, Giardia lamblia
DFGERIYPSPSWSAEVLGTK

SEQ ID NO: 3070242 - protein, 23 aa, Giardia lamblia
DFHARPTIPLSTFVVLPYIDQEI

SEQ ID NO: 3070243 - protein, 23 aa, Giardia lamblia
DFHERLSPVSLLIGILSSTGRNM

SEQ ID NO: 3070244 - protein, 18 aa, Giardia lamblia
DFIHKVSVLTSWEDRRQL

SEQ ID NO: 3070245 - protein, 21 aa, Giardia lamblia
DFISITLPLLLTMLAASIMFN

SEQ ID NO: 3070246 - protein, 25 aa, Giardia lamblia
DFITIPFRIGFAISLIGEAIILASG

SEQ ID NO: 3070247 - protein, 17 aa, Giardia lamblia
DFLEGKDPKDVFVDGWR

SEQ ID NO: 3070248 - protein, 20 aa, Giardia lamblia
DFLIKVVAFAFRLTSAQVSH

SEQ ID NO: 3070249 - protein, 17 aa, Giardia lamblia
DFLLIEAHLSFSQGELM

SEQ ID NO: 3070250 - protein, 18 aa, Giardia lamblia
DFLPLVVELLRLYSHDEH

SEQ ID NO: 3070251 - protein, 18 aa, Giardia lamblia
DFLTLALDERYGAKNTVT

SEQ ID NO: 3070252 - protein, 27 aa, Giardia lamblia
DFNKIRDCPCCDYAIGADIAFQRPIVP

SEQ ID NO: 3070253 - protein, 24 aa, Giardia lamblia
DFPKGCNALAMAMMSGHKESVQLL

SEQ ID NO: 3070254 - protein, 25 aa, Giardia lamblia
DFPLNCADKIFSKDIMVVSSSECMR

SEQ ID NO: 3070255 - protein, 21 aa, Giardia lamblia
DFSAKILVLAILFPGFATFFF

SEQ ID NO: 3070256 - protein, 25 aa, Giardia lamblia
DFSLPEFKYLRRLLFVHGHYTHLRN

SEQ ID NO: 3070257 - protein, 17 aa, Giardia lamblia
DFVCLISLHLKNDKAAY

SEQ ID NO: 3070258 - protein, 24 aa, Giardia lamblia
DFVSKLYSNVCIMESSQLNFSENA

SEQ ID NO: 3070259 - protein, 21 aa, Giardia lamblia
DFVSLCIEAILPFTVTPNYAL

SEQ ID NO: 3070260 - protein, 21 aa, Giardia lamblia
DGACTGCKTTGYFLFQGGCYT

SEQ ID NO: 3070261 - protein, 17 aa, Giardia lamblia
DGAFKDPHFKASEQYIM

SEQ ID NO: 3070262 - protein, 17 aa, Giardia lamblia
DGAFRPPSWPDLVTASN

SEQ ID NO: 3070263 - protein, 27 aa, Giardia lamblia
DGAIYCMRYAGVFIFGAIYGVLFRVDL

SEQ ID NO: 3070264 - protein, 23 aa, Giardia lamblia
DGAKRLKTPCVNLKVDVVNLNAH

SEQ ID NO: 3070265 - protein, 17 aa, Giardia lamblia
DGANPLVYCIEPVIVNP

SEQ ID NO: 3070266 - protein, 19 aa, Giardia lamblia
DGAVCPHGNCVLLEAAKNY

SEQ ID NO: 3070267 - protein, 24 aa, Giardia lamblia
DGAVSPPVIYYKLGHVTLPLIDSM

SEQ ID NO: 3070268 - protein, 19 aa, Giardia lamblia
DGAYFLYKGGCYGVDNEPG

SEQ ID NO: 3070269 - protein, 26 aa, Giardia lamblia
DGCSPMAFTGTFAFTLVSHVRECVEV

SEQ ID NO: 3070270 - protein, 21 aa, Giardia lamblia
DGCYTYWMMGSLYLLVGDGEF

SEQ ID NO: 3070271 - protein, 17 aa, Giardia lamblia
DGDALCRALLFFDSNNR

SEQ ID NO: 3070272 - protein, 23 aa, Giardia lamblia
DGDEVPADCLLMISSSQTKTAMV

SEQ ID NO: 3070273 - protein, 23 aa, Giardia lamblia
DGDSTCMPLAFLFEQQQYSLVEN

SEQ ID NO: 3070274 - protein, 18 aa, Giardia lamblia
DGETAWQIAQRNSHKHLL

SEQ ID NO: 3070275 - protein, 23 aa, Giardia lamblia
DGEVEYRPVLPFIQNKHYTSMGE

SEQ ID NO: 3070276 - protein, 21 aa, Giardia lamblia
DGFCLPKACIFEITKLDNTKM

SEQ ID NO: 3070277 - protein, 19 aa, Giardia lamblia
DGFCLPKACIFEITTLTNQ

SEQ ID NO: 3070278 - protein, 19 aa, Giardia lamblia
DGFCLPKACMFEITTLTNQ

SEQ ID NO: 3070279 - protein, 19 aa, Giardia lamblia
DGFCLPKQCIFKVPRLDGG

SEQ ID NO: 3070280 - protein, 19 aa, Giardia lamblia
DGFCLPKSCVFAVGTLDGQ

SEQ ID NO: 3070281 - protein, 17 aa, Giardia lamblia
DGFPLLTMLSMKPNKAI

SEQ ID NO: 3070282 - protein, 24 aa, Giardia lamblia
DGFRRGEVYTSFFMALPSSVRQLY

SEQ ID NO: 3070283 - protein, 17 aa, Giardia lamblia
DGFRSDGTFVEYFSSII

SEQ ID NO: 3070284 - protein, 17 aa, Giardia lamblia
DGICTGLLGVYVGISDN

SEQ ID NO: 3070285 - protein, 19 aa, Giardia lamblia
DGIFRAGLLLCCTLISFFA

SEQ ID NO: 3070286 - protein, 22 aa, Giardia lamblia
DGILACCALAILLSEDVPDKFH

SEQ ID NO: 3070287 - protein, 19 aa, Giardia lamblia
DGIRLGCTCYDGFYSPGPG

SEQ ID NO: 3070288 - protein, 24 aa, Giardia lamblia
DGKKPKCLCNKGFETVGSDLCVPM

SEQ ID NO: 3070289 - protein, 19 aa, Giardia lamblia
DGKLIYDRAEFLPPAESFY

SEQ ID NO: 3070290 - protein, 20 aa, Giardia lamblia
DGLFQYCLICSETKSHWMFE

SEQ ID NO: 3070291 - protein, 23 aa, Giardia lamblia
DGLRAKNIFDRRLVYFSNKNYSG

SEQ ID NO: 3070292 - protein, 20 aa, Giardia lamblia
DGLSSIMWLVTAAKNSDNVA

SEQ ID NO: 3070293 - protein, 18 aa, Giardia lamblia
DGMFAEFSTLPIYSEILD

SEQ ID NO: 3070294 - protein, 17 aa, Giardia lamblia
DGNACICDGNLVPVGNV

SEQ ID NO: 3070295 - protein, 23 aa, Giardia lamblia
DGPRCACDLLYILSAQYGCVPLN

SEQ ID NO: 3070296 - protein, 21 aa, Giardia lamblia
DGQFGHMWYNYCGGVGDCIQK

SEQ ID NO: 3070297 - protein, 18 aa, Giardia lamblia
DGQLRVLSLLTQEVAYID

SEQ ID NO: 3070298 - protein, 20 aa, Giardia lamblia
DGQPKCLGCWDEAATGVANC

SEQ ID NO: 3070299 - protein, 18 aa, Giardia lamblia
DGRIGPECISMRCLATTR

SEQ ID NO: 3070300 - protein, 21 aa, Giardia lamblia
DGRRPLHVTAFRQEYPEVVYL

SEQ ID NO: 3070301 - protein, 21 aa, Giardia lamblia
DGSVHFIDFEAVFEYPKLLSY

SEQ ID NO: 3070302 - protein, 26 aa, Giardia lamblia
DGTFSYKPCFPFVYTTSATPFNSRPF

SEQ ID NO: 3070303 - protein, 22 aa, Giardia lamblia
DGVDYANFMGFRGRRDDESVIS

SEQ ID NO: 3070304 - protein, 17 aa, Giardia lamblia
DGVLGVHDLHVWTFTDE

SEQ ID NO: 3070305 - protein, 24 aa, Giardia lamblia
DGVPGCATCTFSSSLTCNSCKPNY

SEQ ID NO: 3070306 - protein, 17 aa, Giardia lamblia
DGVQWAQFMEQFEIKKE

SEQ ID NO: 3070307 - protein, 33 aa, Giardia lamblia
DGVYAYPPFWAMGAYIFVLWSMKLMDARHIARA

SEQ ID NO: 3070308 - protein, 23 aa, Giardia lamblia
DHGAPSLPPRRPSCGDSTTEPNS

SEQ ID NO: 3070309 - protein, 18 aa, Giardia lamblia
DHHCPWIGNCVGLRNHGY

SEQ ID NO: 3070310 - protein, 20 aa, Giardia lamblia
DHIRMNLSIDTALLIMDATR

SEQ ID NO: 3070311 - protein, 22 aa, Giardia lamblia
DHKKGVVFCLSLASPSVASLSF

SEQ ID NO: 3070312 - protein, 18 aa, Giardia lamblia
DHLICSRLSRAVTSPSLS

SEQ ID NO: 3070313 - protein, 25 aa, Giardia lamblia
DHTPIIPVMCRWSEQKEMPEKSENI

SEQ ID NO: 3070314 - protein, 21 aa, Giardia lamblia
DHVLRLRRLIFSSSGGVHVPE

SEQ ID NO: 3070315 - protein, 26 aa, Giardia lamblia
DIAVFFCSKAWHAAFLITPIDALGHE

SEQ ID NO: 3070316 - protein, 18 aa, Giardia lamblia
DIDESCGVTSEYTFISRP

SEQ ID NO: 3070317 - protein, 17 aa, Giardia lamblia
DIDKGWCHFSREKHDTE

SEQ ID NO: 3070318 - protein, 25 aa, Giardia lamblia
DIERMKRIIACLNQVFVQLSELVVE

SEQ ID NO: 3070319 - protein, 33 aa, Giardia lamblia
DIFELMYAKVFPRLKFCQYFIKQPGTVFHDIRY

SEQ ID NO: 3070320 - protein, 26 aa, Giardia lamblia
DIFFLSASCFNWLKLSVRVLANIVPD

SEQ ID NO: 3070321 - protein, 17 aa, Giardia lamblia
DIGLFVIAWLYFGNFIP

SEQ ID NO: 3070322 - protein, 33 aa, Giardia lamblia
DIGLIDFFHTARMFRWIGVVITIVLAGVLASIL

SEQ ID NO: 3070323 - protein, 20 aa, Giardia lamblia
DIHLTSMLTRAGLDFFDSDS

SEQ ID NO: 3070324 - protein, 20 aa, Giardia lamblia
DIHTKYKFMRPMGALFNIYR

SEQ ID NO: 3070325 - protein, 20 aa, Giardia lamblia
DIIANFKLVYTPLIEKSLPL

SEQ ID NO: 3070326 - protein, 23 aa, Giardia lamblia
DIIRQGRCSLVTLIMTYKTLALK

SEQ ID NO: 3070327 - protein, 17 aa, Giardia lamblia
DILGMPLIDCILKDVYR

SEQ ID NO: 3070328 - protein, 17 aa, Giardia lamblia
DILKGVYRYVDYVRTLE

SEQ ID NO: 3070329 - protein, 17 aa, Giardia lamblia
DILLLAFSLHISADSVT

SEQ ID NO: 3070330 - protein, 22 aa, Giardia lamblia
DILPATELVQFIAYASYETELV

SEQ ID NO: 3070331 - protein, 24 aa, Giardia lamblia
DIMKRVWQSLLIFKGDFLNEAING

SEQ ID NO: 3070332 - protein, 27 aa, Giardia lamblia
DIPDPLPDLLFRKIVFEIVNLLVSAED

SEQ ID NO: 3070333 - protein, 22 aa, Giardia lamblia
DIPEEARFSFSVTTSGTYQLCF

SEQ ID NO: 3070334 - protein, 24 aa, Giardia lamblia
DIPELCLKLLTLVKLRLVTTIAHA

SEQ ID NO: 3070335 - protein, 18 aa, Giardia lamblia
DIRGHGLLFIDLLLGTTY

SEQ ID NO: 3070336 - protein, 18 aa, Giardia lamblia
DIRLEFYEQFPFTETYQD

SEQ ID NO: 3070337 - protein, 19 aa, Giardia lamblia
DISDYRAGTQILIGSTCLD

SEQ ID NO: 3070338 - protein, 19 aa, Giardia lamblia
DISEIISLVTKFEKVFMLT

SEQ ID NO: 3070339 - protein, 24 aa, Giardia lamblia
DISLCSIIVPWLMTGFAGYLMPRE

SEQ ID NO: 3070340 - protein, 18 aa, Giardia lamblia
DIVEECYYYLAKLSSCLF

SEQ ID NO: 3070341 - protein, 20 aa, Giardia lamblia
DIVSRVEPFPKRQADHPTVG

SEQ ID NO: 3070342 - protein, 26 aa, Giardia lamblia
DIVYDCVPIRAFTVFAIHVTDLAIKF

SEQ ID NO: 3070343 - protein, 26 aa, Giardia lamblia
DIYLQLNPMVKWTIICYIQKDVVTIR

SEQ ID NO: 3070344 - protein, 25 aa, Giardia lamblia
DKAIPRILLASLFLDRVARARIPIS

SEQ ID NO: 3070345 - protein, 25 aa, Giardia lamblia
DKAKTLRGGRGFALGTGASGARGRD

SEQ ID NO: 3070346 - protein, 28 aa, Giardia lamblia
DKDLIWKYRYYMRKYPRGLIKVISSIPQ

SEQ ID NO: 3070347 - protein, 17 aa, Giardia lamblia
DKECLLASLGQQNLNTA

SEQ ID NO: 3070348 - protein, 22 aa, Giardia lamblia
DKELLSGKLLYLSKELFSNLTN

SEQ ID NO: 3070349 - protein, 17 aa, Giardia lamblia
DKFKELWVKIWKPPHPE

SEQ ID NO: 3070350 - protein, 25 aa, Giardia lamblia
DKGAFSVRTIMHFGQCISAVSSSLV

SEQ ID NO: 3070351 - protein, 24 aa, Giardia lamblia
DKGITLKLAIGMLHIIADVILFIR

SEQ ID NO: 3070352 - protein, 25 aa, Giardia lamblia
DKGVCTTCASGYFFHYGSCYKFGGS

SEQ ID NO: 3070353 - protein, 22 aa, Giardia lamblia
DKGVCTTCGNGYFFHYGSCYKF

SEQ ID NO: 3070354 - protein, 20 aa, Giardia lamblia
DKIIFTIDWKQLRPRLFERI

SEQ ID NO: 3070355 - protein, 17 aa, Giardia lamblia
DKIPYQYIYKVLLDEED

SEQ ID NO: 3070356 - protein, 17 aa, Giardia lamblia
DKLCSSSLYALVPDFHC

SEQ ID NO: 3070357 - protein, 20 aa, Giardia lamblia
DKLDAYIKMRSHVRELGLFI

SEQ ID NO: 3070358 - protein, 18 aa, Giardia lamblia
DKLFTRPTAIIIPSIAEL

SEQ ID NO: 3070359 - protein, 24 aa, Giardia lamblia
DKLGVIFPFVMLKNHQTTASDDAF

SEQ ID NO: 3070360 - protein, 25 aa, Giardia lamblia
DKLLKYICIKLCKGVSQASVQRELT

SEQ ID NO: 3070361 - protein, 17 aa, Giardia lamblia
DKLVCSLLHPQVVTDHS

SEQ ID NO: 3070362 - protein, 19 aa, Giardia lamblia
DKMELVYKIMLSRFNGAST

SEQ ID NO: 3070363 - protein, 23 aa, Giardia lamblia
DKNGRTALMYAARACLSPGVPGL

SEQ ID NO: 3070364 - protein, 18 aa, Giardia lamblia
DKPLLQWNDVLERNPVLY

SEQ ID NO: 3070365 - protein, 40 aa, Giardia lamblia
DKQCKTEFLLEALRRLPACRKSWFIPWFTNKAIVPALDLP

SEQ ID NO: 3070366 - protein, 20 aa, Giardia lamblia
DKRVALWGLDGAQLLGIVQR

SEQ ID NO: 3070367 - protein, 17 aa, Giardia lamblia
DKSFPICVAVLDKTALA

SEQ ID NO: 3070368 - protein, 17 aa, Giardia lamblia
DKSRWFNHNTLYNVDFL

SEQ ID NO: 3070369 - protein, 21 aa, Giardia lamblia
DKSSWAGKKIESILASRIIEQ

SEQ ID NO: 3070370 - protein, 24 aa, Giardia lamblia
DKSVKRLDAVSVMDPLTSEIHDTQ

SEQ ID NO: 3070371 - protein, 23 aa, Giardia lamblia
DKTRLRHGHSFNVSTLEDYHRLH

SEQ ID NO: 3070372 - protein, 25 aa, Giardia lamblia
DKVINLRCRLHMASVLLHPKILTSA

SEQ ID NO: 3070373 - protein, 19 aa, Giardia lamblia
DKVVTCLSIAQSCGLLPNT

SEQ ID NO: 3070374 - protein, 20 aa, Giardia lamblia
DKVVTCLSIAQSCGLLPNTA

SEQ ID NO: 3070375 - protein, 19 aa, Giardia lamblia
DKWTFEGHHLFIDDINDRV

SEQ ID NO: 3070376 - protein, 23 aa, Giardia lamblia
DKYYPGWRAFRDEHDPGWWSDFW

SEQ ID NO: 3070377 - protein, 18 aa, Giardia lamblia
DLACSIGYRSIISPGSSK

SEQ ID NO: 3070378 - protein, 23 aa, Giardia lamblia
DLAGLRYNPLFPYFKSSYGAKHA

SEQ ID NO: 3070379 - protein, 20 aa, Giardia lamblia
DLAIKFCTINGVANDTILTF

SEQ ID NO: 3070380 - protein, 24 aa, Giardia lamblia
DLAKALAMPCIVFNCSESLDYRIM

SEQ ID NO: 3070381 - protein, 33 aa, Giardia lamblia
DLALAHKVIEHYYRVAMKEALYLNKPHIQKQLT

SEQ ID NO: 3070382 - protein, 19 aa, Giardia lamblia
DLANVYALLLQRSSKAMSY

SEQ ID NO: 3070383 - protein, 26 aa, Giardia lamblia
DLAVVLCFPCKHVVTCKSCWKQLNNT

SEQ ID NO: 3070384 - protein, 22 aa, Giardia lamblia
DLAYGCLKRQLVMDNPHASSLL

SEQ ID NO: 3070385 - protein, 25 aa, Giardia lamblia
DLCDYKFNILDFIQLLASIKALMRR

SEQ ID NO: 3070386 - protein, 17 aa, Giardia lamblia
DLCPIVYFYDIGVQLLH

SEQ ID NO: 3070387 - protein, 17 aa, Giardia lamblia
DLCSISLGSAHPRLRKA

SEQ ID NO: 3070388 - protein, 21 aa, Giardia lamblia
DLCVPMECIKDGAVCPHGNCV

SEQ ID NO: 3070389 - protein, 23 aa, Giardia lamblia
DLDHPGLRCKGCYQICCSSPIPM

SEQ ID NO: 3070390 - protein, 25 aa, Giardia lamblia
DLDSGGLAAKNFSLFCSEILTQDTT

SEQ ID NO: 3070391 - protein, 30 aa, Giardia lamblia
DLDVYFYSKFIRLFLWGVSSKRTMDTYWSD

SEQ ID NO: 3070392 - protein, 24 aa, Giardia lamblia
DLESSKICYSEVYKAPVAAQGEID

SEQ ID NO: 3070393 - protein, 18 aa, Giardia lamblia
DLFFKRQPLAYNITRINL

SEQ ID NO: 3070394 - protein, 25 aa, Giardia lamblia
DLFLPEVGEALLLTSYTLVEVLKVV

SEQ ID NO: 3070395 - protein, 23 aa, Giardia lamblia
DLFMIKLTGFRLFNIAYDPIEDT

SEQ ID NO: 3070396 - protein, 25 aa, Giardia lamblia
DLFPDILSVSLWIACPAVIFIVTNL

SEQ ID NO: 3070397 - protein, 26 aa, Giardia lamblia
DLFSFGCLLYRILFRRYPFEQFMDKS

SEQ ID NO: 3070398 - protein, 24 aa, Giardia lamblia
DLGALSGHSSWGFLSQIAETVANP

SEQ ID NO: 3070399 - protein, 20 aa, Giardia lamblia
DLGKTLGMYVVVFNCSDQMD

SEQ ID NO: 3070400 - protein, 18 aa, Giardia lamblia
DLHLIEFISRSNVQSLPV

SEQ ID NO: 3070401 - protein, 20 aa, Giardia lamblia
DLICSCLYPSISSQSAISTN

SEQ ID NO: 3070402 - protein, 26 aa, Giardia lamblia
DLIEKADCTKLFIEFFSATGPQKALF

SEQ ID NO: 3070403 - protein, 25 aa, Giardia lamblia
DLIQYFKLAITFSKYSSNVFHGACS

SEQ ID NO: 3070404 - protein, 21 aa, Giardia lamblia
DLIRQWTRVCDSIPKDAAPPS

SEQ ID NO: 3070405 - protein, 24 aa, Giardia lamblia
DLIRRCPLIRSAVLYNNIYTSTSA

SEQ ID NO: 3070406 - protein, 19 aa, Giardia lamblia
DLISIFFNHFDVVPEDDHY

SEQ ID NO: 3070407 - protein, 18 aa, Giardia lamblia
DLISRASSNFDIPDNQRI

SEQ ID NO: 3070408 - protein, 26 aa, Giardia lamblia
DLISSWPHYLWIALWGILIGTAITLL

SEQ ID NO: 3070409 - protein, 26 aa, Giardia lamblia
DLKCSPLPRRICSLMESRYNRQKYVV

SEQ ID NO: 3070410 - protein, 25 aa, Giardia lamblia
DLKDVLIELACTYLLQAKLIDADIS

SEQ ID NO: 3070411 - protein, 23 aa, Giardia lamblia
DLKKLILDVLVEFCTGFPTVLDP

SEQ ID NO: 3070412 - protein, 26 aa, Giardia lamblia
DLKPFCIKGGISGPANRAFFYNSSSP

SEQ ID NO: 3070413 - protein, 22 aa, Giardia lamblia
DLKYSQVVVKEFQCAKLDKPMY

SEQ ID NO: 3070414 - protein, 26 aa, Giardia lamblia
DLLEALKLLCKGNMLATDKLLQCIQE

SEQ ID NO: 3070415 - protein, 20 aa, Giardia lamblia
DLLEFCLVPNPTLRPQIRDV

SEQ ID NO: 3070416 - protein, 18 aa, Giardia lamblia
DLLFVIVPCQAFAGVAVN

SEQ ID NO: 3070417 - protein, 26 aa, Giardia lamblia
DLLGAILLCLQFLFDVKDEALFFTAI

SEQ ID NO: 3070418 - protein, 25 aa, Giardia lamblia
DLLKRPGRLLTFLAIDPSEHEDTRS

SEQ ID NO: 3070419 - protein, 19 aa, Giardia lamblia
DLLLCISRTTGAFYIPTFQ

SEQ ID NO: 3070420 - protein, 17 aa, Giardia lamblia
DLLLRKRQDALNEIQSL

SEQ ID NO: 3070421 - protein, 26 aa, Giardia lamblia
DLLPEAVGLYFLLAIVCRSYHLNGGN

SEQ ID NO: 3070422 - protein, 17 aa, Giardia lamblia
DLLQLHAFIAINVISFY

SEQ ID NO: 3070423 - protein, 20 aa, Giardia lamblia
DLLRNLCSMYEQLDSCHRLK

SEQ ID NO: 3070424 - protein, 21 aa, Giardia lamblia
DLLSYRIQQIITDYCRKNEQP

SEQ ID NO: 3070425 - protein, 25 aa, Giardia lamblia
DLLTSDLFTGLGLATHFRKTITGLI

SEQ ID NO: 3070426 - protein, 19 aa, Giardia lamblia
DLMELFKLSFRSEDKTFFR

SEQ ID NO: 3070427 - protein, 18 aa, Giardia lamblia
DLPFSMKNTRFVAISAGV

SEQ ID NO: 3070428 - protein, 26 aa, Giardia lamblia
DLPWLPPPVWKTVLWFLFDTVMILIS

SEQ ID NO: 3070429 - protein, 24 aa, Giardia lamblia
DLQGRSALIYAVMYGCSAVIPLLL

SEQ ID NO: 3070430 - protein, 27 aa, Giardia lamblia
DLQQSLLRFYKFRGLDLSPDRVAIVTD

SEQ ID NO: 3070431 - protein, 21 aa, Giardia lamblia
DLRKCIKAMRCRNGGQRLTVI

SEQ ID NO: 3070432 - protein, 24 aa, Giardia lamblia
DLSADMQKAGLIAMYMGISELRAE

SEQ ID NO: 3070433 - protein, 20 aa, Giardia lamblia
DLSAVLSYRASYSNGDISVS

SEQ ID NO: 3070434 - protein, 23 aa, Giardia lamblia
DLSGNCKPELALKMDVKCHDISQ

SEQ ID NO: 3070435 - protein, 21 aa, Giardia lamblia
DLSLPCVSIGVAHERADITDE

SEQ ID NO: 3070436 - protein, 20 aa, Giardia lamblia
DLSPIFSALIAVLPTAPIST

SEQ ID NO: 3070437 - protein, 23 aa, Giardia lamblia
DLSRECPSVRSFSQYNPTEFATG

SEQ ID NO: 3070438 - protein, 25 aa, Giardia lamblia
DLSVYRLVSILGRLPLFNQGSVLSQ

SEQ ID NO: 3070439 - protein, 20 aa, Giardia lamblia
DLTCKLLLSNAFRLTNLDSM

SEQ ID NO: 3070440 - protein, 30 aa, Giardia lamblia
DLTLWLSPRYNCFKLVDLFATKSDIRIVVQ

SEQ ID NO: 3070441 - protein, 25 aa, Giardia lamblia
DLTSGMTCIAGYCQKGCLFDDDCGA

SEQ ID NO: 3070442 - protein, 28 aa, Giardia lamblia
DLTWGWWWICWCSLSLREGLLGISRASE

SEQ ID NO: 3070443 - protein, 17 aa, Giardia lamblia
DLVCTRCSPGLVSVDGF

SEQ ID NO: 3070444 - protein, 22 aa, Giardia lamblia
DLVLELYGGIKVDKKAAKSLET

SEQ ID NO: 3070445 - protein, 29 aa, Giardia lamblia
DLVLRYPVPNTKLGAWGFINAYVASDHIS

SEQ ID NO: 3070446 - protein, 17 aa, Giardia lamblia
DLVSRYGSQTGYKPILP

SEQ ID NO: 3070447 - protein, 28 aa, Giardia lamblia
DLYSFRKSCLRLRSFFSDNLLIVDPDEQ

SEQ ID NO: 3070448 - protein, 28 aa, Giardia lamblia
DLYSYRSLPRFFAVLASLIAAVIITIIV

SEQ ID NO: 3070449 - protein, 33 aa, Giardia lamblia
DMCACLYEARLLRLNHKLVLLYHRYTRLLHINL

SEQ ID NO: 3070450 - protein, 23 aa, Giardia lamblia
DMIIGICVLIVFTFVNLLTKSTG

SEQ ID NO: 3070451 - protein, 25 aa, Giardia lamblia
DMLALLCPCVNYLDILEHELSVTVT

SEQ ID NO: 3070452 - protein, 20 aa, Giardia lamblia
DMLNLRITFINVDSNEDRVL

SEQ ID NO: 3070453 - protein, 26 aa, Giardia lamblia
DMLQAMAIRYRIDYAIEKASLDDIFT

SEQ ID NO: 3070454 - protein, 18 aa, Giardia lamblia
DMPLCAACDESGRCLLCV

SEQ ID NO: 3070455 - protein, 21 aa, Giardia lamblia
DMPSHLFQLKYKYTRPPDTPL

SEQ ID NO: 3070456 - protein, 19 aa, Giardia lamblia
DMQSFLSVTFLYTDISTSL

SEQ ID NO: 3070457 - protein, 20 aa, Giardia lamblia
DMSALLGSSVAVIFNLKPIM

SEQ ID NO: 3070458 - protein, 25 aa, Giardia lamblia
DMSLVEPMYLFALSYYIRLFVTAIN

SEQ ID NO: 3070459 - protein, 22 aa, Giardia lamblia
DMVCDAFVLLLSLCFFSYAKSI

SEQ ID NO: 3070460 - protein, 25 aa, Giardia lamblia
DMVTRMCIIAGPCAPLDGLPIAFNE

SEQ ID NO: 3070461 - protein, 22 aa, Giardia lamblia
DMVYRAWYQLRYASGTPEQGAP

SEQ ID NO: 3070462 - protein, 25 aa, Giardia lamblia
DNDRSIRAALIFAITLILINSSSRF

SEQ ID NO: 3070463 - protein, 24 aa, Giardia lamblia
DNEGRSLLMYAMFGVPPQHLSNII

SEQ ID NO: 3070464 - protein, 17 aa, Giardia lamblia
DNELVDILKLCGLNLRT

SEQ ID NO: 3070465 - protein, 18 aa, Giardia lamblia
DNFMKYLISKVAGYNVEE

SEQ ID NO: 3070466 - protein, 26 aa, Giardia lamblia
DNGMPCFLADFGPYVFFAGSVMVPPL

SEQ ID NO: 3070467 - protein, 21 aa, Giardia lamblia
DNIVSLILGWIFSELDTPGQI

SEQ ID NO: 3070468 - protein, 22 aa, Giardia lamblia
DNKRIRAPVSLTLQDLSSDEDE

SEQ ID NO: 3070469 - protein, 23 aa, Giardia lamblia
DNLGRTALMYAAFTGLTLAAQEL

SEQ ID NO: 3070470 - protein, 18 aa, Giardia lamblia
DNLNLLLKEIEFVVERGG

SEQ ID NO: 3070471 - protein, 20 aa, Giardia lamblia
DNLVHFFSFLGGVEACTSKI

SEQ ID NO: 3070472 - protein, 17 aa, Giardia lamblia
DNNIKLISCSRATTRII

SEQ ID NO: 3070473 - protein, 26 aa, Giardia lamblia
DNPEFPFLFVSGLRKTYRKAKRCTVV

SEQ ID NO: 3070474 - protein, 20 aa, Giardia lamblia
DNPLILVFVLIYFVSILFLN

SEQ ID NO: 3070475 - protein, 17 aa, Giardia lamblia
DNPLVCFNLMAIMMTIR

SEQ ID NO: 3070476 - protein, 26 aa, Giardia lamblia
DNPRRITFLPKWPLFIRGILEAVAII

SEQ ID NO: 3070477 - protein, 19 aa, Giardia lamblia
DNPSLISFVNILSSRLGHI

SEQ ID NO: 3070478 - protein, 20 aa, Giardia lamblia
DNTGHCALHYAIRRKNADLT

SEQ ID NO: 3070479 - protein, 19 aa, Giardia lamblia
DPAALSLFLSRICINEYDN

SEQ ID NO: 3070480 - protein, 17 aa, Giardia lamblia
DPAELLGFIGSRLHAMF

SEQ ID NO: 3070481 - protein, 22 aa, Giardia lamblia
DPALRMMGGVFNLFHVNPAESF

SEQ ID NO: 3070482 - protein, 17 aa, Giardia lamblia
DPCYLKYDGVLSQSGKT

SEQ ID NO: 3070483 - protein, 21 aa, Giardia lamblia
DPEVPSWKNTVFRDVIEFFEK

SEQ ID NO: 3070484 - protein, 19 aa, Giardia lamblia
DPFSKEYIMPFGVLVIMIL

SEQ ID NO: 3070485 - protein, 19 aa, Giardia lamblia
DPGFALTPFSVWGSGNTQQ

SEQ ID NO: 3070486 - protein, 18 aa, Giardia lamblia
DPGNLYLLHEGWIQGLSL

SEQ ID NO: 3070487 - protein, 25 aa, Giardia lamblia
DPHKVWKPGLPRLSYTVTAVITIEE

SEQ ID NO: 3070488 - protein, 28 aa, Giardia lamblia
DPKVAAFVACCFILICFMISVFLTDINP

SEQ ID NO: 3070489 - protein, 17 aa, Giardia lamblia
DPLLKRQIWAFVKDLVE

SEQ ID NO: 3070490 - protein, 24 aa, Giardia lamblia
DPPIPKWIMFLPFNSIAFSLGDAL

SEQ ID NO: 3070491 - protein, 27 aa, Giardia lamblia
DPQLSYCYFPLVVLALVYLYLIRANLP

SEQ ID NO: 3070492 - protein, 18 aa, Giardia lamblia
DPSHPIVQLKDAILELRL

SEQ ID NO: 3070493 - protein, 23 aa, Giardia lamblia
DPSSIRYKGNFRQAFKRLVDDPV

SEQ ID NO: 3070494 - protein, 24 aa, Giardia lamblia
DPSVLPLLVKLCRTNPDINDLRLL

SEQ ID NO: 3070495 - protein, 24 aa, Giardia lamblia
DPSWRVRLATWNMLARHNFTDLVS

SEQ ID NO: 3070496 - protein, 22 aa, Giardia lamblia
DPVDMRAVFEINKARSQSPFRC

SEQ ID NO: 3070497 - protein, 20 aa, Giardia lamblia
DPVLLFRLSQSINYKNKDSV

SEQ ID NO: 3070498 - protein, 19 aa, Giardia lamblia
DPVLLRLISRVIQKYTGIS

SEQ ID NO: 3070499 - protein, 35 aa, Giardia lamblia
DPVPWSGECVSAFLTRYQRAFFKLFHQQGSSGDFF

SEQ ID NO: 3070500 - protein, 19 aa, Giardia lamblia
DPWIGCFFYTRGHSIPCLN

SEQ ID NO: 3070501 - protein, 23 aa, Giardia lamblia
DPYEGSPRYSIFMREGTRVGNCK

SEQ ID NO: 3070502 - protein, 25 aa, Giardia lamblia
DPYLVLKAGLTFGVMFPLSLLRNVK

SEQ ID NO: 3070503 - protein, 23 aa, Giardia lamblia
DQCFFDPYRLIPVSFAACSKFDH

SEQ ID NO: 3070504 - protein, 28 aa, Giardia lamblia
DQFDARLCWDILLLYGRNRGLVLSGLEH

SEQ ID NO: 3070505 - protein, 24 aa, Giardia lamblia
DQGHCGSCYTAATVWAMTARVMVA

SEQ ID NO: 3070506 - protein, 17 aa, Giardia lamblia
DQISCVFTDQQIAALKC

SEQ ID NO: 3070507 - protein, 33 aa, Giardia lamblia
DQLARLSDRLTLMPEFARFILEFIPVAPFDEEL

SEQ ID NO: 3070508 - protein, 35 aa, Giardia lamblia
DQLMGPTCPFIFIEVPFFYRYVIESSTSKGILSSL

SEQ ID NO: 3070509 - protein, 17 aa, Giardia lamblia
DQLRPELLFKQRKCYSV

SEQ ID NO: 3070510 - protein, 19 aa, Giardia lamblia
DQNISFVFLLRLILPANIH

SEQ ID NO: 3070511 - protein, 18 aa, Giardia lamblia
DQQCRSMLSLALESIDGA

SEQ ID NO: 3070512 - protein, 18 aa, Giardia lamblia
DQRKVCSFLPKQPNIIQT

SEQ ID NO: 3070513 - protein, 23 aa, Giardia lamblia
DQSSSCSHVWLCSETGELTSVLI

SEQ ID NO: 3070514 - protein, 24 aa, Giardia lamblia
DQTKLYSVCLTIFLDMNKQCINLP

SEQ ID NO: 3070515 - protein, 18 aa, Giardia lamblia
DQTMLHRFAQVFSSIAEV

SEQ ID NO: 3070516 - protein, 33 aa, Giardia lamblia
DQVGVGFLAFFGFSIKQARAFTKVFRAAHPMQE

SEQ ID NO: 3070517 - protein, 22 aa, Giardia lamblia
DQVVRFVGSIFRRDIMKAELGR

SEQ ID NO: 3070518 - protein, 18 aa, Giardia lamblia
DQVVSQMFLLLRSEFSRQ

SEQ ID NO: 3070519 - protein, 17 aa, Giardia lamblia
DQYSAYIITEFFVFGNV

SEQ ID NO: 3070520 - protein, 19 aa, Giardia lamblia
DRANNALTYKSKFTLDTMC

SEQ ID NO: 3070521 - protein, 24 aa, Giardia lamblia
DRARYEKVLDICCLIPDLKLFKAG

SEQ ID NO: 3070522 - protein, 18 aa, Giardia lamblia
DRGHACFINFLTTIAPYY

SEQ ID NO: 3070523 - protein, 27 aa, Giardia lamblia
DRGSVCKRLSIGFSLSLLDFVLGYAAS

SEQ ID NO: 3070524 - protein, 24 aa, Giardia lamblia
DRHTIKTIYLYGGCAQWDSDTWAK

SEQ ID NO: 3070525 - protein, 24 aa, Giardia lamblia
DRIDPVSCSELFYTTLMPKCTDDS

SEQ ID NO: 3070526 - protein, 30 aa, Giardia lamblia
DRIQRSRILSALCPFLGLPMTIKAVEDFAA

SEQ ID NO: 3070527 - protein, 21 aa, Giardia lamblia
DRKTYKIILSVDVFLTQQNLD

SEQ ID NO: 3070528 - protein, 24 aa, Giardia lamblia
DRKYRPKEFFGLKRYCKEQPQYVA

SEQ ID NO: 3070529 - protein, 20 aa, Giardia lamblia
DRLLSCSKFDPLLIALQNKI

SEQ ID NO: 3070530 - protein, 19 aa, Giardia lamblia
DRLPSPKLKKIAADLIFNN

SEQ ID NO: 3070531 - protein, 22 aa, Giardia lamblia
DRLRTFPSLVTNLTIDWFKNWP

SEQ ID NO: 3070532 - protein, 23 aa, Giardia lamblia
DRNKCVCYPGFVSIDGKCYSKQC

SEQ ID NO: 3070533 - protein, 24 aa, Giardia lamblia
DRNMAIKRVHLWAKKKYGLQQLVT

SEQ ID NO: 3070534 - protein, 21 aa, Giardia lamblia
DRPTLRHLGLETVPPTTVDEG

SEQ ID NO: 3070535 - protein, 22 aa, Giardia lamblia
DRRFSMHSTMFYSGRAYCRPSR

SEQ ID NO: 3070536 - protein, 24 aa, Giardia lamblia
DRRVTEFTSLFSHMSHHKWNATRL

SEQ ID NO: 3070537 - protein, 19 aa, Giardia lamblia
DRSKGASLLTMLISLADHI

SEQ ID NO: 3070538 - protein, 25 aa, Giardia lamblia
DRSMGWKNAIDFAIITPANAEEICR

SEQ ID NO: 3070539 - protein, 24 aa, Giardia lamblia
DRSYKDFFPPIFVHSSKKKTGFLE

SEQ ID NO: 3070540 - protein, 31 aa, Giardia lamblia
DRTASLEWLGGAWSALCDAGIECYVTSEEFR

SEQ ID NO: 3070541 - protein, 17 aa, Giardia lamblia
DRTASVFMRDYLGSQPS

SEQ ID NO: 3070542 - protein, 24 aa, Giardia lamblia
DRTRRFYCGFAEGLTDGITTNGPS

SEQ ID NO: 3070543 - protein, 17 aa, Giardia lamblia
DRYGRYVSHLILSQYHE

SEQ ID NO: 3070544 - protein, 24 aa, Giardia lamblia
DRYMDGLVTKRCVRSGTTNILSTF

SEQ ID NO: 3070545 - protein, 20 aa, Giardia lamblia
DSALEYFSRLQLDIITTILR

SEQ ID NO: 3070546 - protein, 27 aa, Giardia lamblia
DSCDAGRSPILFVICRGKLAEGIDFSN

SEQ ID NO: 3070547 - protein, 20 aa, Giardia lamblia
DSEFACPICMSDPNYPVLTQ

SEQ ID NO: 3070548 - protein, 30 aa, Giardia lamblia
DSEIALLRWYILKVCIKFGDLSNPCRPIEI

SEQ ID NO: 3070549 - protein, 24 aa, Giardia lamblia
DSELKWAQSLIVCEILLALGKVFS

SEQ ID NO: 3070550 - protein, 19 aa, Giardia lamblia
DSFCGNLGFATCDNSAQKC

SEQ ID NO: 3070551 - protein, 17 aa, Giardia lamblia
DSFLRFTPDNYKTYLQN

SEQ ID NO: 3070552 - protein, 33 aa, Giardia lamblia
DSFQLPSDFDFELCLLDPLAGAAVRLLRDMTPT

SEQ ID NO: 3070553 - protein, 25 aa, Giardia lamblia
DSFSKADCWSRFYQKCLVTALSAWM

SEQ ID NO: 3070554 - protein, 24 aa, Giardia lamblia
DSFYCKSPLMARAIQTYFDFVRPI

SEQ ID NO: 3070555 - protein, 25 aa, Giardia lamblia
DSGICRICASRTFLDSRKTCSACSS

SEQ ID NO: 3070556 - protein, 21 aa, Giardia lamblia
DSHVYRTPYLYLLPQFPDLSA

SEQ ID NO: 3070557 - protein, 25 aa, Giardia lamblia
DSIAFQWNLYHSLRILGSSSSVSAS

SEQ ID NO: 3070558 - protein, 21 aa, Giardia lamblia
DSILQRFSRELLFVQRSTANV

SEQ ID NO: 3070559 - protein, 19 aa, Giardia lamblia
DSISGSYCRAAISESSLDD

SEQ ID NO: 3070560 - protein, 20 aa, Giardia lamblia
DSISRILIRSLYPLKPLCKN

SEQ ID NO: 3070561 - protein, 18 aa, Giardia lamblia
DSISRYLLCKETPKKQPN

SEQ ID NO: 3070562 - protein, 27 aa, Giardia lamblia
DSKGMCLSCSDATHGITGCKKCALKTL

SEQ ID NO: 3070563 - protein, 17 aa, Giardia lamblia
DSKGWTALMKAAFYGKS

SEQ ID NO: 3070564 - protein, 23 aa, Giardia lamblia
DSKKAKKGLALSLTLYASLFLLS

SEQ ID NO: 3070565 - protein, 20 aa, Giardia lamblia
DSLAFICSFAAPRLLLKPSL

SEQ ID NO: 3070566 - protein, 24 aa, Giardia lamblia
DSLIGVIRLACDILIDEVGLKELR

SEQ ID NO: 3070567 - protein, 19 aa, Giardia lamblia
DSLMLLGIQNSVFRRQIDI

SEQ ID NO: 3070568 - protein, 26 aa, Giardia lamblia
DSLPASMCRPLPYIRHIASLKDIPPH

SEQ ID NO: 3070569 - protein, 21 aa, Giardia lamblia
DSLPIIFKLLEQVTLTPTQIV

SEQ ID NO: 3070570 - protein, 19 aa, Giardia lamblia
DSLPPAYGVHSLPQAIFAL

SEQ ID NO: 3070571 - protein, 17 aa, Giardia lamblia
DSLQRLAVTSAIEQTLL

SEQ ID NO: 3070572 - protein, 27 aa, Giardia lamblia
DSNPNICLCASCASTFGSPSCGNNASN

SEQ ID NO: 3070573 - protein, 26 aa, Giardia lamblia
DSPCLKVGTCYTFAWGPTGNKDVEAF

SEQ ID NO: 3070574 - protein, 22 aa, Giardia lamblia
DSPDFLQLFGCIYYETHATALE

SEQ ID NO: 3070575 - protein, 29 aa, Giardia lamblia
DSPLFVGGELHYRIVLTVNKLCSENRMFE

SEQ ID NO: 3070576 - protein, 17 aa, Giardia lamblia
DSPMSIEKLRFISELFQ

SEQ ID NO: 3070577 - protein, 19 aa, Giardia lamblia
DSRRGLVDLLLKFIFVFAI

SEQ ID NO: 3070578 - protein, 20 aa, Giardia lamblia
DSRYYALLRKLCNSVFNATT

SEQ ID NO: 3070579 - protein, 21 aa, Giardia lamblia
DSSCLKCAGRESRSCTLCPPG

SEQ ID NO: 3070580 - protein, 24 aa, Giardia lamblia
DSSGTMKLDMCFGDEQMSSSQEHE

SEQ ID NO: 3070581 - protein, 34 aa, Giardia lamblia
DSSSEFNMVRFLEAQSGGASRIFGQSIFGLSQAI

SEQ ID NO: 3070582 - protein, 20 aa, Giardia lamblia
DSTISGRLLFAVDLAIANGH

SEQ ID NO: 3070583 - protein, 29 aa, Giardia lamblia
DSTVHLKWRPATCGLTYASTVDFWITDRF

SEQ ID NO: 3070584 - protein, 28 aa, Giardia lamblia
DSVEFYYEFLRFIGMASILMLDGGMKQK

SEQ ID NO: 3070585 - protein, 20 aa, Giardia lamblia
DSVFNRGKYVTIPYGSESYG

SEQ ID NO: 3070586 - protein, 19 aa, Giardia lamblia
DSYLPLLRVLGMMHYSVHT

SEQ ID NO: 3070587 - protein, 24 aa, Giardia lamblia
DSYRDICIQFSLMIERSRLCVYFP

SEQ ID NO: 3070588 - protein, 24 aa, Giardia lamblia
DTADWPYTFIFTGHSLGAGVAALL

SEQ ID NO: 3070589 - protein, 18 aa, Giardia lamblia
DTCLSCALEVEHCGLCSY

SEQ ID NO: 3070590 - protein, 17 aa, Giardia lamblia
DTCPAFKNPSVLLECQM

SEQ ID NO: 3070591 - protein, 18 aa, Giardia lamblia
DTFSRAIFLGNVLISNTY

SEQ ID NO: 3070592 - protein, 26 aa, Giardia lamblia
DTGRITDFLAFIPMFTAVPFRLVYSI

SEQ ID NO: 3070593 - protein, 24 aa, Giardia lamblia
DTHLFCSLCFNLSGVDALVSKCLC

SEQ ID NO: 3070594 - protein, 19 aa, Giardia lamblia
DTIEMLSILASVTKDEVLG

SEQ ID NO: 3070595 - protein, 17 aa, Giardia lamblia
DTIPDKPLLQWNDVLER

SEQ ID NO: 3070596 - protein, 25 aa, Giardia lamblia
DTKRAPCFDPLLFLMLDAGASYFFS

SEQ ID NO: 3070597 - protein, 21 aa, Giardia lamblia
DTKSPKAKRGIEKSSTDQVSR

SEQ ID NO: 3070598 - protein, 19 aa, Giardia lamblia
DTKYTDFLLYNSFFEVASN

SEQ ID NO: 3070599 - protein, 25 aa, Giardia lamblia
DTLFAQYCVCKNAFVNTLYENMFSK

SEQ ID NO: 3070600 - protein, 22 aa, Giardia lamblia
DTLLEFYSYLTLTPGGYTRYVP

SEQ ID NO: 3070601 - protein, 17 aa, Giardia lamblia
DTNCIDCNQSTGECSAC

SEQ ID NO: 3070602 - protein, 18 aa, Giardia lamblia
DTNCKSCVVDNICEECKD

SEQ ID NO: 3070603 - protein, 18 aa, Giardia lamblia
DTNIPIRVPHDLYQNVVN

SEQ ID NO: 3070604 - protein, 26 aa, Giardia lamblia
DTPGKLPKDRSWKAAKNVMGSIDTFL

SEQ ID NO: 3070605 - protein, 24 aa, Giardia lamblia
DTPHLRFIAKMNVDLWKSELKRRK

SEQ ID NO: 3070606 - protein, 21 aa, Giardia lamblia
DTRFAIEAHRSFFDVYLSSCI

SEQ ID NO: 3070607 - protein, 18 aa, Giardia lamblia
DTRLAVLATGSFADGYLD

SEQ ID NO: 3070608 - protein, 26 aa, Giardia lamblia
DTRLFYKLKKVLLRAVTKQVQKYDKT

SEQ ID NO: 3070609 - protein, 22 aa, Giardia lamblia
DTRVDHVMTMFGRMRGLSKKEC

SEQ ID NO: 3070610 - protein, 22 aa, Giardia lamblia
DTSFRSPLIILDKLLKDAFHRR

SEQ ID NO: 3070611 - protein, 25 aa, Giardia lamblia
DTSLRCTREDMALSMANDDLVDNNS

SEQ ID NO: 3070612 - protein, 19 aa, Giardia lamblia
DTSLRPSIRTWRKKWKSQL

SEQ ID NO: 3070613 - protein, 22 aa, Giardia lamblia
DTSMLPPTLKAVARRVSSNSDD

SEQ ID NO: 3070614 - protein, 17 aa, Giardia lamblia
DTTEFFLAVGGESFVTD

SEQ ID NO: 3070615 - protein, 18 aa, Giardia lamblia
DTTIRAWNWLAGIELACF

SEQ ID NO: 3070616 - protein, 30 aa, Giardia lamblia
DTTLALIFFNFCGLSIILADELGDNRDDVV

SEQ ID NO: 3070617 - protein, 21 aa, Giardia lamblia
DTTVYPGRILFFVRPVKRNVQ

SEQ ID NO: 3070618 - protein, 17 aa, Giardia lamblia
DTVCSRCAAGYIISSSA

SEQ ID NO: 3070619 - protein, 17 aa, Giardia lamblia
DTVDEYSEFCALSECGR

SEQ ID NO: 3070620 - protein, 28 aa, Giardia lamblia
DTVFAGSFYRFILYALLPLLARALPVQQ

SEQ ID NO: 3070621 - protein, 17 aa, Giardia lamblia
DTVFPLWLGLIHSLLHS

SEQ ID NO: 3070622 - protein, 23 aa, Giardia lamblia
DTWTELYHSIAIQQRELLSRIQL

SEQ ID NO: 3070623 - protein, 26 aa, Giardia lamblia
DTYTIFPFRYVMSYLNNVTYDELSCV

SEQ ID NO: 3070624 - protein, 39 aa, Giardia lamblia
DVANCSRCKTVVWKQQWGWRFLIGILFFIFWISLAFLDD

SEQ ID NO: 3070625 - protein, 18 aa, Giardia lamblia
DVDCSFILALGEGVVGAL

SEQ ID NO: 3070626 - protein, 25 aa, Giardia lamblia
DVDSCSISNCLVCLANNRDVCATCS

SEQ ID NO: 3070627 - protein, 19 aa, Giardia lamblia
DVEALCGWTGLNKENYPDV

SEQ ID NO: 3070628 - protein, 20 aa, Giardia lamblia
DVFSDIWPAFAMAYEGEETD

SEQ ID NO: 3070629 - protein, 23 aa, Giardia lamblia
DVFVPRLCTLLLKHLNSTVPFFN

SEQ ID NO: 3070630 - protein, 24 aa, Giardia lamblia
DVFVVIFCCLLRYHALTISKSKEL

SEQ ID NO: 3070631 - protein, 23 aa, Giardia lamblia
DVGFHCGKPLFTLTIFNNKSTDL

SEQ ID NO: 3070632 - protein, 18 aa, Giardia lamblia
DVHGCTDYYLNLVELSKK

SEQ ID NO: 3070633 - protein, 25 aa, Giardia lamblia
DVHPPLHLCVINLVIGTLYTVRGNI

SEQ ID NO: 3070634 - protein, 19 aa, Giardia lamblia
DVIREVLKTSATIHSITMA

SEQ ID NO: 3070635 - protein, 23 aa, Giardia lamblia
DVISVSDTHGWIYGHRHLPEYGD

SEQ ID NO: 3070636 - protein, 18 aa, Giardia lamblia
DVKLCSMVLLPYAGDQSR

SEQ ID NO: 3070637 - protein, 19 aa, Giardia lamblia
DVLNVFLLMMLGKCEHSDH

SEQ ID NO: 3070638 - protein, 24 aa, Giardia lamblia
DVLRGCPVCLVNGGCRCVRVSWPA

SEQ ID NO: 3070639 - protein, 22 aa, Giardia lamblia
DVLRLARSHELAFMAQLSPEQD

SEQ ID NO: 3070640 - protein, 20 aa, Giardia lamblia
DVLSLTPLVSFRNLEAQVRL

SEQ ID NO: 3070641 - protein, 24 aa, Giardia lamblia
DVNFVVVCGCCFSINELIQYGGRC

SEQ ID NO: 3070642 - protein, 21 aa, Giardia lamblia
DVPFPTGSLAEPWSCAEYQIT

SEQ ID NO: 3070643 - protein, 29 aa, Giardia lamblia
DVSKAIGGFCGRIFLRDSVVIYEVSSSCT

SEQ ID NO: 3070644 - protein, 19 aa, Giardia lamblia
DVSLYRWLHFTTTLLSICV

SEQ ID NO: 3070645 - protein, 25 aa, Giardia lamblia
DVTLELFASPSLRVPHTANKVVNLE

SEQ ID NO: 3070646 - protein, 18 aa, Giardia lamblia
DVTLPYLPGDSMQSTRFL

SEQ ID NO: 3070647 - protein, 19 aa, Giardia lamblia
DVVKFVLSVVAMRADNSCY

SEQ ID NO: 3070648 - protein, 20 aa, Giardia lamblia
DVVLRLAMAGVSLYLETDRT

SEQ ID NO: 3070649 - protein, 24 aa, Giardia lamblia
DVVPLISALFFRDFNLNKIQESNR

SEQ ID NO: 3070650 - protein, 24 aa, Giardia lamblia
DVVPQPVLYDGFRTDGTFIEYYSS

SEQ ID NO: 3070651 - protein, 24 aa, Giardia lamblia
DVVPQPVLYDGFRTDGTFVEYYSS

SEQ ID NO: 3070652 - protein, 25 aa, Giardia lamblia
DVYHMSFNYYWRHRNNALALTGNAY

SEQ ID NO: 3070653 - protein, 22 aa, Giardia lamblia
DWLRLKNKIIYHSKSVAGSIYN

SEQ ID NO: 3070654 - protein, 18 aa, Giardia lamblia
DWRRTGYVHSYRHDPPPA

SEQ ID NO: 3070655 - protein, 19 aa, Giardia lamblia
DWSKPGAKFSAHYLSALSS

SEQ ID NO: 3070656 - protein, 19 aa, Giardia lamblia
DWVSWPLLVNDCTQLHEVD

SEQ ID NO: 3070657 - protein, 30 aa, Giardia lamblia
DYCECPTCLWTCSKLGFYDVYKEEEIKNGQ

SEQ ID NO: 3070658 - protein, 20 aa, Giardia lamblia
DYDIYWDVWVLVLSISVSVI

SEQ ID NO: 3070659 - protein, 20 aa, Giardia lamblia
DYELKYEVSNFFYGGLYGPY

SEQ ID NO: 3070660 - protein, 34 aa, Giardia lamblia
DYFVKRVRRVLSKACISIGIAHGLCIETILGNHG

SEQ ID NO: 3070661 - protein, 20 aa, Giardia lamblia
DYHGSAVIHPLKLPSTESEL

SEQ ID NO: 3070662 - protein, 21 aa, Giardia lamblia
DYIAAGLFLMHGFATAQDLGR

SEQ ID NO: 3070663 - protein, 24 aa, Giardia lamblia
DYIECARLLLDEVCMQDANGWTAL

SEQ ID NO: 3070664 - protein, 20 aa, Giardia lamblia
DYIFVFICGIPITALNFTLN

SEQ ID NO: 3070665 - protein, 17 aa, Giardia lamblia
DYIGCVRSCSLALKEFN

SEQ ID NO: 3070666 - protein, 27 aa, Giardia lamblia
DYIVVCKKASWLRRIFHTNLSLLSGSL

SEQ ID NO: 3070667 - protein, 19 aa, Giardia lamblia
DYLERSGDVIFIRSISTPG

SEQ ID NO: 3070668 - protein, 25 aa, Giardia lamblia
DYLKRKIKLTINWTVALAGVTTISA

SEQ ID NO: 3070669 - protein, 18 aa, Giardia lamblia
DYLLHGIAYLFGIYCTIT

SEQ ID NO: 3070670 - protein, 27 aa, Giardia lamblia
DYLRSCNSWPDFPWHIFSDCLTPSNIW

SEQ ID NO: 3070671 - protein, 18 aa, Giardia lamblia
DYPRGLKEIAEYTQETRL

SEQ ID NO: 3070672 - protein, 29 aa, Giardia lamblia
DYRGLPFLYSHYKTFLFFYINSEATILKP

SEQ ID NO: 3070673 - protein, 28 aa, Giardia lamblia
DYSVCLYVVPNFCLFPKAATRAATATLK

SEQ ID NO: 3070674 - protein, 24 aa, Giardia lamblia
DYTQKRLVCGRVSLPFYESPDERS

SEQ ID NO: 3070675 - protein, 21 aa, Giardia lamblia
DYVDCSLLFLLEIADNLYRAL

SEQ ID NO: 3070676 - protein, 25 aa, Giardia lamblia
DYVTAVGAWLCPVVFIIHLCVALII

SEQ ID NO: 3070677 - protein, 19 aa, Giardia lamblia
EAAAAIYARGLVNRQAMVT

SEQ ID NO: 3070678 - protein, 20 aa, Giardia lamblia
EAACMYSALNCLRTIRDADS

SEQ ID NO: 3070679 - protein, 20 aa, Giardia lamblia
EAAERYILVTGIRRTLLPTL

SEQ ID NO: 3070680 - protein, 20 aa, Giardia lamblia
EAAGAFTYPSLIKYKDKIAI

SEQ ID NO: 3070681 - protein, 20 aa, Giardia lamblia
EAAIKLLLHYGDGSTDIDKA

SEQ ID NO: 3070682 - protein, 29 aa, Giardia lamblia
EAAKRLSIDRGRWLSTWIGVGGAVSNVAI

SEQ ID NO: 3070683 - protein, 22 aa, Giardia lamblia
EAANYCLCPQIIQLFEGDPQKA

SEQ ID NO: 3070684 - protein, 19 aa, Giardia lamblia
EACALYDGVLYPYGSPLGR

SEQ ID NO: 3070685 - protein, 26 aa, Giardia lamblia
EADNARECIALIPGLTVFSTASPGVV

SEQ ID NO: 3070686 - protein, 24 aa, Giardia lamblia
EADRMANGLIHFLKSTHSYTDKEG

SEQ ID NO: 3070687 - protein, 22 aa, Giardia lamblia
EAEASVIIPHIIKGLIEDSDDK

SEQ ID NO: 3070688 - protein, 18 aa, Giardia lamblia
EAFEREAIHRGIPKLFSK

SEQ ID NO: 3070689 - protein, 24 aa, Giardia lamblia
EAFILEWVSGAFFDKTIGRIGSEL

SEQ ID NO: 3070690 - protein, 19 aa, Giardia lamblia
EAFSSALKRYRYFSESIVR

SEQ ID NO: 3070691 - protein, 21 aa, Giardia lamblia
EAFSSIFTRGPYKSLPSGPVA

SEQ ID NO: 3070692 - protein, 18 aa, Giardia lamblia
EAGILRFTTATAEYSSLG

SEQ ID NO: 3070693 - protein, 19 aa, Giardia lamblia
EAHGLLLLLCPVLPAALEG

SEQ ID NO: 3070694 - protein, 21 aa, Giardia lamblia
EAHLKLLAIYIAVELKILLCD

SEQ ID NO: 3070695 - protein, 22 aa, Giardia lamblia
EAHLSIYCNFFGPHPAISGPTV

SEQ ID NO: 3070696 - protein, 21 aa, Giardia lamblia
EAICIQCAIGYYVSDGTCSPC

SEQ ID NO: 3070697 - protein, 30 aa, Giardia lamblia
EAIEFVLKSTILKRSFCTHRSLSNYQFRAL

SEQ ID NO: 3070698 - protein, 18 aa, Giardia lamblia
EAIHYALLGARRITVAPL

SEQ ID NO: 3070699 - protein, 26 aa, Giardia lamblia
EAIKAKCPYCREEIKDMIQLDYSFET

SEQ ID NO: 3070700 - protein, 24 aa, Giardia lamblia
EAIKRLKTSSDHIIKGFMEDNTAE

SEQ ID NO: 3070701 - protein, 28 aa, Giardia lamblia
EAIRGMYRGVICFPKYYEGRPMTDCLSG

SEQ ID NO: 3070702 - protein, 19 aa, Giardia lamblia
EAIVRRSLYYKFLEQATKI

SEQ ID NO: 3070703 - protein, 20 aa, Giardia lamblia
EAKGKLMLAEAFAQQGSVSG

SEQ ID NO: 3070704 - protein, 18 aa, Giardia lamblia
EAKNTCWLVADTITKDGI

SEQ ID NO: 3070705 - protein, 21 aa, Giardia lamblia
EAKRPVSTVSLLHATPRLTIP

SEQ ID NO: 3070706 - protein, 17 aa, Giardia lamblia
EAKYRLDQHDYKFGKIY

SEQ ID NO: 3070707 - protein, 28 aa, Giardia lamblia
EALASYWERACMFVLVATIFISALRIMP

SEQ ID NO: 3070708 - protein, 18 aa, Giardia lamblia
EALCGLDLHLKQGEVTGL

SEQ ID NO: 3070709 - protein, 24 aa, Giardia lamblia
EALEAMLPMNVFVDICKKPPAPYE

SEQ ID NO: 3070710 - protein, 19 aa, Giardia lamblia
EALITRNLFMLCSNDQILQ

SEQ ID NO: 3070711 - protein, 26 aa, Giardia lamblia
EALIYDHFMLLIFKLFAIFIPVGMEF

SEQ ID NO: 3070712 - protein, 19 aa, Giardia lamblia
EALLARGCIGKCPQHNQNV

SEQ ID NO: 3070713 - protein, 20 aa, Giardia lamblia
EALNLLPFLTSFEAIKQLCD

SEQ ID NO: 3070714 - protein, 21 aa, Giardia lamblia
EALPHAHLLNRMKRAKGSSIF

SEQ ID NO: 3070715 - protein, 25 aa, Giardia lamblia
EAMKKTRIAMEVEMGELALEKDEAF

SEQ ID NO: 3070716 - protein, 19 aa, Giardia lamblia
EAMQLRLPHFLIVNTNLHE

SEQ ID NO: 3070717 - protein, 18 aa, Giardia lamblia
EAMRLCVIEIVRGSFSNL

SEQ ID NO: 3070718 - protein, 18 aa, Giardia lamblia
EANSYCSPTTISMQNSAA

SEQ ID NO: 3070719 - protein, 20 aa, Giardia lamblia
EAPFSSFIPEIEKLARDADT

SEQ ID NO: 3070720 - protein, 26 aa, Giardia lamblia
EAPSLPRKICLLIDTALLILMTMRSS

SEQ ID NO: 3070721 - protein, 25 aa, Giardia lamblia
EAQAPKLPLLFPSGCHKAKHIWGAI

SEQ ID NO: 3070722 - protein, 29 aa, Giardia lamblia
EAQDRYVARFPIRIQKHIRENHLLALSEL

SEQ ID NO: 3070723 - protein, 22 aa, Giardia lamblia
EARALILGKACLCITFYESSLD

SEQ ID NO: 3070724 - protein, 24 aa, Giardia lamblia
EARDLRFASFLPMDRSALHRRNQE

SEQ ID NO: 3070725 - protein, 26 aa, Giardia lamblia
EARSDACSLLLRICPLCNVTDTVKEY

SEQ ID NO: 3070726 - protein, 25 aa, Giardia lamblia
EASGRFGASALWYLVDKAAVVGPLE

SEQ ID NO: 3070727 - protein, 23 aa, Giardia lamblia
EASPYRLKLPFYTLGPEASALFP

SEQ ID NO: 3070728 - protein, 23 aa, Giardia lamblia
EASRPSIVASPAFQKADSFVSTS

SEQ ID NO: 3070729 - protein, 27 aa, Giardia lamblia
EASSMLKWDALQGMLLDTGQLQLSLSA

SEQ ID NO: 3070730 - protein, 25 aa, Giardia lamblia
EASTMGFEMLSVFLTHGSNSLSHLV

SEQ ID NO: 3070731 - protein, 26 aa, Giardia lamblia
EATEAGHLFWKVIRCISTSSNSSDKT

SEQ ID NO: 3070732 - protein, 25 aa, Giardia lamblia
EATEKCFPEYLASRGKAKALLGRHS

SEQ ID NO: 3070733 - protein, 18 aa, Giardia lamblia
EATISWLGTVSGYAPGTY

SEQ ID NO: 3070734 - protein, 22 aa, Giardia lamblia
EAVLLPLCLLVTSFVKLNQLYK

SEQ ID NO: 3070735 - protein, 21 aa, Giardia lamblia
EAWSNLCYLFSKYHNKSANTL

SEQ ID NO: 3070736 - protein, 21 aa, Giardia lamblia
EAYEQAKIELLRELRQDLSVE

SEQ ID NO: 3070737 - protein, 32 aa, Giardia lamblia
EAYFSTTQLSTWPAGCTALMLAAHSGSVQSIN

SEQ ID NO: 3070738 - protein, 24 aa, Giardia lamblia
EAYLNGLCKRIFPHQTDSWISQYV

SEQ ID NO: 3070739 - protein, 17 aa, Giardia lamblia
ECAGELFVSLDGQSCLG

SEQ ID NO: 3070740 - protein, 18 aa, Giardia lamblia
ECAGELFVSLDGRSCLGE

SEQ ID NO: 3070741 - protein, 21 aa, Giardia lamblia
ECAVSRWCIDFAVMTYPNTLA

SEQ ID NO: 3070742 - protein, 22 aa, Giardia lamblia
ECDMLGRTALMYAAQHDQVRAA

SEQ ID NO: 3070743 - protein, 29 aa, Giardia lamblia
ECDPTCLACTAPGPGHCTRCPSGALLKRA

SEQ ID NO: 3070744 - protein, 28 aa, Giardia lamblia
ECDPTCLACTAPGPGRCTRCPSDKLLKK

SEQ ID NO: 3070745 - protein, 28 aa, Giardia lamblia
ECDPTCLACTAPGPGRCTRCPSDKLLKR

SEQ ID NO: 3070746 - protein, 28 aa, Giardia lamblia
ECDPTCLGCTAPGPGRCTRCPSDKLLKR

SEQ ID NO: 3070747 - protein, 25 aa, Giardia lamblia
ECILPESISPLVFIIKLLKTEPLEK

SEQ ID NO: 3070748 - protein, 19 aa, Giardia lamblia
ECISRRKLLSFLLLPNAAD

SEQ ID NO: 3070749 - protein, 20 aa, Giardia lamblia
ECKVLLKKNFSTLIHNDINS

SEQ ID NO: 3070750 - protein, 20 aa, Giardia lamblia
ECLPRGCFNTGDLSGQEATK

SEQ ID NO: 3070751 - protein, 19 aa, Giardia lamblia
ECLPRGCFNTGDYSDQEAT

SEQ ID NO: 3070752 - protein, 17 aa, Giardia lamblia
ECLRSHKKAVLDMLDAN

SEQ ID NO: 3070753 - protein, 23 aa, Giardia lamblia
ECLSEGRLHCWNGVCRQKCAQAT

SEQ ID NO: 3070754 - protein, 19 aa, Giardia lamblia
ECLSILKTLLLQYPLPRYP

SEQ ID NO: 3070755 - protein, 17 aa, Giardia lamblia
ECLTCPTGGVSADGTCA

SEQ ID NO: 3070756 - protein, 22 aa, Giardia lamblia
ECLTCTVSGCSHCNRDDMCSAC

SEQ ID NO: 3070757 - protein, 20 aa, Giardia lamblia
ECMQELDGLQLFYVSFMRDI

SEQ ID NO: 3070758 - protein, 21 aa, Giardia lamblia
ECPNKRYTLGQVLKVHSKPIV

SEQ ID NO: 3070759 - protein, 18 aa, Giardia lamblia
ECPTESFWTSGRECIPCA

SEQ ID NO: 3070760 - protein, 17 aa, Giardia lamblia
ECQTCTFSNSRVMCTKC

SEQ ID NO: 3070761 - protein, 22 aa, Giardia lamblia
ECTADACVRCKLGYVSVDGQCQ

SEQ ID NO: 3070762 - protein, 17 aa, Giardia lamblia
ECTFLFQRIVISLFCSW

SEQ ID NO: 3070763 - protein, 21 aa, Giardia lamblia
ECYQFVSTISKRVCIKDTILT

SEQ ID NO: 3070764 - protein, 23 aa, Giardia lamblia
EDADWRPIHIFPEGTTTTERGLL

SEQ ID NO: 3070765 - protein, 27 aa, Giardia lamblia
EDAEGLRAVLFSCYYGICELLFNIACS

SEQ ID NO: 3070766 - protein, 20 aa, Giardia lamblia
EDEFALALANSFKQTCAYNI

SEQ ID NO: 3070767 - protein, 23 aa, Giardia lamblia
EDEFYMLSSIGDWEIGLELLLYG

SEQ ID NO: 3070768 - protein, 25 aa, Giardia lamblia
EDFSLRVYMALKLCTDEGPISLSCL

SEQ ID NO: 3070769 - protein, 22 aa, Giardia lamblia
EDGCATCGSVIAGSRYCSVCRG

SEQ ID NO: 3070770 - protein, 24 aa, Giardia lamblia
EDGGFRLVLVVADEDGDIVVSMES

SEQ ID NO: 3070771 - protein, 36 aa, Giardia lamblia
EDGIFLLAREGYYSVAIHLLRCFLTSFSAISSKALE

SEQ ID NO: 3070772 - protein, 26 aa, Giardia lamblia
EDHLLLLFIKHFRPAFLRIAVNNYIV

SEQ ID NO: 3070773 - protein, 21 aa, Giardia lamblia
EDIEGVFFYSYLFYGENSVGD

SEQ ID NO: 3070774 - protein, 26 aa, Giardia lamblia
EDIFQRFILCKGKDAFNALQKAVVMV

SEQ ID NO: 3070775 - protein, 27 aa, Giardia lamblia
EDKKLLYKGFKKRSSEALVQKEKDATG

SEQ ID NO: 3070776 - protein, 17 aa, Giardia lamblia
EDKLSRIRVSVTIGFAI

SEQ ID NO: 3070777 - protein, 22 aa, Giardia lamblia
EDKMKVMLALIMLALACMSMVP

SEQ ID NO: 3070778 - protein, 20 aa, Giardia lamblia
EDLGSFPYQPAWVKEPDTIP

SEQ ID NO: 3070779 - protein, 21 aa, Giardia lamblia
EDLRFKSVFDDGLYDNQDLVP

SEQ ID NO: 3070780 - protein, 25 aa, Giardia lamblia
EDLRIMVRMCLRKHASDRISSENLC

SEQ ID NO: 3070781 - protein, 17 aa, Giardia lamblia
EDLRMYLQYLISLKNKY

SEQ ID NO: 3070782 - protein, 23 aa, Giardia lamblia
EDNKLYMCLDDFVFADPEVPSWK

SEQ ID NO: 3070783 - protein, 20 aa, Giardia lamblia
EDNRFFAMKVLKKRNVLDRR

SEQ ID NO: 3070784 - protein, 23 aa, Giardia lamblia
EDNVSCVELLAPVENGMVDERGT

SEQ ID NO: 3070785 - protein, 21 aa, Giardia lamblia
EDPSRILAAYRMLSRSNIHTI

SEQ ID NO: 3070786 - protein, 23 aa, Giardia lamblia
EDQARLVLHAMHFDPSIERINEV

SEQ ID NO: 3070787 - protein, 19 aa, Giardia lamblia
EDQCLLELLTKAFIQTLLR

SEQ ID NO: 3070788 - protein, 25 aa, Giardia lamblia
EDQKDLLKRLKIGYSKELLHIDSSL

SEQ ID NO: 3070789 - protein, 20 aa, Giardia lamblia
EDRLLRVFLLHNISKHLFLG

SEQ ID NO: 3070790 - protein, 20 aa, Giardia lamblia
EDRSCYDRVAAMVNTESLGS

SEQ ID NO: 3070791 - protein, 26 aa, Giardia lamblia
EDTIIFKFTQFRGIITETVLYLVQAG

SEQ ID NO: 3070792 - protein, 17 aa, Giardia lamblia
EDVDLVLKRCKDMSNPI

SEQ ID NO: 3070793 - protein, 32 aa, Giardia lamblia
EDVIRLGVSYILYHCIRNLSNITLRYFPNILP

SEQ ID NO: 3070794 - protein, 25 aa, Giardia lamblia
EDYKFSFNRKCLVGATVLQKEALSE

SEQ ID NO: 3070795 - protein, 23 aa, Giardia lamblia
EDYQMGLAMRKLFSTKRCGFISS

SEQ ID NO: 3070796 - protein, 26 aa, Giardia lamblia
EEAFYRVADFMAFLIVRSSSTFLQLI

SEQ ID NO: 3070797 - protein, 24 aa, Giardia lamblia
EEDDLRLSLFGLLLTSNFEYNMNC

SEQ ID NO: 3070798 - protein, 22 aa, Giardia lamblia
EEEAPRLLHLFFQQFESSVRGT

SEQ ID NO: 3070799 - protein, 24 aa, Giardia lamblia
EEECSGLHCDTCGAETHGTTHLSL

SEQ ID NO: 3070800 - protein, 24 aa, Giardia lamblia
EEIKWEVYRHGPLPVSVYAGNDLF

SEQ ID NO: 3070801 - protein, 18 aa, Giardia lamblia
EEILMRINEVVIGDQNIA

SEQ ID NO: 3070802 - protein, 23 aa, Giardia lamblia
EEIPPSAALIRPAPSASSVTQLA

SEQ ID NO: 3070803 - protein, 25 aa, Giardia lamblia
EEIQCLCNLATFGLGLDIVADSRVL

SEQ ID NO: 3070804 - protein, 27 aa, Giardia lamblia
EEIQHLCRIVHAYFKTIFGFTQSPRII

SEQ ID NO: 3070805 - protein, 22 aa, Giardia lamblia
EEKKIYLTYLLRKLQVSRNLSA

SEQ ID NO: 3070806 - protein, 25 aa, Giardia lamblia
EEKQEAIEFVRQIALSREERAKERE

SEQ ID NO: 3070807 - protein, 17 aa, Giardia lamblia
EELARRDAEEAAKTASA

SEQ ID NO: 3070808 - protein, 24 aa, Giardia lamblia
EELCMWRQHCLPSDNATTESMGCL

SEQ ID NO: 3070809 - protein, 17 aa, Giardia lamblia
EELRKLSTYTGFGIGIS

SEQ ID NO: 3070810 - protein, 18 aa, Giardia lamblia
EENACCLSGEITSLRGSP

SEQ ID NO: 3070811 - protein, 29 aa, Giardia lamblia
EEPDVPCGELKMGILAHIGRIFSGDVLNS

SEQ ID NO: 3070812 - protein, 17 aa, Giardia lamblia
EEPLCMIHEDLIIKTFN

SEQ ID NO: 3070813 - protein, 26 aa, Giardia lamblia
EEQRCGESLMHLCTINDSFMASSSSF

SEQ ID NO: 3070814 - protein, 22 aa, Giardia lamblia
EEQRIASLGSRGIVPGIENELF

SEQ ID NO: 3070815 - protein, 25 aa, Giardia lamblia
EEQVYRFMAAIIWILNQLVHICRTS

SEQ ID NO: 3070816 - protein, 25 aa, Giardia lamblia
EERLELVKIVAYLKGVDISVCEKIA

SEQ ID NO: 3070817 - protein, 25 aa, Giardia lamblia
EERRARAVILYYLFYTYALLQLLPT

SEQ ID NO: 3070818 - protein, 23 aa, Giardia lamblia
EERYKLLGLLYICIEEDYGKFWG

SEQ ID NO: 3070819 - protein, 32 aa, Giardia lamblia
EETLHLFILLNYCKGGSLLNLRRSVFNRQMTE

SEQ ID NO: 3070820 - protein, 23 aa, Giardia lamblia
EEVACAFSGSILTYTEEEQLQNI

SEQ ID NO: 3070821 - protein, 25 aa, Giardia lamblia
EEVDPRVRMLLKYGTDKAHPYALTR

SEQ ID NO: 3070822 - protein, 29 aa, Giardia lamblia
EEVMASWACLNRIYNLVVAISFGVTGGYL

SEQ ID NO: 3070823 - protein, 25 aa, Giardia lamblia
EEVRERFCSPPGYRISPTRGSSPKR

SEQ ID NO: 3070824 - protein, 27 aa, Giardia lamblia
EEVYLLRSIIYFNLCRNGVVTPRKRRL

SEQ ID NO: 3070825 - protein, 20 aa, Giardia lamblia
EFAERVKLSIARAARLIPRP

SEQ ID NO: 3070826 - protein, 19 aa, Giardia lamblia
EFCDSMKIVFCSENSKYLI

SEQ ID NO: 3070827 - protein, 17 aa, Giardia lamblia
EFCSRYLTRGEVIFLAL

SEQ ID NO: 3070828 - protein, 17 aa, Giardia lamblia
EFDKRVKMISGLREVGY

SEQ ID NO: 3070829 - protein, 17 aa, Giardia lamblia
EFDLDRWMVKRRIVKYP

SEQ ID NO: 3070830 - protein, 24 aa, Giardia lamblia
EFEGPCFLCGFSLSGFSSKEYVII

SEQ ID NO: 3070831 - protein, 20 aa, Giardia lamblia
EFFLFYGGCYDITHPIGKSI

SEQ ID NO: 3070832 - protein, 22 aa, Giardia lamblia
EFFLFYSGCYDITHPIGKSICS

SEQ ID NO: 3070833 - protein, 21 aa, Giardia lamblia
EFGSLPMLVVSGFLQKSIGGM

SEQ ID NO: 3070834 - protein, 32 aa, Giardia lamblia
EFHTKPGVFSPFYYLYCLWISPTLIGQQNKQQ

SEQ ID NO: 3070835 - protein, 24 aa, Giardia lamblia
EFIGRRIIMSISFAGYTVMMAVYS

SEQ ID NO: 3070836 - protein, 17 aa, Giardia lamblia
EFIKSLISNVGRRGESQ

SEQ ID NO: 3070837 - protein, 34 aa, Giardia lamblia
EFKEKMASVTLWFSLRLISLFLVAYLKDITTPEV

SEQ ID NO: 3070838 - protein, 26 aa, Giardia lamblia
EFKGKRCSMEWTALMWAAKFGDVKMV

SEQ ID NO: 3070839 - protein, 18 aa, Giardia lamblia
EFKTRGLLNLAPSETSEL

SEQ ID NO: 3070840 - protein, 34 aa, Giardia lamblia
EFLFRGDCIHNTFDIVCGIALSFVPSASSTELSN

SEQ ID NO: 3070841 - protein, 28 aa, Giardia lamblia
EFLLLLRLLEYYAEIPIIVIAYLLEIIT

SEQ ID NO: 3070842 - protein, 20 aa, Giardia lamblia
EFLNPALFIINAMQTYGRTF

SEQ ID NO: 3070843 - protein, 24 aa, Giardia lamblia
EFLRFLLEHRYFIYDGVLPGSKDK

SEQ ID NO: 3070844 - protein, 19 aa, Giardia lamblia
EFMLPCLYNPTTRINYPGY

SEQ ID NO: 3070845 - protein, 23 aa, Giardia lamblia
EFMNKLFSLMSFRKKNLTSLVVS

SEQ ID NO: 3070846 - protein, 18 aa, Giardia lamblia
EFMSKFFVITVFLMQFLL

SEQ ID NO: 3070847 - protein, 19 aa, Giardia lamblia
EFPFLANLVDVYDDLKRGC

SEQ ID NO: 3070848 - protein, 25 aa, Giardia lamblia
EFQGLKKLLLWHGRNSYIGSAQMCQ

SEQ ID NO: 3070849 - protein, 19 aa, Giardia lamblia
EFRDSMCLEDHGHAWLTLC

SEQ ID NO: 3070850 - protein, 25 aa, Giardia lamblia
EFSAFPRTVDFLLDPLILPMLRRRT

SEQ ID NO: 3070851 - protein, 22 aa, Giardia lamblia
EFSISSIVVAFPMDNFINNSPG

SEQ ID NO: 3070852 - protein, 20 aa, Giardia lamblia
EFSNSVPLHPVLKNRVTVLL

SEQ ID NO: 3070853 - protein, 17 aa, Giardia lamblia
EFTDVVLRLAMAGVSLY

SEQ ID NO: 3070854 - protein, 23 aa, Giardia lamblia
EFVLKLIEFIVLFFNKTIVHEEI

SEQ ID NO: 3070855 - protein, 24 aa, Giardia lamblia
EFWRELKSALAGLISKPRKGLAAK

SEQ ID NO: 3070856 - protein, 25 aa, Giardia lamblia
EGCKMKFPNPLLIAFPAHTIPWQAF

SEQ ID NO: 3070857 - protein, 20 aa, Giardia lamblia
EGDCSILACKTCNTTDTTRC

SEQ ID NO: 3070858 - protein, 24 aa, Giardia lamblia
EGDEPCRLKLVFISLCHSSIRRAL

SEQ ID NO: 3070859 - protein, 23 aa, Giardia lamblia
EGDSRYFIHVGMMVLLHQLLFVL

SEQ ID NO: 3070860 - protein, 18 aa, Giardia lamblia
EGELRYVQCGVHTRSIQC

SEQ ID NO: 3070861 - protein, 20 aa, Giardia lamblia
EGFLPRVRLSMLTVGQAAKT

SEQ ID NO: 3070862 - protein, 23 aa, Giardia lamblia
EGGCYLRFMQHVTYEFKPMTYSH

SEQ ID NO: 3070863 - protein, 22 aa, Giardia lamblia
EGHRSRAWFRMVDYQHIGALSM

SEQ ID NO: 3070864 - protein, 21 aa, Giardia lamblia
EGHVWSVFYVRGNRLLMADAH

SEQ ID NO: 3070865 - protein, 17 aa, Giardia lamblia
EGILDNFLFNLLMPITF

SEQ ID NO: 3070866 - protein, 34 aa, Giardia lamblia
EGILITSLKCPVCIPCYLCWIEDNSTYFVTDLAH

SEQ ID NO: 3070867 - protein, 24 aa, Giardia lamblia
EGILSCWSTSLALLYALLPSYETT

SEQ ID NO: 3070868 - protein, 36 aa, Giardia lamblia
EGINHLHYMMGLRYIYRWLGDFVYQLVITSIVALIC

SEQ ID NO: 3070869 - protein, 19 aa, Giardia lamblia
EGIPDCYRQDVWPRLLNAQ

SEQ ID NO: 3070870 - protein, 18 aa, Giardia lamblia
EGKCTACAANCATCTGER

SEQ ID NO: 3070871 - protein, 22 aa, Giardia lamblia
EGKKVFAANCVVESGILQLSDS

SEQ ID NO: 3070872 - protein, 20 aa, Giardia lamblia
EGLCISSQCIQRGTDGTVTI

SEQ ID NO: 3070873 - protein, 17 aa, Giardia lamblia
EGLEYLTIGVIFAAQSN

SEQ ID NO: 3070874 - protein, 27 aa, Giardia lamblia
EGLKKSACNIFCYKPFIEFPSPPETFG

SEQ ID NO: 3070875 - protein, 29 aa, Giardia lamblia
EGLLREHKRAVLLLISLRISELLCQCLYQ

SEQ ID NO: 3070876 - protein, 21 aa, Giardia lamblia
EGLRGLVVWIFALIERGIFGA

SEQ ID NO: 3070877 - protein, 17 aa, Giardia lamblia
EGLSLTIAVSLTLAAKR

SEQ ID NO: 3070878 - protein, 24 aa, Giardia lamblia
EGMFYRRPIIKKKVKTEFNIIQIL

SEQ ID NO: 3070879 - protein, 23 aa, Giardia lamblia
EGNCLAYLFPLVATFIYMFIILF

SEQ ID NO: 3070880 - protein, 29 aa, Giardia lamblia
EGNSAYGKKCAKCTKVLINSDQPGISDEN

SEQ ID NO: 3070881 - protein, 17 aa, Giardia lamblia
EGPKRALLLSGHAEASD

SEQ ID NO: 3070882 - protein, 24 aa, Giardia lamblia
EGRGVPEFWCDMGYATGYHHFDLV

SEQ ID NO: 3070883 - protein, 23 aa, Giardia lamblia
EGRTKEPICLTSPEVDAEIRNIS

SEQ ID NO: 3070884 - protein, 28 aa, Giardia lamblia
EGRTSEVSWNCNVFGPFRRILASDTLQA

SEQ ID NO: 3070885 - protein, 25 aa, Giardia lamblia
EGSGDWKPAFDIANAFQMSTVISSK

SEQ ID NO: 3070886 - protein, 25 aa, Giardia lamblia
EGSRPYLLALSILHILPLDRMSSTH

SEQ ID NO: 3070887 - protein, 19 aa, Giardia lamblia
EGSVTYAGYFLAHAPRDAT

SEQ ID NO: 3070888 - protein, 19 aa, Giardia lamblia
EGSYARYTVTYDDGDASLF

SEQ ID NO: 3070889 - protein, 20 aa, Giardia lamblia
EGTCVSGAIAGMVSTRKAVY

SEQ ID NO: 3070890 - protein, 27 aa, Giardia lamblia
EGTIFFLLTIYFDYIIPRESNGVPLPW

SEQ ID NO: 3070891 - protein, 19 aa, Giardia lamblia
EGVLRFNCCTRHRTASSRA

SEQ ID NO: 3070892 - protein, 25 aa, Giardia lamblia
EGYREPRVMLGIIKKFFPLSEETTV

SEQ ID NO: 3070893 - protein, 25 aa, Giardia lamblia
EHCHQLKCFVLRLSEQCAPSMLSLY

SEQ ID NO: 3070894 - protein, 22 aa, Giardia lamblia
EHDPKGWYLPKGMPVANSAINN

SEQ ID NO: 3070895 - protein, 19 aa, Giardia lamblia
EHFARSVTLKDIFIYLDQG

SEQ ID NO: 3070896 - protein, 17 aa, Giardia lamblia
EHGALEFPCQFTEYHVG

SEQ ID NO: 3070897 - protein, 24 aa, Giardia lamblia
EHLDRSLELLTHISDLLIFNTVCF

SEQ ID NO: 3070898 - protein, 20 aa, Giardia lamblia
EHLTPLCVHHHGLGAMNSNA

SEQ ID NO: 3070899 - protein, 17 aa, Giardia lamblia
EHMEVVMRYDELKKKEL

SEQ ID NO: 3070900 - protein, 22 aa, Giardia lamblia
EHMKAEFTQAFNLLNNPKLANF

SEQ ID NO: 3070901 - protein, 20 aa, Giardia lamblia
EHNLSCSYNKSAVLAHFLER

SEQ ID NO: 3070902 - protein, 20 aa, Giardia lamblia
EHREPTVLFNCISTSTGSVR

SEQ ID NO: 3070903 - protein, 25 aa, Giardia lamblia
EHRKLFQTYAFRVIALGARIHIHCL

SEQ ID NO: 3070904 - protein, 17 aa, Giardia lamblia
EHSYMGYNLPVVAQTDP

SEQ ID NO: 3070905 - protein, 24 aa, Giardia lamblia
EHVILKRRVTSPITLCSHYDGPMF

SEQ ID NO: 3070906 - protein, 19 aa, Giardia lamblia
EHVWIEPTYSFFVVSSLAH

SEQ ID NO: 3070907 - protein, 26 aa, Giardia lamblia
EHYCHACTGHFCPLCMSTDAYFFPYQ

SEQ ID NO: 3070908 - protein, 22 aa, Giardia lamblia
EHYCSIRGCKIAYYAGNTKNLT

SEQ ID NO: 3070909 - protein, 25 aa, Giardia lamblia
EHYILLADLLFCFTTGCEGGSVFMS

SEQ ID NO: 3070910 - protein, 18 aa, Giardia lamblia
EHYKLGGWLQRYPLTITF

SEQ ID NO: 3070911 - protein, 21 aa, Giardia lamblia
EIAETRILVGRAAKDGAQRSA

SEQ ID NO: 3070912 - protein, 29 aa, Giardia lamblia
EICHLSRSWRYSVIPSYCSSAEGWSTKVT

SEQ ID NO: 3070913 - protein, 31 aa, Giardia lamblia
EICLPNKIRYVFPRHCKVVVVAHSKCLSLRK

SEQ ID NO: 3070914 - protein, 20 aa, Giardia lamblia
EIEECPRDYFGEELQRGTEI

SEQ ID NO: 3070915 - protein, 23 aa, Giardia lamblia
EIFAEAIALIGLISGIVMTTSVG

SEQ ID NO: 3070916 - protein, 26 aa, Giardia lamblia
EIFNYAASIFGIFVTWIAPLMVIMYM

SEQ ID NO: 3070917 - protein, 32 aa, Giardia lamblia
EIFTGHATWTSWGFGFLRVMKIYDFNFQTLNT

SEQ ID NO: 3070918 - protein, 24 aa, Giardia lamblia
EIGGRSALMYAIQFGHADVAALLV

SEQ ID NO: 3070919 - protein, 32 aa, Giardia lamblia
EIIENMRILISFCWPHKLVLEASKGLNKNLAS

SEQ ID NO: 3070920 - protein, 19 aa, Giardia lamblia
EIIPYDTLVTIFKTIKQNF

SEQ ID NO: 3070921 - protein, 22 aa, Giardia lamblia
EIIRRLAEKVGVFETDNAAFSS

SEQ ID NO: 3070922 - protein, 21 aa, Giardia lamblia
EIKNDKLEIMRHYEEGAIQQQ

SEQ ID NO: 3070923 - protein, 19 aa, Giardia lamblia
EILEHAGTTFVERLLIAKK

SEQ ID NO: 3070924 - protein, 18 aa, Giardia lamblia
EILEPPARLQTPQDQQRQ

SEQ ID NO: 3070925 - protein, 17 aa, Giardia lamblia
EILESYPSIGHKACRGL

SEQ ID NO: 3070926 - protein, 19 aa, Giardia lamblia
EILLVLLCEADAYTKEITY

SEQ ID NO: 3070927 - protein, 21 aa, Giardia lamblia
EILQHIEHIYGLGVTNTSSEF

SEQ ID NO: 3070928 - protein, 21 aa, Giardia lamblia
EILRRGMASLERYLTTTHSQF

SEQ ID NO: 3070929 - protein, 26 aa, Giardia lamblia
EIMFYNRMVKDLVDYIRYARYDVIPD

SEQ ID NO: 3070930 - protein, 33 aa, Giardia lamblia
EINRFVKLISIIAICIGVLFFILSLSLGIEWLE

SEQ ID NO: 3070931 - protein, 18 aa, Giardia lamblia
EINYFFKRNNMLRLTQKR

SEQ ID NO: 3070932 - protein, 17 aa, Giardia lamblia
EIPGRGSLMDRARADLC

SEQ ID NO: 3070933 - protein, 26 aa, Giardia lamblia
EIQDCRRACRECEDKLSLQEAELSSL

SEQ ID NO: 3070934 - protein, 21 aa, Giardia lamblia
EIQSRFAGTNARLELFSNYAA

SEQ ID NO: 3070935 - protein, 20 aa, Giardia lamblia
EIRKAKLAYYSRLLTRGEPL

SEQ ID NO: 3070936 - protein, 24 aa, Giardia lamblia
EISELKEQFLATSIDGQPYSINYA

SEQ ID NO: 3070937 - protein, 18 aa, Giardia lamblia
EISNVCKLMHKFKSVDIV

SEQ ID NO: 3070938 - protein, 25 aa, Giardia lamblia
EITGEPEWWRDFWGPTIKDNLPDPE

SEQ ID NO: 3070939 - protein, 24 aa, Giardia lamblia
EIVIPDIRYKLRLKTNYDSYLNGS

SEQ ID NO: 3070940 - protein, 23 aa, Giardia lamblia
EIVPALLCVAVTYSKEFLANKSI

SEQ ID NO: 3070941 - protein, 19 aa, Giardia lamblia
EIVSLLAQLEYGMRNKHGY

SEQ ID NO: 3070942 - protein, 24 aa, Giardia lamblia
EIYGEPPWWRSFWGPTIRDKAPDP

SEQ ID NO: 3070943 - protein, 33 aa, Giardia lamblia
EKANKRFLSVLFRLIKRFSRLLFTDICFSGPNR

SEQ ID NO: 3070944 - protein, 19 aa, Giardia lamblia
EKAQECVITSYAVIAMEIT

SEQ ID NO: 3070945 - protein, 22 aa, Giardia lamblia
EKAQSLMAVFPEFVKRIEGDHI

SEQ ID NO: 3070946 - protein, 20 aa, Giardia lamblia
EKARKSEHLIVVAPPTSHAL

SEQ ID NO: 3070947 - protein, 17 aa, Giardia lamblia
EKAYSIIPHTNFPSPAI

SEQ ID NO: 3070948 - protein, 21 aa, Giardia lamblia
EKCLILRCIEVSFSHVDSDKL

SEQ ID NO: 3070949 - protein, 17 aa, Giardia lamblia
EKEWCSFGHRFSSRCGI

SEQ ID NO: 3070950 - protein, 22 aa, Giardia lamblia
EKHSISGLLLRNKAGSTAPSIP

SEQ ID NO: 3070951 - protein, 18 aa, Giardia lamblia
EKILEAASYIGFDLQTIG

SEQ ID NO: 3070952 - protein, 24 aa, Giardia lamblia
EKINRCCPHVLPYMGEYESKTHGF

SEQ ID NO: 3070953 - protein, 25 aa, Giardia lamblia
EKIPVLPCSLFLPVLYMAETLRHIE

SEQ ID NO: 3070954 - protein, 19 aa, Giardia lamblia
EKIRLLISCLFGGGCCDQD

SEQ ID NO: 3070955 - protein, 21 aa, Giardia lamblia
EKIVKANLFLSGKQTAAGMSA

SEQ ID NO: 3070956 - protein, 22 aa, Giardia lamblia
EKKGKRGKVGFHQPSNELALEP

SEQ ID NO: 3070957 - protein, 19 aa, Giardia lamblia
EKLARTFPVLPAFNRPGSS

SEQ ID NO: 3070958 - protein, 19 aa, Giardia lamblia
EKLLSLVCVEFKLEERWES

SEQ ID NO: 3070959 - protein, 18 aa, Giardia lamblia
EKLPDGYPGLLTTSLKYL

SEQ ID NO: 3070960 - protein, 22 aa, Giardia lamblia
EKLQKCGGHILAEVVGAAIKSL

SEQ ID NO: 3070961 - protein, 24 aa, Giardia lamblia
EKLRGEGIIVLPSLEEVAHFVELY

SEQ ID NO: 3070962 - protein, 19 aa, Giardia lamblia
EKLSKLIITEAFLSAHVFV

SEQ ID NO: 3070963 - protein, 21 aa, Giardia lamblia
EKLTEVFWRASNAGLDLQHAI

SEQ ID NO: 3070964 - protein, 20 aa, Giardia lamblia
EKMAHFLAFVLKEALPVVDY

SEQ ID NO: 3070965 - protein, 21 aa, Giardia lamblia
EKNATALFRAWKDDSHGMDCS

SEQ ID NO: 3070966 - protein, 20 aa, Giardia lamblia
EKPVKHLALFSVEDEQEEYE

SEQ ID NO: 3070967 - protein, 18 aa, Giardia lamblia
EKRARICLSASSGACLRC

SEQ ID NO: 3070968 - protein, 24 aa, Giardia lamblia
EKSDIWSLGLIVYELCTFERLVSG

SEQ ID NO: 3070969 - protein, 17 aa, Giardia lamblia
EKSWGRPADAFICSTYC

SEQ ID NO: 3070970 - protein, 18 aa, Giardia lamblia
EKTIIIFSAGRLEYKNKG

SEQ ID NO: 3070971 - protein, 25 aa, Giardia lamblia
EKVHRIVHTWFPMLVNPERYLRDVH

SEQ ID NO: 3070972 - protein, 27 aa, Giardia lamblia
EKVKSTIPYYFSVCYAESGMPAAPMGH

SEQ ID NO: 3070973 - protein, 20 aa, Giardia lamblia
EKYADMCIRQKTSIASDSAE

SEQ ID NO: 3070974 - protein, 17 aa, Giardia lamblia
EKYFRSIVVDGSILLLV

SEQ ID NO: 3070975 - protein, 26 aa, Giardia lamblia
ELACGREAILSISRFKTRQHRLRYTL

SEQ ID NO: 3070976 - protein, 20 aa, Giardia lamblia
ELACIRYCRLAVYYQNKLLS

SEQ ID NO: 3070977 - protein, 20 aa, Giardia lamblia
ELACLYNLIRGYPLSPVELS

SEQ ID NO: 3070978 - protein, 25 aa, Giardia lamblia
ELALPSTRLSPSWDDLRKGYIDTIS

SEQ ID NO: 3070979 - protein, 25 aa, Giardia lamblia
ELALQRRIEEFKRTGRKSEFVVDPG

SEQ ID NO: 3070980 - protein, 17 aa, Giardia lamblia
ELARLAADIDVRSFASG

SEQ ID NO: 3070981 - protein, 21 aa, Giardia lamblia
ELCCIYTVLSSLYFTAPQEFC

SEQ ID NO: 3070982 - protein, 19 aa, Giardia lamblia
ELCEGGDLHDFLALLCRSD

SEQ ID NO: 3070983 - protein, 25 aa, Giardia lamblia
ELCMLRRRGLDIILSSSWRLTPNDL

SEQ ID NO: 3070984 - protein, 23 aa, Giardia lamblia
ELCSIGIKSAQPILNHIRTSKLT

SEQ ID NO: 3070985 - protein, 20 aa, Giardia lamblia
ELDACLHAAVAGGLESPLDD

SEQ ID NO: 3070986 - protein, 26 aa, Giardia lamblia
ELDGCKRPPLYVFKFYMAMEKYGDAA

SEQ ID NO: 3070987 - protein, 20 aa, Giardia lamblia
ELDHELSIHVQKTKNCGAYI

SEQ ID NO: 3070988 - protein, 22 aa, Giardia lamblia
ELDMILRLTAQMCEALAYLHSP

SEQ ID NO: 3070989 - protein, 26 aa, Giardia lamblia
ELDMVKGIPLGAIRLSLGYITTVEDV

SEQ ID NO: 3070990 - protein, 24 aa, Giardia lamblia
ELDSLPYLVLLSFLGATDLEDEEE

SEQ ID NO: 3070991 - protein, 26 aa, Giardia lamblia
ELDYCPGGSLADLFKKQRRLIQQMPI

SEQ ID NO: 3070992 - protein, 26 aa, Giardia lamblia
ELEPRTCLYLSTTFLVYLQILSGSVE

SEQ ID NO: 3070993 - protein, 23 aa, Giardia lamblia
ELFQRLSTPISMVGPSHADTCVL

SEQ ID NO: 3070994 - protein, 19 aa, Giardia lamblia
ELGEGFTALMAAATNGHEA

SEQ ID NO: 3070995 - protein, 21 aa, Giardia lamblia
ELGIKYTLPLAARTSLLSYDY

SEQ ID NO: 3070996 - protein, 26 aa, Giardia lamblia
ELGLAEARLSLRTMDLQKLVSPQTVS

SEQ ID NO: 3070997 - protein, 19 aa, Giardia lamblia
ELIASGLMQSEFIYLTYDI

SEQ ID NO: 3070998 - protein, 26 aa, Giardia lamblia
ELIMNCKLEYSKSWRGQIAAYVSLLY

SEQ ID NO: 3070999 - protein, 24 aa, Giardia lamblia
ELKEHPCVVAIVLNKGGHLGTLLR

SEQ ID NO: 3071000 - protein, 21 aa, Giardia lamblia
ELKTQIAALFPKNDSHFIKSD

SEQ ID NO: 3071001 - protein, 24 aa, Giardia lamblia
ELLESELLQYLKYVTRQSGDDINL

SEQ ID NO: 3071002 - protein, 24 aa, Giardia lamblia
ELLFNIACSIVRRSVAAPDFTPAH

SEQ ID NO: 3071003 - protein, 38 aa, Giardia lamblia
ELLGADWPILMLLKGFRIPWSMGDPAMLGLYSVAIRYI

SEQ ID NO: 3071004 - protein, 19 aa, Giardia lamblia
ELLHICIYSATMGIYALHK

SEQ ID NO: 3071005 - protein, 21 aa, Giardia lamblia
ELLLGLYPAAYLKYLNETASD

SEQ ID NO: 3071006 - protein, 27 aa, Giardia lamblia
ELLLVAPALMWLFTSVVFRVMYHLSIE

SEQ ID NO: 3071007 - protein, 23 aa, Giardia lamblia
ELLPGPFLIPIVVFPFIVLLSSL

SEQ ID NO: 3071008 - protein, 25 aa, Giardia lamblia
ELLPPCYNLLPLPYRLRCSVQGLLR

SEQ ID NO: 3071009 - protein, 24 aa, Giardia lamblia
ELLTIPNWIRRLTAASTLIHVANE

SEQ ID NO: 3071010 - protein, 19 aa, Giardia lamblia
ELLVLGRVLYKYVADLPCS

SEQ ID NO: 3071011 - protein, 25 aa, Giardia lamblia
ELLWRMTAQLASAVAYIHSKDIVHY

SEQ ID NO: 3071012 - protein, 24 aa, Giardia lamblia
ELLYKWMNTCLGYKTIKKSNLIGL

SEQ ID NO: 3071013 - protein, 24 aa, Giardia lamblia
ELNAHIHSLYSWKDISIPSEDSIS

SEQ ID NO: 3071014 - protein, 19 aa, Giardia lamblia
ELNEFPIIYNMCCLCACIS

SEQ ID NO: 3071015 - protein, 18 aa, Giardia lamblia
ELNRVLPMLQKADEALQN

SEQ ID NO: 3071016 - protein, 17 aa, Giardia lamblia
ELNTYLVFEDKSPGYVC

SEQ ID NO: 3071017 - protein, 21 aa, Giardia lamblia
ELPAELTIRYCKHVHSTCSGL

SEQ ID NO: 3071018 - protein, 23 aa, Giardia lamblia
ELPCTLINVNLAFRKGERIGIVG

SEQ ID NO: 3071019 - protein, 24 aa, Giardia lamblia
ELPDNLKALFRAVSMVVPDYSLIA

SEQ ID NO: 3071020 - protein, 18 aa, Giardia lamblia
ELPTNPKPLLSLHQSPPI

SEQ ID NO: 3071021 - protein, 21 aa, Giardia lamblia
ELQARLSALDQEIFALKRDNL

SEQ ID NO: 3071022 - protein, 25 aa, Giardia lamblia
ELQAYKGSLFCRSRGRKITVDTSLP

SEQ ID NO: 3071023 - protein, 18 aa, Giardia lamblia
ELSARTAIPSTITTWEAI

SEQ ID NO: 3071024 - protein, 29 aa, Giardia lamblia
ELSCNSELWGSVWQRCVSPILVFQYTRNE

SEQ ID NO: 3071025 - protein, 25 aa, Giardia lamblia
ELSFCIFRLDSKYDKRTQITSLVKY

SEQ ID NO: 3071026 - protein, 40 aa, Giardia lamblia
ELSLERCIYSCSPCTIDDLALRGGVRRTWTLRQMPTITFR

SEQ ID NO: 3071027 - protein, 19 aa, Giardia lamblia
ELSLGCWLILHGVAAGFFL

SEQ ID NO: 3071028 - protein, 35 aa, Giardia lamblia
ELSRIFLKRLYKLLYHLRTFFFTKIIALEPSVQAA

SEQ ID NO: 3071029 - protein, 23 aa, Giardia lamblia
ELTDLMPAITLPSNDRARLLSTE

SEQ ID NO: 3071030 - protein, 20 aa, Giardia lamblia
ELTHSLPLASINNIGPCSDI

SEQ ID NO: 3071031 - protein, 21 aa, Giardia lamblia
ELTKFLKYMVDTHIAHRLLLI

SEQ ID NO: 3071032 - protein, 27 aa, Giardia lamblia
ELTPLEHLRLMVGFTCRNLKPNIKDIE

SEQ ID NO: 3071033 - protein, 33 aa, Giardia lamblia
ELTSYITLCHAPRLLLEGIIEFFQSRVTAAQCT

SEQ ID NO: 3071034 - protein, 26 aa, Giardia lamblia
ELVAYIRPSIKLGLQSAVEIELLVDT

SEQ ID NO: 3071035 - protein, 21 aa, Giardia lamblia
ELVHVTFPFAKKVFTNGDAPL

SEQ ID NO: 3071036 - protein, 17 aa, Giardia lamblia
ELVRLYRTYFFSMDEEF

SEQ ID NO: 3071037 - protein, 21 aa, Giardia lamblia
ELVTTSFVGNVRDCLVELGAM

SEQ ID NO: 3071038 - protein, 27 aa, Giardia lamblia
ELWSVEFLCGAANYFAQFYGNYIYLRK

SEQ ID NO: 3071039 - protein, 20 aa, Giardia lamblia
ELYEDWARLYRHNVIRRDTL

SEQ ID NO: 3071040 - protein, 26 aa, Giardia lamblia
ELYIRDMCCCLTDTILCMSDADTIQK

SEQ ID NO: 3071041 - protein, 31 aa, Giardia lamblia
ELYISWIKYGGIGKFVLCLVLYIITQLIQQF

SEQ ID NO: 3071042 - protein, 17 aa, Giardia lamblia
ELYKSVRMLKEFTSLNE

SEQ ID NO: 3071043 - protein, 21 aa, Giardia lamblia
ELYRLLKDCSLLCKNGVRTDK

SEQ ID NO: 3071044 - protein, 20 aa, Giardia lamblia
ELYTKVTICGQAFLMYQIRR

SEQ ID NO: 3071045 - protein, 19 aa, Giardia lamblia
EMAIIKAMRAEDVNMVKIL

SEQ ID NO: 3071046 - protein, 18 aa, Giardia lamblia
EMCTCIDAFTALVNPKDR

SEQ ID NO: 3071047 - protein, 25 aa, Giardia lamblia
EMDRFTASINRLVYRGILETSVMNS

SEQ ID NO: 3071048 - protein, 25 aa, Giardia lamblia
EMGDIPSCRPVDCLAKYGHSRPYFS

SEQ ID NO: 3071049 - protein, 19 aa, Giardia lamblia
EMISEIPLHALPLHYVRSE

SEQ ID NO: 3071050 - protein, 20 aa, Giardia lamblia
EMLDLLLSAARGRQATARPV

SEQ ID NO: 3071051 - protein, 23 aa, Giardia lamblia
EMPVYYRKAPLLPSIIKYINPDG

SEQ ID NO: 3071052 - protein, 22 aa, Giardia lamblia
EMSSTQAFHILKLQPQSATNGA

SEQ ID NO: 3071053 - protein, 21 aa, Giardia lamblia
EMYNELCGSPDNLLLVTGYAT

SEQ ID NO: 3071054 - protein, 18 aa, Giardia lamblia
ENCSRATGSVALLHDTLE

SEQ ID NO: 3071055 - protein, 20 aa, Giardia lamblia
ENDEVYLFARMLFSDLDNDY

SEQ ID NO: 3071056 - protein, 25 aa, Giardia lamblia
ENDIIPFGIGFQGSLSFGFTEKYLN

SEQ ID NO: 3071057 - protein, 24 aa, Giardia lamblia
ENFISGDLSPYVLSQIKFSRLLTD

SEQ ID NO: 3071058 - protein, 25 aa, Giardia lamblia
ENIIKSAFLYAFIWSFATTAMQNTK

SEQ ID NO: 3071059 - protein, 20 aa, Giardia lamblia
ENKIKLAYWLNVVVCVISFG

SEQ ID NO: 3071060 - protein, 36 aa, Giardia lamblia
ENKWNVILYDIWRPMVLRKSFLSREFKKCNTELYYL

SEQ ID NO: 3071061 - protein, 17 aa, Giardia lamblia
ENLACCTHLVLSTNTLP

SEQ ID NO: 3071062 - protein, 17 aa, Giardia lamblia
ENLFELLGLSLEYVDPV

SEQ ID NO: 3071063 - protein, 25 aa, Giardia lamblia
ENLHVWRSLATLCIQNGYVDLLKTC

SEQ ID NO: 3071064 - protein, 17 aa, Giardia lamblia
ENLLWWYFFTPMMSFAA

SEQ ID NO: 3071065 - protein, 21 aa, Giardia lamblia
ENLPESFYIVFSKFNGSFTNA

SEQ ID NO: 3071066 - protein, 17 aa, Giardia lamblia
ENPEFFVFSEKLLSDGI

SEQ ID NO: 3071067 - protein, 20 aa, Giardia lamblia
ENPFLAIMAFYAQKNPKFEW

SEQ ID NO: 3071068 - protein, 18 aa, Giardia lamblia
ENREEYWMLAPVAAPSGV

SEQ ID NO: 3071069 - protein, 19 aa, Giardia lamblia
ENRIELLLADGLEEVAHEV

SEQ ID NO: 3071070 - protein, 20 aa, Giardia lamblia
ENRLAVPLLTLGHLFVEHIL

SEQ ID NO: 3071071 - protein, 25 aa, Giardia lamblia
ENRLQYPECLDVCMNLLKDDSKQGQ

SEQ ID NO: 3071072 - protein, 22 aa, Giardia lamblia
ENSCPALVPIRPLIEADTESDN

SEQ ID NO: 3071073 - protein, 22 aa, Giardia lamblia
ENTGYLGFMGMKYPVGYEYKAG

SEQ ID NO: 3071074 - protein, 30 aa, Giardia lamblia
ENTLKKSNKCLCCTIIFSILGLAILILITS

SEQ ID NO: 3071075 - protein, 25 aa, Giardia lamblia
ENTRWPIPVRFVFDGVEISTGEKEA

SEQ ID NO: 3071076 - protein, 19 aa, Giardia lamblia
ENVGLIPIMARVRSVNVTA

SEQ ID NO: 3071077 - protein, 20 aa, Giardia lamblia
EPAAGAFMRPSITTVATVSA

SEQ ID NO: 3071078 - protein, 18 aa, Giardia lamblia
EPACKFIGTEELFQSRVA

SEQ ID NO: 3071079 - protein, 18 aa, Giardia lamblia
EPDFPYSSRSCLFSTDFL

SEQ ID NO: 3071080 - protein, 19 aa, Giardia lamblia
EPGDFRTSIYMDMTNISDT

SEQ ID NO: 3071081 - protein, 20 aa, Giardia lamblia
EPGLHSILFRLSTIKDVATL

SEQ ID NO: 3071082 - protein, 20 aa, Giardia lamblia
EPIIRTLLRILLPGELYFSL

SEQ ID NO: 3071083 - protein, 22 aa, Giardia lamblia
EPKAPDVVALWNRLKVMYLQVI

SEQ ID NO: 3071084 - protein, 20 aa, Giardia lamblia
EPLDHLHLINIFRSDNLTLI

SEQ ID NO: 3071085 - protein, 18 aa, Giardia lamblia
EPLELVECTKKCMTVSDR

SEQ ID NO: 3071086 - protein, 19 aa, Giardia lamblia
EPLFKSFCECMLQRNPDKR

SEQ ID NO: 3071087 - protein, 20 aa, Giardia lamblia
EPLLSIMFTNWERARREDLA

SEQ ID NO: 3071088 - protein, 19 aa, Giardia lamblia
EPLTIFLATMSIRSVVIPI

SEQ ID NO: 3071089 - protein, 20 aa, Giardia lamblia
EPLYPMVYVLFRMGHYESLT

SEQ ID NO: 3071090 - protein, 21 aa, Giardia lamblia
EPMACPASERFIGKVNSQPII

SEQ ID NO: 3071091 - protein, 23 aa, Giardia lamblia
EPNRISYMFALLLRHLITVDLQL

SEQ ID NO: 3071092 - protein, 22 aa, Giardia lamblia
EPNVGCRECPRGHKCEVTPAGQ

SEQ ID NO: 3071093 - protein, 17 aa, Giardia lamblia
EPPERRFRRPVKKNSVL

SEQ ID NO: 3071094 - protein, 23 aa, Giardia lamblia
EPPGLCAPTPPLPGVSATATIAF

SEQ ID NO: 3071095 - protein, 21 aa, Giardia lamblia
EPPIICPEGYFLDKGLCTLCH

SEQ ID NO: 3071096 - protein, 23 aa, Giardia lamblia
EPRCIKCRFGYGLIEKTAAVSTT

SEQ ID NO: 3071097 - protein, 22 aa, Giardia lamblia
EPRPPKSFCRLFFETFKDVTII

SEQ ID NO: 3071098 - protein, 17 aa, Giardia lamblia
EPSDCKAGEQLTDDGVC

SEQ ID NO: 3071099 - protein, 25 aa, Giardia lamblia
EPSKGFDCVFEFSNLFHLSLSMFLY

SEQ ID NO: 3071100 - protein, 18 aa, Giardia lamblia
EPSYCLTLGCSEDPYEFT

SEQ ID NO: 3071101 - protein, 30 aa, Giardia lamblia
EPVDIRLRYRFTRKEMALFDGRHNAKALDV

SEQ ID NO: 3071102 - protein, 17 aa, Giardia lamblia
EPYCFNLEVSKGSNMAG

SEQ ID NO: 3071103 - protein, 17 aa, Giardia lamblia
EPYRLYYTCSRAIKNPH

SEQ ID NO: 3071104 - protein, 18 aa, Giardia lamblia
EQACALQVLGAGYFTSEQ

SEQ ID NO: 3071105 - protein, 19 aa, Giardia lamblia
EQCVSCSISNCGQCSSDNF

SEQ ID NO: 3071106 - protein, 18 aa, Giardia lamblia
EQDRLGARAKDTLTHERY

SEQ ID NO: 3071107 - protein, 17 aa, Giardia lamblia
EQDTLCTYTPIQQLPLT

SEQ ID NO: 3071108 - protein, 18 aa, Giardia lamblia
EQFIRFGQELVPYLAQLT

SEQ ID NO: 3071109 - protein, 26 aa, Giardia lamblia
EQFYNLSCLLRKSYVSAVLKDQCSRG

SEQ ID NO: 3071110 - protein, 25 aa, Giardia lamblia
EQICKQTSVAFCLFSSAYLPSLIIN

SEQ ID NO: 3071111 - protein, 25 aa, Giardia lamblia
EQINIFAAIVLYDFPLGERSQLILT

SEQ ID NO: 3071112 - protein, 25 aa, Giardia lamblia
EQKHNVVACLLSRCRTVAHVDTYAI

SEQ ID NO: 3071113 - protein, 19 aa, Giardia lamblia
EQKPLIFSLIAPRYQQVLF

SEQ ID NO: 3071114 - protein, 19 aa, Giardia lamblia
EQLALRNGPAFSLPHVSEY

SEQ ID NO: 3071115 - protein, 18 aa, Giardia lamblia
EQLGRIGYIMSDKTGTLT

SEQ ID NO: 3071116 - protein, 18 aa, Giardia lamblia
EQLISFFVGERIRNNVQE

SEQ ID NO: 3071117 - protein, 24 aa, Giardia lamblia
EQLPRLRLETIVGECMAYIFSGFY

SEQ ID NO: 3071118 - protein, 17 aa, Giardia lamblia
EQLRAKWSNGPVRLNRA

SEQ ID NO: 3071119 - protein, 19 aa, Giardia lamblia
EQNQWWRLVTGFLVTTNPD

SEQ ID NO: 3071120 - protein, 19 aa, Giardia lamblia
EQRAKVPLLVQSLAETTIS

SEQ ID NO: 3071121 - protein, 18 aa, Giardia lamblia
EQRFGIACEDTFFILARY

SEQ ID NO: 3071122 - protein, 20 aa, Giardia lamblia
EQRGSGVMMHSILQKAKTDV

SEQ ID NO: 3071123 - protein, 23 aa, Giardia lamblia
EQRSKVAVFLVDFLDLHDSVISE

SEQ ID NO: 3071124 - protein, 26 aa, Giardia lamblia
EQTFLLCLRPFFTLLSLLHCTLLRQT

SEQ ID NO: 3071125 - protein, 22 aa, Giardia lamblia
EQYPEIYSALYGATTKQRLMLK

SEQ ID NO: 3071126 - protein, 19 aa, Giardia lamblia
EQYSKLLLEDHVNLDEVDV

SEQ ID NO: 3071127 - protein, 18 aa, Giardia lamblia
EQYVPGSVGNCIACSSTQ

SEQ ID NO: 3071128 - protein, 36 aa, Giardia lamblia
ERATRYPSFYPRKGELLKDAYLSSVTMESRLWGMLN

SEQ ID NO: 3071129 - protein, 27 aa, Giardia lamblia
ERCSTGYWIAFGVCFSISIITIIIIIL

SEQ ID NO: 3071130 - protein, 24 aa, Giardia lamblia
ERFTEVPFLLSVVEDLLFHIATAA

SEQ ID NO: 3071131 - protein, 20 aa, Giardia lamblia
ERFTRDWSRSTKCLEYISTR

SEQ ID NO: 3071132 - protein, 19 aa, Giardia lamblia
ERGAFMISFLEKLSSELNV

SEQ ID NO: 3071133 - protein, 17 aa, Giardia lamblia
ERGEMAIIKAMRAEDVN

SEQ ID NO: 3071134 - protein, 25 aa, Giardia lamblia
ERGGDCRLMPDGRFVMYTREIEEMI

SEQ ID NO: 3071135 - protein, 19 aa, Giardia lamblia
ERHKRELLLASAIGPCSNG

SEQ ID NO: 3071136 - protein, 20 aa, Giardia lamblia
ERHSVFFLLAIVCFAAVLAI

SEQ ID NO: 3071137 - protein, 22 aa, Giardia lamblia
ERILGCLDPVWFNRSDRTERTE

SEQ ID NO: 3071138 - protein, 21 aa, Giardia lamblia
ERITRICTSMLMFITSSHNRA

SEQ ID NO: 3071139 - protein, 24 aa, Giardia lamblia
ERKIRYGYSRLAGFLSTNHSGPTS

SEQ ID NO: 3071140 - protein, 24 aa, Giardia lamblia
ERKKGCGGVEYFYVYTTMLLAHMC

SEQ ID NO: 3071141 - protein, 21 aa, Giardia lamblia
ERKVPYPLILFKALQNPIGAM

SEQ ID NO: 3071142 - protein, 28 aa, Giardia lamblia
ERLAERYPRFMFYTLAWFYPVIRTASKQ

SEQ ID NO: 3071143 - protein, 17 aa, Giardia lamblia
ERLAIAFVRTIIIIEVE

SEQ ID NO: 3071144 - protein, 19 aa, Giardia lamblia
ERLEAYKARYPNRAPLADV

SEQ ID NO: 3071145 - protein, 19 aa, Giardia lamblia
ERLHGKFNEKEREVQKERT

SEQ ID NO: 3071146 - protein, 29 aa, Giardia lamblia
ERLIVSAISYLSLRSGIYTSMQVPSEAAA

SEQ ID NO: 3071147 - protein, 19 aa, Giardia lamblia
ERLLAEHKRRKNLVPIAVI

SEQ ID NO: 3071148 - protein, 19 aa, Giardia lamblia
ERLLSLELSEPVKHSINTP

SEQ ID NO: 3071149 - protein, 26 aa, Giardia lamblia
ERLSAEFKAQLVASVCTVAAPHPDGS

SEQ ID NO: 3071150 - protein, 20 aa, Giardia lamblia
ERMLIKRGWATTLNFGHNID

SEQ ID NO: 3071151 - protein, 20 aa, Giardia lamblia
ERMLWPGLAEIPAYLVRVHS

SEQ ID NO: 3071152 - protein, 24 aa, Giardia lamblia
ERMWQIFVANCGCTYTLEKVFPKV

SEQ ID NO: 3071153 - protein, 24 aa, Giardia lamblia
ERNEAYAAEMSRLVMSYIDGVIDF

SEQ ID NO: 3071154 - protein, 21 aa, Giardia lamblia
ERNRMYGILIAPIFSKLFHDV

SEQ ID NO: 3071155 - protein, 20 aa, Giardia lamblia
ERNSRDFSAAYGLGQLGPAF

SEQ ID NO: 3071156 - protein, 25 aa, Giardia lamblia
ERPDAAKWSAIYGRHCGVGATGVCG

SEQ ID NO: 3071157 - protein, 20 aa, Giardia lamblia
ERPSSGVLRRLRLYEYFKRL

SEQ ID NO: 3071158 - protein, 19 aa, Giardia lamblia
ERPTYRYSPIFKVICWPMC

SEQ ID NO: 3071159 - protein, 25 aa, Giardia lamblia
ERSRLCVYFPSFTYHDYISLGLYNN

SEQ ID NO: 3071160 - protein, 24 aa, Giardia lamblia
ERSRLRMTQPLTRATIRTAAIQDS

SEQ ID NO: 3071161 - protein, 20 aa, Giardia lamblia
ERVQLALSLTTGFAGDIVID

SEQ ID NO: 3071162 - protein, 25 aa, Giardia lamblia
ERVRQDLPGSLVFILPGLVKTYHEH

SEQ ID NO: 3071163 - protein, 18 aa, Giardia lamblia
ERVWDAGHIPLLFNVDQY

SEQ ID NO: 3071164 - protein, 20 aa, Giardia lamblia
ERVYMPVPFYVATMPKPLNL

SEQ ID NO: 3071165 - protein, 26 aa, Giardia lamblia
ERWQVLRPLLLLTFTDFVVLFGTLER

SEQ ID NO: 3071166 - protein, 17 aa, Giardia lamblia
ERYCFIHMYPWGGCLVF

SEQ ID NO: 3071167 - protein, 17 aa, Giardia lamblia
ERYPYLEIADQFASKAG

SEQ ID NO: 3071168 - protein, 21 aa, Giardia lamblia
ESAAKGIGRANSFLKSPTLAP

SEQ ID NO: 3071169 - protein, 18 aa, Giardia lamblia
ESARECQTIFTLSVLQTY

SEQ ID NO: 3071170 - protein, 23 aa, Giardia lamblia
ESDTPLQHFIIHWSSTMQVALKS

SEQ ID NO: 3071171 - protein, 18 aa, Giardia lamblia
ESEILYKLIDSFEARYGI

SEQ ID NO: 3071172 - protein, 22 aa, Giardia lamblia
ESESPLALFSVLYLCAVHMFAS

SEQ ID NO: 3071173 - protein, 17 aa, Giardia lamblia
ESEVWEILAGIVTAIDS

SEQ ID NO: 3071174 - protein, 22 aa, Giardia lamblia
ESFIIKCLLYCINVSFCMGTTA

SEQ ID NO: 3071175 - protein, 19 aa, Giardia lamblia
ESFYCKIMGLVCYGTAGVQ

SEQ ID NO: 3071176 - protein, 24 aa, Giardia lamblia
ESGDWSCQCSGLLTTYVSTCVLST

SEQ ID NO: 3071177 - protein, 26 aa, Giardia lamblia
ESGFERLYFEYGLRAPQELFLLSGML

SEQ ID NO: 3071178 - protein, 19 aa, Giardia lamblia
ESGILLVRDDLDLHRNVKT

SEQ ID NO: 3071179 - protein, 19 aa, Giardia lamblia
ESGMPAAPMGHVYIPETRM

SEQ ID NO: 3071180 - protein, 22 aa, Giardia lamblia
ESGQALLVLSCFLTGDYGFPKS

SEQ ID NO: 3071181 - protein, 19 aa, Giardia lamblia
ESGSGWPSGMVVTSKSHRR

SEQ ID NO: 3071182 - protein, 27 aa, Giardia lamblia
ESHGAYTFCSLAGLYILLGCSSAALRD

SEQ ID NO: 3071183 - protein, 18 aa, Giardia lamblia
ESIESKKMSAWEIAAGSR

SEQ ID NO: 3071184 - protein, 26 aa, Giardia lamblia
ESIFPRIVEMLSLTAHDKLNCNRNVS

SEQ ID NO: 3071185 - protein, 17 aa, Giardia lamblia
ESILTMLAILYMDAGKI

SEQ ID NO: 3071186 - protein, 19 aa, Giardia lamblia
ESKDILLGSGFFVPRRLIT

SEQ ID NO: 3071187 - protein, 25 aa, Giardia lamblia
ESKGRVYIVLFLKRLNDYHSDLAKD

SEQ ID NO: 3071188 - protein, 25 aa, Giardia lamblia
ESLFRLLDDFNIFAFQLLGDYLHTY

SEQ ID NO: 3071189 - protein, 18 aa, Giardia lamblia
ESLKVLYSSLVMYRKKAR

SEQ ID NO: 3071190 - protein, 20 aa, Giardia lamblia
ESLLPKFGPDISVIDISNNA

SEQ ID NO: 3071191 - protein, 21 aa, Giardia lamblia
ESLRTLLRSTFCSLKATVWRH

SEQ ID NO: 3071192 - protein, 24 aa, Giardia lamblia
ESLSGLCFYHPELLACAQTVAPDR

SEQ ID NO: 3071193 - protein, 18 aa, Giardia lamblia
ESMALIKLLAAYPTVACV

SEQ ID NO: 3071194 - protein, 18 aa, Giardia lamblia
ESPLVLELLQFVQSALEG

SEQ ID NO: 3071195 - protein, 20 aa, Giardia lamblia
ESPTTLSIRSIYVFVKYVRR

SEQ ID NO: 3071196 - protein, 19 aa, Giardia lamblia
ESRDALFLLQGLESLMATA

SEQ ID NO: 3071197 - protein, 24 aa, Giardia lamblia
ESRSKELYKGFVYNMHQYLHFSDP

SEQ ID NO: 3071198 - protein, 19 aa, Giardia lamblia
ESRVKVVWIPEFVSKTSPV

SEQ ID NO: 3071199 - protein, 19 aa, Giardia lamblia
ESSAMAFLYHIFTYLDTER

SEQ ID NO: 3071200 - protein, 29 aa, Giardia lamblia
ESSFYLSLILSRKVTEFSVRSFGLNYLWS

SEQ ID NO: 3071201 - protein, 22 aa, Giardia lamblia
ESSPLYHLFLPYLLSFPNTFIY

SEQ ID NO: 3071202 - protein, 24 aa, Giardia lamblia
ESTFTPMIVWLFFKQSARVYTYRI

SEQ ID NO: 3071203 - protein, 19 aa, Giardia lamblia
ESTTIMWAIASMYLQQTYP

SEQ ID NO: 3071204 - protein, 23 aa, Giardia lamblia
ESVIRRLKCTDYYLHSRDTPFLF

SEQ ID NO: 3071205 - protein, 19 aa, Giardia lamblia
ESVKFMFVTLLGAASSFRA

SEQ ID NO: 3071206 - protein, 24 aa, Giardia lamblia
ESVSVPRLLYYISHYIVTGNAYVV

SEQ ID NO: 3071207 - protein, 24 aa, Giardia lamblia
ESVVAGRCTRCLGNYFLYEGGCYS

SEQ ID NO: 3071208 - protein, 24 aa, Giardia lamblia
ESWASEPIAAFLYLSLSNSERLVT

SEQ ID NO: 3071209 - protein, 25 aa, Giardia lamblia
ESWHRMRGELARMFGHIAGLHPHHV

SEQ ID NO: 3071210 - protein, 20 aa, Giardia lamblia
ETALSISLHNSHFAIADLLV

SEQ ID NO: 3071211 - protein, 23 aa, Giardia lamblia
ETAMAIFCLSNEYPLLDYDIKKV

SEQ ID NO: 3071212 - protein, 19 aa, Giardia lamblia
ETCKYEFKAIFTPYLGRSQ

SEQ ID NO: 3071213 - protein, 20 aa, Giardia lamblia
ETCSISFHKMLLLMYQEGGP

SEQ ID NO: 3071214 - protein, 22 aa, Giardia lamblia
ETCTVCPTGFHLVHFGENNATC

SEQ ID NO: 3071215 - protein, 17 aa, Giardia lamblia
ETCYSRITAVCTELLGS

SEQ ID NO: 3071216 - protein, 26 aa, Giardia lamblia
ETDLFLLDFLHFFKPYSIQALLDSLQ

SEQ ID NO: 3071217 - protein, 24 aa, Giardia lamblia
ETDWKMRKALNFTQGKGIEYLRDV

SEQ ID NO: 3071218 - protein, 24 aa, Giardia lamblia
ETETRMQYLYSIVWEQGVLIFDRL

SEQ ID NO: 3071219 - protein, 24 aa, Giardia lamblia
ETFCTECYRGAYAGAYGMPCHSTC

SEQ ID NO: 3071220 - protein, 20 aa, Giardia lamblia
ETGGETVLMWAVHKREETFL

SEQ ID NO: 3071221 - protein, 24 aa, Giardia lamblia
ETGGRFKPYLPLDIDSSIFPPLIT

SEQ ID NO: 3071222 - protein, 21 aa, Giardia lamblia
ETGKCILCNASGDGYTGVANC

SEQ ID NO: 3071223 - protein, 23 aa, Giardia lamblia
ETGPQFHGCFDALEPSAVQSSVI

SEQ ID NO: 3071224 - protein, 18 aa, Giardia lamblia
ETHFPLSYLQAGTDDDYH

SEQ ID NO: 3071225 - protein, 19 aa, Giardia lamblia
ETIHYFFGHLIGKRNNASL

SEQ ID NO: 3071226 - protein, 25 aa, Giardia lamblia
ETILDYFAACFIISYSMLSDLTPPL

SEQ ID NO: 3071227 - protein, 24 aa, Giardia lamblia
ETIPFPTMPLRVIQCENLWMENES

SEQ ID NO: 3071228 - protein, 17 aa, Giardia lamblia
ETKPWADLVTEKVRRHW

SEQ ID NO: 3071229 - protein, 19 aa, Giardia lamblia
ETLDIMALTVVQHVIARNI

SEQ ID NO: 3071230 - protein, 19 aa, Giardia lamblia
ETLLSFDYERCLKIKEIKG

SEQ ID NO: 3071231 - protein, 19 aa, Giardia lamblia
ETLLYKFIVTEEIAFDPKI

SEQ ID NO: 3071232 - protein, 25 aa, Giardia lamblia
ETLQFEVLRKFGLVDPFDPANPRNA

SEQ ID NO: 3071233 - protein, 21 aa, Giardia lamblia
ETLRAAFQVLYVLLVLIYLTI

SEQ ID NO: 3071234 - protein, 25 aa, Giardia lamblia
ETNLRVVKRLDMPGTSLPHPSSSSI

SEQ ID NO: 3071235 - protein, 19 aa, Giardia lamblia
ETPKLSCIGLHCMAVCVSD

SEQ ID NO: 3071236 - protein, 20 aa, Giardia lamblia
ETPRYKYFVSSIIGSDMPYL

SEQ ID NO: 3071237 - protein, 23 aa, Giardia lamblia
ETPSLLPSWSIRASSLLHTGLLI

SEQ ID NO: 3071238 - protein, 28 aa, Giardia lamblia
ETPVSICGVSMPKGCTLQLVTYDISRDR

SEQ ID NO: 3071239 - protein, 19 aa, Giardia lamblia
ETRYARYFASFGYHSISKE

SEQ ID NO: 3071240 - protein, 17 aa, Giardia lamblia
ETSAECNWCQNEKYGPI

SEQ ID NO: 3071241 - protein, 18 aa, Giardia lamblia
ETVPHLMATVKIVHQMAR

SEQ ID NO: 3071242 - protein, 32 aa, Giardia lamblia
ETVPSNDYYIMWPVFIVRNSFIPLDMEEFCTM

SEQ ID NO: 3071243 - protein, 28 aa, Giardia lamblia
ETYIPKKIKIYIDREMDFNRVLYTHNGQ

SEQ ID NO: 3071244 - protein, 19 aa, Giardia lamblia
ETYPTFSALFAKRHAESLN

SEQ ID NO: 3071245 - protein, 17 aa, Giardia lamblia
ETYRISKPTAIDHHNIF

SEQ ID NO: 3071246 - protein, 20 aa, Giardia lamblia
EVAERLGVIGLYLYTCFSNM

SEQ ID NO: 3071247 - protein, 25 aa, Giardia lamblia
EVAGELLSLCCLYRDFFIPPLSTML

SEQ ID NO: 3071248 - protein, 27 aa, Giardia lamblia
EVAKASLRYTDWYSCARRLMASYWNYV

SEQ ID NO: 3071249 - protein, 18 aa, Giardia lamblia
EVALDFIFPSPLAVLSEL

SEQ ID NO: 3071250 - protein, 19 aa, Giardia lamblia
EVAQARRVRRKRPQGIHRT

SEQ ID NO: 3071251 - protein, 19 aa, Giardia lamblia
EVARKNLFLQMNDIPLPQD

SEQ ID NO: 3071252 - protein, 24 aa, Giardia lamblia
EVAYRILLGLGLPVYIPAYLMHVW

SEQ ID NO: 3071253 - protein, 28 aa, Giardia lamblia
EVCELSFKLTLCTQLPPIHILVIHREIF

SEQ ID NO: 3071254 - protein, 24 aa, Giardia lamblia
EVCLPMMMLFGFAALASYGLLTDA

SEQ ID NO: 3071255 - protein, 20 aa, Giardia lamblia
EVDAPYFAPSFRGLTSFVKA

SEQ ID NO: 3071256 - protein, 24 aa, Giardia lamblia
EVDDWSPLMLWVLRGNRGDVAPDD

SEQ ID NO: 3071257 - protein, 19 aa, Giardia lamblia
EVDTIPGVCKLCQDGFFRL

SEQ ID NO: 3071258 - protein, 23 aa, Giardia lamblia
EVFAKYCPWLRNTVDALAGLGRR

SEQ ID NO: 3071259 - protein, 21 aa, Giardia lamblia
EVGMLFCSVFLERYRQMHYAF

SEQ ID NO: 3071260 - protein, 24 aa, Giardia lamblia
EVILERKYWAAAFHVNGMSSKTEL

SEQ ID NO: 3071261 - protein, 17 aa, Giardia lamblia
EVIRLCYEASRVAAAEE

SEQ ID NO: 3071262 - protein, 22 aa, Giardia lamblia
EVKRSIYITMRLFDRLKSLSEE

SEQ ID NO: 3071263 - protein, 25 aa, Giardia lamblia
EVLARRMTCFLVVSLIHPLSPLLIS

SEQ ID NO: 3071264 - protein, 23 aa, Giardia lamblia
EVLELSQLRACFDSIPLDKNGVG

SEQ ID NO: 3071265 - protein, 17 aa, Giardia lamblia
EVLFRYSNPDSKSFDSR

SEQ ID NO: 3071266 - protein, 18 aa, Giardia lamblia
EVLIKRHVVFLCIACSAV

SEQ ID NO: 3071267 - protein, 20 aa, Giardia lamblia
EVLKLWDFLFSFGLGLMPLL

SEQ ID NO: 3071268 - protein, 17 aa, Giardia lamblia
EVLKTSATIHSITMAER

SEQ ID NO: 3071269 - protein, 18 aa, Giardia lamblia
EVLLFCINFLTANLPDNA

SEQ ID NO: 3071270 - protein, 20 aa, Giardia lamblia
EVLRHLALAGKRTHEGVSAL

SEQ ID NO: 3071271 - protein, 17 aa, Giardia lamblia
EVLYKLYSEDGVLGQLV

SEQ ID NO: 3071272 - protein, 20 aa, Giardia lamblia
EVPSVFALNAHDSLDLFAKV

SEQ ID NO: 3071273 - protein, 32 aa, Giardia lamblia
EVQACKICTRRGLCFGKSLPTIKVREEDVQIV

SEQ ID NO: 3071274 - protein, 17 aa, Giardia lamblia
EVQDMTCIVSFPVIVPD

SEQ ID NO: 3071275 - protein, 24 aa, Giardia lamblia
EVRSYKMFYLYVILILYNEYNRVR

SEQ ID NO: 3071276 - protein, 25 aa, Giardia lamblia
EVRVTCFFDDLAIFQKLFSAHCNMT

SEQ ID NO: 3071277 - protein, 26 aa, Giardia lamblia
EVSCSLCGGLSTWTAVVCAHVARFTI

SEQ ID NO: 3071278 - protein, 23 aa, Giardia lamblia
EVSMYHVMILAVIFAVFITDISG

SEQ ID NO: 3071279 - protein, 18 aa, Giardia lamblia
EVVKELFKALSTVQDERS

SEQ ID NO: 3071280 - protein, 18 aa, Giardia lamblia
EVVKRVGMLELIVVGFFM

SEQ ID NO: 3071281 - protein, 26 aa, Giardia lamblia
EVVLPTKVSVDWPLFHHTFMVASVGV

SEQ ID NO: 3071282 - protein, 25 aa, Giardia lamblia
EVVRRFCPEFLWARDVSSAGQPNQA

SEQ ID NO: 3071283 - protein, 20 aa, Giardia lamblia
EVVRYFPVVYLTIASLLHVY

SEQ ID NO: 3071284 - protein, 18 aa, Giardia lamblia
EVVSPTLILHITRVLGCI

SEQ ID NO: 3071285 - protein, 17 aa, Giardia lamblia
EVWEILAGIVTAIDSLR

SEQ ID NO: 3071286 - protein, 19 aa, Giardia lamblia
EVYCIKRKSLLRQVCHAVT

SEQ ID NO: 3071287 - protein, 22 aa, Giardia lamblia
EVYRSTLPPGMQLIDHIKQSHF

SEQ ID NO: 3071288 - protein, 21 aa, Giardia lamblia
EWIDSSFLRALREAIALSENM

SEQ ID NO: 3071289 - protein, 19 aa, Giardia lamblia
EWIFISLAFYIAGYARVIR

SEQ ID NO: 3071290 - protein, 26 aa, Giardia lamblia
EYCVAVEISGSWAISYMRDVESVLGH

SEQ ID NO: 3071291 - protein, 19 aa, Giardia lamblia
EYEGVGVFFDWDEYLHDKF

SEQ ID NO: 3071292 - protein, 18 aa, Giardia lamblia
EYEKCFEKMSADALLAIR

SEQ ID NO: 3071293 - protein, 32 aa, Giardia lamblia
EYFRRRAKKRAEIRYGGLFIEMDRFTASINRL

SEQ ID NO: 3071294 - protein, 22 aa, Giardia lamblia
EYFSFMGEFLINFSDLNPLSDT

SEQ ID NO: 3071295 - protein, 18 aa, Giardia lamblia
EYGEHISGGKVCSTVEAQ

SEQ ID NO: 3071296 - protein, 19 aa, Giardia lamblia
EYGVLGGFGGLIGGLIGGA

SEQ ID NO: 3071297 - protein, 19 aa, Giardia lamblia
EYIMPFGVLVIMILYTASL

SEQ ID NO: 3071298 - protein, 17 aa, Giardia lamblia
EYIYVPRISTGSIDEIL

SEQ ID NO: 3071299 - protein, 25 aa, Giardia lamblia
EYLLYLRQLCIGLANEVTRLTTSDL

SEQ ID NO: 3071300 - protein, 21 aa, Giardia lamblia
EYLMQCNKFLSALYTVTNPHR

SEQ ID NO: 3071301 - protein, 24 aa, Giardia lamblia
EYMVPNCVILYYFLTKAPFIHVLG

SEQ ID NO: 3071302 - protein, 21 aa, Giardia lamblia
EYNYIPFCTKLVGMKLYGMLY

SEQ ID NO: 3071303 - protein, 19 aa, Giardia lamblia
EYPLMFMRIFYGKETKLSM

SEQ ID NO: 3071304 - protein, 23 aa, Giardia lamblia
EYSEAMLSLAVRVITTVCGAPQT

SEQ ID NO: 3071305 - protein, 20 aa, Giardia lamblia
EYSFSWKLHFFYEFRAWFGT

SEQ ID NO: 3071306 - protein, 20 aa, Giardia lamblia
EYSGRYIGFFTSLYYFIGYS

SEQ ID NO: 3071307 - protein, 17 aa, Giardia lamblia
EYTCCGELLNMVKRTEE

SEQ ID NO: 3071308 - protein, 19 aa, Giardia lamblia
EYTRLSENILFLLETTSLR

SEQ ID NO: 3071309 - protein, 23 aa, Giardia lamblia
EYTSRFESILNFASSNHLPILRL

SEQ ID NO: 3071310 - protein, 18 aa, Giardia lamblia
EYVCPQLLYIKQDQPGDQ

SEQ ID NO: 3071311 - protein, 22 aa, Giardia lamblia
EYVKLLFPRPFDYIFNLFVTFD

SEQ ID NO: 3071312 - protein, 19 aa, Giardia lamblia
FAANEVKPHLSVQHVTHRY

SEQ ID NO: 3071313 - protein, 18 aa, Giardia lamblia
FAARLAIKSMALYAPPPA

SEQ ID NO: 3071314 - protein, 18 aa, Giardia lamblia
FAASYAYSLCFRYTDMLI

SEQ ID NO: 3071315 - protein, 19 aa, Giardia lamblia
FAAVAFLRLLTARLSKLLL

SEQ ID NO: 3071316 - protein, 18 aa, Giardia lamblia
FACEMIWATIQADLLVFA

SEQ ID NO: 3071317 - protein, 17 aa, Giardia lamblia
FACLADCIVKLFTYYFN

SEQ ID NO: 3071318 - protein, 23 aa, Giardia lamblia
FACVYTTRLLYWLFRKNNSLRCI

SEQ ID NO: 3071319 - protein, 24 aa, Giardia lamblia
FADICAFGVCADGFYFSYDNSKCL

SEQ ID NO: 3071320 - protein, 19 aa, Giardia lamblia
FADLCSAPGGWSYTILERF

SEQ ID NO: 3071321 - protein, 17 aa, Giardia lamblia
FAECYTLDGKSVGEYLI

SEQ ID NO: 3071322 - protein, 21 aa, Giardia lamblia
FAEEFLIFILKKSLRTLRNID

SEQ ID NO: 3071323 - protein, 21 aa, Giardia lamblia
FAEEILDALSISYSNGTALCL

SEQ ID NO: 3071324 - protein, 30 aa, Giardia lamblia
FAEEQLRFAEALCCDFKSILLDDPHRNHSQ

SEQ ID NO: 3071325 - protein, 20 aa, Giardia lamblia
FAEFITRVVAYLMIEGISHV

SEQ ID NO: 3071326 - protein, 26 aa, Giardia lamblia
FAELVGFGSLCLSLGAAFALLTADPP

SEQ ID NO: 3071327 - protein, 37 aa, Giardia lamblia
FAEMRPAEVSYVFERYLWKFVFELTAYEVKNPVFELI

SEQ ID NO: 3071328 - protein, 23 aa, Giardia lamblia
FAERPDIYIGRKITDPYLTANDL

SEQ ID NO: 3071329 - protein, 22 aa, Giardia lamblia
FAGDHCVLCSPSAYSPDTTIKC

SEQ ID NO: 3071330 - protein, 18 aa, Giardia lamblia
FAGIYSHLSCLPGVSCQS

SEQ ID NO: 3071331 - protein, 17 aa, Giardia lamblia
FAGSFGYSITRSDYAEL

SEQ ID NO: 3071332 - protein, 18 aa, Giardia lamblia
FAHDLGLRSIRMALRAGQ

SEQ ID NO: 3071333 - protein, 21 aa, Giardia lamblia
FAIFMHLLRLSYLVDSMLNKE

SEQ ID NO: 3071334 - protein, 20 aa, Giardia lamblia
FAKERGCRTIVLVPDEYETR

SEQ ID NO: 3071335 - protein, 19 aa, Giardia lamblia
FAKSRAAMEDHLISVMIKS

SEQ ID NO: 3071336 - protein, 36 aa, Giardia lamblia
FALHCYKPTPLYVMDEIDAALDFRNVSIIAKYIKGR

SEQ ID NO: 3071337 - protein, 28 aa, Giardia lamblia
FALRRSSRPIAFFSMEPIFYRYIEAARR

SEQ ID NO: 3071338 - protein, 25 aa, Giardia lamblia
FALSCLYCPKGIALDYLNFHELEYH

SEQ ID NO: 3071339 - protein, 29 aa, Giardia lamblia
FALTCSLFSRWYVRWPRYQLSQYVRIYGE

SEQ ID NO: 3071340 - protein, 31 aa, Giardia lamblia
FAMAFKSVFSAAIISWFSVIFVPQMILLLSK

SEQ ID NO: 3071341 - protein, 27 aa, Giardia lamblia
FANDMDLCLTNLILLFCNEIIDGSSSK

SEQ ID NO: 3071342 - protein, 26 aa, Giardia lamblia
FANECHVLGALLSLIASLGVLCTEGD

SEQ ID NO: 3071343 - protein, 22 aa, Giardia lamblia
FANLLPHRALDYIFQDKDIKLQ

SEQ ID NO: 3071344 - protein, 17 aa, Giardia lamblia
FAPFLAERITIEKVLEL

SEQ ID NO: 3071345 - protein, 19 aa, Giardia lamblia
FAPPLRFNKFVSKFFTSFA

SEQ ID NO: 3071346 - protein, 22 aa, Giardia lamblia
FAPTRTGLVVFKIMTTHRHSLA

SEQ ID NO: 3071347 - protein, 23 aa, Giardia lamblia
FAQLMMYPPWYGIFYNLMAVIAG

SEQ ID NO: 3071348 - protein, 17 aa, Giardia lamblia
FAQTLPYILHAPANVDN

SEQ ID NO: 3071349 - protein, 18 aa, Giardia lamblia
FARGFIFSALYSIFRPIF

SEQ ID NO: 3071350 - protein, 34 aa, Giardia lamblia
FARMKTAALRLCFKRSSFYRYLLDENKDPESSPN

SEQ ID NO: 3071351 - protein, 20 aa, Giardia lamblia
FASAMPYLLMAFIGKTALQG

SEQ ID NO: 3071352 - protein, 18 aa, Giardia lamblia
FASFPDQMRTSSLFQKTP

SEQ ID NO: 3071353 - protein, 30 aa, Giardia lamblia
FASILAAVRGWRMHYCFNATSVYSAHKAIQ

SEQ ID NO: 3071354 - protein, 23 aa, Giardia lamblia
FASLSLVPGMLLWRSFSSDKALL

SEQ ID NO: 3071355 - protein, 17 aa, Giardia lamblia
FASNLSYSNIVESYNAS

SEQ ID NO: 3071356 - protein, 24 aa, Giardia lamblia
FASPRNLCRLSLLQAEITRHKQAA

SEQ ID NO: 3071357 - protein, 24 aa, Giardia lamblia
FASTLCFLWLYFTYCTLLLNVGEA

SEQ ID NO: 3071358 - protein, 25 aa, Giardia lamblia
FATFYPKWRDYYAWFNDVSVCLGNM

SEQ ID NO: 3071359 - protein, 27 aa, Giardia lamblia
FATYSDRIIRCMLTFTTLPDARLLTSS

SEQ ID NO: 3071360 - protein, 18 aa, Giardia lamblia
FAVLDLIQTTAFNIAMVY

SEQ ID NO: 3071361 - protein, 24 aa, Giardia lamblia
FAYLFPLLLREGFFNTTQVTSSQI

SEQ ID NO: 3071362 - protein, 18 aa, Giardia lamblia
FCACSFPYTSVGGLCVHQ

SEQ ID NO: 3071363 - protein, 18 aa, Giardia lamblia
FCAKEVYSSPSIVLISSQ

SEQ ID NO: 3071364 - protein, 26 aa, Giardia lamblia
FCDAGFKNPFLQAASCKLTCQLFTIC

SEQ ID NO: 3071365 - protein, 26 aa, Giardia lamblia
FCDSGSISVHFYQRFTYLLQNHEAKQ

SEQ ID NO: 3071366 - protein, 23 aa, Giardia lamblia
FCEKSLYTLSFIKICTGTLMRDM

SEQ ID NO: 3071367 - protein, 19 aa, Giardia lamblia
FCHAFFFQTRVLLKSHLSY

SEQ ID NO: 3071368 - protein, 26 aa, Giardia lamblia
FCIHGAAVSKARYIAECVQFNSIGIS

SEQ ID NO: 3071369 - protein, 25 aa, Giardia lamblia
FCIREPSRLLAFVFQYVFFALFAGS

SEQ ID NO: 3071370 - protein, 19 aa, Giardia lamblia
FCNEVCAYIEFSKAAPGVV

SEQ ID NO: 3071371 - protein, 21 aa, Giardia lamblia
FCNLYSPSAGYIFSRDFCDII

SEQ ID NO: 3071372 - protein, 18 aa, Giardia lamblia
FCSAFRKALLDVHTRVIV

SEQ ID NO: 3071373 - protein, 17 aa, Giardia lamblia
FCSLKATVWRHSTSRAI

SEQ ID NO: 3071374 - protein, 19 aa, Giardia lamblia
FCSVEPCITNIEYEFGDTW

SEQ ID NO: 3071375 - protein, 18 aa, Giardia lamblia
FCVFYRLVRFILNKRAQQ

SEQ ID NO: 3071376 - protein, 22 aa, Giardia lamblia
FCVPRNSYCQFTYDTTNLTETA

SEQ ID NO: 3071377 - protein, 19 aa, Giardia lamblia
FCYLMSGLDSHRFADIGTL

SEQ ID NO: 3071378 - protein, 19 aa, Giardia lamblia
FDAFMAHDHFLLRYDNPGD

SEQ ID NO: 3071379 - protein, 22 aa, Giardia lamblia
FDASLLQFLAWLSESTIFELKT

SEQ ID NO: 3071380 - protein, 18 aa, Giardia lamblia
FDASNNCIDHCKSLGDYF

SEQ ID NO: 3071381 - protein, 26 aa, Giardia lamblia
FDDDGRCKGVFACCPKILAKSDEKFA

SEQ ID NO: 3071382 - protein, 18 aa, Giardia lamblia
FDDKLFMFRHLMRLGSNC

SEQ ID NO: 3071383 - protein, 24 aa, Giardia lamblia
FDDLIQRVAFMRRWLTNGQPATFW

SEQ ID NO: 3071384 - protein, 17 aa, Giardia lamblia
FDEAFKLQMKAQRTLPC

SEQ ID NO: 3071385 - protein, 20 aa, Giardia lamblia
FDEGRYEECLSRNSRAMAAF

SEQ ID NO: 3071386 - protein, 20 aa, Giardia lamblia
FDEKNGWVLNDNGFFFSNKY

SEQ ID NO: 3071387 - protein, 19 aa, Giardia lamblia
FDESGAFFRACQSTFLVLN

SEQ ID NO: 3071388 - protein, 19 aa, Giardia lamblia
FDGCGRTIIGNGIIVIPLM

SEQ ID NO: 3071389 - protein, 18 aa, Giardia lamblia
FDGICIRSPAALSAEPKD

SEQ ID NO: 3071390 - protein, 25 aa, Giardia lamblia
FDGIKIVALKLVDQLAMPDTSNLSA

SEQ ID NO: 3071391 - protein, 25 aa, Giardia lamblia
FDGKDAWVTRPGWFTDVVYYHPTDE

SEQ ID NO: 3071392 - protein, 25 aa, Giardia lamblia
FDGQLCGAISTFLRQSLMETKLDHT

SEQ ID NO: 3071393 - protein, 30 aa, Giardia lamblia
FDGYSLKKRLGYRFFPEVQMAANNTAHGHS

SEQ ID NO: 3071394 - protein, 18 aa, Giardia lamblia
FDHHCPWVGTDVGLRNYG

SEQ ID NO: 3071395 - protein, 27 aa, Giardia lamblia
FDHSFRCGGCGKLSHHTLLNFLQFDTS

SEQ ID NO: 3071396 - protein, 28 aa, Giardia lamblia
FDIPTTLLRRILGLSFKAQDIMLSSPEM

SEQ ID NO: 3071397 - protein, 25 aa, Giardia lamblia
FDIQYRVQVVLYIRLTLLKYTLISP

SEQ ID NO: 3071398 - protein, 24 aa, Giardia lamblia
FDKIISIDHVFTFIHLLPSNPYRT

SEQ ID NO: 3071399 - protein, 40 aa, Giardia lamblia
FDKLLFGVGMLESFGAVFLCLYFIWAGFFFAVFGQNNSWI

SEQ ID NO: 3071400 - protein, 20 aa, Giardia lamblia
FDKSRCLINAPVVVTSSPSF

SEQ ID NO: 3071401 - protein, 25 aa, Giardia lamblia
FDKVAYRSIHFWAVPSLAPNTFKFQ

SEQ ID NO: 3071402 - protein, 18 aa, Giardia lamblia
FDKVKRYDPAGAVREAPP

SEQ ID NO: 3071403 - protein, 20 aa, Giardia lamblia
FDLFCTRLKKIADIIITNEN

SEQ ID NO: 3071404 - protein, 20 aa, Giardia lamblia
FDLLFLSRSVVPGFDSLLSL

SEQ ID NO: 3071405 - protein, 19 aa, Giardia lamblia
FDLPGIVKYAPRNTRSKPI

SEQ ID NO: 3071406 - protein, 20 aa, Giardia lamblia
FDLTNCRPLQGTPNILLNLH

SEQ ID NO: 3071407 - protein, 34 aa, Giardia lamblia
FDMLRSQLIFFIAICILGGVSVHLLGPRYSGKTT

SEQ ID NO: 3071408 - protein, 25 aa, Giardia lamblia
FDMSSRDWCLCWILTGSLRLLQKNF

SEQ ID NO: 3071409 - protein, 24 aa, Giardia lamblia
FDPQIPHVHIYGSVAYFAQSSCIF

SEQ ID NO: 3071410 - protein, 26 aa, Giardia lamblia
FDRSLQMFDLLLARFADKRTRLYSVF

SEQ ID NO: 3071411 - protein, 18 aa, Giardia lamblia
FDSAELTGNVGFFAQLNM

SEQ ID NO: 3071412 - protein, 17 aa, Giardia lamblia
FDSIPYLNHLFETLQST

SEQ ID NO: 3071413 - protein, 21 aa, Giardia lamblia
FDSLLCEGEKAIFRAAVAIFK

SEQ ID NO: 3071414 - protein, 25 aa, Giardia lamblia
FDSPEEMSKYFSVPIFHSTNCSYRS

SEQ ID NO: 3071415 - protein, 17 aa, Giardia lamblia
FDSPTLLSSPRFCASYV

SEQ ID NO: 3071416 - protein, 17 aa, Giardia lamblia
FDSRVGYGLMNRRNDLD

SEQ ID NO: 3071417 - protein, 17 aa, Giardia lamblia
FDSSPDLLYFVTATNSK

SEQ ID NO: 3071418 - protein, 24 aa, Giardia lamblia
FDSTLDILTLISFAFEYLVDQLLL

SEQ ID NO: 3071419 - protein, 31 aa, Giardia lamblia
FDTKYETRFSIVLHLYSLIGSQLMSFDRSIL

SEQ ID NO: 3071420 - protein, 18 aa, Giardia lamblia
FDVADFAGAGDRYLVLVS

SEQ ID NO: 3071421 - protein, 18 aa, Giardia lamblia
FDVHRKFFYAHPISNDDC

SEQ ID NO: 3071422 - protein, 18 aa, Giardia lamblia
FDYQEFREMLVIDGQAKG

SEQ ID NO: 3071423 - protein, 17 aa, Giardia lamblia
FDYYVDWQPVIDYQQKM

SEQ ID NO: 3071424 - protein, 17 aa, Giardia lamblia
FEAVFEYPKLLSYAELV

SEQ ID NO: 3071425 - protein, 22 aa, Giardia lamblia
FECTNCAPGYYLAGTQCVKCLA

SEQ ID NO: 3071426 - protein, 21 aa, Giardia lamblia
FEDFGRLALHVDEEAVRGRIR

SEQ ID NO: 3071427 - protein, 20 aa, Giardia lamblia
FEDSGRLALYVDEEAVRGRI

SEQ ID NO: 3071428 - protein, 25 aa, Giardia lamblia
FEEARTYYELVGFLMDKCLDYERSE

SEQ ID NO: 3071429 - protein, 22 aa, Giardia lamblia
FEEASIWIFLASMLDLFVLLHG

SEQ ID NO: 3071430 - protein, 26 aa, Giardia lamblia
FEESYGVACIGSFCLESSELIRPNTI

SEQ ID NO: 3071431 - protein, 18 aa, Giardia lamblia
FEFEFPADKIINVQAEME

SEQ ID NO: 3071432 - protein, 20 aa, Giardia lamblia
FEFVCDAAAFASGREFLNPA

SEQ ID NO: 3071433 - protein, 37 aa, Giardia lamblia
FEHLFSLLVPNVFSIPGCRQRLLRLLAKCLQTSYVAS

SEQ ID NO: 3071434 - protein, 18 aa, Giardia lamblia
FEIHVYSLAYGYEALLAD

SEQ ID NO: 3071435 - protein, 19 aa, Giardia lamblia
FEILCNHLIEYLHPDLYSV

SEQ ID NO: 3071436 - protein, 40 aa, Giardia lamblia
FEILLFKLLYTYVMEDIYPQWSVFILLLFHGADRDMRYIA

SEQ ID NO: 3071437 - protein, 26 aa, Giardia lamblia
FEKLKGKGFFEIVRLFFTTRVGRILL

SEQ ID NO: 3071438 - protein, 17 aa, Giardia lamblia
FEKMSADALLAIRHHSS

SEQ ID NO: 3071439 - protein, 17 aa, Giardia lamblia
FELLNSETLEFCDETNT

SEQ ID NO: 3071440 - protein, 22 aa, Giardia lamblia
FELPREEVIILGIESFSCPRTA

SEQ ID NO: 3071441 - protein, 17 aa, Giardia lamblia
FELRDIDSALAIAQDKL

SEQ ID NO: 3071442 - protein, 22 aa, Giardia lamblia
FELSDLCAYRTYEYSIVTKEID

SEQ ID NO: 3071443 - protein, 27 aa, Giardia lamblia
FELSEADMNGVISAVIERLSAEFKAQL

SEQ ID NO: 3071444 - protein, 17 aa, Giardia lamblia
FELSLFVMDVLSYTEEL

SEQ ID NO: 3071445 - protein, 23 aa, Giardia lamblia
FEQAWSIGLINMLGMTRRPITRS

SEQ ID NO: 3071446 - protein, 27 aa, Giardia lamblia
FERIMGYALICLKSAYSHGDLISTDSL

SEQ ID NO: 3071447 - protein, 21 aa, Giardia lamblia
FERYGQLYIAFCTEYAADNRV

SEQ ID NO: 3071448 - protein, 25 aa, Giardia lamblia
FESGRIAALLAVVIAFGYAVGGFLG

SEQ ID NO: 3071449 - protein, 17 aa, Giardia lamblia
FESHGFRVTDLGTAILL

SEQ ID NO: 3071450 - protein, 17 aa, Giardia lamblia
FESPGQRQSIMDGICMS

SEQ ID NO: 3071451 - protein, 20 aa, Giardia lamblia
FESRCRLGLEDTPILLQYTS

SEQ ID NO: 3071452 - protein, 20 aa, Giardia lamblia
FETHIVYLLASFLAEYLLYV

SEQ ID NO: 3071453 - protein, 17 aa, Giardia lamblia
FETYPAQVTLLAIQLLW

SEQ ID NO: 3071454 - protein, 31 aa, Giardia lamblia
FEVMPLSLCARLKGLLFYNSNSAFPHIIQAA

SEQ ID NO: 3071455 - protein, 18 aa, Giardia lamblia
FFCVGSYTLSYRLEDKLS

SEQ ID NO: 3071456 - protein, 25 aa, Giardia lamblia
FFEVLPRPELVYILMKLLIYSLAYD

SEQ ID NO: 3071457 - protein, 22 aa, Giardia lamblia
FFFSNKYGFGLLNVTKAVSIAE

SEQ ID NO: 3071458 - protein, 28 aa, Giardia lamblia
FFGAPLIFPYCWALFYGAQLISHSKMHQ

SEQ ID NO: 3071459 - protein, 17 aa, Giardia lamblia
FFGLNKKTVSAFLSRLE

SEQ ID NO: 3071460 - protein, 18 aa, Giardia lamblia
FFGQEDIHTVRLGYARKK

SEQ ID NO: 3071461 - protein, 19 aa, Giardia lamblia
FFGTLKLDLKQVLVRLRHI

SEQ ID NO: 3071462 - protein, 17 aa, Giardia lamblia
FFHKRSYVPDRYRDQIP

SEQ ID NO: 3071463 - protein, 31 aa, Giardia lamblia
FFHKSCLMIPLKGCLHFSLRRLFPINIKIIW

SEQ ID NO: 3071464 - protein, 17 aa, Giardia lamblia
FFHLDMPVFVSWSPISD

SEQ ID NO: 3071465 - protein, 20 aa, Giardia lamblia
FFHLTCHDLWCYNCNSYKTS

SEQ ID NO: 3071466 - protein, 17 aa, Giardia lamblia
FFHPKKHMTAFINICTP

SEQ ID NO: 3071467 - protein, 23 aa, Giardia lamblia
FFHPLPAMALLAVISSLTTVDAL

SEQ ID NO: 3071468 - protein, 18 aa, Giardia lamblia
FFIARIVVYPTYLIIPPI

SEQ ID NO: 3071469 - protein, 22 aa, Giardia lamblia
FFLLGSCHRLASHFPPTGKQYF

SEQ ID NO: 3071470 - protein, 19 aa, Giardia lamblia
FFLMIPRLQPVSSVIQAIN

SEQ ID NO: 3071471 - protein, 19 aa, Giardia lamblia
FFLMWLFVPWIWSIVFGAL

SEQ ID NO: 3071472 - protein, 27 aa, Giardia lamblia
FFLNIAIRIYLPISLVIPHPSLRDFWI

SEQ ID NO: 3071473 - protein, 17 aa, Giardia lamblia
FFLPEPVDILLVLHSNL

SEQ ID NO: 3071474 - protein, 24 aa, Giardia lamblia
FFLVHRFCAVLYYKLLSTPLNPSE

SEQ ID NO: 3071475 - protein, 20 aa, Giardia lamblia
FFMLPFQFFYVVTILSTTSN

SEQ ID NO: 3071476 - protein, 18 aa, Giardia lamblia
FFNAPRGTYSVIFTSGAS

SEQ ID NO: 3071477 - protein, 24 aa, Giardia lamblia
FFSILFCWLYLPKVPRFKESKFDY

SEQ ID NO: 3071478 - protein, 18 aa, Giardia lamblia
FFSSVILLLDIISMTQST

SEQ ID NO: 3071479 - protein, 17 aa, Giardia lamblia
FFSTGLPLYPAISTSSN

SEQ ID NO: 3071480 - protein, 17 aa, Giardia lamblia
FFTLKFTIFEQLKRHLV

SEQ ID NO: 3071481 - protein, 22 aa, Giardia lamblia
FFTLLACLSMLFEAPFLPIQKY

SEQ ID NO: 3071482 - protein, 30 aa, Giardia lamblia
FFVFSGRRGLHCWICDARARKLSKDSRKSM

SEQ ID NO: 3071483 - protein, 18 aa, Giardia lamblia
FFVTWGPEVTEVFRSVST

SEQ ID NO: 3071484 - protein, 18 aa, Giardia lamblia
FFYKHLLMEYPDLFCQAE

SEQ ID NO: 3071485 - protein, 21 aa, Giardia lamblia
FGAALMAGELYNWNWRNGSLL

SEQ ID NO: 3071486 - protein, 18 aa, Giardia lamblia
FGADYELFYIPELSVALQ

SEQ ID NO: 3071487 - protein, 18 aa, Giardia lamblia
FGAFLLQLLFPFTPIIQT

SEQ ID NO: 3071488 - protein, 20 aa, Giardia lamblia
FGAGLCCGLAALAAGLAIGV

SEQ ID NO: 3071489 - protein, 25 aa, Giardia lamblia
FGAKEYCILCKHVAGATDTYIKAEG

SEQ ID NO: 3071490 - protein, 25 aa, Giardia lamblia
FGDCKCNFKGIAIIDFFTERDEGTG

SEQ ID NO: 3071491 - protein, 22 aa, Giardia lamblia
FGDGSWYKGQFIAGKQTGVGTY

SEQ ID NO: 3071492 - protein, 25 aa, Giardia lamblia
FGEDCTDLLPLISVPEDFDNESLVA

SEQ ID NO: 3071493 - protein, 22 aa, Giardia lamblia
FGEREPYIWNAFLFGVVGWCFV

SEQ ID NO: 3071494 - protein, 17 aa, Giardia lamblia
FGHLKCAEILAKYEAGH

SEQ ID NO: 3071495 - protein, 17 aa, Giardia lamblia
FGHRRLLNAFPILPDGY

SEQ ID NO: 3071496 - protein, 18 aa, Giardia lamblia
FGIFSIVVSMLTWYTRAK

SEQ ID NO: 3071497 - protein, 23 aa, Giardia lamblia
FGILSCISFSITLFLLAIFMGVL

SEQ ID NO: 3071498 - protein, 24 aa, Giardia lamblia
FGKLCSYGYTFSGNFKDVFSDAIV

SEQ ID NO: 3071499 - protein, 25 aa, Giardia lamblia
FGMHPTFNWCLIFMASLQTKRRQRK

SEQ ID NO: 3071500 - protein, 18 aa, Giardia lamblia
FGNMADLQFDTMDMSYTD

SEQ ID NO: 3071501 - protein, 21 aa, Giardia lamblia
FGSEPRSGFAADRSASTGAGA

SEQ ID NO: 3071502 - protein, 25 aa, Giardia lamblia
FGSPTIFYCIIAFMVTELMEPYKLI

SEQ ID NO: 3071503 - protein, 18 aa, Giardia lamblia
FGSTDAFAFESGRMPMIV

SEQ ID NO: 3071504 - protein, 18 aa, Giardia lamblia
FGSYRVAQIILMVVISVI

SEQ ID NO: 3071505 - protein, 25 aa, Giardia lamblia
FGSYYKIMFGLGVFLTPFSIGFGNF

SEQ ID NO: 3071506 - protein, 18 aa, Giardia lamblia
FGTLRPRSAWVCSGNDDL

SEQ ID NO: 3071507 - protein, 25 aa, Giardia lamblia
FGVIIFQLFPLMVVYKLPLLKKNSV

SEQ ID NO: 3071508 - protein, 17 aa, Giardia lamblia
FGVPGFLAFPLFARIRS

SEQ ID NO: 3071509 - protein, 25 aa, Giardia lamblia
FGYCSRARRLFLLALFLDCVACPFL

SEQ ID NO: 3071510 - protein, 19 aa, Giardia lamblia
FHADLCNYNVFYSLYVMVQ

SEQ ID NO: 3071511 - protein, 18 aa, Giardia lamblia
FHAFSGPVKGRIKELSGS

SEQ ID NO: 3071512 - protein, 39 aa, Giardia lamblia
FHAYASSVLLFFRGRSASCIRLDLLIQYARTEFLTKPGL

SEQ ID NO: 3071513 - protein, 17 aa, Giardia lamblia
FHDVVKLGVEKTLRKTA

SEQ ID NO: 3071514 - protein, 27 aa, Giardia lamblia
FHEWDILVCPYEWISKSDYYTISAKGV

SEQ ID NO: 3071515 - protein, 20 aa, Giardia lamblia
FHEYFPYSCNIIRKQLSELQ

SEQ ID NO: 3071516 - protein, 17 aa, Giardia lamblia
FHKNLALLGADHAQNLS

SEQ ID NO: 3071517 - protein, 26 aa, Giardia lamblia
FHLGFLRFLFDSAFTTEIDRFSGNSL

SEQ ID NO: 3071518 - protein, 18 aa, Giardia lamblia
FHLHCSDCRSAEISEHIA

SEQ ID NO: 3071519 - protein, 18 aa, Giardia lamblia
FHLPELAPIITADKFFFA

SEQ ID NO: 3071520 - protein, 17 aa, Giardia lamblia
FHLSFASLLVFLLVFAV

SEQ ID NO: 3071521 - protein, 17 aa, Giardia lamblia
FHLYRLCDYLIVCQTKQ

SEQ ID NO: 3071522 - protein, 17 aa, Giardia lamblia
FHMIIQFFRNVAADRLL

SEQ ID NO: 3071523 - protein, 20 aa, Giardia lamblia
FHPELPHILFSGSWDTTIRA

SEQ ID NO: 3071524 - protein, 21 aa, Giardia lamblia
FHSLKLPPYCNPADLKRVLKI

SEQ ID NO: 3071525 - protein, 18 aa, Giardia lamblia
FHSTVLLFLRYYPCDPKS

SEQ ID NO: 3071526 - protein, 27 aa, Giardia lamblia
FIAIACISYCSFFLIFKYLYQIKFKKF

SEQ ID NO: 3071527 - protein, 25 aa, Giardia lamblia
FIAIFPDLFYNIALIALRASDYSIT

SEQ ID NO: 3071528 - protein, 17 aa, Giardia lamblia
FICGIPITALNFTLNGI

SEQ ID NO: 3071529 - protein, 21 aa, Giardia lamblia
FICSTYCYSKCLFDIDCDMSN

SEQ ID NO: 3071530 - protein, 17 aa, Giardia lamblia
FIDCIEYIFWFEKHKEG

SEQ ID NO: 3071531 - protein, 31 aa, Giardia lamblia
FIDGFLRKRILDPIFRAAREYGSLLSSDLPD

SEQ ID NO: 3071532 - protein, 25 aa, Giardia lamblia
FIDNHVTALFTFCGFACEPPSSNAS

SEQ ID NO: 3071533 - protein, 17 aa, Giardia lamblia
FIDTELMQARSWLFSTL

SEQ ID NO: 3071534 - protein, 21 aa, Giardia lamblia
FIEHNRMMAVHPYNAANSSKK

SEQ ID NO: 3071535 - protein, 23 aa, Giardia lamblia
FIEIIKANTLWRAIPYARVTHLL

SEQ ID NO: 3071536 - protein, 22 aa, Giardia lamblia
FIELTDSLLFYSSEFCNVIDVY

SEQ ID NO: 3071537 - protein, 25 aa, Giardia lamblia
FIFAHASSGLSIRHPVFLRITELKK

SEQ ID NO: 3071538 - protein, 17 aa, Giardia lamblia
FIGPLVFVIELAMAYTR

SEQ ID NO: 3071539 - protein, 17 aa, Giardia lamblia
FIHDRCTLLLATTPDND

SEQ ID NO: 3071540 - protein, 18 aa, Giardia lamblia
FIHYCASLPTAFSTLANV

SEQ ID NO: 3071541 - protein, 22 aa, Giardia lamblia
FIIEHMSWRACYIVCAVLSAIT

SEQ ID NO: 3071542 - protein, 26 aa, Giardia lamblia
FIKHMQRLPAPLIYYSISIAIMAVSF

SEQ ID NO: 3071543 - protein, 17 aa, Giardia lamblia
FILFDKLLFGVGMLESF

SEQ ID NO: 3071544 - protein, 17 aa, Giardia lamblia
FILGNIVDENKFLAEDA

SEQ ID NO: 3071545 - protein, 25 aa, Giardia lamblia
FILHFLDCVFNYIFINDPTCVHLHN

SEQ ID NO: 3071546 - protein, 17 aa, Giardia lamblia
FILLSGMAVGDQLQASP

SEQ ID NO: 3071547 - protein, 22 aa, Giardia lamblia
FILPACFIIIYYVSFKYIPEDV

SEQ ID NO: 3071548 - protein, 17 aa, Giardia lamblia
FILSCLLIIPAFVKHLI

SEQ ID NO: 3071549 - protein, 18 aa, Giardia lamblia
FILSSDLREKAIRVSPFY

SEQ ID NO: 3071550 - protein, 21 aa, Giardia lamblia
FILVICLYAQIGSTLTVKNLV

SEQ ID NO: 3071551 - protein, 17 aa, Giardia lamblia
FIMEVLKQISWDARLLF

SEQ ID NO: 3071552 - protein, 26 aa, Giardia lamblia
FIMNFLFPSLFKFGSSSSESLSPEEK

SEQ ID NO: 3071553 - protein, 18 aa, Giardia lamblia
FINHCLSLSFGLYTTQFA

SEQ ID NO: 3071554 - protein, 19 aa, Giardia lamblia
FINLILILYSCSWKILTAE

SEQ ID NO: 3071555 - protein, 27 aa, Giardia lamblia
FIPLQRFRLLYLISLIVQQFFENIVFS

SEQ ID NO: 3071556 - protein, 27 aa, Giardia lamblia
FIPRINPYRISHEFLQKSQLIVPGIIS

SEQ ID NO: 3071557 - protein, 19 aa, Giardia lamblia
FIRPLLYEHCAWFKDVQAA

SEQ ID NO: 3071558 - protein, 25 aa, Giardia lamblia
FIRQILTCLYKQWLALIQSPQSYII

SEQ ID NO: 3071559 - protein, 24 aa, Giardia lamblia
FISEMFYYYIRTIFLFIDIFQPIF

SEQ ID NO: 3071560 - protein, 19 aa, Giardia lamblia
FISLCPQEWNNIWINLTVR

SEQ ID NO: 3071561 - protein, 19 aa, Giardia lamblia
FISVKALLHRNMRLLDAIV

SEQ ID NO: 3071562 - protein, 20 aa, Giardia lamblia
FITELCKRYKTLRYFFRTNV

SEQ ID NO: 3071563 - protein, 24 aa, Giardia lamblia
FITSMRFFQTRASFLGTQQAFTPM

SEQ ID NO: 3071564 - protein, 23 aa, Giardia lamblia
FIVKGSGYAGLMTVVRLVAETTM

SEQ ID NO: 3071565 - protein, 24 aa, Giardia lamblia
FIVLCTREPLFIVFSLTGNMAISD

SEQ ID NO: 3071566 - protein, 23 aa, Giardia lamblia
FIWGILVPICFASPYKHLSSFLS

SEQ ID NO: 3071567 - protein, 29 aa, Giardia lamblia
FIYSVAIKCLKYYASFAHHSGNSIIYSLL

SEQ ID NO: 3071568 - protein, 18 aa, Giardia lamblia
FIYTCSILKRISRRSPSL

SEQ ID NO: 3071569 - protein, 25 aa, Giardia lamblia
FIYVQRWDVYLVIALIAATLGNILL

SEQ ID NO: 3071570 - protein, 17 aa, Giardia lamblia
FIYYHAYDFPAEIFRTC

SEQ ID NO: 3071571 - protein, 22 aa, Giardia lamblia
FKAKHLDRLYGPLGDYLMNGFA

SEQ ID NO: 3071572 - protein, 34 aa, Giardia lamblia
FKASEFRYFSALVFKFTFPISLIYTLGARVTIVY

SEQ ID NO: 3071573 - protein, 18 aa, Giardia lamblia
FKASFADMLSLVRSGGLY

SEQ ID NO: 3071574 - protein, 28 aa, Giardia lamblia
FKDECPESAALAVLTVHTFLRLLPVFGQ

SEQ ID NO: 3071575 - protein, 26 aa, Giardia lamblia
FKDLLYKLLQPFPFKRITWNELASHP

SEQ ID NO: 3071576 - protein, 20 aa, Giardia lamblia
FKDPHFKASEQYIMNKSYQS

SEQ ID NO: 3071577 - protein, 21 aa, Giardia lamblia
FKDSFPLTFTLLYDLLYLGAA

SEQ ID NO: 3071578 - protein, 19 aa, Giardia lamblia
FKFQLPRNAIATYMSAAYT

SEQ ID NO: 3071579 - protein, 22 aa, Giardia lamblia
FKGEAWRNITGYMYQPFQVTVF

SEQ ID NO: 3071580 - protein, 17 aa, Giardia lamblia
FKHTFAAATISIYKFAS

SEQ ID NO: 3071581 - protein, 18 aa, Giardia lamblia
FKIKMGKLNIHIDQSTID

SEQ ID NO: 3071582 - protein, 24 aa, Giardia lamblia
FKKCNTELYYLYTRMSARSSSFEC

SEQ ID NO: 3071583 - protein, 24 aa, Giardia lamblia
FKKKGEAHAESFYEISLLLNAMQS

SEQ ID NO: 3071584 - protein, 21 aa, Giardia lamblia
FKKNLRFKKILITPCSSTVRM

SEQ ID NO: 3071585 - protein, 26 aa, Giardia lamblia
FKKQLAMCYCFLPFAYIQSDEKEVFR

SEQ ID NO: 3071586 - protein, 28 aa, Giardia lamblia
FKLLCSFSVPCIFSMVISAIYMNVDAIF

SEQ ID NO: 3071587 - protein, 19 aa, Giardia lamblia
FKLLEAVHTLLLFQLRTDQ

SEQ ID NO: 3071588 - protein, 19 aa, Giardia lamblia
FKLNLLYYDEKGICADVKI

SEQ ID NO: 3071589 - protein, 19 aa, Giardia lamblia
FKLPDYHMAYPCSNTSAGG

SEQ ID NO: 3071590 - protein, 24 aa, Giardia lamblia
FKLQMKAQRTLPCSSTPSYEMIKL

SEQ ID NO: 3071591 - protein, 30 aa, Giardia lamblia
FKLRASMRPYGFSGSYSFTSVDLRYAIELL

SEQ ID NO: 3071592 - protein, 27 aa, Giardia lamblia
FKLSLLRKMDFGMILLVFTAGAYGQLT

SEQ ID NO: 3071593 - protein, 21 aa, Giardia lamblia
FKMSSCLRFLDLGSYAANSLV

SEQ ID NO: 3071594 - protein, 20 aa, Giardia lamblia
FKNSIYGGAMIFPVQKVFSD

SEQ ID NO: 3071595 - protein, 23 aa, Giardia lamblia
FKPHLRQPPAILRVDGPKPEKQS

SEQ ID NO: 3071596 - protein, 19 aa, Giardia lamblia
FKPLVALLYMIALSEENVA

SEQ ID NO: 3071597 - protein, 17 aa, Giardia lamblia
FKPTVHYTRTLIVNSAV

SEQ ID NO: 3071598 - protein, 32 aa, Giardia lamblia
FKRIAKQFTKAWCCEDVLSLIYHAGFVSDEYF

SEQ ID NO: 3071599 - protein, 25 aa, Giardia lamblia
FKRIVREIQVLKLLDHSNIVRLLEV

SEQ ID NO: 3071600 - protein, 19 aa, Giardia lamblia
FKSGWIISHLVFFGLSFLI

SEQ ID NO: 3071601 - protein, 26 aa, Giardia lamblia
FKSLKASRLHFFPVLVTSCSILTDFD

SEQ ID NO: 3071602 - protein, 23 aa, Giardia lamblia
FKTACGSPSYASPEMLSGKKYHG

SEQ ID NO: 3071603 - protein, 19 aa, Giardia lamblia
FKTGLLRVLPSVYLRGLFI

SEQ ID NO: 3071604 - protein, 17 aa, Giardia lamblia
FKTIFGFTQSPRIIDHT

SEQ ID NO: 3071605 - protein, 18 aa, Giardia lamblia
FKTLVIVESYLFGRHCFR

SEQ ID NO: 3071606 - protein, 20 aa, Giardia lamblia
FKTRTCLTAEFQLEGEAYFS

SEQ ID NO: 3071607 - protein, 20 aa, Giardia lamblia
FKVKRGALVGIHGRVGSGKS

SEQ ID NO: 3071608 - protein, 17 aa, Giardia lamblia
FKYAASVFVLDEKRHII

SEQ ID NO: 3071609 - protein, 17 aa, Giardia lamblia
FKYLNYHLTDCPQIIDE

SEQ ID NO: 3071610 - protein, 24 aa, Giardia lamblia
FKYLRADKYLTMLMPLLPTPEARQ

SEQ ID NO: 3071611 - protein, 19 aa, Giardia lamblia
FLACACFSREAWPKPMQVI

SEQ ID NO: 3071612 - protein, 19 aa, Giardia lamblia
FLACGAYIKHSLIAERVES

SEQ ID NO: 3071613 - protein, 17 aa, Giardia lamblia
FLAISLLVFCNCILEKA

SEQ ID NO: 3071614 - protein, 27 aa, Giardia lamblia
FLALICAYGTFQLADSLLFSGIISIII

SEQ ID NO: 3071615 - protein, 28 aa, Giardia lamblia
FLASYPRVIRLILWKKVLKNIHSDSRIT

SEQ ID NO: 3071616 - protein, 20 aa, Giardia lamblia
FLCSRKFYRTRCPKDNPEFP

SEQ ID NO: 3071617 - protein, 20 aa, Giardia lamblia
FLDASFPDGMFAEFSTLPIY

SEQ ID NO: 3071618 - protein, 17 aa, Giardia lamblia
FLDEVCSNKSYFTGGTW

SEQ ID NO: 3071619 - protein, 25 aa, Giardia lamblia
FLDILRLSLNIHEELMLSTLLKIKV

SEQ ID NO: 3071620 - protein, 28 aa, Giardia lamblia
FLDKSHFLSLCYHADFTLVGDKRGKLLF

SEQ ID NO: 3071621 - protein, 22 aa, Giardia lamblia
FLDLLCYDKFIRSCCSSKTVST

SEQ ID NO: 3071622 - protein, 17 aa, Giardia lamblia
FLDPATEVVSWIAPASI

SEQ ID NO: 3071623 - protein, 33 aa, Giardia lamblia
FLEEELRFISLLVSCYYELDFLLCDQELMWLLS

SEQ ID NO: 3071624 - protein, 24 aa, Giardia lamblia
FLEELAMAFNTMWSLNLVQPTQFF

SEQ ID NO: 3071625 - protein, 20 aa, Giardia lamblia
FLEHVVRHWAGSQFPMLHIC

SEQ ID NO: 3071626 - protein, 19 aa, Giardia lamblia
FLEIGLKFLNSQEVFSAIR

SEQ ID NO: 3071627 - protein, 19 aa, Giardia lamblia
FLELFTRYPKVMAGLALVG

SEQ ID NO: 3071628 - protein, 25 aa, Giardia lamblia
FLEVSRLSTMLLQDEFDLYKSLLPN

SEQ ID NO: 3071629 - protein, 19 aa, Giardia lamblia
FLFACGHVVGALRDDVYIA

SEQ ID NO: 3071630 - protein, 19 aa, Giardia lamblia
FLFLKREGVDLGSLSYDST

SEQ ID NO: 3071631 - protein, 17 aa, Giardia lamblia
FLFSGTIRTCLCFYSQL

SEQ ID NO: 3071632 - protein, 23 aa, Giardia lamblia
FLHFRYIHRVDFSMIAKMARNMV

SEQ ID NO: 3071633 - protein, 18 aa, Giardia lamblia
FLHTLPHLLFNFGTDVED

SEQ ID NO: 3071634 - protein, 26 aa, Giardia lamblia
FLICPESWAPYVTMLIAALGFATFFP

SEQ ID NO: 3071635 - protein, 21 aa, Giardia lamblia
FLIFRIISIVVMISFPYTLDI

SEQ ID NO: 3071636 - protein, 18 aa, Giardia lamblia
FLIGLPLDSCKSSPTKLH

SEQ ID NO: 3071637 - protein, 19 aa, Giardia lamblia
FLIGMLHWFLESIDDVLVA

SEQ ID NO: 3071638 - protein, 24 aa, Giardia lamblia
FLIINLVDFCLFYVLRELHPDSPL

SEQ ID NO: 3071639 - protein, 17 aa, Giardia lamblia
FLIMAIILLIKRTGEQS

SEQ ID NO: 3071640 - protein, 17 aa, Giardia lamblia
FLINMLKGRLDQWPHSR

SEQ ID NO: 3071641 - protein, 18 aa, Giardia lamblia
FLIVICLGLFVGTLYDLE

SEQ ID NO: 3071642 - protein, 18 aa, Giardia lamblia
FLIVVISVFTLVGAVVLK

SEQ ID NO: 3071643 - protein, 21 aa, Giardia lamblia
FLKEFPGDFIAEGLDQTRGWF

SEQ ID NO: 3071644 - protein, 18 aa, Giardia lamblia
FLKQDFYPRVDVTDSSDG

SEQ ID NO: 3071645 - protein, 17 aa, Giardia lamblia
FLKQTKGIFKWSRQAQQ

SEQ ID NO: 3071646 - protein, 17 aa, Giardia lamblia
FLKRKPTKWQVVGVVFS

SEQ ID NO: 3071647 - protein, 24 aa, Giardia lamblia
FLLAEPVLRYGLLCAVANVSRSVD

SEQ ID NO: 3071648 - protein, 26 aa, Giardia lamblia
FLLAQLKLPFVDNFMIRLTRESWASE

SEQ ID NO: 3071649 - protein, 26 aa, Giardia lamblia
FLLCDQELMWLLSRNFSILVLNDTVS

SEQ ID NO: 3071650 - protein, 25 aa, Giardia lamblia
FLLDGCSSGCCTIFDDIPWLSTAMS

SEQ ID NO: 3071651 - protein, 20 aa, Giardia lamblia
FLLDSCSSSGLYIDEKSIKY

SEQ ID NO: 3071652 - protein, 18 aa, Giardia lamblia
FLLETGFINLRNCDMSTL

SEQ ID NO: 3071653 - protein, 17 aa, Giardia lamblia
FLLMTFVSIVSPFTNQP

SEQ ID NO: 3071654 - protein, 26 aa, Giardia lamblia
FLLRRFHSRILYCAFVENLALMLTSY

SEQ ID NO: 3071655 - protein, 20 aa, Giardia lamblia
FLLSCTFTLLVLSRYSSKRN

SEQ ID NO: 3071656 - protein, 24 aa, Giardia lamblia
FLLSERISPIVLYSGEKVLGIDTV

SEQ ID NO: 3071657 - protein, 18 aa, Giardia lamblia
FLLSMGVEPFTVRYLSVS

SEQ ID NO: 3071658 - protein, 39 aa, Giardia lamblia
FLMLTRKWVYAVLLSKYCLCITILLLSVGLFVYQRTTPD

SEQ ID NO: 3071659 - protein, 22 aa, Giardia lamblia
FLMQCSWFTFYRIDARRRSPRP

SEQ ID NO: 3071660 - protein, 17 aa, Giardia lamblia
FLMQSCTRQDPWNLHNL

SEQ ID NO: 3071661 - protein, 19 aa, Giardia lamblia
FLMRGMSYAVLFSYALPMS

SEQ ID NO: 3071662 - protein, 20 aa, Giardia lamblia
FLNIPRYIVNYFLNTHGTYV

SEQ ID NO: 3071663 - protein, 24 aa, Giardia lamblia
FLNIPSYPWLSATYPRFLSKIGSS

SEQ ID NO: 3071664 - protein, 17 aa, Giardia lamblia
FLPKLVGPWVAHFRKER

SEQ ID NO: 3071665 - protein, 17 aa, Giardia lamblia
FLPLMIGSIKTILTHLD

SEQ ID NO: 3071666 - protein, 19 aa, Giardia lamblia
FLQKFSRIHIYQRMKESFE

SEQ ID NO: 3071667 - protein, 30 aa, Giardia lamblia
FLQLYYKCMPEFKRAVATVAIGTATVLTDK

SEQ ID NO: 3071668 - protein, 26 aa, Giardia lamblia
FLQMFEIIISVSLGFPVLTDDKNLSQ

SEQ ID NO: 3071669 - protein, 19 aa, Giardia lamblia
FLQPYYKAPGFELPLSKVL

SEQ ID NO: 3071670 - protein, 19 aa, Giardia lamblia
FLQSLAVSCRFELHTKRIS

SEQ ID NO: 3071671 - protein, 26 aa, Giardia lamblia
FLQSSAFLLGFIWWYALTIRLLYVSK

SEQ ID NO: 3071672 - protein, 24 aa, Giardia lamblia
FLQVFLRFLLGDVHLTLENAKQCI

SEQ ID NO: 3071673 - protein, 20 aa, Giardia lamblia
FLRALREAIALSENMDSGTP

SEQ ID NO: 3071674 - protein, 21 aa, Giardia lamblia
FLRRFSFTTPATFKNILSTAD

SEQ ID NO: 3071675 - protein, 17 aa, Giardia lamblia
FLRSNGIIVVFVLIPIL

SEQ ID NO: 3071676 - protein, 20 aa, Giardia lamblia
FLSEIRRLFTSRCFVERLFT

SEQ ID NO: 3071677 - protein, 18 aa, Giardia lamblia
FLSGELSNAVLFGDFSAG

SEQ ID NO: 3071678 - protein, 23 aa, Giardia lamblia
FLSHLPLSMPFERVLEHLAYIRG

SEQ ID NO: 3071679 - protein, 24 aa, Giardia lamblia
FLSILMCTRIDVFLLDGMREDFFL

SEQ ID NO: 3071680 - protein, 26 aa, Giardia lamblia
FLSLNYRSTNPFWFVHLMSMVKLYGQ

SEQ ID NO: 3071681 - protein, 19 aa, Giardia lamblia
FLSLVCYLLAYFVEFQKTK

SEQ ID NO: 3071682 - protein, 18 aa, Giardia lamblia
FLSLYTRFTFPYPDALGF

SEQ ID NO: 3071683 - protein, 18 aa, Giardia lamblia
FLSTCFKKVLVAKEQSRP

SEQ ID NO: 3071684 - protein, 17 aa, Giardia lamblia
FLSVVLMKVMTSFLSVR

SEQ ID NO: 3071685 - protein, 24 aa, Giardia lamblia
FLTATRPSLSVLREYQANSTSQYM

SEQ ID NO: 3071686 - protein, 26 aa, Giardia lamblia
FLTDDLYKRFQFIWDEFSHINDDMTL

SEQ ID NO: 3071687 - protein, 17 aa, Giardia lamblia
FLTGPHRTIFAAIKEMQ

SEQ ID NO: 3071688 - protein, 19 aa, Giardia lamblia
FLTLEEFIELPILQNALPE

SEQ ID NO: 3071689 - protein, 26 aa, Giardia lamblia
FLTLGILLSYIMEWGLISVCRGTIKN

SEQ ID NO: 3071690 - protein, 26 aa, Giardia lamblia
FLTNILDLAYMFARYVVSPAASLNYG

SEQ ID NO: 3071691 - protein, 21 aa, Giardia lamblia
FLVALFVCANYAYSKEPIVQT

SEQ ID NO: 3071692 - protein, 20 aa, Giardia lamblia
FLVGMLRSCPLVSVCDTLRD

SEQ ID NO: 3071693 - protein, 18 aa, Giardia lamblia
FLVRILSSAYGYPDQLLL

SEQ ID NO: 3071694 - protein, 18 aa, Giardia lamblia
FLVRRVEDNRFFAMKVLK

SEQ ID NO: 3071695 - protein, 18 aa, Giardia lamblia
FLWIPLQILITYDAINFT

SEQ ID NO: 3071696 - protein, 19 aa, Giardia lamblia
FLYCTSLGFVGEFECINFD

SEQ ID NO: 3071697 - protein, 24 aa, Giardia lamblia
FLYEYSDSYLLQFIEGLLLVEYHL

SEQ ID NO: 3071698 - protein, 26 aa, Giardia lamblia
FLYQDSRTGLKLTEFALATRDFSILT

SEQ ID NO: 3071699 - protein, 17 aa, Giardia lamblia
FLYYFRRAIGSSFKHIV

SEQ ID NO: 3071700 - protein, 23 aa, Giardia lamblia
FMCCCKPCKSSYQLCRKPPKDTI

SEQ ID NO: 3071701 - protein, 17 aa, Giardia lamblia
FMDHWIVSGAVYYKVLG

SEQ ID NO: 3071702 - protein, 26 aa, Giardia lamblia
FMFSNLFDFSNRLGKATVHITSISNH

SEQ ID NO: 3071703 - protein, 21 aa, Giardia lamblia
FMISQAIWRRFGNSIFTALLG

SEQ ID NO: 3071704 - protein, 19 aa, Giardia lamblia
FMLVFCLFGTLMTSVLVPS

SEQ ID NO: 3071705 - protein, 26 aa, Giardia lamblia
FMMMEFYDQFHIVYIYFRQRALRRSA

SEQ ID NO: 3071706 - protein, 17 aa, Giardia lamblia
FMNRAVDSLTVYMKALW

SEQ ID NO: 3071707 - protein, 19 aa, Giardia lamblia
FMRPMGALFNIYRRLSENY

SEQ ID NO: 3071708 - protein, 18 aa, Giardia lamblia
FMRSIELEYSLLSSLSKL

SEQ ID NO: 3071709 - protein, 27 aa, Giardia lamblia
FMRYIKRHNITALVLFLLSWVFALAIA

SEQ ID NO: 3071710 - protein, 20 aa, Giardia lamblia
FMSFPSKSLINLFRAFVSCS

SEQ ID NO: 3071711 - protein, 18 aa, Giardia lamblia
FMSGTSLMLAAWYGSAEC

SEQ ID NO: 3071712 - protein, 18 aa, Giardia lamblia
FNACKAKIFTDMRKGMSV

SEQ ID NO: 3071713 - protein, 18 aa, Giardia lamblia
FNANLSFNQLALRKTSRQ

SEQ ID NO: 3071714 - protein, 25 aa, Giardia lamblia
FNCNNSCVFYDCKVGFYLDPLAYER

SEQ ID NO: 3071715 - protein, 24 aa, Giardia lamblia
FNCSPGYSGAFCSTFQCTINGDCG

SEQ ID NO: 3071716 - protein, 17 aa, Giardia lamblia
FNDSIMEFLRTVVYREK

SEQ ID NO: 3071717 - protein, 26 aa, Giardia lamblia
FNEIKAVDHLLCLLVNSAILVRETSI

SEQ ID NO: 3071718 - protein, 19 aa, Giardia lamblia
FNETLGTFLVICRGTLVDI

SEQ ID NO: 3071719 - protein, 25 aa, Giardia lamblia
FNEVGMELLCCFYKEVDAVEKDSVR

SEQ ID NO: 3071720 - protein, 19 aa, Giardia lamblia
FNFNFKLFLQDCNPTKSTL

SEQ ID NO: 3071721 - protein, 17 aa, Giardia lamblia
FNGPLNCMNDITAEAQM

SEQ ID NO: 3071722 - protein, 18 aa, Giardia lamblia
FNHCKKHTYHIAKPSFLL

SEQ ID NO: 3071723 - protein, 21 aa, Giardia lamblia
FNHCPHLKSFKSLGGGQVYVT

SEQ ID NO: 3071724 - protein, 31 aa, Giardia lamblia
FNIALVCIAPCRCSQCCRRCCHRKLEMEQTS

SEQ ID NO: 3071725 - protein, 17 aa, Giardia lamblia
FNLAPLIYSLFIGIHNI

SEQ ID NO: 3071726 - protein, 27 aa, Giardia lamblia
FNLASVDRYACLVTRNMLFKHVTCCPW

SEQ ID NO: 3071727 - protein, 17 aa, Giardia lamblia
FNLGSLLSATREHYPLL

SEQ ID NO: 3071728 - protein, 26 aa, Giardia lamblia
FNLICPHPGLYCSWIVRNTIAEYTLC

SEQ ID NO: 3071729 - protein, 17 aa, Giardia lamblia
FNLSGLNKALTWELLLK

SEQ ID NO: 3071730 - protein, 20 aa, Giardia lamblia
FNLSICVITGINWAAVERTH

SEQ ID NO: 3071731 - protein, 26 aa, Giardia lamblia
FNMEYYPVKACTRVPGANAYTDMTSK

SEQ ID NO: 3071732 - protein, 19 aa, Giardia lamblia
FNMGLPIPMHHMLLSTLRF

SEQ ID NO: 3071733 - protein, 18 aa, Giardia lamblia
FNMRTYRWAAVSSADDAP

SEQ ID NO: 3071734 - protein, 22 aa, Giardia lamblia
FNPDAGLYCYVLGDAENVTAMA

SEQ ID NO: 3071735 - protein, 22 aa, Giardia lamblia
FNPSLFLTYIDTIFLCSRKMHV

SEQ ID NO: 3071736 - protein, 25 aa, Giardia lamblia
FNPSRFRFAMPLRRQDLDPPLLVAE

SEQ ID NO: 3071737 - protein, 18 aa, Giardia lamblia
FNRSEAILSSNQWYFQLV

SEQ ID NO: 3071738 - protein, 35 aa, Giardia lamblia
FNRSPDFMQYFSFEPRLRITRPMRLSLLYNLASQS

SEQ ID NO: 3071739 - protein, 24 aa, Giardia lamblia
FNSFYRERLAICFSTVVFTLVSSV

SEQ ID NO: 3071740 - protein, 22 aa, Giardia lamblia
FNSLIRVVRSLLLWLEQDGKIE

SEQ ID NO: 3071741 - protein, 24 aa, Giardia lamblia
FNTDCFPQLYFSDADVKKLTEVMS

SEQ ID NO: 3071742 - protein, 18 aa, Giardia lamblia
FNTFRLIAPQLKRITPIL

SEQ ID NO: 3071743 - protein, 25 aa, Giardia lamblia
FNTPDLRALADLTWSRLLNQSPSAE

SEQ ID NO: 3071744 - protein, 18 aa, Giardia lamblia
FNYSFIVVLVLEACQRPA

SEQ ID NO: 3071745 - protein, 21 aa, Giardia lamblia
FPAPSFGVFINFARICYHVKH

SEQ ID NO: 3071746 - protein, 17 aa, Giardia lamblia
FPASCAPASSDPGVHSV

SEQ ID NO: 3071747 - protein, 17 aa, Giardia lamblia
FPCHFLVSRTGGFVLET

SEQ ID NO: 3071748 - protein, 17 aa, Giardia lamblia
FPDGMFAEFSTLPIYSE

SEQ ID NO: 3071749 - protein, 20 aa, Giardia lamblia
FPGTETWCTTPRFSRRAYRS

SEQ ID NO: 3071750 - protein, 28 aa, Giardia lamblia
FPHHESHCICGLDADIVLLGLGLHVHNV

SEQ ID NO: 3071751 - protein, 27 aa, Giardia lamblia
FPKHLCASCLDGLISEVVYLNDKGTSC

SEQ ID NO: 3071752 - protein, 18 aa, Giardia lamblia
FPLICIFLSHIKPEEAWR

SEQ ID NO: 3071753 - protein, 27 aa, Giardia lamblia
FPLIIPVLNLFYPSFLILSRIGSRNLV

SEQ ID NO: 3071754 - protein, 20 aa, Giardia lamblia
FPLQLSPVISILNQVGIISF

SEQ ID NO: 3071755 - protein, 23 aa, Giardia lamblia
FPLVCKPAVPAISFIEAHSSTAQ

SEQ ID NO: 3071756 - protein, 28 aa, Giardia lamblia
FPLWVTWATGCIIRYCILLPIRAFLFLF

SEQ ID NO: 3071757 - protein, 23 aa, Giardia lamblia
FPQKRLTDLMGLLGAATRVFHKC

SEQ ID NO: 3071758 - protein, 24 aa, Giardia lamblia
FPQLCKKLGKYISMELDCVYRESA

SEQ ID NO: 3071759 - protein, 25 aa, Giardia lamblia
FPQNSKFDLSLCLRHARIDNNSNVH

SEQ ID NO: 3071760 - protein, 17 aa, Giardia lamblia
FPRCLYYTYHWLSPIIK

SEQ ID NO: 3071761 - protein, 30 aa, Giardia lamblia
FPRTVGDLFISLACDCWFARNIPISTAEQI

SEQ ID NO: 3071762 - protein, 19 aa, Giardia lamblia
FPSLEPFSVLQSSSLTLEK

SEQ ID NO: 3071763 - protein, 34 aa, Giardia lamblia
FPSLHFHCSDIDPAASINGHFALLLRDHMLLLDA

SEQ ID NO: 3071764 - protein, 20 aa, Giardia lamblia
FPSRPSHSNIRILLVPLQGK

SEQ ID NO: 3071765 - protein, 17 aa, Giardia lamblia
FPSTMKIVNAARKTDLS

SEQ ID NO: 3071766 - protein, 34 aa, Giardia lamblia
FPTFGYPLYWAFRCEMRLNLVFSSAYSLFMLKIL

SEQ ID NO: 3071767 - protein, 24 aa, Giardia lamblia
FPTIWTQLVVPTWLTKVFYVLFPP

SEQ ID NO: 3071768 - protein, 17 aa, Giardia lamblia
FPTLGLWNKVTGVFLSS

SEQ ID NO: 3071769 - protein, 17 aa, Giardia lamblia
FPTMLFHYIISFYLPCS

SEQ ID NO: 3071770 - protein, 26 aa, Giardia lamblia
FPTRPCFKVPLPYRIDKLFAVCNCRR

SEQ ID NO: 3071771 - protein, 27 aa, Giardia lamblia
FPTSFSLKGVKFAKLLHTGKRSKSAGA

SEQ ID NO: 3071772 - protein, 17 aa, Giardia lamblia
FPVLPAFNRPGSSSFAA

SEQ ID NO: 3071773 - protein, 21 aa, Giardia lamblia
FPWSNRSQFMYSKHNHNSVLG

SEQ ID NO: 3071774 - protein, 21 aa, Giardia lamblia
FPYICKCGKTDGTCMCNRVYN

SEQ ID NO: 3071775 - protein, 17 aa, Giardia lamblia
FPYLLSFLSSRSLEEAS

SEQ ID NO: 3071776 - protein, 17 aa, Giardia lamblia
FQAELLMARSLRNKYLV

SEQ ID NO: 3071777 - protein, 35 aa, Giardia lamblia
FQAVPLLAGLIHLYASYLHYCDFSLVLQRLSCRLA

SEQ ID NO: 3071778 - protein, 29 aa, Giardia lamblia
FQDNHGWSALHWAVFYGCANIVQYLAPLE

SEQ ID NO: 3071779 - protein, 21 aa, Giardia lamblia
FQEEVLELSLSLARAKDLGAI

SEQ ID NO: 3071780 - protein, 23 aa, Giardia lamblia
FQFVLGHGCVHPACIDPITNAVC

SEQ ID NO: 3071781 - protein, 17 aa, Giardia lamblia
FQGSAILSTLFDLQTAG

SEQ ID NO: 3071782 - protein, 17 aa, Giardia lamblia
FQHIFVRGLLLSKIFGK

SEQ ID NO: 3071783 - protein, 20 aa, Giardia lamblia
FQHRLMRAEHVELQDKHERL

SEQ ID NO: 3071784 - protein, 34 aa, Giardia lamblia
FQIIREFIEILYLYLARFGRHIVVTLTSFYKIEM

SEQ ID NO: 3071785 - protein, 18 aa, Giardia lamblia
FQILFGVLLHMRRQIELL

SEQ ID NO: 3071786 - protein, 17 aa, Giardia lamblia
FQKLFSLLVYVNRDTSS

SEQ ID NO: 3071787 - protein, 25 aa, Giardia lamblia
FQKRWELPEPMALIEELLRPIPRIW

SEQ ID NO: 3071788 - protein, 17 aa, Giardia lamblia
FQLKYKYTRPPDTPLYA

SEQ ID NO: 3071789 - protein, 26 aa, Giardia lamblia
FQLLIFMITWLPYFIIAYMMPGGTDV

SEQ ID NO: 3071790 - protein, 17 aa, Giardia lamblia
FQNIRSMVICAEGQEGH

SEQ ID NO: 3071791 - protein, 17 aa, Giardia lamblia
FQQWLSAVVQKVRSQTK

SEQ ID NO: 3071792 - protein, 18 aa, Giardia lamblia
FQRIWKERLNIHDRESEK

SEQ ID NO: 3071793 - protein, 17 aa, Giardia lamblia
FQSCRSGTSEQFLEMDE

SEQ ID NO: 3071794 - protein, 30 aa, Giardia lamblia
FQSDIPPLLQFYDWIAVGFDNVKANDFQAS

SEQ ID NO: 3071795 - protein, 19 aa, Giardia lamblia
FQSTTRFIYSFPHKSLLSD

SEQ ID NO: 3071796 - protein, 20 aa, Giardia lamblia
FQSTVCQLLMELLVLVQDAE

SEQ ID NO: 3071797 - protein, 20 aa, Giardia lamblia
FQTDWLFDSWNRAIHTLYPL

SEQ ID NO: 3071798 - protein, 35 aa, Giardia lamblia
FQTRISVYRLFDYKRYLEIMAALVYTVSGQSFHLV

SEQ ID NO: 3071799 - protein, 23 aa, Giardia lamblia
FQTRTRLFLVTTFATGGELFYHL

SEQ ID NO: 3071800 - protein, 19 aa, Giardia lamblia
FQYNYRKLFGVRKAVSIGI

SEQ ID NO: 3071801 - protein, 17 aa, Giardia lamblia
FRAAHPMQERLLTRQDR

SEQ ID NO: 3071802 - protein, 22 aa, Giardia lamblia
FRAFLMPCHNYVGFLDSALNYI

SEQ ID NO: 3071803 - protein, 17 aa, Giardia lamblia
FRAPLRLPEAFHPEGLC

SEQ ID NO: 3071804 - protein, 18 aa, Giardia lamblia
FRASYAGYIVRRTLALML

SEQ ID NO: 3071805 - protein, 17 aa, Giardia lamblia
FRAVLSLGDQHRVILRD

SEQ ID NO: 3071806 - protein, 19 aa, Giardia lamblia
FRCAFVTILCNTFLSMVFY

SEQ ID NO: 3071807 - protein, 29 aa, Giardia lamblia
FRDACSRFSDLPFMFFRNGLATTLPERPR

SEQ ID NO: 3071808 - protein, 19 aa, Giardia lamblia
FRDGCCLITKMLTYNPPTC

SEQ ID NO: 3071809 - protein, 21 aa, Giardia lamblia
FRDQNGRTGLMQNIIQSISYP

SEQ ID NO: 3071810 - protein, 17 aa, Giardia lamblia
FRDRLRTFPSLVTNLTI

SEQ ID NO: 3071811 - protein, 18 aa, Giardia lamblia
FRDVHAVEVLFQSIARLF

SEQ ID NO: 3071812 - protein, 27 aa, Giardia lamblia
FREDTIEFLRWVSANALEMGLDETCAI

SEQ ID NO: 3071813 - protein, 21 aa, Giardia lamblia
FRERFPHLIGIRASGNNFFCT

SEQ ID NO: 3071814 - protein, 17 aa, Giardia lamblia
FRGSLPLIFSQPPTYKF

SEQ ID NO: 3071815 - protein, 18 aa, Giardia lamblia
FRGTCREGLCKNGNVVNG

SEQ ID NO: 3071816 - protein, 26 aa, Giardia lamblia
FRHELKCLRSDYSRLLQYICRKDATE

SEQ ID NO: 3071817 - protein, 27 aa, Giardia lamblia
FRHWPPKRLRIAFVQRLVQRKGADLIG

SEQ ID NO: 3071818 - protein, 27 aa, Giardia lamblia
FRIVDSFYCTFSVMYLTHMDTHLFCSL

SEQ ID NO: 3071819 - protein, 20 aa, Giardia lamblia
FRKRMPTPLNRIFLLDDPGI

SEQ ID NO: 3071820 - protein, 25 aa, Giardia lamblia
FRLFFNQFFLVLAFLQLYRPLQVGL

SEQ ID NO: 3071821 - protein, 26 aa, Giardia lamblia
FRLFFNQFFLVLAFLQLYRPLQVGLA

SEQ ID NO: 3071822 - protein, 20 aa, Giardia lamblia
FRLGASYTAPVLFYYSPATE

SEQ ID NO: 3071823 - protein, 18 aa, Giardia lamblia
FRLLSAIVELGTYLYTEA

SEQ ID NO: 3071824 - protein, 19 aa, Giardia lamblia
FRLQYGMDFAMSIFTQLKE

SEQ ID NO: 3071825 - protein, 28 aa, Giardia lamblia
FRLSGPMWHGLCRVYDPFTNQLRHNRYG

SEQ ID NO: 3071826 - protein, 18 aa, Giardia lamblia
FRMGCSAVLFSNNPSYRI

SEQ ID NO: 3071827 - protein, 18 aa, Giardia lamblia
FRMKGLRRLVKQIPNILS

SEQ ID NO: 3071828 - protein, 20 aa, Giardia lamblia
FRMSFINMFANILVTPSRVL

SEQ ID NO: 3071829 - protein, 17 aa, Giardia lamblia
FRNMLAYQTDEFLSLFA

SEQ ID NO: 3071830 - protein, 20 aa, Giardia lamblia
FRNPCQRKQLSTRLISDTFQ

SEQ ID NO: 3071831 - protein, 21 aa, Giardia lamblia
FRNSLIFKQTRSFNIKDTDSI

SEQ ID NO: 3071832 - protein, 20 aa, Giardia lamblia
FRPLMIIKPDIDYIAAGLFL

SEQ ID NO: 3071833 - protein, 25 aa, Giardia lamblia
FRPSKPVQRLSCRQRFMQNAWGVLI

SEQ ID NO: 3071834 - protein, 27 aa, Giardia lamblia
FRPYTRGAMRISFEFPIKSTEKVIKSL

SEQ ID NO: 3071835 - protein, 18 aa, Giardia lamblia
FRQAFKRLVDDPVEQGTE

SEQ ID NO: 3071836 - protein, 19 aa, Giardia lamblia
FRQDWDRRRTFAAAVQDAV

SEQ ID NO: 3071837 - protein, 20 aa, Giardia lamblia
FRQEEKVLCRALRDSNIPKI

SEQ ID NO: 3071838 - protein, 17 aa, Giardia lamblia
FRQEYPEVVYLLATAKR

SEQ ID NO: 3071839 - protein, 22 aa, Giardia lamblia
FRQSAVWVLVVVVARLVYTFFT

SEQ ID NO: 3071840 - protein, 18 aa, Giardia lamblia
FRRGFSLRALGMIDEAAL

SEQ ID NO: 3071841 - protein, 18 aa, Giardia lamblia
FRSLCIYFGLNKVCPSLL

SEQ ID NO: 3071842 - protein, 20 aa, Giardia lamblia
FRSLSLFAAYLHVRNLRPHI

SEQ ID NO: 3071843 - protein, 17 aa, Giardia lamblia
FRTGQVSVQGFRSADFT

SEQ ID NO: 3071844 - protein, 17 aa, Giardia lamblia
FRTSIYMDMTNISDTLQ

SEQ ID NO: 3071845 - protein, 18 aa, Giardia lamblia
FRTTSLLLRDFGALLDSL

SEQ ID NO: 3071846 - protein, 24 aa, Giardia lamblia
FRVLEFASLLILHKVFKRPIFASK

SEQ ID NO: 3071847 - protein, 17 aa, Giardia lamblia
FRVVLFLLLVPIAVHII

SEQ ID NO: 3071848 - protein, 26 aa, Giardia lamblia
FRYSFIPCYIHNPAFLIMAIILLIKR

SEQ ID NO: 3071849 - protein, 25 aa, Giardia lamblia
FSACKLKTIVPAGSNSEVFRRMSAF

SEQ ID NO: 3071850 - protein, 29 aa, Giardia lamblia
FSADVRSLLRAALDLRFDEIKLGMSALRQ

SEQ ID NO: 3071851 - protein, 26 aa, Giardia lamblia
FSAFMLLYRMEYINGGLLFNSLSYYR

SEQ ID NO: 3071852 - protein, 17 aa, Giardia lamblia
FSAHAFLTQFLKKYGKE

SEQ ID NO: 3071853 - protein, 29 aa, Giardia lamblia
FSALFAFSTIPLFTGWLMLGYTVVFTSLP

SEQ ID NO: 3071854 - protein, 19 aa, Giardia lamblia
FSALIPCTIAVSFGSISSA

SEQ ID NO: 3071855 - protein, 22 aa, Giardia lamblia
FSATAELWVCNMHLYLEELLFA

SEQ ID NO: 3071856 - protein, 24 aa, Giardia lamblia
FSCSCPCSIIARKEVDTIDLAEYP

SEQ ID NO: 3071857 - protein, 25 aa, Giardia lamblia
FSCTCLSSFSGAICDVHVGQEDHEN

SEQ ID NO: 3071858 - protein, 31 aa, Giardia lamblia
FSDDFSFTFMVRLFYEAYLSLYKRLIPFLIT

SEQ ID NO: 3071859 - protein, 23 aa, Giardia lamblia
FSDYPLRLSFSANVHKFFICQLT

SEQ ID NO: 3071860 - protein, 22 aa, Giardia lamblia
FSDYTKYSLLFLRPSRVLLPTS

SEQ ID NO: 3071861 - protein, 24 aa, Giardia lamblia
FSEIERNLRLALSHIGTVANGTNT

SEQ ID NO: 3071862 - protein, 27 aa, Giardia lamblia
FSELIRLLYRMGKEADIAHLTDATVLK

SEQ ID NO: 3071863 - protein, 18 aa, Giardia lamblia
FSERICRFDPTVLTDEQI

SEQ ID NO: 3071864 - protein, 17 aa, Giardia lamblia
FSERSDLFASRNSQGLI

SEQ ID NO: 3071865 - protein, 27 aa, Giardia lamblia
FSFTRVPFCWGGCFCMPRQAIYEGSPS

SEQ ID NO: 3071866 - protein, 25 aa, Giardia lamblia
FSFVERLYEALAYMLSLTDTTATGY

SEQ ID NO: 3071867 - protein, 24 aa, Giardia lamblia
FSGFEFNGASALMFSVANNNLALV

SEQ ID NO: 3071868 - protein, 26 aa, Giardia lamblia
FSGHYRIPWTHLTQFQVAKAPYSIPA

SEQ ID NO: 3071869 - protein, 29 aa, Giardia lamblia
FSGISYNRLILFYVRQFIFGLAWSLSCQL

SEQ ID NO: 3071870 - protein, 17 aa, Giardia lamblia
FSGLDCGLNSCGVEQDY

SEQ ID NO: 3071871 - protein, 24 aa, Giardia lamblia
FSGNFSFREAIRLLSISPSKHVPF

SEQ ID NO: 3071872 - protein, 20 aa, Giardia lamblia
FSGQGRLLFVPSGITELDRT

SEQ ID NO: 3071873 - protein, 18 aa, Giardia lamblia
FSGQLIRIVSGCLEHDTK

SEQ ID NO: 3071874 - protein, 20 aa, Giardia lamblia
FSGRLTYKLPDSIPISQIFM

SEQ ID NO: 3071875 - protein, 25 aa, Giardia lamblia
FSGTIRTCLCFYSQLTAEGITPKDM

SEQ ID NO: 3071876 - protein, 19 aa, Giardia lamblia
FSICTNGYAELRLVYISNF

SEQ ID NO: 3071877 - protein, 23 aa, Giardia lamblia
FSIEELNVIISICESLNLNLMGH

SEQ ID NO: 3071878 - protein, 17 aa, Giardia lamblia
FSIFFLIPFLHSVQSIM

SEQ ID NO: 3071879 - protein, 18 aa, Giardia lamblia
FSIILRVTKFNTMAVIFF

SEQ ID NO: 3071880 - protein, 24 aa, Giardia lamblia
FSIMSTELLPLVRLQRVDLSREDV

SEQ ID NO: 3071881 - protein, 27 aa, Giardia lamblia
FSIQSPCTPARCHVVGAYIPTLSELYR

SEQ ID NO: 3071882 - protein, 27 aa, Giardia lamblia
FSISYRLRDLIAIALSYKHLCGRRRVT

SEQ ID NO: 3071883 - protein, 28 aa, Giardia lamblia
FSITHFLTCLAFILSIFYKINNGGFEFY

SEQ ID NO: 3071884 - protein, 18 aa, Giardia lamblia
FSKASRILIKMTPKSGSQ

SEQ ID NO: 3071885 - protein, 26 aa, Giardia lamblia
FSKHSLCGTPIYTSRDISDKKGGRVE

SEQ ID NO: 3071886 - protein, 22 aa, Giardia lamblia
FSKLFSHNRFISVLYAHAINHA

SEQ ID NO: 3071887 - protein, 20 aa, Giardia lamblia
FSKPISCYNVCKPEIDEYLA

SEQ ID NO: 3071888 - protein, 23 aa, Giardia lamblia
FSKVVLCLYIIAFLGNLPIFVRN

SEQ ID NO: 3071889 - protein, 25 aa, Giardia lamblia
FSLANYSVCWTCNDYATVQVEGILS

SEQ ID NO: 3071890 - protein, 24 aa, Giardia lamblia
FSLAYKLLVTDAMFDLCTSNSLPL

SEQ ID NO: 3071891 - protein, 17 aa, Giardia lamblia
FSLFIGIIVIIYTFGSI

SEQ ID NO: 3071892 - protein, 17 aa, Giardia lamblia
FSLPAWVDPGYLPRSPV

SEQ ID NO: 3071893 - protein, 18 aa, Giardia lamblia
FSLSKCIGCICKTLMNAR

SEQ ID NO: 3071894 - protein, 28 aa, Giardia lamblia
FSLSLTTALPWDVRYGLVQRISFTGMAG

SEQ ID NO: 3071895 - protein, 25 aa, Giardia lamblia
FSMKKMMRDQCLVRKLHACETMGSV

SEQ ID NO: 3071896 - protein, 20 aa, Giardia lamblia
FSMKNTRFVAISAGVAAYLV

SEQ ID NO: 3071897 - protein, 20 aa, Giardia lamblia
FSMLPRVIPVVLDIIVSEVN

SEQ ID NO: 3071898 - protein, 24 aa, Giardia lamblia
FSNAMKIFPIRTTRTYAVTTSLVG

SEQ ID NO: 3071899 - protein, 18 aa, Giardia lamblia
FSPEAMLFLTTKMANPIP

SEQ ID NO: 3071900 - protein, 22 aa, Giardia lamblia
FSPEEILDGMGLHAKIDSIKSP

SEQ ID NO: 3071901 - protein, 17 aa, Giardia lamblia
FSPEVHAKLTIINFTIS

SEQ ID NO: 3071902 - protein, 22 aa, Giardia lamblia
FSPHHCAIIVALGCAMLSPITV

SEQ ID NO: 3071903 - protein, 19 aa, Giardia lamblia
FSPSSNWYMDEGRLPFLSP

SEQ ID NO: 3071904 - protein, 23 aa, Giardia lamblia
FSQDIIRFHAEFLAKKEVPQAAS

SEQ ID NO: 3071905 - protein, 20 aa, Giardia lamblia
FSQFPRRIWSLVTSLVLSLC

SEQ ID NO: 3071906 - protein, 25 aa, Giardia lamblia
FSQLEIRCNPAFFTCFTYCNQNYSE

SEQ ID NO: 3071907 - protein, 19 aa, Giardia lamblia
FSQLIGHLAAWMGTTGNSK

SEQ ID NO: 3071908 - protein, 21 aa, Giardia lamblia
FSQRSVIGVAIYTYSTPLKLP

SEQ ID NO: 3071909 - protein, 24 aa, Giardia lamblia
FSREIDFRMKLNLTEQISLNMTYF

SEQ ID NO: 3071910 - protein, 17 aa, Giardia lamblia
FSRGVAGIFALNSALNS

SEQ ID NO: 3071911 - protein, 22 aa, Giardia lamblia
FSRPSLNDNTVWLWENAWKSFI

SEQ ID NO: 3071912 - protein, 20 aa, Giardia lamblia
FSSDEIHTFCTVLITERFTE

SEQ ID NO: 3071913 - protein, 27 aa, Giardia lamblia
FSSKYSKWGELWTELLISSFYCPDTGL

SEQ ID NO: 3071914 - protein, 19 aa, Giardia lamblia
FSSLLPAHFHLLARTMDVR

SEQ ID NO: 3071915 - protein, 20 aa, Giardia lamblia
FSSNGLRLGSIYLTNLTPDS

SEQ ID NO: 3071916 - protein, 18 aa, Giardia lamblia
FSSPKLGYLQGSSPRQFT

SEQ ID NO: 3071917 - protein, 20 aa, Giardia lamblia
FSSQLAIFAEFLLRQTTAFP

SEQ ID NO: 3071918 - protein, 17 aa, Giardia lamblia
FSSSLTCNSCKPNYKQS

SEQ ID NO: 3071919 - protein, 25 aa, Giardia lamblia
FSSVAEPLLRCFSVTSKKTLYLPES

SEQ ID NO: 3071920 - protein, 21 aa, Giardia lamblia
FSSVLRLLARYLDLGEYSLTV

SEQ ID NO: 3071921 - protein, 18 aa, Giardia lamblia
FSTFDFVIHPSLYSSSLC

SEQ ID NO: 3071922 - protein, 19 aa, Giardia lamblia
FSTLELWLIWIFTLPLFPL

SEQ ID NO: 3071923 - protein, 18 aa, Giardia lamblia
FSTLKWTLVLLQGLVRFD

SEQ ID NO: 3071924 - protein, 22 aa, Giardia lamblia
FSTREFRLLMLFYDSLQTLLSI

SEQ ID NO: 3071925 - protein, 20 aa, Giardia lamblia
FSTTGFYFLFNLVYIILLIL

SEQ ID NO: 3071926 - protein, 17 aa, Giardia lamblia
FSVENGRLLHYISSSNE

SEQ ID NO: 3071927 - protein, 19 aa, Giardia lamblia
FSVGMGCANLRLILKDTST

SEQ ID NO: 3071928 - protein, 19 aa, Giardia lamblia
FSYCNPLFIQRVISVYNLK

SEQ ID NO: 3071929 - protein, 24 aa, Giardia lamblia
FSYEHFYVIFCKFWELDTDHDQLI

SEQ ID NO: 3071930 - protein, 17 aa, Giardia lamblia
FSYGRRLTPPEAFVTGS

SEQ ID NO: 3071931 - protein, 20 aa, Giardia lamblia
FSYKLDFLGMLVSPVTLVLV

SEQ ID NO: 3071932 - protein, 20 aa, Giardia lamblia
FTAEMQLGIEIFTDTEQDIK

SEQ ID NO: 3071933 - protein, 20 aa, Giardia lamblia
FTAMEYCAYNNLLPQLSLLV

SEQ ID NO: 3071934 - protein, 17 aa, Giardia lamblia
FTCCCKRSKSSNGASTF

SEQ ID NO: 3071935 - protein, 22 aa, Giardia lamblia
FTCKVFKDYVIVGGNIYGVLPE

SEQ ID NO: 3071936 - protein, 29 aa, Giardia lamblia
FTDEECALFDARILTIFTHINSLVGNILK

SEQ ID NO: 3071937 - protein, 18 aa, Giardia lamblia
FTDGSFQLFALILETIVH

SEQ ID NO: 3071938 - protein, 21 aa, Giardia lamblia
FTDHFFAHFFLYLDEQLETPQ

SEQ ID NO: 3071939 - protein, 18 aa, Giardia lamblia
FTDIFVKIGIPDIARANY

SEQ ID NO: 3071940 - protein, 17 aa, Giardia lamblia
FTDTQLAYFYKELTFSR

SEQ ID NO: 3071941 - protein, 24 aa, Giardia lamblia
FTFSLKCFGHPVGKEGVLNNWAIR

SEQ ID NO: 3071942 - protein, 23 aa, Giardia lamblia
FTGHLDCAKALFSSESAEKDNAG

SEQ ID NO: 3071943 - protein, 30 aa, Giardia lamblia
FTGPAQMVFHYSIYFAIGWALLLGPLLGLF

SEQ ID NO: 3071944 - protein, 17 aa, Giardia lamblia
FTGPIPVGSVPHPRYGS

SEQ ID NO: 3071945 - protein, 20 aa, Giardia lamblia
FTGSSRYEGRIVFSNGTTHR

SEQ ID NO: 3071946 - protein, 25 aa, Giardia lamblia
FTIDRIIPSNVRFIITRCADQGEVL

SEQ ID NO: 3071947 - protein, 17 aa, Giardia lamblia
FTILYSVYVCQAVIHLL

SEQ ID NO: 3071948 - protein, 23 aa, Giardia lamblia
FTIPCLELYLAVLQHPVTIFLIP

SEQ ID NO: 3071949 - protein, 24 aa, Giardia lamblia
FTIPESYPTPALLTAFFNILHINL

SEQ ID NO: 3071950 - protein, 25 aa, Giardia lamblia
FTLASLISIYFLVMLSLQRNIRGGI

SEQ ID NO: 3071951 - protein, 17 aa, Giardia lamblia
FTLDTMCQRQGDLDIIC

SEQ ID NO: 3071952 - protein, 23 aa, Giardia lamblia
FTLHKKEILGLVAASGGGKSTLL

SEQ ID NO: 3071953 - protein, 17 aa, Giardia lamblia
FTLLKIVFSAAAVDKAI

SEQ ID NO: 3071954 - protein, 17 aa, Giardia lamblia
FTLLKQRKHSVLDTRAS

SEQ ID NO: 3071955 - protein, 17 aa, Giardia lamblia
FTLLNFAGDAYKMIVGT

SEQ ID NO: 3071956 - protein, 22 aa, Giardia lamblia
FTLLTGRPYRLFAYLQNVLTKR

SEQ ID NO: 3071957 - protein, 23 aa, Giardia lamblia
FTLPLRMESIAGLSSLRYYPLSF

SEQ ID NO: 3071958 - protein, 19 aa, Giardia lamblia
FTNKISYTYNDNWLITDYA

SEQ ID NO: 3071959 - protein, 18 aa, Giardia lamblia
FTNLFYTFCIFIPNIIFL

SEQ ID NO: 3071960 - protein, 19 aa, Giardia lamblia
FTPLFSIIFDRTFNEAVTT

SEQ ID NO: 3071961 - protein, 27 aa, Giardia lamblia
FTPMMSFAAILGFVGWSAQDFKSFMNS

SEQ ID NO: 3071962 - protein, 17 aa, Giardia lamblia
FTRMNMILIIGNCILHL

SEQ ID NO: 3071963 - protein, 18 aa, Giardia lamblia
FTRREIDENLILNRYIGS

SEQ ID NO: 3071964 - protein, 22 aa, Giardia lamblia
FTRREIDENLILNRYIGSSPDE

SEQ ID NO: 3071965 - protein, 25 aa, Giardia lamblia
FTSAPVEDFVAWPALSFPGPEYLAC

SEQ ID NO: 3071966 - protein, 26 aa, Giardia lamblia
FTSLYYFIGYSFRFDDFLSTDQSLSF

SEQ ID NO: 3071967 - protein, 22 aa, Giardia lamblia
FTSVVFRVMYHLSIEGIYGGEE

SEQ ID NO: 3071968 - protein, 18 aa, Giardia lamblia
FTTIEVLENLMLVDADLY

SEQ ID NO: 3071969 - protein, 30 aa, Giardia lamblia
FTTLRSRLLPALCISYGRYLEYIKHLFTAV

SEQ ID NO: 3071970 - protein, 24 aa, Giardia lamblia
FTTRSIPCSIFIFHADMRQMILLG

SEQ ID NO: 3071971 - protein, 19 aa, Giardia lamblia
FTVHKRFLDVFSNIHDKLW

SEQ ID NO: 3071972 - protein, 17 aa, Giardia lamblia
FTVPVLQKLVKVLCAHP

SEQ ID NO: 3071973 - protein, 20 aa, Giardia lamblia
FTVQLLRLFLTRGPFQQTQI

SEQ ID NO: 3071974 - protein, 27 aa, Giardia lamblia
FTVQLSCELHMIWPKRDTVVSTTYFYE

SEQ ID NO: 3071975 - protein, 23 aa, Giardia lamblia
FTVSRLASKLKRELLGVQIRNPM

SEQ ID NO: 3071976 - protein, 17 aa, Giardia lamblia
FTYIPVLLFIGSQRYAD

SEQ ID NO: 3071977 - protein, 17 aa, Giardia lamblia
FTYLQAFIRCFLVRKSV

SEQ ID NO: 3071978 - protein, 27 aa, Giardia lamblia
FVALCFVPELLNAVSLLYVPQDYLLGL

SEQ ID NO: 3071979 - protein, 19 aa, Giardia lamblia
FVANACRHLTVSLDDALMH

SEQ ID NO: 3071980 - protein, 24 aa, Giardia lamblia
FVAQWIIAASLEYIKFKERPDLQV

SEQ ID NO: 3071981 - protein, 17 aa, Giardia lamblia
FVATKFIGHPALSQLSD

SEQ ID NO: 3071982 - protein, 24 aa, Giardia lamblia
FVCCLFPCRAILLDIVKADRTTKR

SEQ ID NO: 3071983 - protein, 17 aa, Giardia lamblia
FVDCTEHFVDIIANQFF

SEQ ID NO: 3071984 - protein, 24 aa, Giardia lamblia
FVDNRFLCVAGFIDGLPIFRSGNP

SEQ ID NO: 3071985 - protein, 22 aa, Giardia lamblia
FVEARKIPSFTCSNSCTNCPRC

SEQ ID NO: 3071986 - protein, 18 aa, Giardia lamblia
FVEKRSLLTQGIFVLIVR

SEQ ID NO: 3071987 - protein, 26 aa, Giardia lamblia
FVEYACSCGKIPYSTTVERYRKYYKQ

SEQ ID NO: 3071988 - protein, 17 aa, Giardia lamblia
FVFPNEFLHLQNIFAQY

SEQ ID NO: 3071989 - protein, 24 aa, Giardia lamblia
FVFWELKHPFAILPRAILTNKKII

SEQ ID NO: 3071990 - protein, 28 aa, Giardia lamblia
FVGACKHFRIMICIPHRIVSVNKSKISR

SEQ ID NO: 3071991 - protein, 19 aa, Giardia lamblia
FVGIPGFPAVFIQLPESIT

SEQ ID NO: 3071992 - protein, 23 aa, Giardia lamblia
FVGNVRDCLVELGAMLSTNYSVS

SEQ ID NO: 3071993 - protein, 18 aa, Giardia lamblia
FVGSYTYNFAWLPALLFQ

SEQ ID NO: 3071994 - protein, 24 aa, Giardia lamblia
FVGWDFCFFINIFIGFFSILFCWL

SEQ ID NO: 3071995 - protein, 30 aa, Giardia lamblia
FVHTILPYCHIILGRYYFRGLFPSSSDDSS

SEQ ID NO: 3071996 - protein, 24 aa, Giardia lamblia
FVHVEFLDIPGCQYIQQRHIADCA

SEQ ID NO: 3071997 - protein, 28 aa, Giardia lamblia
FVHYMMSPKCFYHALIPQIVDACNKLTK

SEQ ID NO: 3071998 - protein, 20 aa, Giardia lamblia
FVIACIASIYTFVRGYVTQI

SEQ ID NO: 3071999 - protein, 32 aa, Giardia lamblia
FVILTVICWLMGFYLYRRFIKSFEACTMLPNS

SEQ ID NO: 3072000 - protein, 17 aa, Giardia lamblia
FVIRPRRGGPLRERAPQ

SEQ ID NO: 3072001 - protein, 17 aa, Giardia lamblia
FVIRPRRGGPLRERAPR

SEQ ID NO: 3072002 - protein, 18 aa, Giardia lamblia
FVIYSLCKVIEFDRYSLR

SEQ ID NO: 3072003 - protein, 22 aa, Giardia lamblia
FVKKVLKVCCCTNGAEQVATEK

SEQ ID NO: 3072004 - protein, 17 aa, Giardia lamblia
FVKYMLPIFRNNFEYSD

SEQ ID NO: 3072005 - protein, 25 aa, Giardia lamblia
FVLTTLVGLCIWTSLLYGLMRVSGV

SEQ ID NO: 3072006 - protein, 26 aa, Giardia lamblia
FVMTMPLMFVCYLVYMAIEIDPKGIG

SEQ ID NO: 3072007 - protein, 18 aa, Giardia lamblia
FVNELNCYQTEMHFQSVS

SEQ ID NO: 3072008 - protein, 17 aa, Giardia lamblia
FVNKLPCNWPVSMTNPT

SEQ ID NO: 3072009 - protein, 25 aa, Giardia lamblia
FVPHHGRASLMAFYMSILPSYISQL

SEQ ID NO: 3072010 - protein, 21 aa, Giardia lamblia
FVPSLLLYLAVDGVILSLYSS

SEQ ID NO: 3072011 - protein, 17 aa, Giardia lamblia
FVQEILDSSSLRKDDAA

SEQ ID NO: 3072012 - protein, 27 aa, Giardia lamblia
FVQRRYVEALQICQLVWDICGPELCEA

SEQ ID NO: 3072013 - protein, 24 aa, Giardia lamblia
FVQSLCLPVRMRFYRLHRAIPLGM

SEQ ID NO: 3072014 - protein, 25 aa, Giardia lamblia
FVRVNALFRFFFKFESIKRAAISIK

SEQ ID NO: 3072015 - protein, 23 aa, Giardia lamblia
FVRVRCPPLPGIYAYFRNETGLK

SEQ ID NO: 3072016 - protein, 25 aa, Giardia lamblia
FVSPKSFCDACRILVHLLPYKEMRE

SEQ ID NO: 3072017 - protein, 25 aa, Giardia lamblia
FVSSCNGYCRLLFTILDNPLYAASV

SEQ ID NO: 3072018 - protein, 30 aa, Giardia lamblia
FVTLLEGLGMILPPVMTLFCEKFNQEKTQT

SEQ ID NO: 3072019 - protein, 19 aa, Giardia lamblia
FVTLRSCIYLMAEIKKGIR

SEQ ID NO: 3072020 - protein, 25 aa, Giardia lamblia
FVTNWKLTYSLRHMPSYTSPDQQLP

SEQ ID NO: 3072021 - protein, 19 aa, Giardia lamblia
FVTSRKGYASLLMFLALRS

SEQ ID NO: 3072022 - protein, 25 aa, Giardia lamblia
FVVACDFNEVIALSVFARQFITQGV

SEQ ID NO: 3072023 - protein, 18 aa, Giardia lamblia
FVVLLRYSFEEFTLQNLI

SEQ ID NO: 3072024 - protein, 17 aa, Giardia lamblia
FVVNCGVPDMMAGADAA

SEQ ID NO: 3072025 - protein, 22 aa, Giardia lamblia
FWETYYLLGMCHMKLQNYSKAL

SEQ ID NO: 3072026 - protein, 17 aa, Giardia lamblia
FWGIPSINTRRFRASQV

SEQ ID NO: 3072027 - protein, 25 aa, Giardia lamblia
FWIQFFGAALYSWLGGNSPWTSVYY

SEQ ID NO: 3072028 - protein, 24 aa, Giardia lamblia
FWMAAKIVVVATCIAYQMVVTKKH

SEQ ID NO: 3072029 - protein, 20 aa, Giardia lamblia
FWMSGLYFPQGFITGVLQMH

SEQ ID NO: 3072030 - protein, 23 aa, Giardia lamblia
FWNKQWCKNPLFPPTAFNKSVLL

SEQ ID NO: 3072031 - protein, 22 aa, Giardia lamblia
FWSCVELSVAYNVEFMNKLFSL

SEQ ID NO: 3072032 - protein, 19 aa, Giardia lamblia
FWSMLGQVVAVVFSSIGAA

SEQ ID NO: 3072033 - protein, 19 aa, Giardia lamblia
FWTATRTKALLPYLYVLVA

SEQ ID NO: 3072034 - protein, 24 aa, Giardia lamblia
FWVVEVRAVMSFSLVKNPRDASVI

SEQ ID NO: 3072035 - protein, 28 aa, Giardia lamblia
FYADLLSAFPNRYALAIVLDQHSDLLLY

SEQ ID NO: 3072036 - protein, 18 aa, Giardia lamblia
FYCCCCRSIRSARYLHRA

SEQ ID NO: 3072037 - protein, 24 aa, Giardia lamblia
FYDKEVKKLCVISERLSDFTLADV

SEQ ID NO: 3072038 - protein, 23 aa, Giardia lamblia
FYDQRLREIAKRYTVLPENHSIF

SEQ ID NO: 3072039 - protein, 21 aa, Giardia lamblia
FYELRIMQFLILQLSVDNIDQ

SEQ ID NO: 3072040 - protein, 19 aa, Giardia lamblia
FYFLFNLVYIILLILTQSV

SEQ ID NO: 3072041 - protein, 21 aa, Giardia lamblia
FYFLYDICPRVYGTSPIQKVA

SEQ ID NO: 3072042 - protein, 25 aa, Giardia lamblia
FYFPLSVPPFSRFLQRGLPEGHDPS

SEQ ID NO: 3072043 - protein, 21 aa, Giardia lamblia
FYFYVDLWYSNSIRQQDENAQ

SEQ ID NO: 3072044 - protein, 20 aa, Giardia lamblia
FYIFLVCYLLFIYSYSLTNH

SEQ ID NO: 3072045 - protein, 18 aa, Giardia lamblia
FYINEPFFPIAYAVPEDK

SEQ ID NO: 3072046 - protein, 23 aa, Giardia lamblia
FYKAGRRAYKMYMKLVKQLFDYE

SEQ ID NO: 3072047 - protein, 19 aa, Giardia lamblia
FYKPPLYMFYDSIKLTLPG

SEQ ID NO: 3072048 - protein, 17 aa, Giardia lamblia
FYLFLGRVHSPGQQVLH

SEQ ID NO: 3072049 - protein, 17 aa, Giardia lamblia
FYLGVAITAVFAILMPP

SEQ ID NO: 3072050 - protein, 26 aa, Giardia lamblia
FYLLPNYPFVYVIRGHRVPVVPIQRS

SEQ ID NO: 3072051 - protein, 22 aa, Giardia lamblia
FYLLPPHPRFSCSCRNKHISIL

SEQ ID NO: 3072052 - protein, 24 aa, Giardia lamblia
FYLPTRPYPTLSIYTLDPLVKLTG

SEQ ID NO: 3072053 - protein, 20 aa, Giardia lamblia
FYLRRHVWHANLIIPHLEPS

SEQ ID NO: 3072054 - protein, 17 aa, Giardia lamblia
FYLSTSIPDTYFYQKKH

SEQ ID NO: 3072055 - protein, 19 aa, Giardia lamblia
FYMAVSWGGYVFLTVLIPL

SEQ ID NO: 3072056 - protein, 17 aa, Giardia lamblia
FYMCKQLKQLSAPTPCP

SEQ ID NO: 3072057 - protein, 22 aa, Giardia lamblia
FYMLPNHMQAILGKLFPISHMS

SEQ ID NO: 3072058 - protein, 23 aa, Giardia lamblia
FYMPSTCYKRAIVFSLGPTTYYD

SEQ ID NO: 3072059 - protein, 18 aa, Giardia lamblia
FYNTVFWVEYDLKRFFTS

SEQ ID NO: 3072060 - protein, 17 aa, Giardia lamblia
FYQKHTHCMLLNIIENT

SEQ ID NO: 3072061 - protein, 17 aa, Giardia lamblia
FYRAYKAKQGSFFVVSS

SEQ ID NO: 3072062 - protein, 17 aa, Giardia lamblia
FYREFIRELYASLCKAR

SEQ ID NO: 3072063 - protein, 18 aa, Giardia lamblia
FYRNATRMLVPFIYSVIY

SEQ ID NO: 3072064 - protein, 23 aa, Giardia lamblia
FYSAELFDKWASLRGVGKLEYGF

SEQ ID NO: 3072065 - protein, 29 aa, Giardia lamblia
FYSYLGIACGLAFSCLGSAYGTAKSGKGV

SEQ ID NO: 3072066 - protein, 18 aa, Giardia lamblia
FYTALSINSSVLRGSLLL

SEQ ID NO: 3072067 - protein, 39 aa, Giardia lamblia
FYTRRCFNLKVLEEIILPGLTGYMMRFRRQITITNGYYN

SEQ ID NO: 3072068 - protein, 34 aa, Giardia lamblia
FYTRYCGSVKGVVRRCPLRFAPLTQLMKRKIVPD

SEQ ID NO: 3072069 - protein, 23 aa, Giardia lamblia
FYVARSHGFYMLKKVQEALKDLD

SEQ ID NO: 3072070 - protein, 18 aa, Giardia lamblia
FYVAYALVSAIWRSLQCT

SEQ ID NO: 3072071 - protein, 27 aa, Giardia lamblia
FYVEITRYLKLSALFHLPSGLYAVVLG

SEQ ID NO: 3072072 - protein, 18 aa, Giardia lamblia
FYVPDSRIFVGVYDCFDL

SEQ ID NO: 3072073 - protein, 19 aa, Giardia lamblia
FYVVYCHRDSYSIQCGELL

SEQ ID NO: 3072074 - protein, 25 aa, Giardia lamblia
GAADHPLCLYNMFAPSCTDNNRSLA

SEQ ID NO: 3072075 - protein, 28 aa, Giardia lamblia
GAALTSLASLRWEQIASQRKTLFNLCIS

SEQ ID NO: 3072076 - protein, 23 aa, Giardia lamblia
GACGSCFTFGAVQAMNSRIMIAT

SEQ ID NO: 3072077 - protein, 21 aa, Giardia lamblia
GACTTCSGAAFLMNGGCYTTE

SEQ ID NO: 3072078 - protein, 21 aa, Giardia lamblia
GACTTCSGAAFLMNGGCYTTV

SEQ ID NO: 3072079 - protein, 17 aa, Giardia lamblia
GADFLYARCHVHHLERH

SEQ ID NO: 3072080 - protein, 20 aa, Giardia lamblia
GADRKIIIWNGIAHTPVSIL

SEQ ID NO: 3072081 - protein, 20 aa, Giardia lamblia
GAEWKLALFTPTKITPIGNG

SEQ ID NO: 3072082 - protein, 24 aa, Giardia lamblia
GAFCKKKSLLTWALICNASSILCV

SEQ ID NO: 3072083 - protein, 18 aa, Giardia lamblia
GAFNYKCLFKTHDDLRQD

SEQ ID NO: 3072084 - protein, 25 aa, Giardia lamblia
GAFPMIRYELLTSNVMLCISTLYTA

SEQ ID NO: 3072085 - protein, 20 aa, Giardia lamblia
GAGDKCFKCTASSGNNNQIT

SEQ ID NO: 3072086 - protein, 24 aa, Giardia lamblia
GAGKSSLVAALFRLAEPERAETDS

SEQ ID NO: 3072087 - protein, 21 aa, Giardia lamblia
GAIPYSAPEKLGLIGQPSIGI

SEQ ID NO: 3072088 - protein, 17 aa, Giardia lamblia
GAISVDRYVYVRILNSM

SEQ ID NO: 3072089 - protein, 18 aa, Giardia lamblia
GAIVSGGLAGRVVSFAVY

SEQ ID NO: 3072090 - protein, 25 aa, Giardia lamblia
GAIWKNRSQQIIGFRVQPLNGTDVS

SEQ ID NO: 3072091 - protein, 18 aa, Giardia lamblia
GALANFKALGLIIRLYFY

SEQ ID NO: 3072092 - protein, 19 aa, Giardia lamblia
GALIGVLAWWVVSRKKKSA

SEQ ID NO: 3072093 - protein, 19 aa, Giardia lamblia
GALSAASNRPSCAFDSPTL

SEQ ID NO: 3072094 - protein, 17 aa, Giardia lamblia
GAMALTGIYYVVLRTNW

SEQ ID NO: 3072095 - protein, 17 aa, Giardia lamblia
GAPELLLAGSLSMLPSH

SEQ ID NO: 3072096 - protein, 23 aa, Giardia lamblia
GAPKPKFQHIWISPWLDGQHGSM

SEQ ID NO: 3072097 - protein, 25 aa, Giardia lamblia
GARFKSPNCFTFIAITRENMVHFVV

SEQ ID NO: 3072098 - protein, 20 aa, Giardia lamblia
GARKSRALADVVFVDDKTSS

SEQ ID NO: 3072099 - protein, 24 aa, Giardia lamblia
GASDCLYCIQPIKGEIGTALCTKC

SEQ ID NO: 3072100 - protein, 28 aa, Giardia lamblia
GASGLLIACMLNRVKIMDEVVCGSYAIF

SEQ ID NO: 3072101 - protein, 25 aa, Giardia lamblia
GASMHLWAPFTLNFWGFIRTPPPPD

SEQ ID NO: 3072102 - protein, 25 aa, Giardia lamblia
GASYKPPQSFIYNWTIPVNMEDIHA

SEQ ID NO: 3072103 - protein, 26 aa, Giardia lamblia
GATKTYRIPAMWILILISLIQSLIVF

SEQ ID NO: 3072104 - protein, 26 aa, Giardia lamblia
GATLFEMCFNISFSQYLMENESAASA

SEQ ID NO: 3072105 - protein, 25 aa, Giardia lamblia
GATMSDFPNLGFIVFFLPELSPISC

SEQ ID NO: 3072106 - protein, 30 aa, Giardia lamblia
GATRIRLKYDLARTRFYFTSARNVDYSSLS

SEQ ID NO: 3072107 - protein, 19 aa, Giardia lamblia
GAVGYCAADVVHATIGTNQ

SEQ ID NO: 3072108 - protein, 25 aa, Giardia lamblia
GAWCQDCVFPFTIVFVNGVAQCVPG

SEQ ID NO: 3072109 - protein, 20 aa, Giardia lamblia
GAWYPLALAFLLPISRIVHE

SEQ ID NO: 3072110 - protein, 17 aa, Giardia lamblia
GAYRTVIELCFDALRQT

SEQ ID NO: 3072111 - protein, 18 aa, Giardia lamblia
GCACNALNCLICNPDDGD

SEQ ID NO: 3072112 - protein, 27 aa, Giardia lamblia
GCAEVRKRFQTIYLYDTYLCQLLAVEV

SEQ ID NO: 3072113 - protein, 25 aa, Giardia lamblia
GCAHRTICAYDRLEILIERTHRVYR

SEQ ID NO: 3072114 - protein, 21 aa, Giardia lamblia
GCATCTACKSSSTVHKQDVQD

SEQ ID NO: 3072115 - protein, 21 aa, Giardia lamblia
GCAVAGFLFIIVFLCVCVVYG

SEQ ID NO: 3072116 - protein, 28 aa, Giardia lamblia
GCAVRYALVCWSEIIVIITFSAGLVVGL

SEQ ID NO: 3072117 - protein, 21 aa, Giardia lamblia
GCCWAMASAALYEISVRSTRN

SEQ ID NO: 3072118 - protein, 22 aa, Giardia lamblia
GCFPCTVSGCSHCNRDDMCEAC

SEQ ID NO: 3072119 - protein, 18 aa, Giardia lamblia
GCGACVRTGAGYNLAYTC

SEQ ID NO: 3072120 - protein, 28 aa, Giardia lamblia
GCGHIACSACLYHMYETRTRKCPICQKP

SEQ ID NO: 3072121 - protein, 19 aa, Giardia lamblia
GCIEAPLLTEEVFYQTQEA

SEQ ID NO: 3072122 - protein, 26 aa, Giardia lamblia
GCIFPRRYGLLEPRDFIIRLLEQQSP

SEQ ID NO: 3072123 - protein, 25 aa, Giardia lamblia
GCIKCTMTGCFACPSSPDICTFCSN

SEQ ID NO: 3072124 - protein, 22 aa, Giardia lamblia
GCIRCSRTGRAICEACADDYYL

SEQ ID NO: 3072125 - protein, 20 aa, Giardia lamblia
GCKTCALGSHRVGDRCVACE

SEQ ID NO: 3072126 - protein, 23 aa, Giardia lamblia
GCKVCKDRFALRNNICIEECPVG

SEQ ID NO: 3072127 - protein, 17 aa, Giardia lamblia
GCLSVMFLLVYSSMTLY

SEQ ID NO: 3072128 - protein, 22 aa, Giardia lamblia
GCLTHAWALTHARLEEAFIDLV

SEQ ID NO: 3072129 - protein, 22 aa, Giardia lamblia
GCLTHAWALTHARLEEAFVDLT

SEQ ID NO: 3072130 - protein, 20 aa, Giardia lamblia
GCNLLAFTCKVFKDYVIVGG

SEQ ID NO: 3072131 - protein, 22 aa, Giardia lamblia
GCPEGFKLVHFGAEEGYRKTCM

SEQ ID NO: 3072132 - protein, 18 aa, Giardia lamblia
GCQACSKDSATTCDACFE

SEQ ID NO: 3072133 - protein, 18 aa, Giardia lamblia
GCQICKPGKVLEPSVVTN

SEQ ID NO: 3072134 - protein, 22 aa, Giardia lamblia
GCRRHLPEKLKKCIEKCAYATV

SEQ ID NO: 3072135 - protein, 21 aa, Giardia lamblia
GCSCNKGYTGSKCESCATGYR

SEQ ID NO: 3072136 - protein, 29 aa, Giardia lamblia
GCSGGFAEMVVKFAEEFGILTENSYYISY

SEQ ID NO: 3072137 - protein, 23 aa, Giardia lamblia
GCYMLSDYVYLVLPLTSSKQQAA

SEQ ID NO: 3072138 - protein, 17 aa, Giardia lamblia
GCYNVLYSPGNRICRTA

SEQ ID NO: 3072139 - protein, 22 aa, Giardia lamblia
GDAKLPGFAAVTLVQLRDLFLA

SEQ ID NO: 3072140 - protein, 26 aa, Giardia lamblia
GDANAASCTACYPGYSLLYGSGTAGT

SEQ ID NO: 3072141 - protein, 18 aa, Giardia lamblia
GDAWRSVYVSAKSHILAM

SEQ ID NO: 3072142 - protein, 22 aa, Giardia lamblia
GDCYRFYSRLIEPCCKYLTKYE

SEQ ID NO: 3072143 - protein, 18 aa, Giardia lamblia
GDDYKSFISHLFSNVLNI

SEQ ID NO: 3072144 - protein, 24 aa, Giardia lamblia
GDGIAGMCCLTFLFYYLQKYKHLS

SEQ ID NO: 3072145 - protein, 31 aa, Giardia lamblia
GDIFLELLLEPCATYEAVIFKGHEAELHSFA

SEQ ID NO: 3072146 - protein, 23 aa, Giardia lamblia
GDIHGRLGLARIVEEMDDFEVIT

SEQ ID NO: 3072147 - protein, 21 aa, Giardia lamblia
GDIKPPLQYKSRFLVQETHQQ

SEQ ID NO: 3072148 - protein, 33 aa, Giardia lamblia
GDIVRRACGKPALKCKLSWCASATRAEGGPTDE

SEQ ID NO: 3072149 - protein, 18 aa, Giardia lamblia
GDIYRGGFYADRRHGAGK

SEQ ID NO: 3072150 - protein, 21 aa, Giardia lamblia
GDLHDFLALLCRSDKQARTEH

SEQ ID NO: 3072151 - protein, 27 aa, Giardia lamblia
GDLIWAPCIFCCNLCITLTLLPYEVVL

SEQ ID NO: 3072152 - protein, 22 aa, Giardia lamblia
GDLKYLYFLAWEDVPDSSTVHS

SEQ ID NO: 3072153 - protein, 25 aa, Giardia lamblia
GDLPEGKPRCKIMAQLYGAILTDFL

SEQ ID NO: 3072154 - protein, 20 aa, Giardia lamblia
GDLYAASCITELNEYFSTLG

SEQ ID NO: 3072155 - protein, 20 aa, Giardia lamblia
GDMGKPVSIYRFSRNAPTGD

SEQ ID NO: 3072156 - protein, 20 aa, Giardia lamblia
GDNYFMVGPHLSWDDKFATN

SEQ ID NO: 3072157 - protein, 22 aa, Giardia lamblia
GDPTITQLVGWLAHHTVRYPLQ

SEQ ID NO: 3072158 - protein, 23 aa, Giardia lamblia
GDQRLESISSLYKQLPSLLNTLE

SEQ ID NO: 3072159 - protein, 17 aa, Giardia lamblia
GDSALLLSLKRPMDACI

SEQ ID NO: 3072160 - protein, 26 aa, Giardia lamblia
GDSISCLLDLPVYWLSHNNMRFVFLN

SEQ ID NO: 3072161 - protein, 21 aa, Giardia lamblia
GDTYRCVCLDFYTLVNKDCIP

SEQ ID NO: 3072162 - protein, 21 aa, Giardia lamblia
GDVFKVRYLLYSGGTISYDNT

SEQ ID NO: 3072163 - protein, 17 aa, Giardia lamblia
GDVPLYFSSSSPLDAEN

SEQ ID NO: 3072164 - protein, 25 aa, Giardia lamblia
GDYFTRHRFELQRRIPVSARKDFRY

SEQ ID NO: 3072165 - protein, 17 aa, Giardia lamblia
GDYGTLVSYIERTRDEA

SEQ ID NO: 3072166 - protein, 28 aa, Giardia lamblia
GDYLFPFPIGDAISAIIGICMFAYSVCR

SEQ ID NO: 3072167 - protein, 20 aa, Giardia lamblia
GDYYFLCLQNYTGLNATIMR

SEQ ID NO: 3072168 - protein, 21 aa, Giardia lamblia
GEAALSFAYIYYLESSVRVDT

SEQ ID NO: 3072169 - protein, 17 aa, Giardia lamblia
GEAGLCTVYSCSSDDPT

SEQ ID NO: 3072170 - protein, 23 aa, Giardia lamblia
GEAYFSYPLVRPLYKGDQIDDSG

SEQ ID NO: 3072171 - protein, 33 aa, Giardia lamblia
GECDWGTVVRACFYTQIAIQWVQYMLYDSECAT

SEQ ID NO: 3072172 - protein, 17 aa, Giardia lamblia
GECSCTPPFVKFAGQNG

SEQ ID NO: 3072173 - protein, 18 aa, Giardia lamblia
GEDLELDLSLPLTQMILK

SEQ ID NO: 3072174 - protein, 20 aa, Giardia lamblia
GEDMPLLILNAISTLHGVNL

SEQ ID NO: 3072175 - protein, 26 aa, Giardia lamblia
GEEIELCFFKKTLALIRLKQARSYVL

SEQ ID NO: 3072176 - protein, 34 aa, Giardia lamblia
GEELPLSICGKVLNSHLGFKCQYCTTDKSSVMCL

SEQ ID NO: 3072177 - protein, 20 aa, Giardia lamblia
GEERFSHSLYRVTFSTFDFV

SEQ ID NO: 3072178 - protein, 25 aa, Giardia lamblia
GEFFTDLFIKTGLIARRARRLQDAA

SEQ ID NO: 3072179 - protein, 24 aa, Giardia lamblia
GEFHLIDLYLARYIARLDDKPLLS

SEQ ID NO: 3072180 - protein, 25 aa, Giardia lamblia
GEFIDLRIYFGLTNFLSHVNLRNEP

SEQ ID NO: 3072181 - protein, 17 aa, Giardia lamblia
GEFKYTGVFANLLCFTC

SEQ ID NO: 3072182 - protein, 20 aa, Giardia lamblia
GEGPERLERIVLLSDLQLGV

SEQ ID NO: 3072183 - protein, 25 aa, Giardia lamblia
GEGVLRSDPWPDFFKEIRRQQDAGS

SEQ ID NO: 3072184 - protein, 19 aa, Giardia lamblia
GEHVPKLLIKYFPSSFDLL

SEQ ID NO: 3072185 - protein, 21 aa, Giardia lamblia
GEIFSGTVLMNGFDVVMMLID

SEQ ID NO: 3072186 - protein, 19 aa, Giardia lamblia
GEIFSLLGHNGCGKSTTVN

SEQ ID NO: 3072187 - protein, 26 aa, Giardia lamblia
GEKNAVIGICSAASTLSEYIGKINHT

SEQ ID NO: 3072188 - protein, 17 aa, Giardia lamblia
GELHTYMGILARITGGD

SEQ ID NO: 3072189 - protein, 18 aa, Giardia lamblia
GELLASTDELCWSLEQSI

SEQ ID NO: 3072190 - protein, 26 aa, Giardia lamblia
GELMKPTMRRLLGITSTDWLPDFSAH

SEQ ID NO: 3072191 - protein, 18 aa, Giardia lamblia
GELSNAVLFGDFSAGHKL

SEQ ID NO: 3072192 - protein, 22 aa, Giardia lamblia
GELTCDAYAIAIAATYNETGPG

SEQ ID NO: 3072193 - protein, 17 aa, Giardia lamblia
GELYFSLMRPPSAQTGQ

SEQ ID NO: 3072194 - protein, 21 aa, Giardia lamblia
GEPIPRIAIIVLAILCFPLGM

SEQ ID NO: 3072195 - protein, 22 aa, Giardia lamblia
GEPLNVYSIFELLGFGFMILGT

SEQ ID NO: 3072196 - protein, 21 aa, Giardia lamblia
GEPPEPALVFASEFSSANVVE

SEQ ID NO: 3072197 - protein, 19 aa, Giardia lamblia
GEQEFEWIAYHMSLFFKHT

SEQ ID NO: 3072198 - protein, 20 aa, Giardia lamblia
GEQWLCLQRNAIFCKLFAAS

SEQ ID NO: 3072199 - protein, 21 aa, Giardia lamblia
GESAIRMANRWNHSRVVSLLE

SEQ ID NO: 3072200 - protein, 30 aa, Giardia lamblia
GESPVKGPCLAFLVKFMEEILGFKTVPADL

SEQ ID NO: 3072201 - protein, 25 aa, Giardia lamblia
GESSKSALLRLIWLLIAAFPDHADL

SEQ ID NO: 3072202 - protein, 25 aa, Giardia lamblia
GETLCAHYDCMRHQQCAAGSVCDID

SEQ ID NO: 3072203 - protein, 25 aa, Giardia lamblia
GETLLMYVCLYVFALRRSFTQLSAN

SEQ ID NO: 3072204 - protein, 23 aa, Giardia lamblia
GETRHLLELHLERLVENIYSLVY

SEQ ID NO: 3072205 - protein, 19 aa, Giardia lamblia
GETSAECNWCQNEKYGPID

SEQ ID NO: 3072206 - protein, 24 aa, Giardia lamblia
GETVCSTTERLLCEILDSSHEIRQ

SEQ ID NO: 3072207 - protein, 19 aa, Giardia lamblia
GEVCLSVKCQVLYCEECDG

SEQ ID NO: 3072208 - protein, 21 aa, Giardia lamblia
GEVDKCLAIVFADGVHSNEIV

SEQ ID NO: 3072209 - protein, 20 aa, Giardia lamblia
GEVQFLLSLQLAQFCDSGSI

SEQ ID NO: 3072210 - protein, 18 aa, Giardia lamblia
GEVVARVEIETMGPLPTK

SEQ ID NO: 3072211 - protein, 18 aa, Giardia lamblia
GEWGAAADACKWTNKTNK

SEQ ID NO: 3072212 - protein, 21 aa, Giardia lamblia
GEWKDGLVGVLIRDMLAKTAA

SEQ ID NO: 3072213 - protein, 17 aa, Giardia lamblia
GEYFLFMGGCYGIKYRP

SEQ ID NO: 3072214 - protein, 21 aa, Giardia lamblia
GEYHSVIPMDAFQYLSPCYAR

SEQ ID NO: 3072215 - protein, 17 aa, Giardia lamblia
GEYKYYITGDMALVLLD

SEQ ID NO: 3072216 - protein, 21 aa, Giardia lamblia
GEYPFLVKITNCYATGEKDQQ

SEQ ID NO: 3072217 - protein, 17 aa, Giardia lamblia
GEYRYGHRYAQVIKSKY

SEQ ID NO: 3072218 - protein, 23 aa, Giardia lamblia
GEYVCLNCSILSDSTLSEIDTHR

SEQ ID NO: 3072219 - protein, 25 aa, Giardia lamblia
GFAALCFCSSLTLAFSFLSVSPILF

SEQ ID NO: 3072220 - protein, 18 aa, Giardia lamblia
GFAAYRGATRIVQSLLGI

SEQ ID NO: 3072221 - protein, 18 aa, Giardia lamblia
GFCGCCWAMASAALYEIS

SEQ ID NO: 3072222 - protein, 24 aa, Giardia lamblia
GFEFYWLMCSLFFGFITILFGLCH

SEQ ID NO: 3072223 - protein, 25 aa, Giardia lamblia
GFEVIELLNSVLIYSILFERSFASF

SEQ ID NO: 3072224 - protein, 18 aa, Giardia lamblia
GFFSFSYTFFATRPTRMY

SEQ ID NO: 3072225 - protein, 19 aa, Giardia lamblia
GFGKCIFSSSGEHRCLCDQ

SEQ ID NO: 3072226 - protein, 26 aa, Giardia lamblia
GFICDCPRGSFGRACNFCDRSFMLIN

SEQ ID NO: 3072227 - protein, 17 aa, Giardia lamblia
GFIDIAFVLAEHEAGIQ

SEQ ID NO: 3072228 - protein, 29 aa, Giardia lamblia
GFLIKWAHLPLCLSYGLQLMGQKSPEMAT

SEQ ID NO: 3072229 - protein, 19 aa, Giardia lamblia
GFLIRPMLYQSLPEFILQN

SEQ ID NO: 3072230 - protein, 23 aa, Giardia lamblia
GFLKGHAQKVKWIYLPDYDSNLG

SEQ ID NO: 3072231 - protein, 18 aa, Giardia lamblia
GFLTGWTLVCFVISYFLL

SEQ ID NO: 3072232 - protein, 20 aa, Giardia lamblia
GFMTRAPVLRRRMRCQRASG

SEQ ID NO: 3072233 - protein, 17 aa, Giardia lamblia
GFNASLFTEDAPGTIAL

SEQ ID NO: 3072234 - protein, 17 aa, Giardia lamblia
GFSLHLLYREFAVVGVP

SEQ ID NO: 3072235 - protein, 24 aa, Giardia lamblia
GFSRSTERLKFIVLDGPIDSAYAE

SEQ ID NO: 3072236 - protein, 17 aa, Giardia lamblia
GGAYHCLIFLSDESVIG

SEQ ID NO: 3072237 - protein, 24 aa, Giardia lamblia
GGCGFKSRRVCFVHFSRAISKCSV

SEQ ID NO: 3072238 - protein, 18 aa, Giardia lamblia
GGCLPSGYYHDPLANILA

SEQ ID NO: 3072239 - protein, 21 aa, Giardia lamblia
GGCLSSILSPLASRRAVATPV

SEQ ID NO: 3072240 - protein, 19 aa, Giardia lamblia
GGCYRVDTELGLKACAYTT

SEQ ID NO: 3072241 - protein, 17 aa, Giardia lamblia
GGDIIVFLPGIVAITDF

SEQ ID NO: 3072242 - protein, 17 aa, Giardia lamblia
GGDVLRAKLVLGPDQNP

SEQ ID NO: 3072243 - protein, 19 aa, Giardia lamblia
GGFKEIFAEFITRVVAYLM

SEQ ID NO: 3072244 - protein, 34 aa, Giardia lamblia
GGFPLSYFLFCIGLFLMIWLARIGGHPHPHVNPR

SEQ ID NO: 3072245 - protein, 31 aa, Giardia lamblia
GGFSGFWLFFPTHAFQAMFLISLKTVPFALN

SEQ ID NO: 3072246 - protein, 27 aa, Giardia lamblia
GGGKGFSLLRLKYVFRTIRAVQRQQAS

SEQ ID NO: 3072247 - protein, 25 aa, Giardia lamblia
GGGTCSQCAYGYRGLLNGCYPVPLF

SEQ ID NO: 3072248 - protein, 22 aa, Giardia lamblia
GGIATNRFYDFLALVTQEECDI

SEQ ID NO: 3072249 - protein, 24 aa, Giardia lamblia
GGIPPDVLDAGAFIGTLSIQLLQA

SEQ ID NO: 3072250 - protein, 18 aa, Giardia lamblia
GGKFRYSFIPCYIHNPAF

SEQ ID NO: 3072251 - protein, 20 aa, Giardia lamblia
GGKLLPAKPGILYPRVPIVH

SEQ ID NO: 3072252 - protein, 17 aa, Giardia lamblia
GGLAGFLCWWFIGRRKA

SEQ ID NO: 3072253 - protein, 19 aa, Giardia lamblia
GGLAGLGYGVYRMVRNYQF

SEQ ID NO: 3072254 - protein, 19 aa, Giardia lamblia
GGLSAFALVWILLYSAQYT

SEQ ID NO: 3072255 - protein, 35 aa, Giardia lamblia
GGLSPRPPINPAFPYPLCLLPLPFRHVNDDANHEQ

SEQ ID NO: 3072256 - protein, 31 aa, Giardia lamblia
GGLTMRSGHTALMIACIYGGLDAALMLAEKE

SEQ ID NO: 3072257 - protein, 18 aa, Giardia lamblia
GGLYQFRQILKSNLNAPV

SEQ ID NO: 3072258 - protein, 22 aa, Giardia lamblia
GGMQRRLCIAIATCGYHKLLLF

SEQ ID NO: 3072259 - protein, 31 aa, Giardia lamblia
GGMRRRASLIIALLGCRHILCLDEFTTGLSV

SEQ ID NO: 3072260 - protein, 17 aa, Giardia lamblia
GGMRRRLSLLNATIGLC

SEQ ID NO: 3072261 - protein, 21 aa, Giardia lamblia
GGMRRRLSVAIALTGSPSVLY

SEQ ID NO: 3072262 - protein, 17 aa, Giardia lamblia
GGNPILFFTEDPIVTCN

SEQ ID NO: 3072263 - protein, 28 aa, Giardia lamblia
GGPDILSSLLRWRHKVEGYSSTQKSHEK

SEQ ID NO: 3072264 - protein, 21 aa, Giardia lamblia
GGPLCSQYSCADADPTCGGHG

SEQ ID NO: 3072265 - protein, 18 aa, Giardia lamblia
GGPQCIFCESITLGCAKC

SEQ ID NO: 3072266 - protein, 19 aa, Giardia lamblia
GGQKARIALARAVYADSDI

SEQ ID NO: 3072267 - protein, 21 aa, Giardia lamblia
GGRPANLWHRLRRHLGEAVCA

SEQ ID NO: 3072268 - protein, 21 aa, Giardia lamblia
GGRVEHDFCINLSRSTTNSSW

SEQ ID NO: 3072269 - protein, 19 aa, Giardia lamblia
GGSFRLTREYNPFSYQSIT

SEQ ID NO: 3072270 - protein, 21 aa, Giardia lamblia
GGSKLECCDCVTGERFDSVEF

SEQ ID NO: 3072271 - protein, 27 aa, Giardia lamblia
GGSSRRSREVLAMINLRNEVSIFSVEG

SEQ ID NO: 3072272 - protein, 21 aa, Giardia lamblia
GGVGACVRDGAGYSCDCRGLA

SEQ ID NO: 3072273 - protein, 24 aa, Giardia lamblia
GGVGICKRNGRSYSCDCGDVAAGS

SEQ ID NO: 3072274 - protein, 29 aa, Giardia lamblia
GGVRRCWCERGFLPALDRSGCVLPIECPP

SEQ ID NO: 3072275 - protein, 29 aa, Giardia lamblia
GGVRRCWCERGFLPALDRSGCVLPTECPS

SEQ ID NO: 3072276 - protein, 26 aa, Giardia lamblia
GGVRRCWCERGFLPAPDKSGCVPAPE

SEQ ID NO: 3072277 - protein, 23 aa, Giardia lamblia
GGVSGALCLQSMLIATADNSVID

SEQ ID NO: 3072278 - protein, 18 aa, Giardia lamblia
GGVYLLDILIHRLCTSGI

SEQ ID NO: 3072279 - protein, 18 aa, Giardia lamblia
GGWTRREPPIPYKPDVWS

SEQ ID NO: 3072280 - protein, 19 aa, Giardia lamblia
GGYAICLPEAVYEGSKLSL

SEQ ID NO: 3072281 - protein, 41 aa, Giardia lamblia
GGYVKRCQSAIIPCFARLGMCLRTIRYTQFVVFYAVSLDPS

SEQ ID NO: 3072282 - protein, 25 aa, Giardia lamblia
GHEDCFKLLAKCAVPNAGSANITPG

SEQ ID NO: 3072283 - protein, 25 aa, Giardia lamblia
GHGFCTGPGVAMCDKGWKDGEAGLC

SEQ ID NO: 3072284 - protein, 22 aa, Giardia lamblia
GHHGCVRYLLGKELGMQDRTGW

SEQ ID NO: 3072285 - protein, 24 aa, Giardia lamblia
GHIDFSHIIDLFFKQLIGADFVLN

SEQ ID NO: 3072286 - protein, 20 aa, Giardia lamblia
GHKLAPLPLLSRLVQYPTYR

SEQ ID NO: 3072287 - protein, 19 aa, Giardia lamblia
GHKVWQIAFGSGFKCNSVV

SEQ ID NO: 3072288 - protein, 21 aa, Giardia lamblia
GHLEIVKLLLPKEGSIADTNG

SEQ ID NO: 3072289 - protein, 19 aa, Giardia lamblia
GHNGALCTLEKPLVFCDEG

SEQ ID NO: 3072290 - protein, 18 aa, Giardia lamblia
GHPIKFSVIETSYNIMNT

SEQ ID NO: 3072291 - protein, 25 aa, Giardia lamblia
GHRLIKRYRGGILSAPCRNTSLDHE

SEQ ID NO: 3072292 - protein, 35 aa, Giardia lamblia
GHSSCPSELTFLYPRPCIITCIKRLTDDLDTAARD

SEQ ID NO: 3072293 - protein, 18 aa, Giardia lamblia
GHTFKLRFPNCSHQVSGP

SEQ ID NO: 3072294 - protein, 19 aa, Giardia lamblia
GHVECVQILAKLEANIVTP

SEQ ID NO: 3072295 - protein, 17 aa, Giardia lamblia
GHVFLLINLSGVLLSAA

SEQ ID NO: 3072296 - protein, 23 aa, Giardia lamblia
GIAEKSWLLKLLFLGTALASSSL

SEQ ID NO: 3072297 - protein, 21 aa, Giardia lamblia
GIAFCRTCLAPLISGPGHCTS

SEQ ID NO: 3072298 - protein, 17 aa, Giardia lamblia
GIASVVVAFAFTTGTYA

SEQ ID NO: 3072299 - protein, 27 aa, Giardia lamblia
GIAVYWLVPLFIRWKVPEIAAHSRIPH

SEQ ID NO: 3072300 - protein, 18 aa, Giardia lamblia
GICRCKCGSGTYLDTGTS

SEQ ID NO: 3072301 - protein, 17 aa, Giardia lamblia
GICSPCIENCLLCTDGA

SEQ ID NO: 3072302 - protein, 19 aa, Giardia lamblia
GICTCPHLSFAGSDCGIAN

SEQ ID NO: 3072303 - protein, 18 aa, Giardia lamblia
GICYQKAKCLKSHAKAPY

SEQ ID NO: 3072304 - protein, 24 aa, Giardia lamblia
GIDLLCITPGWFMTVFSNCLKFSV

SEQ ID NO: 3072305 - protein, 17 aa, Giardia lamblia
GIFCCIWFVAVSILIPF

SEQ ID NO: 3072306 - protein, 18 aa, Giardia lamblia
GIFLMGWITDAFIIPFMV

SEQ ID NO: 3072307 - protein, 21 aa, Giardia lamblia
GIFSCFSIYKFMMTRVARSAK

SEQ ID NO: 3072308 - protein, 24 aa, Giardia lamblia
GIHKASKVLFLLERILGPQDDEEL

SEQ ID NO: 3072309 - protein, 27 aa, Giardia lamblia
GIIFILLLRRYRMITPQVKRLSNMVTS

SEQ ID NO: 3072310 - protein, 17 aa, Giardia lamblia
GIIPEIEGMVFVRTLDE

SEQ ID NO: 3072311 - protein, 23 aa, Giardia lamblia
GIISIQAIRVIGLYLCVCTTGYI

SEQ ID NO: 3072312 - protein, 18 aa, Giardia lamblia
GIISTAVLLLEYLKTSVF

SEQ ID NO: 3072313 - protein, 22 aa, Giardia lamblia
GIKCSSCNSGFVFVQAEEDSQG

SEQ ID NO: 3072314 - protein, 24 aa, Giardia lamblia
GIKTFEILNNIVLDFVQVLEHLLE

SEQ ID NO: 3072315 - protein, 18 aa, Giardia lamblia
GIKVLRPVIHSYLPAKLG

SEQ ID NO: 3072316 - protein, 23 aa, Giardia lamblia
GILDRVNLLLIHRTPRDRTAEDR

SEQ ID NO: 3072317 - protein, 19 aa, Giardia lamblia
GILPAYLLSISPRTRQAVV

SEQ ID NO: 3072318 - protein, 23 aa, Giardia lamblia
GILPEIDRIAACKMLSRLPECCW

SEQ ID NO: 3072319 - protein, 19 aa, Giardia lamblia
GILPLPSICNSIIIDKNSS

SEQ ID NO: 3072320 - protein, 17 aa, Giardia lamblia
GILPVCVPKVCLDPETL

SEQ ID NO: 3072321 - protein, 21 aa, Giardia lamblia
GINAVFCSCKMTFKLTSSEEH

SEQ ID NO: 3072322 - protein, 24 aa, Giardia lamblia
GINVATGCFVGFALIAGATSASVL

SEQ ID NO: 3072323 - protein, 22 aa, Giardia lamblia
GIRDMVFIYSFVFYACSELLSC

SEQ ID NO: 3072324 - protein, 18 aa, Giardia lamblia
GIRTRARTLLSVYELLWK

SEQ ID NO: 3072325 - protein, 18 aa, Giardia lamblia
GISDKIIFTIDWKQLRPR

SEQ ID NO: 3072326 - protein, 25 aa, Giardia lamblia
GISELERFAFKYSYPNHELLDVNDY

SEQ ID NO: 3072327 - protein, 18 aa, Giardia lamblia
GISRTCTQLTLNEEYSIN

SEQ ID NO: 3072328 - protein, 17 aa, Giardia lamblia
GISTLFLTLEPAASVAH

SEQ ID NO: 3072329 - protein, 18 aa, Giardia lamblia
GITRYPADRSFEPSPGHR

SEQ ID NO: 3072330 - protein, 19 aa, Giardia lamblia
GIVELSNLFIRPEALDMLQ

SEQ ID NO: 3072331 - protein, 18 aa, Giardia lamblia
GIVGLCLSAHIDSSLANI

SEQ ID NO: 3072332 - protein, 28 aa, Giardia lamblia
GIVIPIPLGIKMLYFLLSQFPMTILSYN

SEQ ID NO: 3072333 - protein, 18 aa, Giardia lamblia
GIVLKDLQSLVLFDPSAY

SEQ ID NO: 3072334 - protein, 29 aa, Giardia lamblia
GIVQHKYRLLVMWSICFTQICLAPYLLDQ

SEQ ID NO: 3072335 - protein, 20 aa, Giardia lamblia
GIVRRCPYIIRSLSLHIARA

SEQ ID NO: 3072336 - protein, 18 aa, Giardia lamblia
GIVVCIAISPVLVTLLNS

SEQ ID NO: 3072337 - protein, 17 aa, Giardia lamblia
GIYGRVGSLALVASQDI

SEQ ID NO: 3072338 - protein, 18 aa, Giardia lamblia
GIYKQGNCSRCIICDPDA

SEQ ID NO: 3072339 - protein, 22 aa, Giardia lamblia
GKALACQRLRDIVCSFRNKVIL

SEQ ID NO: 3072340 - protein, 21 aa, Giardia lamblia
GKAQIPLTIFFINDSINPLLP

SEQ ID NO: 3072341 - protein, 17 aa, Giardia lamblia
GKCGGEYFLFMGGCYGI

SEQ ID NO: 3072342 - protein, 18 aa, Giardia lamblia
GKCGVCFDGYAPNTSGIC

SEQ ID NO: 3072343 - protein, 18 aa, Giardia lamblia
GKCLSTGCAQGYYYHSYA

SEQ ID NO: 3072344 - protein, 19 aa, Giardia lamblia
GKCLSTGCAQGYYYHSYAK

SEQ ID NO: 3072345 - protein, 20 aa, Giardia lamblia
GKCRSCLAISGGCKSCVYGL

SEQ ID NO: 3072346 - protein, 25 aa, Giardia lamblia
GKCVPCPKGTWGPRCSTRKCWFTTR

SEQ ID NO: 3072347 - protein, 23 aa, Giardia lamblia
GKDAEIARLTLLLDSPSKAKLVV

SEQ ID NO: 3072348 - protein, 33 aa, Giardia lamblia
GKDLFSYCRLPDILARDGIHSWVPEEVDSPVDP

SEQ ID NO: 3072349 - protein, 23 aa, Giardia lamblia
GKEPAEVFVDGWRPDLSGITDGF

SEQ ID NO: 3072350 - protein, 19 aa, Giardia lamblia
GKFLVPELVSFTRRHGPAL

SEQ ID NO: 3072351 - protein, 22 aa, Giardia lamblia
GKGCQKGVQFIQALKDVSLLFT

SEQ ID NO: 3072352 - protein, 18 aa, Giardia lamblia
GKHKYLIGLDLVKQLSDI

SEQ ID NO: 3072353 - protein, 20 aa, Giardia lamblia
GKHPIMARLQFPASANQLNI

SEQ ID NO: 3072354 - protein, 23 aa, Giardia lamblia
GKIALIIPLGWGIKGLTQEQKVR

SEQ ID NO: 3072355 - protein, 20 aa, Giardia lamblia
GKIPGCLVASPIYEGSCEFC

SEQ ID NO: 3072356 - protein, 18 aa, Giardia lamblia
GKISPSLMTSFITQSPGI

SEQ ID NO: 3072357 - protein, 24 aa, Giardia lamblia
GKITCPKHLLANIERFEERLKEQR

SEQ ID NO: 3072358 - protein, 21 aa, Giardia lamblia
GKKFACKEIFLPKLPEDLVDA

SEQ ID NO: 3072359 - protein, 25 aa, Giardia lamblia
GKKSNEFMLQILLRPSYSLQAKYLL

SEQ ID NO: 3072360 - protein, 18 aa, Giardia lamblia
GKLAGLRAKNSFSKLHYF

SEQ ID NO: 3072361 - protein, 21 aa, Giardia lamblia
GKLDSWLGLMVDGSSAPLWSE

SEQ ID NO: 3072362 - protein, 19 aa, Giardia lamblia
GKLHPNFMYNPLNLAESED

SEQ ID NO: 3072363 - protein, 25 aa, Giardia lamblia
GKLIHAFLQLCDFARDTSQAHDSSE

SEQ ID NO: 3072364 - protein, 20 aa, Giardia lamblia
GKLLYEVIGTYLFAITSPLG

SEQ ID NO: 3072365 - protein, 19 aa, Giardia lamblia
GKLPSMKAYAGEINNIMIP

SEQ ID NO: 3072366 - protein, 20 aa, Giardia lamblia
GKLRICCFDKTGTLCDCEVK

SEQ ID NO: 3072367 - protein, 20 aa, Giardia lamblia
GKLRPIVFHTSSSAFSNSIY

SEQ ID NO: 3072368 - protein, 18 aa, Giardia lamblia
GKMKRWILWLQNLAINNI

SEQ ID NO: 3072369 - protein, 25 aa, Giardia lamblia
GKMVDIWALGALLFEMLVGSAPFSY

SEQ ID NO: 3072370 - protein, 20 aa, Giardia lamblia
GKPLSVLVCEYMDYQIHSLS

SEQ ID NO: 3072371 - protein, 23 aa, Giardia lamblia
GKPNCLPCDTNIFYVHTNMSLIA

SEQ ID NO: 3072372 - protein, 28 aa, Giardia lamblia
GKPPTILSGRSLLKFELLATQDPANPSE

SEQ ID NO: 3072373 - protein, 25 aa, Giardia lamblia
GKRACSLQQRDPCSNLRTINRTRLR

SEQ ID NO: 3072374 - protein, 26 aa, Giardia lamblia
GKRGKIVVPLGYDYSEQLLVSALLAY

SEQ ID NO: 3072375 - protein, 22 aa, Giardia lamblia
GKRGLRLLPFVFSLIADVLLQI

SEQ ID NO: 3072376 - protein, 20 aa, Giardia lamblia
GKSELKAIMNLAETTTATSE

SEQ ID NO: 3072377 - protein, 18 aa, Giardia lamblia
GKSSILRTLADVVRQPLV

SEQ ID NO: 3072378 - protein, 17 aa, Giardia lamblia
GKTALMHAAEKGDVCEA

SEQ ID NO: 3072379 - protein, 20 aa, Giardia lamblia
GKTDMCLDDPNYAFNSREMD

SEQ ID NO: 3072380 - protein, 17 aa, Giardia lamblia
GKVDLLKTQARDMEKRL

SEQ ID NO: 3072381 - protein, 24 aa, Giardia lamblia
GKVELRLKSLFDLLEIKNKDVFNA

SEQ ID NO: 3072382 - protein, 24 aa, Giardia lamblia
GKVKNDMVSLIFAGRYIILLMSIF

SEQ ID NO: 3072383 - protein, 17 aa, Giardia lamblia
GKVLLAIIMQLSRTIPA

SEQ ID NO: 3072384 - protein, 22 aa, Giardia lamblia
GKVSSLTRLYVPIINRPYSVVG

SEQ ID NO: 3072385 - protein, 18 aa, Giardia lamblia
GKVTDGLCTLVHDDFLAI

SEQ ID NO: 3072386 - protein, 23 aa, Giardia lamblia
GKYKHFVDACARARQHYAKLLFY

SEQ ID NO: 3072387 - protein, 24 aa, Giardia lamblia
GKYPLVYPRVCIKANFYRQDETID

SEQ ID NO: 3072388 - protein, 19 aa, Giardia lamblia
GKYREWLQHIDVLHWSIEQ

SEQ ID NO: 3072389 - protein, 18 aa, Giardia lamblia
GLAAAFAYIPIFHVAFLT

SEQ ID NO: 3072390 - protein, 22 aa, Giardia lamblia
GLAAKGVKGFFRGLGQGLVGSI

SEQ ID NO: 3072391 - protein, 18 aa, Giardia lamblia
GLAGRVVSFAVYVNDMTY

SEQ ID NO: 3072392 - protein, 18 aa, Giardia lamblia
GLAIRFNTIKGSSCNALL

SEQ ID NO: 3072393 - protein, 19 aa, Giardia lamblia
GLALKNALLSAGVPVSEAN

SEQ ID NO: 3072394 - protein, 23 aa, Giardia lamblia
GLASFLIRMAIKEFPTFGYPLYW

SEQ ID NO: 3072395 - protein, 23 aa, Giardia lamblia
GLCARCPRGGFMLDTSRNECVPC

SEQ ID NO: 3072396 - protein, 18 aa, Giardia lamblia
GLCGGPGAGFLSGSGSCV

SEQ ID NO: 3072397 - protein, 18 aa, Giardia lamblia
GLCVSCYKTHLLYHSGCY

SEQ ID NO: 3072398 - protein, 22 aa, Giardia lamblia
GLDKCLSFFITVLKDIGPRILT

SEQ ID NO: 3072399 - protein, 21 aa, Giardia lamblia
GLDLYFVGLITFIGSLAAIPT

SEQ ID NO: 3072400 - protein, 18 aa, Giardia lamblia
GLDPLTCRSLHDYIRYVA

SEQ ID NO: 3072401 - protein, 27 aa, Giardia lamblia
GLEGARRLLTLKGFERMLRKRRIGYYY

SEQ ID NO: 3072402 - protein, 17 aa, Giardia lamblia
GLESMYKSLPWYNKKTN

SEQ ID NO: 3072403 - protein, 24 aa, Giardia lamblia
GLFLFCVHVTLRLRTYTSSRIMQL

SEQ ID NO: 3072404 - protein, 21 aa, Giardia lamblia
GLFREAWVWIVINLVAQLLTA

SEQ ID NO: 3072405 - protein, 21 aa, Giardia lamblia
GLGAVSARKKSGCWRRTTTCY

SEQ ID NO: 3072406 - protein, 25 aa, Giardia lamblia
GLGCVALTWLLFVSVLRRSSPSTLL

SEQ ID NO: 3072407 - protein, 23 aa, Giardia lamblia
GLGEYGIDVEFQWKDRSIVNPSF

SEQ ID NO: 3072408 - protein, 18 aa, Giardia lamblia
GLGLCKDALWSGSTLMGI

SEQ ID NO: 3072409 - protein, 24 aa, Giardia lamblia
GLGNACCTEGEILAYIGDIVHQVE

SEQ ID NO: 3072410 - protein, 24 aa, Giardia lamblia
GLGSLPMGFLFFFSYIPMLQGNYT

SEQ ID NO: 3072411 - protein, 21 aa, Giardia lamblia
GLGYQCVGLTLPFYLTDLSAT

SEQ ID NO: 3072412 - protein, 18 aa, Giardia lamblia
GLHQARQAIAIIPQEPFL

SEQ ID NO: 3072413 - protein, 25 aa, Giardia lamblia
GLIAFAIAMPLSFYITSMQGRITSL

SEQ ID NO: 3072414 - protein, 21 aa, Giardia lamblia
GLIGFLSWRFCCKNKKPKHPL

SEQ ID NO: 3072415 - protein, 18 aa, Giardia lamblia
GLIGNLYLECGFAGAGTC

SEQ ID NO: 3072416 - protein, 23 aa, Giardia lamblia
GLKACVTEACKLNKTLAGPEAPE

SEQ ID NO: 3072417 - protein, 20 aa, Giardia lamblia
GLKALKAWLKDSLEHCHQLK

SEQ ID NO: 3072418 - protein, 22 aa, Giardia lamblia
GLKDSFGNTALILAVKNNSYIY

SEQ ID NO: 3072419 - protein, 19 aa, Giardia lamblia
GLKELFIDLFYYMLHYCTM

SEQ ID NO: 3072420 - protein, 33 aa, Giardia lamblia
GLKKLPTTALHRWAFEQVFSWNWSQPFDAVKTP

SEQ ID NO: 3072421 - protein, 22 aa, Giardia lamblia
GLKKRLLKNLSEEYLLSLTAVK

SEQ ID NO: 3072422 - protein, 23 aa, Giardia lamblia
GLKSVMAAICTTFPPVAVIKNRF

SEQ ID NO: 3072423 - protein, 19 aa, Giardia lamblia
GLLCRSLQTTMDWASVSSE

SEQ ID NO: 3072424 - protein, 24 aa, Giardia lamblia
GLLGCSRPLIHLLETAMVQKKADS

SEQ ID NO: 3072425 - protein, 17 aa, Giardia lamblia
GLLNHIFYSPRLALNAT

SEQ ID NO: 3072426 - protein, 27 aa, Giardia lamblia
GLLSEEILRLILLIIYNQIVFVFSLNY

SEQ ID NO: 3072427 - protein, 27 aa, Giardia lamblia
GLLSVFEYWTRIGIKGYPPAVALAPDF

SEQ ID NO: 3072428 - protein, 25 aa, Giardia lamblia
GLLWARAVGLPAILTEHSMARGDVF

SEQ ID NO: 3072429 - protein, 20 aa, Giardia lamblia
GLMLLAFLSTCFKKVLVAKE

SEQ ID NO: 3072430 - protein, 18 aa, Giardia lamblia
GLMSLILATHYLKQGFDI

SEQ ID NO: 3072431 - protein, 18 aa, Giardia lamblia
GLMTDAASVVSLPQRTPS

SEQ ID NO: 3072432 - protein, 19 aa, Giardia lamblia
GLNGLKLNTPVAWVPTILL

SEQ ID NO: 3072433 - protein, 20 aa, Giardia lamblia
GLNRSRFGADYELFYIPELS

SEQ ID NO: 3072434 - protein, 23 aa, Giardia lamblia
GLNVRTRIALELVLLPFKTLIAI

SEQ ID NO: 3072435 - protein, 24 aa, Giardia lamblia
GLPLAVTISLAFSMKKMMRDQCLV

SEQ ID NO: 3072436 - protein, 23 aa, Giardia lamblia
GLPLRITIHAIRKLMLNIQEGAI

SEQ ID NO: 3072437 - protein, 19 aa, Giardia lamblia
GLQPWDWVWTFPITSGEDK

SEQ ID NO: 3072438 - protein, 22 aa, Giardia lamblia
GLRAPQELFLLSGMLNDMRLHR

SEQ ID NO: 3072439 - protein, 27 aa, Giardia lamblia
GLRDKCGRTALIYAIECRNRRVIPFLL

SEQ ID NO: 3072440 - protein, 27 aa, Giardia lamblia
GLRVGVCTGVAFGSLLGSKQFRFDVFG

SEQ ID NO: 3072441 - protein, 19 aa, Giardia lamblia
GLSAIVFSDEHPRYVSRAT

SEQ ID NO: 3072442 - protein, 19 aa, Giardia lamblia
GLSDLPGVFQLDGDQISTV

SEQ ID NO: 3072443 - protein, 22 aa, Giardia lamblia
GLSDYRGITGLMRASLHGFTTI

SEQ ID NO: 3072444 - protein, 24 aa, Giardia lamblia
GLSLCFPSTFLSTAIMMGPMTLGA

SEQ ID NO: 3072445 - protein, 26 aa, Giardia lamblia
GLSQIPNRRFALWWSPTINRSSVYIG

SEQ ID NO: 3072446 - protein, 20 aa, Giardia lamblia
GLSSRYPITIVYTIGLVGIM

SEQ ID NO: 3072447 - protein, 17 aa, Giardia lamblia
GLSVSLKTKQMVLACLR

SEQ ID NO: 3072448 - protein, 27 aa, Giardia lamblia
GLTALMLRAGTRGCRCVDQSLLEAESG

SEQ ID NO: 3072449 - protein, 23 aa, Giardia lamblia
GLTALQIAATFGRNYVLDSVCKT

SEQ ID NO: 3072450 - protein, 28 aa, Giardia lamblia
GLTGYEVVDGFCLPAACIFEVTASDDTK

SEQ ID NO: 3072451 - protein, 19 aa, Giardia lamblia
GLTKGMCKLFYSYPDATAL

SEQ ID NO: 3072452 - protein, 26 aa, Giardia lamblia
GLVDLLLKFIFVFAISSTDDKLCQVI

SEQ ID NO: 3072453 - protein, 18 aa, Giardia lamblia
GLVKDLNKIVGFSGLTGF

SEQ ID NO: 3072454 - protein, 17 aa, Giardia lamblia
GLVKSSLLERLETLGLF

SEQ ID NO: 3072455 - protein, 28 aa, Giardia lamblia
GLVPLIFWAVCKCIGFTELRYTVISCLY

SEQ ID NO: 3072456 - protein, 22 aa, Giardia lamblia
GLVSFLLRWLLCRRTQSHETKR

SEQ ID NO: 3072457 - protein, 17 aa, Giardia lamblia
GLYGSSCSESFCGSNCN

SEQ ID NO: 3072458 - protein, 20 aa, Giardia lamblia
GLYLYTCFSNMALLYNCTFG

SEQ ID NO: 3072459 - protein, 19 aa, Giardia lamblia
GLYSSGAFEAACMYSALNC

SEQ ID NO: 3072460 - protein, 22 aa, Giardia lamblia
GMCASCAMTHILYMGGCYNPAA

SEQ ID NO: 3072461 - protein, 25 aa, Giardia lamblia
GMEHALVYMCVQFFILSFWSFCYSI

SEQ ID NO: 3072462 - protein, 19 aa, Giardia lamblia
GMGTWMCLALLLQSRGMRF

SEQ ID NO: 3072463 - protein, 27 aa, Giardia lamblia
GMKRRTCLAMALAGRPSLFLLDEVTSG

SEQ ID NO: 3072464 - protein, 24 aa, Giardia lamblia
GMLFMLLLILGYRAGLDAFIRSAN

SEQ ID NO: 3072465 - protein, 25 aa, Giardia lamblia
GMLPCTGIALSEVEFLVSRVMSAGL

SEQ ID NO: 3072466 - protein, 18 aa, Giardia lamblia
GMLPSVWKRAVIASDSST

SEQ ID NO: 3072467 - protein, 25 aa, Giardia lamblia
GMLRVEFGCPMFKMVHVKKKFTSTA

SEQ ID NO: 3072468 - protein, 23 aa, Giardia lamblia
GMLSCTFFGIALVIVAFFMGVLK

SEQ ID NO: 3072469 - protein, 18 aa, Giardia lamblia
GMPPDYIIAAAFGECKYG

SEQ ID NO: 3072470 - protein, 19 aa, Giardia lamblia
GMPPKSVYVNTWRPDLTKI

SEQ ID NO: 3072471 - protein, 17 aa, Giardia lamblia
GNAFIPLATTVRNDAAY

SEQ ID NO: 3072472 - protein, 18 aa, Giardia lamblia
GNCTKCLDGYFKVTRAKF

SEQ ID NO: 3072473 - protein, 24 aa, Giardia lamblia
GNDMCLAHHLFVNKLPCNWPVSMT

SEQ ID NO: 3072474 - protein, 25 aa, Giardia lamblia
GNDMLDLVLIRFFLALHTYSQECGG

SEQ ID NO: 3072475 - protein, 17 aa, Giardia lamblia
GNFFGANVLNPWNFSPP

SEQ ID NO: 3072476 - protein, 23 aa, Giardia lamblia
GNGGLKKRCKPLAYVDRRSQSIE

SEQ ID NO: 3072477 - protein, 18 aa, Giardia lamblia
GNGSCTRSGDSYFCTCKS

SEQ ID NO: 3072478 - protein, 19 aa, Giardia lamblia
GNGSCTRSGDSYFCTCKSG

SEQ ID NO: 3072479 - protein, 21 aa, Giardia lamblia
GNGYALKGVRLYENDTVAALY

SEQ ID NO: 3072480 - protein, 18 aa, Giardia lamblia
GNIGEYIPIFIASSQLSG

SEQ ID NO: 3072481 - protein, 17 aa, Giardia lamblia
GNINFGINRIIKGLEPV

SEQ ID NO: 3072482 - protein, 17 aa, Giardia lamblia
GNISARMTTLSSSDGKL

SEQ ID NO: 3072483 - protein, 26 aa, Giardia lamblia
GNKFLARLRALILIFNHIDITRVNKL

SEQ ID NO: 3072484 - protein, 22 aa, Giardia lamblia
GNLELCKACVHEAGVVTKANDS

SEQ ID NO: 3072485 - protein, 20 aa, Giardia lamblia
GNLLDRRTRSLLFLDKYSFE

SEQ ID NO: 3072486 - protein, 33 aa, Giardia lamblia
GNLLPLHPCVRIWRRFTRWLLIYLTGHPRRGKG

SEQ ID NO: 3072487 - protein, 25 aa, Giardia lamblia
GNLSPFISGYIFPYSNPFITRLKHF

SEQ ID NO: 3072488 - protein, 28 aa, Giardia lamblia
GNMIRGFCNTCTMMLPYISSAYITTAYL

SEQ ID NO: 3072489 - protein, 18 aa, Giardia lamblia
GNMPCRLIGILVAGFAAY

SEQ ID NO: 3072490 - protein, 24 aa, Giardia lamblia
GNPLRAIMIAGVYWAANEVTYKGV

SEQ ID NO: 3072491 - protein, 19 aa, Giardia lamblia
GNQGRRAATVLSYSLYGDS

SEQ ID NO: 3072492 - protein, 24 aa, Giardia lamblia
GNQRTRAPLIRKRRSYDGPARITL

SEQ ID NO: 3072493 - protein, 17 aa, Giardia lamblia
GNRSVRSAFVITLCAQV

SEQ ID NO: 3072494 - protein, 23 aa, Giardia lamblia
GNSCKKFLGCTGVIIDDGGECAE

SEQ ID NO: 3072495 - protein, 17 aa, Giardia lamblia
GNSERGCRCECAEKSYK

SEQ ID NO: 3072496 - protein, 17 aa, Giardia lamblia
GNSIGRFGAALMAGELY

SEQ ID NO: 3072497 - protein, 24 aa, Giardia lamblia
GNTEGKLECFATYSFATIIPTPIR

SEQ ID NO: 3072498 - protein, 23 aa, Giardia lamblia
GNTQRALRLCRFLDQKPLWAQMA

SEQ ID NO: 3072499 - protein, 31 aa, Giardia lamblia
GNVCSAAGCTRCTKGYFLHYGSCFNISTDSA

SEQ ID NO: 3072500 - protein, 25 aa, Giardia lamblia
GNVGFGSFPTHWIINVSTYGPILGD

SEQ ID NO: 3072501 - protein, 20 aa, Giardia lamblia
GNVRITFRMGLYSYSLLSTC

SEQ ID NO: 3072502 - protein, 25 aa, Giardia lamblia
GNYPYKRLTLRLRFNTTSIVQRAKE

SEQ ID NO: 3072503 - protein, 19 aa, Giardia lamblia
GNYSFLLARKILFKITPHS

SEQ ID NO: 3072504 - protein, 20 aa, Giardia lamblia
GPALCKDCLPGYKALSTGTE

SEQ ID NO: 3072505 - protein, 18 aa, Giardia lamblia
GPCVKDAKKGRCTACRGS

SEQ ID NO: 3072506 - protein, 17 aa, Giardia lamblia
GPDCGKNPCGIIYHSIG

SEQ ID NO: 3072507 - protein, 23 aa, Giardia lamblia
GPDFSVLIFIVFKDKVVIKACGT

SEQ ID NO: 3072508 - protein, 18 aa, Giardia lamblia
GPFDHQVCVWCNEEKQCK

SEQ ID NO: 3072509 - protein, 19 aa, Giardia lamblia
GPGASDCLSCPLGDPIAGT

SEQ ID NO: 3072510 - protein, 22 aa, Giardia lamblia
GPGYVSTCFFMDQEMPFYPTRL

SEQ ID NO: 3072511 - protein, 20 aa, Giardia lamblia
GPIIYTRILSIAAVCLYIAS

SEQ ID NO: 3072512 - protein, 26 aa, Giardia lamblia
GPILSIFCVMVFSLPAWVDPGYLPRS

SEQ ID NO: 3072513 - protein, 19 aa, Giardia lamblia
GPKKADWLNLKKLLILDLP

SEQ ID NO: 3072514 - protein, 22 aa, Giardia lamblia
GPKYRLALSLILIILGVFYSVS

SEQ ID NO: 3072515 - protein, 18 aa, Giardia lamblia
GPLEKWKDLLNLLPTKSY

SEQ ID NO: 3072516 - protein, 24 aa, Giardia lamblia
GPLGLPREWPLVAGAPEGTTTNGT

SEQ ID NO: 3072517 - protein, 25 aa, Giardia lamblia
GPLIAARLLFYPFITSIWGNCVQFE

SEQ ID NO: 3072518 - protein, 17 aa, Giardia lamblia
GPLIIGKNAPFWRRSTG

SEQ ID NO: 3072519 - protein, 17 aa, Giardia lamblia
GPLMLLAIYVLRRLGPY

SEQ ID NO: 3072520 - protein, 19 aa, Giardia lamblia
GPLQSFFMRYIKRHNITAL

SEQ ID NO: 3072521 - protein, 17 aa, Giardia lamblia
GPLVTGMKQGHWVILDE

SEQ ID NO: 3072522 - protein, 26 aa, Giardia lamblia
GPMYEVPAALILLEVIRALQIQSLSQ

SEQ ID NO: 3072523 - protein, 27 aa, Giardia lamblia
GPNACAACGLGMCLQCTPGSPSSPSTN

SEQ ID NO: 3072524 - protein, 21 aa, Giardia lamblia
GPPDRDANCSNCSQPSIKSAS

SEQ ID NO: 3072525 - protein, 25 aa, Giardia lamblia
GPQQRLCAALALLHERAPSIVQQYH

SEQ ID NO: 3072526 - protein, 17 aa, Giardia lamblia
GPQSLGIILHKDSLLAS

SEQ ID NO: 3072527 - protein, 19 aa, Giardia lamblia
GPSASGRTALLSHLASKLG

SEQ ID NO: 3072528 - protein, 18 aa, Giardia lamblia
GPSHFDCLTCRVGELESS

SEQ ID NO: 3072529 - protein, 20 aa, Giardia lamblia
GPTMSLMACMNIPVMDGISN

SEQ ID NO: 3072530 - protein, 29 aa, Giardia lamblia
GPWTNSCLEDMLPNFINFEEFLTGYTHEL

SEQ ID NO: 3072531 - protein, 18 aa, Giardia lamblia
GPYAFYKLSGSLALLLKR

SEQ ID NO: 3072532 - protein, 25 aa, Giardia lamblia
GPYLICVPIKALIQGAATPVTLSLT

SEQ ID NO: 3072533 - protein, 31 aa, Giardia lamblia
GPYLYLGCDPTIWKRLYDAIQRSAHKAAFNS

SEQ ID NO: 3072534 - protein, 20 aa, Giardia lamblia
GQAFPTGGLAWILASPYSLR

SEQ ID NO: 3072535 - protein, 20 aa, Giardia lamblia
GQAIPAYALDYNRPDSIVEK

SEQ ID NO: 3072536 - protein, 19 aa, Giardia lamblia
GQALFFFHAKTVFPISEQV

SEQ ID NO: 3072537 - protein, 19 aa, Giardia lamblia
GQANCNFDVWGDVVNMAAR

SEQ ID NO: 3072538 - protein, 24 aa, Giardia lamblia
GQCVCLMCGAKINIEQPVIITEDT

SEQ ID NO: 3072539 - protein, 23 aa, Giardia lamblia
GQCVCSQGAVLFRGTCREGLCKN

SEQ ID NO: 3072540 - protein, 23 aa, Giardia lamblia
GQFGVGFYSAYLVAEKVEVITKH

SEQ ID NO: 3072541 - protein, 19 aa, Giardia lamblia
GQIIRPVEIVTVFAESCSD

SEQ ID NO: 3072542 - protein, 18 aa, Giardia lamblia
GQKIPMKVILYRNEYSNV

SEQ ID NO: 3072543 - protein, 24 aa, Giardia lamblia
GQKKWIVGGFCGLVANSQILNTYA

SEQ ID NO: 3072544 - protein, 22 aa, Giardia lamblia
GQKRRLSVAIALTGSPSVLYLD

SEQ ID NO: 3072545 - protein, 19 aa, Giardia lamblia
GQKRWGRKGDCEREHHIDH

SEQ ID NO: 3072546 - protein, 17 aa, Giardia lamblia
GQLDGAYAFATYVPLLK

SEQ ID NO: 3072547 - protein, 17 aa, Giardia lamblia
GQLWRLVTSFLYFGDFS

SEQ ID NO: 3072548 - protein, 25 aa, Giardia lamblia
GQPSMEFISFTLPDMYSTELKKFIE

SEQ ID NO: 3072549 - protein, 18 aa, Giardia lamblia
GQTDVCSVVQVFTLNYSS

SEQ ID NO: 3072550 - protein, 18 aa, Giardia lamblia
GQTPRSSVYLVRRSDGAV

SEQ ID NO: 3072551 - protein, 20 aa, Giardia lamblia
GQTSLMLAVLRRNAPLVTVL

SEQ ID NO: 3072552 - protein, 18 aa, Giardia lamblia
GQTTTGWTALMFAAAGGF

SEQ ID NO: 3072553 - protein, 24 aa, Giardia lamblia
GQVISRIMTCISYAYVQASTAVIK

SEQ ID NO: 3072554 - protein, 20 aa, Giardia lamblia
GQVVLFILMIYKLARMLSFN

SEQ ID NO: 3072555 - protein, 19 aa, Giardia lamblia
GQYALRYLWLNGTSAVQAL

SEQ ID NO: 3072556 - protein, 23 aa, Giardia lamblia
GQYREAAAISILYLNHFVNENPE

SEQ ID NO: 3072557 - protein, 27 aa, Giardia lamblia
GRAIFLVMFLCCLLLSLLLTSVVYLIT

SEQ ID NO: 3072558 - protein, 19 aa, Giardia lamblia
GRAPKRVACRRKNDLTDIY

SEQ ID NO: 3072559 - protein, 24 aa, Giardia lamblia
GRAYYCATHLLTLGSHSIFGSGNV

SEQ ID NO: 3072560 - protein, 17 aa, Giardia lamblia
GRCLGCETGYYVSETHT

SEQ ID NO: 3072561 - protein, 18 aa, Giardia lamblia
GRCTACRGSYFLYQGGCY

SEQ ID NO: 3072562 - protein, 20 aa, Giardia lamblia
GRCVCLLGYSISFNGLTCVK

SEQ ID NO: 3072563 - protein, 27 aa, Giardia lamblia
GRDFYLLYFKRFIKSSIISNLGQRNVF

SEQ ID NO: 3072564 - protein, 18 aa, Giardia lamblia
GRFASLLTTFIGKLTMIT

SEQ ID NO: 3072565 - protein, 20 aa, Giardia lamblia
GRFIDFSKAITFVDPKDSLT

SEQ ID NO: 3072566 - protein, 25 aa, Giardia lamblia
GRFLAVVAYLLRLSGDSDYCGPSPS

SEQ ID NO: 3072567 - protein, 23 aa, Giardia lamblia
GRFPEPLAVFYLAQIVLVIEYLH

SEQ ID NO: 3072568 - protein, 22 aa, Giardia lamblia
GRIECVGALAPYEAKAHGVRAA

SEQ ID NO: 3072569 - protein, 17 aa, Giardia lamblia
GRIGPECISMRCLATTR

SEQ ID NO: 3072570 - protein, 18 aa, Giardia lamblia
GRIHPLKLPWIGHNNVVY

SEQ ID NO: 3072571 - protein, 19 aa, Giardia lamblia
GRILFFVRPVKRNVQIANA

SEQ ID NO: 3072572 - protein, 29 aa, Giardia lamblia
GRISASDMVKWARRIDLDLKNGGAVLNKA

SEQ ID NO: 3072573 - protein, 19 aa, Giardia lamblia
GRISYPKTIGFVSQYNTLW

SEQ ID NO: 3072574 - protein, 17 aa, Giardia lamblia
GRIYSMAALSLVSPEID

SEQ ID NO: 3072575 - protein, 24 aa, Giardia lamblia
GRLDRFGRSALFIAAQNGNAHIVK

SEQ ID NO: 3072576 - protein, 21 aa, Giardia lamblia
GRLIMSNAFGCRLNQNIITNI

SEQ ID NO: 3072577 - protein, 17 aa, Giardia lamblia
GRLLFAVDLAIANGHTI

SEQ ID NO: 3072578 - protein, 20 aa, Giardia lamblia
GRLLYSFLRALLLQKNQRSD

SEQ ID NO: 3072579 - protein, 23 aa, Giardia lamblia
GRLPSMRLVFPFLAISSPFSKFA

SEQ ID NO: 3072580 - protein, 17 aa, Giardia lamblia
GRLSWADGQSFYTIDNI

SEQ ID NO: 3072581 - protein, 18 aa, Giardia lamblia
GRLTKKCTGYINSIVQST

SEQ ID NO: 3072582 - protein, 19 aa, Giardia lamblia
GRNILFWIGCGTVLISTTC

SEQ ID NO: 3072583 - protein, 21 aa, Giardia lamblia
GRNVMKLFLLHPVSGDRRRAL

SEQ ID NO: 3072584 - protein, 19 aa, Giardia lamblia
GRPADAFICSTYCYSKCLF

SEQ ID NO: 3072585 - protein, 18 aa, Giardia lamblia
GRPDGLRNYIWVQQDPAT

SEQ ID NO: 3072586 - protein, 21 aa, Giardia lamblia
GRPEYSVFILVYVVHNYVFQI

SEQ ID NO: 3072587 - protein, 19 aa, Giardia lamblia
GRPICTAAFKGNANEAHTN

SEQ ID NO: 3072588 - protein, 27 aa, Giardia lamblia
GRQELPENLKALFRSVAMICSQVVWCV

SEQ ID NO: 3072589 - protein, 24 aa, Giardia lamblia
GRRTARFSQRFAFDDDLEPDLQQS

SEQ ID NO: 3072590 - protein, 24 aa, Giardia lamblia
GRSCNIPAFVFVQQLLGYVWEVYP

SEQ ID NO: 3072591 - protein, 18 aa, Giardia lamblia
GRSIFRNRILDTLKSSIV

SEQ ID NO: 3072592 - protein, 27 aa, Giardia lamblia
GRSMCVACDMLGCQYCRILYNDRNKSI

SEQ ID NO: 3072593 - protein, 20 aa, Giardia lamblia
GRSRAEECMHLQIAEDLKQE

SEQ ID NO: 3072594 - protein, 20 aa, Giardia lamblia
GRSSVYGPFMAKDTHYIVNR

SEQ ID NO: 3072595 - protein, 22 aa, Giardia lamblia
GRTEMCSLGYVDLHANGDDSGL

SEQ ID NO: 3072596 - protein, 20 aa, Giardia lamblia
GRTFSLETLVHIWKCLSIYE

SEQ ID NO: 3072597 - protein, 24 aa, Giardia lamblia
GRTTSVCLLTFYFGADRIEKQSNF

SEQ ID NO: 3072598 - protein, 20 aa, Giardia lamblia
GRVAGKYLRYTVAPIILVAG

SEQ ID NO: 3072599 - protein, 30 aa, Giardia lamblia
GRVHIPGTFCFLGYCLMPLAAYTFVAMMMA

SEQ ID NO: 3072600 - protein, 19 aa, Giardia lamblia
GRVLYKYVADLPCSASPLF

SEQ ID NO: 3072601 - protein, 18 aa, Giardia lamblia
GRYIAYGVVLNVALVACV

SEQ ID NO: 3072602 - protein, 23 aa, Giardia lamblia
GSAEGVCGWSCTGSCAGQTSCGI

SEQ ID NO: 3072603 - protein, 23 aa, Giardia lamblia
GSAPAEMPISIFANLSNYTGFLF

SEQ ID NO: 3072604 - protein, 25 aa, Giardia lamblia
GSARMRTAMNITRICYIGFVYLLYY

SEQ ID NO: 3072605 - protein, 25 aa, Giardia lamblia
GSAVVKRKLGYEVLTHVAQVAHEPL

SEQ ID NO: 3072606 - protein, 19 aa, Giardia lamblia
GSCAPCPDDSIGMNCMDRL

SEQ ID NO: 3072607 - protein, 17 aa, Giardia lamblia
GSCLVCPINCRTCSSQY

SEQ ID NO: 3072608 - protein, 26 aa, Giardia lamblia
GSCLYQCVHYALSTLVFMHLDGSPVN

SEQ ID NO: 3072609 - protein, 17 aa, Giardia lamblia
GSCSFREMLIRARHSFL

SEQ ID NO: 3072610 - protein, 19 aa, Giardia lamblia
GSDLILRLDKYGTIGSPGF

SEQ ID NO: 3072611 - protein, 17 aa, Giardia lamblia
GSECILCSDTIDRNGVM

SEQ ID NO: 3072612 - protein, 17 aa, Giardia lamblia
GSEYKVLASGDCPSDTQ

SEQ ID NO: 3072613 - protein, 21 aa, Giardia lamblia
GSFKKRGIVKVLQRLIVDGYI

SEQ ID NO: 3072614 - protein, 20 aa, Giardia lamblia
GSGITLFLAIYFTEVLARAY

SEQ ID NO: 3072615 - protein, 21 aa, Giardia lamblia
GSGKSSLLLAILGEVALSTSS

SEQ ID NO: 3072616 - protein, 20 aa, Giardia lamblia
GSGKSSLLLALLGELANTSP

SEQ ID NO: 3072617 - protein, 17 aa, Giardia lamblia
GSGPGTCVPCDDQTDGV

SEQ ID NO: 3072618 - protein, 18 aa, Giardia lamblia
GSGQPCFLTMHHEVQHTG

SEQ ID NO: 3072619 - protein, 23 aa, Giardia lamblia
GSGRKSLTRLAAFICDCDLETIE

SEQ ID NO: 3072620 - protein, 26 aa, Giardia lamblia
GSGWNELLKLLSFNTLRERMADGTDS

SEQ ID NO: 3072621 - protein, 17 aa, Giardia lamblia
GSIAGMLEAVMLSIKNG

SEQ ID NO: 3072622 - protein, 17 aa, Giardia lamblia
GSINAKLADTVKDYIEH

SEQ ID NO: 3072623 - protein, 17 aa, Giardia lamblia
GSIPATFIYRTNSFWFL

SEQ ID NO: 3072624 - protein, 20 aa, Giardia lamblia
GSIPCRTRLLYLLVSGPIIC

SEQ ID NO: 3072625 - protein, 25 aa, Giardia lamblia
GSISAPCWVNSYILIYKDYFSVSLE

SEQ ID NO: 3072626 - protein, 27 aa, Giardia lamblia
GSISVLRWILEFVVLAFLIIDIRSLKN

SEQ ID NO: 3072627 - protein, 17 aa, Giardia lamblia
GSITYLPSCCNASSLPM

SEQ ID NO: 3072628 - protein, 22 aa, Giardia lamblia
GSKARFPPRTKPLEIIILDRRA

SEQ ID NO: 3072629 - protein, 19 aa, Giardia lamblia
GSKLLPLFINMIVSHLPRV

SEQ ID NO: 3072630 - protein, 17 aa, Giardia lamblia
GSKQLLSCVCSFQGEVE

SEQ ID NO: 3072631 - protein, 23 aa, Giardia lamblia
GSKRLLMKRLFIGIFSRLFVIAL

SEQ ID NO: 3072632 - protein, 17 aa, Giardia lamblia
GSLAEPWSCAEYQITEL

SEQ ID NO: 3072633 - protein, 19 aa, Giardia lamblia
GSLCICMEGYILQDDTCVS

SEQ ID NO: 3072634 - protein, 23 aa, Giardia lamblia
GSLCNACSSDAVLIDGLCASDSC

SEQ ID NO: 3072635 - protein, 17 aa, Giardia lamblia
GSLDHLIFIPYIHVLLF

SEQ ID NO: 3072636 - protein, 17 aa, Giardia lamblia
GSLKFLVYAIRKALETM

SEQ ID NO: 3072637 - protein, 20 aa, Giardia lamblia
GSLKRFAQTLPYILHAPANV

SEQ ID NO: 3072638 - protein, 33 aa, Giardia lamblia
GSLLIELFSTASLKSTRWIIAFINTLSYFSTLR

SEQ ID NO: 3072639 - protein, 19 aa, Giardia lamblia
GSLLVKHLSVPPVIKKLRK

SEQ ID NO: 3072640 - protein, 18 aa, Giardia lamblia
GSLPLIFSQPPTYKFTPA

SEQ ID NO: 3072641 - protein, 19 aa, Giardia lamblia
GSLSATFAGAIPYSAPEKL

SEQ ID NO: 3072642 - protein, 18 aa, Giardia lamblia
GSLTVWKLAIEKKELQPI

SEQ ID NO: 3072643 - protein, 20 aa, Giardia lamblia
GSLYSWRHVEFPNLGANSTY

SEQ ID NO: 3072644 - protein, 24 aa, Giardia lamblia
GSMLCTVLACLYSRSLLSRKHTQA

SEQ ID NO: 3072645 - protein, 19 aa, Giardia lamblia
GSMQICLCYVFSRLYRSFL

SEQ ID NO: 3072646 - protein, 21 aa, Giardia lamblia
GSMRFAIAWVRVLEGMGTWMC

SEQ ID NO: 3072647 - protein, 18 aa, Giardia lamblia
GSNRACPQFVQFNPLANP

SEQ ID NO: 3072648 - protein, 20 aa, Giardia lamblia
GSNSEVFRRMSAFLASSLNI

SEQ ID NO: 3072649 - protein, 23 aa, Giardia lamblia
GSNSRSSDHWSLGRNTIGSMRSI

SEQ ID NO: 3072650 - protein, 18 aa, Giardia lamblia
GSPIDWTADMGHFVSSCN

SEQ ID NO: 3072651 - protein, 18 aa, Giardia lamblia
GSPLPCFHATKATEADQP

SEQ ID NO: 3072652 - protein, 23 aa, Giardia lamblia
GSQKHLFSYVALIFSNPQFLPMN

SEQ ID NO: 3072653 - protein, 23 aa, Giardia lamblia
GSRAKYILRMISLDTVFLELTSL

SEQ ID NO: 3072654 - protein, 25 aa, Giardia lamblia
GSRRKGIDPESFWLKIQDMVIFDPD

SEQ ID NO: 3072655 - protein, 19 aa, Giardia lamblia
GSRRLRYILDTQFPVEPIL

SEQ ID NO: 3072656 - protein, 25 aa, Giardia lamblia
GSSADLFFRRGVCYYDLRRWSDSIS

SEQ ID NO: 3072657 - protein, 18 aa, Giardia lamblia
GSSGEFLLHTDLPAVPEA

SEQ ID NO: 3072658 - protein, 18 aa, Giardia lamblia
GSSMPAYIDIILCVFPTT

SEQ ID NO: 3072659 - protein, 18 aa, Giardia lamblia
GSSNISHSVLRRKSVSAA

SEQ ID NO: 3072660 - protein, 25 aa, Giardia lamblia
GSSSLVPFAMRCNFSSSNLVHVTKL

SEQ ID NO: 3072661 - protein, 20 aa, Giardia lamblia
GSSVLSCITPNASITSSISA

SEQ ID NO: 3072662 - protein, 21 aa, Giardia lamblia
GSTGELLCFSFQPAAFTGNTT

SEQ ID NO: 3072663 - protein, 19 aa, Giardia lamblia
GSVCTPCTPGTYQPNSGSG

SEQ ID NO: 3072664 - protein, 20 aa, Giardia lamblia
GSVLFYRTLANMTIDDVLRN

SEQ ID NO: 3072665 - protein, 22 aa, Giardia lamblia
GSVPPLLRRTYKIFNPSMTRNI

SEQ ID NO: 3072666 - protein, 19 aa, Giardia lamblia
GSVTGLVIYTGKQVRIMLG

SEQ ID NO: 3072667 - protein, 20 aa, Giardia lamblia
GSVVKIKALHNFQDTGYLFS

SEQ ID NO: 3072668 - protein, 18 aa, Giardia lamblia
GSYAVPVCVHPLLFNRPG

SEQ ID NO: 3072669 - protein, 21 aa, Giardia lamblia
GTAIYGSCLFVLQGFSPNLEN

SEQ ID NO: 3072670 - protein, 25 aa, Giardia lamblia
GTALQWAVCAGHIEAARLLLAEVGI

SEQ ID NO: 3072671 - protein, 18 aa, Giardia lamblia
GTALRYSYTKAYTKMKSM

SEQ ID NO: 3072672 - protein, 17 aa, Giardia lamblia
GTCKACATGCSTCASAG

SEQ ID NO: 3072673 - protein, 20 aa, Giardia lamblia
GTCRRCRPGYRHNKETLTCM

SEQ ID NO: 3072674 - protein, 21 aa, Giardia lamblia
GTCTTCSGAAFLMNGGCYTKA

SEQ ID NO: 3072675 - protein, 17 aa, Giardia lamblia
GTCVWKCSTDCSADQVC

SEQ ID NO: 3072676 - protein, 23 aa, Giardia lamblia
GTDDVSWRINVIRMVTRPLRTMV

SEQ ID NO: 3072677 - protein, 17 aa, Giardia lamblia
GTDEPRCSFPAPDGKRA

SEQ ID NO: 3072678 - protein, 19 aa, Giardia lamblia
GTDSAKCLLFSLQYTGSNI

SEQ ID NO: 3072679 - protein, 20 aa, Giardia lamblia
GTDVYPWIDPVSFLVFNIMA

SEQ ID NO: 3072680 - protein, 18 aa, Giardia lamblia
GTEGYPFVHVEFLDIPGC

SEQ ID NO: 3072681 - protein, 21 aa, Giardia lamblia
GTELLPILPPQGIDAPQSLGI

SEQ ID NO: 3072682 - protein, 25 aa, Giardia lamblia
GTESLCCVCFRKARRQKGESDFLTG

SEQ ID NO: 3072683 - protein, 17 aa, Giardia lamblia
GTFFHIDFGHFLGNFKK

SEQ ID NO: 3072684 - protein, 17 aa, Giardia lamblia
GTFIEYYSSVIFGSTGQ

SEQ ID NO: 3072685 - protein, 17 aa, Giardia lamblia
GTFVEYYSSVIFGSTGQ

SEQ ID NO: 3072686 - protein, 19 aa, Giardia lamblia
GTFYKRWFRSGSRCSLLCY

SEQ ID NO: 3072687 - protein, 24 aa, Giardia lamblia
GTFYKRWFRSGSRCSLLCYLVFVL

SEQ ID NO: 3072688 - protein, 26 aa, Giardia lamblia
GTGFCTSCKDTAFLFYGSCYAIDKVP

SEQ ID NO: 3072689 - protein, 26 aa, Giardia lamblia
GTGFNIIKVALLILDMCSNFREKERA

SEQ ID NO: 3072690 - protein, 24 aa, Giardia lamblia
GTGSWRLSRINVFQAVQPTHPSVY

SEQ ID NO: 3072691 - protein, 24 aa, Giardia lamblia
GTHQRGRIAPGMRIVIDVVKTNLE

SEQ ID NO: 3072692 - protein, 18 aa, Giardia lamblia
GTILPFVANCGFVDSLSG

SEQ ID NO: 3072693 - protein, 19 aa, Giardia lamblia
GTLAWSPRTLESMGEKNFQ

SEQ ID NO: 3072694 - protein, 24 aa, Giardia lamblia
GTLFNFNHCNLLTWIDGVLEKVAG

SEQ ID NO: 3072695 - protein, 18 aa, Giardia lamblia
GTLFPAKVSKNFKKMTNE

SEQ ID NO: 3072696 - protein, 28 aa, Giardia lamblia
GTLKSYTARIFIRFAFAILAAVASITIF

SEQ ID NO: 3072697 - protein, 17 aa, Giardia lamblia
GTLPPLLSDSAHISTEY

SEQ ID NO: 3072698 - protein, 24 aa, Giardia lamblia
GTLPRLPLCRDLPGCTSQTVYLAF

SEQ ID NO: 3072699 - protein, 27 aa, Giardia lamblia
GTLRKLSRFKIIKYLGLDNIYDSISQC

SEQ ID NO: 3072700 - protein, 24 aa, Giardia lamblia
GTLRSSLCPYSHMLAEKIPVGEIP

SEQ ID NO: 3072701 - protein, 18 aa, Giardia lamblia
GTLSMGFNPALRPQHSSV

SEQ ID NO: 3072702 - protein, 23 aa, Giardia lamblia
GTPILRASLYNSIIGYQEPQNTD

SEQ ID NO: 3072703 - protein, 19 aa, Giardia lamblia
GTPNLSCIGFHCMAVCVSN

SEQ ID NO: 3072704 - protein, 17 aa, Giardia lamblia
GTQKLTFLNTIESVIRR

SEQ ID NO: 3072705 - protein, 22 aa, Giardia lamblia
GTSEITVSFVVIKDSPAGANSV

SEQ ID NO: 3072706 - protein, 17 aa, Giardia lamblia
GTSKLREGTGLELVAYS

SEQ ID NO: 3072707 - protein, 20 aa, Giardia lamblia
GTSMSVVLCTSKEPVAAFPL

SEQ ID NO: 3072708 - protein, 19 aa, Giardia lamblia
GTTGYCFQLAAKYKNELKY

SEQ ID NO: 3072709 - protein, 18 aa, Giardia lamblia
GTVCSLRPCQSLDQRIDR

SEQ ID NO: 3072710 - protein, 20 aa, Giardia lamblia
GTVLIHLNVLFDIRGLKIAL

SEQ ID NO: 3072711 - protein, 25 aa, Giardia lamblia
GTVRVPPKFSAKMACTSRTYEYMMP

SEQ ID NO: 3072712 - protein, 26 aa, Giardia lamblia
GTVTELKPSAAIRVPVKLRPDVILNQ

SEQ ID NO: 3072713 - protein, 24 aa, Giardia lamblia
GTVTPASCFTRFKTGAFRLNVPVQ

SEQ ID NO: 3072714 - protein, 27 aa, Giardia lamblia
GVAALLGYFFRPLLGDRVRVYGFGAPP

SEQ ID NO: 3072715 - protein, 28 aa, Giardia lamblia
GVAERWVGVFVAMLWVPALRGLDSAMNV

SEQ ID NO: 3072716 - protein, 17 aa, Giardia lamblia
GVAYPCYGNYYSHRDRM

SEQ ID NO: 3072717 - protein, 22 aa, Giardia lamblia
GVCGSFIPYMLVKCRSSDKALL

SEQ ID NO: 3072718 - protein, 20 aa, Giardia lamblia
GVCRANLLYTQYSCFCNDEY

SEQ ID NO: 3072719 - protein, 25 aa, Giardia lamblia
GVCSCGGNGKVCCDLQTDCFCPTFV

SEQ ID NO: 3072720 - protein, 23 aa, Giardia lamblia
GVCTGCLRGYMLYMGGCYDPAAI

SEQ ID NO: 3072721 - protein, 25 aa, Giardia lamblia
GVDGLWKCRCHFGSIRAQDGNCYPL

SEQ ID NO: 3072722 - protein, 29 aa, Giardia lamblia
GVDPEEFLCFKATCSSMIAELGYVLNQVT

SEQ ID NO: 3072723 - protein, 17 aa, Giardia lamblia
GVEEVRAALQRGSEGGL

SEQ ID NO: 3072724 - protein, 17 aa, Giardia lamblia
GVEGLRVRIADFGQVGD

SEQ ID NO: 3072725 - protein, 24 aa, Giardia lamblia
GVEHVSRLHVLIVYSIYDLFEMTE

SEQ ID NO: 3072726 - protein, 21 aa, Giardia lamblia
GVEVWVMRNSWGEQWGSYGHF

SEQ ID NO: 3072727 - protein, 22 aa, Giardia lamblia
GVFDFPGLLPTLSTEQGVDAGH

SEQ ID NO: 3072728 - protein, 17 aa, Giardia lamblia
GVFKLPDYHMAYPCSNT

SEQ ID NO: 3072729 - protein, 28 aa, Giardia lamblia
GVFSHKDIELILSVVFGYKINVLSSKPI

SEQ ID NO: 3072730 - protein, 24 aa, Giardia lamblia
GVFWELTYTVSFGFINVGPIITCV

SEQ ID NO: 3072731 - protein, 19 aa, Giardia lamblia
GVGACVRDGAGYKCDCRGL

SEQ ID NO: 3072732 - protein, 19 aa, Giardia lamblia
GVGACVRNGAGYKCDCRGL

SEQ ID NO: 3072733 - protein, 18 aa, Giardia lamblia
GVGACVRNGAGYRCDCRG

SEQ ID NO: 3072734 - protein, 18 aa, Giardia lamblia
GVGCFCKKGTWDHKTEQC

SEQ ID NO: 3072735 - protein, 18 aa, Giardia lamblia
GVGDCIKKPGASKYACDC

SEQ ID NO: 3072736 - protein, 24 aa, Giardia lamblia
GVGRTGCPMIFGFLATLIEYVQTQ

SEQ ID NO: 3072737 - protein, 17 aa, Giardia lamblia
GVHAIRTANRWNHSEVA

SEQ ID NO: 3072738 - protein, 17 aa, Giardia lamblia
GVHAVRLSVPLLVVHKG

SEQ ID NO: 3072739 - protein, 20 aa, Giardia lamblia
GVHFQFPFEPYPSQIEYMSS

SEQ ID NO: 3072740 - protein, 19 aa, Giardia lamblia
GVHLKLHIIQCILRLAFPL

SEQ ID NO: 3072741 - protein, 24 aa, Giardia lamblia
GVKLRKAQFYTHLNKFLVERLLSS

SEQ ID NO: 3072742 - protein, 25 aa, Giardia lamblia
GVLFSKSMYSVFCKDGIVVPAVQNR

SEQ ID NO: 3072743 - protein, 19 aa, Giardia lamblia
GVLIWWLVFQRRRGSGFGG

SEQ ID NO: 3072744 - protein, 46 aa, Giardia lamblia
GVLKLNLGVFYKYPCCYKKPDPFVFNWKLFLGIVLGALGPYFGIAR

SEQ ID NO: 3072745 - protein, 18 aa, Giardia lamblia
GVLLPLIFSDQFTEQSIH

SEQ ID NO: 3072746 - protein, 17 aa, Giardia lamblia
GVLNSYVDLIGFQQLYP

SEQ ID NO: 3072747 - protein, 18 aa, Giardia lamblia
GVLRDRGKGLAYRLTMDL

SEQ ID NO: 3072748 - protein, 24 aa, Giardia lamblia
GVLSCSKLPPALERLMRLFDMVGD

SEQ ID NO: 3072749 - protein, 31 aa, Giardia lamblia
GVLSSIAYCWRYRHLRKLLKEKKETSITSEL

SEQ ID NO: 3072750 - protein, 24 aa, Giardia lamblia
GVLYALRAPRKFVKDMIDFNEPTN

SEQ ID NO: 3072751 - protein, 22 aa, Giardia lamblia
GVMWPKDQFLAIIQSFGVILTS

SEQ ID NO: 3072752 - protein, 24 aa, Giardia lamblia
GVPAPMRMGIVFGLIGSIIFSLFI

SEQ ID NO: 3072753 - protein, 17 aa, Giardia lamblia
GVPYPSALHKTLTFRNI

SEQ ID NO: 3072754 - protein, 18 aa, Giardia lamblia
GVQGPFFVRVVQMPPITP

SEQ ID NO: 3072755 - protein, 24 aa, Giardia lamblia
GVQLLHVIHKWAFLVPNELDKLHA

SEQ ID NO: 3072756 - protein, 18 aa, Giardia lamblia
GVRITRLYSILVAALPAP

SEQ ID NO: 3072757 - protein, 21 aa, Giardia lamblia
GVRKLDAFIRMMTNGRVYIDN

SEQ ID NO: 3072758 - protein, 20 aa, Giardia lamblia
GVRLFLCEFIFALVTCSYYH

SEQ ID NO: 3072759 - protein, 23 aa, Giardia lamblia
GVVMCVLASWSFVLQTVVAALFT

SEQ ID NO: 3072760 - protein, 24 aa, Giardia lamblia
GVVPHPLKFFSIGWQGWIVTLVLG

SEQ ID NO: 3072761 - protein, 17 aa, Giardia lamblia
GVVSLALTHPWQVTVTR

SEQ ID NO: 3072762 - protein, 18 aa, Giardia lamblia
GVYMCGKLATLKTAYVSL

SEQ ID NO: 3072763 - protein, 22 aa, Giardia lamblia
GVYPRDEVVALLFTPPNDSVHS

SEQ ID NO: 3072764 - protein, 19 aa, Giardia lamblia
GWAGEAFSSVCVRTLSMSL

SEQ ID NO: 3072765 - protein, 25 aa, Giardia lamblia
GWMRFGANILTIWIFILCYILVLKR

SEQ ID NO: 3072766 - protein, 19 aa, Giardia lamblia
GWTALMWAAHFGRTEVVRL

SEQ ID NO: 3072767 - protein, 21 aa, Giardia lamblia
GWTPWFRYVEQGNYPAVQCLI

SEQ ID NO: 3072768 - protein, 24 aa, Giardia lamblia
GWTYTRAVFLLVFFYGVFCYGSSY

SEQ ID NO: 3072769 - protein, 28 aa, Giardia lamblia
GYATYMLYKSCSVHFGISEAHEPTTFYE

SEQ ID NO: 3072770 - protein, 20 aa, Giardia lamblia
GYCLPNKCVFNVKQNGKDVD

SEQ ID NO: 3072771 - protein, 18 aa, Giardia lamblia
GYCTLCVDGFFLDTTSSI

SEQ ID NO: 3072772 - protein, 22 aa, Giardia lamblia
GYDHIRSIILIGIMASARQLIF

SEQ ID NO: 3072773 - protein, 17 aa, Giardia lamblia
GYDSTSHIGVMINNPNP

SEQ ID NO: 3072774 - protein, 20 aa, Giardia lamblia
GYEVSGYLIIEFHDADDSYV

SEQ ID NO: 3072775 - protein, 24 aa, Giardia lamblia
GYEYLKFVVFTVHLFGRPTQVIQL

SEQ ID NO: 3072776 - protein, 17 aa, Giardia lamblia
GYFAFLLAGSHDNIALC

SEQ ID NO: 3072777 - protein, 25 aa, Giardia lamblia
GYFALEVYYLAHLVARYLSSHVLFI

SEQ ID NO: 3072778 - protein, 17 aa, Giardia lamblia
GYFYIMLLVVTIYISLL

SEQ ID NO: 3072779 - protein, 20 aa, Giardia lamblia
GYGVYRMVRNYQFHVSPYKV

SEQ ID NO: 3072780 - protein, 26 aa, Giardia lamblia
GYGYYKGTEAWVIRNSWGEKWGDYGY

SEQ ID NO: 3072781 - protein, 18 aa, Giardia lamblia
GYILVRPGYYRWCQIYHV

SEQ ID NO: 3072782 - protein, 26 aa, Giardia lamblia
GYLAYFEFVVWWALVTKLKFLDDASY

SEQ ID NO: 3072783 - protein, 22 aa, Giardia lamblia
GYLFRQCLFDAAGCMIGQSVAS

SEQ ID NO: 3072784 - protein, 18 aa, Giardia lamblia
GYMKACLKSNKLFILLEL

SEQ ID NO: 3072785 - protein, 22 aa, Giardia lamblia
GYNALELLSVFAAAILILKSPT

SEQ ID NO: 3072786 - protein, 24 aa, Giardia lamblia
GYPPGAHMRLLLQLFGQAMHTYIS

SEQ ID NO: 3072787 - protein, 19 aa, Giardia lamblia
GYQEACAILKDYEGPPATD

SEQ ID NO: 3072788 - protein, 18 aa, Giardia lamblia
GYQIPAFVALGTCALPGL

SEQ ID NO: 3072789 - protein, 28 aa, Giardia lamblia
GYSELMWFRARINAISGVHFLNLILIVI

SEQ ID NO: 3072790 - protein, 24 aa, Giardia lamblia
GYSFIRIVLPLTVTAIYRNRVLEY

SEQ ID NO: 3072791 - protein, 25 aa, Giardia lamblia
GYSKYDWPMSCLHQLNQARHHMMNG

SEQ ID NO: 3072792 - protein, 18 aa, Giardia lamblia
GYSVSLYAPLYETPQGQE

SEQ ID NO: 3072793 - protein, 18 aa, Giardia lamblia
GYTGRWTPIGNHGFELRI

SEQ ID NO: 3072794 - protein, 18 aa, Giardia lamblia
GYTGSKCESCATGYRETN

SEQ ID NO: 3072795 - protein, 19 aa, Giardia lamblia
GYVKGRSPHECIPKKCTYR

SEQ ID NO: 3072796 - protein, 23 aa, Giardia lamblia
GYYDAFARRRHLVNSLIAMDPVE

SEQ ID NO: 3072797 - protein, 25 aa, Giardia lamblia
GYYPPEFISNSSFALMMLEGGFPPH

SEQ ID NO: 3072798 - protein, 17 aa, Giardia lamblia
HAAELRVSMADSIRKHD

SEQ ID NO: 3072799 - protein, 21 aa, Giardia lamblia
HAAETCPFLLTAGLDKTLRYV

SEQ ID NO: 3072800 - protein, 18 aa, Giardia lamblia
HACFINFLTTIAPYYIGT

SEQ ID NO: 3072801 - protein, 24 aa, Giardia lamblia
HACHNCRCFCRCTRTYQPTGAYVT

SEQ ID NO: 3072802 - protein, 23 aa, Giardia lamblia
HACTHISEAIVLRVAESIEKAID

SEQ ID NO: 3072803 - protein, 24 aa, Giardia lamblia
HAFLKKELQLDCYFRSLCNEHNVF

SEQ ID NO: 3072804 - protein, 17 aa, Giardia lamblia
HAFNPCILSAGRLDNSA

SEQ ID NO: 3072805 - protein, 17 aa, Giardia lamblia
HAGTTFVERLLIAKKLI

SEQ ID NO: 3072806 - protein, 30 aa, Giardia lamblia
HAGVLICEANRCWRFLDFILTAKRHQLARG

SEQ ID NO: 3072807 - protein, 25 aa, Giardia lamblia
HAILSRASALTFLLAYSSADIHFYA

SEQ ID NO: 3072808 - protein, 31 aa, Giardia lamblia
HAKWLAFIPSFAVRLFFSIFRENSILCRVNI

SEQ ID NO: 3072809 - protein, 24 aa, Giardia lamblia
HALLSVQIYSFFYFLSTLVFTCGT

SEQ ID NO: 3072810 - protein, 25 aa, Giardia lamblia
HALYNDCLRYGIILYSRETRRIFHS

SEQ ID NO: 3072811 - protein, 17 aa, Giardia lamblia
HANDMRFARVQDSNGPS

SEQ ID NO: 3072812 - protein, 19 aa, Giardia lamblia
HAPCTKCYKGYYLTGQTCT

SEQ ID NO: 3072813 - protein, 25 aa, Giardia lamblia
HAPFDTCYALCYFLKTFGFSRPSLY

SEQ ID NO: 3072814 - protein, 31 aa, Giardia lamblia
HAQAAMCLYRTSRLASRFGDAAVNVLLPATV

SEQ ID NO: 3072815 - protein, 19 aa, Giardia lamblia
HAQAVGFTAFLMVIVLAGL

SEQ ID NO: 3072816 - protein, 26 aa, Giardia lamblia
HAQQCFSNLCAFVRGMHYDAVFSHGA

SEQ ID NO: 3072817 - protein, 26 aa, Giardia lamblia
HARNLIFDELLLFTGYLRQPAVVTAL

SEQ ID NO: 3072818 - protein, 23 aa, Giardia lamblia
HASARFIWDKAILDFHQNIKAIR

SEQ ID NO: 3072819 - protein, 25 aa, Giardia lamblia
HASTSRTLLRYKYEKAVEINKRTAV

SEQ ID NO: 3072820 - protein, 30 aa, Giardia lamblia
HAYDFPAEIFRTCSFDSGTNFKRVKIMLRP

SEQ ID NO: 3072821 - protein, 24 aa, Giardia lamblia
HAYKNARFNYKRHIRVFSRVLLVF

SEQ ID NO: 3072822 - protein, 22 aa, Giardia lamblia
HCARDGDSLYCFERRQLKSNLA

SEQ ID NO: 3072823 - protein, 20 aa, Giardia lamblia
HCAVAIVLFVLVSSHVNEGA

SEQ ID NO: 3072824 - protein, 18 aa, Giardia lamblia
HCIVYFDHHCPWVGTDVG

SEQ ID NO: 3072825 - protein, 21 aa, Giardia lamblia
HCKCLEGFSGLDCGLNSCGVE

SEQ ID NO: 3072826 - protein, 20 aa, Giardia lamblia
HCKRTPYGNKVRKLQQVDPH

SEQ ID NO: 3072827 - protein, 20 aa, Giardia lamblia
HCLNHYCIIVGYIISPSTPN

SEQ ID NO: 3072828 - protein, 18 aa, Giardia lamblia
HCNTCGHCVMYLDHHCPW

SEQ ID NO: 3072829 - protein, 20 aa, Giardia lamblia
HCSGCVRIADDLDEIFTGHA

SEQ ID NO: 3072830 - protein, 22 aa, Giardia lamblia
HCTRCPSGALLKRASGAATGSC

SEQ ID NO: 3072831 - protein, 25 aa, Giardia lamblia
HDEFCLKFRVFQVLKQRPMARRSFL

SEQ ID NO: 3072832 - protein, 24 aa, Giardia lamblia
HDEFISRLRLALSCSGAADHPLCL

SEQ ID NO: 3072833 - protein, 23 aa, Giardia lamblia
HDFSCALLLYRVFICPPLQDSYA

SEQ ID NO: 3072834 - protein, 24 aa, Giardia lamblia
HDGTFLYHLMKRLGVDVSSIHNRL

SEQ ID NO: 3072835 - protein, 32 aa, Giardia lamblia
HDISFRDVVFLGEARLKLLIQLVDNLKNDSLT

SEQ ID NO: 3072836 - protein, 26 aa, Giardia lamblia
HDNMCAAEVALTCGHYDCAELLRSAE

SEQ ID NO: 3072837 - protein, 22 aa, Giardia lamblia
HDPDEICSHCLKKYNNLKSATP

SEQ ID NO: 3072838 - protein, 17 aa, Giardia lamblia
HDRCTLLLATTPDNDLV

SEQ ID NO: 3072839 - protein, 25 aa, Giardia lamblia
HDTPCLPGFLIFYLHLYLCPQQYDD

SEQ ID NO: 3072840 - protein, 20 aa, Giardia lamblia
HDTRKKLSVEFAALRGSEDP

SEQ ID NO: 3072841 - protein, 19 aa, Giardia lamblia
HDYARIVGHPSILSQQEKG

SEQ ID NO: 3072842 - protein, 23 aa, Giardia lamblia
HEALRRFADLLLTFLHDEKRELR

SEQ ID NO: 3072843 - protein, 22 aa, Giardia lamblia
HEARMAMKNGLTALMKASMLGN

SEQ ID NO: 3072844 - protein, 31 aa, Giardia lamblia
HEEISQCPYCSVFSIRCNLFQLSSRGETVCS

SEQ ID NO: 3072845 - protein, 22 aa, Giardia lamblia
HEETLCKLPVPSAELPNTLKTF

SEQ ID NO: 3072846 - protein, 32 aa, Giardia lamblia
HEFKLTGTNINFWKWYITYFVGKCSSAQASEG

SEQ ID NO: 3072847 - protein, 19 aa, Giardia lamblia
HEFLIRIKEILLKKRTFDA

SEQ ID NO: 3072848 - protein, 17 aa, Giardia lamblia
HEFRKVISRHTGSEPLL

SEQ ID NO: 3072849 - protein, 26 aa, Giardia lamblia
HEGECSPCTIAHCLDCKSDVATCNAC

SEQ ID NO: 3072850 - protein, 19 aa, Giardia lamblia
HEISLPIADIIASAVVLSA

SEQ ID NO: 3072851 - protein, 21 aa, Giardia lamblia
HEIWTAMAMLCLNPMERQNWS

SEQ ID NO: 3072852 - protein, 20 aa, Giardia lamblia
HELPRARASSALHVPDVCKE

SEQ ID NO: 3072853 - protein, 17 aa, Giardia lamblia
HELTLTFDCERILFIVY

SEQ ID NO: 3072854 - protein, 17 aa, Giardia lamblia
HEPTFILGYLWCIMSRI

SEQ ID NO: 3072855 - protein, 25 aa, Giardia lamblia
HEQDRGAMNWLPRDMHLTEKTSGSR

SEQ ID NO: 3072856 - protein, 24 aa, Giardia lamblia
HEQYNIDESWGFVFINQSSRVEVH

SEQ ID NO: 3072857 - protein, 18 aa, Giardia lamblia
HERAKCLQELGLHELATD

SEQ ID NO: 3072858 - protein, 28 aa, Giardia lamblia
HERPGYCPVCKLLRVPSDLRLTQRAMAL

SEQ ID NO: 3072859 - protein, 20 aa, Giardia lamblia
HEWDVVPSCNINYRHAIYYN

SEQ ID NO: 3072860 - protein, 19 aa, Giardia lamblia
HFAAKCTVINFAHSDEKIF

SEQ ID NO: 3072861 - protein, 20 aa, Giardia lamblia
HFALLLRDHMLLLDANAEVP

SEQ ID NO: 3072862 - protein, 25 aa, Giardia lamblia
HFALRCMMHTCLIKPIAYTDDQISE

SEQ ID NO: 3072863 - protein, 22 aa, Giardia lamblia
HFCQCRRGWVGAACDAPRAGFR

SEQ ID NO: 3072864 - protein, 21 aa, Giardia lamblia
HFEETYPWIAPIHEHNYYANG

SEQ ID NO: 3072865 - protein, 21 aa, Giardia lamblia
HFEKKFHRFSAFDRLHHLEQL

SEQ ID NO: 3072866 - protein, 32 aa, Giardia lamblia
HFHKDSITGLAWLHRRGLLAACSHDRKLTLWS

SEQ ID NO: 3072867 - protein, 19 aa, Giardia lamblia
HFLPRGLLFDRITCPNYTT

SEQ ID NO: 3072868 - protein, 18 aa, Giardia lamblia
HFMMGIVILMYIDVQLLP

SEQ ID NO: 3072869 - protein, 18 aa, Giardia lamblia
HFRKERRSFVKLASGNTF

SEQ ID NO: 3072870 - protein, 21 aa, Giardia lamblia
HFSNLLSSYVQWLETDNGSYV

SEQ ID NO: 3072871 - protein, 22 aa, Giardia lamblia
HFSSKRAPLLFRMSRTKNDHGT

SEQ ID NO: 3072872 - protein, 26 aa, Giardia lamblia
HFVLQEFKYRLARFVDSLDQICCNLQ

SEQ ID NO: 3072873 - protein, 18 aa, Giardia lamblia
HGALRVERIMRELIKAGG

SEQ ID NO: 3072874 - protein, 24 aa, Giardia lamblia
HGDKLRIGLHVSVFGYAETIAAVW

SEQ ID NO: 3072875 - protein, 25 aa, Giardia lamblia
HGEIPAYFRRASWTYLTLKYTQEAE

SEQ ID NO: 3072876 - protein, 18 aa, Giardia lamblia
HGGVHLTIRAEFVTTKYV

SEQ ID NO: 3072877 - protein, 26 aa, Giardia lamblia
HGIADRDGRVALHYCAEKNYIDAARI

SEQ ID NO: 3072878 - protein, 20 aa, Giardia lamblia
HGKASIFISRMISTINHKAL

SEQ ID NO: 3072879 - protein, 24 aa, Giardia lamblia
HGKKIDEDLLWAIMIQVLLALSYC

SEQ ID NO: 3072880 - protein, 22 aa, Giardia lamblia
HGLAHKTYRSFLLDRNSLSILG

SEQ ID NO: 3072881 - protein, 19 aa, Giardia lamblia
HGLEPELRESSLVNPLSSS

SEQ ID NO: 3072882 - protein, 25 aa, Giardia lamblia
HGLQRSAGILSEFGAYMATVMMDLL

SEQ ID NO: 3072883 - protein, 18 aa, Giardia lamblia
HGLSCIKPNATLTFLLQN

SEQ ID NO: 3072884 - protein, 30 aa, Giardia lamblia
HGPRGSSLVRPRTTMSASLQQSHGPRDDFF

SEQ ID NO: 3072885 - protein, 19 aa, Giardia lamblia
HGRCFCKIRNCNKCHENGK

SEQ ID NO: 3072886 - protein, 19 aa, Giardia lamblia
HGSCSILFDSGEGICICNS

SEQ ID NO: 3072887 - protein, 22 aa, Giardia lamblia
HGTLCYPSACISGGTLCGGNGD

SEQ ID NO: 3072888 - protein, 18 aa, Giardia lamblia
HGTLCYPSACVSGGTLCG

SEQ ID NO: 3072889 - protein, 19 aa, Giardia lamblia
HGTLCYPSACVSGGTLCGG

SEQ ID NO: 3072890 - protein, 24 aa, Giardia lamblia
HGTYSFEASQQWLGAATILDTTLK

SEQ ID NO: 3072891 - protein, 18 aa, Giardia lamblia
HGVSKAWEAITNALLKIH

SEQ ID NO: 3072892 - protein, 28 aa, Giardia lamblia
HGVTRHTVCYSVYRCNFSDAILDAPRTM

SEQ ID NO: 3072893 - protein, 20 aa, Giardia lamblia
HGYFLRFLLFGVLGSLTSCL

SEQ ID NO: 3072894 - protein, 28 aa, Giardia lamblia
HHVKTLYVPCLMRPQLIVYANYIQFFFR

SEQ ID NO: 3072895 - protein, 17 aa, Giardia lamblia
HHYGIRPIVEIVKTPSI

SEQ ID NO: 3072896 - protein, 18 aa, Giardia lamblia
HIAVALGYVGTRYSGSQW

SEQ ID NO: 3072897 - protein, 22 aa, Giardia lamblia
HIAYSFSDFFLLSERISPIVLY

SEQ ID NO: 3072898 - protein, 24 aa, Giardia lamblia
HIEVIRMLSGFNMRMLIIQLRLDR

SEQ ID NO: 3072899 - protein, 19 aa, Giardia lamblia
HIFELGVSIFMLVPPTNVS

SEQ ID NO: 3072900 - protein, 24 aa, Giardia lamblia
HIFLMSFAEVFQIMSYFYIQAFNN

SEQ ID NO: 3072901 - protein, 19 aa, Giardia lamblia
HIGNIFLQMHEMWSRNLLD

SEQ ID NO: 3072902 - protein, 26 aa, Giardia lamblia
HIGRCIRKLAGICASFKLQIQQDAPI

SEQ ID NO: 3072903 - protein, 20 aa, Giardia lamblia
HIHSPLRLRSVLGAPNPKNI

SEQ ID NO: 3072904 - protein, 33 aa, Giardia lamblia
HIKPEEAWRGLPWNFLCSRSFYRRKKLDLTKVS

SEQ ID NO: 3072905 - protein, 18 aa, Giardia lamblia
HILLPYINARVYRMVPKA

SEQ ID NO: 3072906 - protein, 17 aa, Giardia lamblia
HILTRYLLKGIFLLLFY

SEQ ID NO: 3072907 - protein, 26 aa, Giardia lamblia
HIMSTFRGSIIGQYLYRIFFLDKGSV

SEQ ID NO: 3072908 - protein, 18 aa, Giardia lamblia
HINCSAPILLEVLTSVCL

SEQ ID NO: 3072909 - protein, 17 aa, Giardia lamblia
HIPTGIDHSGPWSVSTV

SEQ ID NO: 3072910 - protein, 24 aa, Giardia lamblia
HIQLRKLCFYFFALLLLSAIVIGG

SEQ ID NO: 3072911 - protein, 24 aa, Giardia lamblia
HIRCAKKQLSLVCRILGLTVSSYI

SEQ ID NO: 3072912 - protein, 22 aa, Giardia lamblia
HITAYKLLLLFYNKKLTLYEVF

SEQ ID NO: 3072913 - protein, 24 aa, Giardia lamblia
HITDLRFYVYDSLLSRAYVGQSVS

SEQ ID NO: 3072914 - protein, 24 aa, Giardia lamblia
HITPLRILTVIAIVSGSLVYSHAE

SEQ ID NO: 3072915 - protein, 17 aa, Giardia lamblia
HIYCELAGMFYAASRLD

SEQ ID NO: 3072916 - protein, 26 aa, Giardia lamblia
HKATLRYLLSWIIWIVFATDTQGGHG

SEQ ID NO: 3072917 - protein, 26 aa, Giardia lamblia
HKAVLSIATSNYWCFFNGFENSVLTP

SEQ ID NO: 3072918 - protein, 20 aa, Giardia lamblia
HKDDLRLSKELNQPPVIVGY

SEQ ID NO: 3072919 - protein, 18 aa, Giardia lamblia
HKHDIVFRDMKPENLLLD

SEQ ID NO: 3072920 - protein, 20 aa, Giardia lamblia
HKKGGFLLDKINLIKRSYSD

SEQ ID NO: 3072921 - protein, 19 aa, Giardia lamblia
HKLGPCGVKNNSGIDHTHM

SEQ ID NO: 3072922 - protein, 17 aa, Giardia lamblia
HKLHNAIVKDDIQGAQN

SEQ ID NO: 3072923 - protein, 19 aa, Giardia lamblia
HKLIPAFLGYIPLASSEVV

SEQ ID NO: 3072924 - protein, 19 aa, Giardia lamblia
HKLSILFVLQQLYPSYLKK

SEQ ID NO: 3072925 - protein, 22 aa, Giardia lamblia
HKNMCAAVSLLSGEPYISTVEL

SEQ ID NO: 3072926 - protein, 24 aa, Giardia lamblia
HKNYFKLAIANLIIGDALAAVEAF

SEQ ID NO: 3072927 - protein, 17 aa, Giardia lamblia
HKPLSLFTIDDINMKSG

SEQ ID NO: 3072928 - protein, 29 aa, Giardia lamblia
HKQEYKTKIGREFPHSFVRLHQSILERII

SEQ ID NO: 3072929 - protein, 19 aa, Giardia lamblia
HKQMEYLCNIFLQSKYFAC

SEQ ID NO: 3072930 - protein, 17 aa, Giardia lamblia
HKQSIFYGARWMQYHPA

SEQ ID NO: 3072931 - protein, 23 aa, Giardia lamblia
HKRDALRCPVCREAISHNIVLTQ

SEQ ID NO: 3072932 - protein, 19 aa, Giardia lamblia
HKRIHFYQDFAILQSFQDL

SEQ ID NO: 3072933 - protein, 20 aa, Giardia lamblia
HKRPVSVLSTRSVSRAPRRL

SEQ ID NO: 3072934 - protein, 26 aa, Giardia lamblia
HKSFTCCFRCPIPAWGVILVTVLMAQ

SEQ ID NO: 3072935 - protein, 24 aa, Giardia lamblia
HKSKKYKDGYVRKCKQLEELEKEL

SEQ ID NO: 3072936 - protein, 17 aa, Giardia lamblia
HKSLLFQHNCQFLYKQI

SEQ ID NO: 3072937 - protein, 18 aa, Giardia lamblia
HLAEGFYLSFISRDGKST

SEQ ID NO: 3072938 - protein, 22 aa, Giardia lamblia
HLALPLVYNYAYRVFGLGLLKS

SEQ ID NO: 3072939 - protein, 18 aa, Giardia lamblia
HLEIVKMLMNRESTMKDL

SEQ ID NO: 3072940 - protein, 23 aa, Giardia lamblia
HLEPMCGPTSMFSIKSKELANPN

SEQ ID NO: 3072941 - protein, 19 aa, Giardia lamblia
HLGFGLKRIRVENLKLRRA

SEQ ID NO: 3072942 - protein, 25 aa, Giardia lamblia
HLHNEFLATYGMKWPYPLDSQAYAR

SEQ ID NO: 3072943 - protein, 19 aa, Giardia lamblia
HLKITPMMILKEVVVGSLL

SEQ ID NO: 3072944 - protein, 17 aa, Giardia lamblia
HLKKAIMNPGTFVHLLD

SEQ ID NO: 3072945 - protein, 22 aa, Giardia lamblia
HLKTELDGLLGPSTITRSKDSS

SEQ ID NO: 3072946 - protein, 17 aa, Giardia lamblia
HLLCTNALCLLVLNLIS

SEQ ID NO: 3072947 - protein, 19 aa, Giardia lamblia
HLLILSWVFVILFIPINEE

SEQ ID NO: 3072948 - protein, 17 aa, Giardia lamblia
HLLPYKEMREFAECYTL

SEQ ID NO: 3072949 - protein, 27 aa, Giardia lamblia
HLMCHPKLLLCYEMCRFHSDCDLTSGM

SEQ ID NO: 3072950 - protein, 20 aa, Giardia lamblia
HLMYPRTAFNMVAWPDGWTI

SEQ ID NO: 3072951 - protein, 27 aa, Giardia lamblia
HLPDCIIIDLILCRYTLLISNYLLSYS

SEQ ID NO: 3072952 - protein, 17 aa, Giardia lamblia
HLPRLFNDLHIVSDLSS

SEQ ID NO: 3072953 - protein, 21 aa, Giardia lamblia
HLRATYKKHIMVSALADDLMA

SEQ ID NO: 3072954 - protein, 17 aa, Giardia lamblia
HLREFFAIYNISSLEHV

SEQ ID NO: 3072955 - protein, 24 aa, Giardia lamblia
HLRIKRAVASYTEMLIKGNAAKPG

SEQ ID NO: 3072956 - protein, 22 aa, Giardia lamblia
HLSLYMCPDVLITLQKQGHYGA

SEQ ID NO: 3072957 - protein, 17 aa, Giardia lamblia
HLTSEWNHTVALSTPAE

SEQ ID NO: 3072958 - protein, 24 aa, Giardia lamblia
HLVFFLRQVMKIATFGSQYAWEAE

SEQ ID NO: 3072959 - protein, 17 aa, Giardia lamblia
HLVRELTKFLKYMVDTH

SEQ ID NO: 3072960 - protein, 25 aa, Giardia lamblia
HLYFTPKLPIFIANLLRAEGAPPLI

SEQ ID NO: 3072961 - protein, 21 aa, Giardia lamblia
HLYVQTRINAVSRVRQDKNTT

SEQ ID NO: 3072962 - protein, 18 aa, Giardia lamblia
HMEEALWEPFKKSMLRDT

SEQ ID NO: 3072963 - protein, 17 aa, Giardia lamblia
HMFCPREHFELRTLATR

SEQ ID NO: 3072964 - protein, 18 aa, Giardia lamblia
HMGSVCIHQSCISQTGEI

SEQ ID NO: 3072965 - protein, 25 aa, Giardia lamblia
HMINKLTEAIECFTKYILAELKFVS

SEQ ID NO: 3072966 - protein, 21 aa, Giardia lamblia
HMKCVKSLLGVEAGHQANDGT

SEQ ID NO: 3072967 - protein, 17 aa, Giardia lamblia
HMLWKRDLDAALEGMEH

SEQ ID NO: 3072968 - protein, 17 aa, Giardia lamblia
HMNLKIRTLKRLILANK

SEQ ID NO: 3072969 - protein, 19 aa, Giardia lamblia
HMSCYEVFGAPVALATKLH

SEQ ID NO: 3072970 - protein, 20 aa, Giardia lamblia
HMSLRIPWQSFWKENISIKV

SEQ ID NO: 3072971 - protein, 25 aa, Giardia lamblia
HMYKCKHAIPLYRCHECVETVENVE

SEQ ID NO: 3072972 - protein, 20 aa, Giardia lamblia
HNCDFRKPTNLYTVIRDLSV

SEQ ID NO: 3072973 - protein, 24 aa, Giardia lamblia
HNKYKCFEILQGREARIRGMTDLM

SEQ ID NO: 3072974 - protein, 23 aa, Giardia lamblia
HNLFTFESLKFFPMDSSRQTVNQ

SEQ ID NO: 3072975 - protein, 18 aa, Giardia lamblia
HNLKAIKSIPVWEREDEG

SEQ ID NO: 3072976 - protein, 18 aa, Giardia lamblia
HNLYKTREPVLIYCQMTK

SEQ ID NO: 3072977 - protein, 27 aa, Giardia lamblia
HNMHMYKARPGTYYIILHPHLMCLNTG

SEQ ID NO: 3072978 - protein, 19 aa, Giardia lamblia
HNTHPTAKVASWWDYGYQI

SEQ ID NO: 3072979 - protein, 23 aa, Giardia lamblia
HNVLRLADFYSCHLAFISALERY

SEQ ID NO: 3072980 - protein, 27 aa, Giardia lamblia
HNVPKMLFGMPCKWLADASSVHLILDG

SEQ ID NO: 3072981 - protein, 25 aa, Giardia lamblia
HPAPDPQFRAPKSVQRNCLRGRMAS

SEQ ID NO: 3072982 - protein, 29 aa, Giardia lamblia
HPAQCIICVSQIYWCEGIHLALEGSSYAG

SEQ ID NO: 3072983 - protein, 26 aa, Giardia lamblia
HPDLRMLIHGGVTFESLQSLPLSVES

SEQ ID NO: 3072984 - protein, 17 aa, Giardia lamblia
HPDYCSRILKLAEKTSG

SEQ ID NO: 3072985 - protein, 20 aa, Giardia lamblia
HPELAKICVNTGCIDNGVYC

SEQ ID NO: 3072986 - protein, 23 aa, Giardia lamblia
HPEPFTRKSVVSLQICQQRDQYS

SEQ ID NO: 3072987 - protein, 29 aa, Giardia lamblia
HPISMTLSYALFHWLELPATELALFYNTL

SEQ ID NO: 3072988 - protein, 21 aa, Giardia lamblia
HPITGKYLWLLVPKDVNYNTR

SEQ ID NO: 3072989 - protein, 17 aa, Giardia lamblia
HPLKLPWIGHNNVVYLF

SEQ ID NO: 3072990 - protein, 24 aa, Giardia lamblia
HPLLQAYRLFYVGTIILVLTPSCL

SEQ ID NO: 3072991 - protein, 21 aa, Giardia lamblia
HPLTMELGRQFFFAIDADKTG

SEQ ID NO: 3072992 - protein, 24 aa, Giardia lamblia
HPLVQEFYTWLIIQSITDECLDDV

SEQ ID NO: 3072993 - protein, 27 aa, Giardia lamblia
HPNFPFSRVSLVPNWMIGNTITGLLYP

SEQ ID NO: 3072994 - protein, 22 aa, Giardia lamblia
HPNILRFISWYQSNDEIWLITE

SEQ ID NO: 3072995 - protein, 31 aa, Giardia lamblia
HPNMDLRINPLIPSIVRWTSGVPYVPPYTIF

SEQ ID NO: 3072996 - protein, 23 aa, Giardia lamblia
HPQFRRLFDPSRLFYLDDTPPQE

SEQ ID NO: 3072997 - protein, 20 aa, Giardia lamblia
HPQPSLTLAQCENRKNNKTV

SEQ ID NO: 3072998 - protein, 22 aa, Giardia lamblia
HPRTDWSSRYYLALFETIVSID

SEQ ID NO: 3072999 - protein, 24 aa, Giardia lamblia
HPVKYHIMGPFTLPKLSFIQQGMR

SEQ ID NO: 3073000 - protein, 19 aa, Giardia lamblia
HQPSVCLFGIFDGHSGTAC

SEQ ID NO: 3073001 - protein, 17 aa, Giardia lamblia
HQRCITSAAARCIPNTE

SEQ ID NO: 3073002 - protein, 25 aa, Giardia lamblia
HQRSYFLGVFPMRPFTLSYTDPRKI

SEQ ID NO: 3073003 - protein, 23 aa, Giardia lamblia
HQTRFAFTRHRHLLPSDHTFSYL

SEQ ID NO: 3073004 - protein, 22 aa, Giardia lamblia
HQTRYLAKHAMKADSKINRLEK

SEQ ID NO: 3073005 - protein, 17 aa, Giardia lamblia
HQVCNGLMFAIVMLNTD

SEQ ID NO: 3073006 - protein, 19 aa, Giardia lamblia
HQVLLCFSTLMSFVVFIPE

SEQ ID NO: 3073007 - protein, 23 aa, Giardia lamblia
HRAGHRPAGIFLMSIDAASSPVP

SEQ ID NO: 3073008 - protein, 27 aa, Giardia lamblia
HRDRMSVCLPLSFQACPIKSADGTIMV

SEQ ID NO: 3073009 - protein, 25 aa, Giardia lamblia
HRDSCAQNRCVFMGWEELCTQCVSG

SEQ ID NO: 3073010 - protein, 24 aa, Giardia lamblia
HRDSWRAAQVLLLNYVHAYISQTV

SEQ ID NO: 3073011 - protein, 20 aa, Giardia lamblia
HRDVVRLLSKYELRLQDNHG

SEQ ID NO: 3073012 - protein, 17 aa, Giardia lamblia
HRFHKSHLLPIAIVTVY

SEQ ID NO: 3073013 - protein, 25 aa, Giardia lamblia
HRGTFILLVVFFRSFLRHSLDSPGL

SEQ ID NO: 3073014 - protein, 24 aa, Giardia lamblia
HRHLPEYGDYGTLLSYIERTRQKA

SEQ ID NO: 3073015 - protein, 18 aa, Giardia lamblia
HRISTFVADVFIRNAYQV

SEQ ID NO: 3073016 - protein, 32 aa, Giardia lamblia
HRLCRPKDMYAVLDVHPFQQMGFMDSDISCLL

SEQ ID NO: 3073017 - protein, 26 aa, Giardia lamblia
HRLFHELYRKCEVMSELAIYKNIISD

SEQ ID NO: 3073018 - protein, 39 aa, Giardia lamblia
HRNTCELHGSLLRPPIQQHWLIGRVVLLLRGKECEQLGQ

SEQ ID NO: 3073019 - protein, 18 aa, Giardia lamblia
HRPLCLVLQESTLVAFDA

SEQ ID NO: 3073020 - protein, 24 aa, Giardia lamblia
HRRKRPRKLTSIGARSSLWTPSVH

SEQ ID NO: 3073021 - protein, 21 aa, Giardia lamblia
HRSKYIIKFDSRWRRIAHMIK

SEQ ID NO: 3073022 - protein, 18 aa, Giardia lamblia
HRTAGNIKKAIFFGVLSG

SEQ ID NO: 3073023 - protein, 22 aa, Giardia lamblia
HRTEFLAAFKHTFAAATISIYK

SEQ ID NO: 3073024 - protein, 21 aa, Giardia lamblia
HRTELKKALYVAAPHLDAVID

SEQ ID NO: 3073025 - protein, 19 aa, Giardia lamblia
HRYVFDISLAIHIEPTNYV

SEQ ID NO: 3073026 - protein, 20 aa, Giardia lamblia
HSAIYFLSIILCIVRVLFGQ

SEQ ID NO: 3073027 - protein, 24 aa, Giardia lamblia
HSAYLRFVRHKAINGRIDERILAT

SEQ ID NO: 3073028 - protein, 20 aa, Giardia lamblia
HSCCAGFASVVFEASSASLR

SEQ ID NO: 3073029 - protein, 19 aa, Giardia lamblia
HSEHIYFTWLIEAFSTMQR

SEQ ID NO: 3073030 - protein, 38 aa, Giardia lamblia
HSFEVYKIKFSKYIITMIRLLRYHFLKVAQQLSTNTKL

SEQ ID NO: 3073031 - protein, 24 aa, Giardia lamblia
HSGGLLVDCLLRIKELLGGDLKVQ

SEQ ID NO: 3073032 - protein, 22 aa, Giardia lamblia
HSGSVPRIFLPEAHAFKTGLLR

SEQ ID NO: 3073033 - protein, 19 aa, Giardia lamblia
HSIHPFLVSSWKLTKQRLT

SEQ ID NO: 3073034 - protein, 26 aa, Giardia lamblia
HSIPLPSFWDIVCFLKAMTSGRFDDL

SEQ ID NO: 3073035 - protein, 20 aa, Giardia lamblia
HSKCLCDMIQLVLLEKKGKT

SEQ ID NO: 3073036 - protein, 22 aa, Giardia lamblia
HSKHFSCLGTIFIGVSECTFQL

SEQ ID NO: 3073037 - protein, 22 aa, Giardia lamblia
HSKHTIPLLLSRFSNDKLLQKS

SEQ ID NO: 3073038 - protein, 22 aa, Giardia lamblia
HSKMSIALIVVFWSVATLILLL

SEQ ID NO: 3073039 - protein, 17 aa, Giardia lamblia
HSLALSFGLTVGAFIVL

SEQ ID NO: 3073040 - protein, 21 aa, Giardia lamblia
HSLPPRQERLLPGKEGSLPDS

SEQ ID NO: 3073041 - protein, 32 aa, Giardia lamblia
HSLPRFSLECKFKFWFHRDPAAALGKILQCTV

SEQ ID NO: 3073042 - protein, 17 aa, Giardia lamblia
HSLQRRGFFCPQCNMVS

SEQ ID NO: 3073043 - protein, 22 aa, Giardia lamblia
HSMHFAHYLLLLIFLCTIALFV

SEQ ID NO: 3073044 - protein, 26 aa, Giardia lamblia
HSNSRLVIRPCIVRRRRKLMRPPRVA

SEQ ID NO: 3073045 - protein, 18 aa, Giardia lamblia
HSRAITLATEREMDTAQM

SEQ ID NO: 3073046 - protein, 22 aa, Giardia lamblia
HSSDGKLGLAMGYNASTAVQSV

SEQ ID NO: 3073047 - protein, 22 aa, Giardia lamblia
HSSIRKDPLFWLRSIFAGQRGS

SEQ ID NO: 3073048 - protein, 21 aa, Giardia lamblia
HSSVSRLLRISSMLIPVDYMF

SEQ ID NO: 3073049 - protein, 25 aa, Giardia lamblia
HSTSNKMCLTRPCAEAITPESELEV

SEQ ID NO: 3073050 - protein, 18 aa, Giardia lamblia
HSVGYAFLSMLATIVSVT

SEQ ID NO: 3073051 - protein, 21 aa, Giardia lamblia
HSVLWSMSYYTAKVLLAYFCA

SEQ ID NO: 3073052 - protein, 17 aa, Giardia lamblia
HSVSARKLRHWDKAFEF

SEQ ID NO: 3073053 - protein, 17 aa, Giardia lamblia
HSVSAYESMNFGLTSSS

SEQ ID NO: 3073054 - protein, 20 aa, Giardia lamblia
HSVTRLNGLIANCVTCQARL

SEQ ID NO: 3073055 - protein, 24 aa, Giardia lamblia
HSYPVEVVVSWPLQAVLYNTGHCG

SEQ ID NO: 3073056 - protein, 18 aa, Giardia lamblia
HTELRFFSEPACLTESEK

SEQ ID NO: 3073057 - protein, 27 aa, Giardia lamblia
HTICGRMLFKQASGFYKQAIEHLFKIK

SEQ ID NO: 3073058 - protein, 27 aa, Giardia lamblia
HTIPTVFGSYSLRGFIIVVWEITQVNT

SEQ ID NO: 3073059 - protein, 20 aa, Giardia lamblia
HTIRLLSALVCDSISNERHA

SEQ ID NO: 3073060 - protein, 19 aa, Giardia lamblia
HTKRLSAITSSFCTSNTCP

SEQ ID NO: 3073061 - protein, 24 aa, Giardia lamblia
HTLIDALICIFQFLETNSLQTHPF

SEQ ID NO: 3073062 - protein, 25 aa, Giardia lamblia
HTLLDIFSLELKESAFLTLFGTIAD

SEQ ID NO: 3073063 - protein, 20 aa, Giardia lamblia
HTLQIARFLGLRTLDQLIDV

SEQ ID NO: 3073064 - protein, 21 aa, Giardia lamblia
HTLRYLLSMFEAVMVNNTPGE

SEQ ID NO: 3073065 - protein, 18 aa, Giardia lamblia
HTLSELLSLLDTHHDLLD

SEQ ID NO: 3073066 - protein, 23 aa, Giardia lamblia
HTNLRSLQYIRWLSGSNSFRPHT

SEQ ID NO: 3073067 - protein, 18 aa, Giardia lamblia
HTRVLLPYFSKAGHMLYF

SEQ ID NO: 3073068 - protein, 20 aa, Giardia lamblia
HTSEAFWKANSHRLLDNSAY

SEQ ID NO: 3073069 - protein, 23 aa, Giardia lamblia
HTVHRTCHKSSKIASSEASEDHK

SEQ ID NO: 3073070 - protein, 17 aa, Giardia lamblia
HTVRYPLQYVSRLLPLT

SEQ ID NO: 3073071 - protein, 18 aa, Giardia lamblia
HTYKTRMGTVITLAVAPV

SEQ ID NO: 3073072 - protein, 34 aa, Giardia lamblia
HVAFNLKLSYLIEHVTCFISSLRLIDSIKTILNY

SEQ ID NO: 3073073 - protein, 21 aa, Giardia lamblia
HVAIELAHRAILVNHIPPTSC

SEQ ID NO: 3073074 - protein, 20 aa, Giardia lamblia
HVCSIFVADMDRLCGGLPVL

SEQ ID NO: 3073075 - protein, 21 aa, Giardia lamblia
HVDCSFFRLILPKLVADRLEV

SEQ ID NO: 3073076 - protein, 22 aa, Giardia lamblia
HVDEYLPLLSFYKAGRRAYKMY

SEQ ID NO: 3073077 - protein, 19 aa, Giardia lamblia
HVFNCGRSVDEVFLIRSMF

SEQ ID NO: 3073078 - protein, 20 aa, Giardia lamblia
HVFSNISFCLQVAPMSSLLC

SEQ ID NO: 3073079 - protein, 29 aa, Giardia lamblia
HVFYRKDGFRLSKWMHLFCDNAIMSLQDL

SEQ ID NO: 3073080 - protein, 23 aa, Giardia lamblia
HVIDSLYYLRSFHTLYYALVTMV

SEQ ID NO: 3073081 - protein, 17 aa, Giardia lamblia
HVLDLFKQGYHTVAGSI

SEQ ID NO: 3073082 - protein, 24 aa, Giardia lamblia
HVLHNFIFLCVHYKMTNEIRSILN

SEQ ID NO: 3073083 - protein, 39 aa, Giardia lamblia
HVRNLRPHIAPPLPFLDFLHYWFLFRVRPGIKNKDFLYA

SEQ ID NO: 3073084 - protein, 20 aa, Giardia lamblia
HVSHFRFLILELNEELESLF

SEQ ID NO: 3073085 - protein, 21 aa, Giardia lamblia
HVSLRCLFSGLGLENGTKKCF

SEQ ID NO: 3073086 - protein, 19 aa, Giardia lamblia
HVTIPFAPLLKRGSALLDQ

SEQ ID NO: 3073087 - protein, 24 aa, Giardia lamblia
HVTVPKGYVCRGVGLSYQDFCVPP

SEQ ID NO: 3073088 - protein, 18 aa, Giardia lamblia
HVWYSRFELTIKKIVHFI

SEQ ID NO: 3073089 - protein, 17 aa, Giardia lamblia
HVYSCNYVGSSPHLVQT

SEQ ID NO: 3073090 - protein, 20 aa, Giardia lamblia
HVYSIYTGAIIKQWDQRASN

SEQ ID NO: 3073091 - protein, 17 aa, Giardia lamblia
HWLFFLLPVVNKVDKLR

SEQ ID NO: 3073092 - protein, 21 aa, Giardia lamblia
HWRIVACLYTNSSLILITLFY

SEQ ID NO: 3073093 - protein, 18 aa, Giardia lamblia
HWSNPYVIALLYYSLLLS

SEQ ID NO: 3073094 - protein, 18 aa, Giardia lamblia
HWSPKLRNVATHSILKDT

SEQ ID NO: 3073095 - protein, 18 aa, Giardia lamblia
HYEKALTVFQIIALSVKV

SEQ ID NO: 3073096 - protein, 19 aa, Giardia lamblia
HYFFFLGVHFFVRMRILAS

SEQ ID NO: 3073097 - protein, 20 aa, Giardia lamblia
HYFFMAAIWALLIPLLFTSW

SEQ ID NO: 3073098 - protein, 36 aa, Giardia lamblia
HYFVKDMFWNFPLNASFARTRILLMDQGLRPPQLVF

SEQ ID NO: 3073099 - protein, 28 aa, Giardia lamblia
HYIVMASDLFEWCMPPPIVSLPQPIVCL

SEQ ID NO: 3073100 - protein, 21 aa, Giardia lamblia
HYKCIKLLSLEIGLNGVTPLM

SEQ ID NO: 3073101 - protein, 24 aa, Giardia lamblia
HYLIVKLLLDYEAYFSTTQLSTWP

SEQ ID NO: 3073102 - protein, 27 aa, Giardia lamblia
HYLSHLRCKYIMPLLPKYGDAPAVSTF

SEQ ID NO: 3073103 - protein, 17 aa, Giardia lamblia
HYLSYSIANKISVSRNL

SEQ ID NO: 3073104 - protein, 18 aa, Giardia lamblia
HYPDGSVYEGTWANDVRE

SEQ ID NO: 3073105 - protein, 18 aa, Giardia lamblia
HYRDCLVIFEGRDIVTYR

SEQ ID NO: 3073106 - protein, 21 aa, Giardia lamblia
HYSCKCATPGKTGFKEVDGYC

SEQ ID NO: 3073107 - protein, 21 aa, Giardia lamblia
HYSSRLFWKGLLQSSITFPAA

SEQ ID NO: 3073108 - protein, 18 aa, Giardia lamblia
HYYAHVFNYDLYYLQVES

SEQ ID NO: 3073109 - protein, 27 aa, Giardia lamblia
HYYYVSLRLILGGLFTVPAQSQLVQEC

SEQ ID NO: 3073110 - protein, 18 aa, Giardia lamblia
IAAAIEWSKSSIPHLQLK

SEQ ID NO: 3073111 - protein, 17 aa, Giardia lamblia
IAACGRGQFSRVDFVKV

SEQ ID NO: 3073112 - protein, 24 aa, Giardia lamblia
IAAFDGWLPLILSIVTSLSISAFT

SEQ ID NO: 3073113 - protein, 23 aa, Giardia lamblia
IAAIPCYLPGNLVYANLSMGMGI

SEQ ID NO: 3073114 - protein, 17 aa, Giardia lamblia
IAALGFATFFPASFLYT

SEQ ID NO: 3073115 - protein, 23 aa, Giardia lamblia
IAARITVALAMLFAGGGAAVRFW

SEQ ID NO: 3073116 - protein, 18 aa, Giardia lamblia
IACLEILAKIHSINTLHR

SEQ ID NO: 3073117 - protein, 19 aa, Giardia lamblia
IACLKDLRLINGACVDSSN

SEQ ID NO: 3073118 - protein, 18 aa, Giardia lamblia
IADGEVFALLGGNGAGKS

SEQ ID NO: 3073119 - protein, 18 aa, Giardia lamblia
IADGYYLLIVDFYDTLHT

SEQ ID NO: 3073120 - protein, 24 aa, Giardia lamblia
IADNLYRALPLSIFLPALIMVIIV

SEQ ID NO: 3073121 - protein, 25 aa, Giardia lamblia
IADSYYKFCVIWAIILMGELCVARH

SEQ ID NO: 3073122 - protein, 26 aa, Giardia lamblia
IAELAEPIGYVLELLLMKLIRKDTNL

SEQ ID NO: 3073123 - protein, 19 aa, Giardia lamblia
IAFGSGFKCNSVVWQATDA

SEQ ID NO: 3073124 - protein, 18 aa, Giardia lamblia
IAFPRNLAIVYFGRSLVG

SEQ ID NO: 3073125 - protein, 26 aa, Giardia lamblia
IAFSSVLCSLFFQLLFLLSRTNIITH

SEQ ID NO: 3073126 - protein, 18 aa, Giardia lamblia
IAGACLLGSFFGGAFTGG

SEQ ID NO: 3073127 - protein, 20 aa, Giardia lamblia
IAGELCLDMAQRGFAYKGKA

SEQ ID NO: 3073128 - protein, 18 aa, Giardia lamblia
IAGFIIEHMSWRACYIVC

SEQ ID NO: 3073129 - protein, 24 aa, Giardia lamblia
IAGVIGFLVWWFVCKKKTNKVNMP

SEQ ID NO: 3073130 - protein, 26 aa, Giardia lamblia
IAHLFVSIWLTMLVFRKTVLQVALKG

SEQ ID NO: 3073131 - protein, 18 aa, Giardia lamblia
IAHSLGGLVVQAYMQTYP

SEQ ID NO: 3073132 - protein, 30 aa, Giardia lamblia
IAICMRYPLLFNKLSFFFNRSEAILSSNQW

SEQ ID NO: 3073133 - protein, 26 aa, Giardia lamblia
IAIGLPEVICVCLTPQMLHAAMELIG

SEQ ID NO: 3073134 - protein, 18 aa, Giardia lamblia
IAITVCFILGLTRIIANK

SEQ ID NO: 3073135 - protein, 20 aa, Giardia lamblia
IAIWMIVVFFHKSCLMIPLK

SEQ ID NO: 3073136 - protein, 17 aa, Giardia lamblia
IAKEIKKSKIFKDSAFV

SEQ ID NO: 3073137 - protein, 21 aa, Giardia lamblia
IAKHLYLLALVARGFTQFSEK

SEQ ID NO: 3073138 - protein, 22 aa, Giardia lamblia
IAKLLINLVFLLRCDKSNLLTY

SEQ ID NO: 3073139 - protein, 25 aa, Giardia lamblia
IAKPLELFEVILLAYLFYYSTTPLL

SEQ ID NO: 3073140 - protein, 22 aa, Giardia lamblia
IAKRRIAYYTGFPYLKQLAYGS

SEQ ID NO: 3073141 - protein, 19 aa, Giardia lamblia
IALDRGVFLPADMPEQKPT

SEQ ID NO: 3073142 - protein, 17 aa, Giardia lamblia
IALELVRSSVQLPLAHY

SEQ ID NO: 3073143 - protein, 19 aa, Giardia lamblia
IALFAHMHVLAVSKGYIPN

SEQ ID NO: 3073144 - protein, 22 aa, Giardia lamblia
IALSCYKVFVSVIASFISIFNR

SEQ ID NO: 3073145 - protein, 17 aa, Giardia lamblia
IALSMELCEGGDLHDFL

SEQ ID NO: 3073146 - protein, 19 aa, Giardia lamblia
IAMAMDVCIVLMYTGLLVV

SEQ ID NO: 3073147 - protein, 25 aa, Giardia lamblia
IAMDLRAQLSFSVIEQHVLNASSCS

SEQ ID NO: 3073148 - protein, 18 aa, Giardia lamblia
IAMLGSRRIFCINERAHT

SEQ ID NO: 3073149 - protein, 21 aa, Giardia lamblia
IANGHTICFDILKFYEHKEEY

SEQ ID NO: 3073150 - protein, 24 aa, Giardia lamblia
IANKELLKLLVLHIDDSVSEISDA

SEQ ID NO: 3073151 - protein, 30 aa, Giardia lamblia
IAPSLHMSVCIIASYILENVYFILFLKRLL

SEQ ID NO: 3073152 - protein, 24 aa, Giardia lamblia
IARCPAFVCSRCSPEQKSIITKMV

SEQ ID NO: 3073153 - protein, 21 aa, Giardia lamblia
IARSRCSVIMLAVDSTQEEAG

SEQ ID NO: 3073154 - protein, 25 aa, Giardia lamblia
IASAPIVKCSVAFMSTNIYNTFFLG

SEQ ID NO: 3073155 - protein, 24 aa, Giardia lamblia
IASFSLILPSCFDRTLVILHQSSI

SEQ ID NO: 3073156 - protein, 23 aa, Giardia lamblia
IASLPHTLTAVFLEEELRFISLL

SEQ ID NO: 3073157 - protein, 21 aa, Giardia lamblia
IATRRGVVIGCRENGTVRSCA

SEQ ID NO: 3073158 - protein, 17 aa, Giardia lamblia
IATSFLLDGCSSGCCTI

SEQ ID NO: 3073159 - protein, 34 aa, Giardia lamblia
IAYLSCAFSKAGLRSLRPVTCQTLDDALVLAHES

SEQ ID NO: 3073160 - protein, 30 aa, Giardia lamblia
IAYNYRRIFCTISFYPRISRHNSVARLGFL

SEQ ID NO: 3073161 - protein, 28 aa, Giardia lamblia
ICAIYRTGAKIRPCFYLPAEGILINDAR

SEQ ID NO: 3073162 - protein, 19 aa, Giardia lamblia
ICCLIPDLKLFKAGDLTEI

SEQ ID NO: 3073163 - protein, 20 aa, Giardia lamblia
ICGFLLRAQNPVLMGLLPPP

SEQ ID NO: 3073164 - protein, 17 aa, Giardia lamblia
ICGQAFLMYQIRRMMGA

SEQ ID NO: 3073165 - protein, 18 aa, Giardia lamblia
ICIFPCREAIFAVTRRAG

SEQ ID NO: 3073166 - protein, 17 aa, Giardia lamblia
ICIGLLTSIVGMLSFSE

SEQ ID NO: 3073167 - protein, 22 aa, Giardia lamblia
ICIVISPLYFLVFLQKGTILTN

SEQ ID NO: 3073168 - protein, 21 aa, Giardia lamblia
ICKATFKKLITLAVHNDLEIR

SEQ ID NO: 3073169 - protein, 22 aa, Giardia lamblia
ICLRCNSCCYVVQIISCIVGLA

SEQ ID NO: 3073170 - protein, 17 aa, Giardia lamblia
ICLRTTSGLSLHLPVYL

SEQ ID NO: 3073171 - protein, 24 aa, Giardia lamblia
ICLYDVGLCPIPIHPESALLDLKR

SEQ ID NO: 3073172 - protein, 30 aa, Giardia lamblia
ICNAIFPSWVLNIFVCLFLILVVGKRISYL

SEQ ID NO: 3073173 - protein, 23 aa, Giardia lamblia
ICNALKTPCLLKSFVPSQTTDGN

SEQ ID NO: 3073174 - protein, 17 aa, Giardia lamblia
ICQRIDKALSEISLNDF

SEQ ID NO: 3073175 - protein, 18 aa, Giardia lamblia
ICSICFDYITLTEKHINL

SEQ ID NO: 3073176 - protein, 21 aa, Giardia lamblia
ICTARLKSVYFNIVLDSTDVF

SEQ ID NO: 3073177 - protein, 32 aa, Giardia lamblia
ICVHKEVLKALPLCALFPIFLSSNVIEPEIPS

SEQ ID NO: 3073178 - protein, 24 aa, Giardia lamblia
ICVVVFFATEKCMVFFTLLACLSM

SEQ ID NO: 3073179 - protein, 20 aa, Giardia lamblia
ICYFAMPFLVTVVSLGKWYR

SEQ ID NO: 3073180 - protein, 24 aa, Giardia lamblia
IDAGRPFIEYSKEIIFISLSGESN

SEQ ID NO: 3073181 - protein, 20 aa, Giardia lamblia
IDAHHTIPCGRACDAKDWSS

SEQ ID NO: 3073182 - protein, 19 aa, Giardia lamblia
IDAMLRCAEAEWDKTYQEA

SEQ ID NO: 3073183 - protein, 19 aa, Giardia lamblia
IDAVLPIFKCIKERAEIER

SEQ ID NO: 3073184 - protein, 20 aa, Giardia lamblia
IDCLNILACMVIIVSQLPAI

SEQ ID NO: 3073185 - protein, 19 aa, Giardia lamblia
IDDACAYYETLLPRQKHKA

SEQ ID NO: 3073186 - protein, 23 aa, Giardia lamblia
IDDLLHNILMEFSYDMATEVANR

SEQ ID NO: 3073187 - protein, 26 aa, Giardia lamblia
IDELCITKSINLCPAGAPSVTFLTVA

SEQ ID NO: 3073188 - protein, 17 aa, Giardia lamblia
IDELVCQNTMQARDMTI

SEQ ID NO: 3073189 - protein, 17 aa, Giardia lamblia
IDENLILNRYIGSSPDE

SEQ ID NO: 3073190 - protein, 18 aa, Giardia lamblia
IDEREWLAYLPGYMDTVL

SEQ ID NO: 3073191 - protein, 19 aa, Giardia lamblia
IDESGACAHLDWEVVTASL

SEQ ID NO: 3073192 - protein, 18 aa, Giardia lamblia
IDFDLPYIQLVYKALLAL

SEQ ID NO: 3073193 - protein, 25 aa, Giardia lamblia
IDGGGIFRSMISQCFMELLNEEEIR

SEQ ID NO: 3073194 - protein, 26 aa, Giardia lamblia
IDGGILCALEIFRHVPEYVMGQIVEA

SEQ ID NO: 3073195 - protein, 17 aa, Giardia lamblia
IDGNCLRSVKALLAHGT

SEQ ID NO: 3073196 - protein, 20 aa, Giardia lamblia
IDHARNILRTACNLEIPNPG

SEQ ID NO: 3073197 - protein, 26 aa, Giardia lamblia
IDHHNIFPLRALFIMLLSRETYHISR

SEQ ID NO: 3073198 - protein, 17 aa, Giardia lamblia
IDIEILDSIPLNGSLYH

SEQ ID NO: 3073199 - protein, 19 aa, Giardia lamblia
IDIGNAYGYKGGNSPDPLS

SEQ ID NO: 3073200 - protein, 17 aa, Giardia lamblia
IDIPQAFLAQQETGSSE

SEQ ID NO: 3073201 - protein, 18 aa, Giardia lamblia
IDISLCDDAAYVLLSTGQ

SEQ ID NO: 3073202 - protein, 30 aa, Giardia lamblia
IDKAWRSQLKWWSCRLCSKPPSIKCRACST

SEQ ID NO: 3073203 - protein, 25 aa, Giardia lamblia
IDKDCLRLLLMNTADLSAAPYSFLN

SEQ ID NO: 3073204 - protein, 17 aa, Giardia lamblia
IDKSCWKQFEFGNCNLK

SEQ ID NO: 3073205 - protein, 19 aa, Giardia lamblia
IDLDESLCIVDLFNYKELY

SEQ ID NO: 3073206 - protein, 24 aa, Giardia lamblia
IDLGSPYSIFGIPLVDQMFSDVLE

SEQ ID NO: 3073207 - protein, 23 aa, Giardia lamblia
IDLLLPDRCNIVDALVSFRKNYH

SEQ ID NO: 3073208 - protein, 21 aa, Giardia lamblia
IDLMGKFILSRYFPKILNKSE

SEQ ID NO: 3073209 - protein, 17 aa, Giardia lamblia
IDLPLCNTLYGMVTAAI

SEQ ID NO: 3073210 - protein, 18 aa, Giardia lamblia
IDLQLSYLHLIAKASTLK

SEQ ID NO: 3073211 - protein, 24 aa, Giardia lamblia
IDLSRLSIFYGTYKLLSYVRQGES

SEQ ID NO: 3073212 - protein, 32 aa, Giardia lamblia
IDLSTPWRRFSFSVKRLLLKLSRSTSANSQRS

SEQ ID NO: 3073213 - protein, 19 aa, Giardia lamblia
IDLTGRIAEFAVWNGLLLS

SEQ ID NO: 3073214 - protein, 26 aa, Giardia lamblia
IDLYKSGPYPGLFFILLPLTPYIALA

SEQ ID NO: 3073215 - protein, 19 aa, Giardia lamblia
IDMATLFRSGAVHRIPTPT

SEQ ID NO: 3073216 - protein, 19 aa, Giardia lamblia
IDNCLQCSTDIFICELCTD

SEQ ID NO: 3073217 - protein, 23 aa, Giardia lamblia
IDNVKMLLIERGIRTSTGRTALM

SEQ ID NO: 3073218 - protein, 19 aa, Giardia lamblia
IDPNNYFIAIARLIEFIPD

SEQ ID NO: 3073219 - protein, 21 aa, Giardia lamblia
IDPRCIFYDDYGMLRVEFGCP

SEQ ID NO: 3073220 - protein, 21 aa, Giardia lamblia
IDPRYTARVEADWLAELLRIL

SEQ ID NO: 3073221 - protein, 23 aa, Giardia lamblia
IDPYSGAFSRVFKDSERSKVFCS

SEQ ID NO: 3073222 - protein, 17 aa, Giardia lamblia
IDRTRHCQIMKDVKSVF

SEQ ID NO: 3073223 - protein, 18 aa, Giardia lamblia
IDSAEIILTLSLDLSLRR

SEQ ID NO: 3073224 - protein, 24 aa, Giardia lamblia
IDSLCLFFVPLACLFWAAWSSGVD

SEQ ID NO: 3073225 - protein, 27 aa, Giardia lamblia
IDSYTLGALLRRLWSLFFDSLGSLTNE

SEQ ID NO: 3073226 - protein, 18 aa, Giardia lamblia
IDTLKESGILLVRDDLDL

SEQ ID NO: 3073227 - protein, 26 aa, Giardia lamblia
IDVILRFLRINALLSISFQIESTECQ

SEQ ID NO: 3073228 - protein, 23 aa, Giardia lamblia
IDVKLDVVRRVFKALLPELPMET

SEQ ID NO: 3073229 - protein, 23 aa, Giardia lamblia
IDVRSILVDTCLALQDAQESKVS

SEQ ID NO: 3073230 - protein, 24 aa, Giardia lamblia
IDYIESILSFRLLKDYNSPHRGTV

SEQ ID NO: 3073231 - protein, 22 aa, Giardia lamblia
IDYRTTSSFQFFERPQTIHPIH

SEQ ID NO: 3073232 - protein, 19 aa, Giardia lamblia
IDYVLRLLTPLPDGTHEVE

SEQ ID NO: 3073233 - protein, 18 aa, Giardia lamblia
IEAAFCAAYAAPHHGAIL

SEQ ID NO: 3073234 - protein, 19 aa, Giardia lamblia
IEAILPFTVTPNYALARYF

SEQ ID NO: 3073235 - protein, 20 aa, Giardia lamblia
IEAIRWGSNIVHNVRKFIQF

SEQ ID NO: 3073236 - protein, 17 aa, Giardia lamblia
IEALDHVYWPEGTPGAP

SEQ ID NO: 3073237 - protein, 30 aa, Giardia lamblia
IECRNRRVIPFLLREAWLIDFHGKTPLEYA

SEQ ID NO: 3073238 - protein, 24 aa, Giardia lamblia
IEDKLIFCRNFVIAIGNVRKLLPE

SEQ ID NO: 3073239 - protein, 23 aa, Giardia lamblia
IEEAISFLYRLFHVSLEASPDLL

SEQ ID NO: 3073240 - protein, 29 aa, Giardia lamblia
IEECLPIPLLLRYLRAWKTPSDAYNSIIY

SEQ ID NO: 3073241 - protein, 29 aa, Giardia lamblia
IEELLRPIPRIWLPFSLKEYAGTIIELFN

SEQ ID NO: 3073242 - protein, 18 aa, Giardia lamblia
IEFDRYSLRRILLDYKLL

SEQ ID NO: 3073243 - protein, 24 aa, Giardia lamblia
IEGFGEAVSLCFTKHTTNEYLLLN

SEQ ID NO: 3073244 - protein, 19 aa, Giardia lamblia
IEGLICIGLVLLNKRPEGT

SEQ ID NO: 3073245 - protein, 24 aa, Giardia lamblia
IEGLIRLAAEYALSLLHKQIRDFS

SEQ ID NO: 3073246 - protein, 31 aa, Giardia lamblia
IEICSPGRLGGSMCIKSLLVPIQVMCVPSLL

SEQ ID NO: 3073247 - protein, 17 aa, Giardia lamblia
IEIKRNLNIHSEKQKEL

SEQ ID NO: 3073248 - protein, 20 aa, Giardia lamblia
IEIPETALAITMHEKSLLHY

SEQ ID NO: 3073249 - protein, 24 aa, Giardia lamblia
IEISADIFFRIFKVLSKNYSKSIF

SEQ ID NO: 3073250 - protein, 22 aa, Giardia lamblia
IEKRGVPTICMIDRNTPGYEFP

SEQ ID NO: 3073251 - protein, 20 aa, Giardia lamblia
IELCSNCVAENEFLRLECQS

SEQ ID NO: 3073252 - protein, 23 aa, Giardia lamblia
IELEHLRGLIFRLITMIELIQKS

SEQ ID NO: 3073253 - protein, 19 aa, Giardia lamblia
IELEPKVKCKAVPLYGKPN

SEQ ID NO: 3073254 - protein, 17 aa, Giardia lamblia
IELLLAIDIDRIEQGGP

SEQ ID NO: 3073255 - protein, 19 aa, Giardia lamblia
IELLLNFQIIQMTRLLKTI

SEQ ID NO: 3073256 - protein, 19 aa, Giardia lamblia
IENDFDAFLFIKSEPNILV

SEQ ID NO: 3073257 - protein, 23 aa, Giardia lamblia
IEPEESFFVRYGRYLSSNRATLI

SEQ ID NO: 3073258 - protein, 24 aa, Giardia lamblia
IEPKEYLFGPVMPRKSYIQADSQN

SEQ ID NO: 3073259 - protein, 19 aa, Giardia lamblia
IEPKVAPENAVMLMQCILR

SEQ ID NO: 3073260 - protein, 19 aa, Giardia lamblia
IEPSREWIDSSFLRALREA

SEQ ID NO: 3073261 - protein, 19 aa, Giardia lamblia
IEQCWSWCMECTSNSLTED

SEQ ID NO: 3073262 - protein, 22 aa, Giardia lamblia
IEQRMRMTIFYNLYKNTMLAII

SEQ ID NO: 3073263 - protein, 24 aa, Giardia lamblia
IERTIRFLAVGGMNVRASTQVVPH

SEQ ID NO: 3073264 - protein, 18 aa, Giardia lamblia
IESFKPTVHYTRTLIVNS

SEQ ID NO: 3073265 - protein, 25 aa, Giardia lamblia
IESHKFAVLSKHCGFSRGDTFALSQ

SEQ ID NO: 3073266 - protein, 19 aa, Giardia lamblia
IESTCNCIVQFLPEKIAKL

SEQ ID NO: 3073267 - protein, 24 aa, Giardia lamblia
IESVLKAALLIRADVPARLSSEQC

SEQ ID NO: 3073268 - protein, 19 aa, Giardia lamblia
IESVLLTHKDRLMVLKRAH

SEQ ID NO: 3073269 - protein, 28 aa, Giardia lamblia
IETLLPQFKFISSIAFQPRHFKMLTREY

SEQ ID NO: 3073270 - protein, 21 aa, Giardia lamblia
IEYSKHPYVIPKLTNARYKLP

SEQ ID NO: 3073271 - protein, 23 aa, Giardia lamblia
IEYVTCVFEYYSLAMEHRTLEPS

SEQ ID NO: 3073272 - protein, 20 aa, Giardia lamblia
IFAIAACSKLLKRALRSKKE

SEQ ID NO: 3073273 - protein, 22 aa, Giardia lamblia
IFAIHICVVMLYILQSFNTNIV

SEQ ID NO: 3073274 - protein, 24 aa, Giardia lamblia
IFAIYKRLLPALADDSILQAALSS

SEQ ID NO: 3073275 - protein, 17 aa, Giardia lamblia
IFAMCSCRQEICLPNKI

SEQ ID NO: 3073276 - protein, 25 aa, Giardia lamblia
IFCQTTLCIYKCCMQNVSHSIPYSL

SEQ ID NO: 3073277 - protein, 23 aa, Giardia lamblia
IFDKTCRPLVASVSGYFRESLYA

SEQ ID NO: 3073278 - protein, 23 aa, Giardia lamblia
IFENLRKSLAYTITSAVPQLLPF

SEQ ID NO: 3073279 - protein, 23 aa, Giardia lamblia
IFGELCPNYVKFYSISDIYGSEN

SEQ ID NO: 3073280 - protein, 24 aa, Giardia lamblia
IFGILYCFQEIVILAPVYAMSRVA

SEQ ID NO: 3073281 - protein, 25 aa, Giardia lamblia
IFGLFGSICGVLIYFVVPILLWHKL

SEQ ID NO: 3073282 - protein, 25 aa, Giardia lamblia
IFHPEILIYVAFSIMLRASKQALAE

SEQ ID NO: 3073283 - protein, 18 aa, Giardia lamblia
IFIAENGLHFVVTGLEYI

SEQ ID NO: 3073284 - protein, 23 aa, Giardia lamblia
IFIQQTFLLFGFHIIPESNENNN

SEQ ID NO: 3073285 - protein, 18 aa, Giardia lamblia
IFIWLASADTPCWCANDQ

SEQ ID NO: 3073286 - protein, 22 aa, Giardia lamblia
IFKCIKERAEIERIICQDVNGE

SEQ ID NO: 3073287 - protein, 21 aa, Giardia lamblia
IFKLRLRKVYNATPDKQLPDA

SEQ ID NO: 3073288 - protein, 22 aa, Giardia lamblia
IFLCTIALFVFIIIASKRPDLI

SEQ ID NO: 3073289 - protein, 28 aa, Giardia lamblia
IFLFIDIFQPIFLCLLFTSFAFSPVHAT

SEQ ID NO: 3073290 - protein, 18 aa, Giardia lamblia
IFLGLKSPVFHGSNHESV

SEQ ID NO: 3073291 - protein, 17 aa, Giardia lamblia
IFLLLFYTICSKIGRER

SEQ ID NO: 3073292 - protein, 20 aa, Giardia lamblia
IFLVMAVRFFLAGTANDNRQ

SEQ ID NO: 3073293 - protein, 18 aa, Giardia lamblia
IFMRAVCNLPEYIKQMKQ

SEQ ID NO: 3073294 - protein, 20 aa, Giardia lamblia
IFPPMLKKLNSVLEKLLKKS

SEQ ID NO: 3073295 - protein, 21 aa, Giardia lamblia
IFQQEIADWIAMDLRAQLSFS

SEQ ID NO: 3073296 - protein, 17 aa, Giardia lamblia
IFSEALALYGLIIALIL

SEQ ID NO: 3073297 - protein, 32 aa, Giardia lamblia
IFSKFSALIKRLCSITLIPLAFFEEAKAILQQ

SEQ ID NO: 3073298 - protein, 43 aa, Giardia lamblia
IFSLFKYLLPMVFCPFYMRRQRKFSIWFLDVFCQPISQYARCG

SEQ ID NO: 3073299 - protein, 17 aa, Giardia lamblia
IFSLLMILKSTEHSLIN

SEQ ID NO: 3073300 - protein, 17 aa, Giardia lamblia
IFTIYWLGYIRLLLEHS

SEQ ID NO: 3073301 - protein, 17 aa, Giardia lamblia
IFTPPLFLYQSPAKLVV

SEQ ID NO: 3073302 - protein, 31 aa, Giardia lamblia
IFVAWLTTIRMLRIRKTFLLLTYDKLLITAF

SEQ ID NO: 3073303 - protein, 19 aa, Giardia lamblia
IFVDPCGIPILGGGKATEK

SEQ ID NO: 3073304 - protein, 17 aa, Giardia lamblia
IFVGFTFMLVATGAYYL

SEQ ID NO: 3073305 - protein, 25 aa, Giardia lamblia
IFYEACTFGYLAYQYFGLFVLDQDE

SEQ ID NO: 3073306 - protein, 24 aa, Giardia lamblia
IFYSPRELGGLGMLSVGSAGVYPS

SEQ ID NO: 3073307 - protein, 24 aa, Giardia lamblia
IFYVICVVAGFYLLVTYVPGKILS

SEQ ID NO: 3073308 - protein, 25 aa, Giardia lamblia
IGAIVGVLCWYFLVYRKKNPRPQWI

SEQ ID NO: 3073309 - protein, 24 aa, Giardia lamblia
IGAYDRLYSLTFPRLKGRELHMFI

SEQ ID NO: 3073310 - protein, 25 aa, Giardia lamblia
IGAYFPFGLCYDFTLLKQRKHSVLD

SEQ ID NO: 3073311 - protein, 25 aa, Giardia lamblia
IGDAYEVMGLPGILKKYGNAGKRRN

SEQ ID NO: 3073312 - protein, 17 aa, Giardia lamblia
IGDGIAGAVGLLALAMY

SEQ ID NO: 3073313 - protein, 20 aa, Giardia lamblia
IGDISDFLRGLLVENMDSRL

SEQ ID NO: 3073314 - protein, 27 aa, Giardia lamblia
IGDNLKWGVLCPCFVLFNEAHYTSLFP

SEQ ID NO: 3073315 - protein, 24 aa, Giardia lamblia
IGDRYGVTVVHRWGVSGFVLFSTL

SEQ ID NO: 3073316 - protein, 17 aa, Giardia lamblia
IGDWEIGLELLLYGDNE

SEQ ID NO: 3073317 - protein, 24 aa, Giardia lamblia
IGELRIIVISVYFAMFPSLLRWAV

SEQ ID NO: 3073318 - protein, 24 aa, Giardia lamblia
IGELRVIVISIYFAMLPSLLRWAI

SEQ ID NO: 3073319 - protein, 25 aa, Giardia lamblia
IGENKAICMSNTWPTSGTSGETLCA

SEQ ID NO: 3073320 - protein, 26 aa, Giardia lamblia
IGEVYRCVCAPGWTGYDCSSCSRGFV

SEQ ID NO: 3073321 - protein, 24 aa, Giardia lamblia
IGFICAYLDILLRLIENNLIKRSL

SEQ ID NO: 3073322 - protein, 34 aa, Giardia lamblia
IGGFAGKIAMQAVRLIRIYSCAAYSNTVNATETS

SEQ ID NO: 3073323 - protein, 24 aa, Giardia lamblia
IGGLRIGPLPSIASTHARRRKSHA

SEQ ID NO: 3073324 - protein, 17 aa, Giardia lamblia
IGGVLGYLTGVEPASDI

SEQ ID NO: 3073325 - protein, 17 aa, Giardia lamblia
IGHATNLDKVFEFAVLW

SEQ ID NO: 3073326 - protein, 18 aa, Giardia lamblia
IGHCACTRNIHGQTALMV

SEQ ID NO: 3073327 - protein, 17 aa, Giardia lamblia
IGHCKRTPYGNKVRKLQ

SEQ ID NO: 3073328 - protein, 22 aa, Giardia lamblia
IGHLCAAFAPELVVFNAPIGKI

SEQ ID NO: 3073329 - protein, 25 aa, Giardia lamblia
IGILIFCLFSIMQILGCIYIQSFSS

SEQ ID NO: 3073330 - protein, 17 aa, Giardia lamblia
IGILKFIVSVTFAMLVG

SEQ ID NO: 3073331 - protein, 24 aa, Giardia lamblia
IGKICECCKYTALMHAVEVDAVDV

SEQ ID NO: 3073332 - protein, 22 aa, Giardia lamblia
IGKIEKIHHYFTLFRIQQIHFA

SEQ ID NO: 3073333 - protein, 17 aa, Giardia lamblia
IGKYVMFDTVEFFEFVC

SEQ ID NO: 3073334 - protein, 18 aa, Giardia lamblia
IGLELLLYGDNETVIQSI

SEQ ID NO: 3073335 - protein, 20 aa, Giardia lamblia
IGLFLSFSFAFMVILFVGQL

SEQ ID NO: 3073336 - protein, 18 aa, Giardia lamblia
IGLLPILSILYFIGMFCY

SEQ ID NO: 3073337 - protein, 20 aa, Giardia lamblia
IGLSLIFKTALRMSIESSNF

SEQ ID NO: 3073338 - protein, 29 aa, Giardia lamblia
IGMLARACADRGSAMLKPQITTVKPASEL

SEQ ID NO: 3073339 - protein, 26 aa, Giardia lamblia
IGMVDLRILLLALINLLSNANYTILV

SEQ ID NO: 3073340 - protein, 23 aa, Giardia lamblia
IGNLHRLQLYTGRDKESHPHNLH

SEQ ID NO: 3073341 - protein, 24 aa, Giardia lamblia
IGPDEARCDPGFKLDDAKNCTLYS

SEQ ID NO: 3073342 - protein, 19 aa, Giardia lamblia
IGPLCPKPSSSRIEAAKDA

SEQ ID NO: 3073343 - protein, 22 aa, Giardia lamblia
IGPQFSYRGVFLLEYIGPLVIW

SEQ ID NO: 3073344 - protein, 24 aa, Giardia lamblia
IGQDSVCKFGLLSISADASAVLEN

SEQ ID NO: 3073345 - protein, 25 aa, Giardia lamblia
IGRGPYFMICVTISMLQDFGPLIDL

SEQ ID NO: 3073346 - protein, 22 aa, Giardia lamblia
IGSCIGASLLALGNRFSNLGWP

SEQ ID NO: 3073347 - protein, 17 aa, Giardia lamblia
IGSELKIVGDMLGYSHP

SEQ ID NO: 3073348 - protein, 18 aa, Giardia lamblia
IGSISFYLLSFISDALQV

SEQ ID NO: 3073349 - protein, 19 aa, Giardia lamblia
IGSPMVPSAPLFGSSGTKM

SEQ ID NO: 3073350 - protein, 26 aa, Giardia lamblia
IGTLKLCDFTCCVYLGDPTGSQELNS

SEQ ID NO: 3073351 - protein, 17 aa, Giardia lamblia
IGVCPQHNTTLWPGLTP

SEQ ID NO: 3073352 - protein, 19 aa, Giardia lamblia
IGVFTPYAFCLKNPEFVDN

SEQ ID NO: 3073353 - protein, 17 aa, Giardia lamblia
IGVGVGYPSLADFLTYL

SEQ ID NO: 3073354 - protein, 19 aa, Giardia lamblia
IGVHLAAYVYYEILEHVIM

SEQ ID NO: 3073355 - protein, 19 aa, Giardia lamblia
IGVLYRLRVLAQRDPAILC

SEQ ID NO: 3073356 - protein, 27 aa, Giardia lamblia
IGYPLIKSICHRLILLPSIEGADGSKK

SEQ ID NO: 3073357 - protein, 18 aa, Giardia lamblia
IHALEDLLGLAIVAFTTD

SEQ ID NO: 3073358 - protein, 17 aa, Giardia lamblia
IHECGVTCIEYITKNLM

SEQ ID NO: 3073359 - protein, 17 aa, Giardia lamblia
IHFDPMFDPLAQASLEA

SEQ ID NO: 3073360 - protein, 29 aa, Giardia lamblia
IHGILSSLFYQFYAITAFPSSFIPALVVS

SEQ ID NO: 3073361 - protein, 17 aa, Giardia lamblia
IHIYLGISVITAGRATS

SEQ ID NO: 3073362 - protein, 23 aa, Giardia lamblia
IHKIPHKVAWGIVGAISMVSFET

SEQ ID NO: 3073363 - protein, 21 aa, Giardia lamblia
IHKRLSNFFITIRNMLYWEDA

SEQ ID NO: 3073364 - protein, 18 aa, Giardia lamblia
IHLGGLVGDAMRGGSDSF

SEQ ID NO: 3073365 - protein, 19 aa, Giardia lamblia
IHLLFTRYHRYLINSYQLI

SEQ ID NO: 3073366 - protein, 36 aa, Giardia lamblia
IHLNLPIIRISQFLLRKNKIVGVLSEFNRYLEGLSA

SEQ ID NO: 3073367 - protein, 24 aa, Giardia lamblia
IHLQRITSFTGVFVEKTFSVKPQL

SEQ ID NO: 3073368 - protein, 18 aa, Giardia lamblia
IHMYRKVRPMKWIPNCRP

SEQ ID NO: 3073369 - protein, 24 aa, Giardia lamblia
IHNYKAVSILAKWEGEKQDHNGLT

SEQ ID NO: 3073370 - protein, 17 aa, Giardia lamblia
IHPAHYLLSSEWDITAL

SEQ ID NO: 3073371 - protein, 18 aa, Giardia lamblia
IHPRIMVVRSLLAKLRDM

SEQ ID NO: 3073372 - protein, 26 aa, Giardia lamblia
IHQVALRWADCLGVTLNLADNPNEIV

SEQ ID NO: 3073373 - protein, 17 aa, Giardia lamblia
IHRDIKPANLLIGDDMQ

SEQ ID NO: 3073374 - protein, 18 aa, Giardia lamblia
IHRRKLETGERVSYDDSS

SEQ ID NO: 3073375 - protein, 24 aa, Giardia lamblia
IHSLCYQFSLELRFVPFKKYCFEF

SEQ ID NO: 3073376 - protein, 19 aa, Giardia lamblia
IHTIHRITPMVLKNDGLMS

SEQ ID NO: 3073377 - protein, 18 aa, Giardia lamblia
IHTRIATFHQMYKANSIA

SEQ ID NO: 3073378 - protein, 23 aa, Giardia lamblia
IHVMREIWKIRSIDGTEKSLKKK

SEQ ID NO: 3073379 - protein, 21 aa, Giardia lamblia
IHVYLDICAQVLKANMLQGNS

SEQ ID NO: 3073380 - protein, 21 aa, Giardia lamblia
IHYKYGFAGVVLRGIDYPYFL

SEQ ID NO: 3073381 - protein, 18 aa, Giardia lamblia
IHYNACALIPPYCAIQIQ

SEQ ID NO: 3073382 - protein, 18 aa, Giardia lamblia
IIAFARNGLQEMGEEPLL

SEQ ID NO: 3073383 - protein, 19 aa, Giardia lamblia
IIAIELLGALPYLNNELSR

SEQ ID NO: 3073384 - protein, 19 aa, Giardia lamblia
IIANFQIVSFAKSRAAMED

SEQ ID NO: 3073385 - protein, 20 aa, Giardia lamblia
IIAVSCRYLLAGIDACVKTG

SEQ ID NO: 3073386 - protein, 19 aa, Giardia lamblia
IICEFSYSFTKLIFVNTST

SEQ ID NO: 3073387 - protein, 26 aa, Giardia lamblia
IICPPEQRFLLLYTFMKRRSDKKIIV

SEQ ID NO: 3073388 - protein, 23 aa, Giardia lamblia
IIDCYDWACSIVDSKKAKKGLAL

SEQ ID NO: 3073389 - protein, 17 aa, Giardia lamblia
IIEILVPISDVAIEGYS

SEQ ID NO: 3073390 - protein, 24 aa, Giardia lamblia
IIESIPYIITCCLFANPNTNYTVC

SEQ ID NO: 3073391 - protein, 25 aa, Giardia lamblia
IIFFICLACAFLISFVEGGATSLFI

SEQ ID NO: 3073392 - protein, 26 aa, Giardia lamblia
IIFVLKMFPIRYVILGWFRLTIDTRK

SEQ ID NO: 3073393 - protein, 24 aa, Giardia lamblia
IIGAVAGFLCWWFLCHKKNGGNCF

SEQ ID NO: 3073394 - protein, 18 aa, Giardia lamblia
IIGICMFAYSVCRYKILS

SEQ ID NO: 3073395 - protein, 27 aa, Giardia lamblia
IIGSVCVELPMGSLVAMHGLAHKTYRS

SEQ ID NO: 3073396 - protein, 19 aa, Giardia lamblia
IIINKCLFKLSKTYQKRSH

SEQ ID NO: 3073397 - protein, 27 aa, Giardia lamblia
IIIPPLLCIFGMLFARPMITMLTPKMG

SEQ ID NO: 3073398 - protein, 20 aa, Giardia lamblia
IIITAIFCGRMLNVHYRQKR

SEQ ID NO: 3073399 - protein, 22 aa, Giardia lamblia
IIKALSTAGGLSFLHSTTFVLK

SEQ ID NO: 3073400 - protein, 22 aa, Giardia lamblia
IIKDPEALYVFLILMDGVLYAR

SEQ ID NO: 3073401 - protein, 23 aa, Giardia lamblia
IIKERRAKNKSHRGVHNDKIDAL

SEQ ID NO: 3073402 - protein, 25 aa, Giardia lamblia
IIKIIPPVFRYKYPASLVTSTSPDI

SEQ ID NO: 3073403 - protein, 20 aa, Giardia lamblia
IIKPDIDYIAAGLFLMHGFA

SEQ ID NO: 3073404 - protein, 28 aa, Giardia lamblia
IILGCVMFICGLTLLIIFLERGPRSAKY

SEQ ID NO: 3073405 - protein, 20 aa, Giardia lamblia
IILHFIPLLVNKAMSSYLLP

SEQ ID NO: 3073406 - protein, 18 aa, Giardia lamblia
IILSVWFASWIRQRRAIR

SEQ ID NO: 3073407 - protein, 17 aa, Giardia lamblia
IILWCYDSVAVVRDSCI

SEQ ID NO: 3073408 - protein, 17 aa, Giardia lamblia
IILYAVIFFMFRRVAPQ

SEQ ID NO: 3073409 - protein, 17 aa, Giardia lamblia
IIMPANPAFSVVFPDKS

SEQ ID NO: 3073410 - protein, 18 aa, Giardia lamblia
IINLLIVLLCELDKRTDI

SEQ ID NO: 3073411 - protein, 17 aa, Giardia lamblia
IINLLIVLNNIYIPTNN

SEQ ID NO: 3073412 - protein, 20 aa, Giardia lamblia
IIPASGIFPFRGMSSYVAPL

SEQ ID NO: 3073413 - protein, 17 aa, Giardia lamblia
IIPRILAFIKENELLSI

SEQ ID NO: 3073414 - protein, 17 aa, Giardia lamblia
IIPYGFAALCFCSSLTL

SEQ ID NO: 3073415 - protein, 17 aa, Giardia lamblia
IIQELGLQTGPYRRTAL

SEQ ID NO: 3073416 - protein, 23 aa, Giardia lamblia
IIQQLYSACYVIRYTDEHKSLPQ

SEQ ID NO: 3073417 - protein, 20 aa, Giardia lamblia
IIRHFLQNYMEVFNDNGANI

SEQ ID NO: 3073418 - protein, 24 aa, Giardia lamblia
IIRMLFCGTTDPLADLFSMRCIIN

SEQ ID NO: 3073419 - protein, 23 aa, Giardia lamblia
IISGKRINAFLSLPDVADNLAAG

SEQ ID NO: 3073420 - protein, 24 aa, Giardia lamblia
IISVMFKRQIRWGSRTYVCSEGRV

SEQ ID NO: 3073421 - protein, 30 aa, Giardia lamblia
IITMRLRCSYLLKYMWRLFSSEYTLPQNIL

SEQ ID NO: 3073422 - protein, 19 aa, Giardia lamblia
IITNLPFPLRMPAAMKLPS

SEQ ID NO: 3073423 - protein, 21 aa, Giardia lamblia
IITQRLIELVIGPVILVSLQH

SEQ ID NO: 3073424 - protein, 17 aa, Giardia lamblia
IIVARARDARILQLSIR

SEQ ID NO: 3073425 - protein, 20 aa, Giardia lamblia
IIVGSTCVLQKSIVITVSVC

SEQ ID NO: 3073426 - protein, 19 aa, Giardia lamblia
IIVMNEIPFSPTTIASITT

SEQ ID NO: 3073427 - protein, 26 aa, Giardia lamblia
IIVPLICFRGLNFLNYVSIVATIMVL

SEQ ID NO: 3073428 - protein, 27 aa, Giardia lamblia
IIVSRFDYNNCWAEIDILQSVYEDDGA

SEQ ID NO: 3073429 - protein, 19 aa, Giardia lamblia
IIVWSSKAFCSWGFTWQCP

SEQ ID NO: 3073430 - protein, 17 aa, Giardia lamblia
IIYANSLDFELSQFRTL

SEQ ID NO: 3073431 - protein, 22 aa, Giardia lamblia
IIYEIYKYGSPRCTTKTVSEQS

SEQ ID NO: 3073432 - protein, 24 aa, Giardia lamblia
IIYGRLGFSGAFISTATPMASSFS

SEQ ID NO: 3073433 - protein, 18 aa, Giardia lamblia
IKAFKRLHINDINEGEHM

SEQ ID NO: 3073434 - protein, 17 aa, Giardia lamblia
IKAISMNAGNLLVATPI

SEQ ID NO: 3073435 - protein, 25 aa, Giardia lamblia
IKAKYRICFLPSPAVNVEHTSEHVL

SEQ ID NO: 3073436 - protein, 17 aa, Giardia lamblia
IKCNCFKGSRTETTNKF

SEQ ID NO: 3073437 - protein, 18 aa, Giardia lamblia
IKCTACSSGYLSADGSSC

SEQ ID NO: 3073438 - protein, 17 aa, Giardia lamblia
IKDGAVCPHGNCVLLEA

SEQ ID NO: 3073439 - protein, 26 aa, Giardia lamblia
IKDHTKLVVSLLQWLDDVSFISSASY

SEQ ID NO: 3073440 - protein, 18 aa, Giardia lamblia
IKDKNGWTALMHAAHGNH

SEQ ID NO: 3073441 - protein, 20 aa, Giardia lamblia
IKDLCIFDGILEHKVPEHVY

SEQ ID NO: 3073442 - protein, 26 aa, Giardia lamblia
IKDLRDFKILVGPLLVRLTMQPSYQE

SEQ ID NO: 3073443 - protein, 18 aa, Giardia lamblia
IKDMCLAAFQSDATISNE

SEQ ID NO: 3073444 - protein, 21 aa, Giardia lamblia
IKDMISFCGVARKADGSEDTL

SEQ ID NO: 3073445 - protein, 20 aa, Giardia lamblia
IKERLVDYAIRFPEDQKDLL

SEQ ID NO: 3073446 - protein, 31 aa, Giardia lamblia
IKETCLRNALHAEMSRRILLLYDSILLAKRH

SEQ ID NO: 3073447 - protein, 26 aa, Giardia lamblia
IKFFSESFMILAIPLFIEVVLGPKYS

SEQ ID NO: 3073448 - protein, 17 aa, Giardia lamblia
IKFRVLVSHISMYTITK

SEQ ID NO: 3073449 - protein, 20 aa, Giardia lamblia
IKFVSGRDLTLFIYSYANNE

SEQ ID NO: 3073450 - protein, 25 aa, Giardia lamblia
IKGECIALAQLLRGVAFAAGCELTT

SEQ ID NO: 3073451 - protein, 26 aa, Giardia lamblia
IKGGVLRCKFGLLRYNVDELRDHDER

SEQ ID NO: 3073452 - protein, 23 aa, Giardia lamblia
IKGLKEDLHFLLAARDEDNQLLA

SEQ ID NO: 3073453 - protein, 17 aa, Giardia lamblia
IKGLLEPKCNPYPNTDG

SEQ ID NO: 3073454 - protein, 23 aa, Giardia lamblia
IKHIAKQFGCPITRINNHEHTDL

SEQ ID NO: 3073455 - protein, 20 aa, Giardia lamblia
IKHLCEPDWQYAAPEVLSSQ

SEQ ID NO: 3073456 - protein, 19 aa, Giardia lamblia
IKICACLTASIFTFSLATP

SEQ ID NO: 3073457 - protein, 35 aa, Giardia lamblia
IKIGFWRAVLPFLRLFPIVRGYRCCHDPAHYSSAI

SEQ ID NO: 3073458 - protein, 17 aa, Giardia lamblia
IKIRWYGANKVMMGGRV

SEQ ID NO: 3073459 - protein, 32 aa, Giardia lamblia
IKKIVHFIILEWRLYVSVHIRQGFDEDLNAPP

SEQ ID NO: 3073460 - protein, 24 aa, Giardia lamblia
IKKLRIAREREYPFNTPLDGHRID

SEQ ID NO: 3073461 - protein, 23 aa, Giardia lamblia
IKKPETFGLRAARDADISIKGVT

SEQ ID NO: 3073462 - protein, 25 aa, Giardia lamblia
IKLIKRQGAIYPRDVYILPRHMRVS

SEQ ID NO: 3073463 - protein, 20 aa, Giardia lamblia
IKLLASRLAMCPDLSGVLPI

SEQ ID NO: 3073464 - protein, 17 aa, Giardia lamblia
IKLLLQYATHLGAELDP

SEQ ID NO: 3073465 - protein, 21 aa, Giardia lamblia
IKLLYACVLFIIFVLKMFPIR

SEQ ID NO: 3073466 - protein, 21 aa, Giardia lamblia
IKLLYCIVVILPFTLLPRGTL

SEQ ID NO: 3073467 - protein, 20 aa, Giardia lamblia
IKLTNFPGIDLFLQNIKGYQ

SEQ ID NO: 3073468 - protein, 25 aa, Giardia lamblia
IKMEARAVIDYAKRFDAYNAAETLE

SEQ ID NO: 3073469 - protein, 18 aa, Giardia lamblia
IKMLELHLLNPLVIHEGG

SEQ ID NO: 3073470 - protein, 19 aa, Giardia lamblia
IKMLIDLLPLLSYIESTAS

SEQ ID NO: 3073471 - protein, 17 aa, Giardia lamblia
IKNACRIAKALRFQRPI

SEQ ID NO: 3073472 - protein, 23 aa, Giardia lamblia
IKNSYAIAAIISRCSFGTHGWTS

SEQ ID NO: 3073473 - protein, 27 aa, Giardia lamblia
IKPAFPMRIKHHVIYAVGNLAQHIETD

SEQ ID NO: 3073474 - protein, 18 aa, Giardia lamblia
IKPANVFLDESYNIKLGD

SEQ ID NO: 3073475 - protein, 25 aa, Giardia lamblia
IKQHNDPDCSLKFYSHTDEISLILR

SEQ ID NO: 3073476 - protein, 19 aa, Giardia lamblia
IKQIVIRRLDLVTCSPKDI

SEQ ID NO: 3073477 - protein, 19 aa, Giardia lamblia
IKRAYSFEFIDCSMQHDEF

SEQ ID NO: 3073478 - protein, 17 aa, Giardia lamblia
IKRNLNIHSEKQKELTK

SEQ ID NO: 3073479 - protein, 21 aa, Giardia lamblia
IKRRLTFITKMHRKILQMRDT

SEQ ID NO: 3073480 - protein, 22 aa, Giardia lamblia
IKSEPNILVPMSIFFITVALYN

SEQ ID NO: 3073481 - protein, 18 aa, Giardia lamblia
IKSVAVDICNKEVQSNLT

SEQ ID NO: 3073482 - protein, 25 aa, Giardia lamblia
IKTGRYKYYRNIKHICSLGLHDVTE

SEQ ID NO: 3073483 - protein, 19 aa, Giardia lamblia
IKTKDGFSLHLLYREFAVV

SEQ ID NO: 3073484 - protein, 22 aa, Giardia lamblia
IKTKEAIVLLLFEATRLRYLSF

SEQ ID NO: 3073485 - protein, 18 aa, Giardia lamblia
IKTWPVAHSNVYSALPDI

SEQ ID NO: 3073486 - protein, 18 aa, Giardia lamblia
IKTYEFLYENVFAKKGDK

SEQ ID NO: 3073487 - protein, 34 aa, Giardia lamblia
IKVSLKEFMCGSARYPGLLPVLAMYTDAYFDTIA

SEQ ID NO: 3073488 - protein, 25 aa, Giardia lamblia
IKWPPLGWASGISWYMKPITKQRNA

SEQ ID NO: 3073489 - protein, 19 aa, Giardia lamblia
IKYAASDYFSFISDSSQHL

SEQ ID NO: 3073490 - protein, 19 aa, Giardia lamblia
IKYTNIRKEILMDIKQKQQ

SEQ ID NO: 3073491 - protein, 18 aa, Giardia lamblia
ILAAILIVPFCFLQEQGM

SEQ ID NO: 3073492 - protein, 17 aa, Giardia lamblia
ILAAIRVYYTYPRFDVE

SEQ ID NO: 3073493 - protein, 18 aa, Giardia lamblia
ILACKTCNTTDTTRCAVC

SEQ ID NO: 3073494 - protein, 24 aa, Giardia lamblia
ILADEVWPFLDVAGFSLQEIQELD

SEQ ID NO: 3073495 - protein, 20 aa, Giardia lamblia
ILADIFLRKAIDISESQCMP

SEQ ID NO: 3073496 - protein, 24 aa, Giardia lamblia
ILAQEHIDVLPLFVKLSVYLNLSL

SEQ ID NO: 3073497 - protein, 19 aa, Giardia lamblia
ILATFPFSTTGFYFLFNLV

SEQ ID NO: 3073498 - protein, 23 aa, Giardia lamblia
ILCAFKPAEPFVVPYYIDNGISM

SEQ ID NO: 3073499 - protein, 18 aa, Giardia lamblia
ILCFTHCAMLAPFTDSVA

SEQ ID NO: 3073500 - protein, 18 aa, Giardia lamblia
ILCRGNLYADIILSDENR

SEQ ID NO: 3073501 - protein, 25 aa, Giardia lamblia
ILDEFGCTYYQFDIGRGPYFMICVT

SEQ ID NO: 3073502 - protein, 19 aa, Giardia lamblia
ILDGIPLSPLIKGSILYFI

SEQ ID NO: 3073503 - protein, 19 aa, Giardia lamblia
ILDIPFRRHISSFTSKSGI

SEQ ID NO: 3073504 - protein, 20 aa, Giardia lamblia
ILDLLLPYEACLCTNDANRV

SEQ ID NO: 3073505 - protein, 28 aa, Giardia lamblia
ILDNFLFNLLMPITFVTLRSCIYLMAEI

SEQ ID NO: 3073506 - protein, 20 aa, Giardia lamblia
ILDNIRIVYMDAKQASPKMR

SEQ ID NO: 3073507 - protein, 18 aa, Giardia lamblia
ILDSIPLNGSLYHMAIIA

SEQ ID NO: 3073508 - protein, 25 aa, Giardia lamblia
ILECLHASNVVAVYGDHAYWRENQY

SEQ ID NO: 3073509 - protein, 27 aa, Giardia lamblia
ILEHATRLSGLRYCFLNVAPGKLESYR

SEQ ID NO: 3073510 - protein, 17 aa, Giardia lamblia
ILELLYVELNASATFLT

SEQ ID NO: 3073511 - protein, 27 aa, Giardia lamblia
ILELRLYRKYRLSCNITKNKILYGMLE

SEQ ID NO: 3073512 - protein, 19 aa, Giardia lamblia
ILENVYFILFLKRLLQYLH

SEQ ID NO: 3073513 - protein, 23 aa, Giardia lamblia
ILERAMHRLSRLHDLRAEPLTIY

SEQ ID NO: 3073514 - protein, 17 aa, Giardia lamblia
ILERIFVLEPERRPTAR

SEQ ID NO: 3073515 - protein, 35 aa, Giardia lamblia
ILEVESRLGALVLTDFKGLVSLVVGRFVTTTGGKM

SEQ ID NO: 3073516 - protein, 24 aa, Giardia lamblia
ILEVPYRVGEEIFVSTSLLTMQNS

SEQ ID NO: 3073517 - protein, 26 aa, Giardia lamblia
ILEYEREFLLSLALKTALPICTKHHS

SEQ ID NO: 3073518 - protein, 18 aa, Giardia lamblia
ILFGSLYLALAIAGTVLI

SEQ ID NO: 3073519 - protein, 23 aa, Giardia lamblia
ILFNKRSRHLFNIYITQTGAGNQ

SEQ ID NO: 3073520 - protein, 17 aa, Giardia lamblia
ILFQLLAPFVIRIYNLD

SEQ ID NO: 3073521 - protein, 23 aa, Giardia lamblia
ILGEIEAIVAFIPFIQQTLPVVT

SEQ ID NO: 3073522 - protein, 27 aa, Giardia lamblia
ILGGRYVVLCGVEFLEESQLNGLINVL

SEQ ID NO: 3073523 - protein, 24 aa, Giardia lamblia
ILGPYCKTIPLFIELSELDITRLC

SEQ ID NO: 3073524 - protein, 17 aa, Giardia lamblia
ILHSRSLAIYKRSLPAN

SEQ ID NO: 3073525 - protein, 22 aa, Giardia lamblia
ILIKKRSCYRLAIESNMRDIIG

SEQ ID NO: 3073526 - protein, 20 aa, Giardia lamblia
ILILFLHYYAHVFNYDLYYL

SEQ ID NO: 3073527 - protein, 25 aa, Giardia lamblia
ILIMKAKVSILLNWYQSQRIFQFVI

SEQ ID NO: 3073528 - protein, 25 aa, Giardia lamblia
ILIRHVLDYIIVRDVNKGLVYSAIY

SEQ ID NO: 3073529 - protein, 23 aa, Giardia lamblia
ILIVCIGCVFLSITHINSPNRLE

SEQ ID NO: 3073530 - protein, 34 aa, Giardia lamblia
ILKDVYRSVSLLQFLWHTAHAFLKKELQLDCYFR

SEQ ID NO: 3073531 - protein, 17 aa, Giardia lamblia
ILKKLIRSVNFMPPALF

SEQ ID NO: 3073532 - protein, 30 aa, Giardia lamblia
ILKLFKLQMCLKYNLEMGYYSIVFTLLDPT

SEQ ID NO: 3073533 - protein, 17 aa, Giardia lamblia
ILKLPYVDTSSCNVSPL

SEQ ID NO: 3073534 - protein, 34 aa, Giardia lamblia
ILKSRRDIIKRRKKQALIHMVVFCSYLLSADTLV

SEQ ID NO: 3073535 - protein, 17 aa, Giardia lamblia
ILLCDKSQPVMTAAEEL

SEQ ID NO: 3073536 - protein, 17 aa, Giardia lamblia
ILLEIYYIISRYKTVPT

SEQ ID NO: 3073537 - protein, 23 aa, Giardia lamblia
ILLLPVKFFPYITSGYASAKSAS

SEQ ID NO: 3073538 - protein, 17 aa, Giardia lamblia
ILLTLFRALIASRKSKL

SEQ ID NO: 3073539 - protein, 19 aa, Giardia lamblia
ILLTVPFEYLDRKKISFLP

SEQ ID NO: 3073540 - protein, 19 aa, Giardia lamblia
ILLWHKLPKLKARSPIIDR

SEQ ID NO: 3073541 - protein, 25 aa, Giardia lamblia
ILLYTFACMVFFFFFIVNMTFPLHF

SEQ ID NO: 3073542 - protein, 25 aa, Giardia lamblia
ILMITLAILLCFMMASAAQLFGADF

SEQ ID NO: 3073543 - protein, 29 aa, Giardia lamblia
ILMIYKLARMLSFNFRYILVTNASNSNTL

SEQ ID NO: 3073544 - protein, 25 aa, Giardia lamblia
ILMQRTVKEFKHMLLKKLNSKLQSL

SEQ ID NO: 3073545 - protein, 30 aa, Giardia lamblia
ILMSVLLCLVSTFFCLYCISTSIFLSLFQN

SEQ ID NO: 3073546 - protein, 17 aa, Giardia lamblia
ILNCPQLKVHLISHLNF

SEQ ID NO: 3073547 - protein, 17 aa, Giardia lamblia
ILNGLKVGELDFNSGDT

SEQ ID NO: 3073548 - protein, 20 aa, Giardia lamblia
ILNLPLLMGARRSFEERHGI

SEQ ID NO: 3073549 - protein, 19 aa, Giardia lamblia
ILNRLFVRSDLNLIHLYGS

SEQ ID NO: 3073550 - protein, 17 aa, Giardia lamblia
ILNTVVCLTRLVFGLAF

SEQ ID NO: 3073551 - protein, 25 aa, Giardia lamblia
ILPFLALCSLYFYTTHFTRRYTIRF

SEQ ID NO: 3073552 - protein, 19 aa, Giardia lamblia
ILPLCLLPRIDFLNFTSLV

SEQ ID NO: 3073553 - protein, 23 aa, Giardia lamblia
ILPSALASWQVFRQLDANSSNLK

SEQ ID NO: 3073554 - protein, 19 aa, Giardia lamblia
ILPVLKLLLDQVASDEVLD

SEQ ID NO: 3073555 - protein, 20 aa, Giardia lamblia
ILQHELKEQIVLASHTQLQA

SEQ ID NO: 3073556 - protein, 19 aa, Giardia lamblia
ILRALRSVLHYATSFSPTD

SEQ ID NO: 3073557 - protein, 20 aa, Giardia lamblia
ILRCENKAGLVMLRQILGVV

SEQ ID NO: 3073558 - protein, 24 aa, Giardia lamblia
ILRDEYRSFYNYDKLCYAYASNAF

SEQ ID NO: 3073559 - protein, 25 aa, Giardia lamblia
ILRGPLRFATTNSWVTKDNVFYLHE

SEQ ID NO: 3073560 - protein, 21 aa, Giardia lamblia
ILRIYCFHISAKCIKAYFEHT

SEQ ID NO: 3073561 - protein, 19 aa, Giardia lamblia
ILRRFKASRILTSSAGICE

SEQ ID NO: 3073562 - protein, 29 aa, Giardia lamblia
ILRSMYRRLILIFSQNVEEIWSFCNRTTS

SEQ ID NO: 3073563 - protein, 25 aa, Giardia lamblia
ILSACVLALDCSLPLNYAGSSPPCV

SEQ ID NO: 3073564 - protein, 17 aa, Giardia lamblia
ILSCCGLDTVYSLLRNY

SEQ ID NO: 3073565 - protein, 22 aa, Giardia lamblia
ILSCVRKIVVLLADDRQLFLEL

SEQ ID NO: 3073566 - protein, 17 aa, Giardia lamblia
ILSDCWIWNSQPFPTHI

SEQ ID NO: 3073567 - protein, 18 aa, Giardia lamblia
ILSDVIFLMLPFPSHAAT

SEQ ID NO: 3073568 - protein, 25 aa, Giardia lamblia
ILSEFKGRCFFCLPDNLDKPAVQRS

SEQ ID NO: 3073569 - protein, 41 aa, Giardia lamblia
ILSEYKFILMELCCLIRLLDRWRVYLLAADCSTRLLEMPVY

SEQ ID NO: 3073570 - protein, 17 aa, Giardia lamblia
ILSFAIYVAAMFIMPEY

SEQ ID NO: 3073571 - protein, 19 aa, Giardia lamblia
ILSHFKLPGEGQVISRIMT

SEQ ID NO: 3073572 - protein, 23 aa, Giardia lamblia
ILSIAVIIWSIWSSFNKKEVPYT

SEQ ID NO: 3073573 - protein, 17 aa, Giardia lamblia
ILSLIITKARFSWMQVM

SEQ ID NO: 3073574 - protein, 42 aa, Giardia lamblia
ILSLSRIPLLFSITACLFAKFPSRYAVSFTLCVVASITDYLD

SEQ ID NO: 3073575 - protein, 24 aa, Giardia lamblia
ILSPFFMFQLFTSILWLFDDFAVY

SEQ ID NO: 3073576 - protein, 24 aa, Giardia lamblia
ILSRRQTPMMFKRVATLSTSGEYV

SEQ ID NO: 3073577 - protein, 18 aa, Giardia lamblia
ILSSRLYFHKLFVILTEL

SEQ ID NO: 3073578 - protein, 27 aa, Giardia lamblia
ILTDLAIYFIPGWRLVSEEIIYGLREH

SEQ ID NO: 3073579 - protein, 23 aa, Giardia lamblia
ILTFPYTVYRLGWVISAVLLAGA

SEQ ID NO: 3073580 - protein, 18 aa, Giardia lamblia
ILTMLTIVREDPPSSESM

SEQ ID NO: 3073581 - protein, 21 aa, Giardia lamblia
ILTSLLFKASCSSLIADPLFN

SEQ ID NO: 3073582 - protein, 24 aa, Giardia lamblia
ILTYYNCYLLSEIVAILSTTVVTC

SEQ ID NO: 3073583 - protein, 29 aa, Giardia lamblia
ILVISGVVGFLCWWFICRSKSRPTENPVH

SEQ ID NO: 3073584 - protein, 21 aa, Giardia lamblia
ILVKYCYLDIDGLRALSICLD

SEQ ID NO: 3073585 - protein, 29 aa, Giardia lamblia
ILVSLLMLRRCRLRRAAKRHVEKESDRLI

SEQ ID NO: 3073586 - protein, 25 aa, Giardia lamblia
ILVVGKRISYLFLIKSDIEEEKALL

SEQ ID NO: 3073587 - protein, 26 aa, Giardia lamblia
ILWTPSPRLLKLFFLGEESRRVVEHR

SEQ ID NO: 3073588 - protein, 24 aa, Giardia lamblia
ILYFYRHLLDIFTVSLLGSDKVCA

SEQ ID NO: 3073589 - protein, 19 aa, Giardia lamblia
ILYLMAVHEGCHMGLAGLA

SEQ ID NO: 3073590 - protein, 18 aa, Giardia lamblia
ILYRLIVMATAYLTDGME

SEQ ID NO: 3073591 - protein, 21 aa, Giardia lamblia
ILYSCSWKILTAEVDFSLTTP

SEQ ID NO: 3073592 - protein, 18 aa, Giardia lamblia
ILYSRLSLDVQFYHIILK

SEQ ID NO: 3073593 - protein, 17 aa, Giardia lamblia
ILYVVLLVFTLSPITVK

SEQ ID NO: 3073594 - protein, 18 aa, Giardia lamblia
IMAILVISALCSQSAYST

SEQ ID NO: 3073595 - protein, 23 aa, Giardia lamblia
IMATCTILSLAVVLLIAILVVTI

SEQ ID NO: 3073596 - protein, 23 aa, Giardia lamblia
IMDHLRLFAPLYGYKHSGIYVNG

SEQ ID NO: 3073597 - protein, 20 aa, Giardia lamblia
IMFMFKGRARELIQSFYDGV

SEQ ID NO: 3073598 - protein, 18 aa, Giardia lamblia
IMFPIRVIIMSWWNIDKQ

SEQ ID NO: 3073599 - protein, 17 aa, Giardia lamblia
IMFVIACIASIYTFVRG

SEQ ID NO: 3073600 - protein, 18 aa, Giardia lamblia
IMHNNGLRPFVFHLAHYL

SEQ ID NO: 3073601 - protein, 27 aa, Giardia lamblia
IMIGALLLGCVVCFDEFNRLAVDNLSS

SEQ ID NO: 3073602 - protein, 26 aa, Giardia lamblia
IMIMAGLRGAISFALSTALVTIPEGT

SEQ ID NO: 3073603 - protein, 23 aa, Giardia lamblia
IMLRKVRAEMIVFAKLRRKQLRR

SEQ ID NO: 3073604 - protein, 17 aa, Giardia lamblia
IMNPFLFNLSWPAIIYR

SEQ ID NO: 3073605 - protein, 26 aa, Giardia lamblia
IMQSRFKAPVVYLREVILSGTSRMEV

SEQ ID NO: 3073606 - protein, 19 aa, Giardia lamblia
IMRDIPLPLISAGVDSSNL

SEQ ID NO: 3073607 - protein, 18 aa, Giardia lamblia
IMRLSRRRLVTFLIGKRQ

SEQ ID NO: 3073608 - protein, 25 aa, Giardia lamblia
IMSIYLELLSYFGINSKCTSVFTDM

SEQ ID NO: 3073609 - protein, 24 aa, Giardia lamblia
IMSPCLRLLQSFTGYHLHSQHSLL

SEQ ID NO: 3073610 - protein, 17 aa, Giardia lamblia
IMVESRINPARFISLLD

SEQ ID NO: 3073611 - protein, 24 aa, Giardia lamblia
IMWPMWKAYLYIFLARLFYNGTLY

SEQ ID NO: 3073612 - protein, 17 aa, Giardia lamblia
INCKKYLLEARYREQKI

SEQ ID NO: 3073613 - protein, 27 aa, Giardia lamblia
INDFLLGDACKIGNLLTPLPSVELDKQ

SEQ ID NO: 3073614 - protein, 18 aa, Giardia lamblia
INDTLGLAYQGWKTTNYS

SEQ ID NO: 3073615 - protein, 22 aa, Giardia lamblia
INEAALTLGRICRGFIIRSESR

SEQ ID NO: 3073616 - protein, 22 aa, Giardia lamblia
INEDPTCLILSPIVVQPALPFI

SEQ ID NO: 3073617 - protein, 20 aa, Giardia lamblia
INEKELWWVLWDGVWMLLVA

SEQ ID NO: 3073618 - protein, 18 aa, Giardia lamblia
INENMVWEISAQIISALR

SEQ ID NO: 3073619 - protein, 26 aa, Giardia lamblia
INETNTLECIVRFAHGFSSIIEKASL

SEQ ID NO: 3073620 - protein, 17 aa, Giardia lamblia
INFTIGKTILYNATPLS

SEQ ID NO: 3073621 - protein, 23 aa, Giardia lamblia
INGQRVPLAWRLTELLLQQDSRV

SEQ ID NO: 3073622 - protein, 22 aa, Giardia lamblia
INGSALRICRPVMDQGRSRTFI

SEQ ID NO: 3073623 - protein, 17 aa, Giardia lamblia
INIFKLRLRKVYNATPD

SEQ ID NO: 3073624 - protein, 17 aa, Giardia lamblia
INIKSFVLILTDEELEA

SEQ ID NO: 3073625 - protein, 18 aa, Giardia lamblia
INKDGETALHMAVDKQAR

SEQ ID NO: 3073626 - protein, 23 aa, Giardia lamblia
INKEVFDLFIACGETYEREHKDD

SEQ ID NO: 3073627 - protein, 23 aa, Giardia lamblia
INKFEANHSWLLRAFSTRLEFRQ

SEQ ID NO: 3073628 - protein, 18 aa, Giardia lamblia
INLIPLVVAVVFSQFPRR

SEQ ID NO: 3073629 - protein, 28 aa, Giardia lamblia
INLLNLSLPCRVARDFSQSKKQTACSPL

SEQ ID NO: 3073630 - protein, 25 aa, Giardia lamblia
INLPKLLSERGFSGQLIRIVSGCLE

SEQ ID NO: 3073631 - protein, 19 aa, Giardia lamblia
INLPLLLRYADLALEMRFG

SEQ ID NO: 3073632 - protein, 17 aa, Giardia lamblia
INLRRVTGPKAEFPRQA

SEQ ID NO: 3073633 - protein, 18 aa, Giardia lamblia
INMRRLSKSKGFRPTRSE

SEQ ID NO: 3073634 - protein, 24 aa, Giardia lamblia
INNACFPLSCLVTIDGEELVCANN

SEQ ID NO: 3073635 - protein, 25 aa, Giardia lamblia
INNEMAKNMGLRCCTLPDDSTENDV

SEQ ID NO: 3073636 - protein, 19 aa, Giardia lamblia
INNILGMMVELNLSKGQVN

SEQ ID NO: 3073637 - protein, 17 aa, Giardia lamblia
INNLDFKVKRGALVGIH

SEQ ID NO: 3073638 - protein, 19 aa, Giardia lamblia
INNPISFIYVQRWDVYLVI

SEQ ID NO: 3073639 - protein, 30 aa, Giardia lamblia
INPAFFYLYQFPFTFAVMYGDIGHGIILTI

SEQ ID NO: 3073640 - protein, 29 aa, Giardia lamblia
INPHSFLAVSIIRLCSRLKSFVNGSLEQL

SEQ ID NO: 3073641 - protein, 21 aa, Giardia lamblia
INPKTIWLFLRDNRAVLRSLL

SEQ ID NO: 3073642 - protein, 20 aa, Giardia lamblia
INQRYLYWFFLRNTGTVQDR

SEQ ID NO: 3073643 - protein, 25 aa, Giardia lamblia
INRDILRYAMHVDKHPLVSIMNALS

SEQ ID NO: 3073644 - protein, 18 aa, Giardia lamblia
INRICLKLASSDSSLNPC

SEQ ID NO: 3073645 - protein, 20 aa, Giardia lamblia
INRTRYLFFQQIPNRNDLVL

SEQ ID NO: 3073646 - protein, 22 aa, Giardia lamblia
INRTVLKYLLLIYKEVVADRAL

SEQ ID NO: 3073647 - protein, 19 aa, Giardia lamblia
INRTYCFMGIALGLNLILS

SEQ ID NO: 3073648 - protein, 23 aa, Giardia lamblia
INSEVVNGFPILNTQLASQEDQP

SEQ ID NO: 3073649 - protein, 18 aa, Giardia lamblia
INSLCILANLFPGPSEEL

SEQ ID NO: 3073650 - protein, 20 aa, Giardia lamblia
INSYKMKMAVIIGILQMIFG

SEQ ID NO: 3073651 - protein, 19 aa, Giardia lamblia
INTGYFKGLGNRDFHSVSL

SEQ ID NO: 3073652 - protein, 27 aa, Giardia lamblia
INTNCKCIACYKCAKTHLLDSMVQAKG

SEQ ID NO: 3073653 - protein, 23 aa, Giardia lamblia
INTPELCCQFFIARTEFPLDNFD

SEQ ID NO: 3073654 - protein, 19 aa, Giardia lamblia
INTQLNLFVVTFTKRINLR

SEQ ID NO: 3073655 - protein, 25 aa, Giardia lamblia
INVAICIALSKFLVTNSHFNNIKMV

SEQ ID NO: 3073656 - protein, 25 aa, Giardia lamblia
INVFLECIDHFTLKDRFAMAVRYLS

SEQ ID NO: 3073657 - protein, 23 aa, Giardia lamblia
INYPQEFENASSFYKRPSNTSAG

SEQ ID NO: 3073658 - protein, 23 aa, Giardia lamblia
INYRHAIYYNLLRRLCSTCTIVP

SEQ ID NO: 3073659 - protein, 28 aa, Giardia lamblia
INYSNCCLFASEMILNFHHATLTTFLLT

SEQ ID NO: 3073660 - protein, 23 aa, Giardia lamblia
IPADEIRGLSTLDLSGTGVSGSF

SEQ ID NO: 3073661 - protein, 43 aa, Giardia lamblia
IPADHPVKLRMWLRLQTISFIYRTLHIVISYDAACFFVSLLMR

SEQ ID NO: 3073662 - protein, 21 aa, Giardia lamblia
IPCMQFYDCEQVLAKFTADQE

SEQ ID NO: 3073663 - protein, 18 aa, Giardia lamblia
IPCVGLYICQVFADAVLS

SEQ ID NO: 3073664 - protein, 17 aa, Giardia lamblia
IPDKPLLQWNDVLERNP

SEQ ID NO: 3073665 - protein, 21 aa, Giardia lamblia
IPDVSAIAFSPAIQMHFNSLT

SEQ ID NO: 3073666 - protein, 25 aa, Giardia lamblia
IPEKICSSYFWFGRLCVSLGTDSSA

SEQ ID NO: 3073667 - protein, 27 aa, Giardia lamblia
IPELTYPAVIGIVWYIIMVCGYIPDIA

SEQ ID NO: 3073668 - protein, 21 aa, Giardia lamblia
IPFEIAATYLYSFMDLAPASA

SEQ ID NO: 3073669 - protein, 20 aa, Giardia lamblia
IPFLCGTGYHKTVHPDSCRS

SEQ ID NO: 3073670 - protein, 19 aa, Giardia lamblia
IPFWVDVCRESHSLEYTGL

SEQ ID NO: 3073671 - protein, 20 aa, Giardia lamblia
IPGVCKLCQDGFFRLPEPAA

SEQ ID NO: 3073672 - protein, 24 aa, Giardia lamblia
IPHQSRCAMLPAPATTGQCSHQPN

SEQ ID NO: 3073673 - protein, 17 aa, Giardia lamblia
IPHRIVIDSSVMRTEAL

SEQ ID NO: 3073674 - protein, 20 aa, Giardia lamblia
IPIANAYLKSSIWTLKLIRA

SEQ ID NO: 3073675 - protein, 19 aa, Giardia lamblia
IPIGFLYLYIVEMTRLRLN

SEQ ID NO: 3073676 - protein, 20 aa, Giardia lamblia
IPILCEPRDTAVLLSGATDI

SEQ ID NO: 3073677 - protein, 19 aa, Giardia lamblia
IPKKGRAKLSSMVEDCVYS

SEQ ID NO: 3073678 - protein, 17 aa, Giardia lamblia
IPKYFPLKGKDANQLYA

SEQ ID NO: 3073679 - protein, 18 aa, Giardia lamblia
IPLAFRMHSNLFSMYFSN

SEQ ID NO: 3073680 - protein, 23 aa, Giardia lamblia
IPLAMKVSLEYGKFTMAGTISYD

SEQ ID NO: 3073681 - protein, 20 aa, Giardia lamblia
IPLFIEVVLGPKYSNIEPPK

SEQ ID NO: 3073682 - protein, 20 aa, Giardia lamblia
IPLHIGTVCSLRPCQSLDQR

SEQ ID NO: 3073683 - protein, 20 aa, Giardia lamblia
IPLLVNKAMSSYLLPLLLLP

SEQ ID NO: 3073684 - protein, 30 aa, Giardia lamblia
IPLPDFKPSTLYYLAVFCVLTSDQRESTVG

SEQ ID NO: 3073685 - protein, 26 aa, Giardia lamblia
IPLSTLAGHVFRRWKETVYCSKNFIL

SEQ ID NO: 3073686 - protein, 18 aa, Giardia lamblia
IPLTFVHRNDTHIISNLA

SEQ ID NO: 3073687 - protein, 17 aa, Giardia lamblia
IPNIIALYLPAHEINYT

SEQ ID NO: 3073688 - protein, 25 aa, Giardia lamblia
IPPENVRTALFAKFPDCTGYNHAIV

SEQ ID NO: 3073689 - protein, 26 aa, Giardia lamblia
IPPTSCLPLSMSQFLATASFIECLCV

SEQ ID NO: 3073690 - protein, 23 aa, Giardia lamblia
IPQLVDCYSCARDRNGFTAMEYC

SEQ ID NO: 3073691 - protein, 22 aa, Giardia lamblia
IPREELRRLITVVPQDNILIRG

SEQ ID NO: 3073692 - protein, 20 aa, Giardia lamblia
IPSARSAALPVLVTDLKAAG

SEQ ID NO: 3073693 - protein, 23 aa, Giardia lamblia
IPSIRGGIYNNYFRHELKCLRSD

SEQ ID NO: 3073694 - protein, 22 aa, Giardia lamblia
IPSLPEPFGMTLDQRAQILTFL

SEQ ID NO: 3073695 - protein, 34 aa, Giardia lamblia
IPSRAWSTRMLKDFEPEWLLSEIDAVCEVYNVSE

SEQ ID NO: 3073696 - protein, 20 aa, Giardia lamblia
IPSTIRAFTSFSYINTYNAP

SEQ ID NO: 3073697 - protein, 18 aa, Giardia lamblia
IPTAIGTVFFSIEQIYEH

SEQ ID NO: 3073698 - protein, 19 aa, Giardia lamblia
IPTCCAVSSELGIVVMSTT

SEQ ID NO: 3073699 - protein, 17 aa, Giardia lamblia
IPTEALYAYKLISYANE

SEQ ID NO: 3073700 - protein, 27 aa, Giardia lamblia
IPTFPRYSLMRLIWRGYFINLLLDVAY

SEQ ID NO: 3073701 - protein, 17 aa, Giardia lamblia
IPTGFAVLERGYQRHNQ

SEQ ID NO: 3073702 - protein, 25 aa, Giardia lamblia
IPTLPVYCKVAGSFKKRGIVKVLQR

SEQ ID NO: 3073703 - protein, 19 aa, Giardia lamblia
IPTLRLLVVSLLLYGIQHF

SEQ ID NO: 3073704 - protein, 26 aa, Giardia lamblia
IPTTSAWDCNLVLYGTEFSKRQSRLL

SEQ ID NO: 3073705 - protein, 22 aa, Giardia lamblia
IPVGLLSFQILFGVLLHMRRQI

SEQ ID NO: 3073706 - protein, 27 aa, Giardia lamblia
IPVSLLRLLAEMKRLSIFSTDQVQDIQ

SEQ ID NO: 3073707 - protein, 23 aa, Giardia lamblia
IPVTIVICIEVLLTNGYFLPLEA

SEQ ID NO: 3073708 - protein, 18 aa, Giardia lamblia
IPVYGLSCGVSLPCYSLE

SEQ ID NO: 3073709 - protein, 19 aa, Giardia lamblia
IPYDIGWIVICNMMFSFGL

SEQ ID NO: 3073710 - protein, 30 aa, Giardia lamblia
IPYPGSVQRTCFSRATLVVATNLAILRPIG

SEQ ID NO: 3073711 - protein, 20 aa, Giardia lamblia
IPYSLARFSEVASYYTNELI

SEQ ID NO: 3073712 - protein, 19 aa, Giardia lamblia
IPYTCLFLSSLIPPHIPVY

SEQ ID NO: 3073713 - protein, 19 aa, Giardia lamblia
IPYYICETALRDMQKSSGF

SEQ ID NO: 3073714 - protein, 22 aa, Giardia lamblia
IQAFKHFIKFLSLLTDGLDLTR

SEQ ID NO: 3073715 - protein, 23 aa, Giardia lamblia
IQAKICPFSKYIYLSVEYLMYLR

SEQ ID NO: 3073716 - protein, 17 aa, Giardia lamblia
IQCGYIRNDHRSIIRYI

SEQ ID NO: 3073717 - protein, 17 aa, Giardia lamblia
IQEVGLFMGEMVRSDEI

SEQ ID NO: 3073718 - protein, 22 aa, Giardia lamblia
IQFSKLFASTQIEWEELECHVD

SEQ ID NO: 3073719 - protein, 18 aa, Giardia lamblia
IQHCSECSLLAPTSRSVT

SEQ ID NO: 3073720 - protein, 24 aa, Giardia lamblia
IQHVCFAASFVLHASSSRKTEVSQ

SEQ ID NO: 3073721 - protein, 20 aa, Giardia lamblia
IQILLLFGAKEYCILCKHVA

SEQ ID NO: 3073722 - protein, 19 aa, Giardia lamblia
IQKLREFIEDTLFVNNITD

SEQ ID NO: 3073723 - protein, 17 aa, Giardia lamblia
IQLFPLLLASVARLSGG

SEQ ID NO: 3073724 - protein, 24 aa, Giardia lamblia
IQLGISCSIIILSVIGIIITAIFC

SEQ ID NO: 3073725 - protein, 28 aa, Giardia lamblia
IQLILTMEGLCMYPSRTDFINFIGDVLS

SEQ ID NO: 3073726 - protein, 19 aa, Giardia lamblia
IQLLWTMWIEAGLRQARQD

SEQ ID NO: 3073727 - protein, 19 aa, Giardia lamblia
IQLNLKMIYNMPFKGIFLS

SEQ ID NO: 3073728 - protein, 17 aa, Giardia lamblia
IQLQIGVFTPYAFCLKN

SEQ ID NO: 3073729 - protein, 19 aa, Giardia lamblia
IQMENGWCAIMSAAINGHT

SEQ ID NO: 3073730 - protein, 25 aa, Giardia lamblia
IQMTRLLKTIKLCRSELKSMRDNHQ

SEQ ID NO: 3073731 - protein, 23 aa, Giardia lamblia
IQPCAVCLDFICEMVFLPCKHCV

SEQ ID NO: 3073732 - protein, 24 aa, Giardia lamblia
IQQKKQWICFDGPVDTLWIESLNT

SEQ ID NO: 3073733 - protein, 18 aa, Giardia lamblia
IQQKRLALKDHLHLLTNE

SEQ ID NO: 3073734 - protein, 27 aa, Giardia lamblia
IQSIPCPVCAATGLLTVVQRPLLSVST

SEQ ID NO: 3073735 - protein, 33 aa, Giardia lamblia
IQSLKLNSFRFLKHIFAPSFQYLFPLYTYSRKD

SEQ ID NO: 3073736 - protein, 19 aa, Giardia lamblia
IQSMRVFKNIGIDNAFYQY

SEQ ID NO: 3073737 - protein, 25 aa, Giardia lamblia
IQSPRSTILFLFLVFATRLPSPYGN

SEQ ID NO: 3073738 - protein, 25 aa, Giardia lamblia
IQSSLYCSPTIFSQVYGDIFFSAQK

SEQ ID NO: 3073739 - protein, 26 aa, Giardia lamblia
IQTPTAYSRKKLPAVDFLSFETVSEQ

SEQ ID NO: 3073740 - protein, 19 aa, Giardia lamblia
IQVGEPFPISFQSHESSES

SEQ ID NO: 3073741 - protein, 17 aa, Giardia lamblia
IQVHSGLLKVIREALFF

SEQ ID NO: 3073742 - protein, 24 aa, Giardia lamblia
IQVMCVPSLLPFVVNLMTVLQNTF

SEQ ID NO: 3073743 - protein, 18 aa, Giardia lamblia
IQYAGLILSYSFNIQMIL

SEQ ID NO: 3073744 - protein, 19 aa, Giardia lamblia
IQYSYGFMTRAPVLRRRMR

SEQ ID NO: 3073745 - protein, 21 aa, Giardia lamblia
IQYYWRVNRYYTFGDPDPNVD

SEQ ID NO: 3073746 - protein, 30 aa, Giardia lamblia
IRAAEIFLGKYVWRECVALFDIDSFDEVLQ

SEQ ID NO: 3073747 - protein, 17 aa, Giardia lamblia
IRARLNQRIAHASTVDI

SEQ ID NO: 3073748 - protein, 23 aa, Giardia lamblia
IRAVRRIKRKNAFLTLLRILMIT

SEQ ID NO: 3073749 - protein, 33 aa, Giardia lamblia
IRAYKSSMLIIFCLIPVYTFLGLVPSIALNNLT

SEQ ID NO: 3073750 - protein, 18 aa, Giardia lamblia
IRCIGLDLFATFYAIPIN

SEQ ID NO: 3073751 - protein, 28 aa, Giardia lamblia
IRDIPLAFWCFYRFIKRFGNMYLPSLYG

SEQ ID NO: 3073752 - protein, 17 aa, Giardia lamblia
IRDRYRFAQTLIAKASI

SEQ ID NO: 3073753 - protein, 21 aa, Giardia lamblia
IREAEPLYYIECRPFSQLLDA

SEQ ID NO: 3073754 - protein, 19 aa, Giardia lamblia
IRELLFHECELYKNDIPCD

SEQ ID NO: 3073755 - protein, 18 aa, Giardia lamblia
IRELLLCELIEYYRKAVV

SEQ ID NO: 3073756 - protein, 23 aa, Giardia lamblia
IRERTRYSFSLFRLIDAYTRSMG

SEQ ID NO: 3073757 - protein, 26 aa, Giardia lamblia
IRFFTPRPPNTFIYILCYLTQIFMFL

SEQ ID NO: 3073758 - protein, 36 aa, Giardia lamblia
IRGHRCKNNMLVFFARLMSLVMMSIWRQCKQHQQTK

SEQ ID NO: 3073759 - protein, 18 aa, Giardia lamblia
IRGMTDLMLLTIRNDVDA

SEQ ID NO: 3073760 - protein, 18 aa, Giardia lamblia
IRGTELYERWRLNKYLRN

SEQ ID NO: 3073761 - protein, 22 aa, Giardia lamblia
IRGVRHRVILVLRGHSLHAIRD

SEQ ID NO: 3073762 - protein, 24 aa, Giardia lamblia
IRHHKFAVLMAILIGKLSIEEIIK

SEQ ID NO: 3073763 - protein, 25 aa, Giardia lamblia
IRIASEILKGIKVIKFFGQEDIHTV

SEQ ID NO: 3073764 - protein, 17 aa, Giardia lamblia
IRIAYYHAFPPGTNLLN

SEQ ID NO: 3073765 - protein, 29 aa, Giardia lamblia
IRISYSVVAFIFCYAGLFQIFNFPLGTFS

SEQ ID NO: 3073766 - protein, 20 aa, Giardia lamblia
IRIVSVFPHVIKISIPSIFL

SEQ ID NO: 3073767 - protein, 24 aa, Giardia lamblia
IRKCMGRGQLPVLIVLDTDKKSIM

SEQ ID NO: 3073768 - protein, 18 aa, Giardia lamblia
IRKIYKSILFQRSNQNVG

SEQ ID NO: 3073769 - protein, 20 aa, Giardia lamblia
IRKRHREASLLYVIVDNATI

SEQ ID NO: 3073770 - protein, 24 aa, Giardia lamblia
IRLAIKGLILLSVDLEQQYKSLAL

SEQ ID NO: 3073771 - protein, 17 aa, Giardia lamblia
IRLISSFVVYAIVTTLN

SEQ ID NO: 3073772 - protein, 18 aa, Giardia lamblia
IRLLSPLEAGICDNRGKC

SEQ ID NO: 3073773 - protein, 21 aa, Giardia lamblia
IRLPYDILSKMQLSYRKCLLI

SEQ ID NO: 3073774 - protein, 17 aa, Giardia lamblia
IRLVMKQIYLSVPRAPD

SEQ ID NO: 3073775 - protein, 23 aa, Giardia lamblia
IRMAYRVFRLRPTAVTLGGVAYL

SEQ ID NO: 3073776 - protein, 23 aa, Giardia lamblia
IRMGAFRLKNRLLTFQELTRHLC

SEQ ID NO: 3073777 - protein, 17 aa, Giardia lamblia
IRNALSLTARSDTDQSP

SEQ ID NO: 3073778 - protein, 34 aa, Giardia lamblia
IRPDGRMFHIDFGWCFGKDPKLMAPKMKVSKDLV

SEQ ID NO: 3073779 - protein, 19 aa, Giardia lamblia
IRPGALPRGRILEVESTDN

SEQ ID NO: 3073780 - protein, 17 aa, Giardia lamblia
IRPYIPSTIRAFTSFSY

SEQ ID NO: 3073781 - protein, 23 aa, Giardia lamblia
IRQAEGYIIKMANYLNALYTLRS

SEQ ID NO: 3073782 - protein, 25 aa, Giardia lamblia
IRRDFWLFMHGLNLLIKNDFSRPLC

SEQ ID NO: 3073783 - protein, 17 aa, Giardia lamblia
IRRELFGLTGPMSNDDE

SEQ ID NO: 3073784 - protein, 23 aa, Giardia lamblia
IRRHDGLCASNFIRKDAIEIRAI

SEQ ID NO: 3073785 - protein, 30 aa, Giardia lamblia
IRRLPMCVICARVAIRFTINTNCKCIACYK

SEQ ID NO: 3073786 - protein, 28 aa, Giardia lamblia
IRRSIYYAYAFCFLMYMLMGCFGALLYG

SEQ ID NO: 3073787 - protein, 19 aa, Giardia lamblia
IRSLRLPSLLSCPSSARSK

SEQ ID NO: 3073788 - protein, 27 aa, Giardia lamblia
IRSSSRFTRRLVRIHVCVDTWALDRAE

SEQ ID NO: 3073789 - protein, 19 aa, Giardia lamblia
IRSTTQFIYVLIIVSVCCI

SEQ ID NO: 3073790 - protein, 25 aa, Giardia lamblia
IRSVVIPICLGLIWDFILLDFHGGK

SEQ ID NO: 3073791 - protein, 24 aa, Giardia lamblia
IRSYEYVLRYALKHVDDSLPAEVE

SEQ ID NO: 3073792 - protein, 21 aa, Giardia lamblia
IRSYRSIFLQSHFNQDYRAAA

SEQ ID NO: 3073793 - protein, 21 aa, Giardia lamblia
IRTAAAIARCATYNSRGIRGY

SEQ ID NO: 3073794 - protein, 24 aa, Giardia lamblia
IRTHCAKEFIGVHLAAYVYYEILE

SEQ ID NO: 3073795 - protein, 18 aa, Giardia lamblia
IRTRQFISTHGFPQLCKK

SEQ ID NO: 3073796 - protein, 20 aa, Giardia lamblia
IRTTPLLIFSLLRIVFGVLF

SEQ ID NO: 3073797 - protein, 17 aa, Giardia lamblia
IRTYYWVTVLEGAIEEI

SEQ ID NO: 3073798 - protein, 23 aa, Giardia lamblia
IRVEKEHRKCISISDLDAPQKVM

SEQ ID NO: 3073799 - protein, 23 aa, Giardia lamblia
IRVPRYRTSSVLVHTNTKRLGIL

SEQ ID NO: 3073800 - protein, 18 aa, Giardia lamblia
ISAAAIVYHCALSPGSGA

SEQ ID NO: 3073801 - protein, 20 aa, Giardia lamblia
ISAAQYKSLIGFITRTAPVS

SEQ ID NO: 3073802 - protein, 18 aa, Giardia lamblia
ISAIVYFFLIIHACTGKR

SEQ ID NO: 3073803 - protein, 20 aa, Giardia lamblia
ISALENEFFLSVAAAQQRFH

SEQ ID NO: 3073804 - protein, 18 aa, Giardia lamblia
ISALNIVSSFAVVFVIFA

SEQ ID NO: 3073805 - protein, 21 aa, Giardia lamblia
ISALVFKVIIVIIATKERVYA

SEQ ID NO: 3073806 - protein, 26 aa, Giardia lamblia
ISAMGYGPWLPTAMMITVVLRNARLF

SEQ ID NO: 3073807 - protein, 26 aa, Giardia lamblia
ISCCLLDFLDAFVLMERIFQLSPNIH

SEQ ID NO: 3073808 - protein, 18 aa, Giardia lamblia
ISCGALVIFGGLRHAFPE

SEQ ID NO: 3073809 - protein, 17 aa, Giardia lamblia
ISCSLLATRELFSYRQE

SEQ ID NO: 3073810 - protein, 17 aa, Giardia lamblia
ISCVVLCQLPSRAPIYV

SEQ ID NO: 3073811 - protein, 20 aa, Giardia lamblia
ISDCKTFISSIVVMDNTPFS

SEQ ID NO: 3073812 - protein, 24 aa, Giardia lamblia
ISDPLLKAKMDWLDKHSVLKGGDW

SEQ ID NO: 3073813 - protein, 22 aa, Giardia lamblia
ISEAPPYFLAALVFLTLNFQLD

SEQ ID NO: 3073814 - protein, 26 aa, Giardia lamblia
ISEATRLENMLPLRASPTVLTEEDNP

SEQ ID NO: 3073815 - protein, 24 aa, Giardia lamblia
ISERLCFYDVFILTLSTLSVPEVR

SEQ ID NO: 3073816 - protein, 26 aa, Giardia lamblia
ISESMPWSKLPSTLSIPILLFSGKLS

SEQ ID NO: 3073817 - protein, 35 aa, Giardia lamblia
ISFEFLGGRFLAFRFAHKLTIFQIVLPFNKLTIEY

SEQ ID NO: 3073818 - protein, 23 aa, Giardia lamblia
ISFFPGSRLVIPLSLDQKPNISP

SEQ ID NO: 3073819 - protein, 19 aa, Giardia lamblia
ISFITSPLATSWGLGAVSA

SEQ ID NO: 3073820 - protein, 18 aa, Giardia lamblia
ISFLPIDVRSTGSLSKSS

SEQ ID NO: 3073821 - protein, 23 aa, Giardia lamblia
ISGEVGYVKAFLYMHGNYNKRGY

SEQ ID NO: 3073822 - protein, 17 aa, Giardia lamblia
ISGFCILFILITVLSVF

SEQ ID NO: 3073823 - protein, 23 aa, Giardia lamblia
ISGLKLKSAYVDLSIGKVSSQSV

SEQ ID NO: 3073824 - protein, 18 aa, Giardia lamblia
ISGLLLVGIAKYYKVIEK

SEQ ID NO: 3073825 - protein, 23 aa, Giardia lamblia
ISGLPRYSNYLFLEGADSTATHG

SEQ ID NO: 3073826 - protein, 21 aa, Giardia lamblia
ISGNAPFSFAVHDLSKKVYEL

SEQ ID NO: 3073827 - protein, 22 aa, Giardia lamblia
ISGWKAFLFTIVFVAICFAINI

SEQ ID NO: 3073828 - protein, 20 aa, Giardia lamblia
ISGYYWRGAAADAVMTHELL

SEQ ID NO: 3073829 - protein, 28 aa, Giardia lamblia
ISHSVLRRKSVSAANMFALYPRSAIGHM

SEQ ID NO: 3073830 - protein, 25 aa, Giardia lamblia
ISHVISVLFACIFSGPVYTETLTHT

SEQ ID NO: 3073831 - protein, 17 aa, Giardia lamblia
ISIAFLILWFIGDLLNL

SEQ ID NO: 3073832 - protein, 19 aa, Giardia lamblia
ISIHFCGFNGTLAFCNFIA

SEQ ID NO: 3073833 - protein, 25 aa, Giardia lamblia
ISILQRYNVFMVCYGIIPCFAVLSG

SEQ ID NO: 3073834 - protein, 25 aa, Giardia lamblia
ISINSRLGTVFAVGENIVYSKAVEG

SEQ ID NO: 3073835 - protein, 17 aa, Giardia lamblia
ISISLGMCDNCGKGYIL

SEQ ID NO: 3073836 - protein, 18 aa, Giardia lamblia
ISIVDLFTAAIVRAHAER

SEQ ID NO: 3073837 - protein, 21 aa, Giardia lamblia
ISIYNLCFKLGHPDDLTQLKM

SEQ ID NO: 3073838 - protein, 27 aa, Giardia lamblia
ISKCVMPLHGYRVGRLLYSFLRALLLQ

SEQ ID NO: 3073839 - protein, 19 aa, Giardia lamblia
ISKLIAVAKPNFFYLRSPS

SEQ ID NO: 3073840 - protein, 23 aa, Giardia lamblia
ISKRCTEEIGFAFMVTGMMRSQN

SEQ ID NO: 3073841 - protein, 17 aa, Giardia lamblia
ISKYCTSMGGGIYANPC

SEQ ID NO: 3073842 - protein, 21 aa, Giardia lamblia
ISLCCLDKDLAVLPSGINTEV

SEQ ID NO: 3073843 - protein, 19 aa, Giardia lamblia
ISLCSGILRLIDASRKGVR

SEQ ID NO: 3073844 - protein, 26 aa, Giardia lamblia
ISLDILKCLTILPSIGDQAIQKYVVN

SEQ ID NO: 3073845 - protein, 20 aa, Giardia lamblia
ISLEEAKEALNLVDIADASD

SEQ ID NO: 3073846 - protein, 18 aa, Giardia lamblia
ISLFGIMSLFGLTILIPV

SEQ ID NO: 3073847 - protein, 18 aa, Giardia lamblia
ISLFKQVFEPLKMWLSPY

SEQ ID NO: 3073848 - protein, 25 aa, Giardia lamblia
ISLGLELAGLERKYLMLRYDANRMF

SEQ ID NO: 3073849 - protein, 20 aa, Giardia lamblia
ISLILRLVAIYDNLSNSKMH

SEQ ID NO: 3073850 - protein, 23 aa, Giardia lamblia
ISLKHCLGLVLLELCTLQCSETS

SEQ ID NO: 3073851 - protein, 17 aa, Giardia lamblia
ISLKRKLDTFKRREGYA

SEQ ID NO: 3073852 - protein, 20 aa, Giardia lamblia
ISLLRKLYINRNVNNGNNSV

SEQ ID NO: 3073853 - protein, 20 aa, Giardia lamblia
ISLYVYRMVDWLPITRLALL

SEQ ID NO: 3073854 - protein, 18 aa, Giardia lamblia
ISNCILCDSPSAGASSRA

SEQ ID NO: 3073855 - protein, 27 aa, Giardia lamblia
ISNEGFRIISILLLIKFFSESFMILAI

SEQ ID NO: 3073856 - protein, 22 aa, Giardia lamblia
ISNIQFFFAFASFPLIIPVLNL

SEQ ID NO: 3073857 - protein, 25 aa, Giardia lamblia
ISNPCQVEVHRDCEWVVASSTSLVP

SEQ ID NO: 3073858 - protein, 21 aa, Giardia lamblia
ISNTCPYHISIDITNTKIDFD

SEQ ID NO: 3073859 - protein, 23 aa, Giardia lamblia
ISPDRAHIFAALFQDPVAAIITS

SEQ ID NO: 3073860 - protein, 20 aa, Giardia lamblia
ISPVICVAVILSGLKKRSDM

SEQ ID NO: 3073861 - protein, 21 aa, Giardia lamblia
ISQCLPCFTEISLLVAVQVNP

SEQ ID NO: 3073862 - protein, 17 aa, Giardia lamblia
ISQLPFAVMSWSEYLIK

SEQ ID NO: 3073863 - protein, 22 aa, Giardia lamblia
ISQPDFAKALSMETISKLREIF

SEQ ID NO: 3073864 - protein, 24 aa, Giardia lamblia
ISQRLSTWTIVWIVIGSVLGVIVL

SEQ ID NO: 3073865 - protein, 28 aa, Giardia lamblia
ISRKHCDAFKLAELRGKFGRNDSEIQTG

SEQ ID NO: 3073866 - protein, 30 aa, Giardia lamblia
ISRSSTVSALRCIFSPFTGKSMVLPVLTLM

SEQ ID NO: 3073867 - protein, 37 aa, Giardia lamblia
ISRSYATVFSICFLKVFRPDAFFSILTLLAEGATDHL

SEQ ID NO: 3073868 - protein, 27 aa, Giardia lamblia
ISRTIPSWKVSSAWSNPPSVTSQETEV

SEQ ID NO: 3073869 - protein, 22 aa, Giardia lamblia
ISSALPIIAFEYFLSSTVPTDI

SEQ ID NO: 3073870 - protein, 18 aa, Giardia lamblia
ISSCTFEICEYLQGERAL

SEQ ID NO: 3073871 - protein, 18 aa, Giardia lamblia
ISSFSLEGGMPLVTKIQW

SEQ ID NO: 3073872 - protein, 20 aa, Giardia lamblia
ISSIHDILCPFTVQLSCELH

SEQ ID NO: 3073873 - protein, 23 aa, Giardia lamblia
ISSMDRGACYNIILTSYESRYIT

SEQ ID NO: 3073874 - protein, 24 aa, Giardia lamblia
ISSRGKFVSLLLFSFEPKDMQVAY

SEQ ID NO: 3073875 - protein, 20 aa, Giardia lamblia
ISSSIAGARFKSPNCFTFIA

SEQ ID NO: 3073876 - protein, 24 aa, Giardia lamblia
ISTEYYPSLLLTGLVAQLFFELLQ

SEQ ID NO: 3073877 - protein, 20 aa, Giardia lamblia
ISTHVIALIMSRLAETYSSI

SEQ ID NO: 3073878 - protein, 22 aa, Giardia lamblia
ISTSLRFNYSILYKDTEFRIRG

SEQ ID NO: 3073879 - protein, 17 aa, Giardia lamblia
ISTTQCIFRMLWHQASV

SEQ ID NO: 3073880 - protein, 38 aa, Giardia lamblia
ISTVLACCGYTGYEFVAFKLLYPTGVYVYYIDGILQRS

SEQ ID NO: 3073881 - protein, 35 aa, Giardia lamblia
ISVCSLAFTAHGVFNCLLLLDIGLIDFFHTARMFR

SEQ ID NO: 3073882 - protein, 25 aa, Giardia lamblia
ISVFTLVGAVVLKIYCTVMSKRDVS

SEQ ID NO: 3073883 - protein, 25 aa, Giardia lamblia
ISVGASRPWLLKALSEVTVLEKLRH

SEQ ID NO: 3073884 - protein, 20 aa, Giardia lamblia
ISVILGRCIEALIKGKLAHD

SEQ ID NO: 3073885 - protein, 17 aa, Giardia lamblia
ISVLLNFINYVSSEIHA

SEQ ID NO: 3073886 - protein, 21 aa, Giardia lamblia
ISVSDTHGWIYGHRHQKELGD

SEQ ID NO: 3073887 - protein, 17 aa, Giardia lamblia
ISVSRFTFFSFAILLWS

SEQ ID NO: 3073888 - protein, 26 aa, Giardia lamblia
ISYDAACFFVSLLMRKTVPNDVIFYK

SEQ ID NO: 3073889 - protein, 24 aa, Giardia lamblia
ISYDLMLEIALCLDKLKIEQLHKD

SEQ ID NO: 3073890 - protein, 20 aa, Giardia lamblia
ISYPHFTLVFSFPEDTTDRR

SEQ ID NO: 3073891 - protein, 18 aa, Giardia lamblia
ISYQSTEWLKVFYNQTSF

SEQ ID NO: 3073892 - protein, 18 aa, Giardia lamblia
ISYSSLLKGFREIDGSET

SEQ ID NO: 3073893 - protein, 25 aa, Giardia lamblia
ISYSYTCVWKSLSSYSSLSFSRYPT

SEQ ID NO: 3073894 - protein, 17 aa, Giardia lamblia
ITACKKCAIKGEVPMDG

SEQ ID NO: 3073895 - protein, 18 aa, Giardia lamblia
ITACKKCAIKGEVPMDGR

SEQ ID NO: 3073896 - protein, 18 aa, Giardia lamblia
ITAGYGFSTKMPKTNSFN

SEQ ID NO: 3073897 - protein, 21 aa, Giardia lamblia
ITALAGCPWRHQSSCIALRKD

SEQ ID NO: 3073898 - protein, 17 aa, Giardia lamblia
ITANCAFNEGSTSESAD

SEQ ID NO: 3073899 - protein, 28 aa, Giardia lamblia
ITARVFAARGIKRFPKLSAESIAGNIDA

SEQ ID NO: 3073900 - protein, 19 aa, Giardia lamblia
ITASRAPCMATGIMQDPAY

SEQ ID NO: 3073901 - protein, 17 aa, Giardia lamblia
ITCPADDMINCKKALRT

SEQ ID NO: 3073902 - protein, 22 aa, Giardia lamblia
ITCYDHHHALLSIKHAIDTILV

SEQ ID NO: 3073903 - protein, 18 aa, Giardia lamblia
ITDSFYIFVLREATRSVG

SEQ ID NO: 3073904 - protein, 18 aa, Giardia lamblia
ITEEIDWSIFFTSTLSKG

SEQ ID NO: 3073905 - protein, 20 aa, Giardia lamblia
ITELGNLLGECLIIDSSELR

SEQ ID NO: 3073906 - protein, 17 aa, Giardia lamblia
ITFKFNATIILYAISQG

SEQ ID NO: 3073907 - protein, 24 aa, Giardia lamblia
ITFLKNPFVCFLNGLLNHIFYSPR

SEQ ID NO: 3073908 - protein, 24 aa, Giardia lamblia
ITFPELSHPGILRYHQIIENEGFI

SEQ ID NO: 3073909 - protein, 24 aa, Giardia lamblia
ITGKFKLSIPSIIMIVTGILGSAG

SEQ ID NO: 3073910 - protein, 25 aa, Giardia lamblia
ITGLCAGYEQLRFLKPIDMPDTLPA

SEQ ID NO: 3073911 - protein, 19 aa, Giardia lamblia
ITGNKWLGLTDMLSESSSS

SEQ ID NO: 3073912 - protein, 18 aa, Giardia lamblia
ITICTAIAMMLLSRSAES

SEQ ID NO: 3073913 - protein, 18 aa, Giardia lamblia
ITIFYIRVTMQLMAIQAI

SEQ ID NO: 3073914 - protein, 22 aa, Giardia lamblia
ITIKKRIFFLLKSFSTETVSLV

SEQ ID NO: 3073915 - protein, 18 aa, Giardia lamblia
ITILIEFWVVEVRAVMSF

SEQ ID NO: 3073916 - protein, 19 aa, Giardia lamblia
ITIMGAIILTFPTIYYGIH

SEQ ID NO: 3073917 - protein, 17 aa, Giardia lamblia
ITIPISFLIASDIANPR

SEQ ID NO: 3073918 - protein, 17 aa, Giardia lamblia
ITIREAEPLYYIECRPF

SEQ ID NO: 3073919 - protein, 25 aa, Giardia lamblia
ITITFCSLAYMFSYIHRICITSITD

SEQ ID NO: 3073920 - protein, 17 aa, Giardia lamblia
ITITSSIDLTGRIAEFA

SEQ ID NO: 3073921 - protein, 21 aa, Giardia lamblia
ITKAMLRVCTTFLLQKYLFKA

SEQ ID NO: 3073922 - protein, 22 aa, Giardia lamblia
ITKKPKRKLAFLKEKLGPSKSG

SEQ ID NO: 3073923 - protein, 19 aa, Giardia lamblia
ITKMRAFKKLFTRELYEDW

SEQ ID NO: 3073924 - protein, 26 aa, Giardia lamblia
ITKRISLLVFYLFRHIFMISSRSFAT

SEQ ID NO: 3073925 - protein, 19 aa, Giardia lamblia
ITLARLFLTGPHRTIFAAI

SEQ ID NO: 3073926 - protein, 19 aa, Giardia lamblia
ITLHRAAVVTVPISLLILN

SEQ ID NO: 3073927 - protein, 24 aa, Giardia lamblia
ITLLKRFIVKVPRIGELERIDKWY

SEQ ID NO: 3073928 - protein, 19 aa, Giardia lamblia
ITLNCGRPGAGVCNITGES

SEQ ID NO: 3073929 - protein, 28 aa, Giardia lamblia
ITLRINFSSEVFLNFIASYPVQVISVVR

SEQ ID NO: 3073930 - protein, 22 aa, Giardia lamblia
ITLRPERMSTLLVGQSASMYGL

SEQ ID NO: 3073931 - protein, 36 aa, Giardia lamblia
ITLTSGYLLRIFFDILFYIIFLFMLFGAHEITDTNQ

SEQ ID NO: 3073932 - protein, 18 aa, Giardia lamblia
ITLVMNWDTFVFSLFSRR

SEQ ID NO: 3073933 - protein, 27 aa, Giardia lamblia
ITMSLMVCMHHGFRISFITSPLATSWG

SEQ ID NO: 3073934 - protein, 23 aa, Giardia lamblia
ITNASSFFAIFIDLFLKLLQKGV

SEQ ID NO: 3073935 - protein, 23 aa, Giardia lamblia
ITNRLVVLANLYLRAQNTKVATF

SEQ ID NO: 3073936 - protein, 19 aa, Giardia lamblia
ITNYIPSLLTLRGDDYKSF

SEQ ID NO: 3073937 - protein, 19 aa, Giardia lamblia
ITPAFFKLLSMNLMQELAL

SEQ ID NO: 3073938 - protein, 28 aa, Giardia lamblia
ITPCAALPIADFWNIVAAEVFSSCERLY

SEQ ID NO: 3073939 - protein, 26 aa, Giardia lamblia
ITPQDCVVCRTGLVKLLLTDLIFIVN

SEQ ID NO: 3073940 - protein, 17 aa, Giardia lamblia
ITPQVKRLSNMVTSPVI

SEQ ID NO: 3073941 - protein, 28 aa, Giardia lamblia
ITPVRPLHEYRYYIGLSQGTKFSSIVAS

SEQ ID NO: 3073942 - protein, 25 aa, Giardia lamblia
ITPYQWLPGTVYSPLVRFHLADSEP

SEQ ID NO: 3073943 - protein, 21 aa, Giardia lamblia
ITSCVPFVICGYIEETKPFVV

SEQ ID NO: 3073944 - protein, 25 aa, Giardia lamblia
ITSRFKVDIWRNAMQRHQFYKAGED

SEQ ID NO: 3073945 - protein, 17 aa, Giardia lamblia
ITTILSYLPLGHIYERE

SEQ ID NO: 3073946 - protein, 18 aa, Giardia lamblia
ITTVNCAGYYSYKSIVAK

SEQ ID NO: 3073947 - protein, 17 aa, Giardia lamblia
ITVSRSLLRLVHTCCRL

SEQ ID NO: 3073948 - protein, 18 aa, Giardia lamblia
IVAESVVEPFVPPIFENH

SEQ ID NO: 3073949 - protein, 22 aa, Giardia lamblia
IVAIVCALFAMLASAGGIGGGV

SEQ ID NO: 3073950 - protein, 17 aa, Giardia lamblia
IVALGCAMLSPITVALI

SEQ ID NO: 3073951 - protein, 20 aa, Giardia lamblia
IVALIWKYVLMEGNASHQEL

SEQ ID NO: 3073952 - protein, 18 aa, Giardia lamblia
IVALLGRRHGETLDASLQ

SEQ ID NO: 3073953 - protein, 17 aa, Giardia lamblia
IVCCGFSAIVPKLSERL

SEQ ID NO: 3073954 - protein, 17 aa, Giardia lamblia
IVCLECDTLYALYQNAC

SEQ ID NO: 3073955 - protein, 28 aa, Giardia lamblia
IVDADGFYDRKEWFFKNLADTTVLAACA

SEQ ID NO: 3073956 - protein, 18 aa, Giardia lamblia
IVDIRYNPHYSLAHLIDL

SEQ ID NO: 3073957 - protein, 18 aa, Giardia lamblia
IVDLPMCPDYFLVAYLQP

SEQ ID NO: 3073958 - protein, 18 aa, Giardia lamblia
IVEFCVKDAIGTDPTPGT

SEQ ID NO: 3073959 - protein, 27 aa, Giardia lamblia
IVEMTRLRLNLAFKSGWIISHLVFFGL

SEQ ID NO: 3073960 - protein, 26 aa, Giardia lamblia
IVESYLFGRHCFRLTAMGLSGSIHLV

SEQ ID NO: 3073961 - protein, 19 aa, Giardia lamblia
IVFAYRMQVTFNQMRRDYT

SEQ ID NO: 3073962 - protein, 17 aa, Giardia lamblia
IVFCKLLHIGQREPSTL

SEQ ID NO: 3073963 - protein, 18 aa, Giardia lamblia
IVFSIFFYLIERKVPYPL

SEQ ID NO: 3073964 - protein, 17 aa, Giardia lamblia
IVFVRWIIILSSIIPLA

SEQ ID NO: 3073965 - protein, 47 aa, Giardia lamblia
IVGLLTCWIPEFLFMTCFFGYMVFCIIYKWLNEWPEGSNPPALTSLL

SEQ ID NO: 3073966 - protein, 24 aa, Giardia lamblia
IVGSCPSLILSDVESLKFQVCACC

SEQ ID NO: 3073967 - protein, 23 aa, Giardia lamblia
IVGVPGCKYCTLPLTNGTNENPV

SEQ ID NO: 3073968 - protein, 17 aa, Giardia lamblia
IVHLHWSDYDIKSPVII

SEQ ID NO: 3073969 - protein, 17 aa, Giardia lamblia
IVHSSILIWGRLSQSPL

SEQ ID NO: 3073970 - protein, 19 aa, Giardia lamblia
IVHYDIKPANVFLDESYNI

SEQ ID NO: 3073971 - protein, 25 aa, Giardia lamblia
IVILLFALGNWRCYPLGQFLYLPAE

SEQ ID NO: 3073972 - protein, 17 aa, Giardia lamblia
IVKDRYFLLYAPHDSPL

SEQ ID NO: 3073973 - protein, 30 aa, Giardia lamblia
IVKSKKCILNYPDLPKLRREKKIKKVETGE

SEQ ID NO: 3073974 - protein, 23 aa, Giardia lamblia
IVKSMFYPLVLPPLGNHLFQVLT

SEQ ID NO: 3073975 - protein, 19 aa, Giardia lamblia
IVLGLCFTGSITYLPSCCN

SEQ ID NO: 3073976 - protein, 36 aa, Giardia lamblia
IVLLLRVSAVCFGCMFTWNVPISFGQIVSFPYDMYI

SEQ ID NO: 3073977 - protein, 19 aa, Giardia lamblia
IVLLTCLGIVFTHLKNHPR

SEQ ID NO: 3073978 - protein, 18 aa, Giardia lamblia
IVLMFFVCANSKLDISTL

SEQ ID NO: 3073979 - protein, 17 aa, Giardia lamblia
IVLPFLAALAYFYMAVS

SEQ ID NO: 3073980 - protein, 18 aa, Giardia lamblia
IVLVCIYVAVGIPQEPRK

SEQ ID NO: 3073981 - protein, 19 aa, Giardia lamblia
IVMATAYLTDGMELYHNED

SEQ ID NO: 3073982 - protein, 18 aa, Giardia lamblia
IVMISGYYWRGAAADAVM

SEQ ID NO: 3073983 - protein, 19 aa, Giardia lamblia
IVNELWSSIFLKSKVPYAE

SEQ ID NO: 3073984 - protein, 23 aa, Giardia lamblia
IVNHPKGLCAMQYSAEGISHIAS

SEQ ID NO: 3073985 - protein, 24 aa, Giardia lamblia
IVNVFSEAFQKVWNDPTSSDVPRY

SEQ ID NO: 3073986 - protein, 19 aa, Giardia lamblia
IVNVMGAVMCLLDTPGKLP

SEQ ID NO: 3073987 - protein, 18 aa, Giardia lamblia
IVPCQAFAGVAVNMLSPA

SEQ ID NO: 3073988 - protein, 17 aa, Giardia lamblia
IVPFISSIHDILCPFTV

SEQ ID NO: 3073989 - protein, 23 aa, Giardia lamblia
IVPTRSVGVLGTYQAKLAQDTDD

SEQ ID NO: 3073990 - protein, 26 aa, Giardia lamblia
IVQGQAAICALCFLYCLITRYTHHQK

SEQ ID NO: 3073991 - protein, 17 aa, Giardia lamblia
IVQLLAAHESGLLDNTG

SEQ ID NO: 3073992 - protein, 18 aa, Giardia lamblia
IVRAVEWGRAVLTNVRKF

SEQ ID NO: 3073993 - protein, 26 aa, Giardia lamblia
IVRLFFTTRVGRILLLIMSIILLIIF

SEQ ID NO: 3073994 - protein, 22 aa, Giardia lamblia
IVRPCSVSIYLQIPLVTGPMIA

SEQ ID NO: 3073995 - protein, 18 aa, Giardia lamblia
IVRRMNLSFLDDRDTHNR

SEQ ID NO: 3073996 - protein, 19 aa, Giardia lamblia
IVRVLSVFHRLMATPPDSG

SEQ ID NO: 3073997 - protein, 25 aa, Giardia lamblia
IVSDWALKFLRLFRQKTQLYFPTSY

SEQ ID NO: 3073998 - protein, 24 aa, Giardia lamblia
IVSFPAVVGRQGYLHRGVRTGTFL

SEQ ID NO: 3073999 - protein, 19 aa, Giardia lamblia
IVSQIAFSVLLRLAVTLTI

SEQ ID NO: 3074000 - protein, 26 aa, Giardia lamblia
IVSRFDYNNCWAEIDILQSVYEDDGA

SEQ ID NO: 3074001 - protein, 19 aa, Giardia lamblia
IVSRLSLVRDLVEDITSGQ

SEQ ID NO: 3074002 - protein, 21 aa, Giardia lamblia
IVSSFAVVFVIFAFIVLNVRF

SEQ ID NO: 3074003 - protein, 28 aa, Giardia lamblia
IVSSYIPFKFLFYFFLLLSSYWVPQCYH

SEQ ID NO: 3074004 - protein, 25 aa, Giardia lamblia
IVSTLPILFKRYWRVANSRQDTGEP

SEQ ID NO: 3074005 - protein, 26 aa, Giardia lamblia
IVSVCCIFVVFIYYCILLCKFYRRLL

SEQ ID NO: 3074006 - protein, 23 aa, Giardia lamblia
IVSYPPHCYLKIVQALYPGSELM

SEQ ID NO: 3074007 - protein, 17 aa, Giardia lamblia
IVTAAKESCSWQKELLD

SEQ ID NO: 3074008 - protein, 28 aa, Giardia lamblia
IVTFKKSCKVSDELAGKAFIDYVKTEFK

SEQ ID NO: 3074009 - protein, 18 aa, Giardia lamblia
IVTLCNLVNLMGAPSSPC

SEQ ID NO: 3074010 - protein, 28 aa, Giardia lamblia
IVTWLLIGSVCFGFYLSFKTRTCLTAEF

SEQ ID NO: 3074011 - protein, 30 aa, Giardia lamblia
IVVCLLCAIGSLFGICFSVGMGCANLRLIL

SEQ ID NO: 3074012 - protein, 24 aa, Giardia lamblia
IVVGIEYLPSWQLLQLCTLANDLR

SEQ ID NO: 3074013 - protein, 21 aa, Giardia lamblia
IVVLCMFVFAIISKANWMTYL

SEQ ID NO: 3074014 - protein, 19 aa, Giardia lamblia
IVVLFRWKGITPNTIGGWR

SEQ ID NO: 3074015 - protein, 21 aa, Giardia lamblia
IVYELCTFERLVSGATVADAI

SEQ ID NO: 3074016 - protein, 17 aa, Giardia lamblia
IWFAAGIINDELKFMPE

SEQ ID NO: 3074017 - protein, 20 aa, Giardia lamblia
IWKPSITYMTGYPPGAHMRL

SEQ ID NO: 3074018 - protein, 17 aa, Giardia lamblia
IWMNCSLARGYATGLVV

SEQ ID NO: 3074019 - protein, 34 aa, Giardia lamblia
IWNAFLFGVVGWCFVSHAMSFLFTDVNVIMHSHE

SEQ ID NO: 3074020 - protein, 18 aa, Giardia lamblia
IWPAFAMAYEGEETDIMI

SEQ ID NO: 3074021 - protein, 22 aa, Giardia lamblia
IWQHLQVLAIEFIAQYLHLHNL

SEQ ID NO: 3074022 - protein, 20 aa, Giardia lamblia
IWSIMIPIIFIAWHKQLLFF

SEQ ID NO: 3074023 - protein, 17 aa, Giardia lamblia
IWYSLLQSVCDNASADD

SEQ ID NO: 3074024 - protein, 18 aa, Giardia lamblia
IYACPEHNLSCSYNKSAV

SEQ ID NO: 3074025 - protein, 18 aa, Giardia lamblia
IYANLALDLLPYNCNSGI

SEQ ID NO: 3074026 - protein, 23 aa, Giardia lamblia
IYCSGDLLANCELLESIYQCQCS

SEQ ID NO: 3074027 - protein, 19 aa, Giardia lamblia
IYDILCISPYLLDPLVHEN

SEQ ID NO: 3074028 - protein, 19 aa, Giardia lamblia
IYERFPKHDALMAELITVL

SEQ ID NO: 3074029 - protein, 18 aa, Giardia lamblia
IYFDVCNTSLFLSNQSNK

SEQ ID NO: 3074030 - protein, 19 aa, Giardia lamblia
IYFPVSEMLQLIHIENTQH

SEQ ID NO: 3074031 - protein, 25 aa, Giardia lamblia
IYFSQALAVIMCIRYYKDSASDNSK

SEQ ID NO: 3074032 - protein, 17 aa, Giardia lamblia
IYFWLLATTALCACTHY

SEQ ID NO: 3074033 - protein, 27 aa, Giardia lamblia
IYGFIISIGLVFPVLMALKIENDFDAF

SEQ ID NO: 3074034 - protein, 21 aa, Giardia lamblia
IYGGNPLRLLRKMANREFRLA

SEQ ID NO: 3074035 - protein, 18 aa, Giardia lamblia
IYGYSSHLLLLVSLVYAA

SEQ ID NO: 3074036 - protein, 18 aa, Giardia lamblia
IYHTCKVKSPGSMSVLLS

SEQ ID NO: 3074037 - protein, 24 aa, Giardia lamblia
IYIAPELLAGAAYGPAADAWSLGC

SEQ ID NO: 3074038 - protein, 25 aa, Giardia lamblia
IYICDCAFLAINLCDQEVQLEKLWA

SEQ ID NO: 3074039 - protein, 20 aa, Giardia lamblia
IYLAATLLANFCRVEDPGCA

SEQ ID NO: 3074040 - protein, 21 aa, Giardia lamblia
IYLACGLPLLRIDKAIKKINQ

SEQ ID NO: 3074041 - protein, 21 aa, Giardia lamblia
IYLKHSHPFTGHLHIMSTLHI

SEQ ID NO: 3074042 - protein, 17 aa, Giardia lamblia
IYLLRKPMEALRVIYVR

SEQ ID NO: 3074043 - protein, 28 aa, Giardia lamblia
IYLLSLGRFFFCSMLTFSASRSPRFKFS

SEQ ID NO: 3074044 - protein, 26 aa, Giardia lamblia
IYLLYRVVYNMVICRAHGNISVIEKI

SEQ ID NO: 3074045 - protein, 17 aa, Giardia lamblia
IYLRQSRHFVPFVHTIH

SEQ ID NO: 3074046 - protein, 17 aa, Giardia lamblia
IYLYSCGSATYNLLGNV

SEQ ID NO: 3074047 - protein, 24 aa, Giardia lamblia
IYNHRRFGDMLAIILIMTIYGTFT

SEQ ID NO: 3074048 - protein, 22 aa, Giardia lamblia
IYNVIMSMLLIKDVYFFPSKAS

SEQ ID NO: 3074049 - protein, 18 aa, Giardia lamblia
IYRCYVFDAIPAYKGPAA

SEQ ID NO: 3074050 - protein, 21 aa, Giardia lamblia
IYRFLAISFPFYINGVSSSVC

SEQ ID NO: 3074051 - protein, 27 aa, Giardia lamblia
IYRRSTFFDYVFKWVRCTTHEQISPSV

SEQ ID NO: 3074052 - protein, 26 aa, Giardia lamblia
IYRVFLCNIYHWYYPYLFIGALNNDI

SEQ ID NO: 3074053 - protein, 18 aa, Giardia lamblia
IYSARGDWSQAIKSLSTI

SEQ ID NO: 3074054 - protein, 20 aa, Giardia lamblia
IYTAMIFRKKDMITYDVYSR

SEQ ID NO: 3074055 - protein, 18 aa, Giardia lamblia
IYTGCIDSLPGRLLRLCD

SEQ ID NO: 3074056 - protein, 25 aa, Giardia lamblia
IYTKLIKLAEHWVEQDAFKKESSRY

SEQ ID NO: 3074057 - protein, 18 aa, Giardia lamblia
IYVHCAVMTFFLTDPKFD

SEQ ID NO: 3074058 - protein, 28 aa, Giardia lamblia
KAAASILLNILINWGGGDIIVFLPGIVA

SEQ ID NO: 3074059 - protein, 26 aa, Giardia lamblia
KAASTKRLSYVGGFAGSCRMGAEVVA

SEQ ID NO: 3074060 - protein, 27 aa, Giardia lamblia
KACAQCSHAAVRACQVAHRYAPQKLRA

SEQ ID NO: 3074061 - protein, 20 aa, Giardia lamblia
KADKIPICCQFFCDNLLCMM

SEQ ID NO: 3074062 - protein, 24 aa, Giardia lamblia
KADVAAIKGVFILVVDKIYDNRYV

SEQ ID NO: 3074063 - protein, 20 aa, Giardia lamblia
KAEALEAILSKYAIGCMLDD

SEQ ID NO: 3074064 - protein, 19 aa, Giardia lamblia
KAEAMLVELVTTLLETWNR

SEQ ID NO: 3074065 - protein, 31 aa, Giardia lamblia
KAEKHHKCSKKCLIIWGVIIAVIAIIVISVL

SEQ ID NO: 3074066 - protein, 17 aa, Giardia lamblia
KAEPLYVTLANRKEFEK

SEQ ID NO: 3074067 - protein, 23 aa, Giardia lamblia
KAERYKLSMLPPFSQLNDPLLGI

SEQ ID NO: 3074068 - protein, 23 aa, Giardia lamblia
KAFDGRTALMIAVQNTALESVLL

SEQ ID NO: 3074069 - protein, 17 aa, Giardia lamblia
KAFEFLKSALESKAVRL

SEQ ID NO: 3074070 - protein, 25 aa, Giardia lamblia
KAHLKTRLDLLLTVRHQGMRLIYEP

SEQ ID NO: 3074071 - protein, 20 aa, Giardia lamblia
KAIDGSRSWTFESSRRQKLE

SEQ ID NO: 3074072 - protein, 17 aa, Giardia lamblia
KAIFRAAVAIFKTAASG

SEQ ID NO: 3074073 - protein, 24 aa, Giardia lamblia
KAIRLRNIKKGFAETVRRRAGALK

SEQ ID NO: 3074074 - protein, 25 aa, Giardia lamblia
KAISTTCLLPLFKRYAFGDPHNDPS

SEQ ID NO: 3074075 - protein, 17 aa, Giardia lamblia
KAITLKSLFNAGWWSFI

SEQ ID NO: 3074076 - protein, 25 aa, Giardia lamblia
KAKRARASSVIGCPLSILDVTEDNT

SEQ ID NO: 3074077 - protein, 17 aa, Giardia lamblia
KALGCDGSRDSVNDQLN

SEQ ID NO: 3074078 - protein, 22 aa, Giardia lamblia
KALGLIIRLYFYDTLHPLDLLF

SEQ ID NO: 3074079 - protein, 25 aa, Giardia lamblia
KALLASGFCKLDFTGLNLDEIPAYS

SEQ ID NO: 3074080 - protein, 18 aa, Giardia lamblia
KALPLLFGRHTALDRKLA

SEQ ID NO: 3074081 - protein, 18 aa, Giardia lamblia
KALPPTLYAVLLLSKTYQ

SEQ ID NO: 3074082 - protein, 17 aa, Giardia lamblia
KALRKMTSFRLDAPTTI

SEQ ID NO: 3074083 - protein, 17 aa, Giardia lamblia
KALSILALYGLGQESNH

SEQ ID NO: 3074084 - protein, 19 aa, Giardia lamblia
KALVTGLLPLSGFVASLLP

SEQ ID NO: 3074085 - protein, 19 aa, Giardia lamblia
KANHMSYAFFEQAGKTGNQ

SEQ ID NO: 3074086 - protein, 22 aa, Giardia lamblia
KANRARTSETWERYSSGEYPTG

SEQ ID NO: 3074087 - protein, 21 aa, Giardia lamblia
KAPGFELPLSKVLGVLSEYES

SEQ ID NO: 3074088 - protein, 20 aa, Giardia lamblia
KAPMLPGIGRPAGVGTISQI

SEQ ID NO: 3074089 - protein, 24 aa, Giardia lamblia
KAQLILSFFRLTPLYIQQDLVQLA

SEQ ID NO: 3074090 - protein, 19 aa, Giardia lamblia
KARKDKRLYGGVPDHNNEY

SEQ ID NO: 3074091 - protein, 24 aa, Giardia lamblia
KARLNRLGIKLTLDLGTRSNSRRS

SEQ ID NO: 3074092 - protein, 22 aa, Giardia lamblia
KARNWKEQRTMLQYIKEADDLN

SEQ ID NO: 3074093 - protein, 21 aa, Giardia lamblia
KARSKEIVQELVLRGQRRDEF

SEQ ID NO: 3074094 - protein, 18 aa, Giardia lamblia
KASFLRTLYPGYDETQAP

SEQ ID NO: 3074095 - protein, 17 aa, Giardia lamblia
KASFRLEYIKVIIGVLL

SEQ ID NO: 3074096 - protein, 18 aa, Giardia lamblia
KASIKYLCVTYACRYNLV

SEQ ID NO: 3074097 - protein, 18 aa, Giardia lamblia
KASLLDCIPLNYRQLQAV

SEQ ID NO: 3074098 - protein, 25 aa, Giardia lamblia
KASLPKMRRAHGFSSVPSPQRLEAD

SEQ ID NO: 3074099 - protein, 19 aa, Giardia lamblia
KASQVLESLLIQLERKVHD

SEQ ID NO: 3074100 - protein, 22 aa, Giardia lamblia
KASRPFPVYLILSVLVQLLSLC

SEQ ID NO: 3074101 - protein, 33 aa, Giardia lamblia
KASRRIIREDFIWRVAAVIVFVLEYLHTHLTPQ

SEQ ID NO: 3074102 - protein, 19 aa, Giardia lamblia
KASSTCYPFQMKISKYCTS

SEQ ID NO: 3074103 - protein, 24 aa, Giardia lamblia
KASVRRHVWTLSFLDEMLPQLDYT

SEQ ID NO: 3074104 - protein, 20 aa, Giardia lamblia
KATASTIRQDACFSSQSIHQ

SEQ ID NO: 3074105 - protein, 23 aa, Giardia lamblia
KATESLFPLFSITQVTFQYKHDS

SEQ ID NO: 3074106 - protein, 25 aa, Giardia lamblia
KATSGYRIAYLMGVIAIIVHDTGAF

SEQ ID NO: 3074107 - protein, 22 aa, Giardia lamblia
KATSSDSLLCFNTTTMELTHSL

SEQ ID NO: 3074108 - protein, 20 aa, Giardia lamblia
KATVEPCLIEDLGPLLNDCT

SEQ ID NO: 3074109 - protein, 19 aa, Giardia lamblia
KAVEDFAAYLSRRTHLHVG

SEQ ID NO: 3074110 - protein, 17 aa, Giardia lamblia
KAVFKPIFEIVGQCGSQ

SEQ ID NO: 3074111 - protein, 25 aa, Giardia lamblia
KAVSGDSVLACFIILFIYICGRDPP

SEQ ID NO: 3074112 - protein, 20 aa, Giardia lamblia
KAYFGRKCIDNTILSAYFTK

SEQ ID NO: 3074113 - protein, 24 aa, Giardia lamblia
KAYWDFIKASLFSLNLLHDHSSDG

SEQ ID NO: 3074114 - protein, 18 aa, Giardia lamblia
KAYYVKRIKSTPTQLAAY

SEQ ID NO: 3074115 - protein, 17 aa, Giardia lamblia
KCAKINHIITYKFAFEV

SEQ ID NO: 3074116 - protein, 17 aa, Giardia lamblia
KCATKGFNERPVLIRAI

SEQ ID NO: 3074117 - protein, 26 aa, Giardia lamblia
KCDVKRPRCTDVFRGLGEVHADTVGF

SEQ ID NO: 3074118 - protein, 32 aa, Giardia lamblia
KCEAITFWTFLWVLPLFWVIVLIINIVSSTIK

SEQ ID NO: 3074119 - protein, 18 aa, Giardia lamblia
KCESCAENAVPISPDVYH

SEQ ID NO: 3074120 - protein, 20 aa, Giardia lamblia
KCESCAESAVPISPDVYHTA

SEQ ID NO: 3074121 - protein, 19 aa, Giardia lamblia
KCFGSCLALGLGYYNDAGV

SEQ ID NO: 3074122 - protein, 19 aa, Giardia lamblia
KCFGSCLALGPGYYNNSGI

SEQ ID NO: 3074123 - protein, 19 aa, Giardia lamblia
KCIKRVCLSDVLPGNTFRN

SEQ ID NO: 3074124 - protein, 22 aa, Giardia lamblia
KCIKYYCNHENYEIKNWNGNAF

SEQ ID NO: 3074125 - protein, 25 aa, Giardia lamblia
KCLLDKLTYIFVIFKLRASMRPYGF

SEQ ID NO: 3074126 - protein, 20 aa, Giardia lamblia
KCLPLPRGQRAQCTVCERGY

SEQ ID NO: 3074127 - protein, 25 aa, Giardia lamblia
KCLVSVGPLRVWPGGLSVSRGIGDF

SEQ ID NO: 3074128 - protein, 19 aa, Giardia lamblia
KCMVFFTLLACLSMLFEAP

SEQ ID NO: 3074129 - protein, 26 aa, Giardia lamblia
KCRACAIPHCRTCNALGKCTVCEKGF

SEQ ID NO: 3074130 - protein, 20 aa, Giardia lamblia
KCRKIKMYAIIAAIILVILL

SEQ ID NO: 3074131 - protein, 19 aa, Giardia lamblia
KCRKSKCYYTDPYENIEKK

SEQ ID NO: 3074132 - protein, 19 aa, Giardia lamblia
KCTNGHCSMRCTNDQGCGN

SEQ ID NO: 3074133 - protein, 19 aa, Giardia lamblia
KCTVPLCAICVENDAMRCE

SEQ ID NO: 3074134 - protein, 20 aa, Giardia lamblia
KCVLCCCSCCCCGCCGCLDC

SEQ ID NO: 3074135 - protein, 19 aa, Giardia lamblia
KCVPCGDNLVGISNCIECT

SEQ ID NO: 3074136 - protein, 20 aa, Giardia lamblia
KCVSACKEVLEVLGHAEGRN

SEQ ID NO: 3074137 - protein, 22 aa, Giardia lamblia
KDAFRARHVYLNLGTMATTGIG

SEQ ID NO: 3074138 - protein, 22 aa, Giardia lamblia
KDAHSLYVKPSFFGHFRLAFPL

SEQ ID NO: 3074139 - protein, 20 aa, Giardia lamblia
KDAILCLAGTIATAAGATDE

SEQ ID NO: 3074140 - protein, 17 aa, Giardia lamblia
KDAKKGRCTACRGSYFL

SEQ ID NO: 3074141 - protein, 17 aa, Giardia lamblia
KDARRHALSFLIQHGLT

SEQ ID NO: 3074142 - protein, 17 aa, Giardia lamblia
KDASRCKYLCTYEGDSR

SEQ ID NO: 3074143 - protein, 30 aa, Giardia lamblia
KDCFARKDYRRCLAISIILPFLQQFTGINA

SEQ ID NO: 3074144 - protein, 31 aa, Giardia lamblia
KDCLIPRQLYRLDFPISSFLSIASLSIEGAL

SEQ ID NO: 3074145 - protein, 20 aa, Giardia lamblia
KDDYGCMFLLDQRYSIEISR

SEQ ID NO: 3074146 - protein, 26 aa, Giardia lamblia
KDELVYSCCQELFFALATVTYSKAKS

SEQ ID NO: 3074147 - protein, 21 aa, Giardia lamblia
KDELYGLFVMIGRLSGVLGSV

SEQ ID NO: 3074148 - protein, 20 aa, Giardia lamblia
KDEQDAFMKMMWPNTNTNEH

SEQ ID NO: 3074149 - protein, 40 aa, Giardia lamblia
KDFRKVQLICFFGLLLPLFLVCTMGWLIAVMVTCRKIPEQ

SEQ ID NO: 3074150 - protein, 17 aa, Giardia lamblia
KDFSAFLVANPDQLLQL

SEQ ID NO: 3074151 - protein, 17 aa, Giardia lamblia
KDFVELYQLGKGGYGEV

SEQ ID NO: 3074152 - protein, 20 aa, Giardia lamblia
KDGILCLPEILSVCETNHVR

SEQ ID NO: 3074153 - protein, 22 aa, Giardia lamblia
KDGKCTKCKGITFTNPEPNAVE

SEQ ID NO: 3074154 - protein, 20 aa, Giardia lamblia
KDGPRATVSIANFTKNSNPV

SEQ ID NO: 3074155 - protein, 17 aa, Giardia lamblia
KDGRTALMIAAETGQDK

SEQ ID NO: 3074156 - protein, 39 aa, Giardia lamblia
KDIARLMAASSLAARPGYASFFICTLYLMINGCTVYDAV

SEQ ID NO: 3074157 - protein, 23 aa, Giardia lamblia
KDIEPKRWYGIFAGLTLAFVIFG

SEQ ID NO: 3074158 - protein, 23 aa, Giardia lamblia
KDIKSVFSSKGLDTTGILELYMC

SEQ ID NO: 3074159 - protein, 23 aa, Giardia lamblia
KDIQLELRYKRCLEEVIRSIQTT

SEQ ID NO: 3074160 - protein, 25 aa, Giardia lamblia
KDKIAIRGPHRIFPGGLAVPRAIGD

SEQ ID NO: 3074161 - protein, 20 aa, Giardia lamblia
KDLDIVYAMSSYKTAYYNCI

SEQ ID NO: 3074162 - protein, 20 aa, Giardia lamblia
KDLLEAPLLKYAEDLEDICS

SEQ ID NO: 3074163 - protein, 24 aa, Giardia lamblia
KDLLPRLRATLVLTANEQSMVDAL

SEQ ID NO: 3074164 - protein, 18 aa, Giardia lamblia
KDLLQCICKRIVLDNPTL

SEQ ID NO: 3074165 - protein, 23 aa, Giardia lamblia
KDLLRTTGSLALIKSVVQLFVLL

SEQ ID NO: 3074166 - protein, 24 aa, Giardia lamblia
KDLPEYYKTVSFKDPLCAVILSIH

SEQ ID NO: 3074167 - protein, 25 aa, Giardia lamblia
KDLPRDRLLPYLVTGVLCLTKQLGP

SEQ ID NO: 3074168 - protein, 18 aa, Giardia lamblia
KDLPYCLQLTSIISSESA

SEQ ID NO: 3074169 - protein, 21 aa, Giardia lamblia
KDLRIRLCTTDRKIVLYTLRD

SEQ ID NO: 3074170 - protein, 21 aa, Giardia lamblia
KDLRPATPVEECVASPTQQMV

SEQ ID NO: 3074171 - protein, 19 aa, Giardia lamblia
KDLRVSLGTVYSLAYLCIT

SEQ ID NO: 3074172 - protein, 18 aa, Giardia lamblia
KDMDCTFHEILLDLPETK

SEQ ID NO: 3074173 - protein, 22 aa, Giardia lamblia
KDMWKYRKQRIVGLQLTVDPSI

SEQ ID NO: 3074174 - protein, 18 aa, Giardia lamblia
KDNATGQFCNVCTKDSFC

SEQ ID NO: 3074175 - protein, 18 aa, Giardia lamblia
KDNLRYLYTIEEILEPIY

SEQ ID NO: 3074176 - protein, 20 aa, Giardia lamblia
KDPHFKASEQYIMNRSYPAN

SEQ ID NO: 3074177 - protein, 19 aa, Giardia lamblia
KDPKDVFVDGWRPNLSGVT

SEQ ID NO: 3074178 - protein, 21 aa, Giardia lamblia
KDPMPGFKFMGQKNVQWFNLR

SEQ ID NO: 3074179 - protein, 18 aa, Giardia lamblia
KDPYTIRYSPHMFEKTTW

SEQ ID NO: 3074180 - protein, 24 aa, Giardia lamblia
KDQGVCGSCWAFGTMTLAESSIIA

SEQ ID NO: 3074181 - protein, 20 aa, Giardia lamblia
KDQNSMLGLGSFSLSTLQHR

SEQ ID NO: 3074182 - protein, 30 aa, Giardia lamblia
KDRIILIPYANPWSDLTLRKSVSERPIAEL

SEQ ID NO: 3074183 - protein, 20 aa, Giardia lamblia
KDRMKEILFGKDQEASIEDT

SEQ ID NO: 3074184 - protein, 17 aa, Giardia lamblia
KDSCGLKFLGLILGCIV

SEQ ID NO: 3074185 - protein, 23 aa, Giardia lamblia
KDSCGLKFLGLILGCIVAFVVIA

SEQ ID NO: 3074186 - protein, 18 aa, Giardia lamblia
KDSFGLTALMYAAMSGYC

SEQ ID NO: 3074187 - protein, 21 aa, Giardia lamblia
KDSGAFVFELCRFDQHFYRLY

SEQ ID NO: 3074188 - protein, 23 aa, Giardia lamblia
KDSSLMARFFGFRDVGHVLECYG

SEQ ID NO: 3074189 - protein, 24 aa, Giardia lamblia
KDSYCAGLSLLSLRESRDALAELP

SEQ ID NO: 3074190 - protein, 26 aa, Giardia lamblia
KDSYIPFTFTEAMIFGEIADYIQVLV

SEQ ID NO: 3074191 - protein, 22 aa, Giardia lamblia
KDTCTKIGLPLINRGESAAGCR

SEQ ID NO: 3074192 - protein, 20 aa, Giardia lamblia
KDTLFWQTYIAKDWKTSYAA

SEQ ID NO: 3074193 - protein, 24 aa, Giardia lamblia
KDVDMKAYISAYGFSYFQDAATPA

SEQ ID NO: 3074194 - protein, 19 aa, Giardia lamblia
KDVSECVICSICFDYITLT

SEQ ID NO: 3074195 - protein, 21 aa, Giardia lamblia
KDYIEHLFASIPIPSTCGQQA

SEQ ID NO: 3074196 - protein, 29 aa, Giardia lamblia
KDYKGFCSRFKDRLERDFGTKGCDVKEIL

SEQ ID NO: 3074197 - protein, 27 aa, Giardia lamblia
KDYPLGISEFFPLKEIYNYTSNINNLL

SEQ ID NO: 3074198 - protein, 18 aa, Giardia lamblia
KDYVCTRLLGNTSTTPYL

SEQ ID NO: 3074199 - protein, 23 aa, Giardia lamblia
KEAGARCSATVWFSGFEFNGASA

SEQ ID NO: 3074200 - protein, 24 aa, Giardia lamblia
KEAKRRGKTFLRHRDVSVSEDFTE

SEQ ID NO: 3074201 - protein, 24 aa, Giardia lamblia
KEAQCKLGGFSSVPAFSDISKCLK

SEQ ID NO: 3074202 - protein, 21 aa, Giardia lamblia
KEASAHALALVADREKVIESL

SEQ ID NO: 3074203 - protein, 26 aa, Giardia lamblia
KEATYFRSLLCMLVLGAIIVITSEVA

SEQ ID NO: 3074204 - protein, 25 aa, Giardia lamblia
KEAVSAFIFPYGCFFDHLDRLHDFS

SEQ ID NO: 3074205 - protein, 22 aa, Giardia lamblia
KECLLPHIISGSFFLIPTLEAI

SEQ ID NO: 3074206 - protein, 17 aa, Giardia lamblia
KEECLYGSCFKKCSSDT

SEQ ID NO: 3074207 - protein, 21 aa, Giardia lamblia
KEEILQLSALFTCPLVPLVWD

SEQ ID NO: 3074208 - protein, 19 aa, Giardia lamblia
KEELAACRGNDGRYTLESL

SEQ ID NO: 3074209 - protein, 17 aa, Giardia lamblia
KEFPVNKLLPLSVQELC

SEQ ID NO: 3074210 - protein, 20 aa, Giardia lamblia
KEGKCPPCTAITGCQTCTNT

SEQ ID NO: 3074211 - protein, 30 aa, Giardia lamblia
KEGVCTGCGAGYFLHRTVCFTPEFYPQICT

SEQ ID NO: 3074212 - protein, 23 aa, Giardia lamblia
KEHISLNILPLVKYGLFDPSWRV

SEQ ID NO: 3074213 - protein, 25 aa, Giardia lamblia
KEIDLSLLIMEFLSTIPLATIALPD

SEQ ID NO: 3074214 - protein, 17 aa, Giardia lamblia
KEIFLRELISNASDALD

SEQ ID NO: 3074215 - protein, 20 aa, Giardia lamblia
KEILYRCPPSSMGSKSNLLI

SEQ ID NO: 3074216 - protein, 22 aa, Giardia lamblia
KEISACLYEFYLSTSGPNWYSS

SEQ ID NO: 3074217 - protein, 26 aa, Giardia lamblia
KEKDCILKDLAFRYYLVSADEHPDHN

SEQ ID NO: 3074218 - protein, 20 aa, Giardia lamblia
KEKMDALAVKQAQLKEVEDK

SEQ ID NO: 3074219 - protein, 21 aa, Giardia lamblia
KEKYPRLTSNIVLNRLEQYFK

SEQ ID NO: 3074220 - protein, 21 aa, Giardia lamblia
KELRNCYFLDTKAGVDCNRNF

SEQ ID NO: 3074221 - protein, 23 aa, Giardia lamblia
KEMLRRRDLEVLTTTLFEASAIS

SEQ ID NO: 3074222 - protein, 18 aa, Giardia lamblia
KENGGVLPQDFVDARAAE

SEQ ID NO: 3074223 - protein, 28 aa, Giardia lamblia
KEPDLALPLAHLFLRYLKVYCSEEEKHT

SEQ ID NO: 3074224 - protein, 19 aa, Giardia lamblia
KEPVKMSVDLLKELKARAK

SEQ ID NO: 3074225 - protein, 17 aa, Giardia lamblia
KEQEDRTGGGFVPTYDY

SEQ ID NO: 3074226 - protein, 20 aa, Giardia lamblia
KEQKIIITIAHRLRTVCNQD

SEQ ID NO: 3074227 - protein, 22 aa, Giardia lamblia
KERKRLLSRLLFNIVTHTLAIT

SEQ ID NO: 3074228 - protein, 18 aa, Giardia lamblia
KERVSSAYVKARRASTDA

SEQ ID NO: 3074229 - protein, 22 aa, Giardia lamblia
KESQHSFDFLRTEYHKLIDQHR

SEQ ID NO: 3074230 - protein, 22 aa, Giardia lamblia
KESSLILAARLHYPLIAKELLI

SEQ ID NO: 3074231 - protein, 23 aa, Giardia lamblia
KETFVSLPLAVVVAYLLTIIASV

SEQ ID NO: 3074232 - protein, 21 aa, Giardia lamblia
KETVKIFGAITQWSEILGITL

SEQ ID NO: 3074233 - protein, 21 aa, Giardia lamblia
KETVYCSKNFILIWTLLIHSK

SEQ ID NO: 3074234 - protein, 21 aa, Giardia lamblia
KEVADMITLDLGFVPHHGRAS

SEQ ID NO: 3074235 - protein, 21 aa, Giardia lamblia
KEVKIGSVYFALPTLFVLASI

SEQ ID NO: 3074236 - protein, 29 aa, Giardia lamblia
KEYLFNVYFLRARALAIINRLERAVKDAF

SEQ ID NO: 3074237 - protein, 30 aa, Giardia lamblia
KEYPEFLTCLMFYLTPSWKKFSYKSLNIVP

SEQ ID NO: 3074238 - protein, 19 aa, Giardia lamblia
KEYTGHAALTMIQSTIELI

SEQ ID NO: 3074239 - protein, 31 aa, Giardia lamblia
KEYYIKNQLCAKGCMGLTTGMCVGPPSNLDR

SEQ ID NO: 3074240 - protein, 17 aa, Giardia lamblia
KFALPFSTKALKYVMDN

SEQ ID NO: 3074241 - protein, 19 aa, Giardia lamblia
KFDICRELRNYFKNLDGDR

SEQ ID NO: 3074242 - protein, 26 aa, Giardia lamblia
KFDPVHSAAGFSLRVTSELLIHILEL

SEQ ID NO: 3074243 - protein, 29 aa, Giardia lamblia
KFEKPWFQTACMFMAMLVCIIAHGIIEAV

SEQ ID NO: 3074244 - protein, 20 aa, Giardia lamblia
KFFITIAELFALGKDPLGQI

SEQ ID NO: 3074245 - protein, 27 aa, Giardia lamblia
KFGSFKRHRCTLPHELLELAHSHSDDS

SEQ ID NO: 3074246 - protein, 18 aa, Giardia lamblia
KFIDIRTFFILEGIQYTI

SEQ ID NO: 3074247 - protein, 20 aa, Giardia lamblia
KFILSDYMVYISWLMNHATI

SEQ ID NO: 3074248 - protein, 28 aa, Giardia lamblia
KFIYCFDESFTGLFPIKSPILCKRYLNT

SEQ ID NO: 3074249 - protein, 18 aa, Giardia lamblia
KFKSILFSEMTQRVRLKL

SEQ ID NO: 3074250 - protein, 18 aa, Giardia lamblia
KFLDCVLAAAPLTTETES

SEQ ID NO: 3074251 - protein, 25 aa, Giardia lamblia
KFLEQATKILLMFLGIIISAFGLLV

SEQ ID NO: 3074252 - protein, 21 aa, Giardia lamblia
KFLEVYPLFSLFVSVNLELEM

SEQ ID NO: 3074253 - protein, 26 aa, Giardia lamblia
KFLNRVACLLFYLSLSYYARNWLYVL

SEQ ID NO: 3074254 - protein, 19 aa, Giardia lamblia
KFLQCPLKSLTGSISKFIA

SEQ ID NO: 3074255 - protein, 26 aa, Giardia lamblia
KFPELAELRRARTAAADILLLVPASC

SEQ ID NO: 3074256 - protein, 25 aa, Giardia lamblia
KFQVCACCSPFVYGITFGGMLVVYS

SEQ ID NO: 3074257 - protein, 25 aa, Giardia lamblia
KFREFCDTCVTLLNFNSVTEVFYAF

SEQ ID NO: 3074258 - protein, 20 aa, Giardia lamblia
KFSSTVLSGRIYKEYIVASG

SEQ ID NO: 3074259 - protein, 30 aa, Giardia lamblia
KFSTLEEIGMSFSLFRTFMHNIPVWGEYLS

SEQ ID NO: 3074260 - protein, 17 aa, Giardia lamblia
KFTTLCSGITSSSTDTD

SEQ ID NO: 3074261 - protein, 17 aa, Giardia lamblia
KFVFQHPIVESKLGLIS

SEQ ID NO: 3074262 - protein, 17 aa, Giardia lamblia
KFVRGVYISTRRLLMEL

SEQ ID NO: 3074263 - protein, 26 aa, Giardia lamblia
KFWKTEFSKGITFPAIGEVFDYYVAI

SEQ ID NO: 3074264 - protein, 22 aa, Giardia lamblia
KGACLACADGYFLYEGGCYETS

SEQ ID NO: 3074265 - protein, 21 aa, Giardia lamblia
KGAICTFCTRPDVAIVALEFE

SEQ ID NO: 3074266 - protein, 24 aa, Giardia lamblia
KGALRYGSPLSLFNLRSLYCQNYC

SEQ ID NO: 3074267 - protein, 17 aa, Giardia lamblia
KGCGEPFSACLPLLEIL

SEQ ID NO: 3074268 - protein, 23 aa, Giardia lamblia
KGDMRTVHYFLRFFERDLNTSES

SEQ ID NO: 3074269 - protein, 20 aa, Giardia lamblia
KGDTRLMSIFLWNLQQKQSL

SEQ ID NO: 3074270 - protein, 25 aa, Giardia lamblia
KGEGSPKCECWDADSSYQLLLQTED

SEQ ID NO: 3074271 - protein, 21 aa, Giardia lamblia
KGEITSVVFGWFSIICWIIAT

SEQ ID NO: 3074272 - protein, 17 aa, Giardia lamblia
KGFSGLHYACMTGALNV

SEQ ID NO: 3074273 - protein, 20 aa, Giardia lamblia
KGGGILDILGLPDLLGGLQG

SEQ ID NO: 3074274 - protein, 25 aa, Giardia lamblia
KGGHSSCLDRLCQYEHRLRNRHGWT

SEQ ID NO: 3074275 - protein, 18 aa, Giardia lamblia
KGHADCCELLLDTKSIVS

SEQ ID NO: 3074276 - protein, 29 aa, Giardia lamblia
KGHEARIYCDTHWTALMFACDSGHQPIVQ

SEQ ID NO: 3074277 - protein, 20 aa, Giardia lamblia
KGHFKCVDILAPLEAKAHGE

SEQ ID NO: 3074278 - protein, 26 aa, Giardia lamblia
KGILLPDGRNAMMMAAGYGAHAVVLA

SEQ ID NO: 3074279 - protein, 25 aa, Giardia lamblia
KGISREDYKGFSLAYCLAASAYFCR

SEQ ID NO: 3074280 - protein, 25 aa, Giardia lamblia
KGIVAECLSMIHFLDTLVAMTKCPS

SEQ ID NO: 3074281 - protein, 29 aa, Giardia lamblia
KGKAAGVADRIIWGWNIDITKFKAVEGNP

SEQ ID NO: 3074282 - protein, 24 aa, Giardia lamblia
KGLCLKCALGYFLHQGGCYSSLYA

SEQ ID NO: 3074283 - protein, 18 aa, Giardia lamblia
KGLWVLLGQLILKVDGAA

SEQ ID NO: 3074284 - protein, 29 aa, Giardia lamblia
KGNIHLVKGFPILAAMDMLYYAFKPQSNL

SEQ ID NO: 3074285 - protein, 22 aa, Giardia lamblia
KGNPLLRILYRSLLQLDSQKQT

SEQ ID NO: 3074286 - protein, 25 aa, Giardia lamblia
KGNPMWKDQQVILTLQLKTEFDINK

SEQ ID NO: 3074287 - protein, 20 aa, Giardia lamblia
KGQSLYLNIMRPFKQLISND

SEQ ID NO: 3074288 - protein, 21 aa, Giardia lamblia
KGRFSRGKFSGLGKLTNPMYN

SEQ ID NO: 3074289 - protein, 19 aa, Giardia lamblia
KGRGRLGSCGVAHFKSISA

SEQ ID NO: 3074290 - protein, 25 aa, Giardia lamblia
KGRMKDLHIWFTRWITSNFVDGPLQ

SEQ ID NO: 3074291 - protein, 19 aa, Giardia lamblia
KGRRGKSYSGRKYVRTVSD

SEQ ID NO: 3074292 - protein, 31 aa, Giardia lamblia
KGSLDALIFPKFDKCWSFSAQRQVKPIVYPA

SEQ ID NO: 3074293 - protein, 23 aa, Giardia lamblia
KGSRAPSPIKEMLPDPASAPKEA

SEQ ID NO: 3074294 - protein, 17 aa, Giardia lamblia
KGTPTLRKSGVDDSISV

SEQ ID NO: 3074295 - protein, 25 aa, Giardia lamblia
KGTQLRDVPSFIGRINNLLTRLKNI

SEQ ID NO: 3074296 - protein, 24 aa, Giardia lamblia
KGVCTGCLRGYMLYMGGCYDPAAI

SEQ ID NO: 3074297 - protein, 25 aa, Giardia lamblia
KGVCTGCLRGYMLYMGGCYDPAATP

SEQ ID NO: 3074298 - protein, 17 aa, Giardia lamblia
KGVLRPIFRELRKPAAI

SEQ ID NO: 3074299 - protein, 19 aa, Giardia lamblia
KGWTALMKAAFYGKSECIP

SEQ ID NO: 3074300 - protein, 21 aa, Giardia lamblia
KGYASLLMFLALRSWPRTWPV

SEQ ID NO: 3074301 - protein, 17 aa, Giardia lamblia
KGYKTRPAILETRPDGV

SEQ ID NO: 3074302 - protein, 24 aa, Giardia lamblia
KGYLTCAGKILAFISKEAKAQPSD

SEQ ID NO: 3074303 - protein, 19 aa, Giardia lamblia
KGYPPAVALAPDFFAQAAQ

SEQ ID NO: 3074304 - protein, 19 aa, Giardia lamblia
KHCSVCYDGVCLACLPGYS

SEQ ID NO: 3074305 - protein, 27 aa, Giardia lamblia
KHDFGYIPFGRRLFVLKVVANEELAKE

SEQ ID NO: 3074306 - protein, 24 aa, Giardia lamblia
KHGGQCKRGLCSCQNGLGGSDCSV

SEQ ID NO: 3074307 - protein, 22 aa, Giardia lamblia
KHGRTALMLAAERGHLEAVKLL

SEQ ID NO: 3074308 - protein, 17 aa, Giardia lamblia
KHHDFQVLSPRRHTSNK

SEQ ID NO: 3074309 - protein, 20 aa, Giardia lamblia
KHIIPNVGLPDMFTVDGNVG

SEQ ID NO: 3074310 - protein, 17 aa, Giardia lamblia
KHIRHLGWRRVFLGRYM

SEQ ID NO: 3074311 - protein, 18 aa, Giardia lamblia
KHKLVELEKVTPPQTQAF

SEQ ID NO: 3074312 - protein, 28 aa, Giardia lamblia
KHMTAFINICTPFFCAIWNACSLFYLTF

SEQ ID NO: 3074313 - protein, 19 aa, Giardia lamblia
KHNVLSFDWPGVGGTDPSR

SEQ ID NO: 3074314 - protein, 17 aa, Giardia lamblia
KHPEVIDSYTLGALLRR

SEQ ID NO: 3074315 - protein, 19 aa, Giardia lamblia
KHRFAEAPPINFFPHIEPT

SEQ ID NO: 3074316 - protein, 21 aa, Giardia lamblia
KHRQYRGRLTKKCTGYINSIV

SEQ ID NO: 3074317 - protein, 23 aa, Giardia lamblia
KHSTDIMSLLFIIARVPTYIFPL

SEQ ID NO: 3074318 - protein, 21 aa, Giardia lamblia
KHVLHTLLIHLGEPNRISYMF

SEQ ID NO: 3074319 - protein, 19 aa, Giardia lamblia
KHVLKELCEVEGPLVAITN

SEQ ID NO: 3074320 - protein, 25 aa, Giardia lamblia
KHYADWPLFVGLGCVLLLAVYAGIL

SEQ ID NO: 3074321 - protein, 17 aa, Giardia lamblia
KHYCGIPECHDPNTKML

SEQ ID NO: 3074322 - protein, 19 aa, Giardia lamblia
KIAHMFKFCSSPFRMSTLG

SEQ ID NO: 3074323 - protein, 22 aa, Giardia lamblia
KIAILLKSTFNFVMGRMKTDKP

SEQ ID NO: 3074324 - protein, 23 aa, Giardia lamblia
KIAQAYAALFGYFYSLSADYQQV

SEQ ID NO: 3074325 - protein, 19 aa, Giardia lamblia
KICTEMAEVVFAKGSERRK

SEQ ID NO: 3074326 - protein, 23 aa, Giardia lamblia
KIDLECLGRSFGLTEVPRVDVPG

SEQ ID NO: 3074327 - protein, 27 aa, Giardia lamblia
KIEGPRPPRRWGVPQLLSLDLCIALLS

SEQ ID NO: 3074328 - protein, 22 aa, Giardia lamblia
KIELLRELRQDLSVELEQRRTK

SEQ ID NO: 3074329 - protein, 25 aa, Giardia lamblia
KIERNLCQVYLYFLRAFVATGDNLL

SEQ ID NO: 3074330 - protein, 17 aa, Giardia lamblia
KIFRIIDYVLRLLTPLP

SEQ ID NO: 3074331 - protein, 24 aa, Giardia lamblia
KIFTHLPSRHLISLQSKFDNAPGG

SEQ ID NO: 3074332 - protein, 22 aa, Giardia lamblia
KIGAAILAACDLWNFSKALELC

SEQ ID NO: 3074333 - protein, 19 aa, Giardia lamblia
KIGAVVSIFAIHICVVMLY

SEQ ID NO: 3074334 - protein, 20 aa, Giardia lamblia
KIGIALCVRCHYTTEDRHFY

SEQ ID NO: 3074335 - protein, 25 aa, Giardia lamblia
KIGSLRFFGLLVFCMAFVSLTISAI

SEQ ID NO: 3074336 - protein, 19 aa, Giardia lamblia
KIHAESAAKGIGRANSFLK

SEQ ID NO: 3074337 - protein, 25 aa, Giardia lamblia
KIHAYKMLPRLGMFSNHSDVLLKSF

SEQ ID NO: 3074338 - protein, 26 aa, Giardia lamblia
KIHYGGRVTDSWDLRTLSCILTGIIN

SEQ ID NO: 3074339 - protein, 24 aa, Giardia lamblia
KIIIDLLRRLFLNNEVRKVFADIN

SEQ ID NO: 3074340 - protein, 23 aa, Giardia lamblia
KIIQRLLGVHGFTFSHHSPTYNY

SEQ ID NO: 3074341 - protein, 20 aa, Giardia lamblia
KIISSQGWFGAITAGDAAEV

SEQ ID NO: 3074342 - protein, 19 aa, Giardia lamblia
KIITSLMIRRDKSMQNPIV

SEQ ID NO: 3074343 - protein, 22 aa, Giardia lamblia
KILDFCRGHFYGTTFNPEKTII

SEQ ID NO: 3074344 - protein, 20 aa, Giardia lamblia
KILMPGSADWFGAVEAGDTS

SEQ ID NO: 3074345 - protein, 19 aa, Giardia lamblia
KILTLSIPLAFRMHSNLFS

SEQ ID NO: 3074346 - protein, 28 aa, Giardia lamblia
KIMARCSQGFWWKVFNNSVFLAVQLESI

SEQ ID NO: 3074347 - protein, 20 aa, Giardia lamblia
KIMHLVFEYGRIDFRVLDNG

SEQ ID NO: 3074348 - protein, 25 aa, Giardia lamblia
KINLRRPTPYFVERKWFNQSVQYGD

SEQ ID NO: 3074349 - protein, 22 aa, Giardia lamblia
KIPSLCLSNILQVMETILNTLT

SEQ ID NO: 3074350 - protein, 19 aa, Giardia lamblia
KIQELRPLVTTTRNYFRML

SEQ ID NO: 3074351 - protein, 19 aa, Giardia lamblia
KISSKRILTFITLPQPDYG

SEQ ID NO: 3074352 - protein, 22 aa, Giardia lamblia
KITRSMSDWVIKSRAGSASSAS

SEQ ID NO: 3074353 - protein, 21 aa, Giardia lamblia
KIVRLSLKILLNVSTLPEAVD

SEQ ID NO: 3074354 - protein, 20 aa, Giardia lamblia
KIVSLLGGASRGFAIIGQYA

SEQ ID NO: 3074355 - protein, 28 aa, Giardia lamblia
KIYNSLEKWAMLVGIKLSISKPTFLEVT

SEQ ID NO: 3074356 - protein, 25 aa, Giardia lamblia
KIYWNARKAIFYSYYPYLPYSTNDQ

SEQ ID NO: 3074357 - protein, 19 aa, Giardia lamblia
KKAIKSKLFFGSPELNYIQ

SEQ ID NO: 3074358 - protein, 21 aa, Giardia lamblia
KKAPVISGIITKASKRSLAAA

SEQ ID NO: 3074359 - protein, 19 aa, Giardia lamblia
KKATIAILARSLHGFLESL

SEQ ID NO: 3074360 - protein, 25 aa, Giardia lamblia
KKDDLLRKRMEAIPTSSSTIYPQGA

SEQ ID NO: 3074361 - protein, 24 aa, Giardia lamblia
KKDFTEGFIFLCSQLMTIDPLLRD

SEQ ID NO: 3074362 - protein, 21 aa, Giardia lamblia
KKDLGCDSCAAVIADCASCVP

SEQ ID NO: 3074363 - protein, 23 aa, Giardia lamblia
KKDLPPTIRRCFTEINVSEMSDD

SEQ ID NO: 3074364 - protein, 29 aa, Giardia lamblia
KKDTVCDFSMRVCLLYAAIVAQSDQLSNK

SEQ ID NO: 3074365 - protein, 22 aa, Giardia lamblia
KKEDLPQLVVYDVLAGSKKYFK

SEQ ID NO: 3074366 - protein, 20 aa, Giardia lamblia
KKFGSSVLRSKYIIMTDEES

SEQ ID NO: 3074367 - protein, 22 aa, Giardia lamblia
KKFNKSCFWCYTVQTISVRNPS

SEQ ID NO: 3074368 - protein, 17 aa, Giardia lamblia
KKFSLAILASALLDQLT

SEQ ID NO: 3074369 - protein, 21 aa, Giardia lamblia
KKFVHICGINPDNVKVMTSAK

SEQ ID NO: 3074370 - protein, 18 aa, Giardia lamblia
KKHRCLKEEKTSRWKLSS

SEQ ID NO: 3074371 - protein, 29 aa, Giardia lamblia
KKHTYHIAKPSFLLCRSVNSVPIKPKTLM

SEQ ID NO: 3074372 - protein, 24 aa, Giardia lamblia
KKIAECFYAPLSVVSLAGLALPQS

SEQ ID NO: 3074373 - protein, 25 aa, Giardia lamblia
KKIHTARQLLCMAVPSISIACSLLN

SEQ ID NO: 3074374 - protein, 19 aa, Giardia lamblia
KKISLSWLEKSIFGSPTSI

SEQ ID NO: 3074375 - protein, 20 aa, Giardia lamblia
KKKLPVSVIFSQYLEQNEFL

SEQ ID NO: 3074376 - protein, 32 aa, Giardia lamblia
KKKMTRTRLALAICATVLIGAINLTGFVLSTF

SEQ ID NO: 3074377 - protein, 25 aa, Giardia lamblia
KKKYGVPCPGFGDCKCNFKGIAIID

SEQ ID NO: 3074378 - protein, 17 aa, Giardia lamblia
KKLCLTFQTKNLTTSSA

SEQ ID NO: 3074379 - protein, 25 aa, Giardia lamblia
KKLIRLYLKEMFMRQIQHQLFVRDQ

SEQ ID NO: 3074380 - protein, 28 aa, Giardia lamblia
KKLLFLEIVVSLFFSLVVLITLQYNVFS

SEQ ID NO: 3074381 - protein, 24 aa, Giardia lamblia
KKLRKLRAPADCACCAKKSNCACT

SEQ ID NO: 3074382 - protein, 17 aa, Giardia lamblia
KKLSSHMLLLLLLVISI

SEQ ID NO: 3074383 - protein, 26 aa, Giardia lamblia
KKLTFRLRMVTFPVINYSNCCLFASE

SEQ ID NO: 3074384 - protein, 19 aa, Giardia lamblia
KKLTIKVPRKLFELDSQLQ

SEQ ID NO: 3074385 - protein, 28 aa, Giardia lamblia
KKNSCCGQCVGGVCSTGLNAHLCKLKSG

SEQ ID NO: 3074386 - protein, 20 aa, Giardia lamblia
KKPIKLRLTDNMDHSGINFL

SEQ ID NO: 3074387 - protein, 20 aa, Giardia lamblia
KKPVTAIAMTGTRTATQESA

SEQ ID NO: 3074388 - protein, 28 aa, Giardia lamblia
KKQLAMLCLPFFSVFVFGVHAVRLSVPL

SEQ ID NO: 3074389 - protein, 17 aa, Giardia lamblia
KKQLDPITINDYFFVLR

SEQ ID NO: 3074390 - protein, 26 aa, Giardia lamblia
KKQSKCNLEHVVVYSFFIILKSASPV

SEQ ID NO: 3074391 - protein, 21 aa, Giardia lamblia
KKQYKKLAVKWHPDRNPNCVD

SEQ ID NO: 3074392 - protein, 22 aa, Giardia lamblia
KKRHVIIPVLMPNAITLCNNEG

SEQ ID NO: 3074393 - protein, 20 aa, Giardia lamblia
KKRLCSHFGDTDVCKAINPS

SEQ ID NO: 3074394 - protein, 17 aa, Giardia lamblia
KKRLKIAQHDDGMARYS

SEQ ID NO: 3074395 - protein, 20 aa, Giardia lamblia
KKSINMWIVIAVIACTHVVV

SEQ ID NO: 3074396 - protein, 18 aa, Giardia lamblia
KKSTIFFYYYKKYSQKFN

SEQ ID NO: 3074397 - protein, 20 aa, Giardia lamblia
KKTATPFSDCYKVLTHFIYM

SEQ ID NO: 3074398 - protein, 28 aa, Giardia lamblia
KKTKVPASVCILTFIFLIIVWSSKAFCS

SEQ ID NO: 3074399 - protein, 19 aa, Giardia lamblia
KKTMARAVGQITLLVPQSI

SEQ ID NO: 3074400 - protein, 25 aa, Giardia lamblia
KKTPFISAPGWKGAHGANMVSVSQQ

SEQ ID NO: 3074401 - protein, 24 aa, Giardia lamblia
KKTSFSVLHPKSWAIHQREGGPCG

SEQ ID NO: 3074402 - protein, 27 aa, Giardia lamblia
KKVASIGKCVWITIILVLLGIVGIWIY

SEQ ID NO: 3074403 - protein, 24 aa, Giardia lamblia
KKVKTREPLGLAYYGFEGYEAYFN

SEQ ID NO: 3074404 - protein, 29 aa, Giardia lamblia
KKVVIPVKIVWPREFYTFSIWTSYSDTAK

SEQ ID NO: 3074405 - protein, 20 aa, Giardia lamblia
KKYMIPWNVKVTSFEALNTS

SEQ ID NO: 3074406 - protein, 17 aa, Giardia lamblia
KKYMPLLVYLRTKYHNN

SEQ ID NO: 3074407 - protein, 26 aa, Giardia lamblia
KLADSMTCTILLLGLASSLGSDTCPA

SEQ ID NO: 3074408 - protein, 22 aa, Giardia lamblia
KLAKLWVQPNLYLMSWEALVDR

SEQ ID NO: 3074409 - protein, 25 aa, Giardia lamblia
KLAYPSLKPLTSWFDDLIQRVAFMR

SEQ ID NO: 3074410 - protein, 20 aa, Giardia lamblia
KLDFVCFRKPDVFKPYQRRE

SEQ ID NO: 3074411 - protein, 25 aa, Giardia lamblia
KLDLFKKDVDAFIAMLKQKTKNAIN

SEQ ID NO: 3074412 - protein, 32 aa, Giardia lamblia
KLDSSCIRMHCHVCKDFSLCLNCYLSQAEYKT

SEQ ID NO: 3074413 - protein, 18 aa, Giardia lamblia
KLDTFKRREGYAGEYAIR

SEQ ID NO: 3074414 - protein, 20 aa, Giardia lamblia
KLDVPRYCGYIFLENVAIID

SEQ ID NO: 3074415 - protein, 23 aa, Giardia lamblia
KLEDVCTAFLYLLYLLVNQNNVL

SEQ ID NO: 3074416 - protein, 25 aa, Giardia lamblia
KLFAIFIPVGMEFYSRNCSDMFIPT

SEQ ID NO: 3074417 - protein, 21 aa, Giardia lamblia
KLFKEFHLVFTGLVPENTVSD

SEQ ID NO: 3074418 - protein, 31 aa, Giardia lamblia
KLFLAHLAEAWLCWRAGMAYDQVYSQMSPEV

SEQ ID NO: 3074419 - protein, 26 aa, Giardia lamblia
KLFLIALYLRKRWIARDSVLERKSDL

SEQ ID NO: 3074420 - protein, 26 aa, Giardia lamblia
KLFLKAGSAYVPFDFPLSGGSVSSSL

SEQ ID NO: 3074421 - protein, 20 aa, Giardia lamblia
KLFLLCSTDHVFNRELLLSK

SEQ ID NO: 3074422 - protein, 19 aa, Giardia lamblia
KLFNICLRSSLTSTDEDLL

SEQ ID NO: 3074423 - protein, 19 aa, Giardia lamblia
KLFRKKCEEKNIINTSERA

SEQ ID NO: 3074424 - protein, 17 aa, Giardia lamblia
KLFRMSFINMFANILVT

SEQ ID NO: 3074425 - protein, 20 aa, Giardia lamblia
KLFSTKRCGFISSCIVATVA

SEQ ID NO: 3074426 - protein, 19 aa, Giardia lamblia
KLFTLKAIYARVIEFMNLL

SEQ ID NO: 3074427 - protein, 17 aa, Giardia lamblia
KLGFSERRLSKTKHFSE

SEQ ID NO: 3074428 - protein, 19 aa, Giardia lamblia
KLGHKAGVIVLYNRDNPYN

SEQ ID NO: 3074429 - protein, 25 aa, Giardia lamblia
KLGLPSRLVGCISQACYQACSYQGT

SEQ ID NO: 3074430 - protein, 21 aa, Giardia lamblia
KLGSIALKLLLIYRVDSPDFL

SEQ ID NO: 3074431 - protein, 23 aa, Giardia lamblia
KLHNVCVIHERLCRSTSSDVSIR

SEQ ID NO: 3074432 - protein, 17 aa, Giardia lamblia
KLICSVDLQVFFRQTRH

SEQ ID NO: 3074433 - protein, 22 aa, Giardia lamblia
KLIEMKDRVDLLLLSTVAHATN

SEQ ID NO: 3074434 - protein, 24 aa, Giardia lamblia
KLIERKLAIPLLLVLERILSLWVA

SEQ ID NO: 3074435 - protein, 20 aa, Giardia lamblia
KLILRILTMLTIVREDPPSS

SEQ ID NO: 3074436 - protein, 19 aa, Giardia lamblia
KLISCSRATTRIIMSIAMS

SEQ ID NO: 3074437 - protein, 20 aa, Giardia lamblia
KLIYVLLKYINLVFDPPLGL

SEQ ID NO: 3074438 - protein, 29 aa, Giardia lamblia
KLKFKQIATFCLAARIAGESLGFNVSAGI

SEQ ID NO: 3074439 - protein, 21 aa, Giardia lamblia
KLKLHTLLPVITFLRNTQYAL

SEQ ID NO: 3074440 - protein, 18 aa, Giardia lamblia
KLKSLAEFTCVCNANYET

SEQ ID NO: 3074441 - protein, 18 aa, Giardia lamblia
KLKSRRIALPTIIHRYFE

SEQ ID NO: 3074442 - protein, 24 aa, Giardia lamblia
KLKTCKPSPFIVEFGEDCTDLLPL

SEQ ID NO: 3074443 - protein, 17 aa, Giardia lamblia
KLLDYGYDYHGIVRYVD

SEQ ID NO: 3074444 - protein, 26 aa, Giardia lamblia
KLLETLCGCISHLISSLPRRLSTSLP

SEQ ID NO: 3074445 - protein, 19 aa, Giardia lamblia
KLLPPISMPYLRSDNPTAT

SEQ ID NO: 3074446 - protein, 26 aa, Giardia lamblia
KLLQCIQELRLCYRAMIDDNSTSDTP

SEQ ID NO: 3074447 - protein, 19 aa, Giardia lamblia
KLLVFKENWMPTRDDMVNP

SEQ ID NO: 3074448 - protein, 25 aa, Giardia lamblia
KLPASRSAADIIGFIKTHLDKLGND

SEQ ID NO: 3074449 - protein, 21 aa, Giardia lamblia
KLPDSLLLGEFNYFNVFMNNP

SEQ ID NO: 3074450 - protein, 22 aa, Giardia lamblia
KLPKLKARSPIIDRLNILLQPQ

SEQ ID NO: 3074451 - protein, 21 aa, Giardia lamblia
KLPVVFSRKVYALALQLKEKN

SEQ ID NO: 3074452 - protein, 25 aa, Giardia lamblia
KLQMHRRTFVALQFAYIFFSSLYAL

SEQ ID NO: 3074453 - protein, 25 aa, Giardia lamblia
KLRRPLKQILFKMGVTSYYSPTSVA

SEQ ID NO: 3074454 - protein, 18 aa, Giardia lamblia
KLRVNDFRQLIPVVQSLD

SEQ ID NO: 3074455 - protein, 17 aa, Giardia lamblia
KLSACMAPFPAILNQTS

SEQ ID NO: 3074456 - protein, 17 aa, Giardia lamblia
KLSDSALNHLFLIAEDG

SEQ ID NO: 3074457 - protein, 19 aa, Giardia lamblia
KLSIERLISLDGFDPLFSN

SEQ ID NO: 3074458 - protein, 20 aa, Giardia lamblia
KLSNSYCLSTLYDIRNSITH

SEQ ID NO: 3074459 - protein, 18 aa, Giardia lamblia
KLSPIALPIYGRVVSRTV

SEQ ID NO: 3074460 - protein, 21 aa, Giardia lamblia
KLSVATGWIGLTGVRPTMEDG

SEQ ID NO: 3074461 - protein, 20 aa, Giardia lamblia
KLTCGTLRPEPLVFIKSHIK

SEQ ID NO: 3074462 - protein, 19 aa, Giardia lamblia
KLTDCLRNLQINELKAFSQ

SEQ ID NO: 3074463 - protein, 17 aa, Giardia lamblia
KLTGVPLGHVFSPEQLK

SEQ ID NO: 3074464 - protein, 26 aa, Giardia lamblia
KLVEVLQVFVERAIMVECDWTRSSFD

SEQ ID NO: 3074465 - protein, 19 aa, Giardia lamblia
KLVGALLRHGIEKHYGDPY

SEQ ID NO: 3074466 - protein, 32 aa, Giardia lamblia
KLVPKRGRGASCLKALGIIKCMQKYGLLRDAI

SEQ ID NO: 3074467 - protein, 19 aa, Giardia lamblia
KLVQFTGPIPVGSVPHPRY

SEQ ID NO: 3074468 - protein, 24 aa, Giardia lamblia
KLVREVCLRLARVLDDVQQFSQMN

SEQ ID NO: 3074469 - protein, 38 aa, Giardia lamblia
KLVTLAIHLSFYFKHVLAICSLGRFLLPMKLKPYNKDF

SEQ ID NO: 3074470 - protein, 23 aa, Giardia lamblia
KLYWDTVEDWALFSGGSGALLFK

SEQ ID NO: 3074471 - protein, 26 aa, Giardia lamblia
KMCLCKDTILHWAVFYLSPGDYHRFH

SEQ ID NO: 3074472 - protein, 17 aa, Giardia lamblia
KMISIPLSIVAEVEMEF

SEQ ID NO: 3074473 - protein, 17 aa, Giardia lamblia
KMKRLSHNLTFLKDKKP

SEQ ID NO: 3074474 - protein, 19 aa, Giardia lamblia
KMLLPLLGIALKILSLQID

SEQ ID NO: 3074475 - protein, 19 aa, Giardia lamblia
KMMITELFLLNVYFYLLQG

SEQ ID NO: 3074476 - protein, 19 aa, Giardia lamblia
KMNLVCIPHYGNAKMANQQ

SEQ ID NO: 3074477 - protein, 26 aa, Giardia lamblia
KMPPVLPVHIVLILLVHIMSTFRGSI

SEQ ID NO: 3074478 - protein, 18 aa, Giardia lamblia
KMSILYDILTLRDDMLHH

SEQ ID NO: 3074479 - protein, 19 aa, Giardia lamblia
KMVPIKWLDSCFCQDPSKS

SEQ ID NO: 3074480 - protein, 24 aa, Giardia lamblia
KMYRTRSVYSISFIFLHVASYSLL

SEQ ID NO: 3074481 - protein, 26 aa, Giardia lamblia
KNDFSRPLCMVDYPSVGRKVRAIKRV

SEQ ID NO: 3074482 - protein, 19 aa, Giardia lamblia
KNDIWALGCILYKLCSDGR

SEQ ID NO: 3074483 - protein, 25 aa, Giardia lamblia
KNEFTSETLFSFIINILQTRYWPAI

SEQ ID NO: 3074484 - protein, 29 aa, Giardia lamblia
KNEISTLPSTIIVRFIPPIFLTATRPSLS

SEQ ID NO: 3074485 - protein, 19 aa, Giardia lamblia
KNGECVACSRVVPNCRTCV

SEQ ID NO: 3074486 - protein, 26 aa, Giardia lamblia
KNGIRAMVFSFLFHGMLYEYGHTKPP

SEQ ID NO: 3074487 - protein, 19 aa, Giardia lamblia
KNHLDCVSLLAPYEADAFH

SEQ ID NO: 3074488 - protein, 24 aa, Giardia lamblia
KNHLRHCILHERFSHSVELLDVCV

SEQ ID NO: 3074489 - protein, 25 aa, Giardia lamblia
KNIAKRFPNLWTEEKIVQLMLDARE

SEQ ID NO: 3074490 - protein, 28 aa, Giardia lamblia
KNIKFGAGRAIELYKYMSTDSICPTYTN

SEQ ID NO: 3074491 - protein, 26 aa, Giardia lamblia
KNIMRLCAFLSLAEWLSLRGETVIST

SEQ ID NO: 3074492 - protein, 19 aa, Giardia lamblia
KNKCIPRACVSGWKDEQTP

SEQ ID NO: 3074493 - protein, 25 aa, Giardia lamblia
KNKVGRTALMTAVNFNHMEIVNLLI

SEQ ID NO: 3074494 - protein, 23 aa, Giardia lamblia
KNLDRVTALLGRGLTSPPLCPKT

SEQ ID NO: 3074495 - protein, 26 aa, Giardia lamblia
KNLEMYKQILSCFIVLSFGEVMMDYF

SEQ ID NO: 3074496 - protein, 31 aa, Giardia lamblia
KNLFVKFYAPWCGHCKQLAPTWEEMSGEFSV

SEQ ID NO: 3074497 - protein, 21 aa, Giardia lamblia
KNLGDSCCTISPFQRLFRSLP

SEQ ID NO: 3074498 - protein, 18 aa, Giardia lamblia
KNLSGGLYPRFSQHMYDT

SEQ ID NO: 3074499 - protein, 31 aa, Giardia lamblia
KNLSRKYAVEWMMYCCNRWASFNYSCISVLL

SEQ ID NO: 3074500 - protein, 18 aa, Giardia lamblia
KNPFDICNIDDDPLVRAV

SEQ ID NO: 3074501 - protein, 17 aa, Giardia lamblia
KNPKVTCLTPRTPRMEL

SEQ ID NO: 3074502 - protein, 23 aa, Giardia lamblia
KNPRPQWIQNIMDKFKFRAPGKS

SEQ ID NO: 3074503 - protein, 22 aa, Giardia lamblia
KNRLRYLEPFLALICAYGTFQL

SEQ ID NO: 3074504 - protein, 19 aa, Giardia lamblia
KNSESFGGLTMPSAREPLG

SEQ ID NO: 3074505 - protein, 39 aa, Giardia lamblia
KNTCYRVTNKFTLRLMLNFYKIQSSIILGSGLPPHLTDP

SEQ ID NO: 3074506 - protein, 21 aa, Giardia lamblia
KNVLLFEIIPAMLLNHESGDW

SEQ ID NO: 3074507 - protein, 32 aa, Giardia lamblia
KNVVFSVACSVFRYMCTKAAVSPKTFDKLINY

SEQ ID NO: 3074508 - protein, 22 aa, Giardia lamblia
KNWNRIAAVAPKIKLSLTDTEL

SEQ ID NO: 3074509 - protein, 27 aa, Giardia lamblia
KNYSLIVKFLLKRHVTMCNAMGVPSNI

SEQ ID NO: 3074510 - protein, 25 aa, Giardia lamblia
KPAPDASCVWGSFSALYSSESSAPV

SEQ ID NO: 3074511 - protein, 19 aa, Giardia lamblia
KPCRPSIVPLLSLSCPAQQ

SEQ ID NO: 3074512 - protein, 27 aa, Giardia lamblia
KPCSKTGLDHQVMFAGYGYYQGVEVWV

SEQ ID NO: 3074513 - protein, 21 aa, Giardia lamblia
KPEALQFLKTWLLHSHSDTPS

SEQ ID NO: 3074514 - protein, 26 aa, Giardia lamblia
KPEFSWRGIPWYFLVSKRFWAVQKDH

SEQ ID NO: 3074515 - protein, 28 aa, Giardia lamblia
KPFTPYDVPEVMLLPLPLELASGNYKSR

SEQ ID NO: 3074516 - protein, 18 aa, Giardia lamblia
KPGSIVLQRGIQVLRNTY

SEQ ID NO: 3074517 - protein, 22 aa, Giardia lamblia
KPHVPFYLSRRMVLNLESCLFA

SEQ ID NO: 3074518 - protein, 20 aa, Giardia lamblia
KPIDYCASSLASALPLPAMP

SEQ ID NO: 3074519 - protein, 17 aa, Giardia lamblia
KPITKWAFITPPLMGPY

SEQ ID NO: 3074520 - protein, 18 aa, Giardia lamblia
KPLDAFFIQQKRLALKDH

SEQ ID NO: 3074521 - protein, 20 aa, Giardia lamblia
KPLLYLAKWADKYVYSTKSS

SEQ ID NO: 3074522 - protein, 21 aa, Giardia lamblia
KPLNLKFCHGGLLSSNVMLLS

SEQ ID NO: 3074523 - protein, 20 aa, Giardia lamblia
KPLYSLYFNTRFLYRRRPNH

SEQ ID NO: 3074524 - protein, 33 aa, Giardia lamblia
KPNGCVLFLKTQRDFFAILLWVAAIVSIISFLI

SEQ ID NO: 3074525 - protein, 25 aa, Giardia lamblia
KPNWCANRVWYVMILSFILGFSLSL

SEQ ID NO: 3074526 - protein, 19 aa, Giardia lamblia
KPPELLSIEHILSIPVYQY

SEQ ID NO: 3074527 - protein, 18 aa, Giardia lamblia
KPPLSRLKDISMGIMQFA

SEQ ID NO: 3074528 - protein, 21 aa, Giardia lamblia
KPPNCCTRCIRSIFAPANSGD

SEQ ID NO: 3074529 - protein, 27 aa, Giardia lamblia
KPPYYNPRIPVVDSFDGFYDPASIVPL

SEQ ID NO: 3074530 - protein, 18 aa, Giardia lamblia
KPQTGFRFALISDTHARY

SEQ ID NO: 3074531 - protein, 19 aa, Giardia lamblia
KPSSVSAFKRPARASQPNS

SEQ ID NO: 3074532 - protein, 19 aa, Giardia lamblia
KPTKGTVIINGWDVRRDPS

SEQ ID NO: 3074533 - protein, 30 aa, Giardia lamblia
KPVYKMICSDIYIILRLVSIICTRIEFCLQ

SEQ ID NO: 3074534 - protein, 24 aa, Giardia lamblia
KPWNLQIFGCFLVVISQLIQSGQI

SEQ ID NO: 3074535 - protein, 20 aa, Giardia lamblia
KPYLLSNITEFTWGSTNLYR

SEQ ID NO: 3074536 - protein, 18 aa, Giardia lamblia
KPYPVGRLLWSADPQSSD

SEQ ID NO: 3074537 - protein, 31 aa, Giardia lamblia
KQACKVTLLSVFKDVVLWLITNPVEKAKELI

SEQ ID NO: 3074538 - protein, 22 aa, Giardia lamblia
KQARAKSILISRDQRHVQSKVL

SEQ ID NO: 3074539 - protein, 19 aa, Giardia lamblia
KQARPSLATYTGYHMLLLS

SEQ ID NO: 3074540 - protein, 23 aa, Giardia lamblia
KQCIFKVPRLDGGAEVDTMCGGR

SEQ ID NO: 3074541 - protein, 24 aa, Giardia lamblia
KQDNKMRILGCIAYKTDGETPDDS

SEQ ID NO: 3074542 - protein, 18 aa, Giardia lamblia
KQELCIKYSESEDDGPSL

SEQ ID NO: 3074543 - protein, 24 aa, Giardia lamblia
KQFPRSFEALKEWANSSTTLKIVR

SEQ ID NO: 3074544 - protein, 21 aa, Giardia lamblia
KQFSPNVLRRLTVDQLSQIIV

SEQ ID NO: 3074545 - protein, 22 aa, Giardia lamblia
KQGMMRRYRACIRATNVKPLLT

SEQ ID NO: 3074546 - protein, 17 aa, Giardia lamblia
KQIESISNLYALFEKKM

SEQ ID NO: 3074547 - protein, 32 aa, Giardia lamblia
KQIRILIEGFIQWSDSLIKFMELMLTVLPTER

SEQ ID NO: 3074548 - protein, 20 aa, Giardia lamblia
KQISSSFAFDDERNLYTCDA

SEQ ID NO: 3074549 - protein, 22 aa, Giardia lamblia
KQKYSLLGLRSVCFLASDIAVF

SEQ ID NO: 3074550 - protein, 18 aa, Giardia lamblia
KQLGQAIPAYALDYNRPD

SEQ ID NO: 3074551 - protein, 21 aa, Giardia lamblia
KQLIYLAWAMTFFCDAENVRA

SEQ ID NO: 3074552 - protein, 18 aa, Giardia lamblia
KQLKERIADLEGRLKGRL

SEQ ID NO: 3074553 - protein, 18 aa, Giardia lamblia
KQLMCEDILNGTARRVGV

SEQ ID NO: 3074554 - protein, 18 aa, Giardia lamblia
KQLQAVFRDSLLTQKVLA

SEQ ID NO: 3074555 - protein, 18 aa, Giardia lamblia
KQNIMFIGPLVFVIELAM

SEQ ID NO: 3074556 - protein, 24 aa, Giardia lamblia
KQQLPEYIIWTIILQLLGLLEWLH

SEQ ID NO: 3074557 - protein, 19 aa, Giardia lamblia
KQRKCYSVMITIRRILLIL

SEQ ID NO: 3074558 - protein, 20 aa, Giardia lamblia
KQRLDGMTALMIAAVTNNVE

SEQ ID NO: 3074559 - protein, 22 aa, Giardia lamblia
KQRRQMFGFILLTIIAVGLLCR

SEQ ID NO: 3074560 - protein, 19 aa, Giardia lamblia
KQSLFPFVANACRHLTVSL

SEQ ID NO: 3074561 - protein, 19 aa, Giardia lamblia
KQSVSIIELILKYLNGELD

SEQ ID NO: 3074562 - protein, 33 aa, Giardia lamblia
KQTCAYNILVISLIFNMFWARTTYREMNVFVYI

SEQ ID NO: 3074563 - protein, 24 aa, Giardia lamblia
KQVRSAAVELCLSAINTSRVKLES

SEQ ID NO: 3074564 - protein, 24 aa, Giardia lamblia
KRAQARTSAMYALLDRNLFYRTQP

SEQ ID NO: 3074565 - protein, 24 aa, Giardia lamblia
KRCEDTGYQRCPLYFIRSILANEK

SEQ ID NO: 3074566 - protein, 31 aa, Giardia lamblia
KRCIVRRELLPGPFLIPVIAFPFIILLSLLK

SEQ ID NO: 3074567 - protein, 20 aa, Giardia lamblia
KRDGTCNLCNASIADCASCV

SEQ ID NO: 3074568 - protein, 26 aa, Giardia lamblia
KRDPIAVSCIPFAYGLLVLLTDKRGL

SEQ ID NO: 3074569 - protein, 18 aa, Giardia lamblia
KREIIFIVPNYKGIYLSE

SEQ ID NO: 3074570 - protein, 23 aa, Giardia lamblia
KREYKQRMITLFMQFQKPYCNCY

SEQ ID NO: 3074571 - protein, 20 aa, Giardia lamblia
KRFGNMYLPSLYGLKLRALT

SEQ ID NO: 3074572 - protein, 30 aa, Giardia lamblia
KRFLGELEMSPELKDSVALFMADANGLVNQ

SEQ ID NO: 3074573 - protein, 21 aa, Giardia lamblia
KRFPDFEWYSSTNFTNPILDR

SEQ ID NO: 3074574 - protein, 26 aa, Giardia lamblia
KRFPRETDRIIAILPVLGYGSHLYAL

SEQ ID NO: 3074575 - protein, 23 aa, Giardia lamblia
KRGLWTDTCCDVVKVLMCILKGI

SEQ ID NO: 3074576 - protein, 38 aa, Giardia lamblia
KRGMLWAMVCLIVFPLSLLPRIDFLNFTSLVAIVSILY

SEQ ID NO: 3074577 - protein, 17 aa, Giardia lamblia
KRGMTALMHAAQQGHGG

SEQ ID NO: 3074578 - protein, 20 aa, Giardia lamblia
KRGSGIMLCEVVAGCMCFTE

SEQ ID NO: 3074579 - protein, 20 aa, Giardia lamblia
KRGWHLAGDRCLACPPPCAA

SEQ ID NO: 3074580 - protein, 20 aa, Giardia lamblia
KRHHMLAASVGRRFGKAFKR

SEQ ID NO: 3074581 - protein, 20 aa, Giardia lamblia
KRIAEGIATRGFFPAIFSTD

SEQ ID NO: 3074582 - protein, 20 aa, Giardia lamblia
KRIRDLRCFIERSIQAPDPR

SEQ ID NO: 3074583 - protein, 22 aa, Giardia lamblia
KRISALPTFVKGVISFYYDVIT

SEQ ID NO: 3074584 - protein, 22 aa, Giardia lamblia
KRIVYIRNLLKVAAEFETNAGR

SEQ ID NO: 3074585 - protein, 19 aa, Giardia lamblia
KRIYVQLATTYKFIDPETL

SEQ ID NO: 3074586 - protein, 26 aa, Giardia lamblia
KRIYVTEPWFDYGYWKDRTQYHLITE

SEQ ID NO: 3074587 - protein, 17 aa, Giardia lamblia
KRKAISCIYESLLHTYD

SEQ ID NO: 3074588 - protein, 26 aa, Giardia lamblia
KRKGIPNHWLFFLFPIVYKADKIRRK

SEQ ID NO: 3074589 - protein, 21 aa, Giardia lamblia
KRKPTKWQVVGVVFSVIGLLF

SEQ ID NO: 3074590 - protein, 19 aa, Giardia lamblia
KRKSLLRQVCHAVTAYFVT

SEQ ID NO: 3074591 - protein, 25 aa, Giardia lamblia
KRKTDFGGIILLSFAYIVSSLSASV

SEQ ID NO: 3074592 - protein, 20 aa, Giardia lamblia
KRKYTLRKLMLLHIVLLQSI

SEQ ID NO: 3074593 - protein, 20 aa, Giardia lamblia
KRLDIPRFEFISFLSDLTDD

SEQ ID NO: 3074594 - protein, 27 aa, Giardia lamblia
KRLDVPDLLAFLKIVFCVIEHTVRDTS

SEQ ID NO: 3074595 - protein, 21 aa, Giardia lamblia
KRLEVLSAKLTRMKWTSWIGT

SEQ ID NO: 3074596 - protein, 25 aa, Giardia lamblia
KRLHTSRTLKELNFPSIHSTDSEDS

SEQ ID NO: 3074597 - protein, 27 aa, Giardia lamblia
KRLIMICVTFGAFIGFLGGYLASNVTY

SEQ ID NO: 3074598 - protein, 21 aa, Giardia lamblia
KRLLWNIILRIRSHRAILLTT

SEQ ID NO: 3074599 - protein, 17 aa, Giardia lamblia
KRLRALSWVSFILGVVL

SEQ ID NO: 3074600 - protein, 37 aa, Giardia lamblia
KRMLHYEQFCWLRRLLLPRAFHVFDIDDYVSYMTQHF

SEQ ID NO: 3074601 - protein, 20 aa, Giardia lamblia
KRMRSLSGFTALLYAIENRN

SEQ ID NO: 3074602 - protein, 17 aa, Giardia lamblia
KRMSFARLYFLSDEELL

SEQ ID NO: 3074603 - protein, 17 aa, Giardia lamblia
KRMSVVLDLEKFGKTSA

SEQ ID NO: 3074604 - protein, 20 aa, Giardia lamblia
KRNFISVSVILFIVKQIAAA

SEQ ID NO: 3074605 - protein, 21 aa, Giardia lamblia
KRNLLQVTPLFPFQSAINLVE

SEQ ID NO: 3074606 - protein, 18 aa, Giardia lamblia
KRPCEIAFEAGHVALGKM

SEQ ID NO: 3074607 - protein, 25 aa, Giardia lamblia
KRPLPELYMPFFRVALTSCPVFAHA

SEQ ID NO: 3074608 - protein, 22 aa, Giardia lamblia
KRQGLELHKVVPSDSLFTEGMF

SEQ ID NO: 3074609 - protein, 25 aa, Giardia lamblia
KRRKIPVPIAVILSVLRQVAAALAY

SEQ ID NO: 3074610 - protein, 23 aa, Giardia lamblia
KRRRGRSELLSFMQVYAGYGADR

SEQ ID NO: 3074611 - protein, 18 aa, Giardia lamblia
KRRSESLLASKMRTLIHI

SEQ ID NO: 3074612 - protein, 19 aa, Giardia lamblia
KRRVVGLGLFSIIFFICLA

SEQ ID NO: 3074613 - protein, 25 aa, Giardia lamblia
KRSCSLCLLDQCLIPVKTCRVSSTL

SEQ ID NO: 3074614 - protein, 23 aa, Giardia lamblia
KRSSEINSKFVIEKHGTHLKKAI

SEQ ID NO: 3074615 - protein, 22 aa, Giardia lamblia
KRTLASAALRFVMKPHERRQHG

SEQ ID NO: 3074616 - protein, 19 aa, Giardia lamblia
KRTNQCLRRLEIPTPPEPL

SEQ ID NO: 3074617 - protein, 21 aa, Giardia lamblia
KRTWCSCRVIHLLAINIVAGL

SEQ ID NO: 3074618 - protein, 19 aa, Giardia lamblia
KRVTLSFDLFSSVSALCIR

SEQ ID NO: 3074619 - protein, 25 aa, Giardia lamblia
KRYPIPGCFYYSISAIFDGSLTDYL

SEQ ID NO: 3074620 - protein, 20 aa, Giardia lamblia
KSAAEALSLYLYLNSVILQR

SEQ ID NO: 3074621 - protein, 23 aa, Giardia lamblia
KSAGISRVRYIAVGSISSAETIM

SEQ ID NO: 3074622 - protein, 23 aa, Giardia lamblia
KSAGSCKIFLTNVNFITGATETL

SEQ ID NO: 3074623 - protein, 18 aa, Giardia lamblia
KSAPSSRRHSAASPSTSS

SEQ ID NO: 3074624 - protein, 20 aa, Giardia lamblia
KSARSRASSALGQSEVANTK

SEQ ID NO: 3074625 - protein, 20 aa, Giardia lamblia
KSASGVELFSYCAVLDDRSA

SEQ ID NO: 3074626 - protein, 22 aa, Giardia lamblia
KSAYVRMTLIFNVAVIVKEFSK

SEQ ID NO: 3074627 - protein, 21 aa, Giardia lamblia
KSDLKPSLYIRNYDPRELETG

SEQ ID NO: 3074628 - protein, 22 aa, Giardia lamblia
KSDPRTVIGLTFESEHNRCEAD

SEQ ID NO: 3074629 - protein, 24 aa, Giardia lamblia
KSDSFRLSTVAGYRLHRMHTKTER

SEQ ID NO: 3074630 - protein, 24 aa, Giardia lamblia
KSDYSIKMGTYLLEKCESGITIDS

SEQ ID NO: 3074631 - protein, 25 aa, Giardia lamblia
KSEAYKHQFLIALKLFVALGDVPCM

SEQ ID NO: 3074632 - protein, 23 aa, Giardia lamblia
KSEKPRTSNFVSINSDRLTIKNL

SEQ ID NO: 3074633 - protein, 21 aa, Giardia lamblia
KSEVVRLLLLKLLLRIIHTCN

SEQ ID NO: 3074634 - protein, 31 aa, Giardia lamblia
KSEYRYPSNIFVPAYAIFLEEFVKLKDLFTS

SEQ ID NO: 3074635 - protein, 18 aa, Giardia lamblia
KSFITFYPMYLIYVNAPR

SEQ ID NO: 3074636 - protein, 22 aa, Giardia lamblia
KSFLELISLYIKLLHGRRREIY

SEQ ID NO: 3074637 - protein, 24 aa, Giardia lamblia
KSGGAVEGRPAWQSKKSSTGSTPS

SEQ ID NO: 3074638 - protein, 22 aa, Giardia lamblia
KSGNHRPLILLIAIRDAEEDGA

SEQ ID NO: 3074639 - protein, 19 aa, Giardia lamblia
KSGSSIKRFHYSGDIELLN

SEQ ID NO: 3074640 - protein, 18 aa, Giardia lamblia
KSHLLPIAIVTVYLWMYY

SEQ ID NO: 3074641 - protein, 18 aa, Giardia lamblia
KSIDRRAAARRQEPSDSY

SEQ ID NO: 3074642 - protein, 22 aa, Giardia lamblia
KSILCSLCRGTSLVGLDKRSCT

SEQ ID NO: 3074643 - protein, 24 aa, Giardia lamblia
KSILRFLGDLFSEFDKRIDRAPQL

SEQ ID NO: 3074644 - protein, 17 aa, Giardia lamblia
KSITCPGYTDPASQVIS

SEQ ID NO: 3074645 - protein, 25 aa, Giardia lamblia
KSIVEAGLPFWIFFDEITNVTRSQS

SEQ ID NO: 3074646 - protein, 18 aa, Giardia lamblia
KSKIDYVFLLIALGLVLV

SEQ ID NO: 3074647 - protein, 19 aa, Giardia lamblia
KSLFSLALSAFINDVEDCE

SEQ ID NO: 3074648 - protein, 24 aa, Giardia lamblia
KSLLPEPLALLLLSSKRASDAAET

SEQ ID NO: 3074649 - protein, 17 aa, Giardia lamblia
KSLLRFHTSIFRLGVSV

SEQ ID NO: 3074650 - protein, 25 aa, Giardia lamblia
KSLNMQSVVLARRWLPFLRESSLPP

SEQ ID NO: 3074651 - protein, 19 aa, Giardia lamblia
KSNCSPEEFNCLAKNIIKH

SEQ ID NO: 3074652 - protein, 27 aa, Giardia lamblia
KSNFELLMSIIFVLRLDPVSEVRTQAM

SEQ ID NO: 3074653 - protein, 28 aa, Giardia lamblia
KSNLSGLWPKLCTHVDFFDPSRNVAKHP

SEQ ID NO: 3074654 - protein, 19 aa, Giardia lamblia
KSPCFSLRSLCRALSFAHR

SEQ ID NO: 3074655 - protein, 25 aa, Giardia lamblia
KSPLEPARFVSPVALNLVDGKGVLV

SEQ ID NO: 3074656 - protein, 26 aa, Giardia lamblia
KSPLKRTMVMGFRIVDSFYCTFSVMY

SEQ ID NO: 3074657 - protein, 25 aa, Giardia lamblia
KSPRLERRLEQGFTLTFRVLASKRL

SEQ ID NO: 3074658 - protein, 18 aa, Giardia lamblia
KSRISAHAEDAWVNSQII

SEQ ID NO: 3074659 - protein, 19 aa, Giardia lamblia
KSRNVLMQQCIVAFYTYLI

SEQ ID NO: 3074660 - protein, 20 aa, Giardia lamblia
KSRRLWRRFFTTGFHDSLGS

SEQ ID NO: 3074661 - protein, 18 aa, Giardia lamblia
KSSFHFAHDLGLRSIRMA

SEQ ID NO: 3074662 - protein, 20 aa, Giardia lamblia
KSSLAIILHNVYIPFSGRHE

SEQ ID NO: 3074663 - protein, 18 aa, Giardia lamblia
KSSLLYFDAIIKASKRTA

SEQ ID NO: 3074664 - protein, 23 aa, Giardia lamblia
KSSLMQALSCSRTASGSAFLESL

SEQ ID NO: 3074665 - protein, 22 aa, Giardia lamblia
KSSSWEIHNAWMSLFGTVAKTT

SEQ ID NO: 3074666 - protein, 32 aa, Giardia lamblia
KSSTGDARWRRPGLEHLSYWAVEEPNVGCREC

SEQ ID NO: 3074667 - protein, 18 aa, Giardia lamblia
KSSTIFRPFGEMWRPLSP

SEQ ID NO: 3074668 - protein, 24 aa, Giardia lamblia
KSSVKVAKSLLARGIPIVITMSTV

SEQ ID NO: 3074669 - protein, 23 aa, Giardia lamblia
KSTNRIGYIFLFNNISLCKVLEE

SEQ ID NO: 3074670 - protein, 43 aa, Giardia lamblia
KSTRYLDLILVCFLLKSFGSLRCFRHMYYLTQIVKPCPSTLCS

SEQ ID NO: 3074671 - protein, 24 aa, Giardia lamblia
KSVLSFFILWLLAIIYLYSIELWQ

SEQ ID NO: 3074672 - protein, 22 aa, Giardia lamblia
KSVSRRLWIFVIIEIALVVLAS

SEQ ID NO: 3074673 - protein, 24 aa, Giardia lamblia
KSVVGRLSRYNIYGYLPKEPFNEL

SEQ ID NO: 3074674 - protein, 19 aa, Giardia lamblia
KSWIPTGLVLVDLLMEMRL

SEQ ID NO: 3074675 - protein, 25 aa, Giardia lamblia
KSYCNIYLKMLFKSLCNYAEADLRL

SEQ ID NO: 3074676 - protein, 30 aa, Giardia lamblia
KSYHCARDAIKAGLPYYAISRAHYMQGVAL

SEQ ID NO: 3074677 - protein, 19 aa, Giardia lamblia
KSYLAVCALYSNPQLSFQF

SEQ ID NO: 3074678 - protein, 19 aa, Giardia lamblia
KTAFDWLAVIIADRLLLKD

SEQ ID NO: 3074679 - protein, 24 aa, Giardia lamblia
KTAGKGRAAFDVKDLVAGEYNATL

SEQ ID NO: 3074680 - protein, 18 aa, Giardia lamblia
KTAIYRLGHQQGLDVVSL

SEQ ID NO: 3074681 - protein, 19 aa, Giardia lamblia
KTALDLAIDGNCLRSVKAL

SEQ ID NO: 3074682 - protein, 20 aa, Giardia lamblia
KTAYVSLFRGHAWPMIHSSL

SEQ ID NO: 3074683 - protein, 20 aa, Giardia lamblia
KTCVASSCIFEYSNGHHVCG

SEQ ID NO: 3074684 - protein, 18 aa, Giardia lamblia
KTCYGMGWCSYSGATEQC

SEQ ID NO: 3074685 - protein, 23 aa, Giardia lamblia
KTEQGRKAFTVNILSKQDITTLQ

SEQ ID NO: 3074686 - protein, 29 aa, Giardia lamblia
KTFESIQILCLIEFLPLILSKKTIKEKIG

SEQ ID NO: 3074687 - protein, 26 aa, Giardia lamblia
KTFGFSRPSLYLAITLSHLYFTPKLP

SEQ ID NO: 3074688 - protein, 24 aa, Giardia lamblia
KTFKEFLMLLSPLIVLLVMLLRKY

SEQ ID NO: 3074689 - protein, 18 aa, Giardia lamblia
KTFLHRIVVRGLYDLAAE

SEQ ID NO: 3074690 - protein, 25 aa, Giardia lamblia
KTFLKCFMESCASQSSYIFANLSID

SEQ ID NO: 3074691 - protein, 23 aa, Giardia lamblia
KTFNCLGDSCLLGGANGVVPHPL

SEQ ID NO: 3074692 - protein, 19 aa, Giardia lamblia
KTGKFTKVFQNIIESYGIP

SEQ ID NO: 3074693 - protein, 30 aa, Giardia lamblia
KTGWRRKAVSCVRKLLAPSFKKLCQSSQED

SEQ ID NO: 3074694 - protein, 18 aa, Giardia lamblia
KTHIKAEYVSAWRRTKRL

SEQ ID NO: 3074695 - protein, 22 aa, Giardia lamblia
KTHLRLLPRRLVASTKPLADLV

SEQ ID NO: 3074696 - protein, 20 aa, Giardia lamblia
KTHSLLFLTLLHKITHLPSV

SEQ ID NO: 3074697 - protein, 25 aa, Giardia lamblia
KTIFSFNIMLAFFIAGCSSALAIAI

SEQ ID NO: 3074698 - protein, 37 aa, Giardia lamblia
KTILGGYCMGRAFFPYRLSHITGRITTILSYLPLGHI

SEQ ID NO: 3074699 - protein, 22 aa, Giardia lamblia
KTIPVYYIWAPWVSYFAYAFKG

SEQ ID NO: 3074700 - protein, 24 aa, Giardia lamblia
KTKDAKCVNLYYMGGLERAIHLPQ

SEQ ID NO: 3074701 - protein, 18 aa, Giardia lamblia
KTKFIYYHAYDFPAEIFR

SEQ ID NO: 3074702 - protein, 24 aa, Giardia lamblia
KTKHPLVVCPKVLDVCKFGELKEA

SEQ ID NO: 3074703 - protein, 17 aa, Giardia lamblia
KTLCLQTILAILEEYAI

SEQ ID NO: 3074704 - protein, 17 aa, Giardia lamblia
KTLENLLGRLLQYEQRT

SEQ ID NO: 3074705 - protein, 25 aa, Giardia lamblia
KTLMWSLPFLCIDLFGVEWVLLNRG

SEQ ID NO: 3074706 - protein, 23 aa, Giardia lamblia
KTLQMQALRRFYTALSINSSVLR

SEQ ID NO: 3074707 - protein, 25 aa, Giardia lamblia
KTLYGVELFCLPPCSVPHFQDAHDR

SEQ ID NO: 3074708 - protein, 17 aa, Giardia lamblia
KTMKVLRNQVFALTKKC

SEQ ID NO: 3074709 - protein, 23 aa, Giardia lamblia
KTMLYKEALFCYTVPEVIQEIDR

SEQ ID NO: 3074710 - protein, 18 aa, Giardia lamblia
KTNAYLSVFDTFQSLWLD

SEQ ID NO: 3074711 - protein, 17 aa, Giardia lamblia
KTNTPYAKWTNVIQTTA

SEQ ID NO: 3074712 - protein, 24 aa, Giardia lamblia
KTQFEFRWGGARRAHHIVDCSLCP

SEQ ID NO: 3074713 - protein, 25 aa, Giardia lamblia
KTRQHRLRYTLARLRERTSCPSAVC

SEQ ID NO: 3074714 - protein, 18 aa, Giardia lamblia
KTRYLKRVASNKIDPAKL

SEQ ID NO: 3074715 - protein, 25 aa, Giardia lamblia
KTSAPFVLKRLRVFLRDLQSHRNLN

SEQ ID NO: 3074716 - protein, 23 aa, Giardia lamblia
KTSFKSCAFVNLTLLRDNSAILM

SEQ ID NO: 3074717 - protein, 19 aa, Giardia lamblia
KTSHVARSITFHSLLHYER

SEQ ID NO: 3074718 - protein, 24 aa, Giardia lamblia
KTSNCPYKDILPAYHAIFKEIQRN

SEQ ID NO: 3074719 - protein, 17 aa, Giardia lamblia
KTSRVTILASYPSRHNI

SEQ ID NO: 3074720 - protein, 21 aa, Giardia lamblia
KTVEIPLSMELLSLYSSAKAS

SEQ ID NO: 3074721 - protein, 24 aa, Giardia lamblia
KTVKIVFESEFDRCLHKREIEEDL

SEQ ID NO: 3074722 - protein, 24 aa, Giardia lamblia
KTVRTSILISFVFVVITVITHATF

SEQ ID NO: 3074723 - protein, 18 aa, Giardia lamblia
KTVSSGMCSVCETYSESV

SEQ ID NO: 3074724 - protein, 19 aa, Giardia lamblia
KVAMVGGVSSFLCSCSHIY

SEQ ID NO: 3074725 - protein, 24 aa, Giardia lamblia
KVASDCFRDAVLYDESMSTIQGAE

SEQ ID NO: 3074726 - protein, 19 aa, Giardia lamblia
KVCHRDMKLENVLLDSSYN

SEQ ID NO: 3074727 - protein, 17 aa, Giardia lamblia
KVCTYRDAIIVRMNPYM

SEQ ID NO: 3074728 - protein, 24 aa, Giardia lamblia
KVDSYRGRLEWGRVDKFNAIGEER

SEQ ID NO: 3074729 - protein, 22 aa, Giardia lamblia
KVFKIEFYRSLFACQTSDIMKR

SEQ ID NO: 3074730 - protein, 17 aa, Giardia lamblia
KVFKRPIFASKYAIRDL

SEQ ID NO: 3074731 - protein, 19 aa, Giardia lamblia
KVFLNREFTPTASRDPPGL

SEQ ID NO: 3074732 - protein, 26 aa, Giardia lamblia
KVFPKPRFFHLPSLYHAALLYRQKLN

SEQ ID NO: 3074733 - protein, 25 aa, Giardia lamblia
KVFSKKLRRAFLVPLRDGVIMLTSS

SEQ ID NO: 3074734 - protein, 25 aa, Giardia lamblia
KVFVLLCIGLSMVLLYIFHSIPIIS

SEQ ID NO: 3074735 - protein, 24 aa, Giardia lamblia
KVGKLRPFFIHSLADLHENIRTIM

SEQ ID NO: 3074736 - protein, 18 aa, Giardia lamblia
KVGLFFANSIPLVNATKD

SEQ ID NO: 3074737 - protein, 23 aa, Giardia lamblia
KVICWPMCRWPTYGKVLYSLSDL

SEQ ID NO: 3074738 - protein, 22 aa, Giardia lamblia
KVKCAARTTLLAYMHAAEKGPT

SEQ ID NO: 3074739 - protein, 23 aa, Giardia lamblia
KVKQCPSFLAALSGIECKRNFYY

SEQ ID NO: 3074740 - protein, 24 aa, Giardia lamblia
KVLFQRDGRLYAMKKKRSATSEDV

SEQ ID NO: 3074741 - protein, 27 aa, Giardia lamblia
KVLGSRCLGKMSFLYIKYFRSLLLMLV

SEQ ID NO: 3074742 - protein, 24 aa, Giardia lamblia
KVLPANQCLLQYQYMDLLAIVLSV

SEQ ID NO: 3074743 - protein, 24 aa, Giardia lamblia
KVLVKLLLHIAISFMVYLRVIADY

SEQ ID NO: 3074744 - protein, 21 aa, Giardia lamblia
KVLVKREWERFTVMYSSRKGF

SEQ ID NO: 3074745 - protein, 18 aa, Giardia lamblia
KVLVPDLRRIFSGLTAKI

SEQ ID NO: 3074746 - protein, 17 aa, Giardia lamblia
KVMPSILSTAAISINSQ

SEQ ID NO: 3074747 - protein, 18 aa, Giardia lamblia
KVMRFLKIELNAYQAALK

SEQ ID NO: 3074748 - protein, 19 aa, Giardia lamblia
KVRPMKWIPNCRPWVVTLI

SEQ ID NO: 3074749 - protein, 27 aa, Giardia lamblia
KVSIKRAVYHYAVFFSRQPIFFHQFSE

SEQ ID NO: 3074750 - protein, 18 aa, Giardia lamblia
KVSSYIMFMFKGRARELI

SEQ ID NO: 3074751 - protein, 21 aa, Giardia lamblia
KVTECTLALIDHLTRLFSRLN

SEQ ID NO: 3074752 - protein, 25 aa, Giardia lamblia
KVTIICSACVIVVMNLTAFFLSTFV

SEQ ID NO: 3074753 - protein, 25 aa, Giardia lamblia
KVTRKRSWIKLSLTFVIDIFPSLLT

SEQ ID NO: 3074754 - protein, 24 aa, Giardia lamblia
KVVDFRIIYTMVTKISDWSATKII

SEQ ID NO: 3074755 - protein, 18 aa, Giardia lamblia
KVVDRIFAEIPRPFRSNV

SEQ ID NO: 3074756 - protein, 25 aa, Giardia lamblia
KVVLLRAGCMAIQLFLILSQFSLQQ

SEQ ID NO: 3074757 - protein, 17 aa, Giardia lamblia
KVYKGFSGLHYACMTGA

SEQ ID NO: 3074758 - protein, 21 aa, Giardia lamblia
KVYPSVLLPRLAWLINTTVHQ

SEQ ID NO: 3074759 - protein, 28 aa, Giardia lamblia
KYCHICSGCLCFYCFCDQRCRCMKNTIM

SEQ ID NO: 3074760 - protein, 20 aa, Giardia lamblia
KYCPERKGPAPGDEALRSID

SEQ ID NO: 3074761 - protein, 18 aa, Giardia lamblia
KYCPWLRNTVDALAGLGR

SEQ ID NO: 3074762 - protein, 17 aa, Giardia lamblia
KYCSKCKTGYVPVDGIC

SEQ ID NO: 3074763 - protein, 20 aa, Giardia lamblia
KYGDTGLMLAARQGDTKVIQ

SEQ ID NO: 3074764 - protein, 19 aa, Giardia lamblia
KYGIFQLHRFHLGKYEHFR

SEQ ID NO: 3074765 - protein, 18 aa, Giardia lamblia
KYGPRLLSSPLFQDLLQL

SEQ ID NO: 3074766 - protein, 33 aa, Giardia lamblia
KYHGAPILAGLSCLRAGADYCYLLVRGSNSQIV

SEQ ID NO: 3074767 - protein, 21 aa, Giardia lamblia
KYIDVNGMRHMYARLLGQLDA

SEQ ID NO: 3074768 - protein, 32 aa, Giardia lamblia
KYIPEDVWLRYRLCILSFTFNDILSGVVSIGV

SEQ ID NO: 3074769 - protein, 26 aa, Giardia lamblia
KYKNELKYSPKRGFISAGAEQLITVA

SEQ ID NO: 3074770 - protein, 17 aa, Giardia lamblia
KYKTAYIDSKSFSSDAI

SEQ ID NO: 3074771 - protein, 17 aa, Giardia lamblia
KYLLEARYREQKIKLKG

SEQ ID NO: 3074772 - protein, 17 aa, Giardia lamblia
KYLSVTLLTRFLTFLNV

SEQ ID NO: 3074773 - protein, 20 aa, Giardia lamblia
KYMSGDTFSYLDYKFGINKE

SEQ ID NO: 3074774 - protein, 19 aa, Giardia lamblia
KYNLLKFILSDYMVYISWL

SEQ ID NO: 3074775 - protein, 19 aa, Giardia lamblia
KYNLPVLLIECMRTKPLEI

SEQ ID NO: 3074776 - protein, 22 aa, Giardia lamblia
KYPHLGQAWASFSLTQLAMGNV

SEQ ID NO: 3074777 - protein, 21 aa, Giardia lamblia
KYPILCKNFELKLLTLDDYHC

SEQ ID NO: 3074778 - protein, 19 aa, Giardia lamblia
KYPTIPLYGFSMVGKKIGY

SEQ ID NO: 3074779 - protein, 25 aa, Giardia lamblia
KYQIIGFSWLVNRFELELNSILSDE

SEQ ID NO: 3074780 - protein, 24 aa, Giardia lamblia
KYRLNSVFVSAFLMLLLSTLTPSH

SEQ ID NO: 3074781 - protein, 26 aa, Giardia lamblia
KYRNLLRKALHGIKRLFFLVHRFCAV

SEQ ID NO: 3074782 - protein, 24 aa, Giardia lamblia
KYRSLKAAGLLQEYEKAAVELGTI

SEQ ID NO: 3074783 - protein, 23 aa, Giardia lamblia
KYSAEYPFRPLGLLKTETSSGDQ

SEQ ID NO: 3074784 - protein, 19 aa, Giardia lamblia
KYSELLYIGTILRYEVTRL

SEQ ID NO: 3074785 - protein, 18 aa, Giardia lamblia
KYSLDIPLHTAFKTYVSA

SEQ ID NO: 3074786 - protein, 28 aa, Giardia lamblia
KYTPTNVMKRVCKYIELVNVALAHGCSI

SEQ ID NO: 3074787 - protein, 25 aa, Giardia lamblia
KYVSGDTYLGFLLMMIATIAFLIVL

SEQ ID NO: 3074788 - protein, 25 aa, Giardia lamblia
KYVVSFIRRYMPILEVPYRVGEEIF

SEQ ID NO: 3074789 - protein, 18 aa, Giardia lamblia
KYWEILLVLLCEADAYTK

SEQ ID NO: 3074790 - protein, 18 aa, Giardia lamblia
KYYESAWLLSRGASTVAF

SEQ ID NO: 3074791 - protein, 18 aa, Giardia lamblia
KYYKVITALAGCPWRHQS

SEQ ID NO: 3074792 - protein, 30 aa, Giardia lamblia
KYYMSFKGNPEWSWFFSYPFSPLISDLALY

SEQ ID NO: 3074793 - protein, 27 aa, Giardia lamblia
LAAEKCVACSVLHCLTCNAANTCASCQ

SEQ ID NO: 3074794 - protein, 36 aa, Giardia lamblia
LAAKCFSLALKTSFTAKFAGPIFEKLRGEGIIVLPS

SEQ ID NO: 3074795 - protein, 17 aa, Giardia lamblia
LAALKSPAFLSIVDTIV

SEQ ID NO: 3074796 - protein, 21 aa, Giardia lamblia
LAALLPRLINYTVESSYYLDM

SEQ ID NO: 3074797 - protein, 18 aa, Giardia lamblia
LAALSRILGKTLGISADL

SEQ ID NO: 3074798 - protein, 19 aa, Giardia lamblia
LAANFRTTSLLLRDFGALL

SEQ ID NO: 3074799 - protein, 17 aa, Giardia lamblia
LAAPAVAVSTNLSLGAH

SEQ ID NO: 3074800 - protein, 24 aa, Giardia lamblia
LAAPRFMHVLGIPLSVVLMLLSAA

SEQ ID NO: 3074801 - protein, 19 aa, Giardia lamblia
LAARNGHLSICQFLADKEC

SEQ ID NO: 3074802 - protein, 20 aa, Giardia lamblia
LAAVNLRLSGNHDLDRYPER

SEQ ID NO: 3074803 - protein, 18 aa, Giardia lamblia
LACALKCEDDELIYNIGT

SEQ ID NO: 3074804 - protein, 18 aa, Giardia lamblia
LACQRPPLHLKKDTLTGD

SEQ ID NO: 3074805 - protein, 25 aa, Giardia lamblia
LACQTRVVVVYNFLFRPSNVSTNVL

SEQ ID NO: 3074806 - protein, 20 aa, Giardia lamblia
LADAIGIRLLFVILGVCPLI

SEQ ID NO: 3074807 - protein, 17 aa, Giardia lamblia
LADFEFASQIVKHQPLT

SEQ ID NO: 3074808 - protein, 19 aa, Giardia lamblia
LADHPPFNFHLLKTNALST

SEQ ID NO: 3074809 - protein, 24 aa, Giardia lamblia
LADILNIDITIRFVKGAPLNQEQF

SEQ ID NO: 3074810 - protein, 18 aa, Giardia lamblia
LADLRSMDSSSRVEHVLQ

SEQ ID NO: 3074811 - protein, 21 aa, Giardia lamblia
LADSLLFSGIISIIISGLLLS

SEQ ID NO: 3074812 - protein, 20 aa, Giardia lamblia
LADTYIGCFSYYTDYNLTRL

SEQ ID NO: 3074813 - protein, 17 aa, Giardia lamblia
LADVVMKFTTLNCQEHL

SEQ ID NO: 3074814 - protein, 18 aa, Giardia lamblia
LAEKLGLSLTSDFRPLAI

SEQ ID NO: 3074815 - protein, 18 aa, Giardia lamblia
LAEKYHFAFFESLLLKLD

SEQ ID NO: 3074816 - protein, 21 aa, Giardia lamblia
LAELLDFFQNLILAVKINSMQ

SEQ ID NO: 3074817 - protein, 20 aa, Giardia lamblia
LAEQMPKRLTPLIELYLNKC

SEQ ID NO: 3074818 - protein, 19 aa, Giardia lamblia
LAERLRIILEPTVTSDLKG

SEQ ID NO: 3074819 - protein, 21 aa, Giardia lamblia
LAFALFTVFVHLFGRLKKLKP

SEQ ID NO: 3074820 - protein, 19 aa, Giardia lamblia
LAFCIRYDPGTLKNFLMSV

SEQ ID NO: 3074821 - protein, 32 aa, Giardia lamblia
LAFKKRAAYTLRFLCRKDFLHIVKTIHERLTA

SEQ ID NO: 3074822 - protein, 19 aa, Giardia lamblia
LAFLSRLWFNRELYIRMAL

SEQ ID NO: 3074823 - protein, 17 aa, Giardia lamblia
LAFMLCAVEVEVVDVMT

SEQ ID NO: 3074824 - protein, 17 aa, Giardia lamblia
LAFPKSVSDCLGRVTDT

SEQ ID NO: 3074825 - protein, 19 aa, Giardia lamblia
LAFRKGERIGIVGRTGAGK

SEQ ID NO: 3074826 - protein, 33 aa, Giardia lamblia
LAGHLHKHITLRKNLFRYNAKGLINYETKSVKR

SEQ ID NO: 3074827 - protein, 19 aa, Giardia lamblia
LAGISAYYGLECLIGDQGV

SEQ ID NO: 3074828 - protein, 21 aa, Giardia lamblia
LAGLGRRTLVYAYRMLDDDDL

SEQ ID NO: 3074829 - protein, 18 aa, Giardia lamblia
LAGLGRRTLVYAYRTLDD

SEQ ID NO: 3074830 - protein, 17 aa, Giardia lamblia
LAGLIGFLSWRFCCKNK

SEQ ID NO: 3074831 - protein, 23 aa, Giardia lamblia
LAGLIGFLSWRFCCKNKKPKHPL

SEQ ID NO: 3074832 - protein, 23 aa, Giardia lamblia
LAGSFKLDERYTYVADCVLYGRY

SEQ ID NO: 3074833 - protein, 19 aa, Giardia lamblia
LAGVYIFCVFYRLVRFILN

SEQ ID NO: 3074834 - protein, 18 aa, Giardia lamblia
LAGYEVFQATFLRDTLPN

SEQ ID NO: 3074835 - protein, 24 aa, Giardia lamblia
LAHLWDLLVSFFVSCINSISNINE

SEQ ID NO: 3074836 - protein, 22 aa, Giardia lamblia
LAICVQRAMTILPELLLLLPDL

SEQ ID NO: 3074837 - protein, 17 aa, Giardia lamblia
LAIELIVHSGRVAEYKW

SEQ ID NO: 3074838 - protein, 27 aa, Giardia lamblia
LAIERWNKLCSLVFIAPDLAKEWVAFF

SEQ ID NO: 3074839 - protein, 24 aa, Giardia lamblia
LAILFPGFATFFFNIMLPPHVSLH

SEQ ID NO: 3074840 - protein, 19 aa, Giardia lamblia
LAILSIVHLHWSDYDIKSP

SEQ ID NO: 3074841 - protein, 17 aa, Giardia lamblia
LAIPLLKRKPKMWEIMG

SEQ ID NO: 3074842 - protein, 31 aa, Giardia lamblia
LAKLCAYSSHMLCIGFLFGIIAPISLPVVTM

SEQ ID NO: 3074843 - protein, 19 aa, Giardia lamblia
LAKLTICIVSAESKSIPDN

SEQ ID NO: 3074844 - protein, 18 aa, Giardia lamblia
LAKSSWFLALSQSIHNLS

SEQ ID NO: 3074845 - protein, 17 aa, Giardia lamblia
LALAITKTLFKSAIGTS

SEQ ID NO: 3074846 - protein, 19 aa, Giardia lamblia
LALCDLCATTLTGIALVYC

SEQ ID NO: 3074847 - protein, 26 aa, Giardia lamblia
LALFAICIISVLWLAVAKPVYEVVQL

SEQ ID NO: 3074848 - protein, 20 aa, Giardia lamblia
LALICTFMLTILSEIRARFI

SEQ ID NO: 3074849 - protein, 17 aa, Giardia lamblia
LALLGSVSAEVLVLTQD

SEQ ID NO: 3074850 - protein, 18 aa, Giardia lamblia
LALLIACFSSPLTILKIY

SEQ ID NO: 3074851 - protein, 24 aa, Giardia lamblia
LALLIRCVLIWLGTYISDPPALSM

SEQ ID NO: 3074852 - protein, 18 aa, Giardia lamblia
LALRFLREQRRGVTNFID

SEQ ID NO: 3074853 - protein, 19 aa, Giardia lamblia
LALRIARIKGFSSVETATS

SEQ ID NO: 3074854 - protein, 19 aa, Giardia lamblia
LALSPGRCSIQFLQAAGPE

SEQ ID NO: 3074855 - protein, 24 aa, Giardia lamblia
LAMESFKPLLYMAILMVTQPQDLL

SEQ ID NO: 3074856 - protein, 20 aa, Giardia lamblia
LAMFMLRYIERYLVETPAEK

SEQ ID NO: 3074857 - protein, 32 aa, Giardia lamblia
LAMPRCALCLLALELLAGLSLSLASLAGGFQA

SEQ ID NO: 3074858 - protein, 20 aa, Giardia lamblia
LAMQVSYNFGKLVMAGSIKR

SEQ ID NO: 3074859 - protein, 17 aa, Giardia lamblia
LANEIYGGNPLRLLRKM

SEQ ID NO: 3074860 - protein, 17 aa, Giardia lamblia
LANITAHLTNLSEDYLS

SEQ ID NO: 3074861 - protein, 24 aa, Giardia lamblia
LAPKESMMVIIFAYDRYSASGFVM

SEQ ID NO: 3074862 - protein, 24 aa, Giardia lamblia
LAPMPVPLSARRSIWNDIETRSPT

SEQ ID NO: 3074863 - protein, 17 aa, Giardia lamblia
LAPPWVRIYRIMRDIPL

SEQ ID NO: 3074864 - protein, 17 aa, Giardia lamblia
LAPYCLLSDNLSFRSYV

SEQ ID NO: 3074865 - protein, 20 aa, Giardia lamblia
LAQARLLLHIEGLRRDQKNM

SEQ ID NO: 3074866 - protein, 19 aa, Giardia lamblia
LAQLCVKYYVSPFTIVRSN

SEQ ID NO: 3074867 - protein, 31 aa, Giardia lamblia
LAQPESRFISNFGVSPIRPFIIKNKASTRKF

SEQ ID NO: 3074868 - protein, 26 aa, Giardia lamblia
LAQSLFCFPAGIKPKVSSFIVSLFTL

SEQ ID NO: 3074869 - protein, 18 aa, Giardia lamblia
LAQSSFNLAPLIYSLFIG

SEQ ID NO: 3074870 - protein, 18 aa, Giardia lamblia
LARPSCFDEAFKLQMKAQ

SEQ ID NO: 3074871 - protein, 18 aa, Giardia lamblia
LARSKLVDRYALVDEARK

SEQ ID NO: 3074872 - protein, 25 aa, Giardia lamblia
LASGDIYRPEFLKIYNDLTMDHGVP

SEQ ID NO: 3074873 - protein, 17 aa, Giardia lamblia
LASHFPPTGKQYFNSLI

SEQ ID NO: 3074874 - protein, 22 aa, Giardia lamblia
LASIDFYRHLPLFARGSLVSVA

SEQ ID NO: 3074875 - protein, 22 aa, Giardia lamblia
LASKRLWGLILLVGLMAWLVRL

SEQ ID NO: 3074876 - protein, 19 aa, Giardia lamblia
LASLGVLLLRKIRVRQRIK

SEQ ID NO: 3074877 - protein, 22 aa, Giardia lamblia
LASMLVGIGLIFAVALADACSP

SEQ ID NO: 3074878 - protein, 25 aa, Giardia lamblia
LASSDATCGVGLFVGAQSSSIAKHS

SEQ ID NO: 3074879 - protein, 18 aa, Giardia lamblia
LATALPPSLCTQDRTATP

SEQ ID NO: 3074880 - protein, 19 aa, Giardia lamblia
LATCDCVHRILKEGRTSEV

SEQ ID NO: 3074881 - protein, 32 aa, Giardia lamblia
LATEFPVMIQWAQTRLGAVFAGRSHGFLLKDH

SEQ ID NO: 3074882 - protein, 25 aa, Giardia lamblia
LATEGRIPLPIPKKYTMSLAAVSVV

SEQ ID NO: 3074883 - protein, 28 aa, Giardia lamblia
LATLIFSSLLFRWHPLYNSICVSRLIMG

SEQ ID NO: 3074884 - protein, 22 aa, Giardia lamblia
LAVAGFLVWWFVFRRGGRPKRG

SEQ ID NO: 3074885 - protein, 19 aa, Giardia lamblia
LAVCVCITVELVLLLCCEK

SEQ ID NO: 3074886 - protein, 17 aa, Giardia lamblia
LAVPGMRDSDSIVASLP

SEQ ID NO: 3074887 - protein, 23 aa, Giardia lamblia
LAVRKNLALARISVHYLPELFKV

SEQ ID NO: 3074888 - protein, 24 aa, Giardia lamblia
LAVRSSFFLGVRVLRTYEARLRLP

SEQ ID NO: 3074889 - protein, 18 aa, Giardia lamblia
LAVSSAFVVFAYATKKGI

SEQ ID NO: 3074890 - protein, 34 aa, Giardia lamblia
LAWVRLIMRRLTTVYEFFRRVQIHVEDENDPAIQ

SEQ ID NO: 3074891 - protein, 33 aa, Giardia lamblia
LAYCLAASAYFCRPFCLAASLFGVQNTVVLKYA

SEQ ID NO: 3074892 - protein, 19 aa, Giardia lamblia
LAYCLSGVVVTVWISLLLM

SEQ ID NO: 3074893 - protein, 19 aa, Giardia lamblia
LAYHLAKPDSHLLVVHLAG

SEQ ID NO: 3074894 - protein, 17 aa, Giardia lamblia
LAYRAQEKMRFYLLPNY

SEQ ID NO: 3074895 - protein, 21 aa, Giardia lamblia
LAYWLNVVVCVISFGIYLACG

SEQ ID NO: 3074896 - protein, 29 aa, Giardia lamblia
LAYYTRPLLSLNFTRYFPSIDESFVNSIY

SEQ ID NO: 3074897 - protein, 17 aa, Giardia lamblia
LCALDTLLAQLAHSVTV

SEQ ID NO: 3074898 - protein, 20 aa, Giardia lamblia
LCALYRGALDTTRACMKHSE

SEQ ID NO: 3074899 - protein, 27 aa, Giardia lamblia
LCEGERRIPIRISFVPDPHGAGLKKYL

SEQ ID NO: 3074900 - protein, 21 aa, Giardia lamblia
LCEGLAYPLMYLFAGDGETER

SEQ ID NO: 3074901 - protein, 21 aa, Giardia lamblia
LCENIKCIAMRQLWRRIGYLE

SEQ ID NO: 3074902 - protein, 17 aa, Giardia lamblia
LCEVCKLGYYLDSTDNV

SEQ ID NO: 3074903 - protein, 18 aa, Giardia lamblia
LCFAYLWWFFLGLFGAHR

SEQ ID NO: 3074904 - protein, 18 aa, Giardia lamblia
LCGCTDLQTILSLIESLN

SEQ ID NO: 3074905 - protein, 18 aa, Giardia lamblia
LCGSRNYLSPEMLARKEY

SEQ ID NO: 3074906 - protein, 23 aa, Giardia lamblia
LCHKKRATMVTVIDRLLTILEED

SEQ ID NO: 3074907 - protein, 18 aa, Giardia lamblia
LCHLDLAIMRKFLDTNPL

SEQ ID NO: 3074908 - protein, 23 aa, Giardia lamblia
LCHMKPLLGSICYREAYIDDEPK

SEQ ID NO: 3074909 - protein, 24 aa, Giardia lamblia
LCHSKMALGMALHFLTEGSDAERS

SEQ ID NO: 3074910 - protein, 22 aa, Giardia lamblia
LCIAENRLVQAYVLLQLAGTLD

SEQ ID NO: 3074911 - protein, 26 aa, Giardia lamblia
LCIKESRVPLSLLFVFLTGVGSLCRR

SEQ ID NO: 3074912 - protein, 21 aa, Giardia lamblia
LCLPIVPKLGSGKMDIALSTK

SEQ ID NO: 3074913 - protein, 21 aa, Giardia lamblia
LCMACTMLGVSMKVNAVEKMI

SEQ ID NO: 3074914 - protein, 20 aa, Giardia lamblia
LCMMQPRGSSLLVGLETGTV

SEQ ID NO: 3074915 - protein, 27 aa, Giardia lamblia
LCMVGITLLIMICFKVIDLEAVPNFQP

SEQ ID NO: 3074916 - protein, 26 aa, Giardia lamblia
LCNIACLMQSTILLQREVRLKPELLE

SEQ ID NO: 3074917 - protein, 21 aa, Giardia lamblia
LCRNALRGGSITAITRPYMAP

SEQ ID NO: 3074918 - protein, 19 aa, Giardia lamblia
LCRYFGMRYEFVFCSPATD

SEQ ID NO: 3074919 - protein, 18 aa, Giardia lamblia
LCSGFSCAGKDQLCGGSQ

SEQ ID NO: 3074920 - protein, 17 aa, Giardia lamblia
LCSIEFRDMKQDPVRLL

SEQ ID NO: 3074921 - protein, 31 aa, Giardia lamblia
LCSLKEHLTVACLRGILAFADETRYARYFAS

SEQ ID NO: 3074922 - protein, 27 aa, Giardia lamblia
LCSLVRVICCYLFPAYRLHTVLQNTVP

SEQ ID NO: 3074923 - protein, 20 aa, Giardia lamblia
LCSMLRGYQIPAFVALGTCA

SEQ ID NO: 3074924 - protein, 17 aa, Giardia lamblia
LCSPSAYSPDTTIKCTS

SEQ ID NO: 3074925 - protein, 18 aa, Giardia lamblia
LCSSSLYALVPDFHCTYE

SEQ ID NO: 3074926 - protein, 18 aa, Giardia lamblia
LCSTCVHGSVATDDGHCT

SEQ ID NO: 3074927 - protein, 24 aa, Giardia lamblia
LCTAVCLCDMLALGEYMRDYFVKR

SEQ ID NO: 3074928 - protein, 23 aa, Giardia lamblia
LCTEMFYAYLLAFLYQCSNFYNE

SEQ ID NO: 3074929 - protein, 17 aa, Giardia lamblia
LCTGARITCGYGLTETC

SEQ ID NO: 3074930 - protein, 18 aa, Giardia lamblia
LCTHIWANTIFLLDATNY

SEQ ID NO: 3074931 - protein, 20 aa, Giardia lamblia
LCTSCKPGFIAAGVVSGDTC

SEQ ID NO: 3074932 - protein, 19 aa, Giardia lamblia
LCVSGRSLLVLSLLILSDD

SEQ ID NO: 3074933 - protein, 22 aa, Giardia lamblia
LCVTKYGICISLSKNTRTYTTI

SEQ ID NO: 3074934 - protein, 18 aa, Giardia lamblia
LDAAAAMDALFKIDLQVN

SEQ ID NO: 3074935 - protein, 18 aa, Giardia lamblia
LDAAERSPLVGIRHSTKE

SEQ ID NO: 3074936 - protein, 24 aa, Giardia lamblia
LDAALQRVISFLVMTAKTDSQNVK

SEQ ID NO: 3074937 - protein, 17 aa, Giardia lamblia
LDAASRVSWLFQRAYEK

SEQ ID NO: 3074938 - protein, 29 aa, Giardia lamblia
LDAFFKDRFIVDGVWARISIPIIPSESFL

SEQ ID NO: 3074939 - protein, 20 aa, Giardia lamblia
LDAFSTFQIVSHKVEISENT

SEQ ID NO: 3074940 - protein, 18 aa, Giardia lamblia
LDAILPRAIHEIYTILAC

SEQ ID NO: 3074941 - protein, 19 aa, Giardia lamblia
LDAILTFLEKYYFEVQSIG

SEQ ID NO: 3074942 - protein, 21 aa, Giardia lamblia
LDAKGKTGLSWQNSGWDNETI

SEQ ID NO: 3074943 - protein, 18 aa, Giardia lamblia
LDALCAKDGIADFMKSLR

SEQ ID NO: 3074944 - protein, 21 aa, Giardia lamblia
LDAMDPTVCNRVFTLTIDISM

SEQ ID NO: 3074945 - protein, 19 aa, Giardia lamblia
LDAPTTIKNACRIAKALRF

SEQ ID NO: 3074946 - protein, 20 aa, Giardia lamblia
LDCHLPPPIFEALLKHALLQ

SEQ ID NO: 3074947 - protein, 23 aa, Giardia lamblia
LDDPAFMTICRYLSQVHGLEEAG

SEQ ID NO: 3074948 - protein, 20 aa, Giardia lamblia
LDDYCRLIHECGVTCIEYIT

SEQ ID NO: 3074949 - protein, 23 aa, Giardia lamblia
LDEIKLFLTKVEEWMKMDKSSIV

SEQ ID NO: 3074950 - protein, 18 aa, Giardia lamblia
LDEIRIVSVFPHVIKISI

SEQ ID NO: 3074951 - protein, 17 aa, Giardia lamblia
LDERLNSHLAFFLTPGG

SEQ ID NO: 3074952 - protein, 20 aa, Giardia lamblia
LDFFCGILLSLALDKDINKE

SEQ ID NO: 3074953 - protein, 17 aa, Giardia lamblia
LDFLHRFNRFHIPEDNL

SEQ ID NO: 3074954 - protein, 17 aa, Giardia lamblia
LDFLRRTVTHGGRCLLY

SEQ ID NO: 3074955 - protein, 17 aa, Giardia lamblia
LDFMGFITGLYYSPHDG

SEQ ID NO: 3074956 - protein, 19 aa, Giardia lamblia
LDFTPLLCEYIHQLYDLKH

SEQ ID NO: 3074957 - protein, 17 aa, Giardia lamblia
LDFWCLGVLLFTLYTHK

SEQ ID NO: 3074958 - protein, 21 aa, Giardia lamblia
LDGDIYWVSWDASLLGTIQRE

SEQ ID NO: 3074959 - protein, 22 aa, Giardia lamblia
LDGGIPPTARFALLNLDHESAI

SEQ ID NO: 3074960 - protein, 26 aa, Giardia lamblia
LDGLGQDVKVCWCNYLNEEMKSIVEE

SEQ ID NO: 3074961 - protein, 17 aa, Giardia lamblia
LDGLPAYSSLLSNADNA

SEQ ID NO: 3074962 - protein, 20 aa, Giardia lamblia
LDGVCYIGSVLLLKIGAISN

SEQ ID NO: 3074963 - protein, 21 aa, Giardia lamblia
LDHARVDVYFTLWDDSQDAAV

SEQ ID NO: 3074964 - protein, 23 aa, Giardia lamblia
LDHIMDLVFSFLIPQEIICFILS

SEQ ID NO: 3074965 - protein, 21 aa, Giardia lamblia
LDILHLIKFYTLQKEIPIVTS

SEQ ID NO: 3074966 - protein, 21 aa, Giardia lamblia
LDILVAFTVVYPSKVETVNED

SEQ ID NO: 3074967 - protein, 19 aa, Giardia lamblia
LDIPALLPYAQRVYSSPRL

SEQ ID NO: 3074968 - protein, 35 aa, Giardia lamblia
LDIPLHGGLGFSFRRLFPLNGKVLLRIFIQGLASW

SEQ ID NO: 3074969 - protein, 22 aa, Giardia lamblia
LDIVALFLGERVLSLNSPGNIS

SEQ ID NO: 3074970 - protein, 27 aa, Giardia lamblia
LDKHSVLKGGDWYSVHAYRSVNQALGR

SEQ ID NO: 3074971 - protein, 24 aa, Giardia lamblia
LDKWCKDCDTIPFSTIDQISSYKE

SEQ ID NO: 3074972 - protein, 18 aa, Giardia lamblia
LDKYGTIGSPGFAYETVY

SEQ ID NO: 3074973 - protein, 17 aa, Giardia lamblia
LDLFAKVCISVLRAEFT

SEQ ID NO: 3074974 - protein, 23 aa, Giardia lamblia
LDLFVSEGCQLFFAINDDGSDIS

SEQ ID NO: 3074975 - protein, 19 aa, Giardia lamblia
LDLIRSYVPFERIVSGLAF

SEQ ID NO: 3074976 - protein, 24 aa, Giardia lamblia
LDLKMCVWALWVLIYTLPLFTFIE

SEQ ID NO: 3074977 - protein, 26 aa, Giardia lamblia
LDLLKDARLFMGGNLVCDAFDLYTHA

SEQ ID NO: 3074978 - protein, 17 aa, Giardia lamblia
LDLLPNMTLRTDSGKAE

SEQ ID NO: 3074979 - protein, 17 aa, Giardia lamblia
LDLLPRVRHQYIVDYKQ

SEQ ID NO: 3074980 - protein, 24 aa, Giardia lamblia
LDLLTRLVSLAVHSHIVLPDHLLT

SEQ ID NO: 3074981 - protein, 17 aa, Giardia lamblia
LDLPRYSSKFIKLSNTF

SEQ ID NO: 3074982 - protein, 17 aa, Giardia lamblia
LDLPSISSYPCIREIEA

SEQ ID NO: 3074983 - protein, 28 aa, Giardia lamblia
LDLQSTCIYLFCKSVYIPSVQLSDDLGR

SEQ ID NO: 3074984 - protein, 27 aa, Giardia lamblia
LDLRIDEIFNKIRLHLGGRFVTALEIM

SEQ ID NO: 3074985 - protein, 21 aa, Giardia lamblia
LDLYIALDFADLNTRDCKYIG

SEQ ID NO: 3074986 - protein, 17 aa, Giardia lamblia
LDLYRDIAVGLSLCMLK

SEQ ID NO: 3074987 - protein, 29 aa, Giardia lamblia
LDMKFTIYSCFALSPSIGFIECILPSESQ

SEQ ID NO: 3074988 - protein, 19 aa, Giardia lamblia
LDMPYDLKTGAISLSDMSI

SEQ ID NO: 3074989 - protein, 17 aa, Giardia lamblia
LDNAENVLLLFVPPVTL

SEQ ID NO: 3074990 - protein, 26 aa, Giardia lamblia
LDNFLYDAWDAFPYVDTIASLTNQDF

SEQ ID NO: 3074991 - protein, 19 aa, Giardia lamblia
LDNGLKRSRLFGFYEAMSG

SEQ ID NO: 3074992 - protein, 18 aa, Giardia lamblia
LDNMIELIHHSRCSMGDP

SEQ ID NO: 3074993 - protein, 22 aa, Giardia lamblia
LDNVCVPILCTIKHPTDISLSQ

SEQ ID NO: 3074994 - protein, 18 aa, Giardia lamblia
LDPARSRRNTCGGPLRKI

SEQ ID NO: 3074995 - protein, 27 aa, Giardia lamblia
LDPFITCRALEAFLVIATRRELNLAKL

SEQ ID NO: 3074996 - protein, 18 aa, Giardia lamblia
LDPGILLKHVQEVRQRLA

SEQ ID NO: 3074997 - protein, 17 aa, Giardia lamblia
LDPLARDRVATLRATLE

SEQ ID NO: 3074998 - protein, 23 aa, Giardia lamblia
LDPQNRTALMLATLASSPGSAQL

SEQ ID NO: 3074999 - protein, 18 aa, Giardia lamblia
LDPVGYVCLLLVYHSMVS

SEQ ID NO: 3075000 - protein, 23 aa, Giardia lamblia
LDPYKMILGHYIFKESQKAHAST

SEQ ID NO: 3075001 - protein, 19 aa, Giardia lamblia
LDPYYRSMNGFFVLIEKEW

SEQ ID NO: 3075002 - protein, 24 aa, Giardia lamblia
LDQAGCLLPGFVSQSCGTALMMAI

SEQ ID NO: 3075003 - protein, 17 aa, Giardia lamblia
LDQRMSTAIYSVVLYGL

SEQ ID NO: 3075004 - protein, 35 aa, Giardia lamblia
LDRLCTACVPLLPTTVCFLLNILIWDEAVEARVMV

SEQ ID NO: 3075005 - protein, 20 aa, Giardia lamblia
LDRVLLLEILFLVAGVIICG

SEQ ID NO: 3075006 - protein, 24 aa, Giardia lamblia
LDSEVCSKADHALDEKQVDDAPQM

SEQ ID NO: 3075007 - protein, 23 aa, Giardia lamblia
LDSMFRFMWVPFFLILCIETANY

SEQ ID NO: 3075008 - protein, 22 aa, Giardia lamblia
LDSNAARVLALFSKTRTEILFR

SEQ ID NO: 3075009 - protein, 23 aa, Giardia lamblia
LDSPACLFLLYSILSDEIDSFVA

SEQ ID NO: 3075010 - protein, 19 aa, Giardia lamblia
LDSSIDLYYSMPMQGSTAF

SEQ ID NO: 3075011 - protein, 25 aa, Giardia lamblia
LDSTDVFINWSFHECVIEGSESEPA

SEQ ID NO: 3075012 - protein, 24 aa, Giardia lamblia
LDTDIQPICLIYRSYNNPAYVSQS

SEQ ID NO: 3075013 - protein, 18 aa, Giardia lamblia
LDTILYCVDYFINQKFFP

SEQ ID NO: 3075014 - protein, 18 aa, Giardia lamblia
LDTLRVIARAAPKDKYRL

SEQ ID NO: 3075015 - protein, 17 aa, Giardia lamblia
LDTMCREVPVASTCDFT

SEQ ID NO: 3075016 - protein, 20 aa, Giardia lamblia
LDTMFLNFLAACGLYLDWAR

SEQ ID NO: 3075017 - protein, 19 aa, Giardia lamblia
LDTYGYWGCVCEYPYFGSG

SEQ ID NO: 3075018 - protein, 25 aa, Giardia lamblia
LDTYSDLCFFTFSAIDAIVQEIQDH

SEQ ID NO: 3075019 - protein, 17 aa, Giardia lamblia
LDVALKYEDCFVDNVGL

SEQ ID NO: 3075020 - protein, 20 aa, Giardia lamblia
LDVISSFLIKTHFRKYFEEQ

SEQ ID NO: 3075021 - protein, 19 aa, Giardia lamblia
LDVSELFGLIKDARPTFNL

SEQ ID NO: 3075022 - protein, 29 aa, Giardia lamblia
LDVSESLELFLRRHLSILYETEATPEERG

SEQ ID NO: 3075023 - protein, 23 aa, Giardia lamblia
LDVTARLKVWTAIHELAHSRTII

SEQ ID NO: 3075024 - protein, 19 aa, Giardia lamblia
LDVVLCDEVTTGLSRTDAM

SEQ ID NO: 3075025 - protein, 18 aa, Giardia lamblia
LDVYTRTNLLLKLLSLMK

SEQ ID NO: 3075026 - protein, 24 aa, Giardia lamblia
LDWFVSLCQALAFYRAVVIQQVSK

SEQ ID NO: 3075027 - protein, 25 aa, Giardia lamblia
LDYLLVTDCNFEFSERSDLFASRNS

SEQ ID NO: 3075028 - protein, 23 aa, Giardia lamblia
LDYLNCWNSYQFTHSYNEMEKDY

SEQ ID NO: 3075029 - protein, 19 aa, Giardia lamblia
LDYTLPFSLGTILLAVYNN

SEQ ID NO: 3075030 - protein, 21 aa, Giardia lamblia
LDYYSSLSFPSFHLHCSDCRS

SEQ ID NO: 3075031 - protein, 19 aa, Giardia lamblia
LEAAKLLLREACMQESAEI

SEQ ID NO: 3075032 - protein, 18 aa, Giardia lamblia
LEAALFFLYVLRVFDDSK

SEQ ID NO: 3075033 - protein, 17 aa, Giardia lamblia
LEAELILLHTLAICVQR

SEQ ID NO: 3075034 - protein, 24 aa, Giardia lamblia
LEAFGGYCTYPTCAGKVLHNGEVK

SEQ ID NO: 3075035 - protein, 26 aa, Giardia lamblia
LEAFLDYVFCFTLYMRADSTVNKEDY

SEQ ID NO: 3075036 - protein, 24 aa, Giardia lamblia
LEAFLSAFCYLELDEYTIVPYSLG

SEQ ID NO: 3075037 - protein, 18 aa, Giardia lamblia
LEAIKPITKWAFITPPLM

SEQ ID NO: 3075038 - protein, 19 aa, Giardia lamblia
LEAIRCSKLLIGTDSLGAF

SEQ ID NO: 3075039 - protein, 18 aa, Giardia lamblia
LEAKRCLAIGLGGTTGLS

SEQ ID NO: 3075040 - protein, 18 aa, Giardia lamblia
LEALAVAVTQNLSCILVG

SEQ ID NO: 3075041 - protein, 20 aa, Giardia lamblia
LEALFRPFLESHLLDPTVIT

SEQ ID NO: 3075042 - protein, 23 aa, Giardia lamblia
LEAQLCDLKELFQIEKDTIGMVV

SEQ ID NO: 3075043 - protein, 20 aa, Giardia lamblia
LEARVFIFLIHFNLVNQLLR

SEQ ID NO: 3075044 - protein, 17 aa, Giardia lamblia
LEASLPQVLRLCSTGAI

SEQ ID NO: 3075045 - protein, 18 aa, Giardia lamblia
LEAVKLLASHELQLRDEK

SEQ ID NO: 3075046 - protein, 17 aa, Giardia lamblia
LEAVKLRSHLSMYADAY

SEQ ID NO: 3075047 - protein, 19 aa, Giardia lamblia
LEAYARAGLLVKALYVARR

SEQ ID NO: 3075048 - protein, 17 aa, Giardia lamblia
LEAYEFLLDHGISGILF

SEQ ID NO: 3075049 - protein, 24 aa, Giardia lamblia
LECAVQLGLCIYKSTYKELADLGV

SEQ ID NO: 3075050 - protein, 23 aa, Giardia lamblia
LECTIILRFFYKHLLMEYPDLFC

SEQ ID NO: 3075051 - protein, 23 aa, Giardia lamblia
LEDGTPCYPLRVDNIIVLHANAI

SEQ ID NO: 3075052 - protein, 31 aa, Giardia lamblia
LEDRLGSYYLRDGRVFTCFANGKLSACMAPF

SEQ ID NO: 3075053 - protein, 18 aa, Giardia lamblia
LEELGPWSPKIYLYGSAV

SEQ ID NO: 3075054 - protein, 18 aa, Giardia lamblia
LEESLVIYEAILAGLFSK

SEQ ID NO: 3075055 - protein, 18 aa, Giardia lamblia
LEEVFIKLGKIYQAGVFS

SEQ ID NO: 3075056 - protein, 25 aa, Giardia lamblia
LEEYCECAPGFVLRDADNIDAGCIQ

SEQ ID NO: 3075057 - protein, 19 aa, Giardia lamblia
LEFHLTAITFFKLLCPLLK

SEQ ID NO: 3075058 - protein, 18 aa, Giardia lamblia
LEGEACIFTKPSGGNRSG

SEQ ID NO: 3075059 - protein, 24 aa, Giardia lamblia
LEGGFPPHIARQFLGITDLSWIDE

SEQ ID NO: 3075060 - protein, 18 aa, Giardia lamblia
LEGIKHKSSLVITAVPKR

SEQ ID NO: 3075061 - protein, 19 aa, Giardia lamblia
LEGLTALLMQHGEIPAYFR

SEQ ID NO: 3075062 - protein, 25 aa, Giardia lamblia
LEGNSRRLSCWAVDNISFVTDTFKG

SEQ ID NO: 3075063 - protein, 18 aa, Giardia lamblia
LEHCWSSPHSWSINTDDS

SEQ ID NO: 3075064 - protein, 18 aa, Giardia lamblia
LEHLKAEHNILQSFNHPN

SEQ ID NO: 3075065 - protein, 20 aa, Giardia lamblia
LEHVCVLPVTPRKNLADLFT

SEQ ID NO: 3075066 - protein, 17 aa, Giardia lamblia
LEIFKQFLAENSILDLK

SEQ ID NO: 3075067 - protein, 25 aa, Giardia lamblia
LEIGESYEDFGFFATIRRGQVFNLS

SEQ ID NO: 3075068 - protein, 33 aa, Giardia lamblia
LEIGLEILRKAWPYLHRETILSLVHRKNPNSAV

SEQ ID NO: 3075069 - protein, 20 aa, Giardia lamblia
LEIIDCLLPYEGLLMDVKAI

SEQ ID NO: 3075070 - protein, 18 aa, Giardia lamblia
LEIKHPIKKISILTNPLT

SEQ ID NO: 3075071 - protein, 18 aa, Giardia lamblia
LEILLGLYQQELQSVLLD

SEQ ID NO: 3075072 - protein, 20 aa, Giardia lamblia
LEILNAFIVSNCSTLLLHDI

SEQ ID NO: 3075073 - protein, 20 aa, Giardia lamblia
LEIVKLLFEKEGHLVDKSNK

SEQ ID NO: 3075074 - protein, 17 aa, Giardia lamblia
LEIYTRVDLDKVQMAAA

SEQ ID NO: 3075075 - protein, 19 aa, Giardia lamblia
LEKLLQCLDLQSCTDDTLK

SEQ ID NO: 3075076 - protein, 22 aa, Giardia lamblia
LEKLWANGCAEVRKRFQTIYLY

SEQ ID NO: 3075077 - protein, 20 aa, Giardia lamblia
LEKMLGITCSTSFHHDTASR

SEQ ID NO: 3075078 - protein, 23 aa, Giardia lamblia
LEKNPRSTGCLALGLVLASTANM

SEQ ID NO: 3075079 - protein, 18 aa, Giardia lamblia
LEKVCLRDFFESQLEGLE

SEQ ID NO: 3075080 - protein, 23 aa, Giardia lamblia
LELADIRSLLCGIIISSHPLVQE

SEQ ID NO: 3075081 - protein, 19 aa, Giardia lamblia
LELDALCITELTRSSNKER

SEQ ID NO: 3075082 - protein, 23 aa, Giardia lamblia
LELDLSLPLTQMILKKNYVTFLT

SEQ ID NO: 3075083 - protein, 20 aa, Giardia lamblia
LELFRRLVRVEARRFNQANN

SEQ ID NO: 3075084 - protein, 17 aa, Giardia lamblia
LELGFVPPVSIYSNTSE

SEQ ID NO: 3075085 - protein, 22 aa, Giardia lamblia
LELKLYIGESLFYTFSSDDARL

SEQ ID NO: 3075086 - protein, 21 aa, Giardia lamblia
LELLRLVPILRKVLELSSLKR

SEQ ID NO: 3075087 - protein, 18 aa, Giardia lamblia
LELLRSLVRLSLHVQLGL

SEQ ID NO: 3075088 - protein, 19 aa, Giardia lamblia
LELMLNTYAPYAFATATST

SEQ ID NO: 3075089 - protein, 28 aa, Giardia lamblia
LELPRFLELRKCYAFRLFVDEAHSIGCL

SEQ ID NO: 3075090 - protein, 17 aa, Giardia lamblia
LELPSTTTFRVKLWYTA

SEQ ID NO: 3075091 - protein, 22 aa, Giardia lamblia
LELSAFWPPPMLYYSGEQIMNV

SEQ ID NO: 3075092 - protein, 17 aa, Giardia lamblia
LELSLYALLVFINAYYI

SEQ ID NO: 3075093 - protein, 35 aa, Giardia lamblia
LELVLLPFKTLIAIALNFSEMFVRSGMAQKYIFYV

SEQ ID NO: 3075094 - protein, 31 aa, Giardia lamblia
LELYYNIRAKFDFFNKPRCLLLVTAYETASI

SEQ ID NO: 3075095 - protein, 20 aa, Giardia lamblia
LEMACTRLLSSFSKSEDDAG

SEQ ID NO: 3075096 - protein, 25 aa, Giardia lamblia
LEMAKIRLSTCTVYLELLRGLNSDI

SEQ ID NO: 3075097 - protein, 32 aa, Giardia lamblia
LEMGFAGPMSIDLRPGILLASMRNSQNYIEKY

SEQ ID NO: 3075098 - protein, 18 aa, Giardia lamblia
LEMLCSILNSIFSSTDFA

SEQ ID NO: 3075099 - protein, 17 aa, Giardia lamblia
LEMNLLFVSESLATQQN

SEQ ID NO: 3075100 - protein, 18 aa, Giardia lamblia
LENIAKFFANCAAEEISE

SEQ ID NO: 3075101 - protein, 18 aa, Giardia lamblia
LENICLCYIIALYNSLRL

SEQ ID NO: 3075102 - protein, 26 aa, Giardia lamblia
LENIFSHQLIKAFEKGAVLGKYPLVY

SEQ ID NO: 3075103 - protein, 20 aa, Giardia lamblia
LENLLWIRTGIILLGSRNTF

SEQ ID NO: 3075104 - protein, 21 aa, Giardia lamblia
LENVKTLIAIPAFLITMCYVL

SEQ ID NO: 3075105 - protein, 21 aa, Giardia lamblia
LEPPEGPLLQFVGGTFEALVT

SEQ ID NO: 3075106 - protein, 17 aa, Giardia lamblia
LEPQFLTSMRLFISNNT

SEQ ID NO: 3075107 - protein, 26 aa, Giardia lamblia
LEREKRKRFVFQFSLHRTDFAIDELT

SEQ ID NO: 3075108 - protein, 17 aa, Giardia lamblia
LESDAGQSFPFVMSYFQ

SEQ ID NO: 3075109 - protein, 23 aa, Giardia lamblia
LESLFRFLVKCIYELDEDSRSGT

SEQ ID NO: 3075110 - protein, 20 aa, Giardia lamblia
LESRMMAALQSFYVLLKDPF

SEQ ID NO: 3075111 - protein, 19 aa, Giardia lamblia
LESSMNFRRFLAARRGNTR

SEQ ID NO: 3075112 - protein, 20 aa, Giardia lamblia
LESTEFWGIPSINTRRFRAS

SEQ ID NO: 3075113 - protein, 23 aa, Giardia lamblia
LESYPSIGHKACRGLLAQRTNKE

SEQ ID NO: 3075114 - protein, 21 aa, Giardia lamblia
LESYRLLKQLLLSSSPLEAKE

SEQ ID NO: 3075115 - protein, 24 aa, Giardia lamblia
LETLLYSCCGFVLVKMSTKDLHPQ

SEQ ID NO: 3075116 - protein, 26 aa, Giardia lamblia
LETLMECLSCCNPLYRDTVVSGLIAA

SEQ ID NO: 3075117 - protein, 19 aa, Giardia lamblia
LETLVHIWKCLSIYEYRTS

SEQ ID NO: 3075118 - protein, 17 aa, Giardia lamblia
LETYIGWMSFKTSGNKT

SEQ ID NO: 3075119 - protein, 24 aa, Giardia lamblia
LEVCSGKGYMKPGITEHADQWHEV

SEQ ID NO: 3075120 - protein, 17 aa, Giardia lamblia
LEVIRALQIQSLSQIDR

SEQ ID NO: 3075121 - protein, 17 aa, Giardia lamblia
LEVLYYSICGCILVAPE

SEQ ID NO: 3075122 - protein, 17 aa, Giardia lamblia
LEVPVPVFYACIDAITP

SEQ ID NO: 3075123 - protein, 20 aa, Giardia lamblia
LEVVRLLLGCEAGMKDSKNK

SEQ ID NO: 3075124 - protein, 30 aa, Giardia lamblia
LEYAIKVLIPRFGDTCIKHLDTYPGAPFAL

SEQ ID NO: 3075125 - protein, 21 aa, Giardia lamblia
LEYGNTLFLILDCMEDYQRHK

SEQ ID NO: 3075126 - protein, 21 aa, Giardia lamblia
LEYSNGISYKGRFSRGKFSGL

SEQ ID NO: 3075127 - protein, 19 aa, Giardia lamblia
LEYYIKLYSSVRLRIYRMK

SEQ ID NO: 3075128 - protein, 17 aa, Giardia lamblia
LFAKVCISVLRAEFTNI

SEQ ID NO: 3075129 - protein, 17 aa, Giardia lamblia
LFAMICGHLPFDHDNTE

SEQ ID NO: 3075130 - protein, 17 aa, Giardia lamblia
LFAYHQFLRLVLTDFTD

SEQ ID NO: 3075131 - protein, 19 aa, Giardia lamblia
LFCKDCGIDYMLSKASLDD

SEQ ID NO: 3075132 - protein, 18 aa, Giardia lamblia
LFCRVHGFNDYFFVFSGR

SEQ ID NO: 3075133 - protein, 17 aa, Giardia lamblia
LFDAHASNSLLLQRLLD

SEQ ID NO: 3075134 - protein, 18 aa, Giardia lamblia
LFDIRARKAVKEVSLRSL

SEQ ID NO: 3075135 - protein, 18 aa, Giardia lamblia
LFFGGICQNVTFRYLYSM

SEQ ID NO: 3075136 - protein, 17 aa, Giardia lamblia
LFFSEHLTPLCVHHHGL

SEQ ID NO: 3075137 - protein, 27 aa, Giardia lamblia
LFGLPGPCPACGAPSQPGASAVLAPGE

SEQ ID NO: 3075138 - protein, 27 aa, Giardia lamblia
LFGLVCLSFISSKLIYVLLKYINLVFD

SEQ ID NO: 3075139 - protein, 23 aa, Giardia lamblia
LFGNACVGINCFINATNDSGGVA

SEQ ID NO: 3075140 - protein, 17 aa, Giardia lamblia
LFGYQPFLYLMEEYAAN

SEQ ID NO: 3075141 - protein, 17 aa, Giardia lamblia
LFHLPSGLYAVVLGAMQ

SEQ ID NO: 3075142 - protein, 21 aa, Giardia lamblia
LFHPCLSQKSGGIFTPDLLEY

SEQ ID NO: 3075143 - protein, 23 aa, Giardia lamblia
LFHVLELFFLISIFMSALLRPIV

SEQ ID NO: 3075144 - protein, 26 aa, Giardia lamblia
LFHYVSWPYIWSRFFGMTFADDDMLA

SEQ ID NO: 3075145 - protein, 24 aa, Giardia lamblia
LFIIGCLLFGFFIFLEKRVTHPLI

SEQ ID NO: 3075146 - protein, 23 aa, Giardia lamblia
LFINVKIDGFWRILSKVLTIPVT

SEQ ID NO: 3075147 - protein, 26 aa, Giardia lamblia
LFLAFCATALFVVRHRLRRIHLYPPF

SEQ ID NO: 3075148 - protein, 18 aa, Giardia lamblia
LFLAMAMIITGTFNTVSR

SEQ ID NO: 3075149 - protein, 28 aa, Giardia lamblia
LFLCSTLLAPACSLGYLWVKSYHSLAEI

SEQ ID NO: 3075150 - protein, 33 aa, Giardia lamblia
LFLDCVACPFLFLKDKSFEYARDLSMQDCKGYM

SEQ ID NO: 3075151 - protein, 18 aa, Giardia lamblia
LFLKLPFISLEDFSDALD

SEQ ID NO: 3075152 - protein, 19 aa, Giardia lamblia
LFLLLRIHLEKHIFSSVMD

SEQ ID NO: 3075153 - protein, 27 aa, Giardia lamblia
LFLNNELFCLGGVKCLYDDSSYDLETR

SEQ ID NO: 3075154 - protein, 19 aa, Giardia lamblia
LFLSCTFVGYAFLHIASRE

SEQ ID NO: 3075155 - protein, 17 aa, Giardia lamblia
LFLTCLEIRIIMTVQKD

SEQ ID NO: 3075156 - protein, 22 aa, Giardia lamblia
LFMFRHLMRLGSNCYLPEQTMS

SEQ ID NO: 3075157 - protein, 18 aa, Giardia lamblia
LFMKLSSHIKLCRHKLVG

SEQ ID NO: 3075158 - protein, 18 aa, Giardia lamblia
LFNHSSSVDAVRFISQFL

SEQ ID NO: 3075159 - protein, 18 aa, Giardia lamblia
LFNRPGGAYHCLIFLSDE

SEQ ID NO: 3075160 - protein, 18 aa, Giardia lamblia
LFNVCLIITLLMGAKFVF

SEQ ID NO: 3075161 - protein, 26 aa, Giardia lamblia
LFQFQKKSICAIFKRFITPQDCVVCR

SEQ ID NO: 3075162 - protein, 17 aa, Giardia lamblia
LFQLIGLPEFYPQLKEL

SEQ ID NO: 3075163 - protein, 27 aa, Giardia lamblia
LFQRIVISLFCSWILSCAIHTHAKIFY

SEQ ID NO: 3075164 - protein, 18 aa, Giardia lamblia
LFRASAYTIICSKIRLLL

SEQ ID NO: 3075165 - protein, 19 aa, Giardia lamblia
LFRGHAWPMIHSSLVKTLL

SEQ ID NO: 3075166 - protein, 21 aa, Giardia lamblia
LFRHECLRVFADRTIADEDRN

SEQ ID NO: 3075167 - protein, 25 aa, Giardia lamblia
LFRREELRNLLNLYDERNRTRRRAR

SEQ ID NO: 3075168 - protein, 17 aa, Giardia lamblia
LFSGLGLENGTKKCFPA

SEQ ID NO: 3075169 - protein, 21 aa, Giardia lamblia
LFSGQCLFTSQILFNDMMVTM

SEQ ID NO: 3075170 - protein, 19 aa, Giardia lamblia
LFSHRIPTTSAWDCNLVLY

SEQ ID NO: 3075171 - protein, 17 aa, Giardia lamblia
LFSIPTLYFCFFLNIAI

SEQ ID NO: 3075172 - protein, 25 aa, Giardia lamblia
LFSKRLEILEAVGITSQFREEFEKK

SEQ ID NO: 3075173 - protein, 25 aa, Giardia lamblia
LFSLLFIMHGYERFFGISKDILSTL

SEQ ID NO: 3075174 - protein, 19 aa, Giardia lamblia
LFTASSVFLALRFISEITA

SEQ ID NO: 3075175 - protein, 24 aa, Giardia lamblia
LFTPLCVALLLLAIGRLEDGIFLL

SEQ ID NO: 3075176 - protein, 18 aa, Giardia lamblia
LFTRELYEDWARLYRHNV

SEQ ID NO: 3075177 - protein, 20 aa, Giardia lamblia
LFVNCCSLVAIVCILLLQVL

SEQ ID NO: 3075178 - protein, 26 aa, Giardia lamblia
LFVRLCPLCVRCFMCCCKPCKSSYQL

SEQ ID NO: 3075179 - protein, 18 aa, Giardia lamblia
LFYSTGLLGLSGRAYYCA

SEQ ID NO: 3075180 - protein, 20 aa, Giardia lamblia
LFYTDCKTFNSVVKITDIGQ

SEQ ID NO: 3075181 - protein, 20 aa, Giardia lamblia
LFYTFCIFIPNIIFLSDKPR

SEQ ID NO: 3075182 - protein, 18 aa, Giardia lamblia
LGALRIMLMYLPSSYYSS

SEQ ID NO: 3075183 - protein, 19 aa, Giardia lamblia
LGAQCWHPSCPIEVRGERN

SEQ ID NO: 3075184 - protein, 19 aa, Giardia lamblia
LGARLYLPHIFSNYVPAMP

SEQ ID NO: 3075185 - protein, 17 aa, Giardia lamblia
LGASLRCDDLGSRGADL

SEQ ID NO: 3075186 - protein, 26 aa, Giardia lamblia
LGATRRALGYYCLWREKTLAKSPTSQ

SEQ ID NO: 3075187 - protein, 20 aa, Giardia lamblia
LGCHTSLKNAVKMILEAAKH

SEQ ID NO: 3075188 - protein, 24 aa, Giardia lamblia
LGDKCLRKCPFGTYDNGDNVCARC

SEQ ID NO: 3075189 - protein, 22 aa, Giardia lamblia
LGEKRARFLSDYTAVGAGCYLF

SEQ ID NO: 3075190 - protein, 21 aa, Giardia lamblia
LGERRVLDLLLYIHAKQTNQG

SEQ ID NO: 3075191 - protein, 24 aa, Giardia lamblia
LGESICLVIFYIKRCIAKRKASAT

SEQ ID NO: 3075192 - protein, 33 aa, Giardia lamblia
LGFVVDLYIFLGLECPCAITISRYLLNMHSNRQ

SEQ ID NO: 3075193 - protein, 27 aa, Giardia lamblia
LGGAYKLKGEAVIAFEYYKTSLTHGNG

SEQ ID NO: 3075194 - protein, 17 aa, Giardia lamblia
LGGFSGISKSSFYDDDA

SEQ ID NO: 3075195 - protein, 24 aa, Giardia lamblia
LGGIFCSTCNVASPDLNSFNDLVS

SEQ ID NO: 3075196 - protein, 18 aa, Giardia lamblia
LGGMRICHFIGDLVLKAG

SEQ ID NO: 3075197 - protein, 21 aa, Giardia lamblia
LGGNCLKCADGYYKAGSDVEH

SEQ ID NO: 3075198 - protein, 25 aa, Giardia lamblia
LGGWLQRYPLTITFLPTSLYFENNG

SEQ ID NO: 3075199 - protein, 19 aa, Giardia lamblia
LGGYLPFYFPLSVPPFSRF

SEQ ID NO: 3075200 - protein, 18 aa, Giardia lamblia
LGIICCVIVIMEYLTTTF

SEQ ID NO: 3075201 - protein, 20 aa, Giardia lamblia
LGILYIFIFNTFRLIAPQLK

SEQ ID NO: 3075202 - protein, 21 aa, Giardia lamblia
LGIQMVNIFGILYCFQEIVIL

SEQ ID NO: 3075203 - protein, 20 aa, Giardia lamblia
LGKCVACPDGRLGPECSLLK

SEQ ID NO: 3075204 - protein, 17 aa, Giardia lamblia
LGLEVARADIFRQPMTT

SEQ ID NO: 3075205 - protein, 20 aa, Giardia lamblia
LGLFSLLFLTGFLFLSTDIH

SEQ ID NO: 3075206 - protein, 25 aa, Giardia lamblia
LGLGLHVHNVYVLRLWQPPFVADTV

SEQ ID NO: 3075207 - protein, 23 aa, Giardia lamblia
LGLMPLLSCLRIIKVRDMLLSHN

SEQ ID NO: 3075208 - protein, 26 aa, Giardia lamblia
LGLNPSVLRFARFAADNSGTLRDCYN

SEQ ID NO: 3075209 - protein, 17 aa, Giardia lamblia
LGLPILVGLKIPVLKAR

SEQ ID NO: 3075210 - protein, 24 aa, Giardia lamblia
LGLTIRSTLKWQLGAFRNMCIGCL

SEQ ID NO: 3075211 - protein, 24 aa, Giardia lamblia
LGLVHCGRGLMHISVTHHHGKAIS

SEQ ID NO: 3075212 - protein, 18 aa, Giardia lamblia
LGLYRMIQNLPFLPLCTF

SEQ ID NO: 3075213 - protein, 23 aa, Giardia lamblia
LGNIAWKVLCNVTYTNKEIDLSL

SEQ ID NO: 3075214 - protein, 24 aa, Giardia lamblia
LGNIFYKEIKAVMASPELDIYASS

SEQ ID NO: 3075215 - protein, 21 aa, Giardia lamblia
LGPCLVPICSLLEELLTIPNW

SEQ ID NO: 3075216 - protein, 23 aa, Giardia lamblia
LGPFKPSFSCILGANGSGKSNVI

SEQ ID NO: 3075217 - protein, 17 aa, Giardia lamblia
LGPKFAPFLAERITIEK

SEQ ID NO: 3075218 - protein, 19 aa, Giardia lamblia
LGPQRKAYRDWVITFTPSA

SEQ ID NO: 3075219 - protein, 19 aa, Giardia lamblia
LGPQRKAYRDWVITFTPSK

SEQ ID NO: 3075220 - protein, 25 aa, Giardia lamblia
LGPYSLLLHFLWPVTLDLVVGALYE

SEQ ID NO: 3075221 - protein, 19 aa, Giardia lamblia
LGQVSIKSLHFLSEIDHPK

SEQ ID NO: 3075222 - protein, 25 aa, Giardia lamblia
LGSALLELWTSIKPFDLPTLFEYRD

SEQ ID NO: 3075223 - protein, 26 aa, Giardia lamblia
LGSEHLIKTPIVFARFLRTYYKMFSD

SEQ ID NO: 3075224 - protein, 25 aa, Giardia lamblia
LGSELRVAELLAMAKPRAPLDSPFE

SEQ ID NO: 3075225 - protein, 19 aa, Giardia lamblia
LGSGLARAILITRAYGGII

SEQ ID NO: 3075226 - protein, 25 aa, Giardia lamblia
LGSICGGILYFGVPIWVYYKLPILR

SEQ ID NO: 3075227 - protein, 33 aa, Giardia lamblia
LGSLLATLLMSWPSTFVLVPLLGLFLWMFMGFR

SEQ ID NO: 3075228 - protein, 27 aa, Giardia lamblia
LGSTSRYKPFWQYFQWSVMESLPKNAA

SEQ ID NO: 3075229 - protein, 19 aa, Giardia lamblia
LGTEIDLLEALKLLCKGNM

SEQ ID NO: 3075230 - protein, 26 aa, Giardia lamblia
LGTESAFRAGALFFNDRLFNLAFLCF

SEQ ID NO: 3075231 - protein, 22 aa, Giardia lamblia
LGTIKLGMSIGFVMVAGSFVET

SEQ ID NO: 3075232 - protein, 18 aa, Giardia lamblia
LGTMLSWNVDAFHVDLRG

SEQ ID NO: 3075233 - protein, 25 aa, Giardia lamblia
LGTRLCFIEKALALPLAIASELHFI

SEQ ID NO: 3075234 - protein, 20 aa, Giardia lamblia
LGVAITAVFAILMPPTMAYA

SEQ ID NO: 3075235 - protein, 24 aa, Giardia lamblia
LGVFCSLYEPWGYTSPECCCAGTP

SEQ ID NO: 3075236 - protein, 18 aa, Giardia lamblia
LGVFFVFFITLAFFPSIT

SEQ ID NO: 3075237 - protein, 26 aa, Giardia lamblia
LGVGDGRYGQIPDYDKLYPLLRDALE

SEQ ID NO: 3075238 - protein, 19 aa, Giardia lamblia
LGVGKFLIQSCISDIKNTA

SEQ ID NO: 3075239 - protein, 21 aa, Giardia lamblia
LGVLCTEGDLASFVQASQTLL

SEQ ID NO: 3075240 - protein, 24 aa, Giardia lamblia
LGVSEFCMYGFTFGTLLIANLLAY

SEQ ID NO: 3075241 - protein, 25 aa, Giardia lamblia
LGVSHEWDMASALSKSLERGYTSGE

SEQ ID NO: 3075242 - protein, 17 aa, Giardia lamblia
LHAAVAGGLESPLDDIL

SEQ ID NO: 3075243 - protein, 19 aa, Giardia lamblia
LHAECKDDLVATFFKQFHA

SEQ ID NO: 3075244 - protein, 23 aa, Giardia lamblia
LHALKRYFVLQLYTTSQIFAFAA

SEQ ID NO: 3075245 - protein, 18 aa, Giardia lamblia
LHALPLHYVRSENLIEAH

SEQ ID NO: 3075246 - protein, 20 aa, Giardia lamblia
LHAMPAFIEKCFDGHAHDSG

SEQ ID NO: 3075247 - protein, 20 aa, Giardia lamblia
LHARLRLLGLRGHIDALRSC

SEQ ID NO: 3075248 - protein, 24 aa, Giardia lamblia
LHEIYKWILSLKVWVIKYSLDIPL

SEQ ID NO: 3075249 - protein, 22 aa, Giardia lamblia
LHENITLLLKRAELHKYGPSLL

SEQ ID NO: 3075250 - protein, 25 aa, Giardia lamblia
LHEYCKEVLRMSYRDIFIARFYPRQ

SEQ ID NO: 3075251 - protein, 26 aa, Giardia lamblia
LHFFYEFRAWFGTVIVLSILVLYFFV

SEQ ID NO: 3075252 - protein, 17 aa, Giardia lamblia
LHFGGFVGSCICNIDSS

SEQ ID NO: 3075253 - protein, 19 aa, Giardia lamblia
LHGGISMAIQRLREILLNR

SEQ ID NO: 3075254 - protein, 26 aa, Giardia lamblia
LHGLSSLYKFVIAKSIVENALETNRL

SEQ ID NO: 3075255 - protein, 19 aa, Giardia lamblia
LHHIKGALNYGLYGTPMDR

SEQ ID NO: 3075256 - protein, 18 aa, Giardia lamblia
LHHNCNLLLNTIDFLHVV

SEQ ID NO: 3075257 - protein, 24 aa, Giardia lamblia
LHIIQCILRLAFPLNNLEINGIDP

SEQ ID NO: 3075258 - protein, 24 aa, Giardia lamblia
LHITRVLGCIGSFMDAEYSLAALT

SEQ ID NO: 3075259 - protein, 26 aa, Giardia lamblia
LHKHCKKEPLMLLPICGILDDIILFR

SEQ ID NO: 3075260 - protein, 22 aa, Giardia lamblia
LHKRDLINAIAIFHLADVAMRT

SEQ ID NO: 3075261 - protein, 17 aa, Giardia lamblia
LHKTSCRALNPNLHLDT

SEQ ID NO: 3075262 - protein, 23 aa, Giardia lamblia
LHLFYPDLHKYSSFSDDVSTHHD

SEQ ID NO: 3075263 - protein, 23 aa, Giardia lamblia
LHLHMCLCLSPGTIIAGTSSTGK

SEQ ID NO: 3075264 - protein, 23 aa, Giardia lamblia
LHLLSFWCLIIVTFQTRLYFLLL

SEQ ID NO: 3075265 - protein, 27 aa, Giardia lamblia
LHLPAAHRAIEFLIRRFRADIKCVEQL

SEQ ID NO: 3075266 - protein, 17 aa, Giardia lamblia
LHLPLAVNPERDPVNES

SEQ ID NO: 3075267 - protein, 17 aa, Giardia lamblia
LHPEGIMRCYVVIDHIT

SEQ ID NO: 3075268 - protein, 25 aa, Giardia lamblia
LHPILRRTGLTWTNLNFANFSGVQI

SEQ ID NO: 3075269 - protein, 18 aa, Giardia lamblia
LHPLLLVFLVGFVQTCVP

SEQ ID NO: 3075270 - protein, 19 aa, Giardia lamblia
LHPTEHKNAILLTSGPYLD

SEQ ID NO: 3075271 - protein, 19 aa, Giardia lamblia
LHPVLKNRVTVLLYEDAKS

SEQ ID NO: 3075272 - protein, 18 aa, Giardia lamblia
LHQSCASTSRIGELLAST

SEQ ID NO: 3075273 - protein, 25 aa, Giardia lamblia
LHRIGRFDVPQVFAVYISSEEPGLH

SEQ ID NO: 3075274 - protein, 28 aa, Giardia lamblia
LHRISNRILDIMGPLVLGLGVLLLVIWL

SEQ ID NO: 3075275 - protein, 17 aa, Giardia lamblia
LHSLHLVLFSLPFSQVY

SEQ ID NO: 3075276 - protein, 25 aa, Giardia lamblia
LHSNWQSMIYLKRCSLNAALSYIQL

SEQ ID NO: 3075277 - protein, 19 aa, Giardia lamblia
LHSRFLKHCIFSLCHELQD

SEQ ID NO: 3075278 - protein, 26 aa, Giardia lamblia
LHSRLFVYARQILKVEEFSSAQRWAR

SEQ ID NO: 3075279 - protein, 25 aa, Giardia lamblia
LHSRLPLQINKRYFGLRQFLLDPPI

SEQ ID NO: 3075280 - protein, 17 aa, Giardia lamblia
LHSSHPVIFYFYNLTVL

SEQ ID NO: 3075281 - protein, 17 aa, Giardia lamblia
LHSSLKDRLLITAEKRI

SEQ ID NO: 3075282 - protein, 19 aa, Giardia lamblia
LHTGVSLGFFVPIALMLVD

SEQ ID NO: 3075283 - protein, 28 aa, Giardia lamblia
LHTNKGWTALMLASRCGYIEVVNLLVHK

SEQ ID NO: 3075284 - protein, 17 aa, Giardia lamblia
LHTRYSKCVPVFQANMF

SEQ ID NO: 3075285 - protein, 21 aa, Giardia lamblia
LHTSSPFCALKALDSILRTDA

SEQ ID NO: 3075286 - protein, 20 aa, Giardia lamblia
LHTTLFRRFITNVLTSSHYL

SEQ ID NO: 3075287 - protein, 26 aa, Giardia lamblia
LHVLKLLRRMGVADVSDFLYDVLPQL

SEQ ID NO: 3075288 - protein, 19 aa, Giardia lamblia
LHVLRCIMNVLIQSPDMTE

SEQ ID NO: 3075289 - protein, 24 aa, Giardia lamblia
LHVLSVSDTHGWVYGHAHQHDIGN

SEQ ID NO: 3075290 - protein, 19 aa, Giardia lamblia
LHYSCLVFTIPIWAGIRYM

SEQ ID NO: 3075291 - protein, 24 aa, Giardia lamblia
LHYTILRIVLLLIIVPETGTLDPM

SEQ ID NO: 3075292 - protein, 19 aa, Giardia lamblia
LHYVKSYTISVGVKQNNAT

SEQ ID NO: 3075293 - protein, 18 aa, Giardia lamblia
LIADALFYATGKFFGTFS

SEQ ID NO: 3075294 - protein, 23 aa, Giardia lamblia
LIAEYPEVFGFPANITYSEYLSH

SEQ ID NO: 3075295 - protein, 24 aa, Giardia lamblia
LIAGALRPKYLVTVDAANKEQSNP

SEQ ID NO: 3075296 - protein, 18 aa, Giardia lamblia
LIALAIAYLVSYRTRTSV

SEQ ID NO: 3075297 - protein, 24 aa, Giardia lamblia
LIALSYATINAFWFGHFLLLASRL

SEQ ID NO: 3075298 - protein, 19 aa, Giardia lamblia
LICSCSRILLSRSAAWSPM

SEQ ID NO: 3075299 - protein, 19 aa, Giardia lamblia
LIDCILKDVYRSVSLLQFL

SEQ ID NO: 3075300 - protein, 19 aa, Giardia lamblia
LIDCISLLVHYSRPAFGFG

SEQ ID NO: 3075301 - protein, 19 aa, Giardia lamblia
LIDLLRPDVFTILNRPATR

SEQ ID NO: 3075302 - protein, 24 aa, Giardia lamblia
LIDMAQRAVRHFRLVGKSMQADDT

SEQ ID NO: 3075303 - protein, 26 aa, Giardia lamblia
LIEAFNLKSAVAWILGDKEAHLNALD

SEQ ID NO: 3075304 - protein, 18 aa, Giardia lamblia
LIEDCLTLLTLIIDGSSA

SEQ ID NO: 3075305 - protein, 26 aa, Giardia lamblia
LIELQELRFSVKLLGTVKQRTDDRLL

SEQ ID NO: 3075306 - protein, 24 aa, Giardia lamblia
LIEYCIYKNLILVFVNGLFSGQCL

SEQ ID NO: 3075307 - protein, 17 aa, Giardia lamblia
LIFMFLKATMAKVDIDE

SEQ ID NO: 3075308 - protein, 18 aa, Giardia lamblia
LIFPFGSIAGMLEAVMLS

SEQ ID NO: 3075309 - protein, 30 aa, Giardia lamblia
LIFSCALSECSIDNLFLLRFILSSDLREKA

SEQ ID NO: 3075310 - protein, 24 aa, Giardia lamblia
LIGDLKLGRVSSCHHYSTNFIVNA

SEQ ID NO: 3075311 - protein, 33 aa, Giardia lamblia
LIGFGGKLILCLSSDFLNTMWLDIYPFLHAHRD

SEQ ID NO: 3075312 - protein, 17 aa, Giardia lamblia
LIGGRLYLDNEINNKYK

SEQ ID NO: 3075313 - protein, 32 aa, Giardia lamblia
LIGYSRDFFIIFKITLVKAVSSFQGHLKEKYA

SEQ ID NO: 3075314 - protein, 23 aa, Giardia lamblia
LIIDPQLQGIAWIKAREERRKEE

SEQ ID NO: 3075315 - protein, 22 aa, Giardia lamblia
LIIPVTILTYWVFTTISDSIDN

SEQ ID NO: 3075316 - protein, 21 aa, Giardia lamblia
LIIRKLRTCSLRNLDHLSNGQ

SEQ ID NO: 3075317 - protein, 23 aa, Giardia lamblia
LIKDARPTFNLRGYSREMQDLLS

SEQ ID NO: 3075318 - protein, 17 aa, Giardia lamblia
LILAAAVGKAFAVQQYI

SEQ ID NO: 3075319 - protein, 18 aa, Giardia lamblia
LILAARLNKIGIVRILAA

SEQ ID NO: 3075320 - protein, 23 aa, Giardia lamblia
LILCSLVLVGFLVYDFITIPFRI

SEQ ID NO: 3075321 - protein, 25 aa, Giardia lamblia
LILIICELEEKWLPSLLLSLGRTVV

SEQ ID NO: 3075322 - protein, 23 aa, Giardia lamblia
LILKTAISFLCFDYSPRTVENQL

SEQ ID NO: 3075323 - protein, 27 aa, Giardia lamblia
LILLEFRAGNLLDLWVLAEKQRYNVHR

SEQ ID NO: 3075324 - protein, 17 aa, Giardia lamblia
LIMELKDDMTLGNFPIS

SEQ ID NO: 3075325 - protein, 24 aa, Giardia lamblia
LIMVYRMINMISFSFTRVPFCWGG

SEQ ID NO: 3075326 - protein, 17 aa, Giardia lamblia
LINAPVVVTSSPSFIEN

SEQ ID NO: 3075327 - protein, 17 aa, Giardia lamblia
LINYSIHSLHLILRIAD

SEQ ID NO: 3075328 - protein, 18 aa, Giardia lamblia
LIPCVELFISDPNVLDTI

SEQ ID NO: 3075329 - protein, 18 aa, Giardia lamblia
LIPHEAGMRCKVSFEACG

SEQ ID NO: 3075330 - protein, 29 aa, Giardia lamblia
LIPKVKACPAFLYLRARIITNMNISLLMK

SEQ ID NO: 3075331 - protein, 25 aa, Giardia lamblia
LIPYPTDLSLLFAMVNELLTELPDT

SEQ ID NO: 3075332 - protein, 32 aa, Giardia lamblia
LIQEIIILLQYIKFGFKFLFVTSDLARIIIPA

SEQ ID NO: 3075333 - protein, 21 aa, Giardia lamblia
LIQKRCVDFAVCIADASDKAD

SEQ ID NO: 3075334 - protein, 25 aa, Giardia lamblia
LIQVPSAVQMRWAGTKGVLILNALL

SEQ ID NO: 3075335 - protein, 23 aa, Giardia lamblia
LIRKHCPVCQGTLAIVCGDHQLG

SEQ ID NO: 3075336 - protein, 20 aa, Giardia lamblia
LIRLLTPCLVELDKHNFIEI

SEQ ID NO: 3075337 - protein, 17 aa, Giardia lamblia
LIRNFSKTLGFTSFIPT

SEQ ID NO: 3075338 - protein, 22 aa, Giardia lamblia
LIRNRLALIVFDELHLIGDHTR

SEQ ID NO: 3075339 - protein, 21 aa, Giardia lamblia
LIRRNCFKAVQSLHFEVLSGV

SEQ ID NO: 3075340 - protein, 23 aa, Giardia lamblia
LISACVRMSYALSQQQIDSNIAT

SEQ ID NO: 3075341 - protein, 17 aa, Giardia lamblia
LISCLKQVILNPKLMNS

SEQ ID NO: 3075342 - protein, 17 aa, Giardia lamblia
LISMAPFLLALALLLVP

SEQ ID NO: 3075343 - protein, 17 aa, Giardia lamblia
LISRVTLYLPYLYHNIF

SEQ ID NO: 3075344 - protein, 26 aa, Giardia lamblia
LITDRFSTALAYIIAILFSFATTAVK

SEQ ID NO: 3075345 - protein, 25 aa, Giardia lamblia
LITELNPYLFRSRIDSIEHVVLSLT

SEQ ID NO: 3075346 - protein, 24 aa, Giardia lamblia
LIVAKNCIHKIGFYTAELKKIPDK

SEQ ID NO: 3075347 - protein, 28 aa, Giardia lamblia
LIVCMMCGQCFCNFCGHTHTNINIQETP

SEQ ID NO: 3075348 - protein, 20 aa, Giardia lamblia
LIVKSCEFVGYLIKARPTAS

SEQ ID NO: 3075349 - protein, 30 aa, Giardia lamblia
LIVLDLASTCIKRGIAIIRNLVTVDLMSIA

SEQ ID NO: 3075350 - protein, 20 aa, Giardia lamblia
LIVPFCFLQEQGMALEPVTS

SEQ ID NO: 3075351 - protein, 25 aa, Giardia lamblia
LIVVDLSCFRECIVAELISNRFHNP

SEQ ID NO: 3075352 - protein, 30 aa, Giardia lamblia
LIWKPGQKVPFKWSLMFALINVFVPAIIAT

SEQ ID NO: 3075353 - protein, 17 aa, Giardia lamblia
LIWYVSYIDVLAFLFNG

SEQ ID NO: 3075354 - protein, 19 aa, Giardia lamblia
LKAAGLKGRPHRSASASTS

SEQ ID NO: 3075355 - protein, 17 aa, Giardia lamblia
LKACVTNACKLDKKLAG

SEQ ID NO: 3075356 - protein, 19 aa, Giardia lamblia
LKAFSWEKQTYWLFCETDT

SEQ ID NO: 3075357 - protein, 26 aa, Giardia lamblia
LKAHSMCVTSLFWLPDTYILSSGADN

SEQ ID NO: 3075358 - protein, 25 aa, Giardia lamblia
LKAITRRRSEILGAQPSNSFDPAPS

SEQ ID NO: 3075359 - protein, 26 aa, Giardia lamblia
LKALADCPCCAVELGSDVTLSENWEP

SEQ ID NO: 3075360 - protein, 31 aa, Giardia lamblia
LKASVQPGIKFCRESPLPLILTLVLGEVDKC

SEQ ID NO: 3075361 - protein, 19 aa, Giardia lamblia
LKCESCAENAVPISPDVYH

SEQ ID NO: 3075362 - protein, 20 aa, Giardia lamblia
LKCESCAENAVPISPDVYHT

SEQ ID NO: 3075363 - protein, 22 aa, Giardia lamblia
LKCGLKKLEHCTSCGTTGKCGV

SEQ ID NO: 3075364 - protein, 17 aa, Giardia lamblia
LKDGCALPISLRNLMLD

SEQ ID NO: 3075365 - protein, 20 aa, Giardia lamblia
LKDIDEICHLSRSWRYSVIP

SEQ ID NO: 3075366 - protein, 18 aa, Giardia lamblia
LKDISMGIMQFAYAASLQ

SEQ ID NO: 3075367 - protein, 18 aa, Giardia lamblia
LKDKNGWTALMHAAHGNH

SEQ ID NO: 3075368 - protein, 23 aa, Giardia lamblia
LKDKRTQLRLGIHDSPNGVRVCR

SEQ ID NO: 3075369 - protein, 27 aa, Giardia lamblia
LKDLRRFKALRLGRDLGGRILRDKAVL

SEQ ID NO: 3075370 - protein, 17 aa, Giardia lamblia
LKDSATTCDACFEPLIM

SEQ ID NO: 3075371 - protein, 19 aa, Giardia lamblia
LKDYLGLAVKEVLLDGLDK

SEQ ID NO: 3075372 - protein, 19 aa, Giardia lamblia
LKEFMGLTYHDMVSLSGKE

SEQ ID NO: 3075373 - protein, 24 aa, Giardia lamblia
LKEIDPPLLLSRAVGCYIKSRQYG

SEQ ID NO: 3075374 - protein, 17 aa, Giardia lamblia
LKELLYWLTEGAPLRIG

SEQ ID NO: 3075375 - protein, 20 aa, Giardia lamblia
LKEQFIMIMAGLRGAISFAL

SEQ ID NO: 3075376 - protein, 18 aa, Giardia lamblia
LKEQIVLASHTQLQAKPL

SEQ ID NO: 3075377 - protein, 21 aa, Giardia lamblia
LKEQQCWFIRAPDYELMYRYM

SEQ ID NO: 3075378 - protein, 20 aa, Giardia lamblia
LKERSDRVGLPWYESPNSIL

SEQ ID NO: 3075379 - protein, 22 aa, Giardia lamblia
LKETEEWIYMRLGYDLCTTSLL

SEQ ID NO: 3075380 - protein, 23 aa, Giardia lamblia
LKETSELAYICAHLNDDMSMAST

SEQ ID NO: 3075381 - protein, 20 aa, Giardia lamblia
LKETVCATGAIVDYTIQKYR

SEQ ID NO: 3075382 - protein, 18 aa, Giardia lamblia
LKEYAGTIIELFNLGSLL

SEQ ID NO: 3075383 - protein, 17 aa, Giardia lamblia
LKFLGLILGCIVAFVII

SEQ ID NO: 3075384 - protein, 17 aa, Giardia lamblia
LKFSPMVISTDPYKPPT

SEQ ID NO: 3075385 - protein, 23 aa, Giardia lamblia
LKGAEILRQLVWSVLDKLHARAF

SEQ ID NO: 3075386 - protein, 30 aa, Giardia lamblia
LKGDFRTGKKLNLRRIIPFIASEFQKDKIW

SEQ ID NO: 3075387 - protein, 20 aa, Giardia lamblia
LKGLSSWITEAAFIPFLRRL

SEQ ID NO: 3075388 - protein, 21 aa, Giardia lamblia
LKGSPEFANMLYSYMLDASND

SEQ ID NO: 3075389 - protein, 19 aa, Giardia lamblia
LKGTCTRAGSCICDDPHTW

SEQ ID NO: 3075390 - protein, 27 aa, Giardia lamblia
LKGVKSLRDMGHMLPLYQEIYEVYIIE

SEQ ID NO: 3075391 - protein, 22 aa, Giardia lamblia
LKHHIIIRTSLALGLLSFSREI

SEQ ID NO: 3075392 - protein, 28 aa, Giardia lamblia
LKHKGSHAFRYLPILARDLMLDNVYPVL

SEQ ID NO: 3075393 - protein, 19 aa, Giardia lamblia
LKHKVVRQLVSFGNEPVVL

SEQ ID NO: 3075394 - protein, 19 aa, Giardia lamblia
LKHRLGAASPKYRNTTLLR

SEQ ID NO: 3075395 - protein, 29 aa, Giardia lamblia
LKHSGTCSVIRGISPFAKREEVLQRLDEA

SEQ ID NO: 3075396 - protein, 25 aa, Giardia lamblia
LKKNDIRSVITFDLMLPLSTSTITD

SEQ ID NO: 3075397 - protein, 18 aa, Giardia lamblia
LKKQSIFFDVQYGIENRD

SEQ ID NO: 3075398 - protein, 22 aa, Giardia lamblia
LKKTPWISWALSNKEIVVNDDE

SEQ ID NO: 3075399 - protein, 17 aa, Giardia lamblia
LKKYISKWRMHLDSCCS

SEQ ID NO: 3075400 - protein, 17 aa, Giardia lamblia
LKLAPCVITSRPTEDDF

SEQ ID NO: 3075401 - protein, 27 aa, Giardia lamblia
LKLDLARPYIKRVLQNCMKELMMPPML

SEQ ID NO: 3075402 - protein, 18 aa, Giardia lamblia
LKLFGVHIPSFFISTIPW

SEQ ID NO: 3075403 - protein, 22 aa, Giardia lamblia
LKLGSNAHQCFAALFQDLLSQG

SEQ ID NO: 3075404 - protein, 22 aa, Giardia lamblia
LKLILDPHDSWNLILHGVLSKV

SEQ ID NO: 3075405 - protein, 17 aa, Giardia lamblia
LKLLLRIIHTCNESNPS

SEQ ID NO: 3075406 - protein, 20 aa, Giardia lamblia
LKLLMIVLFLVFQIDRSALA

SEQ ID NO: 3075407 - protein, 26 aa, Giardia lamblia
LKLMPTCLHVPMGWVSFGISRPSEMH

SEQ ID NO: 3075408 - protein, 25 aa, Giardia lamblia
LKLNNTCYANICIRGTVSNQNACTC

SEQ ID NO: 3075409 - protein, 19 aa, Giardia lamblia
LKLNTPVAWVPTILLTILM

SEQ ID NO: 3075410 - protein, 22 aa, Giardia lamblia
LKLPLPIIPIFCRSSIIKQILL

SEQ ID NO: 3075411 - protein, 21 aa, Giardia lamblia
LKLPWMPVPAYGKVFDGKGHT

SEQ ID NO: 3075412 - protein, 18 aa, Giardia lamblia
LKLYLTLFQEELDNPTIL

SEQ ID NO: 3075413 - protein, 27 aa, Giardia lamblia
LKNYLDMVLAFLMRYAKESLKFAERLL

SEQ ID NO: 3075414 - protein, 26 aa, Giardia lamblia
LKQNRYPWQWKVYKHILLSSIPHYLK

SEQ ID NO: 3075415 - protein, 22 aa, Giardia lamblia
LKQRMNDILAKWNIADDSYWDE

SEQ ID NO: 3075416 - protein, 28 aa, Giardia lamblia
LKQRPMARRSFLRFALLLQAGDRIYKQL

SEQ ID NO: 3075417 - protein, 18 aa, Giardia lamblia
LKRCSLNAALSYIQLSDT

SEQ ID NO: 3075418 - protein, 22 aa, Giardia lamblia
LKRDRSGRDIFYYVENTVQYEH

SEQ ID NO: 3075419 - protein, 20 aa, Giardia lamblia
LKSDRGKLGFSERRLSKTKH

SEQ ID NO: 3075420 - protein, 23 aa, Giardia lamblia
LKSGHLDIALALHDLERQDHSLV

SEQ ID NO: 3075421 - protein, 20 aa, Giardia lamblia
LKSGQAISELEAFVMAFDSA

SEQ ID NO: 3075422 - protein, 23 aa, Giardia lamblia
LKSIDSATCLPFLSSLSDCLRRR

SEQ ID NO: 3075423 - protein, 22 aa, Giardia lamblia
LKSIHIPDVIIIASRLSNFIAV

SEQ ID NO: 3075424 - protein, 24 aa, Giardia lamblia
LKSKPAARLLLRVGSDSLERNDAS

SEQ ID NO: 3075425 - protein, 20 aa, Giardia lamblia
LKSLLPYLIEQLELCQKSLS

SEQ ID NO: 3075426 - protein, 17 aa, Giardia lamblia
LKSNGIVLPTSVSTKPL

SEQ ID NO: 3075427 - protein, 18 aa, Giardia lamblia
LKSRKPNVALSFRMDSLD

SEQ ID NO: 3075428 - protein, 18 aa, Giardia lamblia
LKTALDMYKSGLVGTTTE

SEQ ID NO: 3075429 - protein, 18 aa, Giardia lamblia
LKTARAHLCLYICMIVMP

SEQ ID NO: 3075430 - protein, 17 aa, Giardia lamblia
LKTARAHLYLYICMIVM

SEQ ID NO: 3075431 - protein, 21 aa, Giardia lamblia
LKTARVHLCLYICMIVMPVVV

SEQ ID NO: 3075432 - protein, 20 aa, Giardia lamblia
LKTLCWTSMSIGGYLDNIQK

SEQ ID NO: 3075433 - protein, 17 aa, Giardia lamblia
LKTLFQKAGVENKNIVF

SEQ ID NO: 3075434 - protein, 22 aa, Giardia lamblia
LKTTYICPICRDDLSNAFLVGC

SEQ ID NO: 3075435 - protein, 23 aa, Giardia lamblia
LKVKHRLQSIVTRFNRFRSLLCT

SEQ ID NO: 3075436 - protein, 19 aa, Giardia lamblia
LKVLDPWARMLPSVEKAPK

SEQ ID NO: 3075437 - protein, 24 aa, Giardia lamblia
LKVRFDYGGTILLTIAVTSFCLLF

SEQ ID NO: 3075438 - protein, 17 aa, Giardia lamblia
LKVTRVVEVLVELGHGV

SEQ ID NO: 3075439 - protein, 19 aa, Giardia lamblia
LKYASLLTKQLQAVFRDSL

SEQ ID NO: 3075440 - protein, 18 aa, Giardia lamblia
LKYCTCDVLPLLKETNYI

SEQ ID NO: 3075441 - protein, 17 aa, Giardia lamblia
LKYFSYEHFYVIFCKFW

SEQ ID NO: 3075442 - protein, 31 aa, Giardia lamblia
LKYMFYKNWLADCREYFVKFIGVLVVNVAAT

SEQ ID NO: 3075443 - protein, 19 aa, Giardia lamblia
LLAALGVPLFFSPLAWLSI

SEQ ID NO: 3075444 - protein, 19 aa, Giardia lamblia
LLADCMGALDPFLSVHTVR

SEQ ID NO: 3075445 - protein, 22 aa, Giardia lamblia
LLAEFYRARLLHTMGKVSAANE

SEQ ID NO: 3075446 - protein, 20 aa, Giardia lamblia
LLAEQCWRSLSAKGYSHDYC

SEQ ID NO: 3075447 - protein, 25 aa, Giardia lamblia
LLAGSMLWGFVTWKYLHVALGLSLI

SEQ ID NO: 3075448 - protein, 18 aa, Giardia lamblia
LLAHMCKLITGRLNLLPR

SEQ ID NO: 3075449 - protein, 23 aa, Giardia lamblia
LLAIRACPSHGFRLTSDIDARSY

SEQ ID NO: 3075450 - protein, 20 aa, Giardia lamblia
LLAIVCFAAVLAILAILMSI

SEQ ID NO: 3075451 - protein, 20 aa, Giardia lamblia
LLAKRYKRAITLGHWLGFLV

SEQ ID NO: 3075452 - protein, 20 aa, Giardia lamblia
LLALACFFLNLGTDPTRPFD

SEQ ID NO: 3075453 - protein, 23 aa, Giardia lamblia
LLALWCVLAGIIAIPLVEQKGRR

SEQ ID NO: 3075454 - protein, 19 aa, Giardia lamblia
LLANLLWNEVVDFEMKVSA

SEQ ID NO: 3075455 - protein, 18 aa, Giardia lamblia
LLAQRIAGINKRYYQLTT

SEQ ID NO: 3075456 - protein, 24 aa, Giardia lamblia
LLARLRSMCQFVSCNSQTYLVSPC

SEQ ID NO: 3075457 - protein, 25 aa, Giardia lamblia
LLAVAPRLPAFVYLLSPNPCSNAVH

SEQ ID NO: 3075458 - protein, 25 aa, Giardia lamblia
LLCMMKLSHTLIVFDFQTFQQKVYE

SEQ ID NO: 3075459 - protein, 18 aa, Giardia lamblia
LLCPSPPACGTCLSDYDL

SEQ ID NO: 3075460 - protein, 19 aa, Giardia lamblia
LLCQCLYQSIIYALTVVFC

SEQ ID NO: 3075461 - protein, 25 aa, Giardia lamblia
LLCQLPIRTASIWDHLLACKDHYTN

SEQ ID NO: 3075462 - protein, 27 aa, Giardia lamblia
LLCSACYERIRQALLLQKDRNARDAAI

SEQ ID NO: 3075463 - protein, 22 aa, Giardia lamblia
LLCYVCFFTTLLMHVNRRRYTT

SEQ ID NO: 3075464 - protein, 23 aa, Giardia lamblia
LLDCSMLCLLLIVGSNKKRLADY

SEQ ID NO: 3075465 - protein, 18 aa, Giardia lamblia
LLDLTGSVTLAFQVFLLS

SEQ ID NO: 3075466 - protein, 25 aa, Giardia lamblia
LLDRDLRPSYHMAVCTHACMHYSSR

SEQ ID NO: 3075467 - protein, 21 aa, Giardia lamblia
LLEACYKRSVLSILETISLSA

SEQ ID NO: 3075468 - protein, 22 aa, Giardia lamblia
LLEASDFILAISDIMVYSQTGS

SEQ ID NO: 3075469 - protein, 17 aa, Giardia lamblia
LLEFSSGYCCRLEKDES

SEQ ID NO: 3075470 - protein, 17 aa, Giardia lamblia
LLEGSRAFSDVILTASH

SEQ ID NO: 3075471 - protein, 25 aa, Giardia lamblia
LLEIIRPAYGTSIVMLVDKVTLRSL

SEQ ID NO: 3075472 - protein, 20 aa, Giardia lamblia
LLEIQVLHFHLCLRNMVNQI

SEQ ID NO: 3075473 - protein, 25 aa, Giardia lamblia
LLELIKNCLYISVNMRSTISQLRSH

SEQ ID NO: 3075474 - protein, 17 aa, Giardia lamblia
LLELRKSMGSDALAREI

SEQ ID NO: 3075475 - protein, 23 aa, Giardia lamblia
LLEPIELPKGVFLVSDKIIRNIA

SEQ ID NO: 3075476 - protein, 23 aa, Giardia lamblia
LLESGFDCQRLFNAVEEDVKTAI

SEQ ID NO: 3075477 - protein, 25 aa, Giardia lamblia
LLFGRHPASLCLHILVSKLPPPEDG

SEQ ID NO: 3075478 - protein, 18 aa, Giardia lamblia
LLFLPQILNFVLSVPQLF

SEQ ID NO: 3075479 - protein, 23 aa, Giardia lamblia
LLFLRMLIYFNSFINFTLTNFNY

SEQ ID NO: 3075480 - protein, 17 aa, Giardia lamblia
LLFMLYGSVSLIFLCFV

SEQ ID NO: 3075481 - protein, 31 aa, Giardia lamblia
LLFNVPLLKYWLERLGALTVTLPIASEVIVR

SEQ ID NO: 3075482 - protein, 17 aa, Giardia lamblia
LLFRKSTVHSFLCHTLF

SEQ ID NO: 3075483 - protein, 17 aa, Giardia lamblia
LLFVHGHYTHLRNSELI

SEQ ID NO: 3075484 - protein, 17 aa, Giardia lamblia
LLGDIHGRLGLARIVEE

SEQ ID NO: 3075485 - protein, 17 aa, Giardia lamblia
LLGECLIIDSSELRMLI

SEQ ID NO: 3075486 - protein, 23 aa, Giardia lamblia
LLGLCIHLRIYPIIFTPFLLLYA

SEQ ID NO: 3075487 - protein, 17 aa, Giardia lamblia
LLGLKLFSTLAHIGSAR

SEQ ID NO: 3075488 - protein, 24 aa, Giardia lamblia
LLGLSLEYVDPVAYLRSNDANTAT

SEQ ID NO: 3075489 - protein, 18 aa, Giardia lamblia
LLGLYAYPLLNLRRPITT

SEQ ID NO: 3075490 - protein, 30 aa, Giardia lamblia
LLGPTGIHGCFYWELVKMVSLIQENAPAFI

SEQ ID NO: 3075491 - protein, 17 aa, Giardia lamblia
LLGSAIYVDAKRQEVSL

SEQ ID NO: 3075492 - protein, 17 aa, Giardia lamblia
LLHEICFGNRISALHDK

SEQ ID NO: 3075493 - protein, 18 aa, Giardia lamblia
LLHELNRPLIAADLAVPS

SEQ ID NO: 3075494 - protein, 29 aa, Giardia lamblia
LLHIFWPLVECYHGGQLKSHIILMSNSIL

SEQ ID NO: 3075495 - protein, 17 aa, Giardia lamblia
LLHKNLLIDLKEYFISF

SEQ ID NO: 3075496 - protein, 18 aa, Giardia lamblia
LLHLFKRDILAVSPFTEN

SEQ ID NO: 3075497 - protein, 21 aa, Giardia lamblia
LLHRNMRLLDAIVPFISSIHD

SEQ ID NO: 3075498 - protein, 27 aa, Giardia lamblia
LLIASAKYSPFVAVFFGTYLALFEVMP

SEQ ID NO: 3075499 - protein, 17 aa, Giardia lamblia
LLIDETWMVLASDGTNI

SEQ ID NO: 3075500 - protein, 29 aa, Giardia lamblia
LLIDLKEYFISFIVIFLLILCLCLVVING

SEQ ID NO: 3075501 - protein, 18 aa, Giardia lamblia
LLIECMRTKPLEIKKIII

SEQ ID NO: 3075502 - protein, 24 aa, Giardia lamblia
LLIGARLRYDMSLGKDGLIDYINW

SEQ ID NO: 3075503 - protein, 17 aa, Giardia lamblia
LLIGVGLGHVFYFLYDI

SEQ ID NO: 3075504 - protein, 26 aa, Giardia lamblia
LLIIAAVALACWLVLRRRRGSKIVSR

SEQ ID NO: 3075505 - protein, 25 aa, Giardia lamblia
LLIIVAVALACWFVLRRRRESRAAL

SEQ ID NO: 3075506 - protein, 36 aa, Giardia lamblia
LLIKSFRYDRQMFPALFRLLLLVTIFQPISIEEQQS

SEQ ID NO: 3075507 - protein, 17 aa, Giardia lamblia
LLIRELGHLDINGFTAL

SEQ ID NO: 3075508 - protein, 25 aa, Giardia lamblia
LLKHVKRAPGAIMHALAEKIGVDAP

SEQ ID NO: 3075509 - protein, 19 aa, Giardia lamblia
LLKKCKAGAIIAEPTGAPT

SEQ ID NO: 3075510 - protein, 18 aa, Giardia lamblia
LLKNLGMKAIRSTSSEMG

SEQ ID NO: 3075511 - protein, 18 aa, Giardia lamblia
LLKQRKHSVLDTRASVAC

SEQ ID NO: 3075512 - protein, 24 aa, Giardia lamblia
LLKSLEKRAIIVTKLITLIHMADF

SEQ ID NO: 3075513 - protein, 18 aa, Giardia lamblia
LLKYPKYRSNSLYMEVVT

SEQ ID NO: 3075514 - protein, 18 aa, Giardia lamblia
LLLAGSLSMLPSHSFPIA

SEQ ID NO: 3075515 - protein, 25 aa, Giardia lamblia
LLLARRLEVSLGLVYAFLVMFSGEL

SEQ ID NO: 3075516 - protein, 26 aa, Giardia lamblia
LLLDIRTLLYSGFFLLGSCHRLASHF

SEQ ID NO: 3075517 - protein, 24 aa, Giardia lamblia
LLLELKMYVCDESKNASKSSVVPI

SEQ ID NO: 3075518 - protein, 17 aa, Giardia lamblia
LLLIAALGAFLSVDSMV

SEQ ID NO: 3075519 - protein, 17 aa, Giardia lamblia
LLLIYRVDSPDFLQLFG

SEQ ID NO: 3075520 - protein, 20 aa, Giardia lamblia
LLLKMYAMLPPLGPQGKAYR

SEQ ID NO: 3075521 - protein, 20 aa, Giardia lamblia
LLLKMYAMLPPLGPQRKAYR

SEQ ID NO: 3075522 - protein, 18 aa, Giardia lamblia
LLLLLPDLCSISLGSAHP

SEQ ID NO: 3075523 - protein, 19 aa, Giardia lamblia
LLLLRSALISISRVSMLLP

SEQ ID NO: 3075524 - protein, 19 aa, Giardia lamblia
LLLNASFCHAFFFQTRVLL

SEQ ID NO: 3075525 - protein, 17 aa, Giardia lamblia
LLLPHLFLCVFIKLFEI

SEQ ID NO: 3075526 - protein, 17 aa, Giardia lamblia
LLLRIMIIIPLFLLLAL

SEQ ID NO: 3075527 - protein, 18 aa, Giardia lamblia
LLLSLCFFSYAKSILYKT

SEQ ID NO: 3075528 - protein, 21 aa, Giardia lamblia
LLLSLCIKASTLFVDENGHTR

SEQ ID NO: 3075529 - protein, 24 aa, Giardia lamblia
LLLVLERILSLWVAVPLFISQFDE

SEQ ID NO: 3075530 - protein, 31 aa, Giardia lamblia
LLLVLKARGAFTLGFSFLMTYRLQRLALSLH

SEQ ID NO: 3075531 - protein, 18 aa, Giardia lamblia
LLMFIVSPLMIFALVEEK

SEQ ID NO: 3075532 - protein, 23 aa, Giardia lamblia
LLNALICIAIFFAAKPTLRKVIL

SEQ ID NO: 3075533 - protein, 25 aa, Giardia lamblia
LLNGRISIEYSRYLLFRKSTVHSFL

SEQ ID NO: 3075534 - protein, 17 aa, Giardia lamblia
LLNNWLFETPKPHFPVL

SEQ ID NO: 3075535 - protein, 24 aa, Giardia lamblia
LLNRMKRAKGSSIFLESYKAPIPQ

SEQ ID NO: 3075536 - protein, 24 aa, Giardia lamblia
LLPEEKAWYSGHPVIVCPKLLNTI

SEQ ID NO: 3075537 - protein, 20 aa, Giardia lamblia
LLPEIIFLQSVVSLEATQGR

SEQ ID NO: 3075538 - protein, 27 aa, Giardia lamblia
LLPFPERVKLGLFLTIMLFDLGAIISP

SEQ ID NO: 3075539 - protein, 20 aa, Giardia lamblia
LLPGGVCSFFDSLKATCGSF

SEQ ID NO: 3075540 - protein, 18 aa, Giardia lamblia
LLPLQPDGAVSAWLSSTA

SEQ ID NO: 3075541 - protein, 25 aa, Giardia lamblia
LLPVSPRFHYPKVFQPITARVFAAR

SEQ ID NO: 3075542 - protein, 17 aa, Giardia lamblia
LLQEPRTASALVTSANL

SEQ ID NO: 3075543 - protein, 32 aa, Giardia lamblia
LLQIFRALKVGLAFTYYLPLIFIFLVSIGREL

SEQ ID NO: 3075544 - protein, 19 aa, Giardia lamblia
LLQKNFWGATLAFMNARMV

SEQ ID NO: 3075545 - protein, 28 aa, Giardia lamblia
LLQSHQDTICRFFKNEISTLPSTIIVRF

SEQ ID NO: 3075546 - protein, 25 aa, Giardia lamblia
LLRDDCSQIFKALRKPSIISNIKVQ

SEQ ID NO: 3075547 - protein, 20 aa, Giardia lamblia
LLRHDFPSFISFYKMHLASR

SEQ ID NO: 3075548 - protein, 18 aa, Giardia lamblia
LLRHISFQNPVDIIPNIV

SEQ ID NO: 3075549 - protein, 17 aa, Giardia lamblia
LLRHPLKKSGLRNKKLA

SEQ ID NO: 3075550 - protein, 36 aa, Giardia lamblia
LLRIVGEAKLNLLLGKLKQRGCSTFNASNLLSEAST

SEQ ID NO: 3075551 - protein, 17 aa, Giardia lamblia
LLRLVHTCCRLSTKVTG

SEQ ID NO: 3075552 - protein, 24 aa, Giardia lamblia
LLRRLCSTCTIVPDELWGKSWSTM

SEQ ID NO: 3075553 - protein, 24 aa, Giardia lamblia
LLRSFPLPACCYVHRYIDGTNPRL

SEQ ID NO: 3075554 - protein, 23 aa, Giardia lamblia
LLRVLPSVYLRGLFIAIGDTEYR

SEQ ID NO: 3075555 - protein, 23 aa, Giardia lamblia
LLRYADLALEMRFGMSQDLLNGR

SEQ ID NO: 3075556 - protein, 27 aa, Giardia lamblia
LLSCLKCKSGSFLDLFRRTCITQCPQN

SEQ ID NO: 3075557 - protein, 20 aa, Giardia lamblia
LLSCSSQLLSDVLRKRFGFT

SEQ ID NO: 3075558 - protein, 18 aa, Giardia lamblia
LLSDGVKRRDRWGRTALM

SEQ ID NO: 3075559 - protein, 41 aa, Giardia lamblia
LLSELFYLHFGGRMFIPFVLCFCGSLAWRTLLRGFCVAIAQ

SEQ ID NO: 3075560 - protein, 17 aa, Giardia lamblia
LLSILPFVPVSDEVAQS

SEQ ID NO: 3075561 - protein, 25 aa, Giardia lamblia
LLSIYEYYNYLTIGDNLKWGVLCPC

SEQ ID NO: 3075562 - protein, 23 aa, Giardia lamblia
LLSLFLLLSCDTFVTNWKLTYSL

SEQ ID NO: 3075563 - protein, 18 aa, Giardia lamblia
LLSLVRRVSVFAGSVEES

SEQ ID NO: 3075564 - protein, 26 aa, Giardia lamblia
LLSNAFRLTNLDSMILILEIVETGSN

SEQ ID NO: 3075565 - protein, 17 aa, Giardia lamblia
LLSNANLSFGIGVDTQA

SEQ ID NO: 3075566 - protein, 27 aa, Giardia lamblia
LLSRIYRPIAALIFPPALKPLTMEQQI

SEQ ID NO: 3075567 - protein, 21 aa, Giardia lamblia
LLSSKCIAHSLTVSCSAFTNV

SEQ ID NO: 3075568 - protein, 21 aa, Giardia lamblia
LLSSLRPVYAIIEEQYNHITN

SEQ ID NO: 3075569 - protein, 25 aa, Giardia lamblia
LLSSRRKREAYAYVDLLSHAQKNMI

SEQ ID NO: 3075570 - protein, 18 aa, Giardia lamblia
LLSSVACIMCEEYVRTMR

SEQ ID NO: 3075571 - protein, 17 aa, Giardia lamblia
LLTASLLLFSRSRHVFS

SEQ ID NO: 3075572 - protein, 17 aa, Giardia lamblia
LLTEKYPTIPLYGFSMV

SEQ ID NO: 3075573 - protein, 29 aa, Giardia lamblia
LLTGDILFFDSDWIRFFIRVTKDSYQSNV

SEQ ID NO: 3075574 - protein, 19 aa, Giardia lamblia
LLTKCDYYMAAAWFVLAAD

SEQ ID NO: 3075575 - protein, 17 aa, Giardia lamblia
LLTLLSISNCLLVTVPA

SEQ ID NO: 3075576 - protein, 19 aa, Giardia lamblia
LLTMWRIEIAPVLPSKLCQ

SEQ ID NO: 3075577 - protein, 25 aa, Giardia lamblia
LLVDRRMLSIFAIYLISAQIPRLVP

SEQ ID NO: 3075578 - protein, 28 aa, Giardia lamblia
LLVHYSRPAFGFGEGFLMHLSAIIYSNL

SEQ ID NO: 3075579 - protein, 19 aa, Giardia lamblia
LLVLFIRRQLWFTKHYMCY

SEQ ID NO: 3075580 - protein, 17 aa, Giardia lamblia
LLVPFMFLRDASKLSRI

SEQ ID NO: 3075581 - protein, 17 aa, Giardia lamblia
LLVQVLYDPDGLFSIIE

SEQ ID NO: 3075582 - protein, 19 aa, Giardia lamblia
LLVVCGILLASLYAMEKQQ

SEQ ID NO: 3075583 - protein, 17 aa, Giardia lamblia
LLVVIWVAIQMYFNTPR

SEQ ID NO: 3075584 - protein, 17 aa, Giardia lamblia
LLWLCSRNLAIVILEGG

SEQ ID NO: 3075585 - protein, 18 aa, Giardia lamblia
LLWPLLGGGVEQEEVHNC

SEQ ID NO: 3075586 - protein, 19 aa, Giardia lamblia
LLYEQRVRYYTAFLHSCDI

SEQ ID NO: 3075587 - protein, 19 aa, Giardia lamblia
LLYFLWILVSYPFMRISGR

SEQ ID NO: 3075588 - protein, 26 aa, Giardia lamblia
LLYGFTSLLLLCFVKPPLEQNTAAQI

SEQ ID NO: 3075589 - protein, 24 aa, Giardia lamblia
LLYGSFLVSYSFYLQALKQPSPFD

SEQ ID NO: 3075590 - protein, 17 aa, Giardia lamblia
LLYIGTILRYEVTRLKN

SEQ ID NO: 3075591 - protein, 17 aa, Giardia lamblia
LLYLAAVNLRLSGNHDL

SEQ ID NO: 3075592 - protein, 18 aa, Giardia lamblia
LLYLKWRRAASLCRIAFI

SEQ ID NO: 3075593 - protein, 17 aa, Giardia lamblia
LLYLREEHICIQFSPSC

SEQ ID NO: 3075594 - protein, 22 aa, Giardia lamblia
LLYLRLHLHLLIFYFITAYSKK

SEQ ID NO: 3075595 - protein, 22 aa, Giardia lamblia
LLYNVMCIYLMALAYKCPQSTH

SEQ ID NO: 3075596 - protein, 23 aa, Giardia lamblia
LLYRLIMHSVLYAKRVHWELDVE

SEQ ID NO: 3075597 - protein, 18 aa, Giardia lamblia
LLYWSRPSDKWVELPSRI

SEQ ID NO: 3075598 - protein, 18 aa, Giardia lamblia
LMAACRKPLESVSVDDMY

SEQ ID NO: 3075599 - protein, 17 aa, Giardia lamblia
LMACCGLGDVQCSSAAE

SEQ ID NO: 3075600 - protein, 19 aa, Giardia lamblia
LMAGKVVRTGRSFNYISGV

SEQ ID NO: 3075601 - protein, 19 aa, Giardia lamblia
LMAILRVCAAEHDAKALYK

SEQ ID NO: 3075602 - protein, 30 aa, Giardia lamblia
LMALFYAVFFFFRLATPFSLQETGIPAIPT

SEQ ID NO: 3075603 - protein, 18 aa, Giardia lamblia
LMALGFSPLLGFVDLSYF

SEQ ID NO: 3075604 - protein, 17 aa, Giardia lamblia
LMARSLRNKYLVPYLDT

SEQ ID NO: 3075605 - protein, 19 aa, Giardia lamblia
LMAYCPLAISRAVRHMLLD

SEQ ID NO: 3075606 - protein, 25 aa, Giardia lamblia
LMDINGRTALMYSVEHDRLDIARRL

SEQ ID NO: 3075607 - protein, 26 aa, Giardia lamblia
LMDLYMAYNVFGFCRYFRDHVDHSFA

SEQ ID NO: 3075608 - protein, 21 aa, Giardia lamblia
LMETGITFQLRNNWVDINNFL

SEQ ID NO: 3075609 - protein, 25 aa, Giardia lamblia
LMFPVYRFLFSFVRVNALFRFFFKF

SEQ ID NO: 3075610 - protein, 18 aa, Giardia lamblia
LMGLCPTLLSISEDTLSE

SEQ ID NO: 3075611 - protein, 19 aa, Giardia lamblia
LMGLLGAATRVFHKCISVN

SEQ ID NO: 3075612 - protein, 24 aa, Giardia lamblia
LMGLRSDLFITYGTYLAMCIYEAW

SEQ ID NO: 3075613 - protein, 19 aa, Giardia lamblia
LMGRSLRASMMNIDGVQTF

SEQ ID NO: 3075614 - protein, 25 aa, Giardia lamblia
LMHDLHLPPLRILKMTPAIRSLRKL

SEQ ID NO: 3075615 - protein, 27 aa, Giardia lamblia
LMIAAALNLPLAVSMLVSHEKRFTKRI

SEQ ID NO: 3075616 - protein, 18 aa, Giardia lamblia
LMKLQMMQLRSMKANMRF

SEQ ID NO: 3075617 - protein, 17 aa, Giardia lamblia
LMLAEAFAQQGSVSGTF

SEQ ID NO: 3075618 - protein, 19 aa, Giardia lamblia
LMLCDYSRAHSLRSQLADI

SEQ ID NO: 3075619 - protein, 19 aa, Giardia lamblia
LMLESCFNFDREIVAVRTL

SEQ ID NO: 3075620 - protein, 18 aa, Giardia lamblia
LMLPHMFWGISDVAQYID

SEQ ID NO: 3075621 - protein, 18 aa, Giardia lamblia
LMPAYCIMTVLAQLEGRS

SEQ ID NO: 3075622 - protein, 22 aa, Giardia lamblia
LMQARSWLFSTLLREIEAAVSE

SEQ ID NO: 3075623 - protein, 22 aa, Giardia lamblia
LMQCVCLPRGYAHSIPMRPPSS

SEQ ID NO: 3075624 - protein, 21 aa, Giardia lamblia
LMRAAEMDYIMGVKLLSEHET

SEQ ID NO: 3075625 - protein, 20 aa, Giardia lamblia
LMRCESGMRSSNGWTALMWA

SEQ ID NO: 3075626 - protein, 17 aa, Giardia lamblia
LMRYYLPSFGLPLASCM

SEQ ID NO: 3075627 - protein, 17 aa, Giardia lamblia
LMSGRLSTMLVVGNTGN

SEQ ID NO: 3075628 - protein, 18 aa, Giardia lamblia
LMSLFGFLFFMTSSSFDV

SEQ ID NO: 3075629 - protein, 17 aa, Giardia lamblia
LMSLRYEQQVSVANHLV

SEQ ID NO: 3075630 - protein, 24 aa, Giardia lamblia
LMSMRESYPFIYAMKQNPAAITSF

SEQ ID NO: 3075631 - protein, 25 aa, Giardia lamblia
LMTILRYKLSLKKREIIFIVPNYKG

SEQ ID NO: 3075632 - protein, 23 aa, Giardia lamblia
LMTPSRLLVGLSRGVAELVSTLD

SEQ ID NO: 3075633 - protein, 18 aa, Giardia lamblia
LMVGHYPLIHGDHYAYQA

SEQ ID NO: 3075634 - protein, 23 aa, Giardia lamblia
LMVIMYMPRIRAMGKPTEDFDDR

SEQ ID NO: 3075635 - protein, 26 aa, Giardia lamblia
LNAAKPAPLRPGLLYGTESNPLSALN

SEQ ID NO: 3075636 - protein, 22 aa, Giardia lamblia
LNADIAYAKAIICENIGELEES

SEQ ID NO: 3075637 - protein, 18 aa, Giardia lamblia
LNAFSYQANQCFSASSAK

SEQ ID NO: 3075638 - protein, 17 aa, Giardia lamblia
LNAHLCKLKSGTVRAVA

SEQ ID NO: 3075639 - protein, 25 aa, Giardia lamblia
LNASGLNPNKGWVILSIIDVAHFLQ

SEQ ID NO: 3075640 - protein, 20 aa, Giardia lamblia
LNCNFLINFTGCSSVGKTEL

SEQ ID NO: 3075641 - protein, 29 aa, Giardia lamblia
LNDCSPLNRPYCVLLFLSLMGSGDVSSAF

SEQ ID NO: 3075642 - protein, 25 aa, Giardia lamblia
LNDIHLKLSYSYVHPITGKYLWLLV

SEQ ID NO: 3075643 - protein, 27 aa, Giardia lamblia
LNDKELRLGWLLPFRLGTPPAPNLLGK

SEQ ID NO: 3075644 - protein, 18 aa, Giardia lamblia
LNEAGALVYMITAEIYTN

SEQ ID NO: 3075645 - protein, 25 aa, Giardia lamblia
LNEEEIRGSPILNMVEHKLIPAFLG

SEQ ID NO: 3075646 - protein, 21 aa, Giardia lamblia
LNELIFIVTIKICLQTKYWSW

SEQ ID NO: 3075647 - protein, 23 aa, Giardia lamblia
LNELLGHVFKYLNYHLTDCPQII

SEQ ID NO: 3075648 - protein, 22 aa, Giardia lamblia
LNELLQDFDFVLGKGAYGSVRA

SEQ ID NO: 3075649 - protein, 18 aa, Giardia lamblia
LNEMALGLHVHRLDDVKL

SEQ ID NO: 3075650 - protein, 18 aa, Giardia lamblia
LNEWKRRRQSYLDHGEHT

SEQ ID NO: 3075651 - protein, 32 aa, Giardia lamblia
LNFELVCSKSLIKHLVFEVSGLDDFLFTNKVV

SEQ ID NO: 3075652 - protein, 23 aa, Giardia lamblia
LNFESLLLLSHVLFDISMIVLDI

SEQ ID NO: 3075653 - protein, 27 aa, Giardia lamblia
LNFLHIPSLRYGFNILKSLGMSNIQAH

SEQ ID NO: 3075654 - protein, 27 aa, Giardia lamblia
LNFLYMKSMYLELGSVLFYRTLANMTI

SEQ ID NO: 3075655 - protein, 17 aa, Giardia lamblia
LNFPTLGLWNKVTGVFL

SEQ ID NO: 3075656 - protein, 25 aa, Giardia lamblia
LNFRYRPDLDLTLRDCNFEILPGEH

SEQ ID NO: 3075657 - protein, 34 aa, Giardia lamblia
LNGICFPKIVSVGSRISFDLVQAMMSGNGVAGII

SEQ ID NO: 3075658 - protein, 18 aa, Giardia lamblia
LNGLFVRSYLSLLITLLP

SEQ ID NO: 3075659 - protein, 18 aa, Giardia lamblia
LNGLVPIFKQFNYKWLTQ

SEQ ID NO: 3075660 - protein, 19 aa, Giardia lamblia
LNIAMTILLCEAGLAELLI

SEQ ID NO: 3075661 - protein, 23 aa, Giardia lamblia
LNIFPSYLTPLFIETFHSTVLLF

SEQ ID NO: 3075662 - protein, 17 aa, Giardia lamblia
LNIPYGLERLVEATQYD

SEQ ID NO: 3075663 - protein, 25 aa, Giardia lamblia
LNKCDYCSRGFYLLPPHPRFSCSCR

SEQ ID NO: 3075664 - protein, 19 aa, Giardia lamblia
LNKIVGFSGLTGFVIISVS

SEQ ID NO: 3075665 - protein, 19 aa, Giardia lamblia
LNKRHMRLPKNIVPVPLKI

SEQ ID NO: 3075666 - protein, 24 aa, Giardia lamblia
LNKSLKSLLAFHMIQLIVEKNIDV

SEQ ID NO: 3075667 - protein, 21 aa, Giardia lamblia
LNLAFADLIPFLRGVFNHGNP

SEQ ID NO: 3075668 - protein, 20 aa, Giardia lamblia
LNLAILASQRWPRAADSATY

SEQ ID NO: 3075669 - protein, 25 aa, Giardia lamblia
LNLDGLSPWQWSKFSTISSELVEDP

SEQ ID NO: 3075670 - protein, 27 aa, Giardia lamblia
LNLDRIYRKFCYSHFMVWFTELDTIKS

SEQ ID NO: 3075671 - protein, 17 aa, Giardia lamblia
LNLGLLGIDDLRLGTLQ

SEQ ID NO: 3075672 - protein, 19 aa, Giardia lamblia
LNLLLCIEQLLPFHDLLGK

SEQ ID NO: 3075673 - protein, 25 aa, Giardia lamblia
LNLLPLFMIILIRFFTPRPPNTFIY

SEQ ID NO: 3075674 - protein, 27 aa, Giardia lamblia
LNLLSRTGARFDYRLLFAQFYSKERIN

SEQ ID NO: 3075675 - protein, 19 aa, Giardia lamblia
LNLSWYTSLCNAVIKNPLA

SEQ ID NO: 3075676 - protein, 17 aa, Giardia lamblia
LNLTAFIGYNKHYYSMF

SEQ ID NO: 3075677 - protein, 18 aa, Giardia lamblia
LNLTRASTVIFYENDWNP

SEQ ID NO: 3075678 - protein, 21 aa, Giardia lamblia
LNMKRIRAAKRFGRSKYSFSQ

SEQ ID NO: 3075679 - protein, 24 aa, Giardia lamblia
LNNWQLVLILSRFEAQKRDSVGET

SEQ ID NO: 3075680 - protein, 23 aa, Giardia lamblia
LNPELRKYFLQSYIHGNIHTDLI

SEQ ID NO: 3075681 - protein, 19 aa, Giardia lamblia
LNPESELLMSPPVPVVQST

SEQ ID NO: 3075682 - protein, 19 aa, Giardia lamblia
LNPFARLKLGGSCYSSLIR

SEQ ID NO: 3075683 - protein, 17 aa, Giardia lamblia
LNPKFHLVLGNRIAAKL

SEQ ID NO: 3075684 - protein, 24 aa, Giardia lamblia
LNPSSKMNVKFTWVSKDTKFQILN

SEQ ID NO: 3075685 - protein, 33 aa, Giardia lamblia
LNQFADSVLLQFLLELTFKIDLDESLCIVDLFN

SEQ ID NO: 3075686 - protein, 25 aa, Giardia lamblia
LNQKRLSVLVPTDFGFTELTTTMHG

SEQ ID NO: 3075687 - protein, 17 aa, Giardia lamblia
LNQLSIFPLISHIQPSL

SEQ ID NO: 3075688 - protein, 18 aa, Giardia lamblia
LNRKEIDLQLSYLHLIAK

SEQ ID NO: 3075689 - protein, 24 aa, Giardia lamblia
LNRLFLFKERMSAIREIFMQTAKC

SEQ ID NO: 3075690 - protein, 18 aa, Giardia lamblia
LNRPRPRQIAEFTTVSGP

SEQ ID NO: 3075691 - protein, 18 aa, Giardia lamblia
LNRYCLKWQSSLPQSVFC

SEQ ID NO: 3075692 - protein, 19 aa, Giardia lamblia
LNSHISCYNQLYNQVQVIS

SEQ ID NO: 3075693 - protein, 26 aa, Giardia lamblia
LNSKLQWALLHRICISIRGAVENILS

SEQ ID NO: 3075694 - protein, 18 aa, Giardia lamblia
LNSLGINEKELWWVLWDG

SEQ ID NO: 3075695 - protein, 24 aa, Giardia lamblia
LNSRLCYCRHSTFRLLQVGEYRYG

SEQ ID NO: 3075696 - protein, 18 aa, Giardia lamblia
LNSSDIWFAAGIINDELK

SEQ ID NO: 3075697 - protein, 17 aa, Giardia lamblia
LNSYAWVGEYLFFAQRN

SEQ ID NO: 3075698 - protein, 25 aa, Giardia lamblia
LNTDFYVRSLRSFGWPGRTGSPLDT

SEQ ID NO: 3075699 - protein, 18 aa, Giardia lamblia
LNTILGFTEDYWARRNRI

SEQ ID NO: 3075700 - protein, 22 aa, Giardia lamblia
LNTLFIALRLYEALASPSKTKP

SEQ ID NO: 3075701 - protein, 25 aa, Giardia lamblia
LNTNRFSRELSFYVSNIMPLIAEIS

SEQ ID NO: 3075702 - protein, 23 aa, Giardia lamblia
LNTPKYDFSLIFQPAHPQESREG

SEQ ID NO: 3075703 - protein, 18 aa, Giardia lamblia
LNTTIIYPSFEQIIDIKG

SEQ ID NO: 3075704 - protein, 19 aa, Giardia lamblia
LNVELAYPIPPFSGEEDDL

SEQ ID NO: 3075705 - protein, 26 aa, Giardia lamblia
LNVLFYVLFMLCRLMAPYTPFVCDWM

SEQ ID NO: 3075706 - protein, 25 aa, Giardia lamblia
LNVTKAVSIAENWPVLPDATYATFS

SEQ ID NO: 3075707 - protein, 26 aa, Giardia lamblia
LNVTYSKFCGIKWLPAKHAVKNLSLS

SEQ ID NO: 3075708 - protein, 20 aa, Giardia lamblia
LPACRGHLHVLDPCLSLLTR

SEQ ID NO: 3075709 - protein, 17 aa, Giardia lamblia
LPALGRSIFRNRILDTL

SEQ ID NO: 3075710 - protein, 18 aa, Giardia lamblia
LPAMRVLAQRIYKKKSVI

SEQ ID NO: 3075711 - protein, 24 aa, Giardia lamblia
LPAPRSGCTTMYIRQNPLSPLSSI

SEQ ID NO: 3075712 - protein, 22 aa, Giardia lamblia
LPAQRTPGGILARRGHTAQAVK

SEQ ID NO: 3075713 - protein, 22 aa, Giardia lamblia
LPASHLYRLLAECFDIIERKHI

SEQ ID NO: 3075714 - protein, 25 aa, Giardia lamblia
LPASLTSWCFLPWESRDRAREESEG

SEQ ID NO: 3075715 - protein, 22 aa, Giardia lamblia
LPCATNCLFCMNGNTPAPYRCT

SEQ ID NO: 3075716 - protein, 19 aa, Giardia lamblia
LPCHADCKTCQGPQSTQCL

SEQ ID NO: 3075717 - protein, 29 aa, Giardia lamblia
LPCHVKIKSISWLTRLIRLLIEEITSQGP

SEQ ID NO: 3075718 - protein, 25 aa, Giardia lamblia
LPDDFDWRDVNGVSYIPGVLDQGAC

SEQ ID NO: 3075719 - protein, 17 aa, Giardia lamblia
LPDGRLVYLRSLHKHLV

SEQ ID NO: 3075720 - protein, 22 aa, Giardia lamblia
LPDIALPKWRYAVFGTCMALAT

SEQ ID NO: 3075721 - protein, 31 aa, Giardia lamblia
LPDPRTLTVSARFLLIDWLLLIVYIIGLLAY

SEQ ID NO: 3075722 - protein, 21 aa, Giardia lamblia
LPDVLEILELLYVELNASATF

SEQ ID NO: 3075723 - protein, 19 aa, Giardia lamblia
LPEDMRIALEVAAELEQNG

SEQ ID NO: 3075724 - protein, 29 aa, Giardia lamblia
LPELLEWINRVLLGPFISYMCYELLVMSV

SEQ ID NO: 3075725 - protein, 17 aa, Giardia lamblia
LPEPCPHVANNDTFSPL

SEQ ID NO: 3075726 - protein, 19 aa, Giardia lamblia
LPEQEGYGILAVKASVATS

SEQ ID NO: 3075727 - protein, 25 aa, Giardia lamblia
LPEQFKKHYSTLCSARIELLNKGHT

SEQ ID NO: 3075728 - protein, 19 aa, Giardia lamblia
LPEQVQLLIGCSYDAVKML

SEQ ID NO: 3075729 - protein, 32 aa, Giardia lamblia
LPESCPYFSPTELKFLGYLVSFVYGLQHLLSE

SEQ ID NO: 3075730 - protein, 18 aa, Giardia lamblia
LPFATLLSSYEKGIKNKV

SEQ ID NO: 3075731 - protein, 23 aa, Giardia lamblia
LPFGSVLCPVHFYIESPDALMMY

SEQ ID NO: 3075732 - protein, 17 aa, Giardia lamblia
LPFHMIIQFFRNVAADR

SEQ ID NO: 3075733 - protein, 29 aa, Giardia lamblia
LPFTIVRLGWVVALFIMAFAFTYSLFGFY

SEQ ID NO: 3075734 - protein, 19 aa, Giardia lamblia
LPGAPRIVGIDSMSPDGIP

SEQ ID NO: 3075735 - protein, 17 aa, Giardia lamblia
LPGEGQVISRIMTCISY

SEQ ID NO: 3075736 - protein, 17 aa, Giardia lamblia
LPGELYFSLMRPPSAQT

SEQ ID NO: 3075737 - protein, 17 aa, Giardia lamblia
LPGLVEYLGQSFLKEES

SEQ ID NO: 3075738 - protein, 21 aa, Giardia lamblia
LPGMTLLSFAVRLLGLEVARA

SEQ ID NO: 3075739 - protein, 20 aa, Giardia lamblia
LPHDMRAAIQVATANRHDDV

SEQ ID NO: 3075740 - protein, 17 aa, Giardia lamblia
LPHFFSKGIRSEGAAGG

SEQ ID NO: 3075741 - protein, 21 aa, Giardia lamblia
LPHLFLCVFIKLFEILHYPYY

SEQ ID NO: 3075742 - protein, 20 aa, Giardia lamblia
LPHPCSMSPSAHRLSDECIQ

SEQ ID NO: 3075743 - protein, 27 aa, Giardia lamblia
LPHPPGRAELFLALGEGFVDYVSLTLL

SEQ ID NO: 3075744 - protein, 32 aa, Giardia lamblia
LPHYNPKGSAGYVFCRFVIWILLIFVFAIGYL

SEQ ID NO: 3075745 - protein, 17 aa, Giardia lamblia
LPIADIIASAVVLSAPN

SEQ ID NO: 3075746 - protein, 20 aa, Giardia lamblia
LPICQPVAFVPNSLNKLYAN

SEQ ID NO: 3075747 - protein, 27 aa, Giardia lamblia
LPIILSRGRIPLLIWDMSNSKELNSVY

SEQ ID NO: 3075748 - protein, 20 aa, Giardia lamblia
LPIIQLIPIPGIKISADSLG

SEQ ID NO: 3075749 - protein, 24 aa, Giardia lamblia
LPIKKPRVSFSRRKRGPKPHKDAA

SEQ ID NO: 3075750 - protein, 24 aa, Giardia lamblia
LPINPRFYINFIMYDTTLMKKQLI

SEQ ID NO: 3075751 - protein, 17 aa, Giardia lamblia
LPIRPSSTAVLAITNSG

SEQ ID NO: 3075752 - protein, 19 aa, Giardia lamblia
LPITRLALLIACFSSPLTI

SEQ ID NO: 3075753 - protein, 27 aa, Giardia lamblia
LPIVFSNLCLICFIGCLITVQTTAVVN

SEQ ID NO: 3075754 - protein, 17 aa, Giardia lamblia
LPIVGLILFAFTRLLFS

SEQ ID NO: 3075755 - protein, 24 aa, Giardia lamblia
LPKSYELGGIWLSSILHHIFNISR

SEQ ID NO: 3075756 - protein, 18 aa, Giardia lamblia
LPKYIEASLLRKEANDAS

SEQ ID NO: 3075757 - protein, 17 aa, Giardia lamblia
LPLEKKILYCFDSEIVR

SEQ ID NO: 3075758 - protein, 25 aa, Giardia lamblia
LPLFKQCCTRVHYKIDFLKSKKSNP

SEQ ID NO: 3075759 - protein, 24 aa, Giardia lamblia
LPLLIPMIICSFLRQEALEHAQKV

SEQ ID NO: 3075760 - protein, 17 aa, Giardia lamblia
LPLLISVGIVSQDIDVG

SEQ ID NO: 3075761 - protein, 17 aa, Giardia lamblia
LPLLVEGVMITFYMAET

SEQ ID NO: 3075762 - protein, 23 aa, Giardia lamblia
LPLPRTVTTIVILIITASVNGDQ

SEQ ID NO: 3075763 - protein, 19 aa, Giardia lamblia
LPLQLFVSITVSVSQMKRK

SEQ ID NO: 3075764 - protein, 17 aa, Giardia lamblia
LPLSKVLGVLSEYESAL

SEQ ID NO: 3075765 - protein, 26 aa, Giardia lamblia
LPLTGLRLDFLVDLVGVYKTSKDVSV

SEQ ID NO: 3075766 - protein, 21 aa, Giardia lamblia
LPLYILRSFVSYNRMARKSKQ

SEQ ID NO: 3075767 - protein, 17 aa, Giardia lamblia
LPMEVSMTVSASLQELR

SEQ ID NO: 3075768 - protein, 23 aa, Giardia lamblia
LPMSLFVSLELVRLVQGIFIEMD

SEQ ID NO: 3075769 - protein, 19 aa, Giardia lamblia
LPNRLYGYIQRTVVPAPYR

SEQ ID NO: 3075770 - protein, 34 aa, Giardia lamblia
LPNVNIAFGRLWVCPDCDRGTFTVRATAVNTGIF

SEQ ID NO: 3075771 - protein, 18 aa, Giardia lamblia
LPPLDAYTFRALSTSSEY

SEQ ID NO: 3075772 - protein, 23 aa, Giardia lamblia
LPPLSKKSSCMLVNERRCKAVQF

SEQ ID NO: 3075773 - protein, 24 aa, Giardia lamblia
LPPPECIENASAMFLAHPLPQELA

SEQ ID NO: 3075774 - protein, 18 aa, Giardia lamblia
LPPPRTGRDYAVRTGQAE

SEQ ID NO: 3075775 - protein, 19 aa, Giardia lamblia
LPPSARLILMNTLRDIYNS

SEQ ID NO: 3075776 - protein, 26 aa, Giardia lamblia
LPQEYRPICGGRLCICSRAGSQSLPA

SEQ ID NO: 3075777 - protein, 21 aa, Giardia lamblia
LPQQITGFFLKVKGLNDLCFD

SEQ ID NO: 3075778 - protein, 21 aa, Giardia lamblia
LPRAPPATVPKTFGFTLKLPA

SEQ ID NO: 3075779 - protein, 19 aa, Giardia lamblia
LPSDPRIYLYMGVDGPTES

SEQ ID NO: 3075780 - protein, 19 aa, Giardia lamblia
LPSISSYPCIREIEASLAG

SEQ ID NO: 3075781 - protein, 17 aa, Giardia lamblia
LPSLIIHGSINKIPSNI

SEQ ID NO: 3075782 - protein, 20 aa, Giardia lamblia
LPSRTIGTGRAYSLLPPAIN

SEQ ID NO: 3075783 - protein, 36 aa, Giardia lamblia
LPSSHILLLLGRDGWPGPRSILLKQLRRNSYSLYAK

SEQ ID NO: 3075784 - protein, 25 aa, Giardia lamblia
LPSTLRFINAQAFGGNTTHFISIGG

SEQ ID NO: 3075785 - protein, 20 aa, Giardia lamblia
LPSTTTFRVKLWYTAGSGIE

SEQ ID NO: 3075786 - protein, 19 aa, Giardia lamblia
LPSTWPATPNPLGLAMDRY

SEQ ID NO: 3075787 - protein, 22 aa, Giardia lamblia
LPSVCQRIGASLLENFNVQLHE

SEQ ID NO: 3075788 - protein, 25 aa, Giardia lamblia
LPSVPGCYLICQYLCKGHWRISITP

SEQ ID NO: 3075789 - protein, 21 aa, Giardia lamblia
LPTTKSVVWLGHYYTSAFVTS

SEQ ID NO: 3075790 - protein, 17 aa, Giardia lamblia
LPVCAYVNVKQGEGGTD

SEQ ID NO: 3075791 - protein, 18 aa, Giardia lamblia
LPVDLLFSTPYVHSSTVY

SEQ ID NO: 3075792 - protein, 17 aa, Giardia lamblia
LPYLDYVQELQLHRKEL

SEQ ID NO: 3075793 - protein, 21 aa, Giardia lamblia
LPYMCCIPNGFLPISNLDNGE

SEQ ID NO: 3075794 - protein, 26 aa, Giardia lamblia
LPYRLRCSVQGLLRGARHDIICENSY

SEQ ID NO: 3075795 - protein, 18 aa, Giardia lamblia
LPYYRLFEPAGYLYKTEV

SEQ ID NO: 3075796 - protein, 25 aa, Giardia lamblia
LQALPSGAFWKWAILLKNVSTYEQT

SEQ ID NO: 3075797 - protein, 25 aa, Giardia lamblia
LQALYLLCHGVVWNFLKTGVHEQNL

SEQ ID NO: 3075798 - protein, 19 aa, Giardia lamblia
LQAMEQFPMSFMLRQEAGS

SEQ ID NO: 3075799 - protein, 18 aa, Giardia lamblia
LQANLRVPDTLGHKPTVP

SEQ ID NO: 3075800 - protein, 22 aa, Giardia lamblia
LQARWVVFVSGFLIAAGSILMG

SEQ ID NO: 3075801 - protein, 18 aa, Giardia lamblia
LQCSTDIFICELCTDGNP

SEQ ID NO: 3075802 - protein, 25 aa, Giardia lamblia
LQDHCGRTALMIAAACNHTACVQML

SEQ ID NO: 3075803 - protein, 25 aa, Giardia lamblia
LQDNHGRTALMFAAEHLHSRVLEFL

SEQ ID NO: 3075804 - protein, 19 aa, Giardia lamblia
LQDSDGWTALIIAALMNNI

SEQ ID NO: 3075805 - protein, 19 aa, Giardia lamblia
LQEHKWAKVLLFGMIILMA

SEQ ID NO: 3075806 - protein, 19 aa, Giardia lamblia
LQFATKLKVTRVVEVLVEL

SEQ ID NO: 3075807 - protein, 18 aa, Giardia lamblia
LQFLAPRADTAFTTNSTP

SEQ ID NO: 3075808 - protein, 23 aa, Giardia lamblia
LQFSYTKLFAFLRRFSFTTPATF

SEQ ID NO: 3075809 - protein, 19 aa, Giardia lamblia
LQGHVWRIVTPHLVPATLW

SEQ ID NO: 3075810 - protein, 19 aa, Giardia lamblia
LQHSFCRAPSAPCNPSDSA

SEQ ID NO: 3075811 - protein, 23 aa, Giardia lamblia
LQHYKEMLVCAGNGVCSCGGNGK

SEQ ID NO: 3075812 - protein, 24 aa, Giardia lamblia
LQILRPYGKFRAMGYNKGLLHCII

SEQ ID NO: 3075813 - protein, 25 aa, Giardia lamblia
LQISNRIVGVIGFPLFMHYLGQLLA

SEQ ID NO: 3075814 - protein, 24 aa, Giardia lamblia
LQIWFSMLYYFVTLVIYTGVLLLG

SEQ ID NO: 3075815 - protein, 18 aa, Giardia lamblia
LQKAFPIELEHIQKCASS

SEQ ID NO: 3075816 - protein, 30 aa, Giardia lamblia
LQKDKSVLCAAFRKLPRNNSYRLALLAMVS

SEQ ID NO: 3075817 - protein, 25 aa, Giardia lamblia
LQKIEGSAFIREWSIRQTTLEEVFL

SEQ ID NO: 3075818 - protein, 19 aa, Giardia lamblia
LQKIITMPMVFNDSLQSTL

SEQ ID NO: 3075819 - protein, 24 aa, Giardia lamblia
LQKKHGLCALALAAQYGRKDIVSS

SEQ ID NO: 3075820 - protein, 17 aa, Giardia lamblia
LQKPWRVAFLDENALDL

SEQ ID NO: 3075821 - protein, 35 aa, Giardia lamblia
LQKYLYKHCNEIKIYPAFVRMLFPKHLCASCLDGL

SEQ ID NO: 3075822 - protein, 19 aa, Giardia lamblia
LQLAINWFTSCVVVKTGKT

SEQ ID NO: 3075823 - protein, 24 aa, Giardia lamblia
LQLGDPPPAAWSWGDVGGASFLPA

SEQ ID NO: 3075824 - protein, 21 aa, Giardia lamblia
LQLHAFIAINVISFYRFTSAL

SEQ ID NO: 3075825 - protein, 17 aa, Giardia lamblia
LQLKALVDDGSCENLDV

SEQ ID NO: 3075826 - protein, 24 aa, Giardia lamblia
LQLKQFEFENVPGLHKQVEAQELE

SEQ ID NO: 3075827 - protein, 17 aa, Giardia lamblia
LQLLRILIASLRDPLDS

SEQ ID NO: 3075828 - protein, 25 aa, Giardia lamblia
LQLPADKAIECIMNYVFEKSPDNLI

SEQ ID NO: 3075829 - protein, 17 aa, Giardia lamblia
LQLPRDNTTLWPGENLD

SEQ ID NO: 3075830 - protein, 20 aa, Giardia lamblia
LQMHEMWSRNLLDSLLSVTG

SEQ ID NO: 3075831 - protein, 24 aa, Giardia lamblia
LQMKPRMVLDIQELYQLIYGNCCV

SEQ ID NO: 3075832 - protein, 22 aa, Giardia lamblia
LQMSSKTPLAFAKLTQDGVQRV

SEQ ID NO: 3075833 - protein, 25 aa, Giardia lamblia
LQNCMKELMMPPMLQDRLIVCRRSL

SEQ ID NO: 3075834 - protein, 18 aa, Giardia lamblia
LQNDFLKEICTVSDKFDQ

SEQ ID NO: 3075835 - protein, 18 aa, Giardia lamblia
LQNLFSLCEEPCTADDAL

SEQ ID NO: 3075836 - protein, 20 aa, Giardia lamblia
LQNRLEAFWNNLADVVSCSS

SEQ ID NO: 3075837 - protein, 17 aa, Giardia lamblia
LQNTIFVGFTFMLVATG

SEQ ID NO: 3075838 - protein, 19 aa, Giardia lamblia
LQPDGWNSWFRHVEQGCSV

SEQ ID NO: 3075839 - protein, 23 aa, Giardia lamblia
LQPHLPKDISIFGTVRVPPKFSA

SEQ ID NO: 3075840 - protein, 23 aa, Giardia lamblia
LQPICFLRPELSRCQSTVRDAFS

SEQ ID NO: 3075841 - protein, 18 aa, Giardia lamblia
LQQARLYAVLAVLGTIPE

SEQ ID NO: 3075842 - protein, 25 aa, Giardia lamblia
LQQLPFCLFMGCSSLSHIPIGHRYE

SEQ ID NO: 3075843 - protein, 27 aa, Giardia lamblia
LQREVRLKPELLENVQAVFEGVAQSTR

SEQ ID NO: 3075844 - protein, 20 aa, Giardia lamblia
LQRHISLLLGNLVTADAEIL

SEQ ID NO: 3075845 - protein, 20 aa, Giardia lamblia
LQRNIRGGIATNRFYDFLAL

SEQ ID NO: 3075846 - protein, 18 aa, Giardia lamblia
LQRSRYAQRWTKTYSIPQ

SEQ ID NO: 3075847 - protein, 26 aa, Giardia lamblia
LQRYCSLFNRAVEAWSVDPAQDEKRH

SEQ ID NO: 3075848 - protein, 18 aa, Giardia lamblia
LQSAILPSSGLDFITAEA

SEQ ID NO: 3075849 - protein, 24 aa, Giardia lamblia
LQSLLPEYCALSFGSNTKQLIAST

SEQ ID NO: 3075850 - protein, 29 aa, Giardia lamblia
LQSSPLVLCCLCVTTVLLITVAYMRAAAA

SEQ ID NO: 3075851 - protein, 24 aa, Giardia lamblia
LQTGKTRRAIHCEDIYSRPYPYET

SEQ ID NO: 3075852 - protein, 24 aa, Giardia lamblia
LQTTISASLSWYVQYYSDILANDA

SEQ ID NO: 3075853 - protein, 18 aa, Giardia lamblia
LQVEYGLYQDRGRRPTME

SEQ ID NO: 3075854 - protein, 18 aa, Giardia lamblia
LQVFYRVIAPRELQKAFP

SEQ ID NO: 3075855 - protein, 23 aa, Giardia lamblia
LQVPRNIRAAAHFLELLGEHEAA

SEQ ID NO: 3075856 - protein, 21 aa, Giardia lamblia
LQYETAMSISKLIAVAKPNFF

SEQ ID NO: 3075857 - protein, 21 aa, Giardia lamblia
LQYLCAKRKAISCIYESLLHT

SEQ ID NO: 3075858 - protein, 22 aa, Giardia lamblia
LQYPLPRYPLLSTLLVTVLEAV

SEQ ID NO: 3075859 - protein, 18 aa, Giardia lamblia
LRAACLTLLVIISVVSAD

SEQ ID NO: 3075860 - protein, 29 aa, Giardia lamblia
LRAELFQIKVRWPMHIRSLYASTQSTDID

SEQ ID NO: 3075861 - protein, 17 aa, Giardia lamblia
LRAENRANLSMWRQLLG

SEQ ID NO: 3075862 - protein, 28 aa, Giardia lamblia
LRAIHTIRRLPSFIILHFIPLLVNKAMS

SEQ ID NO: 3075863 - protein, 18 aa, Giardia lamblia
LRALDLRIDEIFNKIRLH

SEQ ID NO: 3075864 - protein, 19 aa, Giardia lamblia
LRAPFSPNKWVTGSTVDLD

SEQ ID NO: 3075865 - protein, 24 aa, Giardia lamblia
LRARANKNAIIWLSVFITTSENDS

SEQ ID NO: 3075866 - protein, 22 aa, Giardia lamblia
LRARIFTTGVFTWPNYGKEGKM

SEQ ID NO: 3075867 - protein, 19 aa, Giardia lamblia
LRASTHIPPILKLKSTTSI

SEQ ID NO: 3075868 - protein, 20 aa, Giardia lamblia
LRCESCTRPDALPLARPPLL

SEQ ID NO: 3075869 - protein, 17 aa, Giardia lamblia
LRCPLEEKFETFTWSLI

SEQ ID NO: 3075870 - protein, 20 aa, Giardia lamblia
LRDIGSLALMSLRYEQQVSV

SEQ ID NO: 3075871 - protein, 21 aa, Giardia lamblia
LRDLTELYLSLAAAMVERCLL

SEQ ID NO: 3075872 - protein, 20 aa, Giardia lamblia
LRDQFCLARKVMEWISDVLV

SEQ ID NO: 3075873 - protein, 23 aa, Giardia lamblia
LRDTFWAAVALRVTVAGYSFIIL

SEQ ID NO: 3075874 - protein, 25 aa, Giardia lamblia
LRDYETEQLWSLLAAQLDKFVISNN

SEQ ID NO: 3075875 - protein, 20 aa, Giardia lamblia
LREEFALLLCEESEPKNHPT

SEQ ID NO: 3075876 - protein, 21 aa, Giardia lamblia
LREELVFKFQLPRNAIATYMS

SEQ ID NO: 3075877 - protein, 26 aa, Giardia lamblia
LREFTRRFLPDFDLLMSILSSLFGIL

SEQ ID NO: 3075878 - protein, 24 aa, Giardia lamblia
LREIDLPKDFRFNITSIRNKEIYT

SEQ ID NO: 3075879 - protein, 18 aa, Giardia lamblia
LRELSHSNPGLATMGYTM

SEQ ID NO: 3075880 - protein, 17 aa, Giardia lamblia
LRFAYSVLTRLSIARQI

SEQ ID NO: 3075881 - protein, 19 aa, Giardia lamblia
LRFFGEYTQGPWCCVPHIH

SEQ ID NO: 3075882 - protein, 22 aa, Giardia lamblia
LRFHRISLVLAHILYTALSKQL

SEQ ID NO: 3075883 - protein, 20 aa, Giardia lamblia
LRFILQEICIIQASIDKWKR

SEQ ID NO: 3075884 - protein, 17 aa, Giardia lamblia
LRFLTTFMGGSLALQEA

SEQ ID NO: 3075885 - protein, 18 aa, Giardia lamblia
LRFPGRQILHMHFTVLFL

SEQ ID NO: 3075886 - protein, 33 aa, Giardia lamblia
LRFVPFKKYCFEFLPTYLTRLGLDKKRAEALYV

SEQ ID NO: 3075887 - protein, 17 aa, Giardia lamblia
LRGESVCEYECIQSDIL

SEQ ID NO: 3075888 - protein, 21 aa, Giardia lamblia
LRGKSLFPLTSFDVQFNGYYL

SEQ ID NO: 3075889 - protein, 19 aa, Giardia lamblia
LRGRMASNMLQPLESGPEL

SEQ ID NO: 3075890 - protein, 21 aa, Giardia lamblia
LRHAEHLLAYNVTSVIDCLTT

SEQ ID NO: 3075891 - protein, 17 aa, Giardia lamblia
LRHASIVLYCLSTAKRP

SEQ ID NO: 3075892 - protein, 26 aa, Giardia lamblia
LRHLRWKEAFALMVARSQVSLLTESS

SEQ ID NO: 3075893 - protein, 19 aa, Giardia lamblia
LRHSIKVTLIFILSAAIRW

SEQ ID NO: 3075894 - protein, 19 aa, Giardia lamblia
LRHVCPPIKCERSDATIGL

SEQ ID NO: 3075895 - protein, 18 aa, Giardia lamblia
LRHVKLIPKLIAQYLQLS

SEQ ID NO: 3075896 - protein, 17 aa, Giardia lamblia
LRIELQDRMSIVSKTKM

SEQ ID NO: 3075897 - protein, 25 aa, Giardia lamblia
LRIKRATEVLTGIRVIKYFSMEKLQ

SEQ ID NO: 3075898 - protein, 19 aa, Giardia lamblia
LRIRSHRAILLTTHAMDEA

SEQ ID NO: 3075899 - protein, 19 aa, Giardia lamblia
LRISGEWDNTTVFIGIFVL

SEQ ID NO: 3075900 - protein, 24 aa, Giardia lamblia
LRISSMLIPVDYMFVSVSTPKRWT

SEQ ID NO: 3075901 - protein, 31 aa, Giardia lamblia
LRITEPFMCRFLLKEDFLSLIDVIYTELQNP

SEQ ID NO: 3075902 - protein, 19 aa, Giardia lamblia
LRITLVRYVHAYRYYSNLL

SEQ ID NO: 3075903 - protein, 26 aa, Giardia lamblia
LRKISAYHLPALIGYSRDFFIIFKIT

SEQ ID NO: 3075904 - protein, 17 aa, Giardia lamblia
LRKNLCGGFVDCTEHFV

SEQ ID NO: 3075905 - protein, 20 aa, Giardia lamblia
LRLFFLVYILIKLPLCKHKS

SEQ ID NO: 3075906 - protein, 18 aa, Giardia lamblia
LRLFKSVIHLLFSSHISL

SEQ ID NO: 3075907 - protein, 26 aa, Giardia lamblia
LRLFTPAELVTLCLLASERHKLGVVI

SEQ ID NO: 3075908 - protein, 18 aa, Giardia lamblia
LRLLAKCLQTSYVASAIQ

SEQ ID NO: 3075909 - protein, 27 aa, Giardia lamblia
LRLLQSRAERAILIALLITFVIAIVCT

SEQ ID NO: 3075910 - protein, 25 aa, Giardia lamblia
LRLLTARLSKLLLEEAIPKNTLNTL

SEQ ID NO: 3075911 - protein, 20 aa, Giardia lamblia
LRLLYSGTYRNGRRRGQGEF

SEQ ID NO: 3075912 - protein, 17 aa, Giardia lamblia
LRLTDNMDHSGINFLDM

SEQ ID NO: 3075913 - protein, 22 aa, Giardia lamblia
LRLVNFKSYAGEHVLGPFKPSF

SEQ ID NO: 3075914 - protein, 21 aa, Giardia lamblia
LRLVPLDSPTTLSLPEPVTGR

SEQ ID NO: 3075915 - protein, 17 aa, Giardia lamblia
LRLWPIMLTDARRLTGR

SEQ ID NO: 3075916 - protein, 25 aa, Giardia lamblia
LRMANAELKAALEIVQSRSTEAEDL

SEQ ID NO: 3075917 - protein, 27 aa, Giardia lamblia
LRMLPGPKLRQVCFFSATMSDKCLEVP

SEQ ID NO: 3075918 - protein, 19 aa, Giardia lamblia
LRMYLQYLISLKNKYFYLD

SEQ ID NO: 3075919 - protein, 17 aa, Giardia lamblia
LRNASSYRTGTKSDLSP

SEQ ID NO: 3075920 - protein, 18 aa, Giardia lamblia
LRNIARTLAFEFGESSKS

SEQ ID NO: 3075921 - protein, 19 aa, Giardia lamblia
LRNRHGWTALMHAAAQNDI

SEQ ID NO: 3075922 - protein, 19 aa, Giardia lamblia
LRNYCIASYNLLMEKKKER

SEQ ID NO: 3075923 - protein, 31 aa, Giardia lamblia
LRPDQGAAIVFNFLISRIFKEDYVTGLIRAR

SEQ ID NO: 3075924 - protein, 21 aa, Giardia lamblia
LRPELLFKQRKCYSVMITIRR

SEQ ID NO: 3075925 - protein, 26 aa, Giardia lamblia
LRPIFRELRKPAAIQRSGNKQCSLAE

SEQ ID NO: 3075926 - protein, 18 aa, Giardia lamblia
LRPLVTTTRNYFRMLFLH

SEQ ID NO: 3075927 - protein, 19 aa, Giardia lamblia
LRPLYELLDVSELFGLIKD

SEQ ID NO: 3075928 - protein, 27 aa, Giardia lamblia
LRPRLFERISNLIPFSIKRLAAAATHE

SEQ ID NO: 3075929 - protein, 22 aa, Giardia lamblia
LRPSQFKALVYAVLSPLLLILG

SEQ ID NO: 3075930 - protein, 26 aa, Giardia lamblia
LRQAEKLPDFVLWRILNGLKVGELDF

SEQ ID NO: 3075931 - protein, 19 aa, Giardia lamblia
LRQDLSVELEQRRTKHRGK

SEQ ID NO: 3075932 - protein, 20 aa, Giardia lamblia
LRQILMWQLNKEVVKVGYIA

SEQ ID NO: 3075933 - protein, 24 aa, Giardia lamblia
LRQINFAVGLACCSLGIIDSKNNL

SEQ ID NO: 3075934 - protein, 24 aa, Giardia lamblia
LRQLSKRTLLYCNLIYRILATGAI

SEQ ID NO: 3075935 - protein, 27 aa, Giardia lamblia
LRQRSDAFLLLSLFMRLAARPIDGLAE

SEQ ID NO: 3075936 - protein, 20 aa, Giardia lamblia
LRQSRPVPNYQAASQAVIVA

SEQ ID NO: 3075937 - protein, 23 aa, Giardia lamblia
LRRAGRTVCELVWEKPTANAKLF

SEQ ID NO: 3075938 - protein, 32 aa, Giardia lamblia
LRRGVEFPHNAIPVVIPFNFEDLTVHPAVSNV

SEQ ID NO: 3075939 - protein, 25 aa, Giardia lamblia
LRRILLDYKLLLGMYNHQEKAIEKL

SEQ ID NO: 3075940 - protein, 26 aa, Giardia lamblia
LRRLFPINIKIIWRILLFAIPQWFFL

SEQ ID NO: 3075941 - protein, 23 aa, Giardia lamblia
LRRLGFCSLYLSYGHDVLLELFK

SEQ ID NO: 3075942 - protein, 18 aa, Giardia lamblia
LRRLHGFLFNFPKCTANC

SEQ ID NO: 3075943 - protein, 25 aa, Giardia lamblia
LRRQLELLKAIILERLAFIVETIPE

SEQ ID NO: 3075944 - protein, 17 aa, Giardia lamblia
LRRVIYCVYSGDYSLLE

SEQ ID NO: 3075945 - protein, 18 aa, Giardia lamblia
LRRYVPISQNFRGLQARR

SEQ ID NO: 3075946 - protein, 20 aa, Giardia lamblia
LRSCPLVSVCDTLRDLLAEV

SEQ ID NO: 3075947 - protein, 18 aa, Giardia lamblia
LRSDFRITQLEGAQETSL

SEQ ID NO: 3075948 - protein, 18 aa, Giardia lamblia
LRSHLSMYADAYKTLKDS

SEQ ID NO: 3075949 - protein, 19 aa, Giardia lamblia
LRSIRMALRAGQLLIEDEP

SEQ ID NO: 3075950 - protein, 19 aa, Giardia lamblia
LRSKNALVIPTKMAFISGS

SEQ ID NO: 3075951 - protein, 21 aa, Giardia lamblia
LRSLEPFSFTIVISTLLFLRM

SEQ ID NO: 3075952 - protein, 24 aa, Giardia lamblia
LRSLHLKGGFLIPRVPPDLDKSRI

SEQ ID NO: 3075953 - protein, 18 aa, Giardia lamblia
LRSMLKKQLDPITINDYF

SEQ ID NO: 3075954 - protein, 17 aa, Giardia lamblia
LRSNFDMLRAGSMTVSL

SEQ ID NO: 3075955 - protein, 26 aa, Giardia lamblia
LRSRAKEVLSILGIKFDMFSLILESL

SEQ ID NO: 3075956 - protein, 25 aa, Giardia lamblia
LRSRESIAIPILLLIPPGAQPGKLI

SEQ ID NO: 3075957 - protein, 18 aa, Giardia lamblia
LRSTCISDRCISSGAETD

SEQ ID NO: 3075958 - protein, 35 aa, Giardia lamblia
LRSTFPTMYSEFIRPYCCAFIVLLDVCAYLNKRGV

SEQ ID NO: 3075959 - protein, 20 aa, Giardia lamblia
LRSVCFLASDIAVFFCSKAW

SEQ ID NO: 3075960 - protein, 28 aa, Giardia lamblia
LRSVKALLAHGTWTRYGQLKDYLQIAER

SEQ ID NO: 3075961 - protein, 22 aa, Giardia lamblia
LRTHPTICHFLVALLAHQKNDS

SEQ ID NO: 3075962 - protein, 17 aa, Giardia lamblia
LRTLHRVAEHGSFLTYD

SEQ ID NO: 3075963 - protein, 25 aa, Giardia lamblia
LRTMAMVILFSWNMAWISLFFDTAE

SEQ ID NO: 3075964 - protein, 29 aa, Giardia lamblia
LRTMLYDICDIVRYVACTTVTSLLSPSNA

SEQ ID NO: 3075965 - protein, 21 aa, Giardia lamblia
LRTQYPGAPFFGGYSTNDTEY

SEQ ID NO: 3075966 - protein, 19 aa, Giardia lamblia
LRTTLANAIQMCALSTLPQ

SEQ ID NO: 3075967 - protein, 17 aa, Giardia lamblia
LRTTLYRIRCACCNDFI

SEQ ID NO: 3075968 - protein, 22 aa, Giardia lamblia
LRTTRHLPLRYQGYSDIIQQSR

SEQ ID NO: 3075969 - protein, 20 aa, Giardia lamblia
LRTTSGLSLHLPVYLANQAV

SEQ ID NO: 3075970 - protein, 19 aa, Giardia lamblia
LRVANKVSCFSIMDTLADT

SEQ ID NO: 3075971 - protein, 17 aa, Giardia lamblia
LRVDRMVILLFLYEQEL

SEQ ID NO: 3075972 - protein, 22 aa, Giardia lamblia
LRVGKRPLVPVYASASATSDLP

SEQ ID NO: 3075973 - protein, 17 aa, Giardia lamblia
LRVGTRNALSPKHIGSP

SEQ ID NO: 3075974 - protein, 26 aa, Giardia lamblia
LRVLSERPDFKWIMNYDTLLFDHIFY

SEQ ID NO: 3075975 - protein, 17 aa, Giardia lamblia
LRVMRCFLSHIRANEAS

SEQ ID NO: 3075976 - protein, 18 aa, Giardia lamblia
LRVPSENAVELFDALILE

SEQ ID NO: 3075977 - protein, 21 aa, Giardia lamblia
LRYANGDVYVGHFLANKICGK

SEQ ID NO: 3075978 - protein, 25 aa, Giardia lamblia
LRYITGSPIYLPWASNFSRKTQIIC

SEQ ID NO: 3075979 - protein, 17 aa, Giardia lamblia
LRYKNQFPLNLKSAESQ

SEQ ID NO: 3075980 - protein, 20 aa, Giardia lamblia
LRYLQKLLMNEAFVYICGEV

SEQ ID NO: 3075981 - protein, 19 aa, Giardia lamblia
LRYRILVEHACLDAQLQEL

SEQ ID NO: 3075982 - protein, 17 aa, Giardia lamblia
LRYRKDLDLVLRNVSFS

SEQ ID NO: 3075983 - protein, 25 aa, Giardia lamblia
LRYSKIPIIHFYSSESMRLNLEHLI

SEQ ID NO: 3075984 - protein, 25 aa, Giardia lamblia
LRYTHFPNGYLFRSGLYESGETAQH

SEQ ID NO: 3075985 - protein, 22 aa, Giardia lamblia
LSAAIRFKNRFHQLDLVIERLN

SEQ ID NO: 3075986 - protein, 20 aa, Giardia lamblia
LSADFIYSFHNLHWPSLRGC

SEQ ID NO: 3075987 - protein, 31 aa, Giardia lamblia
LSADGGKVGLTWDPRLEPFISSRRLKTTLGV

SEQ ID NO: 3075988 - protein, 19 aa, Giardia lamblia
LSAFCSLLGSWAGHHSTTR

SEQ ID NO: 3075989 - protein, 20 aa, Giardia lamblia
LSAGIPFVGIPGFPAVFIQL

SEQ ID NO: 3075990 - protein, 18 aa, Giardia lamblia
LSAKRYVPLSAEKQKYCE

SEQ ID NO: 3075991 - protein, 20 aa, Giardia lamblia
LSALCAVGLIPLQRLPKVEQ

SEQ ID NO: 3075992 - protein, 18 aa, Giardia lamblia
LSALYAYYREPYCFNLEV

SEQ ID NO: 3075993 - protein, 19 aa, Giardia lamblia
LSANEFWSLQVLTDRPQAY

SEQ ID NO: 3075994 - protein, 18 aa, Giardia lamblia
LSANYVVALLSFYEYIVS

SEQ ID NO: 3075995 - protein, 18 aa, Giardia lamblia
LSAQPPVDTEAIYREAYE

SEQ ID NO: 3075996 - protein, 17 aa, Giardia lamblia
LSARNVSSLGLIILNDL

SEQ ID NO: 3075997 - protein, 17 aa, Giardia lamblia
LSARPYINLAQSIPTET

SEQ ID NO: 3075998 - protein, 28 aa, Giardia lamblia
LSASGYRYLCIPSKCLTSKTGLERICSG

SEQ ID NO: 3075999 - protein, 24 aa, Giardia lamblia
LSAVTIVQFFLCRLRNILLDLESR

SEQ ID NO: 3076000 - protein, 25 aa, Giardia lamblia
LSCADVDRLFGIRIRAEKPVPEQTV

SEQ ID NO: 3076001 - protein, 20 aa, Giardia lamblia
LSCGVSLPCYSLEILWLSKL

SEQ ID NO: 3076002 - protein, 26 aa, Giardia lamblia
LSCLELLVRFALVVGFLDFDESCRRS

SEQ ID NO: 3076003 - protein, 20 aa, Giardia lamblia
LSCLPGVSCQSCSSVEEHEL

SEQ ID NO: 3076004 - protein, 17 aa, Giardia lamblia
LSDEMASCISLVDYIAS

SEQ ID NO: 3076005 - protein, 22 aa, Giardia lamblia
LSDIIFSLSLFKVILDKEKLCL

SEQ ID NO: 3076006 - protein, 17 aa, Giardia lamblia
LSDLCPIVYFYDIGVQL

SEQ ID NO: 3076007 - protein, 21 aa, Giardia lamblia
LSDLILHMYFCAHFLGKEFLS

SEQ ID NO: 3076008 - protein, 29 aa, Giardia lamblia
LSDLKSSPGVRAWVALLCSLIIGFSPIHS

SEQ ID NO: 3076009 - protein, 22 aa, Giardia lamblia
LSDMLPSIISFVSESEVFYTFE

SEQ ID NO: 3076010 - protein, 20 aa, Giardia lamblia
LSDPSCQEWTVLDPQEQIFL

SEQ ID NO: 3076011 - protein, 35 aa, Giardia lamblia
LSDTYSLSRCRCGAIRCPYCGGLGSNMGLISGSYL

SEQ ID NO: 3076012 - protein, 17 aa, Giardia lamblia
LSDVKNFVVQVVITATI

SEQ ID NO: 3076013 - protein, 25 aa, Giardia lamblia
LSDVLRAADSFGLLANEWSIDVSRL

SEQ ID NO: 3076014 - protein, 22 aa, Giardia lamblia
LSEDKCLQCLINGECGDLSPYL

SEQ ID NO: 3076015 - protein, 18 aa, Giardia lamblia
LSEDYCIDCVAEIEERRL

SEQ ID NO: 3076016 - protein, 29 aa, Giardia lamblia
LSEGLYSQFFKKFCSNIVHRAAFMAPGLL

SEQ ID NO: 3076017 - protein, 24 aa, Giardia lamblia
LSEKARLALETELDLLPRVRHQYI

SEQ ID NO: 3076018 - protein, 17 aa, Giardia lamblia
LSEKLSVATGWIGLTGV

SEQ ID NO: 3076019 - protein, 24 aa, Giardia lamblia
LSENFKAYINRFVDLISGRCSRDY

SEQ ID NO: 3076020 - protein, 18 aa, Giardia lamblia
LSENILFLLETTSLRLEA

SEQ ID NO: 3076021 - protein, 18 aa, Giardia lamblia
LSERPANFILSGVNPVLA

SEQ ID NO: 3076022 - protein, 20 aa, Giardia lamblia
LSFASLLVFLLVFAVLLFVL

SEQ ID NO: 3076023 - protein, 19 aa, Giardia lamblia
LSFFYKQLGSYPVLFSSRA

SEQ ID NO: 3076024 - protein, 23 aa, Giardia lamblia
LSFGVSIVSVFFFDGTCTAVDTD

SEQ ID NO: 3076025 - protein, 22 aa, Giardia lamblia
LSFLVPTPFFLSIKHKYSIELS

SEQ ID NO: 3076026 - protein, 24 aa, Giardia lamblia
LSFMPRLTAQLLRAFDAAELQSTP

SEQ ID NO: 3076027 - protein, 17 aa, Giardia lamblia
LSFRSRLTIGLHINKTS

SEQ ID NO: 3076028 - protein, 19 aa, Giardia lamblia
LSFSLAINGVVKPLFCNYR

SEQ ID NO: 3076029 - protein, 19 aa, Giardia lamblia
LSFWSFCYSILQAYIQRIS

SEQ ID NO: 3076030 - protein, 22 aa, Giardia lamblia
LSGDLEVFWAPVILILSTIIAK

SEQ ID NO: 3076031 - protein, 32 aa, Giardia lamblia
LSGGDCWDLYLQVFACVEYYFDVADKNQFPRL

SEQ ID NO: 3076032 - protein, 18 aa, Giardia lamblia
LSGKACFHLGTATHLSYV

SEQ ID NO: 3076033 - protein, 24 aa, Giardia lamblia
LSGKAMPYLPCVSQYLDSILGFFD

SEQ ID NO: 3076034 - protein, 17 aa, Giardia lamblia
LSGLGMVAKASYCHSIS

SEQ ID NO: 3076035 - protein, 19 aa, Giardia lamblia
LSGLLGMFSPALVPPPITW

SEQ ID NO: 3076036 - protein, 22 aa, Giardia lamblia
LSGNNELVWSRVITTLSVGAGT

SEQ ID NO: 3076037 - protein, 17 aa, Giardia lamblia
LSGPAVIMRVCRAIDAA

SEQ ID NO: 3076038 - protein, 24 aa, Giardia lamblia
LSGRELLEQMLLDILYVIIRVLVG

SEQ ID NO: 3076039 - protein, 22 aa, Giardia lamblia
LSGRHVAACLGLKNLEADLSRN

SEQ ID NO: 3076040 - protein, 26 aa, Giardia lamblia
LSHAVVGFTICICIGLLTSIVGMLSF

SEQ ID NO: 3076041 - protein, 26 aa, Giardia lamblia
LSHMIRTGCEIHIFRSLPSDSLLHKT

SEQ ID NO: 3076042 - protein, 18 aa, Giardia lamblia
LSHPCCSLMEFLGLTVPA

SEQ ID NO: 3076043 - protein, 25 aa, Giardia lamblia
LSHRYLLYRIGDFIWNVFNEKILQP

SEQ ID NO: 3076044 - protein, 18 aa, Giardia lamblia
LSIAAVCLYIASIFMPRL

SEQ ID NO: 3076045 - protein, 23 aa, Giardia lamblia
LSICQFLADKECGLVGSPDSLLA

SEQ ID NO: 3076046 - protein, 18 aa, Giardia lamblia
LSICSRGSSTPSMASIKS

SEQ ID NO: 3076047 - protein, 20 aa, Giardia lamblia
LSIDMSYSLSSSVSLEDVLE

SEQ ID NO: 3076048 - protein, 20 aa, Giardia lamblia
LSIDRPTTFMSIKINQGPEI

SEQ ID NO: 3076049 - protein, 24 aa, Giardia lamblia
LSIIVYICAIKFVYSLAPIYFRTL

SEQ ID NO: 3076050 - protein, 21 aa, Giardia lamblia
LSILISCLISVFGLSPANATT

SEQ ID NO: 3076051 - protein, 23 aa, Giardia lamblia
LSISLGEGIIFCGRMSLCTMLPN

SEQ ID NO: 3076052 - protein, 23 aa, Giardia lamblia
LSKAAKYGLLRCPARLLESDLRY

SEQ ID NO: 3076053 - protein, 24 aa, Giardia lamblia
LSKEIRPHFDVSVAPLKEAVATDP

SEQ ID NO: 3076054 - protein, 17 aa, Giardia lamblia
LSKELNQPPVIVGYNKF

SEQ ID NO: 3076055 - protein, 21 aa, Giardia lamblia
LSKKLGVVILIKGVVDVVVSP

SEQ ID NO: 3076056 - protein, 23 aa, Giardia lamblia
LSKMTVFCLINAGVAQVFNLTDA

SEQ ID NO: 3076057 - protein, 23 aa, Giardia lamblia
LSKPCLSMALFSHEKTALINEQS

SEQ ID NO: 3076058 - protein, 17 aa, Giardia lamblia
LSKSIPLTFVHRNDTHI

SEQ ID NO: 3076059 - protein, 21 aa, Giardia lamblia
LSKTDPFFWIFKEQEDRTGGG

SEQ ID NO: 3076060 - protein, 17 aa, Giardia lamblia
LSLADPYESLYLLEFNH

SEQ ID NO: 3076061 - protein, 17 aa, Giardia lamblia
LSLDRGRLSEEPTGRSI

SEQ ID NO: 3076062 - protein, 22 aa, Giardia lamblia
LSLFLKYRYKYTLASKRAKAVQ

SEQ ID NO: 3076063 - protein, 25 aa, Giardia lamblia
LSLGIEWLESFLFGVGIIVANVPEG

SEQ ID NO: 3076064 - protein, 24 aa, Giardia lamblia
LSLIEEIFMCRACLCFTIFQVDEE

SEQ ID NO: 3076065 - protein, 19 aa, Giardia lamblia
LSLLRKLTIDIWSRVPNLI

SEQ ID NO: 3076066 - protein, 18 aa, Giardia lamblia
LSLLSAFLSALSFSEDTR

SEQ ID NO: 3076067 - protein, 25 aa, Giardia lamblia
LSLLTPRFFAGWLDNMIELIHHSRC

SEQ ID NO: 3076068 - protein, 22 aa, Giardia lamblia
LSLPSPVLLGFCSDLAQKILEC

SEQ ID NO: 3076069 - protein, 17 aa, Giardia lamblia
LSLRYRKDLDLVLRNVS

SEQ ID NO: 3076070 - protein, 36 aa, Giardia lamblia
LSLTCRLSVARVFARESVRLIKLWRANGSTLPKNTQ

SEQ ID NO: 3076071 - protein, 23 aa, Giardia lamblia
LSLYMMGNPVYKRVGRSAFYTPS

SEQ ID NO: 3076072 - protein, 17 aa, Giardia lamblia
LSMCTKETINWVVDQIR

SEQ ID NO: 3076073 - protein, 18 aa, Giardia lamblia
LSMESVPPATRRLIERYT

SEQ ID NO: 3076074 - protein, 17 aa, Giardia lamblia
LSMPLFATEDIKIMPHT

SEQ ID NO: 3076075 - protein, 17 aa, Giardia lamblia
LSMVIPFTGAPSRSVYR

SEQ ID NO: 3076076 - protein, 20 aa, Giardia lamblia
LSNIFLKFTRNSFLVQQPQV

SEQ ID NO: 3076077 - protein, 20 aa, Giardia lamblia
LSNLKIIYANSLDFELSQFR

SEQ ID NO: 3076078 - protein, 25 aa, Giardia lamblia
LSNLQYRLIIAYVVVMLLSGQFFAH

SEQ ID NO: 3076079 - protein, 25 aa, Giardia lamblia
LSNPFTIPHPITFQLESNQISILEI

SEQ ID NO: 3076080 - protein, 18 aa, Giardia lamblia
LSNPRALGVSPGRKPLPS

SEQ ID NO: 3076081 - protein, 18 aa, Giardia lamblia
LSNTFLQLLSRFCAPINL

SEQ ID NO: 3076082 - protein, 25 aa, Giardia lamblia
LSNTLRGTFGFSRMKPLIEDLQAHT

SEQ ID NO: 3076083 - protein, 20 aa, Giardia lamblia
LSPHRCELFTIETGSAVDIM

SEQ ID NO: 3076084 - protein, 23 aa, Giardia lamblia
LSPIRSGSVYYLLSTIAAVSRYY

SEQ ID NO: 3076085 - protein, 25 aa, Giardia lamblia
LSPISSFRVTFAIPKEKIGGKLMSF

SEQ ID NO: 3076086 - protein, 18 aa, Giardia lamblia
LSPSELNSSVLLDSLTFK

SEQ ID NO: 3076087 - protein, 17 aa, Giardia lamblia
LSPSSAPGLHWDQSIYI

SEQ ID NO: 3076088 - protein, 17 aa, Giardia lamblia
LSPTAIVESEFVIRAIR

SEQ ID NO: 3076089 - protein, 18 aa, Giardia lamblia
LSPVDMFSMQFLKHTGQY

SEQ ID NO: 3076090 - protein, 26 aa, Giardia lamblia
LSQALVKLPSLLSEISAKLLADESLC

SEQ ID NO: 3076091 - protein, 24 aa, Giardia lamblia
LSQFTRAAVKRVFQIFTSVPSQLL

SEQ ID NO: 3076092 - protein, 24 aa, Giardia lamblia
LSQHIGSPVWLVLQNAHLVPDFVN

SEQ ID NO: 3076093 - protein, 17 aa, Giardia lamblia
LSQRAFYRVAFYESSSP

SEQ ID NO: 3076094 - protein, 23 aa, Giardia lamblia
LSRAGSSCFQRIFQMPSDASSLL

SEQ ID NO: 3076095 - protein, 18 aa, Giardia lamblia
LSRCRRNLSSHPVVTTIY

SEQ ID NO: 3076096 - protein, 23 aa, Giardia lamblia
LSRESPRLKVLYAELNSLHHFIS

SEQ ID NO: 3076097 - protein, 22 aa, Giardia lamblia
LSRFCAPINLSIAGLLDAFSSS

SEQ ID NO: 3076098 - protein, 17 aa, Giardia lamblia
LSRLEEIESLDISHTQK

SEQ ID NO: 3076099 - protein, 31 aa, Giardia lamblia
LSRQPDALVSLSLEMYLAFTTVIKAMQAPSQ

SEQ ID NO: 3076100 - protein, 21 aa, Giardia lamblia
LSRTPRRRGLLGLALAGAFLL

SEQ ID NO: 3076101 - protein, 18 aa, Giardia lamblia
LSRYCMQNHMFCPREHFE

SEQ ID NO: 3076102 - protein, 19 aa, Giardia lamblia
LSSAGCLTHAWALTHARLE

SEQ ID NO: 3076103 - protein, 18 aa, Giardia lamblia
LSSASLHYASDRGMLDVD

SEQ ID NO: 3076104 - protein, 19 aa, Giardia lamblia
LSSCLPGHGMPIFTHSLDI

SEQ ID NO: 3076105 - protein, 19 aa, Giardia lamblia
LSSCLTLSQLTSWDTEASD

SEQ ID NO: 3076106 - protein, 18 aa, Giardia lamblia
LSSEKSLNNHLLDKEIHN

SEQ ID NO: 3076107 - protein, 19 aa, Giardia lamblia
LSSFIFKAQSVAFLVFIII

SEQ ID NO: 3076108 - protein, 19 aa, Giardia lamblia
LSSFLCYSIPVTTYIQRVP

SEQ ID NO: 3076109 - protein, 19 aa, Giardia lamblia
LSSKEVVEFVYANRPTIMI

SEQ ID NO: 3076110 - protein, 19 aa, Giardia lamblia
LSSLPCKLTNLAQIAEEYY

SEQ ID NO: 3076111 - protein, 22 aa, Giardia lamblia
LSSLSLIFALHCYKPTPLYVMD

SEQ ID NO: 3076112 - protein, 25 aa, Giardia lamblia
LSSPKDSWCKDAFTALTKDQQRQVC

SEQ ID NO: 3076113 - protein, 19 aa, Giardia lamblia
LSSSFMLEAVFSPETHAEA

SEQ ID NO: 3076114 - protein, 17 aa, Giardia lamblia
LSSSWRLTPNDLAIEES

SEQ ID NO: 3076115 - protein, 24 aa, Giardia lamblia
LSSTLKLLPIVTLFGLMTPILLLS

SEQ ID NO: 3076116 - protein, 24 aa, Giardia lamblia
LSSTTTFLTIHWQLKRLPEQFKKH

SEQ ID NO: 3076117 - protein, 27 aa, Giardia lamblia
LSSVIFCPSLFMALVIAPFINRYGPMN

SEQ ID NO: 3076118 - protein, 26 aa, Giardia lamblia
LSTAKRPSAQFVAMCCRLAQTSEAVL

SEQ ID NO: 3076119 - protein, 25 aa, Giardia lamblia
LSTCARVIAISAFFIITALQLRNVK

SEQ ID NO: 3076120 - protein, 17 aa, Giardia lamblia
LSTDIHIYLGISVITAG

SEQ ID NO: 3076121 - protein, 27 aa, Giardia lamblia
LSTEATPAYVPRGFCGNASQYYLKKGT

SEQ ID NO: 3076122 - protein, 19 aa, Giardia lamblia
LSTECEFCISELMKMFYGK

SEQ ID NO: 3076123 - protein, 17 aa, Giardia lamblia
LSTGGFRPALFTRNVIL

SEQ ID NO: 3076124 - protein, 17 aa, Giardia lamblia
LSTLTIVFAVLFQLYIP

SEQ ID NO: 3076125 - protein, 18 aa, Giardia lamblia
LSTMSPANLPLRPIPSNV

SEQ ID NO: 3076126 - protein, 23 aa, Giardia lamblia
LSTRGICIIHILYSVFYVVTFLV

SEQ ID NO: 3076127 - protein, 22 aa, Giardia lamblia
LSTSRLPLNYAQVSNPINKLLL

SEQ ID NO: 3076128 - protein, 24 aa, Giardia lamblia
LSTSWLDFVIGFFITTTQLIIVLN

SEQ ID NO: 3076129 - protein, 24 aa, Giardia lamblia
LSVCWCTLVSLTIAPASRYIVSAV

SEQ ID NO: 3076130 - protein, 18 aa, Giardia lamblia
LSVEALFGHICTKLKLHT

SEQ ID NO: 3076131 - protein, 19 aa, Giardia lamblia
LSVLFRQSAVWVLVVVVAR

SEQ ID NO: 3076132 - protein, 22 aa, Giardia lamblia
LSVRILSSLCPINSSELIIYKD

SEQ ID NO: 3076133 - protein, 22 aa, Giardia lamblia
LSVSLGALIAIGASVYTYLSVR

SEQ ID NO: 3076134 - protein, 25 aa, Giardia lamblia
LSVTGFPRLQFRTDSSMYAPFISST

SEQ ID NO: 3076135 - protein, 21 aa, Giardia lamblia
LSVTLLTRFLTFLNVFLPVKV

SEQ ID NO: 3076136 - protein, 17 aa, Giardia lamblia
LSVTYGLLARAGERYKR

SEQ ID NO: 3076137 - protein, 24 aa, Giardia lamblia
LSVVKRPLGTLGIKASDVKDGMYR

SEQ ID NO: 3076138 - protein, 23 aa, Giardia lamblia
LSVYELLSYPPIKAIIAESAIAP

SEQ ID NO: 3076139 - protein, 24 aa, Giardia lamblia
LSWADFSNFLSSFVTPALAISNSH

SEQ ID NO: 3076140 - protein, 18 aa, Giardia lamblia
LSWADGQSFYTIDNIAKL

SEQ ID NO: 3076141 - protein, 18 aa, Giardia lamblia
LSWMSFAMFTRSWVCAVF

SEQ ID NO: 3076142 - protein, 27 aa, Giardia lamblia
LSYMKYIRIYLLIFIKFLRHLEYLHTA

SEQ ID NO: 3076143 - protein, 17 aa, Giardia lamblia
LSYQLKHQIMALFYGKG

SEQ ID NO: 3076144 - protein, 23 aa, Giardia lamblia
LTAEQRLGAAVVIQEDTNVRVKD

SEQ ID NO: 3076145 - protein, 17 aa, Giardia lamblia
LTAHDKLNCNRNVSDFR

SEQ ID NO: 3076146 - protein, 21 aa, Giardia lamblia
LTALMYCCLSKNYSLADLLLS

SEQ ID NO: 3076147 - protein, 18 aa, Giardia lamblia
LTALNFLYMKSMYLELGS

SEQ ID NO: 3076148 - protein, 18 aa, Giardia lamblia
LTALPSIRCYGSEDHLIE

SEQ ID NO: 3076149 - protein, 38 aa, Giardia lamblia
LTARPKLGALRACIYPHYSFECNMDFLMIITLITDRFS

SEQ ID NO: 3076150 - protein, 29 aa, Giardia lamblia
LTAYKLAQYTLRFLNDMMAFSSMSSKYYE

SEQ ID NO: 3076151 - protein, 17 aa, Giardia lamblia
LTCKGPGPMECLTCPTG

SEQ ID NO: 3076152 - protein, 25 aa, Giardia lamblia
LTDAIDLSNEFILLSGMAVGDQLQA

SEQ ID NO: 3076153 - protein, 26 aa, Giardia lamblia
LTDLCYLTLMIAHRFYLGGAPQGPAG

SEQ ID NO: 3076154 - protein, 20 aa, Giardia lamblia
LTDWARGYFALEVYYLAHLV

SEQ ID NO: 3076155 - protein, 26 aa, Giardia lamblia
LTEEWGNVRIRLHLERNFSNLYISHL

SEQ ID NO: 3076156 - protein, 23 aa, Giardia lamblia
LTEFCTNFRNCIIELLDSFDSLF

SEQ ID NO: 3076157 - protein, 17 aa, Giardia lamblia
LTEQHIPQQASPTRTYK

SEQ ID NO: 3076158 - protein, 25 aa, Giardia lamblia
LTEREALEYIPLATPLCFQYLHLLF

SEQ ID NO: 3076159 - protein, 17 aa, Giardia lamblia
LTETLDLVSAFPLTNLA

SEQ ID NO: 3076160 - protein, 19 aa, Giardia lamblia
LTFDRWYKYVLAIFVGPIL

SEQ ID NO: 3076161 - protein, 26 aa, Giardia lamblia
LTFNMIYAGVRWNNFLAMTSNAENQV

SEQ ID NO: 3076162 - protein, 19 aa, Giardia lamblia
LTFPGPALIQPLTRDTLTR

SEQ ID NO: 3076163 - protein, 22 aa, Giardia lamblia
LTFTTKPGWNFNVNGPKSIVLP

SEQ ID NO: 3076164 - protein, 18 aa, Giardia lamblia
LTGDIKLELLHISPEERD

SEQ ID NO: 3076165 - protein, 22 aa, Giardia lamblia
LTGEAFPAALLTLSDPLQGDFM

SEQ ID NO: 3076166 - protein, 24 aa, Giardia lamblia
LTGFARYFISLTLNVFYLKLQSLS

SEQ ID NO: 3076167 - protein, 18 aa, Giardia lamblia
LTGLLKCIPQPSYTFYLK

SEQ ID NO: 3076168 - protein, 29 aa, Giardia lamblia
LTGLYRQGFKEFLRVTAQIGVCLLDEINI

SEQ ID NO: 3076169 - protein, 23 aa, Giardia lamblia
LTGQGLRYAPLVSQTKLRTQLIL

SEQ ID NO: 3076170 - protein, 18 aa, Giardia lamblia
LTGQYCFVHGHITPDTVF

SEQ ID NO: 3076171 - protein, 27 aa, Giardia lamblia
LTGRKCISGICSCPFSYGGDDCQTDTC

SEQ ID NO: 3076172 - protein, 19 aa, Giardia lamblia
LTGSLIKPLINYNVTTHYV

SEQ ID NO: 3076173 - protein, 19 aa, Giardia lamblia
LTGSVTLAFQVFLLSSVSE

SEQ ID NO: 3076174 - protein, 38 aa, Giardia lamblia
LTHDRQCYCCPCSGCDCGGGCASGYCKHLQSEAEECCS

SEQ ID NO: 3076175 - protein, 23 aa, Giardia lamblia
LTHKDRLMVLKRAHVQTDYDRDS

SEQ ID NO: 3076176 - protein, 23 aa, Giardia lamblia
LTIGEPWSLVTFVLFALTFFIAR

SEQ ID NO: 3076177 - protein, 17 aa, Giardia lamblia
LTIHVDWTISKTSSDLS

SEQ ID NO: 3076178 - protein, 17 aa, Giardia lamblia
LTIIPDINLHIFTILCA

SEQ ID NO: 3076179 - protein, 26 aa, Giardia lamblia
LTIKYKLYRWLGAALLTLLFLLRIII

SEQ ID NO: 3076180 - protein, 18 aa, Giardia lamblia
LTIPRSISALNIVSSFAV

SEQ ID NO: 3076181 - protein, 18 aa, Giardia lamblia
LTITAWVYGIRFSKKLET

SEQ ID NO: 3076182 - protein, 18 aa, Giardia lamblia
LTKALLLKASPRHYTNAF

SEQ ID NO: 3076183 - protein, 25 aa, Giardia lamblia
LTKNARTLFKLALSGFTRNFLSDFS

SEQ ID NO: 3076184 - protein, 17 aa, Giardia lamblia
LTKYKRKRNFISVSVIL

SEQ ID NO: 3076185 - protein, 26 aa, Giardia lamblia
LTLAFPLATAFMLLFPLASFTLGLLG

SEQ ID NO: 3076186 - protein, 23 aa, Giardia lamblia
LTLCGKSIVISSELFNYQGPISD

SEQ ID NO: 3076187 - protein, 18 aa, Giardia lamblia
LTLELADQYACICDYKDA

SEQ ID NO: 3076188 - protein, 17 aa, Giardia lamblia
LTLEYGNTLFLILDCME

SEQ ID NO: 3076189 - protein, 17 aa, Giardia lamblia
LTLKKPMSVPVPYTDIP

SEQ ID NO: 3076190 - protein, 24 aa, Giardia lamblia
LTLPKRLFMESSFYYLTVNLHDEL

SEQ ID NO: 3076191 - protein, 17 aa, Giardia lamblia
LTLPLYILRSFVSYNRM

SEQ ID NO: 3076192 - protein, 20 aa, Giardia lamblia
LTLPMTPYVYLRLERLSLLS

SEQ ID NO: 3076193 - protein, 19 aa, Giardia lamblia
LTLPVIMAGILSIYGLITS

SEQ ID NO: 3076194 - protein, 17 aa, Giardia lamblia
LTLRFLTTFMGGSLALQ

SEQ ID NO: 3076195 - protein, 21 aa, Giardia lamblia
LTLTFDCERILFIVYLSSFIM

SEQ ID NO: 3076196 - protein, 17 aa, Giardia lamblia
LTLTGLVEQEAFSGQGR

SEQ ID NO: 3076197 - protein, 18 aa, Giardia lamblia
LTLTIEFFMPVVFHNPLA

SEQ ID NO: 3076198 - protein, 34 aa, Giardia lamblia
LTLTLRHWRIIKALIHLFFRYYGILDVQTGNDSH

SEQ ID NO: 3076199 - protein, 26 aa, Giardia lamblia
LTLVKLRLVTTIAHAMLWELFLAGIN

SEQ ID NO: 3076200 - protein, 20 aa, Giardia lamblia
LTLYEVFTVLLLKRIRGLVN

SEQ ID NO: 3076201 - protein, 18 aa, Giardia lamblia
LTMCVFSRLQIMATERST

SEQ ID NO: 3076202 - protein, 18 aa, Giardia lamblia
LTNFYKFPTTLQHMTRNH

SEQ ID NO: 3076203 - protein, 29 aa, Giardia lamblia
LTPDFWLQYIHGMMDAFLIYAGSILVTSA

SEQ ID NO: 3076204 - protein, 17 aa, Giardia lamblia
LTPDLLLVTGIPFYPKV

SEQ ID NO: 3076205 - protein, 23 aa, Giardia lamblia
LTPEEARGGRLLLFAQQQSKFNL

SEQ ID NO: 3076206 - protein, 17 aa, Giardia lamblia
LTPPEAFVTGSIAGFLT

SEQ ID NO: 3076207 - protein, 22 aa, Giardia lamblia
LTPTALLAMMHFIGTFSMPASK

SEQ ID NO: 3076208 - protein, 23 aa, Giardia lamblia
LTPVPFCSACIEDAGFSAFAKTH

SEQ ID NO: 3076209 - protein, 17 aa, Giardia lamblia
LTQALDLSFSWLHELNY

SEQ ID NO: 3076210 - protein, 17 aa, Giardia lamblia
LTQIEKLWIDSIYNDSG

SEQ ID NO: 3076211 - protein, 24 aa, Giardia lamblia
LTQLKMILVNDIRFLVSHFSDKFN

SEQ ID NO: 3076212 - protein, 17 aa, Giardia lamblia
LTREMWNNSCGGSSSAT

SEQ ID NO: 3076213 - protein, 21 aa, Giardia lamblia
LTRYLLKGIFLLLFYTICSKI

SEQ ID NO: 3076214 - protein, 17 aa, Giardia lamblia
LTSDFRPLAILRNIASK

SEQ ID NO: 3076215 - protein, 25 aa, Giardia lamblia
LTSHLLYLLLVCFRDLHIVKPGRSR

SEQ ID NO: 3076216 - protein, 17 aa, Giardia lamblia
LTSIIPMYSLPGSPKTW

SEQ ID NO: 3076217 - protein, 35 aa, Giardia lamblia
LTSKEAYCLAMLRKAHPKVDFSIFTTPLVGSGEEP

SEQ ID NO: 3076218 - protein, 25 aa, Giardia lamblia
LTSKRFLQRRALLYNTHMLPGSTSH

SEQ ID NO: 3076219 - protein, 25 aa, Giardia lamblia
LTSLLSIVCLIYFMVMILSFAILSN

SEQ ID NO: 3076220 - protein, 19 aa, Giardia lamblia
LTSLNGFGGMYYFGKDLEA

SEQ ID NO: 3076221 - protein, 20 aa, Giardia lamblia
LTSQFFYPFISTFSNTASFF

SEQ ID NO: 3076222 - protein, 23 aa, Giardia lamblia
LTSRAPLIVDIIFYDSCVAIEIL

SEQ ID NO: 3076223 - protein, 27 aa, Giardia lamblia
LTSVCLPCIHCPRWVEMFYEQFYATDC

SEQ ID NO: 3076224 - protein, 24 aa, Giardia lamblia
LTSWKECFQKPIPFTPYLPSHLEM

SEQ ID NO: 3076225 - protein, 24 aa, Giardia lamblia
LTTLRRPDFLGGKEPAEVFVDGWR

SEQ ID NO: 3076226 - protein, 17 aa, Giardia lamblia
LTTQCAKDFCSKISTGI

SEQ ID NO: 3076227 - protein, 24 aa, Giardia lamblia
LTTQLPILLFRSMSFYHRNAAGPI

SEQ ID NO: 3076228 - protein, 19 aa, Giardia lamblia
LTTTFSVLFPFLAKNDAMI

SEQ ID NO: 3076229 - protein, 23 aa, Giardia lamblia
LTVALCILLDFLVLLLQSRTLCR

SEQ ID NO: 3076230 - protein, 26 aa, Giardia lamblia
LTVDCNPGFGGLRCGNCTTDSACAHG

SEQ ID NO: 3076231 - protein, 17 aa, Giardia lamblia
LTVFQIIALSVKVIPSS

SEQ ID NO: 3076232 - protein, 25 aa, Giardia lamblia
LTVHTFLRLLPVFGQSPSADKIHEL

SEQ ID NO: 3076233 - protein, 24 aa, Giardia lamblia
LTVLLSIILWRISRISGPGSKITT

SEQ ID NO: 3076234 - protein, 25 aa, Giardia lamblia
LTVNRMKPAICKTVDLHGAEDPNHP

SEQ ID NO: 3076235 - protein, 21 aa, Giardia lamblia
LTVSALCLSSALSRTDSSNIA

SEQ ID NO: 3076236 - protein, 17 aa, Giardia lamblia
LTVTRAFFDTIKAVTIA

SEQ ID NO: 3076237 - protein, 28 aa, Giardia lamblia
LTWEENWTKLKSCLDCMGYPHIDILTNI

SEQ ID NO: 3076238 - protein, 19 aa, Giardia lamblia
LTYLQLFFSYAMTISLMPF

SEQ ID NO: 3076239 - protein, 21 aa, Giardia lamblia
LTYPALYYPISMHPPANLPIF

SEQ ID NO: 3076240 - protein, 26 aa, Giardia lamblia
LTYQFSVEFLKMLALKNTLFSYGRRL

SEQ ID NO: 3076241 - protein, 17 aa, Giardia lamblia
LVAIVCILLLQVLQSSI

SEQ ID NO: 3076242 - protein, 26 aa, Giardia lamblia
LVAVAGFLIWWFVIRPRRGGPLRERA

SEQ ID NO: 3076243 - protein, 25 aa, Giardia lamblia
LVAVAGFLVWWFVIRPRRGGPLRER

SEQ ID NO: 3076244 - protein, 18 aa, Giardia lamblia
LVAVIKRWIESVSVYNAV

SEQ ID NO: 3076245 - protein, 26 aa, Giardia lamblia
LVAVLRGWIPASFLYFAFQTRTKHLR

SEQ ID NO: 3076246 - protein, 21 aa, Giardia lamblia
LVCIGVGLFFVFRRKPAQQLD

SEQ ID NO: 3076247 - protein, 19 aa, Giardia lamblia
LVCQIYFYERIISLQELPG

SEQ ID NO: 3076248 - protein, 22 aa, Giardia lamblia
LVCVMLIAFRVSKFRRLWHLGR

SEQ ID NO: 3076249 - protein, 31 aa, Giardia lamblia
LVDFPEMFTRGQLKFSYNLLGEQEIYRYDDV

SEQ ID NO: 3076250 - protein, 19 aa, Giardia lamblia
LVDILKLCGLNLRTPAGET

SEQ ID NO: 3076251 - protein, 22 aa, Giardia lamblia
LVDKVCVGLNCFINATDSNGRL

SEQ ID NO: 3076252 - protein, 17 aa, Giardia lamblia
LVDLDITSCVPFVICGY

SEQ ID NO: 3076253 - protein, 19 aa, Giardia lamblia
LVDQFSLIITKTFMASSQK

SEQ ID NO: 3076254 - protein, 17 aa, Giardia lamblia
LVDQLAMPDTSNLSASA

SEQ ID NO: 3076255 - protein, 21 aa, Giardia lamblia
LVDSKGWTALMYAAAKGHADC

SEQ ID NO: 3076256 - protein, 24 aa, Giardia lamblia
LVDVRYTGFLWGRNLVTLKAGGYT

SEQ ID NO: 3076257 - protein, 27 aa, Giardia lamblia
LVEGRGLCCVCMARPPSFIGVPCGHAL

SEQ ID NO: 3076258 - protein, 19 aa, Giardia lamblia
LVEIIKYVWDKEAQYKENH

SEQ ID NO: 3076259 - protein, 18 aa, Giardia lamblia
LVELVVLFFSFVFPTCLQ

SEQ ID NO: 3076260 - protein, 19 aa, Giardia lamblia
LVENCIPPSCIEDGLECGG

SEQ ID NO: 3076261 - protein, 28 aa, Giardia lamblia
LVEVLKVVYVMRDFAFERIMGYALICLK

SEQ ID NO: 3076262 - protein, 26 aa, Giardia lamblia
LVFCNCILEKAALERVFVPVYASIFS

SEQ ID NO: 3076263 - protein, 24 aa, Giardia lamblia
LVFGEALALYGLIIALILNFSGSN

SEQ ID NO: 3076264 - protein, 18 aa, Giardia lamblia
LVFIFSAIFTLSFLNPKS

SEQ ID NO: 3076265 - protein, 17 aa, Giardia lamblia
LVFKDGPLVTGMKQGHW

SEQ ID NO: 3076266 - protein, 18 aa, Giardia lamblia
LVFSLCFDPLQDVKKLET

SEQ ID NO: 3076267 - protein, 17 aa, Giardia lamblia
LVGCGHIACSACLYHMY

SEQ ID NO: 3076268 - protein, 22 aa, Giardia lamblia
LVGDKRGKLLFLEKKLTIKVPR

SEQ ID NO: 3076269 - protein, 23 aa, Giardia lamblia
LVGELRISASNLRLMTNAFLETL

SEQ ID NO: 3076270 - protein, 18 aa, Giardia lamblia
LVGFGKNLMMIQGIAGAA

SEQ ID NO: 3076271 - protein, 25 aa, Giardia lamblia
LVGLPCILCSLALGSMPRNITAVKL

SEQ ID NO: 3076272 - protein, 30 aa, Giardia lamblia
LVGMLVMICVLAWPALIVVIPTIILYAVIF

SEQ ID NO: 3076273 - protein, 17 aa, Giardia lamblia
LVGRRLNRLDILDTTAL

SEQ ID NO: 3076274 - protein, 30 aa, Giardia lamblia
LVHQELRLIALRLVSAISHEGELTIFEQEL

SEQ ID NO: 3076275 - protein, 25 aa, Giardia lamblia
LVHRLTNNHGFVFPNEFLHLQNIFA

SEQ ID NO: 3076276 - protein, 32 aa, Giardia lamblia
LVHVLGALCLKTPAAWYSLVTFVLKSSIDLIT

SEQ ID NO: 3076277 - protein, 29 aa, Giardia lamblia
LVIHREIFYKAVLAFEALAFIKNLNLSEQ

SEQ ID NO: 3076278 - protein, 30 aa, Giardia lamblia
LVIIILFALVIRFYLKFDNLVVTNLLVTRR

SEQ ID NO: 3076279 - protein, 18 aa, Giardia lamblia
LVILIVSAIIFKEKGLMD

SEQ ID NO: 3076280 - protein, 27 aa, Giardia lamblia
LVLAAVAGFLVWWFVIRPRKSGVLRER

SEQ ID NO: 3076281 - protein, 17 aa, Giardia lamblia
LVLARHPTFLIPNVTNA

SEQ ID NO: 3076282 - protein, 23 aa, Giardia lamblia
LVLCIHSVWCFSLAILALVHANN

SEQ ID NO: 3076283 - protein, 24 aa, Giardia lamblia
LVLGCEHRGAIVLDLLSGLEISVI

SEQ ID NO: 3076284 - protein, 17 aa, Giardia lamblia
LVLIGWEGVFGLFLTVG

SEQ ID NO: 3076285 - protein, 19 aa, Giardia lamblia
LVLKMRDSYSISFRTANQQ

SEQ ID NO: 3076286 - protein, 19 aa, Giardia lamblia
LVLLAFLIFMFLKATMAKV

SEQ ID NO: 3076287 - protein, 23 aa, Giardia lamblia
LVLLRRDIKFLFTTRVEIKLESN

SEQ ID NO: 3076288 - protein, 17 aa, Giardia lamblia
LVLMAVFLDALYSAKPL

SEQ ID NO: 3076289 - protein, 18 aa, Giardia lamblia
LVLMSATKDPLVLRTIFP

SEQ ID NO: 3076290 - protein, 23 aa, Giardia lamblia
LVLPFVLGLCFNIALVCIAPCRC

SEQ ID NO: 3076291 - protein, 19 aa, Giardia lamblia
LVLVLAVTMIKEFVDDIQR

SEQ ID NO: 3076292 - protein, 19 aa, Giardia lamblia
LVLVSRLHDILGILDTETN

SEQ ID NO: 3076293 - protein, 18 aa, Giardia lamblia
LVLYRKSTPIDMTALQNT

SEQ ID NO: 3076294 - protein, 26 aa, Giardia lamblia
LVNCIDMRPSSIVFTLAAKEDLEPAV

SEQ ID NO: 3076295 - protein, 17 aa, Giardia lamblia
LVNTVVFLLGMYQDLAI

SEQ ID NO: 3076296 - protein, 19 aa, Giardia lamblia
LVNYCPSQVLLNGLTYQTS

SEQ ID NO: 3076297 - protein, 22 aa, Giardia lamblia
LVPDSALRFVRPTKSAESCYDS

SEQ ID NO: 3076298 - protein, 17 aa, Giardia lamblia
LVPGLGVFFVFFITLAF

SEQ ID NO: 3076299 - protein, 20 aa, Giardia lamblia
LVPHCCGYEPVYIRFPDVTH

SEQ ID NO: 3076300 - protein, 24 aa, Giardia lamblia
LVPNPTLRPQIRDVIAMTEHILKV

SEQ ID NO: 3076301 - protein, 17 aa, Giardia lamblia
LVPSFIIERNWQVQSLL

SEQ ID NO: 3076302 - protein, 29 aa, Giardia lamblia
LVQIGSPLYCLWTASNLCVMDLYVSSETP

SEQ ID NO: 3076303 - protein, 23 aa, Giardia lamblia
LVQKAAFFLLCIHALAKQLQFYF

SEQ ID NO: 3076304 - protein, 19 aa, Giardia lamblia
LVRPKVLIRDGVFSSKESA

SEQ ID NO: 3076305 - protein, 25 aa, Giardia lamblia
LVRSLPAPVCAALFGLPGPCPACGA

SEQ ID NO: 3076306 - protein, 19 aa, Giardia lamblia
LVSAFPLTNLAAGPNYTTD

SEQ ID NO: 3076307 - protein, 19 aa, Giardia lamblia
LVSCFLPLDLMFLVPALLV

SEQ ID NO: 3076308 - protein, 18 aa, Giardia lamblia
LVSCPREKLFKVLEPALQ

SEQ ID NO: 3076309 - protein, 19 aa, Giardia lamblia
LVSGLMFCIAFFKEQAAGW

SEQ ID NO: 3076310 - protein, 26 aa, Giardia lamblia
LVSIICTRIEFCLQILERVPSDCRQV

SEQ ID NO: 3076311 - protein, 22 aa, Giardia lamblia
LVSILAMCFALLSGTSIFEADK

SEQ ID NO: 3076312 - protein, 27 aa, Giardia lamblia
LVSKIALHYQIPWLVPRRQKSKPRNAH

SEQ ID NO: 3076313 - protein, 17 aa, Giardia lamblia
LVSLCIETLMLHTRYSK

SEQ ID NO: 3076314 - protein, 17 aa, Giardia lamblia
LVSLLGITTHTELINVF

SEQ ID NO: 3076315 - protein, 20 aa, Giardia lamblia
LVSLQLWKAYILANKERLAK

SEQ ID NO: 3076316 - protein, 18 aa, Giardia lamblia
LVSSCKGISGYYRGLYAS

SEQ ID NO: 3076317 - protein, 18 aa, Giardia lamblia
LVSTCRATLLAHCSHVDS

SEQ ID NO: 3076318 - protein, 19 aa, Giardia lamblia
LVTAGCFTICMCVIMMLLC

SEQ ID NO: 3076319 - protein, 27 aa, Giardia lamblia
LVTDFLCCSCFRALVNILHESPSSNYA

SEQ ID NO: 3076320 - protein, 27 aa, Giardia lamblia
LVTFLKRLLFIIPFISHYVVEWFYPSI

SEQ ID NO: 3076321 - protein, 17 aa, Giardia lamblia
LVTKEVRSYKMFYLYVI

SEQ ID NO: 3076322 - protein, 24 aa, Giardia lamblia
LVTLRRPDFLGGKEPAEVFVTGGG

SEQ ID NO: 3076323 - protein, 17 aa, Giardia lamblia
LVTSFLYFGDFSIGVIF

SEQ ID NO: 3076324 - protein, 18 aa, Giardia lamblia
LVTSLSYEVFHGMDEYLI

SEQ ID NO: 3076325 - protein, 17 aa, Giardia lamblia
LVVAISFGVTGGYLAPA

SEQ ID NO: 3076326 - protein, 25 aa, Giardia lamblia
LVVDYVYRFVAGLANSSVKPANCTS

SEQ ID NO: 3076327 - protein, 19 aa, Giardia lamblia
LVVELLRLYSHDEHESIIS

SEQ ID NO: 3076328 - protein, 18 aa, Giardia lamblia
LVVFIGSNLYYVSWSETD

SEQ ID NO: 3076329 - protein, 25 aa, Giardia lamblia
LVVLTTPALFAWKDFCSLSSSASIF

SEQ ID NO: 3076330 - protein, 20 aa, Giardia lamblia
LVVPPRCNQAFLGALTPTEL

SEQ ID NO: 3076331 - protein, 18 aa, Giardia lamblia
LVVVVARLVYTFFTSITF

SEQ ID NO: 3076332 - protein, 19 aa, Giardia lamblia
LVYCHNYNALFVYKLSTNV

SEQ ID NO: 3076333 - protein, 18 aa, Giardia lamblia
LVYLPGLVEYLGQSFLKE

SEQ ID NO: 3076334 - protein, 20 aa, Giardia lamblia
LWCIMSRIAVDNADIKEAGF

SEQ ID NO: 3076335 - protein, 23 aa, Giardia lamblia
LWDSLRSNFAITRPHTLNSIIEH

SEQ ID NO: 3076336 - protein, 24 aa, Giardia lamblia
LWEPFKKSMLRDTRVTAARTLAFA

SEQ ID NO: 3076337 - protein, 26 aa, Giardia lamblia
LWHRLRRHLGEAVCALIPKAQQVISL

SEQ ID NO: 3076338 - protein, 17 aa, Giardia lamblia
LWICASSLLASPSSSVC

SEQ ID NO: 3076339 - protein, 18 aa, Giardia lamblia
LWIHDLWTDLATVSDILT

SEQ ID NO: 3076340 - protein, 22 aa, Giardia lamblia
LWIPLLEIYEEFMGNSYSSSKV

SEQ ID NO: 3076341 - protein, 20 aa, Giardia lamblia
LWPGENLDPVGILVAGLGLV

SEQ ID NO: 3076342 - protein, 26 aa, Giardia lamblia
LWRKAHGLKESFTYLQAFIRCFLVRK

SEQ ID NO: 3076343 - protein, 18 aa, Giardia lamblia
LWSSIFLKSKVPYAEAHG

SEQ ID NO: 3076344 - protein, 19 aa, Giardia lamblia
LWTELHSGMSAAGASEALL

SEQ ID NO: 3076345 - protein, 18 aa, Giardia lamblia
LWVNIGLDAAERSPLVGI

SEQ ID NO: 3076346 - protein, 17 aa, Giardia lamblia
LWWYFFTPMMSFAAILG

SEQ ID NO: 3076347 - protein, 17 aa, Giardia lamblia
LWYHGFLQCVFRQYHDK

SEQ ID NO: 3076348 - protein, 17 aa, Giardia lamblia
LYACCTIIDDAMGKKEP

SEQ ID NO: 3076349 - protein, 17 aa, Giardia lamblia
LYALLVFINAYYIELLL

SEQ ID NO: 3076350 - protein, 18 aa, Giardia lamblia
LYALSSLASEHGFVGLTT

SEQ ID NO: 3076351 - protein, 19 aa, Giardia lamblia
LYALYGQPGLRHDVGLSSS

SEQ ID NO: 3076352 - protein, 17 aa, Giardia lamblia
LYCKSISAFSILGKRNA

SEQ ID NO: 3076353 - protein, 26 aa, Giardia lamblia
LYCNHYLRMAGILLHSISILRALTEL

SEQ ID NO: 3076354 - protein, 17 aa, Giardia lamblia
LYDAFGMPVASYSSEIR

SEQ ID NO: 3076355 - protein, 22 aa, Giardia lamblia
LYDFKYASALTKIIEDVVPAEE

SEQ ID NO: 3076356 - protein, 21 aa, Giardia lamblia
LYDKLEIVQLLAAHESGLLDN

SEQ ID NO: 3076357 - protein, 25 aa, Giardia lamblia
LYDRFISLTWSCFIYDSVLLLLLGV

SEQ ID NO: 3076358 - protein, 25 aa, Giardia lamblia
LYDVFKRLSPELVLKIEQDVSFDYL

SEQ ID NO: 3076359 - protein, 24 aa, Giardia lamblia
LYFGERFFFPYIIVRYYERKSIEN

SEQ ID NO: 3076360 - protein, 17 aa, Giardia lamblia
LYFGSTVQYGRQLRDLG

SEQ ID NO: 3076361 - protein, 18 aa, Giardia lamblia
LYFHKLFVILTELLLIPL

SEQ ID NO: 3076362 - protein, 18 aa, Giardia lamblia
LYFNTRFLYRRRPNHWAY

SEQ ID NO: 3076363 - protein, 18 aa, Giardia lamblia
LYFRHKVGNFVWTTDRYW

SEQ ID NO: 3076364 - protein, 18 aa, Giardia lamblia
LYGDFLFDSEAERYFLAI

SEQ ID NO: 3076365 - protein, 24 aa, Giardia lamblia
LYGFASLLFLCFVKPPLEQNTAAQ

SEQ ID NO: 3076366 - protein, 17 aa, Giardia lamblia
LYGGFSPYVKIKTGPDA

SEQ ID NO: 3076367 - protein, 18 aa, Giardia lamblia
LYGKLLRSVSHVFTPSLY

SEQ ID NO: 3076368 - protein, 19 aa, Giardia lamblia
LYGPIFLSSMPKYFEDKME

SEQ ID NO: 3076369 - protein, 20 aa, Giardia lamblia
LYGSIILRCMYSIIRAPFHL

SEQ ID NO: 3076370 - protein, 20 aa, Giardia lamblia
LYIFLARLFYNGTLYVFLVL

SEQ ID NO: 3076371 - protein, 17 aa, Giardia lamblia
LYIGFGQLFEPCLVLVL

SEQ ID NO: 3076372 - protein, 33 aa, Giardia lamblia
LYIIIKEFFKTYVARGIIPRDDLVFLSADVGST

SEQ ID NO: 3076373 - protein, 32 aa, Giardia lamblia
LYILFARLCGCGSKRCRICLRCNSCCYVVQII

SEQ ID NO: 3076374 - protein, 19 aa, Giardia lamblia
LYIYCVLKGRTEMCSLGYV

SEQ ID NO: 3076375 - protein, 21 aa, Giardia lamblia
LYKDIGQYLALLMTRGQNNSL

SEQ ID NO: 3076376 - protein, 17 aa, Giardia lamblia
LYKILSWNKNTTCAAEE

SEQ ID NO: 3076377 - protein, 18 aa, Giardia lamblia
LYKLCNYFNLSRYYRLLE

SEQ ID NO: 3076378 - protein, 27 aa, Giardia lamblia
LYKMASKLVERVRCSMPKKQTLCRAPF

SEQ ID NO: 3076379 - protein, 19 aa, Giardia lamblia
LYKNFKWQTFKYLRGLTEF

SEQ ID NO: 3076380 - protein, 17 aa, Giardia lamblia
LYKYVLRCSYDRGAPDG

SEQ ID NO: 3076381 - protein, 19 aa, Giardia lamblia
LYLALAIAGTVLIHLNVLF

SEQ ID NO: 3076382 - protein, 19 aa, Giardia lamblia
LYLECGFAGAGTCTSDGCT

SEQ ID NO: 3076383 - protein, 17 aa, Giardia lamblia
LYLKRRFQQSGIPNGDD

SEQ ID NO: 3076384 - protein, 19 aa, Giardia lamblia
LYLNKCVQPLLYNKLPSGK

SEQ ID NO: 3076385 - protein, 18 aa, Giardia lamblia
LYLPHIFSNYVPAMPNTE

SEQ ID NO: 3076386 - protein, 23 aa, Giardia lamblia
LYLQCPPLTLGSVQGLAALLSKT

SEQ ID NO: 3076387 - protein, 20 aa, Giardia lamblia
LYLQNEFKTLAFLNAEVDNE

SEQ ID NO: 3076388 - protein, 20 aa, Giardia lamblia
LYLSHILSTLTIVFAVLFQL

SEQ ID NO: 3076389 - protein, 19 aa, Giardia lamblia
LYLSLAAAMVERCLLYGTT

SEQ ID NO: 3076390 - protein, 32 aa, Giardia lamblia
LYMNGCVPRACFPQYNPRASLCGGNGLCDMSS

SEQ ID NO: 3076391 - protein, 25 aa, Giardia lamblia
LYNWNWRNGSIFFLLYGFASLLFLC

SEQ ID NO: 3076392 - protein, 25 aa, Giardia lamblia
LYNWNWRNGSIFFLLYGFTSLLLLC

SEQ ID NO: 3076393 - protein, 21 aa, Giardia lamblia
LYPDPHVYYFDRYLRQNSEAY

SEQ ID NO: 3076394 - protein, 18 aa, Giardia lamblia
LYPKRYILHQGTTKRPSS

SEQ ID NO: 3076395 - protein, 20 aa, Giardia lamblia
LYPQCIGHATNLDKVFEFAV

SEQ ID NO: 3076396 - protein, 18 aa, Giardia lamblia
LYPTIPISFITTNYDNYY

SEQ ID NO: 3076397 - protein, 20 aa, Giardia lamblia
LYQQFKYFFNLYFLGITISQ

SEQ ID NO: 3076398 - protein, 21 aa, Giardia lamblia
LYRDIAVGLSLCMLKTYCNFL

SEQ ID NO: 3076399 - protein, 27 aa, Giardia lamblia
LYREFAVVGVPLGIVFIAAARETHRTT

SEQ ID NO: 3076400 - protein, 19 aa, Giardia lamblia
LYRGGCYPSKSALAQSICA

SEQ ID NO: 3076401 - protein, 18 aa, Giardia lamblia
LYRRFTSVFDSFRADNLT

SEQ ID NO: 3076402 - protein, 26 aa, Giardia lamblia
LYRRILKNIIVFPVFISAECKSFIAK

SEQ ID NO: 3076403 - protein, 17 aa, Giardia lamblia
LYRVTFSTFDFVIHPSL

SEQ ID NO: 3076404 - protein, 19 aa, Giardia lamblia
LYSDCASILYGVLRENGID

SEQ ID NO: 3076405 - protein, 30 aa, Giardia lamblia
LYSHCLKVVVRFQGKYGRFMIDRYSSTFSC

SEQ ID NO: 3076406 - protein, 20 aa, Giardia lamblia
LYSIRIDKTYALSVGTSSFA

SEQ ID NO: 3076407 - protein, 20 aa, Giardia lamblia
LYSLCQGDWVLELTGSAFSD

SEQ ID NO: 3076408 - protein, 25 aa, Giardia lamblia
LYTEIPAYFPLAGYEMYRPYVQRKP

SEQ ID NO: 3076409 - protein, 19 aa, Giardia lamblia
LYTELGCYKRDKIANSMLY

SEQ ID NO: 3076410 - protein, 24 aa, Giardia lamblia
LYTGCAVANCGICRSDQYTCDFCV

SEQ ID NO: 3076411 - protein, 17 aa, Giardia lamblia
LYTLPYYIIRSLNDTEK

SEQ ID NO: 3076412 - protein, 18 aa, Giardia lamblia
LYTSAPLSPMRMLPQQND

SEQ ID NO: 3076413 - protein, 28 aa, Giardia lamblia
LYVRSLCKTHYFLKAEAMLVELVTTLLE

SEQ ID NO: 3076414 - protein, 18 aa, Giardia lamblia
LYVSLLAIVEYHRRIVDP

SEQ ID NO: 3076415 - protein, 26 aa, Giardia lamblia
LYVYIFRGNVRMDWRLLHQNRTFAYV

SEQ ID NO: 3076416 - protein, 22 aa, Giardia lamblia
LYYGYRHVWTMLVLVEAKATLE

SEQ ID NO: 3076417 - protein, 19 aa, Giardia lamblia
LYYILKFVLSICTAYMHWN

SEQ ID NO: 3076418 - protein, 24 aa, Giardia lamblia
MAASARAPCVKRLVSAATAEGHNC

SEQ ID NO: 3076419 - protein, 22 aa, Giardia lamblia
MACMPLCNFLGPAMVPILRCEN

SEQ ID NO: 3076420 - protein, 23 aa, Giardia lamblia
MADDLFRLAVVGSDAALVILDED

SEQ ID NO: 3076421 - protein, 22 aa, Giardia lamblia
MADMLYNCIKKQLNVADDDTVN

SEQ ID NO: 3076422 - protein, 19 aa, Giardia lamblia
MAGIHGCGLCQAQAGSGAV

SEQ ID NO: 3076423 - protein, 17 aa, Giardia lamblia
MAGKPPTILSGRSLLKF

SEQ ID NO: 3076424 - protein, 18 aa, Giardia lamblia
MAGLLCSEKVFLACLNST

SEQ ID NO: 3076425 - protein, 21 aa, Giardia lamblia
MAGSVYSLVTFIRWIIILNAI

SEQ ID NO: 3076426 - protein, 22 aa, Giardia lamblia
MAGVCRYHPALEFLRATPEFQV

SEQ ID NO: 3076427 - protein, 20 aa, Giardia lamblia
MAGVLYRFLQEADRRPFLSA

SEQ ID NO: 3076428 - protein, 29 aa, Giardia lamblia
MAICVGIGTWKCRVMRKALMHVHNKSHRF

SEQ ID NO: 3076429 - protein, 25 aa, Giardia lamblia
MAINFLRPFLFRSIYPGSLDNPPQY

SEQ ID NO: 3076430 - protein, 19 aa, Giardia lamblia
MAKHAVCTRTAFETLGAQN

SEQ ID NO: 3076431 - protein, 17 aa, Giardia lamblia
MALGCMHFVDACSDVSF

SEQ ID NO: 3076432 - protein, 17 aa, Giardia lamblia
MALKRLTIIPDINLHIF

SEQ ID NO: 3076433 - protein, 17 aa, Giardia lamblia
MALLAHRGNEYSASGIE

SEQ ID NO: 3076434 - protein, 24 aa, Giardia lamblia
MALLPRGLTVFGWNASITNDDAFT

SEQ ID NO: 3076435 - protein, 18 aa, Giardia lamblia
MALLSMYIDLVMPKKTGI

SEQ ID NO: 3076436 - protein, 26 aa, Giardia lamblia
MALLYNCTFGPLSLYSLNDGKWIPKD

SEQ ID NO: 3076437 - protein, 22 aa, Giardia lamblia
MAMSNYLLRLALSYPAVLYPLI

SEQ ID NO: 3076438 - protein, 25 aa, Giardia lamblia
MAPYTPFVCDWMYLQLRPVMNLPGV

SEQ ID NO: 3076439 - protein, 23 aa, Giardia lamblia
MASSGSCSYCKIGYSNLAGTCTA

SEQ ID NO: 3076440 - protein, 18 aa, Giardia lamblia
MASSLPRQMPSECGHSKY

SEQ ID NO: 3076441 - protein, 18 aa, Giardia lamblia
MATFKLADVITRTIVTAG

SEQ ID NO: 3076442 - protein, 21 aa, Giardia lamblia
MAVTIPVYYFISLGRNGQVCP

SEQ ID NO: 3076443 - protein, 17 aa, Giardia lamblia
MCGGPLNTCLSISGDQY

SEQ ID NO: 3076444 - protein, 26 aa, Giardia lamblia
MCILKYFVHKHVEAFSGVDKERPSSG

SEQ ID NO: 3076445 - protein, 20 aa, Giardia lamblia
MCPMCASKTVAIFFDSTLDI

SEQ ID NO: 3076446 - protein, 24 aa, Giardia lamblia
MCQFLCAVAARFAHNETVPLVISL

SEQ ID NO: 3076447 - protein, 31 aa, Giardia lamblia
MCVECAAAIKWCLECTGAGACTRCASGAYLE

SEQ ID NO: 3076448 - protein, 17 aa, Giardia lamblia
MDAAELFAPPREEQTMQ

SEQ ID NO: 3076449 - protein, 20 aa, Giardia lamblia
MDAGKILLYLLLKILQSILS

SEQ ID NO: 3076450 - protein, 26 aa, Giardia lamblia
MDEGRLPFLSPMPYRAARLSNVQGAD

SEQ ID NO: 3076451 - protein, 19 aa, Giardia lamblia
MDIFGLAFDTCLDYLSNYN

SEQ ID NO: 3076452 - protein, 22 aa, Giardia lamblia
MDLELMSSLVLDSVQAVASDSF

SEQ ID NO: 3076453 - protein, 17 aa, Giardia lamblia
MDLFFGVPCIPREQEST

SEQ ID NO: 3076454 - protein, 22 aa, Giardia lamblia
MDLQKIDSMVLVFDCVSDEMIT

SEQ ID NO: 3076455 - protein, 20 aa, Giardia lamblia
MDLSSHRFLILQGEIEQVSL

SEQ ID NO: 3076456 - protein, 18 aa, Giardia lamblia
MDLYYGSLVQELGIDLRL

SEQ ID NO: 3076457 - protein, 28 aa, Giardia lamblia
MDQGLRPPQLVFYEMCMLKHDLSKSHGL

SEQ ID NO: 3076458 - protein, 25 aa, Giardia lamblia
MDRKLLGAVCHFFAQYACSCDPSTM

SEQ ID NO: 3076459 - protein, 23 aa, Giardia lamblia
MDYDIGWTVWPLALTVTVGVLVT

SEQ ID NO: 3076460 - protein, 17 aa, Giardia lamblia
MEDGRGLCRRIIHQRKM

SEQ ID NO: 3076461 - protein, 23 aa, Giardia lamblia
MEEFCTMVSLIYGTLGIERDSIC

SEQ ID NO: 3076462 - protein, 20 aa, Giardia lamblia
MEFFCRITPPSAIHKFLQDD

SEQ ID NO: 3076463 - protein, 23 aa, Giardia lamblia
MEFRNRMEILMTIVAQFFERNDI

SEQ ID NO: 3076464 - protein, 17 aa, Giardia lamblia
MEGCITCKGTLSECETC

SEQ ID NO: 3076465 - protein, 27 aa, Giardia lamblia
MEGGRCRRCSKGYLLYYGGCYNTIKPV

SEQ ID NO: 3076466 - protein, 19 aa, Giardia lamblia
MEIQRCFGDIANLSMSTAV

SEQ ID NO: 3076467 - protein, 26 aa, Giardia lamblia
MELQMAKLTIFGSILIGDLSRMNVYY

SEQ ID NO: 3076468 - protein, 19 aa, Giardia lamblia
MELRFQNQCRFASKRLNIA

SEQ ID NO: 3076469 - protein, 26 aa, Giardia lamblia
MEMHGEMRVTIILDYKQMFIFMFLQD

SEQ ID NO: 3076470 - protein, 22 aa, Giardia lamblia
MEPVELILREAFILEWVSGAFF

SEQ ID NO: 3076471 - protein, 17 aa, Giardia lamblia
MEVIKYTNIRKEILMDI

SEQ ID NO: 3076472 - protein, 24 aa, Giardia lamblia
MEVLLKILFILSRTTYNSFDILPF

SEQ ID NO: 3076473 - protein, 18 aa, Giardia lamblia
MEYPDLFCQAEALKQSQI

SEQ ID NO: 3076474 - protein, 19 aa, Giardia lamblia
MFALPIFILILVFINVIIC

SEQ ID NO: 3076475 - protein, 21 aa, Giardia lamblia
MFAYSVCRYKILSRMSDPNVA

SEQ ID NO: 3076476 - protein, 18 aa, Giardia lamblia
MFDLRTLFLQEVASLEMI

SEQ ID NO: 3076477 - protein, 25 aa, Giardia lamblia
MFELSIPFPVGRFISIPSPSSTICS

SEQ ID NO: 3076478 - protein, 18 aa, Giardia lamblia
MFFLCMFLALFLDKHENF

SEQ ID NO: 3076479 - protein, 23 aa, Giardia lamblia
MFGFLYRSSYVSSYVERASDIIK

SEQ ID NO: 3076480 - protein, 20 aa, Giardia lamblia
MFGGDFIGIVACSLNMDALI

SEQ ID NO: 3076481 - protein, 20 aa, Giardia lamblia
MFKGVILLLLASALGCVPRQ

SEQ ID NO: 3076482 - protein, 27 aa, Giardia lamblia
MFLLDQRYSIEISRKQLSGWLADQLVS

SEQ ID NO: 3076483 - protein, 23 aa, Giardia lamblia
MFSCFATGFAILFVILDTMGDES

SEQ ID NO: 3076484 - protein, 18 aa, Giardia lamblia
MFTGYIVIILPELIYHED

SEQ ID NO: 3076485 - protein, 18 aa, Giardia lamblia
MFTSFGLTYGFVTQIRPL

SEQ ID NO: 3076486 - protein, 29 aa, Giardia lamblia
MFTTLRILPRYVKQTDIAPLFKKAVAVQQ

SEQ ID NO: 3076487 - protein, 20 aa, Giardia lamblia
MGAFYMKSKFALTKIDADNA

SEQ ID NO: 3076488 - protein, 17 aa, Giardia lamblia
MGASGCKEECRINVDGC

SEQ ID NO: 3076489 - protein, 25 aa, Giardia lamblia
MGCIVNFPAACAFRGLAGIGSACLY

SEQ ID NO: 3076490 - protein, 19 aa, Giardia lamblia
MGCVEAISYLTSRYKRARS

SEQ ID NO: 3076491 - protein, 17 aa, Giardia lamblia
MGGCYKVASPPGNLMCT

SEQ ID NO: 3076492 - protein, 18 aa, Giardia lamblia
MGILCASSVFGTIFDMRW

SEQ ID NO: 3076493 - protein, 24 aa, Giardia lamblia
MGLSFRNLLTFVGLPTKTSVGKDI

SEQ ID NO: 3076494 - protein, 23 aa, Giardia lamblia
MGMDFSNYFPIVIIVLTILFASN

SEQ ID NO: 3076495 - protein, 24 aa, Giardia lamblia
MGPLPTKLRPSSRRNRGSTSAQRG

SEQ ID NO: 3076496 - protein, 23 aa, Giardia lamblia
MGSVLFAFLLCHCIHSNHMEMIW

SEQ ID NO: 3076497 - protein, 22 aa, Giardia lamblia
MGVGDIRFYGGWYGYVLGDKEA

SEQ ID NO: 3076498 - protein, 18 aa, Giardia lamblia
MGVICSLVPQSYGLNLTC

SEQ ID NO: 3076499 - protein, 17 aa, Giardia lamblia
MGVLRPSLYTVGLSASA

SEQ ID NO: 3076500 - protein, 17 aa, Giardia lamblia
MHAACNGFIDIAFVLAE

SEQ ID NO: 3076501 - protein, 17 aa, Giardia lamblia
MHLQLPPLCPSSRTEKP

SEQ ID NO: 3076502 - protein, 25 aa, Giardia lamblia
MHMYCSRLMACVGCMLAVGGDHAFR

SEQ ID NO: 3076503 - protein, 24 aa, Giardia lamblia
MHYGDPPPAAWSWGDVGGASFLPA

SEQ ID NO: 3076504 - protein, 18 aa, Giardia lamblia
MIAVPLKLLMIVLFLVFQ

SEQ ID NO: 3076505 - protein, 27 aa, Giardia lamblia
MIAVTRRKLDFVKLLAPVEAGKKNSNG

SEQ ID NO: 3076506 - protein, 18 aa, Giardia lamblia
MIDACISVTVTMSDFILR

SEQ ID NO: 3076507 - protein, 34 aa, Giardia lamblia
MIDLSTPWRRFSFSVKRLLLKLSRSTSGGLENDD

SEQ ID NO: 3076508 - protein, 23 aa, Giardia lamblia
MIDRYSSTFSCARFTGDDRTKKK

SEQ ID NO: 3076509 - protein, 19 aa, Giardia lamblia
MIEEVVWRVAAYLSSALYY

SEQ ID NO: 3076510 - protein, 22 aa, Giardia lamblia
MIEKLIPREAMGMTLLVTDVEK

SEQ ID NO: 3076511 - protein, 19 aa, Giardia lamblia
MIEYIGLLTYRSISERIRV

SEQ ID NO: 3076512 - protein, 18 aa, Giardia lamblia
MILCDFELALPSTRLSPS

SEQ ID NO: 3076513 - protein, 40 aa, Giardia lamblia
MIMRLPRYIDCAPALPSNRCARCGGKRPEHYCHACTGHFC

SEQ ID NO: 3076514 - protein, 18 aa, Giardia lamblia
MIQDCYDSLYFGETYQPL

SEQ ID NO: 3076515 - protein, 19 aa, Giardia lamblia
MIRNPCYIEDGTFIDPYDY

SEQ ID NO: 3076516 - protein, 17 aa, Giardia lamblia
MISRFAFEYPAAGVSVE

SEQ ID NO: 3076517 - protein, 26 aa, Giardia lamblia
MITKLFKLYPSMSIHALVSLVPPGSM

SEQ ID NO: 3076518 - protein, 24 aa, Giardia lamblia
MITLRPERMLTLLVGQSASTYGLE

SEQ ID NO: 3076519 - protein, 25 aa, Giardia lamblia
MITMLTPKMGMLWGETASKEMVLMF

SEQ ID NO: 3076520 - protein, 25 aa, Giardia lamblia
MITRFLFKNLRLCAIDKACASLSSL

SEQ ID NO: 3076521 - protein, 21 aa, Giardia lamblia
MIVFCSLNFLIKAYPFAEFEY

SEQ ID NO: 3076522 - protein, 25 aa, Giardia lamblia
MKDILIRVYYAWFIKTPIFSTEIYN

SEQ ID NO: 3076523 - protein, 18 aa, Giardia lamblia
MKEAGRGRQGRRICTADY

SEQ ID NO: 3076524 - protein, 23 aa, Giardia lamblia
MKGLMLELPGNWDGLLGKVEGGS

SEQ ID NO: 3076525 - protein, 21 aa, Giardia lamblia
MKGSQSRVFKQFTKKASKAQQ

SEQ ID NO: 3076526 - protein, 25 aa, Giardia lamblia
MKIDDCPIYLYPIPVTIVICIEVLL

SEQ ID NO: 3076527 - protein, 19 aa, Giardia lamblia
MKLDVGSLVAYALLCGYVS

SEQ ID NO: 3076528 - protein, 20 aa, Giardia lamblia
MKLPQEWIIPLSTYDTITPF

SEQ ID NO: 3076529 - protein, 19 aa, Giardia lamblia
MKMAILRLLSMTSVISGLA

SEQ ID NO: 3076530 - protein, 17 aa, Giardia lamblia
MKMAVIIGILQMIFGIV

SEQ ID NO: 3076531 - protein, 20 aa, Giardia lamblia
MKMRCPVIISGYVLANVTAL

SEQ ID NO: 3076532 - protein, 20 aa, Giardia lamblia
MKNTIMRRSLIFTNYPAITY

SEQ ID NO: 3076533 - protein, 21 aa, Giardia lamblia
MKPRNAESLLDLQTEAFLKHL

SEQ ID NO: 3076534 - protein, 23 aa, Giardia lamblia
MKRKCASCSDFSLMADAAHSTEA

SEQ ID NO: 3076535 - protein, 25 aa, Giardia lamblia
MKRTNILRIILLLSSLVIGGVVVFL

SEQ ID NO: 3076536 - protein, 19 aa, Giardia lamblia
MKTMCKDGIHIKNYDSIEN

SEQ ID NO: 3076537 - protein, 17 aa, Giardia lamblia
MKTRSFHSYSMVSLTSW

SEQ ID NO: 3076538 - protein, 24 aa, Giardia lamblia
MKVFSQHFVHLFSLLPDDMKNGTT

SEQ ID NO: 3076539 - protein, 20 aa, Giardia lamblia
MKVKKAFLPGNIVPAANCQT

SEQ ID NO: 3076540 - protein, 26 aa, Giardia lamblia
MKYVDGRTALMWGAFTGHLDCAKALF

SEQ ID NO: 3076541 - protein, 31 aa, Giardia lamblia
MLAEQRASYVWRTICPDSHFTNCDQSYMCMS

SEQ ID NO: 3076542 - protein, 19 aa, Giardia lamblia
MLAISCLWLQAHGEEDDLR

SEQ ID NO: 3076543 - protein, 18 aa, Giardia lamblia
MLARCGVGTIILVDKDVV

SEQ ID NO: 3076544 - protein, 17 aa, Giardia lamblia
MLARLDYTLPFSLGTIL

SEQ ID NO: 3076545 - protein, 17 aa, Giardia lamblia
MLCLELLAANRKVALKF

SEQ ID NO: 3076546 - protein, 19 aa, Giardia lamblia
MLDSIPIYNSKAMRKLFRL

SEQ ID NO: 3076547 - protein, 27 aa, Giardia lamblia
MLEKHLSKIFPGFAHFIFASSSDLCHC

SEQ ID NO: 3076548 - protein, 27 aa, Giardia lamblia
MLEMIDPRVDTIYPFINICLRVPSENA

SEQ ID NO: 3076549 - protein, 18 aa, Giardia lamblia
MLEMLRLQTISFLDETVD

SEQ ID NO: 3076550 - protein, 20 aa, Giardia lamblia
MLFCECISALVAQDACRAEL

SEQ ID NO: 3076551 - protein, 22 aa, Giardia lamblia
MLFITRIVSFLQNYLSNPSFRG

SEQ ID NO: 3076552 - protein, 19 aa, Giardia lamblia
MLFTMGYCVIVRNRKGKAK

SEQ ID NO: 3076553 - protein, 24 aa, Giardia lamblia
MLHGFYPDLHIIFKLMTPPDTLLA

SEQ ID NO: 3076554 - protein, 25 aa, Giardia lamblia
MLHHVSPYAMKRGHTMSIGMLARAC

SEQ ID NO: 3076555 - protein, 25 aa, Giardia lamblia
MLIHHCKRLHECLDVLCRYEHILQS

SEQ ID NO: 3076556 - protein, 18 aa, Giardia lamblia
MLITGAWISSHFFICKQA

SEQ ID NO: 3076557 - protein, 24 aa, Giardia lamblia
MLITPVLCLCYWVLAAYVDLLLPS

SEQ ID NO: 3076558 - protein, 19 aa, Giardia lamblia
MLKDDMDIIDCPHNESKRA

SEQ ID NO: 3076559 - protein, 34 aa, Giardia lamblia
MLKGPLYLRMRVLKLSIIIAMSLCTVLYCLVGFF

SEQ ID NO: 3076560 - protein, 31 aa, Giardia lamblia
MLLCITSFCACLRLYAVDLRWSPHRTPVPES

SEQ ID NO: 3076561 - protein, 26 aa, Giardia lamblia
MLLSIAFVCVWLFHPVFAGAAVLGSV

SEQ ID NO: 3076562 - protein, 31 aa, Giardia lamblia
MLNEIHMLTALHCPRIPQVIETFYAEDEHKI

SEQ ID NO: 3076563 - protein, 22 aa, Giardia lamblia
MLNSADAYEVFGAILDNSTLMT

SEQ ID NO: 3076564 - protein, 27 aa, Giardia lamblia
MLNTFGCLFSLWYLLVLKIYATGDFFV

SEQ ID NO: 3076565 - protein, 18 aa, Giardia lamblia
MLNYRLLVQVLYDPDGLF

SEQ ID NO: 3076566 - protein, 18 aa, Giardia lamblia
MLPYSWRKKHLIQYEQAC

SEQ ID NO: 3076567 - protein, 22 aa, Giardia lamblia
MLRSELDLYRSLHGDIKERTES

SEQ ID NO: 3076568 - protein, 26 aa, Giardia lamblia
MLSLLWSILCTICLTPSAVPLLKFMD

SEQ ID NO: 3076569 - protein, 18 aa, Giardia lamblia
MLSPITVALIGQRGSGKS

SEQ ID NO: 3076570 - protein, 22 aa, Giardia lamblia
MLTDARRLTGRYIRSYEYVLRY

SEQ ID NO: 3076571 - protein, 17 aa, Giardia lamblia
MLVPHFRQGGLVGTLGT

SEQ ID NO: 3076572 - protein, 18 aa, Giardia lamblia
MLVVSGFLQKSIGGMFFN

SEQ ID NO: 3076573 - protein, 17 aa, Giardia lamblia
MLWEYLHDMSITLTKNS

SEQ ID NO: 3076574 - protein, 21 aa, Giardia lamblia
MLYERRYAPALEFADSVLRGS

SEQ ID NO: 3076575 - protein, 26 aa, Giardia lamblia
MLYGSVSLIFLCFVRPILEQNVANQL

SEQ ID NO: 3076576 - protein, 24 aa, Giardia lamblia
MLYIFNCTFYILLLLSQNKLAEVE

SEQ ID NO: 3076577 - protein, 21 aa, Giardia lamblia
MLYNVCYKIFGSDAEKEEYFR

SEQ ID NO: 3076578 - protein, 21 aa, Giardia lamblia
MMEILKITPIRNYYSKQFNDL

SEQ ID NO: 3076579 - protein, 23 aa, Giardia lamblia
MMELMRIVPRYILELLAGALEAN

SEQ ID NO: 3076580 - protein, 36 aa, Giardia lamblia
MMGQRYTNRWLADFTYNFILSFCVAVLLVIMCYAGD

SEQ ID NO: 3076581 - protein, 26 aa, Giardia lamblia
MMKAALEMLASLMALINYHNKYGPIL

SEQ ID NO: 3076582 - protein, 18 aa, Giardia lamblia
MMPYDLRNASSYRTGTKS

SEQ ID NO: 3076583 - protein, 27 aa, Giardia lamblia
MMQLRSMKANMRFYVPDSRIFVGVYDC

SEQ ID NO: 3076584 - protein, 17 aa, Giardia lamblia
MMRLCDMLTTTPGLAQG

SEQ ID NO: 3076585 - protein, 38 aa, Giardia lamblia
MNAILIGRLNGAVVLCYKELKPAAAANLGAHMRGVLEQ

SEQ ID NO: 3076586 - protein, 29 aa, Giardia lamblia
MNCMKCNSSGCLRCDSGWLLIESECVPCK

SEQ ID NO: 3076587 - protein, 23 aa, Giardia lamblia
MNDLRWHEFPCFAAEGSQGLSSF

SEQ ID NO: 3076588 - protein, 24 aa, Giardia lamblia
MNDYPRISAVNMLEPLLDIILPII

SEQ ID NO: 3076589 - protein, 19 aa, Giardia lamblia
MNEVLTIVFSFFLPALNAL

SEQ ID NO: 3076590 - protein, 22 aa, Giardia lamblia
MNGSFCPQRRQLLTTASSTAQQ

SEQ ID NO: 3076591 - protein, 26 aa, Giardia lamblia
MNILFLRRRVRLYQWIAIIGTVSACA

SEQ ID NO: 3076592 - protein, 24 aa, Giardia lamblia
MNIVKKRPAFPLDVVLRAIKKLDT

SEQ ID NO: 3076593 - protein, 27 aa, Giardia lamblia
MNKSKRILAHYLFIIFLLLASTLGGYA

SEQ ID NO: 3076594 - protein, 29 aa, Giardia lamblia
MNLDRPHLLPALKTGWWFATVYESELLYC

SEQ ID NO: 3076595 - protein, 20 aa, Giardia lamblia
MNLPVPKRIPLLYPGLEKAS

SEQ ID NO: 3076596 - protein, 21 aa, Giardia lamblia
MNMARFVSMINNFAPRPATSS

SEQ ID NO: 3076597 - protein, 20 aa, Giardia lamblia
MNQFFLLPAEYGYLTTADLN

SEQ ID NO: 3076598 - protein, 29 aa, Giardia lamblia
MNVLVPLLLRLVQMMFARYSSLLEALGVS

SEQ ID NO: 3076599 - protein, 18 aa, Giardia lamblia
MNVTKGYLFRLLPFPERV

SEQ ID NO: 3076600 - protein, 21 aa, Giardia lamblia
MPDTLPAFGASVFAPSVHRAA

SEQ ID NO: 3076601 - protein, 31 aa, Giardia lamblia
MPEKSENIFLIAIRYYLSFFHIPGESQQIER

SEQ ID NO: 3076602 - protein, 26 aa, Giardia lamblia
MPFYYRTSLFVALKLMIQYFKVLAEG

SEQ ID NO: 3076603 - protein, 40 aa, Giardia lamblia
MPGDKYLGMTAFLMACAMNCIGVVKLIMEAAGETGSSNKE

SEQ ID NO: 3076604 - protein, 19 aa, Giardia lamblia
MPGLQGMALTYRLDDLVSG

SEQ ID NO: 3076605 - protein, 24 aa, Giardia lamblia
MPIPSNHVLYHLFKKKGEAHAESF

SEQ ID NO: 3076606 - protein, 19 aa, Giardia lamblia
MPIVSLIIKCIRLEELFLI

SEQ ID NO: 3076607 - protein, 18 aa, Giardia lamblia
MPNLDVVSPYILTHDLHQ

SEQ ID NO: 3076608 - protein, 17 aa, Giardia lamblia
MPSISGAGFPFPQESPH

SEQ ID NO: 3076609 - protein, 23 aa, Giardia lamblia
MPSPEEHLYLAAYVQSVITVCGY

SEQ ID NO: 3076610 - protein, 17 aa, Giardia lamblia
MPSYVSTSLLPKASATP

SEQ ID NO: 3076611 - protein, 18 aa, Giardia lamblia
MQACVSCSDTARQGIANC

SEQ ID NO: 3076612 - protein, 18 aa, Giardia lamblia
MQAYMPHLLRSCSLEPVR

SEQ ID NO: 3076613 - protein, 24 aa, Giardia lamblia
MQDRTGWTALMWATQGNYATCVKE

SEQ ID NO: 3076614 - protein, 25 aa, Giardia lamblia
MQEVEALADRCCIMKLGKVIAEGTI

SEQ ID NO: 3076615 - protein, 23 aa, Giardia lamblia
MQIPVQFPLQIPKPGSMDDVGIC

SEQ ID NO: 3076616 - protein, 22 aa, Giardia lamblia
MQKQDIAMCYKKKMTTINGGYV

SEQ ID NO: 3076617 - protein, 27 aa, Giardia lamblia
MQKYAGRWRSIICIYELAARLLKIGSL

SEQ ID NO: 3076618 - protein, 18 aa, Giardia lamblia
MQLALPIFELILSFTSQR

SEQ ID NO: 3076619 - protein, 23 aa, Giardia lamblia
MQLSYRKCLLIIGISMSSLSINS

SEQ ID NO: 3076620 - protein, 18 aa, Giardia lamblia
MQMKAMRFFIQLSPLVLA

SEQ ID NO: 3076621 - protein, 18 aa, Giardia lamblia
MQRANLKSGYLAEKLSAL

SEQ ID NO: 3076622 - protein, 22 aa, Giardia lamblia
MQSTRFLHRYFGRNFMTIEALS

SEQ ID NO: 3076623 - protein, 23 aa, Giardia lamblia
MQTLTCKGLVYSASDLLIPDSAD

SEQ ID NO: 3076624 - protein, 29 aa, Giardia lamblia
MQTPYCICFPRYYIVSADEGMASKPNSYG

SEQ ID NO: 3076625 - protein, 17 aa, Giardia lamblia
MQVKLADFGVCRLYENA

SEQ ID NO: 3076626 - protein, 23 aa, Giardia lamblia
MQVPSEAAASCFTKYEQTPTVIG

SEQ ID NO: 3076627 - protein, 25 aa, Giardia lamblia
MQWLPELNEALGLITMDGHVQRTVM

SEQ ID NO: 3076628 - protein, 20 aa, Giardia lamblia
MQYGSSYAKRACPLALAVMN

SEQ ID NO: 3076629 - protein, 18 aa, Giardia lamblia
MRAIKSVLVMAGGLRRKY

SEQ ID NO: 3076630 - protein, 18 aa, Giardia lamblia
MRDSYSISFRTANQQTFK

SEQ ID NO: 3076631 - protein, 28 aa, Giardia lamblia
MRDTFCRSATLLPIFMRAVCNLPEYIKQ

SEQ ID NO: 3076632 - protein, 24 aa, Giardia lamblia
MREYEFLLLLLMIRTAMALALGIK

SEQ ID NO: 3076633 - protein, 20 aa, Giardia lamblia
MRFYRLHRAIPLGMPAVPVS

SEQ ID NO: 3076634 - protein, 19 aa, Giardia lamblia
MRGSAAAQERPRVLRGPTI

SEQ ID NO: 3076635 - protein, 31 aa, Giardia lamblia
MRGYIEMRKKLKILLGLKAFRGVKISSQTSL

SEQ ID NO: 3076636 - protein, 18 aa, Giardia lamblia
MRGYLSAKSLSVEKLPLL

SEQ ID NO: 3076637 - protein, 23 aa, Giardia lamblia
MRHYLYSALYSWQQPLRAALLSV

SEQ ID NO: 3076638 - protein, 17 aa, Giardia lamblia
MRIVRDSLLGFCLYVPF

SEQ ID NO: 3076639 - protein, 23 aa, Giardia lamblia
MRKPVYCATCKVPRCCTRESQQN

SEQ ID NO: 3076640 - protein, 25 aa, Giardia lamblia
MRKPVYCATCKVPRCCTRESQQNVA

SEQ ID NO: 3076641 - protein, 24 aa, Giardia lamblia
MRNWKNETALMLAIMNEQEECIKL

SEQ ID NO: 3076642 - protein, 17 aa, Giardia lamblia
MRPLLKLSADGDMSVTF

SEQ ID NO: 3076643 - protein, 18 aa, Giardia lamblia
MRPSLKLHQQRGAASDTI

SEQ ID NO: 3076644 - protein, 21 aa, Giardia lamblia
MRREFSIVPSHIVWTLYRQLL

SEQ ID NO: 3076645 - protein, 23 aa, Giardia lamblia
MRRKIESWPHYGVSYRVCPNYDA

SEQ ID NO: 3076646 - protein, 18 aa, Giardia lamblia
MRSATLLRRFFYIDDHNS

SEQ ID NO: 3076647 - protein, 22 aa, Giardia lamblia
MRSLEDSGRFSPEMSTILERLM

SEQ ID NO: 3076648 - protein, 19 aa, Giardia lamblia
MRTLIHIYYLFSILSQALF

SEQ ID NO: 3076649 - protein, 18 aa, Giardia lamblia
MRTRTEFHPEYVPYNKYP

SEQ ID NO: 3076650 - protein, 19 aa, Giardia lamblia
MRTSIVWICMVVVYYCTYK

SEQ ID NO: 3076651 - protein, 17 aa, Giardia lamblia
MRVYIVAYYLYDTLVTQ

SEQ ID NO: 3076652 - protein, 20 aa, Giardia lamblia
MRYAKESLKFAERLLNAQEL

SEQ ID NO: 3076653 - protein, 19 aa, Giardia lamblia
MRYSQEWEAIVKRSGRWID

SEQ ID NO: 3076654 - protein, 25 aa, Giardia lamblia
MSAELSTLFPCCGSPIDWTADMGHF

SEQ ID NO: 3076655 - protein, 21 aa, Giardia lamblia
MSASVCGEGPQQLSILSPNES

SEQ ID NO: 3076656 - protein, 25 aa, Giardia lamblia
MSEPFPEIYALLLYSVNSMTPVLQK

SEQ ID NO: 3076657 - protein, 20 aa, Giardia lamblia
MSGCAVAVEILIPHEATLTD

SEQ ID NO: 3076658 - protein, 18 aa, Giardia lamblia
MSGQYLHRQQQRLPTDKM

SEQ ID NO: 3076659 - protein, 29 aa, Giardia lamblia
MSGSCTRIASRFSVELDVFLQILMPLLSS

SEQ ID NO: 3076660 - protein, 17 aa, Giardia lamblia
MSGTLYSSFLHALQTMG

SEQ ID NO: 3076661 - protein, 20 aa, Giardia lamblia
MSGYSNFGFLLVLSMASIGI

SEQ ID NO: 3076662 - protein, 23 aa, Giardia lamblia
MSIHRIPLIRKVRDYYAYYLKEV

SEQ ID NO: 3076663 - protein, 25 aa, Giardia lamblia
MSILILLLDCFFLRNSPGKDGDQLV

SEQ ID NO: 3076664 - protein, 17 aa, Giardia lamblia
MSIRTAAAIARCATYNS

SEQ ID NO: 3076665 - protein, 30 aa, Giardia lamblia
MSISALRLIYVLVFLPTVYLIFLYYDRHAR

SEQ ID NO: 3076666 - protein, 27 aa, Giardia lamblia
MSIYGLRLGRILWAFLPARDVVSNWKT

SEQ ID NO: 3076667 - protein, 17 aa, Giardia lamblia
MSKVVDFRIIYTMVTKI

SEQ ID NO: 3076668 - protein, 18 aa, Giardia lamblia
MSLADAYSKFHILVDQVL

SEQ ID NO: 3076669 - protein, 20 aa, Giardia lamblia
MSLALLFYLTVLMWTEETAT

SEQ ID NO: 3076670 - protein, 26 aa, Giardia lamblia
MSLCTVLYCLVGFFGALIFGKTIDSN

SEQ ID NO: 3076671 - protein, 18 aa, Giardia lamblia
MSLFCLPFSTAKEIEERS

SEQ ID NO: 3076672 - protein, 18 aa, Giardia lamblia
MSLIPLLCEKEFGRLDRF

SEQ ID NO: 3076673 - protein, 18 aa, Giardia lamblia
MSLQEFLIGLPLDSCKSS

SEQ ID NO: 3076674 - protein, 26 aa, Giardia lamblia
MSLRDPVRILLPFVLVTFLKRLLFII

SEQ ID NO: 3076675 - protein, 24 aa, Giardia lamblia
MSNCPGLTVSHLFPEHTKILLYLR

SEQ ID NO: 3076676 - protein, 19 aa, Giardia lamblia
MSPKFARSKALGIDPRSLA

SEQ ID NO: 3076677 - protein, 25 aa, Giardia lamblia
MSRLNLYYCLLDFLSECIGVQKIKS

SEQ ID NO: 3076678 - protein, 33 aa, Giardia lamblia
MSSAALPWIRMCAFYKHCYEGLLTNRESLLNFG

SEQ ID NO: 3076679 - protein, 22 aa, Giardia lamblia
MSSRHLREFGSRHLLRVEFAVP

SEQ ID NO: 3076680 - protein, 23 aa, Giardia lamblia
MSTPHILSPLGFGLDSVAIIDNQ

SEQ ID NO: 3076681 - protein, 33 aa, Giardia lamblia
MSVCQCAGEFPLFKCCAVALFYSILLVFEYGDS

SEQ ID NO: 3076682 - protein, 18 aa, Giardia lamblia
MSVINVFASMAFSMDSVN

SEQ ID NO: 3076683 - protein, 19 aa, Giardia lamblia
MSYAVLFSYALPMSLFVSL

SEQ ID NO: 3076684 - protein, 19 aa, Giardia lamblia
MSYLRVVEHTVWKEVNEKL

SEQ ID NO: 3076685 - protein, 17 aa, Giardia lamblia
MTACAHILAVLGGQDPQ

SEQ ID NO: 3076686 - protein, 17 aa, Giardia lamblia
MTARLSHTPSWRMFLLV

SEQ ID NO: 3076687 - protein, 20 aa, Giardia lamblia
MTAVLKRDRVGLSVYIDQAG

SEQ ID NO: 3076688 - protein, 21 aa, Giardia lamblia
MTEEGCRLVLRSLMQSESEEF

SEQ ID NO: 3076689 - protein, 28 aa, Giardia lamblia
MTEFRGLKKLLLWYGKCSYVGSAQICQF

SEQ ID NO: 3076690 - protein, 22 aa, Giardia lamblia
MTERADCIGILEILLGSHALLS

SEQ ID NO: 3076691 - protein, 26 aa, Giardia lamblia
MTFGLLDVLLCLGIERASFHILGPKP

SEQ ID NO: 3076692 - protein, 26 aa, Giardia lamblia
MTGHYNFPIIGEWNRSTGLFLSVPTY

SEQ ID NO: 3076693 - protein, 28 aa, Giardia lamblia
MTGYHRLATPLIHYAHKFGLEGEIELFK

SEQ ID NO: 3076694 - protein, 19 aa, Giardia lamblia
MTILPELLLLLPDLCSISL

SEQ ID NO: 3076695 - protein, 27 aa, Giardia lamblia
MTIPLLMVRCISFRTAFRCSSLYTLHS

SEQ ID NO: 3076696 - protein, 17 aa, Giardia lamblia
MTKCPSVTFLADNPVDK

SEQ ID NO: 3076697 - protein, 37 aa, Giardia lamblia
MTLARSCIHLVGYMTWPAMLLCAFLSMLKAGTFTTAN

SEQ ID NO: 3076698 - protein, 26 aa, Giardia lamblia
MTLRVLTMLLGFAFMCCVSVIEGVVG

SEQ ID NO: 3076699 - protein, 24 aa, Giardia lamblia
MTMPLMFVCYLVYMAIEIDPKGIG

SEQ ID NO: 3076700 - protein, 22 aa, Giardia lamblia
MTRDGRTALMIAASRDYPDVCE

SEQ ID NO: 3076701 - protein, 23 aa, Giardia lamblia
MTRSKLLKVLACMTSSSDECRLV

SEQ ID NO: 3076702 - protein, 20 aa, Giardia lamblia
MTRSRASGFYGADDDDDRLS

SEQ ID NO: 3076703 - protein, 25 aa, Giardia lamblia
MTRSYRLPFILGYNLGAKKLYLVLV

SEQ ID NO: 3076704 - protein, 23 aa, Giardia lamblia
MTSAKRPILYHLIQAETGKEIPV

SEQ ID NO: 3076705 - protein, 23 aa, Giardia lamblia
MTSASMFRLCKTVGRINLDELCT

SEQ ID NO: 3076706 - protein, 26 aa, Giardia lamblia
MTSKLFASCFAFLFSLDTIFSASHDG

SEQ ID NO: 3076707 - protein, 24 aa, Giardia lamblia
MTSLCCIRAIDLLKVGLDRTEEMR

SEQ ID NO: 3076708 - protein, 27 aa, Giardia lamblia
MTTSLLKLTALFARTSYALIAARTHLL

SEQ ID NO: 3076709 - protein, 25 aa, Giardia lamblia
MTVMSVDISDEFLIIMFGQTNGGSQ

SEQ ID NO: 3076710 - protein, 24 aa, Giardia lamblia
MTVRPVCIFVLMLVLALTNGNGAD

SEQ ID NO: 3076711 - protein, 26 aa, Giardia lamblia
MVASISACPFCKAQITTVVTLDSPAS

SEQ ID NO: 3076712 - protein, 24 aa, Giardia lamblia
MVDSCLDILSGLVLFICARLARSG

SEQ ID NO: 3076713 - protein, 24 aa, Giardia lamblia
MVFIFPGMFGYSVTKRFGGPKHRY

SEQ ID NO: 3076714 - protein, 17 aa, Giardia lamblia
MVFKSSKTLGILMTALL

SEQ ID NO: 3076715 - protein, 26 aa, Giardia lamblia
MVHLTANVRAAAILDAFFKDRFIVDG

SEQ ID NO: 3076716 - protein, 26 aa, Giardia lamblia
MVIFPICCNNHWSIYMYIGKQSKLSN

SEQ ID NO: 3076717 - protein, 19 aa, Giardia lamblia
MVKHAKMSILYDILTLRDD

SEQ ID NO: 3076718 - protein, 20 aa, Giardia lamblia
MVKRMLSIRLSFNDIHIQAI

SEQ ID NO: 3076719 - protein, 22 aa, Giardia lamblia
MVMEAICILVGAKPDWDSAKKV

SEQ ID NO: 3076720 - protein, 26 aa, Giardia lamblia
MVMIKNAWEAFVLRYSKEQTRRAFLD

SEQ ID NO: 3076721 - protein, 24 aa, Giardia lamblia
MVNVCPIINICLAIGQTKTNVNAL

SEQ ID NO: 3076722 - protein, 21 aa, Giardia lamblia
MVPVPIKIGGRIQPVVYLPNK

SEQ ID NO: 3076723 - protein, 25 aa, Giardia lamblia
MVSTLCVLVSWAGMILIGQWTRISV

SEQ ID NO: 3076724 - protein, 22 aa, Giardia lamblia
MVTRPLRTMVMVVPLPVELQRL

SEQ ID NO: 3076725 - protein, 18 aa, Giardia lamblia
MVVALVCWLVLRRRRGPK

SEQ ID NO: 3076726 - protein, 17 aa, Giardia lamblia
MVVIASFLMRLTQTNPA

SEQ ID NO: 3076727 - protein, 17 aa, Giardia lamblia
MWAFGVMIFELATGRTP

SEQ ID NO: 3076728 - protein, 17 aa, Giardia lamblia
MWDAIQMAKYERSIVLT

SEQ ID NO: 3076729 - protein, 17 aa, Giardia lamblia
MWIVIAVIACTHVVVMM

SEQ ID NO: 3076730 - protein, 20 aa, Giardia lamblia
MWYNYCGGVGDCVKKKDGNE

SEQ ID NO: 3076731 - protein, 23 aa, Giardia lamblia
MYCLDIRFEQILSRENGSASTAD

SEQ ID NO: 3076732 - protein, 21 aa, Giardia lamblia
MYGCSAVIPLLLKLEAGLQDN

SEQ ID NO: 3076733 - protein, 20 aa, Giardia lamblia
MYHCACSNPLFDEFSNCAEC

SEQ ID NO: 3076734 - protein, 18 aa, Giardia lamblia
MYKSLPWYNKKTNLQATK

SEQ ID NO: 3076735 - protein, 20 aa, Giardia lamblia
MYLLEIFSLLMILKSTEHSL

SEQ ID NO: 3076736 - protein, 19 aa, Giardia lamblia
MYLLHLDILMFTKYNLPVL

SEQ ID NO: 3076737 - protein, 18 aa, Giardia lamblia
MYNKFTGLDNMRAPINRI

SEQ ID NO: 3076738 - protein, 26 aa, Giardia lamblia
MYNKGWRAASLLIVLIPVHVGQFYAE

SEQ ID NO: 3076739 - protein, 27 aa, Giardia lamblia
MYNVCTFTMACLFIRQYCEAQSGTLTT

SEQ ID NO: 3076740 - protein, 18 aa, Giardia lamblia
MYNYGFSRFDFVHNALFT

SEQ ID NO: 3076741 - protein, 17 aa, Giardia lamblia
MYPVFPWLADDRNLAKT

SEQ ID NO: 3076742 - protein, 25 aa, Giardia lamblia
MYSLGITLLELWFLPTASDNLSNLR

SEQ ID NO: 3076743 - protein, 19 aa, Giardia lamblia
MYSYGVVAFACFVGNINLF

SEQ ID NO: 3076744 - protein, 17 aa, Giardia lamblia
MYSYGWADNGHASHEAL

SEQ ID NO: 3076745 - protein, 18 aa, Giardia lamblia
MYTGLWIFCAWLCCSLQK

SEQ ID NO: 3076746 - protein, 17 aa, Giardia lamblia
MYTLKCLNIDSSRISSE

SEQ ID NO: 3076747 - protein, 25 aa, Giardia lamblia
MYTLSLRLSTLVLMPYSISACDDIA

SEQ ID NO: 3076748 - protein, 18 aa, Giardia lamblia
MYVDIVCKYTQFKWYSRR

SEQ ID NO: 3076749 - protein, 24 aa, Giardia lamblia
NAALILLLRIVYRIISNSSAPQSK

SEQ ID NO: 3076750 - protein, 18 aa, Giardia lamblia
NAALTMLSKMSKFQDIHL

SEQ ID NO: 3076751 - protein, 22 aa, Giardia lamblia
NACEIPFGLSLDGRNCLEVGGC

SEQ ID NO: 3076752 - protein, 25 aa, Giardia lamblia
NACRIAKALRFQRPILLEGDPGVGK

SEQ ID NO: 3076753 - protein, 18 aa, Giardia lamblia
NADFSSRLQFFGDPSIEM

SEQ ID NO: 3076754 - protein, 21 aa, Giardia lamblia
NADLCRADRQLSGSVDQTCAT

SEQ ID NO: 3076755 - protein, 22 aa, Giardia lamblia
NADSRYVEFTGITIEIQLKIAV

SEQ ID NO: 3076756 - protein, 20 aa, Giardia lamblia
NAEELLPFLIDKANVAWIIE

SEQ ID NO: 3076757 - protein, 20 aa, Giardia lamblia
NAGACPPCNVPCKTCVNSAD

SEQ ID NO: 3076758 - protein, 17 aa, Giardia lamblia
NAGEYVLDWAQRGGEKA

SEQ ID NO: 3076759 - protein, 25 aa, Giardia lamblia
NAGLCLTCVYPAYSIQPDRRSCSLG

SEQ ID NO: 3076760 - protein, 19 aa, Giardia lamblia
NAGLWAFGSMDVPKDRFIL

SEQ ID NO: 3076761 - protein, 18 aa, Giardia lamblia
NAHDSLDLFAKVCISVLR

SEQ ID NO: 3076762 - protein, 19 aa, Giardia lamblia
NAHHVLFTVVFKGYNVVTG

SEQ ID NO: 3076763 - protein, 18 aa, Giardia lamblia
NAILEFVELLGKYPLLTH

SEQ ID NO: 3076764 - protein, 21 aa, Giardia lamblia
NAKHYCSYCGDSSQAPIDGIC

SEQ ID NO: 3076765 - protein, 18 aa, Giardia lamblia
NAKMKAIIQAGRQLALRG

SEQ ID NO: 3076766 - protein, 21 aa, Giardia lamblia
NALIRLKWGTPALIAVFTPVI

SEQ ID NO: 3076767 - protein, 21 aa, Giardia lamblia
NAMIRLCLGLGLIVSLLLYNG

SEQ ID NO: 3076768 - protein, 24 aa, Giardia lamblia
NAPGGCLSCSEFVSAIASSREIFA

SEQ ID NO: 3076769 - protein, 23 aa, Giardia lamblia
NAPRVKMGFFDKEIDMRAMNLFW

SEQ ID NO: 3076770 - protein, 25 aa, Giardia lamblia
NAQRVPWKINWPVRFMVLLHHASAE

SEQ ID NO: 3076771 - protein, 21 aa, Giardia lamblia
NARVEPLMRFLSSCISPRLIV

SEQ ID NO: 3076772 - protein, 19 aa, Giardia lamblia
NASLSYVKALRHIYGSEKD

SEQ ID NO: 3076773 - protein, 21 aa, Giardia lamblia
NASRFCTAIAHFTCLGETTIS

SEQ ID NO: 3076774 - protein, 18 aa, Giardia lamblia
NASYAPRNGACILIKENP

SEQ ID NO: 3076775 - protein, 24 aa, Giardia lamblia
NATAAGCTFGWFAFENSATRHDWG

SEQ ID NO: 3076776 - protein, 17 aa, Giardia lamblia
NATFWRHGNALSLQYAT

SEQ ID NO: 3076777 - protein, 20 aa, Giardia lamblia
NATLRVGFGDVQKTYQGALE

SEQ ID NO: 3076778 - protein, 17 aa, Giardia lamblia
NATRMLVPFIYSVIYEQ

SEQ ID NO: 3076779 - protein, 24 aa, Giardia lamblia
NATTALPWSRYVAILLPTTEMQMS

SEQ ID NO: 3076780 - protein, 24 aa, Giardia lamblia
NAVAFDVFSSFLFASTPLYVTFHQ

SEQ ID NO: 3076781 - protein, 25 aa, Giardia lamblia
NAVLQIKLCWHLNRLAGEAFTPQTI

SEQ ID NO: 3076782 - protein, 19 aa, Giardia lamblia
NAWECGSCPVGFYQYSGRC

SEQ ID NO: 3076783 - protein, 17 aa, Giardia lamblia
NAYQAALKHCLKLYLTL

SEQ ID NO: 3076784 - protein, 19 aa, Giardia lamblia
NCAQNRCIFVGRDELCTQC

SEQ ID NO: 3076785 - protein, 24 aa, Giardia lamblia
NCFGIEIVNWFSILLSVVIILPFF

SEQ ID NO: 3076786 - protein, 23 aa, Giardia lamblia
NCGAYIPLPYILRVRLGEKNRPY

SEQ ID NO: 3076787 - protein, 25 aa, Giardia lamblia
NCIPVSSALCSPSKPISPHISRRLH

SEQ ID NO: 3076788 - protein, 18 aa, Giardia lamblia
NCRTCVPASGALSTQEIV

SEQ ID NO: 3076789 - protein, 18 aa, Giardia lamblia
NCSLARGYATGLVVYTGK

SEQ ID NO: 3076790 - protein, 19 aa, Giardia lamblia
NCSLFCPTPSFSAMIVNKY

SEQ ID NO: 3076791 - protein, 18 aa, Giardia lamblia
NCSLKSSSLITLISVLVV

SEQ ID NO: 3076792 - protein, 19 aa, Giardia lamblia
NCVLRRCYVGSNVHIEDGI

SEQ ID NO: 3076793 - protein, 18 aa, Giardia lamblia
NCVSCAPPSNGQGSVTCY

SEQ ID NO: 3076794 - protein, 19 aa, Giardia lamblia
NDCKQFVGFIAHSNNMLYF

SEQ ID NO: 3076795 - protein, 19 aa, Giardia lamblia
NDDEMEWDDAALIYYMYNL

SEQ ID NO: 3076796 - protein, 24 aa, Giardia lamblia
NDDSCFKWSSTAGGTFEIEECPRD

SEQ ID NO: 3076797 - protein, 18 aa, Giardia lamblia
NDENCLRCDENLDSCVEC

SEQ ID NO: 3076798 - protein, 26 aa, Giardia lamblia
NDFPFIDSIRLARYVKLQETSIDGGG

SEQ ID NO: 3076799 - protein, 26 aa, Giardia lamblia
NDHDTRTKLAYAFQCLDDTNMIITDA

SEQ ID NO: 3076800 - protein, 26 aa, Giardia lamblia
NDIFSSFYSSFAILFNACCAQASAGT

SEQ ID NO: 3076801 - protein, 25 aa, Giardia lamblia
NDINFAFLSLCQFHSSFDGVISSFR

SEQ ID NO: 3076802 - protein, 23 aa, Giardia lamblia
NDKCINIIYAIRILTSRYLHVDI

SEQ ID NO: 3076803 - protein, 17 aa, Giardia lamblia
NDLFPLRGNDDGALRVM

SEQ ID NO: 3076804 - protein, 17 aa, Giardia lamblia
NDLKGDIFPAVISQACR

SEQ ID NO: 3076805 - protein, 17 aa, Giardia lamblia
NDLPLLISVGIVSQDID

SEQ ID NO: 3076806 - protein, 25 aa, Giardia lamblia
NDNVCKMEHNMGYLIHARYESSNDQ

SEQ ID NO: 3076807 - protein, 20 aa, Giardia lamblia
NDPARFSFVRFCQESAIFER

SEQ ID NO: 3076808 - protein, 23 aa, Giardia lamblia
NDQCTKCKPGFFMKQPGSAGKCF

SEQ ID NO: 3076809 - protein, 28 aa, Giardia lamblia
NDRIKGSWLDFNDKIFLSIQGVFAPYVN

SEQ ID NO: 3076810 - protein, 24 aa, Giardia lamblia
NDRLFNLAFLCFTYAFMNLDRPHL

SEQ ID NO: 3076811 - protein, 21 aa, Giardia lamblia
NDSVAVLKCLAHSADADGLYI

SEQ ID NO: 3076812 - protein, 18 aa, Giardia lamblia
NDVIPLLLGILYSEAVAP

SEQ ID NO: 3076813 - protein, 20 aa, Giardia lamblia
NDVREGRGILTYKDGSYYEG

SEQ ID NO: 3076814 - protein, 21 aa, Giardia lamblia
NEAHRSWGDFIYKKKKYGVPC

SEQ ID NO: 3076815 - protein, 17 aa, Giardia lamblia
NEAIRFAGMSLGLPRYV

SEQ ID NO: 3076816 - protein, 21 aa, Giardia lamblia
NEANYKWFLFALISAIHMYFL

SEQ ID NO: 3076817 - protein, 25 aa, Giardia lamblia
NEARDLCLEKAKIVNTKWKEFAELI

SEQ ID NO: 3076818 - protein, 19 aa, Giardia lamblia
NEDFRLARVGLLPQSGSGK

SEQ ID NO: 3076819 - protein, 17 aa, Giardia lamblia
NEFKCVCDPGYVFLPTM

SEQ ID NO: 3076820 - protein, 24 aa, Giardia lamblia
NEHATCFVSIPVIIEGTISGMQLF

SEQ ID NO: 3076821 - protein, 22 aa, Giardia lamblia
NEHIRKCMRRAAEIHRQVRTYA

SEQ ID NO: 3076822 - protein, 19 aa, Giardia lamblia
NEIDGLKLLISKLQGESPD

SEQ ID NO: 3076823 - protein, 19 aa, Giardia lamblia
NEISHYWFANRKMLKGLIL

SEQ ID NO: 3076824 - protein, 17 aa, Giardia lamblia
NEKPLLYLAKWADKYVY

SEQ ID NO: 3076825 - protein, 20 aa, Giardia lamblia
NEMHCLLNLIVYDISLNYSP

SEQ ID NO: 3076826 - protein, 29 aa, Giardia lamblia
NEMILCSALRCILHLQVIEVISNIITGVP

SEQ ID NO: 3076827 - protein, 22 aa, Giardia lamblia
NENFALFVAMVLIGSAIVMSLV

SEQ ID NO: 3076828 - protein, 18 aa, Giardia lamblia
NERIKGLMTDAASVVSLP

SEQ ID NO: 3076829 - protein, 32 aa, Giardia lamblia
NERIPLMPYMRLVFEIGDLKYASPATVSRAGI

SEQ ID NO: 3076830 - protein, 22 aa, Giardia lamblia
NERKQKHIFAIYKRLLPALADD

SEQ ID NO: 3076831 - protein, 21 aa, Giardia lamblia
NESKELYVIIGNNLLLLDANQ

SEQ ID NO: 3076832 - protein, 21 aa, Giardia lamblia
NESLPVLFPMNADVTVRNYQT

SEQ ID NO: 3076833 - protein, 30 aa, Giardia lamblia
NESSLRAWSVRRDKCLLPNLTMYGNTDTKY

SEQ ID NO: 3076834 - protein, 21 aa, Giardia lamblia
NESVCLMMKAALEMLASLMAL

SEQ ID NO: 3076835 - protein, 25 aa, Giardia lamblia
NETKMFMDLDGFWKKLLSKTQDYPK

SEQ ID NO: 3076836 - protein, 29 aa, Giardia lamblia
NETNLKWLRRYSCLIFLNTRIKDELSGMY

SEQ ID NO: 3076837 - protein, 40 aa, Giardia lamblia
NEVFLRSVIYSVEILRIIFLRAKCELSFMELFGDFIDVLY

SEQ ID NO: 3076838 - protein, 22 aa, Giardia lamblia
NEVNAVMDLVLFRDAMEHVCRI

SEQ ID NO: 3076839 - protein, 24 aa, Giardia lamblia
NEVPFKLEPAFLLKQSINLTKADP

SEQ ID NO: 3076840 - protein, 23 aa, Giardia lamblia
NEVYLPPNIKFRLPEEARNIRSV

SEQ ID NO: 3076841 - protein, 18 aa, Giardia lamblia
NEYVNCGIFGFLDQGTVA

SEQ ID NO: 3076842 - protein, 20 aa, Giardia lamblia
NFAKSITYHAVYSINPTNLI

SEQ ID NO: 3076843 - protein, 23 aa, Giardia lamblia
NFDYSVCNTYPFLLAVPSRYSGE

SEQ ID NO: 3076844 - protein, 23 aa, Giardia lamblia
NFGEPEWSDALDLMIKVDSMLQQ

SEQ ID NO: 3076845 - protein, 28 aa, Giardia lamblia
NFLAACGLYLDWARYRTVLLYLLGQVNS

SEQ ID NO: 3076846 - protein, 20 aa, Giardia lamblia
NFLEELQLLYSVSDSLYTST

SEQ ID NO: 3076847 - protein, 24 aa, Giardia lamblia
NFLPDVVDFAGLYVKDANKPILKY

SEQ ID NO: 3076848 - protein, 31 aa, Giardia lamblia
NFLQTLDWRSNPTYMKAIISFYEKANSLENI

SEQ ID NO: 3076849 - protein, 21 aa, Giardia lamblia
NFLRAICKKALVSSYVHLLSE

SEQ ID NO: 3076850 - protein, 19 aa, Giardia lamblia
NFNYTWCLQSQKNLVDSKG

SEQ ID NO: 3076851 - protein, 25 aa, Giardia lamblia
NFPDAEMIFSIFFVVGCCIAVLVPL

SEQ ID NO: 3076852 - protein, 21 aa, Giardia lamblia
NFSCEGLRTLVWAVRELSPGF

SEQ ID NO: 3076853 - protein, 23 aa, Giardia lamblia
NFSIDAFTAFPLFTTAFCGHYNS

SEQ ID NO: 3076854 - protein, 17 aa, Giardia lamblia
NFSIYTRDCPLLETNQA

SEQ ID NO: 3076855 - protein, 17 aa, Giardia lamblia
NFWTEQRLGLSTGGCIG

SEQ ID NO: 3076856 - protein, 17 aa, Giardia lamblia
NFYHFAIAGTRFDAQQG

SEQ ID NO: 3076857 - protein, 20 aa, Giardia lamblia
NGACIRCELSILGCDACSER

SEQ ID NO: 3076858 - protein, 20 aa, Giardia lamblia
NGACIRCELSILGCDTCSER

SEQ ID NO: 3076859 - protein, 23 aa, Giardia lamblia
NGFETASLYGRWETSDPCSNSIS

SEQ ID NO: 3076860 - protein, 17 aa, Giardia lamblia
NGFGCTYQDISVMQCKR

SEQ ID NO: 3076861 - protein, 18 aa, Giardia lamblia
NGFPVCLSYMNHLGLDTY

SEQ ID NO: 3076862 - protein, 24 aa, Giardia lamblia
NGGCRCVRVSWPAVRSPDSKSAPQ

SEQ ID NO: 3076863 - protein, 25 aa, Giardia lamblia
NGHCSACAVTHIFFKYGCYDRYGSI

SEQ ID NO: 3076864 - protein, 23 aa, Giardia lamblia
NGHEACVRLLLDEELDITQPDKK

SEQ ID NO: 3076865 - protein, 20 aa, Giardia lamblia
NGHSACVRLLLAEAKMRNWK

SEQ ID NO: 3076866 - protein, 21 aa, Giardia lamblia
NGIDGCAILNLPDVGADTLID

SEQ ID NO: 3076867 - protein, 19 aa, Giardia lamblia
NGLNVLMFGFLYRSSYVSS

SEQ ID NO: 3076868 - protein, 25 aa, Giardia lamblia
NGLRPFVFHLAHYLMLFTLTFSSFL

SEQ ID NO: 3076869 - protein, 17 aa, Giardia lamblia
NGMKVVKLFGMEDVQEA

SEQ ID NO: 3076870 - protein, 25 aa, Giardia lamblia
NGNGADFSVCFPIGDGIAGAVGLLA

SEQ ID NO: 3076871 - protein, 18 aa, Giardia lamblia
NGPAFSLPHVSEYSLGDI

SEQ ID NO: 3076872 - protein, 20 aa, Giardia lamblia
NGPCNRFYLQSVLNVIRDYN

SEQ ID NO: 3076873 - protein, 19 aa, Giardia lamblia
NGPLPGVLLIAEIAWKLYE

SEQ ID NO: 3076874 - protein, 22 aa, Giardia lamblia
NGSLAFSLCDSIYFSLNPSLFT

SEQ ID NO: 3076875 - protein, 24 aa, Giardia lamblia
NGTALCLRGSLSNHILIERVLSPV

SEQ ID NO: 3076876 - protein, 22 aa, Giardia lamblia
NGTCTGCAGLFFYYKNGCYNPK

SEQ ID NO: 3076877 - protein, 23 aa, Giardia lamblia
NGTNARRGWARIIANSINDVDRV

SEQ ID NO: 3076878 - protein, 35 aa, Giardia lamblia
NGVLHLKKRRRGTLFPEYAFNRAFKKLEALATPEE

SEQ ID NO: 3076879 - protein, 24 aa, Giardia lamblia
NGVPLPWNFIFTCCCKRSKSSNGA

SEQ ID NO: 3076880 - protein, 26 aa, Giardia lamblia
NGYAELRLVYISNFPIKQVVVGVSGG

SEQ ID NO: 3076881 - protein, 19 aa, Giardia lamblia
NGYYLCTFINPHIITGQTA

SEQ ID NO: 3076882 - protein, 31 aa, Giardia lamblia
NHARKPLVICIGDLYFSRYNPLFHHKAYTCL

SEQ ID NO: 3076883 - protein, 27 aa, Giardia lamblia
NHECSIMRSYRIGLHRIRAERFQYIQS

SEQ ID NO: 3076884 - protein, 22 aa, Giardia lamblia
NHLDCVRLLLEREKNVGGESAI

SEQ ID NO: 3076885 - protein, 21 aa, Giardia lamblia
NHMEMIWISRVLPINAQLMLL

SEQ ID NO: 3076886 - protein, 22 aa, Giardia lamblia
NHVLHYRTDMKIVEQLDKIRNM

SEQ ID NO: 3076887 - protein, 23 aa, Giardia lamblia
NHYLKGGALCRLAAKAGTAERIL

SEQ ID NO: 3076888 - protein, 24 aa, Giardia lamblia
NIAFTSLVSLRFTCTDIMEGGNPE

SEQ ID NO: 3076889 - protein, 19 aa, Giardia lamblia
NICRTCLDHLVLCFNHSSV

SEQ ID NO: 3076890 - protein, 22 aa, Giardia lamblia
NIDIPCLRKKLQKYMYAATNTH

SEQ ID NO: 3076891 - protein, 28 aa, Giardia lamblia
NIDISLTFRPSALFTAFRAQACYITGGT

SEQ ID NO: 3076892 - protein, 26 aa, Giardia lamblia
NIDLLQRSWYGLVIVVGIVAILMGVI

SEQ ID NO: 3076893 - protein, 26 aa, Giardia lamblia
NIELMIRVLIMARPCFKEKELDAALS

SEQ ID NO: 3076894 - protein, 23 aa, Giardia lamblia
NIERHIGCFAAAVSDLLIINVWN

SEQ ID NO: 3076895 - protein, 18 aa, Giardia lamblia
NIGRRFSSMFINETQLVQ

SEQ ID NO: 3076896 - protein, 23 aa, Giardia lamblia
NIHERIALCPPPIIQSSDTKKLL

SEQ ID NO: 3076897 - protein, 18 aa, Giardia lamblia
NIHLKYTTLKVITEYLEM

SEQ ID NO: 3076898 - protein, 17 aa, Giardia lamblia
NIIAHLFVSIWLTMLVF

SEQ ID NO: 3076899 - protein, 24 aa, Giardia lamblia
NIKPPELRNAIILETQLLLSFNHP

SEQ ID NO: 3076900 - protein, 21 aa, Giardia lamblia
NIKSIGLRILIAFYHSLCMYF

SEQ ID NO: 3076901 - protein, 23 aa, Giardia lamblia
NILFANPFLLLFAGSHYILIEKE

SEQ ID NO: 3076902 - protein, 24 aa, Giardia lamblia
NILKEEIERLIAMRKKNEKLLQDM

SEQ ID NO: 3076903 - protein, 24 aa, Giardia lamblia
NILPEVVYTLTIIVPFEYDTSVSV

SEQ ID NO: 3076904 - protein, 19 aa, Giardia lamblia
NILQKFSFNGAIAKCMSRN

SEQ ID NO: 3076905 - protein, 24 aa, Giardia lamblia
NILSSRLGHIITCSIAIDSFTDML

SEQ ID NO: 3076906 - protein, 17 aa, Giardia lamblia
NIMRPFKQLISNDISSF

SEQ ID NO: 3076907 - protein, 18 aa, Giardia lamblia
NINALRFTASYTEESAKQ

SEQ ID NO: 3076908 - protein, 18 aa, Giardia lamblia
NIPKILSNVDMLRSASHI

SEQ ID NO: 3076909 - protein, 18 aa, Giardia lamblia
NIQAHVWAVTRRAYESLI

SEQ ID NO: 3076910 - protein, 22 aa, Giardia lamblia
NIQSICLLNSCNRQQYDDLLAV

SEQ ID NO: 3076911 - protein, 17 aa, Giardia lamblia
NIRFGLQPWDWVWTFPI

SEQ ID NO: 3076912 - protein, 20 aa, Giardia lamblia
NIRISATLCGLISNLTVDEL

SEQ ID NO: 3076913 - protein, 31 aa, Giardia lamblia
NISALPYPSWVQFCRGSLSWYEDYGLHSITP

SEQ ID NO: 3076914 - protein, 20 aa, Giardia lamblia
NISSNLYLTGFYIVNLNFIK

SEQ ID NO: 3076915 - protein, 32 aa, Giardia lamblia
NIVIFICSLVMKFSVFKVAPYVLLLQALLCLF

SEQ ID NO: 3076916 - protein, 28 aa, Giardia lamblia
NIVTTLLLRWIGPRIKDFSFNRYRHAID

SEQ ID NO: 3076917 - protein, 23 aa, Giardia lamblia
NIYKPCIPVVNFLINGINERATR

SEQ ID NO: 3076918 - protein, 23 aa, Giardia lamblia
NIYVKRLLCPRTSSGGDNDSNNY

SEQ ID NO: 3076919 - protein, 17 aa, Giardia lamblia
NKALTWELLLKRTAHAS

SEQ ID NO: 3076920 - protein, 23 aa, Giardia lamblia
NKCDTCMPGYFLVTTTDPQGKKC

SEQ ID NO: 3076921 - protein, 23 aa, Giardia lamblia
NKCEYRTALEPVLARYRATHTVL

SEQ ID NO: 3076922 - protein, 25 aa, Giardia lamblia
NKCHGVMLPCIFKLQSFSSGTTLNS

SEQ ID NO: 3076923 - protein, 21 aa, Giardia lamblia
NKDAVFRFFINRVRDNLHIVL

SEQ ID NO: 3076924 - protein, 19 aa, Giardia lamblia
NKDIKNFFCYCSDGYINAL

SEQ ID NO: 3076925 - protein, 24 aa, Giardia lamblia
NKDIPLWVIDAYVAKFEETTVQSE

SEQ ID NO: 3076926 - protein, 27 aa, Giardia lamblia
NKFMRPRAVIFREFAINWLGDIKEVQA

SEQ ID NO: 3076927 - protein, 34 aa, Giardia lamblia
NKFTSCLFLSLPSLKLFQKTHCSYDAARMDEKAL

SEQ ID NO: 3076928 - protein, 19 aa, Giardia lamblia
NKFVSKFFTSFAMESTLSS

SEQ ID NO: 3076929 - protein, 23 aa, Giardia lamblia
NKGNTPMSIAFKRGYTELYNVLN

SEQ ID NO: 3076930 - protein, 30 aa, Giardia lamblia
NKHGLVSCFFKWLCVSIFQGSVLLMFSQFL

SEQ ID NO: 3076931 - protein, 29 aa, Giardia lamblia
NKHKDKYKWVWLGLCVFLMLTRKWVYAVL

SEQ ID NO: 3076932 - protein, 29 aa, Giardia lamblia
NKIRPQGMFPRLVFWVVHENMHYQCVGIL

SEQ ID NO: 3076933 - protein, 22 aa, Giardia lamblia
NKLCSQYNGSVFINGQPNPSSY

SEQ ID NO: 3076934 - protein, 23 aa, Giardia lamblia
NKLIDCSSMWLGVRERMVSYLKY

SEQ ID NO: 3076935 - protein, 18 aa, Giardia lamblia
NKLPCNWPVSMTNPTIAF

SEQ ID NO: 3076936 - protein, 21 aa, Giardia lamblia
NKLTEILGIVFYLDQDQPYYI

SEQ ID NO: 3076937 - protein, 23 aa, Giardia lamblia
NKLTIEYPERWALSTHTISACQL

SEQ ID NO: 3076938 - protein, 18 aa, Giardia lamblia
NKLWHLLSPGGYFLESNF

SEQ ID NO: 3076939 - protein, 18 aa, Giardia lamblia
NKMLPIFHDEGGKPINLP

SEQ ID NO: 3076940 - protein, 22 aa, Giardia lamblia
NKNCGRFAGYLYSNTNFSYNLA

SEQ ID NO: 3076941 - protein, 20 aa, Giardia lamblia
NKRSALMFAAHMGNVGSTCL

SEQ ID NO: 3076942 - protein, 24 aa, Giardia lamblia
NKSRPSPLTFFLLVTAGCFTICMC

SEQ ID NO: 3076943 - protein, 25 aa, Giardia lamblia
NKTCSLRPYALSIFERVLEELPKTS

SEQ ID NO: 3076944 - protein, 24 aa, Giardia lamblia
NKTDFPRLTLSTRAPKTCMQLDVE

SEQ ID NO: 3076945 - protein, 23 aa, Giardia lamblia
NKTVRLWFKLIFTGLELLLASNY

SEQ ID NO: 3076946 - protein, 22 aa, Giardia lamblia
NKVCGPKALAQRLEDAIDSVRD

SEQ ID NO: 3076947 - protein, 17 aa, Giardia lamblia
NKWLSGVVQGVSFFVTY

SEQ ID NO: 3076948 - protein, 38 aa, Giardia lamblia
NKYGFGLIWMFYEFLLKQWKAGPPIEYESCQARAPSTI

SEQ ID NO: 3076949 - protein, 26 aa, Giardia lamblia
NKYRFASPLSSYHFFVTWGPEVTEVF

SEQ ID NO: 3076950 - protein, 24 aa, Giardia lamblia
NLADKRCFVFAFKPFPTLPNVKTE

SEQ ID NO: 3076951 - protein, 23 aa, Giardia lamblia
NLADVVSCSSFYRDAYEHSSAAR

SEQ ID NO: 3076952 - protein, 25 aa, Giardia lamblia
NLAECLKILFVPILYIPLEAYKLTP

SEQ ID NO: 3076953 - protein, 19 aa, Giardia lamblia
NLAILSIILGCVMFICGLT

SEQ ID NO: 3076954 - protein, 23 aa, Giardia lamblia
NLAKLNCLLTYGISIRSGGSMSS

SEQ ID NO: 3076955 - protein, 18 aa, Giardia lamblia
NLAQIWIVEVYCIKRKSL

SEQ ID NO: 3076956 - protein, 18 aa, Giardia lamblia
NLCKICSLGYYLDTQATP

SEQ ID NO: 3076957 - protein, 18 aa, Giardia lamblia
NLDCGSPCPIGCDCDPAL

SEQ ID NO: 3076958 - protein, 20 aa, Giardia lamblia
NLDCKGIIFCLTKGECVTIC

SEQ ID NO: 3076959 - protein, 23 aa, Giardia lamblia
NLDELCTYRFPLATETEMKPQQL

SEQ ID NO: 3076960 - protein, 22 aa, Giardia lamblia
NLDMGCSPLFEFEQRNHYFVKD

SEQ ID NO: 3076961 - protein, 19 aa, Giardia lamblia
NLEYCKLDIFVKKLIEMKD

SEQ ID NO: 3076962 - protein, 19 aa, Giardia lamblia
NLHRSFHCEKVFSKPRKDG

SEQ ID NO: 3076963 - protein, 19 aa, Giardia lamblia
NLIAVKILSTFETQMTNSN

SEQ ID NO: 3076964 - protein, 24 aa, Giardia lamblia
NLIFWARLWIGTAVGCLAGSLRIR

SEQ ID NO: 3076965 - protein, 28 aa, Giardia lamblia
NLITIKEIRSFPGLRSMAFTESADILDR

SEQ ID NO: 3076966 - protein, 24 aa, Giardia lamblia
NLLAKVTYSWSFIRPYGNCCKRCF

SEQ ID NO: 3076967 - protein, 17 aa, Giardia lamblia
NLLCGLLGIHFLVLPPG

SEQ ID NO: 3076968 - protein, 19 aa, Giardia lamblia
NLLHKLGYTSLRPIQLACF

SEQ ID NO: 3076969 - protein, 17 aa, Giardia lamblia
NLLKILINRSLYSHFMN

SEQ ID NO: 3076970 - protein, 33 aa, Giardia lamblia
NLLPLHSCVRIWRRFTRWLLIYLTGHPRRGKGS

SEQ ID NO: 3076971 - protein, 25 aa, Giardia lamblia
NLLQRPCCIDWSIFYLSSNRAEPYT

SEQ ID NO: 3076972 - protein, 28 aa, Giardia lamblia
NLLSLFPLRLQKHLALVVFAKLISIIPA

SEQ ID NO: 3076973 - protein, 23 aa, Giardia lamblia
NLLTSKFMDCFIESYLKKTQFRV

SEQ ID NO: 3076974 - protein, 26 aa, Giardia lamblia
NLMGSLKFGSLPAMYCLRELITHLMD

SEQ ID NO: 3076975 - protein, 27 aa, Giardia lamblia
NLPADLRLILYHSLLRLLYKDGERIAY

SEQ ID NO: 3076976 - protein, 23 aa, Giardia lamblia
NLPFTSTFRDIFGFQELFQSTNY

SEQ ID NO: 3076977 - protein, 23 aa, Giardia lamblia
NLPPFRSMYCRWQYFYDQRLREI

SEQ ID NO: 3076978 - protein, 20 aa, Giardia lamblia
NLPRRVRTQKGWQFTNMSQP

SEQ ID NO: 3076979 - protein, 23 aa, Giardia lamblia
NLQGGSALMLAARNGHLSICQFL

SEQ ID NO: 3076980 - protein, 23 aa, Giardia lamblia
NLQIFPCELVIHINLSNELGVLF

SEQ ID NO: 3076981 - protein, 18 aa, Giardia lamblia
NLREELDGAITLSSVGDI

SEQ ID NO: 3076982 - protein, 19 aa, Giardia lamblia
NLRHIVWADYITVTAVLAL

SEQ ID NO: 3076983 - protein, 29 aa, Giardia lamblia
NLRIPSMKFPHVFNFRSVLDPTYLNTAEE

SEQ ID NO: 3076984 - protein, 20 aa, Giardia lamblia
NLRLRYRNTYMVAGKLLDKL

SEQ ID NO: 3076985 - protein, 31 aa, Giardia lamblia
NLRRPITTLLRRLESFCARIGTTSMNINYLS

SEQ ID NO: 3076986 - protein, 21 aa, Giardia lamblia
NLSLERFRLGASYTAPVLFYY

SEQ ID NO: 3076987 - protein, 26 aa, Giardia lamblia
NLSNDFPKLLGLDFMLIQHRLAPDAN

SEQ ID NO: 3076988 - protein, 26 aa, Giardia lamblia
NLTLFTGKVSYHWSPYGIGFHDPGAR

SEQ ID NO: 3076989 - protein, 18 aa, Giardia lamblia
NLVISSLFYLRRHVWHAN

SEQ ID NO: 3076990 - protein, 25 aa, Giardia lamblia
NLYNCGWVLGMFCLLLVGLSSGYAF

SEQ ID NO: 3076991 - protein, 29 aa, Giardia lamblia
NLYVKGLFVLCIFLAFVLTMAGSVYSLVT

SEQ ID NO: 3076992 - protein, 24 aa, Giardia lamblia
NMANGLGVFICYLIYACPEHNLSC

SEQ ID NO: 3076993 - protein, 26 aa, Giardia lamblia
NMDWFISLWHNLKFDASNNCIDHCKS

SEQ ID NO: 3076994 - protein, 26 aa, Giardia lamblia
NMILPLCINLPLGKRKYRESVLGKHG

SEQ ID NO: 3076995 - protein, 30 aa, Giardia lamblia
NMLFKHVTCCPWTILALYSSFHEWDVVPSC

SEQ ID NO: 3076996 - protein, 19 aa, Giardia lamblia
NMPEIQSICIFPCREAIFA

SEQ ID NO: 3076997 - protein, 23 aa, Giardia lamblia
NMSALCMISAFGFGERFFLPYTI

SEQ ID NO: 3076998 - protein, 25 aa, Giardia lamblia
NMSLPIINALTFKPSCESLSSSIRP

SEQ ID NO: 3076999 - protein, 21 aa, Giardia lamblia
NMTFPLHFRSPFVSSGLDINS

SEQ ID NO: 3077000 - protein, 23 aa, Giardia lamblia
NNAYAPLTICGDVILGTVAGVLH

SEQ ID NO: 3077001 - protein, 24 aa, Giardia lamblia
NNCATCANGYYLASVRKYKLCRPC

SEQ ID NO: 3077002 - protein, 21 aa, Giardia lamblia
NNEIYLFARFLFGDLDFDFYL

SEQ ID NO: 3077003 - protein, 28 aa, Giardia lamblia
NNFCLDEFGAIRFRLDLGHTLKNMILVD

SEQ ID NO: 3077004 - protein, 21 aa, Giardia lamblia
NNFFCTKGVYGVQESKMSAPD

SEQ ID NO: 3077005 - protein, 20 aa, Giardia lamblia
NNFFVLRMGKYREWLQHIDV

SEQ ID NO: 3077006 - protein, 19 aa, Giardia lamblia
NNILGCLTLFSASTIFDEE

SEQ ID NO: 3077007 - protein, 28 aa, Giardia lamblia
NNLHVLLRKAECLFYLSDYIGCVRSCSL

SEQ ID NO: 3077008 - protein, 22 aa, Giardia lamblia
NNLQFKAAVIKAMCTLRRTVAD

SEQ ID NO: 3077009 - protein, 24 aa, Giardia lamblia
NNLRLKVRHLVPINVKILGTLLLR

SEQ ID NO: 3077010 - protein, 26 aa, Giardia lamblia
NNLVCTRCSPGLVSVDGFSCPLTCTE

SEQ ID NO: 3077011 - protein, 17 aa, Giardia lamblia
NNPHIARSGSCSLSTMS

SEQ ID NO: 3077012 - protein, 27 aa, Giardia lamblia
NNPVRKLPCNHLYHKDCIQSWIVSGNT

SEQ ID NO: 3077013 - protein, 21 aa, Giardia lamblia
NNRGETALMLALKHGQEDAGL

SEQ ID NO: 3077014 - protein, 25 aa, Giardia lamblia
NNRKHCFPYLNGLDHLLSNMSYYIH

SEQ ID NO: 3077015 - protein, 24 aa, Giardia lamblia
NNSCPGCLLYLFDFLIHSLLATAA

SEQ ID NO: 3077016 - protein, 23 aa, Giardia lamblia
NNSGFYLGIYARQYIVLRIEISD

SEQ ID NO: 3077017 - protein, 22 aa, Giardia lamblia
NNSLKLSVPLLRATEWIAKLLI

SEQ ID NO: 3077018 - protein, 24 aa, Giardia lamblia
NNVCTKCGFSSFLFNGGCVSKSSS

SEQ ID NO: 3077019 - protein, 19 aa, Giardia lamblia
NPAALFAYRQALFYTCCQA

SEQ ID NO: 3077020 - protein, 24 aa, Giardia lamblia
NPAIWGYAILYVFIGLVGGTMIVV

SEQ ID NO: 3077021 - protein, 23 aa, Giardia lamblia
NPALKRTAQFDGFDALDNLYKSY

SEQ ID NO: 3077022 - protein, 19 aa, Giardia lamblia
NPAVFSRYRAFKVFCPAAQ

SEQ ID NO: 3077023 - protein, 18 aa, Giardia lamblia
NPDMSLEEFQRIWKERLN

SEQ ID NO: 3077024 - protein, 20 aa, Giardia lamblia
NPEPLPGFPCPNIDTHLDQH

SEQ ID NO: 3077025 - protein, 26 aa, Giardia lamblia
NPEPRASSCYPEFMLPCLYNPTTRIN

SEQ ID NO: 3077026 - protein, 23 aa, Giardia lamblia
NPFHSLFTFRILSVEALFGHICT

SEQ ID NO: 3077027 - protein, 21 aa, Giardia lamblia
NPFKYKKLLDYGYDYHGIVRY

SEQ ID NO: 3077028 - protein, 17 aa, Giardia lamblia
NPGFGEREPYIWNAFLF

SEQ ID NO: 3077029 - protein, 18 aa, Giardia lamblia
NPGLYFRRLEDVLVVCAY

SEQ ID NO: 3077030 - protein, 23 aa, Giardia lamblia
NPHSCILEILILLLRAVQVSQEY

SEQ ID NO: 3077031 - protein, 21 aa, Giardia lamblia
NPILGCYFWNDLLAIIGPAEI

SEQ ID NO: 3077032 - protein, 21 aa, Giardia lamblia
NPKDFRYISLLTYGRQTPIHV

SEQ ID NO: 3077033 - protein, 24 aa, Giardia lamblia
NPKIPIGWSPTAGRLAWVRLIMRR

SEQ ID NO: 3077034 - protein, 22 aa, Giardia lamblia
NPPALPSPCRRLAFITKGDANK

SEQ ID NO: 3077035 - protein, 23 aa, Giardia lamblia
NPPLERFLFPLAYSRSLPVNIDC

SEQ ID NO: 3077036 - protein, 26 aa, Giardia lamblia
NPPMTYTVPFALMFSYAFSSLQYIRA

SEQ ID NO: 3077037 - protein, 25 aa, Giardia lamblia
NPPQYLVKWMKLYAVDLVSVAAALP

SEQ ID NO: 3077038 - protein, 22 aa, Giardia lamblia
NPQIRSKVCQRVVPLIDDHYHP

SEQ ID NO: 3077039 - protein, 32 aa, Giardia lamblia
NPRDRFIELSAFFPAHETHVLGLTETYAVPIE

SEQ ID NO: 3077040 - protein, 20 aa, Giardia lamblia
NPRFAFPSDHIMLLRQMELL

SEQ ID NO: 3077041 - protein, 21 aa, Giardia lamblia
NPRKVYPIGLLITVLIVTLVY

SEQ ID NO: 3077042 - protein, 24 aa, Giardia lamblia
NPSKLRLAVLTSIVSVISGYFIKF

SEQ ID NO: 3077043 - protein, 20 aa, Giardia lamblia
NPSMEVPLWYEVATSNPQIR

SEQ ID NO: 3077044 - protein, 18 aa, Giardia lamblia
NPWSCAAYIFLADGLPTM

SEQ ID NO: 3077045 - protein, 22 aa, Giardia lamblia
NPYKRLGNIFIGLFQIVSVANS

SEQ ID NO: 3077046 - protein, 24 aa, Giardia lamblia
NQAARSPGLFKRRQQEVTGAVMCG

SEQ ID NO: 3077047 - protein, 28 aa, Giardia lamblia
NQENLPIFECYDYIILLGDLNYRIDKAT

SEQ ID NO: 3077048 - protein, 26 aa, Giardia lamblia
NQGGFLSIDFWKAFSHLVGNLLTGGT

SEQ ID NO: 3077049 - protein, 25 aa, Giardia lamblia
NQIFFYLLLAFCITSYIRPNDIFLK

SEQ ID NO: 3077050 - protein, 18 aa, Giardia lamblia
NQLALLYLPRLVDASPDD

SEQ ID NO: 3077051 - protein, 31 aa, Giardia lamblia
NQLDEAIKWDVLRCIGVLGGLVRRKIDLCSR

SEQ ID NO: 3077052 - protein, 17 aa, Giardia lamblia
NQLGHLFLQRSSQYGPK

SEQ ID NO: 3077053 - protein, 21 aa, Giardia lamblia
NQLLHEIYLRLCAGEKMDRNF

SEQ ID NO: 3077054 - protein, 17 aa, Giardia lamblia
NQLPVDILRKVITTDEG

SEQ ID NO: 3077055 - protein, 25 aa, Giardia lamblia
NQLTKLLCQFSFTIFFVHMTVSQEL

SEQ ID NO: 3077056 - protein, 19 aa, Giardia lamblia
NQMIRACREYLRTDSTSLL

SEQ ID NO: 3077057 - protein, 31 aa, Giardia lamblia
NQQYRICAPYARLPLSFAVLYSQLTTVPLTG

SEQ ID NO: 3077058 - protein, 22 aa, Giardia lamblia
NQRSLRFFPLKPVGLGCIFMRA

SEQ ID NO: 3077059 - protein, 23 aa, Giardia lamblia
NQSKINFILGMRAINGIFAITIP

SEQ ID NO: 3077060 - protein, 20 aa, Giardia lamblia
NRAICISITETLFKVYPSVL

SEQ ID NO: 3077061 - protein, 18 aa, Giardia lamblia
NRATLIYLPRPALEIQPS

SEQ ID NO: 3077062 - protein, 19 aa, Giardia lamblia
NRDKFLLFYTAFYTTTLSD

SEQ ID NO: 3077063 - protein, 20 aa, Giardia lamblia
NRFTVMDIFYILRSLLASSL

SEQ ID NO: 3077064 - protein, 22 aa, Giardia lamblia
NRGYCQINLAGGICRCYSAYLN

SEQ ID NO: 3077065 - protein, 21 aa, Giardia lamblia
NRHHECVSVLKSVESGTRLQG

SEQ ID NO: 3077066 - protein, 18 aa, Giardia lamblia
NRIIDLFQVRHWNYELAP

SEQ ID NO: 3077067 - protein, 20 aa, Giardia lamblia
NRILRECRWARDASNSERTV

SEQ ID NO: 3077068 - protein, 20 aa, Giardia lamblia
NRLGVRYCEDRCYSRSSSCS

SEQ ID NO: 3077069 - protein, 17 aa, Giardia lamblia
NRLIILTSHCMEETDVL

SEQ ID NO: 3077070 - protein, 23 aa, Giardia lamblia
NRLLQMAYLIACNGCCCHFSRND

SEQ ID NO: 3077071 - protein, 19 aa, Giardia lamblia
NRLPLLLDPVVFHYISGSL

SEQ ID NO: 3077072 - protein, 19 aa, Giardia lamblia
NRNDLVLLVSLNFHVWDYP

SEQ ID NO: 3077073 - protein, 22 aa, Giardia lamblia
NRPSAILPINMRPRMVKPHQMR

SEQ ID NO: 3077074 - protein, 18 aa, Giardia lamblia
NRQLAHWFEQQLLFSDTS

SEQ ID NO: 3077075 - protein, 18 aa, Giardia lamblia
NRRDCVQLLLKAEGMLKC

SEQ ID NO: 3077076 - protein, 39 aa, Giardia lamblia
NRRRCAFGMCLNLGPAELCLKCTPGLLLIDGACVEQDSH

SEQ ID NO: 3077077 - protein, 25 aa, Giardia lamblia
NRSIKRMNIVICITVIVTSLFNSVM

SEQ ID NO: 3077078 - protein, 21 aa, Giardia lamblia
NRSTLLFSIMDPMEGLLPGAE

SEQ ID NO: 3077079 - protein, 20 aa, Giardia lamblia
NRSYRARILSIDRLSDPESS

SEQ ID NO: 3077080 - protein, 19 aa, Giardia lamblia
NRTRFIIFNPVHIRCAKKQ

SEQ ID NO: 3077081 - protein, 20 aa, Giardia lamblia
NRTSLQRLCIIRALRPDRLM

SEQ ID NO: 3077082 - protein, 18 aa, Giardia lamblia
NRTVIPYYYWWDGTNNNV

SEQ ID NO: 3077083 - protein, 25 aa, Giardia lamblia
NRVCCRKCVDPLFFINNGACVSETF

SEQ ID NO: 3077084 - protein, 21 aa, Giardia lamblia
NRWTTLAVDMDQVFRNAYRNA

SEQ ID NO: 3077085 - protein, 20 aa, Giardia lamblia
NRYFYFPSNPMYDLTLMDKI

SEQ ID NO: 3077086 - protein, 19 aa, Giardia lamblia
NRYQGALSLFARKATASTI

SEQ ID NO: 3077087 - protein, 23 aa, Giardia lamblia
NSACLAAFAILRRIQQSGSADLR

SEQ ID NO: 3077088 - protein, 23 aa, Giardia lamblia
NSARYTGLILMNSFTLISRLIML

SEQ ID NO: 3077089 - protein, 26 aa, Giardia lamblia
NSCTNCPRCRVHAVCNHCHAKIAILL

SEQ ID NO: 3077090 - protein, 22 aa, Giardia lamblia
NSEKIKSYCRMNMDLQSVELLF

SEQ ID NO: 3077091 - protein, 18 aa, Giardia lamblia
NSEKRAALSTVKKNKSQL

SEQ ID NO: 3077092 - protein, 25 aa, Giardia lamblia
NSELTTIFCDLEFLLQAKVSSDHDL

SEQ ID NO: 3077093 - protein, 18 aa, Giardia lamblia
NSESKECKSSTCKASSKS

SEQ ID NO: 3077094 - protein, 21 aa, Giardia lamblia
NSEVPRLLLLASGPLALATPQ

SEQ ID NO: 3077095 - protein, 17 aa, Giardia lamblia
NSFSCACYEGTVKVGNG

SEQ ID NO: 3077096 - protein, 18 aa, Giardia lamblia
NSFSCSRSVTSLHQTISG

SEQ ID NO: 3077097 - protein, 17 aa, Giardia lamblia
NSHVDVCGLVRTCATGN

SEQ ID NO: 3077098 - protein, 18 aa, Giardia lamblia
NSHVKRSNVKVVVLAGST

SEQ ID NO: 3077099 - protein, 19 aa, Giardia lamblia
NSIAVKFLIKQEAGMQTDS

SEQ ID NO: 3077100 - protein, 20 aa, Giardia lamblia
NSIEGLSTFQIEPVTSNMDM

SEQ ID NO: 3077101 - protein, 24 aa, Giardia lamblia
NSIHPRLLAYLALLVDPTDQSESI

SEQ ID NO: 3077102 - protein, 21 aa, Giardia lamblia
NSKIRYSKLILIGSDPAQLNP

SEQ ID NO: 3077103 - protein, 25 aa, Giardia lamblia
NSLCNRMYREIFTIGLSQEVMTYLD

SEQ ID NO: 3077104 - protein, 19 aa, Giardia lamblia
NSLIAGLFTEWDGKDPMML

SEQ ID NO: 3077105 - protein, 27 aa, Giardia lamblia
NSLNRFFDVYAFFAGLLSKGSLSGCAS

SEQ ID NO: 3077106 - protein, 20 aa, Giardia lamblia
NSMLEASILLPCFSDARSQH

SEQ ID NO: 3077107 - protein, 20 aa, Giardia lamblia
NSPLFPSFCDVLVAVISSSK

SEQ ID NO: 3077108 - protein, 23 aa, Giardia lamblia
NSPSWALSIFVTWDKNREACLQA

SEQ ID NO: 3077109 - protein, 28 aa, Giardia lamblia
NSRFSPELLSFVPYCFQDTLRDGHVTSL

SEQ ID NO: 3077110 - protein, 18 aa, Giardia lamblia
NSRICYRKTPSAQSKQGK

SEQ ID NO: 3077111 - protein, 17 aa, Giardia lamblia
NSRKILFDVHRKFFYAH

SEQ ID NO: 3077112 - protein, 24 aa, Giardia lamblia
NSRNCLLCNAVIFGTAYCSQCTSG

SEQ ID NO: 3077113 - protein, 23 aa, Giardia lamblia
NSSPDDAIRCLGKVLIRSQAISK

SEQ ID NO: 3077114 - protein, 19 aa, Giardia lamblia
NSSRLCVIIGQVTKSQPIL

SEQ ID NO: 3077115 - protein, 25 aa, Giardia lamblia
NSSVLRGSLLLNFWRTGETAQSGVA

SEQ ID NO: 3077116 - protein, 21 aa, Giardia lamblia
NSTESIIFLRGLASTPLTPDI

SEQ ID NO: 3077117 - protein, 25 aa, Giardia lamblia
NSVARLGFLTGLLINMYSDCDRQYP

SEQ ID NO: 3077118 - protein, 25 aa, Giardia lamblia
NSVPFKISGLFPKYRSLKAAGLLQE

SEQ ID NO: 3077119 - protein, 19 aa, Giardia lamblia
NSVTEVFYAFSVEYKDDTS

SEQ ID NO: 3077120 - protein, 23 aa, Giardia lamblia
NSYLDYKCHCSPGAIPYKNRCYS

SEQ ID NO: 3077121 - protein, 23 aa, Giardia lamblia
NSYPDFIKMISIQQLANCFLVNS

SEQ ID NO: 3077122 - protein, 20 aa, Giardia lamblia
NTAGVPVLRRAKGNCTESLA

SEQ ID NO: 3077123 - protein, 24 aa, Giardia lamblia
NTARLRLYYNATLVYTLFRGSLPL

SEQ ID NO: 3077124 - protein, 20 aa, Giardia lamblia
NTCLACHESCAFCTGPSADQ

SEQ ID NO: 3077125 - protein, 24 aa, Giardia lamblia
NTDLYDRIKLMTGRERSEDLRYVD

SEQ ID NO: 3077126 - protein, 31 aa, Giardia lamblia
NTELLPLRVHIALLKLRLFDESGYHDLKAYL

SEQ ID NO: 3077127 - protein, 23 aa, Giardia lamblia
NTFAAWLPMFLLFSANVAIFSAF

SEQ ID NO: 3077128 - protein, 23 aa, Giardia lamblia
NTGTRFLFSILFPDDLLDTKGNS

SEQ ID NO: 3077129 - protein, 23 aa, Giardia lamblia
NTHTLKPSFTFSFSALGMTLLWQ

SEQ ID NO: 3077130 - protein, 19 aa, Giardia lamblia
NTIDFYKPIRLINTAEPPV

SEQ ID NO: 3077131 - protein, 20 aa, Giardia lamblia
NTIKGSSCNALLATFLGVAC

SEQ ID NO: 3077132 - protein, 23 aa, Giardia lamblia
NTIRYKTIYLMESLSEGLHVAQL

SEQ ID NO: 3077133 - protein, 26 aa, Giardia lamblia
NTLTMVCIWALVPLLVLMAVFLDALY

SEQ ID NO: 3077134 - protein, 23 aa, Giardia lamblia
NTPILYCGEFLIRRNCFKAVQSL

SEQ ID NO: 3077135 - protein, 17 aa, Giardia lamblia
NTPYAKWTNVIQTTAKP

SEQ ID NO: 3077136 - protein, 17 aa, Giardia lamblia
NTQLRMFVATCADLVSA

SEQ ID NO: 3077137 - protein, 23 aa, Giardia lamblia
NTRKGVLQASNWFSAVLSGATLF

SEQ ID NO: 3077138 - protein, 25 aa, Giardia lamblia
NTRLFNCLKLGKAHAIVEDDLMAFM

SEQ ID NO: 3077139 - protein, 19 aa, Giardia lamblia
NTSVVRRGLLQILLSCLRA

SEQ ID NO: 3077140 - protein, 17 aa, Giardia lamblia
NTVFSAAQSFDIYRLTM

SEQ ID NO: 3077141 - protein, 25 aa, Giardia lamblia
NTVQLCLCKEFLRKTVTKVLCSGAH

SEQ ID NO: 3077142 - protein, 18 aa, Giardia lamblia
NTWYCFNDDKVTRVTNPP

SEQ ID NO: 3077143 - protein, 18 aa, Giardia lamblia
NTYCMDGQDKQCYIVEGG

SEQ ID NO: 3077144 - protein, 29 aa, Giardia lamblia
NTYRLDSSTGLCWPSACFGASSKSEKVCG

SEQ ID NO: 3077145 - protein, 17 aa, Giardia lamblia
NVAIPIIAQYTGKASLL

SEQ ID NO: 3077146 - protein, 20 aa, Giardia lamblia
NVCGFFGMSPACQKMKPNDH

SEQ ID NO: 3077147 - protein, 23 aa, Giardia lamblia
NVDRSRFEDCVGLDITDVPFDDA

SEQ ID NO: 3077148 - protein, 20 aa, Giardia lamblia
NVEFPCLEKALISGNPLFID

SEQ ID NO: 3077149 - protein, 22 aa, Giardia lamblia
NVFFDPRTVQWYSKLARLDENS

SEQ ID NO: 3077150 - protein, 19 aa, Giardia lamblia
NVFNYIVLDIQKWFAEKAE

SEQ ID NO: 3077151 - protein, 24 aa, Giardia lamblia
NVFYAEFRLVAWSLSSSYRTTLGG

SEQ ID NO: 3077152 - protein, 19 aa, Giardia lamblia
NVHFWKLTEQHIPQQASPT

SEQ ID NO: 3077153 - protein, 19 aa, Giardia lamblia
NVIGSCILKALSTAKHQQI

SEQ ID NO: 3077154 - protein, 26 aa, Giardia lamblia
NVIQICPFCQIMYAYINIVGKGYKLH

SEQ ID NO: 3077155 - protein, 18 aa, Giardia lamblia
NVISCFYPFEPLCLPRSS

SEQ ID NO: 3077156 - protein, 24 aa, Giardia lamblia
NVKPDAIRFLALHDRWPTQKEVTM

SEQ ID NO: 3077157 - protein, 19 aa, Giardia lamblia
NVLGATFCSKCALNTDALI

SEQ ID NO: 3077158 - protein, 27 aa, Giardia lamblia
NVLILLEHAWRLLGINLTDFPTATSSG

SEQ ID NO: 3077159 - protein, 18 aa, Giardia lamblia
NVLPDFNYLLTFQRHVYT

SEQ ID NO: 3077160 - protein, 22 aa, Giardia lamblia
NVLQYCFIREICFVLEAHWSNP

SEQ ID NO: 3077161 - protein, 24 aa, Giardia lamblia
NVNGLEQMDPVFLSKVLDCEVIPT

SEQ ID NO: 3077162 - protein, 21 aa, Giardia lamblia
NVPGTVCKRVLAGLDKERGKI

SEQ ID NO: 3077163 - protein, 23 aa, Giardia lamblia
NVQGEPAIICAIKAEAKECISIL

SEQ ID NO: 3077164 - protein, 18 aa, Giardia lamblia
NVSFRFPIYNKDISLSTQ

SEQ ID NO: 3077165 - protein, 19 aa, Giardia lamblia
NVSHLWAPRKEFFDTEPQL

SEQ ID NO: 3077166 - protein, 17 aa, Giardia lamblia
NVSPEFANVYSGVRDMN

SEQ ID NO: 3077167 - protein, 17 aa, Giardia lamblia
NVSREFTDLIASKAGFQ

SEQ ID NO: 3077168 - protein, 18 aa, Giardia lamblia
NVSSLGLIILNDLDPKLF

SEQ ID NO: 3077169 - protein, 23 aa, Giardia lamblia
NVTFRYLYSMEFMRSKDYKETMI

SEQ ID NO: 3077170 - protein, 23 aa, Giardia lamblia
NVTIRLDYITGYLVHEEGDVSIN

SEQ ID NO: 3077171 - protein, 23 aa, Giardia lamblia
NVVIKLDLSESFQAMLAGMGTPT

SEQ ID NO: 3077172 - protein, 24 aa, Giardia lamblia
NVVLPEWLLLVLEVAFLLYTTQKM

SEQ ID NO: 3077173 - protein, 28 aa, Giardia lamblia
NVVTGLPCLLPYVVALSIDTKILGEMIS

SEQ ID NO: 3077174 - protein, 23 aa, Giardia lamblia
NVYAKSRSRSHCTDFQSRTELLG

SEQ ID NO: 3077175 - protein, 17 aa, Giardia lamblia
NVYFSVVNMLSRPLEEY

SEQ ID NO: 3077176 - protein, 21 aa, Giardia lamblia
NVYRRSGCYVKKPTWTLSTLQ

SEQ ID NO: 3077177 - protein, 18 aa, Giardia lamblia
NWCRLCDDALKAIEERFT

SEQ ID NO: 3077178 - protein, 29 aa, Giardia lamblia
NWELRVLKAVFKRSFCNTGTSSSNISKAP

SEQ ID NO: 3077179 - protein, 29 aa, Giardia lamblia
NWPTTRLLLCLVCAHLLDATTFGAALAEL

SEQ ID NO: 3077180 - protein, 21 aa, Giardia lamblia
NWRNGSLLFMLYGSVSLIFLC

SEQ ID NO: 3077181 - protein, 19 aa, Giardia lamblia
NWSIKSDVWSVACIAYEMC

SEQ ID NO: 3077182 - protein, 23 aa, Giardia lamblia
NYCRRCQEGFLPVDGLCLGGNAS

SEQ ID NO: 3077183 - protein, 24 aa, Giardia lamblia
NYDDYRPAYDYALNTYHNIFLALD

SEQ ID NO: 3077184 - protein, 18 aa, Giardia lamblia
NYECVCSPGYVQASDGTC

SEQ ID NO: 3077185 - protein, 25 aa, Giardia lamblia
NYGLRPRDLVTMSVLPGERLVALDS

SEQ ID NO: 3077186 - protein, 18 aa, Giardia lamblia
NYKWLTQIEKLWIDSIYN

SEQ ID NO: 3077187 - protein, 24 aa, Giardia lamblia
NYLFKAKFLSILGMDDCLELSFKL

SEQ ID NO: 3077188 - protein, 20 aa, Giardia lamblia
NYLYPYYKRALVLLRNAPCD

SEQ ID NO: 3077189 - protein, 25 aa, Giardia lamblia
NYMPILKFLASKECKIKDHKGRTAL

SEQ ID NO: 3077190 - protein, 17 aa, Giardia lamblia
NYNFLFLKREGVDLGSL

SEQ ID NO: 3077191 - protein, 21 aa, Giardia lamblia
NYNIFPAMHAILILQMIFIVP

SEQ ID NO: 3077192 - protein, 18 aa, Giardia lamblia
NYQYRQVLSIGTDLNSEQ

SEQ ID NO: 3077193 - protein, 21 aa, Giardia lamblia
NYSDLLIIFIELCYDNTQSSL

SEQ ID NO: 3077194 - protein, 18 aa, Giardia lamblia
NYSSLWAQTYLTYSLPIT

SEQ ID NO: 3077195 - protein, 20 aa, Giardia lamblia
NYSYTIRIGVQINQSNVSFR

SEQ ID NO: 3077196 - protein, 18 aa, Giardia lamblia
NYTGFLFRITSLCHMKPL

SEQ ID NO: 3077197 - protein, 19 aa, Giardia lamblia
NYVPPGLESCLGYTESPEL

SEQ ID NO: 3077198 - protein, 25 aa, Giardia lamblia
NYYPVFPYYCATMMGFVLGLCLLSA

SEQ ID NO: 3077199 - protein, 25 aa, Giardia lamblia
PAAAREAASFGAPRFVFYFDGDVLH

SEQ ID NO: 3077200 - protein, 23 aa, Giardia lamblia
PAAFLRRQLWTAISIVTQLLTAN

SEQ ID NO: 3077201 - protein, 17 aa, Giardia lamblia
PAAILLIYIRDIPLAFW

SEQ ID NO: 3077202 - protein, 17 aa, Giardia lamblia
PAAMKLPSLPACDQSFY

SEQ ID NO: 3077203 - protein, 19 aa, Giardia lamblia
PAARIWYSLLQSVCDNASA

SEQ ID NO: 3077204 - protein, 28 aa, Giardia lamblia
PAATRFVHCLCFRIFPSLVYSPDDSTIQ

SEQ ID NO: 3077205 - protein, 20 aa, Giardia lamblia
PACISHLEAVYNFLDTSFGT

SEQ ID NO: 3077206 - protein, 46 aa, Giardia lamblia
PACLYGDHLGMFFALCSYHIWFRMLLDPLFRRSTLIMSVDDQTDPY

SEQ ID NO: 3077207 - protein, 24 aa, Giardia lamblia
PACREVKHEMVLYLANRILSANLT

SEQ ID NO: 3077208 - protein, 18 aa, Giardia lamblia
PADPVWMQMANKLRADIL

SEQ ID NO: 3077209 - protein, 17 aa, Giardia lamblia
PAGAPSVTFLTVATAGQ

SEQ ID NO: 3077210 - protein, 21 aa, Giardia lamblia
PAGDAPQLWAGLLRAALAGAG

SEQ ID NO: 3077211 - protein, 18 aa, Giardia lamblia
PAHTVIILGTKVYADSCW

SEQ ID NO: 3077212 - protein, 20 aa, Giardia lamblia
PAKICGGVGACVRDGAGYSC

SEQ ID NO: 3077213 - protein, 17 aa, Giardia lamblia
PALIKNVSFVVELEDHI

SEQ ID NO: 3077214 - protein, 17 aa, Giardia lamblia
PALKVIINAILLRNKTS

SEQ ID NO: 3077215 - protein, 22 aa, Giardia lamblia
PALMSSLCRQEDELKRAKAQAH

SEQ ID NO: 3077216 - protein, 25 aa, Giardia lamblia
PALPQSLDLVWRDAICGSCIDPQDG

SEQ ID NO: 3077217 - protein, 24 aa, Giardia lamblia
PANPRNAYEYSILFMNLLNAIPGN

SEQ ID NO: 3077218 - protein, 18 aa, Giardia lamblia
PAPELTDMLFRMASQSDE

SEQ ID NO: 3077219 - protein, 25 aa, Giardia lamblia
PAPFTIVPLEPCYKFLEDRRLMAQY

SEQ ID NO: 3077220 - protein, 18 aa, Giardia lamblia
PAPPRLLPSTLRRLSELS

SEQ ID NO: 3077221 - protein, 17 aa, Giardia lamblia
PAPTPAYTPINLSNINQ

SEQ ID NO: 3077222 - protein, 17 aa, Giardia lamblia
PASDVWSLGVIIYELVT

SEQ ID NO: 3077223 - protein, 23 aa, Giardia lamblia
PASFLYTHCRIVEQSIRQSICCN

SEQ ID NO: 3077224 - protein, 29 aa, Giardia lamblia
PASHPHLKISLIGAVLCFFSKFQKEDQCL

SEQ ID NO: 3077225 - protein, 25 aa, Giardia lamblia
PASLERCGYLSLNWHSSLNEDSFEL

SEQ ID NO: 3077226 - protein, 23 aa, Giardia lamblia
PASNARLSLTIGLSVTAVALLLI

SEQ ID NO: 3077227 - protein, 20 aa, Giardia lamblia
PATFIYRTNSFWFLSNAALV

SEQ ID NO: 3077228 - protein, 19 aa, Giardia lamblia
PATQFQAFFSHIGFSALML

SEQ ID NO: 3077229 - protein, 51 aa, Giardia lamblia
PAVESCALADAVHDLSCRRMYYANFIDFYLSYCLGRYAIISSLTLDEVMRG

SEQ ID NO: 3077230 - protein, 25 aa, Giardia lamblia
PAVFTSFAKRLLVSILDLQPISKLK

SEQ ID NO: 3077231 - protein, 17 aa, Giardia lamblia
PAVKRDAPVTAYAPEDI

SEQ ID NO: 3077232 - protein, 21 aa, Giardia lamblia
PAVLCKTCNIVRPPGASHCNT

SEQ ID NO: 3077233 - protein, 18 aa, Giardia lamblia
PAVMSCSLSQPRLSDPRT

SEQ ID NO: 3077234 - protein, 23 aa, Giardia lamblia
PAVVLLCSIAFFITCMSMYIQFQ

SEQ ID NO: 3077235 - protein, 22 aa, Giardia lamblia
PAYRMLWLYTPFFLELLNTLAS

SEQ ID NO: 3077236 - protein, 18 aa, Giardia lamblia
PCDILLTVPFEYLDRKKI

SEQ ID NO: 3077237 - protein, 26 aa, Giardia lamblia
PCDITNCLVCATGLKCESCAENAVPI

SEQ ID NO: 3077238 - protein, 19 aa, Giardia lamblia
PCFAVLSGVNPDEFTILYS

SEQ ID NO: 3077239 - protein, 24 aa, Giardia lamblia
PCFKEKELDAALSQVMKHVFSSPS

SEQ ID NO: 3077240 - protein, 23 aa, Giardia lamblia
PCGQLKITLPLEFHLTAITFFKL

SEQ ID NO: 3077241 - protein, 22 aa, Giardia lamblia
PCIANLKLSYMRARDSNSEPET

SEQ ID NO: 3077242 - protein, 20 aa, Giardia lamblia
PCIITSIYLLQFLKEQLSLI

SEQ ID NO: 3077243 - protein, 20 aa, Giardia lamblia
PCIYPESFSWTGTPDSAPNT

SEQ ID NO: 3077244 - protein, 19 aa, Giardia lamblia
PCLQFLLMKLQMMQLRSMK

SEQ ID NO: 3077245 - protein, 17 aa, Giardia lamblia
PCPRSAFSQYFAGKSPF

SEQ ID NO: 3077246 - protein, 22 aa, Giardia lamblia
PCQAYCIPPHIFRSEMRLGVLC

SEQ ID NO: 3077247 - protein, 22 aa, Giardia lamblia
PCRCNCLQLMPSFDAHFSNLLS

SEQ ID NO: 3077248 - protein, 23 aa, Giardia lamblia
PCTKFKPKATHLLSANREILSTG

SEQ ID NO: 3077249 - protein, 23 aa, Giardia lamblia
PCVKLPRHVHIQLDCSGLSTQTL

SEQ ID NO: 3077250 - protein, 20 aa, Giardia lamblia
PDALKAGLLSVTGHVRLLAT

SEQ ID NO: 3077251 - protein, 27 aa, Giardia lamblia
PDALYLRLSPEYGRAFYEISVFLRQFS

SEQ ID NO: 3077252 - protein, 21 aa, Giardia lamblia
PDAMALLIFFMLPFQFFYVVT

SEQ ID NO: 3077253 - protein, 18 aa, Giardia lamblia
PDCYVSNCVQCFASNPGI

SEQ ID NO: 3077254 - protein, 22 aa, Giardia lamblia
PDEYETRIGLAHGTEPILVPAL

SEQ ID NO: 3077255 - protein, 18 aa, Giardia lamblia
PDFEGGLIDAMTIKRDLE

SEQ ID NO: 3077256 - protein, 20 aa, Giardia lamblia
PDGRCVGEGKDIHCECNPDF

SEQ ID NO: 3077257 - protein, 25 aa, Giardia lamblia
PDGTCKLCGNGYFLYKGGCYSITHG

SEQ ID NO: 3077258 - protein, 22 aa, Giardia lamblia
PDHRVRCAAVAAIHSVRARYGD

SEQ ID NO: 3077259 - protein, 17 aa, Giardia lamblia
PDICTIMGCDPMSFIQL

SEQ ID NO: 3077260 - protein, 27 aa, Giardia lamblia
PDIFGEFRGTLILACTIGYAICLQYLQ

SEQ ID NO: 3077261 - protein, 28 aa, Giardia lamblia
PDIFPLSFLYSFSFTWSSLYIAFSAALP

SEQ ID NO: 3077262 - protein, 17 aa, Giardia lamblia
PDIKRSPTGIILSTYAL

SEQ ID NO: 3077263 - protein, 19 aa, Giardia lamblia
PDIRKRFNALASDTDLIAI

SEQ ID NO: 3077264 - protein, 19 aa, Giardia lamblia
PDLFCPLQADFSTGLLAPE

SEQ ID NO: 3077265 - protein, 19 aa, Giardia lamblia
PDLKACVTDACKLDKTLAG

SEQ ID NO: 3077266 - protein, 18 aa, Giardia lamblia
PDLLFADLCSAPGGWSYT

SEQ ID NO: 3077267 - protein, 21 aa, Giardia lamblia
PDLLLVTGIPFYPKVSPDILG

SEQ ID NO: 3077268 - protein, 21 aa, Giardia lamblia
PDLLQLFGRVFTIFFGSFPLE

SEQ ID NO: 3077269 - protein, 22 aa, Giardia lamblia
PDLLSVPLFARNRVDVQESSLF

SEQ ID NO: 3077270 - protein, 21 aa, Giardia lamblia
PDLRLYSQLTNYCRIANIDSS

SEQ ID NO: 3077271 - protein, 19 aa, Giardia lamblia
PDMHEMSSLDPRRMHETPA

SEQ ID NO: 3077272 - protein, 25 aa, Giardia lamblia
PDMSWCASCDMSGRCLSCVTSGHNV

SEQ ID NO: 3077273 - protein, 35 aa, Giardia lamblia
PDMYTPMYMCFILPFCFFILTPLFSYRLSQEKGEG

SEQ ID NO: 3077274 - protein, 21 aa, Giardia lamblia
PDNTRFCPFGFNRFVSSALLE

SEQ ID NO: 3077275 - protein, 21 aa, Giardia lamblia
PDNVLSCSATELIPVDKELSD

SEQ ID NO: 3077276 - protein, 25 aa, Giardia lamblia
PDNVSLLAFIFAASYAYSLCFRYTD

SEQ ID NO: 3077277 - protein, 26 aa, Giardia lamblia
PDPASPVRCIPVLKSSSDMLIADLQR

SEQ ID NO: 3077278 - protein, 24 aa, Giardia lamblia
PDPCSVAGCKTCVSGNRQLCLVCH

SEQ ID NO: 3077279 - protein, 25 aa, Giardia lamblia
PDPKDRLPFEIPLGPVHFFQKGLLP

SEQ ID NO: 3077280 - protein, 24 aa, Giardia lamblia
PDPRIYFAKALACYRENNFPLCLR

SEQ ID NO: 3077281 - protein, 19 aa, Giardia lamblia
PDRAREMLVAGRLQPMQIG

SEQ ID NO: 3077282 - protein, 18 aa, Giardia lamblia
PDRIMWAIMQRIVRTTSL

SEQ ID NO: 3077283 - protein, 18 aa, Giardia lamblia
PDRRALAASSGFFSDPHL

SEQ ID NO: 3077284 - protein, 22 aa, Giardia lamblia
PDRRGRVWMILLGIGYVNSKRY

SEQ ID NO: 3077285 - protein, 23 aa, Giardia lamblia
PDSAIKFRSLEIQTTYGTDCFIK

SEQ ID NO: 3077286 - protein, 20 aa, Giardia lamblia
PDSVRFVFESSTLRHATLAT

SEQ ID NO: 3077287 - protein, 24 aa, Giardia lamblia
PDTCPDFSVCRGHYTSPLTVDCNP

SEQ ID NO: 3077288 - protein, 17 aa, Giardia lamblia
PDVYKANAVNVLIDGIL

SEQ ID NO: 3077289 - protein, 19 aa, Giardia lamblia
PDYIIAAAFGECKYGKGEI

SEQ ID NO: 3077290 - protein, 26 aa, Giardia lamblia
PDYPTIWTQFAIPTWLTKVFYVLFPP

SEQ ID NO: 3077291 - protein, 25 aa, Giardia lamblia
PDYPTIWTQLAIPTWLTKVFYVLFP

SEQ ID NO: 3077292 - protein, 18 aa, Giardia lamblia
PEAAVVCTKSLESIFTRS

SEQ ID NO: 3077293 - protein, 18 aa, Giardia lamblia
PEALLQFNDFLPADYAFI

SEQ ID NO: 3077294 - protein, 17 aa, Giardia lamblia
PEASLLPRPSERENSDP

SEQ ID NO: 3077295 - protein, 17 aa, Giardia lamblia
PEATSYVTGVCFHAFSG

SEQ ID NO: 3077296 - protein, 20 aa, Giardia lamblia
PEAVRSCHLGMAVTKEELED

SEQ ID NO: 3077297 - protein, 17 aa, Giardia lamblia
PECLEYLLRALASMTSS

SEQ ID NO: 3077298 - protein, 20 aa, Giardia lamblia
PEDKLICLTCFANGDLLTPV

SEQ ID NO: 3077299 - protein, 20 aa, Giardia lamblia
PEDQRISLFSAKLEELQAGN

SEQ ID NO: 3077300 - protein, 24 aa, Giardia lamblia
PEEFPHLYKLVTHRSRYYSQDDEY

SEQ ID NO: 3077301 - protein, 24 aa, Giardia lamblia
PEEHMALLMTRTVILLIYSTWAVL

SEQ ID NO: 3077302 - protein, 21 aa, Giardia lamblia
PEEKETYLATSVPRLSSEKSL

SEQ ID NO: 3077303 - protein, 28 aa, Giardia lamblia
PEELFASDIILCFLKFFNPLNLDDVVHV

SEQ ID NO: 3077304 - protein, 21 aa, Giardia lamblia
PEETYSYLMYLLGRIVDAHNQ

SEQ ID NO: 3077305 - protein, 26 aa, Giardia lamblia
PEFYSCLRSTILFSQQLINISKKSSE

SEQ ID NO: 3077306 - protein, 20 aa, Giardia lamblia
PEGYVECSGHGKCIGDHIVG

SEQ ID NO: 3077307 - protein, 19 aa, Giardia lamblia
PEHIRMPDVSQREFRVNNT

SEQ ID NO: 3077308 - protein, 18 aa, Giardia lamblia
PEIANFFLQLQEKFANIK

SEQ ID NO: 3077309 - protein, 20 aa, Giardia lamblia
PEICRRDYWANGGWETFLSI

SEQ ID NO: 3077310 - protein, 27 aa, Giardia lamblia
PEICSISPRITYAWLVVTVLARYNTII

SEQ ID NO: 3077311 - protein, 17 aa, Giardia lamblia
PEIKEYTGHAALTMIQS

SEQ ID NO: 3077312 - protein, 25 aa, Giardia lamblia
PEIPSIRSSGLYDFLVSENGVEMQS

SEQ ID NO: 3077313 - protein, 17 aa, Giardia lamblia
PEKCDRYALHSGTSAMS

SEQ ID NO: 3077314 - protein, 25 aa, Giardia lamblia
PEKGQGFSNCFDLYACCTIIDDAMG

SEQ ID NO: 3077315 - protein, 18 aa, Giardia lamblia
PEKGVAQYNEMHYLIAEL

SEQ ID NO: 3077316 - protein, 22 aa, Giardia lamblia
PEKIAKLRAMAARLFNSSIRIG

SEQ ID NO: 3077317 - protein, 17 aa, Giardia lamblia
PEKKATIAILARSLHGF

SEQ ID NO: 3077318 - protein, 20 aa, Giardia lamblia
PEKRKELLLMLQKQCIAVST

SEQ ID NO: 3077319 - protein, 20 aa, Giardia lamblia
PELASLLEFTKCVIKKDTQF

SEQ ID NO: 3077320 - protein, 23 aa, Giardia lamblia
PELCSTCYNPAYKLSLRSDQCVP

SEQ ID NO: 3077321 - protein, 24 aa, Giardia lamblia
PELDLPNPLCFNIYSIKSIEARDS

SEQ ID NO: 3077322 - protein, 26 aa, Giardia lamblia
PELFRKRLLDKIQIIYAQKAAEMPIS

SEQ ID NO: 3077323 - protein, 38 aa, Giardia lamblia
PELLHLALEISRSTLFPFLHPDNRVMVATVGLAFEPVM

SEQ ID NO: 3077324 - protein, 20 aa, Giardia lamblia
PELLLLAAWTIQPSLDANFS

SEQ ID NO: 3077325 - protein, 26 aa, Giardia lamblia
PELLRFIDDLTKWYIRFNRDTLKGED

SEQ ID NO: 3077326 - protein, 18 aa, Giardia lamblia
PELPRFTDYEGYKLLGGM

SEQ ID NO: 3077327 - protein, 19 aa, Giardia lamblia
PELSAGIWHLIHILFSTAI

SEQ ID NO: 3077328 - protein, 21 aa, Giardia lamblia
PELYCAISGTLQATEHASNDA

SEQ ID NO: 3077329 - protein, 21 aa, Giardia lamblia
PENAVMLMQCILRHEPNTSEA

SEQ ID NO: 3077330 - protein, 19 aa, Giardia lamblia
PERRFRRPVKKNSVLEAML

SEQ ID NO: 3077331 - protein, 25 aa, Giardia lamblia
PERTIWKVACMLLSVIQHACDHNYI

SEQ ID NO: 3077332 - protein, 28 aa, Giardia lamblia
PESEIVYWRARMASFSAVHQRVHSISWL

SEQ ID NO: 3077333 - protein, 32 aa, Giardia lamblia
PESLSECSHNLCALAYAVKQLWTMLDAQEANL

SEQ ID NO: 3077334 - protein, 17 aa, Giardia lamblia
PETAGGGFAGRVSADVD

SEQ ID NO: 3077335 - protein, 30 aa, Giardia lamblia
PETPLGASMARRTCMEGSLVYLDKSTNIKS

SEQ ID NO: 3077336 - protein, 20 aa, Giardia lamblia
PEVHAKLTIINFTISTDALE

SEQ ID NO: 3077337 - protein, 17 aa, Giardia lamblia
PEVIYAKTLATLSLDLL

SEQ ID NO: 3077338 - protein, 20 aa, Giardia lamblia
PEVKRRVCSFRKHQRPQVYE

SEQ ID NO: 3077339 - protein, 22 aa, Giardia lamblia
PEVLASGFLSSFAYHQLIQMPD

SEQ ID NO: 3077340 - protein, 20 aa, Giardia lamblia
PEVLEKLVASYNCKNKEKLI

SEQ ID NO: 3077341 - protein, 19 aa, Giardia lamblia
PEVTEVFRSVSTRLSLPNL

SEQ ID NO: 3077342 - protein, 28 aa, Giardia lamblia
PEYFDKRSIVTLTFWFRVVLGACAAVFP

SEQ ID NO: 3077343 - protein, 17 aa, Giardia lamblia
PEYLKFSTMLNNYVGRH

SEQ ID NO: 3077344 - protein, 19 aa, Giardia lamblia
PFAVHRIDFSAAYDTVRAA

SEQ ID NO: 3077345 - protein, 20 aa, Giardia lamblia
PFEKTCVSPMCLINTTDSTG

SEQ ID NO: 3077346 - protein, 20 aa, Giardia lamblia
PFIVTPLMFGGDFIGIVACS

SEQ ID NO: 3077347 - protein, 18 aa, Giardia lamblia
PFLFFNWTPGGLTTYGIL

SEQ ID NO: 3077348 - protein, 23 aa, Giardia lamblia
PFLSLPPKSSFRLFISSMPVKHF

SEQ ID NO: 3077349 - protein, 19 aa, Giardia lamblia
PFNFHLLKTNALSTFDLGV

SEQ ID NO: 3077350 - protein, 26 aa, Giardia lamblia
PFQGELSTFCLFLINMLKGRLDQWPH

SEQ ID NO: 3077351 - protein, 19 aa, Giardia lamblia
PFSACLPLLEILRADACAF

SEQ ID NO: 3077352 - protein, 19 aa, Giardia lamblia
PFSIKRLAAAATHEPNPTV

SEQ ID NO: 3077353 - protein, 26 aa, Giardia lamblia
PFSLEEFERMCITRCRDMAVNLDEIV

SEQ ID NO: 3077354 - protein, 22 aa, Giardia lamblia
PFSSCSAMVLRVDEFCTKLKTC

SEQ ID NO: 3077355 - protein, 23 aa, Giardia lamblia
PFSSWDSAFGRYARPSKNLFSQR

SEQ ID NO: 3077356 - protein, 20 aa, Giardia lamblia
PFTGAPSRSVYRTIYSSSEL

SEQ ID NO: 3077357 - protein, 20 aa, Giardia lamblia
PGACEIMAILVISALCSQSA

SEQ ID NO: 3077358 - protein, 20 aa, Giardia lamblia
PGAIFLQGHVWRIVTPHLVP

SEQ ID NO: 3077359 - protein, 17 aa, Giardia lamblia
PGALPALVRSLPAPVCA

SEQ ID NO: 3077360 - protein, 17 aa, Giardia lamblia
PGASVIFYIANSAMILV

SEQ ID NO: 3077361 - protein, 19 aa, Giardia lamblia
PGDFRFILGPLAYAAQSGR

SEQ ID NO: 3077362 - protein, 21 aa, Giardia lamblia
PGEALAAGARRVGLRCESCTR

SEQ ID NO: 3077363 - protein, 18 aa, Giardia lamblia
PGETRCFRDQVKKDDRLS

SEQ ID NO: 3077364 - protein, 21 aa, Giardia lamblia
PGGGFHCYAVPFSRPLQTNTP

SEQ ID NO: 3077365 - protein, 30 aa, Giardia lamblia
PGGVRRCWCERGFLPALDRSECVLPIECPP

SEQ ID NO: 3077366 - protein, 23 aa, Giardia lamblia
PGISGYVLCWLIIAFARNGLQEM

SEQ ID NO: 3077367 - protein, 17 aa, Giardia lamblia
PGKCIFDSDIIEYRCLC

SEQ ID NO: 3077368 - protein, 25 aa, Giardia lamblia
PGKMSYKDFIPFILAEEDKDSDPAL

SEQ ID NO: 3077369 - protein, 20 aa, Giardia lamblia
PGLCECARYTLRQIPNVLPA

SEQ ID NO: 3077370 - protein, 20 aa, Giardia lamblia
PGLLPCFYYRDSFTVECTEC

SEQ ID NO: 3077371 - protein, 18 aa, Giardia lamblia
PGLLRWAVDPPIPIWLLF

SEQ ID NO: 3077372 - protein, 22 aa, Giardia lamblia
PGNNCKTCWNGRVLKGSTCVPA

SEQ ID NO: 3077373 - protein, 19 aa, Giardia lamblia
PGRCVPSKLIANGAVCSDN

SEQ ID NO: 3077374 - protein, 20 aa, Giardia lamblia
PGRLRAYDMLHFNHLLVCAL

SEQ ID NO: 3077375 - protein, 22 aa, Giardia lamblia
PGSACSDSSCATSKHLPAMQEE

SEQ ID NO: 3077376 - protein, 20 aa, Giardia lamblia
PGSAGKCFACDSKADNGIEG

SEQ ID NO: 3077377 - protein, 24 aa, Giardia lamblia
PGSFSRFWHELVDDFPPFTKIVTA

SEQ ID NO: 3077378 - protein, 17 aa, Giardia lamblia
PGSGTWGPEPYKCKPDL

SEQ ID NO: 3077379 - protein, 19 aa, Giardia lamblia
PGSHICKTVSSGMCSVCET

SEQ ID NO: 3077380 - protein, 35 aa, Giardia lamblia
PGSSFSYTTTLSWRMYYIIAKLCSRSSFIDTPENQ

SEQ ID NO: 3077381 - protein, 20 aa, Giardia lamblia
PGTLCPLLHFLVASQNINEE

SEQ ID NO: 3077382 - protein, 25 aa, Giardia lamblia
PGTPPRLGQIFGCRCRPGFSGEACD

SEQ ID NO: 3077383 - protein, 23 aa, Giardia lamblia
PGVCKEALVYSFLSVALKMVHLT

SEQ ID NO: 3077384 - protein, 22 aa, Giardia lamblia
PGVSILHIFVDPCGIPILGGGK

SEQ ID NO: 3077385 - protein, 20 aa, Giardia lamblia
PGWWEFRETQELGWWDNFWT

SEQ ID NO: 3077386 - protein, 24 aa, Giardia lamblia
PGYRRPQPLEGWDKDVLKQYKYVL

SEQ ID NO: 3077387 - protein, 22 aa, Giardia lamblia
PGYVCVPYTRIYVSPRQIVAVC

SEQ ID NO: 3077388 - protein, 18 aa, Giardia lamblia
PHCLACHSTYFGINVMSD

SEQ ID NO: 3077389 - protein, 24 aa, Giardia lamblia
PHICSDGYCTYCYKTHIYHNGGCY

SEQ ID NO: 3077390 - protein, 23 aa, Giardia lamblia
PHIFLEILLDLVVNARQYSKPSI

SEQ ID NO: 3077391 - protein, 23 aa, Giardia lamblia
PHIVPPSNYLFRAITAITGTPLL

SEQ ID NO: 3077392 - protein, 18 aa, Giardia lamblia
PHLAPFVLDRDIRFADVT

SEQ ID NO: 3077393 - protein, 27 aa, Giardia lamblia
PHLLRSCSLEPVRISWSLDGAIYCMRY

SEQ ID NO: 3077394 - protein, 29 aa, Giardia lamblia
PHLPPTCACTTDFLLEEFSYFTIPESYPT

SEQ ID NO: 3077395 - protein, 29 aa, Giardia lamblia
PHLQILYTRYYCRLHTIEGLAPLMGLAEL

SEQ ID NO: 3077396 - protein, 17 aa, Giardia lamblia
PHQARPLSLRSMGTQSW

SEQ ID NO: 3077397 - protein, 32 aa, Giardia lamblia
PHQTALMLACFYGHLSIVRLLFHKEKSIVSTS

SEQ ID NO: 3077398 - protein, 26 aa, Giardia lamblia
PHSAVFKLYTYRGTIIHTDFRAPLRL

SEQ ID NO: 3077399 - protein, 38 aa, Giardia lamblia
PHSNVLTVFLCLCSAVLFHEMGHLLLMYSTKTPIRGFE

SEQ ID NO: 3077400 - protein, 23 aa, Giardia lamblia
PHVPATFRKGWLPSPGAASDTPH

SEQ ID NO: 3077401 - protein, 30 aa, Giardia lamblia
PHYTHLIAFLPWLSARKLLRVYKRVFISRR

SEQ ID NO: 3077402 - protein, 18 aa, Giardia lamblia
PICHACFNAQAASSNILG

SEQ ID NO: 3077403 - protein, 18 aa, Giardia lamblia
PICKALLVFLFSNNMPLS

SEQ ID NO: 3077404 - protein, 19 aa, Giardia lamblia
PIDGLAEFCRVVTMYTSSF

SEQ ID NO: 3077405 - protein, 22 aa, Giardia lamblia
PIDPVMSLALFFNGITLPSALL

SEQ ID NO: 3077406 - protein, 18 aa, Giardia lamblia
PIDVCPDSSAVYGAGSEC

SEQ ID NO: 3077407 - protein, 20 aa, Giardia lamblia
PIFLPLHYILGYTLGAVSTR

SEQ ID NO: 3077408 - protein, 19 aa, Giardia lamblia
PIIEPWLPSVTAFFKRLCI

SEQ ID NO: 3077409 - protein, 20 aa, Giardia lamblia
PIIGPVLNFIFKRFPDATAK

SEQ ID NO: 3077410 - protein, 17 aa, Giardia lamblia
PIIVSLLLADSRYFSDL

SEQ ID NO: 3077411 - protein, 29 aa, Giardia lamblia
PIKGSVYYFNCFKDPLVVILWDRISVSLQ

SEQ ID NO: 3077412 - protein, 24 aa, Giardia lamblia
PILPCSGLQAPVALTFGLQHSVTM

SEQ ID NO: 3077413 - protein, 25 aa, Giardia lamblia
PILVGLKIPVLKARREYMEATRAAM

SEQ ID NO: 3077414 - protein, 17 aa, Giardia lamblia
PILVPALVAVRTRESPT

SEQ ID NO: 3077415 - protein, 23 aa, Giardia lamblia
PIPTRIYGTIVFQNPYKDMLVCF

SEQ ID NO: 3077416 - protein, 18 aa, Giardia lamblia
PIQKLLCDVLYTGHAKKA

SEQ ID NO: 3077417 - protein, 28 aa, Giardia lamblia
PIQNGRFLPDYIVKLGLLPKLKDLLRTT

SEQ ID NO: 3077418 - protein, 18 aa, Giardia lamblia
PIQPCTPTSIEFRDVCFS

SEQ ID NO: 3077419 - protein, 27 aa, Giardia lamblia
PIRGFEVGIRYFIPFVTIFGALNSPGS

SEQ ID NO: 3077420 - protein, 24 aa, Giardia lamblia
PIRLLAIDVARNYALVALSTGRDS

SEQ ID NO: 3077421 - protein, 18 aa, Giardia lamblia
PIRSRKYNLLKFILSDYM

SEQ ID NO: 3077422 - protein, 25 aa, Giardia lamblia
PISLRVNLDLAKIITSLMIRRDKSM

SEQ ID NO: 3077423 - protein, 20 aa, Giardia lamblia
PISNQLSAFIVFFLKLQLMN

SEQ ID NO: 3077424 - protein, 20 aa, Giardia lamblia
PISSAVSCLLEYIIYSLSGV

SEQ ID NO: 3077425 - protein, 17 aa, Giardia lamblia
PISTLLSQKICASGDSL

SEQ ID NO: 3077426 - protein, 25 aa, Giardia lamblia
PITPSLCYASIFYRYFSETAPVRAH

SEQ ID NO: 3077427 - protein, 23 aa, Giardia lamblia
PIVCTLHFGWTYTRAVFLLVFFY

SEQ ID NO: 3077428 - protein, 26 aa, Giardia lamblia
PIVERMGRRFLLFLGTFILTAMLIML

SEQ ID NO: 3077429 - protein, 26 aa, Giardia lamblia
PIVEYMTMMFLLKFGAISVELPADVS

SEQ ID NO: 3077430 - protein, 19 aa, Giardia lamblia
PIVRIAALVMPYTQNSLLN

SEQ ID NO: 3077431 - protein, 17 aa, Giardia lamblia
PIWVYYKLPILRVESKN

SEQ ID NO: 3077432 - protein, 24 aa, Giardia lamblia
PKAESRPALFFFSGRRQSGSANHS

SEQ ID NO: 3077433 - protein, 20 aa, Giardia lamblia
PKAFVISFLQTYRFDVESAD

SEQ ID NO: 3077434 - protein, 20 aa, Giardia lamblia
PKAGLSLEIGLEILRKAWPY

SEQ ID NO: 3077435 - protein, 24 aa, Giardia lamblia
PKASRYVPESTFLVFLGVGLGVII

SEQ ID NO: 3077436 - protein, 18 aa, Giardia lamblia
PKAVSSWVDRSFSSVFIA

SEQ ID NO: 3077437 - protein, 26 aa, Giardia lamblia
PKAYHILNLVDLFLIGAFVAVYLTLR

SEQ ID NO: 3077438 - protein, 22 aa, Giardia lamblia
PKDCSVSLLNIHQGMYTNFAIH

SEQ ID NO: 3077439 - protein, 17 aa, Giardia lamblia
PKDDTRFLSSIDYDKYV

SEQ ID NO: 3077440 - protein, 18 aa, Giardia lamblia
PKDGVLVVNRIESRRAAP

SEQ ID NO: 3077441 - protein, 22 aa, Giardia lamblia
PKDLIHRYYFFKVNPQDPEFLS

SEQ ID NO: 3077442 - protein, 26 aa, Giardia lamblia
PKDSRTGRLIAMLVMVFFYMLAELIV

SEQ ID NO: 3077443 - protein, 21 aa, Giardia lamblia
PKDTFSFAMLLNYTAYPNANK

SEQ ID NO: 3077444 - protein, 39 aa, Giardia lamblia
PKDYMKILSTFALLVSRCAGIFALRVDSVITFGDLAIGF

SEQ ID NO: 3077445 - protein, 18 aa, Giardia lamblia
PKETLSFVISLVPEDVDI

SEQ ID NO: 3077446 - protein, 25 aa, Giardia lamblia
PKFEWKGPHAEWLKAQIYQEAAKKH

SEQ ID NO: 3077447 - protein, 21 aa, Giardia lamblia
PKGPKARAFSRLSSLKLNVDE

SEQ ID NO: 3077448 - protein, 26 aa, Giardia lamblia
PKKKRIVGLTLLLFVALLIFGSLAVI

SEQ ID NO: 3077449 - protein, 21 aa, Giardia lamblia
PKKRFCMHENLAAGDEVSGRV

SEQ ID NO: 3077450 - protein, 22 aa, Giardia lamblia
PKKRYDAVLFRRADRADREDNS

SEQ ID NO: 3077451 - protein, 23 aa, Giardia lamblia
PKLLPHEAEHLMMVLSELPEPSR

SEQ ID NO: 3077452 - protein, 23 aa, Giardia lamblia
PKLTPCYHAPEVIGGKNWSIKSD

SEQ ID NO: 3077453 - protein, 19 aa, Giardia lamblia
PKLVGPWVAHFRKERRSFV

SEQ ID NO: 3077454 - protein, 28 aa, Giardia lamblia
PKNFSTYLAIVIWRLFNKPQPELHKDQT

SEQ ID NO: 3077455 - protein, 23 aa, Giardia lamblia
PKPESIRPYLAMLNRCSKGLGKE

SEQ ID NO: 3077456 - protein, 18 aa, Giardia lamblia
PKQLVAMLRVFAKRTQSS

SEQ ID NO: 3077457 - protein, 24 aa, Giardia lamblia
PKRQELRSFYPPKALNVPAQCSSN

SEQ ID NO: 3077458 - protein, 24 aa, Giardia lamblia
PKRYSDRFLYFAIKLKALLTKLEA

SEQ ID NO: 3077459 - protein, 30 aa, Giardia lamblia
PKVDNISLFYVWRVSDYFKKVYADPLDPSY

SEQ ID NO: 3077460 - protein, 17 aa, Giardia lamblia
PKVSILVSMRLSQLQLR

SEQ ID NO: 3077461 - protein, 24 aa, Giardia lamblia
PKVSPDILGSIVFTEDSEQREKRL

SEQ ID NO: 3077462 - protein, 17 aa, Giardia lamblia
PKVTCLTPRTPRMELPE

SEQ ID NO: 3077463 - protein, 25 aa, Giardia lamblia
PKWLKWLRYNAFHLLYPVGVLAGEV

SEQ ID NO: 3077464 - protein, 18 aa, Giardia lamblia
PLAAYACLANGGGSIEDL

SEQ ID NO: 3077465 - protein, 26 aa, Giardia lamblia
PLAFSKIRFCISSTPLTSFRAISDLK

SEQ ID NO: 3077466 - protein, 18 aa, Giardia lamblia
PLAYRSCALEPTYQDSRL

SEQ ID NO: 3077467 - protein, 20 aa, Giardia lamblia
PLCKECEPMSFVSYVKAGAT

SEQ ID NO: 3077468 - protein, 18 aa, Giardia lamblia
PLCNSLWESNAIKAEYST

SEQ ID NO: 3077469 - protein, 26 aa, Giardia lamblia
PLDELDVYLKLVYTVLDFEHLKIVPL

SEQ ID NO: 3077470 - protein, 18 aa, Giardia lamblia
PLEDPSEDFVSLCIEAIL

SEQ ID NO: 3077471 - protein, 23 aa, Giardia lamblia
PLELRPTNLPAIAVSALVGAVAD

SEQ ID NO: 3077472 - protein, 21 aa, Giardia lamblia
PLERADQVFLDRLTVETHMPL

SEQ ID NO: 3077473 - protein, 20 aa, Giardia lamblia
PLERCYDTAITKRKERDSSA

SEQ ID NO: 3077474 - protein, 20 aa, Giardia lamblia
PLFCNYRLTSPQAQGHVSPF

SEQ ID NO: 3077475 - protein, 19 aa, Giardia lamblia
PLFCSFSLVDMLLMMTEGG

SEQ ID NO: 3077476 - protein, 19 aa, Giardia lamblia
PLFIQRVISVYNLKTVVLL

SEQ ID NO: 3077477 - protein, 27 aa, Giardia lamblia
PLFMHYLGQLLACFDLLHPGEDVFLPF

SEQ ID NO: 3077478 - protein, 23 aa, Giardia lamblia
PLFRRHPELLLGILSDRYTGYQD

SEQ ID NO: 3077479 - protein, 23 aa, Giardia lamblia
PLGKCCYHPTSYVIAVMTNTLNC

SEQ ID NO: 3077480 - protein, 25 aa, Giardia lamblia
PLGTCKNPLCFPAQYLNSRRSARFP

SEQ ID NO: 3077481 - protein, 18 aa, Giardia lamblia
PLGYYQHYIDGVGPFSSC

SEQ ID NO: 3077482 - protein, 19 aa, Giardia lamblia
PLHYMGIPIFLLAQLKLPF

SEQ ID NO: 3077483 - protein, 18 aa, Giardia lamblia
PLIAPSIIIRDPETCELK

SEQ ID NO: 3077484 - protein, 25 aa, Giardia lamblia
PLIEYRLYSAKCCVDMQTRSLIYNS

SEQ ID NO: 3077485 - protein, 19 aa, Giardia lamblia
PLIISWCRTCGTALDSLRR

SEQ ID NO: 3077486 - protein, 17 aa, Giardia lamblia
PLIQAFYLFGPRATAVL

SEQ ID NO: 3077487 - protein, 18 aa, Giardia lamblia
PLITVVRKAVGVQTVAQS

SEQ ID NO: 3077488 - protein, 23 aa, Giardia lamblia
PLIVEDCLCAFPQYLEQHEVSVE

SEQ ID NO: 3077489 - protein, 24 aa, Giardia lamblia
PLKNLKYLLNFKVWTQTRDFLQLQ

SEQ ID NO: 3077490 - protein, 23 aa, Giardia lamblia
PLKPLCKNYGYKIITELGNLLGE

SEQ ID NO: 3077491 - protein, 24 aa, Giardia lamblia
PLKPVGLGCIFMRAGRTEEGQRRM

SEQ ID NO: 3077492 - protein, 27 aa, Giardia lamblia
PLKQKARLSLMVLRLLQARIASILSKR

SEQ ID NO: 3077493 - protein, 22 aa, Giardia lamblia
PLKRLYHNIFMVMAQKDGFITE

SEQ ID NO: 3077494 - protein, 31 aa, Giardia lamblia
PLLACKARVLAAEMYLELAYVYLESTGILTN

SEQ ID NO: 3077495 - protein, 20 aa, Giardia lamblia
PLLATELYIRDLLERKRDQL

SEQ ID NO: 3077496 - protein, 18 aa, Giardia lamblia
PLLDLYLSVGGLIGDLKL

SEQ ID NO: 3077497 - protein, 20 aa, Giardia lamblia
PLLEAPIPYSARAGSGGPSE

SEQ ID NO: 3077498 - protein, 31 aa, Giardia lamblia
PLLGLFLWMFMGFRAVSPLLRRTTSLLNSHV

SEQ ID NO: 3077499 - protein, 25 aa, Giardia lamblia
PLLKRKPKMWEIMGVCFAFLGLALV

SEQ ID NO: 3077500 - protein, 26 aa, Giardia lamblia
PLLKRKPKMWEIMGVCFAFLGLVLVG

SEQ ID NO: 3077501 - protein, 25 aa, Giardia lamblia
PLLLLRIRGLIYAFSQALTKIQENI

SEQ ID NO: 3077502 - protein, 18 aa, Giardia lamblia
PLLNPGIMTSIATVGTSI

SEQ ID NO: 3077503 - protein, 25 aa, Giardia lamblia
PLMDGAKIAIGWLVDVLQTYLNPLR

SEQ ID NO: 3077504 - protein, 24 aa, Giardia lamblia
PLMPPDVGKLLEWTDQTLDFRDSV

SEQ ID NO: 3077505 - protein, 18 aa, Giardia lamblia
PLNTCLSISGDQYTCMCN

SEQ ID NO: 3077506 - protein, 29 aa, Giardia lamblia
PLPKQRRTPVKWKKPSKVFLLSKEISTCS

SEQ ID NO: 3077507 - protein, 20 aa, Giardia lamblia
PLPLLSRLVQYPTYRDGSPI

SEQ ID NO: 3077508 - protein, 17 aa, Giardia lamblia
PLPSLSIVPNTNLGTVM

SEQ ID NO: 3077509 - protein, 19 aa, Giardia lamblia
PLPVFKVILFPQLSFLRDA

SEQ ID NO: 3077510 - protein, 19 aa, Giardia lamblia
PLQHKVIEFFRVGTGGIFS

SEQ ID NO: 3077511 - protein, 30 aa, Giardia lamblia
PLQICRHKLLWKRIVSKTVDYQNNKTRMHA

SEQ ID NO: 3077512 - protein, 20 aa, Giardia lamblia
PLRKCKSCKQGFLTYLYEWI

SEQ ID NO: 3077513 - protein, 23 aa, Giardia lamblia
PLRKRKFKTAKEIIENTEYEGVG

SEQ ID NO: 3077514 - protein, 29 aa, Giardia lamblia
PLSELCRYICSIFSLLPVFFYANVFQSLA

SEQ ID NO: 3077515 - protein, 23 aa, Giardia lamblia
PLSKSMVMILAFYFDIHTVASFV

SEQ ID NO: 3077516 - protein, 26 aa, Giardia lamblia
PLSPLIKGSILYFIIKAVAEIIMSPS

SEQ ID NO: 3077517 - protein, 18 aa, Giardia lamblia
PLSSDMRKAFAGPGENSM

SEQ ID NO: 3077518 - protein, 24 aa, Giardia lamblia
PLSTERLHRAFSMDYINTATHHQV

SEQ ID NO: 3077519 - protein, 18 aa, Giardia lamblia
PLSTRKSSCPDRIRKIAR

SEQ ID NO: 3077520 - protein, 19 aa, Giardia lamblia
PLTDRCYITLAQAIGMYLG

SEQ ID NO: 3077521 - protein, 22 aa, Giardia lamblia
PLTEPFLRSLFLKVYPHHTESW

SEQ ID NO: 3077522 - protein, 26 aa, Giardia lamblia
PLTFYSLLELFGFGVMILGVMIHNDV

SEQ ID NO: 3077523 - protein, 24 aa, Giardia lamblia
PLTGTRRLICLASQELYSTILGLD

SEQ ID NO: 3077524 - protein, 18 aa, Giardia lamblia
PLTKIYTRSQIKAITNFE

SEQ ID NO: 3077525 - protein, 28 aa, Giardia lamblia
PLTLEFIFLRLFKFCGGSEVADGKLSSI

SEQ ID NO: 3077526 - protein, 26 aa, Giardia lamblia
PLTLYSLLELFGFGVMILGVMIHNDV

SEQ ID NO: 3077527 - protein, 19 aa, Giardia lamblia
PLVIKYGGAVVFNISLISC

SEQ ID NO: 3077528 - protein, 18 aa, Giardia lamblia
PLVISLAMELIWKTRSDS

SEQ ID NO: 3077529 - protein, 24 aa, Giardia lamblia
PLVKLTGALFRRALAAMLTSPEFY

SEQ ID NO: 3077530 - protein, 17 aa, Giardia lamblia
PLVPSTFNLGKRERQLH

SEQ ID NO: 3077531 - protein, 22 aa, Giardia lamblia
PLVSLTCKLILLSDDLSTQIED

SEQ ID NO: 3077532 - protein, 31 aa, Giardia lamblia
PLYFLPPYIDPHLYRLIRVYLLSPQNLNVIL

SEQ ID NO: 3077533 - protein, 21 aa, Giardia lamblia
PMCRLEVTLLAGLNIGYPVAV

SEQ ID NO: 3077534 - protein, 20 aa, Giardia lamblia
PMDAFQYLSPCYARETELDS

SEQ ID NO: 3077535 - protein, 28 aa, Giardia lamblia
PMFFLPKYLSVRSRRFSSIYTFLHYVPW

SEQ ID NO: 3077536 - protein, 26 aa, Giardia lamblia
PMFTAVPFRLVYSIVILSTTINPLTM

SEQ ID NO: 3077537 - protein, 18 aa, Giardia lamblia
PMGTEICCKCHMNDSVHW

SEQ ID NO: 3077538 - protein, 17 aa, Giardia lamblia
PMNRCGPVLISTYLIMH

SEQ ID NO: 3077539 - protein, 25 aa, Giardia lamblia
PMRLEAPPACAYPWTYAPESSAGDR

SEQ ID NO: 3077540 - protein, 25 aa, Giardia lamblia
PMTMIIRFAALESFLSVLTQALYTN

SEQ ID NO: 3077541 - protein, 17 aa, Giardia lamblia
PMTMPFYRAYKAKQGSF

SEQ ID NO: 3077542 - protein, 22 aa, Giardia lamblia
PMVCNITGTMSWVISDKTTVTI

SEQ ID NO: 3077543 - protein, 22 aa, Giardia lamblia
PMVYIIPGFFGYTISKRQGGPK

SEQ ID NO: 3077544 - protein, 18 aa, Giardia lamblia
PNAAPGTECILCHDTMGA

SEQ ID NO: 3077545 - protein, 20 aa, Giardia lamblia
PNCISCAPPSNGQGSVTCYV

SEQ ID NO: 3077546 - protein, 18 aa, Giardia lamblia
PNCTKCKAPSTGHGPVHC

SEQ ID NO: 3077547 - protein, 28 aa, Giardia lamblia
PNDIFLKVTFPWGLYIFFTIVVSLQASF

SEQ ID NO: 3077548 - protein, 26 aa, Giardia lamblia
PNDSRFTVFLKYCIEELLKHFHRSIL

SEQ ID NO: 3077549 - protein, 24 aa, Giardia lamblia
PNDTRLKCIIHRDLKPDNILLTGD

SEQ ID NO: 3077550 - protein, 17 aa, Giardia lamblia
PNFKASFADMLSLVRSG

SEQ ID NO: 3077551 - protein, 21 aa, Giardia lamblia
PNFKLYGIVLGVFFMAITFLF

SEQ ID NO: 3077552 - protein, 28 aa, Giardia lamblia
PNGELRVPSPLARYASMRPRASSVADYN

SEQ ID NO: 3077553 - protein, 17 aa, Giardia lamblia
PNGFLPISNLDNGEYGD

SEQ ID NO: 3077554 - protein, 17 aa, Giardia lamblia
PNGRFPHEIVLELVPIG

SEQ ID NO: 3077555 - protein, 26 aa, Giardia lamblia
PNGVSFKLPWDAITFIFSKIHYGGRV

SEQ ID NO: 3077556 - protein, 21 aa, Giardia lamblia
PNIIRLSLQMNLRDFLLCIFS

SEQ ID NO: 3077557 - protein, 17 aa, Giardia lamblia
PNIYAYMHLYLKKEIYL

SEQ ID NO: 3077558 - protein, 20 aa, Giardia lamblia
PNKVWIRLISSFVVYAIVTT

SEQ ID NO: 3077559 - protein, 17 aa, Giardia lamblia
PNLAKLGNKYMYENLGK

SEQ ID NO: 3077560 - protein, 20 aa, Giardia lamblia
PNLFIPFIAIDSVALVMEPV

SEQ ID NO: 3077561 - protein, 19 aa, Giardia lamblia
PNLKACVTDACKLNKSLAG

SEQ ID NO: 3077562 - protein, 21 aa, Giardia lamblia
PNLLCDFYQCRSIDGQPAVKA

SEQ ID NO: 3077563 - protein, 23 aa, Giardia lamblia
PNLRSSRFARSYPFVQRRYVEAL

SEQ ID NO: 3077564 - protein, 20 aa, Giardia lamblia
PNMPRPVIAHTGFKLIATMN

SEQ ID NO: 3077565 - protein, 19 aa, Giardia lamblia
PNNRSRLFVSTKIPNYHKD

SEQ ID NO: 3077566 - protein, 20 aa, Giardia lamblia
PNQMRWLLHKNLLIDLKEYF

SEQ ID NO: 3077567 - protein, 18 aa, Giardia lamblia
PNSGLIFDYYVDWQPVID

SEQ ID NO: 3077568 - protein, 18 aa, Giardia lamblia
PNSLIPIRSVHFNEEDVH

SEQ ID NO: 3077569 - protein, 26 aa, Giardia lamblia
PNSRCIKGVCKFFCVLDSDCDAYNVC

SEQ ID NO: 3077570 - protein, 17 aa, Giardia lamblia
PNSRYAFSPAQAYKTPF

SEQ ID NO: 3077571 - protein, 21 aa, Giardia lamblia
PNTEPKWIVLDGDIDALWVES

SEQ ID NO: 3077572 - protein, 20 aa, Giardia lamblia
PNTKKFGTFLMRGMSYAVLF

SEQ ID NO: 3077573 - protein, 19 aa, Giardia lamblia
PNVALSFRMDSLDWNTASM

SEQ ID NO: 3077574 - protein, 24 aa, Giardia lamblia
PNVNAEFLGSMVLRDTEGVSVLSA

SEQ ID NO: 3077575 - protein, 19 aa, Giardia lamblia
PNVSAILYQLCDVHPLKRL

SEQ ID NO: 3077576 - protein, 18 aa, Giardia lamblia
PNVWQFCATDSASYQSTC

SEQ ID NO: 3077577 - protein, 27 aa, Giardia lamblia
PNWCANKVWYVMILSFFLGTSLSLLSL

SEQ ID NO: 3077578 - protein, 19 aa, Giardia lamblia
PNYKMPPVRPEWDEDVIAE

SEQ ID NO: 3077579 - protein, 17 aa, Giardia lamblia
PPAESFYSMVGKSRTLL

SEQ ID NO: 3077580 - protein, 19 aa, Giardia lamblia
PPASMLSLFLGKRRWNALS

SEQ ID NO: 3077581 - protein, 21 aa, Giardia lamblia
PPDMRCLGDFISKLDQIQAAL

SEQ ID NO: 3077582 - protein, 26 aa, Giardia lamblia
PPDPYIFTLMYMRAYYLLKTHYSMRI

SEQ ID NO: 3077583 - protein, 22 aa, Giardia lamblia
PPEINLVLFGRLISGYKLSINF

SEQ ID NO: 3077584 - protein, 23 aa, Giardia lamblia
PPELFRGQYLPGLYVHPKVDYRA

SEQ ID NO: 3077585 - protein, 20 aa, Giardia lamblia
PPEVYQKLLTLVDHINLKIG

SEQ ID NO: 3077586 - protein, 17 aa, Giardia lamblia
PPGALHIQVHRIHDDTM

SEQ ID NO: 3077587 - protein, 19 aa, Giardia lamblia
PPGEAFASISTPYRGSSPS

SEQ ID NO: 3077588 - protein, 28 aa, Giardia lamblia
PPGSFFYMSRFTQIQFPPGYALSSDADF

SEQ ID NO: 3077589 - protein, 31 aa, Giardia lamblia
PPHKIDVRWIGLIFEGVWSIIFAEVYRMVSK

SEQ ID NO: 3077590 - protein, 21 aa, Giardia lamblia
PPIFLLFLVIFSRRFPSTTYS

SEQ ID NO: 3077591 - protein, 22 aa, Giardia lamblia
PPLSADLLSCFAAVDPSAPASD

SEQ ID NO: 3077592 - protein, 26 aa, Giardia lamblia
PPMRRISPVFDCWFESGSMPYAQKHY

SEQ ID NO: 3077593 - protein, 17 aa, Giardia lamblia
PPNLSMESVDFGGQYAS

SEQ ID NO: 3077594 - protein, 17 aa, Giardia lamblia
PPPAPLVPFEFHTKPGV

SEQ ID NO: 3077595 - protein, 17 aa, Giardia lamblia
PPPQALDKLSLWNINNH

SEQ ID NO: 3077596 - protein, 18 aa, Giardia lamblia
PPPVVCAYTVHFAIDASS

SEQ ID NO: 3077597 - protein, 21 aa, Giardia lamblia
PPREFSATLARGLSTGEYTFL

SEQ ID NO: 3077598 - protein, 17 aa, Giardia lamblia
PPRSHHCGVCSRCVLDF

SEQ ID NO: 3077599 - protein, 19 aa, Giardia lamblia
PPSACPCDLQLTNCNSCGS

SEQ ID NO: 3077600 - protein, 21 aa, Giardia lamblia
PPSFHCVRNYQIINVGPPLLS

SEQ ID NO: 3077601 - protein, 17 aa, Giardia lamblia
PPVPLMINDNVYAPDLV

SEQ ID NO: 3077602 - protein, 27 aa, Giardia lamblia
PPYSLRLPLKRVNGIEFRKKGTKVNGK

SEQ ID NO: 3077603 - protein, 27 aa, Giardia lamblia
PQDIPLRIVLELVPIIVSLLLADSRYF

SEQ ID NO: 3077604 - protein, 31 aa, Giardia lamblia
PQDYCKPETKSICKQGVLSAKRRCDVLEVPN

SEQ ID NO: 3077605 - protein, 20 aa, Giardia lamblia
PQETCTRRGQAFGIIASSLF

SEQ ID NO: 3077606 - protein, 18 aa, Giardia lamblia
PQFLTSMRLFISNNTYPD

SEQ ID NO: 3077607 - protein, 17 aa, Giardia lamblia
PQIAATDFVREWNKKVY

SEQ ID NO: 3077608 - protein, 18 aa, Giardia lamblia
PQICTKARAGVCEVCGPT

SEQ ID NO: 3077609 - protein, 24 aa, Giardia lamblia
PQIGIKIYCIFYLVMLGSMIVSSY

SEQ ID NO: 3077610 - protein, 20 aa, Giardia lamblia
PQIRGLSFIQSWAEQDMLLA

SEQ ID NO: 3077611 - protein, 18 aa, Giardia lamblia
PQKLRAWLSQGQKKITLK

SEQ ID NO: 3077612 - protein, 19 aa, Giardia lamblia
PQLTVRYHVKIIRGLTPRA

SEQ ID NO: 3077613 - protein, 19 aa, Giardia lamblia
PQLYLICGAYRTVIELCFD

SEQ ID NO: 3077614 - protein, 22 aa, Giardia lamblia
PQPESIKDFLLNFNPSRFRFAM

SEQ ID NO: 3077615 - protein, 26 aa, Giardia lamblia
PQPIAIFSCHSLGCTMIKICACLTAS

SEQ ID NO: 3077616 - protein, 19 aa, Giardia lamblia
PQPISLPPQIIFNLDIGGY

SEQ ID NO: 3077617 - protein, 19 aa, Giardia lamblia
PQPNLFALFDLPQVRIADI

SEQ ID NO: 3077618 - protein, 19 aa, Giardia lamblia
PQPPLWPREQLVGSAHISA

SEQ ID NO: 3077619 - protein, 17 aa, Giardia lamblia
PQRIRIRLMSFTFLIFR

SEQ ID NO: 3077620 - protein, 20 aa, Giardia lamblia
PQRLKDLLVEKSLPLTSVSA

SEQ ID NO: 3077621 - protein, 24 aa, Giardia lamblia
PQRTLRYYYLWSLQFIASPILFPF

SEQ ID NO: 3077622 - protein, 20 aa, Giardia lamblia
PQSGCGLAEAGTCAFTGLQY

SEQ ID NO: 3077623 - protein, 17 aa, Giardia lamblia
PQSLSFKPLSAIRRENK

SEQ ID NO: 3077624 - protein, 18 aa, Giardia lamblia
PQVRIADILLKLQQSEIV

SEQ ID NO: 3077625 - protein, 23 aa, Giardia lamblia
PQWLRASPLVSYMYMDAAFIHTA

SEQ ID NO: 3077626 - protein, 23 aa, Giardia lamblia
PQYSRPFLCSTLLSVLQDGPLAT

SEQ ID NO: 3077627 - protein, 19 aa, Giardia lamblia
PRAGILPPRSLGGGEWSAA

SEQ ID NO: 3077628 - protein, 19 aa, Giardia lamblia
PRAGLLPPRSLGGGEWGAA

SEQ ID NO: 3077629 - protein, 19 aa, Giardia lamblia
PRAGLLPPRSLGGGEWGAV

SEQ ID NO: 3077630 - protein, 19 aa, Giardia lamblia
PRAGLLPPRSLGGGEWSAA

SEQ ID NO: 3077631 - protein, 21 aa, Giardia lamblia
PRALCEYAFHFVELIDATYGD

SEQ ID NO: 3077632 - protein, 24 aa, Giardia lamblia
PRDDFFVGLDRLFSILNRNNTVPV

SEQ ID NO: 3077633 - protein, 19 aa, Giardia lamblia
PRDLTRWIASVKDHYGSYQ

SEQ ID NO: 3077634 - protein, 31 aa, Giardia lamblia
PRDYYAAYCNFVYLCSKYCIITVVPVIQNGF

SEQ ID NO: 3077635 - protein, 20 aa, Giardia lamblia
PREKMLKEWVKQMDGLIANY

SEQ ID NO: 3077636 - protein, 27 aa, Giardia lamblia
PREKPRVLKLLLQRGYSLSVSGDDTLA

SEQ ID NO: 3077637 - protein, 26 aa, Giardia lamblia
PRELPEAFARLSWSVSNSVSRRASAN

SEQ ID NO: 3077638 - protein, 19 aa, Giardia lamblia
PRERVGYNTVYTGSCTSTT

SEQ ID NO: 3077639 - protein, 18 aa, Giardia lamblia
PRFSCSCRNKHISILQRY

SEQ ID NO: 3077640 - protein, 22 aa, Giardia lamblia
PRGISVGDVYDCYVGSSRVEAR

SEQ ID NO: 3077641 - protein, 24 aa, Giardia lamblia
PRGLPRRCLHVMAGAGNLCHLAVL

SEQ ID NO: 3077642 - protein, 21 aa, Giardia lamblia
PRITSAATLLRYTLDTLISAQ

SEQ ID NO: 3077643 - protein, 19 aa, Giardia lamblia
PRKFIPWSNGKNFPSALFC

SEQ ID NO: 3077644 - protein, 21 aa, Giardia lamblia
PRKRVLACLPLLLVSTATAMA

SEQ ID NO: 3077645 - protein, 22 aa, Giardia lamblia
PRKSCDLQKIALILKGLSDLLP

SEQ ID NO: 3077646 - protein, 20 aa, Giardia lamblia
PRLFLLCFLTSPDAIEEDLA

SEQ ID NO: 3077647 - protein, 20 aa, Giardia lamblia
PRLLAALYLSNLQYRLIIAY

SEQ ID NO: 3077648 - protein, 22 aa, Giardia lamblia
PRLLPSTLRRLSELSILPDTFG

SEQ ID NO: 3077649 - protein, 19 aa, Giardia lamblia
PRLLPYGSADMARFLNHLG

SEQ ID NO: 3077650 - protein, 20 aa, Giardia lamblia
PRLLSSPLFQDLLQLHAFIA

SEQ ID NO: 3077651 - protein, 17 aa, Giardia lamblia
PRLPSKYSTTSQMLSVM

SEQ ID NO: 3077652 - protein, 17 aa, Giardia lamblia
PRMHLQLPPLCPSSRTE

SEQ ID NO: 3077653 - protein, 17 aa, Giardia lamblia
PRMLPDREHVLEDIKIN

SEQ ID NO: 3077654 - protein, 23 aa, Giardia lamblia
PRMSLCACNASNLYVLTNHDPGK

SEQ ID NO: 3077655 - protein, 22 aa, Giardia lamblia
PRNNSYRLALLAMVSRKPLYSL

SEQ ID NO: 3077656 - protein, 18 aa, Giardia lamblia
PRNPCIDLAIPDQALPGS

SEQ ID NO: 3077657 - protein, 19 aa, Giardia lamblia
PRNVVPFNEYLCAGEDFRS

SEQ ID NO: 3077658 - protein, 21 aa, Giardia lamblia
PRPEGTVYYDRCYSEPVECGN

SEQ ID NO: 3077659 - protein, 28 aa, Giardia lamblia
PRPFDYIFNLFVTFDCDFESSDLIYRLV

SEQ ID NO: 3077660 - protein, 21 aa, Giardia lamblia
PRPGKPILASFAFGNVIGVID

SEQ ID NO: 3077661 - protein, 20 aa, Giardia lamblia
PRQFKQSFFFLTKDLNISFL

SEQ ID NO: 3077662 - protein, 18 aa, Giardia lamblia
PRQRNWELYYCKICGLVT

SEQ ID NO: 3077663 - protein, 23 aa, Giardia lamblia
PRRVRPRVFTALLTKMYRYDAST

SEQ ID NO: 3077664 - protein, 20 aa, Giardia lamblia
PRSGFCGSDICLTGGPDNPD

SEQ ID NO: 3077665 - protein, 23 aa, Giardia lamblia
PRSIASLYFLIRIAHAAYFSYSR

SEQ ID NO: 3077666 - protein, 29 aa, Giardia lamblia
PRSKKKCHAKLLIGEGAIHCKIFSDNETL

SEQ ID NO: 3077667 - protein, 18 aa, Giardia lamblia
PRSLADINNLCAGKGVFD

SEQ ID NO: 3077668 - protein, 19 aa, Giardia lamblia
PRSPSIRKVISESACHEIT

SEQ ID NO: 3077669 - protein, 27 aa, Giardia lamblia
PRTFNCTKPSFFAKLFASSTNQGTDHF

SEQ ID NO: 3077670 - protein, 19 aa, Giardia lamblia
PRTLESMGEKNFQLALDTL

SEQ ID NO: 3077671 - protein, 23 aa, Giardia lamblia
PRTLIELRHIRAYLGGWDFFSYA

SEQ ID NO: 3077672 - protein, 25 aa, Giardia lamblia
PRTTSMPLHVSMSMSTLPNIADYMA

SEQ ID NO: 3077673 - protein, 17 aa, Giardia lamblia
PRVRPMVLIGANVCNQL

SEQ ID NO: 3077674 - protein, 25 aa, Giardia lamblia
PRYLSYDRPIVYFARVGYLSLDIVN

SEQ ID NO: 3077675 - protein, 24 aa, Giardia lamblia
PSAAYPRIFERFKKQAFSGIGSSL

SEQ ID NO: 3077676 - protein, 17 aa, Giardia lamblia
PSAEMRELLQLYTSPSA

SEQ ID NO: 3077677 - protein, 23 aa, Giardia lamblia
PSAPEVFAGYCVERTSDTTSSRL

SEQ ID NO: 3077678 - protein, 19 aa, Giardia lamblia
PSDRYRFDDLVPLIKTPVL

SEQ ID NO: 3077679 - protein, 24 aa, Giardia lamblia
PSEFAATMLRIFRHSPYDLLRVYF

SEQ ID NO: 3077680 - protein, 24 aa, Giardia lamblia
PSEFLYRMMPSYSQQTYKHRLSTR

SEQ ID NO: 3077681 - protein, 25 aa, Giardia lamblia
PSENAVELFDALILELKPFTTLLVD

SEQ ID NO: 3077682 - protein, 24 aa, Giardia lamblia
PSESLKIVTLLAEKAIWMTHFTNI

SEQ ID NO: 3077683 - protein, 27 aa, Giardia lamblia
PSFDSHKWIPYVIKAGVSFLIILPLSL

SEQ ID NO: 3077684 - protein, 17 aa, Giardia lamblia
PSFISFYKMHLASRISS

SEQ ID NO: 3077685 - protein, 26 aa, Giardia lamblia
PSFLVTCTFPHSFDSMILPSVPLPEP

SEQ ID NO: 3077686 - protein, 18 aa, Giardia lamblia
PSFPDSHVNLTFAFTTLR

SEQ ID NO: 3077687 - protein, 19 aa, Giardia lamblia
PSFVFLLNIFFFKYLSLRA

SEQ ID NO: 3077688 - protein, 23 aa, Giardia lamblia
PSGAESFIAPNRVELHSHSAYTS

SEQ ID NO: 3077689 - protein, 19 aa, Giardia lamblia
PSGCHKAKHIWGAIYQEAR

SEQ ID NO: 3077690 - protein, 24 aa, Giardia lamblia
PSGCNLCAPGYFWTSSVHGCIRCD

SEQ ID NO: 3077691 - protein, 19 aa, Giardia lamblia
PSGFLGMNLLNPWLCDSDP

SEQ ID NO: 3077692 - protein, 20 aa, Giardia lamblia
PSGLLVRVSSKLLAMLVYFL

SEQ ID NO: 3077693 - protein, 24 aa, Giardia lamblia
PSHSSLCRKPWQLFTKDYWSTSGE

SEQ ID NO: 3077694 - protein, 26 aa, Giardia lamblia
PSIHCIKRAIPWLDLILLLETSISGL

SEQ ID NO: 3077695 - protein, 24 aa, Giardia lamblia
PSIHILLSRMGRMFLSGSYPTENY

SEQ ID NO: 3077696 - protein, 40 aa, Giardia lamblia
PSIKKEFTERLLLCLRKRLSTKYFREFTIGYTMPENLVSS

SEQ ID NO: 3077697 - protein, 21 aa, Giardia lamblia
PSILELMSLPSPSPAGGTMST

SEQ ID NO: 3077698 - protein, 17 aa, Giardia lamblia
PSIPMAAPKLLIKNEAT

SEQ ID NO: 3077699 - protein, 41 aa, Giardia lamblia
PSKHVPFIAFRGCDFILAMPLGCIFIFTRHRLHDGGSSRLV

SEQ ID NO: 3077700 - protein, 23 aa, Giardia lamblia
PSLEEVAHFVELYKEYDPSDYEH

SEQ ID NO: 3077701 - protein, 32 aa, Giardia lamblia
PSLLRWAIDPPIPKWIMFLPFNTIALSLGDAL

SEQ ID NO: 3077702 - protein, 18 aa, Giardia lamblia
PSLSCVRKSALICSCSRI

SEQ ID NO: 3077703 - protein, 19 aa, Giardia lamblia
PSLTLYPIDGFTPIEVSLL

SEQ ID NO: 3077704 - protein, 27 aa, Giardia lamblia
PSNCLMCTGATPNECLLCIDNYSYDSQ

SEQ ID NO: 3077705 - protein, 18 aa, Giardia lamblia
PSNYPIYGAYNIRANRIM

SEQ ID NO: 3077706 - protein, 17 aa, Giardia lamblia
PSPHVCSIFVADMDRLC

SEQ ID NO: 3077707 - protein, 25 aa, Giardia lamblia
PSPLLRPIYEGTIVRCENGLDADPP

SEQ ID NO: 3077708 - protein, 27 aa, Giardia lamblia
PSRVLEFIIQMLLCFCYTDELADDSVS

SEQ ID NO: 3077709 - protein, 21 aa, Giardia lamblia
PSSAPGLHWDQSIYILIRHVL

SEQ ID NO: 3077710 - protein, 26 aa, Giardia lamblia
PSSCQSFLMLYGWDVMNPRTRTTGTS

SEQ ID NO: 3077711 - protein, 24 aa, Giardia lamblia
PSSFIPALVVSVILTRTLREIAVT

SEQ ID NO: 3077712 - protein, 24 aa, Giardia lamblia
PSSLRRIIDCLAILMHAPLSKISH

SEQ ID NO: 3077713 - protein, 20 aa, Giardia lamblia
PSSSRPSVTVSQVIALTNIF

SEQ ID NO: 3077714 - protein, 25 aa, Giardia lamblia
PSSYISLRMERCIDNAGHRYFNRGI

SEQ ID NO: 3077715 - protein, 41 aa, Giardia lamblia
PSTAKPGLRTGLRPFLKQVRRPKDVYSFKCTPSNSFNLLQH

SEQ ID NO: 3077716 - protein, 18 aa, Giardia lamblia
PSTTCSRNNLVAQELCID

SEQ ID NO: 3077717 - protein, 26 aa, Giardia lamblia
PSTTTFKVKLWYTAGSGIESASVSLA

SEQ ID NO: 3077718 - protein, 22 aa, Giardia lamblia
PSVFYMECGPAIANLYDGLSSS

SEQ ID NO: 3077719 - protein, 21 aa, Giardia lamblia
PSVGCKRELEDSGALLAYYPQ

SEQ ID NO: 3077720 - protein, 17 aa, Giardia lamblia
PSVTFLADNPVDKNLCS

SEQ ID NO: 3077721 - protein, 17 aa, Giardia lamblia
PTAAKWGSIPLPSVSVT

SEQ ID NO: 3077722 - protein, 25 aa, Giardia lamblia
PTALELLTMPALQRVRRSLLEKGPI

SEQ ID NO: 3077723 - protein, 28 aa, Giardia lamblia
PTCNPPASVYVRFEYIYVPRISTGSIDE

SEQ ID NO: 3077724 - protein, 27 aa, Giardia lamblia
PTDAYARFAFHQLFSWDIKTHDWKSYT

SEQ ID NO: 3077725 - protein, 24 aa, Giardia lamblia
PTDFEWLRQTRFYWSTDTDNCKIQ

SEQ ID NO: 3077726 - protein, 29 aa, Giardia lamblia
PTDVVFLAVYSLRCRIALKDPATTVDDKI

SEQ ID NO: 3077727 - protein, 22 aa, Giardia lamblia
PTFILGYLWCIMSRIAVDNADI

SEQ ID NO: 3077728 - protein, 18 aa, Giardia lamblia
PTGISGEVVARVEIETMG

SEQ ID NO: 3077729 - protein, 17 aa, Giardia lamblia
PTIISFIHRIGRAGRMG

SEQ ID NO: 3077730 - protein, 26 aa, Giardia lamblia
PTLDFSPALLRLFISVLLMIRLQHGP

SEQ ID NO: 3077731 - protein, 17 aa, Giardia lamblia
PTLVFLALFGIFEIITN

SEQ ID NO: 3077732 - protein, 21 aa, Giardia lamblia
PTLYFCFFLNIAIRIYLPISL

SEQ ID NO: 3077733 - protein, 25 aa, Giardia lamblia
PTNFLASACIEWLARLRKDEGSYTM

SEQ ID NO: 3077734 - protein, 24 aa, Giardia lamblia
PTNYFYRYRIHPITGSLLPLPLIL

SEQ ID NO: 3077735 - protein, 27 aa, Giardia lamblia
PTPEEARWCLVRCLSPYSLRQLELEII

SEQ ID NO: 3077736 - protein, 24 aa, Giardia lamblia
PTPLDIISAIPLQYRYAATSIVNG

SEQ ID NO: 3077737 - protein, 17 aa, Giardia lamblia
PTPSFSAMIVNKYGLNK

SEQ ID NO: 3077738 - protein, 21 aa, Giardia lamblia
PTRINLGAFAFDLTELKDAFV

SEQ ID NO: 3077739 - protein, 20 aa, Giardia lamblia
PTRLPHAGARLPTFQQNKKP

SEQ ID NO: 3077740 - protein, 28 aa, Giardia lamblia
PTSADFRGELLFLLRLMQMHVHQTKEGV

SEQ ID NO: 3077741 - protein, 22 aa, Giardia lamblia
PTSCTSCYPGFVLDHAGGPAGT

SEQ ID NO: 3077742 - protein, 20 aa, Giardia lamblia
PTSFCVHLPSLLFASNKALL

SEQ ID NO: 3077743 - protein, 17 aa, Giardia lamblia
PTSHTPLPSGLKDCGND

SEQ ID NO: 3077744 - protein, 18 aa, Giardia lamblia
PTSIEFRDVCFSYKTGCD

SEQ ID NO: 3077745 - protein, 25 aa, Giardia lamblia
PTSVLDILSFFSCKYYDRKITDVVH

SEQ ID NO: 3077746 - protein, 17 aa, Giardia lamblia
PTTDLSLSLLLEPTSTY

SEQ ID NO: 3077747 - protein, 24 aa, Giardia lamblia
PTTILCLLFLYLLASFNCTTYSIL

SEQ ID NO: 3077748 - protein, 20 aa, Giardia lamblia
PTVLDPAAAVAITKAISSAE

SEQ ID NO: 3077749 - protein, 17 aa, Giardia lamblia
PTVSEAALNYKRPMSEQ

SEQ ID NO: 3077750 - protein, 20 aa, Giardia lamblia
PTVTFMPVFSRYTGPNPANL

SEQ ID NO: 3077751 - protein, 26 aa, Giardia lamblia
PTVVYSWKLFSLLSIYNPRRFSDWYE

SEQ ID NO: 3077752 - protein, 18 aa, Giardia lamblia
PTWVSGILDICRAKVDYF

SEQ ID NO: 3077753 - protein, 26 aa, Giardia lamblia
PTYPGEIMYGHYFLSYGDRYVYNAHD

SEQ ID NO: 3077754 - protein, 23 aa, Giardia lamblia
PVDEAIKFLAQRILLLSRTVKIS

SEQ ID NO: 3077755 - protein, 22 aa, Giardia lamblia
PVDLWYPIWVTITLVFALFLGM

SEQ ID NO: 3077756 - protein, 28 aa, Giardia lamblia
PVEEYSIWKCAEELLAALSYIQEFKNSQ

SEQ ID NO: 3077757 - protein, 35 aa, Giardia lamblia
PVHATFYAKLCIPPLCVIYLLGLIYEFNSEPNYVS

SEQ ID NO: 3077758 - protein, 19 aa, Giardia lamblia
PVHGYAGIRGCSRCMLPSS

SEQ ID NO: 3077759 - protein, 25 aa, Giardia lamblia
PVIAFPFIILLSLLKFFGLNTSQRK

SEQ ID NO: 3077760 - protein, 18 aa, Giardia lamblia
PVIAGIKPNSDWYSCKHT

SEQ ID NO: 3077761 - protein, 17 aa, Giardia lamblia
PVISAAALTVRMLPHPA

SEQ ID NO: 3077762 - protein, 17 aa, Giardia lamblia
PVLEAPLVMFLTGAEVL

SEQ ID NO: 3077763 - protein, 18 aa, Giardia lamblia
PVLGRCTPVTTLLKTTVL

SEQ ID NO: 3077764 - protein, 24 aa, Giardia lamblia
PVLKHGVCPNEHLITLIKVLVKRE

SEQ ID NO: 3077765 - protein, 25 aa, Giardia lamblia
PVLPMKFETCLTLQYILENRTTVDL

SEQ ID NO: 3077766 - protein, 20 aa, Giardia lamblia
PVLTKLFIKRTRLQTQQLII

SEQ ID NO: 3077767 - protein, 25 aa, Giardia lamblia
PVLTRLRNLLPLLFLINKLVALYFD

SEQ ID NO: 3077768 - protein, 21 aa, Giardia lamblia
PVLTRRAHIVAAAINTLSATS

SEQ ID NO: 3077769 - protein, 20 aa, Giardia lamblia
PVMLNTKFHLVDAVESIKPF

SEQ ID NO: 3077770 - protein, 18 aa, Giardia lamblia
PVNGFSLPLTGLRLDFLV

SEQ ID NO: 3077771 - protein, 29 aa, Giardia lamblia
PVNIDCNLLLPACRALIIASQGSLSSAAS

SEQ ID NO: 3077772 - protein, 20 aa, Giardia lamblia
PVQLMQKWAPSRSASLKVQD

SEQ ID NO: 3077773 - protein, 23 aa, Giardia lamblia
PVRELRLYIVVDGVVIRYRRSYY

SEQ ID NO: 3077774 - protein, 19 aa, Giardia lamblia
PVSGRVCFNIGTSKANRDI

SEQ ID NO: 3077775 - protein, 25 aa, Giardia lamblia
PVTGSLPYWKFVFATACFAILDLVQ

SEQ ID NO: 3077776 - protein, 23 aa, Giardia lamblia
PVTRTSPLLSLLQRSLPTSLPLV

SEQ ID NO: 3077777 - protein, 22 aa, Giardia lamblia
PVVLCIMGSMFGMFFGSMMSAS

SEQ ID NO: 3077778 - protein, 19 aa, Giardia lamblia
PVYIPAYLMHVWTVSFLLS

SEQ ID NO: 3077779 - protein, 19 aa, Giardia lamblia
PWINPARQLFDKDLVLIAY

SEQ ID NO: 3077780 - protein, 21 aa, Giardia lamblia
PWIVRGIVEVIFLEFYAVHTI

SEQ ID NO: 3077781 - protein, 20 aa, Giardia lamblia
PWLNSARLSMNVFLLSGYVY

SEQ ID NO: 3077782 - protein, 29 aa, Giardia lamblia
PWLPSVTAFFKRLCIVTFKKSCKVSDELA

SEQ ID NO: 3077783 - protein, 31 aa, Giardia lamblia
PWMAFLEIVRRVSVFMPLFGCHASIAPLLSE

SEQ ID NO: 3077784 - protein, 29 aa, Giardia lamblia
PWQAFLEIVRRVSIFLALFGCQISIAPLL

SEQ ID NO: 3077785 - protein, 22 aa, Giardia lamblia
PWQKIYECPILVKVLSYSHVYS

SEQ ID NO: 3077786 - protein, 18 aa, Giardia lamblia
PWQSFWKENISIKVSTVY

SEQ ID NO: 3077787 - protein, 34 aa, Giardia lamblia
PWSIRRRATALLWEYRLGFKRTRNMLLQFMHHLG

SEQ ID NO: 3077788 - protein, 22 aa, Giardia lamblia
PWVRIYRIMRDIPLPLISAGVD

SEQ ID NO: 3077789 - protein, 19 aa, Giardia lamblia
PWVSVQLNYTIKVGTAKDK

SEQ ID NO: 3077790 - protein, 19 aa, Giardia lamblia
PYALLLKFLHPESSPVLFM

SEQ ID NO: 3077791 - protein, 21 aa, Giardia lamblia
PYDFVSLRFSARAIQETIRQH

SEQ ID NO: 3077792 - protein, 26 aa, Giardia lamblia
PYESLYLLEFNHRLHILHSPVATLQY

SEQ ID NO: 3077793 - protein, 24 aa, Giardia lamblia
PYETIDCIFNETMLFVNIQSTNRL

SEQ ID NO: 3077794 - protein, 34 aa, Giardia lamblia
PYFDLRLIQVYLIFDKFRGCVSTLLFKKLKQILF

SEQ ID NO: 3077795 - protein, 24 aa, Giardia lamblia
PYGGSFLCLCLNGLAVGYLAPQRL

SEQ ID NO: 3077796 - protein, 25 aa, Giardia lamblia
PYGPRPAERFIVVIALSVAATMKEG

SEQ ID NO: 3077797 - protein, 21 aa, Giardia lamblia
PYHLFLLPAQVSWTEVTKAIK

SEQ ID NO: 3077798 - protein, 20 aa, Giardia lamblia
PYIFGLGIICCVIVIMEYLT

SEQ ID NO: 3077799 - protein, 18 aa, Giardia lamblia
PYIIRSLSLHIARADSIL

SEQ ID NO: 3077800 - protein, 28 aa, Giardia lamblia
PYIPDCKELLKVFAYHLVVSFMFTFDPN

SEQ ID NO: 3077801 - protein, 22 aa, Giardia lamblia
PYKEMREFAECYTLDGKSVGEY

SEQ ID NO: 3077802 - protein, 34 aa, Giardia lamblia
PYLSEVITLLCILCPLGPCVGEVFAIDNDSASPQ

SEQ ID NO: 3077803 - protein, 19 aa, Giardia lamblia
PYLTGLIFVLLKIIAVCPK

SEQ ID NO: 3077804 - protein, 18 aa, Giardia lamblia
PYMLSRVFHLYVTIETEK

SEQ ID NO: 3077805 - protein, 25 aa, Giardia lamblia
PYNLMNCGWLLGMFFLVLIGVSSAL

SEQ ID NO: 3077806 - protein, 21 aa, Giardia lamblia
PYPSLQPYLLKAIREALFMVS

SEQ ID NO: 3077807 - protein, 28 aa, Giardia lamblia
PYQAHYILKFLRQIRIVIYDSLRSLPNN

SEQ ID NO: 3077808 - protein, 17 aa, Giardia lamblia
PYQYIYKVLLDEEDTFL

SEQ ID NO: 3077809 - protein, 25 aa, Giardia lamblia
PYTVMRSGWVIGLFSMIFVIVIGSI

SEQ ID NO: 3077810 - protein, 21 aa, Giardia lamblia
PYTYEEGRRLLAQYPENPAYC

SEQ ID NO: 3077811 - protein, 18 aa, Giardia lamblia
PYVFIEFLHCYSRQMQRF

SEQ ID NO: 3077812 - protein, 21 aa, Giardia lamblia
PYVPCAVSLGFTRTSDSRTML

SEQ ID NO: 3077813 - protein, 17 aa, Giardia lamblia
PYYKTTERIIAKHHRLA

SEQ ID NO: 3077814 - protein, 23 aa, Giardia lamblia
QAAFRGCKLRTTLYRIRCACCND

SEQ ID NO: 3077815 - protein, 24 aa, Giardia lamblia
QAAGWKFGMVYFFYGILTGATVPI

SEQ ID NO: 3077816 - protein, 18 aa, Giardia lamblia
QAAIRQCEELSQYKDARA

SEQ ID NO: 3077817 - protein, 18 aa, Giardia lamblia
QAAKTVFIRYFQSFTPVQ

SEQ ID NO: 3077818 - protein, 23 aa, Giardia lamblia
QAAPYVVAYDCCFPPDSDNYLQC

SEQ ID NO: 3077819 - protein, 19 aa, Giardia lamblia
QAAVPAWGMAVPSFQPVLS

SEQ ID NO: 3077820 - protein, 33 aa, Giardia lamblia
QADLPRRGHFIITIPQVCYIFDGMSLPGNPFSI

SEQ ID NO: 3077821 - protein, 20 aa, Giardia lamblia
QADRTIIYACDAFIAECKVL

SEQ ID NO: 3077822 - protein, 18 aa, Giardia lamblia
QAEGLLFTTYIAKNMYHV

SEQ ID NO: 3077823 - protein, 18 aa, Giardia lamblia
QAEIHYLLSHMSREDSRY

SEQ ID NO: 3077824 - protein, 17 aa, Giardia lamblia
QAELDAMPFYNVPGDGV

SEQ ID NO: 3077825 - protein, 32 aa, Giardia lamblia
QAFCIPLRSIMVMCLKLVIRVVELLNSKLQWA

SEQ ID NO: 3077826 - protein, 20 aa, Giardia lamblia
QAFFSHIGFSALMLAAELNQ

SEQ ID NO: 3077827 - protein, 20 aa, Giardia lamblia
QAIILAALLIKRYLSSKYFD

SEQ ID NO: 3077828 - protein, 23 aa, Giardia lamblia
QAIPAIRRKITFRGDISAPLDQQ

SEQ ID NO: 3077829 - protein, 17 aa, Giardia lamblia
QAIRLRKTANHYVPLTK

SEQ ID NO: 3077830 - protein, 26 aa, Giardia lamblia
QAKSPRTDLYWLIVQWYILTEKVSQE

SEQ ID NO: 3077831 - protein, 19 aa, Giardia lamblia
QALIRPVDFLALLFGSLCH

SEQ ID NO: 3077832 - protein, 23 aa, Giardia lamblia
QAQEARAAMTARIDAMAAQDRER

SEQ ID NO: 3077833 - protein, 19 aa, Giardia lamblia
QAQLPGGCLPSGYYHDPLA

SEQ ID NO: 3077834 - protein, 23 aa, Giardia lamblia
QARHPNCVRALIMAEAQEENSLY

SEQ ID NO: 3077835 - protein, 23 aa, Giardia lamblia
QASMELLEFEITYGPVVPEASRP

SEQ ID NO: 3077836 - protein, 24 aa, Giardia lamblia
QATARPVDCYGIYLPSWFSFIHAG

SEQ ID NO: 3077837 - protein, 18 aa, Giardia lamblia
QAVLLCGPSASGRTALLS

SEQ ID NO: 3077838 - protein, 17 aa, Giardia lamblia
QAVSYTLMRLCTIDDVN

SEQ ID NO: 3077839 - protein, 19 aa, Giardia lamblia
QAWSGAVLCLRCADGDLPL

SEQ ID NO: 3077840 - protein, 26 aa, Giardia lamblia
QAWVQYLLSWPGSRYKLKDANNAESI

SEQ ID NO: 3077841 - protein, 19 aa, Giardia lamblia
QAYDGGSCSNNFGGESHGA

SEQ ID NO: 3077842 - protein, 17 aa, Giardia lamblia
QCADGSILIDGICIPCP

SEQ ID NO: 3077843 - protein, 17 aa, Giardia lamblia
QCDHIRMNLSIDTALLI

SEQ ID NO: 3077844 - protein, 18 aa, Giardia lamblia
QCELKYVAPTSVPLIGAI

SEQ ID NO: 3077845 - protein, 17 aa, Giardia lamblia
QCGFNLFEGCASCDQID

SEQ ID NO: 3077846 - protein, 28 aa, Giardia lamblia
QCGHIYCYSCLKLWLTNSRESNCAMCRA

SEQ ID NO: 3077847 - protein, 19 aa, Giardia lamblia
QCHSRGFLAVCSLRQAVPR

SEQ ID NO: 3077848 - protein, 23 aa, Giardia lamblia
QCIGRGSFGSVYYCLHRESRNEF

SEQ ID NO: 3077849 - protein, 24 aa, Giardia lamblia
QCLNCIIMDLIIRSQKDFSAFLVA

SEQ ID NO: 3077850 - protein, 19 aa, Giardia lamblia
QCLRCKAYDTAPIDDACIP

SEQ ID NO: 3077851 - protein, 24 aa, Giardia lamblia
QCMTCKPGFFMKGSGPGTCVPCDD

SEQ ID NO: 3077852 - protein, 17 aa, Giardia lamblia
QCNPGYVGRHCDLCDKG

SEQ ID NO: 3077853 - protein, 19 aa, Giardia lamblia
QCNYPNCSIVLLNDNLYAV

SEQ ID NO: 3077854 - protein, 25 aa, Giardia lamblia
QCPNEMYCLSGRCVAKCTTTADCEK

SEQ ID NO: 3077855 - protein, 17 aa, Giardia lamblia
QCQRWLFSSPEVLQAAR

SEQ ID NO: 3077856 - protein, 18 aa, Giardia lamblia
QCVFLPVDEVFALINRSR

SEQ ID NO: 3077857 - protein, 22 aa, Giardia lamblia
QCVIKGCGIAHCVECTNDGTPQ

SEQ ID NO: 3077858 - protein, 21 aa, Giardia lamblia
QDACRAELVFVTLLSFEDVGA

SEQ ID NO: 3077859 - protein, 26 aa, Giardia lamblia
QDAILIWDLYQRKFIAVLRIFAPSSP

SEQ ID NO: 3077860 - protein, 29 aa, Giardia lamblia
QDARAACRRCLSHISMLLGPRNLGTILLS

SEQ ID NO: 3077861 - protein, 24 aa, Giardia lamblia
QDCKLTSTAALDWSLFHRLCYSSR

SEQ ID NO: 3077862 - protein, 20 aa, Giardia lamblia
QDEFDLYKSLLPNYGTIEEI

SEQ ID NO: 3077863 - protein, 22 aa, Giardia lamblia
QDFCVPPRWAAYEHMYATHRTD

SEQ ID NO: 3077864 - protein, 18 aa, Giardia lamblia
QDFILKVFVKLEDIDLSI

SEQ ID NO: 3077865 - protein, 24 aa, Giardia lamblia
QDIGSACRLVMLTWEENWTKLKSC

SEQ ID NO: 3077866 - protein, 23 aa, Giardia lamblia
QDILPILMKAYFCYVLVMMAINF

SEQ ID NO: 3077867 - protein, 20 aa, Giardia lamblia
QDIRRFQKLFSLLVYVNRDT

SEQ ID NO: 3077868 - protein, 26 aa, Giardia lamblia
QDLAVRTPLFLAYTYCSFAKAMMTSD

SEQ ID NO: 3077869 - protein, 26 aa, Giardia lamblia
QDLCVEIYKVLGFRYLDSEFINRLIL

SEQ ID NO: 3077870 - protein, 27 aa, Giardia lamblia
QDLGLRDKRGYTCFMRLVERCSSLPAS

SEQ ID NO: 3077871 - protein, 17 aa, Giardia lamblia
QDLGVCLQSLMNGTAIY

SEQ ID NO: 3077872 - protein, 18 aa, Giardia lamblia
QDLRPSIVRREISDPYFR

SEQ ID NO: 3077873 - protein, 24 aa, Giardia lamblia
QDLSMSMQLYWLYCTLAIISPQTA

SEQ ID NO: 3077874 - protein, 23 aa, Giardia lamblia
QDLSRTGLAFTMPPYDALVDAVR

SEQ ID NO: 3077875 - protein, 23 aa, Giardia lamblia
QDPKHFTFMIGFDAPFEKQGSGT

SEQ ID NO: 3077876 - protein, 24 aa, Giardia lamblia
QDPLLEFSLRMIALELVRSSVQLP

SEQ ID NO: 3077877 - protein, 27 aa, Giardia lamblia
QDSRLTLLVRLDFIVAILTGNRDHVKC

SEQ ID NO: 3077878 - protein, 35 aa, Giardia lamblia
QDTCDRLLCALASFRGVVVRLRLRRLRDISTTQCI

SEQ ID NO: 3077879 - protein, 23 aa, Giardia lamblia
QDTCISCAHIPGCQVCDSTGVCL

SEQ ID NO: 3077880 - protein, 18 aa, Giardia lamblia
QDVIGLRLIFLARAGFLT

SEQ ID NO: 3077881 - protein, 30 aa, Giardia lamblia
QDVLKCLRALMRYLGTYAFEVVQPTPASTD

SEQ ID NO: 3077882 - protein, 22 aa, Giardia lamblia
QEACIPVASWVGGTDSVYKSIS

SEQ ID NO: 3077883 - protein, 29 aa, Giardia lamblia
QEAEFIKLFFREAFSMIFISAMDNVQDAS

SEQ ID NO: 3077884 - protein, 22 aa, Giardia lamblia
QEARLEKGLELFAQSSAQASEL

SEQ ID NO: 3077885 - protein, 38 aa, Giardia lamblia
QEAYTYWYDCFMLDLLFNIPDTFSLKLFNEYEKIKQTI

SEQ ID NO: 3077886 - protein, 21 aa, Giardia lamblia
QECDCAPPLMPERDTSEEGAG

SEQ ID NO: 3077887 - protein, 18 aa, Giardia lamblia
QEDRTGGGFVPTYDYRHH

SEQ ID NO: 3077888 - protein, 18 aa, Giardia lamblia
QEECIKLLMDKEGSLRTH

SEQ ID NO: 3077889 - protein, 24 aa, Giardia lamblia
QEELCLIKWLSHGRILVTCDVSGQ

SEQ ID NO: 3077890 - protein, 18 aa, Giardia lamblia
QEELQRDLCMLVAPLCRF

SEQ ID NO: 3077891 - protein, 19 aa, Giardia lamblia
QEFYYRHLFSSNTTLNTLS

SEQ ID NO: 3077892 - protein, 20 aa, Giardia lamblia
QEIALTCKFLLDLSKGQGYT

SEQ ID NO: 3077893 - protein, 22 aa, Giardia lamblia
QEIVRPAPGFLLFATQNPSGSY

SEQ ID NO: 3077894 - protein, 19 aa, Giardia lamblia
QEKCILCSDNIGFGGSKGI

SEQ ID NO: 3077895 - protein, 18 aa, Giardia lamblia
QEKPDMWLPIPVESIDHT

SEQ ID NO: 3077896 - protein, 17 aa, Giardia lamblia
QELECIKTISSSEGRIK

SEQ ID NO: 3077897 - protein, 18 aa, Giardia lamblia
QELRACADYSTQILLVEI

SEQ ID NO: 3077898 - protein, 17 aa, Giardia lamblia
QEPRFDIYVSNYLQSLE

SEQ ID NO: 3077899 - protein, 21 aa, Giardia lamblia
QEPRIKFTRIDALEDRDKEYL

SEQ ID NO: 3077900 - protein, 17 aa, Giardia lamblia
QEQRVLSVLSRHDLRGV

SEQ ID NO: 3077901 - protein, 18 aa, Giardia lamblia
QESLLIIWRSLIVLDAPY

SEQ ID NO: 3077902 - protein, 24 aa, Giardia lamblia
QESYKARAYFVLGTTYLNSTRTPL

SEQ ID NO: 3077903 - protein, 24 aa, Giardia lamblia
QEVAHKWTSICFASNPKTHTRTIP

SEQ ID NO: 3077904 - protein, 18 aa, Giardia lamblia
QEVCKQCMPGYILDTDSS

SEQ ID NO: 3077905 - protein, 23 aa, Giardia lamblia
QEVEALADRCCIMKSGEIVALGT

SEQ ID NO: 3077906 - protein, 25 aa, Giardia lamblia
QEYAELGHFIAVFALVVILLILFFF

SEQ ID NO: 3077907 - protein, 20 aa, Giardia lamblia
QEYIRLVGLNNMLVDASKES

SEQ ID NO: 3077908 - protein, 18 aa, Giardia lamblia
QFDCSRFNLATSNRELLQ

SEQ ID NO: 3077909 - protein, 22 aa, Giardia lamblia
QFDMMGCTALMYAAAGNWPDVI

SEQ ID NO: 3077910 - protein, 38 aa, Giardia lamblia
QFDQKFGLFVPMVCWQCGILYEMGRYTAASSVLKAQED

SEQ ID NO: 3077911 - protein, 28 aa, Giardia lamblia
QFDSRVQYSAGLGLWAIVVLYPTISFQG

SEQ ID NO: 3077912 - protein, 23 aa, Giardia lamblia
QFEYLCLLLRYFFNSKGAIPPEV

SEQ ID NO: 3077913 - protein, 18 aa, Giardia lamblia
QFGVCILLFLGLLLLLAE

SEQ ID NO: 3077914 - protein, 26 aa, Giardia lamblia
QFHCVPMQLGCPGYILVRPGYYRWCQ

SEQ ID NO: 3077915 - protein, 24 aa, Giardia lamblia
QFHPFEGYSLPPCISLPSIPNSGL

SEQ ID NO: 3077916 - protein, 23 aa, Giardia lamblia
QFIPNVCFINGYMKACLKSNKLF

SEQ ID NO: 3077917 - protein, 30 aa, Giardia lamblia
QFIPRLVDYSINFACVTSLLAVISNSFLKQ

SEQ ID NO: 3077918 - protein, 23 aa, Giardia lamblia
QFKKRPCLWCASKPTSNGITMVC

SEQ ID NO: 3077919 - protein, 18 aa, Giardia lamblia
QFLPCTTVTCLRDMNRLL

SEQ ID NO: 3077920 - protein, 26 aa, Giardia lamblia
QFPMLHICKFLLTLMDLVGRLKHHII

SEQ ID NO: 3077921 - protein, 19 aa, Giardia lamblia
QFSSIVFCQVCHHSIPEII

SEQ ID NO: 3077922 - protein, 24 aa, Giardia lamblia
QFTGPRRILFKVVPYTGNAYAAAL

SEQ ID NO: 3077923 - protein, 23 aa, Giardia lamblia
QFTLKTPSSFALYKHESHPNMDL

SEQ ID NO: 3077924 - protein, 25 aa, Giardia lamblia
QGCQACSKDSATTCDACFEPLIMKE

SEQ ID NO: 3077925 - protein, 19 aa, Giardia lamblia
QGCQACSKDSATTCDTCFS

SEQ ID NO: 3077926 - protein, 23 aa, Giardia lamblia
QGDGSLWAGLGCNIAKPLELFEV

SEQ ID NO: 3077927 - protein, 28 aa, Giardia lamblia
QGGWLILFLRFALPLILVLVLYLNPLVA

SEQ ID NO: 3077928 - protein, 20 aa, Giardia lamblia
QGHVSPFFFIQFNNISLKVV

SEQ ID NO: 3077929 - protein, 18 aa, Giardia lamblia
QGIIERFASLSILGYLDD

SEQ ID NO: 3077930 - protein, 21 aa, Giardia lamblia
QGIRTLLLIDCRKDEVDDDTH

SEQ ID NO: 3077931 - protein, 17 aa, Giardia lamblia
QGMNCPAAILLIYIRDI

SEQ ID NO: 3077932 - protein, 23 aa, Giardia lamblia
QGSCGCCWAMASAAFYEISVRLT

SEQ ID NO: 3077933 - protein, 25 aa, Giardia lamblia
QGSGRKGLPQSFINRFLNVYVDVLK

SEQ ID NO: 3077934 - protein, 18 aa, Giardia lamblia
QGTCIYPAGQKCTNGHCS

SEQ ID NO: 3077935 - protein, 17 aa, Giardia lamblia
QGWTLHGTLCYPSACVS

SEQ ID NO: 3077936 - protein, 21 aa, Giardia lamblia
QHGPNSYIFRGLEQVYAETVE

SEQ ID NO: 3077937 - protein, 20 aa, Giardia lamblia
QHLKHGAAIKKVQDMCERLH

SEQ ID NO: 3077938 - protein, 20 aa, Giardia lamblia
QHLLTEWPDNVQLLDIMHVC

SEQ ID NO: 3077939 - protein, 24 aa, Giardia lamblia
QHRLAPDANRTAACTQTFVYLVSC

SEQ ID NO: 3077940 - protein, 24 aa, Giardia lamblia
QHSTFRASPFHKRQRRESILTMLA

SEQ ID NO: 3077941 - protein, 25 aa, Giardia lamblia
QHTSEKLATIALFIEFVYLSSCPLK

SEQ ID NO: 3077942 - protein, 26 aa, Giardia lamblia
QHVSDCLWAYLILPLLHEIFIVNNRK

SEQ ID NO: 3077943 - protein, 24 aa, Giardia lamblia
QIAFKDSLADFFVLLQELSAYGKT

SEQ ID NO: 3077944 - protein, 24 aa, Giardia lamblia
QICMTCGILAIEILALTLKKPMSV

SEQ ID NO: 3077945 - protein, 25 aa, Giardia lamblia
QIHLDCLRSLWTFFQKGTVDVYNDL

SEQ ID NO: 3077946 - protein, 18 aa, Giardia lamblia
QIIELVAFQPYRFSKNSM

SEQ ID NO: 3077947 - protein, 26 aa, Giardia lamblia
QIIKYLRYLWFLAQSYRDKVLCMHQR

SEQ ID NO: 3077948 - protein, 22 aa, Giardia lamblia
QIKDCYNQTLALREKLSAIESA

SEQ ID NO: 3077949 - protein, 25 aa, Giardia lamblia
QILDFPCAWDPVSETYNFMEPNSLD

SEQ ID NO: 3077950 - protein, 23 aa, Giardia lamblia
QILHCRRVLLTFLSDSVAVASSQ

SEQ ID NO: 3077951 - protein, 18 aa, Giardia lamblia
QILLDKRVTTILHNTSAL

SEQ ID NO: 3077952 - protein, 20 aa, Giardia lamblia
QINLFFKFLDEVCSNKSYFT

SEQ ID NO: 3077953 - protein, 25 aa, Giardia lamblia
QINRRTLYRAHRWHNLYARGQDNTN

SEQ ID NO: 3077954 - protein, 24 aa, Giardia lamblia
QIPLPYKLAYRIDPYHNAMMPRGY

SEQ ID NO: 3077955 - protein, 17 aa, Giardia lamblia
QIPPKFKSSGQCDLLDT

SEQ ID NO: 3077956 - protein, 29 aa, Giardia lamblia
QIQCCSIFDNFFSNFLFRSTIIVLSSYIR

SEQ ID NO: 3077957 - protein, 24 aa, Giardia lamblia
QIQRMRHVCMFKAQTYQTCVPYAT

SEQ ID NO: 3077958 - protein, 17 aa, Giardia lamblia
QITIGFQSTTRFIYSFP

SEQ ID NO: 3077959 - protein, 18 aa, Giardia lamblia
QIVMPIWASALIFSKTMK

SEQ ID NO: 3077960 - protein, 28 aa, Giardia lamblia
QKAALTKCYFCDIHHRFQFEQQQQQPDD

SEQ ID NO: 3077961 - protein, 21 aa, Giardia lamblia
QKAARLQKRMEAMNKRERSHM

SEQ ID NO: 3077962 - protein, 21 aa, Giardia lamblia
QKFELLHTFPFTSETKRMSVV

SEQ ID NO: 3077963 - protein, 18 aa, Giardia lamblia
QKHTHCMLLNIIENTDPK

SEQ ID NO: 3077964 - protein, 17 aa, Giardia lamblia
QKICQRIDKALSEISLN

SEQ ID NO: 3077965 - protein, 29 aa, Giardia lamblia
QKICYGPAVVREWCEYFSRTHDSAKDPVL

SEQ ID NO: 3077966 - protein, 25 aa, Giardia lamblia
QKIPYKWRLLIIMFNVFLPAIVATF

SEQ ID NO: 3077967 - protein, 20 aa, Giardia lamblia
QKLAEKLAHLALEREATDNI

SEQ ID NO: 3077968 - protein, 22 aa, Giardia lamblia
QKLDFYLTNSFILLFEILIPYI

SEQ ID NO: 3077969 - protein, 36 aa, Giardia lamblia
QKLEYVEVFLRYALICLLICSIHLLLSASRLADYNP

SEQ ID NO: 3077970 - protein, 18 aa, Giardia lamblia
QKLLCQIETLKGDMQALA

SEQ ID NO: 3077971 - protein, 18 aa, Giardia lamblia
QKLLERRKAFGIAGTSEI

SEQ ID NO: 3077972 - protein, 20 aa, Giardia lamblia
QKLPEGCIFMAYSSIGMYTI

SEQ ID NO: 3077973 - protein, 20 aa, Giardia lamblia
QKLSCVMPTLARIFTDHFFA

SEQ ID NO: 3077974 - protein, 21 aa, Giardia lamblia
QKLYCKFDPIITLREFTRRFL

SEQ ID NO: 3077975 - protein, 30 aa, Giardia lamblia
QKSVEFPIIYGCLLCIWLSSFVEKRSLLTQ

SEQ ID NO: 3077976 - protein, 25 aa, Giardia lamblia
QKTKASTYWARKLKRGDGVALDSDP

SEQ ID NO: 3077977 - protein, 17 aa, Giardia lamblia
QKTKITAGYGFSTKMPK

SEQ ID NO: 3077978 - protein, 21 aa, Giardia lamblia
QKTKNAINWGLALVGVTTVSG

SEQ ID NO: 3077979 - protein, 18 aa, Giardia lamblia
QKTTDLAPRFQVSTWDRR

SEQ ID NO: 3077980 - protein, 17 aa, Giardia lamblia
QKVDLMFTEVPKYQDTR

SEQ ID NO: 3077981 - protein, 17 aa, Giardia lamblia
QKVKKYKTAYIDSKSFS

SEQ ID NO: 3077982 - protein, 18 aa, Giardia lamblia
QKVLFPLLISVTVLLLLF

SEQ ID NO: 3077983 - protein, 26 aa, Giardia lamblia
QKVLPLNHPILYLWGPSPSHNEVFLR

SEQ ID NO: 3077984 - protein, 18 aa, Giardia lamblia
QKYAAAMGYLLGSTLLHP

SEQ ID NO: 3077985 - protein, 17 aa, Giardia lamblia
QKYCVFNLSGLNKALTW

SEQ ID NO: 3077986 - protein, 24 aa, Giardia lamblia
QKYKYPSFCPHRREAFENARTALM

SEQ ID NO: 3077987 - protein, 24 aa, Giardia lamblia
QLAKDNKSFCPFANQFFEKLLHEI

SEQ ID NO: 3077988 - protein, 25 aa, Giardia lamblia
QLAMLEVFISVFVFLRHHSFDASPA

SEQ ID NO: 3077989 - protein, 20 aa, Giardia lamblia
QLCRLHLPQSVYLEINFSSY

SEQ ID NO: 3077990 - protein, 18 aa, Giardia lamblia
QLDGEFVSISAFDSISVV

SEQ ID NO: 3077991 - protein, 36 aa, Giardia lamblia
QLEICSIYLIGWLRLTQNLTLCYDGALVAQLVTILS

SEQ ID NO: 3077992 - protein, 21 aa, Giardia lamblia
QLELCNAVLDSIRHFAQTKLI

SEQ ID NO: 3077993 - protein, 24 aa, Giardia lamblia
QLESELADARFILGNIVDENKFLA

SEQ ID NO: 3077994 - protein, 21 aa, Giardia lamblia
QLFAKAVPWIGLVFVSQITLA

SEQ ID NO: 3077995 - protein, 22 aa, Giardia lamblia
QLFFCPLWLWLSEIIGRKPVYI

SEQ ID NO: 3077996 - protein, 23 aa, Giardia lamblia
QLFFCPLWLWLSEIIGRRPVYIV

SEQ ID NO: 3077997 - protein, 17 aa, Giardia lamblia
QLFFKTEFAGGYQLLLD

SEQ ID NO: 3077998 - protein, 22 aa, Giardia lamblia
QLFNDCNLEFCWSSDAASVVKG

SEQ ID NO: 3077999 - protein, 26 aa, Giardia lamblia
QLFNYAIEFFRYIRHAAATILSVSLE

SEQ ID NO: 3078000 - protein, 20 aa, Giardia lamblia
QLGMGFCGSLAYELSSSFML

SEQ ID NO: 3078001 - protein, 18 aa, Giardia lamblia
QLGRCLWGKCVCFDGVLG

SEQ ID NO: 3078002 - protein, 30 aa, Giardia lamblia
QLIHGISLDISRPLFWKAFNQSMIERVYNS

SEQ ID NO: 3078003 - protein, 20 aa, Giardia lamblia
QLILLQSCAFRELSALNLCL

SEQ ID NO: 3078004 - protein, 18 aa, Giardia lamblia
QLKVDVLDMFFITHMNYK

SEQ ID NO: 3078005 - protein, 23 aa, Giardia lamblia
QLKYNLRGLFALASLNEVGDSRP

SEQ ID NO: 3078006 - protein, 18 aa, Giardia lamblia
QLLGYVWEVYPFIDEDPS

SEQ ID NO: 3078007 - protein, 18 aa, Giardia lamblia
QLLKLSLQTYSHVVARII

SEQ ID NO: 3078008 - protein, 18 aa, Giardia lamblia
QLLLMISDGRLKEKGGVA

SEQ ID NO: 3078009 - protein, 17 aa, Giardia lamblia
QLLNRFWANVPRALDPR

SEQ ID NO: 3078010 - protein, 23 aa, Giardia lamblia
QLLRLPVECFFGTGMCATSQHIR

SEQ ID NO: 3078011 - protein, 18 aa, Giardia lamblia
QLMVKEVGMSSAHPTLSC

SEQ ID NO: 3078012 - protein, 22 aa, Giardia lamblia
QLNFYLSLRDLLMLSAGAQDKD

SEQ ID NO: 3078013 - protein, 21 aa, Giardia lamblia
QLPNGMTALMFAASAGNKEIV

SEQ ID NO: 3078014 - protein, 24 aa, Giardia lamblia
QLPRLCLPLKIEITTEGSLLYDQV

SEQ ID NO: 3078015 - protein, 31 aa, Giardia lamblia
QLQYLKLLERFIRYLFTQVVSRFESNLIELQ

SEQ ID NO: 3078016 - protein, 25 aa, Giardia lamblia
QLRDLCLPADLPLEAYEFLLDHGIS

SEQ ID NO: 3078017 - protein, 20 aa, Giardia lamblia
QLRIPRSLLVFNQECVTEEE

SEQ ID NO: 3078018 - protein, 21 aa, Giardia lamblia
QLRKICCHPDLFEHTSSVGPF

SEQ ID NO: 3078019 - protein, 18 aa, Giardia lamblia
QLRLDRRQNRILSYKVWI

SEQ ID NO: 3078020 - protein, 25 aa, Giardia lamblia
QLRQRIGPCRIIFYMDTKTFAPELR

SEQ ID NO: 3078021 - protein, 23 aa, Giardia lamblia
QLRSICKDLIYSRIQGMSVISQA

SEQ ID NO: 3078022 - protein, 19 aa, Giardia lamblia
QLSDCKLPTEVVLPTKVSV

SEQ ID NO: 3078023 - protein, 18 aa, Giardia lamblia
QLSNMVFLDEFIKYNREQ

SEQ ID NO: 3078024 - protein, 18 aa, Giardia lamblia
QLTGLTLNGLVANIGRNF

SEQ ID NO: 3078025 - protein, 38 aa, Giardia lamblia
QLTLYFSSHLMRLIVMMKRGASPLLRPIIKGQNCTLET

SEQ ID NO: 3078026 - protein, 19 aa, Giardia lamblia
QLTNLRDQFCLARKVMEWI

SEQ ID NO: 3078027 - protein, 18 aa, Giardia lamblia
QLTPEFLVFVFSVYSRFL

SEQ ID NO: 3078028 - protein, 24 aa, Giardia lamblia
QLVAEPFRIGFLLVLALGSLMKCT

SEQ ID NO: 3078029 - protein, 24 aa, Giardia lamblia
QLVKSRALSSITLRQSHFQLLVVF

SEQ ID NO: 3078030 - protein, 35 aa, Giardia lamblia
QLVSLQWRVYLLMSRCIFIISYVRAHANKLFYYVD

SEQ ID NO: 3078031 - protein, 20 aa, Giardia lamblia
QMDVLEFPWYALLQNASISA

SEQ ID NO: 3078032 - protein, 31 aa, Giardia lamblia
QMGSFKPVPLYIICLVSFGIFSIVVSMLTWY

SEQ ID NO: 3078033 - protein, 25 aa, Giardia lamblia
QMHELLNFLLLRGSKLSLHLANSSV

SEQ ID NO: 3078034 - protein, 19 aa, Giardia lamblia
QMLCVVMYYLLTRCSDTMV

SEQ ID NO: 3078035 - protein, 17 aa, Giardia lamblia
QMLDKFKSILFSEMTQR

SEQ ID NO: 3078036 - protein, 18 aa, Giardia lamblia
QMMSRVAYALSFLESPLV

SEQ ID NO: 3078037 - protein, 23 aa, Giardia lamblia
QMPSECGHSKYLRRQRISPETYK

SEQ ID NO: 3078038 - protein, 24 aa, Giardia lamblia
QMYTEIPRYFPLNKKAADQLYANR

SEQ ID NO: 3078039 - protein, 26 aa, Giardia lamblia
QNAEARGGPRLRSGRFDPSTLFSQQS

SEQ ID NO: 3078040 - protein, 19 aa, Giardia lamblia
QNDVCARCSTGAPPENGKC

SEQ ID NO: 3078041 - protein, 17 aa, Giardia lamblia
QNGRCVCLLGYSISFNG

SEQ ID NO: 3078042 - protein, 24 aa, Giardia lamblia
QNIVGKCKLVYLSKPGRKFSTSLS

SEQ ID NO: 3078043 - protein, 19 aa, Giardia lamblia
QNIWACIKQTLSSQYVQFC

SEQ ID NO: 3078044 - protein, 27 aa, Giardia lamblia
QNKEGRTALMFAAWNGYTDCVKLLKDM

SEQ ID NO: 3078045 - protein, 24 aa, Giardia lamblia
QNKYWGVGLFNYWKITNLPRFLLV

SEQ ID NO: 3078046 - protein, 23 aa, Giardia lamblia
QNMRHCVPNPGVILIMSLLFTGS

SEQ ID NO: 3078047 - protein, 24 aa, Giardia lamblia
QNPPKGALISSVFDSIIFITCSDD

SEQ ID NO: 3078048 - protein, 25 aa, Giardia lamblia
QNPYKDMLVCFPPPQALDKLSLWNI

SEQ ID NO: 3078049 - protein, 18 aa, Giardia lamblia
QNQRCIFSEILLHDHQHN

SEQ ID NO: 3078050 - protein, 20 aa, Giardia lamblia
QNTLRYAWMTVQEVTPPGYL

SEQ ID NO: 3078051 - protein, 17 aa, Giardia lamblia
QNYMEVFNDNGANIHLK

SEQ ID NO: 3078052 - protein, 25 aa, Giardia lamblia
QPAMLPEYNRVIIIAPISLLLGTST

SEQ ID NO: 3078053 - protein, 24 aa, Giardia lamblia
QPARRICLHSCPIGYAANPITNTC

SEQ ID NO: 3078054 - protein, 22 aa, Giardia lamblia
QPCATLPVKVMPPATNIIDGFL

SEQ ID NO: 3078055 - protein, 22 aa, Giardia lamblia
QPCDIANCRVCATGLKCESCAE

SEQ ID NO: 3078056 - protein, 21 aa, Giardia lamblia
QPEALPCYISLQFQPQNQCPQ

SEQ ID NO: 3078057 - protein, 27 aa, Giardia lamblia
QPGKLIVEYYLGYSITVWPVVSETTAE

SEQ ID NO: 3078058 - protein, 18 aa, Giardia lamblia
QPIIDLLEFCLVPNPTLR

SEQ ID NO: 3078059 - protein, 21 aa, Giardia lamblia
QPIRFEFMGYIILAKSIKDLG

SEQ ID NO: 3078060 - protein, 17 aa, Giardia lamblia
QPKEILISDIVESSQPR

SEQ ID NO: 3078061 - protein, 21 aa, Giardia lamblia
QPLALCLYATSAFLSFRNASE

SEQ ID NO: 3078062 - protein, 19 aa, Giardia lamblia
QPLASLFTFMTLLLLQLSP

SEQ ID NO: 3078063 - protein, 17 aa, Giardia lamblia
QPLCPVLLALSASTSVL

SEQ ID NO: 3078064 - protein, 25 aa, Giardia lamblia
QPLRGWRINLYKCVAYPVYFLMQCS

SEQ ID NO: 3078065 - protein, 17 aa, Giardia lamblia
QPQACSTLTDFLNHIQA

SEQ ID NO: 3078066 - protein, 20 aa, Giardia lamblia
QPSKSRAILQPSAFNIDAMV

SEQ ID NO: 3078067 - protein, 18 aa, Giardia lamblia
QQAIPWFYNLLLTKQPRV

SEQ ID NO: 3078068 - protein, 31 aa, Giardia lamblia
QQFLKKLEKGDCGTVTFGLECTAIALSSDTN

SEQ ID NO: 3078069 - protein, 42 aa, Giardia lamblia
QQFLWGGFCASPKSGFYGQVLCCLPCTVDNLYLRIVTLEDVW

SEQ ID NO: 3078070 - protein, 25 aa, Giardia lamblia
QQHAPELRSMVSIIFDRLPLHDHSI

SEQ ID NO: 3078071 - protein, 27 aa, Giardia lamblia
QQILNGFCPIIFEMCKNIPTGSIPATF

SEQ ID NO: 3078072 - protein, 24 aa, Giardia lamblia
QQIRGFNMHLIRAIGSCTSALNKY

SEQ ID NO: 3078073 - protein, 17 aa, Giardia lamblia
QQKEVFYQYFLENDTKF

SEQ ID NO: 3078074 - protein, 24 aa, Giardia lamblia
QQLMERVSFFFAFSKDVGHSDFLP

SEQ ID NO: 3078075 - protein, 28 aa, Giardia lamblia
QQNIIFSVIYHWNVWQRCMSVTSSDKVI

SEQ ID NO: 3078076 - protein, 20 aa, Giardia lamblia
QQPAICAGEGYPVGNYGERL

SEQ ID NO: 3078077 - protein, 22 aa, Giardia lamblia
QQRYNFKLVLMSATKDPLVLRT

SEQ ID NO: 3078078 - protein, 26 aa, Giardia lamblia
QQVLLSILLRLSFSYISMSPFSFIVL

SEQ ID NO: 3078079 - protein, 18 aa, Giardia lamblia
QQVLSLLTPRFFAGWLDN

SEQ ID NO: 3078080 - protein, 31 aa, Giardia lamblia
QQYQTFGSFFWRWFLERGIITQKPAHTIVSG

SEQ ID NO: 3078081 - protein, 24 aa, Giardia lamblia
QRAAETLMRYALLAIYQIVYLSCR

SEQ ID NO: 3078082 - protein, 24 aa, Giardia lamblia
QRAKCHVLAFFLFLGVMLSIIAAA

SEQ ID NO: 3078083 - protein, 19 aa, Giardia lamblia
QRCRCMKNTIMRRSLIFTN

SEQ ID NO: 3078084 - protein, 28 aa, Giardia lamblia
QRDLCMLVAPLCRFLYVTLSKGIYLTTS

SEQ ID NO: 3078085 - protein, 26 aa, Giardia lamblia
QRDQYSCAYHMFVLVFSLLSMLQDGY

SEQ ID NO: 3078086 - protein, 20 aa, Giardia lamblia
QRDYRLLGSAIYVDAKRQEV

SEQ ID NO: 3078087 - protein, 18 aa, Giardia lamblia
QREPPVYPLLYASHDVCC

SEQ ID NO: 3078088 - protein, 25 aa, Giardia lamblia
QRFCSSPDRSDRPTLRHLGLETVPP

SEQ ID NO: 3078089 - protein, 28 aa, Giardia lamblia
QRFLTIWMPAVFVCLLALPKMSYLESYR

SEQ ID NO: 3078090 - protein, 20 aa, Giardia lamblia
QRHKIHVERFFLPFLSIATC

SEQ ID NO: 3078091 - protein, 20 aa, Giardia lamblia
QRIAVLPTFINSIIGFLYDT

SEQ ID NO: 3078092 - protein, 17 aa, Giardia lamblia
QRIDKALSEISLNDFEA

SEQ ID NO: 3078093 - protein, 19 aa, Giardia lamblia
QRIFCRTRFSTCREKICSC

SEQ ID NO: 3078094 - protein, 23 aa, Giardia lamblia
QRISTLCAFICGKLITKLLDSVT

SEQ ID NO: 3078095 - protein, 23 aa, Giardia lamblia
QRITAVYGCGDYLAFCTVHEDTR

SEQ ID NO: 3078096 - protein, 23 aa, Giardia lamblia
QRKLLACRDGYYAIMKEKDPEFY

SEQ ID NO: 3078097 - protein, 22 aa, Giardia lamblia
QRKTLFNLCISLIVSDSREIRI

SEQ ID NO: 3078098 - protein, 19 aa, Giardia lamblia
QRKTSIQFLKKSRRKGMPS

SEQ ID NO: 3078099 - protein, 17 aa, Giardia lamblia
QRLCAKSVCDVQTNKNV

SEQ ID NO: 3078100 - protein, 34 aa, Giardia lamblia
QRLIDVPVCPTCQRPYMLAQLYFKLLQTAVESSR

SEQ ID NO: 3078101 - protein, 24 aa, Giardia lamblia
QRLISPAMMLVSMFVSQRMKKMQM

SEQ ID NO: 3078102 - protein, 23 aa, Giardia lamblia
QRLRTDFIQRTGLHSSRDIHNLL

SEQ ID NO: 3078103 - protein, 26 aa, Giardia lamblia
QRLVFVQACGLEFYRTVLNELVETVM

SEQ ID NO: 3078104 - protein, 17 aa, Giardia lamblia
QRMKGSQSRVFKQFTKK

SEQ ID NO: 3078105 - protein, 17 aa, Giardia lamblia
QRMSTAIYSVVLYGLEN

SEQ ID NO: 3078106 - protein, 18 aa, Giardia lamblia
QRPAAPTCMALKRLTIIP

SEQ ID NO: 3078107 - protein, 20 aa, Giardia lamblia
QRPIVPIPVFTGSLYGQNHT

SEQ ID NO: 3078108 - protein, 20 aa, Giardia lamblia
QRQLLCVAHALLRDTEVILL

SEQ ID NO: 3078109 - protein, 26 aa, Giardia lamblia
QRRNCFVVCFYWLLFIMSMYSFFKTI

SEQ ID NO: 3078110 - protein, 18 aa, Giardia lamblia
QRRNCLNHDTCDEMTFLL

SEQ ID NO: 3078111 - protein, 25 aa, Giardia lamblia
QRSAEPGSFFIPLPGPAISSQHLEM

SEQ ID NO: 3078112 - protein, 23 aa, Giardia lamblia
QRSERELVRLSTIQRPPEPTLAE

SEQ ID NO: 3078113 - protein, 22 aa, Giardia lamblia
QRSGSPFSALVFKRQTEAGDDP

SEQ ID NO: 3078114 - protein, 23 aa, Giardia lamblia
QRTILRMIHYLGIGEAIVNIYLG

SEQ ID NO: 3078115 - protein, 23 aa, Giardia lamblia
QRVGIARAVARGGSVLVLDEATS

SEQ ID NO: 3078116 - protein, 26 aa, Giardia lamblia
QRYLCFKAIAARVFEYDQLLNLIIHQ

SEQ ID NO: 3078117 - protein, 18 aa, Giardia lamblia
QRYLTFKNLSDMLIARAI

SEQ ID NO: 3078118 - protein, 30 aa, Giardia lamblia
QSAVFPWERLLLRLAGWQRGVPILKNVYSI

SEQ ID NO: 3078119 - protein, 19 aa, Giardia lamblia
QSFIYEIYETKSLPTPTAS

SEQ ID NO: 3078120 - protein, 18 aa, Giardia lamblia
QSFQECLFILRSVQTEVL

SEQ ID NO: 3078121 - protein, 28 aa, Giardia lamblia
QSGRLVGCAPCLFSHPDCLNRSVVRLSF

SEQ ID NO: 3078122 - protein, 26 aa, Giardia lamblia
QSHHWYSLRPLWNVTEDVVKIGSLAI

SEQ ID NO: 3078123 - protein, 19 aa, Giardia lamblia
QSIFYGARWMQYHPADVLH

SEQ ID NO: 3078124 - protein, 17 aa, Giardia lamblia
QSILSLLYHFSRHRTEA

SEQ ID NO: 3078125 - protein, 23 aa, Giardia lamblia
QSIMDGICMSLYLQNEFKTLAFL

SEQ ID NO: 3078126 - protein, 26 aa, Giardia lamblia
QSIPILRVGFLFTYLAPLVLVLAVTM

SEQ ID NO: 3078127 - protein, 20 aa, Giardia lamblia
QSIQCCPLHIGMDLCDSILG

SEQ ID NO: 3078128 - protein, 25 aa, Giardia lamblia
QSISKVCAFEGFLERNIPEHVIRFY

SEQ ID NO: 3078129 - protein, 23 aa, Giardia lamblia
QSISLCILAILSLLEHATLFVSR

SEQ ID NO: 3078130 - protein, 22 aa, Giardia lamblia
QSIYGRYALQRVGVLNSYVDLI

SEQ ID NO: 3078131 - protein, 26 aa, Giardia lamblia
QSKRMSYPNTFTWREEKHHDFQVLSP

SEQ ID NO: 3078132 - protein, 24 aa, Giardia lamblia
QSLAAKSLCFWVIAIEKYSYTIRE

SEQ ID NO: 3078133 - protein, 20 aa, Giardia lamblia
QSLACLGMYLVFALVVSLVI

SEQ ID NO: 3078134 - protein, 25 aa, Giardia lamblia
QSLHKADLPSFVFKHFAQCSQPYPA

SEQ ID NO: 3078135 - protein, 25 aa, Giardia lamblia
QSLLPRYRAVPIVAALDMSAFYIPQ

SEQ ID NO: 3078136 - protein, 24 aa, Giardia lamblia
QSLLSRMPEDWSLARVMAKSFKYP

SEQ ID NO: 3078137 - protein, 27 aa, Giardia lamblia
QSLMLLCSRYAYELLHIPIHRQNAMNA

SEQ ID NO: 3078138 - protein, 25 aa, Giardia lamblia
QSLSLKCLLFPGFYLPHELSLLLTA

SEQ ID NO: 3078139 - protein, 21 aa, Giardia lamblia
QSLWNQCYARTGATRNEISTV

SEQ ID NO: 3078140 - protein, 20 aa, Giardia lamblia
QSNDEIWLITELCEGGSLES

SEQ ID NO: 3078141 - protein, 18 aa, Giardia lamblia
QSNILICTPMAASARAPC

SEQ ID NO: 3078142 - protein, 26 aa, Giardia lamblia
QSQTGRFVWRDSELIRALERGYWVEL

SEQ ID NO: 3078143 - protein, 20 aa, Giardia lamblia
QSSKLSCLTSIFNDLINYLE

SEQ ID NO: 3078144 - protein, 19 aa, Giardia lamblia
QSTCLYNDIFSSFYSSFAI

SEQ ID NO: 3078145 - protein, 32 aa, Giardia lamblia
QSTLHCFCTLPLKIRRVIKDCLAVTLNHLYQC

SEQ ID NO: 3078146 - protein, 24 aa, Giardia lamblia
QSTLKLLLILAMGIAGHEVLSHVS

SEQ ID NO: 3078147 - protein, 18 aa, Giardia lamblia
QSWLRFLHTVHLSDPTYS

SEQ ID NO: 3078148 - protein, 21 aa, Giardia lamblia
QSWTCIYLRHKSIYTLDPIRE

SEQ ID NO: 3078149 - protein, 23 aa, Giardia lamblia
QSYPQRFLSVLLKRQSDQQQQEQ

SEQ ID NO: 3078150 - protein, 27 aa, Giardia lamblia
QSYTLFLRYLLRPEAPKTLSDSFKRTF

SEQ ID NO: 3078151 - protein, 19 aa, Giardia lamblia
QSYVKWIQQECEFFTRSSG

SEQ ID NO: 3078152 - protein, 18 aa, Giardia lamblia
QTAIACLESMLDMLTTPP

SEQ ID NO: 3078153 - protein, 23 aa, Giardia lamblia
QTANLPLLPGFNGQVIPPAPCTG

SEQ ID NO: 3078154 - protein, 23 aa, Giardia lamblia
QTCSVCLSGYYLSTNKCFRCTAG

SEQ ID NO: 3078155 - protein, 27 aa, Giardia lamblia
QTDDVVLKRCMEAFFTSEYASLCIQTV

SEQ ID NO: 3078156 - protein, 20 aa, Giardia lamblia
QTDGSLFCQCQRGWSGSACD

SEQ ID NO: 3078157 - protein, 17 aa, Giardia lamblia
QTDIARILIPYEAGMRS

SEQ ID NO: 3078158 - protein, 26 aa, Giardia lamblia
QTDRCLYEIIVPPSLGQVRVSRISDP

SEQ ID NO: 3078159 - protein, 17 aa, Giardia lamblia
QTDYCAARNLALILTSL

SEQ ID NO: 3078160 - protein, 17 aa, Giardia lamblia
QTFLHNCLNNFADPAAL

SEQ ID NO: 3078161 - protein, 25 aa, Giardia lamblia
QTGIKRLWLNESIICGDVRSDEEPL

SEQ ID NO: 3078162 - protein, 17 aa, Giardia lamblia
QTHIQRRILKIGYHLTL

SEQ ID NO: 3078163 - protein, 22 aa, Giardia lamblia
QTIFTGCRFATIALVLLFTIVG

SEQ ID NO: 3078164 - protein, 19 aa, Giardia lamblia
QTIYQLRPSNTFHEGQMKL

SEQ ID NO: 3078165 - protein, 25 aa, Giardia lamblia
QTKYWSWATLIALIFTVTVFVILLL

SEQ ID NO: 3078166 - protein, 24 aa, Giardia lamblia
QTLLCGLPSLPPCPESRDILRALF

SEQ ID NO: 3078167 - protein, 22 aa, Giardia lamblia
QTLRKCSRCGSHRTRYEPFFDL

SEQ ID NO: 3078168 - protein, 20 aa, Giardia lamblia
QTLSRVKAYYVKRIKSTPTQ

SEQ ID NO: 3078169 - protein, 20 aa, Giardia lamblia
QTMWLYRQLQGFDEDGDEDN

SEQ ID NO: 3078170 - protein, 26 aa, Giardia lamblia
QTNYRKRPTLSYILNLPLLMGARRSF

SEQ ID NO: 3078171 - protein, 26 aa, Giardia lamblia
QTPPKICAMLEPTGSCSIVDDSGIGQ

SEQ ID NO: 3078172 - protein, 21 aa, Giardia lamblia
QTPRRHPIIIFDSPNDLLDFL

SEQ ID NO: 3078173 - protein, 26 aa, Giardia lamblia
QTRDKWTALMLCAKYNRYEVATELVP

SEQ ID NO: 3078174 - protein, 26 aa, Giardia lamblia
QTSAKDFIALYSFGLVVAGMGVKTVK

SEQ ID NO: 3078175 - protein, 22 aa, Giardia lamblia
QTSRYMLAYIFFQYFLVQVCGE

SEQ ID NO: 3078176 - protein, 26 aa, Giardia lamblia
QTYLRRWEDYCFSKDIARLMAASSLA

SEQ ID NO: 3078177 - protein, 25 aa, Giardia lamblia
QVFEPLKMWLSPYIALPIGKDYGFI

SEQ ID NO: 3078178 - protein, 25 aa, Giardia lamblia
QVGDLWRSLICGNYIILRQEYMYKL

SEQ ID NO: 3078179 - protein, 26 aa, Giardia lamblia
QVGILYGILIDGCIYLRKNLCGGFVD

SEQ ID NO: 3078180 - protein, 20 aa, Giardia lamblia
QVHIRFILRALLFLVAGLCG

SEQ ID NO: 3078181 - protein, 18 aa, Giardia lamblia
QVILPILCLPFIGTTIVL

SEQ ID NO: 3078182 - protein, 20 aa, Giardia lamblia
QVISVVRQCVTWFFINYPQE

SEQ ID NO: 3078183 - protein, 17 aa, Giardia lamblia
QVLALLYCIVRRTCRFI

SEQ ID NO: 3078184 - protein, 22 aa, Giardia lamblia
QVLCAIDSPGIFWDVIQDKIKQ

SEQ ID NO: 3078185 - protein, 24 aa, Giardia lamblia
QVLTKHCNRGICTILAHIHVQFET

SEQ ID NO: 3078186 - protein, 18 aa, Giardia lamblia
QVPPRDAILSSIPIEASD

SEQ ID NO: 3078187 - protein, 19 aa, Giardia lamblia
QVQARLGVDPEKGLTQEQR

SEQ ID NO: 3078188 - protein, 17 aa, Giardia lamblia
QVQYSITVVTRIFYLLD

SEQ ID NO: 3078189 - protein, 26 aa, Giardia lamblia
QVRKESRLVAVLMFPVYRFLFSFVRV

SEQ ID NO: 3078190 - protein, 19 aa, Giardia lamblia
QVTLLAIQLLWTMWIEAGL

SEQ ID NO: 3078191 - protein, 20 aa, Giardia lamblia
QVVGMEGFWGLLITVFIVSP

SEQ ID NO: 3078192 - protein, 19 aa, Giardia lamblia
QVVVSCFFISMAVTCLCVT

SEQ ID NO: 3078193 - protein, 20 aa, Giardia lamblia
QVYRYTRFLCDYEIKMSSAD

SEQ ID NO: 3078194 - protein, 22 aa, Giardia lamblia
QVYSVMPHRILTYYNCYLLSEI

SEQ ID NO: 3078195 - protein, 17 aa, Giardia lamblia
QWAKTVLAMKELFETYE

SEQ ID NO: 3078196 - protein, 23 aa, Giardia lamblia
QWEYKHILLTLLHRQCTITKTSL

SEQ ID NO: 3078197 - protein, 21 aa, Giardia lamblia
QWHGARKYLGPTLKSTSGDII

SEQ ID NO: 3078198 - protein, 24 aa, Giardia lamblia
QYALRPLALIGMIFIGALAFFCRL

SEQ ID NO: 3078199 - protein, 20 aa, Giardia lamblia
QYASCDSVYPLLPYDEAIFS

SEQ ID NO: 3078200 - protein, 21 aa, Giardia lamblia
QYASNCLEEFISMIQEHPMNV

SEQ ID NO: 3078201 - protein, 17 aa, Giardia lamblia
QYLDIPYTYEEGRRLLA

SEQ ID NO: 3078202 - protein, 24 aa, Giardia lamblia
QYLFYRPSSFFSEARKGSASLTDA

SEQ ID NO: 3078203 - protein, 18 aa, Giardia lamblia
QYLGPKIKARFMGQIEAK

SEQ ID NO: 3078204 - protein, 22 aa, Giardia lamblia
QYLHKQCRYGLYGLPYELVQSV

SEQ ID NO: 3078205 - protein, 18 aa, Giardia lamblia
QYNTLKGYSLVSPASALA

SEQ ID NO: 3078206 - protein, 21 aa, Giardia lamblia
QYRCSCSDGFFLITPTQCVSN

SEQ ID NO: 3078207 - protein, 19 aa, Giardia lamblia
QYRHGRATALVYLSPTLAI

SEQ ID NO: 3078208 - protein, 24 aa, Giardia lamblia
QYSNMLLRVSMWTELTQFLREQDF

SEQ ID NO: 3078209 - protein, 26 aa, Giardia lamblia
QYVNIRLAGALMKILTLTVRSFDLST

SEQ ID NO: 3078210 - protein, 18 aa, Giardia lamblia
QYVPPVQLMQKWAPSRSA

SEQ ID NO: 3078211 - protein, 21 aa, Giardia lamblia
QYYGLWSFTLSRQFEVTTDTL

SEQ ID NO: 3078212 - protein, 28 aa, Giardia lamblia
QYYPYLATACMKEWIDVEVLLESPRKST

SEQ ID NO: 3078213 - protein, 26 aa, Giardia lamblia
RAAAGLDGCVPWSCYPMLNGSICGPF

SEQ ID NO: 3078214 - protein, 18 aa, Giardia lamblia
RAASLCRIAFILIDSFLS

SEQ ID NO: 3078215 - protein, 27 aa, Giardia lamblia
RACDLPTRLPVSFSAAFISVKANNSQT

SEQ ID NO: 3078216 - protein, 20 aa, Giardia lamblia
RACRKKERAASFLPCPSESP

SEQ ID NO: 3078217 - protein, 18 aa, Giardia lamblia
RADACAFAAHRAASSANP

SEQ ID NO: 3078218 - protein, 33 aa, Giardia lamblia
RADELYQHLRLFYYFRCNWTFGKQSLEISDTMA

SEQ ID NO: 3078219 - protein, 19 aa, Giardia lamblia
RAEIPKRTGKSLSETHFLQ

SEQ ID NO: 3078220 - protein, 25 aa, Giardia lamblia
RAEIRMHLEKISLLQADLLEEEKKF

SEQ ID NO: 3078221 - protein, 24 aa, Giardia lamblia
RAENRFIPVETMFFAANQIAAGLA

SEQ ID NO: 3078222 - protein, 17 aa, Giardia lamblia
RAGGVTFSMNDAVFSLS

SEQ ID NO: 3078223 - protein, 25 aa, Giardia lamblia
RAGKFTEWLDILPFYNDISDLLDLV

SEQ ID NO: 3078224 - protein, 32 aa, Giardia lamblia
RAGLKGYCVPKCFRWLFDIDWSTDQELMTPSM

SEQ ID NO: 3078225 - protein, 18 aa, Giardia lamblia
RAGPIVTCSGCETKRLSP

SEQ ID NO: 3078226 - protein, 19 aa, Giardia lamblia
RAGTQILIGSTCLDAERIP

SEQ ID NO: 3078227 - protein, 18 aa, Giardia lamblia
RAGVCAMHGFVIGTCLCL

SEQ ID NO: 3078228 - protein, 20 aa, Giardia lamblia
RAHLLYMLFTIVLTDIQVIF

SEQ ID NO: 3078229 - protein, 20 aa, Giardia lamblia
RAHNLFKSNFDTIFEIIPAV

SEQ ID NO: 3078230 - protein, 18 aa, Giardia lamblia
RAILCRHGAFSAWLKFSP

SEQ ID NO: 3078231 - protein, 21 aa, Giardia lamblia
RAIMVECDWTRSSFDGADAIT

SEQ ID NO: 3078232 - protein, 18 aa, Giardia lamblia
RAIPVFLLYENALRAKDS

SEQ ID NO: 3078233 - protein, 19 aa, Giardia lamblia
RAITPRLFLLCFLTSPDAI

SEQ ID NO: 3078234 - protein, 26 aa, Giardia lamblia
RAIVGGGAFMLLSFVSSVGILSLISS

SEQ ID NO: 3078235 - protein, 17 aa, Giardia lamblia
RAKCATKGFNERPVLIR

SEQ ID NO: 3078236 - protein, 18 aa, Giardia lamblia
RAKCQAFVVSLLTTTEMQ

SEQ ID NO: 3078237 - protein, 18 aa, Giardia lamblia
RAKLSSMVEDCVYSLVII

SEQ ID NO: 3078238 - protein, 18 aa, Giardia lamblia
RALAQMQSLFLLFTGKAF

SEQ ID NO: 3078239 - protein, 24 aa, Giardia lamblia
RALFKKMLRSIFRSPMSFFDTTPT

SEQ ID NO: 3078240 - protein, 25 aa, Giardia lamblia
RALGKRRPKELIKHAPEHLPLGSIS

SEQ ID NO: 3078241 - protein, 17 aa, Giardia lamblia
RALLCMEDGRGLCRRII

SEQ ID NO: 3078242 - protein, 27 aa, Giardia lamblia
RALMVYAACEPVLWRPAIEKGSAGSRV

SEQ ID NO: 3078243 - protein, 18 aa, Giardia lamblia
RALPLFIRLSEHLNQHTL

SEQ ID NO: 3078244 - protein, 19 aa, Giardia lamblia
RALSWVSFILGVVLFVSAL

SEQ ID NO: 3078245 - protein, 27 aa, Giardia lamblia
RANKKRVPEDIIWKVLVGVLEALAYLE

SEQ ID NO: 3078246 - protein, 25 aa, Giardia lamblia
RANMPAFPYFGGVGALGYNMLQNPL

SEQ ID NO: 3078247 - protein, 18 aa, Giardia lamblia
RANPSASISAEFNSYQSV

SEQ ID NO: 3078248 - protein, 19 aa, Giardia lamblia
RANSFLKSPTLAPLRTNSE

SEQ ID NO: 3078249 - protein, 18 aa, Giardia lamblia
RANTEVKGSFIYFGLLAA

SEQ ID NO: 3078250 - protein, 19 aa, Giardia lamblia
RANYIPIYITAGVAGACIV

SEQ ID NO: 3078251 - protein, 21 aa, Giardia lamblia
RAPFYTTLLVEWLRHVASVHI

SEQ ID NO: 3078252 - protein, 27 aa, Giardia lamblia
RAPHKMSRLSLHTHQRHHYGIRPIVEI

SEQ ID NO: 3078253 - protein, 20 aa, Giardia lamblia
RAPQEFLKKAVRYFSAPVTR

SEQ ID NO: 3078254 - protein, 19 aa, Giardia lamblia
RAQKDICAEVEEILNYNVR

SEQ ID NO: 3078255 - protein, 23 aa, Giardia lamblia
RAQNLARLVCYRVLRQNPEERAT

SEQ ID NO: 3078256 - protein, 22 aa, Giardia lamblia
RAQTMFVTWLFVWSTGCRIIEK

SEQ ID NO: 3078257 - protein, 20 aa, Giardia lamblia
RARGLLFLCDNLNPQIVRAI

SEQ ID NO: 3078258 - protein, 19 aa, Giardia lamblia
RARPMALIAVNIVTQIGTG

SEQ ID NO: 3078259 - protein, 25 aa, Giardia lamblia
RARSRADRTPLEFAAELGSIRSIEH

SEQ ID NO: 3078260 - protein, 19 aa, Giardia lamblia
RARTLLSVYELLWKLSERF

SEQ ID NO: 3078261 - protein, 23 aa, Giardia lamblia
RARYLKKELHPFAMDYRTILELC

SEQ ID NO: 3078262 - protein, 24 aa, Giardia lamblia
RASEFPLLRPYYTTSHSIVQNILN

SEQ ID NO: 3078263 - protein, 24 aa, Giardia lamblia
RASEKDGPCIYGLIVKIAKNRRKP

SEQ ID NO: 3078264 - protein, 26 aa, Giardia lamblia
RASELNLKLSKLVPVPHLGSFKAHDS

SEQ ID NO: 3078265 - protein, 25 aa, Giardia lamblia
RASLSKMLFGYSMPKMKPSKKSRTQ

SEQ ID NO: 3078266 - protein, 23 aa, Giardia lamblia
RASRPESWIWSSPNLVKSIFRIY

SEQ ID NO: 3078267 - protein, 19 aa, Giardia lamblia
RATDLSRLAPPVYNTSPQE

SEQ ID NO: 3078268 - protein, 18 aa, Giardia lamblia
RATFPADLTRAFIDANGH

SEQ ID NO: 3078269 - protein, 19 aa, Giardia lamblia
RATLTYQWRVLSEQGTHSY

SEQ ID NO: 3078270 - protein, 20 aa, Giardia lamblia
RATVMPAFKLLEAVHTLLLF

SEQ ID NO: 3078271 - protein, 21 aa, Giardia lamblia
RAYIQALCEELGTPTSFDDDW

SEQ ID NO: 3078272 - protein, 25 aa, Giardia lamblia
RAYLGGWDFFSYAAIPITELLQDVK

SEQ ID NO: 3078273 - protein, 21 aa, Giardia lamblia
RCAAMLRQAIRLRKTANHYVP

SEQ ID NO: 3078274 - protein, 19 aa, Giardia lamblia
RCACCNDFILMRFAISNDF

SEQ ID NO: 3078275 - protein, 18 aa, Giardia lamblia
RCDCRGLATGDLCDTCTP

SEQ ID NO: 3078276 - protein, 21 aa, Giardia lamblia
RCDKIHFGWRTTQGIQPLSFY

SEQ ID NO: 3078277 - protein, 21 aa, Giardia lamblia
RCGSTLIGIMAYVAPEVLLHN

SEQ ID NO: 3078278 - protein, 21 aa, Giardia lamblia
RCILCSDTVGFGGYRGASDCL

SEQ ID NO: 3078279 - protein, 21 aa, Giardia lamblia
RCIYRKRIRQAEGYIIKMANY

SEQ ID NO: 3078280 - protein, 17 aa, Giardia lamblia
RCLFKREECSTCNNGYY

SEQ ID NO: 3078281 - protein, 26 aa, Giardia lamblia
RCLKIKEIKGLLLFGNHEQEFPLLDF

SEQ ID NO: 3078282 - protein, 19 aa, Giardia lamblia
RCLLCNDAGAGGGWTGVDG

SEQ ID NO: 3078283 - protein, 20 aa, Giardia lamblia
RCLLCNDAGAGGGWTGVDGC

SEQ ID NO: 3078284 - protein, 22 aa, Giardia lamblia
RCLYYTYHWLSPIIKLIKRQGA

SEQ ID NO: 3078285 - protein, 23 aa, Giardia lamblia
RCNSMCRECFGPNTCTECAAANA

SEQ ID NO: 3078286 - protein, 17 aa, Giardia lamblia
RCPTAGAIGAVLFPVNK

SEQ ID NO: 3078287 - protein, 19 aa, Giardia lamblia
RCPVSAVLMELYAAKIVIF

SEQ ID NO: 3078288 - protein, 20 aa, Giardia lamblia
RCSDAHCKRCAGPGVCTRCQ

SEQ ID NO: 3078289 - protein, 25 aa, Giardia lamblia
RCSIHKRIAVLMLKGNGTYAQLFDI

SEQ ID NO: 3078290 - protein, 22 aa, Giardia lamblia
RCSLLCYLVFVLLWQGSTQYQG

SEQ ID NO: 3078291 - protein, 20 aa, Giardia lamblia
RCSQGFFPLDGRCVSTSGQQ

SEQ ID NO: 3078292 - protein, 18 aa, Giardia lamblia
RCSTGAPPENGKCPAATP

SEQ ID NO: 3078293 - protein, 19 aa, Giardia lamblia
RCTFSGSIVEYCEHSLSVH

SEQ ID NO: 3078294 - protein, 28 aa, Giardia lamblia
RCVADITIGLILLFKRAMQLARIEIADR

SEQ ID NO: 3078295 - protein, 19 aa, Giardia lamblia
RCVPCAIDNCETCDVSQLG

SEQ ID NO: 3078296 - protein, 18 aa, Giardia lamblia
RCVRMIRLYATDSGSYMK

SEQ ID NO: 3078297 - protein, 24 aa, Giardia lamblia
RCYCLEAGHLSSVWFGVDLIAITR

SEQ ID NO: 3078298 - protein, 19 aa, Giardia lamblia
RDCHAVIVSILRRLEYNIR

SEQ ID NO: 3078299 - protein, 18 aa, Giardia lamblia
RDCLTVVVLTAGMSEKDA

SEQ ID NO: 3078300 - protein, 19 aa, Giardia lamblia
RDCPAEGFWTSGRECIPCV

SEQ ID NO: 3078301 - protein, 18 aa, Giardia lamblia
RDDLKTLFQKAGVENKNI

SEQ ID NO: 3078302 - protein, 20 aa, Giardia lamblia
RDDYDYLSFKPIKSRRWERR

SEQ ID NO: 3078303 - protein, 25 aa, Giardia lamblia
RDEEKACSCVEPLVDQFSLIITKTF

SEQ ID NO: 3078304 - protein, 19 aa, Giardia lamblia
RDFISYALVLQKYYQSSIS

SEQ ID NO: 3078305 - protein, 23 aa, Giardia lamblia
RDFLLCIFSAMIYKLASLCTPIT

SEQ ID NO: 3078306 - protein, 18 aa, Giardia lamblia
RDGAGYKCDCRGLATGDL

SEQ ID NO: 3078307 - protein, 28 aa, Giardia lamblia
RDGVGELCFKGKMAVAGNYSGSLLFRKI

SEQ ID NO: 3078308 - protein, 25 aa, Giardia lamblia
RDHHCPWIGSCVGFHNFGYFIRFLM

SEQ ID NO: 3078309 - protein, 23 aa, Giardia lamblia
RDIHQRYAAALALPETYEGAHLT

SEQ ID NO: 3078310 - protein, 25 aa, Giardia lamblia
RDILNVIRLCPRYWGTRNEAGLTAL

SEQ ID NO: 3078311 - protein, 17 aa, Giardia lamblia
RDIPPYPLYTALMIAVT

SEQ ID NO: 3078312 - protein, 18 aa, Giardia lamblia
RDIVMCYMESDRYDHQAT

SEQ ID NO: 3078313 - protein, 23 aa, Giardia lamblia
RDKHLPLGTIFFSCMSILILLLD

SEQ ID NO: 3078314 - protein, 17 aa, Giardia lamblia
RDKNGWTALMHAAHSNH

SEQ ID NO: 3078315 - protein, 24 aa, Giardia lamblia
RDKPCKKFSGGMQRRLCIAIATCG

SEQ ID NO: 3078316 - protein, 20 aa, Giardia lamblia
RDKPLPSIVFESLLVLTYFV

SEQ ID NO: 3078317 - protein, 21 aa, Giardia lamblia
RDMEKRLKITLEENKNLYKEL

SEQ ID NO: 3078318 - protein, 24 aa, Giardia lamblia
RDMLPCAVPDFLSMDRKCARALHS

SEQ ID NO: 3078319 - protein, 17 aa, Giardia lamblia
RDNCILQNLKLYLTHVY

SEQ ID NO: 3078320 - protein, 33 aa, Giardia lamblia
RDNPEIVGLGLLFKWLKLLVTYHKRFSTSVGDP

SEQ ID NO: 3078321 - protein, 19 aa, Giardia lamblia
RDNTTLWPGENLDPVGILV

SEQ ID NO: 3078322 - protein, 19 aa, Giardia lamblia
RDPAILCINSLRVEQLLSD

SEQ ID NO: 3078323 - protein, 18 aa, Giardia lamblia
RDQEWDQAIEILKDQLAQ

SEQ ID NO: 3078324 - protein, 25 aa, Giardia lamblia
RDQRASEFITAFTLINTYLRDIYKT

SEQ ID NO: 3078325 - protein, 17 aa, Giardia lamblia
RDRELSHLINIKMNSAY

SEQ ID NO: 3078326 - protein, 23 aa, Giardia lamblia
RDRLCTQGKHYGHYLLAKIFGFR

SEQ ID NO: 3078327 - protein, 24 aa, Giardia lamblia
RDRLSHLLPLILQMLFAFYNMYSS

SEQ ID NO: 3078328 - protein, 18 aa, Giardia lamblia
RDRNGFTAMEYCAYNNLL

SEQ ID NO: 3078329 - protein, 22 aa, Giardia lamblia
RDSHDLCALDYAVLAESLVCVR

SEQ ID NO: 3078330 - protein, 26 aa, Giardia lamblia
RDSIFRYVCFLTYFLPSTTSLPLMGF

SEQ ID NO: 3078331 - protein, 24 aa, Giardia lamblia
RDSLAADIAFEFQCQALEENRLLL

SEQ ID NO: 3078332 - protein, 27 aa, Giardia lamblia
RDSLLGFCLYVPFKQISSSFAFDDERN

SEQ ID NO: 3078333 - protein, 20 aa, Giardia lamblia
RDSRGRTALMHASYSNNIEA

SEQ ID NO: 3078334 - protein, 25 aa, Giardia lamblia
RDSRLPLKFLATFEPRLKYASLLTK

SEQ ID NO: 3078335 - protein, 25 aa, Giardia lamblia
RDSYSIQCGELLKSYMSRGMQPSPY

SEQ ID NO: 3078336 - protein, 20 aa, Giardia lamblia
RDVAEVLAMMGLMAEEVHAN

SEQ ID NO: 3078337 - protein, 26 aa, Giardia lamblia
RDVCFSYKTGCDILHGLTLSVHPGQK

SEQ ID NO: 3078338 - protein, 22 aa, Giardia lamblia
RDVKRLSTAIINVQRKLYNITA

SEQ ID NO: 3078339 - protein, 23 aa, Giardia lamblia
RDYCAKCSNTALSNYCMECQDDY

SEQ ID NO: 3078340 - protein, 18 aa, Giardia lamblia
RDYFDFYSSFVYEGNGPA

SEQ ID NO: 3078341 - protein, 24 aa, Giardia lamblia
RDYIPAYNGSYSWAHNSTAPAVYN

SEQ ID NO: 3078342 - protein, 23 aa, Giardia lamblia
REAFWRQYSVFIVIGAIVVLFIL

SEQ ID NO: 3078343 - protein, 17 aa, Giardia lamblia
REALECKINSAAIRNPY

SEQ ID NO: 3078344 - protein, 19 aa, Giardia lamblia
REAVSLFAQAFMNHSIISN

SEQ ID NO: 3078345 - protein, 35 aa, Giardia lamblia
REDAESLPHFLVYWCKSRYGLRSLVSSLLYCIIAN

SEQ ID NO: 3078346 - protein, 17 aa, Giardia lamblia
REECSTCNNGYYLSTDS

SEQ ID NO: 3078347 - protein, 27 aa, Giardia lamblia
REEHICIQFSPSCIIYANMRLSHRVDT

SEQ ID NO: 3078348 - protein, 20 aa, Giardia lamblia
REEKSRLSMEVEELNLKLQR

SEQ ID NO: 3078349 - protein, 17 aa, Giardia lamblia
REFFAIYNISSLEHVWI

SEQ ID NO: 3078350 - protein, 20 aa, Giardia lamblia
REGKIPLQLYHVMDSSSSFM

SEQ ID NO: 3078351 - protein, 19 aa, Giardia lamblia
REHFELRTLATRDVALDVK

SEQ ID NO: 3078352 - protein, 17 aa, Giardia lamblia
REHRSRTAFPSLLDSQM

SEQ ID NO: 3078353 - protein, 19 aa, Giardia lamblia
REICAKFNSDFFLIKLADV

SEQ ID NO: 3078354 - protein, 17 aa, Giardia lamblia
REIDENLILNRYIGSSP

SEQ ID NO: 3078355 - protein, 18 aa, Giardia lamblia
REIEDFVCLISLHLKNDK

SEQ ID NO: 3078356 - protein, 21 aa, Giardia lamblia
REILFRAAYINAFTLLSGAIH

SEQ ID NO: 3078357 - protein, 17 aa, Giardia lamblia
REIRMFMACTLWNPSQV

SEQ ID NO: 3078358 - protein, 21 aa, Giardia lamblia
REISTWATCRLMVIISYTKVF

SEQ ID NO: 3078359 - protein, 19 aa, Giardia lamblia
REKAIRVSPFYNIHDERCQ

SEQ ID NO: 3078360 - protein, 19 aa, Giardia lamblia
RELEDSGALLAYYPQANTL

SEQ ID NO: 3078361 - protein, 24 aa, Giardia lamblia
RELFLRARIKRLATSVMMVSTLCV

SEQ ID NO: 3078362 - protein, 24 aa, Giardia lamblia
RELHPDSPLLMYFLWIPLQILITY

SEQ ID NO: 3078363 - protein, 19 aa, Giardia lamblia
RELISAPGYAAFQSTVCQL

SEQ ID NO: 3078364 - protein, 19 aa, Giardia lamblia
RELLEMFRLSDAHRLVADY

SEQ ID NO: 3078365 - protein, 19 aa, Giardia lamblia
RELLISRYLVILYGVDTLT

SEQ ID NO: 3078366 - protein, 20 aa, Giardia lamblia
RELSDPFLFGKDVLSASLAE

SEQ ID NO: 3078367 - protein, 24 aa, Giardia lamblia
RELSLKAQCIIPSIYNFSQVNCYL

SEQ ID NO: 3078368 - protein, 24 aa, Giardia lamblia
RELTKRLSAMGVSLILTGRDATVL

SEQ ID NO: 3078369 - protein, 20 aa, Giardia lamblia
RELTNMIILAIKLSLGLVHC

SEQ ID NO: 3078370 - protein, 18 aa, Giardia lamblia
RELVKYRLKCVRDGCLFS

SEQ ID NO: 3078371 - protein, 23 aa, Giardia lamblia
RENIELFATLLHRGSISGLENVQ

SEQ ID NO: 3078372 - protein, 17 aa, Giardia lamblia
REPGIDIPQAFLAQQET

SEQ ID NO: 3078373 - protein, 23 aa, Giardia lamblia
REPLLEYNLGFAFSSDSADFHVA

SEQ ID NO: 3078374 - protein, 19 aa, Giardia lamblia
REPPHAFSVLDNDSTVLES

SEQ ID NO: 3078375 - protein, 18 aa, Giardia lamblia
RERLSIDMSYSLSSSVSL

SEQ ID NO: 3078376 - protein, 20 aa, Giardia lamblia
RESILPWLNTVCNYIEQGLT

SEQ ID NO: 3078377 - protein, 24 aa, Giardia lamblia
RESKKSFVSWYFIGILKSVLSFFI

SEQ ID NO: 3078378 - protein, 21 aa, Giardia lamblia
RETQELGWWDNFWTQIPDLRD

SEQ ID NO: 3078379 - protein, 18 aa, Giardia lamblia
RETSECLLENSIHILHNK

SEQ ID NO: 3078380 - protein, 20 aa, Giardia lamblia
REVDSGLLIEYALPPHATIQ

SEQ ID NO: 3078381 - protein, 23 aa, Giardia lamblia
REVLILRLVLRMMSFSSSDRSID

SEQ ID NO: 3078382 - protein, 25 aa, Giardia lamblia
REVVDECFHCLDLLGTNNYMTSSDS

SEQ ID NO: 3078383 - protein, 17 aa, Giardia lamblia
REVVVAPLALVRVNSYA

SEQ ID NO: 3078384 - protein, 22 aa, Giardia lamblia
REWLAYLPGYMDTVLSYHTNPT

SEQ ID NO: 3078385 - protein, 18 aa, Giardia lamblia
REWLRGALRGGFKEIFAE

SEQ ID NO: 3078386 - protein, 20 aa, Giardia lamblia
REYFQLWDRILGYNALELLS

SEQ ID NO: 3078387 - protein, 23 aa, Giardia lamblia
REYHCSVCAQGFYLTLDTTSSPI

SEQ ID NO: 3078388 - protein, 19 aa, Giardia lamblia
REYQRYCAMTSSVHSLTTW

SEQ ID NO: 3078389 - protein, 33 aa, Giardia lamblia
RFADKRTRLYSVFRYDLIVLFFKLQRLCYDSLK

SEQ ID NO: 3078390 - protein, 18 aa, Giardia lamblia
RFALESALFTAGGMLAGF

SEQ ID NO: 3078391 - protein, 20 aa, Giardia lamblia
RFANSICRNLSLPFGIDSTQ

SEQ ID NO: 3078392 - protein, 21 aa, Giardia lamblia
RFATIMFCDIKGFTSLSDKMP

SEQ ID NO: 3078393 - protein, 23 aa, Giardia lamblia
RFDEIKLGMSALRQHTSEKLATI

SEQ ID NO: 3078394 - protein, 24 aa, Giardia lamblia
RFDHHCFWLGTDVGFRNHGYFYIM

SEQ ID NO: 3078395 - protein, 23 aa, Giardia lamblia
RFDHLRFYSRLSLKHAEGARLFV

SEQ ID NO: 3078396 - protein, 22 aa, Giardia lamblia
RFDSRQGTRCYLSIDSAGMLTD

SEQ ID NO: 3078397 - protein, 22 aa, Giardia lamblia
RFFAGLSQVGAWICFDEFNRID

SEQ ID NO: 3078398 - protein, 17 aa, Giardia lamblia
RFFYATVASLAFTSMLA

SEQ ID NO: 3078399 - protein, 18 aa, Giardia lamblia
RFIQLLVCQMQRLSTLDR

SEQ ID NO: 3078400 - protein, 23 aa, Giardia lamblia
RFLFGDLDFDFYLTYLDIQRALG

SEQ ID NO: 3078401 - protein, 25 aa, Giardia lamblia
RFLRFHCFLPLFSLINSLTQFNMST

SEQ ID NO: 3078402 - protein, 26 aa, Giardia lamblia
RFLYRRRPNHWAYYFNHCKKHTYHIA

SEQ ID NO: 3078403 - protein, 31 aa, Giardia lamblia
RFMNLLVCMYEIPFAAHLRAKNSLLESLVPL

SEQ ID NO: 3078404 - protein, 20 aa, Giardia lamblia
RFPLYGLAFSPYFPLLACAS

SEQ ID NO: 3078405 - protein, 18 aa, Giardia lamblia
RFRLPRLNAQVNFAAQNL

SEQ ID NO: 3078406 - protein, 18 aa, Giardia lamblia
RFSCLMRPECLIIDQEGQ

SEQ ID NO: 3078407 - protein, 18 aa, Giardia lamblia
RFSPSYFVSFFNASADNL

SEQ ID NO: 3078408 - protein, 18 aa, Giardia lamblia
RFSSMFINETQLVQHLFL

SEQ ID NO: 3078409 - protein, 20 aa, Giardia lamblia
RFTDYEGYKLLGGMMQTFVM

SEQ ID NO: 3078410 - protein, 18 aa, Giardia lamblia
RFTKRIDGSTALMAAASN

SEQ ID NO: 3078411 - protein, 19 aa, Giardia lamblia
RFTNIPLFPDIYMTEQLIP

SEQ ID NO: 3078412 - protein, 17 aa, Giardia lamblia
RFTSAIIVVTGRADPYV

SEQ ID NO: 3078413 - protein, 24 aa, Giardia lamblia
RFVAEIFEPFLLGARNLLMSRTVL

SEQ ID NO: 3078414 - protein, 20 aa, Giardia lamblia
RFVALSSFNEKVCFFELSIA

SEQ ID NO: 3078415 - protein, 26 aa, Giardia lamblia
RFYLRRWCTAVLWLLTGGILGIGWLV

SEQ ID NO: 3078416 - protein, 26 aa, Giardia lamblia
RFYQKCLVTALSAWMLVVCSLTKLLA

SEQ ID NO: 3078417 - protein, 21 aa, Giardia lamblia
RFYTQTFKVFGYINLHHELNL

SEQ ID NO: 3078418 - protein, 18 aa, Giardia lamblia
RGADPSWFSACSDNKTDV

SEQ ID NO: 3078419 - protein, 24 aa, Giardia lamblia
RGDKLPKNFDWRSVNGKSYVPEPF

SEQ ID NO: 3078420 - protein, 27 aa, Giardia lamblia
RGDLSSSLCSPVFLQFLELVYYLLSAY

SEQ ID NO: 3078421 - protein, 23 aa, Giardia lamblia
RGEHMKLRWNVIYNGVDLVKHIL

SEQ ID NO: 3078422 - protein, 24 aa, Giardia lamblia
RGERLRKLFPMHSLIEIKDYGTLV

SEQ ID NO: 3078423 - protein, 24 aa, Giardia lamblia
RGFLVYRADMLAPFVYSPALPDTI

SEQ ID NO: 3078424 - protein, 18 aa, Giardia lamblia
RGFLWGFDVIMTFGACLQ

SEQ ID NO: 3078425 - protein, 19 aa, Giardia lamblia
RGGLEKHLQAGVERQDVIG

SEQ ID NO: 3078426 - protein, 20 aa, Giardia lamblia
RGHLCKIFIDEFLATNPNYD

SEQ ID NO: 3078427 - protein, 20 aa, Giardia lamblia
RGHMNIYIRQCFVQYSCIII

SEQ ID NO: 3078428 - protein, 17 aa, Giardia lamblia
RGHTMSIGMLARACADR

SEQ ID NO: 3078429 - protein, 17 aa, Giardia lamblia
RGIPDMHEMSSLDPRRM

SEQ ID NO: 3078430 - protein, 19 aa, Giardia lamblia
RGIPGCSRCSYNVEKKGPI

SEQ ID NO: 3078431 - protein, 24 aa, Giardia lamblia
RGKKRMSSLISICIRAYKSSMLII

SEQ ID NO: 3078432 - protein, 24 aa, Giardia lamblia
RGLFERHKLIFISQLCFNVLRKDN

SEQ ID NO: 3078433 - protein, 20 aa, Giardia lamblia
RGLLELMRYYLPSFGLPLAS

SEQ ID NO: 3078434 - protein, 24 aa, Giardia lamblia
RGLLLLVARLANWCRDQLLIESYV

SEQ ID NO: 3078435 - protein, 25 aa, Giardia lamblia
RGLSLLCLKQAFLFTRDTIAASDYE

SEQ ID NO: 3078436 - protein, 19 aa, Giardia lamblia
RGMCFRYNDSYDREREHCV

SEQ ID NO: 3078437 - protein, 20 aa, Giardia lamblia
RGQCIQMWTGYMCACDNNTP

SEQ ID NO: 3078438 - protein, 23 aa, Giardia lamblia
RGQTALMCFCMIDSTNVLTFLYA

SEQ ID NO: 3078439 - protein, 20 aa, Giardia lamblia
RGQTDVVCFLSQYEANYLDN

SEQ ID NO: 3078440 - protein, 19 aa, Giardia lamblia
RGRQGRRICTADYEAEIAV

SEQ ID NO: 3078441 - protein, 18 aa, Giardia lamblia
RGSFPIVKYQSGGSVPGE

SEQ ID NO: 3078442 - protein, 18 aa, Giardia lamblia
RGSLSHVHNGPWITLSLS

SEQ ID NO: 3078443 - protein, 26 aa, Giardia lamblia
RGSTQLLVLRLYRWYNNQLNEIRRLP

SEQ ID NO: 3078444 - protein, 23 aa, Giardia lamblia
RGSYLLISLVCYVLLFISLFIPF

SEQ ID NO: 3078445 - protein, 23 aa, Giardia lamblia
RGTKQAHGCIARCSKQKKLAYIC

SEQ ID NO: 3078446 - protein, 17 aa, Giardia lamblia
RGVAGIFALNSALNSTA

SEQ ID NO: 3078447 - protein, 20 aa, Giardia lamblia
RGVFLLEYIGPLVIWVVVAM

SEQ ID NO: 3078448 - protein, 25 aa, Giardia lamblia
RGVPVSKDFLCIKCGADKDCVTFDS

SEQ ID NO: 3078449 - protein, 33 aa, Giardia lamblia
RHAILSYRIPCCRVFLIDVCETLLNSNALPLMK

SEQ ID NO: 3078450 - protein, 19 aa, Giardia lamblia
RHASGITRYPADRSFEPSP

SEQ ID NO: 3078451 - protein, 23 aa, Giardia lamblia
RHDLRGVAELTILTGSLSSADVP

SEQ ID NO: 3078452 - protein, 17 aa, Giardia lamblia
RHECMLLLEDKDCVSSP

SEQ ID NO: 3078453 - protein, 19 aa, Giardia lamblia
RHEFHPVRHALVYLNGPAQ

SEQ ID NO: 3078454 - protein, 20 aa, Giardia lamblia
RHFSLIIAMNSYRTRNFQCI

SEQ ID NO: 3078455 - protein, 23 aa, Giardia lamblia
RHGKGRGGKRLKIDNAGEKEERK

SEQ ID NO: 3078456 - protein, 18 aa, Giardia lamblia
RHIFSSTVEPIIWEIVDL

SEQ ID NO: 3078457 - protein, 25 aa, Giardia lamblia
RHIRYLKKTCRSFAQEAPLTGWWVG

SEQ ID NO: 3078458 - protein, 22 aa, Giardia lamblia
RHKSLPSQRLRQSIDANKFASE

SEQ ID NO: 3078459 - protein, 18 aa, Giardia lamblia
RHMAIDGLMALKFTTQDL

SEQ ID NO: 3078460 - protein, 20 aa, Giardia lamblia
RHSACCFLQVFLRFLLGDVH

SEQ ID NO: 3078461 - protein, 21 aa, Giardia lamblia
RHSFKTVFAYESISLKRDPVI

SEQ ID NO: 3078462 - protein, 24 aa, Giardia lamblia
RHSGFCHRFLTVLSMKRSLRKGCS

SEQ ID NO: 3078463 - protein, 26 aa, Giardia lamblia
RHVVFLCIACSAVSYPVMAKLNGLVP

SEQ ID NO: 3078464 - protein, 18 aa, Giardia lamblia
RIALPTIIHRYFEEGFWN

SEQ ID NO: 3078465 - protein, 25 aa, Giardia lamblia
RIANLLRGKFRWSTLEATSLSPAIR

SEQ ID NO: 3078466 - protein, 26 aa, Giardia lamblia
RIANYYTTVFICMGLIYWGLAMLILL

SEQ ID NO: 3078467 - protein, 19 aa, Giardia lamblia
RICGNCLYFYDYFNEKLTA

SEQ ID NO: 3078468 - protein, 17 aa, Giardia lamblia
RIDFSAAYDTVRAALQP

SEQ ID NO: 3078469 - protein, 21 aa, Giardia lamblia
RIDKWYIGKGLLVFDSSVNLL

SEQ ID NO: 3078470 - protein, 17 aa, Giardia lamblia
RIDLCASKLSGNQHPTA

SEQ ID NO: 3078471 - protein, 18 aa, Giardia lamblia
RIDPVFRDVLGTKLSYAH

SEQ ID NO: 3078472 - protein, 27 aa, Giardia lamblia
RIDVIANFKVSKAFLPYNTETVTGTNC

SEQ ID NO: 3078473 - protein, 26 aa, Giardia lamblia
RIESRRAAPVNIAFTSIFAILLVGAV

SEQ ID NO: 3078474 - protein, 24 aa, Giardia lamblia
RIFKLSWSDVKLFLPTALRGSLSL

SEQ ID NO: 3078475 - protein, 26 aa, Giardia lamblia
RIFTELKCVYLAISYYISNILQKMEP

SEQ ID NO: 3078476 - protein, 19 aa, Giardia lamblia
RIGDCLKQYCGTWDQRTRE

SEQ ID NO: 3078477 - protein, 22 aa, Giardia lamblia
RIGRKAACMLFAVLVAGLLGLT

SEQ ID NO: 3078478 - protein, 17 aa, Giardia lamblia
RIHIRGMELGQRAMMHA

SEQ ID NO: 3078479 - protein, 32 aa, Giardia lamblia
RIIFSMFLVHVFLFEIFKRTIFMIKNRPHFCK

SEQ ID NO: 3078480 - protein, 21 aa, Giardia lamblia
RIKLEGLKIAFGNPYSKNLPP

SEQ ID NO: 3078481 - protein, 19 aa, Giardia lamblia
RIKLLGSDEPVIYSRVSAD

SEQ ID NO: 3078482 - protein, 23 aa, Giardia lamblia
RIKLWCRGKSPSVGASLAIGDGQ

SEQ ID NO: 3078483 - protein, 17 aa, Giardia lamblia
RIKRAIHEASEYTRAYI

SEQ ID NO: 3078484 - protein, 19 aa, Giardia lamblia
RILANICADEYADAALKWQ

SEQ ID NO: 3078485 - protein, 26 aa, Giardia lamblia
RILDGCKSFFRHYYVFSTQHLLHVVF

SEQ ID NO: 3078486 - protein, 18 aa, Giardia lamblia
RILQCVFLPVDEVFALIN

SEQ ID NO: 3078487 - protein, 19 aa, Giardia lamblia
RILSYKVWIAFISVSIKLA

SEQ ID NO: 3078488 - protein, 19 aa, Giardia lamblia
RIMALALCDLCATTLTGIA

SEQ ID NO: 3078489 - protein, 21 aa, Giardia lamblia
RIMIIIPLFLLLALACFFLNL

SEQ ID NO: 3078490 - protein, 21 aa, Giardia lamblia
RIMIIPKLRSAMVHCAATPAA

SEQ ID NO: 3078491 - protein, 24 aa, Giardia lamblia
RIMTTRLIYALLILREQFLGDSNA

SEQ ID NO: 3078492 - protein, 17 aa, Giardia lamblia
RINDKFDDDCLIAAIKY

SEQ ID NO: 3078493 - protein, 19 aa, Giardia lamblia
RINIYCLHEGMSLKRSTTP

SEQ ID NO: 3078494 - protein, 17 aa, Giardia lamblia
RIPCGILGVLLVTVPAF

SEQ ID NO: 3078495 - protein, 28 aa, Giardia lamblia
RIPFLYKLKHAFMLPMDYWPPNLAFSLL

SEQ ID NO: 3078496 - protein, 22 aa, Giardia lamblia
RIPGCETCAVGSGNLLTCSACL

SEQ ID NO: 3078497 - protein, 18 aa, Giardia lamblia
RIPSQLMGRHEGKDGGEE

SEQ ID NO: 3078498 - protein, 19 aa, Giardia lamblia
RIQNSWGADWCDGGTSRIA

SEQ ID NO: 3078499 - protein, 17 aa, Giardia lamblia
RIRCSILEYPIYTVDHD

SEQ ID NO: 3078500 - protein, 22 aa, Giardia lamblia
RIRGYLPIIFAFLALMYPTTII

SEQ ID NO: 3078501 - protein, 20 aa, Giardia lamblia
RIRNCYKCYDSARCSECSTG

SEQ ID NO: 3078502 - protein, 18 aa, Giardia lamblia
RIRSEGGAFCEHASAMSF

SEQ ID NO: 3078503 - protein, 17 aa, Giardia lamblia
RIRVFIRSLLQAINFLY

SEQ ID NO: 3078504 - protein, 19 aa, Giardia lamblia
RISFACACIGTKPLDVVLC

SEQ ID NO: 3078505 - protein, 25 aa, Giardia lamblia
RISGRLCPRTGLYTVKHKENLLLEK

SEQ ID NO: 3078506 - protein, 23 aa, Giardia lamblia
RISKARYQCLCGKIFFIVKPDVK

SEQ ID NO: 3078507 - protein, 23 aa, Giardia lamblia
RISLLARLFIKQILFEDVLNEKV

SEQ ID NO: 3078508 - protein, 25 aa, Giardia lamblia
RITGCLRELACLLIQSKSHQALTRL

SEQ ID NO: 3078509 - protein, 18 aa, Giardia lamblia
RITPMVLKNDGLMSNAIT

SEQ ID NO: 3078510 - protein, 25 aa, Giardia lamblia
RITRYPQLAHAYAFQNMGIPSDRYR

SEQ ID NO: 3078511 - protein, 27 aa, Giardia lamblia
RITTPFKAPNPRPVILVLGEDYSGKSS

SEQ ID NO: 3078512 - protein, 23 aa, Giardia lamblia
RITYSKDLWLAMLDLIEPDTSLR

SEQ ID NO: 3078513 - protein, 18 aa, Giardia lamblia
RIYHAVNIFERLRREASR

SEQ ID NO: 3078514 - protein, 23 aa, Giardia lamblia
RIYPCYFPIRFIRGPPALTPQLL

SEQ ID NO: 3078515 - protein, 22 aa, Giardia lamblia
RKALLLLHWKIFISRRQYDWMC

SEQ ID NO: 3078516 - protein, 20 aa, Giardia lamblia
RKALSEYFELYRVYARVSTL

SEQ ID NO: 3078517 - protein, 31 aa, Giardia lamblia
RKAYERLRCLLGCWALEFGLLPYYRLFEPAG

SEQ ID NO: 3078518 - protein, 21 aa, Giardia lamblia
RKDAVHRAAERLCSWPLYAML

SEQ ID NO: 3078519 - protein, 17 aa, Giardia lamblia
RKFTGPAQMVFHYSIYF

SEQ ID NO: 3078520 - protein, 18 aa, Giardia lamblia
RKGDSWTVRAMKLRAAQQ

SEQ ID NO: 3078521 - protein, 27 aa, Giardia lamblia
RKGGTSAPEPFVWEVLSQMAYGLRDLH

SEQ ID NO: 3078522 - protein, 22 aa, Giardia lamblia
RKGIIRSGGIGILRGSHKNINP

SEQ ID NO: 3078523 - protein, 18 aa, Giardia lamblia
RKGSISWATVSSSCGDTY

SEQ ID NO: 3078524 - protein, 19 aa, Giardia lamblia
RKGSMRLSYGPARASQMRM

SEQ ID NO: 3078525 - protein, 26 aa, Giardia lamblia
RKGVTGSLPYWKFVLATTCFAVLDLI

SEQ ID NO: 3078526 - protein, 17 aa, Giardia lamblia
RKHFDKKIIPDNINTTI

SEQ ID NO: 3078527 - protein, 19 aa, Giardia lamblia
RKHKSGAVPPSYMDKEEAK

SEQ ID NO: 3078528 - protein, 19 aa, Giardia lamblia
RKILSCSVSLSAAFDSQTD

SEQ ID NO: 3078529 - protein, 34 aa, Giardia lamblia
RKIPIFANFRLWKPLRLLKKAVLKNRRTRAYGSL

SEQ ID NO: 3078530 - protein, 19 aa, Giardia lamblia
RKKELRYLQKLLMNEAFVY

SEQ ID NO: 3078531 - protein, 21 aa, Giardia lamblia
RKKQMPIGALIMGLIVGAVVA

SEQ ID NO: 3078532 - protein, 23 aa, Giardia lamblia
RKLANEIWPQCGLVPGKEDYELL

SEQ ID NO: 3078533 - protein, 19 aa, Giardia lamblia
RKLKKPKEQAGVDIRSKQL

SEQ ID NO: 3078534 - protein, 19 aa, Giardia lamblia
RKLMLLHIVLLQSIKDMAH

SEQ ID NO: 3078535 - protein, 17 aa, Giardia lamblia
RKLSTYTGFGIGISESK

SEQ ID NO: 3078536 - protein, 19 aa, Giardia lamblia
RKLVLRLCNPNRIFDPSKP

SEQ ID NO: 3078537 - protein, 18 aa, Giardia lamblia
RKLYLRGLSYVWGGGLAG

SEQ ID NO: 3078538 - protein, 21 aa, Giardia lamblia
RKMLSEAFQNRFIMIEFADIS

SEQ ID NO: 3078539 - protein, 17 aa, Giardia lamblia
RKMQLFNNQVSKYKELL

SEQ ID NO: 3078540 - protein, 18 aa, Giardia lamblia
RKMTSFRLDAPTTIKNAC

SEQ ID NO: 3078541 - protein, 23 aa, Giardia lamblia
RKPADSSTVWSGILERGDEDSLD

SEQ ID NO: 3078542 - protein, 18 aa, Giardia lamblia
RKPMEALRVIYVRTKKTT

SEQ ID NO: 3078543 - protein, 21 aa, Giardia lamblia
RKPRSFPIHWLQTRKTSTKKK

SEQ ID NO: 3078544 - protein, 19 aa, Giardia lamblia
RKQLSGWLADQLVSTELAG

SEQ ID NO: 3078545 - protein, 19 aa, Giardia lamblia
RKRFGFTYPSLVHGITIMG

SEQ ID NO: 3078546 - protein, 17 aa, Giardia lamblia
RKRLINLSNYYGTLETH

SEQ ID NO: 3078547 - protein, 22 aa, Giardia lamblia
RKRTAVDFATYLFAQAIKSFIT

SEQ ID NO: 3078548 - protein, 18 aa, Giardia lamblia
RKSPIGLFLNDSYGVGIE

SEQ ID NO: 3078549 - protein, 21 aa, Giardia lamblia
RKTEVSQLLSALKGLILLQQE

SEQ ID NO: 3078550 - protein, 23 aa, Giardia lamblia
RKTQGSSCLADLATVRNLIKANR

SEQ ID NO: 3078551 - protein, 17 aa, Giardia lamblia
RKVESRDALFLLQGLES

SEQ ID NO: 3078552 - protein, 21 aa, Giardia lamblia
RKVGQFSYGMKRRTCLAMALA

SEQ ID NO: 3078553 - protein, 17 aa, Giardia lamblia
RKVVCHRELMVPEEKEK

SEQ ID NO: 3078554 - protein, 17 aa, Giardia lamblia
RKWSILISLTVVVFTAL

SEQ ID NO: 3078555 - protein, 17 aa, Giardia lamblia
RKYCSQSGESLEILLSL

SEQ ID NO: 3078556 - protein, 20 aa, Giardia lamblia
RLADCPSPVYTRVSIGNLNQ

SEQ ID NO: 3078557 - protein, 21 aa, Giardia lamblia
RLAETYSSILSRSMGNIRRIL

SEQ ID NO: 3078558 - protein, 21 aa, Giardia lamblia
RLAGLSCTVLLFSEPYVSASV

SEQ ID NO: 3078559 - protein, 19 aa, Giardia lamblia
RLATDFLVGCAALSVHSIP

SEQ ID NO: 3078560 - protein, 18 aa, Giardia lamblia
RLATLFVYANPYVTDVLT

SEQ ID NO: 3078561 - protein, 23 aa, Giardia lamblia
RLCGGLPVLYRYSAHGILPAYLL

SEQ ID NO: 3078562 - protein, 26 aa, Giardia lamblia
RLCSLLQRSAINFIFQLIAGLSQCIA

SEQ ID NO: 3078563 - protein, 21 aa, Giardia lamblia
RLDDVKLALVYTYSSLSNTFD

SEQ ID NO: 3078564 - protein, 29 aa, Giardia lamblia
RLDLVVAPFRIRRVISLEIESPDALYLRL

SEQ ID NO: 3078565 - protein, 22 aa, Giardia lamblia
RLDRSELLRIFNMDAYKSDSSL

SEQ ID NO: 3078566 - protein, 22 aa, Giardia lamblia
RLEDCKQRLSAMGVNVEQALEK

SEQ ID NO: 3078567 - protein, 21 aa, Giardia lamblia
RLEIVKLLFEKEGHLIDKSDE

SEQ ID NO: 3078568 - protein, 21 aa, Giardia lamblia
RLEIVKLLFEKEGHLIDKSNE

SEQ ID NO: 3078569 - protein, 20 aa, Giardia lamblia
RLELRVVHYILAIFVGLICG

SEQ ID NO: 3078570 - protein, 21 aa, Giardia lamblia
RLENLISHSIHPFLVSSWKLT

SEQ ID NO: 3078571 - protein, 39 aa, Giardia lamblia
RLETTLGTKLFEWEDGPILNCMKRGHILLLDEVSLADES

SEQ ID NO: 3078572 - protein, 17 aa, Giardia lamblia
RLFFLVHRFCAVLYYKL

SEQ ID NO: 3078573 - protein, 24 aa, Giardia lamblia
RLFGINLQMHFYLRRGVEFPHNAI

SEQ ID NO: 3078574 - protein, 19 aa, Giardia lamblia
RLFIGGAVGDYKCNTVAGA

SEQ ID NO: 3078575 - protein, 18 aa, Giardia lamblia
RLFTLSLLQYSSCSKGVQ

SEQ ID NO: 3078576 - protein, 21 aa, Giardia lamblia
RLFTSRCFVERLFTMLDKSCG

SEQ ID NO: 3078577 - protein, 24 aa, Giardia lamblia
RLFYECFSFISSSWYTLLIDVSLF

SEQ ID NO: 3078578 - protein, 20 aa, Giardia lamblia
RLGEAPVFKLLCSFSVPCIF

SEQ ID NO: 3078579 - protein, 18 aa, Giardia lamblia
RLGNILIGLFQIVSVANS

SEQ ID NO: 3078580 - protein, 20 aa, Giardia lamblia
RLGSLVRNRCNAITERPINL

SEQ ID NO: 3078581 - protein, 20 aa, Giardia lamblia
RLGVPEFKVLLSNYLCLLFL

SEQ ID NO: 3078582 - protein, 28 aa, Giardia lamblia
RLHCQQDRCSSCALAPSSFINPSSMNVT

SEQ ID NO: 3078583 - protein, 19 aa, Giardia lamblia
RLHYKHWAIIFSIISALIV

SEQ ID NO: 3078584 - protein, 22 aa, Giardia lamblia
RLIAPQLKRITPILSSPILALV

SEQ ID NO: 3078585 - protein, 20 aa, Giardia lamblia
RLIELLLPYEASICPELLEA

SEQ ID NO: 3078586 - protein, 18 aa, Giardia lamblia
RLIISPTIDSYRQIFLDT

SEQ ID NO: 3078587 - protein, 24 aa, Giardia lamblia
RLISGYKLSINFIPTNAVVGQPSK

SEQ ID NO: 3078588 - protein, 17 aa, Giardia lamblia
RLKAGMVQEALTIKDDS

SEQ ID NO: 3078589 - protein, 21 aa, Giardia lamblia
RLKFVHKLFESLVIILNVISD

SEQ ID NO: 3078590 - protein, 20 aa, Giardia lamblia
RLKGRELHMFIEPPEINLVL

SEQ ID NO: 3078591 - protein, 22 aa, Giardia lamblia
RLKINEYISIVFEVENLKNASP

SEQ ID NO: 3078592 - protein, 30 aa, Giardia lamblia
RLKNILKVDCFKLPLSYDIKLATFCVVECA

SEQ ID NO: 3078593 - protein, 21 aa, Giardia lamblia
RLLCTPTAPIASWPAKILTTK

SEQ ID NO: 3078594 - protein, 26 aa, Giardia lamblia
RLLDSCYMIPYLLAHHGAFTGVQELL

SEQ ID NO: 3078595 - protein, 25 aa, Giardia lamblia
RLLFAKELYRYLSIKQSGDNKALQL

SEQ ID NO: 3078596 - protein, 21 aa, Giardia lamblia
RLLGDLAPWCMRAYTVSTWIN

SEQ ID NO: 3078597 - protein, 18 aa, Giardia lamblia
RLLGLTILSIVMGLLLTV

SEQ ID NO: 3078598 - protein, 20 aa, Giardia lamblia
RLLNECRARAAAELATSEQM

SEQ ID NO: 3078599 - protein, 24 aa, Giardia lamblia
RLLQARIASILSKRGRDHGAEAEH

SEQ ID NO: 3078600 - protein, 24 aa, Giardia lamblia
RLLQPGRMLLEFLLLGAESLESEY

SEQ ID NO: 3078601 - protein, 17 aa, Giardia lamblia
RLLVDFLSYGIFALDCK

SEQ ID NO: 3078602 - protein, 17 aa, Giardia lamblia
RLNACVWNRASEPPIIC

SEQ ID NO: 3078603 - protein, 19 aa, Giardia lamblia
RLNDVLEHPIRLSSSNPDT

SEQ ID NO: 3078604 - protein, 26 aa, Giardia lamblia
RLNEKVIKEFAVFIDPLIQFFYMTSD

SEQ ID NO: 3078605 - protein, 24 aa, Giardia lamblia
RLNGLNYLFYFAWKEYPLEGRVMV

SEQ ID NO: 3078606 - protein, 19 aa, Giardia lamblia
RLNGVCKHPELFVGAIQSL

SEQ ID NO: 3078607 - protein, 19 aa, Giardia lamblia
RLNKIGIVRILAAHEHGRM

SEQ ID NO: 3078608 - protein, 24 aa, Giardia lamblia
RLNNALRMFSLHFVNMRTECIKVC

SEQ ID NO: 3078609 - protein, 19 aa, Giardia lamblia
RLNSHLAFFLTPGGVIYAL

SEQ ID NO: 3078610 - protein, 17 aa, Giardia lamblia
RLPDEFMSKFFVITVFL

SEQ ID NO: 3078611 - protein, 17 aa, Giardia lamblia
RLPEEARNIRSVVQCDS

SEQ ID NO: 3078612 - protein, 32 aa, Giardia lamblia
RLPSSIHLACIRKRRYGLVRSRGSSGKATLSL

SEQ ID NO: 3078613 - protein, 32 aa, Giardia lamblia
RLQDKCLRYTALMIAVLLGWNRAVEALAHSKI

SEQ ID NO: 3078614 - protein, 18 aa, Giardia lamblia
RLQFEAALTQFISKITKF

SEQ ID NO: 3078615 - protein, 20 aa, Giardia lamblia
RLQGSFNTRGIFPVVEPTAL

SEQ ID NO: 3078616 - protein, 20 aa, Giardia lamblia
RLQLIIIVQCSLVLVFVISF

SEQ ID NO: 3078617 - protein, 23 aa, Giardia lamblia
RLQRYKILLANQFRVKSLVQTYL

SEQ ID NO: 3078618 - protein, 18 aa, Giardia lamblia
RLQSFSNFIYLSVEYLLY

SEQ ID NO: 3078619 - protein, 21 aa, Giardia lamblia
RLRCFSRPRIEKLIESLFGII

SEQ ID NO: 3078620 - protein, 18 aa, Giardia lamblia
RLRDDYEILDFLCDMNIS

SEQ ID NO: 3078621 - protein, 24 aa, Giardia lamblia
RLRIYRMKTSFDRPSQSTILQSKA

SEQ ID NO: 3078622 - protein, 24 aa, Giardia lamblia
RLRKTKLFRTLDCTVHELLGQKFQ

SEQ ID NO: 3078623 - protein, 31 aa, Giardia lamblia
RLRQHFRCVVCLFTEVYCCSEAFRSSSDGKA

SEQ ID NO: 3078624 - protein, 17 aa, Giardia lamblia
RLSAKDCPTRGTSSPAI

SEQ ID NO: 3078625 - protein, 19 aa, Giardia lamblia
RLSEQCAPSMLSLYMSDTL

SEQ ID NO: 3078626 - protein, 19 aa, Giardia lamblia
RLSIFIFDDLNIMDSKAVL

SEQ ID NO: 3078627 - protein, 20 aa, Giardia lamblia
RLSKCTQFPVTGSSSVRDSI

SEQ ID NO: 3078628 - protein, 25 aa, Giardia lamblia
RLSRPRSVTKLVRRPLHMLKQESNL

SEQ ID NO: 3078629 - protein, 18 aa, Giardia lamblia
RLSSDCSRRQITIPESSN

SEQ ID NO: 3078630 - protein, 19 aa, Giardia lamblia
RLSSFFRAVLSLGDQHRVI

SEQ ID NO: 3078631 - protein, 24 aa, Giardia lamblia
RLSSPSIYFDLHFDSSSRSSPTDS

SEQ ID NO: 3078632 - protein, 20 aa, Giardia lamblia
RLSTCDELPYTIKESTLESD

SEQ ID NO: 3078633 - protein, 18 aa, Giardia lamblia
RLSTLDEILILWLQVQQN

SEQ ID NO: 3078634 - protein, 20 aa, Giardia lamblia
RLSTNNCGFIAQTHTSIRGS

SEQ ID NO: 3078635 - protein, 18 aa, Giardia lamblia
RLSVRYPALSAFWTTLSP

SEQ ID NO: 3078636 - protein, 29 aa, Giardia lamblia
RLSYVLPPFLGYAVLQWATLYGINVLAFP

SEQ ID NO: 3078637 - protein, 19 aa, Giardia lamblia
RLTEFWMPHIRDINEVRMI

SEQ ID NO: 3078638 - protein, 21 aa, Giardia lamblia
RLTETRYLLFTTKDIVDLDLE

SEQ ID NO: 3078639 - protein, 25 aa, Giardia lamblia
RLTIDTRKGKIIFYILGLLIVTMAT

SEQ ID NO: 3078640 - protein, 19 aa, Giardia lamblia
RLTPPYVRIIAYTMAIIVL

SEQ ID NO: 3078641 - protein, 17 aa, Giardia lamblia
RLTVIELDGLKSAKQLE

SEQ ID NO: 3078642 - protein, 18 aa, Giardia lamblia
RLVCSLIGLMVPAGGGYI

SEQ ID NO: 3078643 - protein, 18 aa, Giardia lamblia
RLVHCDLRPANVLISADG

SEQ ID NO: 3078644 - protein, 23 aa, Giardia lamblia
RLVINSVCLLFNLHLFSNDYVKS

SEQ ID NO: 3078645 - protein, 19 aa, Giardia lamblia
RLVSEEIIYGLREHAFSIS

SEQ ID NO: 3078646 - protein, 20 aa, Giardia lamblia
RLYGPLGDYLMNGFANAAMG

SEQ ID NO: 3078647 - protein, 21 aa, Giardia lamblia
RMFMACTLWNPSQVNITADGA

SEQ ID NO: 3078648 - protein, 26 aa, Giardia lamblia
RMFNSRFPVCLSNLSVEGLRELTVRQ

SEQ ID NO: 3078649 - protein, 18 aa, Giardia lamblia
RMIAVPLKLLMIVLFLVF

SEQ ID NO: 3078650 - protein, 33 aa, Giardia lamblia
RMIKCERIIKIVLWSASVLFLGLSALGFYVYHH

SEQ ID NO: 3078651 - protein, 29 aa, Giardia lamblia
RMIQNLPFLPLCTFLRSVAARSYQTTDLI

SEQ ID NO: 3078652 - protein, 26 aa, Giardia lamblia
RMKCGRLGVCTTIPPVTGINARALQR

SEQ ID NO: 3078653 - protein, 27 aa, Giardia lamblia
RMLLVSCLFLLSALCIFEGYQQLSCID

SEQ ID NO: 3078654 - protein, 21 aa, Giardia lamblia
RMNVYYNRIIDLFQVRHWNYE

SEQ ID NO: 3078655 - protein, 18 aa, Giardia lamblia
RMPIYFLVLKGTGHVQAL

SEQ ID NO: 3078656 - protein, 19 aa, Giardia lamblia
RMRCSACGDTAVCNKGFCY

SEQ ID NO: 3078657 - protein, 22 aa, Giardia lamblia
RMRNKRLSIARFYGEKYFSVED

SEQ ID NO: 3078658 - protein, 23 aa, Giardia lamblia
RMSTRLPVLLSVRGSLNKSSHSA

SEQ ID NO: 3078659 - protein, 19 aa, Giardia lamblia
RMTELLPTIVHHLLSKISA

SEQ ID NO: 3078660 - protein, 19 aa, Giardia lamblia
RMVATWLKVLDPWARMLPS

SEQ ID NO: 3078661 - protein, 23 aa, Giardia lamblia
RMYDLRLVLEYTNVTSFIQTSKN

SEQ ID NO: 3078662 - protein, 19 aa, Giardia lamblia
RMYKAMLFAFMFMTIASTL

SEQ ID NO: 3078663 - protein, 19 aa, Giardia lamblia
RNAAGYLFSNTYGFGLVDV

SEQ ID NO: 3078664 - protein, 20 aa, Giardia lamblia
RNAYLKLFYLEEAANADVKN

SEQ ID NO: 3078665 - protein, 18 aa, Giardia lamblia
RNCLGHALDVGRDIERVE

SEQ ID NO: 3078666 - protein, 28 aa, Giardia lamblia
RNCNLFIVVLCFIDLSLIVYKASGILRP

SEQ ID NO: 3078667 - protein, 18 aa, Giardia lamblia
RNDDSLWLYPGVAEHGYN

SEQ ID NO: 3078668 - protein, 19 aa, Giardia lamblia
RNFCNRYDAGTVMYSYGWA

SEQ ID NO: 3078669 - protein, 20 aa, Giardia lamblia
RNFYLPRFFYTGITTSSDEA

SEQ ID NO: 3078670 - protein, 18 aa, Giardia lamblia
RNGAGYKCDCRGLATGDL

SEQ ID NO: 3078671 - protein, 19 aa, Giardia lamblia
RNGLQEMGEEPLLDSSTSL

SEQ ID NO: 3078672 - protein, 24 aa, Giardia lamblia
RNGLTDKPARRYMLLKDSERYRLT

SEQ ID NO: 3078673 - protein, 19 aa, Giardia lamblia
RNGPDLDHYVGVLRNSAES

SEQ ID NO: 3078674 - protein, 26 aa, Giardia lamblia
RNGPNKLRLVMCVPEAQQTTRSLMYF

SEQ ID NO: 3078675 - protein, 24 aa, Giardia lamblia
RNIGETPLRYTVRLFSDLIQSTNG

SEQ ID NO: 3078676 - protein, 24 aa, Giardia lamblia
RNIPEHVIRFYSYRRLTDKKWFGN

SEQ ID NO: 3078677 - protein, 17 aa, Giardia lamblia
RNISLLYPHSERVLSWL

SEQ ID NO: 3078678 - protein, 23 aa, Giardia lamblia
RNIYCRGYWQYPMQEPTRDTVQQ

SEQ ID NO: 3078679 - protein, 24 aa, Giardia lamblia
RNKILRFELHITFVSLAIEIACMF

SEQ ID NO: 3078680 - protein, 21 aa, Giardia lamblia
RNKSFRCKHSGWRRIMTARFM

SEQ ID NO: 3078681 - protein, 17 aa, Giardia lamblia
RNLGFSIVDDADESKLR

SEQ ID NO: 3078682 - protein, 25 aa, Giardia lamblia
RNLIRNCVYYWGFASAISWTILQSN

SEQ ID NO: 3078683 - protein, 18 aa, Giardia lamblia
RNLPCGIGGQCLETSLGS

SEQ ID NO: 3078684 - protein, 20 aa, Giardia lamblia
RNLRGMGLHLARHAFGETDS

SEQ ID NO: 3078685 - protein, 18 aa, Giardia lamblia
RNLWLMIILFYISTTSLK

SEQ ID NO: 3078686 - protein, 20 aa, Giardia lamblia
RNMREKSAIIVRDHETQRTS

SEQ ID NO: 3078687 - protein, 17 aa, Giardia lamblia
RNNIFAFMMPRQSITTI

SEQ ID NO: 3078688 - protein, 22 aa, Giardia lamblia
RNNLKASWVPKAIQEKRFHNWL

SEQ ID NO: 3078689 - protein, 19 aa, Giardia lamblia
RNNLLPSFSLDSIDTSFRS

SEQ ID NO: 3078690 - protein, 28 aa, Giardia lamblia
RNNRRRCACLLWPLEHAIADRDGISPRD

SEQ ID NO: 3078691 - protein, 19 aa, Giardia lamblia
RNNVQLIALVLLNFISISF

SEQ ID NO: 3078692 - protein, 31 aa, Giardia lamblia
RNRQWLGVFLKNWTLFCASFGGFLSVLVLTF

SEQ ID NO: 3078693 - protein, 24 aa, Giardia lamblia
RNSEWFKALCPYEATLRDSRGRTA

SEQ ID NO: 3078694 - protein, 17 aa, Giardia lamblia
RNSFYRLVLGLIVEFGH

SEQ ID NO: 3078695 - protein, 20 aa, Giardia lamblia
RNTKCCKRAGSLTETSMKGN

SEQ ID NO: 3078696 - protein, 19 aa, Giardia lamblia
RNTLSIARSRRSTRILLMI

SEQ ID NO: 3078697 - protein, 37 aa, Giardia lamblia
RNVMRALASNKCMLCVMMVICIIVLIVSIVDLAQATK

SEQ ID NO: 3078698 - protein, 24 aa, Giardia lamblia
RNYILPHCIFIFATILAYDPSIYV

SEQ ID NO: 3078699 - protein, 17 aa, Giardia lamblia
RPAEMKTPILTPSQSLK

SEQ ID NO: 3078700 - protein, 19 aa, Giardia lamblia
RPANFILSGVNPVLADAAL

SEQ ID NO: 3078701 - protein, 24 aa, Giardia lamblia
RPARIGSLVMKTSWPFFAVSSILM

SEQ ID NO: 3078702 - protein, 25 aa, Giardia lamblia
RPCHASCFSCNGPGASDCLSCPLGD

SEQ ID NO: 3078703 - protein, 21 aa, Giardia lamblia
RPDGLKIYPTLIIRGTELYER

SEQ ID NO: 3078704 - protein, 18 aa, Giardia lamblia
RPDIKFRVLVSHISMYTI

SEQ ID NO: 3078705 - protein, 24 aa, Giardia lamblia
RPEHNLKVNIIIKMVAPGVPAGYE

SEQ ID NO: 3078706 - protein, 20 aa, Giardia lamblia
RPEKTYPARSIFLNSHVSHP

SEQ ID NO: 3078707 - protein, 20 aa, Giardia lamblia
RPGALLMIVKTDFNKDILAN

SEQ ID NO: 3078708 - protein, 28 aa, Giardia lamblia
RPGNIGVLSARCGQLLYIISHLAPLEAR

SEQ ID NO: 3078709 - protein, 21 aa, Giardia lamblia
RPGYKHAPTLLKRPIDIAPLS

SEQ ID NO: 3078710 - protein, 21 aa, Giardia lamblia
RPISHFTPDSWSRKPGQLVVL

SEQ ID NO: 3078711 - protein, 19 aa, Giardia lamblia
RPISTCLTVSLGYVGLVAA

SEQ ID NO: 3078712 - protein, 20 aa, Giardia lamblia
RPKAKRPCVQITKDDTIVAD

SEQ ID NO: 3078713 - protein, 20 aa, Giardia lamblia
RPKENNVFELFNISQNKLLC

SEQ ID NO: 3078714 - protein, 24 aa, Giardia lamblia
RPLEEFARRGDLVLLYILHQTAVI

SEQ ID NO: 3078715 - protein, 24 aa, Giardia lamblia
RPLHDYRIYYVLTTGASLKFLLET

SEQ ID NO: 3078716 - protein, 19 aa, Giardia lamblia
RPLMAVFCFVYVCMADCFD

SEQ ID NO: 3078717 - protein, 26 aa, Giardia lamblia
RPMKGRVHRFLRLCINISSATSKQSI

SEQ ID NO: 3078718 - protein, 24 aa, Giardia lamblia
RPMNICSCMIINSILGRILENADT

SEQ ID NO: 3078719 - protein, 21 aa, Giardia lamblia
RPNACDYYLFFSISNTTRPIK

SEQ ID NO: 3078720 - protein, 28 aa, Giardia lamblia
RPNTEVQGLLAFFARLMVSGGISSYTQC

SEQ ID NO: 3078721 - protein, 43 aa, Giardia lamblia
RPPLLRAVAVPPGFAGPVPLRLPGDLFLGAVVTRARAGHALSV

SEQ ID NO: 3078722 - protein, 34 aa, Giardia lamblia
RPPSFIGVPCGHALMCHSCMVASISACPFCKAQI

SEQ ID NO: 3078723 - protein, 19 aa, Giardia lamblia
RPQESMLLNSKFHRITVGS

SEQ ID NO: 3078724 - protein, 18 aa, Giardia lamblia
RPQSALSHTGRPTTSLRT

SEQ ID NO: 3078725 - protein, 23 aa, Giardia lamblia
RPQYRYSCAISCLVSIFNHLFNR

SEQ ID NO: 3078726 - protein, 19 aa, Giardia lamblia
RPRRLFEPMLQYPDGFSAC

SEQ ID NO: 3078727 - protein, 20 aa, Giardia lamblia
RPRRLFEPMLQYPNGFPVCL

SEQ ID NO: 3078728 - protein, 20 aa, Giardia lamblia
RPRRLFEPMLQYPNGFSACL

SEQ ID NO: 3078729 - protein, 19 aa, Giardia lamblia
RPSLIAILYILSAAIAGSV

SEQ ID NO: 3078730 - protein, 17 aa, Giardia lamblia
RPSNTFHEGQMKLSENI

SEQ ID NO: 3078731 - protein, 26 aa, Giardia lamblia
RPTDDPCVFCLKGNALLKAEKYTEAI

SEQ ID NO: 3078732 - protein, 18 aa, Giardia lamblia
RPTLLAICGHFIEVNVDA

SEQ ID NO: 3078733 - protein, 25 aa, Giardia lamblia
RPTVVLCLCNTFFLLHHYTIRDVPE

SEQ ID NO: 3078734 - protein, 20 aa, Giardia lamblia
RPVLAKLFRCYGTVEAIESL

SEQ ID NO: 3078735 - protein, 17 aa, Giardia lamblia
RPWPALIKNVSFVVELE

SEQ ID NO: 3078736 - protein, 27 aa, Giardia lamblia
RPYGNCCKRCFCLLANHELALTKRSFC

SEQ ID NO: 3078737 - protein, 17 aa, Giardia lamblia
RQACYKFAYYTTLHAMP

SEQ ID NO: 3078738 - protein, 20 aa, Giardia lamblia
RQATEYLLHLIAELGRSSPS

SEQ ID NO: 3078739 - protein, 20 aa, Giardia lamblia
RQDKLGWTALMWLSVMGGAD

SEQ ID NO: 3078740 - protein, 26 aa, Giardia lamblia
RQDYAVRIIAGMEAFLTRVYQEDLNT

SEQ ID NO: 3078741 - protein, 17 aa, Giardia lamblia
RQFKLLLAKQAPSYADL

SEQ ID NO: 3078742 - protein, 30 aa, Giardia lamblia
RQGTTIGALKCFMCQQPVYKEPVYPKSVIT

SEQ ID NO: 3078743 - protein, 23 aa, Giardia lamblia
RQIEAMGVLYTMLRVVWVDICQF

SEQ ID NO: 3078744 - protein, 17 aa, Giardia lamblia
RQILKYLLIENLFDPIL

SEQ ID NO: 3078745 - protein, 24 aa, Giardia lamblia
RQKHPDFGILLSMSTLSIDTNRRI

SEQ ID NO: 3078746 - protein, 20 aa, Giardia lamblia
RQKRARLATQFPEVKKRFCI

SEQ ID NO: 3078747 - protein, 20 aa, Giardia lamblia
RQLANAFYYQWDNVETSAKT

SEQ ID NO: 3078748 - protein, 23 aa, Giardia lamblia
RQLKALGMLCGDVPFYHPLQCVM

SEQ ID NO: 3078749 - protein, 27 aa, Giardia lamblia
RQLWFTKHYMCYKDLRIKRATEVLTGI

SEQ ID NO: 3078750 - protein, 35 aa, Giardia lamblia
RQMFKLNGVPTWLYWCANFIYQLCFAVLVYSVMVV

SEQ ID NO: 3078751 - protein, 17 aa, Giardia lamblia
RQMTFLLFLLLGGIYKK

SEQ ID NO: 3078752 - protein, 23 aa, Giardia lamblia
RQNISCVMSLYAYESGFQDNHGW

SEQ ID NO: 3078753 - protein, 19 aa, Giardia lamblia
RQNLKPVLPSFVAQEAIRG

SEQ ID NO: 3078754 - protein, 19 aa, Giardia lamblia
RQNVRVVLELYNIVTDLLS

SEQ ID NO: 3078755 - protein, 22 aa, Giardia lamblia
RQQEYLRFCMPILLDRLPHCFT

SEQ ID NO: 3078756 - protein, 18 aa, Giardia lamblia
RQQFIVLFIIKAALDNTQ

SEQ ID NO: 3078757 - protein, 24 aa, Giardia lamblia
RQQKLSIFAFVIYSLCKVIEFDRY

SEQ ID NO: 3078758 - protein, 24 aa, Giardia lamblia
RQQNRLYMQIAFTNCLANNVLVGG

SEQ ID NO: 3078759 - protein, 26 aa, Giardia lamblia
RQRLLMKMTPFRRGIFYSILIVAIGI

SEQ ID NO: 3078760 - protein, 19 aa, Giardia lamblia
RQRQHAIYKILYNASMHEL

SEQ ID NO: 3078761 - protein, 30 aa, Giardia lamblia
RQSGVPLSQLWLRKACLEKGIDLSRLSIFY

SEQ ID NO: 3078762 - protein, 28 aa, Giardia lamblia
RQVCNKLRLRVGLVVDHINNNCVVPQFC

SEQ ID NO: 3078763 - protein, 19 aa, Giardia lamblia
RQVFIFLAMLQKGSHGLLS

SEQ ID NO: 3078764 - protein, 23 aa, Giardia lamblia
RQVKVVDCLPQLHMNKLQLRLLD

SEQ ID NO: 3078765 - protein, 24 aa, Giardia lamblia
RQVSVPVTYTFPVVVPFTSARKRM

SEQ ID NO: 3078766 - protein, 41 aa, Giardia lamblia
RQVVDQALKCYFHSVSYVDCIKWLQYVSGIIDMRPSYDADL

SEQ ID NO: 3078767 - protein, 24 aa, Giardia lamblia
RQYFLQLRMRVMPGTESSSKLAIY

SEQ ID NO: 3078768 - protein, 23 aa, Giardia lamblia
RQYNELFAELELRYRELGYNFVS

SEQ ID NO: 3078769 - protein, 29 aa, Giardia lamblia
RQYPLLWLCTGLSVGVLFLLGKALLLNTY

SEQ ID NO: 3078770 - protein, 20 aa, Giardia lamblia
RQYSICRPFFVSVLLNQIFF

SEQ ID NO: 3078771 - protein, 17 aa, Giardia lamblia
RRAATVLSYSLYGDSSG

SEQ ID NO: 3078772 - protein, 20 aa, Giardia lamblia
RRAGIDGVFTLDFKNSIYGG

SEQ ID NO: 3078773 - protein, 19 aa, Giardia lamblia
RRALLWRTCVFIFTCYIAF

SEQ ID NO: 3078774 - protein, 34 aa, Giardia lamblia
RRALVIPGIVFRLWRVYTFIIRMYRHVLHRKVFS

SEQ ID NO: 3078775 - protein, 19 aa, Giardia lamblia
RRANGYSDFILKMALSSQM

SEQ ID NO: 3078776 - protein, 17 aa, Giardia lamblia
RRARPRRQFVGVFCKNI

SEQ ID NO: 3078777 - protein, 23 aa, Giardia lamblia
RRASALEKMKHKLMVAERRKNMQ

SEQ ID NO: 3078778 - protein, 24 aa, Giardia lamblia
RRDPSEIYKSIGLCPQHDAYIPIL

SEQ ID NO: 3078779 - protein, 28 aa, Giardia lamblia
RRDYTILLHLFIKLPVEIRKEVASYWIS

SEQ ID NO: 3078780 - protein, 18 aa, Giardia lamblia
RRELPSLQYGFLADIVSC

SEQ ID NO: 3078781 - protein, 18 aa, Giardia lamblia
RRESCLECSDRLHRNIEN

SEQ ID NO: 3078782 - protein, 25 aa, Giardia lamblia
RREVLKASIFLFHCISPRGWDIREA

SEQ ID NO: 3078783 - protein, 20 aa, Giardia lamblia
RRFCMTHLRSFVDSRHSFTV

SEQ ID NO: 3078784 - protein, 24 aa, Giardia lamblia
RRFEKLKIGVSLLLHKPVFGDLIW

SEQ ID NO: 3078785 - protein, 18 aa, Giardia lamblia
RRFFCGFLEGLTDSLQDD

SEQ ID NO: 3078786 - protein, 20 aa, Giardia lamblia
RRFNSMPSPFLFIPPSYMLC

SEQ ID NO: 3078787 - protein, 41 aa, Giardia lamblia
RRFSSIYTFLHYVPWYFPLDLAKIYCCLTDLTSGHEESISP

SEQ ID NO: 3078788 - protein, 17 aa, Giardia lamblia
RRFYFPNSHDLLYHQYR

SEQ ID NO: 3078789 - protein, 21 aa, Giardia lamblia
RRGFFCPQCNMVSTSDYLLFD

SEQ ID NO: 3078790 - protein, 17 aa, Giardia lamblia
RRGLLGLALAGAFLLIL

SEQ ID NO: 3078791 - protein, 20 aa, Giardia lamblia
RRHALSFLIQHGLTSTDLLH

SEQ ID NO: 3078792 - protein, 24 aa, Giardia lamblia
RRIFPGKTLWKFNFAGTLQSSMVL

SEQ ID NO: 3078793 - protein, 19 aa, Giardia lamblia
RRIFRKSLFISALMVLILQ

SEQ ID NO: 3078794 - protein, 17 aa, Giardia lamblia
RRIMAGEYLVVVSGSVS

SEQ ID NO: 3078795 - protein, 17 aa, Giardia lamblia
RRIPVSARKDFRYNKIL

SEQ ID NO: 3078796 - protein, 26 aa, Giardia lamblia
RRISIVVGLLLFWSLYLIHKVLEAKD

SEQ ID NO: 3078797 - protein, 21 aa, Giardia lamblia
RRITITAMYLLFYFSNYFYLE

SEQ ID NO: 3078798 - protein, 35 aa, Giardia lamblia
RRKIDGVRCACFLRHKPGLIAIGFSSGIIKICNIN

SEQ ID NO: 3078799 - protein, 30 aa, Giardia lamblia
RRKLRILRWELLRPTIVIPVVIYSSLRFFK

SEQ ID NO: 3078800 - protein, 20 aa, Giardia lamblia
RRLADLLLQCNLIDDACAYY

SEQ ID NO: 3078801 - protein, 18 aa, Giardia lamblia
RRLFEFFRKYPGFTDFGE

SEQ ID NO: 3078802 - protein, 19 aa, Giardia lamblia
RRLGVKEIHLLCTNALCLL

SEQ ID NO: 3078803 - protein, 20 aa, Giardia lamblia
RRLLDNNGRTALMYASVGGH

SEQ ID NO: 3078804 - protein, 21 aa, Giardia lamblia
RRLPTERLAHYIASLLGTTIG

SEQ ID NO: 3078805 - protein, 25 aa, Giardia lamblia
RRLRLYEYFKRLEITDLICEQIYTA

SEQ ID NO: 3078806 - protein, 20 aa, Giardia lamblia
RRLSKSKGFRPTRSEVPVSL

SEQ ID NO: 3078807 - protein, 24 aa, Giardia lamblia
RRLTELYNQLLVSYARVFHKLDHV

SEQ ID NO: 3078808 - protein, 17 aa, Giardia lamblia
RRLTIALACVGNPRVIF

SEQ ID NO: 3078809 - protein, 20 aa, Giardia lamblia
RRMLKLAYHLAKPDSHLLVV

SEQ ID NO: 3078810 - protein, 18 aa, Giardia lamblia
RRMRCQRASGVTTKLSSL

SEQ ID NO: 3078811 - protein, 23 aa, Giardia lamblia
RRMSNLRSILSCCGLDTVYSLLR

SEQ ID NO: 3078812 - protein, 18 aa, Giardia lamblia
RRNCGSVVEILCDHESGL

SEQ ID NO: 3078813 - protein, 22 aa, Giardia lamblia
RRNLTYKKLDAFVGELDLIGRL

SEQ ID NO: 3078814 - protein, 26 aa, Giardia lamblia
RRNLVSLSYSNGRIVAFNPTNIRTQT

SEQ ID NO: 3078815 - protein, 21 aa, Giardia lamblia
RRPAISRSWCISDEHRASLDK

SEQ ID NO: 3078816 - protein, 17 aa, Giardia lamblia
RRPSTREILAFDTQIQT

SEQ ID NO: 3078817 - protein, 19 aa, Giardia lamblia
RRQIDISVHIFGSVIADFN

SEQ ID NO: 3078818 - protein, 17 aa, Giardia lamblia
RRQNRILSYKVWIAFIS

SEQ ID NO: 3078819 - protein, 18 aa, Giardia lamblia
RRQSFKLATSSFHAPIYI

SEQ ID NO: 3078820 - protein, 19 aa, Giardia lamblia
RRRALKVLLGLTHNALENN

SEQ ID NO: 3078821 - protein, 27 aa, Giardia lamblia
RRRGQGEFALKCNDKLLVEYSGQFDAD

SEQ ID NO: 3078822 - protein, 18 aa, Giardia lamblia
RRRLNYLAAPYAPEQYTI

SEQ ID NO: 3078823 - protein, 19 aa, Giardia lamblia
RRRLVTFLIGKRQYSICRP

SEQ ID NO: 3078824 - protein, 30 aa, Giardia lamblia
RRRRKLMRPPRVALPGSLTFVADVSYTLLM

SEQ ID NO: 3078825 - protein, 21 aa, Giardia lamblia
RRRSPRPIICVSNHVGLLDIF

SEQ ID NO: 3078826 - protein, 34 aa, Giardia lamblia
RRSEISFEVCIGYPEYLVHPDFRYADKAMQGDVG

SEQ ID NO: 3078827 - protein, 19 aa, Giardia lamblia
RRSFVKLASGNTFRSLLNQ

SEQ ID NO: 3078828 - protein, 34 aa, Giardia lamblia
RRSKFSSWRKYALFRSCYNSCNFTFRYLYDLDTL

SEQ ID NO: 3078829 - protein, 19 aa, Giardia lamblia
RRSMLKIVSLLGGASRGFA

SEQ ID NO: 3078830 - protein, 20 aa, Giardia lamblia
RRSYDGPARITLPFFNTHPY

SEQ ID NO: 3078831 - protein, 24 aa, Giardia lamblia
RRTILSIGLLQFFGAPLIFPYCWA

SEQ ID NO: 3078832 - protein, 17 aa, Giardia lamblia
RRTKLRFSASAIVKILF

SEQ ID NO: 3078833 - protein, 18 aa, Giardia lamblia
RRTLLRTDGDLVIRMRNL

SEQ ID NO: 3078834 - protein, 22 aa, Giardia lamblia
RRTLPKNISALFRIVMMSQAEV

SEQ ID NO: 3078835 - protein, 19 aa, Giardia lamblia
RRVALAPVHVGLSSMLFTE

SEQ ID NO: 3078836 - protein, 23 aa, Giardia lamblia
RRVPVPVPQCVAGLTALSNDVEK

SEQ ID NO: 3078837 - protein, 18 aa, Giardia lamblia
RRVRRKRPQGIHRTIEET

SEQ ID NO: 3078838 - protein, 22 aa, Giardia lamblia
RRVRYSALVIQHMWRTKLYHFE

SEQ ID NO: 3078839 - protein, 20 aa, Giardia lamblia
RRVVLACLHEVYRGLDAETL

SEQ ID NO: 3078840 - protein, 23 aa, Giardia lamblia
RRVVPLEALPLVILNAELGINIT

SEQ ID NO: 3078841 - protein, 19 aa, Giardia lamblia
RRYETLGVLSFACIMGTFA

SEQ ID NO: 3078842 - protein, 22 aa, Giardia lamblia
RSAAKGPSFFRFFRGTKAEIHG

SEQ ID NO: 3078843 - protein, 19 aa, Giardia lamblia
RSACSRIVSELSDLESGLQ

SEQ ID NO: 3078844 - protein, 33 aa, Giardia lamblia
RSAEQYRELTIPFSRVVAIIFYAYSSFRKTLYQ

SEQ ID NO: 3078845 - protein, 24 aa, Giardia lamblia
RSAFNNLILWCITASRAPCMATGI

SEQ ID NO: 3078846 - protein, 21 aa, Giardia lamblia
RSARFPAVPFAFMPLIQGAAQ

SEQ ID NO: 3078847 - protein, 25 aa, Giardia lamblia
RSDEKRLDRFFAMKYYVSAKPFRSL

SEQ ID NO: 3078848 - protein, 17 aa, Giardia lamblia
RSDKKIIVFLSSRDSVE

SEQ ID NO: 3078849 - protein, 25 aa, Giardia lamblia
RSDPGRLATHYSLSVLISRIMTTRL

SEQ ID NO: 3078850 - protein, 25 aa, Giardia lamblia
RSDWMRLLFKMYKYAKLTYDYIDVD

SEQ ID NO: 3078851 - protein, 25 aa, Giardia lamblia
RSEALKSKFQRVCLGATATDEAHMQ

SEQ ID NO: 3078852 - protein, 21 aa, Giardia lamblia
RSELKDAFAAADEFVLGYTSY

SEQ ID NO: 3078853 - protein, 29 aa, Giardia lamblia
RSEVFSLDMFWRLCVTNAISAVLLFVGER

SEQ ID NO: 3078854 - protein, 23 aa, Giardia lamblia
RSFAGLKWKTKLQKFANRLASRS

SEQ ID NO: 3078855 - protein, 20 aa, Giardia lamblia
RSFHSYSMVSLTSWQGSPAA

SEQ ID NO: 3078856 - protein, 32 aa, Giardia lamblia
RSFLRTAQILAVRYNYQLGMHGFNLEVHPTAL

SEQ ID NO: 3078857 - protein, 22 aa, Giardia lamblia
RSFLYKTVLSIFAHRIKTFTDY

SEQ ID NO: 3078858 - protein, 21 aa, Giardia lamblia
RSFPLCIVSNVIDASFACTLS

SEQ ID NO: 3078859 - protein, 17 aa, Giardia lamblia
RSGEVTADFVVSDLSLF

SEQ ID NO: 3078860 - protein, 18 aa, Giardia lamblia
RSGQCAVDFCNVLGATFC

SEQ ID NO: 3078861 - protein, 18 aa, Giardia lamblia
RSHPRIKDTLANELHGPQ

SEQ ID NO: 3078862 - protein, 17 aa, Giardia lamblia
RSIDLCESSKAYLLGAV

SEQ ID NO: 3078863 - protein, 19 aa, Giardia lamblia
RSIICPRDAVLVNELHASN

SEQ ID NO: 3078864 - protein, 17 aa, Giardia lamblia
RSIKRYNIRLSAVQRLN

SEQ ID NO: 3078865 - protein, 19 aa, Giardia lamblia
RSILSFLYPHIKKSAKYSE

SEQ ID NO: 3078866 - protein, 42 aa, Giardia lamblia
RSINKPRGWLRYSTSAFKWPLFKPFLRPLTCKPILEEHVSFL

SEQ ID NO: 3078867 - protein, 17 aa, Giardia lamblia
RSIPGLFSPNFNVVSTP

SEQ ID NO: 3078868 - protein, 20 aa, Giardia lamblia
RSISGMSWVWTLPFCAFMFF

SEQ ID NO: 3078869 - protein, 21 aa, Giardia lamblia
RSIYACLKKVFGDSPDIKKSY

SEQ ID NO: 3078870 - protein, 25 aa, Giardia lamblia
RSIYSAELCDLFAIMCSPDPSVRPS

SEQ ID NO: 3078871 - protein, 17 aa, Giardia lamblia
RSIYVFVKYVRRHEQNV

SEQ ID NO: 3078872 - protein, 23 aa, Giardia lamblia
RSKFFPCPVCNTIESVGSERISK

SEQ ID NO: 3078873 - protein, 23 aa, Giardia lamblia
RSKRELLRSPSLQFIDSDFGVRL

SEQ ID NO: 3078874 - protein, 20 aa, Giardia lamblia
RSKSALLFSLLRIPLFNTTP

SEQ ID NO: 3078875 - protein, 19 aa, Giardia lamblia
RSLFYVFMTVRPVCIFVLM

SEQ ID NO: 3078876 - protein, 25 aa, Giardia lamblia
RSLIFFRSIEVVDRVYSFLFHVKDS

SEQ ID NO: 3078877 - protein, 19 aa, Giardia lamblia
RSLKVLFTLNTRSCLPLQD

SEQ ID NO: 3078878 - protein, 18 aa, Giardia lamblia
RSLLFKLIVANQFASPRN

SEQ ID NO: 3078879 - protein, 20 aa, Giardia lamblia
RSLLFRFALVKNPTYNDLAE

SEQ ID NO: 3078880 - protein, 17 aa, Giardia lamblia
RSLLPTRERLQLFHKRR

SEQ ID NO: 3078881 - protein, 17 aa, Giardia lamblia
RSLLSIKHIEVGESRSA

SEQ ID NO: 3078882 - protein, 19 aa, Giardia lamblia
RSLLSILLPLPRTVTTIVI

SEQ ID NO: 3078883 - protein, 18 aa, Giardia lamblia
RSLPTSLPLVTRGLLGPS

SEQ ID NO: 3078884 - protein, 18 aa, Giardia lamblia
RSLSAKGYSHDYCNALRG

SEQ ID NO: 3078885 - protein, 18 aa, Giardia lamblia
RSLSECDGPLLAHAAKNF

SEQ ID NO: 3078886 - protein, 27 aa, Giardia lamblia
RSLSLVAEIMWRYAQVHTPSVILADDN

SEQ ID NO: 3078887 - protein, 17 aa, Giardia lamblia
RSLTSLNDVSIWTDASV

SEQ ID NO: 3078888 - protein, 24 aa, Giardia lamblia
RSLWSPNNQNIWLLLNAIKTVIEK

SEQ ID NO: 3078889 - protein, 24 aa, Giardia lamblia
RSLYLKGVRSREGEALMLMQPTSE

SEQ ID NO: 3078890 - protein, 20 aa, Giardia lamblia
RSNATLKERVAKILTATERI

SEQ ID NO: 3078891 - protein, 19 aa, Giardia lamblia
RSNGIIVVFVLIPILVAVI

SEQ ID NO: 3078892 - protein, 18 aa, Giardia lamblia
RSNVKVVVLAGSTRSEQS

SEQ ID NO: 3078893 - protein, 23 aa, Giardia lamblia
RSPHLCEHHYKALAELVGCTLPS

SEQ ID NO: 3078894 - protein, 30 aa, Giardia lamblia
RSPLVEALKGYIWTELCSYLKGSGSSAPEW

SEQ ID NO: 3078895 - protein, 18 aa, Giardia lamblia
RSPVCGLTGVTGARFSSG

SEQ ID NO: 3078896 - protein, 19 aa, Giardia lamblia
RSPVWVDLYSYRSLPRFFA

SEQ ID NO: 3078897 - protein, 23 aa, Giardia lamblia
RSQLRFIRICSDLAKTATKLLTT

SEQ ID NO: 3078898 - protein, 23 aa, Giardia lamblia
RSQSPFRCHLQAQKLKNVSQNFV

SEQ ID NO: 3078899 - protein, 24 aa, Giardia lamblia
RSQSRMPCGLSFYDPLDTPHTSLL

SEQ ID NO: 3078900 - protein, 25 aa, Giardia lamblia
RSQVRTRLRTAVSYRDELEEQHAAV

SEQ ID NO: 3078901 - protein, 18 aa, Giardia lamblia
RSRPVSGISSHSHASRLT

SEQ ID NO: 3078902 - protein, 24 aa, Giardia lamblia
RSSAPDFCKTCTDRTQFELSCINR

SEQ ID NO: 3078903 - protein, 19 aa, Giardia lamblia
RSSAVSGLTREMWNNSCGG

SEQ ID NO: 3078904 - protein, 41 aa, Giardia lamblia
RSSCKADSSFSLKAWTRSFFKRAACYINIGIIKIIPPVFRY

SEQ ID NO: 3078905 - protein, 18 aa, Giardia lamblia
RSSNGWTALMWAAHFGRT

SEQ ID NO: 3078906 - protein, 24 aa, Giardia lamblia
RSSPSSLALIFSHIIKTRLMHVID

SEQ ID NO: 3078907 - protein, 18 aa, Giardia lamblia
RSSSAFQHVSSKLGISQS

SEQ ID NO: 3078908 - protein, 22 aa, Giardia lamblia
RSSYLIHSFVFDIQYRVQVVLY

SEQ ID NO: 3078909 - protein, 18 aa, Giardia lamblia
RSTCFAFLGSNGAGKSTT

SEQ ID NO: 3078910 - protein, 18 aa, Giardia lamblia
RSTFMIRDFNLLTIVFTM

SEQ ID NO: 3078911 - protein, 24 aa, Giardia lamblia
RSTRGSGHCLGFFDGIFPEHNVLS

SEQ ID NO: 3078912 - protein, 27 aa, Giardia lamblia
RSTRMIQAWLRGCRARRLVSTCRATLL

SEQ ID NO: 3078913 - protein, 17 aa, Giardia lamblia
RSTYGQWAVIIVAVILA

SEQ ID NO: 3078914 - protein, 26 aa, Giardia lamblia
RSVLSLLCRLCKAISMVSSLDVMGIL

SEQ ID NO: 3078915 - protein, 20 aa, Giardia lamblia
RSVTKLNYFCNLYSPSAGYI

SEQ ID NO: 3078916 - protein, 20 aa, Giardia lamblia
RSVTLKDIFIYLDQGARIQV

SEQ ID NO: 3078917 - protein, 19 aa, Giardia lamblia
RSYINPVVFSILPLFTNVI

SEQ ID NO: 3078918 - protein, 17 aa, Giardia lamblia
RSYLRTTVMVIKYYMSF

SEQ ID NO: 3078919 - protein, 19 aa, Giardia lamblia
RTAFNMVAWPDGWTISDDL

SEQ ID NO: 3078920 - protein, 20 aa, Giardia lamblia
RTAIKNVLKTAAGDAGIDVL

SEQ ID NO: 3078921 - protein, 21 aa, Giardia lamblia
RTALMAAARFGHLSIIRLLSP

SEQ ID NO: 3078922 - protein, 18 aa, Giardia lamblia
RTANRWNHSEVASFLESE

SEQ ID NO: 3078923 - protein, 28 aa, Giardia lamblia
RTCFSIDSSKIWLKYYKVITALAGCPWR

SEQ ID NO: 3078924 - protein, 19 aa, Giardia lamblia
RTCKRPQRRSAISDNNAGA

SEQ ID NO: 3078925 - protein, 25 aa, Giardia lamblia
RTEALIKLLVLNSFKLSSATANHML

SEQ ID NO: 3078926 - protein, 19 aa, Giardia lamblia
RTGPKIYGVLCATSEPDPC

SEQ ID NO: 3078927 - protein, 18 aa, Giardia lamblia
RTHANLRGLHNLVSDDDL

SEQ ID NO: 3078928 - protein, 19 aa, Giardia lamblia
RTIIGNGIIVIPLMPCNYM

SEQ ID NO: 3078929 - protein, 24 aa, Giardia lamblia
RTILHNCFDAFLFRAQQAAITQED

SEQ ID NO: 3078930 - protein, 22 aa, Giardia lamblia
RTIRTFITCCLEITDSEARLQE

SEQ ID NO: 3078931 - protein, 17 aa, Giardia lamblia
RTISRFLALSVQDLGFL

SEQ ID NO: 3078932 - protein, 21 aa, Giardia lamblia
RTKALLPYLYVLVAAIVYIGM

SEQ ID NO: 3078933 - protein, 19 aa, Giardia lamblia
RTKEPRLQFEAALTQFISK

SEQ ID NO: 3078934 - protein, 23 aa, Giardia lamblia
RTKLDLSPLLAHIPFVEASCPLS

SEQ ID NO: 3078935 - protein, 18 aa, Giardia lamblia
RTKNAQFIVISLRNNTFE

SEQ ID NO: 3078936 - protein, 19 aa, Giardia lamblia
RTKYELHLASFSDLRSYLQ

SEQ ID NO: 3078937 - protein, 23 aa, Giardia lamblia
RTLLPHLLLYMSRKREYCPGALK

SEQ ID NO: 3078938 - protein, 19 aa, Giardia lamblia
RTLPLFVERENKVIDTTFK

SEQ ID NO: 3078939 - protein, 22 aa, Giardia lamblia
RTLRSYPHIELLMAIDRVAYGI

SEQ ID NO: 3078940 - protein, 21 aa, Giardia lamblia
RTLVCLIYLYVYIFRGNVRMD

SEQ ID NO: 3078941 - protein, 17 aa, Giardia lamblia
RTMFGTLAWSPRTLESM

SEQ ID NO: 3078942 - protein, 26 aa, Giardia lamblia
RTMIPFSSVIFFYFVASTFKLGNITC

SEQ ID NO: 3078943 - protein, 18 aa, Giardia lamblia
RTNAFWIDILISSLCIMV

SEQ ID NO: 3078944 - protein, 19 aa, Giardia lamblia
RTNELGQLLGIIQANIDEF

SEQ ID NO: 3078945 - protein, 19 aa, Giardia lamblia
RTNHQFKKATASTVPSGEA

SEQ ID NO: 3078946 - protein, 19 aa, Giardia lamblia
RTNYFALFINKLVKRRLEM

SEQ ID NO: 3078947 - protein, 20 aa, Giardia lamblia
RTPFPIRYTGLRIYTSAISD

SEQ ID NO: 3078948 - protein, 19 aa, Giardia lamblia
RTQRLPTRLAQAAAAEQCD

SEQ ID NO: 3078949 - protein, 22 aa, Giardia lamblia
RTQYRCFEYLRLLVAAAGHAFD

SEQ ID NO: 3078950 - protein, 23 aa, Giardia lamblia
RTRLDCLRRYSAVPPPDQIDSIL

SEQ ID NO: 3078951 - protein, 21 aa, Giardia lamblia
RTRLRVHPAIIEKIQNLYAAI

SEQ ID NO: 3078952 - protein, 20 aa, Giardia lamblia
RTRNMLLQFMHHLGSVQDNT

SEQ ID NO: 3078953 - protein, 19 aa, Giardia lamblia
RTSIIGYFMGKWLQNNTTA

SEQ ID NO: 3078954 - protein, 27 aa, Giardia lamblia
RTSPPVLYALCRLRRLPRGGGGRFLGI

SEQ ID NO: 3078955 - protein, 19 aa, Giardia lamblia
RTSTMPVFPSSLKSADWNV

SEQ ID NO: 3078956 - protein, 32 aa, Giardia lamblia
RTTAIPCFGCNGMLRNVTWSVAYYERLLNAKV

SEQ ID NO: 3078957 - protein, 22 aa, Giardia lamblia
RTTFKCLPNAEVLMPIPSNHVL

SEQ ID NO: 3078958 - protein, 18 aa, Giardia lamblia
RTTREGFLHSIIPKQLSK

SEQ ID NO: 3078959 - protein, 19 aa, Giardia lamblia
RTTYREMNVFVYIKKSINM

SEQ ID NO: 3078960 - protein, 19 aa, Giardia lamblia
RTVALHRFLSLVELMSVQV

SEQ ID NO: 3078961 - protein, 32 aa, Giardia lamblia
RTVDSTRFWFADVLAIFGLNLVKCRIIPEKIL

SEQ ID NO: 3078962 - protein, 24 aa, Giardia lamblia
RTVSGVCMIVFFGSMLWYPFYLPY

SEQ ID NO: 3078963 - protein, 20 aa, Giardia lamblia
RTWQYWKPYVLIAVPSIFDM

SEQ ID NO: 3078964 - protein, 18 aa, Giardia lamblia
RTYCKQCNLAGEFPINGL

SEQ ID NO: 3078965 - protein, 17 aa, Giardia lamblia
RTYRIALAHITERVSTE

SEQ ID NO: 3078966 - protein, 18 aa, Giardia lamblia
RVAEYKWFLLSILAHTKS

SEQ ID NO: 3078967 - protein, 24 aa, Giardia lamblia
RVAGCKHFSHSSCLSFNKITSLPK

SEQ ID NO: 3078968 - protein, 17 aa, Giardia lamblia
RVARLLVSIYRKENEMR

SEQ ID NO: 3078969 - protein, 17 aa, Giardia lamblia
RVDDAIVSLSEATRKAE

SEQ ID NO: 3078970 - protein, 18 aa, Giardia lamblia
RVEADWLAELLRILCFSD

SEQ ID NO: 3078971 - protein, 24 aa, Giardia lamblia
RVFSDSRFTRFINYVSASIIEEIS

SEQ ID NO: 3078972 - protein, 29 aa, Giardia lamblia
RVGLEACMRKGVKFIGCIKTLEKEERHSV

SEQ ID NO: 3078973 - protein, 32 aa, Giardia lamblia
RVGLKGYCVPKCFRWLFDIDWSTDQDLMTPSL

SEQ ID NO: 3078974 - protein, 20 aa, Giardia lamblia
RVHSISWLQSCVTLLQNTQS

SEQ ID NO: 3078975 - protein, 19 aa, Giardia lamblia
RVIDLKRAITEFGGVPEER

SEQ ID NO: 3078976 - protein, 24 aa, Giardia lamblia
RVIFSGRITSIWHLKQLLEDRAIK

SEQ ID NO: 3078977 - protein, 18 aa, Giardia lamblia
RVIPVVLDIIVSEVNAKV

SEQ ID NO: 3078978 - protein, 24 aa, Giardia lamblia
RVKNIELWYFLAFFLLTPAVVGVS

SEQ ID NO: 3078979 - protein, 19 aa, Giardia lamblia
RVLATLVMMLKAAVAEAEK

SEQ ID NO: 3078980 - protein, 28 aa, Giardia lamblia
RVLCYPSRVEPSLKWIRIASDIILQRLV

SEQ ID NO: 3078981 - protein, 20 aa, Giardia lamblia
RVLEHLAYIRGYQIYYSSGI

SEQ ID NO: 3078982 - protein, 18 aa, Giardia lamblia
RVLGDLDFTFGEHNADAA

SEQ ID NO: 3078983 - protein, 24 aa, Giardia lamblia
RVLPPRPSTALGVQTTRSPLRSPL

SEQ ID NO: 3078984 - protein, 26 aa, Giardia lamblia
RVLSHFLRAFWIPPHYHYVVYSVLNF

SEQ ID NO: 3078985 - protein, 17 aa, Giardia lamblia
RVLSRLVCMFYQRLEAV

SEQ ID NO: 3078986 - protein, 25 aa, Giardia lamblia
RVMAKSFKYPVVFVDSYHIVIVPEA

SEQ ID NO: 3078987 - protein, 22 aa, Giardia lamblia
RVMCTKCSQGLISLDSSSCVSQ

SEQ ID NO: 3078988 - protein, 22 aa, Giardia lamblia
RVMVRPKFINYFFLIAGALRPK

SEQ ID NO: 3078989 - protein, 20 aa, Giardia lamblia
RVNMTECYDISKGSEIDMAL

SEQ ID NO: 3078990 - protein, 17 aa, Giardia lamblia
RVPSSWTKLAYPSLKPL

SEQ ID NO: 3078991 - protein, 18 aa, Giardia lamblia
RVPVKLRPDVILNQDTAY

SEQ ID NO: 3078992 - protein, 27 aa, Giardia lamblia
RVQDFFKHTELCVALNLDKCRITSCLA

SEQ ID NO: 3078993 - protein, 22 aa, Giardia lamblia
RVQELLCILQEYWREHEQEMAR

SEQ ID NO: 3078994 - protein, 17 aa, Giardia lamblia
RVRAALLEIERAFEMMI

SEQ ID NO: 3078995 - protein, 23 aa, Giardia lamblia
RVRLACRHRRRSAGNTGNFKAVG

SEQ ID NO: 3078996 - protein, 17 aa, Giardia lamblia
RVRPRAGSIRTHHPGEK

SEQ ID NO: 3078997 - protein, 18 aa, Giardia lamblia
RVSLEVENLFKIQSSLYC

SEQ ID NO: 3078998 - protein, 22 aa, Giardia lamblia
RVSNSFGPRARGWKCASSPTSD

SEQ ID NO: 3078999 - protein, 20 aa, Giardia lamblia
RVSTACWLDLVCVLNLDTLN

SEQ ID NO: 3079000 - protein, 20 aa, Giardia lamblia
RVSVDYFNKEICFLVTPSDC

SEQ ID NO: 3079001 - protein, 18 aa, Giardia lamblia
RVSWLFQRAYEKMLSLIE

SEQ ID NO: 3079002 - protein, 23 aa, Giardia lamblia
RVTEALLTLPKRSPFINQCTNLP

SEQ ID NO: 3079003 - protein, 25 aa, Giardia lamblia
RVTFLRPCGFLLFSSFINVENLKDI

SEQ ID NO: 3079004 - protein, 19 aa, Giardia lamblia
RVTGPKAEFPRQATEYLLH

SEQ ID NO: 3079005 - protein, 28 aa, Giardia lamblia
RVTNDIFQFFLYLMKYLKTYRKQLKAFI

SEQ ID NO: 3079006 - protein, 29 aa, Giardia lamblia
RVTSELLIHILELGAYLYGGCPALTGPSG

SEQ ID NO: 3079007 - protein, 28 aa, Giardia lamblia
RVVAIDYRLQRKLSLIVPVKANNENTLL

SEQ ID NO: 3079008 - protein, 26 aa, Giardia lamblia
RVVKVMPPKLALLFLETIVLAGQYVF

SEQ ID NO: 3079009 - protein, 26 aa, Giardia lamblia
RVVPIWYFYCYPKNFLGYETVSFYQY

SEQ ID NO: 3079010 - protein, 24 aa, Giardia lamblia
RVVRRHIIGFAFLGSSVVTALGAC

SEQ ID NO: 3079011 - protein, 22 aa, Giardia lamblia
RVYKRLHLKGKAAGVADRIIWG

SEQ ID NO: 3079012 - protein, 19 aa, Giardia lamblia
RVYRRLRCPLEEKFETFTW

SEQ ID NO: 3079013 - protein, 32 aa, Giardia lamblia
RWCQIYHVDFLYRRAVLLMKREVVVAPLALVR

SEQ ID NO: 3079014 - protein, 19 aa, Giardia lamblia
RWINFSWILSPRLLQSPHV

SEQ ID NO: 3079015 - protein, 22 aa, Giardia lamblia
RWSDSISDFSRCLEINPAHPSA

SEQ ID NO: 3079016 - protein, 25 aa, Giardia lamblia
RYAMSNAEALVFMMAYVTHLFTLPL

SEQ ID NO: 3079017 - protein, 17 aa, Giardia lamblia
RYAQRWTKTYSIPQSSS

SEQ ID NO: 3079018 - protein, 39 aa, Giardia lamblia
RYARYDVIPDYILQFMIQRHVDNLFKLINHLVRARSYYN

SEQ ID NO: 3079019 - protein, 19 aa, Giardia lamblia
RYASSKGIDVRSILVDTCL

SEQ ID NO: 3079020 - protein, 17 aa, Giardia lamblia
RYCGYIFLENVAIIDVL

SEQ ID NO: 3079021 - protein, 24 aa, Giardia lamblia
RYCINIWLIFALFKINAMDLSEPF

SEQ ID NO: 3079022 - protein, 20 aa, Giardia lamblia
RYDAGTVMYSYGWADNGHAS

SEQ ID NO: 3079023 - protein, 19 aa, Giardia lamblia
RYEDAVVMCQLALREWSDY

SEQ ID NO: 3079024 - protein, 19 aa, Giardia lamblia
RYEFHLESLSFYLPLVNFK

SEQ ID NO: 3079025 - protein, 22 aa, Giardia lamblia
RYEYLVCHGLHRLAYQIANAVV

SEQ ID NO: 3079026 - protein, 19 aa, Giardia lamblia
RYFFRTNVSKLLSVLFEAL

SEQ ID NO: 3079027 - protein, 19 aa, Giardia lamblia
RYFFTAGLPLGGYTGAVTD

SEQ ID NO: 3079028 - protein, 24 aa, Giardia lamblia
RYFPYKGGCYEKGTPIGLSICKDV

SEQ ID NO: 3079029 - protein, 20 aa, Giardia lamblia
RYGALTLMYCICTFNSAVIS

SEQ ID NO: 3079030 - protein, 19 aa, Giardia lamblia
RYGKEAPLFTEALPGLLAD

SEQ ID NO: 3079031 - protein, 20 aa, Giardia lamblia
RYGLSTAKLNAFNRCYHETR

SEQ ID NO: 3079032 - protein, 20 aa, Giardia lamblia
RYGQTLCLKSYTVLEDTLAS

SEQ ID NO: 3079033 - protein, 17 aa, Giardia lamblia
RYHFPSFNLAVISFEDP

SEQ ID NO: 3079034 - protein, 20 aa, Giardia lamblia
RYKLPPILDSGLPKARVSED

SEQ ID NO: 3079035 - protein, 19 aa, Giardia lamblia
RYKLVKSIKTLLEVEHETW

SEQ ID NO: 3079036 - protein, 17 aa, Giardia lamblia
RYLCVPAVCVVSETNSS

SEQ ID NO: 3079037 - protein, 26 aa, Giardia lamblia
RYLECGAWLMLYVYKALFRITHIIYA

SEQ ID NO: 3079038 - protein, 21 aa, Giardia lamblia
RYLHVSGPFLLFEVAILPQAK

SEQ ID NO: 3079039 - protein, 21 aa, Giardia lamblia
RYLTRGEVIFLALSEIDIETY

SEQ ID NO: 3079040 - protein, 23 aa, Giardia lamblia
RYMANIDLGLAVFRYLRDTMSDS

SEQ ID NO: 3079041 - protein, 19 aa, Giardia lamblia
RYMQRFTAFIRDFKYYQSF

SEQ ID NO: 3079042 - protein, 26 aa, Giardia lamblia
RYNIRLSAVQRLNFGSVLNISDSQLP

SEQ ID NO: 3079043 - protein, 21 aa, Giardia lamblia
RYNPHYSLAHLIDLYSSGVKP

SEQ ID NO: 3079044 - protein, 25 aa, Giardia lamblia
RYNPVIANSLTWFLKHHAAFVCFSR

SEQ ID NO: 3079045 - protein, 23 aa, Giardia lamblia
RYNRARSITLWGALYATLLNALI

SEQ ID NO: 3079046 - protein, 24 aa, Giardia lamblia
RYPEIADYVLLMLSSRAAFCRASG

SEQ ID NO: 3079047 - protein, 32 aa, Giardia lamblia
RYRMLDLSKAHHKPHLCIRVMFYTTAVILVLF

SEQ ID NO: 3079048 - protein, 18 aa, Giardia lamblia
RYRTVLLYLLGQVNSSPN

SEQ ID NO: 3079049 - protein, 19 aa, Giardia lamblia
RYRVGDFYLDLSSLLPQFA

SEQ ID NO: 3079050 - protein, 18 aa, Giardia lamblia
RYRVTLPTSVKFIENEDN

SEQ ID NO: 3079051 - protein, 19 aa, Giardia lamblia
RYSAILGFNGLLSPTHSFT

SEQ ID NO: 3079052 - protein, 18 aa, Giardia lamblia
RYSFEEFTLQNLILRDTE

SEQ ID NO: 3079053 - protein, 18 aa, Giardia lamblia
RYSKCVPVFQANMFLVAS

SEQ ID NO: 3079054 - protein, 17 aa, Giardia lamblia
RYSLRRILLDYKLLLGM

SEQ ID NO: 3079055 - protein, 18 aa, Giardia lamblia
RYVVPWLQRENVLGQASR

SEQ ID NO: 3079056 - protein, 25 aa, Giardia lamblia
RYVVYKGMLYTGGVLRHVSEATDAM

SEQ ID NO: 3079057 - protein, 26 aa, Giardia lamblia
RYWEHCMMHYMSLFRVVSPWMRGYAS

SEQ ID NO: 3079058 - protein, 22 aa, Giardia lamblia
RYYPLSFVAHLCRGFFCEKSLY

SEQ ID NO: 3079059 - protein, 24 aa, Giardia lamblia
RYYYRAVAIEILFFAYRILSEVIN

SEQ ID NO: 3079060 - protein, 27 aa, Giardia lamblia
SAADKALSMLLGFGFLLFVFAYSIYRI

SEQ ID NO: 3079061 - protein, 25 aa, Giardia lamblia
SAADRTRLTNAFLYCEYAPDQEYKD

SEQ ID NO: 3079062 - protein, 19 aa, Giardia lamblia
SAAGCRRLLFFPNIEGPHE

SEQ ID NO: 3079063 - protein, 23 aa, Giardia lamblia
SAALTLFYYHFFFNPHIVGSAGA

SEQ ID NO: 3079064 - protein, 23 aa, Giardia lamblia
SAAQWSMPSLRCLANAARPDYLC

SEQ ID NO: 3079065 - protein, 25 aa, Giardia lamblia
SAASALRLGKQFKVPVAPYSRELIE

SEQ ID NO: 3079066 - protein, 21 aa, Giardia lamblia
SAASRVGEKMAVYELVNVIGA

SEQ ID NO: 3079067 - protein, 18 aa, Giardia lamblia
SAAVAIAMLVEFRSLSLF

SEQ ID NO: 3079068 - protein, 23 aa, Giardia lamblia
SACTPAIVPFYWELVPVNRRSVT

SEQ ID NO: 3079069 - protein, 19 aa, Giardia lamblia
SADAPRRVKLSLDKDPLPR

SEQ ID NO: 3079070 - protein, 17 aa, Giardia lamblia
SADCHYVRIVSLCDVFS

SEQ ID NO: 3079071 - protein, 25 aa, Giardia lamblia
SADLRKLDCRFGINAGDCMVGVFGC

SEQ ID NO: 3079072 - protein, 19 aa, Giardia lamblia
SADLSCYTKILADLVSRYG

SEQ ID NO: 3079073 - protein, 21 aa, Giardia lamblia
SADPRTSILIDISSIDLEVEP

SEQ ID NO: 3079074 - protein, 25 aa, Giardia lamblia
SADSYRSAIEYAVKYLADHGLQTTY

SEQ ID NO: 3079075 - protein, 25 aa, Giardia lamblia
SAELCLIGRLMVPSVFVKLLDLGKS

SEQ ID NO: 3079076 - protein, 23 aa, Giardia lamblia
SAEQRVQNFFTFFNTSATATPTP

SEQ ID NO: 3079077 - protein, 25 aa, Giardia lamblia
SAFLGICLDSFYPQWDVGAACYLTR

SEQ ID NO: 3079078 - protein, 22 aa, Giardia lamblia
SAFLHGLRLAWIEFNSKFYQAE

SEQ ID NO: 3079079 - protein, 27 aa, Giardia lamblia
SAFMPEFYSLLVMRFITGIALTGMNVT

SEQ ID NO: 3079080 - protein, 26 aa, Giardia lamblia
SAFYRFPFDHSPLFAPETMVSRIHAG

SEQ ID NO: 3079081 - protein, 18 aa, Giardia lamblia
SAGEFGRISALLEETAQD

SEQ ID NO: 3079082 - protein, 25 aa, Giardia lamblia
SAGHKLCAAALWKASNTYPGTSLRL

SEQ ID NO: 3079083 - protein, 17 aa, Giardia lamblia
SAGKECPWQQDSQPAMS

SEQ ID NO: 3079084 - protein, 19 aa, Giardia lamblia
SAGKLCVNLSFGSNILLVI

SEQ ID NO: 3079085 - protein, 24 aa, Giardia lamblia
SAGKLEFVRLLAPHEARMQDNDGY

SEQ ID NO: 3079086 - protein, 26 aa, Giardia lamblia
SAGNTGNFKAVGWADDLGGTEGRTQK

SEQ ID NO: 3079087 - protein, 24 aa, Giardia lamblia
SAGQPCAYDSPSFISFLIQDNLAA

SEQ ID NO: 3079088 - protein, 18 aa, Giardia lamblia
SAHTTINLSHVWCAEHIG

SEQ ID NO: 3079089 - protein, 20 aa, Giardia lamblia
SAIFLFGFPLYRGIPTVISY

SEQ ID NO: 3079090 - protein, 23 aa, Giardia lamblia
SAIIIIVAWIFRFMVADKKYESA

SEQ ID NO: 3079091 - protein, 24 aa, Giardia lamblia
SAIQAEFRKAIILLLNEQYSQCLC

SEQ ID NO: 3079092 - protein, 34 aa, Giardia lamblia
SAIVPKLSERLGLNRVFLAGAFLFAVVTFLMGFL

SEQ ID NO: 3079093 - protein, 23 aa, Giardia lamblia
SAKCIKAYFEHTIFKILEEPDVP

SEQ ID NO: 3079094 - protein, 28 aa, Giardia lamblia
SAKLLADESLCLSSLISESILDGKLPPQ

SEQ ID NO: 3079095 - protein, 17 aa, Giardia lamblia
SAKNLVFSLCFDPLQDV

SEQ ID NO: 3079096 - protein, 17 aa, Giardia lamblia
SALAALFQKRWELPEPM

SEQ ID NO: 3079097 - protein, 29 aa, Giardia lamblia
SALDYAAGEGYLECVQLIVKRQDLTPDDL

SEQ ID NO: 3079098 - protein, 27 aa, Giardia lamblia
SALEFCMRLALVLSCRFQDLKEEVVRY

SEQ ID NO: 3079099 - protein, 29 aa, Giardia lamblia
SALFCSSVCQVFCGCFPLKKSLFKLVTSL

SEQ ID NO: 3079100 - protein, 18 aa, Giardia lamblia
SALFPSRGTLPPLLSDSA

SEQ ID NO: 3079101 - protein, 20 aa, Giardia lamblia
SALIEKLCAIFVANAADQSG

SEQ ID NO: 3079102 - protein, 17 aa, Giardia lamblia
SALNCNFLINFTGCSSV

SEQ ID NO: 3079103 - protein, 19 aa, Giardia lamblia
SALPQEITANCAFNEGSTS

SEQ ID NO: 3079104 - protein, 19 aa, Giardia lamblia
SALQRVRLVASPSTRRRMV

SEQ ID NO: 3079105 - protein, 18 aa, Giardia lamblia
SALSFLSVVLMKVMTSFL

SEQ ID NO: 3079106 - protein, 24 aa, Giardia lamblia
SALSSGLYSRCLQSARKDLINQTQ

SEQ ID NO: 3079107 - protein, 25 aa, Giardia lamblia
SALWSGRGSLSLAFNKKEKSVVGRL

SEQ ID NO: 3079108 - protein, 19 aa, Giardia lamblia
SAMFEELAILSAIQHETDI

SEQ ID NO: 3079109 - protein, 17 aa, Giardia lamblia
SANDFPFIDSIRLARYV

SEQ ID NO: 3079110 - protein, 32 aa, Giardia lamblia
SANFPELLWEKSIGNIFLLIAMYLLASASSTI

SEQ ID NO: 3079111 - protein, 21 aa, Giardia lamblia
SANPELEWAGQLSLIAVSLVA

SEQ ID NO: 3079112 - protein, 21 aa, Giardia lamblia
SANSGPLSWSEKLVREVCLRL

SEQ ID NO: 3079113 - protein, 20 aa, Giardia lamblia
SAPLYSPRTQRFVPIPSNLL

SEQ ID NO: 3079114 - protein, 17 aa, Giardia lamblia
SAPPVWDKLTGVRKPVE

SEQ ID NO: 3079115 - protein, 20 aa, Giardia lamblia
SAPRLRQIILSLITDNASDY

SEQ ID NO: 3079116 - protein, 17 aa, Giardia lamblia
SAPRTAFFSVSFSVTYL

SEQ ID NO: 3079117 - protein, 17 aa, Giardia lamblia
SAPTMRGHISRMLMMSI

SEQ ID NO: 3079118 - protein, 19 aa, Giardia lamblia
SAPTSRKSVLYVLYTLAEF

SEQ ID NO: 3079119 - protein, 25 aa, Giardia lamblia
SAQIPRLVPLLPFNYSFIVVLVLEA

SEQ ID NO: 3079120 - protein, 29 aa, Giardia lamblia
SAQKDKLLCCKKIMYSCLSSKAKELVTNE

SEQ ID NO: 3079121 - protein, 22 aa, Giardia lamblia
SAQYDRPSVVWAISKVFVLLCI

SEQ ID NO: 3079122 - protein, 20 aa, Giardia lamblia
SARISAFGNVFSFLCNTLLG

SEQ ID NO: 3079123 - protein, 42 aa, Giardia lamblia
SASAIVKILFAWCFRMQRLLKGVCLGPWLRKQASTFEETESY

SEQ ID NO: 3079124 - protein, 23 aa, Giardia lamblia
SASARLVLVYAIFGLLVAYLQCA

SEQ ID NO: 3079125 - protein, 17 aa, Giardia lamblia
SASCGVGRECVHGNCVQ

SEQ ID NO: 3079126 - protein, 17 aa, Giardia lamblia
SASCGYATFDVQAPLNH

SEQ ID NO: 3079127 - protein, 18 aa, Giardia lamblia
SASCVTFGNSICNRNAGK

SEQ ID NO: 3079128 - protein, 18 aa, Giardia lamblia
SASFLISLALMGTDGDLD

SEQ ID NO: 3079129 - protein, 20 aa, Giardia lamblia
SASGKLCKAALYNMFEILRA

SEQ ID NO: 3079130 - protein, 27 aa, Giardia lamblia
SASIVEFMTYILLRFAYSVLTRLSIAR

SEQ ID NO: 3079131 - protein, 25 aa, Giardia lamblia
SASLSVPMTPAWVDAMISRFAFEYP

SEQ ID NO: 3079132 - protein, 26 aa, Giardia lamblia
SASRSTEVLNMMSLQANLRVPDTLGH

SEQ ID NO: 3079133 - protein, 17 aa, Giardia lamblia
SASTRKWYWLPRYKFSL

SEQ ID NO: 3079134 - protein, 18 aa, Giardia lamblia
SATCPTVIGPLSRVLVFG

SEQ ID NO: 3079135 - protein, 25 aa, Giardia lamblia
SATDGHAEWALISALFTLSPGADFP

SEQ ID NO: 3079136 - protein, 26 aa, Giardia lamblia
SATLFCVYSLPAVIKEYIIMPANPAF

SEQ ID NO: 3079137 - protein, 19 aa, Giardia lamblia
SATLTCAMKRVMLRYFKEE

SEQ ID NO: 3079138 - protein, 24 aa, Giardia lamblia
SATSCGTCAPGYFLSTSNGVSSCL

SEQ ID NO: 3079139 - protein, 25 aa, Giardia lamblia
SATSSRILMLKALYARLLEHKETLD

SEQ ID NO: 3079140 - protein, 22 aa, Giardia lamblia
SAVKLLPLDVAKVFCMSADGLI

SEQ ID NO: 3079141 - protein, 22 aa, Giardia lamblia
SAVLKSRIFDMAPYTVTNAIPD

SEQ ID NO: 3079142 - protein, 17 aa, Giardia lamblia
SAVSSLLKPPGIQATPE

SEQ ID NO: 3079143 - protein, 18 aa, Giardia lamblia
SAVYKKLFSVPGVYGSLV

SEQ ID NO: 3079144 - protein, 34 aa, Giardia lamblia
SAYIYHILTFIPYRFTSNPAKVITAWKKLLTVSF

SEQ ID NO: 3079145 - protein, 20 aa, Giardia lamblia
SAYLPSRMLVLYDGPEIASK

SEQ ID NO: 3079146 - protein, 17 aa, Giardia lamblia
SCAPGRYIRYGDSGRSC

SEQ ID NO: 3079147 - protein, 34 aa, Giardia lamblia
SCCCCGCCGCLDCFLKYAFRIGVGVGYPSLADFL

SEQ ID NO: 3079148 - protein, 35 aa, Giardia lamblia
SCCCCGCCGCLDCFLKYAFRIGVGVGYPSLADFLT

SEQ ID NO: 3079149 - protein, 17 aa, Giardia lamblia
SCGEASFDFSSNKWTAT

SEQ ID NO: 3079150 - protein, 19 aa, Giardia lamblia
SCGYFTDFITRVIEGGDLY

SEQ ID NO: 3079151 - protein, 22 aa, Giardia lamblia
SCHACMRAGGCIWIDSYSYTSA

SEQ ID NO: 3079152 - protein, 19 aa, Giardia lamblia
SCHKELDGSLTFIVAEPTL

SEQ ID NO: 3079153 - protein, 26 aa, Giardia lamblia
SCHPLLRLGLGCRCLAEKTAVKVIKA

SEQ ID NO: 3079154 - protein, 24 aa, Giardia lamblia
SCILYPPPTLWKGQSLYLNIMRPF

SEQ ID NO: 3079155 - protein, 25 aa, Giardia lamblia
SCIQAFSGWFARVFDTDVGILNLKL

SEQ ID NO: 3079156 - protein, 20 aa, Giardia lamblia
SCIWMSPYYIVIILSTIEKK

SEQ ID NO: 3079157 - protein, 19 aa, Giardia lamblia
SCLDRYLLVNGVCEESCPL

SEQ ID NO: 3079158 - protein, 20 aa, Giardia lamblia
SCLIDCILTPSVRRSSTMTE

SEQ ID NO: 3079159 - protein, 23 aa, Giardia lamblia
SCLLPPMRPVVHISKVNGRSGIG

SEQ ID NO: 3079160 - protein, 19 aa, Giardia lamblia
SCLLPPYGYQLYRANNLLS

SEQ ID NO: 3079161 - protein, 18 aa, Giardia lamblia
SCLTSIFNDLINYLESPS

SEQ ID NO: 3079162 - protein, 24 aa, Giardia lamblia
SCNCTKPGYLHMGSVCIHQSCISQ

SEQ ID NO: 3079163 - protein, 17 aa, Giardia lamblia
SCNGICYQEPATKTTQL

SEQ ID NO: 3079164 - protein, 17 aa, Giardia lamblia
SCNGIVCLSCKDGFTNP

SEQ ID NO: 3079165 - protein, 22 aa, Giardia lamblia
SCPGGLEAFFFILFNLAERRIA

SEQ ID NO: 3079166 - protein, 17 aa, Giardia lamblia
SCPSGICTSCEPGYQLM

SEQ ID NO: 3079167 - protein, 18 aa, Giardia lamblia
SCPVGFYQYSGRCVSSYC

SEQ ID NO: 3079168 - protein, 21 aa, Giardia lamblia
SCQARAPSTIISRRFYTDLRQ

SEQ ID NO: 3079169 - protein, 19 aa, Giardia lamblia
SCRDFCLIALSSVAAKAAG

SEQ ID NO: 3079170 - protein, 24 aa, Giardia lamblia
SCSALPPPHILYLLQCRTEDPNFK

SEQ ID NO: 3079171 - protein, 21 aa, Giardia lamblia
SCSATRPSGCFSDSTDSFYVP

SEQ ID NO: 3079172 - protein, 22 aa, Giardia lamblia
SCSPCTAAGCARCDGGVCTSCK

SEQ ID NO: 3079173 - protein, 23 aa, Giardia lamblia
SCSPCTAAGCARCDGGVCTSCKR

SEQ ID NO: 3079174 - protein, 20 aa, Giardia lamblia
SCSQGWTLHGTLCYPSACVS

SEQ ID NO: 3079175 - protein, 20 aa, Giardia lamblia
SCSSGLCVICPENYFFHEGG

SEQ ID NO: 3079176 - protein, 29 aa, Giardia lamblia
SCSSLDERLVWNIGTLVLKIMTMKPAMSS

SEQ ID NO: 3079177 - protein, 21 aa, Giardia lamblia
SCSYGSIVVMYGVALVGTIRA

SEQ ID NO: 3079178 - protein, 20 aa, Giardia lamblia
SCTACYPGYVLNRSSGDTGT

SEQ ID NO: 3079179 - protein, 20 aa, Giardia lamblia
SCTACYPGYVLSRSSDDTGT

SEQ ID NO: 3079180 - protein, 22 aa, Giardia lamblia
SCTKGLLVLFTRFINLILILYS

SEQ ID NO: 3079181 - protein, 26 aa, Giardia lamblia
SCTKGSLVSYCQWCPTSSHGTPQCLY

SEQ ID NO: 3079182 - protein, 17 aa, Giardia lamblia
SCTLVIFYEEGMSILDL

SEQ ID NO: 3079183 - protein, 20 aa, Giardia lamblia
SCTNRGFYNTVFWVEYDLKR

SEQ ID NO: 3079184 - protein, 23 aa, Giardia lamblia
SCTRCGPRFFLHAGGCYEIGRSP

SEQ ID NO: 3079185 - protein, 21 aa, Giardia lamblia
SCVPVTLLVLHHFSAPRVKIP

SEQ ID NO: 3079186 - protein, 23 aa, Giardia lamblia
SDACMALLKQMRCMCTQLTCYNI

SEQ ID NO: 3079187 - protein, 21 aa, Giardia lamblia
SDAGQSFPFVMSYFQKPSSTI

SEQ ID NO: 3079188 - protein, 24 aa, Giardia lamblia
SDAPRAGSFNALLFLQVLLGILCA

SEQ ID NO: 3079189 - protein, 22 aa, Giardia lamblia
SDARKELLAALRTETLEASLTS

SEQ ID NO: 3079190 - protein, 29 aa, Giardia lamblia
SDARLLVKGNFILVTAWERYVLNQSINYM

SEQ ID NO: 3079191 - protein, 19 aa, Giardia lamblia
SDCQYEYSDIISIEPDSDT

SEQ ID NO: 3079192 - protein, 21 aa, Giardia lamblia
SDCWTHYNFSTDRGFRSESVA

SEQ ID NO: 3079193 - protein, 18 aa, Giardia lamblia
SDFDGGFDRYNYPKLTDV

SEQ ID NO: 3079194 - protein, 24 aa, Giardia lamblia
SDFDYALRLARMIFTRAEKSTQTL

SEQ ID NO: 3079195 - protein, 20 aa, Giardia lamblia
SDFFLIKLADVYGETGNFLA

SEQ ID NO: 3079196 - protein, 18 aa, Giardia lamblia
SDFHKFMLLIFGLLVGLI

SEQ ID NO: 3079197 - protein, 19 aa, Giardia lamblia
SDFILKMALSSQMDEESQT

SEQ ID NO: 3079198 - protein, 30 aa, Giardia lamblia
SDFIPELDLHLFKSVISRILSLSTKQLESA

SEQ ID NO: 3079199 - protein, 17 aa, Giardia lamblia
SDFKYAASVFVLDEKRH

SEQ ID NO: 3079200 - protein, 21 aa, Giardia lamblia
SDGAALCPPLAQGLTLTELLW

SEQ ID NO: 3079201 - protein, 17 aa, Giardia lamblia
SDGDFDTLLTLLNFSTV

SEQ ID NO: 3079202 - protein, 18 aa, Giardia lamblia
SDGQHLLRNVLRNKSTQA

SEQ ID NO: 3079203 - protein, 21 aa, Giardia lamblia
SDGRTALMYACERGMSELINV

SEQ ID NO: 3079204 - protein, 17 aa, Giardia lamblia
SDGSMRFAIAWVRVLEG

SEQ ID NO: 3079205 - protein, 19 aa, Giardia lamblia
SDHGLLIFHLPELAPIITA

SEQ ID NO: 3079206 - protein, 26 aa, Giardia lamblia
SDIDHSFCRLIIWLAGAMPQECSVTT

SEQ ID NO: 3079207 - protein, 17 aa, Giardia lamblia
SDIELSLPSPVLLGFCS

SEQ ID NO: 3079208 - protein, 24 aa, Giardia lamblia
SDIHGRTALMYAVLESNADAVELL

SEQ ID NO: 3079209 - protein, 23 aa, Giardia lamblia
SDIRVFLSRHHTWFCLTEDSSER

SEQ ID NO: 3079210 - protein, 17 aa, Giardia lamblia
SDIWFAAGIINDELKFM

SEQ ID NO: 3079211 - protein, 28 aa, Giardia lamblia
SDKWVELPSRILVVFSLFFLFMLPVMIP

SEQ ID NO: 3079212 - protein, 25 aa, Giardia lamblia
SDLEFKMDFVKALLKRDRSGRDIFY

SEQ ID NO: 3079213 - protein, 20 aa, Giardia lamblia
SDLHRSLSFITPRITYSKDL

SEQ ID NO: 3079214 - protein, 21 aa, Giardia lamblia
SDLIYRLVSAVTEYTGSASSG

SEQ ID NO: 3079215 - protein, 20 aa, Giardia lamblia
SDLKSKFTTLCSGITSSSTD

SEQ ID NO: 3079216 - protein, 19 aa, Giardia lamblia
SDLLYRKLLTLSELSRSSS

SEQ ID NO: 3079217 - protein, 27 aa, Giardia lamblia
SDLPAENGFRWVDGVLLKAVKEGAFIL

SEQ ID NO: 3079218 - protein, 19 aa, Giardia lamblia
SDLVHRAFIYSRFIRSTEQ

SEQ ID NO: 3079219 - protein, 29 aa, Giardia lamblia
SDLYFRVFFSGIFGLKYLKPINRGDLKLL

SEQ ID NO: 3079220 - protein, 21 aa, Giardia lamblia
SDLYTSVCLLCNPHSNSSLPI

SEQ ID NO: 3079221 - protein, 17 aa, Giardia lamblia
SDMLQMFHFAETVRKFM

SEQ ID NO: 3079222 - protein, 17 aa, Giardia lamblia
SDMWAFGVMIFELATGR

SEQ ID NO: 3079223 - protein, 20 aa, Giardia lamblia
SDNLLNFLLSMGVEPFTVRY

SEQ ID NO: 3079224 - protein, 18 aa, Giardia lamblia
SDNLPLTPLFDGLQGTRD

SEQ ID NO: 3079225 - protein, 31 aa, Giardia lamblia
SDNLSGFVLAFGDNVFTVFEVAIGKVPHLAG

SEQ ID NO: 3079226 - protein, 18 aa, Giardia lamblia
SDPIRIAYYHAFPPGTNL

SEQ ID NO: 3079227 - protein, 31 aa, Giardia lamblia
SDPPPRIVIDWRPLMKLFIRQVFIGTSILLT

SEQ ID NO: 3079228 - protein, 25 aa, Giardia lamblia
SDRFRRILSTFVFYLCLGFFTGDGK

SEQ ID NO: 3079229 - protein, 22 aa, Giardia lamblia
SDRGKCGFSERILARTKHFPEN

SEQ ID NO: 3079230 - protein, 29 aa, Giardia lamblia
SDSFPDFYNTLRVFPFRTSLTPFLTAISG

SEQ ID NO: 3079231 - protein, 19 aa, Giardia lamblia
SDSHYFVGYGYYYPSQQKG

SEQ ID NO: 3079232 - protein, 24 aa, Giardia lamblia
SDSPFFLHQQLRGIIISMRNMLYE

SEQ ID NO: 3079233 - protein, 18 aa, Giardia lamblia
SDSRCISCAPGYSPTNGV

SEQ ID NO: 3079234 - protein, 17 aa, Giardia lamblia
SDTCCAISTSGDMFLFG

SEQ ID NO: 3079235 - protein, 25 aa, Giardia lamblia
SDTILRFPLVSSFTSNLSLEYACIP

SEQ ID NO: 3079236 - protein, 37 aa, Giardia lamblia
SDTLDFLALIMILRVSFAMALGIKPEILLTAKSSANT

SEQ ID NO: 3079237 - protein, 24 aa, Giardia lamblia
SDTLRYAFLYSKLFALFITDVVPL

SEQ ID NO: 3079238 - protein, 25 aa, Giardia lamblia
SDTQIRGKFSLAFSALKYSVLIQLG

SEQ ID NO: 3079239 - protein, 31 aa, Giardia lamblia
SDTSIFTYLDFMKKLFTVRVELGVSLQQNVA

SEQ ID NO: 3079240 - protein, 19 aa, Giardia lamblia
SDTSMCIARSTNLVSPNQR

SEQ ID NO: 3079241 - protein, 23 aa, Giardia lamblia
SDVFYFRPIEAVTPIYYLEELGP

SEQ ID NO: 3079242 - protein, 27 aa, Giardia lamblia
SDVILLICIFCWIKVMKDYPHLNYDET

SEQ ID NO: 3079243 - protein, 24 aa, Giardia lamblia
SDYVSRAPLAVAYVNDYISTFPIE

SEQ ID NO: 3079244 - protein, 20 aa, Giardia lamblia
SEAAASHYIIRAAVLIALGI

SEQ ID NO: 3079245 - protein, 22 aa, Giardia lamblia
SEAHSFRLKLMLFVETLYDVFK

SEQ ID NO: 3079246 - protein, 19 aa, Giardia lamblia
SEALALYGLIIALILSTKS

SEQ ID NO: 3079247 - protein, 20 aa, Giardia lamblia
SEALFPINHSLLYSAESAPK

SEQ ID NO: 3079248 - protein, 21 aa, Giardia lamblia
SEARYRPRLLAATVTGLCVLA

SEQ ID NO: 3079249 - protein, 25 aa, Giardia lamblia
SEASGSLFRLWERSGLASEPRSTSL

SEQ ID NO: 3079250 - protein, 19 aa, Giardia lamblia
SECCALFKSIRELDPEDIE

SEQ ID NO: 3079251 - protein, 18 aa, Giardia lamblia
SECPDPFASDFIDPASFI

SEQ ID NO: 3079252 - protein, 19 aa, Giardia lamblia
SEDICNLLNGLLRYEPGNR

SEQ ID NO: 3079253 - protein, 23 aa, Giardia lamblia
SEECVKLLVPHEACISDMNGFTA

SEQ ID NO: 3079254 - protein, 27 aa, Giardia lamblia
SEEQHKEVIGRVLGLFSELTAMQDFSE

SEQ ID NO: 3079255 - protein, 18 aa, Giardia lamblia
SEEYKLDSLAAMNKSQAV

SEQ ID NO: 3079256 - protein, 17 aa, Giardia lamblia
SEGGAFCEHASAMSFNL

SEQ ID NO: 3079257 - protein, 25 aa, Giardia lamblia
SEGLQALLRCLSCSHNNVSNSVLSS

SEQ ID NO: 3079258 - protein, 22 aa, Giardia lamblia
SEGMKQMYYKLGLSANSGPLSW

SEQ ID NO: 3079259 - protein, 38 aa, Giardia lamblia
SEGPWSDVKLMLISNFAFYPAWEAFIINHGIRLGHKSL

SEQ ID NO: 3079260 - protein, 24 aa, Giardia lamblia
SEHMPRFVGSIIMFLVVCVTTVLI

SEQ ID NO: 3079261 - protein, 18 aa, Giardia lamblia
SEHYRSVAQFLIDNVTEN

SEQ ID NO: 3079262 - protein, 25 aa, Giardia lamblia
SEIRGRLTSCLQLGNSLGTFFVYLL

SEQ ID NO: 3079263 - protein, 22 aa, Giardia lamblia
SEIRVVMVLILYFSIWTITPTI

SEQ ID NO: 3079264 - protein, 28 aa, Giardia lamblia
SEKDCLLCDGRDALMLAAQVGNTSAVDA

SEQ ID NO: 3079265 - protein, 22 aa, Giardia lamblia
SELFHFCNDLAYVVGARDMTKK

SEQ ID NO: 3079266 - protein, 28 aa, Giardia lamblia
SELFSSEPGLRCFLMACCGLGDVQCSSA

SEQ ID NO: 3079267 - protein, 23 aa, Giardia lamblia
SELIMLPEMIYRALTQTGAVQTK

SEQ ID NO: 3079268 - protein, 17 aa, Giardia lamblia
SELIRPNTIVKMDDGVY

SEQ ID NO: 3079269 - protein, 22 aa, Giardia lamblia
SELMKMFYGKPGFYIYQVSNLI

SEQ ID NO: 3079270 - protein, 20 aa, Giardia lamblia
SELPGGLATLVGSRGVTLSG

SEQ ID NO: 3079271 - protein, 22 aa, Giardia lamblia
SELPSRLLGDRATFPADLTRAF

SEQ ID NO: 3079272 - protein, 17 aa, Giardia lamblia
SELRAIHTIRRLPSFII

SEQ ID NO: 3079273 - protein, 17 aa, Giardia lamblia
SELRNLYYNPFRTYLQQ

SEQ ID NO: 3079274 - protein, 23 aa, Giardia lamblia
SELYGLRCNVILDKLVDQKYAAA

SEQ ID NO: 3079275 - protein, 23 aa, Giardia lamblia
SELYRIPLALNQASAELFGAFIS

SEQ ID NO: 3079276 - protein, 21 aa, Giardia lamblia
SEMLYSIYFYVLVGDIISTHH

SEQ ID NO: 3079277 - protein, 18 aa, Giardia lamblia
SEMRLGVLCEIQRNEDPQ

SEQ ID NO: 3079278 - protein, 22 aa, Giardia lamblia
SENEVIRAITFVSDNSLALQSG

SEQ ID NO: 3079279 - protein, 19 aa, Giardia lamblia
SEPFLGRWVGRSVEKIRKH

SEQ ID NO: 3079280 - protein, 23 aa, Giardia lamblia
SEQEIVRSCRFCFDNSRCSKLKL

SEQ ID NO: 3079281 - protein, 19 aa, Giardia lamblia
SERAHTRMPGPSYQEIVSA

SEQ ID NO: 3079282 - protein, 40 aa, Giardia lamblia
SERAILPLIMKYSLDKALGYYWHFMLGLPYTGMAVFSFNA

SEQ ID NO: 3079283 - protein, 26 aa, Giardia lamblia
SERAYGNFMCIVFREIMELKLEDMVY

SEQ ID NO: 3079284 - protein, 31 aa, Giardia lamblia
SERFFDSRLLRYCIFLSKYILLYLYPSSILV

SEQ ID NO: 3079285 - protein, 25 aa, Giardia lamblia
SERYQLALANARLKAGMVQEALTIK

SEQ ID NO: 3079286 - protein, 19 aa, Giardia lamblia
SESFVCSLLNAFMTSAVFA

SEQ ID NO: 3079287 - protein, 23 aa, Giardia lamblia
SESGVPCVDFLTNFYKFPTTLQH

SEQ ID NO: 3079288 - protein, 24 aa, Giardia lamblia
SESHRRFRCGPYSFVNTVDISFLS

SEQ ID NO: 3079289 - protein, 30 aa, Giardia lamblia
SESSADYELRCLIVALVVLSCVPAVDYREA

SEQ ID NO: 3079290 - protein, 18 aa, Giardia lamblia
SESYYEINAMRATQADIV

SEQ ID NO: 3079291 - protein, 24 aa, Giardia lamblia
SETDLLRRLSILLILLVRALGDGL

SEQ ID NO: 3079292 - protein, 18 aa, Giardia lamblia
SETFPVEFRRALFKTDTN

SEQ ID NO: 3079293 - protein, 25 aa, Giardia lamblia
SETKKAIGVIACNKLERIFFDCYLH

SEQ ID NO: 3079294 - protein, 17 aa, Giardia lamblia
SETSFSEFFPHHESHCI

SEQ ID NO: 3079295 - protein, 25 aa, Giardia lamblia
SEVEWHPNFRLYLVTKLANPSFSPE

SEQ ID NO: 3079296 - protein, 22 aa, Giardia lamblia
SEVFKPGVISCCLLDFLDAFVL

SEQ ID NO: 3079297 - protein, 18 aa, Giardia lamblia
SEVKAFITELCKRYKTLR

SEQ ID NO: 3079298 - protein, 18 aa, Giardia lamblia
SEVLKLLATPVLVVIRDL

SEQ ID NO: 3079299 - protein, 22 aa, Giardia lamblia
SEVLRPKARFVRQTRRGLDTTT

SEQ ID NO: 3079300 - protein, 25 aa, Giardia lamblia
SEYFPGESYVNWIALQLINDDIHNW

SEQ ID NO: 3079301 - protein, 23 aa, Giardia lamblia
SEYFYPMLVAIVLDADMSSSDMD

SEQ ID NO: 3079302 - protein, 26 aa, Giardia lamblia
SEYIAFCKEKIPPFLLHLYDKSPTRD

SEQ ID NO: 3079303 - protein, 20 aa, Giardia lamblia
SEYPHLRRYSEITMLMDELA

SEQ ID NO: 3079304 - protein, 20 aa, Giardia lamblia
SEYSCCSPSSILSTFQGIRG

SEQ ID NO: 3079305 - protein, 21 aa, Giardia lamblia
SEYVFKPMLILLDGFLEQKEH

SEQ ID NO: 3079306 - protein, 24 aa, Giardia lamblia
SFAAPRLLLKPSLVIAKPKTLAAV

SEQ ID NO: 3079307 - protein, 19 aa, Giardia lamblia
SFAEIFGAVGHQSILLDQC

SEQ ID NO: 3079308 - protein, 25 aa, Giardia lamblia
SFANLRLSMDLPHLPGAPRIVGIDS

SEQ ID NO: 3079309 - protein, 20 aa, Giardia lamblia
SFCEARFGNMADLQFDTMDM

SEQ ID NO: 3079310 - protein, 25 aa, Giardia lamblia
SFCGTPDYLSGEIISGVPHGKMVDI

SEQ ID NO: 3079311 - protein, 26 aa, Giardia lamblia
SFDAVSLPGLPGFLIARQAAYGYSVT

SEQ ID NO: 3079312 - protein, 18 aa, Giardia lamblia
SFDRCVNLLSKIVSIFFM

SEQ ID NO: 3079313 - protein, 17 aa, Giardia lamblia
SFEDLKNYKSLKMQKSN

SEQ ID NO: 3079314 - protein, 19 aa, Giardia lamblia
SFELLDLFQNKDCEESVSG

SEQ ID NO: 3079315 - protein, 18 aa, Giardia lamblia
SFESFYFKINLRRPTPYF

SEQ ID NO: 3079316 - protein, 20 aa, Giardia lamblia
SFEYCYYHVLGGLKRIIECS

SEQ ID NO: 3079317 - protein, 22 aa, Giardia lamblia
SFFRVTLRYAEACSSKRLDTME

SEQ ID NO: 3079318 - protein, 17 aa, Giardia lamblia
SFFYYDIHTKYKFMRPM

SEQ ID NO: 3079319 - protein, 18 aa, Giardia lamblia
SFGGLTMPSAREPLGKKN

SEQ ID NO: 3079320 - protein, 24 aa, Giardia lamblia
SFGHSLVKYLLLPVSGYMVTRGSS

SEQ ID NO: 3079321 - protein, 27 aa, Giardia lamblia
SFHNLHWPSLRGCSGHIPTGIDHSGPW

SEQ ID NO: 3079322 - protein, 22 aa, Giardia lamblia
SFHRSSCMCSTLFYDSGDPVIL

SEQ ID NO: 3079323 - protein, 17 aa, Giardia lamblia
SFIARFSGLTLPLMIGS

SEQ ID NO: 3079324 - protein, 21 aa, Giardia lamblia
SFIIECDRFNTEIAQNAALTI

SEQ ID NO: 3079325 - protein, 20 aa, Giardia lamblia
SFIPARLIGFTTIKRISTLD

SEQ ID NO: 3079326 - protein, 25 aa, Giardia lamblia
SFKEALLAVIYRYVVSPSPRDVLPY

SEQ ID NO: 3079327 - protein, 24 aa, Giardia lamblia
SFKQPPPLVKMVMEAICILVGAKP

SEQ ID NO: 3079328 - protein, 19 aa, Giardia lamblia
SFKSPDYMGPYIVPTIALL

SEQ ID NO: 3079329 - protein, 18 aa, Giardia lamblia
SFLFDFETGVFPQYLMLA

SEQ ID NO: 3079330 - protein, 29 aa, Giardia lamblia
SFLHNFLYWGLIRRRFHLSDYVPLSDSSA

SEQ ID NO: 3079331 - protein, 27 aa, Giardia lamblia
SFLIPQEIICFILSFYRRSQLSVRQLG

SEQ ID NO: 3079332 - protein, 18 aa, Giardia lamblia
SFLPDVRGTESFVIVFAL

SEQ ID NO: 3079333 - protein, 19 aa, Giardia lamblia
SFLTPVIIAILCLLSGLNL

SEQ ID NO: 3079334 - protein, 25 aa, Giardia lamblia
SFLTRTKLGLYISYFNFLVFNFVMF

SEQ ID NO: 3079335 - protein, 21 aa, Giardia lamblia
SFNEKVCFFELSIAQSSNGLF

SEQ ID NO: 3079336 - protein, 22 aa, Giardia lamblia
SFNYSCISVLLSLALSIGVIII

SEQ ID NO: 3079337 - protein, 17 aa, Giardia lamblia
SFPNVINNLDFKVKRGA

SEQ ID NO: 3079338 - protein, 24 aa, Giardia lamblia
SFRSTRDSICLADMDIVIAPNSEL

SEQ ID NO: 3079339 - protein, 21 aa, Giardia lamblia
SFSELMLAPKTWRRDKKSVTK

SEQ ID NO: 3079340 - protein, 23 aa, Giardia lamblia
SFSEYWLNTPFLVNWYTLTMYHF

SEQ ID NO: 3079341 - protein, 26 aa, Giardia lamblia
SFSLMKRLLGSTAMHCIDGGILCALE

SEQ ID NO: 3079342 - protein, 25 aa, Giardia lamblia
SFSVDPRLQWHFSTFSVDFPSDENL

SEQ ID NO: 3079343 - protein, 26 aa, Giardia lamblia
SFTEYPWSGARAIQLLLFLMQLKSVA

SEQ ID NO: 3079344 - protein, 18 aa, Giardia lamblia
SFVFLLRLILPANIHIGL

SEQ ID NO: 3079345 - protein, 18 aa, Giardia lamblia
SFVLIFNFLFKVFSNREM

SEQ ID NO: 3079346 - protein, 26 aa, Giardia lamblia
SFVTAHSLVAVWMLFIMFRKSILDMP

SEQ ID NO: 3079347 - protein, 17 aa, Giardia lamblia
SFYCTENTIYLAYSPNT

SEQ ID NO: 3079348 - protein, 23 aa, Giardia lamblia
SFYRYLFDLMTNWILIVDVWFLP

SEQ ID NO: 3079349 - protein, 17 aa, Giardia lamblia
SGAAVRRGKCHCMGGQV

SEQ ID NO: 3079350 - protein, 24 aa, Giardia lamblia
SGADVPNRVLALLFGENREEYWML

SEQ ID NO: 3079351 - protein, 17 aa, Giardia lamblia
SGALFWAKEIRVEDDTG

SEQ ID NO: 3079352 - protein, 19 aa, Giardia lamblia
SGDESLMFTTPVEAPNVIY

SEQ ID NO: 3079353 - protein, 24 aa, Giardia lamblia
SGECTECLEHFYGHDCKINPCEID

SEQ ID NO: 3079354 - protein, 23 aa, Giardia lamblia
SGFTCSCSYGFFLAEKYCVPNQC

SEQ ID NO: 3079355 - protein, 20 aa, Giardia lamblia
SGFVPKNLGSVIGYLHDGVV

SEQ ID NO: 3079356 - protein, 23 aa, Giardia lamblia
SGGCYPNSCVYLWQNPTDGASYI

SEQ ID NO: 3079357 - protein, 18 aa, Giardia lamblia
SGGLYPRFSQHMYDTVLM

SEQ ID NO: 3079358 - protein, 22 aa, Giardia lamblia
SGGMKRRLTVALSLIGNSHVIF

SEQ ID NO: 3079359 - protein, 20 aa, Giardia lamblia
SGGQKARIALARAVYSDADI

SEQ ID NO: 3079360 - protein, 20 aa, Giardia lamblia
SGGRAGRWSPVYMAGVDILI

SEQ ID NO: 3079361 - protein, 19 aa, Giardia lamblia
SGGSIWPASLRLVRHRHAR

SEQ ID NO: 3079362 - protein, 25 aa, Giardia lamblia
SGHLLSVLYAFWGITGKGEFSDHTI

SEQ ID NO: 3079363 - protein, 24 aa, Giardia lamblia
SGHLPYRLLKSFSEKVGTLTLTVA

SEQ ID NO: 3079364 - protein, 22 aa, Giardia lamblia
SGHPYLRLHPRHGQNVLFTQCN

SEQ ID NO: 3079365 - protein, 25 aa, Giardia lamblia
SGHWNFWGRLGHGMLRTLTIYLLIG

SEQ ID NO: 3079366 - protein, 20 aa, Giardia lamblia
SGILAICLACLFTALLYAHV

SEQ ID NO: 3079367 - protein, 18 aa, Giardia lamblia
SGINLRVSSLGSEYSASF

SEQ ID NO: 3079368 - protein, 30 aa, Giardia lamblia
SGKFLERFGSINMFLCWAFLATLSSLCSAF

SEQ ID NO: 3079369 - protein, 24 aa, Giardia lamblia
SGKTSCLACSVGSYQGLQGAETCI

SEQ ID NO: 3079370 - protein, 17 aa, Giardia lamblia
SGLCVICPENYFFHEGG

SEQ ID NO: 3079371 - protein, 24 aa, Giardia lamblia
SGLDLLTYLPALLLVTLNHQRNPE

SEQ ID NO: 3079372 - protein, 18 aa, Giardia lamblia
SGLELFLSNGWKMVTYKE

SEQ ID NO: 3079373 - protein, 24 aa, Giardia lamblia
SGLESLCLELSMICMKVSAIDDVI

SEQ ID NO: 3079374 - protein, 19 aa, Giardia lamblia
SGLHYACMTGALNVVTTLL

SEQ ID NO: 3079375 - protein, 21 aa, Giardia lamblia
SGLLLSRYSEPNWAHSSVETM

SEQ ID NO: 3079376 - protein, 20 aa, Giardia lamblia
SGLVASFFRIIHQALALQQI

SEQ ID NO: 3079377 - protein, 17 aa, Giardia lamblia
SGNELCYGILDLLQRLK

SEQ ID NO: 3079378 - protein, 25 aa, Giardia lamblia
SGPIEIIKLALLNYHEFEALHPKEG

SEQ ID NO: 3079379 - protein, 23 aa, Giardia lamblia
SGPIICFTLALTLVIPNLTILSS

SEQ ID NO: 3079380 - protein, 23 aa, Giardia lamblia
SGPNWYSSEGWNVLADESGDYCL

SEQ ID NO: 3079381 - protein, 19 aa, Giardia lamblia
SGPVSFVYVVESLDDPAFM

SEQ ID NO: 3079382 - protein, 25 aa, Giardia lamblia
SGQGRLKYMLWLVFFYLGVAITAVF

SEQ ID NO: 3079383 - protein, 19 aa, Giardia lamblia
SGRIYKEYIVASGADKSMF

SEQ ID NO: 3079384 - protein, 26 aa, Giardia lamblia
SGRLISFKTFCLWLLASIVISFMIFV

SEQ ID NO: 3079385 - protein, 26 aa, Giardia lamblia
SGSAEGVCGWSCKGSCAGRTSCGIDG

SEQ ID NO: 3079386 - protein, 23 aa, Giardia lamblia
SGSFYSKCIVFFLLRSRIEENSR

SEQ ID NO: 3079387 - protein, 19 aa, Giardia lamblia
SGSGEMAACFTTVAASSTV

SEQ ID NO: 3079388 - protein, 18 aa, Giardia lamblia
SGSGWPSGMVVTSRSYRR

SEQ ID NO: 3079389 - protein, 24 aa, Giardia lamblia
SGSIAVLTSMGWLILLEFRAGNLL

SEQ ID NO: 3079390 - protein, 19 aa, Giardia lamblia
SGSLLFRKIAHMFKFCSSP

SEQ ID NO: 3079391 - protein, 18 aa, Giardia lamblia
SGSLSFWMAAKIVVVATC

SEQ ID NO: 3079392 - protein, 18 aa, Giardia lamblia
SGSMLRNALLYTEVVFTT

SEQ ID NO: 3079393 - protein, 24 aa, Giardia lamblia
SGSQYAVALFLRKNLSGTIKNVTI

SEQ ID NO: 3079394 - protein, 29 aa, Giardia lamblia
SGSSALPQEVWRFMRLCTGARITCGYGLT

SEQ ID NO: 3079395 - protein, 30 aa, Giardia lamblia
SGSSALPQEVWRFMRLCTGARITCGYGLTE

SEQ ID NO: 3079396 - protein, 22 aa, Giardia lamblia
SGSSCYPIGCGYHDPLDRTTVL

SEQ ID NO: 3079397 - protein, 17 aa, Giardia lamblia
SGTARYDFFPGNVTRDD

SEQ ID NO: 3079398 - protein, 18 aa, Giardia lamblia
SGTCAPCEAGTYSNKTAA

SEQ ID NO: 3079399 - protein, 23 aa, Giardia lamblia
SGTLKTPAFYYVGAFTKGVFHGS

SEQ ID NO: 3079400 - protein, 30 aa, Giardia lamblia
SGTPCLLSRWPRFFFLFDCDINPDWIEAFN

SEQ ID NO: 3079401 - protein, 20 aa, Giardia lamblia
SGVKPAYLVYVLVPLSCCQK

SEQ ID NO: 3079402 - protein, 19 aa, Giardia lamblia
SGVSQMFILFNINKSKPLR

SEQ ID NO: 3079403 - protein, 27 aa, Giardia lamblia
SGVYRLTRHPGYLGWFIWAVSTQVMLA

SEQ ID NO: 3079404 - protein, 20 aa, Giardia lamblia
SGYCTLCVDGFFLDTTSSIH

SEQ ID NO: 3079405 - protein, 24 aa, Giardia lamblia
SGYLAEKLSALSLDELHGHIAHNY

SEQ ID NO: 3079406 - protein, 20 aa, Giardia lamblia
SGYRALRMLDSIPIYNSKAM

SEQ ID NO: 3079407 - protein, 19 aa, Giardia lamblia
SHAAIPSYLLATAQLTSPV

SEQ ID NO: 3079408 - protein, 19 aa, Giardia lamblia
SHALLRMFDQLFGASLHYP

SEQ ID NO: 3079409 - protein, 29 aa, Giardia lamblia
SHASQPAGFLFDWVMSIYGFLKIKAKVQP

SEQ ID NO: 3079410 - protein, 23 aa, Giardia lamblia
SHDALCADLALYHGLSPAGDTEN

SEQ ID NO: 3079411 - protein, 20 aa, Giardia lamblia
SHFFICKQAKLKAEQENRTR

SEQ ID NO: 3079412 - protein, 26 aa, Giardia lamblia
SHFYYYKRIHFYFSLLVALLTSLVVS

SEQ ID NO: 3079413 - protein, 24 aa, Giardia lamblia
SHHCGVCSRCVLDFDHHCIWTNSC

SEQ ID NO: 3079414 - protein, 17 aa, Giardia lamblia
SHHSYVSLIGLIIVVSQ

SEQ ID NO: 3079415 - protein, 23 aa, Giardia lamblia
SHIKRVAITDGRFYVALENICLC

SEQ ID NO: 3079416 - protein, 26 aa, Giardia lamblia
SHINISKEVLCQFLLSVTSLAPGDEQ

SEQ ID NO: 3079417 - protein, 18 aa, Giardia lamblia
SHIRSYINPVVFSILPLF

SEQ ID NO: 3079418 - protein, 21 aa, Giardia lamblia
SHKCAHFDGYITYFPSTPAAL

SEQ ID NO: 3079419 - protein, 22 aa, Giardia lamblia
SHLEYFSNALLFIATLLVTIEQ

SEQ ID NO: 3079420 - protein, 17 aa, Giardia lamblia
SHLNFPTLGLWNKVTGV

SEQ ID NO: 3079421 - protein, 20 aa, Giardia lamblia
SHLRTAIVGYPILRGKIVTL

SEQ ID NO: 3079422 - protein, 25 aa, Giardia lamblia
SHLTIAWPSSIAFRTNPEENAETVM

SEQ ID NO: 3079423 - protein, 22 aa, Giardia lamblia
SHMWYNYCGGVGDCIQKKDKSG

SEQ ID NO: 3079424 - protein, 25 aa, Giardia lamblia
SHNISRLRLADIFHRNLPAYCEGLL

SEQ ID NO: 3079425 - protein, 36 aa, Giardia lamblia
SHPLIPLPLLACRLVITGLLLHRGFARYNSTPRSNI

SEQ ID NO: 3079426 - protein, 28 aa, Giardia lamblia
SHPVVRLRMRYLFRFFIDCEASENPVYT

SEQ ID NO: 3079427 - protein, 26 aa, Giardia lamblia
SHQKQCYCAPEILLHLQYSDKSEMWS

SEQ ID NO: 3079428 - protein, 18 aa, Giardia lamblia
SHRNRFVANMIKENSPNK

SEQ ID NO: 3079429 - protein, 17 aa, Giardia lamblia
SHSIPYSLARFSEVASY

SEQ ID NO: 3079430 - protein, 24 aa, Giardia lamblia
SHTKRLERDLTFLAASAIEDRLAD

SEQ ID NO: 3079431 - protein, 19 aa, Giardia lamblia
SHTLHFWVTVSSVVFAALL

SEQ ID NO: 3079432 - protein, 26 aa, Giardia lamblia
SHTMRLKAARLISALRSKSVALLLTD

SEQ ID NO: 3079433 - protein, 29 aa, Giardia lamblia
SHTPCEFLWRVLIPLVIHVLNGLFVRSYL

SEQ ID NO: 3079434 - protein, 28 aa, Giardia lamblia
SHTRTFARHLLKLSDWVSDTTVLLHEYC

SEQ ID NO: 3079435 - protein, 23 aa, Giardia lamblia
SHTSFYLSLPLMDIYLRLTTAVR

SEQ ID NO: 3079436 - protein, 20 aa, Giardia lamblia
SHVNLTFAFTTLRSRLLPAL

SEQ ID NO: 3079437 - protein, 18 aa, Giardia lamblia
SHYQRILEYYIKLYSSVR

SEQ ID NO: 3079438 - protein, 18 aa, Giardia lamblia
SIAAMKATGASIFQKYNR

SEQ ID NO: 3079439 - protein, 20 aa, Giardia lamblia
SIADGLKVIFTIDYPSFREA

SEQ ID NO: 3079440 - protein, 25 aa, Giardia lamblia
SIAEPYPQLSAFLLAFIMGCHLTLA

SEQ ID NO: 3079441 - protein, 25 aa, Giardia lamblia
SIALIHEFLCIFLYCTSLGFVGEFE

SEQ ID NO: 3079442 - protein, 22 aa, Giardia lamblia
SIDKWKRFIGQDIHKRQDSVSG

SEQ ID NO: 3079443 - protein, 27 aa, Giardia lamblia
SIEDERRLRAAIAIRAPFYTTLLVEWL

SEQ ID NO: 3079444 - protein, 19 aa, Giardia lamblia
SIEEMHRVLLFSMYEAVHG

SEQ ID NO: 3079445 - protein, 28 aa, Giardia lamblia
SIEKLRFISELFQYASADFFRSTEMLTL

SEQ ID NO: 3079446 - protein, 21 aa, Giardia lamblia
SIELLGVLLVRSSVIKADSLS

SEQ ID NO: 3079447 - protein, 24 aa, Giardia lamblia
SIERLCRQHYFRPPVAGLEDPVRR

SEQ ID NO: 3079448 - protein, 18 aa, Giardia lamblia
SIFAKFVNELNCYQTEMH

SEQ ID NO: 3079449 - protein, 25 aa, Giardia lamblia
SIGDEFILSLAYLDWLFSLPPTLPL

SEQ ID NO: 3079450 - protein, 25 aa, Giardia lamblia
SIGLPRRYSVAGVYIANHPANIPLL

SEQ ID NO: 3079451 - protein, 30 aa, Giardia lamblia
SIHIPVCVVCLSFAIFPFIRPLLYEHCAWF

SEQ ID NO: 3079452 - protein, 18 aa, Giardia lamblia
SIIFPPIFLLFLVIFSRR

SEQ ID NO: 3079453 - protein, 29 aa, Giardia lamblia
SIILTELLLIILLKLAKFSYRKKKESIDA

SEQ ID NO: 3079454 - protein, 20 aa, Giardia lamblia
SIIRYLLRRTPLQIEHDAIL

SEQ ID NO: 3079455 - protein, 17 aa, Giardia lamblia
SIISKFHINEMITLQLL

SEQ ID NO: 3079456 - protein, 18 aa, Giardia lamblia
SIISYIYRCYVFDAIPAY

SEQ ID NO: 3079457 - protein, 21 aa, Giardia lamblia
SIKSYRCLRPSNILLTEDDII

SEQ ID NO: 3079458 - protein, 24 aa, Giardia lamblia
SIKVHPNFRLFISYAPTSDISRAL

SEQ ID NO: 3079459 - protein, 23 aa, Giardia lamblia
SILIPFNIDAMFAFFEATGQLVH

SEQ ID NO: 3079460 - protein, 22 aa, Giardia lamblia
SILKKNGWVYLKLNCNRQLPAW

SEQ ID NO: 3079461 - protein, 20 aa, Giardia lamblia
SILLCGIPIIMPSDTRTISK

SEQ ID NO: 3079462 - protein, 17 aa, Giardia lamblia
SILMGRSLRASMMNIDG

SEQ ID NO: 3079463 - protein, 19 aa, Giardia lamblia
SILPFVVNCGVPDMMAGAD

SEQ ID NO: 3079464 - protein, 17 aa, Giardia lamblia
SILSYRSAYLQKLNSVA

SEQ ID NO: 3079465 - protein, 19 aa, Giardia lamblia
SIMEFLRTVVYREKFQPEV

SEQ ID NO: 3079466 - protein, 35 aa, Giardia lamblia
SIMNEVRILSRLLHPFIVKYYYSWIETTSDTVQNA

SEQ ID NO: 3079467 - protein, 18 aa, Giardia lamblia
SIMSFSMFIHAFVRIFFF

SEQ ID NO: 3079468 - protein, 20 aa, Giardia lamblia
SINCGGFNASLFTEDAPGTI

SEQ ID NO: 3079469 - protein, 22 aa, Giardia lamblia
SINKWYALIPVFGPVSILTQLQ

SEQ ID NO: 3079470 - protein, 22 aa, Giardia lamblia
SIPCISSSYSLGLYRMIQNLPF

SEQ ID NO: 3079471 - protein, 21 aa, Giardia lamblia
SIPEEYRKVFVSNVSIDLLCN

SEQ ID NO: 3079472 - protein, 25 aa, Giardia lamblia
SIPISATLAPVVWIMIFMTFSISFP

SEQ ID NO: 3079473 - protein, 21 aa, Giardia lamblia
SIQSAPVLNTWAARSRSEVTS

SEQ ID NO: 3079474 - protein, 24 aa, Giardia lamblia
SIRNHATLILISWMNYLYTKLNNL

SEQ ID NO: 3079475 - protein, 26 aa, Giardia lamblia
SIRNMLRPGILSGYLCKSLNMQSVVL

SEQ ID NO: 3079476 - protein, 19 aa, Giardia lamblia
SIRSFGFLAGDAVDPYLYN

SEQ ID NO: 3079477 - protein, 23 aa, Giardia lamblia
SISACDDIACYLAVIADRLATSH

SEQ ID NO: 3079478 - protein, 24 aa, Giardia lamblia
SISFACYVRDLWNVQSRDSSFAKN

SEQ ID NO: 3079479 - protein, 19 aa, Giardia lamblia
SISKQLKGSPSMIYTLQAA

SEQ ID NO: 3079480 - protein, 21 aa, Giardia lamblia
SISMSLLMTVWAFLQANTLFL

SEQ ID NO: 3079481 - protein, 22 aa, Giardia lamblia
SISPWFALIPFFGPISVHSQLQ

SEQ ID NO: 3079482 - protein, 23 aa, Giardia lamblia
SISRIRLFLINALQASASAPADA

SEQ ID NO: 3079483 - protein, 20 aa, Giardia lamblia
SISTIRSSFVYSNWTSTADQ

SEQ ID NO: 3079484 - protein, 18 aa, Giardia lamblia
SITEKFACCTFMKSTGTC

SEQ ID NO: 3079485 - protein, 21 aa, Giardia lamblia
SITGLRASLQATLLVEHPQTG

SEQ ID NO: 3079486 - protein, 22 aa, Giardia lamblia
SITPHACLYPLLTETPSSLISN

SEQ ID NO: 3079487 - protein, 25 aa, Giardia lamblia
SIVALICVFSSLFGGLNGLKLNTPV

SEQ ID NO: 3079488 - protein, 33 aa, Giardia lamblia
SIVCVLVPLVIRYKLPYLRRMSAGRNIDLCAIA

SEQ ID NO: 3079489 - protein, 24 aa, Giardia lamblia
SIVHLPSMYLFQIVSIMVDAVEAD

SEQ ID NO: 3079490 - protein, 23 aa, Giardia lamblia
SIVNRFNILYVYRPLSDSEMSAA

SEQ ID NO: 3079491 - protein, 35 aa, Giardia lamblia
SIVTRFNRFRSLLCTSPEYRSLLDVYTRTNLLLKL

SEQ ID NO: 3079492 - protein, 23 aa, Giardia lamblia
SIWGNCVQFELGLFECLKNRKIM

SEQ ID NO: 3079493 - protein, 18 aa, Giardia lamblia
SIWLPSAAYGLFISSAPQ

SEQ ID NO: 3079494 - protein, 19 aa, Giardia lamblia
SIWMSLCALFSFTPLSLLQ

SEQ ID NO: 3079495 - protein, 19 aa, Giardia lamblia
SIYDLTKALLLKASPRHYT

SEQ ID NO: 3079496 - protein, 26 aa, Giardia lamblia
SIYPIQLVPCYKFYTLGRSYIENATN

SEQ ID NO: 3079497 - protein, 24 aa, Giardia lamblia
SKAKAGYFEACFAPCVVAQKLNIL

SEQ ID NO: 3079498 - protein, 18 aa, Giardia lamblia
SKAPGRWPNNSIPGMNYV

SEQ ID NO: 3079499 - protein, 25 aa, Giardia lamblia
SKCGPMFIPRIHVFARMTPEQKADI

SEQ ID NO: 3079500 - protein, 25 aa, Giardia lamblia
SKDFARSLGRFCIVLNCTEALDYST

SEQ ID NO: 3079501 - protein, 19 aa, Giardia lamblia
SKDYLYWHVAKALTKYLKA

SEQ ID NO: 3079502 - protein, 23 aa, Giardia lamblia
SKEAATRFWAIRAIATATRTILI

SEQ ID NO: 3079503 - protein, 31 aa, Giardia lamblia
SKEGVFVLTCKMCKERYTYKYGLLDTPNEAH

SEQ ID NO: 3079504 - protein, 19 aa, Giardia lamblia
SKELAAFVLDICLLPLGIT

SEQ ID NO: 3079505 - protein, 46 aa, Giardia lamblia
SKELTCSAFAACYYRKLMRKNLLSLRSIRQFYRCIQPVCNLLDIQF

SEQ ID NO: 3079506 - protein, 23 aa, Giardia lamblia
SKETGRPTLIWVDNILQCNSMLQ

SEQ ID NO: 3079507 - protein, 23 aa, Giardia lamblia
SKEVKLDSTLILNEDLLKRLDAT

SEQ ID NO: 3079508 - protein, 25 aa, Giardia lamblia
SKFGEARMPLHLPVKRLLKDPSATS

SEQ ID NO: 3079509 - protein, 23 aa, Giardia lamblia
SKFIEFSESLGLGIVSSKTSDPK

SEQ ID NO: 3079510 - protein, 19 aa, Giardia lamblia
SKGEPLPSLSIVPNTNLGT

SEQ ID NO: 3079511 - protein, 26 aa, Giardia lamblia
SKGNEFKSILFALIFFHAIVIERRKF

SEQ ID NO: 3079512 - protein, 24 aa, Giardia lamblia
SKGNLEACRMLLPVEGRMQNKEGR

SEQ ID NO: 3079513 - protein, 17 aa, Giardia lamblia
SKGSAFFSNRPRYFYSL

SEQ ID NO: 3079514 - protein, 23 aa, Giardia lamblia
SKGVCLQTILTFAAMASYFANSM

SEQ ID NO: 3079515 - protein, 19 aa, Giardia lamblia
SKHLATVRSLKPCSPLLEE

SEQ ID NO: 3079516 - protein, 17 aa, Giardia lamblia
SKICGGIGVCVRDDTEY

SEQ ID NO: 3079517 - protein, 20 aa, Giardia lamblia
SKILKLAVSSAFVVFAYATK

SEQ ID NO: 3079518 - protein, 22 aa, Giardia lamblia
SKISSRDGLLCERYGKDEDDLM

SEQ ID NO: 3079519 - protein, 17 aa, Giardia lamblia
SKISTGINFNGLQFHCV

SEQ ID NO: 3079520 - protein, 26 aa, Giardia lamblia
SKKEIIIKCSMSYHQARLYKTVQQQF

SEQ ID NO: 3079521 - protein, 24 aa, Giardia lamblia
SKKISVKFMALWLINSVPIHVLSC

SEQ ID NO: 3079522 - protein, 26 aa, Giardia lamblia
SKKKVAAKVPVWQRLISPAMMLVSMF

SEQ ID NO: 3079523 - protein, 18 aa, Giardia lamblia
SKLFCLLADRIVDDSRAK

SEQ ID NO: 3079524 - protein, 18 aa, Giardia lamblia
SKLFFGSPELNYIQSRVT

SEQ ID NO: 3079525 - protein, 22 aa, Giardia lamblia
SKLFSLASAYQFVGKTKESSRC

SEQ ID NO: 3079526 - protein, 23 aa, Giardia lamblia
SKLIRHVAFLIAKYTLVDPDPSS

SEQ ID NO: 3079527 - protein, 17 aa, Giardia lamblia
SKLMGRMILRSDNRSVG

SEQ ID NO: 3079528 - protein, 24 aa, Giardia lamblia
SKLPDVKTGLSLLSTVQLLVDPAT

SEQ ID NO: 3079529 - protein, 23 aa, Giardia lamblia
SKLQRILAQLSREFTLSTLDRLA

SEQ ID NO: 3079530 - protein, 26 aa, Giardia lamblia
SKLRTHCMLEYSTLVGCLLEKVSISL

SEQ ID NO: 3079531 - protein, 23 aa, Giardia lamblia
SKLSRIGIFSTLFIMITVASTAV

SEQ ID NO: 3079532 - protein, 18 aa, Giardia lamblia
SKLSSWKFSLSSLNSSKL

SEQ ID NO: 3079533 - protein, 27 aa, Giardia lamblia
SKLTNGLCFRKGMKILSRESPRLKVLY

SEQ ID NO: 3079534 - protein, 25 aa, Giardia lamblia
SKLYFEYYLLPGMVVKRMLIDQLSC

SEQ ID NO: 3079535 - protein, 24 aa, Giardia lamblia
SKMPNRFPNVIFYSPRELGGLGML

SEQ ID NO: 3079536 - protein, 18 aa, Giardia lamblia
SKNKVCVVAGGKADPSAT

SEQ ID NO: 3079537 - protein, 17 aa, Giardia lamblia
SKPEVMELWVHIIILLH

SEQ ID NO: 3079538 - protein, 19 aa, Giardia lamblia
SKPTAIDHHNIFPLRALFI

SEQ ID NO: 3079539 - protein, 17 aa, Giardia lamblia
SKQASLGLRPERSESSS

SEQ ID NO: 3079540 - protein, 30 aa, Giardia lamblia
SKQKKLAYICLILDMLDCEVLRAFLDAPKE

SEQ ID NO: 3079541 - protein, 18 aa, Giardia lamblia
SKRHKLRHYCLMVFLRCL

SEQ ID NO: 3079542 - protein, 34 aa, Giardia lamblia
SKRRYFCQIKELYHECLHNLPFVGEPVLLSNKRI

SEQ ID NO: 3079543 - protein, 23 aa, Giardia lamblia
SKRSASSFLCLSAIVKDSDPDSL

SEQ ID NO: 3079544 - protein, 20 aa, Giardia lamblia
SKRSIVLLMRDRIEYIHSDL

SEQ ID NO: 3079545 - protein, 28 aa, Giardia lamblia
SKSIFKELRRYISIYSPRYLGIRSTLSQ

SEQ ID NO: 3079546 - protein, 18 aa, Giardia lamblia
SKSLINLFRAFVSCSAQT

SEQ ID NO: 3079547 - protein, 25 aa, Giardia lamblia
SKSVAAAGICEWARNIVSYNEIYKI

SEQ ID NO: 3079548 - protein, 17 aa, Giardia lamblia
SKTFWKLVEIQLSCFSI

SEQ ID NO: 3079549 - protein, 21 aa, Giardia lamblia
SKTHCISGYFGGKTIHCAVQL

SEQ ID NO: 3079550 - protein, 20 aa, Giardia lamblia
SKTPSTKCSLSLSKDSLLSS

SEQ ID NO: 3079551 - protein, 18 aa, Giardia lamblia
SKVNAIVVLAGRDVTIDT

SEQ ID NO: 3079552 - protein, 20 aa, Giardia lamblia
SKVSAALELQSLEARLRTVS

SEQ ID NO: 3079553 - protein, 19 aa, Giardia lamblia
SKYCSRCKAGYVPVDGVCV

SEQ ID NO: 3079554 - protein, 25 aa, Giardia lamblia
SKYKSNRHAFHWNRNVFPGCGEGLV

SEQ ID NO: 3079555 - protein, 25 aa, Giardia lamblia
SKYLAPRLLNYVTLFGQMHQLAPQF

SEQ ID NO: 3079556 - protein, 22 aa, Giardia lamblia
SKYYLCKSPVYSPNYLRLTSWK

SEQ ID NO: 3079557 - protein, 20 aa, Giardia lamblia
SLAARGIYYTRIDFSFRKSV

SEQ ID NO: 3079558 - protein, 17 aa, Giardia lamblia
SLADAKILTGIAWIPEQ

SEQ ID NO: 3079559 - protein, 18 aa, Giardia lamblia
SLAFYISWTHPSVSLHLD

SEQ ID NO: 3079560 - protein, 25 aa, Giardia lamblia
SLAMGKLSPIGPWGILTSSDTAAFA

SEQ ID NO: 3079561 - protein, 25 aa, Giardia lamblia
SLARASYNYTLCPRCASDIASYKVT

SEQ ID NO: 3079562 - protein, 27 aa, Giardia lamblia
SLCADGISLLSARRGRAISQITRRELQ

SEQ ID NO: 3079563 - protein, 20 aa, Giardia lamblia
SLCFRGMILTGDLSQIVYPR

SEQ ID NO: 3079564 - protein, 18 aa, Giardia lamblia
SLCGSPMVFIFPGMFGYS

SEQ ID NO: 3079565 - protein, 17 aa, Giardia lamblia
SLCRPCHASCFSCNGPG

SEQ ID NO: 3079566 - protein, 19 aa, Giardia lamblia
SLCSGVDWSGSKASKGMRV

SEQ ID NO: 3079567 - protein, 21 aa, Giardia lamblia
SLDLLEFGIIFVVTLNSVAHA

SEQ ID NO: 3079568 - protein, 25 aa, Giardia lamblia
SLDLNRVLGCSNYLYSKSVGMESPT

SEQ ID NO: 3079569 - protein, 22 aa, Giardia lamblia
SLDNIILCPYQFGGGQRAAETL

SEQ ID NO: 3079570 - protein, 22 aa, Giardia lamblia
SLDPRRMHETPARISEDDILSA

SEQ ID NO: 3079571 - protein, 30 aa, Giardia lamblia
SLDTTELFPDFFPRKNRPSALVGTLGTFIS

SEQ ID NO: 3079572 - protein, 21 aa, Giardia lamblia
SLEALPLGCYVDTLFTHENIE

SEQ ID NO: 3079573 - protein, 22 aa, Giardia lamblia
SLEELWALLHFVMPELFERKDD

SEQ ID NO: 3079574 - protein, 25 aa, Giardia lamblia
SLEGLRSVVGYVRYHFPSFNLAVIS

SEQ ID NO: 3079575 - protein, 25 aa, Giardia lamblia
SLEKERFSLELLLFRVENVTEKFND

SEQ ID NO: 3079576 - protein, 19 aa, Giardia lamblia
SLFDLEWLSSSSIISYYNT

SEQ ID NO: 3079577 - protein, 18 aa, Giardia lamblia
SLFFKEVTEILKAQMKDQ

SEQ ID NO: 3079578 - protein, 26 aa, Giardia lamblia
SLFKHSCLYTCLFIQFLLNDNKNLFH

SEQ ID NO: 3079579 - protein, 25 aa, Giardia lamblia
SLFKSARTMLPIAMKTLNNKYLKKI

SEQ ID NO: 3079580 - protein, 19 aa, Giardia lamblia
SLFLGKRRWNALSYSANSS

SEQ ID NO: 3079581 - protein, 19 aa, Giardia lamblia
SLFLLLTLLFSFGHAIFPT

SEQ ID NO: 3079582 - protein, 18 aa, Giardia lamblia
SLGALPSIRAYSFESHFI

SEQ ID NO: 3079583 - protein, 19 aa, Giardia lamblia
SLGALPSIRAYSFESHFIA

SEQ ID NO: 3079584 - protein, 19 aa, Giardia lamblia
SLGGSSCRQAYIPIDAIER

SEQ ID NO: 3079585 - protein, 25 aa, Giardia lamblia
SLGSAHPRLRKAFLSSQDPLLEVVS

SEQ ID NO: 3079586 - protein, 23 aa, Giardia lamblia
SLGTPLVLVFGFLFTLELLHLEP

SEQ ID NO: 3079587 - protein, 17 aa, Giardia lamblia
SLHARRFCMTHLRSFVD

SEQ ID NO: 3079588 - protein, 26 aa, Giardia lamblia
SLHIARADSILGVFSDTILRFPLVSS

SEQ ID NO: 3079589 - protein, 25 aa, Giardia lamblia
SLHKTRQSYAFARNCFSAENKPADY

SEQ ID NO: 3079590 - protein, 26 aa, Giardia lamblia
SLHNYKRLYALIKYSWLYCTVATAAV

SEQ ID NO: 3079591 - protein, 24 aa, Giardia lamblia
SLHQRPRVAGLERDNASLLQTNFI

SEQ ID NO: 3079592 - protein, 23 aa, Giardia lamblia
SLHTYPFALGILGPYCKTIPLFI

SEQ ID NO: 3079593 - protein, 18 aa, Giardia lamblia
SLHWQFQNIRSMVICAEG

SEQ ID NO: 3079594 - protein, 18 aa, Giardia lamblia
SLIAPRYQQVLFSKEVPY

SEQ ID NO: 3079595 - protein, 24 aa, Giardia lamblia
SLICCSTALRKLRLLNKCDYCSRG

SEQ ID NO: 3079596 - protein, 29 aa, Giardia lamblia
SLIIKCIRLEELFLISALAVLRRMPLAFK

SEQ ID NO: 3079597 - protein, 26 aa, Giardia lamblia
SLIITKARFSWMQVMFSCFATGFAIL

SEQ ID NO: 3079598 - protein, 18 aa, Giardia lamblia
SLIPSASVLVCYQTAADT

SEQ ID NO: 3079599 - protein, 29 aa, Giardia lamblia
SLISACTLFGFHHLGLFTAMLDASFGKTK

SEQ ID NO: 3079600 - protein, 19 aa, Giardia lamblia
SLISELYIYCVLKGRTEMC

SEQ ID NO: 3079601 - protein, 19 aa, Giardia lamblia
SLITPELLLLAAWTIQPSL

SEQ ID NO: 3079602 - protein, 24 aa, Giardia lamblia
SLIVCLLAFGIKHRILVSEQNAAT

SEQ ID NO: 3079603 - protein, 17 aa, Giardia lamblia
SLIYRRLLQLAQLTGPP

SEQ ID NO: 3079604 - protein, 17 aa, Giardia lamblia
SLLAGWFVNSTVTEDAL

SEQ ID NO: 3079605 - protein, 18 aa, Giardia lamblia
SLLCCIAASLAILVLLVG

SEQ ID NO: 3079606 - protein, 30 aa, Giardia lamblia
SLLHYERLCTRFALLYLQVYTDFCSQQNHL

SEQ ID NO: 3079607 - protein, 18 aa, Giardia lamblia
SLLIKGRLGVYGEQLLNR

SEQ ID NO: 3079608 - protein, 22 aa, Giardia lamblia
SLLKMLCYIGFTIIESQEQLLL

SEQ ID NO: 3079609 - protein, 22 aa, Giardia lamblia
SLLLLCASGVYGNELTNYIQYE

SEQ ID NO: 3079610 - protein, 25 aa, Giardia lamblia
SLLLLRAAIYNGRFDGQLCGAISTF

SEQ ID NO: 3079611 - protein, 20 aa, Giardia lamblia
SLLLSLGRTVVCIVSILCYG

SEQ ID NO: 3079612 - protein, 24 aa, Giardia lamblia
SLLLSTGCGVAMRLGSWMVTILLF

SEQ ID NO: 3079613 - protein, 18 aa, Giardia lamblia
SLLMACPDLPASGDNSSN

SEQ ID NO: 3079614 - protein, 23 aa, Giardia lamblia
SLLNCPVYSKSVLRLIKDSGKLT

SEQ ID NO: 3079615 - protein, 31 aa, Giardia lamblia
SLLPLPLILKAWRYFVRFLYVYFTGKAKSGK

SEQ ID NO: 3079616 - protein, 18 aa, Giardia lamblia
SLLQGSSVLSCITPNASI

SEQ ID NO: 3079617 - protein, 26 aa, Giardia lamblia
SLLQRLCRRESLTILRLLCSNDDRRL

SEQ ID NO: 3079618 - protein, 19 aa, Giardia lamblia
SLLRDILCDVSDIKFKTKL

SEQ ID NO: 3079619 - protein, 21 aa, Giardia lamblia
SLLSSLGMRAALFSMTVNNTE

SEQ ID NO: 3079620 - protein, 19 aa, Giardia lamblia
SLLTLRGDDYKSFISHLFS

SEQ ID NO: 3079621 - protein, 17 aa, Giardia lamblia
SLLTQGIFVLIVRILNC

SEQ ID NO: 3079622 - protein, 24 aa, Giardia lamblia
SLLTRLLPYIPYCIDTEYPSRVVD

SEQ ID NO: 3079623 - protein, 24 aa, Giardia lamblia
SLMDRARADLCSGTCYVCNPSDRV

SEQ ID NO: 3079624 - protein, 28 aa, Giardia lamblia
SLMNMYIIRIMSGFINFTVSRLASKLKR

SEQ ID NO: 3079625 - protein, 23 aa, Giardia lamblia
SLNAASFSTEFNIFVTETENSNP

SEQ ID NO: 3079626 - protein, 25 aa, Giardia lamblia
SLNQPRLRMKAHFYIYNPPIFSSRR

SEQ ID NO: 3079627 - protein, 17 aa, Giardia lamblia
SLNRAATNYAYFDYITK

SEQ ID NO: 3079628 - protein, 19 aa, Giardia lamblia
SLPPCIGSMDGLEYLNLTG

SEQ ID NO: 3079629 - protein, 20 aa, Giardia lamblia
SLPVECFIDGFLRKRILDPI

SEQ ID NO: 3079630 - protein, 19 aa, Giardia lamblia
SLQASFLVMGFVLSLALHI

SEQ ID NO: 3079631 - protein, 23 aa, Giardia lamblia
SLQELRRLFIYCTEPFKIMNAGK

SEQ ID NO: 3079632 - protein, 20 aa, Giardia lamblia
SLQFWDMLYGKLLRSVSHVF

SEQ ID NO: 3079633 - protein, 17 aa, Giardia lamblia
SLQHCRFEKVAQHNISW

SEQ ID NO: 3079634 - protein, 23 aa, Giardia lamblia
SLQISELLSFLSPVGSTIDGSAR

SEQ ID NO: 3079635 - protein, 26 aa, Giardia lamblia
SLQSAYRTALFISIFMVVVLAIGIYY

SEQ ID NO: 3079636 - protein, 24 aa, Giardia lamblia
SLQTISCAFSLFKSTDFTFLCELS

SEQ ID NO: 3079637 - protein, 29 aa, Giardia lamblia
SLRDREFCRLWSIFDWEYKVAVSTLAPPE

SEQ ID NO: 3079638 - protein, 21 aa, Giardia lamblia
SLRDVSVIFPLKGRATKTENP

SEQ ID NO: 3079639 - protein, 19 aa, Giardia lamblia
SLRISELLCQCLYQSIIYA

SEQ ID NO: 3079640 - protein, 21 aa, Giardia lamblia
SLRIVEYQTIFLFLIIIQGAL

SEQ ID NO: 3079641 - protein, 22 aa, Giardia lamblia
SLRKISCPSIHFNRNVHLSPLG

SEQ ID NO: 3079642 - protein, 23 aa, Giardia lamblia
SLRKRIRKGPGRRRLPDIALPKW

SEQ ID NO: 3079643 - protein, 35 aa, Giardia lamblia
SLRSLCRALSFAHRFRAAAGLRRSMYEGFMLAFGS

SEQ ID NO: 3079644 - protein, 27 aa, Giardia lamblia
SLRSRSTFCGLSLCTERLRLIENSANF

SEQ ID NO: 3079645 - protein, 19 aa, Giardia lamblia
SLSALKFLQHRISVRRDVG

SEQ ID NO: 3079646 - protein, 22 aa, Giardia lamblia
SLSCSISPFGAFAVLVYSGLHF

SEQ ID NO: 3079647 - protein, 24 aa, Giardia lamblia
SLSEFLITYGPHWIGAPTPLDIIS

SEQ ID NO: 3079648 - protein, 19 aa, Giardia lamblia
SLSFYLPLVNFKASMNSIK

SEQ ID NO: 3079649 - protein, 30 aa, Giardia lamblia
SLSKFERMFCYFVILGLCALLFSQWIVNPW

SEQ ID NO: 3079650 - protein, 24 aa, Giardia lamblia
SLSKYYVCGKLGNFGECVGTGSGF

SEQ ID NO: 3079651 - protein, 24 aa, Giardia lamblia
SLSLRIALRTHKTFFFDHNMGVNN

SEQ ID NO: 3079652 - protein, 24 aa, Giardia lamblia
SLSLRPDSALLFQAVISTLYVRSL

SEQ ID NO: 3079653 - protein, 20 aa, Giardia lamblia
SLSMCVRAGCIDENNVYCGG

SEQ ID NO: 3079654 - protein, 27 aa, Giardia lamblia
SLSPSDFIAPFLFDLQFQLNLLYSSII

SEQ ID NO: 3079655 - protein, 22 aa, Giardia lamblia
SLSRWRTADLLTGYISSLPQAL

SEQ ID NO: 3079656 - protein, 25 aa, Giardia lamblia
SLSSSFKLDTSWIPEFLSVLRSSST

SEQ ID NO: 3079657 - protein, 31 aa, Giardia lamblia
SLSTSCISFSIFVAGIHRFLSESGVPCVDFL

SEQ ID NO: 3079658 - protein, 22 aa, Giardia lamblia
SLTGYFIFRCVKYSQHVKKCKA

SEQ ID NO: 3079659 - protein, 17 aa, Giardia lamblia
SLTNFPFESFQLTTNPD

SEQ ID NO: 3079660 - protein, 17 aa, Giardia lamblia
SLTNFPLTAVNLSANPS

SEQ ID NO: 3079661 - protein, 18 aa, Giardia lamblia
SLTSALQCVLNLEYDQET

SEQ ID NO: 3079662 - protein, 18 aa, Giardia lamblia
SLTSIKVFVEDNAGLSVH

SEQ ID NO: 3079663 - protein, 21 aa, Giardia lamblia
SLVCVLPWDVIYTEFVLVSFA

SEQ ID NO: 3079664 - protein, 24 aa, Giardia lamblia
SLVEPRYAKLIARTIEIAVTNKAG

SEQ ID NO: 3079665 - protein, 18 aa, Giardia lamblia
SLVFKHQLLPTLQHSNAL

SEQ ID NO: 3079666 - protein, 23 aa, Giardia lamblia
SLVKNPRDASVIFATPRCGSGQP

SEQ ID NO: 3079667 - protein, 24 aa, Giardia lamblia
SLVLQRLSCRLAMSGHKHHDEQNF

SEQ ID NO: 3079668 - protein, 19 aa, Giardia lamblia
SLVLRFSFILLNDIASAPI

SEQ ID NO: 3079669 - protein, 20 aa, Giardia lamblia
SLVQGVWCIFLTSIGSPYKM

SEQ ID NO: 3079670 - protein, 24 aa, Giardia lamblia
SLVRRLKSKGSYYLANSKRALRIG

SEQ ID NO: 3079671 - protein, 24 aa, Giardia lamblia
SLVSLRLFLTDSLHNRIYGEQNIE

SEQ ID NO: 3079672 - protein, 30 aa, Giardia lamblia
SLVTNLTIDWFKNWPKAALMDVANSVLQQE

SEQ ID NO: 3079673 - protein, 18 aa, Giardia lamblia
SLVTSAMRKLCLKTSLSV

SEQ ID NO: 3079674 - protein, 20 aa, Giardia lamblia
SLVYYVFFCLTICPLATALL

SEQ ID NO: 3079675 - protein, 20 aa, Giardia lamblia
SLWGTCFAWLENMVVFAKSF

SEQ ID NO: 3079676 - protein, 23 aa, Giardia lamblia
SLWYSQEMMARYAVKHPSPRTRS

SEQ ID NO: 3079677 - protein, 25 aa, Giardia lamblia
SLYCSCLNPFFTFMSPIIKRSGRQG

SEQ ID NO: 3079678 - protein, 26 aa, Giardia lamblia
SLYESRLPKSCCIKGGLRDIPNVTFK

SEQ ID NO: 3079679 - protein, 24 aa, Giardia lamblia
SLYHTLKAYVPRLLDAGRTLLATG

SEQ ID NO: 3079680 - protein, 24 aa, Giardia lamblia
SLYKPEIYTLFPLQEGNMRLSVEV

SEQ ID NO: 3079681 - protein, 26 aa, Giardia lamblia
SLYLFPECVLFVFTYFRLLDITPTEA

SEQ ID NO: 3079682 - protein, 18 aa, Giardia lamblia
SLYVLGLFPKTLENLLGR

SEQ ID NO: 3079683 - protein, 18 aa, Giardia lamblia
SMAHLYGDHFTRTILPNY

SEQ ID NO: 3079684 - protein, 24 aa, Giardia lamblia
SMCCLPYAVLLNIVFSDLGRIRVI

SEQ ID NO: 3079685 - protein, 26 aa, Giardia lamblia
SMCVECATAIKWCLECTGAGACTRCA

SEQ ID NO: 3079686 - protein, 33 aa, Giardia lamblia
SMDEEFVRLVLCRSSMLFSCITTGFTTKTNQSV

SEQ ID NO: 3079687 - protein, 26 aa, Giardia lamblia
SMEPIFYRYIEAARRLTLFLHGYEDI

SEQ ID NO: 3079688 - protein, 25 aa, Giardia lamblia
SMERHCPYCRKYVCRHFTINEEDIL

SEQ ID NO: 3079689 - protein, 18 aa, Giardia lamblia
SMGLPVFLLTAATRSIYT

SEQ ID NO: 3079690 - protein, 24 aa, Giardia lamblia
SMGPLSCRLLASDVQMIYSRAKDK

SEQ ID NO: 3079691 - protein, 23 aa, Giardia lamblia
SMIHPRVLLLVFLPHNFLEATPC

SEQ ID NO: 3079692 - protein, 27 aa, Giardia lamblia
SMIKSLCAVMCSCLMLLLVPANAESTS

SEQ ID NO: 3079693 - protein, 17 aa, Giardia lamblia
SMIPMSAIIDHHLTLIY

SEQ ID NO: 3079694 - protein, 22 aa, Giardia lamblia
SMKIVFCSENSKYLILMMVAYF

SEQ ID NO: 3079695 - protein, 24 aa, Giardia lamblia
SMLLPELLYILPRLTIVRNGVQDM

SEQ ID NO: 3079696 - protein, 22 aa, Giardia lamblia
SMLLPVFSFILYKGTKRCAFLF

SEQ ID NO: 3079697 - protein, 23 aa, Giardia lamblia
SMMMCVGALPSLLFLIVMMSEYT

SEQ ID NO: 3079698 - protein, 25 aa, Giardia lamblia
SMMQWAEAMLKPALVEYNDINDIKD

SEQ ID NO: 3079699 - protein, 17 aa, Giardia lamblia
SMMRSDLTIAMIQALSL

SEQ ID NO: 3079700 - protein, 17 aa, Giardia lamblia
SMNCIVNGLVLASDGQK

SEQ ID NO: 3079701 - protein, 33 aa, Giardia lamblia
SMNMGFSLIRYRLRFRNLLLYNSIVFDTLIQLR

SEQ ID NO: 3079702 - protein, 22 aa, Giardia lamblia
SMPVKHFPASVLQTSLKITTEP

SEQ ID NO: 3079703 - protein, 25 aa, Giardia lamblia
SMQDCKGYMTAIKKDPAFIFLQTSA

SEQ ID NO: 3079704 - protein, 33 aa, Giardia lamblia
SMQLVFFKFSYAYRTYFKLAFPEDTYLESLFRL

SEQ ID NO: 3079705 - protein, 17 aa, Giardia lamblia
SMRFKVMAGYITAGEDK

SEQ ID NO: 3079706 - protein, 26 aa, Giardia lamblia
SMSKELESALCLHFLKTRRETRKHEL

SEQ ID NO: 3079707 - protein, 22 aa, Giardia lamblia
SMSLFTNSPWLLAFSTESIAAM

SEQ ID NO: 3079708 - protein, 18 aa, Giardia lamblia
SMSLRTILSAGFNCEDSP

SEQ ID NO: 3079709 - protein, 22 aa, Giardia lamblia
SMTRNIYISALFTLVSCILALI

SEQ ID NO: 3079710 - protein, 19 aa, Giardia lamblia
SNACICFMNSLVGNSSAYL

SEQ ID NO: 3079711 - protein, 28 aa, Giardia lamblia
SNAMPAIPLPLSFRLSTIRNFIPDYSVF

SEQ ID NO: 3079712 - protein, 20 aa, Giardia lamblia
SNANWHWRFLASPQGLIKYI

SEQ ID NO: 3079713 - protein, 25 aa, Giardia lamblia
SNATWCIGCNKFLMRSNWLSSHFRI

SEQ ID NO: 3079714 - protein, 24 aa, Giardia lamblia
SNDLKLWLPLSMTQWNPCLFGFQG

SEQ ID NO: 3079715 - protein, 17 aa, Giardia lamblia
SNDQILQALGFLEGALC

SEQ ID NO: 3079716 - protein, 22 aa, Giardia lamblia
SNECTTCPAGQIVNTHGDGCVS

SEQ ID NO: 3079717 - protein, 28 aa, Giardia lamblia
SNEVYKHYWLGLIWEWTLGMIQSNKPAR

SEQ ID NO: 3079718 - protein, 25 aa, Giardia lamblia
SNFHSRFALTNAVARIQLYKIGISS

SEQ ID NO: 3079719 - protein, 23 aa, Giardia lamblia
SNFIKGILKRIFVLDPEERLTAK

SEQ ID NO: 3079720 - protein, 25 aa, Giardia lamblia
SNFKLKFLYWNAMREHGAMEYLVVQ

SEQ ID NO: 3079721 - protein, 24 aa, Giardia lamblia
SNFKSMWGGSTYSFIAITSYLSDR

SEQ ID NO: 3079722 - protein, 24 aa, Giardia lamblia
SNFVGWMIYHFLLGYVKSGGLEGM

SEQ ID NO: 3079723 - protein, 24 aa, Giardia lamblia
SNGDTPLHYAIRMGCVEAISYLTS

SEQ ID NO: 3079724 - protein, 21 aa, Giardia lamblia
SNGLTIHWLEKVLLKAPHDSC

SEQ ID NO: 3079725 - protein, 21 aa, Giardia lamblia
SNHKALRCFILSVPGSPLTHY

SEQ ID NO: 3079726 - protein, 21 aa, Giardia lamblia
SNILEHPWINPARQLFDKDLV

SEQ ID NO: 3079727 - protein, 24 aa, Giardia lamblia
SNKASARFAYRISQAQSAPANKDS

SEQ ID NO: 3079728 - protein, 20 aa, Giardia lamblia
SNKCTFCMPGYALTSDSTCQ

SEQ ID NO: 3079729 - protein, 18 aa, Giardia lamblia
SNKFARIVNKLRRGSSGE

SEQ ID NO: 3079730 - protein, 17 aa, Giardia lamblia
SNLHFGEQWLCLQRNAI

SEQ ID NO: 3079731 - protein, 25 aa, Giardia lamblia
SNLHFSKDVLFPFKLQDVTLQNITP

SEQ ID NO: 3079732 - protein, 18 aa, Giardia lamblia
SNLSCLDAILPRAIHEIY

SEQ ID NO: 3079733 - protein, 20 aa, Giardia lamblia
SNMLLRKGSISWATVSSSCG

SEQ ID NO: 3079734 - protein, 23 aa, Giardia lamblia
SNNKPANMTLFWLSQPNEPTDTP

SEQ ID NO: 3079735 - protein, 20 aa, Giardia lamblia
SNNYCRCALVISLPYPNISD

SEQ ID NO: 3079736 - protein, 18 aa, Giardia lamblia
SNPALYLLVLNNFFVLRM

SEQ ID NO: 3079737 - protein, 23 aa, Giardia lamblia
SNPDESLVILCLGSHQSVIRTYF

SEQ ID NO: 3079738 - protein, 19 aa, Giardia lamblia
SNRAFVFEGLEYLTIGVIF

SEQ ID NO: 3079739 - protein, 24 aa, Giardia lamblia
SNRIRFFPKKAKISSIVLLMGLYL

SEQ ID NO: 3079740 - protein, 18 aa, Giardia lamblia
SNSLLLQRLLDAVSAEIS

SEQ ID NO: 3079741 - protein, 34 aa, Giardia lamblia
SNSRDGRLTPFFKEPFSFHSICSMFLHKPLSLFT

SEQ ID NO: 3079742 - protein, 25 aa, Giardia lamblia
SNSRLSCIAALILLLASNSRVMVRP

SEQ ID NO: 3079743 - protein, 34 aa, Giardia lamblia
SNSRRYESALSFVCALWPLWVYLSQVFDKAICDV

SEQ ID NO: 3079744 - protein, 19 aa, Giardia lamblia
SNSSLPIHSIISARDIANV

SEQ ID NO: 3079745 - protein, 25 aa, Giardia lamblia
SNTIRYKTIYLMESLREGLHVAQLT

SEQ ID NO: 3079746 - protein, 18 aa, Giardia lamblia
SNTSVLTWSRAMAANLIA

SEQ ID NO: 3079747 - protein, 25 aa, Giardia lamblia
SNVFKEALCLPQFTEICVTDTDIAS

SEQ ID NO: 3079748 - protein, 33 aa, Giardia lamblia
SNVIDSLLFVFGWRARALRHSRLADLIHTSSEH

SEQ ID NO: 3079749 - protein, 19 aa, Giardia lamblia
SNVLFSFFNTVFSYYLKTI

SEQ ID NO: 3079750 - protein, 24 aa, Giardia lamblia
SNVMLCISTLYTARLEEVFRGRNI

SEQ ID NO: 3079751 - protein, 23 aa, Giardia lamblia
SNVPESFHTLRFPPHSFQTLQHY

SEQ ID NO: 3079752 - protein, 20 aa, Giardia lamblia
SNYDCKTFAFSRKNPLTTLS

SEQ ID NO: 3079753 - protein, 27 aa, Giardia lamblia
SPAALLYEVLRRLDICHSNNLISKADF

SEQ ID NO: 3079754 - protein, 19 aa, Giardia lamblia
SPACVLDGVSVCGGSGECL

SEQ ID NO: 3079755 - protein, 20 aa, Giardia lamblia
SPAGVFPLLATELYIRDLLE

SEQ ID NO: 3079756 - protein, 25 aa, Giardia lamblia
SPANCRIFEGSIRITIMTKKGLTSA

SEQ ID NO: 3079757 - protein, 27 aa, Giardia lamblia
SPASCDRKAYMGYTFTAGCIGLAHSSP

SEQ ID NO: 3079758 - protein, 20 aa, Giardia lamblia
SPASDMWNLGAIVYELTTLR

SEQ ID NO: 3079759 - protein, 20 aa, Giardia lamblia
SPATCYDCSHMIDAEEHISL

SEQ ID NO: 3079760 - protein, 21 aa, Giardia lamblia
SPDAKLTVFLAELNQAIRNIY

SEQ ID NO: 3079761 - protein, 31 aa, Giardia lamblia
SPDIGFGLAIPRPRLTPNLREYPECIRVMTR

SEQ ID NO: 3079762 - protein, 23 aa, Giardia lamblia
SPDIYKDPLRGISLHSKPLPPPD

SEQ ID NO: 3079763 - protein, 20 aa, Giardia lamblia
SPDLCPRNVVPFNEYLCAGE

SEQ ID NO: 3079764 - protein, 25 aa, Giardia lamblia
SPDVSNRVFYLFGLSSLHHDNIKTG

SEQ ID NO: 3079765 - protein, 21 aa, Giardia lamblia
SPDYLYDVFISRELDRVQSPV

SEQ ID NO: 3079766 - protein, 21 aa, Giardia lamblia
SPELQRLRALATILNLQDYSH

SEQ ID NO: 3079767 - protein, 23 aa, Giardia lamblia
SPEPSAAVSANWITEHTLLLIKY

SEQ ID NO: 3079768 - protein, 28 aa, Giardia lamblia
SPESCLFYMRFCFAVTYDLLGFPSLGQD

SEQ ID NO: 3079769 - protein, 17 aa, Giardia lamblia
SPETYKGLVSALGAVTF

SEQ ID NO: 3079770 - protein, 21 aa, Giardia lamblia
SPFRPGCVIGARAAAKYFRIP

SEQ ID NO: 3079771 - protein, 19 aa, Giardia lamblia
SPFSKFAAVAFLRLLTARL

SEQ ID NO: 3079772 - protein, 19 aa, Giardia lamblia
SPFVASLLKLLTDRRSEIS

SEQ ID NO: 3079773 - protein, 20 aa, Giardia lamblia
SPHGIIICIDLLYREIAAYG

SEQ ID NO: 3079774 - protein, 26 aa, Giardia lamblia
SPIHLLTCLLSEDFDLGYGISTKMTT

SEQ ID NO: 3079775 - protein, 18 aa, Giardia lamblia
SPIIPLSLLLYLSVALYD

SEQ ID NO: 3079776 - protein, 25 aa, Giardia lamblia
SPILFPFRLLTMVLSFIIAFVSLRI

SEQ ID NO: 3079777 - protein, 27 aa, Giardia lamblia
SPITALCFLGQWPLLFSASASGACYIH

SEQ ID NO: 3079778 - protein, 29 aa, Giardia lamblia
SPITVKIYWADLLIPVSISYGFWSVVIKP

SEQ ID NO: 3079779 - protein, 24 aa, Giardia lamblia
SPKAVCVVIPLYFEVGLDKRGLLS

SEQ ID NO: 3079780 - protein, 22 aa, Giardia lamblia
SPKHPFLCVYKAMRQYKESDYS

SEQ ID NO: 3079781 - protein, 28 aa, Giardia lamblia
SPKSALSDCLCRLGSAIVEYKALLMPHT

SEQ ID NO: 3079782 - protein, 24 aa, Giardia lamblia
SPLDKLWYSLLYLKRTQTLQDSMA

SEQ ID NO: 3079783 - protein, 25 aa, Giardia lamblia
SPLLCYKLFCRVVISKFQEAYLHDL

SEQ ID NO: 3079784 - protein, 17 aa, Giardia lamblia
SPLLISILLSFKIGSCD

SEQ ID NO: 3079785 - protein, 20 aa, Giardia lamblia
SPLLQWDLLILFQPFSLLGA

SEQ ID NO: 3079786 - protein, 25 aa, Giardia lamblia
SPLPRAARSGASFGPGPLVSQEDVG

SEQ ID NO: 3079787 - protein, 21 aa, Giardia lamblia
SPLTWILSLLFPSFNIQHIFD

SEQ ID NO: 3079788 - protein, 22 aa, Giardia lamblia
SPMKTRYSTPMHRFSSTLNQTM

SEQ ID NO: 3079789 - protein, 28 aa, Giardia lamblia
SPMLVLLLVCYFLKIAFKTSSEEKDLNY

SEQ ID NO: 3079790 - protein, 19 aa, Giardia lamblia
SPPCPRSLADINNLCAGKG

SEQ ID NO: 3079791 - protein, 17 aa, Giardia lamblia
SPPKIKLSRVFQYDEEA

SEQ ID NO: 3079792 - protein, 20 aa, Giardia lamblia
SPPLYRGVLEQAPNMNSTEM

SEQ ID NO: 3079793 - protein, 26 aa, Giardia lamblia
SPPPPRIHTTLQFFICQVYTGSDVLF

SEQ ID NO: 3079794 - protein, 20 aa, Giardia lamblia
SPQFCLSIIKLFANDMDLCL

SEQ ID NO: 3079795 - protein, 25 aa, Giardia lamblia
SPQTACTFAPFGNVMPKFSYDPKLP

SEQ ID NO: 3079796 - protein, 23 aa, Giardia lamblia
SPQYLVGLEVIRSSMFAAQKSFQ

SEQ ID NO: 3079797 - protein, 23 aa, Giardia lamblia
SPRARPMALIAINVMTLIGTAIA

SEQ ID NO: 3079798 - protein, 23 aa, Giardia lamblia
SPSRISCNIFSPSFEISIPVQAD

SEQ ID NO: 3079799 - protein, 20 aa, Giardia lamblia
SPSTLSRCGILSLEDSIQNY

SEQ ID NO: 3079800 - protein, 23 aa, Giardia lamblia
SPTDYRYTPVFVVATDGLHIFYV

SEQ ID NO: 3079801 - protein, 26 aa, Giardia lamblia
SPTLRLANLHLLSFLQEHHSVIKHLY

SEQ ID NO: 3079802 - protein, 22 aa, Giardia lamblia
SPTQLCVFIAWNRSCPYLYSNK

SEQ ID NO: 3079803 - protein, 18 aa, Giardia lamblia
SPTVGLCALFVDSQAQQL

SEQ ID NO: 3079804 - protein, 25 aa, Giardia lamblia
SPVPLKEIFCNRIYRRCVFISVCMP

SEQ ID NO: 3079805 - protein, 18 aa, Giardia lamblia
SPVRKLRASTVGATEQLT

SEQ ID NO: 3079806 - protein, 19 aa, Giardia lamblia
SPVSLPMVSLLGIGARGSA

SEQ ID NO: 3079807 - protein, 18 aa, Giardia lamblia
SPVSVRPLLLFTGELNAH

SEQ ID NO: 3079808 - protein, 18 aa, Giardia lamblia
SPVYLPGIGVFFLVILSE

SEQ ID NO: 3079809 - protein, 19 aa, Giardia lamblia
SPWSKCTTMYAAHSYLHIS

SEQ ID NO: 3079810 - protein, 21 aa, Giardia lamblia
SPYRRFKMNLVCIPHYGNAKM

SEQ ID NO: 3079811 - protein, 26 aa, Giardia lamblia
SQAEFFRFVVLKVKESSQVLGFSRIP

SEQ ID NO: 3079812 - protein, 18 aa, Giardia lamblia
SQAMCTFLQKIEGSAFIR

SEQ ID NO: 3079813 - protein, 25 aa, Giardia lamblia
SQAPKCKLALELTDSVPMRIITAIL

SEQ ID NO: 3079814 - protein, 23 aa, Giardia lamblia
SQARARSSVYGMINAHTLLSKSI

SEQ ID NO: 3079815 - protein, 22 aa, Giardia lamblia
SQAYPGCYCSCSDRLSNVKETP

SEQ ID NO: 3079816 - protein, 27 aa, Giardia lamblia
SQDLLKIIKLYALFLIEGDAPTAGVVR

SEQ ID NO: 3079817 - protein, 25 aa, Giardia lamblia
SQEDLCTFKELFSQWKELAMKYLSK

SEQ ID NO: 3079818 - protein, 21 aa, Giardia lamblia
SQFNVPRVVAIDYRLQRKLSL

SEQ ID NO: 3079819 - protein, 17 aa, Giardia lamblia
SQFSRLPTIPLENTRWP

SEQ ID NO: 3079820 - protein, 18 aa, Giardia lamblia
SQHIIALSAAFSVTDKLF

SEQ ID NO: 3079821 - protein, 18 aa, Giardia lamblia
SQHVIGVELFLPADSFIS

SEQ ID NO: 3079822 - protein, 22 aa, Giardia lamblia
SQIKEAYRALVYQNNADTSAEA

SEQ ID NO: 3079823 - protein, 19 aa, Giardia lamblia
SQIVCKLVLLSSNTGTIGM

SEQ ID NO: 3079824 - protein, 27 aa, Giardia lamblia
SQLESRFNPFISRSFQKAVLASCLDTE

SEQ ID NO: 3079825 - protein, 31 aa, Giardia lamblia
SQLGHEPTCFVLAFGGGPSFDQAELVAKIHS

SEQ ID NO: 3079826 - protein, 22 aa, Giardia lamblia
SQLIVSLLLFFSAMNHKTSRIS

SEQ ID NO: 3079827 - protein, 23 aa, Giardia lamblia
SQLLDLPSLAAFLSAQVSAEASK

SEQ ID NO: 3079828 - protein, 25 aa, Giardia lamblia
SQLPPFHLLFPCLFPEPLSKPEVME

SEQ ID NO: 3079829 - protein, 28 aa, Giardia lamblia
SQMSVLRRSRFVFCGRIINYMTSLSNAL

SEQ ID NO: 3079830 - protein, 23 aa, Giardia lamblia
SQNALEWRTSVIQSISSSLNEMM

SEQ ID NO: 3079831 - protein, 30 aa, Giardia lamblia
SQNMWPLFIVGCNDIRCIYENVPEADPNVP

SEQ ID NO: 3079832 - protein, 25 aa, Giardia lamblia
SQNTMGWTALCFAADNGHTACVRLL

SEQ ID NO: 3079833 - protein, 20 aa, Giardia lamblia
SQPGHGWARQDGIKSRYQNC

SEQ ID NO: 3079834 - protein, 18 aa, Giardia lamblia
SQQACLMSHYTMDVSNVH

SEQ ID NO: 3079835 - protein, 26 aa, Giardia lamblia
SQQALCLAEKFYSAVVPVDAFCKFLV

SEQ ID NO: 3079836 - protein, 27 aa, Giardia lamblia
SQRTLACSFRWWSFTLIVTSIYLIQRA

SEQ ID NO: 3079837 - protein, 21 aa, Giardia lamblia
SQSLLPVAVDFTFKDCVRSAV

SEQ ID NO: 3079838 - protein, 17 aa, Giardia lamblia
SQTIVALIWKYVLMEGN

SEQ ID NO: 3079839 - protein, 20 aa, Giardia lamblia
SQTLCLYPSFDQHIDQQHFA

SEQ ID NO: 3079840 - protein, 25 aa, Giardia lamblia
SQVQLPICASIPFSHFSSILSTGVS

SEQ ID NO: 3079841 - protein, 18 aa, Giardia lamblia
SQVRFARLPSAQPVTADT

SEQ ID NO: 3079842 - protein, 24 aa, Giardia lamblia
SQVSGWLAICVGHSLDFQHHKELV

SEQ ID NO: 3079843 - protein, 17 aa, Giardia lamblia
SQYCYCRTLEGCSNEVH

SEQ ID NO: 3079844 - protein, 23 aa, Giardia lamblia
SRADEECRFCDAARDSAEILEQE

SEQ ID NO: 3079845 - protein, 25 aa, Giardia lamblia
SRAKLMGAIKLVFSTASLEYMVPNC

SEQ ID NO: 3079846 - protein, 23 aa, Giardia lamblia
SRCGSGSLILRHIQSKILVYAIN

SEQ ID NO: 3079847 - protein, 24 aa, Giardia lamblia
SRCSLLCYLVFVLLWQGSTQYQGV

SEQ ID NO: 3079848 - protein, 19 aa, Giardia lamblia
SRDAISRVALLLSTELGIL

SEQ ID NO: 3079849 - protein, 26 aa, Giardia lamblia
SRDHREFLVFRALVLAYAQPPFVQPV

SEQ ID NO: 3079850 - protein, 17 aa, Giardia lamblia
SRDMFFKICDTLLTLTQ

SEQ ID NO: 3079851 - protein, 25 aa, Giardia lamblia
SRDYPDVCELLAPYEANIYCDRGRD

SEQ ID NO: 3079852 - protein, 40 aa, Giardia lamblia
SREIVYNLPPCYMFGMSFPRMYKGKAGVTWITELVETDYM

SEQ ID NO: 3079853 - protein, 29 aa, Giardia lamblia
SRENACFQFPCINLLLSTIVRHTELPVDV

SEQ ID NO: 3079854 - protein, 19 aa, Giardia lamblia
SRFGKAFHLVRELTKFLKY

SEQ ID NO: 3079855 - protein, 18 aa, Giardia lamblia
SRFHKLEPPFSLQNYSKL

SEQ ID NO: 3079856 - protein, 34 aa, Giardia lamblia
SRFLGPLICASWDPRPASCLALLSSHNGASAIVD

SEQ ID NO: 3079857 - protein, 27 aa, Giardia lamblia
SRGHADCLFHLFAEAFIRNRDGQLALD

SEQ ID NO: 3079858 - protein, 18 aa, Giardia lamblia
SRGIALQEYTSFHIIEHF

SEQ ID NO: 3079859 - protein, 18 aa, Giardia lamblia
SRGQFSFADLAEAMIDKK

SEQ ID NO: 3079860 - protein, 23 aa, Giardia lamblia
SRGRGRCKSVSFKSKRQDDCSID

SEQ ID NO: 3079861 - protein, 25 aa, Giardia lamblia
SRHFSPDDSYCWNRHLYPSQITSTE

SEQ ID NO: 3079862 - protein, 20 aa, Giardia lamblia
SRHHLFRLLSAIVELGTYLY

SEQ ID NO: 3079863 - protein, 21 aa, Giardia lamblia
SRIAYSISYWSYLHQYDSIAE

SEQ ID NO: 3079864 - protein, 17 aa, Giardia lamblia
SRILIKMTPKSGSQYAV

SEQ ID NO: 3079865 - protein, 17 aa, Giardia lamblia
SRIMLKDDMDIIDCPHN

SEQ ID NO: 3079866 - protein, 18 aa, Giardia lamblia
SRINPARFISLLDSPSEL

SEQ ID NO: 3079867 - protein, 19 aa, Giardia lamblia
SRIRGECAAVKEPVLTTLS

SEQ ID NO: 3079868 - protein, 19 aa, Giardia lamblia
SRIRVSVTIGFAISILVYQ

SEQ ID NO: 3079869 - protein, 19 aa, Giardia lamblia
SRIYLVIVANYKLKYIQLF

SEQ ID NO: 3079870 - protein, 22 aa, Giardia lamblia
SRLAMCPDLSGVLPIVYAIENK

SEQ ID NO: 3079871 - protein, 21 aa, Giardia lamblia
SRLFFYRTFVDDWLLLTTSIA

SEQ ID NO: 3079872 - protein, 32 aa, Giardia lamblia
SRLHYILIVQRILEVMSLLASDSFVRAPSLVT

SEQ ID NO: 3079873 - protein, 25 aa, Giardia lamblia
SRLIDMARLLFRDLLAPDTFLLNDV

SEQ ID NO: 3079874 - protein, 21 aa, Giardia lamblia
SRLLLYPLLAYCLSGVVVTVW

SEQ ID NO: 3079875 - protein, 33 aa, Giardia lamblia
SRLLMLCEDLMWPRWRTQLTCSLCNPDPKLIQE

SEQ ID NO: 3079876 - protein, 19 aa, Giardia lamblia
SRLLPLTKIEPVLFTCTAI

SEQ ID NO: 3079877 - protein, 17 aa, Giardia lamblia
SRLPFDIMTIGNHDMDN

SEQ ID NO: 3079878 - protein, 19 aa, Giardia lamblia
SRLPIYDPYMLSRVFHLYV

SEQ ID NO: 3079879 - protein, 23 aa, Giardia lamblia
SRLRETRCFLTALMIAAIVGAVN

SEQ ID NO: 3079880 - protein, 19 aa, Giardia lamblia
SRLRSDGCCSVETPLTAAI

SEQ ID NO: 3079881 - protein, 25 aa, Giardia lamblia
SRLSQLREFACFITMNPSYKGRRTL

SEQ ID NO: 3079882 - protein, 17 aa, Giardia lamblia
SRLTNLYTHKSQLLPSS

SEQ ID NO: 3079883 - protein, 27 aa, Giardia lamblia
SRLVCMFYQRLEAVVAHIQSDAEQASK

SEQ ID NO: 3079884 - protein, 26 aa, Giardia lamblia
SRLWFNRELYIRMALYPLVEQGHKDP

SEQ ID NO: 3079885 - protein, 21 aa, Giardia lamblia
SRMDALLHFPETMSERTLIDL

SEQ ID NO: 3079886 - protein, 25 aa, Giardia lamblia
SRNSFISAVLIGARIIKVSVNTNAN

SEQ ID NO: 3079887 - protein, 22 aa, Giardia lamblia
SRNTFKTVLWRLMLDETNECTV

SEQ ID NO: 3079888 - protein, 20 aa, Giardia lamblia
SRPLLSLENMEQWPERATPD

SEQ ID NO: 3079889 - protein, 17 aa, Giardia lamblia
SRPTTDLSLSLLLEPTS

SEQ ID NO: 3079890 - protein, 26 aa, Giardia lamblia
SRQEAESLPHFLLYYAKNKYGVTAIV

SEQ ID NO: 3079891 - protein, 19 aa, Giardia lamblia
SRRGLAGSILATMNVLHSL

SEQ ID NO: 3079892 - protein, 22 aa, Giardia lamblia
SRRLVGAWNRTVARDAARGKKR

SEQ ID NO: 3079893 - protein, 21 aa, Giardia lamblia
SRRSMTAMLKRAETAGFSVKT

SEQ ID NO: 3079894 - protein, 20 aa, Giardia lamblia
SRRTSLSLSDRASEIMEYAP

SEQ ID NO: 3079895 - protein, 22 aa, Giardia lamblia
SRSAGICSLIAHVFRRHDMEKD

SEQ ID NO: 3079896 - protein, 25 aa, Giardia lamblia
SRSAKLFLLAFLRKDELVYSCCQEL

SEQ ID NO: 3079897 - protein, 33 aa, Giardia lamblia
SRSDAMATFLIYHICSYVYLLIHGADKGAIEVS

SEQ ID NO: 3079898 - protein, 30 aa, Giardia lamblia
SRSDSICTVCRMLKSFGGFGYIEDCDGYDT

SEQ ID NO: 3079899 - protein, 22 aa, Giardia lamblia
SRSFSFNVVHGGLSRQEAESLP

SEQ ID NO: 3079900 - protein, 34 aa, Giardia lamblia
SRSGIRSTSPWRVASRLGYIAVLLLDATLLIFKL

SEQ ID NO: 3079901 - protein, 22 aa, Giardia lamblia
SRSPRFKFSLIQELGVYNVITS

SEQ ID NO: 3079902 - protein, 21 aa, Giardia lamblia
SRSRHSRLLARHSSISAYKCM

SEQ ID NO: 3079903 - protein, 24 aa, Giardia lamblia
SRSSCSRSSASFCEKDRLLELPAL

SEQ ID NO: 3079904 - protein, 21 aa, Giardia lamblia
SRSSLSLLLRNEITHALADRS

SEQ ID NO: 3079905 - protein, 22 aa, Giardia lamblia
SRTCLSTLLSIMHLYEKLFNCR

SEQ ID NO: 3079906 - protein, 23 aa, Giardia lamblia
SRTFLWKYLKSLRIRAQQTDKRF

SEQ ID NO: 3079907 - protein, 18 aa, Giardia lamblia
SRTPLMFDSLVILITMVS

SEQ ID NO: 3079908 - protein, 21 aa, Giardia lamblia
SRTSTYPSLCAHWVGTDIVVV

SEQ ID NO: 3079909 - protein, 26 aa, Giardia lamblia
SRTTACQACFPGYYHSGTKCFKCTDD

SEQ ID NO: 3079910 - protein, 29 aa, Giardia lamblia
SRWKLSSKDALDWSTWRKRHLLLVFIGIL

SEQ ID NO: 3079911 - protein, 20 aa, Giardia lamblia
SRYALLFTIFNCCIGSGLLA

SEQ ID NO: 3079912 - protein, 29 aa, Giardia lamblia
SRYRAFKVFCPAAQWITNSVMKRVRVSRY

SEQ ID NO: 3079913 - protein, 19 aa, Giardia lamblia
SRYRRRLAKRDAYKKAGIT

SEQ ID NO: 3079914 - protein, 19 aa, Giardia lamblia
SRYTGGLFHEPCSVYGADH

SEQ ID NO: 3079915 - protein, 22 aa, Giardia lamblia
SSAGCTTCLLGYYIAAEGKRQP

SEQ ID NO: 3079916 - protein, 23 aa, Giardia lamblia
SSAKLPAKFAYGCHCALSLLGIN

SEQ ID NO: 3079917 - protein, 24 aa, Giardia lamblia
SSALLAAVLFRLSDFCQWCSDFEQ

SEQ ID NO: 3079918 - protein, 20 aa, Giardia lamblia
SSAMNPSWYILRYLHVSGPF

SEQ ID NO: 3079919 - protein, 19 aa, Giardia lamblia
SSAPAFPLAPTNPILVPPI

SEQ ID NO: 3079920 - protein, 20 aa, Giardia lamblia
SSAQLCLQGLLAVEYRRLVK

SEQ ID NO: 3079921 - protein, 25 aa, Giardia lamblia
SSASIFTVLACFSLSDSLLPTTKSV

SEQ ID NO: 3079922 - protein, 18 aa, Giardia lamblia
SSASLRFFGLNKKTVSAF

SEQ ID NO: 3079923 - protein, 19 aa, Giardia lamblia
SSATSRYALLFTIFNCCIG

SEQ ID NO: 3079924 - protein, 23 aa, Giardia lamblia
SSCVASVRASELFSYPQETINMR

SEQ ID NO: 3079925 - protein, 19 aa, Giardia lamblia
SSDALCLTTLVANTNGTDT

SEQ ID NO: 3079926 - protein, 26 aa, Giardia lamblia
SSDDARLCFLLQLLDFVQSLCLPVRM

SEQ ID NO: 3079927 - protein, 23 aa, Giardia lamblia
SSDIRYIGEYVYGVFYGAGKAFL

SEQ ID NO: 3079928 - protein, 18 aa, Giardia lamblia
SSDIWSAACFLYELLTGD

SEQ ID NO: 3079929 - protein, 19 aa, Giardia lamblia
SSDLCFINLQMKRIVNHCK

SEQ ID NO: 3079930 - protein, 26 aa, Giardia lamblia
SSDVPPRLARRGRLKSRGRKDHQTRR

SEQ ID NO: 3079931 - protein, 18 aa, Giardia lamblia
SSEAWILTWSIRQTTMEE

SEQ ID NO: 3079932 - protein, 19 aa, Giardia lamblia
SSECVLNWPTTRLLLCLVC

SEQ ID NO: 3079933 - protein, 39 aa, Giardia lamblia
SSEECCAFCSILDLPLCSCCNCCLCFCDCKYVMSDTGAT

SEQ ID NO: 3079934 - protein, 23 aa, Giardia lamblia
SSEEPLFLRSLRNANLAPRSSVS

SEQ ID NO: 3079935 - protein, 22 aa, Giardia lamblia
SSEKGSSLATVFTKDTDFSLYT

SEQ ID NO: 3079936 - protein, 20 aa, Giardia lamblia
SSELRMLIIDVLYAGIAGIY

SEQ ID NO: 3079937 - protein, 34 aa, Giardia lamblia
SSELYRISLYFLRKLLVVALPMPGLFEVINSILQ

SEQ ID NO: 3079938 - protein, 26 aa, Giardia lamblia
SSFGIAGRVRYSFTFPDTTYVDNLPP

SEQ ID NO: 3079939 - protein, 17 aa, Giardia lamblia
SSFIQFRLGDAGAGSQL

SEQ ID NO: 3079940 - protein, 26 aa, Giardia lamblia
SSFYQYSISFSPVFLIVEEDDPVLQQ

SEQ ID NO: 3079941 - protein, 18 aa, Giardia lamblia
SSGAMLRYIDDVISDAAP

SEQ ID NO: 3079942 - protein, 17 aa, Giardia lamblia
SSGFLRRANGYSDFILK

SEQ ID NO: 3079943 - protein, 25 aa, Giardia lamblia
SSGFQLSFNILRAIFKSSSSSAAPF

SEQ ID NO: 3079944 - protein, 18 aa, Giardia lamblia
SSGKLILQMLMAGVDITE

SEQ ID NO: 3079945 - protein, 20 aa, Giardia lamblia
SSGKMLIPRCQLVNDAHGYD

SEQ ID NO: 3079946 - protein, 32 aa, Giardia lamblia
SSGTQRWRTIMKYKSRCKVLLSGTPIQNSLEE

SEQ ID NO: 3079947 - protein, 21 aa, Giardia lamblia
SSGYFKFSPSSNWYMDEGRLP

SEQ ID NO: 3079948 - protein, 19 aa, Giardia lamblia
SSHIKLCRHKLVGDSQQAM

SEQ ID NO: 3079949 - protein, 22 aa, Giardia lamblia
SSHSLTLCSMIYEYYYHVINSL

SEQ ID NO: 3079950 - protein, 19 aa, Giardia lamblia
SSIAGSTHPQGFNIATFNE

SEQ ID NO: 3079951 - protein, 20 aa, Giardia lamblia
SSICVLWILVVILMQSPSFL

SEQ ID NO: 3079952 - protein, 23 aa, Giardia lamblia
SSIFRKLDIIFADLLSSLQISNC

SEQ ID NO: 3079953 - protein, 20 aa, Giardia lamblia
SSIINLIAICYVHILCTSNF

SEQ ID NO: 3079954 - protein, 23 aa, Giardia lamblia
SSIKDLDLITGYFQFTGKTTITT

SEQ ID NO: 3079955 - protein, 25 aa, Giardia lamblia
SSILLFCRNSFLAIHNILYHLSLQD

SEQ ID NO: 3079956 - protein, 30 aa, Giardia lamblia
SSISAYKCMLAMLISYILFIFAHASSGLSI

SEQ ID NO: 3079957 - protein, 21 aa, Giardia lamblia
SSISIGILFFIHELLSMTYVD

SEQ ID NO: 3079958 - protein, 18 aa, Giardia lamblia
SSKLAIYTYFPRLSSSVT

SEQ ID NO: 3079959 - protein, 23 aa, Giardia lamblia
SSKREVTSLLSLRDLSDDSQTEY

SEQ ID NO: 3079960 - protein, 21 aa, Giardia lamblia
SSKVPLDRVVECSGRDCSNKL

SEQ ID NO: 3079961 - protein, 19 aa, Giardia lamblia
SSLASALPLPAMPDLTAVS

SEQ ID NO: 3079962 - protein, 26 aa, Giardia lamblia
SSLCCTPMSLSFLRKAILHITLGLYA

SEQ ID NO: 3079963 - protein, 25 aa, Giardia lamblia
SSLDFLRGVGILGMTLVHSLFNAVQ

SEQ ID NO: 3079964 - protein, 20 aa, Giardia lamblia
SSLEGLSFDPYLVLKAGLTF

SEQ ID NO: 3079965 - protein, 25 aa, Giardia lamblia
SSLFFVVQCFPKMALITTISAPERF

SEQ ID NO: 3079966 - protein, 17 aa, Giardia lamblia
SSLHIGRTFSLETLVHI

SEQ ID NO: 3079967 - protein, 18 aa, Giardia lamblia
SSLITYTRICRFIFEVAE

SEQ ID NO: 3079968 - protein, 17 aa, Giardia lamblia
SSLKTRFSVQLDNLMEL

SEQ ID NO: 3079969 - protein, 30 aa, Giardia lamblia
SSLLDGYWFLGLGFICIKTGRVKDGVPYLI

SEQ ID NO: 3079970 - protein, 19 aa, Giardia lamblia
SSLLERLETLGLFPVDEEQ

SEQ ID NO: 3079971 - protein, 23 aa, Giardia lamblia
SSLLKKTAPILVRTFEPDPLLSD

SEQ ID NO: 3079972 - protein, 18 aa, Giardia lamblia
SSLLSLISETGHSRRTEQ

SEQ ID NO: 3079973 - protein, 17 aa, Giardia lamblia
SSLLYFSASLILLSELS

SEQ ID NO: 3079974 - protein, 24 aa, Giardia lamblia
SSLPARLGYFPLFVFSLTLIPTAM

SEQ ID NO: 3079975 - protein, 25 aa, Giardia lamblia
SSLPKDFFSSLLLHLVDTLSNEAFL

SEQ ID NO: 3079976 - protein, 17 aa, Giardia lamblia
SSLRELFELDYLDFART

SEQ ID NO: 3079977 - protein, 18 aa, Giardia lamblia
SSLYSLWIKDVVPSQLFS

SEQ ID NO: 3079978 - protein, 22 aa, Giardia lamblia
SSMVSFCGNVFVDLVNLPKNQH

SEQ ID NO: 3079979 - protein, 24 aa, Giardia lamblia
SSNINKFYIVPIITRLFSLCIKSN

SEQ ID NO: 3079980 - protein, 22 aa, Giardia lamblia
SSNRCLGYLSILILHTCLAILL

SEQ ID NO: 3079981 - protein, 23 aa, Giardia lamblia
SSPDAMALYLFLWKMGLHSTMRQ

SEQ ID NO: 3079982 - protein, 19 aa, Giardia lamblia
SSPLCTVDIYGRVSRDSIA

SEQ ID NO: 3079983 - protein, 26 aa, Giardia lamblia
SSPLPFRKGCYLAEDLLGNILSDANI

SEQ ID NO: 3079984 - protein, 20 aa, Giardia lamblia
SSPRRKLNLPVAKVAMNAKA

SEQ ID NO: 3079985 - protein, 23 aa, Giardia lamblia
SSPSRLPGLFSALSNENTSWMSL

SEQ ID NO: 3079986 - protein, 33 aa, Giardia lamblia
SSPVYAFGIDPAWRWSDNSMMFINSYKMKMAVI

SEQ ID NO: 3079987 - protein, 29 aa, Giardia lamblia
SSQFSANIYLCFLSLFFTSYIGLAQLLFE

SEQ ID NO: 3079988 - protein, 25 aa, Giardia lamblia
SSQLHSIHVEWWKRLLSKLRTHCML

SEQ ID NO: 3079989 - protein, 18 aa, Giardia lamblia
SSQLRLLYSGTYRNGRRR

SEQ ID NO: 3079990 - protein, 19 aa, Giardia lamblia
SSQPGICLVPICTKNEDGC

SEQ ID NO: 3079991 - protein, 17 aa, Giardia lamblia
SSQTFFLKQLVSLPPDF

SEQ ID NO: 3079992 - protein, 17 aa, Giardia lamblia
SSRAAFCRASGFHSLAA

SEQ ID NO: 3079993 - protein, 31 aa, Giardia lamblia
SSRETLIVYPLQVMGSLRFYAPPIVETLLSN

SEQ ID NO: 3079994 - protein, 20 aa, Giardia lamblia
SSRIRFCISSGHTEEQLRQV

SEQ ID NO: 3079995 - protein, 24 aa, Giardia lamblia
SSSDPRYGLKRGIQTGMLSCTFFG

SEQ ID NO: 3079996 - protein, 25 aa, Giardia lamblia
SSSFSGEEFISFVGYHSKMSIALIV

SEQ ID NO: 3079997 - protein, 18 aa, Giardia lamblia
SSSIPVLIFLVSQEGCLR

SEQ ID NO: 3079998 - protein, 21 aa, Giardia lamblia
SSSLDILSLRSYYRVTKLYLR

SEQ ID NO: 3079999 - protein, 26 aa, Giardia lamblia
SSSSCFRDSKIGRWVNFVAKYPSELS

SEQ ID NO: 3080000 - protein, 22 aa, Giardia lamblia
SSSTIPIIFLLTVGADPLSQLQ

SEQ ID NO: 3080001 - protein, 25 aa, Giardia lamblia
SSSYLPDLLLRAALQDLKKQMATTS

SEQ ID NO: 3080002 - protein, 28 aa, Giardia lamblia
SSTKLRIRISILDWKASVANQIKTYKER

SEQ ID NO: 3080003 - protein, 22 aa, Giardia lamblia
SSTLEALTCRQLLTHTPGQGVL

SEQ ID NO: 3080004 - protein, 30 aa, Giardia lamblia
SSTSSSDCVFQFPMVWWLVLVSLLQSLVVI

SEQ ID NO: 3080005 - protein, 22 aa, Giardia lamblia
SSVGCAKCFFGGSISATAAEAS

SEQ ID NO: 3080006 - protein, 18 aa, Giardia lamblia
SSVGCLTHAWALTHARLE

SEQ ID NO: 3080007 - protein, 24 aa, Giardia lamblia
SSVIKWISVGSCTAGALASASLLF

SEQ ID NO: 3080008 - protein, 17 aa, Giardia lamblia
SSVIPLFDGILFALTSF

SEQ ID NO: 3080009 - protein, 25 aa, Giardia lamblia
SSVLKEDAENLILFYDMKNFSGHVP

SEQ ID NO: 3080010 - protein, 27 aa, Giardia lamblia
SSVQLPLAHYLLFWEAAEALLSKQCSS

SEQ ID NO: 3080011 - protein, 23 aa, Giardia lamblia
SSVSALCIRILYIIHSASKLQKE

SEQ ID NO: 3080012 - protein, 17 aa, Giardia lamblia
SSVYIGYRSQIDLTGVY

SEQ ID NO: 3080013 - protein, 17 aa, Giardia lamblia
SSVYLVRRSDGAVVALK

SEQ ID NO: 3080014 - protein, 20 aa, Giardia lamblia
SSVYSPRDLTRWIASVKDHY

SEQ ID NO: 3080015 - protein, 19 aa, Giardia lamblia
SSYCKRPIGPIILFISGLP

SEQ ID NO: 3080016 - protein, 28 aa, Giardia lamblia
SSYELPDPLRLVGCALFGTYLAIASEAP

SEQ ID NO: 3080017 - protein, 20 aa, Giardia lamblia
SSYFFPRTVEDIMEYMANPS

SEQ ID NO: 3080018 - protein, 25 aa, Giardia lamblia
SSYGSCKCVRGYKGVDCTYETCGGY

SEQ ID NO: 3080019 - protein, 25 aa, Giardia lamblia
SSYIKFLLRILQFFSDESPTLLLPA

SEQ ID NO: 3080020 - protein, 24 aa, Giardia lamblia
STAATTICSWCLAVVEYATAWDNV

SEQ ID NO: 3080021 - protein, 25 aa, Giardia lamblia
STAFRSFSLLLLRVLNTELLLVAPA

SEQ ID NO: 3080022 - protein, 20 aa, Giardia lamblia
STAMYSRCVADITIGLILLF

SEQ ID NO: 3080023 - protein, 22 aa, Giardia lamblia
STARLSPFYILGGRSNAEYYEF

SEQ ID NO: 3080024 - protein, 20 aa, Giardia lamblia
STCAVGYYAAFAPRRGETGK

SEQ ID NO: 3080025 - protein, 18 aa, Giardia lamblia
STCREKICSCLLVVCGIL

SEQ ID NO: 3080026 - protein, 23 aa, Giardia lamblia
STCYMFVPEFQFFEKPGAGGQSY

SEQ ID NO: 3080027 - protein, 19 aa, Giardia lamblia
STDELCWSLEQSIFVDNER

SEQ ID NO: 3080028 - protein, 24 aa, Giardia lamblia
STDFTFLCELSRIRGECAAVKEPV

SEQ ID NO: 3080029 - protein, 24 aa, Giardia lamblia
STDVLKMTALMFACDRENVEGALM

SEQ ID NO: 3080030 - protein, 22 aa, Giardia lamblia
STEMELRKALSNGRDVTLNDDI

SEQ ID NO: 3080031 - protein, 19 aa, Giardia lamblia
STEVYHCNVSIKKQTMKKT

SEQ ID NO: 3080032 - protein, 19 aa, Giardia lamblia
STFERLACYTRVHTMARES

SEQ ID NO: 3080033 - protein, 25 aa, Giardia lamblia
STFLKRLGLLMFPYVRFNERSTNLP

SEQ ID NO: 3080034 - protein, 23 aa, Giardia lamblia
STFWTVCVIYIFQLASVPSLAAL

SEQ ID NO: 3080035 - protein, 23 aa, Giardia lamblia
STGCTTCLFGYYIATERRGQPGQ

SEQ ID NO: 3080036 - protein, 21 aa, Giardia lamblia
STGCTTCLLGYYIAAEGKRQP

SEQ ID NO: 3080037 - protein, 19 aa, Giardia lamblia
STGRTALMIAARYGHTDVC

SEQ ID NO: 3080038 - protein, 33 aa, Giardia lamblia
STHFHPAYVAGYVKYTVCHKVIIGEGIYSEADI

SEQ ID NO: 3080039 - protein, 17 aa, Giardia lamblia
STHPQGFNIATFNELKT

SEQ ID NO: 3080040 - protein, 17 aa, Giardia lamblia
STIDLTGLLKCIPQPSY

SEQ ID NO: 3080041 - protein, 21 aa, Giardia lamblia
STIDVWCRVQKGYLYLLNIFG

SEQ ID NO: 3080042 - protein, 18 aa, Giardia lamblia
STIELIDILLAFSSVTEE

SEQ ID NO: 3080043 - protein, 23 aa, Giardia lamblia
STKAEMRNEFRAILDEKEKIIYQ

SEQ ID NO: 3080044 - protein, 26 aa, Giardia lamblia
STKMGIFSVFFLPVLLIILGWILSDV

SEQ ID NO: 3080045 - protein, 18 aa, Giardia lamblia
STLDRLANITAHLTNLSE

SEQ ID NO: 3080046 - protein, 17 aa, Giardia lamblia
STLFIKNSYAIAAIISR

SEQ ID NO: 3080047 - protein, 27 aa, Giardia lamblia
STLKSSFISVLCEFIRLTPEKESVNKP

SEQ ID NO: 3080048 - protein, 19 aa, Giardia lamblia
STLSGGWKRRLSVACSLCN

SEQ ID NO: 3080049 - protein, 19 aa, Giardia lamblia
STLSQIYFWLLATTALCAC

SEQ ID NO: 3080050 - protein, 23 aa, Giardia lamblia
STNFSDQCFDGWTDLLQILGEVD

SEQ ID NO: 3080051 - protein, 20 aa, Giardia lamblia
STNSINACPSMSVFTHLASQ

SEQ ID NO: 3080052 - protein, 23 aa, Giardia lamblia
STPKRWTKKLVDTRNGIRTASYT

SEQ ID NO: 3080053 - protein, 24 aa, Giardia lamblia
STPRSNICLLLGVIHTLFVTLDIT

SEQ ID NO: 3080054 - protein, 25 aa, Giardia lamblia
STPWKETKTILLRPDFVQERKTSCS

SEQ ID NO: 3080055 - protein, 18 aa, Giardia lamblia
STRFRKKYINHHRPTRVL

SEQ ID NO: 3080056 - protein, 28 aa, Giardia lamblia
STRQLSAHLGRPCFVFNCDEAFDYASVV

SEQ ID NO: 3080057 - protein, 25 aa, Giardia lamblia
STSANVRASALLFLGFFMDAAYGVN

SEQ ID NO: 3080058 - protein, 17 aa, Giardia lamblia
STSFKQWVPLLTRALQQ

SEQ ID NO: 3080059 - protein, 24 aa, Giardia lamblia
STSLLLRKSHNVLLNMHRQLQIYR

SEQ ID NO: 3080060 - protein, 17 aa, Giardia lamblia
STSLRFAFNKDVYLVGV

SEQ ID NO: 3080061 - protein, 22 aa, Giardia lamblia
STSQGSFSWLGTLAHLHGNILR

SEQ ID NO: 3080062 - protein, 29 aa, Giardia lamblia
STSRAHRCYFRMVLVMLFIYDKYVLLPAG

SEQ ID NO: 3080063 - protein, 24 aa, Giardia lamblia
STSRLVPVLAELPPGFEIEPTGGL

SEQ ID NO: 3080064 - protein, 29 aa, Giardia lamblia
STSRRSACEGILRTVCRALPEARGVAMQK

SEQ ID NO: 3080065 - protein, 24 aa, Giardia lamblia
STTNSSWRPPGLEKSDQTACANLV

SEQ ID NO: 3080066 - protein, 24 aa, Giardia lamblia
STTPISSLRLVWSMLQNSASDDGF

SEQ ID NO: 3080067 - protein, 20 aa, Giardia lamblia
STTVSVIFDDCCWIYHFITS

SEQ ID NO: 3080068 - protein, 26 aa, Giardia lamblia
STVCNVSNCLRCDLVTLRICTMCDSG

SEQ ID NO: 3080069 - protein, 17 aa, Giardia lamblia
STVEAWEAEEIISELRY

SEQ ID NO: 3080070 - protein, 27 aa, Giardia lamblia
STVELFVRALLPFGLFLFCVHVTLRLR

SEQ ID NO: 3080071 - protein, 17 aa, Giardia lamblia
STVHSFLCHTLFSRGQE

SEQ ID NO: 3080072 - protein, 23 aa, Giardia lamblia
STVYSREFLLFIVDCTNRGEAWT

SEQ ID NO: 3080073 - protein, 24 aa, Giardia lamblia
STWRTEMLICIKHKQMEYLCNIFL

SEQ ID NO: 3080074 - protein, 27 aa, Giardia lamblia
STYADGFCKIYLPKEAFMGGDVRVTIR

SEQ ID NO: 3080075 - protein, 17 aa, Giardia lamblia
STYDAAVNWMVNLQSYF

SEQ ID NO: 3080076 - protein, 19 aa, Giardia lamblia
STYLMKEYPEFLTCLMFYL

SEQ ID NO: 3080077 - protein, 19 aa, Giardia lamblia
SVAGLAFVALCFVPELLNA

SEQ ID NO: 3080078 - protein, 20 aa, Giardia lamblia
SVAGVLVWFFLFRNRKGPMK

SEQ ID NO: 3080079 - protein, 24 aa, Giardia lamblia
SVAISWLLEKVVAYTDVRCRKSAA

SEQ ID NO: 3080080 - protein, 17 aa, Giardia lamblia
SVALFQFIGSWLQFNFS

SEQ ID NO: 3080081 - protein, 26 aa, Giardia lamblia
SVCLEFPRRFFTRFAPKILEATNQNA

SEQ ID NO: 3080082 - protein, 18 aa, Giardia lamblia
SVCTKLEALSPFLTYPLT

SEQ ID NO: 3080083 - protein, 23 aa, Giardia lamblia
SVDRLANMLVDFVRLSPIERTNL

SEQ ID NO: 3080084 - protein, 18 aa, Giardia lamblia
SVDYKVFTVMGLPVSSSI

SEQ ID NO: 3080085 - protein, 23 aa, Giardia lamblia
SVEFAAPITKYVVYPGERTDFRY

SEQ ID NO: 3080086 - protein, 18 aa, Giardia lamblia
SVELLVSLFGVSRTFLQA

SEQ ID NO: 3080087 - protein, 24 aa, Giardia lamblia
SVELPEIYDILATRKAMLAFENIK

SEQ ID NO: 3080088 - protein, 26 aa, Giardia lamblia
SVERALKFGFTLIIEDGDSLDPALFV

SEQ ID NO: 3080089 - protein, 21 aa, Giardia lamblia
SVEWLVQLFISKPVRPKHGLI

SEQ ID NO: 3080090 - protein, 25 aa, Giardia lamblia
SVFKRSEDAFGYVYYLWMFIGGPIL

SEQ ID NO: 3080091 - protein, 23 aa, Giardia lamblia
SVFTGNIVDLEWKGKPPENSNVI

SEQ ID NO: 3080092 - protein, 26 aa, Giardia lamblia
SVGDRPAYQVPKSIDRRAAARRQEPS

SEQ ID NO: 3080093 - protein, 17 aa, Giardia lamblia
SVGRRFGKAFKRVVDAY

SEQ ID NO: 3080094 - protein, 18 aa, Giardia lamblia
SVHAIVFVGTEQGRIQAF

SEQ ID NO: 3080095 - protein, 19 aa, Giardia lamblia
SVHLVFSGLAAVGADQYLW

SEQ ID NO: 3080096 - protein, 26 aa, Giardia lamblia
SVHYLPELFKVFRYVIERLNLCISPE

SEQ ID NO: 3080097 - protein, 31 aa, Giardia lamblia
SVIAITLVSVFKCCPCASVKRIYYKQQSKGH

SEQ ID NO: 3080098 - protein, 19 aa, Giardia lamblia
SVIFPEFIKSKSSIIDARL

SEQ ID NO: 3080099 - protein, 18 aa, Giardia lamblia
SVIGKSELGLGFTGKNAL

SEQ ID NO: 3080100 - protein, 22 aa, Giardia lamblia
SVILLCYGILFFIVRSRDKSVY

SEQ ID NO: 3080101 - protein, 20 aa, Giardia lamblia
SVILRFSIYSDTIFNSEDDA

SEQ ID NO: 3080102 - protein, 31 aa, Giardia lamblia
SVINCYALEVMITWFAKGPVVAFSILQKTSI

SEQ ID NO: 3080103 - protein, 21 aa, Giardia lamblia
SVIPPELPMEVSMTVSASLQE

SEQ ID NO: 3080104 - protein, 22 aa, Giardia lamblia
SVISGYFIKFSHDPRFMLYGMF

SEQ ID NO: 3080105 - protein, 27 aa, Giardia lamblia
SVITAFWKTHALETHFALSGPEVPAEH

SEQ ID NO: 3080106 - protein, 18 aa, Giardia lamblia
SVKGFNMRTYRWAAVSSA

SEQ ID NO: 3080107 - protein, 25 aa, Giardia lamblia
SVKSMTPYAPVSMPTGLTASEVPIC

SEQ ID NO: 3080108 - protein, 30 aa, Giardia lamblia
SVLESLTTVSLCFDLLIGAHVNLYRMRSLE

SEQ ID NO: 3080109 - protein, 23 aa, Giardia lamblia
SVLETFAGLIDRIYLDSEASSTD

SEQ ID NO: 3080110 - protein, 18 aa, Giardia lamblia
SVLFAIFMHLLRLSYLVD

SEQ ID NO: 3080111 - protein, 36 aa, Giardia lamblia
SVLIKRASSAVSWNAVFSRRALECLSDERKRYNELV

SEQ ID NO: 3080112 - protein, 18 aa, Giardia lamblia
SVLLESFWSDLYGIDLSN

SEQ ID NO: 3080113 - protein, 19 aa, Giardia lamblia
SVLPHPFVSMAHKQLATFS

SEQ ID NO: 3080114 - protein, 17 aa, Giardia lamblia
SVLPPDIFGEFRGTLIL

SEQ ID NO: 3080115 - protein, 24 aa, Giardia lamblia
SVLVRLQMDLAFGRVYGSITTFNS

SEQ ID NO: 3080116 - protein, 20 aa, Giardia lamblia
SVMQCKRETGMLIKTNIIQL

SEQ ID NO: 3080117 - protein, 25 aa, Giardia lamblia
SVMQRLRLVFKKRIRDLRCFIERSI

SEQ ID NO: 3080118 - protein, 23 aa, Giardia lamblia
SVMREHLLIYIIIIILFLLTIIL

SEQ ID NO: 3080119 - protein, 17 aa, Giardia lamblia
SVMSVLRPTDAAPRLEK

SEQ ID NO: 3080120 - protein, 21 aa, Giardia lamblia
SVPAFNILSATSFALACLLDP

SEQ ID NO: 3080121 - protein, 21 aa, Giardia lamblia
SVPAPIRFVRDPTLNDLKNSI

SEQ ID NO: 3080122 - protein, 23 aa, Giardia lamblia
SVQAVLTYSCETFVRYLLIIIYY

SEQ ID NO: 3080123 - protein, 23 aa, Giardia lamblia
SVQSIRMLIPFAPQEIFDSMCTF

SEQ ID NO: 3080124 - protein, 19 aa, Giardia lamblia
SVRDWPRQIKLLTRPSFQQ

SEQ ID NO: 3080125 - protein, 26 aa, Giardia lamblia
SVRRMAICSLTLIVSTAWENPGVATA

SEQ ID NO: 3080126 - protein, 26 aa, Giardia lamblia
SVRSPKRWTATFSHIYNTRYFTELSA

SEQ ID NO: 3080127 - protein, 23 aa, Giardia lamblia
SVRSRSSVMFLYRRSRSLRKVTE

SEQ ID NO: 3080128 - protein, 20 aa, Giardia lamblia
SVSASYFLFFFKVLRASSLD

SEQ ID NO: 3080129 - protein, 20 aa, Giardia lamblia
SVSCKARDTVTCGGVFGHVF

SEQ ID NO: 3080130 - protein, 18 aa, Giardia lamblia
SVSDLDLSGLRTYDTGSF

SEQ ID NO: 3080131 - protein, 22 aa, Giardia lamblia
SVSERPIAELIDKVSVKGSLDA

SEQ ID NO: 3080132 - protein, 17 aa, Giardia lamblia
SVSFMLRLPSTKVSESV

SEQ ID NO: 3080133 - protein, 27 aa, Giardia lamblia
SVTCIKGCTRSASIPGITGLIDVISSS

SEQ ID NO: 3080134 - protein, 19 aa, Giardia lamblia
SVTDMPSLGILGSVLYSAI

SEQ ID NO: 3080135 - protein, 23 aa, Giardia lamblia
SVTLMLCCIMIFVIFLNGEINLV

SEQ ID NO: 3080136 - protein, 24 aa, Giardia lamblia
SVTRPFPFLTYFGPRSDLAALSRI

SEQ ID NO: 3080137 - protein, 23 aa, Giardia lamblia
SVVGFLLWWFLYRRTQPYGAKHV

SEQ ID NO: 3080138 - protein, 22 aa, Giardia lamblia
SVVQTICRLLDALLSEYYTSPG

SEQ ID NO: 3080139 - protein, 18 aa, Giardia lamblia
SVVRIMIGALLLGCVVCF

SEQ ID NO: 3080140 - protein, 23 aa, Giardia lamblia
SVWEILMFSNFVDILRDMISVGQ

SEQ ID NO: 3080141 - protein, 35 aa, Giardia lamblia
SVYIHFVHFYMTYHFIRLVWSTIRAFDPLETSFLF

SEQ ID NO: 3080142 - protein, 25 aa, Giardia lamblia
SVYKELLKGMPIRFYDIAKTLVPTR

SEQ ID NO: 3080143 - protein, 24 aa, Giardia lamblia
SVYYPLNIGSFFGRFESDTPLQHF

SEQ ID NO: 3080144 - protein, 21 aa, Giardia lamblia
SWCLRQGIATQLRSPRQDLHN

SEQ ID NO: 3080145 - protein, 18 aa, Giardia lamblia
SWGADWGVYGYAYVAQGG

SEQ ID NO: 3080146 - protein, 22 aa, Giardia lamblia
SWGEKWGDYGYFYVPIGEDTLC

SEQ ID NO: 3080147 - protein, 26 aa, Giardia lamblia
SWIFQFINGYFLIKGSLPVGLINSFT

SEQ ID NO: 3080148 - protein, 23 aa, Giardia lamblia
SWIWSGSGLYYFTIDRIIPSNVR

SEQ ID NO: 3080149 - protein, 18 aa, Giardia lamblia
SWLSPAPNILFFLQNTIF

SEQ ID NO: 3080150 - protein, 17 aa, Giardia lamblia
SWRFCCKNKKPKHPLDI

SEQ ID NO: 3080151 - protein, 18 aa, Giardia lamblia
SWSSAINYILFYSGSGNY

SEQ ID NO: 3080152 - protein, 19 aa, Giardia lamblia
SYCQTHRYVFVQLASSIGG

SEQ ID NO: 3080153 - protein, 17 aa, Giardia lamblia
SYDCLPVGIPDSIRNPD

SEQ ID NO: 3080154 - protein, 23 aa, Giardia lamblia
SYDHSNCWSNPYIIYNINTDYDP

SEQ ID NO: 3080155 - protein, 19 aa, Giardia lamblia
SYEGYPAAFAPKNVSLKNL

SEQ ID NO: 3080156 - protein, 24 aa, Giardia lamblia
SYETFKINVVWTHEMRHYLYSALY

SEQ ID NO: 3080157 - protein, 18 aa, Giardia lamblia
SYFSPDLCGVHAGCALLE

SEQ ID NO: 3080158 - protein, 22 aa, Giardia lamblia
SYHLFSVMAVEFIDSMVDITSR

SEQ ID NO: 3080159 - protein, 19 aa, Giardia lamblia
SYINLRLTWSNSRSLGSGN

SEQ ID NO: 3080160 - protein, 18 aa, Giardia lamblia
SYINMCKILLGLASSKTY

SEQ ID NO: 3080161 - protein, 33 aa, Giardia lamblia
SYKAPIPQFLSCASVLRSRVLSFVLSTTQASSD

SEQ ID NO: 3080162 - protein, 26 aa, Giardia lamblia
SYKPFKLTKRMFASIMQHLPRMLPDR

SEQ ID NO: 3080163 - protein, 19 aa, Giardia lamblia
SYLAHYIMLSLLWSILCTI

SEQ ID NO: 3080164 - protein, 19 aa, Giardia lamblia
SYLEAFSMVLVESLQEACI

SEQ ID NO: 3080165 - protein, 19 aa, Giardia lamblia
SYMLCITITELYDAIVEEG

SEQ ID NO: 3080166 - protein, 18 aa, Giardia lamblia
SYNGATCDEGWKNVGTSL

SEQ ID NO: 3080167 - protein, 24 aa, Giardia lamblia
SYNVMPFKNSFVYIANLTAEEVAC

SEQ ID NO: 3080168 - protein, 18 aa, Giardia lamblia
SYPNNCDIYAILVPCESS

SEQ ID NO: 3080169 - protein, 23 aa, Giardia lamblia
SYPNTCVFFIFVLFTGLTMASTF

SEQ ID NO: 3080170 - protein, 18 aa, Giardia lamblia
SYPPFNFYDGPPFATGLP

SEQ ID NO: 3080171 - protein, 31 aa, Giardia lamblia
SYPQIRLSLLLKRAECISSVLLFLWVSGDIS

SEQ ID NO: 3080172 - protein, 27 aa, Giardia lamblia
SYPYCWRSDTPLIYRAIPSWFVRVEQI

SEQ ID NO: 3080173 - protein, 25 aa, Giardia lamblia
SYQRSGCSGSIMLDCGLHPALSETR

SEQ ID NO: 3080174 - protein, 34 aa, Giardia lamblia
SYSADWLMRVMNRWLSFRVNVIMGIFASLVSMSV

SEQ ID NO: 3080175 - protein, 23 aa, Giardia lamblia
SYSFCPLRNCIKCPVTDADKLCE

SEQ ID NO: 3080176 - protein, 21 aa, Giardia lamblia
SYSNGFRFLRNTLGFMGFIDL

SEQ ID NO: 3080177 - protein, 19 aa, Giardia lamblia
SYVKALRHIYGSEKDYMSR

SEQ ID NO: 3080178 - protein, 24 aa, Giardia lamblia
SYVPFERIVSGLAFVYKTIASDTY

SEQ ID NO: 3080179 - protein, 26 aa, Giardia lamblia
SYWVPQCYHMYKIRSPTMGYTYTYVV

SEQ ID NO: 3080180 - protein, 19 aa, Giardia lamblia
SYYGPRFAFDADYRDRVIL

SEQ ID NO: 3080181 - protein, 19 aa, Giardia lamblia
SYYKLICRIADSCHTVATL

SEQ ID NO: 3080182 - protein, 20 aa, Giardia lamblia
SYYRNFFSYHMPDILRDTEM

SEQ ID NO: 3080183 - protein, 42 aa, Giardia lamblia
SYYTAKVLLAYFCAFGTDTLELITAIAPDFAVVLTEVSPDMG

SEQ ID NO: 3080184 - protein, 23 aa, Giardia lamblia
SYYYKRFFLTGSVHDYDTFYILL

SEQ ID NO: 3080185 - protein, 28 aa, Giardia lamblia
TAAALGELCCNIMLWILLIGTSLKSLME

SEQ ID NO: 3080186 - protein, 17 aa, Giardia lamblia
TAAFDYARRRAIRDHPT

SEQ ID NO: 3080187 - protein, 17 aa, Giardia lamblia
TAALKALLNSGGYASLV

SEQ ID NO: 3080188 - protein, 27 aa, Giardia lamblia
TAARTRMAASLGICLQDDAILYEPLTV

SEQ ID NO: 3080189 - protein, 23 aa, Giardia lamblia
TACELKARHTLMAQQVDISAVSA

SEQ ID NO: 3080190 - protein, 23 aa, Giardia lamblia
TACTLQNCDLCYDGSICDTCSSG

SEQ ID NO: 3080191 - protein, 18 aa, Giardia lamblia
TADYTCRNNFCYKKCPTT

SEQ ID NO: 3080192 - protein, 20 aa, Giardia lamblia
TAEAFLRLCRAIVYTPISVL

SEQ ID NO: 3080193 - protein, 24 aa, Giardia lamblia
TAEFTRTQLHICINKNYQVCETYP

SEQ ID NO: 3080194 - protein, 18 aa, Giardia lamblia
TAEGRYKLVKSIKTLLEV

SEQ ID NO: 3080195 - protein, 18 aa, Giardia lamblia
TAFCAQTNLSYGFNRSII

SEQ ID NO: 3080196 - protein, 17 aa, Giardia lamblia
TAFGLKFVKEGDVSQLA

SEQ ID NO: 3080197 - protein, 19 aa, Giardia lamblia
TAGDLISPFVRPNHLIKSK

SEQ ID NO: 3080198 - protein, 27 aa, Giardia lamblia
TAGGFFRPAVPWWPSPSKGLGLGSLPM

SEQ ID NO: 3080199 - protein, 24 aa, Giardia lamblia
TAGIGLYCTWVFVMSITAIIVCIQ

SEQ ID NO: 3080200 - protein, 19 aa, Giardia lamblia
TAGRLAWVRLIMRRLTTVY

SEQ ID NO: 3080201 - protein, 25 aa, Giardia lamblia
TAHRGEDFCHLWAFYKNKELIEPLP

SEQ ID NO: 3080202 - protein, 19 aa, Giardia lamblia
TAIACYFRNNFADADFKRL

SEQ ID NO: 3080203 - protein, 21 aa, Giardia lamblia
TAIICPSFFVEFHDKVSFYSH

SEQ ID NO: 3080204 - protein, 26 aa, Giardia lamblia
TAITFFKLLCPLLKSLEKRAIIVTKL

SEQ ID NO: 3080205 - protein, 22 aa, Giardia lamblia
TAIVALQLVIAWLRDYETEQLW

SEQ ID NO: 3080206 - protein, 19 aa, Giardia lamblia
TAKCTVCKYGKYIKENGND

SEQ ID NO: 3080207 - protein, 25 aa, Giardia lamblia
TAKEKCILCGDTVGFNGKVGMDGCS

SEQ ID NO: 3080208 - protein, 26 aa, Giardia lamblia
TAKEYFRKMCTPPCTDEASALQMGLR

SEQ ID NO: 3080209 - protein, 25 aa, Giardia lamblia
TAKKWKNWKAWMAIDKLLNDLIPIP

SEQ ID NO: 3080210 - protein, 26 aa, Giardia lamblia
TALPPVCFYGTIKIDYSNYLATVARQ

SEQ ID NO: 3080211 - protein, 18 aa, Giardia lamblia
TALPTVFIYMFKKTMARA

SEQ ID NO: 3080212 - protein, 22 aa, Giardia lamblia
TALRAATCAAMGMPPSAAYPRI

SEQ ID NO: 3080213 - protein, 18 aa, Giardia lamblia
TALSIAMERGHNHIVELL

SEQ ID NO: 3080214 - protein, 25 aa, Giardia lamblia
TALTYIRFIALSKMWTDMVLEMTKI

SEQ ID NO: 3080215 - protein, 19 aa, Giardia lamblia
TAMGSLYCSRCALDDEWPI

SEQ ID NO: 3080216 - protein, 26 aa, Giardia lamblia
TAMSLLKFRDSILFDGIMDEPPADLL

SEQ ID NO: 3080217 - protein, 25 aa, Giardia lamblia
TANLPTTLSIILSNIFLKFTRNSFL

SEQ ID NO: 3080218 - protein, 27 aa, Giardia lamblia
TAPDCKVSSCTYCDARDSGICRICASR

SEQ ID NO: 3080219 - protein, 23 aa, Giardia lamblia
TAPEPVISLFLSRFAHTLRLGAT

SEQ ID NO: 3080220 - protein, 25 aa, Giardia lamblia
TAPNIYSVICATVYIIVPNRTKKIG

SEQ ID NO: 3080221 - protein, 22 aa, Giardia lamblia
TAPSCSIFAIKISLVPDSALRF

SEQ ID NO: 3080222 - protein, 26 aa, Giardia lamblia
TAPVPFYWWRNGRVYYDEGLVAVSLA

SEQ ID NO: 3080223 - protein, 27 aa, Giardia lamblia
TAPYMCYRDNLAFARPLPLFKTNAIIR

SEQ ID NO: 3080224 - protein, 18 aa, Giardia lamblia
TAQRCRESIESKKMSAWE

SEQ ID NO: 3080225 - protein, 23 aa, Giardia lamblia
TASDLRLPSAVLDKIQLILSSAS

SEQ ID NO: 3080226 - protein, 21 aa, Giardia lamblia
TASFFAKVLFALRRSSRPIAF

SEQ ID NO: 3080227 - protein, 25 aa, Giardia lamblia
TASFKCPFHDLLLVDDDIFHNPEAT

SEQ ID NO: 3080228 - protein, 22 aa, Giardia lamblia
TASKPRLSLRMGQKKYMDLELM

SEQ ID NO: 3080229 - protein, 23 aa, Giardia lamblia
TATSSLFSLSWVRSLSLYSSSPG

SEQ ID NO: 3080230 - protein, 22 aa, Giardia lamblia
TATWLPYFMLMLPWLIKCTTES

SEQ ID NO: 3080231 - protein, 19 aa, Giardia lamblia
TAVRSEILIQWAGELENRL

SEQ ID NO: 3080232 - protein, 19 aa, Giardia lamblia
TAVSLLLHFPTLINGVIRQ

SEQ ID NO: 3080233 - protein, 23 aa, Giardia lamblia
TAWRICRELNIDYMLILYGGMSG

SEQ ID NO: 3080234 - protein, 25 aa, Giardia lamblia
TAYAIATSFARKDCFTNELVNSLRV

SEQ ID NO: 3080235 - protein, 23 aa, Giardia lamblia
TCAASRCNKSWKSLWMCCTCGRF

SEQ ID NO: 3080236 - protein, 24 aa, Giardia lamblia
TCAESGTACRLCFNGYSPNETGSC

SEQ ID NO: 3080237 - protein, 21 aa, Giardia lamblia
TCAIAYLGVFNLKYRAELLEF

SEQ ID NO: 3080238 - protein, 24 aa, Giardia lamblia
TCDSSKCTFCMPGYALTSDSTCQA

SEQ ID NO: 3080239 - protein, 18 aa, Giardia lamblia
TCFANGDLLTPVAPSSIA

SEQ ID NO: 3080240 - protein, 27 aa, Giardia lamblia
TCGHCVMYLDHHCPWVGTDVGFRNHFY

SEQ ID NO: 3080241 - protein, 17 aa, Giardia lamblia
TCGIESCQACTPKDNDL

SEQ ID NO: 3080242 - protein, 17 aa, Giardia lamblia
TCGIESCQACTPKDNNL

SEQ ID NO: 3080243 - protein, 18 aa, Giardia lamblia
TCGSTCACFAKRAREAHM

SEQ ID NO: 3080244 - protein, 20 aa, Giardia lamblia
TCGYHKLLLFDEATTGTDPE

SEQ ID NO: 3080245 - protein, 25 aa, Giardia lamblia
TCIRTAACRCVYLVVSCLTRTLSMS

SEQ ID NO: 3080246 - protein, 30 aa, Giardia lamblia
TCKCGLGTAGLTCAIPFCRGPSQKCNDPKI

SEQ ID NO: 3080247 - protein, 24 aa, Giardia lamblia
TCKCPPAYTGAKCENCATNYKRHS

SEQ ID NO: 3080248 - protein, 23 aa, Giardia lamblia
TCKETRFTSIDAYVVQLLDSETT

SEQ ID NO: 3080249 - protein, 24 aa, Giardia lamblia
TCKRSCVSPVHISSTFKISTSSSL

SEQ ID NO: 3080250 - protein, 23 aa, Giardia lamblia
TCLSRLKTMQLFASVAILHTNFK

SEQ ID NO: 3080251 - protein, 18 aa, Giardia lamblia
TCNSFASIHVEELAQDTI

SEQ ID NO: 3080252 - protein, 26 aa, Giardia lamblia
TCPSIKFLYVCSGLSILYYRIPFVRD

SEQ ID NO: 3080253 - protein, 18 aa, Giardia lamblia
TCQVFMLLTYIQRQHLKS

SEQ ID NO: 3080254 - protein, 19 aa, Giardia lamblia
TCRNNFCYKKCPTTSAELG

SEQ ID NO: 3080255 - protein, 22 aa, Giardia lamblia
TCRPCPRTGYYCLSGEDPKPCP

SEQ ID NO: 3080256 - protein, 20 aa, Giardia lamblia
TCSCSQGWTLHGTLCYPSAC

SEQ ID NO: 3080257 - protein, 19 aa, Giardia lamblia
TCSTYIFSTVLPRLNLGTN

SEQ ID NO: 3080258 - protein, 17 aa, Giardia lamblia
TCTECQAGFVTKDSACV

SEQ ID NO: 3080259 - protein, 26 aa, Giardia lamblia
TCTPCGADCWICESTAKCTVCKYGKY

SEQ ID NO: 3080260 - protein, 23 aa, Giardia lamblia
TCTQCPNGFHLVHFGEHNKTCMH

SEQ ID NO: 3080261 - protein, 24 aa, Giardia lamblia
TCTQDCWDYTSFWVLSSSGPTTDN

SEQ ID NO: 3080262 - protein, 23 aa, Giardia lamblia
TCTTIDWFQAWPHEALVSVGKRF

SEQ ID NO: 3080263 - protein, 31 aa, Giardia lamblia
TCVAIFLVHLGFCFVAIYFIDGCATCTACKS

SEQ ID NO: 3080264 - protein, 18 aa, Giardia lamblia
TCYSCKKGFFSPNLDCGS

SEQ ID NO: 3080265 - protein, 20 aa, Giardia lamblia
TDDEVRAIAAMYTHPAFALS

SEQ ID NO: 3080266 - protein, 20 aa, Giardia lamblia
TDDLRPATVDALHHSPKEHL

SEQ ID NO: 3080267 - protein, 32 aa, Giardia lamblia
TDEEGSTNKCCYDIESIFSLGMPSDEKSFELL

SEQ ID NO: 3080268 - protein, 25 aa, Giardia lamblia
TDELISDIFWEFDKQPILNEENFEF

SEQ ID NO: 3080269 - protein, 35 aa, Giardia lamblia
TDESIDFFKGVSLCFIDFLKPIVFILLRNSSHLNW

SEQ ID NO: 3080270 - protein, 17 aa, Giardia lamblia
TDFRIMAAAARSAALDS

SEQ ID NO: 3080271 - protein, 27 aa, Giardia lamblia
TDFTYRYRYPFMIAFTGSSRYEGRIVF

SEQ ID NO: 3080272 - protein, 24 aa, Giardia lamblia
TDGTVCIAGGFAYVVRAPISNILS

SEQ ID NO: 3080273 - protein, 24 aa, Giardia lamblia
TDHTGRTALSWATERGYVNIVRYL

SEQ ID NO: 3080274 - protein, 20 aa, Giardia lamblia
TDIEIYPGYISLFVRESSAD

SEQ ID NO: 3080275 - protein, 17 aa, Giardia lamblia
TDIHLGMQLFLVAHSNN

SEQ ID NO: 3080276 - protein, 26 aa, Giardia lamblia
TDILKAASPILFKRFVYKVMSMCDED

SEQ ID NO: 3080277 - protein, 17 aa, Giardia lamblia
TDIRNALSLTARSDTDQ

SEQ ID NO: 3080278 - protein, 21 aa, Giardia lamblia
TDIVKLLFPYEGHLKDNKGNT

SEQ ID NO: 3080279 - protein, 20 aa, Giardia lamblia
TDLAPRFQVSTWDRRMSNLR

SEQ ID NO: 3080280 - protein, 17 aa, Giardia lamblia
TDLCSYFQGHRYARILD

SEQ ID NO: 3080281 - protein, 28 aa, Giardia lamblia
TDLFGSLHKLCFIIARANGFLHMEPFHT

SEQ ID NO: 3080282 - protein, 34 aa, Giardia lamblia
TDLHLPALRRTDLEFSDNHLFLLYSFSTAMFALV

SEQ ID NO: 3080283 - protein, 21 aa, Giardia lamblia
TDLPKRYAECMRKCDRVVKAG

SEQ ID NO: 3080284 - protein, 30 aa, Giardia lamblia
TDLRKITHFCLGDAIASIFGGCLDQLEPSC

SEQ ID NO: 3080285 - protein, 24 aa, Giardia lamblia
TDMLGRSALMYAVINKRPACVSIL

SEQ ID NO: 3080286 - protein, 21 aa, Giardia lamblia
TDNISVIVVLFRWKGITPNTI

SEQ ID NO: 3080287 - protein, 17 aa, Giardia lamblia
TDQCISCGDGYGADGYS

SEQ ID NO: 3080288 - protein, 26 aa, Giardia lamblia
TDRNGRTGLMIAAERGYLGIMRLLIP

SEQ ID NO: 3080289 - protein, 17 aa, Giardia lamblia
TDRRPAISRSWCISDEH

SEQ ID NO: 3080290 - protein, 22 aa, Giardia lamblia
TDRSLRFLAYPYIVFPVNNTTH

SEQ ID NO: 3080291 - protein, 24 aa, Giardia lamblia
TDRTLRFVPPITVSLGKVTDGLCT

SEQ ID NO: 3080292 - protein, 25 aa, Giardia lamblia
TDSEIFPGSLYLPAMITDQSASLLA

SEQ ID NO: 3080293 - protein, 24 aa, Giardia lamblia
TDSKGRTALMLAAIYGHADACKVL

SEQ ID NO: 3080294 - protein, 18 aa, Giardia lamblia
TDSSIYYNNIWDIVRTDK

SEQ ID NO: 3080295 - protein, 26 aa, Giardia lamblia
TDSTKACVCLRLFNLCSTDAPEALLQ

SEQ ID NO: 3080296 - protein, 18 aa, Giardia lamblia
TDSVPMRIITAILPLNPD

SEQ ID NO: 3080297 - protein, 36 aa, Giardia lamblia
TDSYLLCEPEVIAVFCVVEGVLLYAQRHSISLNTTR

SEQ ID NO: 3080298 - protein, 24 aa, Giardia lamblia
TDTDAFRFFYAFQVNCESANIRLV

SEQ ID NO: 3080299 - protein, 18 aa, Giardia lamblia
TDTYLLRASVSYYDEQRE

SEQ ID NO: 3080300 - protein, 17 aa, Giardia lamblia
TDVCKLLLEEAGLQDQE

SEQ ID NO: 3080301 - protein, 17 aa, Giardia lamblia
TDVEVDFFARILCGDYD

SEQ ID NO: 3080302 - protein, 18 aa, Giardia lamblia
TDVHCFTISTLVSQPSLP

SEQ ID NO: 3080303 - protein, 18 aa, Giardia lamblia
TDVKDGFKPAASANNILT

SEQ ID NO: 3080304 - protein, 25 aa, Giardia lamblia
TDYMPWLLRRTFSLAYRNLLLSYIS

SEQ ID NO: 3080305 - protein, 21 aa, Giardia lamblia
TEAAHKLLLFDAHASNSLLLQ

SEQ ID NO: 3080306 - protein, 22 aa, Giardia lamblia
TEAKRNLLLSWIWSGSGLYYFT

SEQ ID NO: 3080307 - protein, 20 aa, Giardia lamblia
TEANAVCALENLQVKEFAHI

SEQ ID NO: 3080308 - protein, 19 aa, Giardia lamblia
TECAGELFVSLDGQSCLEE

SEQ ID NO: 3080309 - protein, 18 aa, Giardia lamblia
TEDLSLFVCTCFNACGKV

SEQ ID NO: 3080310 - protein, 17 aa, Giardia lamblia
TEDVCTRTAYIACACLL

SEQ ID NO: 3080311 - protein, 18 aa, Giardia lamblia
TEECQRRDTTIGIYSESD

SEQ ID NO: 3080312 - protein, 23 aa, Giardia lamblia
TEFPLDNFDRFIASHLHTPLLVE

SEQ ID NO: 3080313 - protein, 27 aa, Giardia lamblia
TEFRGLKKLLLWYGKCSYVGSAQICQF

SEQ ID NO: 3080314 - protein, 25 aa, Giardia lamblia
TEIGREFITIPGLQHDLKNTSVIIT

SEQ ID NO: 3080315 - protein, 17 aa, Giardia lamblia
TEIIRRFYDGFDQIYIP

SEQ ID NO: 3080316 - protein, 17 aa, Giardia lamblia
TEILVPPEGRWKRTEDD

SEQ ID NO: 3080317 - protein, 25 aa, Giardia lamblia
TELARTGTVLSVFEQAWSIGLINML

SEQ ID NO: 3080318 - protein, 22 aa, Giardia lamblia
TELCTTCLEPADSLEALPLGCY

SEQ ID NO: 3080319 - protein, 21 aa, Giardia lamblia
TELFLGKRLVFRALDVAWTTT

SEQ ID NO: 3080320 - protein, 22 aa, Giardia lamblia
TELKCSACTTGMVPNFNQVHCI

SEQ ID NO: 3080321 - protein, 17 aa, Giardia lamblia
TELNKLRQERMVPDTAT

SEQ ID NO: 3080322 - protein, 22 aa, Giardia lamblia
TELPPEYQFVTWEYRKKLREQG

SEQ ID NO: 3080323 - protein, 27 aa, Giardia lamblia
TELPTARTRLWLIDMVIFPICCNNHWS

SEQ ID NO: 3080324 - protein, 24 aa, Giardia lamblia
TELREHLCSLPIWEYKQTAIACLE

SEQ ID NO: 3080325 - protein, 17 aa, Giardia lamblia
TELRRLASDYVSRAPLA

SEQ ID NO: 3080326 - protein, 22 aa, Giardia lamblia
TELSAVAVFLAGLILAGECFAL

SEQ ID NO: 3080327 - protein, 22 aa, Giardia lamblia
TELWLYMWMMFVLFSGLMLLAF

SEQ ID NO: 3080328 - protein, 19 aa, Giardia lamblia
TELYERWRLNKYLRNLPTH

SEQ ID NO: 3080329 - protein, 20 aa, Giardia lamblia
TELYNLFLCDNCLTGVGETL

SEQ ID NO: 3080330 - protein, 20 aa, Giardia lamblia
TENERCIKEYYAKHADTRRE

SEQ ID NO: 3080331 - protein, 21 aa, Giardia lamblia
TENLSRFNIMLLDIGQTLNSY

SEQ ID NO: 3080332 - protein, 21 aa, Giardia lamblia
TENRYKCLFDEYNMHFGHNYE

SEQ ID NO: 3080333 - protein, 33 aa, Giardia lamblia
TEPPKTRCVVVGKLRLFQLYNMLNCSAIPSHFT

SEQ ID NO: 3080334 - protein, 25 aa, Giardia lamblia
TEPRASYRMAVGLLSLQCHTNHRLM

SEQ ID NO: 3080335 - protein, 22 aa, Giardia lamblia
TEPRCHCGPPPAAPLSSFGIAG

SEQ ID NO: 3080336 - protein, 23 aa, Giardia lamblia
TEQELVLFWSLLEDFSLRVYMAL

SEQ ID NO: 3080337 - protein, 34 aa, Giardia lamblia
TEQQALEFLSEFKIIDNLHNWKVNIAQSLGRYLP

SEQ ID NO: 3080338 - protein, 20 aa, Giardia lamblia
TEQWYKYKYLILNYGAPNAN

SEQ ID NO: 3080339 - protein, 27 aa, Giardia lamblia
TERAYHCKICRGCVLKRDHHCPWIGSC

SEQ ID NO: 3080340 - protein, 24 aa, Giardia lamblia
TERISASISTIWLMEQYYGVSRSN

SEQ ID NO: 3080341 - protein, 26 aa, Giardia lamblia
TERKAAKRNIPRGCFYDLTTDFISAV

SEQ ID NO: 3080342 - protein, 17 aa, Giardia lamblia
TERMRELEVEKTVTEEK

SEQ ID NO: 3080343 - protein, 20 aa, Giardia lamblia
TERPSADVLLEYPYLTKAIL

SEQ ID NO: 3080344 - protein, 22 aa, Giardia lamblia
TERVRFNLRFSPLTDLYQMGFF

SEQ ID NO: 3080345 - protein, 30 aa, Giardia lamblia
TESDLAQIRACPCCDFKMEQNITVPRTHIP

SEQ ID NO: 3080346 - protein, 23 aa, Giardia lamblia
TESLIMPECVFRRYKEYFTLVLA

SEQ ID NO: 3080347 - protein, 24 aa, Giardia lamblia
TETAHLKYSFPSIIAADKNTIDSS

SEQ ID NO: 3080348 - protein, 25 aa, Giardia lamblia
TETEYDYSICLLDFSNRDFTSTFDS

SEQ ID NO: 3080349 - protein, 24 aa, Giardia lamblia
TETGAPCKWLAPLQTSYQLKSGAM

SEQ ID NO: 3080350 - protein, 17 aa, Giardia lamblia
TETRLYNSLGNVFINSR

SEQ ID NO: 3080351 - protein, 25 aa, Giardia lamblia
TETSPRFLLVREIICRLQNQRCIFS

SEQ ID NO: 3080352 - protein, 22 aa, Giardia lamblia
TEVLKYGCGHYMTPNYGAQLLR

SEQ ID NO: 3080353 - protein, 17 aa, Giardia lamblia
TEVMSPILLSSAAAKRK

SEQ ID NO: 3080354 - protein, 25 aa, Giardia lamblia
TEVRAEASAMILLIVSAELPMDLIQ

SEQ ID NO: 3080355 - protein, 34 aa, Giardia lamblia
TEYHVGWQLPYQGYRWPYLYSRPCPDSVSEQSTR

SEQ ID NO: 3080356 - protein, 17 aa, Giardia lamblia
TEYVRRKWSILISLTVV

SEQ ID NO: 3080357 - protein, 23 aa, Giardia lamblia
TEYVSSVLLEFNFIKHVIDSLYY

SEQ ID NO: 3080358 - protein, 24 aa, Giardia lamblia
TFAPELRKQLAIPSAAPRQEHVSP

SEQ ID NO: 3080359 - protein, 18 aa, Giardia lamblia
TFEALVTKFGSFKRHRCT

SEQ ID NO: 3080360 - protein, 32 aa, Giardia lamblia
TFEAMAVMLEKRCGPSAWQLSATMSVNAPKGL

SEQ ID NO: 3080361 - protein, 28 aa, Giardia lamblia
TFEEGYRAGFSWLVYRMIDRFLNQKSLA

SEQ ID NO: 3080362 - protein, 24 aa, Giardia lamblia
TFFDKTLFHFAWFLLKDYDANVEE

SEQ ID NO: 3080363 - protein, 20 aa, Giardia lamblia
TFFNRAKCYFEMHDYHRYVF

SEQ ID NO: 3080364 - protein, 18 aa, Giardia lamblia
TFIARKGSILALLGTNGA

SEQ ID NO: 3080365 - protein, 26 aa, Giardia lamblia
TFINQIWPCYVWYRDNVLSAAKKYIS

SEQ ID NO: 3080366 - protein, 23 aa, Giardia lamblia
TFISRPKMVLLMTPNVRSLLEYM

SEQ ID NO: 3080367 - protein, 27 aa, Giardia lamblia
TFITRYGEHFSRFAIIASLQPGTKNYY

SEQ ID NO: 3080368 - protein, 26 aa, Giardia lamblia
TFKENEYKAALLLPPFEVYKPMLNRQ

SEQ ID NO: 3080369 - protein, 23 aa, Giardia lamblia
TFLGVACALSLVQAVFQMAVIRI

SEQ ID NO: 3080370 - protein, 18 aa, Giardia lamblia
TFLLPIVLYKLYVALDTT

SEQ ID NO: 3080371 - protein, 20 aa, Giardia lamblia
TFLLRCLYAYAFTSLNFLAC

SEQ ID NO: 3080372 - protein, 21 aa, Giardia lamblia
TFLNLICKFIDAVPLSISAVK

SEQ ID NO: 3080373 - protein, 34 aa, Giardia lamblia
TFLNMIYMRLHIHYKALYSYALFFTPAGNSPIEG

SEQ ID NO: 3080374 - protein, 19 aa, Giardia lamblia
TFMSVCLNGDVGLLSVGDS

SEQ ID NO: 3080375 - protein, 28 aa, Giardia lamblia
TFNKVSSCCLTFCIQRIMILLSTASAND

SEQ ID NO: 3080376 - protein, 19 aa, Giardia lamblia
TFPDGSVYEGMWRENEMWG

SEQ ID NO: 3080377 - protein, 18 aa, Giardia lamblia
TFQNSLWISPGRKTVPLD

SEQ ID NO: 3080378 - protein, 28 aa, Giardia lamblia
TFQSEILDIIAIFAIPIGFLYLYIVEMT

SEQ ID NO: 3080379 - protein, 20 aa, Giardia lamblia
TFRHPCLLRLYEVIQSTELD

SEQ ID NO: 3080380 - protein, 19 aa, Giardia lamblia
TFRHVFNCLLLYTQALFSG

SEQ ID NO: 3080381 - protein, 24 aa, Giardia lamblia
TFRQRKYLSLWKHSIATTARNKSI

SEQ ID NO: 3080382 - protein, 22 aa, Giardia lamblia
TFSISFPLARLLDLISGKPKEI

SEQ ID NO: 3080383 - protein, 27 aa, Giardia lamblia
TFSNKLYLEMCLQYPIFHQLLSTRILE

SEQ ID NO: 3080384 - protein, 19 aa, Giardia lamblia
TFTASSNWERLLAQGPKTA

SEQ ID NO: 3080385 - protein, 28 aa, Giardia lamblia
TFTIFRDSLCYYVYLYANLFSMTLGNRF

SEQ ID NO: 3080386 - protein, 17 aa, Giardia lamblia
TFVAGVVRISREEEIQI

SEQ ID NO: 3080387 - protein, 18 aa, Giardia lamblia
TFVGYAFLHIASREWVFP

SEQ ID NO: 3080388 - protein, 32 aa, Giardia lamblia
TFVKKWRFTNQLFKFDICCNLHEGLTMDKPDL

SEQ ID NO: 3080389 - protein, 19 aa, Giardia lamblia
TFVSACLMQSYHGRIPLFD

SEQ ID NO: 3080390 - protein, 30 aa, Giardia lamblia
TFVSLAIEIACMFSSLLGMNVYIPNSESVP

SEQ ID NO: 3080391 - protein, 26 aa, Giardia lamblia
TFYIRLNIRLLKVFHEMKLISRVTLY

SEQ ID NO: 3080392 - protein, 24 aa, Giardia lamblia
TGAGLKANLFSASNMSFSQAYHSV

SEQ ID NO: 3080393 - protein, 21 aa, Giardia lamblia
TGASITIWGVFPLVPIPVSIL

SEQ ID NO: 3080394 - protein, 21 aa, Giardia lamblia
TGASLKFLLETGFINLRNCDM

SEQ ID NO: 3080395 - protein, 17 aa, Giardia lamblia
TGAYNLRLTSNVTTTLK

SEQ ID NO: 3080396 - protein, 27 aa, Giardia lamblia
TGDMVCKLCPKFFYGNDCAVNPCGIDN

SEQ ID NO: 3080397 - protein, 21 aa, Giardia lamblia
TGDYLPEYMTDALFLLDEARI

SEQ ID NO: 3080398 - protein, 24 aa, Giardia lamblia
TGEALPKERCCMRCRNKYKPGKAS

SEQ ID NO: 3080399 - protein, 22 aa, Giardia lamblia
TGEGLGHVGVGLFIENSTRKIR

SEQ ID NO: 3080400 - protein, 17 aa, Giardia lamblia
TGELVAHPKEYTVSCPY

SEQ ID NO: 3080401 - protein, 25 aa, Giardia lamblia
TGFCTSCKDTAFLFYGSCYAIDKVP

SEQ ID NO: 3080402 - protein, 18 aa, Giardia lamblia
TGFLRYSKIPIIHFYSSE

SEQ ID NO: 3080403 - protein, 17 aa, Giardia lamblia
TGIFAYAIPIGFVTVAD

SEQ ID NO: 3080404 - protein, 19 aa, Giardia lamblia
TGIKLMVKKVYVMFVCCMC

SEQ ID NO: 3080405 - protein, 18 aa, Giardia lamblia
TGILQILLLFILSCLLII

SEQ ID NO: 3080406 - protein, 19 aa, Giardia lamblia
TGIPNHWLFFLLPVVNKVD

SEQ ID NO: 3080407 - protein, 17 aa, Giardia lamblia
TGIPQVMSLAALAVLFA

SEQ ID NO: 3080408 - protein, 18 aa, Giardia lamblia
TGIYCQMFSPTIRENIIA

SEQ ID NO: 3080409 - protein, 26 aa, Giardia lamblia
TGKCVPCPKGTWGPRCSTRKCWLTTR

SEQ ID NO: 3080410 - protein, 36 aa, Giardia lamblia
TGKSFFLNHIIRVMAIDFPTYIILKVLNVEWKPTDP

SEQ ID NO: 3080411 - protein, 26 aa, Giardia lamblia
TGKSFLRRYAPAFSEIVETRVLPIFF

SEQ ID NO: 3080412 - protein, 17 aa, Giardia lamblia
TGLHGFLALATVYPIYQ

SEQ ID NO: 3080413 - protein, 20 aa, Giardia lamblia
TGLKGIPTMFLFTDTQIVNE

SEQ ID NO: 3080414 - protein, 32 aa, Giardia lamblia
TGLLETFGAIFFCQYLIWAGLFFGGICQNVTF

SEQ ID NO: 3080415 - protein, 17 aa, Giardia lamblia
TGLLNLLLSKEHTPSGY

SEQ ID NO: 3080416 - protein, 18 aa, Giardia lamblia
TGLMQNIIQSISYPRAIL

SEQ ID NO: 3080417 - protein, 21 aa, Giardia lamblia
TGLRVLMLGFLFHTSPYDGVY

SEQ ID NO: 3080418 - protein, 18 aa, Giardia lamblia
TGNFLAMICNRPITPSLC

SEQ ID NO: 3080419 - protein, 26 aa, Giardia lamblia
TGNPIFSWECYSPWVTYSNEHGSVIP

SEQ ID NO: 3080420 - protein, 17 aa, Giardia lamblia
TGPACVNGDCAYGDGAH

SEQ ID NO: 3080421 - protein, 17 aa, Giardia lamblia
TGPACVNGDCAYGDGAY

SEQ ID NO: 3080422 - protein, 24 aa, Giardia lamblia
TGRREVRPPIAWNSGSRYLCNPVV

SEQ ID NO: 3080423 - protein, 23 aa, Giardia lamblia
TGRRIKLSFLNSGISRTCTQLTL

SEQ ID NO: 3080424 - protein, 19 aa, Giardia lamblia
TGRVSTAMYSRCVADITIG

SEQ ID NO: 3080425 - protein, 18 aa, Giardia lamblia
TGSLPFATLLSSYEKGIK

SEQ ID NO: 3080426 - protein, 19 aa, Giardia lamblia
TGTCKACAAGCSTCTGAGD

SEQ ID NO: 3080427 - protein, 17 aa, Giardia lamblia
TGTCRRSRCVWVDPYDH

SEQ ID NO: 3080428 - protein, 23 aa, Giardia lamblia
TGTFCRSCLPGFESYYTITHSTI

SEQ ID NO: 3080429 - protein, 21 aa, Giardia lamblia
TGTHLGFLFGVYIYGSLLLTF

SEQ ID NO: 3080430 - protein, 22 aa, Giardia lamblia
TGTNCKRSIIKLLDKMQTSSPM

SEQ ID NO: 3080431 - protein, 26 aa, Giardia lamblia
TGTVGFCLIFTFSSYNIFLVRLQNLS

SEQ ID NO: 3080432 - protein, 22 aa, Giardia lamblia
TGVALKELLAYIQVTYKGLYNI

SEQ ID NO: 3080433 - protein, 26 aa, Giardia lamblia
TGVFSCKRFVQLILYEGSAIFSTKLM

SEQ ID NO: 3080434 - protein, 19 aa, Giardia lamblia
TGYQKYPRPLECDDGTTIS

SEQ ID NO: 3080435 - protein, 17 aa, Giardia lamblia
TGYQMAVPPTVLTPSKN

SEQ ID NO: 3080436 - protein, 24 aa, Giardia lamblia
TGYSDPRVLNFLNVKLPLHMAYSV

SEQ ID NO: 3080437 - protein, 24 aa, Giardia lamblia
THALNPAWRQPIFNLTSSVEKQDY

SEQ ID NO: 3080438 - protein, 25 aa, Giardia lamblia
THGITGCKKCALKTLSGEAESTVVC

SEQ ID NO: 3080439 - protein, 20 aa, Giardia lamblia
THGLEPFWVATYLMSDRYIS

SEQ ID NO: 3080440 - protein, 22 aa, Giardia lamblia
THHMLQFIALLGNFKLVNSLDF

SEQ ID NO: 3080441 - protein, 19 aa, Giardia lamblia
THIPIKEFSGSLDGNGNSL

SEQ ID NO: 3080442 - protein, 24 aa, Giardia lamblia
THKCLSCSQLWWCNSGVLCDTCPD

SEQ ID NO: 3080443 - protein, 17 aa, Giardia lamblia
THLGFALVLSMTTLTAN

SEQ ID NO: 3080444 - protein, 21 aa, Giardia lamblia
THLRAARTVRYFLHLSQSLTF

SEQ ID NO: 3080445 - protein, 24 aa, Giardia lamblia
THLSLEEYKRLLVDIQNHCQATKI

SEQ ID NO: 3080446 - protein, 19 aa, Giardia lamblia
THLSQFLCEHVLAFERDST

SEQ ID NO: 3080447 - protein, 18 aa, Giardia lamblia
THLYGKWREYKDKAQASK

SEQ ID NO: 3080448 - protein, 17 aa, Giardia lamblia
THNSLAYVMNFPHLSGV

SEQ ID NO: 3080449 - protein, 27 aa, Giardia lamblia
THPLLAIPRWHFHINIQTQTLIQYKTS

SEQ ID NO: 3080450 - protein, 23 aa, Giardia lamblia
THRHTWCPKSVCTCFENSISDFH

SEQ ID NO: 3080451 - protein, 19 aa, Giardia lamblia
THSIIRKKLEAYMVSADKL

SEQ ID NO: 3080452 - protein, 20 aa, Giardia lamblia
THSLEFRDALIAATNNTNTR

SEQ ID NO: 3080453 - protein, 18 aa, Giardia lamblia
THSLPHISPLCSSLRSVI

SEQ ID NO: 3080454 - protein, 21 aa, Giardia lamblia
THTIPTVFGLSGSFDQNETTP

SEQ ID NO: 3080455 - protein, 27 aa, Giardia lamblia
THTYPLAIGDKVTMVFYKQELTKGDGR

SEQ ID NO: 3080456 - protein, 22 aa, Giardia lamblia
THWNCSILTAGVVAYGGVVVTA

SEQ ID NO: 3080457 - protein, 17 aa, Giardia lamblia
THYLWCAVLGLTGLLIS

SEQ ID NO: 3080458 - protein, 18 aa, Giardia lamblia
THYSRPVRRLIHEIEKRG

SEQ ID NO: 3080459 - protein, 21 aa, Giardia lamblia
TIAANPLMLPHMFWGISDVAQ

SEQ ID NO: 3080460 - protein, 18 aa, Giardia lamblia
TIAAYVIPVFKNCPYFRR

SEQ ID NO: 3080461 - protein, 20 aa, Giardia lamblia
TIAIRALWFSTIHCIAIVMG

SEQ ID NO: 3080462 - protein, 18 aa, Giardia lamblia
TIARLKRRKLIAPVHTSI

SEQ ID NO: 3080463 - protein, 23 aa, Giardia lamblia
TIATCILCVTLYLLAGITDPGYM

SEQ ID NO: 3080464 - protein, 25 aa, Giardia lamblia
TICCKQCKNTGLAIIDGDCSDFNLM

SEQ ID NO: 3080465 - protein, 21 aa, Giardia lamblia
TICELCTIKAYVVDPAGSSCV

SEQ ID NO: 3080466 - protein, 19 aa, Giardia lamblia
TIDIPVFDFHPGLVHDNKW

SEQ ID NO: 3080467 - protein, 18 aa, Giardia lamblia
TIEICGFLLRAQNPVLMG

SEQ ID NO: 3080468 - protein, 20 aa, Giardia lamblia
TIESFSRMIFAIQVDTLHGG

SEQ ID NO: 3080469 - protein, 25 aa, Giardia lamblia
TIETRLRSLLPLVSLTCKLILLSDD

SEQ ID NO: 3080470 - protein, 19 aa, Giardia lamblia
TIFDMRWLTSALNYSNDDV

SEQ ID NO: 3080471 - protein, 22 aa, Giardia lamblia
TIFIKALKYFLFYHTALVPYSI

SEQ ID NO: 3080472 - protein, 17 aa, Giardia lamblia
TIFWLGVSFARVENIDS

SEQ ID NO: 3080473 - protein, 19 aa, Giardia lamblia
TIGRLSLSDVKNFVVQVVI

SEQ ID NO: 3080474 - protein, 22 aa, Giardia lamblia
TIHYYKLPLVLTQIINPTSNKT

SEQ ID NO: 3080475 - protein, 21 aa, Giardia lamblia
TIICKKTQLTYVWNSQQLTFP

SEQ ID NO: 3080476 - protein, 27 aa, Giardia lamblia
TIICSKIRLLLHKSFYWVPTAREEDLR

SEQ ID NO: 3080477 - protein, 23 aa, Giardia lamblia
TIIKADRLLTVTVLCVMLSSMIC

SEQ ID NO: 3080478 - protein, 23 aa, Giardia lamblia
TIILRVVTFIIAFAKDYRQSGVP

SEQ ID NO: 3080479 - protein, 23 aa, Giardia lamblia
TIKLSDISSVLWKESAHRCTQIE

SEQ ID NO: 3080480 - protein, 24 aa, Giardia lamblia
TIKPDLLKALVYFISTQNPVLLSV

SEQ ID NO: 3080481 - protein, 24 aa, Giardia lamblia
TIKSAESFLALLQEGGACYEEGSG

SEQ ID NO: 3080482 - protein, 20 aa, Giardia lamblia
TIKSAGCSLLATVETLCADN

SEQ ID NO: 3080483 - protein, 17 aa, Giardia lamblia
TILEHGASVVYPTIAQK

SEQ ID NO: 3080484 - protein, 26 aa, Giardia lamblia
TILERFPRARGVAMSLSADGGKVGLT

SEQ ID NO: 3080485 - protein, 23 aa, Giardia lamblia
TILIPFLASKLFNISESCEETVS

SEQ ID NO: 3080486 - protein, 18 aa, Giardia lamblia
TILRRPDFLEGKDPKDVF

SEQ ID NO: 3080487 - protein, 18 aa, Giardia lamblia
TILRTIRTFITCCLEITD

SEQ ID NO: 3080488 - protein, 24 aa, Giardia lamblia
TILSEIRARFIFQDDTKVDLLNTT

SEQ ID NO: 3080489 - protein, 19 aa, Giardia lamblia
TILSFNFFSSVILLLDIIS

SEQ ID NO: 3080490 - protein, 18 aa, Giardia lamblia
TIMHIPNIIALYLPAHEI

SEQ ID NO: 3080491 - protein, 17 aa, Giardia lamblia
TINRSSVYIGYRSQIDL

SEQ ID NO: 3080492 - protein, 19 aa, Giardia lamblia
TINSCGIISTAVLLLEYLK

SEQ ID NO: 3080493 - protein, 21 aa, Giardia lamblia
TINSFRHFYRAFIDKLSPADA

SEQ ID NO: 3080494 - protein, 18 aa, Giardia lamblia
TIPCKHGGECVVSSGGNY

SEQ ID NO: 3080495 - protein, 25 aa, Giardia lamblia
TIPDTWYQSLFCLSLSPKTKPKKTS

SEQ ID NO: 3080496 - protein, 20 aa, Giardia lamblia
TIPELCKSMASLYLSTQQSQ

SEQ ID NO: 3080497 - protein, 30 aa, Giardia lamblia
TIPIASFLMCLRVGLSAVISSVYAHVCDAI

SEQ ID NO: 3080498 - protein, 30 aa, Giardia lamblia
TIQCTRYHIRFLTWYYIMWTVSRISAVVSV

SEQ ID NO: 3080499 - protein, 25 aa, Giardia lamblia
TIRLHCLQCINCLAANGSSLSTLFN

SEQ ID NO: 3080500 - protein, 24 aa, Giardia lamblia
TISCAKGSAGVGVFDLEEYGATTQ

SEQ ID NO: 3080501 - protein, 25 aa, Giardia lamblia
TISLYGCLEQLLFEFVDTIEGHGCA

SEQ ID NO: 3080502 - protein, 24 aa, Giardia lamblia
TISRFLRRNSLIFSVVNQTSTNGI

SEQ ID NO: 3080503 - protein, 18 aa, Giardia lamblia
TITMKRAKGASLIDLNED

SEQ ID NO: 3080504 - protein, 17 aa, Giardia lamblia
TITNCRYASIGGFTGFS

SEQ ID NO: 3080505 - protein, 21 aa, Giardia lamblia
TITNLLEWIIPYLITLDQDSL

SEQ ID NO: 3080506 - protein, 23 aa, Giardia lamblia
TIVKRLKYAKALKNAREEAAIIP

SEQ ID NO: 3080507 - protein, 25 aa, Giardia lamblia
TIVSLEKELLCTLSAVDHSSILTNT

SEQ ID NO: 3080508 - protein, 20 aa, Giardia lamblia
TIYRSYEVLAKFCSLKKFSR

SEQ ID NO: 3080509 - protein, 18 aa, Giardia lamblia
TKAKSMWLEEFVETAHEH

SEQ ID NO: 3080510 - protein, 22 aa, Giardia lamblia
TKCHKCKGLIDPGNATKLAIKY

SEQ ID NO: 3080511 - protein, 17 aa, Giardia lamblia
TKCSLSLSKDSLLSSHD

SEQ ID NO: 3080512 - protein, 21 aa, Giardia lamblia
TKDAQLCVGCQLVDHGAACHA

SEQ ID NO: 3080513 - protein, 25 aa, Giardia lamblia
TKDGKVHIFDFCLAKTISSPGARHG

SEQ ID NO: 3080514 - protein, 24 aa, Giardia lamblia
TKDLFVPWYNSFRFFTQQATRYHE

SEQ ID NO: 3080515 - protein, 23 aa, Giardia lamblia
TKDMWAQHLMYFEYLLLVYYGLF

SEQ ID NO: 3080516 - protein, 31 aa, Giardia lamblia
TKEKTECWGRGYCLLDFGGGNCVCFDAYVNR

SEQ ID NO: 3080517 - protein, 23 aa, Giardia lamblia
TKESFCTACKRSGAMPNVDGVCI

SEQ ID NO: 3080518 - protein, 23 aa, Giardia lamblia
TKESSRCLEILFTNHKKYAKSLS

SEQ ID NO: 3080519 - protein, 24 aa, Giardia lamblia
TKFGRQLKDAFSFTELYRKKKEYK

SEQ ID NO: 3080520 - protein, 20 aa, Giardia lamblia
TKFLPFGAQIVFTVYAVNKK

SEQ ID NO: 3080521 - protein, 19 aa, Giardia lamblia
TKFNTMAVIFFFNSKVYFS

SEQ ID NO: 3080522 - protein, 25 aa, Giardia lamblia
TKGECVTICKLLKSKGISALPFHST

SEQ ID NO: 3080523 - protein, 19 aa, Giardia lamblia
TKGIFKWSRQAQQQQQQQG

SEQ ID NO: 3080524 - protein, 19 aa, Giardia lamblia
TKGYLFRLLPFPERVKLGL

SEQ ID NO: 3080525 - protein, 21 aa, Giardia lamblia
TKHGMSALMFAVENGHADVAR

SEQ ID NO: 3080526 - protein, 29 aa, Giardia lamblia
TKIATAVKVHGCLEFLSKIPADQYRRIRA

SEQ ID NO: 3080527 - protein, 21 aa, Giardia lamblia
TKILKIRYVPLSKPSIYTLSG

SEQ ID NO: 3080528 - protein, 23 aa, Giardia lamblia
TKILSCRCICRMGLYNSSGTCTP

SEQ ID NO: 3080529 - protein, 22 aa, Giardia lamblia
TKLIVLTNCRSIYGRYVELGIT

SEQ ID NO: 3080530 - protein, 26 aa, Giardia lamblia
TKLLIPRPGDTVLYLRHSALHVRKNE

SEQ ID NO: 3080531 - protein, 18 aa, Giardia lamblia
TKLLLNWSDVDTISASLD

SEQ ID NO: 3080532 - protein, 26 aa, Giardia lamblia
TKLLYKRGRHELSLRKAPQRFRGVSP

SEQ ID NO: 3080533 - protein, 21 aa, Giardia lamblia
TKLPSNICNLANTLEIFLVAN

SEQ ID NO: 3080534 - protein, 20 aa, Giardia lamblia
TKLQRCIVTALATIDVHSRD

SEQ ID NO: 3080535 - protein, 19 aa, Giardia lamblia
TKLVYSFSLMKRLLGSTAM

SEQ ID NO: 3080536 - protein, 19 aa, Giardia lamblia
TKLYARYSQVQAFSQRKLI

SEQ ID NO: 3080537 - protein, 17 aa, Giardia lamblia
TKLYHFEKGYLLTAQAR

SEQ ID NO: 3080538 - protein, 22 aa, Giardia lamblia
TKNTFPYLFEVYNETVLQHVSD

SEQ ID NO: 3080539 - protein, 20 aa, Giardia lamblia
TKPLWVRLVSFHTFPKDDTR

SEQ ID NO: 3080540 - protein, 21 aa, Giardia lamblia
TKPPRCCSLGGSVIPDQLRSY

SEQ ID NO: 3080541 - protein, 18 aa, Giardia lamblia
TKQACLWCPDDGKCKNYD

SEQ ID NO: 3080542 - protein, 25 aa, Giardia lamblia
TKRAETHTSFGFVRLCNGYERHFST

SEQ ID NO: 3080543 - protein, 24 aa, Giardia lamblia
TKRDSCGNTAVLIAAKVGDENMVE

SEQ ID NO: 3080544 - protein, 25 aa, Giardia lamblia
TKRIDWVVVAPISIAAVLIAICAAI

SEQ ID NO: 3080545 - protein, 27 aa, Giardia lamblia
TKRRTCAYSYVPYEMLTFLSPSSAPGL

SEQ ID NO: 3080546 - protein, 18 aa, Giardia lamblia
TKRWLFLNREAAIYHHLK

SEQ ID NO: 3080547 - protein, 35 aa, Giardia lamblia
TKSLIHLMVTWRRVELMSWNGFFSRVHTQFSNVSL

SEQ ID NO: 3080548 - protein, 21 aa, Giardia lamblia
TKSVYLKDFVELYQLGKGGYG

SEQ ID NO: 3080549 - protein, 18 aa, Giardia lamblia
TKTLCFMTTSLLKLTALF

SEQ ID NO: 3080550 - protein, 22 aa, Giardia lamblia
TKTQFRSVLDWVSTGATQLQSC

SEQ ID NO: 3080551 - protein, 20 aa, Giardia lamblia
TKTRLNQLVMLFRVSLEVEN

SEQ ID NO: 3080552 - protein, 23 aa, Giardia lamblia
TKTSRSALKRVVRESQRIHANHL

SEQ ID NO: 3080553 - protein, 35 aa, Giardia lamblia
TKYFSFYDICESFDFRLELYISLLQESRKYDEKAH

SEQ ID NO: 3080554 - protein, 17 aa, Giardia lamblia
TKYPLVLLAGSMLWGFV

SEQ ID NO: 3080555 - protein, 21 aa, Giardia lamblia
TKYVIMCWSAISFYIGTDNIR

SEQ ID NO: 3080556 - protein, 18 aa, Giardia lamblia
TLAEIVFNSAQLIKSNIY

SEQ ID NO: 3080557 - protein, 20 aa, Giardia lamblia
TLAFLKERLGDLDFASTIQS

SEQ ID NO: 3080558 - protein, 19 aa, Giardia lamblia
TLAGCWGMLAVNRISELKN

SEQ ID NO: 3080559 - protein, 24 aa, Giardia lamblia
TLARSCIHLVGYMTWPAMLLCAFL

SEQ ID NO: 3080560 - protein, 25 aa, Giardia lamblia
TLASASMGFKCDYIASNISLEGHYF

SEQ ID NO: 3080561 - protein, 21 aa, Giardia lamblia
TLCLYCLVLDLLLQLNLLSIS

SEQ ID NO: 3080562 - protein, 23 aa, Giardia lamblia
TLCPLCGRDVFNPAPQQEPLRSE

SEQ ID NO: 3080563 - protein, 18 aa, Giardia lamblia
TLCSVDISNCILCDSPSA

SEQ ID NO: 3080564 - protein, 18 aa, Giardia lamblia
TLDFKNSIYGGAMIFPVQ

SEQ ID NO: 3080565 - protein, 24 aa, Giardia lamblia
TLDLPITVTQYFLAFSLTSLLEVR

SEQ ID NO: 3080566 - protein, 17 aa, Giardia lamblia
TLEALIYDHFMLLIFKL

SEQ ID NO: 3080567 - protein, 17 aa, Giardia lamblia
TLESEFFEQHVFYRKDG

SEQ ID NO: 3080568 - protein, 19 aa, Giardia lamblia
TLFDCLFGLVATREQSSTD

SEQ ID NO: 3080569 - protein, 19 aa, Giardia lamblia
TLFGARFYLKLKHRCKSTT

SEQ ID NO: 3080570 - protein, 20 aa, Giardia lamblia
TLFLCSILAILISLFSPLAP

SEQ ID NO: 3080571 - protein, 29 aa, Giardia lamblia
TLFLCSTLLAPVCSLGYLWVKSYHSLAEI

SEQ ID NO: 3080572 - protein, 26 aa, Giardia lamblia
TLFLDPRWAEDITFPTMLFHYIISFY

SEQ ID NO: 3080573 - protein, 18 aa, Giardia lamblia
TLFLQEVASLEMISEIPL

SEQ ID NO: 3080574 - protein, 17 aa, Giardia lamblia
TLFQKAGVENKNIVFML

SEQ ID NO: 3080575 - protein, 18 aa, Giardia lamblia
TLGCVLSSGFAFKQSFGW

SEQ ID NO: 3080576 - protein, 18 aa, Giardia lamblia
TLHRRLQVEYGLYQDRGR

SEQ ID NO: 3080577 - protein, 25 aa, Giardia lamblia
TLILFCSFSPLLLAAPRFMHVLGIP

SEQ ID NO: 3080578 - protein, 28 aa, Giardia lamblia
TLIPLACHRRLSILILNMMQIQAFLVRQ

SEQ ID NO: 3080579 - protein, 23 aa, Giardia lamblia
TLIRLHRDYLFWFDREKLTIKEI

SEQ ID NO: 3080580 - protein, 19 aa, Giardia lamblia
TLIVPLPLPLDGSNKASAR

SEQ ID NO: 3080581 - protein, 26 aa, Giardia lamblia
TLIYLPRPALEIQPSLFSQSEIYFYM

SEQ ID NO: 3080582 - protein, 36 aa, Giardia lamblia
TLKAEYEEFLLSIVEEFNRLHAWMCNYRSKAATLGG

SEQ ID NO: 3080583 - protein, 20 aa, Giardia lamblia
TLKPIPKRDVDAHDNECPCL

SEQ ID NO: 3080584 - protein, 19 aa, Giardia lamblia
TLKSNILFFKDCDEDRLKN

SEQ ID NO: 3080585 - protein, 21 aa, Giardia lamblia
TLKTRYAAAIRRIKNEIIELR

SEQ ID NO: 3080586 - protein, 25 aa, Giardia lamblia
TLKVKRPIKLNGFGLLDCSMLCLLL

SEQ ID NO: 3080587 - protein, 23 aa, Giardia lamblia
TLLAFPNFYAFYLRDQVSMSASR

SEQ ID NO: 3080588 - protein, 28 aa, Giardia lamblia
TLLASFSLFWSRLYKLLLHTDTIHSTYT

SEQ ID NO: 3080589 - protein, 19 aa, Giardia lamblia
TLLEALLYLLSQERPVYDR

SEQ ID NO: 3080590 - protein, 17 aa, Giardia lamblia
TLLGLLIFFVTQSPPPD

SEQ ID NO: 3080591 - protein, 22 aa, Giardia lamblia
TLLKLSEMYVFGEMAKEPIAPY

SEQ ID NO: 3080592 - protein, 25 aa, Giardia lamblia
TLLLIKYVLCRLFTIILALDKNFPS

SEQ ID NO: 3080593 - protein, 23 aa, Giardia lamblia
TLLNKEFRSVTNLCGAKLIDSYE

SEQ ID NO: 3080594 - protein, 28 aa, Giardia lamblia
TLLPDVEGRLAIKGIFTYENKPIAGNKC

SEQ ID NO: 3080595 - protein, 18 aa, Giardia lamblia
TLLQRLLCIVPALEGKYS

SEQ ID NO: 3080596 - protein, 17 aa, Giardia lamblia
TLLRAANFLGVKNQLRS

SEQ ID NO: 3080597 - protein, 22 aa, Giardia lamblia
TLMPAQCSHILLKTTALQELVG

SEQ ID NO: 3080598 - protein, 18 aa, Giardia lamblia
TLNGHRYLVTKEVRSYKM

SEQ ID NO: 3080599 - protein, 24 aa, Giardia lamblia
TLPFCFCQIPSWAYILITYVFAQL

SEQ ID NO: 3080600 - protein, 25 aa, Giardia lamblia
TLPLLKPRIKALTIIAPQPSIASRD

SEQ ID NO: 3080601 - protein, 20 aa, Giardia lamblia
TLPLLPLLLLRVTGADAARP

SEQ ID NO: 3080602 - protein, 18 aa, Giardia lamblia
TLPSTVPYASLRPDAQQY

SEQ ID NO: 3080603 - protein, 19 aa, Giardia lamblia
TLQRSFRELLRTEVHTPKI

SEQ ID NO: 3080604 - protein, 31 aa, Giardia lamblia
TLRLLGVSEGVYWFVRWISTVVMSFFSSVIL

SEQ ID NO: 3080605 - protein, 23 aa, Giardia lamblia
TLRPEPLVFIKSHIKIALYSFAS

SEQ ID NO: 3080606 - protein, 18 aa, Giardia lamblia
TLRVHEFFHALAHPDSEL

SEQ ID NO: 3080607 - protein, 24 aa, Giardia lamblia
TLRYFGLSPAEARRVSHGLVKEVF

SEQ ID NO: 3080608 - protein, 27 aa, Giardia lamblia
TLSHWKKRWDLRLSLIEETLIRTVHAN

SEQ ID NO: 3080609 - protein, 19 aa, Giardia lamblia
TLSIPIQSMRVFKNIGIDN

SEQ ID NO: 3080610 - protein, 20 aa, Giardia lamblia
TLSPRRPSCVVEHKTQLMEA

SEQ ID NO: 3080611 - protein, 19 aa, Giardia lamblia
TLSRFPWFIDVFIRPLEEF

SEQ ID NO: 3080612 - protein, 24 aa, Giardia lamblia
TLSRGGSCAKKMSRPQILQRNKKI

SEQ ID NO: 3080613 - protein, 17 aa, Giardia lamblia
TLSRIMLLVAPIGQGAC

SEQ ID NO: 3080614 - protein, 23 aa, Giardia lamblia
TLTETRQALLLNYCDAAVHKAAI

SEQ ID NO: 3080615 - protein, 20 aa, Giardia lamblia
TLTFFKVVYTLISKFHIKNE

SEQ ID NO: 3080616 - protein, 17 aa, Giardia lamblia
TLTSRYMKLTGHTEHTS

SEQ ID NO: 3080617 - protein, 24 aa, Giardia lamblia
TLTSSHRWSSFSLAIFKVKCAART

SEQ ID NO: 3080618 - protein, 32 aa, Giardia lamblia
TLTTCVSLLPNLRLGTPLKAIWNAYHTIRQNF

SEQ ID NO: 3080619 - protein, 24 aa, Giardia lamblia
TLVALSGLISRVWVEFSGEGAKEV

SEQ ID NO: 3080620 - protein, 18 aa, Giardia lamblia
TLVCAYFLATIMIIAIIR

SEQ ID NO: 3080621 - protein, 23 aa, Giardia lamblia
TLVDLRVPVFYALLNNMGDFVLT

SEQ ID NO: 3080622 - protein, 18 aa, Giardia lamblia
TLVDRSSFLSLNYRSTNP

SEQ ID NO: 3080623 - protein, 17 aa, Giardia lamblia
TLVPIAVILSVLRQVAA

SEQ ID NO: 3080624 - protein, 19 aa, Giardia lamblia
TLVRLSFIFVLLVVSYQLF

SEQ ID NO: 3080625 - protein, 19 aa, Giardia lamblia
TLWKTGLFDTDMLKRQVQE

SEQ ID NO: 3080626 - protein, 18 aa, Giardia lamblia
TLYEAVGIALRVTKMSNV

SEQ ID NO: 3080627 - protein, 18 aa, Giardia lamblia
TLYFLAKFLIFRRKNKQR

SEQ ID NO: 3080628 - protein, 26 aa, Giardia lamblia
TLYKAFRLAIDFLSLTPHRGRNFNIA

SEQ ID NO: 3080629 - protein, 17 aa, Giardia lamblia
TLYRSDITYPLFVLIPS

SEQ ID NO: 3080630 - protein, 19 aa, Giardia lamblia
TMCREVPVASTCDFTNFLL

SEQ ID NO: 3080631 - protein, 25 aa, Giardia lamblia
TMEIRLSLLTVKFVIIVSVNGPKEG

SEQ ID NO: 3080632 - protein, 22 aa, Giardia lamblia
TMHILRSFLKLLLAHIQLPENR

SEQ ID NO: 3080633 - protein, 18 aa, Giardia lamblia
TMLDNTIHDWRHGSEQLL

SEQ ID NO: 3080634 - protein, 23 aa, Giardia lamblia
TMLKGGYCACIIRSHSVPDKTSL

SEQ ID NO: 3080635 - protein, 17 aa, Giardia lamblia
TMLPNIGLIRLPYDILS

SEQ ID NO: 3080636 - protein, 27 aa, Giardia lamblia
TMPLRRPRGYGWAFLRGLKDPVVIVLT

SEQ ID NO: 3080637 - protein, 24 aa, Giardia lamblia
TMPPELYGVLLGQCFLMLHESDIA

SEQ ID NO: 3080638 - protein, 28 aa, Giardia lamblia
TMQTYGISWCYKGALATSALQVCLEQHL

SEQ ID NO: 3080639 - protein, 18 aa, Giardia lamblia
TMSEFFRALQMRYHGHQD

SEQ ID NO: 3080640 - protein, 23 aa, Giardia lamblia
TMSGRYLYSTGFQDLEYDALPST

SEQ ID NO: 3080641 - protein, 19 aa, Giardia lamblia
TMSRIDAFPSQVVCIEGIY

SEQ ID NO: 3080642 - protein, 24 aa, Giardia lamblia
TMYPLPEGLFDWEDPHLINYQTTL

SEQ ID NO: 3080643 - protein, 24 aa, Giardia lamblia
TNAATCYHCYKLEMNTWSDAKVKA

SEQ ID NO: 3080644 - protein, 27 aa, Giardia lamblia
TNAIPDCFGNIGLELVLSTSLNLLFVG

SEQ ID NO: 3080645 - protein, 18 aa, Giardia lamblia
TNCTRSGVNYNTFLFNGG

SEQ ID NO: 3080646 - protein, 17 aa, Giardia lamblia
TNESMIEEVVWRVAAYL

SEQ ID NO: 3080647 - protein, 17 aa, Giardia lamblia
TNFCLYVSLLAIVEYHR

SEQ ID NO: 3080648 - protein, 25 aa, Giardia lamblia
TNGEGASCLMDFNFVNSKFTTSETK

SEQ ID NO: 3080649 - protein, 24 aa, Giardia lamblia
TNGPELSHALALLAGSASKERGEL

SEQ ID NO: 3080650 - protein, 22 aa, Giardia lamblia
TNGWCMPGYMTKGALQRELNRY

SEQ ID NO: 3080651 - protein, 30 aa, Giardia lamblia
TNHISTCKYTWYNFIFKFLIEQYQRPNNIF

SEQ ID NO: 3080652 - protein, 21 aa, Giardia lamblia
TNIALWAMICLLHTSRYKCRP

SEQ ID NO: 3080653 - protein, 23 aa, Giardia lamblia
TNISLRGSIPVSFQQVPNLSQKP

SEQ ID NO: 3080654 - protein, 17 aa, Giardia lamblia
TNLDICVLLSEMLPNRP

SEQ ID NO: 3080655 - protein, 24 aa, Giardia lamblia
TNLHLRTKYRFQLYRYSYKTVVEL

SEQ ID NO: 3080656 - protein, 25 aa, Giardia lamblia
TNLIISSSPFHWNLYPVSQAHDRIR

SEQ ID NO: 3080657 - protein, 17 aa, Giardia lamblia
TNLILILYSRLSLDVQF

SEQ ID NO: 3080658 - protein, 26 aa, Giardia lamblia
TNLQGAAAIFAHFIYLYVFLGPDLFK

SEQ ID NO: 3080659 - protein, 18 aa, Giardia lamblia
TNLSYGFNRSIIYYTQAP

SEQ ID NO: 3080660 - protein, 24 aa, Giardia lamblia
TNLTPGRCYYYYVPSFTTSDELNS

SEQ ID NO: 3080661 - protein, 25 aa, Giardia lamblia
TNLYYSNIFLLNFTQIAPLNVSELI

SEQ ID NO: 3080662 - protein, 25 aa, Giardia lamblia
TNPDTDCPVVRSFREACSSGQQVLL

SEQ ID NO: 3080663 - protein, 23 aa, Giardia lamblia
TNPLQFRKMFPIFSKNIEIPYLE

SEQ ID NO: 3080664 - protein, 27 aa, Giardia lamblia
TNRRITIRLYRGGVCVDNSILYKFSST

SEQ ID NO: 3080665 - protein, 26 aa, Giardia lamblia
TNSYCTTEIMAATLLRNDSIIKALVP

SEQ ID NO: 3080666 - protein, 24 aa, Giardia lamblia
TNTFGQLILYWAILLSPRTTISTL

SEQ ID NO: 3080667 - protein, 20 aa, Giardia lamblia
TNVWMAMSVYENVYYSTIFR

SEQ ID NO: 3080668 - protein, 17 aa, Giardia lamblia
TNYTWRNISLLYPHSER

SEQ ID NO: 3080669 - protein, 17 aa, Giardia lamblia
TPACFNYTVAVIENDGL

SEQ ID NO: 3080670 - protein, 17 aa, Giardia lamblia
TPASFAINTVVKSNNAD

SEQ ID NO: 3080671 - protein, 20 aa, Giardia lamblia
TPAWCLGDQVLGVWSLQFTD

SEQ ID NO: 3080672 - protein, 23 aa, Giardia lamblia
TPCLPYRYEALYVHPPTSTQLLT

SEQ ID NO: 3080673 - protein, 30 aa, Giardia lamblia
TPDPKDVVCFPRFSYSRSKRRVFFTPIQLC

SEQ ID NO: 3080674 - protein, 18 aa, Giardia lamblia
TPDSWSRKPGQLVVLAIA

SEQ ID NO: 3080675 - protein, 26 aa, Giardia lamblia
TPEAYPRLLILLDFIVCVTSVVICKS

SEQ ID NO: 3080676 - protein, 23 aa, Giardia lamblia
TPENVRLSIYFFSLLTGHYLIDN

SEQ ID NO: 3080677 - protein, 20 aa, Giardia lamblia
TPEVKLAGRLVKFPSGPTTV

SEQ ID NO: 3080678 - protein, 25 aa, Giardia lamblia
TPGELYLFVHAFKASHVLSAVGTFF

SEQ ID NO: 3080679 - protein, 23 aa, Giardia lamblia
TPGSACATLACDEPQHDAEYDNI

SEQ ID NO: 3080680 - protein, 27 aa, Giardia lamblia
TPHSGKAYAAALIFPVSLSGIISDMAV

SEQ ID NO: 3080681 - protein, 18 aa, Giardia lamblia
TPIYYLEELGPWSPKIYL

SEQ ID NO: 3080682 - protein, 18 aa, Giardia lamblia
TPLAIGRLGVEYYAAASV

SEQ ID NO: 3080683 - protein, 19 aa, Giardia lamblia
TPLDLSFRLMIASSETSSV

SEQ ID NO: 3080684 - protein, 18 aa, Giardia lamblia
TPLGAGNEVGRSCFILSY

SEQ ID NO: 3080685 - protein, 17 aa, Giardia lamblia
TPLGCFFPDALECALIT

SEQ ID NO: 3080686 - protein, 19 aa, Giardia lamblia
TPLGRRIQTPTAYSRKKLP

SEQ ID NO: 3080687 - protein, 22 aa, Giardia lamblia
TPLHLPPLVTIGVMKLPDSLLL

SEQ ID NO: 3080688 - protein, 24 aa, Giardia lamblia
TPMEVFRPLLTVDLIVSIDRACHI

SEQ ID NO: 3080689 - protein, 23 aa, Giardia lamblia
TPMFAKFPKVRRYFSVSFTSTVE

SEQ ID NO: 3080690 - protein, 20 aa, Giardia lamblia
TPMLQRLATRATLSNCMIEV

SEQ ID NO: 3080691 - protein, 19 aa, Giardia lamblia
TPNKRRLLLKKAITIAITV

SEQ ID NO: 3080692 - protein, 19 aa, Giardia lamblia
TPPQFYVRPVNRFESDKTL

SEQ ID NO: 3080693 - protein, 28 aa, Giardia lamblia
TPQDLLFVLSVSFLDYFTVGHLHQSPDS

SEQ ID NO: 3080694 - protein, 17 aa, Giardia lamblia
TPQRAVQQLKLFQTQFS

SEQ ID NO: 3080695 - protein, 17 aa, Giardia lamblia
TPQSCFASVRSAISTTV

SEQ ID NO: 3080696 - protein, 18 aa, Giardia lamblia
TPQWKGVPLSHVISHILL

SEQ ID NO: 3080697 - protein, 18 aa, Giardia lamblia
TPSHKLSILFVLQQLYPS

SEQ ID NO: 3080698 - protein, 19 aa, Giardia lamblia
TPSKDCYNFFSSISSTNLS

SEQ ID NO: 3080699 - protein, 18 aa, Giardia lamblia
TPSLKKQHRFFAKRYAAE

SEQ ID NO: 3080700 - protein, 20 aa, Giardia lamblia
TPSYEMIKLLASRLAMCPDL

SEQ ID NO: 3080701 - protein, 19 aa, Giardia lamblia
TPVEWRLVQSVAQLIYASL

SEQ ID NO: 3080702 - protein, 25 aa, Giardia lamblia
TPVVFRILLLAGHLVIIFERALPLF

SEQ ID NO: 3080703 - protein, 31 aa, Giardia lamblia
TPYELWLCIPFAFYFYWLVTAIFFSKRHKLR

SEQ ID NO: 3080704 - protein, 17 aa, Giardia lamblia
TQANFPPALNIQTRLQT

SEQ ID NO: 3080705 - protein, 19 aa, Giardia lamblia
TQCIFRMLWHQASVHDQLP

SEQ ID NO: 3080706 - protein, 18 aa, Giardia lamblia
TQCLPCHADCKTCQGPQS

SEQ ID NO: 3080707 - protein, 20 aa, Giardia lamblia
TQCQCISLAISDLLDDEDEI

SEQ ID NO: 3080708 - protein, 23 aa, Giardia lamblia
TQCSSCLSISILDSVSSLVERIF

SEQ ID NO: 3080709 - protein, 25 aa, Giardia lamblia
TQGNCWDYKNTWIVSPDGIGSVATA

SEQ ID NO: 3080710 - protein, 19 aa, Giardia lamblia
TQGPWCCVPHIHNIEFSKQ

SEQ ID NO: 3080711 - protein, 19 aa, Giardia lamblia
TQGSLMLMKTFKSMENRSQ

SEQ ID NO: 3080712 - protein, 26 aa, Giardia lamblia
TQIVKPCPSTLCSLRARANKNAIIWL

SEQ ID NO: 3080713 - protein, 25 aa, Giardia lamblia
TQKAVICRKLHIVLLEAYIRAFITH

SEQ ID NO: 3080714 - protein, 26 aa, Giardia lamblia
TQKFRKAYMMYLPFIPYISTLQSTHE

SEQ ID NO: 3080715 - protein, 29 aa, Giardia lamblia
TQKRSFIPWKVIEGLIYLMVITIFFSLIF

SEQ ID NO: 3080716 - protein, 17 aa, Giardia lamblia
TQLCGGCGACVRTGAGY

SEQ ID NO: 3080717 - protein, 27 aa, Giardia lamblia
TQLVASLFLKFCLFKGSKKLDDFLHNL

SEQ ID NO: 3080718 - protein, 23 aa, Giardia lamblia
TQLYKLAICNDGSACASSEKDAH

SEQ ID NO: 3080719 - protein, 17 aa, Giardia lamblia
TQNWIGIGLTFTGLTVS

SEQ ID NO: 3080720 - protein, 17 aa, Giardia lamblia
TQPEKKATIAILARSLH

SEQ ID NO: 3080721 - protein, 28 aa, Giardia lamblia
TQQNIYCWSDFLLYVGLRPKELIRTQNM

SEQ ID NO: 3080722 - protein, 24 aa, Giardia lamblia
TQSLSVPLYNIFARDVVSTKQRRF

SEQ ID NO: 3080723 - protein, 20 aa, Giardia lamblia
TQTLLYKLQPALPLPFNLLE

SEQ ID NO: 3080724 - protein, 27 aa, Giardia lamblia
TQVPIAIRYAFPDSRILLVQPRRLPTE

SEQ ID NO: 3080725 - protein, 17 aa, Giardia lamblia
TQWSSTFDFIFPKTDTS

SEQ ID NO: 3080726 - protein, 17 aa, Giardia lamblia
TQYAVGIVVMGTLPDFS

SEQ ID NO: 3080727 - protein, 29 aa, Giardia lamblia
TRAAASLPNCDFFKLIVYNISQYPEDVDY

SEQ ID NO: 3080728 - protein, 17 aa, Giardia lamblia
TRAAVSLIPLLIYYFFF

SEQ ID NO: 3080729 - protein, 25 aa, Giardia lamblia
TRAEIARYYSIYRPISIRGALIYFI

SEQ ID NO: 3080730 - protein, 22 aa, Giardia lamblia
TRAKDRFLEYMPHVPSALLSIA

SEQ ID NO: 3080731 - protein, 21 aa, Giardia lamblia
TRARQAAALGDAIDYGGLNTL

SEQ ID NO: 3080732 - protein, 18 aa, Giardia lamblia
TRATRTGYQMAVPPTVLT

SEQ ID NO: 3080733 - protein, 30 aa, Giardia lamblia
TRCPVSAVLMELCAAKIVIFSSLMVGDLSS

SEQ ID NO: 3080734 - protein, 17 aa, Giardia lamblia
TRCTSCVPEHIWNGEEC

SEQ ID NO: 3080735 - protein, 23 aa, Giardia lamblia
TREHLQLLMIFGVKHIMVAVNKL

SEQ ID NO: 3080736 - protein, 19 aa, Giardia lamblia
TREIRYYHTFKLSSISTSE

SEQ ID NO: 3080737 - protein, 17 aa, Giardia lamblia
TREPVLIYCQMTKMLDL

SEQ ID NO: 3080738 - protein, 19 aa, Giardia lamblia
TRFAISYNVTEMNGHNIDL

SEQ ID NO: 3080739 - protein, 21 aa, Giardia lamblia
TRFHSDIAIIASHYISHLARC

SEQ ID NO: 3080740 - protein, 17 aa, Giardia lamblia
TRFVKMIELDAYVDDLT

SEQ ID NO: 3080741 - protein, 23 aa, Giardia lamblia
TRGCIKIDIMSMLLRESISLDSL

SEQ ID NO: 3080742 - protein, 22 aa, Giardia lamblia
TRGHHRCGSGFTALMAAGQANA

SEQ ID NO: 3080743 - protein, 35 aa, Giardia lamblia
TRGMLVRLLQGYAIFSVVWSCLGLFGKDLYVQKID

SEQ ID NO: 3080744 - protein, 23 aa, Giardia lamblia
TRIATCGTIDLGIDLDNDRAVTP

SEQ ID NO: 3080745 - protein, 18 aa, Giardia lamblia
TRIYMKKSLIDFFTNPKY

SEQ ID NO: 3080746 - protein, 17 aa, Giardia lamblia
TRKCSMLLGGLTYISIS

SEQ ID NO: 3080747 - protein, 18 aa, Giardia lamblia
TRKNRAMFDLVTSVVEYL

SEQ ID NO: 3080748 - protein, 25 aa, Giardia lamblia
TRKRCAKMYLILFSVCVMLHDKRLQ

SEQ ID NO: 3080749 - protein, 22 aa, Giardia lamblia
TRKWYWLPRYKFSLMTDDYTYQ

SEQ ID NO: 3080750 - protein, 20 aa, Giardia lamblia
TRLILGLVFDVPFICLSKTG

SEQ ID NO: 3080751 - protein, 21 aa, Giardia lamblia
TRLKQDICDTIRCLNEQTRAL

SEQ ID NO: 3080752 - protein, 17 aa, Giardia lamblia
TRLMHVIDLREFGLHNF

SEQ ID NO: 3080753 - protein, 23 aa, Giardia lamblia
TRLPYAELQRLGYVTPLPKQRRT

SEQ ID NO: 3080754 - protein, 22 aa, Giardia lamblia
TRLREASKIVFPTYEQVVPSME

SEQ ID NO: 3080755 - protein, 17 aa, Giardia lamblia
TRLRLSRASLSEKLSVA

SEQ ID NO: 3080756 - protein, 26 aa, Giardia lamblia
TRNEYDILLFVAHTIYLMLSPNAPLN

SEQ ID NO: 3080757 - protein, 26 aa, Giardia lamblia
TRNFQCIRNLNKLGFYQAAGAIMPSV

SEQ ID NO: 3080758 - protein, 26 aa, Giardia lamblia
TRPSLTEAFNLLPVSIFEYLDKADSE

SEQ ID NO: 3080759 - protein, 24 aa, Giardia lamblia
TRPTPCTGCLYATDFAGVMSLADP

SEQ ID NO: 3080760 - protein, 27 aa, Giardia lamblia
TRQIMCSPCLLSSRVKFHKDLAATSAL

SEQ ID NO: 3080761 - protein, 19 aa, Giardia lamblia
TRRFFCGFLENITENLSTG

SEQ ID NO: 3080762 - protein, 18 aa, Giardia lamblia
TRRFNVIMVTDGVATQIF

SEQ ID NO: 3080763 - protein, 18 aa, Giardia lamblia
TRRGQAFGIIASSLFSGH

SEQ ID NO: 3080764 - protein, 17 aa, Giardia lamblia
TRRTAIVTKSLFAMMHI

SEQ ID NO: 3080765 - protein, 29 aa, Giardia lamblia
TRSEVFSLDMFWRLCVTNAISTVLLFVGE

SEQ ID NO: 3080766 - protein, 26 aa, Giardia lamblia
TRSFPEQGVLCYWRLIIKSLSLVFQE

SEQ ID NO: 3080767 - protein, 17 aa, Giardia lamblia
TRSGVNYNTFLFNGGCY

SEQ ID NO: 3080768 - protein, 20 aa, Giardia lamblia
TRSTPCLPFPTISSGTARYD

SEQ ID NO: 3080769 - protein, 19 aa, Giardia lamblia
TRTAYIACACLLTPTYVVF

SEQ ID NO: 3080770 - protein, 17 aa, Giardia lamblia
TRTGYQMAVPPTVLTPS

SEQ ID NO: 3080771 - protein, 18 aa, Giardia lamblia
TRTIPVFLVKDVDIPDPL

SEQ ID NO: 3080772 - protein, 20 aa, Giardia lamblia
TRTRKCPICQKPYKQEDIVE

SEQ ID NO: 3080773 - protein, 19 aa, Giardia lamblia
TRVIQRIAVLPTFINSIIG

SEQ ID NO: 3080774 - protein, 25 aa, Giardia lamblia
TRVLKSALCKCFLAPQAIPHRLRNL

SEQ ID NO: 3080775 - protein, 21 aa, Giardia lamblia
TRVYARSGFTYATLALTTDHA

SEQ ID NO: 3080776 - protein, 25 aa, Giardia lamblia
TRYADYIIDCLFPPSSGLARSKLVD

SEQ ID NO: 3080777 - protein, 20 aa, Giardia lamblia
TRYDKPQGYSFIRIVLPLTV

SEQ ID NO: 3080778 - protein, 19 aa, Giardia lamblia
TRYEPFFDLLVPYNPEKTF

SEQ ID NO: 3080779 - protein, 27 aa, Giardia lamblia
TSAELCARNGIDLLHFLRNMPPYRVQA

SEQ ID NO: 3080780 - protein, 23 aa, Giardia lamblia
TSAFKELCLRSIIIKSLATGQSV

SEQ ID NO: 3080781 - protein, 27 aa, Giardia lamblia
TSCSDEFREHMGIYILIIVLAVIVLVL

SEQ ID NO: 3080782 - protein, 17 aa, Giardia lamblia
TSCSRCADGYYLEVSGS

SEQ ID NO: 3080783 - protein, 18 aa, Giardia lamblia
TSEDGFYFRNLRTTSEKC

SEQ ID NO: 3080784 - protein, 25 aa, Giardia lamblia
TSEGSLLRWEVILIAVTLGIVGFFA

SEQ ID NO: 3080785 - protein, 21 aa, Giardia lamblia
TSELRRRALDAAENLLWSVNY

SEQ ID NO: 3080786 - protein, 21 aa, Giardia lamblia
TSETCFYLFVLDAHRGTADVS

SEQ ID NO: 3080787 - protein, 19 aa, Giardia lamblia
TSFFLGCLLSGIFTICIFG

SEQ ID NO: 3080788 - protein, 23 aa, Giardia lamblia
TSFHPSHWPEFLAELRFVCGTQA

SEQ ID NO: 3080789 - protein, 25 aa, Giardia lamblia
TSFIMCFRDVIKLSKKSETIQQQMR

SEQ ID NO: 3080790 - protein, 27 aa, Giardia lamblia
TSFLQRLCFALSFDRSFRFEYSARELT

SEQ ID NO: 3080791 - protein, 30 aa, Giardia lamblia
TSGDTKPFFAMKSYMSLFFAVLGLVIVNSI

SEQ ID NO: 3080792 - protein, 20 aa, Giardia lamblia
TSGRVIRWSEYPHLRRYSEI

SEQ ID NO: 3080793 - protein, 21 aa, Giardia lamblia
TSGSVAYDFVRHAMLAANVSQ

SEQ ID NO: 3080794 - protein, 20 aa, Giardia lamblia
TSHRWSVLLVITLVGSYASF

SEQ ID NO: 3080795 - protein, 17 aa, Giardia lamblia
TSIAQPVHRQPGAKEYP

SEQ ID NO: 3080796 - protein, 21 aa, Giardia lamblia
TSIICGHIPLIFLQISDKEAF

SEQ ID NO: 3080797 - protein, 19 aa, Giardia lamblia
TSILACLHLLSFWCLIIVT

SEQ ID NO: 3080798 - protein, 20 aa, Giardia lamblia
TSILKIVALLGRRHGETLDA

SEQ ID NO: 3080799 - protein, 23 aa, Giardia lamblia
TSIVIPLELNRWTTLAVDMDQVF

SEQ ID NO: 3080800 - protein, 24 aa, Giardia lamblia
TSKPRRKLTFVVPMVSRATEHMYA

SEQ ID NO: 3080801 - protein, 23 aa, Giardia lamblia
TSLCDNLRSALPQEITANCAFNE

SEQ ID NO: 3080802 - protein, 17 aa, Giardia lamblia
TSLCHMKPLLGSICYRE

SEQ ID NO: 3080803 - protein, 17 aa, Giardia lamblia
TSLCMMQPRGSSLLVGL

SEQ ID NO: 3080804 - protein, 17 aa, Giardia lamblia
TSLCSGFSCAGKDQLCG

SEQ ID NO: 3080805 - protein, 25 aa, Giardia lamblia
TSLDLKLKRFWPLKPKIIKTIIVGS

SEQ ID NO: 3080806 - protein, 18 aa, Giardia lamblia
TSLFNRKKVKTREPLGLA

SEQ ID NO: 3080807 - protein, 25 aa, Giardia lamblia
TSLLIPRPGMEIAQPATAAGDAQGD

SEQ ID NO: 3080808 - protein, 25 aa, Giardia lamblia
TSLPKTCSICRRFYNTCLPVVTAYK

SEQ ID NO: 3080809 - protein, 26 aa, Giardia lamblia
TSMIFAWPTIFAFLPVGIIFILLLRR

SEQ ID NO: 3080810 - protein, 18 aa, Giardia lamblia
TSMLSYYVSILFVTALVS

SEQ ID NO: 3080811 - protein, 17 aa, Giardia lamblia
TSMYPVFPWLADDRNLA

SEQ ID NO: 3080812 - protein, 32 aa, Giardia lamblia
TSNMRLCGLLSEFYLQFFGRDILATFPFSTTG

SEQ ID NO: 3080813 - protein, 31 aa, Giardia lamblia
TSNQSPPIFICFLLMFIFHVLLRSNSVIRHP

SEQ ID NO: 3080814 - protein, 24 aa, Giardia lamblia
TSNVVYRVSEWVVAPAADNTEIYT

SEQ ID NO: 3080815 - protein, 28 aa, Giardia lamblia
TSPLRILRMKVLIHLARMLFPVHLYVDS

SEQ ID NO: 3080816 - protein, 18 aa, Giardia lamblia
TSPQAQGHVSPFFFIQFN

SEQ ID NO: 3080817 - protein, 19 aa, Giardia lamblia
TSPQFSIISNVDWLEAAQH

SEQ ID NO: 3080818 - protein, 25 aa, Giardia lamblia
TSRSRCSVQYFFPVLLAVNSVGILT

SEQ ID NO: 3080819 - protein, 31 aa, Giardia lamblia
TSSAARTAFFWLYCVFSTFKPSYSQESLAEI

SEQ ID NO: 3080820 - protein, 20 aa, Giardia lamblia
TSSFILLLFCLLDHFCTSSL

SEQ ID NO: 3080821 - protein, 24 aa, Giardia lamblia
TSSKYRCCCFYTGFAANVIGLCGC

SEQ ID NO: 3080822 - protein, 20 aa, Giardia lamblia
TSSLRPLIAPSIIIRDPETC

SEQ ID NO: 3080823 - protein, 22 aa, Giardia lamblia
TSSVLSKWLSMLLKQLSSPEIH

SEQ ID NO: 3080824 - protein, 25 aa, Giardia lamblia
TSTMPANLILRIRSSVGLIPTLYNE

SEQ ID NO: 3080825 - protein, 19 aa, Giardia lamblia
TSTRLWIHDLWTDLATVSD

SEQ ID NO: 3080826 - protein, 22 aa, Giardia lamblia
TSVDLRYAIELLVKEFAAQLAK

SEQ ID NO: 3080827 - protein, 24 aa, Giardia lamblia
TSVLKSLLCRSEDFLSYVGNVINS

SEQ ID NO: 3080828 - protein, 20 aa, Giardia lamblia
TSVPHVPASLIDRLTDVLRL

SEQ ID NO: 3080829 - protein, 21 aa, Giardia lamblia
TSVRYRLFRDILISLSNTLSD

SEQ ID NO: 3080830 - protein, 23 aa, Giardia lamblia
TSVYCLSWTFLVPRASTRRYRNY

SEQ ID NO: 3080831 - protein, 18 aa, Giardia lamblia
TSYCGLQIEVPPCTEAYL

SEQ ID NO: 3080832 - protein, 33 aa, Giardia lamblia
TSYLLRYFIYIFINRLTPLYSRTILEYLTNLFT

SEQ ID NO: 3080833 - protein, 19 aa, Giardia lamblia
TSYPCSLAINLYSNPLHVF

SEQ ID NO: 3080834 - protein, 17 aa, Giardia lamblia
TSYRFKHPVRLVRQDSV

SEQ ID NO: 3080835 - protein, 22 aa, Giardia lamblia
TSYVLRLLVTVRMAAPDLTHFL

SEQ ID NO: 3080836 - protein, 19 aa, Giardia lamblia
TSYVMPFVFLVPMIIVGIR

SEQ ID NO: 3080837 - protein, 34 aa, Giardia lamblia
TTAELKGECLAEKRLRLGSKLFGAFITCLTDNLM

SEQ ID NO: 3080838 - protein, 19 aa, Giardia lamblia
TTALCDLHTAISVVEDIKQ

SEQ ID NO: 3080839 - protein, 18 aa, Giardia lamblia
TTALMIAAALNLPLAVSM

SEQ ID NO: 3080840 - protein, 31 aa, Giardia lamblia
TTALSRYLFMRVIYCPFSEYTFAANLQRLSS

SEQ ID NO: 3080841 - protein, 17 aa, Giardia lamblia
TTCIKCRDGYGIHEGEC

SEQ ID NO: 3080842 - protein, 20 aa, Giardia lamblia
TTCTACYSGFVLNTTTGASA

SEQ ID NO: 3080843 - protein, 19 aa, Giardia lamblia
TTCTACYSGFVLSAASGAS

SEQ ID NO: 3080844 - protein, 22 aa, Giardia lamblia
TTDFISAVSMLKRSGSPANVVE

SEQ ID NO: 3080845 - protein, 26 aa, Giardia lamblia
TTDGSFVCLCKRGWTGTACDVVAPNF

SEQ ID NO: 3080846 - protein, 22 aa, Giardia lamblia
TTEYCFSCSNYILGSSSDPDID

SEQ ID NO: 3080847 - protein, 19 aa, Giardia lamblia
TTFCASPFMFLGPYNSIAS

SEQ ID NO: 3080848 - protein, 20 aa, Giardia lamblia
TTFDSFRNSLIFKQTRSFNI

SEQ ID NO: 3080849 - protein, 25 aa, Giardia lamblia
TTFPSLYQWCRLLFGDKQNSLAHFN

SEQ ID NO: 3080850 - protein, 20 aa, Giardia lamblia
TTGCYLCALDTLLAQLAHSV

SEQ ID NO: 3080851 - protein, 26 aa, Giardia lamblia
TTGSICKAVTWALVHPDRMCCSQRRN

SEQ ID NO: 3080852 - protein, 24 aa, Giardia lamblia
TTGSSCYKLRTTTIVSTNGPQELL

SEQ ID NO: 3080853 - protein, 26 aa, Giardia lamblia
TTGSYRLAISCLYYYELLYTVVAGGS

SEQ ID NO: 3080854 - protein, 24 aa, Giardia lamblia
TTHFTRRYTIRFIEWSSRKQQPFV

SEQ ID NO: 3080855 - protein, 23 aa, Giardia lamblia
TTICQACNMILIGLLVGVATQVF

SEQ ID NO: 3080856 - protein, 22 aa, Giardia lamblia
TTIEPRDKYVIISINYTSYIVK

SEQ ID NO: 3080857 - protein, 21 aa, Giardia lamblia
TTIGLPCFKDSLHLSEMSTIV

SEQ ID NO: 3080858 - protein, 18 aa, Giardia lamblia
TTIIKTLFSYEGELNATL

SEQ ID NO: 3080859 - protein, 19 aa, Giardia lamblia
TTILRKVMHENIAPLLDYF

SEQ ID NO: 3080860 - protein, 18 aa, Giardia lamblia
TTILRTSPQFSIISNVDW

SEQ ID NO: 3080861 - protein, 25 aa, Giardia lamblia
TTLAHWCAVCIVTGLGDRHSCNILI

SEQ ID NO: 3080862 - protein, 21 aa, Giardia lamblia
TTLLMYCCKRNLHSFVDVLVR

SEQ ID NO: 3080863 - protein, 22 aa, Giardia lamblia
TTLPKYKWKKLIRVTSSPAMRY

SEQ ID NO: 3080864 - protein, 27 aa, Giardia lamblia
TTLRDWNGWCALMWAASKNNISCVRLL

SEQ ID NO: 3080865 - protein, 27 aa, Giardia lamblia
TTLRIIDPRSGNFILRGVIHHKAVLDL

SEQ ID NO: 3080866 - protein, 24 aa, Giardia lamblia
TTLSSYKWLIGFSKLEDSFLHTVS

SEQ ID NO: 3080867 - protein, 20 aa, Giardia lamblia
TTLVKLCKKYLNQVQAGDSD

SEQ ID NO: 3080868 - protein, 17 aa, Giardia lamblia
TTLWRASLRDEIQKRGL

SEQ ID NO: 3080869 - protein, 29 aa, Giardia lamblia
TTLYFQGLCKLDGYCFEDIYSYTPKPLQL

SEQ ID NO: 3080870 - protein, 17 aa, Giardia lamblia
TTMELTHSLPLASINNI

SEQ ID NO: 3080871 - protein, 19 aa, Giardia lamblia
TTMVGPICHACFNAQAASS

SEQ ID NO: 3080872 - protein, 24 aa, Giardia lamblia
TTNPRPVFYILIRNMELLGVSYDP

SEQ ID NO: 3080873 - protein, 22 aa, Giardia lamblia
TTPSCIPIDWSTYAALKGTGKG

SEQ ID NO: 3080874 - protein, 23 aa, Giardia lamblia
TTPTRISPFLTFADELPTGSLQI

SEQ ID NO: 3080875 - protein, 17 aa, Giardia lamblia
TTRKTLRVHEFFHALAH

SEQ ID NO: 3080876 - protein, 22 aa, Giardia lamblia
TTRVILKSVIWAIFHPDLMCRK

SEQ ID NO: 3080877 - protein, 19 aa, Giardia lamblia
TTRYRNVLTYSDFTTYFTY

SEQ ID NO: 3080878 - protein, 17 aa, Giardia lamblia
TTSCIYANLALDLLPYN

SEQ ID NO: 3080879 - protein, 27 aa, Giardia lamblia
TTSCPRCIRAGDSLRLIDDGALVTALE

SEQ ID NO: 3080880 - protein, 29 aa, Giardia lamblia
TTSERGELCLLELREGYQLDSTTLDPNFV

SEQ ID NO: 3080881 - protein, 31 aa, Giardia lamblia
TTSLKYLMFSGFVFKSSFYAFFDCRKMSYMT

SEQ ID NO: 3080882 - protein, 18 aa, Giardia lamblia
TTSSFLLATHDLYQSLVD

SEQ ID NO: 3080883 - protein, 19 aa, Giardia lamblia
TTSTIEWMTITAPTTVETT

SEQ ID NO: 3080884 - protein, 24 aa, Giardia lamblia
TTTCDACLPGYFLQSSSNACVKCA

SEQ ID NO: 3080885 - protein, 18 aa, Giardia lamblia
TTWSSLAAYAFFKNLALQ

SEQ ID NO: 3080886 - protein, 19 aa, Giardia lamblia
TTYEYRGRQLLTLQQNRFI

SEQ ID NO: 3080887 - protein, 17 aa, Giardia lamblia
TTYSGPVSFVYVVESLD

SEQ ID NO: 3080888 - protein, 17 aa, Giardia lamblia
TTYSILIALLVKQVRLA

SEQ ID NO: 3080889 - protein, 27 aa, Giardia lamblia
TVAISVLKCCPCAAVKKLYDRTKATAL

SEQ ID NO: 3080890 - protein, 18 aa, Giardia lamblia
TVALILLVAFPFLILLEE

SEQ ID NO: 3080891 - protein, 18 aa, Giardia lamblia
TVALRVPMFTPRELHELI

SEQ ID NO: 3080892 - protein, 22 aa, Giardia lamblia
TVAPCLSAFSGLITQRLDGQPS

SEQ ID NO: 3080893 - protein, 17 aa, Giardia lamblia
TVARIVSSRMELRMTNY

SEQ ID NO: 3080894 - protein, 20 aa, Giardia lamblia
TVAVLYDIFVPSAFEASFLD

SEQ ID NO: 3080895 - protein, 18 aa, Giardia lamblia
TVCPLCRRKDTVLSSSIP

SEQ ID NO: 3080896 - protein, 22 aa, Giardia lamblia
TVCSLCRTGLVPINGVCVNQTT

SEQ ID NO: 3080897 - protein, 26 aa, Giardia lamblia
TVCSNNGYCGYGFFGDSKCMCLPEYD

SEQ ID NO: 3080898 - protein, 18 aa, Giardia lamblia
TVDCVAQVTMIRTVVTNL

SEQ ID NO: 3080899 - protein, 17 aa, Giardia lamblia
TVDEGLSAIVFSDEHPR

SEQ ID NO: 3080900 - protein, 27 aa, Giardia lamblia
TVDIPIRIGRMLGYFIKYSYSAYQTVE

SEQ ID NO: 3080901 - protein, 17 aa, Giardia lamblia
TVERAHGYNNCLELYAY

SEQ ID NO: 3080902 - protein, 18 aa, Giardia lamblia
TVEYKLSRIFSISISTSG

SEQ ID NO: 3080903 - protein, 25 aa, Giardia lamblia
TVFFIEPLFRGCAYSFSSTQQDAIV

SEQ ID NO: 3080904 - protein, 19 aa, Giardia lamblia
TVFFYKRLISNGMLTDTYL

SEQ ID NO: 3080905 - protein, 19 aa, Giardia lamblia
TVFSKVSFELSLFVMDVLS

SEQ ID NO: 3080906 - protein, 27 aa, Giardia lamblia
TVGSDCKLRLVVDACPVRTSIITEDPV

SEQ ID NO: 3080907 - protein, 24 aa, Giardia lamblia
TVGVAFPIAWAIPGDDHGSYENYL

SEQ ID NO: 3080908 - protein, 20 aa, Giardia lamblia
TVIAMTRIMHCFGGTDQFNK

SEQ ID NO: 3080909 - protein, 18 aa, Giardia lamblia
TVIELCFDALRQTQVLSP

SEQ ID NO: 3080910 - protein, 19 aa, Giardia lamblia
TVIFSYLVTCLFSMNDPEK

SEQ ID NO: 3080911 - protein, 27 aa, Giardia lamblia
TVIRLLYAFVVALSFAIIMFPIRVIIM

SEQ ID NO: 3080912 - protein, 19 aa, Giardia lamblia
TVISVWILCVLFKRTAFDI

SEQ ID NO: 3080913 - protein, 22 aa, Giardia lamblia
TVKNCIFLGKYQVCQSKLLNRC

SEQ ID NO: 3080914 - protein, 22 aa, Giardia lamblia
TVKRYSLTDFREFLRGAIEAAV

SEQ ID NO: 3080915 - protein, 23 aa, Giardia lamblia
TVLKASSYGFVFRLLNLSTGSSF

SEQ ID NO: 3080916 - protein, 26 aa, Giardia lamblia
TVLLMDCPYALFNLILAMIMSQQSSK

SEQ ID NO: 3080917 - protein, 28 aa, Giardia lamblia
TVLSNFGFHRMQFVIYKIVSLTNSRSFY

SEQ ID NO: 3080918 - protein, 23 aa, Giardia lamblia
TVPAISSQAGWQVHLLCMTPKSI

SEQ ID NO: 3080919 - protein, 19 aa, Giardia lamblia
TVSDSVWVDGLYRIITYPY

SEQ ID NO: 3080920 - protein, 21 aa, Giardia lamblia
TVSIYKDFRKAVSRHSGLSTS

SEQ ID NO: 3080921 - protein, 21 aa, Giardia lamblia
TVSLLEEFVRPFSGAEDVDAV

SEQ ID NO: 3080922 - protein, 24 aa, Giardia lamblia
TVSLPEPFRLTGYQTNTTPIILSH

SEQ ID NO: 3080923 - protein, 21 aa, Giardia lamblia
TVSMPLFFSVCRTADRLMDII

SEQ ID NO: 3080924 - protein, 24 aa, Giardia lamblia
TVSRLDACLLYLKLILDPHDSWNL

SEQ ID NO: 3080925 - protein, 18 aa, Giardia lamblia
TVTCLRDMNRLLAGNLSL

SEQ ID NO: 3080926 - protein, 30 aa, Giardia lamblia
TVTVLCWACFTFLLSYTFVIRKYRREQAAI

SEQ ID NO: 3080927 - protein, 25 aa, Giardia lamblia
TVVCLTRLVFGLAFVLIIGLMNQDN

SEQ ID NO: 3080928 - protein, 19 aa, Giardia lamblia
TVVFLLGMYQDLAINVVNY

SEQ ID NO: 3080929 - protein, 21 aa, Giardia lamblia
TVVLRNARLFDILSGVETRLQ

SEQ ID NO: 3080930 - protein, 25 aa, Giardia lamblia
TVVSIFRIIGMLIMTCNNESTLIKI

SEQ ID NO: 3080931 - protein, 20 aa, Giardia lamblia
TVWISLLLMRVNLYGIVYNN

SEQ ID NO: 3080932 - protein, 17 aa, Giardia lamblia
TVYLIFLYYDRHARKCQ

SEQ ID NO: 3080933 - protein, 18 aa, Giardia lamblia
TWFNRTDWSTSIDAQTMC

SEQ ID NO: 3080934 - protein, 25 aa, Giardia lamblia
TWLYSKRPLLALAEASAMSMGGPPD

SEQ ID NO: 3080935 - protein, 18 aa, Giardia lamblia
TYALEWLMHRVFLTWIGK

SEQ ID NO: 3080936 - protein, 21 aa, Giardia lamblia
TYARSVLKVGVSMYAAAEDIE

SEQ ID NO: 3080937 - protein, 17 aa, Giardia lamblia
TYDGGYDSIHFSVPDTN

SEQ ID NO: 3080938 - protein, 24 aa, Giardia lamblia
TYDKLLITAFYRWSDLARGRHKLM

SEQ ID NO: 3080939 - protein, 17 aa, Giardia lamblia
TYFKNVFNYIVLDIQKW

SEQ ID NO: 3080940 - protein, 24 aa, Giardia lamblia
TYFNEIWLSGILFLDLLIDEVQTE

SEQ ID NO: 3080941 - protein, 17 aa, Giardia lamblia
TYGCWTNGSECLWKNKL

SEQ ID NO: 3080942 - protein, 19 aa, Giardia lamblia
TYHCYPVTQTLLYKLQPAL

SEQ ID NO: 3080943 - protein, 19 aa, Giardia lamblia
TYIAKDWKTSYAASERFFD

SEQ ID NO: 3080944 - protein, 33 aa, Giardia lamblia
TYKTKLPALEGMPLPRSMPAVIKPECCDKRDNL

SEQ ID NO: 3080945 - protein, 24 aa, Giardia lamblia
TYLAMCIYEAWIFAEGVMAHPSVI

SEQ ID NO: 3080946 - protein, 21 aa, Giardia lamblia
TYLEFYLIYFFTGQYKVSHGL

SEQ ID NO: 3080947 - protein, 20 aa, Giardia lamblia
TYLRDIYKTLTLGGDAQLEF

SEQ ID NO: 3080948 - protein, 19 aa, Giardia lamblia
TYLSLGVPVMATINTWANG

SEQ ID NO: 3080949 - protein, 25 aa, Giardia lamblia
TYLTILIRCLLRYYTNINLFQPTMV

SEQ ID NO: 3080950 - protein, 21 aa, Giardia lamblia
TYLVSPCRLIVLIRAHASFLY

SEQ ID NO: 3080951 - protein, 23 aa, Giardia lamblia
TYMSSAYPCLRDYYIYHRSSVRD

SEQ ID NO: 3080952 - protein, 19 aa, Giardia lamblia
TYMYKPECYYVEPAKAEPF

SEQ ID NO: 3080953 - protein, 28 aa, Giardia lamblia
TYNWISFPFIVLLLQFKPFFSQFFTAVA

SEQ ID NO: 3080954 - protein, 23 aa, Giardia lamblia
TYPGELMVGHYPLIHGDHYAYQA

SEQ ID NO: 3080955 - protein, 26 aa, Giardia lamblia
TYPLADIAYGFTFILIHLLRSIAEPY

SEQ ID NO: 3080956 - protein, 18 aa, Giardia lamblia
TYQDISVMQCKRETGMLI

SEQ ID NO: 3080957 - protein, 23 aa, Giardia lamblia
TYQSFLGMCYRYCVTDTDCPLFM

SEQ ID NO: 3080958 - protein, 19 aa, Giardia lamblia
TYQSHRWAKQDYSGDFINE

SEQ ID NO: 3080959 - protein, 21 aa, Giardia lamblia
TYRAPPPVVYLVFMLLDTILY

SEQ ID NO: 3080960 - protein, 23 aa, Giardia lamblia
TYTRAEPDIVMFMDTMQLYQNLL

SEQ ID NO: 3080961 - protein, 19 aa, Giardia lamblia
TYTRICRFIFEVAESHQFS

SEQ ID NO: 3080962 - protein, 25 aa, Giardia lamblia
TYTVYELLDHLLLFLSLSHQSLTSQ

SEQ ID NO: 3080963 - protein, 17 aa, Giardia lamblia
TYVTAWASFPSQFVAST

SEQ ID NO: 3080964 - protein, 25 aa, Giardia lamblia
TYYCSSRSILVLRQVFIFLAMLQKG

SEQ ID NO: 3080965 - protein, 25 aa, Giardia lamblia
TYYLPGPLFGMGLCGMHVTIQSATM

SEQ ID NO: 3080966 - protein, 20 aa, Giardia lamblia
TYYRDWFLRYDGQNCIQCSK

SEQ ID NO: 3080967 - protein, 17 aa, Giardia lamblia
VAAKFSLRAHAYRALIS

SEQ ID NO: 3080968 - protein, 19 aa, Giardia lamblia
VAAPAPRAASPVPAAPVAQ

SEQ ID NO: 3080969 - protein, 20 aa, Giardia lamblia
VAAVCLLNNWLFETPKPHFP

SEQ ID NO: 3080970 - protein, 28 aa, Giardia lamblia
VACQNLQVAYGFGRRKLIAVDNFTFIAR

SEQ ID NO: 3080971 - protein, 21 aa, Giardia lamblia
VADAFAALGYQMSFSDLLNVI

SEQ ID NO: 3080972 - protein, 25 aa, Giardia lamblia
VADEVFGFYMFRRLYSLARSYFSPD

SEQ ID NO: 3080973 - protein, 23 aa, Giardia lamblia
VADIRSILPFLFLNHPPTFLIDM

SEQ ID NO: 3080974 - protein, 18 aa, Giardia lamblia
VADKLFGIPSRLGGPSAT

SEQ ID NO: 3080975 - protein, 18 aa, Giardia lamblia
VADLNLTAFIGYNKHYYS

SEQ ID NO: 3080976 - protein, 17 aa, Giardia lamblia
VADLPCSASPLFTDESI

SEQ ID NO: 3080977 - protein, 26 aa, Giardia lamblia
VADRLPRTLTELAMGIFELIGERQRD

SEQ ID NO: 3080978 - protein, 18 aa, Giardia lamblia
VAEFEGMRRGLVEETPDT

SEQ ID NO: 3080979 - protein, 18 aa, Giardia lamblia
VAEIKGRMLREVTESIKD

SEQ ID NO: 3080980 - protein, 17 aa, Giardia lamblia
VAELIPYEKCAVSKNYH

SEQ ID NO: 3080981 - protein, 22 aa, Giardia lamblia
VAERPPPKILYAARTHAQIEQA

SEQ ID NO: 3080982 - protein, 17 aa, Giardia lamblia
VAFACFVGNINLFLAPN

SEQ ID NO: 3080983 - protein, 18 aa, Giardia lamblia
VAGFGRHREAPLGALSPY

SEQ ID NO: 3080984 - protein, 40 aa, Giardia lamblia
VAGKPGRTPIKFSELLQGFNFTKFKIVQGVINAILLSILH

SEQ ID NO: 3080985 - protein, 21 aa, Giardia lamblia
VAIAMLVEFRSLSLFAAYLHV

SEQ ID NO: 3080986 - protein, 23 aa, Giardia lamblia
VAIFRLLSFLVLQTIVWICSIVI

SEQ ID NO: 3080987 - protein, 31 aa, Giardia lamblia
VAIGALVGFLCWWFIFRGRRIDASPSTMTLI

SEQ ID NO: 3080988 - protein, 24 aa, Giardia lamblia
VAILDHVEFLPGRPYTYFFTSPFS

SEQ ID NO: 3080989 - protein, 18 aa, Giardia lamblia
VAILITWIKIFIARTPSC

SEQ ID NO: 3080990 - protein, 18 aa, Giardia lamblia
VAILLVPFMFLRDASKLS

SEQ ID NO: 3080991 - protein, 22 aa, Giardia lamblia
VAIPLSILILLSRLEEIESLDI

SEQ ID NO: 3080992 - protein, 17 aa, Giardia lamblia
VAKDLSPIMARLEPNIL

SEQ ID NO: 3080993 - protein, 18 aa, Giardia lamblia
VAKRATFCAASALEDEAS

SEQ ID NO: 3080994 - protein, 18 aa, Giardia lamblia
VALARAVYSGCDILLLDD

SEQ ID NO: 3080995 - protein, 26 aa, Giardia lamblia
VALDHYCPWVGLPIGLRNMLPFVVSL

SEQ ID NO: 3080996 - protein, 34 aa, Giardia lamblia
VALKGGLKFSTKRLFPLNGRILLKVFLIGMLHWF

SEQ ID NO: 3080997 - protein, 27 aa, Giardia lamblia
VALKKRDMQTFLALPLFVYMSERTTDK

SEQ ID NO: 3080998 - protein, 19 aa, Giardia lamblia
VALMNEFWSLGDLMLECGL

SEQ ID NO: 3080999 - protein, 25 aa, Giardia lamblia
VALQKKFLCSTFQMLEAIFQKHTDS

SEQ ID NO: 3081000 - protein, 19 aa, Giardia lamblia
VALRLLLPAMHVVLDKYVV

SEQ ID NO: 3081001 - protein, 23 aa, Giardia lamblia
VANACKFDAWFLNMYWAIVALSP

SEQ ID NO: 3081002 - protein, 18 aa, Giardia lamblia
VANAYTAVFVYNMLGLVF

SEQ ID NO: 3081003 - protein, 22 aa, Giardia lamblia
VANCVSCAPPAGGNGGPVTCYI

SEQ ID NO: 3081004 - protein, 27 aa, Giardia lamblia
VANDLWCAPDLETLWVESHVAKYVDVT

SEQ ID NO: 3081005 - protein, 24 aa, Giardia lamblia
VANIYLSHFFFIIFIWGILVPICF

SEQ ID NO: 3081006 - protein, 24 aa, Giardia lamblia
VANYKLKYIQLFTVLQPVPNLFAS

SEQ ID NO: 3081007 - protein, 24 aa, Giardia lamblia
VAPDRFQTLFIARMVNRLTAEPYP

SEQ ID NO: 3081008 - protein, 17 aa, Giardia lamblia
VAPNRYAVYTVKNCDAA

SEQ ID NO: 3081009 - protein, 17 aa, Giardia lamblia
VAQHKPCDINCGLESVS

SEQ ID NO: 3081010 - protein, 34 aa, Giardia lamblia
VAQRIKNKWLFLHIFSFPFCHEKFLHKIVKLTSV

SEQ ID NO: 3081011 - protein, 29 aa, Giardia lamblia
VARCTRVCIPRMLLLMAYKHLVISTKGKE

SEQ ID NO: 3081012 - protein, 23 aa, Giardia lamblia
VARELHGPYALFLADGGFLIEGP

SEQ ID NO: 3081013 - protein, 17 aa, Giardia lamblia
VASFCFSQRLRAYNTSV

SEQ ID NO: 3081014 - protein, 17 aa, Giardia lamblia
VASGVMKPSAAMKNTLP

SEQ ID NO: 3081015 - protein, 24 aa, Giardia lamblia
VASMCGRVPILLSVVRPEYSVFTL

SEQ ID NO: 3081016 - protein, 18 aa, Giardia lamblia
VATCDFGIDVARASSSAS

SEQ ID NO: 3081017 - protein, 17 aa, Giardia lamblia
VATCDSFSLVLKMRDSY

SEQ ID NO: 3081018 - protein, 17 aa, Giardia lamblia
VATCILGLGDRHNDNIM

SEQ ID NO: 3081019 - protein, 25 aa, Giardia lamblia
VATCIPDLLSCISREVADVIPDSLW

SEQ ID NO: 3081020 - protein, 18 aa, Giardia lamblia
VATFSGFRNSKCVSQIVC

SEQ ID NO: 3081021 - protein, 21 aa, Giardia lamblia
VATRLAAPWPLLLSPDLLLAV

SEQ ID NO: 3081022 - protein, 17 aa, Giardia lamblia
VAVKILYEKIRECVRTF

SEQ ID NO: 3081023 - protein, 24 aa, Giardia lamblia
VAVLRRLVFLLADLDPENGALHVL

SEQ ID NO: 3081024 - protein, 17 aa, Giardia lamblia
VAVPAFFHPSIMKKSHS

SEQ ID NO: 3081025 - protein, 18 aa, Giardia lamblia
VAVPEFSVLLNYLAKSGN

SEQ ID NO: 3081026 - protein, 17 aa, Giardia lamblia
VAVSRARLEDVFEHLLD

SEQ ID NO: 3081027 - protein, 25 aa, Giardia lamblia
VAVSRARRLFVCIGAVDQYDNQIWR

SEQ ID NO: 3081028 - protein, 20 aa, Giardia lamblia
VAVTQNLSCILVGSPESGKS

SEQ ID NO: 3081029 - protein, 18 aa, Giardia lamblia
VAYALSFLESPLVLELLQ

SEQ ID NO: 3081030 - protein, 23 aa, Giardia lamblia
VAYGIRQARKFAQEKFIDVHTNK

SEQ ID NO: 3081031 - protein, 23 aa, Giardia lamblia
VCASLKGGGTLLLESLYCTISTE

SEQ ID NO: 3081032 - protein, 20 aa, Giardia lamblia
VCCVTLLLLLVMSLILYSII

SEQ ID NO: 3081033 - protein, 19 aa, Giardia lamblia
VCDFIYRINCLDSLDRTNT

SEQ ID NO: 3081034 - protein, 17 aa, Giardia lamblia
VCESCQTLLLTFIQVQH

SEQ ID NO: 3081035 - protein, 18 aa, Giardia lamblia
VCIMPRLSSAAIAGISIV

SEQ ID NO: 3081036 - protein, 24 aa, Giardia lamblia
VCKQWRSNFNFTFSKAEGGDRYLC

SEQ ID NO: 3081037 - protein, 19 aa, Giardia lamblia
VCLSINMLLLNTASQSSTL

SEQ ID NO: 3081038 - protein, 19 aa, Giardia lamblia
VCLWSALATEPTQGINSEI

SEQ ID NO: 3081039 - protein, 22 aa, Giardia lamblia
VCMKESSAGVLARKAAKKMGKT

SEQ ID NO: 3081040 - protein, 18 aa, Giardia lamblia
VCMYPYFFANDTLSASGN

SEQ ID NO: 3081041 - protein, 18 aa, Giardia lamblia
VCNHCHAKIAILLKSTFN

SEQ ID NO: 3081042 - protein, 24 aa, Giardia lamblia
VCSHGFFYLYNFLREELVFKFQLP

SEQ ID NO: 3081043 - protein, 23 aa, Giardia lamblia
VCTEWKTQFDFIFNKNDNDGGYL

SEQ ID NO: 3081044 - protein, 23 aa, Giardia lamblia
VCTRCSPGLVSVDGFSCPLTCTE

SEQ ID NO: 3081045 - protein, 24 aa, Giardia lamblia
VCTSMKKSPSCLFYTGSSTAVLPL

SEQ ID NO: 3081046 - protein, 24 aa, Giardia lamblia
VCTTCAISGCTKCDLQSTVIQCND

SEQ ID NO: 3081047 - protein, 20 aa, Giardia lamblia
VCTTCSSSAFLMNGGCYTKA

SEQ ID NO: 3081048 - protein, 18 aa, Giardia lamblia
VCVHPLLFNRPGGAYHCL

SEQ ID NO: 3081049 - protein, 20 aa, Giardia lamblia
VCYLLAYFVEFQKTKILNKY

SEQ ID NO: 3081050 - protein, 17 aa, Giardia lamblia
VDAGIRGKVCLVTNMGS

SEQ ID NO: 3081051 - protein, 21 aa, Giardia lamblia
VDAMGRTALMYATRANNDNVI

SEQ ID NO: 3081052 - protein, 24 aa, Giardia lamblia
VDAPALDVIRLFSEISNLYTHYLA

SEQ ID NO: 3081053 - protein, 17 aa, Giardia lamblia
VDASFRMYELFKQALED

SEQ ID NO: 3081054 - protein, 19 aa, Giardia lamblia
VDATCSRWGAFAGSNASLN

SEQ ID NO: 3081055 - protein, 18 aa, Giardia lamblia
VDAYRAYSKFGLNADIGK

SEQ ID NO: 3081056 - protein, 22 aa, Giardia lamblia
VDCNRNFLCFTIIPTEAHECDV

SEQ ID NO: 3081057 - protein, 26 aa, Giardia lamblia
VDCSLCPEANMADSIGRFLSSLEEQL

SEQ ID NO: 3081058 - protein, 17 aa, Giardia lamblia
VDDLISLALELATSGPQ

SEQ ID NO: 3081059 - protein, 19 aa, Giardia lamblia
VDEFIIFKECLSLITEEIV

SEQ ID NO: 3081060 - protein, 19 aa, Giardia lamblia
VDESYAAGTDEPRCSFPAP

SEQ ID NO: 3081061 - protein, 44 aa, Giardia lamblia
VDEVFLIRSMFYFFLLRFNVVTILRKPLPSQFLLKSLEYSQAAR

SEQ ID NO: 3081062 - protein, 22 aa, Giardia lamblia
VDFEMKVSALLVNQAIISELEA

SEQ ID NO: 3081063 - protein, 19 aa, Giardia lamblia
VDFSARLIALSGALVDIQR

SEQ ID NO: 3081064 - protein, 23 aa, Giardia lamblia
VDFSSLLTCINRMISLTKSIDFH

SEQ ID NO: 3081065 - protein, 27 aa, Giardia lamblia
VDFTFKDCVRSAVLRALMLRLITLFDA

SEQ ID NO: 3081066 - protein, 32 aa, Giardia lamblia
VDGAAQFRGILFIPKRAPFDMWDAQKKKTGIK

SEQ ID NO: 3081067 - protein, 17 aa, Giardia lamblia
VDGCLKCTASGKADTPA

SEQ ID NO: 3081068 - protein, 18 aa, Giardia lamblia
VDGCLKCTASGKADTPAT

SEQ ID NO: 3081069 - protein, 19 aa, Giardia lamblia
VDGFLLGGIAYVVKKKSAA

SEQ ID NO: 3081070 - protein, 24 aa, Giardia lamblia
VDGRSCVVPLLLQEAGMQSSDGYT

SEQ ID NO: 3081071 - protein, 17 aa, Giardia lamblia
VDHAKGLTGIWATVHAM

SEQ ID NO: 3081072 - protein, 20 aa, Giardia lamblia
VDIALVLKLRVNDFRQLIPV

SEQ ID NO: 3081073 - protein, 21 aa, Giardia lamblia
VDIVHLLAPREAKLRGSMQRT

SEQ ID NO: 3081074 - protein, 21 aa, Giardia lamblia
VDKLIRFFAVAQHKPCDINCG

SEQ ID NO: 3081075 - protein, 17 aa, Giardia lamblia
VDLDLLILNAAKPAPLR

SEQ ID NO: 3081076 - protein, 19 aa, Giardia lamblia
VDLKIALRPSKSVEPLPVK

SEQ ID NO: 3081077 - protein, 25 aa, Giardia lamblia
VDLLARVLRPWAYHFAAISTMLTYL

SEQ ID NO: 3081078 - protein, 24 aa, Giardia lamblia
VDLLRPRLRSGQPFLPADPTISGV

SEQ ID NO: 3081079 - protein, 20 aa, Giardia lamblia
VDLMLSVLMGHNLRKVIMQG

SEQ ID NO: 3081080 - protein, 19 aa, Giardia lamblia
VDLQVFFRQTRHLLTHSSI

SEQ ID NO: 3081081 - protein, 17 aa, Giardia lamblia
VDLVVLFSDCLVPSTYV

SEQ ID NO: 3081082 - protein, 25 aa, Giardia lamblia
VDMEYMRILPLGLFVQTITNWTPQD

SEQ ID NO: 3081083 - protein, 19 aa, Giardia lamblia
VDMLYEITNYIPSLLTLRG

SEQ ID NO: 3081084 - protein, 21 aa, Giardia lamblia
VDMYVRILLIYLELITLLDCT

SEQ ID NO: 3081085 - protein, 17 aa, Giardia lamblia
VDNLYLRIVTLEDVWTV

SEQ ID NO: 3081086 - protein, 17 aa, Giardia lamblia
VDPLLQWLPLYEILKLA

SEQ ID NO: 3081087 - protein, 22 aa, Giardia lamblia
VDPPIPIWLLFLPFNTIALNLG

SEQ ID NO: 3081088 - protein, 20 aa, Giardia lamblia
VDPRTLCGLATKEMYDAQDS

SEQ ID NO: 3081089 - protein, 18 aa, Giardia lamblia
VDQGCPVILKEVDLSNLS

SEQ ID NO: 3081090 - protein, 17 aa, Giardia lamblia
VDRCGGLLRLYAEENVG

SEQ ID NO: 3081091 - protein, 20 aa, Giardia lamblia
VDRIRMHIVGSDGDKVGTIK

SEQ ID NO: 3081092 - protein, 33 aa, Giardia lamblia
VDSAFRNRPVFDILMEACTSWSLCSSRKSTPDS

SEQ ID NO: 3081093 - protein, 23 aa, Giardia lamblia
VDSCSISNCLACLANSRDVCATC

SEQ ID NO: 3081094 - protein, 23 aa, Giardia lamblia
VDSCTDFRAIPTISLTRVVPRDI

SEQ ID NO: 3081095 - protein, 24 aa, Giardia lamblia
VDSRGRTALMHAVDRNNTLMITEL

SEQ ID NO: 3081096 - protein, 25 aa, Giardia lamblia
VDTRETPQFKLVWPNMNLTLKIRLQ

SEQ ID NO: 3081097 - protein, 23 aa, Giardia lamblia
VDTTGRCALSYALRTRSFNTARV

SEQ ID NO: 3081098 - protein, 20 aa, Giardia lamblia
VDVLAEFRDSMCLEDHGHAW

SEQ ID NO: 3081099 - protein, 26 aa, Giardia lamblia
VDVLLVSLGFTFGRVLSRLVCMFYQR

SEQ ID NO: 3081100 - protein, 26 aa, Giardia lamblia
VDYFKDILEYFFIFATIWASGGTMFK

SEQ ID NO: 3081101 - protein, 17 aa, Giardia lamblia
VDYLRLELAEIITHYTN

SEQ ID NO: 3081102 - protein, 18 aa, Giardia lamblia
VDYSVCYLNDALIINATN

SEQ ID NO: 3081103 - protein, 18 aa, Giardia lamblia
VDYTTLFLLLKLVVNSLL

SEQ ID NO: 3081104 - protein, 21 aa, Giardia lamblia
VEALGFALADLRSMDSSSRVE

SEQ ID NO: 3081105 - protein, 25 aa, Giardia lamblia
VEAVVLRTGFEMSQGQLIRKILFDT

SEQ ID NO: 3081106 - protein, 18 aa, Giardia lamblia
VECSRAGPRYANEAYECA

SEQ ID NO: 3081107 - protein, 26 aa, Giardia lamblia
VEDILRLEVKLLKHKYIQQHLKHGAA

SEQ ID NO: 3081108 - protein, 25 aa, Giardia lamblia
VEDPSFRATHPWFYAAATNDVQYVQ

SEQ ID NO: 3081109 - protein, 18 aa, Giardia lamblia
VEDVPLPVFKVILFPQLS

SEQ ID NO: 3081110 - protein, 17 aa, Giardia lamblia
VEGCAKCSFKEEVTILL

SEQ ID NO: 3081111 - protein, 18 aa, Giardia lamblia
VEGCLSLAEGVCVGQNRA

SEQ ID NO: 3081112 - protein, 21 aa, Giardia lamblia
VEGKRRACFHARNLVYTLLQE

SEQ ID NO: 3081113 - protein, 20 aa, Giardia lamblia
VEGLGSFLLLSDVKVSQRQL

SEQ ID NO: 3081114 - protein, 24 aa, Giardia lamblia
VEGLRELTVRQALPPRPVPLEESD

SEQ ID NO: 3081115 - protein, 23 aa, Giardia lamblia
VEHRFTDHMYDLFGELENDPIFG

SEQ ID NO: 3081116 - protein, 21 aa, Giardia lamblia
VEILMCKNITLGYGLATASAI

SEQ ID NO: 3081117 - protein, 17 aa, Giardia lamblia
VEIPRECVIHDLPVNVK

SEQ ID NO: 3081118 - protein, 21 aa, Giardia lamblia
VEITELKALLSNQDHLINALV

SEQ ID NO: 3081119 - protein, 18 aa, Giardia lamblia
VEKHLRQVALYEYRDKPC

SEQ ID NO: 3081120 - protein, 20 aa, Giardia lamblia
VELAYSYSVITLFLLLRIHL

SEQ ID NO: 3081121 - protein, 33 aa, Giardia lamblia
VELEVFRPAAYLWRCIYIFASLLDRELSSPDIG

SEQ ID NO: 3081122 - protein, 19 aa, Giardia lamblia
VELFTRMGTLVTDVDVDLL

SEQ ID NO: 3081123 - protein, 17 aa, Giardia lamblia
VELQGLYSLLGTIHRRK

SEQ ID NO: 3081124 - protein, 21 aa, Giardia lamblia
VENCISCAPPTGGNGGSVTCY

SEQ ID NO: 3081125 - protein, 17 aa, Giardia lamblia
VEPIIWEIVDLCNNNLN

SEQ ID NO: 3081126 - protein, 24 aa, Giardia lamblia
VEQAKRLYIAYPYCVTATHTLAWV

SEQ ID NO: 3081127 - protein, 26 aa, Giardia lamblia
VEQKGRRYLIFIGMPIILFSLILLMT

SEQ ID NO: 3081128 - protein, 19 aa, Giardia lamblia
VEQLRPYSFFRGTDKAFEA

SEQ ID NO: 3081129 - protein, 25 aa, Giardia lamblia
VERIMRELIKAGGIIDYGHSDFDGG

SEQ ID NO: 3081130 - protein, 17 aa, Giardia lamblia
VERQRFALSSSRNSAKM

SEQ ID NO: 3081131 - protein, 24 aa, Giardia lamblia
VERRAICGPLALASKTKPCRPSIV

SEQ ID NO: 3081132 - protein, 29 aa, Giardia lamblia
VERYDKAYFKLCALADILTAMDKPGSEIA

SEQ ID NO: 3081133 - protein, 19 aa, Giardia lamblia
VERYQRFTPDLQIDYYNVP

SEQ ID NO: 3081134 - protein, 18 aa, Giardia lamblia
VESIFPIIVFPVIAVIGM

SEQ ID NO: 3081135 - protein, 18 aa, Giardia lamblia
VESLSHWHTYVIASVKLR

SEQ ID NO: 3081136 - protein, 21 aa, Giardia lamblia
VESPAGIALIVFVSLLLLATI

SEQ ID NO: 3081137 - protein, 20 aa, Giardia lamblia
VETGHGLFECSCRSGFSGPF

SEQ ID NO: 3081138 - protein, 24 aa, Giardia lamblia
VETHMPLVFLCREAHWNYFTYIPV

SEQ ID NO: 3081139 - protein, 30 aa, Giardia lamblia
VETINWKALDLLGALTYDLKLVAGYGNIAN

SEQ ID NO: 3081140 - protein, 20 aa, Giardia lamblia
VEVIFLEFYAVHTIRLPVLE

SEQ ID NO: 3081141 - protein, 39 aa, Giardia lamblia
VEVPELLQAILPNWSSKRRYSLCESIYSCKLVQRSKQAY

SEQ ID NO: 3081142 - protein, 26 aa, Giardia lamblia
VEVPGTWPMVEICISAVKLLPLDVAK

SEQ ID NO: 3081143 - protein, 27 aa, Giardia lamblia
VEVVLRSARGIPGRLVIVLWTGYMDTS

SEQ ID NO: 3081144 - protein, 19 aa, Giardia lamblia
VEVYCRIISSAFGLDKTST

SEQ ID NO: 3081145 - protein, 22 aa, Giardia lamblia
VEYHLPVSILRVISEMKRLQKY

SEQ ID NO: 3081146 - protein, 18 aa, Giardia lamblia
VFATACFAILDLVQTTAF

SEQ ID NO: 3081147 - protein, 23 aa, Giardia lamblia
VFCSLKGRLSDILTELSDTIPAY

SEQ ID NO: 3081148 - protein, 19 aa, Giardia lamblia
VFDFHPGLVHDNKWRAWLS

SEQ ID NO: 3081149 - protein, 25 aa, Giardia lamblia
VFDIRRGELLLAREIALPRLTDDAL

SEQ ID NO: 3081150 - protein, 17 aa, Giardia lamblia
VFDVLYYILKFVLSICT

SEQ ID NO: 3081151 - protein, 26 aa, Giardia lamblia
VFEFAVLWCDASVWFHILKVLLVEGF

SEQ ID NO: 3081152 - protein, 22 aa, Giardia lamblia
VFELCRFDQHFYRLYLDTTEKQ

SEQ ID NO: 3081153 - protein, 19 aa, Giardia lamblia
VFFSLCLILTLLKEILQEC

SEQ ID NO: 3081154 - protein, 19 aa, Giardia lamblia
VFGAPVALATKLHEKIVAY

SEQ ID NO: 3081155 - protein, 24 aa, Giardia lamblia
VFHKCISVNWAHEYSGLCDTGILV

SEQ ID NO: 3081156 - protein, 17 aa, Giardia lamblia
VFHNFLMLESCFNFDRE

SEQ ID NO: 3081157 - protein, 34 aa, Giardia lamblia
VFIGFMRGLSNWMIASRCLHGFVLVFVTYSIIIN

SEQ ID NO: 3081158 - protein, 20 aa, Giardia lamblia
VFIWLLTFCISFNFLSAPSL

SEQ ID NO: 3081159 - protein, 27 aa, Giardia lamblia
VFKKFMPVTEICRFLWHQMLSNVRKTS

SEQ ID NO: 3081160 - protein, 29 aa, Giardia lamblia
VFKNCPYFRRYPSVKFYREFIRELYASLC

SEQ ID NO: 3081161 - protein, 17 aa, Giardia lamblia
VFLALRFISEITAPTII

SEQ ID NO: 3081162 - protein, 26 aa, Giardia lamblia
VFLAQLHPSYKCSMIPMSAIIDHHLT

SEQ ID NO: 3081163 - protein, 17 aa, Giardia lamblia
VFLKPQYGQWSMLDSIL

SEQ ID NO: 3081164 - protein, 19 aa, Giardia lamblia
VFLLRCDKSNLLTYTDRYF

SEQ ID NO: 3081165 - protein, 26 aa, Giardia lamblia
VFLQDCPGHRDFVPSLIRAVSQPDAA

SEQ ID NO: 3081166 - protein, 18 aa, Giardia lamblia
VFNGDLISPILYLVMSRL

SEQ ID NO: 3081167 - protein, 30 aa, Giardia lamblia
VFNMYAFTIRDWRVLKALITLFLVYDNVLN

SEQ ID NO: 3081168 - protein, 19 aa, Giardia lamblia
VFNTELWDAVLYIICSYLG

SEQ ID NO: 3081169 - protein, 29 aa, Giardia lamblia
VFQKLGLRLEIFSTLALSFSDNILYFYRH

SEQ ID NO: 3081170 - protein, 17 aa, Giardia lamblia
VFQSLACLGMYLVFALV

SEQ ID NO: 3081171 - protein, 20 aa, Giardia lamblia
VFRLFEPRIAAGVMTSLSIF

SEQ ID NO: 3081172 - protein, 24 aa, Giardia lamblia
VFRRYKEYFTLVLALAARNTDIAK

SEQ ID NO: 3081173 - protein, 23 aa, Giardia lamblia
VFSADEFILFPAVLMLLLRAVFT

SEQ ID NO: 3081174 - protein, 22 aa, Giardia lamblia
VFSESRVQSRIELKEVIRDIMA

SEQ ID NO: 3081175 - protein, 27 aa, Giardia lamblia
VFSIYFVYCALVFVNAYLIASRGSLSH

SEQ ID NO: 3081176 - protein, 23 aa, Giardia lamblia
VFSNCLKFSVSLRIFDSLLCEGE

SEQ ID NO: 3081177 - protein, 24 aa, Giardia lamblia
VFSNFYKRNFVLRLPQGTGSALSF

SEQ ID NO: 3081178 - protein, 17 aa, Giardia lamblia
VFSRLQIMATERSTLKI

SEQ ID NO: 3081179 - protein, 28 aa, Giardia lamblia
VFSVGLLIRCLFAGVIAEQVSPSSIITY

SEQ ID NO: 3081180 - protein, 25 aa, Giardia lamblia
VFTCGTCFMQGYLLSNVMSDILGPT

SEQ ID NO: 3081181 - protein, 17 aa, Giardia lamblia
VFTEANAVCALENLQVK

SEQ ID NO: 3081182 - protein, 25 aa, Giardia lamblia
VFTGLRARFQAIYDEAKFTSICMNL

SEQ ID NO: 3081183 - protein, 25 aa, Giardia lamblia
VFTIFFGSFPLEFSNVLLESAAMLH

SEQ ID NO: 3081184 - protein, 18 aa, Giardia lamblia
VFVNPAFAQGRSDLVRDR

SEQ ID NO: 3081185 - protein, 17 aa, Giardia lamblia
VFYAFSVEYKDDTSVIA

SEQ ID NO: 3081186 - protein, 19 aa, Giardia lamblia
VFYEQLFTLSYGFSVSENK

SEQ ID NO: 3081187 - protein, 20 aa, Giardia lamblia
VFYPLAIVRASLGYVRQVKE

SEQ ID NO: 3081188 - protein, 19 aa, Giardia lamblia
VFYPTRSTPCLPFPTISSG

SEQ ID NO: 3081189 - protein, 17 aa, Giardia lamblia
VGALCASASSPLSDLAT

SEQ ID NO: 3081190 - protein, 18 aa, Giardia lamblia
VGALDFTPIIALTAESLS

SEQ ID NO: 3081191 - protein, 27 aa, Giardia lamblia
VGASITFLACIILKYKKNRLRYLEPFL

SEQ ID NO: 3081192 - protein, 20 aa, Giardia lamblia
VGCHAKRCYVGGFASMATGP

SEQ ID NO: 3081193 - protein, 22 aa, Giardia lamblia
VGCILKAIVLCIGDDKDSLLML

SEQ ID NO: 3081194 - protein, 22 aa, Giardia lamblia
VGCTALMFAAAYDYIECARLLL

SEQ ID NO: 3081195 - protein, 25 aa, Giardia lamblia
VGEFPVRLKLLYTLSALLSNIEELA

SEQ ID NO: 3081196 - protein, 22 aa, Giardia lamblia
VGESICLAIFYIKRCLVKRNVS

SEQ ID NO: 3081197 - protein, 19 aa, Giardia lamblia
VGESYVAGTDEPRCSFPAP

SEQ ID NO: 3081198 - protein, 28 aa, Giardia lamblia
VGFQDKWGWSALMWAACAGDADTTKLLA

SEQ ID NO: 3081199 - protein, 17 aa, Giardia lamblia
VGFVILTVICWLMGFYL

SEQ ID NO: 3081200 - protein, 26 aa, Giardia lamblia
VGGAGLKCSFDITAKMWITKSDTDME

SEQ ID NO: 3081201 - protein, 23 aa, Giardia lamblia
VGGFTHTICLSIAVVGNIMLKVL

SEQ ID NO: 3081202 - protein, 19 aa, Giardia lamblia
VGGSLTFDTHVYRAFHDTT

SEQ ID NO: 3081203 - protein, 19 aa, Giardia lamblia
VGHCLESPILANCLRGQTT

SEQ ID NO: 3081204 - protein, 25 aa, Giardia lamblia
VGHEYRCFFSTGLCDCGSVVSTGKT

SEQ ID NO: 3081205 - protein, 19 aa, Giardia lamblia
VGHSCGRPSLSSYLDYHTG

SEQ ID NO: 3081206 - protein, 24 aa, Giardia lamblia
VGHSCIPSACVVYLSGTPVTCGGF

SEQ ID NO: 3081207 - protein, 17 aa, Giardia lamblia
VGIALRVTKMSNVYRSF

SEQ ID NO: 3081208 - protein, 17 aa, Giardia lamblia
VGIAWLFTVTAGVLLLN

SEQ ID NO: 3081209 - protein, 19 aa, Giardia lamblia
VGIHFRVVLFLLLVPIAVH

SEQ ID NO: 3081210 - protein, 19 aa, Giardia lamblia
VGIPRPQESMLLNSKFHRI

SEQ ID NO: 3081211 - protein, 30 aa, Giardia lamblia
VGKSIAKRYVEFHAMAFLKPSESVFYRNAT

SEQ ID NO: 3081212 - protein, 17 aa, Giardia lamblia
VGLFGMALAYPVEILMC

SEQ ID NO: 3081213 - protein, 23 aa, Giardia lamblia
VGLFKILLTVAFDLDIPELCLKL

SEQ ID NO: 3081214 - protein, 18 aa, Giardia lamblia
VGLLRAFLTYVLTTNCSL

SEQ ID NO: 3081215 - protein, 23 aa, Giardia lamblia
VGLSCKAPCLYRNILTDASADLL

SEQ ID NO: 3081216 - protein, 22 aa, Giardia lamblia
VGLWKFLYFGWLAFNWAVIFLY

SEQ ID NO: 3081217 - protein, 22 aa, Giardia lamblia
VGLYVVCTYTGIITLLDMMDAQ

SEQ ID NO: 3081218 - protein, 28 aa, Giardia lamblia
VGMLVMICVLAWPALIVVIPTIILYAVI

SEQ ID NO: 3081219 - protein, 29 aa, Giardia lamblia
VGMSSAHPTLSCALYCAVVANNLIAVKIL

SEQ ID NO: 3081220 - protein, 26 aa, Giardia lamblia
VGNPSYSWGRQCHRHIPSSFNSNEQS

SEQ ID NO: 3081221 - protein, 26 aa, Giardia lamblia
VGQDACSWGSCTIMDGSLCSQCASSD

SEQ ID NO: 3081222 - protein, 31 aa, Giardia lamblia
VGRGGWRSPNFWFELLFYLFILISVLLYAFN

SEQ ID NO: 3081223 - protein, 29 aa, Giardia lamblia
VGRRGESQMVYYLLRGVFLLALQINPILA

SEQ ID NO: 3081224 - protein, 19 aa, Giardia lamblia
VGSILRLSPSIYMPTNARK

SEQ ID NO: 3081225 - protein, 24 aa, Giardia lamblia
VGSLCRRTEVSISQCTSVPDSKGV

SEQ ID NO: 3081226 - protein, 25 aa, Giardia lamblia
VGSLLMFERARCIESVLLTHKDRLM

SEQ ID NO: 3081227 - protein, 26 aa, Giardia lamblia
VGSPRTVPHILIRYNLLRDRSNPIRR

SEQ ID NO: 3081228 - protein, 18 aa, Giardia lamblia
VGTCIRYYLVDKYSTHLK

SEQ ID NO: 3081229 - protein, 25 aa, Giardia lamblia
VGTLSIPCQGCFLLTSGFLGCVMAT

SEQ ID NO: 3081230 - protein, 20 aa, Giardia lamblia
VGTYVTFCLTLLWHSPASRL

SEQ ID NO: 3081231 - protein, 19 aa, Giardia lamblia
VGVGSWIVSTCVSYFYHLF

SEQ ID NO: 3081232 - protein, 20 aa, Giardia lamblia
VGVIRKMKDNLAVVASDITC

SEQ ID NO: 3081233 - protein, 35 aa, Giardia lamblia
VGYGAHKGRPVWILRNSWGTGWGVSGYYYIGRGSN

SEQ ID NO: 3081234 - protein, 26 aa, Giardia lamblia
VGYGRYRGTAVWIVRNSWGADWGVYG

SEQ ID NO: 3081235 - protein, 26 aa, Giardia lamblia
VGYMTWPAMLLCAFLSVLSGHPYDGQ

SEQ ID NO: 3081236 - protein, 21 aa, Giardia lamblia
VGYVVCYTLLIFVDKLIVAIF

SEQ ID NO: 3081237 - protein, 18 aa, Giardia lamblia
VHANSFFIACIISLCAAA

SEQ ID NO: 3081238 - protein, 23 aa, Giardia lamblia
VHCFAMPILIISVMFKRQIRWGS

SEQ ID NO: 3081239 - protein, 18 aa, Giardia lamblia
VHDNKWRAWLSFEQNKQV

SEQ ID NO: 3081240 - protein, 25 aa, Giardia lamblia
VHELKELWLSDSFFSLKHCAFNGHT

SEQ ID NO: 3081241 - protein, 24 aa, Giardia lamblia
VHFYTNMFPLVFKSLEALFQTGPC

SEQ ID NO: 3081242 - protein, 25 aa, Giardia lamblia
VHGKVELFYDPALRKDNRYSDSYPH

SEQ ID NO: 3081243 - protein, 21 aa, Giardia lamblia
VHGSEGLGGYLAISQSLGQVC

SEQ ID NO: 3081244 - protein, 21 aa, Giardia lamblia
VHGSWPLRRDFTVEYVNKAEY

SEQ ID NO: 3081245 - protein, 17 aa, Giardia lamblia
VHICRTSLLMWIFLGYA

SEQ ID NO: 3081246 - protein, 18 aa, Giardia lamblia
VHIPSFFISTIPWFTLAA

SEQ ID NO: 3081247 - protein, 32 aa, Giardia lamblia
VHIVRRPKKAIKFILRIDISFTEKVHRIVHTW

SEQ ID NO: 3081248 - protein, 25 aa, Giardia lamblia
VHKELEVGHAIFANAYLLGYIILSV

SEQ ID NO: 3081249 - protein, 19 aa, Giardia lamblia
VHKKLGALTKVFSVGLLIR

SEQ ID NO: 3081250 - protein, 20 aa, Giardia lamblia
VHKLASISIIGPVIDNTSTR

SEQ ID NO: 3081251 - protein, 25 aa, Giardia lamblia
VHKLDSFVIALQFIMKGVLRPIFRE

SEQ ID NO: 3081252 - protein, 17 aa, Giardia lamblia
VHLKKQRVLFALPCDLS

SEQ ID NO: 3081253 - protein, 26 aa, Giardia lamblia
VHLRPHPKQSLTILRVFTTLATALLD

SEQ ID NO: 3081254 - protein, 23 aa, Giardia lamblia
VHLTELRKFLAITPTERVRFNLR

SEQ ID NO: 3081255 - protein, 25 aa, Giardia lamblia
VHMGLCSKSPLFASYFVHGLSLSSF

SEQ ID NO: 3081256 - protein, 24 aa, Giardia lamblia
VHPDFGAIVLCQVVGRAIHFAAKC

SEQ ID NO: 3081257 - protein, 18 aa, Giardia lamblia
VHPDSCRSFFANVSTSTV

SEQ ID NO: 3081258 - protein, 24 aa, Giardia lamblia
VHPRKSYHYHTSCADISVTWTRSL

SEQ ID NO: 3081259 - protein, 17 aa, Giardia lamblia
VHRDLRPANIFISADGE

SEQ ID NO: 3081260 - protein, 17 aa, Giardia lamblia
VHRDMCRSPAVKIQDES

SEQ ID NO: 3081261 - protein, 24 aa, Giardia lamblia
VHRSIRPMSFVKLSSFFSDSGAHA

SEQ ID NO: 3081262 - protein, 23 aa, Giardia lamblia
VHRYHFPLFYERLMLNSLINGYP

SEQ ID NO: 3081263 - protein, 18 aa, Giardia lamblia
VHSLEIARAAALCGAKVV

SEQ ID NO: 3081264 - protein, 17 aa, Giardia lamblia
VHSVQKFLLNPNASKPR

SEQ ID NO: 3081265 - protein, 17 aa, Giardia lamblia
VHTLLLFQLRTDQRALQ

SEQ ID NO: 3081266 - protein, 21 aa, Giardia lamblia
VHTPKIILRFVKNLLSCLGER

SEQ ID NO: 3081267 - protein, 18 aa, Giardia lamblia
VHVIDALIFLSKLGASKH

SEQ ID NO: 3081268 - protein, 21 aa, Giardia lamblia
VHVLYCVRQIIASKLMLPEGI

SEQ ID NO: 3081269 - protein, 19 aa, Giardia lamblia
VHYFKRRAYSYVDFSANKL

SEQ ID NO: 3081270 - protein, 24 aa, Giardia lamblia
VIALTFCTYCFLLITEVNYHGNFA

SEQ ID NO: 3081271 - protein, 19 aa, Giardia lamblia
VIAPRELQKAFPIELEHIQ

SEQ ID NO: 3081272 - protein, 21 aa, Giardia lamblia
VIAVIQARAAKYLFHGAKPRV

SEQ ID NO: 3081273 - protein, 19 aa, Giardia lamblia
VICNMMFSFGLGVFFTTNN

SEQ ID NO: 3081274 - protein, 26 aa, Giardia lamblia
VIDKIPANCSFKAFIDQVDEYIKKDK

SEQ ID NO: 3081275 - protein, 26 aa, Giardia lamblia
VIDSTYLPLCHKLTHLFDGLKGRDLN

SEQ ID NO: 3081276 - protein, 22 aa, Giardia lamblia
VIEESFLGPSLCQVRVDRQVSQ

SEQ ID NO: 3081277 - protein, 20 aa, Giardia lamblia
VIERRKFGPIGYVCNLCSRS

SEQ ID NO: 3081278 - protein, 20 aa, Giardia lamblia
VIESAFICRIQARRATAEEL

SEQ ID NO: 3081279 - protein, 18 aa, Giardia lamblia
VIEYLHKHDIVFRDMKPE

SEQ ID NO: 3081280 - protein, 20 aa, Giardia lamblia
VIEYYIRFKDFDFADLLEYI

SEQ ID NO: 3081281 - protein, 27 aa, Giardia lamblia
VIFIVPFLLYRFFNRPPETIFKGSYVS

SEQ ID NO: 3081282 - protein, 18 aa, Giardia lamblia
VIFKVISVYSGFRYQVDS

SEQ ID NO: 3081283 - protein, 28 aa, Giardia lamblia
VIGDVRCFLNFRGWNFDPVFPLEKKDFT

SEQ ID NO: 3081284 - protein, 24 aa, Giardia lamblia
VIGFLKILVVPVVILKDAILCLAG

SEQ ID NO: 3081285 - protein, 23 aa, Giardia lamblia
VIGLCGCIGMFVAVSQPFIGVDN

SEQ ID NO: 3081286 - protein, 17 aa, Giardia lamblia
VIGLQACLFLEHVVRHW

SEQ ID NO: 3081287 - protein, 26 aa, Giardia lamblia
VIHGKSKRKSYVFPIETFMPPAVDGI

SEQ ID NO: 3081288 - protein, 25 aa, Giardia lamblia
VIIAILCLLSGLNLVGIVMTIIPVP

SEQ ID NO: 3081289 - protein, 18 aa, Giardia lamblia
VIIGAAIIFPLTIPRSIS

SEQ ID NO: 3081290 - protein, 26 aa, Giardia lamblia
VIIIASRLSNFIAVKALFLAESGYSV

SEQ ID NO: 3081291 - protein, 21 aa, Giardia lamblia
VIILLTLRQILMWQLNKEVVK

SEQ ID NO: 3081292 - protein, 17 aa, Giardia lamblia
VIILPFFIFFGAAAPQF

SEQ ID NO: 3081293 - protein, 21 aa, Giardia lamblia
VIKHCLPEAEIIEKSPMGVFF

SEQ ID NO: 3081294 - protein, 23 aa, Giardia lamblia
VIKTIQLPLCILLFHEQYNIDES

SEQ ID NO: 3081295 - protein, 29 aa, Giardia lamblia
VILRILPIFFKLKIKYHKQLEKVASNLLR

SEQ ID NO: 3081296 - protein, 18 aa, Giardia lamblia
VIMALKIIDLSALSSNAQ

SEQ ID NO: 3081297 - protein, 25 aa, Giardia lamblia
VIMLLSWPTIVFIIPLGILYIFIFN

SEQ ID NO: 3081298 - protein, 27 aa, Giardia lamblia
VIMYRNIRFTLSYMRFLRDRNDQLYRA

SEQ ID NO: 3081299 - protein, 21 aa, Giardia lamblia
VIPTLKGLYSSGAFEAACMYS

SEQ ID NO: 3081300 - protein, 27 aa, Giardia lamblia
VIQELRLIEPIVRTWRSFEFVCDAAAF

SEQ ID NO: 3081301 - protein, 20 aa, Giardia lamblia
VIQSTELDKLLMIMDLAEGP

SEQ ID NO: 3081302 - protein, 19 aa, Giardia lamblia
VIQYYCWDVDGMAHPLDGV

SEQ ID NO: 3081303 - protein, 33 aa, Giardia lamblia
VIRASAFITSACLQRIFLNLVCYNTSYNYIFQT

SEQ ID NO: 3081304 - protein, 25 aa, Giardia lamblia
VIRCADFHAPLYLAAQLLRLDLRES

SEQ ID NO: 3081305 - protein, 19 aa, Giardia lamblia
VIRHACSFHTDIRRIDASI

SEQ ID NO: 3081306 - protein, 23 aa, Giardia lamblia
VISKPCDWMRNVVDQLATTGRRT

SEQ ID NO: 3081307 - protein, 31 aa, Giardia lamblia
VISRNCIPLFPRLVLASSFSATTARASKNVL

SEQ ID NO: 3081308 - protein, 18 aa, Giardia lamblia
VITVAGLLRSILQHLTGF

SEQ ID NO: 3081309 - protein, 31 aa, Giardia lamblia
VIVLFLFCIALGFTILACFLIQRSYTQKFIV

SEQ ID NO: 3081310 - protein, 23 aa, Giardia lamblia
VIYNCNLRSFLREASKLAAERSA

SEQ ID NO: 3081311 - protein, 27 aa, Giardia lamblia
VKALTLLAIRYSMLISNGMFKVDDNEM

SEQ ID NO: 3081312 - protein, 20 aa, Giardia lamblia
VKASMKAIMGQFIDAFHRFT

SEQ ID NO: 3081313 - protein, 23 aa, Giardia lamblia
VKAVKRYIPYQARMVAKLVKAGR

SEQ ID NO: 3081314 - protein, 21 aa, Giardia lamblia
VKCLIPRIKRAIHEASEYTRA

SEQ ID NO: 3081315 - protein, 25 aa, Giardia lamblia
VKCYYTRLDPDFTFDTSVRSRYWYT

SEQ ID NO: 3081316 - protein, 25 aa, Giardia lamblia
VKCYYTRLDPDFTFNTSVRSRYWYT

SEQ ID NO: 3081317 - protein, 23 aa, Giardia lamblia
VKDELYKPLLLYRTVVLPKATFK

SEQ ID NO: 3081318 - protein, 24 aa, Giardia lamblia
VKEICLAPPLAGFHTGLATVRSPS

SEQ ID NO: 3081319 - protein, 21 aa, Giardia lamblia
VKELLDSFNIIIHCHPVPFLV

SEQ ID NO: 3081320 - protein, 26 aa, Giardia lamblia
VKERCKRLGIPFPYPYSSGLRTNLSE

SEQ ID NO: 3081321 - protein, 23 aa, Giardia lamblia
VKEYYIPDFVKSIIRISYSVVAF

SEQ ID NO: 3081322 - protein, 17 aa, Giardia lamblia
VKFLKQREQLLAQTESE

SEQ ID NO: 3081323 - protein, 25 aa, Giardia lamblia
VKGFWTVVERFWKALAGVEFSDLQA

SEQ ID NO: 3081324 - protein, 22 aa, Giardia lamblia
VKGMFIFCLLLSALVTFATTTR

SEQ ID NO: 3081325 - protein, 23 aa, Giardia lamblia
VKGMFIFCLLLSALVTFATTTRS

SEQ ID NO: 3081326 - protein, 25 aa, Giardia lamblia
VKILKKKVEHMGLFKAPNLAERQHS

SEQ ID NO: 3081327 - protein, 26 aa, Giardia lamblia
VKIMLRPPSFLLYKIGPVCTSDDLTF

SEQ ID NO: 3081328 - protein, 20 aa, Giardia lamblia
VKISEALMDIFLDLSTLDQS

SEQ ID NO: 3081329 - protein, 20 aa, Giardia lamblia
VKIVCGISSSIAGARFKSPN

SEQ ID NO: 3081330 - protein, 24 aa, Giardia lamblia
VKKGQREALTWVSYILPLMDESIA

SEQ ID NO: 3081331 - protein, 22 aa, Giardia lamblia
VKKGREGQIEWAVLSDIFSSPK

SEQ ID NO: 3081332 - protein, 22 aa, Giardia lamblia
VKKLRFAGIKINIVTGDSIETT

SEQ ID NO: 3081333 - protein, 20 aa, Giardia lamblia
VKLADFGVCRLYENAQEHMA

SEQ ID NO: 3081334 - protein, 17 aa, Giardia lamblia
VKLIPKLIAQYLQLSGG

SEQ ID NO: 3081335 - protein, 22 aa, Giardia lamblia
VKLPLHMAYSVIFVSVASRFFS

SEQ ID NO: 3081336 - protein, 25 aa, Giardia lamblia
VKNGAFRPSYPIFHQYMAVCLQVSQ

SEQ ID NO: 3081337 - protein, 24 aa, Giardia lamblia
VKNGHPVLFCGPAGSGKTSLLKSM

SEQ ID NO: 3081338 - protein, 18 aa, Giardia lamblia
VKNLHIVKALAPYEAGIQ

SEQ ID NO: 3081339 - protein, 30 aa, Giardia lamblia
VKNPEIMGALPKYAVRTIMALLCEASTSDI

SEQ ID NO: 3081340 - protein, 19 aa, Giardia lamblia
VKNPGIYDALAIQGLVSIQ

SEQ ID NO: 3081341 - protein, 29 aa, Giardia lamblia
VKPRQNYELSVIFLTELLKLANNMPDLVQ

SEQ ID NO: 3081342 - protein, 29 aa, Giardia lamblia
VKPSFFGHFRLAFPLAFNVSKTGSVTFTD

SEQ ID NO: 3081343 - protein, 18 aa, Giardia lamblia
VKPYLCVSPRCISNSATN

SEQ ID NO: 3081344 - protein, 17 aa, Giardia lamblia
VKQRHWLEISKVTDKPS

SEQ ID NO: 3081345 - protein, 24 aa, Giardia lamblia
VKQVCFLESPPLYERSGETMLPVL

SEQ ID NO: 3081346 - protein, 19 aa, Giardia lamblia
VKRPHVRGGREHAVSEAIQ

SEQ ID NO: 3081347 - protein, 23 aa, Giardia lamblia
VKRRDRWGRTALMFAAMSGCAVA

SEQ ID NO: 3081348 - protein, 24 aa, Giardia lamblia
VKRYKDFKALSGIDMYIGPGECIC

SEQ ID NO: 3081349 - protein, 30 aa, Giardia lamblia
VKSFAEGLLLIRPLLPISLLELLCSMKQNV

SEQ ID NO: 3081350 - protein, 23 aa, Giardia lamblia
VKSKARIALRHLLELQEQKMKIN

SEQ ID NO: 3081351 - protein, 23 aa, Giardia lamblia
VKSRELVILWFAYLFQMFSSQLP

SEQ ID NO: 3081352 - protein, 18 aa, Giardia lamblia
VKTHWAYLIVIRVLAGFP

SEQ ID NO: 3081353 - protein, 23 aa, Giardia lamblia
VKTPRPLSQYRFIVTFDIDGANP

SEQ ID NO: 3081354 - protein, 17 aa, Giardia lamblia
VKVAEDIARQEHEDGDE

SEQ ID NO: 3081355 - protein, 21 aa, Giardia lamblia
VKVLCAHPIFLTSEKMAHFLA

SEQ ID NO: 3081356 - protein, 18 aa, Giardia lamblia
VKVPTVWHDPVDIGQFDM

SEQ ID NO: 3081357 - protein, 19 aa, Giardia lamblia
VKYDSRKSVFHNFLMLESC

SEQ ID NO: 3081358 - protein, 26 aa, Giardia lamblia
VKYRLKCVRDGCLFSLYEGNLSVYNP

SEQ ID NO: 3081359 - protein, 22 aa, Giardia lamblia
VLAACAPAGGGRNVVSMRTISH

SEQ ID NO: 3081360 - protein, 29 aa, Giardia lamblia
VLAAVAGFLVWWFVIRPRRGGPLRERAPQ

SEQ ID NO: 3081361 - protein, 25 aa, Giardia lamblia
VLAFGFGEATAFLLAIVGLILQTKR

SEQ ID NO: 3081362 - protein, 20 aa, Giardia lamblia
VLAILCFPLGMLDFSVLIDV

SEQ ID NO: 3081363 - protein, 25 aa, Giardia lamblia
VLAKRLTKRLAPIATEIHDSVERML

SEQ ID NO: 3081364 - protein, 24 aa, Giardia lamblia
VLALEAVMYFSLCIYQLGPQGAAQ

SEQ ID NO: 3081365 - protein, 24 aa, Giardia lamblia
VLAVAGFLVWWFVFRRGGRPRRGG

SEQ ID NO: 3081366 - protein, 18 aa, Giardia lamblia
VLAYLFYVVYCHRDSYSI

SEQ ID NO: 3081367 - protein, 18 aa, Giardia lamblia
VLCPNFPTTRGVKFDVVG

SEQ ID NO: 3081368 - protein, 19 aa, Giardia lamblia
VLDQGACGSCFTFGAVQAM

SEQ ID NO: 3081369 - protein, 19 aa, Giardia lamblia
VLDTICLQSSFIDVGQEFV

SEQ ID NO: 3081370 - protein, 26 aa, Giardia lamblia
VLEQLHKCFYALPVVLQRVMSNVTMA

SEQ ID NO: 3081371 - protein, 22 aa, Giardia lamblia
VLERFSLSELSSFKHNKRDQRV

SEQ ID NO: 3081372 - protein, 23 aa, Giardia lamblia
VLETLSLHWAAPVFGLPHFEKKF

SEQ ID NO: 3081373 - protein, 17 aa, Giardia lamblia
VLFACVYTTRLLYWLFR

SEQ ID NO: 3081374 - protein, 18 aa, Giardia lamblia
VLFAVGLLALCLMTVTPF

SEQ ID NO: 3081375 - protein, 26 aa, Giardia lamblia
VLFAVNRLSSFMLMSLRDPVRILLPF

SEQ ID NO: 3081376 - protein, 20 aa, Giardia lamblia
VLFFVVWVLVAALFKVLSAF

SEQ ID NO: 3081377 - protein, 30 aa, Giardia lamblia
VLFLLSWVFALAIACYYYAPFNPIKIKSIK

SEQ ID NO: 3081378 - protein, 25 aa, Giardia lamblia
VLFPQLEMFRQAKIHNIIIEGLQVK

SEQ ID NO: 3081379 - protein, 19 aa, Giardia lamblia
VLFQLYIPVSHELEHIIDL

SEQ ID NO: 3081380 - protein, 18 aa, Giardia lamblia
VLFSLPFSQVYDSIAQTP

SEQ ID NO: 3081381 - protein, 26 aa, Giardia lamblia
VLGALVLPCNLLFRLLPMAREYGYRG

SEQ ID NO: 3081382 - protein, 18 aa, Giardia lamblia
VLGSYVIKTILVHVARKK

SEQ ID NO: 3081383 - protein, 25 aa, Giardia lamblia
VLGTLAFLVDIEWSYSAASTSISDA

SEQ ID NO: 3081384 - protein, 27 aa, Giardia lamblia
VLHFEEFVELLAGLVIAPPTTIDPLLL

SEQ ID NO: 3081385 - protein, 17 aa, Giardia lamblia
VLHSYKLDIEVLNKTAV

SEQ ID NO: 3081386 - protein, 52 aa, Giardia lamblia
VLHTCHLLGRRLVCVCVAEFTFVKCLQRITACLCAGYVVLVFGLQYLPTPQI

SEQ ID NO: 3081387 - protein, 19 aa, Giardia lamblia
VLIDFPSYFSLYTLIPTIP

SEQ ID NO: 3081388 - protein, 19 aa, Giardia lamblia
VLIFGCNLAQIWIVEVYCI

SEQ ID NO: 3081389 - protein, 25 aa, Giardia lamblia
VLILRRYASLCIKDHYDTPLVLVSY

SEQ ID NO: 3081390 - protein, 24 aa, Giardia lamblia
VLIPCAVAFLFEGAMGFLEYTGVM

SEQ ID NO: 3081391 - protein, 23 aa, Giardia lamblia
VLIRAHASFLYYPTLLTLLGQKV

SEQ ID NO: 3081392 - protein, 27 aa, Giardia lamblia
VLISQGVCKLCDFGFARQMSQQTLALQ

SEQ ID NO: 3081393 - protein, 26 aa, Giardia lamblia
VLKLFLCLFCHFVGREAKILSDACLA

SEQ ID NO: 3081394 - protein, 17 aa, Giardia lamblia
VLLARLTLIPLLLEERD

SEQ ID NO: 3081395 - protein, 17 aa, Giardia lamblia
VLLCNSIPGLAIVGFGT

SEQ ID NO: 3081396 - protein, 24 aa, Giardia lamblia
VLLCREVHYLRQLRIEIPETALAI

SEQ ID NO: 3081397 - protein, 17 aa, Giardia lamblia
VLLDEEFNFDRELDSAA

SEQ ID NO: 3081398 - protein, 20 aa, Giardia lamblia
VLLELFKYPIVLTSTVSGKR

SEQ ID NO: 3081399 - protein, 24 aa, Giardia lamblia
VLLEMSHSLSVLPLPGALFADEPS

SEQ ID NO: 3081400 - protein, 17 aa, Giardia lamblia
VLLKSHLSYSWEPLPHQ

SEQ ID NO: 3081401 - protein, 23 aa, Giardia lamblia
VLLLEYLKTSVFVDRIRVRYISA

SEQ ID NO: 3081402 - protein, 18 aa, Giardia lamblia
VLLLIIIARLVYKARYGG

SEQ ID NO: 3081403 - protein, 32 aa, Giardia lamblia
VLLLQALLCLFIFKYVKPFLISYILIMKAKVS

SEQ ID NO: 3081404 - protein, 18 aa, Giardia lamblia
VLLLSLFIGYFVPQTYIL

SEQ ID NO: 3081405 - protein, 25 aa, Giardia lamblia
VLLPTARKAFSGKFMEECQQSVIAF

SEQ ID NO: 3081406 - protein, 25 aa, Giardia lamblia
VLLQIPSALFVKASVDSAAGSGETV

SEQ ID NO: 3081407 - protein, 24 aa, Giardia lamblia
VLLRETLRLVSWALGPKAHSECRD

SEQ ID NO: 3081408 - protein, 22 aa, Giardia lamblia
VLLRRCIMSLVDYCSDHIFLYS

SEQ ID NO: 3081409 - protein, 18 aa, Giardia lamblia
VLLSLAPLVSHLDLSPIE

SEQ ID NO: 3081410 - protein, 27 aa, Giardia lamblia
VLLVLGGVIGFCVWWFLVRGKKGQAAQ

SEQ ID NO: 3081411 - protein, 24 aa, Giardia lamblia
VLLVVAGVLCWFFLKKKKVIKNKP

SEQ ID NO: 3081412 - protein, 26 aa, Giardia lamblia
VLLWEALNLAKLCMKSLTSSKAPIYE

SEQ ID NO: 3081413 - protein, 17 aa, Giardia lamblia
VLMALKIENDFDAFLFI

SEQ ID NO: 3081414 - protein, 17 aa, Giardia lamblia
VLMPYAVPLRMGLYKDA

SEQ ID NO: 3081415 - protein, 18 aa, Giardia lamblia
VLMQQCIVAFYTYLILEH

SEQ ID NO: 3081416 - protein, 29 aa, Giardia lamblia
VLMQRIISWFLVIHVILLVLLYVYLQFAP

SEQ ID NO: 3081417 - protein, 18 aa, Giardia lamblia
VLMTIDVGTDFKIRAFLE

SEQ ID NO: 3081418 - protein, 23 aa, Giardia lamblia
VLNMRTLMALFKLVGSRVSDKKS

SEQ ID NO: 3081419 - protein, 26 aa, Giardia lamblia
VLNTATECYLEFLLYSVFSEIDELVL

SEQ ID NO: 3081420 - protein, 26 aa, Giardia lamblia
VLPCHGSYSFARICERWNSQLNTTYS

SEQ ID NO: 3081421 - protein, 17 aa, Giardia lamblia
VLPCVKLPRHVHIQLDC

SEQ ID NO: 3081422 - protein, 22 aa, Giardia lamblia
VLPGINCRLALPIPSGDALVRA

SEQ ID NO: 3081423 - protein, 26 aa, Giardia lamblia
VLPHKRFLFKTILELSSIIRDSFACY

SEQ ID NO: 3081424 - protein, 27 aa, Giardia lamblia
VLPNDCLRLSFITPYELRAPLQRHKIH

SEQ ID NO: 3081425 - protein, 17 aa, Giardia lamblia
VLPVLSLFYARPISIFL

SEQ ID NO: 3081426 - protein, 18 aa, Giardia lamblia
VLQALAFLHGVREATSGI

SEQ ID NO: 3081427 - protein, 18 aa, Giardia lamblia
VLQVKRKQLFVLGNLMQS

SEQ ID NO: 3081428 - protein, 18 aa, Giardia lamblia
VLRDLYRCSSRSLQSVIK

SEQ ID NO: 3081429 - protein, 24 aa, Giardia lamblia
VLRIEISDVYKIERNLCQVYLYFL

SEQ ID NO: 3081430 - protein, 34 aa, Giardia lamblia
VLRSVCQTVAIPKLICSTDLFVLERNVLPIVQNM

SEQ ID NO: 3081431 - protein, 23 aa, Giardia lamblia
VLSELFRIDPLIIREFAGESISL

SEQ ID NO: 3081432 - protein, 24 aa, Giardia lamblia
VLSELKARLKPMNATALMVAAASN

SEQ ID NO: 3081433 - protein, 18 aa, Giardia lamblia
VLSFSGISYNRLILFYVR

SEQ ID NO: 3081434 - protein, 17 aa, Giardia lamblia
VLSIPDLISRASSNFDI

SEQ ID NO: 3081435 - protein, 19 aa, Giardia lamblia
VLSLCLSVTYGLLARAGER

SEQ ID NO: 3081436 - protein, 29 aa, Giardia lamblia
VLSLTKLRVKRCILCFQVDSTPIASALLP

SEQ ID NO: 3081437 - protein, 28 aa, Giardia lamblia
VLSRPIMELCIAISLNLMRMQCTAEHIE

SEQ ID NO: 3081438 - protein, 34 aa, Giardia lamblia
VLSSGFAFKQSFGWKLAHLCLPSVHSTFELMHMF

SEQ ID NO: 3081439 - protein, 26 aa, Giardia lamblia
VLSSIAYCWRYKHLRKLLKEKIAGST

SEQ ID NO: 3081440 - protein, 25 aa, Giardia lamblia
VLSVLFCSISYYIAYMYGATANEGG

SEQ ID NO: 3081441 - protein, 18 aa, Giardia lamblia
VLSVLSRHDLRGVAELTI

SEQ ID NO: 3081442 - protein, 31 aa, Giardia lamblia
VLTCYCSHILPLAGFTVGFLLLLAFLLTLHT

SEQ ID NO: 3081443 - protein, 19 aa, Giardia lamblia
VLTDEEFSRGLKLSELTDI

SEQ ID NO: 3081444 - protein, 25 aa, Giardia lamblia
VLTDVCSWLPCSHSFRDQFFDFLTE

SEQ ID NO: 3081445 - protein, 24 aa, Giardia lamblia
VLTKVLRKDIQFGGEVTFIPVSGI

SEQ ID NO: 3081446 - protein, 19 aa, Giardia lamblia
VLTRIRTTPLLIFSLLRIV

SEQ ID NO: 3081447 - protein, 26 aa, Giardia lamblia
VLVAVAGFLVWWFVIRPRRGGPLRER

SEQ ID NO: 3081448 - protein, 25 aa, Giardia lamblia
VLVFSFPVVCFALRRAVEDAIFQTE

SEQ ID NO: 3081449 - protein, 22 aa, Giardia lamblia
VLVGFLCWWFIFRGKRTSAPSN

SEQ ID NO: 3081450 - protein, 27 aa, Giardia lamblia
VLVGFLCWWFIFRGRRIDASPSTMTLI

SEQ ID NO: 3081451 - protein, 23 aa, Giardia lamblia
VLVGFLCWWFLCRGKRIGASPST

SEQ ID NO: 3081452 - protein, 23 aa, Giardia lamblia
VLVGFLCWWFLCRSKHIGASSST

SEQ ID NO: 3081453 - protein, 19 aa, Giardia lamblia
VLVMAGGLRRKYGHLTEDV

SEQ ID NO: 3081454 - protein, 20 aa, Giardia lamblia
VLVVCAICVIIIGSLAMCGV

SEQ ID NO: 3081455 - protein, 25 aa, Giardia lamblia
VLVYNCSTCISMIHKGKTTLRVAEE

SEQ ID NO: 3081456 - protein, 31 aa, Giardia lamblia
VLYDLKSVIRDLCLFVHSLPIKASYSAISFS

SEQ ID NO: 3081457 - protein, 19 aa, Giardia lamblia
VLYRRGVLPQSFRISVEAL

SEQ ID NO: 3081458 - protein, 19 aa, Giardia lamblia
VLYTRFATYTIKILKNQAI

SEQ ID NO: 3081459 - protein, 29 aa, Giardia lamblia
VMAALKPYLPLLVAMGVLLVLPFVLGLCF

SEQ ID NO: 3081460 - protein, 17 aa, Giardia lamblia
VMAGFGFIEDCIDVSRK

SEQ ID NO: 3081461 - protein, 19 aa, Giardia lamblia
VMAKLNGLVPIFKQFNYKW

SEQ ID NO: 3081462 - protein, 21 aa, Giardia lamblia
VMELLCAYAASPNVVIKLDLS

SEQ ID NO: 3081463 - protein, 38 aa, Giardia lamblia
VMFSDAFMKRNELSYKFRMLSHRQMLRYADQLGATPRE

SEQ ID NO: 3081464 - protein, 19 aa, Giardia lamblia
VMGFFGFEHHVFELVNPGL

SEQ ID NO: 3081465 - protein, 30 aa, Giardia lamblia
VMLFSYPLLCYGLRCTIESMFYSPGQKIPY

SEQ ID NO: 3081466 - protein, 24 aa, Giardia lamblia
VMLLSGQFFAHFGLYNPASGHLPY

SEQ ID NO: 3081467 - protein, 19 aa, Giardia lamblia
VMPTECFFGTLKLDLKQVL

SEQ ID NO: 3081468 - protein, 17 aa, Giardia lamblia
VMPTLARIFTDHFFAHF

SEQ ID NO: 3081469 - protein, 27 aa, Giardia lamblia
VMSLHYRLQMDIIFLLRDGKNAARARA

SEQ ID NO: 3081470 - protein, 34 aa, Giardia lamblia
VMSLTQESLCFIRCFFSLLPRRLSSYLLCKELQI

SEQ ID NO: 3081471 - protein, 18 aa, Giardia lamblia
VMSPILLSSAAAKRKSTM

SEQ ID NO: 3081472 - protein, 26 aa, Giardia lamblia
VMWVFCILMLQLASLLINFWTEQRLG

SEQ ID NO: 3081473 - protein, 17 aa, Giardia lamblia
VNCMKTLLRNTADTTLT

SEQ ID NO: 3081474 - protein, 23 aa, Giardia lamblia
VNDAYKFKDWLALLRTMKQQSAL

SEQ ID NO: 3081475 - protein, 18 aa, Giardia lamblia
VNDGFYICDCPSKEYYIK

SEQ ID NO: 3081476 - protein, 19 aa, Giardia lamblia
VNEFIPYYICETALRDMQK

SEQ ID NO: 3081477 - protein, 23 aa, Giardia lamblia
VNERCYIYRSELLQMVSTYQTAP

SEQ ID NO: 3081478 - protein, 22 aa, Giardia lamblia
VNIKRAVWQSVLAVITDMQLSV

SEQ ID NO: 3081479 - protein, 28 aa, Giardia lamblia
VNISHSLFNRGLCAVAFSNGVVTVMLTT

SEQ ID NO: 3081480 - protein, 35 aa, Giardia lamblia
VNKDPFSTFCYLRQARLRNVFGMTALMLAAKYGNQ

SEQ ID NO: 3081481 - protein, 25 aa, Giardia lamblia
VNLLKRYEAGLGMKPLQTTAMMLAA

SEQ ID NO: 3081482 - protein, 24 aa, Giardia lamblia
VNLLSKIVSIFFMYVHQNPEMVSA

SEQ ID NO: 3081483 - protein, 17 aa, Giardia lamblia
VNLSFGSNILLVILKII

SEQ ID NO: 3081484 - protein, 23 aa, Giardia lamblia
VNMANCIYANASIELNAISQFEP

SEQ ID NO: 3081485 - protein, 19 aa, Giardia lamblia
VNPSLAYLLCRRVLDSDGG

SEQ ID NO: 3081486 - protein, 22 aa, Giardia lamblia
VNRIPCRFCNPDVAIEKTTPGI

SEQ ID NO: 3081487 - protein, 26 aa, Giardia lamblia
VNRTCVFCRAYLLGCTKCTISRDSDI

SEQ ID NO: 3081488 - protein, 19 aa, Giardia lamblia
VNRVVCIAASMIYISQQAS

SEQ ID NO: 3081489 - protein, 24 aa, Giardia lamblia
VNSCASCRDGFYGSNCAACPERCA

SEQ ID NO: 3081490 - protein, 17 aa, Giardia lamblia
VNSRFPLTKIYTRSQIK

SEQ ID NO: 3081491 - protein, 24 aa, Giardia lamblia
VNSSCWLSAPGMGWVKKDGIGNAS

SEQ ID NO: 3081492 - protein, 18 aa, Giardia lamblia
VNTFFKPYFVAVLINIPK

SEQ ID NO: 3081493 - protein, 18 aa, Giardia lamblia
VNTFLLLFALKRKRERYA

SEQ ID NO: 3081494 - protein, 31 aa, Giardia lamblia
VNTKAKAMWKRLFYAIVFFHGILLERRKFGP

SEQ ID NO: 3081495 - protein, 25 aa, Giardia lamblia
VNTKWKEFAELIGVTTKKLIDANLV

SEQ ID NO: 3081496 - protein, 25 aa, Giardia lamblia
VNWSEFKMFCSIVTDLLQTFPASAP

SEQ ID NO: 3081497 - protein, 18 aa, Giardia lamblia
VNYLKYAGLDSWGSDEIQ

SEQ ID NO: 3081498 - protein, 17 aa, Giardia lamblia
VNYYDCFSNVRVVISTK

SEQ ID NO: 3081499 - protein, 21 aa, Giardia lamblia
VPAKCGILLCGALETDVALSI

SEQ ID NO: 3081500 - protein, 17 aa, Giardia lamblia
VPCHPACVSCTGPEEAD

SEQ ID NO: 3081501 - protein, 25 aa, Giardia lamblia
VPDKDRPSLLAAFRNGLRSITAALR

SEQ ID NO: 3081502 - protein, 20 aa, Giardia lamblia
VPDMARAYISAVLAGDSTLF

SEQ ID NO: 3081503 - protein, 18 aa, Giardia lamblia
VPESIIYSYGYLFTGTSI

SEQ ID NO: 3081504 - protein, 26 aa, Giardia lamblia
VPFGCDMPGFFVLSSWVYQVLAVFWE

SEQ ID NO: 3081505 - protein, 17 aa, Giardia lamblia
VPGDVFLATCAIAYLGV

SEQ ID NO: 3081506 - protein, 18 aa, Giardia lamblia
VPGFLAFPLFARIRSEYR

SEQ ID NO: 3081507 - protein, 19 aa, Giardia lamblia
VPGLFKVFKDIVGSCTDST

SEQ ID NO: 3081508 - protein, 20 aa, Giardia lamblia
VPIGECIRALAKPYSKLRSF

SEQ ID NO: 3081509 - protein, 24 aa, Giardia lamblia
VPIKARGSITAWLGNLEQRMKQTI

SEQ ID NO: 3081510 - protein, 22 aa, Giardia lamblia
VPIPVSSPFLVEFRNFDFQMLR

SEQ ID NO: 3081511 - protein, 40 aa, Giardia lamblia
VPISMQFTMRIFLQQGVLRFCLSKGFITLFLDPRWAEDIT

SEQ ID NO: 3081512 - protein, 26 aa, Giardia lamblia
VPKAWGMPVCDLMSLIFSCALSECSI

SEQ ID NO: 3081513 - protein, 20 aa, Giardia lamblia
VPKICPPQCLCREQSIACTG

SEQ ID NO: 3081514 - protein, 18 aa, Giardia lamblia
VPKIDVGGSLEILNSPIV

SEQ ID NO: 3081515 - protein, 24 aa, Giardia lamblia
VPLDNGYCIGFGYIVDKSISDVFV

SEQ ID NO: 3081516 - protein, 19 aa, Giardia lamblia
VPLFFSPLAWLSIKDEEPY

SEQ ID NO: 3081517 - protein, 18 aa, Giardia lamblia
VPLKAATVITDLETAFQP

SEQ ID NO: 3081518 - protein, 21 aa, Giardia lamblia
VPLRPSIDAVDCWVDEDGDRD

SEQ ID NO: 3081519 - protein, 17 aa, Giardia lamblia
VPMFTPRELHELIDDVL

SEQ ID NO: 3081520 - protein, 20 aa, Giardia lamblia
VPNFQPPITMRGIVLLALKH

SEQ ID NO: 3081521 - protein, 17 aa, Giardia lamblia
VPNIVLYPCQHFVYTPV

SEQ ID NO: 3081522 - protein, 24 aa, Giardia lamblia
VPPACYLELLSLYSELLAQRIAGI

SEQ ID NO: 3081523 - protein, 22 aa, Giardia lamblia
VPPESFAKCSGFTSCTDCTNNL

SEQ ID NO: 3081524 - protein, 25 aa, Giardia lamblia
VPQLLPFLLFVLFGFPNAMSSIMIL

SEQ ID NO: 3081525 - protein, 21 aa, Giardia lamblia
VPQSLRFLAISLLVFCNCILE

SEQ ID NO: 3081526 - protein, 29 aa, Giardia lamblia
VPSTELLSRFSLCLSCFQQFLVDIADAEE

SEQ ID NO: 3081527 - protein, 21 aa, Giardia lamblia
VPTKHISALLGILNYDGASYI

SEQ ID NO: 3081528 - protein, 24 aa, Giardia lamblia
VPTMSALICFSYRDSPTIAGQLVF

SEQ ID NO: 3081529 - protein, 19 aa, Giardia lamblia
VPVALYFCILVNRTVPTLF

SEQ ID NO: 3081530 - protein, 20 aa, Giardia lamblia
VPVCSPCNPAAQPEHPVDPA

SEQ ID NO: 3081531 - protein, 18 aa, Giardia lamblia
VPVLTIFVLYIVQTAIYS

SEQ ID NO: 3081532 - protein, 17 aa, Giardia lamblia
VPVTKYVIMCWSAISFY

SEQ ID NO: 3081533 - protein, 22 aa, Giardia lamblia
VPYDKTCVCVFINLPADLRLIL

SEQ ID NO: 3081534 - protein, 23 aa, Giardia lamblia
VPYSDLLSICYVHVPTILVAHTL

SEQ ID NO: 3081535 - protein, 17 aa, Giardia lamblia
VPYTGNAYAAALILPTG

SEQ ID NO: 3081536 - protein, 25 aa, Giardia lamblia
VPYYELFKSLYFYWLGQHDFSCALL

SEQ ID NO: 3081537 - protein, 19 aa, Giardia lamblia
VQASFSWLLVTRVLFGLFS

SEQ ID NO: 3081538 - protein, 24 aa, Giardia lamblia
VQEEFKYWGTYYHDATSFFCYNCS

SEQ ID NO: 3081539 - protein, 17 aa, Giardia lamblia
VQELVLRGQRRDEFGNL

SEQ ID NO: 3081540 - protein, 24 aa, Giardia lamblia
VQGLIDMHNLQHWCHNAGVVDSTT

SEQ ID NO: 3081541 - protein, 27 aa, Giardia lamblia
VQHFPYMCSSGIFADASFERLFDQSTT

SEQ ID NO: 3081542 - protein, 19 aa, Giardia lamblia
VQIADGCAFIHPSPLDTIS

SEQ ID NO: 3081543 - protein, 22 aa, Giardia lamblia
VQIATACGVILIFNFTEILRDS

SEQ ID NO: 3081544 - protein, 20 aa, Giardia lamblia
VQLDLGSFVLRHTGHPDLAY

SEQ ID NO: 3081545 - protein, 21 aa, Giardia lamblia
VQLESISPISYIKRLAQTKKK

SEQ ID NO: 3081546 - protein, 18 aa, Giardia lamblia
VQNLIGFIFTFFQAVLYV

SEQ ID NO: 3081547 - protein, 17 aa, Giardia lamblia
VQQCSKAHISVAMVTGD

SEQ ID NO: 3081548 - protein, 27 aa, Giardia lamblia
VQRNDIVAVYCLLPLQAGVQDRNGYTA

SEQ ID NO: 3081549 - protein, 17 aa, Giardia lamblia
VQSLPISTSIPMPMPVQ

SEQ ID NO: 3081550 - protein, 23 aa, Giardia lamblia
VQSMRWIFHRLALSLADPIGSPF

SEQ ID NO: 3081551 - protein, 17 aa, Giardia lamblia
VQSPERYNMEKPMKSDF

SEQ ID NO: 3081552 - protein, 23 aa, Giardia lamblia
VQSVKRFFLWFWNLYYMKFDQIS

SEQ ID NO: 3081553 - protein, 23 aa, Giardia lamblia
VQSWFKTLCMHYGLSGTSCTIYK

SEQ ID NO: 3081554 - protein, 18 aa, Giardia lamblia
VQTPFLYAFDYIKDHTKL

SEQ ID NO: 3081555 - protein, 21 aa, Giardia lamblia
VQTVLYFPKLAIFAETTTIYS

SEQ ID NO: 3081556 - protein, 35 aa, Giardia lamblia
VQVLECYATILSKFGRLQPFFVHSINDLHHHSDTI

SEQ ID NO: 3081557 - protein, 17 aa, Giardia lamblia
VQVSQEYAELVSNTISA

SEQ ID NO: 3081558 - protein, 24 aa, Giardia lamblia
VQYLEVIRSITLVLLVAELFDSLL

SEQ ID NO: 3081559 - protein, 17 aa, Giardia lamblia
VQYPTYRDGSPIYPALQ

SEQ ID NO: 3081560 - protein, 17 aa, Giardia lamblia
VQYSCIIITLTDATTHL

SEQ ID NO: 3081561 - protein, 18 aa, Giardia lamblia
VQYSLCYAAKDFFANALS

SEQ ID NO: 3081562 - protein, 17 aa, Giardia lamblia
VQYVEKYFCLRTTGHRF

SEQ ID NO: 3081563 - protein, 17 aa, Giardia lamblia
VRARYGDIISLGDVYTR

SEQ ID NO: 3081564 - protein, 18 aa, Giardia lamblia
VRASIMRWIPYNKMNGRT

SEQ ID NO: 3081565 - protein, 26 aa, Giardia lamblia
VRAVICMYCVSWLFWAFFAGQIANNV

SEQ ID NO: 3081566 - protein, 25 aa, Giardia lamblia
VRDALARLAGRFGTINDVSDTCCDS

SEQ ID NO: 3081567 - protein, 18 aa, Giardia lamblia
VRDFDFRIPETIFDKDPV

SEQ ID NO: 3081568 - protein, 19 aa, Giardia lamblia
VRDGAGYSCDCRGLATGNL

SEQ ID NO: 3081569 - protein, 18 aa, Giardia lamblia
VRDIQILLLFGAKEYCIL

SEQ ID NO: 3081570 - protein, 27 aa, Giardia lamblia
VRDQGLCSGSWAIAAVDMFSMYHCSMY

SEQ ID NO: 3081571 - protein, 19 aa, Giardia lamblia
VRFESCLQKATSPAESQEC

SEQ ID NO: 3081572 - protein, 17 aa, Giardia lamblia
VRFFFNVFEETKASGAF

SEQ ID NO: 3081573 - protein, 17 aa, Giardia lamblia
VRFSKKLTIEMVSQFVT

SEQ ID NO: 3081574 - protein, 18 aa, Giardia lamblia
VRGASLAIVLSRTLVCLI

SEQ ID NO: 3081575 - protein, 22 aa, Giardia lamblia
VRGEKARIVSIIKDMCNEGIDP

SEQ ID NO: 3081576 - protein, 17 aa, Giardia lamblia
VRGERNLPCGIGGQCLE

SEQ ID NO: 3081577 - protein, 20 aa, Giardia lamblia
VRGSSFFRKVLGHYAYVERS

SEQ ID NO: 3081578 - protein, 19 aa, Giardia lamblia
VRGTESFVIVFALGTFLIL

SEQ ID NO: 3081579 - protein, 20 aa, Giardia lamblia
VRGTESFVIVFALGTFLILL

SEQ ID NO: 3081580 - protein, 26 aa, Giardia lamblia
VRGTWPTVPVPQGFSLAKHITDTIPF

SEQ ID NO: 3081581 - protein, 18 aa, Giardia lamblia
VRHLETWDKGAPAVYKYV

SEQ ID NO: 3081582 - protein, 20 aa, Giardia lamblia
VRHNEVFALLGANGAGKSTI

SEQ ID NO: 3081583 - protein, 17 aa, Giardia lamblia
VRILYVLVIFTAFVCCL

SEQ ID NO: 3081584 - protein, 18 aa, Giardia lamblia
VRIRTRLLLANARAKGKK

SEQ ID NO: 3081585 - protein, 21 aa, Giardia lamblia
VRKGELVGIFGAVGSGKTALH

SEQ ID NO: 3081586 - protein, 19 aa, Giardia lamblia
VRKKGRPTLVLDLDATLFY

SEQ ID NO: 3081587 - protein, 18 aa, Giardia lamblia
VRKSALICSCSRILLSRS

SEQ ID NO: 3081588 - protein, 17 aa, Giardia lamblia
VRLLLAEAKMRNWKNET

SEQ ID NO: 3081589 - protein, 19 aa, Giardia lamblia
VRLLSFFRGKIPVIVTPIF

SEQ ID NO: 3081590 - protein, 23 aa, Giardia lamblia
VRLQCATLPWSVFLPTYEFKISR

SEQ ID NO: 3081591 - protein, 22 aa, Giardia lamblia
VRLRENINLFNLYKITPSHKLS

SEQ ID NO: 3081592 - protein, 18 aa, Giardia lamblia
VRLSFSYDGLMLYAVNSI

SEQ ID NO: 3081593 - protein, 20 aa, Giardia lamblia
VRLSVPLLVVHKGEESQGTV

SEQ ID NO: 3081594 - protein, 17 aa, Giardia lamblia
VRLYRTYFFSMDEEFVR

SEQ ID NO: 3081595 - protein, 22 aa, Giardia lamblia
VRMHLPEVLALLNVIFDEVPET

SEQ ID NO: 3081596 - protein, 25 aa, Giardia lamblia
VRNFSPFDRRYWKGATTDSLPKSDR

SEQ ID NO: 3081597 - protein, 19 aa, Giardia lamblia
VRNGAGYRCDCRGLATGDL

SEQ ID NO: 3081598 - protein, 28 aa, Giardia lamblia
VRNQGKCGSCWAFATVAAFEACALYDGV

SEQ ID NO: 3081599 - protein, 29 aa, Giardia lamblia
VRNQGVCGCCWAMASAVMLEGMTRSTQSY

SEQ ID NO: 3081600 - protein, 22 aa, Giardia lamblia
VRPDETFHLTAYVDSLLSVVAT

SEQ ID NO: 3081601 - protein, 18 aa, Giardia lamblia
VRSAFVITLCAQVIQFWD

SEQ ID NO: 3081602 - protein, 25 aa, Giardia lamblia
VRSCDLSVTIPLVILIVSAIIFKEK

SEQ ID NO: 3081603 - protein, 20 aa, Giardia lamblia
VRSNCFQIYGVECTKSADAA

SEQ ID NO: 3081604 - protein, 26 aa, Giardia lamblia
VRSYLISCFNKTLGCFCSDDQSQEND

SEQ ID NO: 3081605 - protein, 20 aa, Giardia lamblia
VRTGSCKAILITTQNEEPLG

SEQ ID NO: 3081606 - protein, 18 aa, Giardia lamblia
VRTKLIASECCKALYRTS

SEQ ID NO: 3081607 - protein, 18 aa, Giardia lamblia
VRTNRIGQRLGLNKETES

SEQ ID NO: 3081608 - protein, 17 aa, Giardia lamblia
VRTQKGWQFTNMSQPGA

SEQ ID NO: 3081609 - protein, 17 aa, Giardia lamblia
VRVLDLNTILGFTEDYW

SEQ ID NO: 3081610 - protein, 21 aa, Giardia lamblia
VRYFLHLSQSLTFYMKKSSRF

SEQ ID NO: 3081611 - protein, 17 aa, Giardia lamblia
VRYPLQYVSRLLPLTKI

SEQ ID NO: 3081612 - protein, 17 aa, Giardia lamblia
VSAELGQPLSGVELYNA

SEQ ID NO: 3081613 - protein, 18 aa, Giardia lamblia
VSAQTILSNFCDFLKKQH

SEQ ID NO: 3081614 - protein, 26 aa, Giardia lamblia
VSARKDFRYNKILNIDKAYSVDVLKF

SEQ ID NO: 3081615 - protein, 35 aa, Giardia lamblia
VSATMLRLLVLELVKFRQMCLLAGTNIQISNVYLH

SEQ ID NO: 3081616 - protein, 25 aa, Giardia lamblia
VSCGCRAVCILTVFWDSRPGEGRLP

SEQ ID NO: 3081617 - protein, 17 aa, Giardia lamblia
VSCHRARQFLTLPEGDY

SEQ ID NO: 3081618 - protein, 19 aa, Giardia lamblia
VSCSDTARQGIANCVECSY

SEQ ID NO: 3081619 - protein, 22 aa, Giardia lamblia
VSCSSGLCVICPENYFFHEGGC

SEQ ID NO: 3081620 - protein, 17 aa, Giardia lamblia
VSDFKDSILSYRSAYLQ

SEQ ID NO: 3081621 - protein, 19 aa, Giardia lamblia
VSDPLLWIMTKCLIISGHD

SEQ ID NO: 3081622 - protein, 19 aa, Giardia lamblia
VSEALVYTLPGLRDGLETK

SEQ ID NO: 3081623 - protein, 25 aa, Giardia lamblia
VSEDTPKITIAWLIQNDALNFKDEL

SEQ ID NO: 3081624 - protein, 17 aa, Giardia lamblia
VSEGILDNFLFNLLMPI

SEQ ID NO: 3081625 - protein, 23 aa, Giardia lamblia
VSFALPCALTYGICPGVNGTITM

SEQ ID NO: 3081626 - protein, 19 aa, Giardia lamblia
VSFFIWFLFVDKILTQTLF

SEQ ID NO: 3081627 - protein, 20 aa, Giardia lamblia
VSFKDHRRNLSFMARNKQKT

SEQ ID NO: 3081628 - protein, 17 aa, Giardia lamblia
VSFTRRHGPALTPLQKD

SEQ ID NO: 3081629 - protein, 23 aa, Giardia lamblia
VSGELRKTCVLEKCISSGQGVDP

SEQ ID NO: 3081630 - protein, 24 aa, Giardia lamblia
VSGRASFKIMWLVWLGQLISLSYS

SEQ ID NO: 3081631 - protein, 17 aa, Giardia lamblia
VSGRVAINPSALYQVRF

SEQ ID NO: 3081632 - protein, 18 aa, Giardia lamblia
VSGTSFYTAPTVKRSKSA

SEQ ID NO: 3081633 - protein, 17 aa, Giardia lamblia
VSHVVLFVQAPLYSTAE

SEQ ID NO: 3081634 - protein, 17 aa, Giardia lamblia
VSIFLSSFIFKAQSVAF

SEQ ID NO: 3081635 - protein, 17 aa, Giardia lamblia
VSILVSMRLSQLQLRGY

SEQ ID NO: 3081636 - protein, 17 aa, Giardia lamblia
VSISLILSVISTVLMAL

SEQ ID NO: 3081637 - protein, 22 aa, Giardia lamblia
VSIYNKFNFIFGVTADYFASIM

SEQ ID NO: 3081638 - protein, 24 aa, Giardia lamblia
VSKGHELEHSLQLFTPLLTSKSPH

SEQ ID NO: 3081639 - protein, 17 aa, Giardia lamblia
VSKKCLTGPPGEATQLC

SEQ ID NO: 3081640 - protein, 17 aa, Giardia lamblia
VSKRLLWNIILRIRSHR

SEQ ID NO: 3081641 - protein, 17 aa, Giardia lamblia
VSLESMFGDTLISDANS

SEQ ID NO: 3081642 - protein, 18 aa, Giardia lamblia
VSLFRLQYGMDFAMSIFT

SEQ ID NO: 3081643 - protein, 25 aa, Giardia lamblia
VSLIDFKLSLISAFITVRQNITESI

SEQ ID NO: 3081644 - protein, 17 aa, Giardia lamblia
VSLIGLIIVVSQQFVQT

SEQ ID NO: 3081645 - protein, 23 aa, Giardia lamblia
VSLKIKLFGCIATFVNALLGSYV

SEQ ID NO: 3081646 - protein, 29 aa, Giardia lamblia
VSLKTMLFHYSLVMLWDLVDSILEADESG

SEQ ID NO: 3081647 - protein, 19 aa, Giardia lamblia
VSLLADFFAEMDRITQSGR

SEQ ID NO: 3081648 - protein, 17 aa, Giardia lamblia
VSLLCMPLTYAQLYLNR

SEQ ID NO: 3081649 - protein, 27 aa, Giardia lamblia
VSLLRHIRIPQFMKVLYRILDPKYVKF

SEQ ID NO: 3081650 - protein, 25 aa, Giardia lamblia
VSLPQPIVCLAKLLSGYISMPKVSL

SEQ ID NO: 3081651 - protein, 23 aa, Giardia lamblia
VSLTYWPELLIASLTYQRSVTQG

SEQ ID NO: 3081652 - protein, 25 aa, Giardia lamblia
VSMLTPFFLCQFLMMCATTGTIYIT

SEQ ID NO: 3081653 - protein, 17 aa, Giardia lamblia
VSNCASCEIDVKYCTEC

SEQ ID NO: 3081654 - protein, 22 aa, Giardia lamblia
VSNLCGFGSFIESMVSRDTFKN

SEQ ID NO: 3081655 - protein, 24 aa, Giardia lamblia
VSPCMPCISLEPPSSMSASECTVR

SEQ ID NO: 3081656 - protein, 34 aa, Giardia lamblia
VSPLRAQFSLSHDYCILCLTSMLLQDKHKEHTLA

SEQ ID NO: 3081657 - protein, 33 aa, Giardia lamblia
VSPRQIVAVCLRFLLPTVCFMATGVGLSLYPQS

SEQ ID NO: 3081658 - protein, 17 aa, Giardia lamblia
VSPRSASHFSPRYASSR

SEQ ID NO: 3081659 - protein, 17 aa, Giardia lamblia
VSPSVHSVQKFLLNPNA

SEQ ID NO: 3081660 - protein, 20 aa, Giardia lamblia
VSQARLASCGAFGGGCAGPA

SEQ ID NO: 3081661 - protein, 31 aa, Giardia lamblia
VSRCEVTEIRICRRWVLSDPSCQEWTVLDPQ

SEQ ID NO: 3081662 - protein, 25 aa, Giardia lamblia
VSRRARGSTTFSFYSKSAISLSKRP

SEQ ID NO: 3081663 - protein, 25 aa, Giardia lamblia
VSRVPNHFNMLAVIVAAYGVFAGSN

SEQ ID NO: 3081664 - protein, 36 aa, Giardia lamblia
VSSDFHARFKLCFSFIAHYALSLAIYRRRPDINLPF

SEQ ID NO: 3081665 - protein, 24 aa, Giardia lamblia
VSSELFDIYKACITYVESYTGEQK

SEQ ID NO: 3081666 - protein, 20 aa, Giardia lamblia
VSSFMCLWPATIALSSDSVP

SEQ ID NO: 3081667 - protein, 24 aa, Giardia lamblia
VSSIDVCIIIAYTILLAILSTIII

SEQ ID NO: 3081668 - protein, 24 aa, Giardia lamblia
VSSIREMYRVVPLAKVVDQLELLY

SEQ ID NO: 3081669 - protein, 24 aa, Giardia lamblia
VSSKLLAMLVYFLRNVNGLEQMDP

SEQ ID NO: 3081670 - protein, 17 aa, Giardia lamblia
VSSRLFFYRTFVDDWLL

SEQ ID NO: 3081671 - protein, 28 aa, Giardia lamblia
VSSSFLPTAIKFHYMFNLRDLTNITEGL

SEQ ID NO: 3081672 - protein, 23 aa, Giardia lamblia
VSSSLKVPFGKEVGITDLSPSRF

SEQ ID NO: 3081673 - protein, 32 aa, Giardia lamblia
VSSTTIICLLAFRHDMVLEFLGLTYFVNMIGL

SEQ ID NO: 3081674 - protein, 24 aa, Giardia lamblia
VSTFCCIKRGCASQVGTIIWFLLY

SEQ ID NO: 3081675 - protein, 26 aa, Giardia lamblia
VSTIVFKETYLMIVFTIGACLMVGLL

SEQ ID NO: 3081676 - protein, 23 aa, Giardia lamblia
VSTLLDCCCDVSLLEKKLDDSCP

SEQ ID NO: 3081677 - protein, 18 aa, Giardia lamblia
VSTRCVRMIRLYATDSGS

SEQ ID NO: 3081678 - protein, 24 aa, Giardia lamblia
VSTRLSLPNLFLFSQASFAGGNLQ

SEQ ID NO: 3081679 - protein, 18 aa, Giardia lamblia
VSTVLCWFSLPELKQKTP

SEQ ID NO: 3081680 - protein, 25 aa, Giardia lamblia
VSVCKGRLAYYRTLEAFLSAFCYLE

SEQ ID NO: 3081681 - protein, 19 aa, Giardia lamblia
VSVGKRFLGELEMSPELKD

SEQ ID NO: 3081682 - protein, 17 aa, Giardia lamblia
VSVSLFAQISQDFAEAA

SEQ ID NO: 3081683 - protein, 26 aa, Giardia lamblia
VSVVGKGSFGKVFLVRRVEDNRFFAM

SEQ ID NO: 3081684 - protein, 18 aa, Giardia lamblia
VTATLRPTASLKQKLNHY

SEQ ID NO: 3081685 - protein, 17 aa, Giardia lamblia
VTATPLLRTMAATLLQT

SEQ ID NO: 3081686 - protein, 23 aa, Giardia lamblia
VTCDSFPLLIPQLEYQSADCCTI

SEQ ID NO: 3081687 - protein, 19 aa, Giardia lamblia
VTCKSCWKQLNNTRHKRDA

SEQ ID NO: 3081688 - protein, 20 aa, Giardia lamblia
VTEALELLAQIPTGFNLTAI

SEQ ID NO: 3081689 - protein, 20 aa, Giardia lamblia
VTEVLCWLRTADFADELTDE

SEQ ID NO: 3081690 - protein, 20 aa, Giardia lamblia
VTFGCVFLVLAIVFIILNCC

SEQ ID NO: 3081691 - protein, 17 aa, Giardia lamblia
VTFWCFDDEKACSVDVY

SEQ ID NO: 3081692 - protein, 17 aa, Giardia lamblia
VTGLLNFLTRPLRQSST

SEQ ID NO: 3081693 - protein, 19 aa, Giardia lamblia
VTGVLCLTKQLGPKGSDSI

SEQ ID NO: 3081694 - protein, 25 aa, Giardia lamblia
VTHKRELVGFAFDLTVYRIQQAAAS

SEQ ID NO: 3081695 - protein, 21 aa, Giardia lamblia
VTHPLCVLLALAPSMYTITGG

SEQ ID NO: 3081696 - protein, 19 aa, Giardia lamblia
VTICKECVNTLYAPKSGVC

SEQ ID NO: 3081697 - protein, 18 aa, Giardia lamblia
VTICLPDQMYVCSCHDIV

SEQ ID NO: 3081698 - protein, 28 aa, Giardia lamblia
VTIEILSCLKHICIFAKSKHEVVWKLNS

SEQ ID NO: 3081699 - protein, 18 aa, Giardia lamblia
VTIPARYKVHPFPSRGSI

SEQ ID NO: 3081700 - protein, 25 aa, Giardia lamblia
VTIPVDFPGCWDLILQNKTSLKKSD

SEQ ID NO: 3081701 - protein, 17 aa, Giardia lamblia
VTIRRIHIRGMELGQRA

SEQ ID NO: 3081702 - protein, 18 aa, Giardia lamblia
VTKISDWSATKIIRSLNN

SEQ ID NO: 3081703 - protein, 23 aa, Giardia lamblia
VTKSYMGGSILKALNGTSASYSI

SEQ ID NO: 3081704 - protein, 17 aa, Giardia lamblia
VTLCVTSIVLSQNVDHG

SEQ ID NO: 3081705 - protein, 35 aa, Giardia lamblia
VTLIFILSAAIRWTILFSCVAWLLNLLVRNAPSTI

SEQ ID NO: 3081706 - protein, 19 aa, Giardia lamblia
VTLLHSFEFFYDSLHDKNI

SEQ ID NO: 3081707 - protein, 20 aa, Giardia lamblia
VTLLRLLPGGVCSFFDSLKA

SEQ ID NO: 3081708 - protein, 19 aa, Giardia lamblia
VTLNFKYLSLFTAIKPFYV

SEQ ID NO: 3081709 - protein, 26 aa, Giardia lamblia
VTLRNRLSYFLLMLFILSLLDTDTIV

SEQ ID NO: 3081710 - protein, 24 aa, Giardia lamblia
VTLSATQFRGWRIKYIHGAGYIKS

SEQ ID NO: 3081711 - protein, 19 aa, Giardia lamblia
VTLYLPYLYHNIFLRIRGL

SEQ ID NO: 3081712 - protein, 18 aa, Giardia lamblia
VTLYWKTGSLFDISNVGI

SEQ ID NO: 3081713 - protein, 21 aa, Giardia lamblia
VTMLSHGWKADGWEQKQQKVL

SEQ ID NO: 3081714 - protein, 17 aa, Giardia lamblia
VTNELPYTRSLLSEPVR

SEQ ID NO: 3081715 - protein, 24 aa, Giardia lamblia
VTNKALVGYSNWSDPAILQAPPTG

SEQ ID NO: 3081716 - protein, 28 aa, Giardia lamblia
VTNLLVTRRAFLGFSDWNSPDIPRDQLV

SEQ ID NO: 3081717 - protein, 30 aa, Giardia lamblia
VTNLLWHLYCSLLFHRRTDVEVDFFARILC

SEQ ID NO: 3081718 - protein, 17 aa, Giardia lamblia
VTNRFCAYDSKQVVYQR

SEQ ID NO: 3081719 - protein, 18 aa, Giardia lamblia
VTPLFPFQSAINLVEHPD

SEQ ID NO: 3081720 - protein, 23 aa, Giardia lamblia
VTPRRKASIFLFYDKGVRKLRIE

SEQ ID NO: 3081721 - protein, 22 aa, Giardia lamblia
VTPRSYKFLLNLLMIDTDEDLD

SEQ ID NO: 3081722 - protein, 34 aa, Giardia lamblia
VTQFRCLLRRSNLIPHRLFYVLPNDCLRLSFITP

SEQ ID NO: 3081723 - protein, 25 aa, Giardia lamblia
VTREMLSKLAFLYSLFYDKSTTDLI

SEQ ID NO: 3081724 - protein, 23 aa, Giardia lamblia
VTRSRRNLLQWLPPLHLTLEDLR

SEQ ID NO: 3081725 - protein, 27 aa, Giardia lamblia
VTSFCLLFSFLAMNAFILTAIFAIMTI

SEQ ID NO: 3081726 - protein, 18 aa, Giardia lamblia
VTSLLAVISNSFLKQTKG

SEQ ID NO: 3081727 - protein, 26 aa, Giardia lamblia
VTSLLWSLIVSVCYHQYENNEIYLFA

SEQ ID NO: 3081728 - protein, 34 aa, Giardia lamblia
VTSMSPKVVMSWIFFCLLGRYNPVIANSLTWFLK

SEQ ID NO: 3081729 - protein, 18 aa, Giardia lamblia
VTSSCFRDRLSNVKYGVD

SEQ ID NO: 3081730 - protein, 24 aa, Giardia lamblia
VTSSRPGPVIAHPCFPQQCKEVSH

SEQ ID NO: 3081731 - protein, 18 aa, Giardia lamblia
VTSTSFRQKYIISEAECR

SEQ ID NO: 3081732 - protein, 18 aa, Giardia lamblia
VTSVPFYSGISLLMLLIQ

SEQ ID NO: 3081733 - protein, 25 aa, Giardia lamblia
VTTFRCFRQLITFLLANKYTQRTLS

SEQ ID NO: 3081734 - protein, 21 aa, Giardia lamblia
VTTRGLSSWTITDNLIGNGAF

SEQ ID NO: 3081735 - protein, 17 aa, Giardia lamblia
VTTRIQLCRNFAHENKP

SEQ ID NO: 3081736 - protein, 17 aa, Giardia lamblia
VTTRPAPTPAYTPINLS

SEQ ID NO: 3081737 - protein, 24 aa, Giardia lamblia
VTTSLKHPISFFLSLINIYATYAQ

SEQ ID NO: 3081738 - protein, 18 aa, Giardia lamblia
VTTTGGKMQDCFASLDSC

SEQ ID NO: 3081739 - protein, 28 aa, Giardia lamblia
VTVAISVLKCCPCAAVKKLYDRTKATAL

SEQ ID NO: 3081740 - protein, 18 aa, Giardia lamblia
VTVLASFIAIMYLQGAGG

SEQ ID NO: 3081741 - protein, 43 aa, Giardia lamblia
VTVLCVMLSSMICCDIFLTLLLLRRVFHSFTLPQYIFGSISVL

SEQ ID NO: 3081742 - protein, 20 aa, Giardia lamblia
VTVMKPTFPLYYHVMTNKTE

SEQ ID NO: 3081743 - protein, 20 aa, Giardia lamblia
VTVSYPWLPVPSFTGVFNGN

SEQ ID NO: 3081744 - protein, 20 aa, Giardia lamblia
VTVWPALFLAKATILLDSLL

SEQ ID NO: 3081745 - protein, 23 aa, Giardia lamblia
VTWMVRGNYAFREDLLPLTDKKK

SEQ ID NO: 3081746 - protein, 29 aa, Giardia lamblia
VVAILKMMLCFRTTCTVRYLPRYVPTTEE

SEQ ID NO: 3081747 - protein, 27 aa, Giardia lamblia
VVASDARLSLKFTRELFMNGVDALQLE

SEQ ID NO: 3081748 - protein, 25 aa, Giardia lamblia
VVAVPCILGIFLFVFLLYILFARLC

SEQ ID NO: 3081749 - protein, 35 aa, Giardia lamblia
VVCAHVARFTIPVPFEVIWYANAPLVFLSSNTPLG

SEQ ID NO: 3081750 - protein, 18 aa, Giardia lamblia
VVCYICYKTASMSITLLP

SEQ ID NO: 3081751 - protein, 20 aa, Giardia lamblia
VVDLLCKWNAKEYAANRHQF

SEQ ID NO: 3081752 - protein, 18 aa, Giardia lamblia
VVEDGLSVARILKKNVIA

SEQ ID NO: 3081753 - protein, 18 aa, Giardia lamblia
VVFGYKINVLSSKPISLS

SEQ ID NO: 3081754 - protein, 20 aa, Giardia lamblia
VVGMLRCIYNSTDLDNLLEY

SEQ ID NO: 3081755 - protein, 17 aa, Giardia lamblia
VVGSLKATFFMGEKLAR

SEQ ID NO: 3081756 - protein, 28 aa, Giardia lamblia
VVHALRAAIFNCIPSRGLGGAVPSSLWR

SEQ ID NO: 3081757 - protein, 17 aa, Giardia lamblia
VVHDCMYTSLSPALLCG

SEQ ID NO: 3081758 - protein, 23 aa, Giardia lamblia
VVIACTTLVFFLGFGNYTYDIQG

SEQ ID NO: 3081759 - protein, 19 aa, Giardia lamblia
VVIFPFIFYIMLYALKELL

SEQ ID NO: 3081760 - protein, 20 aa, Giardia lamblia
VVIKEVHLLSSIPPSDSTLV

SEQ ID NO: 3081761 - protein, 18 aa, Giardia lamblia
VVISLCLVYYTNLLLYIE

SEQ ID NO: 3081762 - protein, 25 aa, Giardia lamblia
VVKSRTSEFAFYLVMFSHSRASTAA

SEQ ID NO: 3081763 - protein, 18 aa, Giardia lamblia
VVLAFVFGHVGALMRRAP

SEQ ID NO: 3081764 - protein, 33 aa, Giardia lamblia
VVLGACAAVFPPFFLKWIRMRISPTDAEKLRRQ

SEQ ID NO: 3081765 - protein, 18 aa, Giardia lamblia
VVLICVGMAIGAAVFIHI

SEQ ID NO: 3081766 - protein, 18 aa, Giardia lamblia
VVLILATFWFFDLDAHTH

SEQ ID NO: 3081767 - protein, 21 aa, Giardia lamblia
VVLPLCLYNVPSISIMNSGVR

SEQ ID NO: 3081768 - protein, 24 aa, Giardia lamblia
VVLSCVPAVDYREALECKINSAAI

SEQ ID NO: 3081769 - protein, 19 aa, Giardia lamblia
VVLYIKLVDLKVANLTVTN

SEQ ID NO: 3081770 - protein, 25 aa, Giardia lamblia
VVLYNCFSCKGQATEYLVTFISLLS

SEQ ID NO: 3081771 - protein, 24 aa, Giardia lamblia
VVMGTICIISFIALLISIQTASLA

SEQ ID NO: 3081772 - protein, 30 aa, Giardia lamblia
VVNDCGIGLPKQCWQHAFFHQQELADISQC

SEQ ID NO: 3081773 - protein, 23 aa, Giardia lamblia
VVNMAARIARGFNSGVFIKQDDF

SEQ ID NO: 3081774 - protein, 25 aa, Giardia lamblia
VVNTFKMSLCTLHVKLLDRTGTLID

SEQ ID NO: 3081775 - protein, 24 aa, Giardia lamblia
VVNVNPLRGTICILAQATGEQECN

SEQ ID NO: 3081776 - protein, 27 aa, Giardia lamblia
VVQKLLLEFMAKFSPDLDSGGLAAKNF

SEQ ID NO: 3081777 - protein, 23 aa, Giardia lamblia
VVRGICCISKLSLLGLLRSLIFF

SEQ ID NO: 3081778 - protein, 17 aa, Giardia lamblia
VVRKEISSILTILNTIP

SEQ ID NO: 3081779 - protein, 19 aa, Giardia lamblia
VVRTLCAAISPQSLDNIIL

SEQ ID NO: 3081780 - protein, 17 aa, Giardia lamblia
VVSKSSLPTLAQVQQGG

SEQ ID NO: 3081781 - protein, 18 aa, Giardia lamblia
VVSLLNIMRQLHSLCKES

SEQ ID NO: 3081782 - protein, 29 aa, Giardia lamblia
VVSMHTLRSGLYLKTKRLFIISLLHTIII

SEQ ID NO: 3081783 - protein, 17 aa, Giardia lamblia
VVTALCQFYIPGDKPPE

SEQ ID NO: 3081784 - protein, 27 aa, Giardia lamblia
VVTEFAYPWFGNFLMFFAMSLVGIGWA

SEQ ID NO: 3081785 - protein, 23 aa, Giardia lamblia
VVTKVFGEVCLTKSSLQYRLTLG

SEQ ID NO: 3081786 - protein, 18 aa, Giardia lamblia
VVTLDDFLAFLIQRVSAQ

SEQ ID NO: 3081787 - protein, 18 aa, Giardia lamblia
VVVGSLLSSISARTKAEP

SEQ ID NO: 3081788 - protein, 18 aa, Giardia lamblia
VVVPCYLLYSMISASFST

SEQ ID NO: 3081789 - protein, 31 aa, Giardia lamblia
VVVTNLLCIVTYIGVTVWQLKTIKRYLIQRK

SEQ ID NO: 3081790 - protein, 17 aa, Giardia lamblia
VVWLGHYYTSAFVTSLL

SEQ ID NO: 3081791 - protein, 25 aa, Giardia lamblia
VVYTTGRASIYWSNTAPIVSLQSLV

SEQ ID NO: 3081792 - protein, 21 aa, Giardia lamblia
VWICSIVILAGYPRDQPLRGW

SEQ ID NO: 3081793 - protein, 23 aa, Giardia lamblia
VWILCVLFKRTAFDIPIKTSLDL

SEQ ID NO: 3081794 - protein, 18 aa, Giardia lamblia
VWMGLSVWENVMYSAIFR

SEQ ID NO: 3081795 - protein, 19 aa, Giardia lamblia
VWSSFYFNTGFLIVTVPVA

SEQ ID NO: 3081796 - protein, 24 aa, Giardia lamblia
VYADSCWEDLSFADILQMAGRAGR

SEQ ID NO: 3081797 - protein, 17 aa, Giardia lamblia
VYANRYFYFPSNPMYDL

SEQ ID NO: 3081798 - protein, 19 aa, Giardia lamblia
VYDEIRSTTQFIYVLIIVS

SEQ ID NO: 3081799 - protein, 31 aa, Giardia lamblia
VYELLWKLSERFEALSVAFTDTFFFSLVTSV

SEQ ID NO: 3081800 - protein, 24 aa, Giardia lamblia
VYETRYNFHYMPKHMEEALWEPFK

SEQ ID NO: 3081801 - protein, 25 aa, Giardia lamblia
VYFALPTLFVLASILLVLLIYLVSF

SEQ ID NO: 3081802 - protein, 19 aa, Giardia lamblia
VYFYKHFPAAQALPDVPAE

SEQ ID NO: 3081803 - protein, 17 aa, Giardia lamblia
VYGEPLNVYSIFELLGF

SEQ ID NO: 3081804 - protein, 22 aa, Giardia lamblia
VYGESWTTYSWMQLAGFLLLIY

SEQ ID NO: 3081805 - protein, 19 aa, Giardia lamblia
VYGMSRCPYFSQIMVNEIQ

SEQ ID NO: 3081806 - protein, 26 aa, Giardia lamblia
VYGMSRRCILGTFLSDMSVLLFTQKI

SEQ ID NO: 3081807 - protein, 24 aa, Giardia lamblia
VYILHIPHLFLKRECLPGGIRAGI

SEQ ID NO: 3081808 - protein, 31 aa, Giardia lamblia
VYINALLRILIEWIAIYAPSLLCYYDVSLSA

SEQ ID NO: 3081809 - protein, 28 aa, Giardia lamblia
VYIPETRMFPGLILGNARSRDLLDCARL

SEQ ID NO: 3081810 - protein, 18 aa, Giardia lamblia
VYLANCFILLYEVLFPFI

SEQ ID NO: 3081811 - protein, 19 aa, Giardia lamblia
VYLDEVFNFSKPVPDKKYS

SEQ ID NO: 3081812 - protein, 17 aa, Giardia lamblia
VYLMDFVILPALYQSFS

SEQ ID NO: 3081813 - protein, 21 aa, Giardia lamblia
VYLPNCFYFHKSAPGYVSARA

SEQ ID NO: 3081814 - protein, 18 aa, Giardia lamblia
VYLRLERLSLLSSVVTEE

SEQ ID NO: 3081815 - protein, 25 aa, Giardia lamblia
VYLRRKPGVVVLFNYFSQPGRGSSR

SEQ ID NO: 3081816 - protein, 19 aa, Giardia lamblia
VYLYFPLSFCFYVITVQTV

SEQ ID NO: 3081817 - protein, 28 aa, Giardia lamblia
VYMKALWFKVPAEFTGAVPELVFHLYRL

SEQ ID NO: 3081818 - protein, 17 aa, Giardia lamblia
VYMRRARANKKRVPEDI

SEQ ID NO: 3081819 - protein, 27 aa, Giardia lamblia
VYMTLAVIFSFWGYRQIIDACTYTRYS

SEQ ID NO: 3081820 - protein, 18 aa, Giardia lamblia
VYMVCLSINMLLLNTASQ

SEQ ID NO: 3081821 - protein, 23 aa, Giardia lamblia
VYNRTSVCSELGYLDHSFYAVVL

SEQ ID NO: 3081822 - protein, 27 aa, Giardia lamblia
VYPGERTDFRYAYCNAAGVVVVKVESN

SEQ ID NO: 3081823 - protein, 25 aa, Giardia lamblia
VYPLLREVTRSFVVPLFAKLAALLS

SEQ ID NO: 3081824 - protein, 18 aa, Giardia lamblia
VYRYKYKISNQIRQLKAL

SEQ ID NO: 3081825 - protein, 17 aa, Giardia lamblia
VYSELVSAFSVGTLSST

SEQ ID NO: 3081826 - protein, 23 aa, Giardia lamblia
VYSEPLSFLTMFTIVIVLFLFCI

SEQ ID NO: 3081827 - protein, 27 aa, Giardia lamblia
VYSRSRRFLRFTVPPNLDICLIQTQSN

SEQ ID NO: 3081828 - protein, 17 aa, Giardia lamblia
VYTACLFFSRTRAPELE

SEQ ID NO: 3081829 - protein, 21 aa, Giardia lamblia
VYTYPSFACEMIWATIQADLL

SEQ ID NO: 3081830 - protein, 18 aa, Giardia lamblia
VYTYRIAKDQPYLLGRLK

SEQ ID NO: 3081831 - protein, 18 aa, Giardia lamblia
VYVLNVYGDMGLRQNASS

SEQ ID NO: 3081832 - protein, 20 aa, Giardia lamblia
VYYILKYKYFAAVEEYRILT

SEQ ID NO: 3081833 - protein, 22 aa, Giardia lamblia
WAGDNRVSYCASLQISELLSFL

SEQ ID NO: 3081834 - protein, 18 aa, Giardia lamblia
WAGFCCIHVQKVSDEATA

SEQ ID NO: 3081835 - protein, 17 aa, Giardia lamblia
WAKVLLFGMIILMAISG

SEQ ID NO: 3081836 - protein, 22 aa, Giardia lamblia
WALLIPLLFTSWYQSLACFVTM

SEQ ID NO: 3081837 - protein, 22 aa, Giardia lamblia
WANGCIPRLTTLIHYAKDLYCL

SEQ ID NO: 3081838 - protein, 20 aa, Giardia lamblia
WARISIPIIPSESFLTRSDA

SEQ ID NO: 3081839 - protein, 30 aa, Giardia lamblia
WASELYPRPVLCALILKMVLFINPDAAASS

SEQ ID NO: 3081840 - protein, 18 aa, Giardia lamblia
WASLRGVGKLEYGFTRSG

SEQ ID NO: 3081841 - protein, 26 aa, Giardia lamblia
WAVLQRFGHRYSKSMSLADAYSKFHI

SEQ ID NO: 3081842 - protein, 19 aa, Giardia lamblia
WCETCAQSLSGIRNGLSMK

SEQ ID NO: 3081843 - protein, 21 aa, Giardia lamblia
WCLECTGAGACTRCASGAYLE

SEQ ID NO: 3081844 - protein, 25 aa, Giardia lamblia
WCRTCGTALDSLRRAISHRVPAEDA

SEQ ID NO: 3081845 - protein, 17 aa, Giardia lamblia
WDAVLYIICSYLGDAQA

SEQ ID NO: 3081846 - protein, 19 aa, Giardia lamblia
WDDAALIYYMYNLLDRHIL

SEQ ID NO: 3081847 - protein, 23 aa, Giardia lamblia
WDICGPELCEAFARCRHQYMHAL

SEQ ID NO: 3081848 - protein, 20 aa, Giardia lamblia
WEAIHRFMHRPAHEPLETII

SEQ ID NO: 3081849 - protein, 29 aa, Giardia lamblia
WEGYPDVLPMPFFLLVLLLNLLWSRHLLA

SEQ ID NO: 3081850 - protein, 19 aa, Giardia lamblia
WEKQTYWLFCETDTCNDIL

SEQ ID NO: 3081851 - protein, 24 aa, Giardia lamblia
WELYYCKICGLVTHAADASSPDAV

SEQ ID NO: 3081852 - protein, 17 aa, Giardia lamblia
WERFTVMYSSRKGFVQG

SEQ ID NO: 3081853 - protein, 24 aa, Giardia lamblia
WFHILKVLLVEGFINTSVDNHTLI

SEQ ID NO: 3081854 - protein, 22 aa, Giardia lamblia
WFLKHHAAFVCFSRCEQPFASV

SEQ ID NO: 3081855 - protein, 18 aa, Giardia lamblia
WFNSFYIRMCKPGQGRYK

SEQ ID NO: 3081856 - protein, 18 aa, Giardia lamblia
WFSARIAEGFSLESELAQ

SEQ ID NO: 3081857 - protein, 17 aa, Giardia lamblia
WFTSCVVVKTGKTLTTL

SEQ ID NO: 3081858 - protein, 23 aa, Giardia lamblia
WFYFMGLCFMTLIASVSFSHIFI

SEQ ID NO: 3081859 - protein, 19 aa, Giardia lamblia
WGCVCEYPYFGSGSSCYPI

SEQ ID NO: 3081860 - protein, 17 aa, Giardia lamblia
WGGGDIIVFLPGIVAIT

SEQ ID NO: 3081861 - protein, 23 aa, Giardia lamblia
WGHLEAVKLLLPVEGRKTNKMGL

SEQ ID NO: 3081862 - protein, 17 aa, Giardia lamblia
WGLCEGLAYPLMYLFAG

SEQ ID NO: 3081863 - protein, 19 aa, Giardia lamblia
WGLDGAQLLGIVQRVNLDP

SEQ ID NO: 3081864 - protein, 17 aa, Giardia lamblia
WGSNIVHNVRKFIQFQY

SEQ ID NO: 3081865 - protein, 23 aa, Giardia lamblia
WGSSWGEDGFFRILKGVNECGIE

SEQ ID NO: 3081866 - protein, 19 aa, Giardia lamblia
WGTQRERMLIKRGWATTLN

SEQ ID NO: 3081867 - protein, 18 aa, Giardia lamblia
WHDDCLNELAAQGYRILS

SEQ ID NO: 3081868 - protein, 18 aa, Giardia lamblia
WIAKLLIKVDRLECAVQL

SEQ ID NO: 3081869 - protein, 30 aa, Giardia lamblia
WIDDELVVVITLRPFYEVSIPNFHPYVQFF

SEQ ID NO: 3081870 - protein, 19 aa, Giardia lamblia
WIEAGLRQARQDKKIMQVT

SEQ ID NO: 3081871 - protein, 30 aa, Giardia lamblia
WIKELKKFVPSLLLWPYWGTQRERMLIKRG

SEQ ID NO: 3081872 - protein, 28 aa, Giardia lamblia
WINSPWIINFVIIWLLYFGAVSFSFVMA

SEQ ID NO: 3081873 - protein, 20 aa, Giardia lamblia
WIQQECEFFTRSSGDFIVQR

SEQ ID NO: 3081874 - protein, 18 aa, Giardia lamblia
WISETIFRSLSLDPAERP

SEQ ID NO: 3081875 - protein, 17 aa, Giardia lamblia
WITEAAFIPFLRRLGFC

SEQ ID NO: 3081876 - protein, 18 aa, Giardia lamblia
WITHVLFIQSSLVYVSAG

SEQ ID NO: 3081877 - protein, 32 aa, Giardia lamblia
WITLSLSTFILFYSCYNILITIFPLIVGKVSR

SEQ ID NO: 3081878 - protein, 21 aa, Giardia lamblia
WIVVAEVIILLTLRQILMWQL

SEQ ID NO: 3081879 - protein, 26 aa, Giardia lamblia
WIVVIKILYALVVCVAYPLVLYPLKL

SEQ ID NO: 3081880 - protein, 27 aa, Giardia lamblia
WKGIQGCTLCTPPVFAGEVLCLSKEVI

SEQ ID NO: 3081881 - protein, 20 aa, Giardia lamblia
WKHLSVRFFFNVFEETKASG

SEQ ID NO: 3081882 - protein, 25 aa, Giardia lamblia
WKHYLRLLCEALEFIQLTPQILRQL

SEQ ID NO: 3081883 - protein, 18 aa, Giardia lamblia
WKKFSYKSLNIVPLEQMG

SEQ ID NO: 3081884 - protein, 18 aa, Giardia lamblia
WKNTVFRDVIEFFEKLKG

SEQ ID NO: 3081885 - protein, 27 aa, Giardia lamblia
WKSLWMCCTCGRFFCGYTDNEHAKDHY

SEQ ID NO: 3081886 - protein, 20 aa, Giardia lamblia
WKVLVGVLEALAYLETYNIE

SEQ ID NO: 3081887 - protein, 17 aa, Giardia lamblia
WLADASSVHLILDGKFD

SEQ ID NO: 3081888 - protein, 20 aa, Giardia lamblia
WLAFNWAVIFLYKQLLKSGH

SEQ ID NO: 3081889 - protein, 21 aa, Giardia lamblia
WLCDSDPKSAGPFYVPESLSP

SEQ ID NO: 3081890 - protein, 20 aa, Giardia lamblia
WLDLVCVLNLDTLNAMDNDG

SEQ ID NO: 3081891 - protein, 18 aa, Giardia lamblia
WLDSCFCQDPSKSTNAIS

SEQ ID NO: 3081892 - protein, 25 aa, Giardia lamblia
WLEAARLYKRCSAFTHALACALKCE

SEQ ID NO: 3081893 - protein, 29 aa, Giardia lamblia
WLESNRFGAPLAFLIDCYFYRQRPSYERM

SEQ ID NO: 3081894 - protein, 18 aa, Giardia lamblia
WLHDLVMLQTLRKIPIFA

SEQ ID NO: 3081895 - protein, 18 aa, Giardia lamblia
WLIAAHLLSALSYLHFSY

SEQ ID NO: 3081896 - protein, 17 aa, Giardia lamblia
WLKDSLEHCHQLKCFVL

SEQ ID NO: 3081897 - protein, 24 aa, Giardia lamblia
WLLLPSFMVPILLTLIFVMIAEAD

SEQ ID NO: 3081898 - protein, 31 aa, Giardia lamblia
WLLSRGASTVAFRLAYNYIKSNRYEDAVVMC

SEQ ID NO: 3081899 - protein, 19 aa, Giardia lamblia
WLMHRVFLTWIGKSALPIL

SEQ ID NO: 3081900 - protein, 19 aa, Giardia lamblia
WLNTVCNYIEQGLTACYST

SEQ ID NO: 3081901 - protein, 17 aa, Giardia lamblia
WLPIPLFSMSVSHNITL

SEQ ID NO: 3081902 - protein, 26 aa, Giardia lamblia
WLPLYEILKLAALLWIALGNGSTQIY

SEQ ID NO: 3081903 - protein, 19 aa, Giardia lamblia
WLSPIIKLIKRQGAIYPRD

SEQ ID NO: 3081904 - protein, 20 aa, Giardia lamblia
WLSSHFRICPGRLLSYKRDY

SEQ ID NO: 3081905 - protein, 19 aa, Giardia lamblia
WLVFQRRRGSGFGGSRDML

SEQ ID NO: 3081906 - protein, 17 aa, Giardia lamblia
WLYCTLAIISPQTAEKF

SEQ ID NO: 3081907 - protein, 20 aa, Giardia lamblia
WLYICDDCIMHVSASDALKR

SEQ ID NO: 3081908 - protein, 20 aa, Giardia lamblia
WLYMGQILLALAYLHCPFKS

SEQ ID NO: 3081909 - protein, 26 aa, Giardia lamblia
WMQRLTDFSARFGINPNFGIDQEFVD

SEQ ID NO: 3081910 - protein, 18 aa, Giardia lamblia
WNATRLFIGSCMHSLLSG

SEQ ID NO: 3081911 - protein, 17 aa, Giardia lamblia
WNDCFRKEMTMSTLREK

SEQ ID NO: 3081912 - protein, 17 aa, Giardia lamblia
WNERYGALTLMYCICTF

SEQ ID NO: 3081913 - protein, 17 aa, Giardia lamblia
WNLCFPVALCVSSASAL

SEQ ID NO: 3081914 - protein, 17 aa, Giardia lamblia
WNPTLLGPYRFLRYNGI

SEQ ID NO: 3081915 - protein, 18 aa, Giardia lamblia
WNRLKVMYLQVIIYGIHT

SEQ ID NO: 3081916 - protein, 20 aa, Giardia lamblia
WNSLFPLKSSYKVFTGPSDV

SEQ ID NO: 3081917 - protein, 24 aa, Giardia lamblia
WNWLAGIELACFSFKSDVYGISIS

SEQ ID NO: 3081918 - protein, 17 aa, Giardia lamblia
WPALSFPGPEYLACQTR

SEQ ID NO: 3081919 - protein, 21 aa, Giardia lamblia
WPATPNPLGLAMDRYMDGLVT

SEQ ID NO: 3081920 - protein, 17 aa, Giardia lamblia
WPDNVQLLDIMHVCDKL

SEQ ID NO: 3081921 - protein, 19 aa, Giardia lamblia
WPDVIKVLIIDERQMKMRC

SEQ ID NO: 3081922 - protein, 25 aa, Giardia lamblia
WPIPSIPVQILIIFSLIEASFLFTN

SEQ ID NO: 3081923 - protein, 17 aa, Giardia lamblia
WPLFHHTFMVASVGVYR

SEQ ID NO: 3081924 - protein, 20 aa, Giardia lamblia
WPLFIRGILEAVAIINRFIT

SEQ ID NO: 3081925 - protein, 19 aa, Giardia lamblia
WPRQIKLLTRPSFQQFTGS

SEQ ID NO: 3081926 - protein, 17 aa, Giardia lamblia
WPVAHSNVYSALPDILN

SEQ ID NO: 3081927 - protein, 24 aa, Giardia lamblia
WQDSCLKKSMPLDTVEDWFKAVGA

SEQ ID NO: 3081928 - protein, 28 aa, Giardia lamblia
WQEIGMVYPRIVYRLGTLTRTLVQFVDE

SEQ ID NO: 3081929 - protein, 19 aa, Giardia lamblia
WQYHKLDTILLSFTILHYQ

SEQ ID NO: 3081930 - protein, 17 aa, Giardia lamblia
WRAWLSFEQNKQVHLFL

SEQ ID NO: 3081931 - protein, 21 aa, Giardia lamblia
WRDLPPIIVSFCDRQCSAQLS

SEQ ID NO: 3081932 - protein, 23 aa, Giardia lamblia
WRENEMWGAGTLVYRDGDRYEGE

SEQ ID NO: 3081933 - protein, 18 aa, Giardia lamblia
WRLTELLLQQDSRVAYLE

SEQ ID NO: 3081934 - protein, 20 aa, Giardia lamblia
WRMFLLVVDSFARFLASGQL

SEQ ID NO: 3081935 - protein, 17 aa, Giardia lamblia
WRYAVFGTCMALATIYN

SEQ ID NO: 3081936 - protein, 20 aa, Giardia lamblia
WSDILSELLIDTVLEAGTHT

SEQ ID NO: 3081937 - protein, 32 aa, Giardia lamblia
WSFHPRYEDIFSEYSKDHWHFTDSSERHKVKS

SEQ ID NO: 3081938 - protein, 21 aa, Giardia lamblia
WSGSKASKGMRVRQLAAAAKD

SEQ ID NO: 3081939 - protein, 17 aa, Giardia lamblia
WSIYMYIGKQSKLSNVL

SEQ ID NO: 3081940 - protein, 19 aa, Giardia lamblia
WSLSCQLPLAERHSLSNLV

SEQ ID NO: 3081941 - protein, 17 aa, Giardia lamblia
WSPVYMAGVDILIEGMR

SEQ ID NO: 3081942 - protein, 17 aa, Giardia lamblia
WSRNPLKVTTCALYAIV

SEQ ID NO: 3081943 - protein, 39 aa, Giardia lamblia
WSSHIKFLVPLGIGAGCYLLFQLGSLFARKRRIQSRIYA

SEQ ID NO: 3081944 - protein, 20 aa, Giardia lamblia
WSSIPPKLIPFLIGLMSRCY

SEQ ID NO: 3081945 - protein, 18 aa, Giardia lamblia
WSTLFKHLAFHTEPVPFV

SEQ ID NO: 3081946 - protein, 18 aa, Giardia lamblia
WSVGTLTFRLLETLVNLH

SEQ ID NO: 3081947 - protein, 18 aa, Giardia lamblia
WSVSRPTTDLSLSLLLEP

SEQ ID NO: 3081948 - protein, 17 aa, Giardia lamblia
WTCKACDPDIAGCTACE

SEQ ID NO: 3081949 - protein, 19 aa, Giardia lamblia
WTDMVLEMTKIHAILANTR

SEQ ID NO: 3081950 - protein, 25 aa, Giardia lamblia
WTGECMKARYSGIYELRPLLIDEPW

SEQ ID NO: 3081951 - protein, 17 aa, Giardia lamblia
WTIICYIQKDVVTIRPI

SEQ ID NO: 3081952 - protein, 23 aa, Giardia lamblia
WTLRQMPTITFRVTFDSTVPLSL

SEQ ID NO: 3081953 - protein, 20 aa, Giardia lamblia
WTPFCMRIAEGVVLLILLCI

SEQ ID NO: 3081954 - protein, 17 aa, Giardia lamblia
WTPKARGGTCVQNATGA

SEQ ID NO: 3081955 - protein, 26 aa, Giardia lamblia
WTPVACYLCDFLGPISKLSNSYCLST

SEQ ID NO: 3081956 - protein, 18 aa, Giardia lamblia
WTSKSLLIGVLWSAGELA

SEQ ID NO: 3081957 - protein, 30 aa, Giardia lamblia
WTTPCGHIFHAACLRRWMDETLQCPVDRAA

SEQ ID NO: 3081958 - protein, 25 aa, Giardia lamblia
WTVSRISAVVSVIVVPFILRAGVSQ

SEQ ID NO: 3081959 - protein, 22 aa, Giardia lamblia
WVRDVFLDLHFESVSGADLQLG

SEQ ID NO: 3081960 - protein, 18 aa, Giardia lamblia
WVTCLCLDTVTSNNSTIL

SEQ ID NO: 3081961 - protein, 24 aa, Giardia lamblia
WVWTLPFCAFMFFYDEMRKLVLRL

SEQ ID NO: 3081962 - protein, 17 aa, Giardia lamblia
WWDNFWTQIPDLRDLER

SEQ ID NO: 3081963 - protein, 20 aa, Giardia lamblia
WWKRLLSKLRTHCMLEYSTL

SEQ ID NO: 3081964 - protein, 20 aa, Giardia lamblia
WYDDTRCPVSAVLMELYAAK

SEQ ID NO: 3081965 - protein, 24 aa, Giardia lamblia
WYESPNSILLYFVFIFKPSERRTV

SEQ ID NO: 3081966 - protein, 20 aa, Giardia lamblia
WYIIMVCGYIPDIATIGKSS

SEQ ID NO: 3081967 - protein, 20 aa, Giardia lamblia
WYIMFSDLILYNTFLTLHGF

SEQ ID NO: 3081968 - protein, 19 aa, Giardia lamblia
WYNYCGGVGDCVKKKDKSG

SEQ ID NO: 3081969 - protein, 19 aa, Giardia lamblia
WYQRAGHQYVYPKEHPNKY

SEQ ID NO: 3081970 - protein, 17 aa, Giardia lamblia
WYSRRNGSLVLPSEGKI

SEQ ID NO: 3081971 - protein, 17 aa, Giardia lamblia
YAAEIASMWEELEGSER

SEQ ID NO: 3081972 - protein, 17 aa, Giardia lamblia
YAAKHGRIECVGALAPY

SEQ ID NO: 3081973 - protein, 30 aa, Giardia lamblia
YAAYPCKMIESIIGPALWDRYGHTFKLRFP

SEQ ID NO: 3081974 - protein, 22 aa, Giardia lamblia
YACIPCIPATYHAQGQHHVSDL

SEQ ID NO: 3081975 - protein, 20 aa, Giardia lamblia
YACSDDILLLAFSLHISADS

SEQ ID NO: 3081976 - protein, 19 aa, Giardia lamblia
YACTVLARLCVDKFHHYFV

SEQ ID NO: 3081977 - protein, 31 aa, Giardia lamblia
YADCHYPSPLFFKLGEVFVRYFNYMSLPFLS

SEQ ID NO: 3081978 - protein, 21 aa, Giardia lamblia
YADDNTICFELALGSHVDLLI

SEQ ID NO: 3081979 - protein, 27 aa, Giardia lamblia
YAEAFKRMYPFLIPFSYSDNGRADTIS

SEQ ID NO: 3081980 - protein, 21 aa, Giardia lamblia
YAFSSIHPFFHILKVSNKMVS

SEQ ID NO: 3081981 - protein, 18 aa, Giardia lamblia
YAGIRGCSRCMLPSSTDT

SEQ ID NO: 3081982 - protein, 18 aa, Giardia lamblia
YAGLDSWGSDEIQLGDGS

SEQ ID NO: 3081983 - protein, 22 aa, Giardia lamblia
YAGTIIELFNLGSLLSATREHY

SEQ ID NO: 3081984 - protein, 23 aa, Giardia lamblia
YAGVGLCEFIVMWSKGDVAVLTD

SEQ ID NO: 3081985 - protein, 23 aa, Giardia lamblia
YAIDKAEICPVLFGDIFLELLLE

SEQ ID NO: 3081986 - protein, 20 aa, Giardia lamblia
YAIVLCPIGFIFILISCILT

SEQ ID NO: 3081987 - protein, 20 aa, Giardia lamblia
YAKASSFRTNHQFKKATAST

SEQ ID NO: 3081988 - protein, 27 aa, Giardia lamblia
YAKFKMSMLDFFVCGTPVAYLTSETED

SEQ ID NO: 3081989 - protein, 17 aa, Giardia lamblia
YAKHELDDSLGLATLID

SEQ ID NO: 3081990 - protein, 22 aa, Giardia lamblia
YAKSVGKEGTFFDGIPVCDPTN

SEQ ID NO: 3081991 - protein, 17 aa, Giardia lamblia
YALKELLYWLTEGAPLR

SEQ ID NO: 3081992 - protein, 23 aa, Giardia lamblia
YALPICIFVTIELLNILNRLFVR

SEQ ID NO: 3081993 - protein, 19 aa, Giardia lamblia
YALSPSLPFHLTSPTQMMS

SEQ ID NO: 3081994 - protein, 17 aa, Giardia lamblia
YALTIRLLYVSKVKTNH

SEQ ID NO: 3081995 - protein, 30 aa, Giardia lamblia
YAPALEFADSVLRGSLGPALIPKVKACPAF

SEQ ID NO: 3081996 - protein, 17 aa, Giardia lamblia
YAPEGLFRKTSMGSITT

SEQ ID NO: 3081997 - protein, 18 aa, Giardia lamblia
YAPMSIVIRTLVKSFAEG

SEQ ID NO: 3081998 - protein, 18 aa, Giardia lamblia
YAPSIFGIRGEFDPNQYV

SEQ ID NO: 3081999 - protein, 23 aa, Giardia lamblia
YAQEMIVAYALPITIMYFVRSPH

SEQ ID NO: 3082000 - protein, 25 aa, Giardia lamblia
YAQLPLLRYIIDRFVSFISSTLQSK

SEQ ID NO: 3082001 - protein, 30 aa, Giardia lamblia
YARDMSACIVRWDAYVICWLNGEFDKRVKM

SEQ ID NO: 3082002 - protein, 21 aa, Giardia lamblia
YASICYAGGLAGWMENSDLNE

SEQ ID NO: 3082003 - protein, 24 aa, Giardia lamblia
YASIWAQSGLPFLSKKSIQDSRLI

SEQ ID NO: 3082004 - protein, 17 aa, Giardia lamblia
YASLCIQTVRYRANVNF

SEQ ID NO: 3082005 - protein, 22 aa, Giardia lamblia
YASLCMGVAWILTLTVCLPCVT

SEQ ID NO: 3082006 - protein, 24 aa, Giardia lamblia
YASPQWRLTWLRQNYALLQDLILD

SEQ ID NO: 3082007 - protein, 33 aa, Giardia lamblia
YASRSLRTAWTVYNRLGAQISRVTTQAAKDTLL

SEQ ID NO: 3082008 - protein, 19 aa, Giardia lamblia
YASVSRFNANLSFNQLALR

SEQ ID NO: 3082009 - protein, 25 aa, Giardia lamblia
YASYKRIDSALAFLSEMSEDCNDID

SEQ ID NO: 3082010 - protein, 26 aa, Giardia lamblia
YATALDCLLNEIFPLPPSIYNNTLTS

SEQ ID NO: 3082011 - protein, 17 aa, Giardia lamblia
YATEIASMWEELQSFDR

SEQ ID NO: 3082012 - protein, 19 aa, Giardia lamblia
YATEPDWSNAFLEAIKPIT

SEQ ID NO: 3082013 - protein, 18 aa, Giardia lamblia
YATLPFYVAMILTDIPIY

SEQ ID NO: 3082014 - protein, 17 aa, Giardia lamblia
YATYGLTSAFARDPTEP

SEQ ID NO: 3082015 - protein, 17 aa, Giardia lamblia
YCELTNVVLPLCLYNVP

SEQ ID NO: 3082016 - protein, 20 aa, Giardia lamblia
YCFDSEIVRLLAICSQNANL

SEQ ID NO: 3082017 - protein, 27 aa, Giardia lamblia
YCILLPIRAFLFLFMLVFCLFGTLMTS

SEQ ID NO: 3082018 - protein, 24 aa, Giardia lamblia
YCKNESRCPYYLGRALVPQARVVT

SEQ ID NO: 3082019 - protein, 21 aa, Giardia lamblia
YCLGSFSVLYLFTPVYADKLG

SEQ ID NO: 3082020 - protein, 17 aa, Giardia lamblia
YCLTLGCSEDPYEFTLT

SEQ ID NO: 3082021 - protein, 17 aa, Giardia lamblia
YCQMFSPTIRENIIAYK

SEQ ID NO: 3082022 - protein, 18 aa, Giardia lamblia
YCRYTCLTHTQSMSDVTL

SEQ ID NO: 3082023 - protein, 23 aa, Giardia lamblia
YCSCLRWYNITTLSSGQCISTRC

SEQ ID NO: 3082024 - protein, 18 aa, Giardia lamblia
YCSVCRGQTSFPLEGTCH

SEQ ID NO: 3082025 - protein, 23 aa, Giardia lamblia
YCVRHLRYWINMQDKYTLHLASN

SEQ ID NO: 3082026 - protein, 17 aa, Giardia lamblia
YDAAVNWMVNLQSYFDS

SEQ ID NO: 3082027 - protein, 18 aa, Giardia lamblia
YDALSLINSIQCEHFNIT

SEQ ID NO: 3082028 - protein, 24 aa, Giardia lamblia
YDASKAGGVTVEFSVTNNFPYGKK

SEQ ID NO: 3082029 - protein, 24 aa, Giardia lamblia
YDATRIYFTLARMVASALNDLAER

SEQ ID NO: 3082030 - protein, 19 aa, Giardia lamblia
YDEMRKLVLRLCNPNRIFD

SEQ ID NO: 3082031 - protein, 21 aa, Giardia lamblia
YDEQLKRLGFPIMTLTSVCMQ

SEQ ID NO: 3082032 - protein, 24 aa, Giardia lamblia
YDFFSYPNIETFGLLNSTIPLALV

SEQ ID NO: 3082033 - protein, 27 aa, Giardia lamblia
YDFLVLVDMILRYCLPTSSYTTYSKRL

SEQ ID NO: 3082034 - protein, 24 aa, Giardia lamblia
YDIKKVELSLCFYDESNRPLPSAT

SEQ ID NO: 3082035 - protein, 19 aa, Giardia lamblia
YDILHNMHMYKARPGTYYI

SEQ ID NO: 3082036 - protein, 17 aa, Giardia lamblia
YDIPRMRKFFSQAGSTD

SEQ ID NO: 3082037 - protein, 24 aa, Giardia lamblia
YDKESRYLVGLLCQQQCVSHYINY

SEQ ID NO: 3082038 - protein, 31 aa, Giardia lamblia
YDKRMGVIRVFLSWDVEWFLRIAGGGYSTEA

SEQ ID NO: 3082039 - protein, 23 aa, Giardia lamblia
YDLEKRMSFLMRMMLSFISAGYQ

SEQ ID NO: 3082040 - protein, 22 aa, Giardia lamblia
YDLPVFLPPLFIPKQKLEYVEV

SEQ ID NO: 3082041 - protein, 18 aa, Giardia lamblia
YDPILAAIRVYYTYPRFD

SEQ ID NO: 3082042 - protein, 25 aa, Giardia lamblia
YDRLETCAIYLLAELDLKMQEKSLG

SEQ ID NO: 3082043 - protein, 25 aa, Giardia lamblia
YDSCVAIEILLEYALNLAQIGLPSV

SEQ ID NO: 3082044 - protein, 24 aa, Giardia lamblia
YDSDECCRILLPLEQDLRLRDGGT

SEQ ID NO: 3082045 - protein, 17 aa, Giardia lamblia
YDSFKPLVALLYMIALS

SEQ ID NO: 3082046 - protein, 21 aa, Giardia lamblia
YDSVRVCLKKAEPLYVTLANR

SEQ ID NO: 3082047 - protein, 26 aa, Giardia lamblia
YDSYLPVEFLYTIALILFSSINIVGV

SEQ ID NO: 3082048 - protein, 18 aa, Giardia lamblia
YDTCYARKYAPQCHQHYI

SEQ ID NO: 3082049 - protein, 24 aa, Giardia lamblia
YDTFYILLGCVLLAAKVSGAPRTF

SEQ ID NO: 3082050 - protein, 20 aa, Giardia lamblia
YDTHPLFRNLLLLEAKRDVI

SEQ ID NO: 3082051 - protein, 18 aa, Giardia lamblia
YDTVIAAGKLELCTISHS

SEQ ID NO: 3082052 - protein, 21 aa, Giardia lamblia
YDVILKHCYTTLGGDEADVPE

SEQ ID NO: 3082053 - protein, 23 aa, Giardia lamblia
YDVSCIDINFKHDIWAAPRNYTP

SEQ ID NO: 3082054 - protein, 21 aa, Giardia lamblia
YDYSRLVELYKTFSAQYDRPS

SEQ ID NO: 3082055 - protein, 19 aa, Giardia lamblia
YEAELSLRQIISLISLCPG

SEQ ID NO: 3082056 - protein, 24 aa, Giardia lamblia
YEAGKVFDCLQLCYETLDTYPGDE

SEQ ID NO: 3082057 - protein, 18 aa, Giardia lamblia
YEAKMQMTGRGWNNGTTS

SEQ ID NO: 3082058 - protein, 20 aa, Giardia lamblia
YECIFFMALLFDAYIVITES

SEQ ID NO: 3082059 - protein, 20 aa, Giardia lamblia
YECSKRASSHEGIPASNKVT

SEQ ID NO: 3082060 - protein, 17 aa, Giardia lamblia
YEELDGFCLPKACIFEI

SEQ ID NO: 3082061 - protein, 22 aa, Giardia lamblia
YEEPILLFLCMGHCIDYTHMFN

SEQ ID NO: 3082062 - protein, 17 aa, Giardia lamblia
YEEVNNVYVRWPSIFTK

SEQ ID NO: 3082063 - protein, 29 aa, Giardia lamblia
YEHWKTLVTFWSRLLREYSLASRLMLLLL

SEQ ID NO: 3082064 - protein, 22 aa, Giardia lamblia
YEIFNYQVVLFLQRTFSEDLDM

SEQ ID NO: 3082065 - protein, 21 aa, Giardia lamblia
YEKRLALAQLLEEFGSLPMLV

SEQ ID NO: 3082066 - protein, 21 aa, Giardia lamblia
YELCTLKVPTFDTLFSSGQPS

SEQ ID NO: 3082067 - protein, 19 aa, Giardia lamblia
YELPSQLFQSFIYEIYETK

SEQ ID NO: 3082068 - protein, 21 aa, Giardia lamblia
YELSQALRIYGTFHELLIFVK

SEQ ID NO: 3082069 - protein, 20 aa, Giardia lamblia
YEMCTLRPLYELLDVSELFG

SEQ ID NO: 3082070 - protein, 24 aa, Giardia lamblia
YEMCTTHLWLSLRYLPSVADTDAP

SEQ ID NO: 3082071 - protein, 17 aa, Giardia lamblia
YEMLTFLSPSSAPGLHW

SEQ ID NO: 3082072 - protein, 31 aa, Giardia lamblia
YENPRLLIVPHYRIMLGISKYVFDHQNAPER

SEQ ID NO: 3082073 - protein, 21 aa, Giardia lamblia
YEPTLPLGLFSHRIPTTSAWD

SEQ ID NO: 3082074 - protein, 25 aa, Giardia lamblia
YEQACFNLLCPVFAAVWTSVSLAYV

SEQ ID NO: 3082075 - protein, 27 aa, Giardia lamblia
YETLLQWFKKYCGYEEGVTIDAFSYDW

SEQ ID NO: 3082076 - protein, 24 aa, Giardia lamblia
YETRKLANIFSHPDFIFKGNTVTI

SEQ ID NO: 3082077 - protein, 22 aa, Giardia lamblia
YEVLAKFCSLKKFSRILYPLFA

SEQ ID NO: 3082078 - protein, 27 aa, Giardia lamblia
YEVLEHYRLLLSWDHEKKRLVFTPPMK

SEQ ID NO: 3082079 - protein, 22 aa, Giardia lamblia
YEVRFHCCLIGSQTILRCSEQT

SEQ ID NO: 3082080 - protein, 18 aa, Giardia lamblia
YEVSNFFYGGLYGPYPLI

SEQ ID NO: 3082081 - protein, 24 aa, Giardia lamblia
YEYMIRFYPKPVLSFFSLAYNVGN

SEQ ID NO: 3082082 - protein, 20 aa, Giardia lamblia
YEYMMPLVFLLPSSQEEASE

SEQ ID NO: 3082083 - protein, 18 aa, Giardia lamblia
YFACFKERARINTQLNLF

SEQ ID NO: 3082084 - protein, 18 aa, Giardia lamblia
YFAPSFRGLTSFVKATEL

SEQ ID NO: 3082085 - protein, 17 aa, Giardia lamblia
YFCYVLVMMAINFLRPF

SEQ ID NO: 3082086 - protein, 23 aa, Giardia lamblia
YFDILEFVGLCLDSRRLRSRSVT

SEQ ID NO: 3082087 - protein, 24 aa, Giardia lamblia
YFEERKRLRLSYAQLLEENFNNIT

SEQ ID NO: 3082088 - protein, 27 aa, Giardia lamblia
YFESMPRLLSGYIRSLFISAARNDLET

SEQ ID NO: 3082089 - protein, 21 aa, Giardia lamblia
YFFPSKASVLLLLIPLLNLLP

SEQ ID NO: 3082090 - protein, 29 aa, Giardia lamblia
YFGPGLSCLCKAAISCLSQLLLSSTSFAS

SEQ ID NO: 3082091 - protein, 19 aa, Giardia lamblia
YFIFKVWFLVVFTSVAIFH

SEQ ID NO: 3082092 - protein, 19 aa, Giardia lamblia
YFILFLKRLLQYLHFSRAK

SEQ ID NO: 3082093 - protein, 21 aa, Giardia lamblia
YFKNKRLVHSQIHMITPSFSS

SEQ ID NO: 3082094 - protein, 17 aa, Giardia lamblia
YFLATIMIIAIIRKVYV

SEQ ID NO: 3082095 - protein, 21 aa, Giardia lamblia
YFLSCVKIAYILRKLSQASVK

SEQ ID NO: 3082096 - protein, 21 aa, Giardia lamblia
YFLSPEIFADVTISEESKSFL

SEQ ID NO: 3082097 - protein, 19 aa, Giardia lamblia
YFNKEICFLVTPSDCDLPK

SEQ ID NO: 3082098 - protein, 19 aa, Giardia lamblia
YFQCFSLKSVHSVSYKEVN

SEQ ID NO: 3082099 - protein, 17 aa, Giardia lamblia
YFQQIKYVWIDKENKFI

SEQ ID NO: 3082100 - protein, 24 aa, Giardia lamblia
YFRSCLKVLFIDAGTIKEVTPESV

SEQ ID NO: 3082101 - protein, 19 aa, Giardia lamblia
YFSSIKFIYWTMLGINILW

SEQ ID NO: 3082102 - protein, 25 aa, Giardia lamblia
YFSSPHHWVRAGAVLALGLSAANTQ

SEQ ID NO: 3082103 - protein, 27 aa, Giardia lamblia
YFVDALCKRILWNIVCETVSWYEDESN

SEQ ID NO: 3082104 - protein, 18 aa, Giardia lamblia
YFVIAGLGLCRNALRGGS

SEQ ID NO: 3082105 - protein, 18 aa, Giardia lamblia
YFVKEGKCTACAANCATC

SEQ ID NO: 3082106 - protein, 23 aa, Giardia lamblia
YFYFKMVYPEGTFILHASAWSFV

SEQ ID NO: 3082107 - protein, 19 aa, Giardia lamblia
YGDGAHFCQCRRGWAGAAC

SEQ ID NO: 3082108 - protein, 20 aa, Giardia lamblia
YGDGAHFCQCRRGWAGAACD

SEQ ID NO: 3082109 - protein, 19 aa, Giardia lamblia
YGDGAHFCQCRRGWVGAAC

SEQ ID NO: 3082110 - protein, 26 aa, Giardia lamblia
YGDGAYFCQCRRGWAGAACDAPRAGF

SEQ ID NO: 3082111 - protein, 23 aa, Giardia lamblia
YGETLRWIIPVTQRFHTAVRCIK

SEQ ID NO: 3082112 - protein, 26 aa, Giardia lamblia
YGFPKSSLFLARFAAIAAIVDGTGQN

SEQ ID NO: 3082113 - protein, 19 aa, Giardia lamblia
YGFSRFDFVHNALFTQKSH

SEQ ID NO: 3082114 - protein, 17 aa, Giardia lamblia
YGGLDAALMLAEKERCI

SEQ ID NO: 3082115 - protein, 23 aa, Giardia lamblia
YGHYLLAKIFGFRAVSRQLENFL

SEQ ID NO: 3082116 - protein, 18 aa, Giardia lamblia
YGIIPCFAVLSGVNPDEF

SEQ ID NO: 3082117 - protein, 28 aa, Giardia lamblia
YGKIVHLRARLLYHYNHLEYVRCKMDSD

SEQ ID NO: 3082118 - protein, 30 aa, Giardia lamblia
YGMHALFFHRCFAVQFLLKAVSLSMGQAQA

SEQ ID NO: 3082119 - protein, 19 aa, Giardia lamblia
YGMPSHFYPLLYTAALVLL

SEQ ID NO: 3082120 - protein, 25 aa, Giardia lamblia
YGMYYRTSILILYCLGSFSVLYLFT

SEQ ID NO: 3082121 - protein, 19 aa, Giardia lamblia
YGNVHLAKFIRSILEESSV

SEQ ID NO: 3082122 - protein, 25 aa, Giardia lamblia
YGRASEIMMATALWSTVLTGALAAV

SEQ ID NO: 3082123 - protein, 25 aa, Giardia lamblia
YGSFRMALKRAYRSQADVSRDPDMS

SEQ ID NO: 3082124 - protein, 22 aa, Giardia lamblia
YGSSCSESFCGSNCNRNGICTQ

SEQ ID NO: 3082125 - protein, 26 aa, Giardia lamblia
YGVMCGFASVMICSGFIGIGVKGTFF

SEQ ID NO: 3082126 - protein, 27 aa, Giardia lamblia
YHAWIKAGGYGIFWGYILLTLTGNGIL

SEQ ID NO: 3082127 - protein, 20 aa, Giardia lamblia
YHCIQRPGPITNLDGTTEHR

SEQ ID NO: 3082128 - protein, 22 aa, Giardia lamblia
YHELLSVYFFKTLHSDFSSTST

SEQ ID NO: 3082129 - protein, 25 aa, Giardia lamblia
YHEVRRKLLIYLDCHLPPPIFEALL

SEQ ID NO: 3082130 - protein, 32 aa, Giardia lamblia
YHGSFRDYFCLRFWFIPHRRYMKSLYDEKITQ

SEQ ID NO: 3082131 - protein, 17 aa, Giardia lamblia
YHIGDGLFSNPALSHYM

SEQ ID NO: 3082132 - protein, 18 aa, Giardia lamblia
YHISRPQQRLFLLTQPTN

SEQ ID NO: 3082133 - protein, 23 aa, Giardia lamblia
YHPEPKYKHLPIYGHELSYMKYI

SEQ ID NO: 3082134 - protein, 21 aa, Giardia lamblia
YHRLLDCYQLLNTVDIAPRTN

SEQ ID NO: 3082135 - protein, 30 aa, Giardia lamblia
YHVSPRLFVELTFILGIDILKVRNYLIKSS

SEQ ID NO: 3082136 - protein, 28 aa, Giardia lamblia
YHYSFFDVLMTFSFNLSICVITGINWAA

SEQ ID NO: 3082137 - protein, 17 aa, Giardia lamblia
YIAMACMPLCNFLGPAM

SEQ ID NO: 3082138 - protein, 28 aa, Giardia lamblia
YIASIFMPRLELIILLRIFSGYSASGLV

SEQ ID NO: 3082139 - protein, 19 aa, Giardia lamblia
YICDCPSKEYYIKNQLCAK

SEQ ID NO: 3082140 - protein, 17 aa, Giardia lamblia
YIDKARIRTRLRLLQSR

SEQ ID NO: 3082141 - protein, 24 aa, Giardia lamblia
YIDPVGSLILCIYILINWTLAART

SEQ ID NO: 3082142 - protein, 19 aa, Giardia lamblia
YIFIKESYFESGLISASIA

SEQ ID NO: 3082143 - protein, 24 aa, Giardia lamblia
YIFSDSLFRFTVVPWKSTSVPDKD

SEQ ID NO: 3082144 - protein, 20 aa, Giardia lamblia
YIICRPKETLSFVISLVPED

SEQ ID NO: 3082145 - protein, 18 aa, Giardia lamblia
YIKAYCRQMKGSRTTSGG

SEQ ID NO: 3082146 - protein, 17 aa, Giardia lamblia
YIKGRTKNAQFIVISLR

SEQ ID NO: 3082147 - protein, 26 aa, Giardia lamblia
YIKPTDLRKFISFHYKSFLKLYNDCE

SEQ ID NO: 3082148 - protein, 18 aa, Giardia lamblia
YIKYKGGCYEAGSFEARD

SEQ ID NO: 3082149 - protein, 22 aa, Giardia lamblia
YILAELKFVSSLILSATTTPEK

SEQ ID NO: 3082150 - protein, 19 aa, Giardia lamblia
YILCEEIRADGSVDVKVNY

SEQ ID NO: 3082151 - protein, 25 aa, Giardia lamblia
YILDGRLPPAPIFNIQLILTMEGLC

SEQ ID NO: 3082152 - protein, 17 aa, Giardia lamblia
YILFCFVNGVTILGLKF

SEQ ID NO: 3082153 - protein, 17 aa, Giardia lamblia
YILLLSVSYDESVSKVA

SEQ ID NO: 3082154 - protein, 17 aa, Giardia lamblia
YINLVFDPPLGLLRSLG

SEQ ID NO: 3082155 - protein, 18 aa, Giardia lamblia
YINRVLEMAIAYQTEGTT

SEQ ID NO: 3082156 - protein, 44 aa, Giardia lamblia
YIPFSGRHEHRFAAACKLVCDSSCIISLLTPYIFERQASISATD

SEQ ID NO: 3082157 - protein, 23 aa, Giardia lamblia
YIPKRPDVLIDIVFWSVGVGSWI

SEQ ID NO: 3082158 - protein, 25 aa, Giardia lamblia
YIPPLSQFAAIFVFGSLILMEALNL

SEQ ID NO: 3082159 - protein, 19 aa, Giardia lamblia
YIPYCKVFFIFSQICSPRV

SEQ ID NO: 3082160 - protein, 19 aa, Giardia lamblia
YIPYLRRQLFVLKTYHTHY

SEQ ID NO: 3082161 - protein, 18 aa, Giardia lamblia
YIQQHLKHGAAIKKVQDM

SEQ ID NO: 3082162 - protein, 20 aa, Giardia lamblia
YIRMRRYAKSLSEVIVPMHR

SEQ ID NO: 3082163 - protein, 21 aa, Giardia lamblia
YIRRLFGCVDLWKSFLKTDPT

SEQ ID NO: 3082164 - protein, 19 aa, Giardia lamblia
YIRRVGVEGLRVRIADFGQ

SEQ ID NO: 3082165 - protein, 20 aa, Giardia lamblia
YIRVDFKGVHTNTIRDFMLQ

SEQ ID NO: 3082166 - protein, 25 aa, Giardia lamblia
YISDPRLIPVINLGPLFPKNNRKHC

SEQ ID NO: 3082167 - protein, 17 aa, Giardia lamblia
YISGAAHIQAFKHFIKF

SEQ ID NO: 3082168 - protein, 18 aa, Giardia lamblia
YISRSAWSPSLKPREGPH

SEQ ID NO: 3082169 - protein, 26 aa, Giardia lamblia
YITRCNHGLFIFVPGMRLIITKEYAY

SEQ ID NO: 3082170 - protein, 21 aa, Giardia lamblia
YIVTSQIEFSCLMTELREHLC

SEQ ID NO: 3082171 - protein, 17 aa, Giardia lamblia
YIYAGVVNKFIRRQVGI

SEQ ID NO: 3082172 - protein, 23 aa, Giardia lamblia
YKCDCKGFATGSLCDSCVSENAT

SEQ ID NO: 3082173 - protein, 20 aa, Giardia lamblia
YKCDCRGLATGDLCDTCTDK

SEQ ID NO: 3082174 - protein, 20 aa, Giardia lamblia
YKCDCRGLATGDLCDTCTPG

SEQ ID NO: 3082175 - protein, 18 aa, Giardia lamblia
YKCMKVGLFFANSIPLVN

SEQ ID NO: 3082176 - protein, 17 aa, Giardia lamblia
YKCVCNLGYSPGTEPNR

SEQ ID NO: 3082177 - protein, 23 aa, Giardia lamblia
YKDLSPAELFTWLEKNGEFARVD

SEQ ID NO: 3082178 - protein, 20 aa, Giardia lamblia
YKDMALFCVTGNEALCSNSE

SEQ ID NO: 3082179 - protein, 23 aa, Giardia lamblia
YKEGVDIWALGAVIYELCTLVPL

SEQ ID NO: 3082180 - protein, 17 aa, Giardia lamblia
YKGGCYEAGSFEAGDIC

SEQ ID NO: 3082181 - protein, 19 aa, Giardia lamblia
YKGGCYEAGSFEARDICDA

SEQ ID NO: 3082182 - protein, 20 aa, Giardia lamblia
YKGNSQFLALVATNKFDELR

SEQ ID NO: 3082183 - protein, 24 aa, Giardia lamblia
YKGTKRCAFLFRLMGPNFSMLNVL

SEQ ID NO: 3082184 - protein, 19 aa, Giardia lamblia
YKHLSSFLSVFKRSEDAFG

SEQ ID NO: 3082185 - protein, 22 aa, Giardia lamblia
YKKYLCKAEFRLYEIGHGIMKR

SEQ ID NO: 3082186 - protein, 17 aa, Giardia lamblia
YKLACALHPVYQRNEFV

SEQ ID NO: 3082187 - protein, 18 aa, Giardia lamblia
YKLIDSFEARYGIKGVKY

SEQ ID NO: 3082188 - protein, 24 aa, Giardia lamblia
YKLPLASCRPGLYFLRNLTYDEQT

SEQ ID NO: 3082189 - protein, 23 aa, Giardia lamblia
YKLQPALPLPFNLLETLSVLPQT

SEQ ID NO: 3082190 - protein, 20 aa, Giardia lamblia
YKLSGSLALLLKRIAEGIAT

SEQ ID NO: 3082191 - protein, 20 aa, Giardia lamblia
YKLVVSFLCEAELVDEVPIK

SEQ ID NO: 3082192 - protein, 20 aa, Giardia lamblia
YKNMEREAAKAAAKAAAVSA

SEQ ID NO: 3082193 - protein, 19 aa, Giardia lamblia
YKNQICFIKSSTRNDYMAS

SEQ ID NO: 3082194 - protein, 25 aa, Giardia lamblia
YKNSYKLQGLMNFRSLDLLPNMTLR

SEQ ID NO: 3082195 - protein, 27 aa, Giardia lamblia
YKPDDNAWCAQAFPLGLSYNHCAAHYT

SEQ ID NO: 3082196 - protein, 20 aa, Giardia lamblia
YKPKNAYEWIQRRYWQIQSN

SEQ ID NO: 3082197 - protein, 19 aa, Giardia lamblia
YKPLLRFARERNSEKEELV

SEQ ID NO: 3082198 - protein, 20 aa, Giardia lamblia
YKPYVPYDFSTLSDVSTLSQ

SEQ ID NO: 3082199 - protein, 19 aa, Giardia lamblia
YKQMFIFMFLQDLLSNSQT

SEQ ID NO: 3082200 - protein, 29 aa, Giardia lamblia
YKQSIQCLSLVSGRPIYRYDIKGDTLTYH

SEQ ID NO: 3082201 - protein, 20 aa, Giardia lamblia
YKRAITLGHWLGFLVFGARY

SEQ ID NO: 3082202 - protein, 21 aa, Giardia lamblia
YKRKTLSLVVSCFTAPGVSVL

SEQ ID NO: 3082203 - protein, 20 aa, Giardia lamblia
YKTFMKRNAPIIAGATVAAV

SEQ ID NO: 3082204 - protein, 18 aa, Giardia lamblia
YKTSNPWLATIKPLTTIT

SEQ ID NO: 3082205 - protein, 17 aa, Giardia lamblia
YKTTVPFTTVIDSDVFK

SEQ ID NO: 3082206 - protein, 20 aa, Giardia lamblia
YKVHPFPSRGSIQCKSVLID

SEQ ID NO: 3082207 - protein, 29 aa, Giardia lamblia
YKYVSKYSVGLAATFLRLVGFGKNLMMIQ

SEQ ID NO: 3082208 - protein, 18 aa, Giardia lamblia
YKYYITGDMALVLLDSMQ

SEQ ID NO: 3082209 - protein, 18 aa, Giardia lamblia
YLAIKVDQGCPVILKEVD

SEQ ID NO: 3082210 - protein, 18 aa, Giardia lamblia
YLATEESFCLVDDINSDL

SEQ ID NO: 3082211 - protein, 19 aa, Giardia lamblia
YLATGVLFFVVWVLVAALF

SEQ ID NO: 3082212 - protein, 18 aa, Giardia lamblia
YLAVLLPKIHLFVLSLGS

SEQ ID NO: 3082213 - protein, 24 aa, Giardia lamblia
YLCDILSILIERQIQISGGESLEL

SEQ ID NO: 3082214 - protein, 19 aa, Giardia lamblia
YLCFVSCTMQVIIFDNYCL

SEQ ID NO: 3082215 - protein, 18 aa, Giardia lamblia
YLCLPSVCLTSDGQVCPH

SEQ ID NO: 3082216 - protein, 22 aa, Giardia lamblia
YLCVCTTGYILAFDAREACYLC

SEQ ID NO: 3082217 - protein, 17 aa, Giardia lamblia
YLDGSHVLSIFRAQCSA

SEQ ID NO: 3082218 - protein, 17 aa, Giardia lamblia
YLDISSILTRVYPGLNC

SEQ ID NO: 3082219 - protein, 24 aa, Giardia lamblia
YLDSEFINRLILSACVLALDCSLP

SEQ ID NO: 3082220 - protein, 19 aa, Giardia lamblia
YLEGFTILLEHEAMTEEGC

SEQ ID NO: 3082221 - protein, 37 aa, Giardia lamblia
YLENFPTIYRTNCQPWRYWFEFVTFYVSGIYMAVIIY

SEQ ID NO: 3082222 - protein, 26 aa, Giardia lamblia
YLENLFKFSHDIFLFLLVPIIIFESA

SEQ ID NO: 3082223 - protein, 21 aa, Giardia lamblia
YLESLFRLVEKVIKHCLPEAE

SEQ ID NO: 3082224 - protein, 18 aa, Giardia lamblia
YLGVSAKLKAGVQTESQG

SEQ ID NO: 3082225 - protein, 21 aa, Giardia lamblia
YLHILEYTFVFGDRVSSVKQL

SEQ ID NO: 3082226 - protein, 17 aa, Giardia lamblia
YLHKHDIVFRDMKPENL

SEQ ID NO: 3082227 - protein, 20 aa, Giardia lamblia
YLHYEMLLSLVLILRRYASL

SEQ ID NO: 3082228 - protein, 23 aa, Giardia lamblia
YLIGRIGFERWITFLEAFQTCIR

SEQ ID NO: 3082229 - protein, 19 aa, Giardia lamblia
YLIHKEARIVDRKGVTALM

SEQ ID NO: 3082230 - protein, 18 aa, Giardia lamblia
YLIIKYGMIALCNKTFSN

SEQ ID NO: 3082231 - protein, 17 aa, Giardia lamblia
YLIKIEQYSKLLLEDHV

SEQ ID NO: 3082232 - protein, 17 aa, Giardia lamblia
YLIKSGRILTSSAQQTF

SEQ ID NO: 3082233 - protein, 19 aa, Giardia lamblia
YLIQCFYSIGFYSALNNSI

SEQ ID NO: 3082234 - protein, 22 aa, Giardia lamblia
YLIQRAAAFLGTLVFGKSVVNL

SEQ ID NO: 3082235 - protein, 25 aa, Giardia lamblia
YLITEIMWHRNCIKIYEYLSTLRFG

SEQ ID NO: 3082236 - protein, 22 aa, Giardia lamblia
YLKEHKRRYLLYKLFGSTHTRD

SEQ ID NO: 3082237 - protein, 26 aa, Giardia lamblia
YLKSSIWTLKLIRAIYSSRINMEESY

SEQ ID NO: 3082238 - protein, 20 aa, Giardia lamblia
YLKTFKRIVTSLLITQQSTA

SEQ ID NO: 3082239 - protein, 24 aa, Giardia lamblia
YLLAKERLLGAIPNKIIKETKQIA

SEQ ID NO: 3082240 - protein, 24 aa, Giardia lamblia
YLLCKELQISNCVPYVMRDVIYPE

SEQ ID NO: 3082241 - protein, 17 aa, Giardia lamblia
YLLDPLAAYACLANGGG

SEQ ID NO: 3082242 - protein, 17 aa, Giardia lamblia
YLLENIFISKIEGFTSD

SEQ ID NO: 3082243 - protein, 18 aa, Giardia lamblia
YLLFYFSNYFYLEPVILR

SEQ ID NO: 3082244 - protein, 23 aa, Giardia lamblia
YLLNIPFSMLSKFIEEYEAGVLP

SEQ ID NO: 3082245 - protein, 17 aa, Giardia lamblia
YLLPIPLSVATELRRLA

SEQ ID NO: 3082246 - protein, 19 aa, Giardia lamblia
YLLPIYVYICRFLVLLRRD

SEQ ID NO: 3082247 - protein, 19 aa, Giardia lamblia
YLMVITIFFSLIFITPLRQ

SEQ ID NO: 3082248 - protein, 18 aa, Giardia lamblia
YLNIKAHYNAVLDLGSSP

SEQ ID NO: 3082249 - protein, 20 aa, Giardia lamblia
YLNPLLRQALYGVYDNCINI

SEQ ID NO: 3082250 - protein, 30 aa, Giardia lamblia
YLPDTWKHIYDMLIYFCRFGNTKKKFKDVL

SEQ ID NO: 3082251 - protein, 18 aa, Giardia lamblia
YLPGDSMQSTRFLHRYFG

SEQ ID NO: 3082252 - protein, 25 aa, Giardia lamblia
YLPLLRITRDIKFIASILRMIPHDK

SEQ ID NO: 3082253 - protein, 28 aa, Giardia lamblia
YLPSCCNASSLPMICHFLAESYINTLET

SEQ ID NO: 3082254 - protein, 17 aa, Giardia lamblia
YLPTASYCMRFIQLMPA

SEQ ID NO: 3082255 - protein, 21 aa, Giardia lamblia
YLQMAEYILLLSVSYDESVSK

SEQ ID NO: 3082256 - protein, 23 aa, Giardia lamblia
YLRLEKRIILSYWLSVVIAVLSL

SEQ ID NO: 3082257 - protein, 20 aa, Giardia lamblia
YLRLELAEIITHYTNSLSKY

SEQ ID NO: 3082258 - protein, 19 aa, Giardia lamblia
YLRMRGFQSQNDFTSLLST

SEQ ID NO: 3082259 - protein, 20 aa, Giardia lamblia
YLRPEAYTVVHLTVNKLIYI

SEQ ID NO: 3082260 - protein, 20 aa, Giardia lamblia
YLRRRLSMGTTLEVTLLHSF

SEQ ID NO: 3082261 - protein, 23 aa, Giardia lamblia
YLRSPNLLLEYKLMSSRFLMLEL

SEQ ID NO: 3082262 - protein, 17 aa, Giardia lamblia
YLSEFVEILSIEPCVPS

SEQ ID NO: 3082263 - protein, 25 aa, Giardia lamblia
YLSHELRFLPTYTMSLFLLTSLANL

SEQ ID NO: 3082264 - protein, 17 aa, Giardia lamblia
YLSLFTAIKPFYVLGDR

SEQ ID NO: 3082265 - protein, 25 aa, Giardia lamblia
YLSMSRLKSAFARVFDYIHTIVTQC

SEQ ID NO: 3082266 - protein, 19 aa, Giardia lamblia
YLSQQFQWYINMFSQAHQL

SEQ ID NO: 3082267 - protein, 24 aa, Giardia lamblia
YLSTLRFGPANGMTQFNQFSRVYN

SEQ ID NO: 3082268 - protein, 25 aa, Giardia lamblia
YLVAMCIEAIFLDEHVALVVVMGTI

SEQ ID NO: 3082269 - protein, 24 aa, Giardia lamblia
YLVESCGLVKFERVYSLAHSTLQH

SEQ ID NO: 3082270 - protein, 18 aa, Giardia lamblia
YLVNIVELVDWDTASVTV

SEQ ID NO: 3082271 - protein, 19 aa, Giardia lamblia
YLWLASKLSTLSCEEVIAH

SEQ ID NO: 3082272 - protein, 17 aa, Giardia lamblia
YLYDFFLASELTFVLPP

SEQ ID NO: 3082273 - protein, 22 aa, Giardia lamblia
YLYHYLMLYARILSVTADIKAY

SEQ ID NO: 3082274 - protein, 21 aa, Giardia lamblia
YLYKQDFKVISKALLTEPKDL

SEQ ID NO: 3082275 - protein, 33 aa, Giardia lamblia
YLYKTEVPFYYYVMYFIIARIIWFYTTLLGISV

SEQ ID NO: 3082276 - protein, 19 aa, Giardia lamblia
YLYPCYRYTSNYLEPVSRQ

SEQ ID NO: 3082277 - protein, 19 aa, Giardia lamblia
YLYRVKALIPKLATTDSVL

SEQ ID NO: 3082278 - protein, 24 aa, Giardia lamblia
YMCAECSKTFCTRCFGGYSISYHD

SEQ ID NO: 3082279 - protein, 20 aa, Giardia lamblia
YMGFLSSTFLAYVFVAMPEE

SEQ ID NO: 3082280 - protein, 17 aa, Giardia lamblia
YMGVAHCTLCDSPKIAS

SEQ ID NO: 3082281 - protein, 26 aa, Giardia lamblia
YMKAYKRFVLIHVVFAYFDDWLHADY

SEQ ID NO: 3082282 - protein, 18 aa, Giardia lamblia
YMLFVRILANICADEYAD

SEQ ID NO: 3082283 - protein, 17 aa, Giardia lamblia
YMLSRQFLVSSFIESII

SEQ ID NO: 3082284 - protein, 23 aa, Giardia lamblia
YMQRLKNCYPRLSREMNDSGMLS

SEQ ID NO: 3082285 - protein, 25 aa, Giardia lamblia
YMRGPVGVICACLDSEQSMQLLGTD

SEQ ID NO: 3082286 - protein, 18 aa, Giardia lamblia
YMSQLLFARHDAIQKVLL

SEQ ID NO: 3082287 - protein, 18 aa, Giardia lamblia
YMTDALFLLDEARISVST

SEQ ID NO: 3082288 - protein, 17 aa, Giardia lamblia
YMTVIRLLYAFVVALSF

SEQ ID NO: 3082289 - protein, 17 aa, Giardia lamblia
YMVDTHIAHRLLLIDYP

SEQ ID NO: 3082290 - protein, 20 aa, Giardia lamblia
YNCNSYKTSNPWLATIKPLT

SEQ ID NO: 3082291 - protein, 18 aa, Giardia lamblia
YNDSYDREREHCVSCKNG

SEQ ID NO: 3082292 - protein, 24 aa, Giardia lamblia
YNEDLCSFYSCIDGYMLTETGVCV

SEQ ID NO: 3082293 - protein, 19 aa, Giardia lamblia
YNFLSINIRCMLADIHNVH

SEQ ID NO: 3082294 - protein, 20 aa, Giardia lamblia
YNFTCVSMVIRLYSKSVPDF

SEQ ID NO: 3082295 - protein, 27 aa, Giardia lamblia
YNGKPVACALLLPKIPSIFYSIFSLQE

SEQ ID NO: 3082296 - protein, 19 aa, Giardia lamblia
YNGRCAAGTLFGYDDLDYS

SEQ ID NO: 3082297 - protein, 23 aa, Giardia lamblia
YNIKLGDFGTSYTCKGPSDDQDL

SEQ ID NO: 3082298 - protein, 17 aa, Giardia lamblia
YNKDIWIASARGKEIEL

SEQ ID NO: 3082299 - protein, 24 aa, Giardia lamblia
YNKFRFLPEYFKKFTSSEKATVIS

SEQ ID NO: 3082300 - protein, 32 aa, Giardia lamblia
YNLAKNRPKCFLSYPSMPCFNDELNVDDLDSG

SEQ ID NO: 3082301 - protein, 17 aa, Giardia lamblia
YNMPFKGIFLSMFTIAS

SEQ ID NO: 3082302 - protein, 27 aa, Giardia lamblia
YNNCGYKFPDTMLGFYEYRDEVVTFAR

SEQ ID NO: 3082303 - protein, 17 aa, Giardia lamblia
YNNLFMFINNGFNQAFI

SEQ ID NO: 3082304 - protein, 19 aa, Giardia lamblia
YNREYADDNTICFELALGS

SEQ ID NO: 3082305 - protein, 25 aa, Giardia lamblia
YNRFPCPRPQLQQTRQAFAEPLAAY

SEQ ID NO: 3082306 - protein, 23 aa, Giardia lamblia
YNRRFETLMQIFLDNCLHVDYLT

SEQ ID NO: 3082307 - protein, 19 aa, Giardia lamblia
YNSLAECERGLSFWRPLFE

SEQ ID NO: 3082308 - protein, 21 aa, Giardia lamblia
YNSLLRYVRDFTGKDYSFPDS

SEQ ID NO: 3082309 - protein, 24 aa, Giardia lamblia
YNSRGESALMLAIQNNSVDCLGVL

SEQ ID NO: 3082310 - protein, 23 aa, Giardia lamblia
YNTLEKLPNFGFINLPTERIAAA

SEQ ID NO: 3082311 - protein, 27 aa, Giardia lamblia
YNTRTRLRLIGWRLLQSAVCAAPTIER

SEQ ID NO: 3082312 - protein, 25 aa, Giardia lamblia
YNTSFRYMVEFGVRYDILRDADLLP

SEQ ID NO: 3082313 - protein, 18 aa, Giardia lamblia
YNVHRYSAILGFNGLLSP

SEQ ID NO: 3082314 - protein, 23 aa, Giardia lamblia
YNVRLLHSIKFVFFAIEKFTKGV

SEQ ID NO: 3082315 - protein, 24 aa, Giardia lamblia
YNYLIPRYFHVFNMAINDDPTTLQ

SEQ ID NO: 3082316 - protein, 25 aa, Giardia lamblia
YNYRTCYTCELWPYVDMEKMQTDLE

SEQ ID NO: 3082317 - protein, 19 aa, Giardia lamblia
YPAEPGVNVPVSLLSAAWL

SEQ ID NO: 3082318 - protein, 17 aa, Giardia lamblia
YPAIVSNMLLLKQRMRT

SEQ ID NO: 3082319 - protein, 18 aa, Giardia lamblia
YPFQMKISKYCTSMGGGI

SEQ ID NO: 3082320 - protein, 22 aa, Giardia lamblia
YPGAPFALAGISAYYGLECLIG

SEQ ID NO: 3082321 - protein, 17 aa, Giardia lamblia
YPGELMVGHYPLIHGDH

SEQ ID NO: 3082322 - protein, 29 aa, Giardia lamblia
YPGFMSCVPCKVSGCSRCTSGYAGDTCEM

SEQ ID NO: 3082323 - protein, 23 aa, Giardia lamblia
YPGLPRALFEAAIRNLSPGVSDI

SEQ ID NO: 3082324 - protein, 21 aa, Giardia lamblia
YPGMFNFLTWNAKLIAIRLLD

SEQ ID NO: 3082325 - protein, 17 aa, Giardia lamblia
YPGYSLLYGSGTAGTCV

SEQ ID NO: 3082326 - protein, 18 aa, Giardia lamblia
YPHRLHRLLIFLLGGAYK

SEQ ID NO: 3082327 - protein, 28 aa, Giardia lamblia
YPIDRLPLKDARSFLTIIPQDPFVFEGT

SEQ ID NO: 3082328 - protein, 26 aa, Giardia lamblia
YPIFSIPLAFAFAMAFKSVFSAAIIS

SEQ ID NO: 3082329 - protein, 21 aa, Giardia lamblia
YPIICDGLLLPTVIFREVMLK

SEQ ID NO: 3082330 - protein, 19 aa, Giardia lamblia
YPKLLSYAELVPFRLTALI

SEQ ID NO: 3082331 - protein, 30 aa, Giardia lamblia
YPLEYDMSFFMKRLLKISCDELSYIDSLAM

SEQ ID NO: 3082332 - protein, 19 aa, Giardia lamblia
YPLGQFLYLPAERISQLQG

SEQ ID NO: 3082333 - protein, 17 aa, Giardia lamblia
YPLVLLAGSMLWGFVTW

SEQ ID NO: 3082334 - protein, 17 aa, Giardia lamblia
YPRFDVEVTRGMNHLLK

SEQ ID NO: 3082335 - protein, 18 aa, Giardia lamblia
YPSSRIGANILFSTPSGT

SEQ ID NO: 3082336 - protein, 24 aa, Giardia lamblia
YPSVIEFEEKLSLVRTYLSRHLMD

SEQ ID NO: 3082337 - protein, 18 aa, Giardia lamblia
YPSYLKKLRVESQSNSKL

SEQ ID NO: 3082338 - protein, 17 aa, Giardia lamblia
YPTLIIRGTELYERWRL

SEQ ID NO: 3082339 - protein, 30 aa, Giardia lamblia
YPTYEFVLPLAVNYKLLPSSFVPNATAYNY

SEQ ID NO: 3082340 - protein, 21 aa, Giardia lamblia
YPVCSRYRRLAAYSTTLVDEI

SEQ ID NO: 3082341 - protein, 20 aa, Giardia lamblia
YPVDAPKGYKTRPAILETRP

SEQ ID NO: 3082342 - protein, 19 aa, Giardia lamblia
YPVDDCSWPSGDHDSCDPE

SEQ ID NO: 3082343 - protein, 21 aa, Giardia lamblia
YPVSCVFGGAVCSGFGKCIFS

SEQ ID NO: 3082344 - protein, 17 aa, Giardia lamblia
YPYLEIADQFASKAGAF

SEQ ID NO: 3082345 - protein, 24 aa, Giardia lamblia
YQALQTILLHFGREHGCVNRINEA

SEQ ID NO: 3082346 - protein, 23 aa, Giardia lamblia
YQARHFSLIIAMNSYRTRNFQCI

SEQ ID NO: 3082347 - protein, 24 aa, Giardia lamblia
YQAVPSYELLPFRIAIADFGESMV

SEQ ID NO: 3082348 - protein, 22 aa, Giardia lamblia
YQEELYDGMLILFPEANDIVPR

SEQ ID NO: 3082349 - protein, 18 aa, Giardia lamblia
YQEFKLLTQLSFIYTICH

SEQ ID NO: 3082350 - protein, 19 aa, Giardia lamblia
YQFMPFIVTPLMFGGDFIG

SEQ ID NO: 3082351 - protein, 17 aa, Giardia lamblia
YQFPDTRLAVLATGSFA

SEQ ID NO: 3082352 - protein, 24 aa, Giardia lamblia
YQIKFKKFLIFSLVLLGLSLFLLI

SEQ ID NO: 3082353 - protein, 23 aa, Giardia lamblia
YQINKYPGRFVCGWADDGKCIET

SEQ ID NO: 3082354 - protein, 28 aa, Giardia lamblia
YQKELAERLRLFRQLEGVFLLPCASHSA

SEQ ID NO: 3082355 - protein, 17 aa, Giardia lamblia
YQLAAALERIFATQSSA

SEQ ID NO: 3082356 - protein, 23 aa, Giardia lamblia
YQLAQSILRPAGISLEGIALPEE

SEQ ID NO: 3082357 - protein, 22 aa, Giardia lamblia
YQMLCSVLSQICHELEPRTCLY

SEQ ID NO: 3082358 - protein, 17 aa, Giardia lamblia
YQPTALRKIYHQMDHGV

SEQ ID NO: 3082359 - protein, 17 aa, Giardia lamblia
YQQFKALHIMINAEMDN

SEQ ID NO: 3082360 - protein, 30 aa, Giardia lamblia
YQQRCLRLPKGMREWEAYIELQAKIEDFGT

SEQ ID NO: 3082361 - protein, 23 aa, Giardia lamblia
YQRLLSIFCEFYNGRSPLFGAQT

SEQ ID NO: 3082362 - protein, 23 aa, Giardia lamblia
YQTAGIACALWLDQDTIIAGSWD

SEQ ID NO: 3082363 - protein, 17 aa, Giardia lamblia
YQVAISENSPAYSISNL

SEQ ID NO: 3082364 - protein, 17 aa, Giardia lamblia
YQVKVPTVWHDPVDIGQ

SEQ ID NO: 3082365 - protein, 17 aa, Giardia lamblia
YQVSKYPGRFVCKRADG

SEQ ID NO: 3082366 - protein, 25 aa, Giardia lamblia
YRAELLEFWHGLLLAYNVRCSPLET

SEQ ID NO: 3082367 - protein, 35 aa, Giardia lamblia
YRANAIAKYLFYRDCDFAAYYRFYSPRIQKTVSYL

SEQ ID NO: 3082368 - protein, 19 aa, Giardia lamblia
YRAQEKMRFYLLPNYPFVY

SEQ ID NO: 3082369 - protein, 20 aa, Giardia lamblia
YRASPRKSPLIVKRAPVAAT

SEQ ID NO: 3082370 - protein, 20 aa, Giardia lamblia
YRAYSKFGLNADIGKTYPIF

SEQ ID NO: 3082371 - protein, 23 aa, Giardia lamblia
YRDECGLAKGVHLAVMKGAPERI

SEQ ID NO: 3082372 - protein, 18 aa, Giardia lamblia
YRDIFIARFYPRQFKQSF

SEQ ID NO: 3082373 - protein, 21 aa, Giardia lamblia
YRDIREVTHLSSHVAIILIRA

SEQ ID NO: 3082374 - protein, 25 aa, Giardia lamblia
YRDTECTLSSIVMELQMAKLTIFGS

SEQ ID NO: 3082375 - protein, 22 aa, Giardia lamblia
YRFFYLLNWIYRTVKGVRMGWI

SEQ ID NO: 3082376 - protein, 35 aa, Giardia lamblia
YRFYSPRIQKTVSYLFWRYYLRTQMQLLNITPSSP

SEQ ID NO: 3082377 - protein, 19 aa, Giardia lamblia
YRGRQLLTLQQNRFIVDST

SEQ ID NO: 3082378 - protein, 17 aa, Giardia lamblia
YRHALKLLESVSLDDLL

SEQ ID NO: 3082379 - protein, 20 aa, Giardia lamblia
YRHPPFLSFTMAKKLKERLF

SEQ ID NO: 3082380 - protein, 28 aa, Giardia lamblia
YRIAKDQPYLLGRLKLRSSWTDITPCHD

SEQ ID NO: 3082381 - protein, 38 aa, Giardia lamblia
YRILDPKYVKFVWRLRGIDFATQMFVWALTALRECCRP

SEQ ID NO: 3082382 - protein, 18 aa, Giardia lamblia
YRKAALLFLNERYREALL

SEQ ID NO: 3082383 - protein, 17 aa, Giardia lamblia
YRKVKRYIDSPASSSEA

SEQ ID NO: 3082384 - protein, 19 aa, Giardia lamblia
YRLLFKKGRVDENASVHSN

SEQ ID NO: 3082385 - protein, 17 aa, Giardia lamblia
YRLLVQVLYDPDGLFSI

SEQ ID NO: 3082386 - protein, 22 aa, Giardia lamblia
YRLNNVRFSRMINLASDQVKSY

SEQ ID NO: 3082387 - protein, 20 aa, Giardia lamblia
YRLTMDLQEYLLVRDVAGST

SEQ ID NO: 3082388 - protein, 20 aa, Giardia lamblia
YRLVLGLIVEFGHFPCEPDT

SEQ ID NO: 3082389 - protein, 23 aa, Giardia lamblia
YRNFAELLHRIPVISSAVETVSI

SEQ ID NO: 3082390 - protein, 18 aa, Giardia lamblia
YRNFLFYKPPLYMFYDSI

SEQ ID NO: 3082391 - protein, 21 aa, Giardia lamblia
YRPEKFVAHVMSMFADSAQLL

SEQ ID NO: 3082392 - protein, 18 aa, Giardia lamblia
YRPFKFRADFVCGEYGVH

SEQ ID NO: 3082393 - protein, 18 aa, Giardia lamblia
YRPISIRGALIYFIVSDM

SEQ ID NO: 3082394 - protein, 18 aa, Giardia lamblia
YRPLAACALSVNRVPEPL

SEQ ID NO: 3082395 - protein, 20 aa, Giardia lamblia
YRPYTIYFMALKVINPTQDT

SEQ ID NO: 3082396 - protein, 17 aa, Giardia lamblia
YRQAFAVEQLRPYSFFR

SEQ ID NO: 3082397 - protein, 21 aa, Giardia lamblia
YRQALFYTCCQALLTETKRTA

SEQ ID NO: 3082398 - protein, 17 aa, Giardia lamblia
YRQLQGFDEDGDEDNGL

SEQ ID NO: 3082399 - protein, 17 aa, Giardia lamblia
YRQVLSIGTDLNSEQNM

SEQ ID NO: 3082400 - protein, 20 aa, Giardia lamblia
YRRSYYYTECHEWADFIEWF

SEQ ID NO: 3082401 - protein, 18 aa, Giardia lamblia
YRSDNKFRARIMTAEREQ

SEQ ID NO: 3082402 - protein, 18 aa, Giardia lamblia
YRSGSFIPSIEAILTGTF

SEQ ID NO: 3082403 - protein, 18 aa, Giardia lamblia
YRSSCPEDGNCGVEDGAS

SEQ ID NO: 3082404 - protein, 28 aa, Giardia lamblia
YRSYYRRYLELLPSFLHLVHKFFCPAYL

SEQ ID NO: 3082405 - protein, 18 aa, Giardia lamblia
YRTSCIHKACLNPDLKGT

SEQ ID NO: 3082406 - protein, 26 aa, Giardia lamblia
YRYLYLRPYALDFLGWASTVFEVIIW

SEQ ID NO: 3082407 - protein, 19 aa, Giardia lamblia
YRYSCMVRDQCVISSAPVL

SEQ ID NO: 3082408 - protein, 18 aa, Giardia lamblia
YSAANLFSSFGAGGEASI

SEQ ID NO: 3082409 - protein, 29 aa, Giardia lamblia
YSAFAKLLFERKELYGALLQLAVYVGHMS

SEQ ID NO: 3082410 - protein, 18 aa, Giardia lamblia
YSALMLAVMSPLAMTYYK

SEQ ID NO: 3082411 - protein, 18 aa, Giardia lamblia
YSAVFPYGVFIKVLNLEE

SEQ ID NO: 3082412 - protein, 17 aa, Giardia lamblia
YSAVSLKTGSPVNILEY

SEQ ID NO: 3082413 - protein, 21 aa, Giardia lamblia
YSAYIITEFFVFGNVASLITR

SEQ ID NO: 3082414 - protein, 20 aa, Giardia lamblia
YSCDCRGLATGDLCDTCTDK

SEQ ID NO: 3082415 - protein, 20 aa, Giardia lamblia
YSCDCRGLATGDLCDTCTSG

SEQ ID NO: 3082416 - protein, 21 aa, Giardia lamblia
YSCDCRGLATGNLCENCVPEK

SEQ ID NO: 3082417 - protein, 19 aa, Giardia lamblia
YSCDPCPDGFVSYEGECLS

SEQ ID NO: 3082418 - protein, 24 aa, Giardia lamblia
YSCKCAFSYKSFNGLCVHQSCMSG

SEQ ID NO: 3082419 - protein, 21 aa, Giardia lamblia
YSDLYVCCVMINQDTIIGRIF

SEQ ID NO: 3082420 - protein, 33 aa, Giardia lamblia
YSDSRFLTSLLHLIGMKKAEGMLSLSSQLISEY

SEQ ID NO: 3082421 - protein, 24 aa, Giardia lamblia
YSEILDKLLFYKLLFIVSPINDGP

SEQ ID NO: 3082422 - protein, 20 aa, Giardia lamblia
YSEPNWAHSSVETMHITMKM

SEQ ID NO: 3082423 - protein, 17 aa, Giardia lamblia
YSFYQKHTHCMLLNIIE

SEQ ID NO: 3082424 - protein, 19 aa, Giardia lamblia
YSGPMLDKLVEGILSTLNL

SEQ ID NO: 3082425 - protein, 22 aa, Giardia lamblia
YSHILRDLRLIYLSLENNYVDP

SEQ ID NO: 3082426 - protein, 25 aa, Giardia lamblia
YSHTRSAEVANVFCRNGVYDLSFNG

SEQ ID NO: 3082427 - protein, 18 aa, Giardia lamblia
YSICGCILVAPEPSLFVE

SEQ ID NO: 3082428 - protein, 26 aa, Giardia lamblia
YSIRTIWKALLLSLACDREARSDACS

SEQ ID NO: 3082429 - protein, 23 aa, Giardia lamblia
YSITLLFLCISIYASAVKFLLLG

SEQ ID NO: 3082430 - protein, 25 aa, Giardia lamblia
YSKCYKSVIVQVYFGVLAVLLERDS

SEQ ID NO: 3082431 - protein, 25 aa, Giardia lamblia
YSKKFRMMHDPSFILRGTHREEGAR

SEQ ID NO: 3082432 - protein, 25 aa, Giardia lamblia
YSKRFRLVMRSIFLVLLLSLFIGYF

SEQ ID NO: 3082433 - protein, 24 aa, Giardia lamblia
YSKRTSLQILGFVYGMSRRCILGT

SEQ ID NO: 3082434 - protein, 18 aa, Giardia lamblia
YSLARSYFSPDLCGVHAG

SEQ ID NO: 3082435 - protein, 25 aa, Giardia lamblia
YSLHHALFIYSWCSKLLTAINKSKD

SEQ ID NO: 3082436 - protein, 18 aa, Giardia lamblia
YSLIYRKSSAILIGSPIN

SEQ ID NO: 3082437 - protein, 17 aa, Giardia lamblia
YSLKDYLGLAVKEVLLD

SEQ ID NO: 3082438 - protein, 24 aa, Giardia lamblia
YSLPHYKSTVLLERLNFMANPSDK

SEQ ID NO: 3082439 - protein, 17 aa, Giardia lamblia
YSMLYCRLASIFTYSLS

SEQ ID NO: 3082440 - protein, 23 aa, Giardia lamblia
YSMPEPLAAYLLNPDTFLPLLQA

SEQ ID NO: 3082441 - protein, 23 aa, Giardia lamblia
YSPVCRPKLALKVPELTSKHQDP

SEQ ID NO: 3082442 - protein, 18 aa, Giardia lamblia
YSRIRGCFHRECVGLPGA

SEQ ID NO: 3082443 - protein, 18 aa, Giardia lamblia
YSRLQLIFVQLYRPASGH

SEQ ID NO: 3082444 - protein, 19 aa, Giardia lamblia
YSSAVVGAWIARILRDPKV

SEQ ID NO: 3082445 - protein, 18 aa, Giardia lamblia
YSSDMSFCQEMLGGEGDN

SEQ ID NO: 3082446 - protein, 19 aa, Giardia lamblia
YSSFHEWDVVPSCNINYRH

SEQ ID NO: 3082447 - protein, 17 aa, Giardia lamblia
YSSFRKTLYQALQTILL

SEQ ID NO: 3082448 - protein, 17 aa, Giardia lamblia
YSSPSIVLISSQRRENG

SEQ ID NO: 3082449 - protein, 17 aa, Giardia lamblia
YSSRGCNNAMNWELFYS

SEQ ID NO: 3082450 - protein, 24 aa, Giardia lamblia
YSSRSCLFSTDFLVLYRKSTPIDM

SEQ ID NO: 3082451 - protein, 20 aa, Giardia lamblia
YSSRYRWAASTIFFTVGVIL

SEQ ID NO: 3082452 - protein, 24 aa, Giardia lamblia
YSTEARLAFFPALPFLLREIGIKG

SEQ ID NO: 3082453 - protein, 19 aa, Giardia lamblia
YSTEFVRIISAMIKYHPDD

SEQ ID NO: 3082454 - protein, 24 aa, Giardia lamblia
YSTELKKFIEWCLIIRQDDRLSVY

SEQ ID NO: 3082455 - protein, 26 aa, Giardia lamblia
YSTLLMICLPISLAVSVGVTVTLLVL

SEQ ID NO: 3082456 - protein, 22 aa, Giardia lamblia
YSVEKRNAWILSHPAQCIICVS

SEQ ID NO: 3082457 - protein, 30 aa, Giardia lamblia
YSVFNMSRVRAMIRLVDYMMVKFMLELLLQ

SEQ ID NO: 3082458 - protein, 17 aa, Giardia lamblia
YSVGGPLSYPLIGTGTV

SEQ ID NO: 3082459 - protein, 23 aa, Giardia lamblia
YSVQSIRFTTRYNLVQSTYVTDK

SEQ ID NO: 3082460 - protein, 18 aa, Giardia lamblia
YSWAHSCFILMYSSWAFA

SEQ ID NO: 3082461 - protein, 22 aa, Giardia lamblia
YSYDCLPVGISDNIRNPNINVL

SEQ ID NO: 3082462 - protein, 23 aa, Giardia lamblia
YSYMRLTLLYLKSIFSQYVSSNA

SEQ ID NO: 3082463 - protein, 24 aa, Giardia lamblia
YTAKASVVYTCYRTYLDQVDTLSA

SEQ ID NO: 3082464 - protein, 17 aa, Giardia lamblia
YTALMYAAFHNKVQIVA

SEQ ID NO: 3082465 - protein, 22 aa, Giardia lamblia
YTARSLRGFISLCPQEWNNIWI

SEQ ID NO: 3082466 - protein, 18 aa, Giardia lamblia
YTAVFVYNMLGLVFVFMP

SEQ ID NO: 3082467 - protein, 34 aa, Giardia lamblia
YTCTPCGIDACKACSKSGNGIKCTACSSGYLSAD

SEQ ID NO: 3082468 - protein, 24 aa, Giardia lamblia
YTDVYRKMCSSFIFNNSSAGVSSE

SEQ ID NO: 3082469 - protein, 22 aa, Giardia lamblia
YTEMLSNLIFNMFKDLVYASVE

SEQ ID NO: 3082470 - protein, 23 aa, Giardia lamblia
YTESICKRNNPHIARSGSCSLST

SEQ ID NO: 3082471 - protein, 18 aa, Giardia lamblia
YTFIRRFYFPNSHDLLYH

SEQ ID NO: 3082472 - protein, 20 aa, Giardia lamblia
YTGAIIKQWDQRASNNHISE

SEQ ID NO: 3082473 - protein, 23 aa, Giardia lamblia
YTGYPLVLCFLSANYVVALLSFY

SEQ ID NO: 3082474 - protein, 23 aa, Giardia lamblia
YTHKRKCALLISSLIDNIPVVIF

SEQ ID NO: 3082475 - protein, 17 aa, Giardia lamblia
YTILLPYVFTKKYGLSS

SEQ ID NO: 3082476 - protein, 17 aa, Giardia lamblia
YTKILADLVSRYGSQTG

SEQ ID NO: 3082477 - protein, 27 aa, Giardia lamblia
YTKMETFHLSGLVDFYISGILRQRLSD

SEQ ID NO: 3082478 - protein, 18 aa, Giardia lamblia
YTLCSVINKVYRWPDLYS

SEQ ID NO: 3082479 - protein, 18 aa, Giardia lamblia
YTLFRGSLPLIFSQPPTY

SEQ ID NO: 3082480 - protein, 18 aa, Giardia lamblia
YTLGQVLKVHSKPIVVSD

SEQ ID NO: 3082481 - protein, 25 aa, Giardia lamblia
YTLNRLVLLAFTFLAVGLFIPLYYL

SEQ ID NO: 3082482 - protein, 25 aa, Giardia lamblia
YTLRSEPVYQLTGFSRHTSLPASLV

SEQ ID NO: 3082483 - protein, 37 aa, Giardia lamblia
YTLTFSAYTEHVWRFCYLRMGMYSGFAITLYTLANNL

SEQ ID NO: 3082484 - protein, 21 aa, Giardia lamblia
YTLYSIRWVEIIYKLYWDTVE

SEQ ID NO: 3082485 - protein, 17 aa, Giardia lamblia
YTMAFNYLLLVGSYLYA

SEQ ID NO: 3082486 - protein, 18 aa, Giardia lamblia
YTMAFSLDALCAKDGIAD

SEQ ID NO: 3082487 - protein, 34 aa, Giardia lamblia
YTNKCDLWSLGCVMYRMMTYLPFYSRYFNRAKAS

SEQ ID NO: 3082488 - protein, 17 aa, Giardia lamblia
YTNYCLNSPVLSCQGLL

SEQ ID NO: 3082489 - protein, 22 aa, Giardia lamblia
YTPQNWSALLFGSRTLKQLMNV

SEQ ID NO: 3082490 - protein, 17 aa, Giardia lamblia
YTQFKWYSRRNGSLVLP

SEQ ID NO: 3082491 - protein, 26 aa, Giardia lamblia
YTQHFFTLWIPFLLDLELRDAEVGML

SEQ ID NO: 3082492 - protein, 17 aa, Giardia lamblia
YTQPSISRIRLFLINAL

SEQ ID NO: 3082493 - protein, 18 aa, Giardia lamblia
YTRYSTIRSLLIVTWNKV

SEQ ID NO: 3082494 - protein, 27 aa, Giardia lamblia
YTSGERRLAVIVGWMVCIVDKLGEIYD

SEQ ID NO: 3082495 - protein, 17 aa, Giardia lamblia
YTSLGVWLARYNKDLKL

SEQ ID NO: 3082496 - protein, 19 aa, Giardia lamblia
YTSLRRSREVHALLQERLN

SEQ ID NO: 3082497 - protein, 26 aa, Giardia lamblia
YTSLSPALLCGLVFMRNALQLKHKVV

SEQ ID NO: 3082498 - protein, 19 aa, Giardia lamblia
YTSNYTKIVLCTYMLNTIS

SEQ ID NO: 3082499 - protein, 18 aa, Giardia lamblia
YTSPPHKIDVRWIGLIFE

SEQ ID NO: 3082500 - protein, 18 aa, Giardia lamblia
YTTAHLIAFFSSLFPFMD

SEQ ID NO: 3082501 - protein, 21 aa, Giardia lamblia
YTVASLLAFVVSLFIINKASR

SEQ ID NO: 3082502 - protein, 21 aa, Giardia lamblia
YTVLSRYPLRVERYMQWNYLF

SEQ ID NO: 3082503 - protein, 21 aa, Giardia lamblia
YTVSCPYCAQPSEPPSRRLLQ

SEQ ID NO: 3082504 - protein, 23 aa, Giardia lamblia
YTYFPRLSSSVTETEFNKLCSQY

SEQ ID NO: 3082505 - protein, 17 aa, Giardia lamblia
YTYPRFDVEVTRGMNHL

SEQ ID NO: 3082506 - protein, 22 aa, Giardia lamblia
YVADCVLYGRYILASQNSRADL

SEQ ID NO: 3082507 - protein, 18 aa, Giardia lamblia
YVALLIMRIVFGLLSEPS

SEQ ID NO: 3082508 - protein, 19 aa, Giardia lamblia
YVCSGKVPTLERIEVDEAS

SEQ ID NO: 3082509 - protein, 17 aa, Giardia lamblia
YVCSPLYGCLVTPRRKA

SEQ ID NO: 3082510 - protein, 24 aa, Giardia lamblia
YVGDFLLHLVLSMWLVLMGLADFS

SEQ ID NO: 3082511 - protein, 19 aa, Giardia lamblia
YVGQCDWFGCKCPEGVSGI

SEQ ID NO: 3082512 - protein, 24 aa, Giardia lamblia
YVHADIKAANVLRLANGNFVLGDF

SEQ ID NO: 3082513 - protein, 28 aa, Giardia lamblia
YVHSSTVYFCCICDLLPTTDEQEKCISQ

SEQ ID NO: 3082514 - protein, 18 aa, Giardia lamblia
YVIICLFVGHTIYYPLHG

SEQ ID NO: 3082515 - protein, 21 aa, Giardia lamblia
YVILLVRYLYTMVGLGVISLE

SEQ ID NO: 3082516 - protein, 19 aa, Giardia lamblia
YVIPGFRRNLSEMKLALFE

SEQ ID NO: 3082517 - protein, 19 aa, Giardia lamblia
YVLLEWKCVSFFFLNALHR

SEQ ID NO: 3082518 - protein, 24 aa, Giardia lamblia
YVLPQRVGPSLAYAASHAPSNETS

SEQ ID NO: 3082519 - protein, 18 aa, Giardia lamblia
YVPCDVFNIACIALPDCC

SEQ ID NO: 3082520 - protein, 17 aa, Giardia lamblia
YVPKAYSIAALRDKPTG

SEQ ID NO: 3082521 - protein, 21 aa, Giardia lamblia
YVPYSFLQLLLLYSTALAILE

SEQ ID NO: 3082522 - protein, 21 aa, Giardia lamblia
YVSLCSPFYASILKLFIEGKF

SEQ ID NO: 3082523 - protein, 19 aa, Giardia lamblia
YVSVRLGLVLSTIVITLVL

SEQ ID NO: 3082524 - protein, 26 aa, Giardia lamblia
YVTAIKELTCPNIVRYKAIHKGSMGD

SEQ ID NO: 3082525 - protein, 23 aa, Giardia lamblia
YVTTFFNIVKWASFHNYLNIGAL

SEQ ID NO: 3082526 - protein, 27 aa, Giardia lamblia
YVVIGGLHFEYAWPLMLTVGAFFVSGY

SEQ ID NO: 3082527 - protein, 23 aa, Giardia lamblia
YVVSTFLAPFSFNKCSLPISETA

SEQ ID NO: 3082528 - protein, 19 aa, Giardia lamblia
YVVTFPRYAGFGSPVHPAF

SEQ ID NO: 3082529 - protein, 18 aa, Giardia lamblia
YVYYEILEHVIMVPHRTL

SEQ ID NO: 3082530 - protein, 26 aa, Giardia lamblia
YWPIRSYRAAARFNLAKLCAYSSHML

SEQ ID NO: 3082531 - protein, 25 aa, Giardia lamblia
YWSAHCTNELISLCSSFLSSFQGSG

SEQ ID NO: 3082532 - protein, 19 aa, Giardia lamblia
YWYEHNSLMHGCHACTHCP

SEQ ID NO: 3082533 - protein, 17 aa, Giardia lamblia
YYAYYLKEVENINRTDA

SEQ ID NO: 3082534 - protein, 25 aa, Giardia lamblia
YYCKDSVMRRCPFGHYSEDGASVCK

SEQ ID NO: 3082535 - protein, 17 aa, Giardia lamblia
YYEGRPMTDCLSGSDLD

SEQ ID NO: 3082536 - protein, 17 aa, Giardia lamblia
YYHAYDFPAEIFRTCSF

SEQ ID NO: 3082537 - protein, 24 aa, Giardia lamblia
YYHERLELLFPLDDMFIGNINLLS

SEQ ID NO: 3082538 - protein, 24 aa, Giardia lamblia
YYHHLPCIQASFYVDRTAKDKKMR

SEQ ID NO: 3082539 - protein, 31 aa, Giardia lamblia
YYKLWFKAGGTWRFVIYVVMWVFCILMLQLA

SEQ ID NO: 3082540 - protein, 20 aa, Giardia lamblia
YYKVFQRLSPVDMFSMQFLK

SEQ ID NO: 3082541 - protein, 31 aa, Giardia lamblia
YYLGRLFAFAVVYNVRFPKVFDSRLISCLIG

SEQ ID NO: 3082542 - protein, 25 aa, Giardia lamblia
YYLSELIIRCFKTKSFIPFLITALI

SEQ ID NO: 3082543 - protein, 18 aa, Giardia lamblia
YYLVRLYFVEKIIPLILS

SEQ ID NO: 3082544 - protein, 20 aa, Giardia lamblia
YYNNSGICSPCIENCLLCTD

SEQ ID NO: 3082545 - protein, 22 aa, Giardia lamblia
YYPSCVSRILASSVCLLSTKTS

SEQ ID NO: 3082546 - protein, 17 aa, Giardia lamblia
YYRLYASLLSYIPTFSL

SEQ ID NO: 3082547 - protein, 19 aa, Giardia lamblia
YYRNIIEGFCRMQEYTDFW

SEQ ID NO: 3082548 - protein, 22 aa, Giardia lamblia
YYRYFIELYRSMSVDFPTEKHL

SEQ ID NO: 3082549 - protein, 18 aa, Giardia lamblia
YYSESRFLAVSKKIGNTI

SEQ ID NO: 3082550 - protein, 18 aa, Giardia lamblia
YYSHYFFMAAIWALLIPL

SEQ ID NO: 3082551 - protein, 24 aa, Giardia lamblia
YYTNHFNFLLSTHFNEIKAVDHLL

SEQ ID NO: 3082552 - protein, 25 aa, Giardia lamblia
YYVIFFRYLLLFSSVIPISLRVNLD

SEQ ID NO: 3082553 - protein, 22 aa, Giardia lamblia
YYVRLCNLETCISRFVDYQLRR

SEQ ID NO: 3082554 - protein, 18 aa, Giardia lamblia
YYVSILFVTALVSNDYCL

SEQ ID NO: 3082555 - protein, 19 aa, Giardia lamblia
VAGFLVWWFVFRRGGRPKR

SEQ ID NO: 3082556 - protein, 22 aa, Giardia lamblia
ASTLRLSVQFLLDNLIGGNYCN

SEQ ID NO: 3082557 - protein, 18 aa, Giardia lamblia
ELLKRLGLHDHAHKQASA

SEQ ID NO: 3082558 - protein, 17 aa, Giardia lamblia
FCAPEYIFHSPLNLNLP

SEQ ID NO: 3082559 - protein, 22 aa, Giardia lamblia
RCWCERGFLPALDRSGCVLPTE

SEQ ID NO: 3082560 - protein, 18 aa, Giardia lamblia
AVFCLACKVKEYTEGSWI

SEQ ID NO: 3082561 - protein, 20 aa, Giardia lamblia
CLACTAPGPGRCTRCPSDKL

SEQ ID NO: 3082562 - protein, 23 aa, Giardia lamblia
FRGLKKLLLWYGKCSYVGSAQIC

SEQ ID NO: 3082563 - protein, 20 aa, Giardia lamblia
GGPSCARWPILVRNLLVGVA

SEQ ID NO: 3082564 - protein, 25 aa, Giardia lamblia
YGAYKGRPVWILRNSWGTGWGVSGY

SEQ ID NO: 3082565 - protein, 22 aa, Giardia lamblia
YPYHLARLGASFSFTNSSSTGG

SEQ ID NO: 3082566 - protein, 19 aa, Giardia lamblia
YYLPLCFIVLVSVGRELYD

SEQ ID NO: 3082567 - protein, 20 aa, Giardia lamblia
AAACKLVCDSSCIISLLTPY

SEQ ID NO: 3082568 - protein, 23 aa, Giardia lamblia
AAASILLNILINWGGGDIIVFLP

SEQ ID NO: 3082569 - protein, 22 aa, Giardia lamblia
AADHPLCLYNMFAPSCTDNNRS

SEQ ID NO: 3082570 - protein, 24 aa, Giardia lamblia
AADKALSMLLGFGFLLFVFAYSIY

SEQ ID NO: 3082571 - protein, 18 aa, Giardia lamblia
AADSFGLLANEWSIDVSR

SEQ ID NO: 3082572 - protein, 22 aa, Giardia lamblia
AAFKLEIKFILTPGERFQLWIL

SEQ ID NO: 3082573 - protein, 17 aa, Giardia lamblia
AALEMLASLMALINYHN

SEQ ID NO: 3082574 - protein, 18 aa, Giardia lamblia
AALPIADFWNIVAAEVFS

SEQ ID NO: 3082575 - protein, 25 aa, Giardia lamblia
AAQIKMVLSYMLFKSAFCDEFKYLF

SEQ ID NO: 3082576 - protein, 19 aa, Giardia lamblia
AASTKRLSYVGGFAGSCRM

SEQ ID NO: 3082577 - protein, 18 aa, Giardia lamblia
AATMLRIFRHSPYDLLRV

SEQ ID NO: 3082578 - protein, 19 aa, Giardia lamblia
AAVRGWRMHYCFNATSVYS

SEQ ID NO: 3082579 - protein, 26 aa, Giardia lamblia
ACAAVFPPFFLKWIRMRISPTDAEKL

SEQ ID NO: 3082580 - protein, 17 aa, Giardia lamblia
ACADRGSAMLKPQITTV

SEQ ID NO: 3082581 - protein, 25 aa, Giardia lamblia
ACAQCSHAAVRACQVAHRYAPQKLR

SEQ ID NO: 3082582 - protein, 18 aa, Giardia lamblia
ACEPVLWRPAIEKGSAGS

SEQ ID NO: 3082583 - protein, 21 aa, Giardia lamblia
ACIRKRRYGLVRSRGSSGKAT

SEQ ID NO: 3082584 - protein, 19 aa, Giardia lamblia
ACISYCSFFLIFKYLYQIK

SEQ ID NO: 3082585 - protein, 17 aa, Giardia lamblia
ACPFCKAQITTVVTLDS

SEQ ID NO: 3082586 - protein, 17 aa, Giardia lamblia
ACRLVMLTWEENWTKLK

SEQ ID NO: 3082587 - protein, 17 aa, Giardia lamblia
ACSIKYLVSCFLPLDLM

SEQ ID NO: 3082588 - protein, 23 aa, Giardia lamblia
ADFRGELLFLLRLMQMHVHQTKE

SEQ ID NO: 3082589 - protein, 18 aa, Giardia lamblia
ADGQSSKCLACWDDTVGG

SEQ ID NO: 3082590 - protein, 23 aa, Giardia lamblia
ADGQSSKCLACWDDTVGGVANCG

SEQ ID NO: 3082591 - protein, 17 aa, Giardia lamblia
ADIFFRIFKVLSKNYSK

SEQ ID NO: 3082592 - protein, 17 aa, Giardia lamblia
ADITIGLILLFKRAMQL

SEQ ID NO: 3082593 - protein, 19 aa, Giardia lamblia
ADKAIECIMNYVFEKSPDN

SEQ ID NO: 3082594 - protein, 17 aa, Giardia lamblia
ADKIFSKDIMVVSSSEC

SEQ ID NO: 3082595 - protein, 22 aa, Giardia lamblia
ADSMTCTILLLGLASSLGSDTC

SEQ ID NO: 3082596 - protein, 20 aa, Giardia lamblia
ADSVLLQFLLELTFKIDLDE

SEQ ID NO: 3082597 - protein, 22 aa, Giardia lamblia
ADSYYKFCVIWAIILMGELCVA

SEQ ID NO: 3082598 - protein, 17 aa, Giardia lamblia
ADWPYTFIFTGHSLGAG

SEQ ID NO: 3082599 - protein, 18 aa, Giardia lamblia
AECLKILFVPILYIPLEA

SEQ ID NO: 3082600 - protein, 23 aa, Giardia lamblia
AEFIKLFFREAFSMIFISAMDNV

SEQ ID NO: 3082601 - protein, 18 aa, Giardia lamblia
AEIMWRYAQVHTPSVILA

SEQ ID NO: 3082602 - protein, 20 aa, Giardia lamblia
AELCLKCTPGLLLIDGACVE

SEQ ID NO: 3082603 - protein, 18 aa, Giardia lamblia
AELLEFWHGLLLAYNVRC

SEQ ID NO: 3082604 - protein, 17 aa, Giardia lamblia
AESGTACRLCFNGYSPN

SEQ ID NO: 3082605 - protein, 20 aa, Giardia lamblia
AESRPALFFFSGRRQSGSAN

SEQ ID NO: 3082606 - protein, 19 aa, Giardia lamblia
AEVSYVFERYLWKFVFELT

SEQ ID NO: 3082607 - protein, 20 aa, Giardia lamblia
AEVYTSFPLSYGFKDLTKKK

SEQ ID NO: 3082608 - protein, 22 aa, Giardia lamblia
AFIKKYRFCSEVPQSGYDKVYR

SEQ ID NO: 3082609 - protein, 24 aa, Giardia lamblia
AFIPSFAVRLFFSIFRENSILCRV

SEQ ID NO: 3082610 - protein, 17 aa, Giardia lamblia
AFLLLSLFMRLAARPID

SEQ ID NO: 3082611 - protein, 24 aa, Giardia lamblia
AFMPEFYSLLVMRFITGIALTGMN

SEQ ID NO: 3082612 - protein, 23 aa, Giardia lamblia
AFTIRDWRVLKALITLFLVYDNV

SEQ ID NO: 3082613 - protein, 18 aa, Giardia lamblia
AFVCVWLFHPVFAGAAVL

SEQ ID NO: 3082614 - protein, 18 aa, Giardia lamblia
AGFLVWWFVFRRGGRPRR

SEQ ID NO: 3082615 - protein, 19 aa, Giardia lamblia
AGGTWRFVIYVVMWVFCIL

SEQ ID NO: 3082616 - protein, 19 aa, Giardia lamblia
AGISRVRYIAVGSISSAET

SEQ ID NO: 3082617 - protein, 18 aa, Giardia lamblia
AGKLEFVRLLAPHEARMQ

SEQ ID NO: 3082618 - protein, 21 aa, Giardia lamblia
AGLKCSFDITAKMWITKSDTD

SEQ ID NO: 3082619 - protein, 19 aa, Giardia lamblia
AGLSCLRAGADYCYLLVRG

SEQ ID NO: 3082620 - protein, 23 aa, Giardia lamblia
AHYEALVLICPWLEEIFVTNKFL

SEQ ID NO: 3082621 - protein, 18 aa, Giardia lamblia
AHYILKFLRQIRIVIYDS

SEQ ID NO: 3082622 - protein, 21 aa, Giardia lamblia
AIEIACMFSSLLGMNVYIPNS

SEQ ID NO: 3082623 - protein, 24 aa, Giardia lamblia
AIERWNKLCSLVFIAPDLAKEWVA

SEQ ID NO: 3082624 - protein, 19 aa, Giardia lamblia
AIFNCIPSRGLGGAVPSSL

SEQ ID NO: 3082625 - protein, 24 aa, Giardia lamblia
AIFPSWVLNIFVCLFLILVVGKRI

SEQ ID NO: 3082626 - protein, 18 aa, Giardia lamblia
AIHICVVMLYILQSFNTN

SEQ ID NO: 3082627 - protein, 21 aa, Giardia lamblia
AINFLRPFLFRSIYPGSLDNP

SEQ ID NO: 3082628 - protein, 23 aa, Giardia lamblia
AISVLKCCPCAAVKKLYDRTKAT

SEQ ID NO: 3082629 - protein, 22 aa, Giardia lamblia
AIVGVLCWYFLVYRKKNPRPQW

SEQ ID NO: 3082630 - protein, 18 aa, Giardia lamblia
AKEYCILCKHVAGATDTY

SEQ ID NO: 3082631 - protein, 24 aa, Giardia lamblia
AKKRAEIRYGGLFIEMDRFTASIN

SEQ ID NO: 3082632 - protein, 17 aa, Giardia lamblia
AKLCAYSSHMLCIGFLF

SEQ ID NO: 3082633 - protein, 17 aa, Giardia lamblia
AKLPGFAAVTLVQLRDL

SEQ ID NO: 3082634 - protein, 19 aa, Giardia lamblia
AKSLNCWDLLKEIRLQHYR

SEQ ID NO: 3082635 - protein, 19 aa, Giardia lamblia
AKVSILLNWYQSQRIFQFV

SEQ ID NO: 3082636 - protein, 21 aa, Giardia lamblia
AKYRICFLPSPAVNVEHTSEH

SEQ ID NO: 3082637 - protein, 19 aa, Giardia lamblia
ALAVLSWITHVLFIQSSLV

SEQ ID NO: 3082638 - protein, 19 aa, Giardia lamblia
ALCLAEKFYSAVVPVDAFC

SEQ ID NO: 3082639 - protein, 19 aa, Giardia lamblia
ALCSYHIWFRMLLDPLFRR

SEQ ID NO: 3082640 - protein, 20 aa, Giardia lamblia
ALDHYCPWVGLPIGLRNMLP

SEQ ID NO: 3082641 - protein, 18 aa, Giardia lamblia
ALEYIPLATPLCFQYLHL

SEQ ID NO: 3082642 - protein, 20 aa, Giardia lamblia
ALFAICIISVLWLAVAKPVY

SEQ ID NO: 3082643 - protein, 17 aa, Giardia lamblia
ALGRTALMWACCNITTP

SEQ ID NO: 3082644 - protein, 17 aa, Giardia lamblia
ALKSKFQRVCLGATATD

SEQ ID NO: 3082645 - protein, 23 aa, Giardia lamblia
ALLASGFCKLDFTGLNLDEIPAY

SEQ ID NO: 3082646 - protein, 25 aa, Giardia lamblia
ALMLACFYGHLSIVRLLFHKEKSIV

SEQ ID NO: 3082647 - protein, 20 aa, Giardia lamblia
ALPQEVWRFMRLCTGARITC

SEQ ID NO: 3082648 - protein, 21 aa, Giardia lamblia
ALPQEVWRFMRLCTGARITCG

SEQ ID NO: 3082649 - protein, 17 aa, Giardia lamblia
ALQEIYDALAYLGSSAR

SEQ ID NO: 3082650 - protein, 19 aa, Giardia lamblia
ALSECSIDNLFLLRFILSS

SEQ ID NO: 3082651 - protein, 20 aa, Giardia lamblia
ALTFCTYCFLLITEVNYHGN

SEQ ID NO: 3082652 - protein, 22 aa, Giardia lamblia
ALTKCYFCDIHHRFQFEQQQQQ

SEQ ID NO: 3082653 - protein, 22 aa, Giardia lamblia
ALVGFLCWWFIFRGRRIDASPS

SEQ ID NO: 3082654 - protein, 17 aa, Giardia lamblia
ALVIPGIVFRLWRVYTF

SEQ ID NO: 3082655 - protein, 18 aa, Giardia lamblia
ALWPLWVYLSQVFDKAIC

SEQ ID NO: 3082656 - protein, 18 aa, Giardia lamblia
AMLLCAFLSVLSGHPYDG

SEQ ID NO: 3082657 - protein, 18 aa, Giardia lamblia
AMMCLRPAKYTINIANGT

SEQ ID NO: 3082658 - protein, 17 aa, Giardia lamblia
AMNWLPRDMHLTEKTSG

SEQ ID NO: 3082659 - protein, 24 aa, Giardia lamblia
AMPRCALCLLALELLAGLSLSLAS

SEQ ID NO: 3082660 - protein, 17 aa, Giardia lamblia
AMPYLPCVSQYLDSILG

SEQ ID NO: 3082661 - protein, 19 aa, Giardia lamblia
APDASCVWGSFSALYSSES

SEQ ID NO: 3082662 - protein, 20 aa, Giardia lamblia
APELRSMVSIIFDRLPLHDH

SEQ ID NO: 3082663 - protein, 22 aa, Giardia lamblia
APSLPRKICLLIDTALLILMTM

SEQ ID NO: 3082664 - protein, 17 aa, Giardia lamblia
APWCGHCKQLAPTWEEM

SEQ ID NO: 3082665 - protein, 23 aa, Giardia lamblia
AQIPRLVPLLPFNYSFIVVLVLE

SEQ ID NO: 3082666 - protein, 25 aa, Giardia lamblia
AQLASKVSECWPCCMTTSSIVSSLH

SEQ ID NO: 3082667 - protein, 17 aa, Giardia lamblia
AQLSFSVIEQHVLNASS

SEQ ID NO: 3082668 - protein, 18 aa, Giardia lamblia
ARAVILYYLFYTYALLQL

SEQ ID NO: 3082669 - protein, 20 aa, Giardia lamblia
ARDAIKAGLPYYAISRAHYM

SEQ ID NO: 3082670 - protein, 17 aa, Giardia lamblia
ARFNYKRHIRVFSRVLL

SEQ ID NO: 3082671 - protein, 18 aa, Giardia lamblia
ARHIAINLLREFVGKLMK

SEQ ID NO: 3082672 - protein, 19 aa, Giardia lamblia
ARKDFRYNKILNIDKAYSV

SEQ ID NO: 3082673 - protein, 24 aa, Giardia lamblia
ARKDYRRCLAISIILPFLQQFTGI

SEQ ID NO: 3082674 - protein, 30 aa, Giardia lamblia
ARMKTAALRLCFKRSSFYRYLLDENKDPES

SEQ ID NO: 3082675 - protein, 18 aa, Giardia lamblia
ARNGIDLLHFLRNMPPYR

SEQ ID NO: 3082676 - protein, 17 aa, Giardia lamblia
ARTLFKLALSGFTRNFL

SEQ ID NO: 3082677 - protein, 19 aa, Giardia lamblia
ARTRLWLIDMVIFPICCNN

SEQ ID NO: 3082678 - protein, 18 aa, Giardia lamblia
ASALRLGKQFKVPVAPYS

SEQ ID NO: 3082679 - protein, 24 aa, Giardia lamblia
ASCDRKAYMGYTFTAGCIGLAHSS

SEQ ID NO: 3082680 - protein, 20 aa, Giardia lamblia
ASDLFEWCMPPPIVSLPQPI

SEQ ID NO: 3082681 - protein, 23 aa, Giardia lamblia
ASFLMCLRVGLSAVISSVYAHVC

SEQ ID NO: 3082682 - protein, 17 aa, Giardia lamblia
ASFRGVVVRLRLRRLRD

SEQ ID NO: 3082683 - protein, 18 aa, Giardia lamblia
ASIFCSDFIYVLASTWPV

SEQ ID NO: 3082684 - protein, 19 aa, Giardia lamblia
ASITFLACIILKYKKNRLR

SEQ ID NO: 3082685 - protein, 17 aa, Giardia lamblia
ASKAGGVTVEFSVTNNF

SEQ ID NO: 3082686 - protein, 21 aa, Giardia lamblia
ASKLVERVRCSMPKKQTLCRA

SEQ ID NO: 3082687 - protein, 19 aa, Giardia lamblia
ASLIIALLGCRHILCLDEF

SEQ ID NO: 3082688 - protein, 23 aa, Giardia lamblia
ASLPNCDFFKLIVYNISQYPEDV

SEQ ID NO: 3082689 - protein, 17 aa, Giardia lamblia
ASLSVPMTPAWVDAMIS

SEQ ID NO: 3082690 - protein, 19 aa, Giardia lamblia
ASSAVSWNAVFSRRALECL

SEQ ID NO: 3082691 - protein, 21 aa, Giardia lamblia
ASTLRLSVQFLLDNLIGGNYC

SEQ ID NO: 3082692 - protein, 21 aa, Giardia lamblia
ASTVAFRLAYNYIKSNRYEDA

SEQ ID NO: 3082693 - protein, 20 aa, Giardia lamblia
ASVDRYACLVTRNMLFKHVT

SEQ ID NO: 3082694 - protein, 17 aa, Giardia lamblia
ASVTLWFSLRLISLFLV

SEQ ID NO: 3082695 - protein, 23 aa, Giardia lamblia
ASYKRIDSALAFLSEMSEDCNDI

SEQ ID NO: 3082696 - protein, 19 aa, Giardia lamblia
ATFYPKWRDYYAWFNDVSV

SEQ ID NO: 3082697 - protein, 20 aa, Giardia lamblia
ATPAYVPRGFCGNASQYYLK

SEQ ID NO: 3082698 - protein, 20 aa, Giardia lamblia
ATRIRLKYDLARTRFYFTSA

SEQ ID NO: 3082699 - protein, 22 aa, Giardia lamblia
ATRRALGYYCLWREKTLAKSPT

SEQ ID NO: 3082700 - protein, 19 aa, Giardia lamblia
ATTICSWCLAVVEYATAWD

SEQ ID NO: 3082701 - protein, 19 aa, Giardia lamblia
AVALACWFVLRRRRESRAA

SEQ ID NO: 3082702 - protein, 18 aa, Giardia lamblia
AVALACWLVLRRRRGSKI

SEQ ID NO: 3082703 - protein, 17 aa, Giardia lamblia
AVICRKLHIVLLEAYIR

SEQ ID NO: 3082704 - protein, 23 aa, Giardia lamblia
AVLQRFGHRYSKSMSLADAYSKF

SEQ ID NO: 3082705 - protein, 19 aa, Giardia lamblia
AVMLEKRCGPSAWQLSATM

SEQ ID NO: 3082706 - protein, 20 aa, Giardia lamblia
AVRYNYQLGMHGFNLEVHPT

SEQ ID NO: 3082707 - protein, 20 aa, Giardia lamblia
AVSRARRLFVCIGAVDQYDN

SEQ ID NO: 3082708 - protein, 24 aa, Giardia lamblia
AVYWLVPLFIRWKVPEIAAHSRIP

SEQ ID NO: 3082709 - protein, 18 aa, Giardia lamblia
AWDAFPYVDTIASLTNQD

SEQ ID NO: 3082710 - protein, 24 aa, Giardia lamblia
AWIKAGGYGIFWGYILLTLTGNGI

SEQ ID NO: 3082711 - protein, 19 aa, Giardia lamblia
AYARFAFHQLFSWDIKTHD

SEQ ID NO: 3082712 - protein, 25 aa, Giardia lamblia
AYERLRCLLGCWALEFGLLPYYRLF

SEQ ID NO: 3082713 - protein, 19 aa, Giardia lamblia
AYFSYPLVRPLYKGDQIDD

SEQ ID NO: 3082714 - protein, 20 aa, Giardia lamblia
AYIYHILTFIPYRFTSNPAK

SEQ ID NO: 3082715 - protein, 17 aa, Giardia lamblia
AYLRFVRHKAINGRIDE

SEQ ID NO: 3082716 - protein, 23 aa, Giardia lamblia
AYLSCAFSKAGLRSLRPVTCQTL

SEQ ID NO: 3082717 - protein, 24 aa, Giardia lamblia
AYNYRRIFCTISFYPRISRHNSVA

SEQ ID NO: 3082718 - protein, 21 aa, Giardia lamblia
AYSSHMLCIGFLFGIIAPISL

SEQ ID NO: 3082719 - protein, 17 aa, Giardia lamblia
CACSEGFLAVSTGEQCV

SEQ ID NO: 3082720 - protein, 23 aa, Giardia lamblia
CAGEFPLFKCCAVALFYSILLVF

SEQ ID NO: 3082721 - protein, 25 aa, Giardia lamblia
CAHVARFTIPVPFEVIWYANAPLVF

SEQ ID NO: 3082722 - protein, 19 aa, Giardia lamblia
CAIPNCVLCDPALTECLAC

SEQ ID NO: 3082723 - protein, 19 aa, Giardia lamblia
CATALFVVRHRLRRIHLYP

SEQ ID NO: 3082724 - protein, 18 aa, Giardia lamblia
CATLPVKVMPPATNIIDG

SEQ ID NO: 3082725 - protein, 17 aa, Giardia lamblia
CAVKHSIVRSGDGYTLH

SEQ ID NO: 3082726 - protein, 19 aa, Giardia lamblia
CCFRCPIPAWGVILVTVLM

SEQ ID NO: 3082727 - protein, 18 aa, Giardia lamblia
CCKQCKNTGLAIIDGDCS

SEQ ID NO: 3082728 - protein, 17 aa, Giardia lamblia
CCNNHWSIYMYIGKQSK

SEQ ID NO: 3082729 - protein, 17 aa, Giardia lamblia
CDACLPGYFLQSSSNAC

SEQ ID NO: 3082730 - protein, 20 aa, Giardia lamblia
CDITNCLVCATGLKCESCAE

SEQ ID NO: 3082731 - protein, 19 aa, Giardia lamblia
CDLWSLGCVMYRMMTYLPF

SEQ ID NO: 3082732 - protein, 20 aa, Giardia lamblia
CDMPGFFVLSSWVYQVLAVF

SEQ ID NO: 3082733 - protein, 18 aa, Giardia lamblia
CDPTIWKRLYDAIQRSAH

SEQ ID NO: 3082734 - protein, 24 aa, Giardia lamblia
CDVKRPRCTDVFRGLGEVHADTVG

SEQ ID NO: 3082735 - protein, 17 aa, Giardia lamblia
CDWGTVVRACFYTQIAI

SEQ ID NO: 3082736 - protein, 19 aa, Giardia lamblia
CEFLWRVLIPLVIHVLNGL

SEQ ID NO: 3082737 - protein, 17 aa, Giardia lamblia
CELKARHTLMAQQVDIS

SEQ ID NO: 3082738 - protein, 23 aa, Giardia lamblia
CELSFKLTLCTQLPPIHILVIHR

SEQ ID NO: 3082739 - protein, 25 aa, Giardia lamblia
CFLLKSFGSLRCFRHMYYLTQIVKP

SEQ ID NO: 3082740 - protein, 20 aa, Giardia lamblia
CFQFPCINLLLSTIVRHTEL

SEQ ID NO: 3082741 - protein, 19 aa, Giardia lamblia
CFSNLCAFVRGMHYDAVFS

SEQ ID NO: 3082742 - protein, 17 aa, Giardia lamblia
CGAGYFLHRTVCFTPEF

SEQ ID NO: 3082743 - protein, 32 aa, Giardia lamblia
CGFPSQKASNAWIRLSVLYAFLPKLVGPWVAH

SEQ ID NO: 3082744 - protein, 20 aa, Giardia lamblia
CGPMFIPRIHVFARMTPEQK

SEQ ID NO: 3082745 - protein, 21 aa, Giardia lamblia
CHICSGCLCFYCFCDQRCRCM

SEQ ID NO: 3082746 - protein, 22 aa, Giardia lamblia
CHPKLLLCYEMCRFHSDCDLTS

SEQ ID NO: 3082747 - protein, 18 aa, Giardia lamblia
CHVLGALLSLIASLGVLC

SEQ ID NO: 3082748 - protein, 18 aa, Giardia lamblia
CIDHFTLKDRFAMAVRYL

SEQ ID NO: 3082749 - protein, 19 aa, Giardia lamblia
CIGVVKLIMEAAGETGSSN

SEQ ID NO: 3082750 - protein, 18 aa, Giardia lamblia
CILGGVSVHLLGPRYSGK

SEQ ID NO: 3082751 - protein, 18 aa, Giardia lamblia
CIVTYIGVTVWQLKTIKR

SEQ ID NO: 3082752 - protein, 23 aa, Giardia lamblia
CKADSSFSLKAWTRSFFKRAACY

SEQ ID NO: 3082753 - protein, 19 aa, Giardia lamblia
CKHAIPLYRCHECVETVEN

SEQ ID NO: 3082754 - protein, 19 aa, Giardia lamblia
CKSFFRHYYVFSTQHLLHV

SEQ ID NO: 3082755 - protein, 20 aa, Giardia lamblia
CKVSSCTYCDARDSGICRIC

SEQ ID NO: 3082756 - protein, 18 aa, Giardia lamblia
CLCKDTILHWAVFYLSPG

SEQ ID NO: 3082757 - protein, 19 aa, Giardia lamblia
CLFLACGYCCLTYDNCVYQ

SEQ ID NO: 3082758 - protein, 18 aa, Giardia lamblia
CLHASNVVAVYGDHAYWR

SEQ ID NO: 3082759 - protein, 18 aa, Giardia lamblia
CLIPRQLYRLDFPISSFL

SEQ ID NO: 3082760 - protein, 21 aa, Giardia lamblia
CLLHTIILLWYCETMMPLSLI

SEQ ID NO: 3082761 - protein, 17 aa, Giardia lamblia
CLLSSRVKFHKDLAATS

SEQ ID NO: 3082762 - protein, 20 aa, Giardia lamblia
CLMIPLKGCLHFSLRRLFPI

SEQ ID NO: 3082763 - protein, 18 aa, Giardia lamblia
CLPYRYEALYVHPPTSTQ

SEQ ID NO: 3082764 - protein, 17 aa, Giardia lamblia
CLRKCPFGTYDNGDNVC

SEQ ID NO: 3082765 - protein, 18 aa, Giardia lamblia
CLSCRGPGACTECKAGYY

SEQ ID NO: 3082766 - protein, 24 aa, Giardia lamblia
CMMCGQCFCNFCGHTHTNINIQET

SEQ ID NO: 3082767 - protein, 18 aa, Giardia lamblia
CNIFCYKPFIEFPSPPET

SEQ ID NO: 3082768 - protein, 19 aa, Giardia lamblia
CNLLLPACRALIIASQGSL

SEQ ID NO: 3082769 - protein, 22 aa, Giardia lamblia
CPPEQRFLLLYTFMKRRSDKKI

SEQ ID NO: 3082770 - protein, 18 aa, Giardia lamblia
CPYCRKYVCRHFTINEED

SEQ ID NO: 3082771 - protein, 19 aa, Giardia lamblia
CQVFCGCFPLKKSLFKLVT

SEQ ID NO: 3082772 - protein, 18 aa, Giardia lamblia
CRALTLPYPMDWTIGQPF

SEQ ID NO: 3082773 - protein, 23 aa, Giardia lamblia
CRHKLLWKRIVSKTVDYQNNKTR

SEQ ID NO: 3082774 - protein, 20 aa, Giardia lamblia
CRSCISAGVCGRCNTGYYLS

SEQ ID NO: 3082775 - protein, 19 aa, Giardia lamblia
CSGSWAIAAVDMFSMYHCS

SEQ ID NO: 3082776 - protein, 20 aa, Giardia lamblia
CSIHKRIAVLMLKGNGTYAQ

SEQ ID NO: 3082777 - protein, 17 aa, Giardia lamblia
CSIYLIGWLRLTQNLTL

SEQ ID NO: 3082778 - protein, 22 aa, Giardia lamblia
CSKIRLLLHKSFYWVPTAREED

SEQ ID NO: 3082779 - protein, 19 aa, Giardia lamblia
CSKSLIKHLVFEVSGLDDF

SEQ ID NO: 3082780 - protein, 28 aa, Giardia lamblia
CSLCCNGCVVCWVSLFLMLFGIVAVVLQ

SEQ ID NO: 3082781 - protein, 25 aa, Giardia lamblia
CSPLNRPYCVLLFLSLMGSGDVSSA

SEQ ID NO: 3082782 - protein, 20 aa, Giardia lamblia
CSPLPRRICSLMESRYNRQK

SEQ ID NO: 3082783 - protein, 19 aa, Giardia lamblia
CSSCLSISILDSVSSLVER

SEQ ID NO: 3082784 - protein, 18 aa, Giardia lamblia
CTFKELFSQWKELAMKYL

SEQ ID NO: 3082785 - protein, 18 aa, Giardia lamblia
CTFPHSFDSMILPSVPLP

SEQ ID NO: 3082786 - protein, 21 aa, Giardia lamblia
CTLFGFHHLGLFTAMLDASFG

SEQ ID NO: 3082787 - protein, 18 aa, Giardia lamblia
CTLMKAGIIPIVRDYNKC

SEQ ID NO: 3082788 - protein, 18 aa, Giardia lamblia
CVLVSWAGMILIGQWTRI

SEQ ID NO: 3082789 - protein, 22 aa, Giardia lamblia
CYALEVMITWFAKGPVVAFSIL

SEQ ID NO: 3082790 - protein, 17 aa, Giardia lamblia
CYERIRQALLLQKDRNA

SEQ ID NO: 3082791 - protein, 17 aa, Giardia lamblia
CYHCYKLEMNTWSDAKV

SEQ ID NO: 3082792 - protein, 18 aa, Giardia lamblia
CYHMYKIRSPTMGYTYTY

SEQ ID NO: 3082793 - protein, 18 aa, Giardia lamblia
CYMFGMSFPRMYKGKAGV

SEQ ID NO: 3082794 - protein, 19 aa, Giardia lamblia
CYYTRLDPDFTFDTSVRSR

SEQ ID NO: 3082795 - protein, 19 aa, Giardia lamblia
CYYTRLDPDFTFNTSVRSR

SEQ ID NO: 3082796 - protein, 18 aa, Giardia lamblia
DALARLAGRFGTINDVSD

SEQ ID NO: 3082797 - protein, 19 aa, Giardia lamblia
DALYLRLSPEYGRAFYEIS

SEQ ID NO: 3082798 - protein, 20 aa, Giardia lamblia
DARLCFLLQLLDFVQSLCLP

SEQ ID NO: 3082799 - protein, 22 aa, Giardia lamblia
DARLCWDILLLYGRNRGLVLSG

SEQ ID NO: 3082800 - protein, 17 aa, Giardia lamblia
DAVSLPGLPGFLIARQA

SEQ ID NO: 3082801 - protein, 18 aa, Giardia lamblia
DCFLKYAFRIGVGVGYPS

SEQ ID NO: 3082802 - protein, 20 aa, Giardia lamblia
DCIIIDLILCRYTLLISNYL

SEQ ID NO: 3082803 - protein, 20 aa, Giardia lamblia
DCPGHRDFVPSLIRAVSQPD

SEQ ID NO: 3082804 - protein, 17 aa, Giardia lamblia
DCRSAEISEHIALLLRD

SEQ ID NO: 3082805 - protein, 23 aa, Giardia lamblia
DCVACPFLFLKDKSFEYARDLSM

SEQ ID NO: 3082806 - protein, 17 aa, Giardia lamblia
DCVFPFTIVFVNGVAQC

SEQ ID NO: 3082807 - protein, 17 aa, Giardia lamblia
DDFDWRDVNGVSYIPGV

SEQ ID NO: 3082808 - protein, 21 aa, Giardia lamblia
DDGRCKGVFACCPKILAKSDE

SEQ ID NO: 3082809 - protein, 18 aa, Giardia lamblia
DDLRLSLFGLLLTSNFEY

SEQ ID NO: 3082810 - protein, 18 aa, Giardia lamblia
DDNTICFELALGSHVDLL

SEQ ID NO: 3082811 - protein, 23 aa, Giardia lamblia
DDTCCGRHLLLWTVIVIMAILLL

SEQ ID NO: 3082812 - protein, 23 aa, Giardia lamblia
DEAIKWDVLRCIGVLGGLVRRKI

SEQ ID NO: 3082813 - protein, 23 aa, Giardia lamblia
DEEKACSCVEPLVDQFSLIITKT

SEQ ID NO: 3082814 - protein, 21 aa, Giardia lamblia
DEFCLKFRVFQVLKQRPMARR

SEQ ID NO: 3082815 - protein, 17 aa, Giardia lamblia
DEKRLDRFFAMKYYVSA

SEQ ID NO: 3082816 - protein, 21 aa, Giardia lamblia
DERLVWNIGTLVLKIMTMKPA

SEQ ID NO: 3082817 - protein, 17 aa, Giardia lamblia
DEVWPFLDVAGFSLQEI

SEQ ID NO: 3082818 - protein, 17 aa, Giardia lamblia
DFGRLALHVDEEAVRGR

SEQ ID NO: 3082819 - protein, 18 aa, Giardia lamblia
DFIKASLFSLNLLHDHSS

SEQ ID NO: 3082820 - protein, 26 aa, Giardia lamblia
DFILAMPLGCIFIFTRHRLHDGGSSR

SEQ ID NO: 3082821 - protein, 19 aa, Giardia lamblia
DFSFTFMVRLFYEAYLSLY

SEQ ID NO: 3082822 - protein, 25 aa, Giardia lamblia
DFTYRYRYPFMIAFTGSSRYEGRIV

SEQ ID NO: 3082823 - protein, 17 aa, Giardia lamblia
DGHAEWALISALFTLSP

SEQ ID NO: 3082824 - protein, 26 aa, Giardia lamblia
DGRMFHIDFGWCFGKDPKLMAPKMKV

SEQ ID NO: 3082825 - protein, 23 aa, Giardia lamblia
DIDHSFCRLIIWLAGAMPQECSV

SEQ ID NO: 3082826 - protein, 18 aa, Giardia lamblia
DIDPAASINGHFALLLRD

SEQ ID NO: 3082827 - protein, 18 aa, Giardia lamblia
DIFGEFRGTLILACTIGY

SEQ ID NO: 3082828 - protein, 18 aa, Giardia lamblia
DIFWEFDKQPILNEENFE

SEQ ID NO: 3082829 - protein, 18 aa, Giardia lamblia
DIHGRTALMYAVLESNAD

SEQ ID NO: 3082830 - protein, 17 aa, Giardia lamblia
DIIPFGIGFQGSLSFGF

SEQ ID NO: 3082831 - protein, 18 aa, Giardia lamblia
DINFAFLSLCQFHSSFDG

SEQ ID NO: 3082832 - protein, 24 aa, Giardia lamblia
DIPIRIGRMLGYFIKYSYSAYQTV

SEQ ID NO: 3082833 - protein, 23 aa, Giardia lamblia
DIPLRIVLELVPIIVSLLLADSR

SEQ ID NO: 3082834 - protein, 21 aa, Giardia lamblia
DKDCLRLLLMNTADLSAAPYS

SEQ ID NO: 3082835 - protein, 25 aa, Giardia lamblia
DKLLFGVGMLESFGAVFLCLYFIWA

SEQ ID NO: 3082836 - protein, 17 aa, Giardia lamblia
DKLLITAFYRWSDLARG

SEQ ID NO: 3082837 - protein, 20 aa, Giardia lamblia
DKLRIGLHVSVFGYAETIAA

SEQ ID NO: 3082838 - protein, 19 aa, Giardia lamblia
DKTLFHFAWFLLKDYDANV

SEQ ID NO: 3082839 - protein, 23 aa, Giardia lamblia
DLASTCIKRGIAIIRNLVTVDLM

SEQ ID NO: 3082840 - protein, 24 aa, Giardia lamblia
DLCVEIYKVLGFRYLDSEFINRLI

SEQ ID NO: 3082841 - protein, 23 aa, Giardia lamblia
DLFGSLHKLCFIIARANGFLHME

SEQ ID NO: 3082842 - protein, 20 aa, Giardia lamblia
DLKMCVWALWVLIYTLPLFT

SEQ ID NO: 3082843 - protein, 24 aa, Giardia lamblia
DLKSSPGVRAWVALLCSLIIGFSP

SEQ ID NO: 3082844 - protein, 22 aa, Giardia lamblia
DLLYKLLQPFPFKRITWNELAS

SEQ ID NO: 3082845 - protein, 20 aa, Giardia lamblia
DLWRSLICGNYIILRQEYMY

SEQ ID NO: 3082846 - protein, 20 aa, Giardia lamblia
DLYDRIKLMTGRERSEDLRY

SEQ ID NO: 3082847 - protein, 20 aa, Giardia lamblia
DMLDLVLIRFFLALHTYSQE

SEQ ID NO: 3082848 - protein, 20 aa, Giardia lamblia
DNARECIALIPGLTVFSTAS

SEQ ID NO: 3082849 - protein, 25 aa, Giardia lamblia
DNFLFNLLMPITFVTLRSCIYLMAE

SEQ ID NO: 3082850 - protein, 18 aa, Giardia lamblia
DNGYCIGFGYIVDKSISD

SEQ ID NO: 3082851 - protein, 21 aa, Giardia lamblia
DPCSVAGCKTCVSGNRQLCLV

SEQ ID NO: 3082852 - protein, 20 aa, Giardia lamblia
DPFVFNWKLFLGIVLGALGP

SEQ ID NO: 3082853 - protein, 20 aa, Giardia lamblia
DPLRFFKALKIYNPDGSYNQ

SEQ ID NO: 3082854 - protein, 18 aa, Giardia lamblia
DRCLYEIIVPPSLGQVRV

SEQ ID NO: 3082855 - protein, 19 aa, Giardia lamblia
DRFIVDGVWARISIPIIPS

SEQ ID NO: 3082856 - protein, 28 aa, Giardia lamblia
DRLGSYYLRDGRVFTCFANGKLSACMAP

SEQ ID NO: 3082857 - protein, 19 aa, Giardia lamblia
DRMANGLIHFLKSTHSYTD

SEQ ID NO: 3082858 - protein, 22 aa, Giardia lamblia
DRMSVCLPLSFQACPIKSADGT

SEQ ID NO: 3082859 - protein, 21 aa, Giardia lamblia
DRSIRAALIFAITLILINSSS

SEQ ID NO: 3082860 - protein, 17 aa, Giardia lamblia
DSLPYLVLLSFLGATDL

SEQ ID NO: 3082861 - protein, 22 aa, Giardia lamblia
DSRFTVFLKYCIEELLKHFHRS

SEQ ID NO: 3082862 - protein, 21 aa, Giardia lamblia
DSRLLRYCIFLSKYILLYLYP

SEQ ID NO: 3082863 - protein, 20 aa, Giardia lamblia
DSRLPLKFLATFEPRLKYAS

SEQ ID NO: 3082864 - protein, 19 aa, Giardia lamblia
DSVMRRCPFGHYSEDGASV

SEQ ID NO: 3082865 - protein, 19 aa, Giardia lamblia
DTIIFKFTQFRGIITETVL

SEQ ID NO: 3082866 - protein, 18 aa, Giardia lamblia
DTILRFPLVSSFTSNLSL

SEQ ID NO: 3082867 - protein, 23 aa, Giardia lamblia
DTVCDFSMRVCLLYAAIVAQSDQ

SEQ ID NO: 3082868 - protein, 17 aa, Giardia lamblia
DVAICICPALTFRRYLK

SEQ ID NO: 3082869 - protein, 18 aa, Giardia lamblia
DVFKRLSPELVLKIEQDV

SEQ ID NO: 3082870 - protein, 19 aa, Giardia lamblia
DVLIELACTYLLQAKLIDA

SEQ ID NO: 3082871 - protein, 22 aa, Giardia lamblia
DVPPRLARRGRLKSRGRKDHQT

SEQ ID NO: 3082872 - protein, 18 aa, Giardia lamblia
DVSNRVFYLFGLSSLHHD

SEQ ID NO: 3082873 - protein, 19 aa, Giardia lamblia
DVVCFPRFSYSRSKRRVFF

SEQ ID NO: 3082874 - protein, 24 aa, Giardia lamblia
DVYFYSKFIRLFLWGVSSKRTMDT

SEQ ID NO: 3082875 - protein, 18 aa, Giardia lamblia
DVYRSVSLLQFLWHTAHA

SEQ ID NO: 3082876 - protein, 19 aa, Giardia lamblia
DWSPLMLWVLRGNRGDVAP

SEQ ID NO: 3082877 - protein, 19 aa, Giardia lamblia
DYNNCWAEIDILQSVYEDD

SEQ ID NO: 3082878 - protein, 18 aa, Giardia lamblia
EAATRFWAIRAIATATRT

SEQ ID NO: 3082879 - protein, 21 aa, Giardia lamblia
EAESLPHFLLYYAKNKYGVTA

SEQ ID NO: 3082880 - protein, 23 aa, Giardia lamblia
EAFKRMYPFLIPFSYSDNGRADT

SEQ ID NO: 3082881 - protein, 24 aa, Giardia lamblia
EAFLDYVFCFTLYMRADSTVNKED

SEQ ID NO: 3082882 - protein, 20 aa, Giardia lamblia
EAFLSAFCYLELDEYTIVPY

SEQ ID NO: 3082883 - protein, 23 aa, Giardia lamblia
EAFNLKSAVAWILGDKEAHLNAL

SEQ ID NO: 3082884 - protein, 19 aa, Giardia lamblia
EAGHLFWKVIRCISTSSNS

SEQ ID NO: 3082885 - protein, 18 aa, Giardia lamblia
EALIKLLVLNSFKLSSAT

SEQ ID NO: 3082886 - protein, 17 aa, Giardia lamblia
EALRLKLEYSMLYCRLA

SEQ ID NO: 3082887 - protein, 18 aa, Giardia lamblia
EAQCKLGGFSSVPAFSDI

SEQ ID NO: 3082888 - protein, 20 aa, Giardia lamblia
EARGGPRLRSGRFDPSTLFS

SEQ ID NO: 3082889 - protein, 23 aa, Giardia lamblia
EATRLENMLPLRASPTVLTEEDN

SEQ ID NO: 3082890 - protein, 19 aa, Giardia lamblia
EAVGLYFLLAIVCRSYHLN

SEQ ID NO: 3082891 - protein, 18 aa, Giardia lamblia
EAYPRLLILLDFIVCVTS

SEQ ID NO: 3082892 - protein, 17 aa, Giardia lamblia
ECMKARYSGIYELRPLL

SEQ ID NO: 3082893 - protein, 23 aa, Giardia lamblia
ECSHNLCALAYAVKQLWTMLDAQ

SEQ ID NO: 3082894 - protein, 22 aa, Giardia lamblia
EDPSFRATHPWFYAAATNDVQY

SEQ ID NO: 3082895 - protein, 23 aa, Giardia lamblia
EDTIEFLRWVSANALEMGLDETC

SEQ ID NO: 3082896 - protein, 18 aa, Giardia lamblia
EDVCTAFLYLLYLLVNQN

SEQ ID NO: 3082897 - protein, 20 aa, Giardia lamblia
EEARWCLVRCLSPYSLRQLE

SEQ ID NO: 3082898 - protein, 36 aa, Giardia lamblia
EECCAFCSILDLPLCSCCNCCLCFCDCKYVMSDTGA

SEQ ID NO: 3082899 - protein, 21 aa, Giardia lamblia
EEEIRGSPILNMVEHKLIPAF

SEQ ID NO: 3082900 - protein, 26 aa, Giardia lamblia
EELFASDIILCFLKFFNPLNLDDVVH

SEQ ID NO: 3082901 - protein, 18 aa, Giardia lamblia
EERKRLRLSYAQLLEENF

SEQ ID NO: 3082902 - protein, 24 aa, Giardia lamblia
EESYGVACIGSFCLESSELIRPNT

SEQ ID NO: 3082903 - protein, 22 aa, Giardia lamblia
EFAVLWCDASVWFHILKVLLVE

SEQ ID NO: 3082904 - protein, 22 aa, Giardia lamblia
EFCMRLALVLSCRFQDLKEEVV

SEQ ID NO: 3082905 - protein, 18 aa, Giardia lamblia
EFDFRMMTNYAFPSNGLA

SEQ ID NO: 3082906 - protein, 21 aa, Giardia lamblia
EFIFLRLFKFCGGSEVADGKL

SEQ ID NO: 3082907 - protein, 20 aa, Giardia lamblia
EFLCFKATCSSMIAELGYVL

SEQ ID NO: 3082908 - protein, 19 aa, Giardia lamblia
EFVELLAGLVIAPPTTIDP

SEQ ID NO: 3082909 - protein, 23 aa, Giardia lamblia
EGERRIPIRISFVPDPHGAGLKK

SEQ ID NO: 3082910 - protein, 20 aa, Giardia lamblia
EGFRIISILLLIKFFSESFM

SEQ ID NO: 3082911 - protein, 20 aa, Giardia lamblia
EGKLECFATYSFATIIPTPI

SEQ ID NO: 3082912 - protein, 20 aa, Giardia lamblia
EGLAGAFLRVVHQALVLGRL

SEQ ID NO: 3082913 - protein, 20 aa, Giardia lamblia
EGLIRLAAEYALSLLHKQIR

SEQ ID NO: 3082914 - protein, 18 aa, Giardia lamblia
EGLPHFMPSLSVLAAELV

SEQ ID NO: 3082915 - protein, 17 aa, Giardia lamblia
EGLRSVVGYVRYHFPSF

SEQ ID NO: 3082916 - protein, 22 aa, Giardia lamblia
EGPRPPRRWGVPQLLSLDLCIA

SEQ ID NO: 3082917 - protein, 23 aa, Giardia lamblia
EGRGLCCVCMARPPSFIGVPCGH

SEQ ID NO: 3082918 - protein, 20 aa, Giardia lamblia
EHMPRFVGSIIMFLVVCVTT

SEQ ID NO: 3082919 - protein, 19 aa, Giardia lamblia
EIAARAGVVAVYPDISLSI

SEQ ID NO: 3082920 - protein, 24 aa, Giardia lamblia
EIFLGKYVWRECVALFDIDSFDEV

SEQ ID NO: 3082921 - protein, 18 aa, Giardia lamblia
EIGREFITIPGLQHDLKN

SEQ ID NO: 3082922 - protein, 19 aa, Giardia lamblia
EIKIYPAFVRMLFPKHLCA

SEQ ID NO: 3082923 - protein, 22 aa, Giardia lamblia
EIPDLRLKYHIRRPSEQEIVRS

SEQ ID NO: 3082924 - protein, 20 aa, Giardia lamblia
EISQCPYCSVFSIRCNLFQL

SEQ ID NO: 3082925 - protein, 19 aa, Giardia lamblia
EIVRRVSVFMPLFGCHASI

SEQ ID NO: 3082926 - protein, 21 aa, Giardia lamblia
EIVYWRARMASFSAVHQRVHS

SEQ ID NO: 3082927 - protein, 21 aa, Giardia lamblia
EKADCTKLFIEFFSATGPQKA

SEQ ID NO: 3082928 - protein, 26 aa, Giardia lamblia
EKHHKCSKKCLIIWGVIIAVIAIIVI

SEQ ID NO: 3082929 - protein, 20 aa, Giardia lamblia
EKICSSYFWFGRLCVSLGTD

SEQ ID NO: 3082930 - protein, 17 aa, Giardia lamblia
EKQLICHLIELTVSLAL

SEQ ID NO: 3082931 - protein, 20 aa, Giardia lamblia
EKRKRFVFQFSLHRTDFAID

SEQ ID NO: 3082932 - protein, 20 aa, Giardia lamblia
ELAELRRARTAAADILLLVP

SEQ ID NO: 3082933 - protein, 17 aa, Giardia lamblia
ELARTGTVLSVFEQAWS

SEQ ID NO: 3082934 - protein, 19 aa, Giardia lamblia
ELESALCLHFLKTRRETRK

SEQ ID NO: 3082935 - protein, 25 aa, Giardia lamblia
ELFSSEPGLRCFLMACCGLGDVQCS

SEQ ID NO: 3082936 - protein, 20 aa, Giardia lamblia
ELHCRRMLHLAALYGSLISA

SEQ ID NO: 3082937 - protein, 22 aa, Giardia lamblia
ELHGSLLRPPIQQHWLIGRVVL

SEQ ID NO: 3082938 - protein, 18 aa, Giardia lamblia
ELHMIWPKRDTVVSTTYF

SEQ ID NO: 3082939 - protein, 18 aa, Giardia lamblia
ELIKNCLYISVNMRSTIS

SEQ ID NO: 3082940 - protein, 19 aa, Giardia lamblia
ELLPGPFLIPIVVFPFIVL

SEQ ID NO: 3082941 - protein, 18 aa, Giardia lamblia
ELLRELRQDLSVELEQRR

SEQ ID NO: 3082942 - protein, 20 aa, Giardia lamblia
ELMWFRARINAISGVHFLNL

SEQ ID NO: 3082943 - protein, 17 aa, Giardia lamblia
ELPEIYDILATRKAMLA

SEQ ID NO: 3082944 - protein, 24 aa, Giardia lamblia
ELRFISLLVSCYYELDFLLCDQEL

SEQ ID NO: 3082945 - protein, 19 aa, Giardia lamblia
ELRRKRFKLLQTYLSHELR

SEQ ID NO: 3082946 - protein, 25 aa, Giardia lamblia
ELRVLKAVFKRSFCNTGTSSSNISK

SEQ ID NO: 3082947 - protein, 18 aa, Giardia lamblia
ELSIPFPVGRFISIPSPS

SEQ ID NO: 3082948 - protein, 20 aa, Giardia lamblia
ELTYPAVIGIVWYIIMVCGY

SEQ ID NO: 3082949 - protein, 18 aa, Giardia lamblia
ELVGFAFDLTVYRIQQAA

SEQ ID NO: 3082950 - protein, 25 aa, Giardia lamblia
ELYPRPVLCALILKMVLFINPDAAA

SEQ ID NO: 3082951 - protein, 20 aa, Giardia lamblia
EMAKNMGLRCCTLPDDSTEN

SEQ ID NO: 3082952 - protein, 19 aa, Giardia lamblia
ENAVELFDALILELKPFTT

SEQ ID NO: 3082953 - protein, 21 aa, Giardia lamblia
ENWTKLKSCLDCMGYPHIDIL

SEQ ID NO: 3082954 - protein, 25 aa, Giardia lamblia
EPDLALPLAHLFLRYLKVYCSEEEK

SEQ ID NO: 3082955 - protein, 18 aa, Giardia lamblia
EPLALLLLSSKRASDAAE

SEQ ID NO: 3082956 - protein, 18 aa, Giardia lamblia
EPLWNLAYAEFWDVFLSH

SEQ ID NO: 3082957 - protein, 19 aa, Giardia lamblia
EPRVMLGIIKKFFPLSEET

SEQ ID NO: 3082958 - protein, 18 aa, Giardia lamblia
EQGRKAFTVNILSKQDIT

SEQ ID NO: 3082959 - protein, 18 aa, Giardia lamblia
EQLHKCFYALPVVLQRVM

SEQ ID NO: 3082960 - protein, 18 aa, Giardia lamblia
EQVYRFMAAIIWILNQLV

SEQ ID NO: 3082961 - protein, 20 aa, Giardia lamblia
ERALKFGFTLIIEDGDSLDP

SEQ ID NO: 3082962 - protein, 25 aa, Giardia lamblia
ERFQLWILSCGLIFVVHIKTGFLLA

SEQ ID NO: 3082963 - protein, 17 aa, Giardia lamblia
ERLCFYDVFILTLSTLS

SEQ ID NO: 3082964 - protein, 17 aa, Giardia lamblia
ERLCSWPLYAMLESLVL

SEQ ID NO: 3082965 - protein, 22 aa, Giardia lamblia
ERMKRIIACLNQVFVQLSELVV

SEQ ID NO: 3082966 - protein, 23 aa, Giardia lamblia
ERWVGVFVAMLWVPALRGLDSAM

SEQ ID NO: 3082967 - protein, 17 aa, Giardia lamblia
ESALSFVCALWPLWVYL

SEQ ID NO: 3082968 - protein, 18 aa, Giardia lamblia
ESICKRNNPHIARSGSCS

SEQ ID NO: 3082969 - protein, 18 aa, Giardia lamblia
ESLMHLCTINDSFMASSS

SEQ ID NO: 3082970 - protein, 19 aa, Giardia lamblia
ESQMVYYLLRGVFLLALQI

SEQ ID NO: 3082971 - protein, 20 aa, Giardia lamblia
ESVLYFAEFVQLYTSGSVAY

SEQ ID NO: 3082972 - protein, 19 aa, Giardia lamblia
ESYEDFGFFATIRRGQVFN

SEQ ID NO: 3082973 - protein, 23 aa, Giardia lamblia
ETEYDYSICLLDFSNRDFTSTFD

SEQ ID NO: 3082974 - protein, 17 aa, Giardia lamblia
ETIDCIFNETMLFVNIQ

SEQ ID NO: 3082975 - protein, 25 aa, Giardia lamblia
ETNLKWLRRYSCLIFLNTRIKDELS

SEQ ID NO: 3082976 - protein, 30 aa, Giardia lamblia
ETVPSNDYYIMWPVFIVRNSFIPLDMEEFC

SEQ ID NO: 3082977 - protein, 24 aa, Giardia lamblia
EVLEHYRLLLSWDHEKKRLVFTPP

SEQ ID NO: 3082978 - protein, 18 aa, Giardia lamblia
EVLLKILFILSRTTYNSF

SEQ ID NO: 3082979 - protein, 19 aa, Giardia lamblia
EVPFFYRYVIESSTSKGIL

SEQ ID NO: 3082980 - protein, 18 aa, Giardia lamblia
EVSWNCNVFGPFRRILAS

SEQ ID NO: 3082981 - protein, 25 aa, Giardia lamblia
EVTEIRICRRWVLSDPSCQEWTVLD

SEQ ID NO: 3082982 - protein, 17 aa, Giardia lamblia
EVVVSWPLQAVLYNTGH

SEQ ID NO: 3082983 - protein, 18 aa, Giardia lamblia
EYCECAPGFVLRDADNID

SEQ ID NO: 3082984 - protein, 17 aa, Giardia lamblia
EYSIWKCAEELLAALSY

SEQ ID NO: 3082985 - protein, 21 aa, Giardia lamblia
EYYPVKACTRVPGANAYTDMT

SEQ ID NO: 3082986 - protein, 18 aa, Giardia lamblia
FAEMVVKFAEEFGILTEN

SEQ ID NO: 3082987 - protein, 18 aa, Giardia lamblia
FAFYPAWEAFIINHGIRL

SEQ ID NO: 3082988 - protein, 18 aa, Giardia lamblia
FAKFPSRYAVSFTLCVVA

SEQ ID NO: 3082989 - protein, 17 aa, Giardia lamblia
FALAIACYYYAPFNPIK

SEQ ID NO: 3082990 - protein, 18 aa, Giardia lamblia
FANFRLWKPLRLLKKAVL

SEQ ID NO: 3082991 - protein, 23 aa, Giardia lamblia
FARSKRLTVAAGRLRTIADSAVT

SEQ ID NO: 3082992 - protein, 18 aa, Giardia lamblia
FASVMICSGFIGIGVKGT

SEQ ID NO: 3082993 - protein, 17 aa, Giardia lamblia
FATGFAILFVILDTMGD

SEQ ID NO: 3082994 - protein, 20 aa, Giardia lamblia
FAVNRLSSFMLMSLRDPVRI

SEQ ID NO: 3082995 - protein, 18 aa, Giardia lamblia
FAYPWFGNFLMFFAMSLV

SEQ ID NO: 3082996 - protein, 17 aa, Giardia lamblia
FCDTCVTLLNFNSVTEV

SEQ ID NO: 3082997 - protein, 19 aa, Giardia lamblia
FCFFILTPLFSYRLSQEKG

SEQ ID NO: 3082998 - protein, 17 aa, Giardia lamblia
FCFLGYCLMPLAAYTFV

SEQ ID NO: 3082999 - protein, 19 aa, Giardia lamblia
FCLFMGCSSLSHIPIGHRY

SEQ ID NO: 3083000 - protein, 19 aa, Giardia lamblia
FCLIPVYTFLGLVPSIALN

SEQ ID NO: 3083001 - protein, 20 aa, Giardia lamblia
FCLLFSFLAMNAFILTAIFA

SEQ ID NO: 3083002 - protein, 18 aa, Giardia lamblia
FCPEFLWARDVSSAGQPN

SEQ ID NO: 3083003 - protein, 17 aa, Giardia lamblia
FCSLCFNLSGVDALVSK

SEQ ID NO: 3083004 - protein, 23 aa, Giardia lamblia
FCVCLLFTKRLMVFLTEYLRYKH

SEQ ID NO: 3083005 - protein, 20 aa, Giardia lamblia
FCVYSLPAVIKEYIIMPANP

SEQ ID NO: 3083006 - protein, 19 aa, Giardia lamblia
FDFELCLLDPLAGAAVRLL

SEQ ID NO: 3083007 - protein, 18 aa, Giardia lamblia
FDHHCFWLGTDVGFRNHG

SEQ ID NO: 3083008 - protein, 18 aa, Giardia lamblia
FDIRRGELLLAREIALPR

SEQ ID NO: 3083009 - protein, 18 aa, Giardia lamblia
FDKCWSFSAQRQVKPIVY

SEQ ID NO: 3083010 - protein, 19 aa, Giardia lamblia
FDKFRGCVSTLLFKKLKQI

SEQ ID NO: 3083011 - protein, 21 aa, Giardia lamblia
FDVLMTFSFNLSICVITGINW

SEQ ID NO: 3083012 - protein, 20 aa, Giardia lamblia
FDYNNCWAEIDILQSVYEDD

SEQ ID NO: 3083013 - protein, 18 aa, Giardia lamblia
FEASQQWLGAATILDTTL

SEQ ID NO: 3083014 - protein, 25 aa, Giardia lamblia
FEEGYRAGFSWLVYRMIDRFLNQKS

SEQ ID NO: 3083015 - protein, 17 aa, Giardia lamblia
FEFNGASALMFSVANNN

SEQ ID NO: 3083016 - protein, 17 aa, Giardia lamblia
FEKAVKCQATLPKVSIL

SEQ ID NO: 3083017 - protein, 17 aa, Giardia lamblia
FELMYAKVFPRLKFCQY

SEQ ID NO: 3083018 - protein, 17 aa, Giardia lamblia
FEMCFNISFSQYLMENE

SEQ ID NO: 3083019 - protein, 22 aa, Giardia lamblia
FERYLWKFVFELTAYEVKNPVF

SEQ ID NO: 3083020 - protein, 25 aa, Giardia lamblia
FESIQILCLIEFLPLILSKKTIKEK

SEQ ID NO: 3083021 - protein, 24 aa, Giardia lamblia
FESMPRLLSGYIRSLFISAARNDL

SEQ ID NO: 3083022 - protein, 22 aa, Giardia lamblia
FEVLPRPELVYILMKLLIYSLA

SEQ ID NO: 3083023 - protein, 18 aa, Giardia lamblia
FEYPVVIVFAIIFALGNT

SEQ ID NO: 3083024 - protein, 17 aa, Giardia lamblia
FFCLLGRYNPVIANSLT

SEQ ID NO: 3083025 - protein, 17 aa, Giardia lamblia
FFFCSMLTFSASRSPRF

SEQ ID NO: 3083026 - protein, 19 aa, Giardia lamblia
FFIIFKITLVKAVSSFQGH

SEQ ID NO: 3083027 - protein, 18 aa, Giardia lamblia
FFSLLPRRLSSYLLCKEL

SEQ ID NO: 3083028 - protein, 24 aa, Giardia lamblia
FFSNRPRYFYSLVFSDSQVLSRHN

SEQ ID NO: 3083029 - protein, 17 aa, Giardia lamblia
FFYEFRAWFGTVIVLSI

SEQ ID NO: 3083030 - protein, 25 aa, Giardia lamblia
FGAVFLCLYFIWAGFFFAVFGQNNS

SEQ ID NO: 3083031 - protein, 20 aa, Giardia lamblia
FGEARMPLHLPVKRLLKDPS

SEQ ID NO: 3083032 - protein, 20 aa, Giardia lamblia
FGEAVSLCFTKHTTNEYLLL

SEQ ID NO: 3083033 - protein, 21 aa, Giardia lamblia
FGFSIKQARAFTKVFRAAHPM

SEQ ID NO: 3083034 - protein, 26 aa, Giardia lamblia
FGGRMFIPFVLCFCGSLAWRTLLRGF

SEQ ID NO: 3083035 - protein, 19 aa, Giardia lamblia
FGNAACIWLLFAEARLENR

SEQ ID NO: 3083036 - protein, 20 aa, Giardia lamblia
FGVVGWCFVSHAMSFLFTDV

SEQ ID NO: 3083037 - protein, 18 aa, Giardia lamblia
FGYKRSETIGGFFNASFL

SEQ ID NO: 3083038 - protein, 20 aa, Giardia lamblia
FHTARMFRWIGVVITIVLAG

SEQ ID NO: 3083039 - protein, 17 aa, Giardia lamblia
FHYSIYFAIGWALLLGP

SEQ ID NO: 3083040 - protein, 18 aa, Giardia lamblia
FIALYSFGLVVAGMGVKT

SEQ ID NO: 3083041 - protein, 20 aa, Giardia lamblia
FICDCPRGSFGRACNFCDRS

SEQ ID NO: 3083042 - protein, 22 aa, Giardia lamblia
FICSLVMKFSVFKVAPYVLLLQ

SEQ ID NO: 3083043 - protein, 17 aa, Giardia lamblia
FIDSIRLARYVKLQETS

SEQ ID NO: 3083044 - protein, 18 aa, Giardia lamblia
FIILEWRLYVSVHIRQGF

SEQ ID NO: 3083045 - protein, 26 aa, Giardia lamblia
FIKRCWTFNLDLRWSPELMLTHPWLV

SEQ ID NO: 3083046 - protein, 19 aa, Giardia lamblia
FILTPGERFQLWILSCGLI

SEQ ID NO: 3083047 - protein, 20 aa, Giardia lamblia
FIMCFRDVIKLSKKSETIQQ

SEQ ID NO: 3083048 - protein, 24 aa, Giardia lamblia
FINQIWPCYVWYRDNVLSAAKKYI

SEQ ID NO: 3083049 - protein, 17 aa, Giardia lamblia
FINRLILSACVLALDCS

SEQ ID NO: 3083050 - protein, 23 aa, Giardia lamblia
FITIPFRIGFAISLIGEAIILAS

SEQ ID NO: 3083051 - protein, 17 aa, Giardia lamblia
FITIPGLQHDLKNTSVI

SEQ ID NO: 3083052 - protein, 18 aa, Giardia lamblia
FITRIVSFLQNYLSNPSF

SEQ ID NO: 3083053 - protein, 22 aa, Giardia lamblia
FITRYGEHFSRFAIIASLQPGT

SEQ ID NO: 3083054 - protein, 21 aa, Giardia lamblia
FIVPFLLYRFFNRPPETIFKG

SEQ ID NO: 3083055 - protein, 18 aa, Giardia lamblia
FKAQLVASVCTVAAPHPD

SEQ ID NO: 3083056 - protein, 21 aa, Giardia lamblia
FKDCVRSAVLRALMLRLITLF

SEQ ID NO: 3083057 - protein, 17 aa, Giardia lamblia
FKFTQFRGIITETVLYL

SEQ ID NO: 3083058 - protein, 17 aa, Giardia lamblia
FKGPKFRVISFIGNLFS

SEQ ID NO: 3083059 - protein, 18 aa, Giardia lamblia
FKGRCFFCLPDNLDKPAV

SEQ ID NO: 3083060 - protein, 20 aa, Giardia lamblia
FKHTELCVALNLDKCRITSC

SEQ ID NO: 3083061 - protein, 20 aa, Giardia lamblia
FKHVLAICSLGRFLLPMKLK

SEQ ID NO: 3083062 - protein, 25 aa, Giardia lamblia
FKHVTCCPWTILALYSSFHEWDVVP

SEQ ID NO: 3083063 - protein, 19 aa, Giardia lamblia
FKISGLFPKYRSLKAAGLL

SEQ ID NO: 3083064 - protein, 17 aa, Giardia lamblia
FKKYCGYEEGVTIDAFS

SEQ ID NO: 3083065 - protein, 18 aa, Giardia lamblia
FKLAELRGKFGRNDSEIQ

SEQ ID NO: 3083066 - protein, 18 aa, Giardia lamblia
FKLDTSWIPEFLSVLRSS

SEQ ID NO: 3083067 - protein, 19 aa, Giardia lamblia
FKLKFLYWNAMREHGAMEY

SEQ ID NO: 3083068 - protein, 18 aa, Giardia lamblia
FKRPFFARARVRCTVVPF

SEQ ID NO: 3083069 - protein, 23 aa, Giardia lamblia
FKSAFCDEFKYLFLDFYNSYGSD

SEQ ID NO: 3083070 - protein, 19 aa, Giardia lamblia
FKSILFALIFFHAIVIERR

SEQ ID NO: 3083071 - protein, 17 aa, Giardia lamblia
FKSPNCFTFIAITRENM

SEQ ID NO: 3083072 - protein, 18 aa, Giardia lamblia
FLAFRFAHKLTIFQIVLP

SEQ ID NO: 3083073 - protein, 17 aa, Giardia lamblia
FLCSTLLAPVCSLGYLW

SEQ ID NO: 3083074 - protein, 17 aa, Giardia lamblia
FLCWWFIFRGRRIDASP

SEQ ID NO: 3083075 - protein, 18 aa, Giardia lamblia
FLDPRWAEDITFPTMLFH

SEQ ID NO: 3083076 - protein, 18 aa, Giardia lamblia
FLESPPLYERSGETMLPV

SEQ ID NO: 3083077 - protein, 17 aa, Giardia lamblia
FLFCVHVTLRLRTYTSS

SEQ ID NO: 3083078 - protein, 17 aa, Giardia lamblia
FLGGRFLAFRFAHKLTI

SEQ ID NO: 3083079 - protein, 17 aa, Giardia lamblia
FLLSIVEEFNRLHAWMC

SEQ ID NO: 3083080 - protein, 21 aa, Giardia lamblia
FLPEVGEALLLTSYTLVEVLK

SEQ ID NO: 3083081 - protein, 18 aa, Giardia lamblia
FLRPCGFLLFSSFINVEN

SEQ ID NO: 3083082 - protein, 20 aa, Giardia lamblia
FLRRRVRLYQWIAIIGTVSA

SEQ ID NO: 3083083 - protein, 18 aa, Giardia lamblia
FLSLCQFHSSFDGVISSF

SEQ ID NO: 3083084 - protein, 17 aa, Giardia lamblia
FLSLFFTSYIGLAQLLF

SEQ ID NO: 3083085 - protein, 17 aa, Giardia lamblia
FLSLPLLEHVIYVDISQ

SEQ ID NO: 3083086 - protein, 18 aa, Giardia lamblia
FLSSLLLFYTMYFSKQYP

SEQ ID NO: 3083087 - protein, 19 aa, Giardia lamblia
FLTCLMFYLTPSWKKFSYK

SEQ ID NO: 3083088 - protein, 26 aa, Giardia lamblia
FLTGYCLRLPIPMSCGRGIQGASGSI

SEQ ID NO: 3083089 - protein, 17 aa, Giardia lamblia
FLTWYYIMWTVSRISAV

SEQ ID NO: 3083090 - protein, 19 aa, Giardia lamblia
FLWLEGCGPYAFYKLSGSL

SEQ ID NO: 3083091 - protein, 22 aa, Giardia lamblia
FLYKLKHAFMLPMDYWPPNLAF

SEQ ID NO: 3083092 - protein, 28 aa, Giardia lamblia
FMTCFFGYMVFCIIYKWLNEWPEGSNPP

SEQ ID NO: 3083093 - protein, 19 aa, Giardia lamblia
FMTYILLRFAYSVLTRLSI

SEQ ID NO: 3083094 - protein, 17 aa, Giardia lamblia
FNEKVCFFELSIAQSSN

SEQ ID NO: 3083095 - protein, 17 aa, Giardia lamblia
FNGASALMFSVANNNLA

SEQ ID NO: 3083096 - protein, 17 aa, Giardia lamblia
FNMFWARTTYREMNVFV

SEQ ID NO: 3083097 - protein, 18 aa, Giardia lamblia
FPAGIKPKVSSFIVSLFT

SEQ ID NO: 3083098 - protein, 21 aa, Giardia lamblia
FPEQGVLCYWRLIIKSLSLVF

SEQ ID NO: 3083099 - protein, 17 aa, Giardia lamblia
FPFGLCYDFTLLKQRKH

SEQ ID NO: 3083100 - protein, 20 aa, Giardia lamblia
FPFLFVSGLRKTYRKAKRCT

SEQ ID NO: 3083101 - protein, 19 aa, Giardia lamblia
FPGESYVNWIALQLINDDI

SEQ ID NO: 3083102 - protein, 19 aa, Giardia lamblia
FPHLYKLVTHRSRYYSQDD

SEQ ID NO: 3083103 - protein, 17 aa, Giardia lamblia
FPINEFISFLMQNNGVY

SEQ ID NO: 3083104 - protein, 22 aa, Giardia lamblia
FPKPRFFHLPSLYHAALLYRQK

SEQ ID NO: 3083105 - protein, 22 aa, Giardia lamblia
FPKSSLFLARFAAIAAIVDGTG

SEQ ID NO: 3083106 - protein, 18 aa, Giardia lamblia
FPLFKSVLFGAKRQATIP

SEQ ID NO: 3083107 - protein, 21 aa, Giardia lamblia
FPLSFLYSFSFTWSSLYIAFS

SEQ ID NO: 3083108 - protein, 17 aa, Giardia lamblia
FPRSFEALKEWANSSTT

SEQ ID NO: 3083109 - protein, 18 aa, Giardia lamblia
FPSLFKFGSSSSESLSPE

SEQ ID NO: 3083110 - protein, 18 aa, Giardia lamblia
FPTHAFQAMFLISLKTVP

SEQ ID NO: 3083111 - protein, 19 aa, Giardia lamblia
FPVRLKLLYTLSALLSNIE

SEQ ID NO: 3083112 - protein, 21 aa, Giardia lamblia
FPYMCSSGIFADASFERLFDQ

SEQ ID NO: 3083113 - protein, 20 aa, Giardia lamblia
FQDKWGWSALMWAACAGDAD

SEQ ID NO: 3083114 - protein, 17 aa, Giardia lamblia
FRAAAGLRRSMYEGFML

SEQ ID NO: 3083115 - protein, 20 aa, Giardia lamblia
FRDSLCYYVYLYANLFSMTL

SEQ ID NO: 3083116 - protein, 17 aa, Giardia lamblia
FRGQYLPGLYVHPKVDY

SEQ ID NO: 3083117 - protein, 20 aa, Giardia lamblia
FRGTLILACTIGYAICLQYL

SEQ ID NO: 3083118 - protein, 19 aa, Giardia lamblia
FRKAYMMYLPFIPYISTLQ

SEQ ID NO: 3083119 - protein, 20 aa, Giardia lamblia
FRREELRNLLNLYDERNRTR

SEQ ID NO: 3083120 - protein, 17 aa, Giardia lamblia
FRYMVEFGVRYDILRDA

SEQ ID NO: 3083121 - protein, 19 aa, Giardia lamblia
FSAMPFKQMHTAFIDEFIR

SEQ ID NO: 3083122 - protein, 17 aa, Giardia lamblia
FSCKGQATEYLVTFISL

SEQ ID NO: 3083123 - protein, 19 aa, Giardia lamblia
FSDQYLGLWSFTIAKDRHL

SEQ ID NO: 3083124 - protein, 21 aa, Giardia lamblia
FSESTIWRLAYGILKALAFMH

SEQ ID NO: 3083125 - protein, 20 aa, Giardia lamblia
FSGRITSIWHLKQLLEDRAI

SEQ ID NO: 3083126 - protein, 20 aa, Giardia lamblia
FSILFCWLYLPKVPRFKESK

SEQ ID NO: 3083127 - protein, 20 aa, Giardia lamblia
FSKIRFCISSTPLTSFRAIS

SEQ ID NO: 3083128 - protein, 22 aa, Giardia lamblia
FSLECKFKFWFHRDPAAALGKI

SEQ ID NO: 3083129 - protein, 22 aa, Giardia lamblia
FSLRVYMALKLCTDEGPISLSC

SEQ ID NO: 3083130 - protein, 22 aa, Giardia lamblia
FSPELLSFVPYCFQDTLRDGHV

SEQ ID NO: 3083131 - protein, 17 aa, Giardia lamblia
FSQHFVHLFSLLPDDMK

SEQ ID NO: 3083132 - protein, 18 aa, Giardia lamblia
FSRELSFYVSNIMPLIAE

SEQ ID NO: 3083133 - protein, 19 aa, Giardia lamblia
FSSIYTFLHYVPWYFPLDL

SEQ ID NO: 3083134 - protein, 19 aa, Giardia lamblia
FSTALAYIIAILFSFATTA

SEQ ID NO: 3083135 - protein, 20 aa, Giardia lamblia
FSTIPLFTGWLMLGYTVVFT

SEQ ID NO: 3083136 - protein, 20 aa, Giardia lamblia
FSTYLAIVIWRLFNKPQPEL

SEQ ID NO: 3083137 - protein, 19 aa, Giardia lamblia
FSVIYHWNVWQRCMSVTSS

SEQ ID NO: 3083138 - protein, 20 aa, Giardia lamblia
FSVLLRLAVTLTITIDPATR

SEQ ID NO: 3083139 - protein, 22 aa, Giardia lamblia
FTAVPFRLVYSIVILSTTINPL

SEQ ID NO: 3083140 - protein, 20 aa, Giardia lamblia
FTIVRLGWVVALFIMAFAFT

SEQ ID NO: 3083141 - protein, 21 aa, Giardia lamblia
FTIYSCFALSPSIGFIECILP

SEQ ID NO: 3083142 - protein, 17 aa, Giardia lamblia
FTPMIVWLFFKQSARVY

SEQ ID NO: 3083143 - protein, 17 aa, Giardia lamblia
FTQFRGIITETVLYLVQ

SEQ ID NO: 3083144 - protein, 18 aa, Giardia lamblia
FTSNPAKVITAWKKLLTV

SEQ ID NO: 3083145 - protein, 21 aa, Giardia lamblia
FVHCLCFRIFPSLVYSPDDST

SEQ ID NO: 3083146 - protein, 18 aa, Giardia lamblia
FVLAFGDNVFTVFEVAIG

SEQ ID NO: 3083147 - protein, 20 aa, Giardia lamblia
FVLQEFKYRLARFVDSLDQI

SEQ ID NO: 3083148 - protein, 21 aa, Giardia lamblia
FWLQYIHGMMDAFLIYAGSIL

SEQ ID NO: 3083149 - protein, 18 aa, Giardia lamblia
FYAKLCIPPLCVIYLLGL

SEQ ID NO: 3083150 - protein, 17 aa, Giardia lamblia
FYALPVVLQRVMSNVTM

SEQ ID NO: 3083151 - protein, 17 aa, Giardia lamblia
FYKHCYEGLLTNRESLL

SEQ ID NO: 3083152 - protein, 20 aa, Giardia lamblia
FYQYSISFSPVFLIVEEDDP

SEQ ID NO: 3083153 - protein, 18 aa, Giardia lamblia
FYRFPFDHSPLFAPETMV

SEQ ID NO: 3083154 - protein, 22 aa, Giardia lamblia
FYSCLRSTILFSQQLINISKKS

SEQ ID NO: 3083155 - protein, 18 aa, Giardia lamblia
FYVICVVAGFYLLVTYVP

SEQ ID NO: 3083156 - protein, 20 aa, Giardia lamblia
FYYLYCLWISPTLIGQQNKQ

SEQ ID NO: 3083157 - protein, 22 aa, Giardia lamblia
FYYYKRIHFYFSLLVALLTSLV

SEQ ID NO: 3083158 - protein, 25 aa, Giardia lamblia
GACKHFRIMICIPHRIVSVNKSKIS

SEQ ID NO: 3083159 - protein, 22 aa, Giardia lamblia
GALKCFMCQQPVYKEPVYPKSV

SEQ ID NO: 3083160 - protein, 23 aa, Giardia lamblia
GALVLPCNLLFRLLPMAREYGYR

SEQ ID NO: 3083161 - protein, 18 aa, Giardia lamblia
GAYIPLPYILRVRLGEKN

SEQ ID NO: 3083162 - protein, 17 aa, Giardia lamblia
GCATCTFSSSLTCNSCK

SEQ ID NO: 3083163 - protein, 20 aa, Giardia lamblia
GCLFSLWYLLVLKIYATGDF

SEQ ID NO: 3083164 - protein, 19 aa, Giardia lamblia
GCLLPPVLWLVGPILSASP

SEQ ID NO: 3083165 - protein, 17 aa, Giardia lamblia
GCTTCLLGYYIAAEGKR

SEQ ID NO: 3083166 - protein, 25 aa, Giardia lamblia
GCVLFLKTQRDFFAILLWVAAIVSI

SEQ ID NO: 3083167 - protein, 19 aa, Giardia lamblia
GCYLLFQLGSLFARKRRIQ

SEQ ID NO: 3083168 - protein, 17 aa, Giardia lamblia
GDIPSCRPVDCLAKYGH

SEQ ID NO: 3083169 - protein, 19 aa, Giardia lamblia
GDIYRPEFLKIYNDLTMDH

SEQ ID NO: 3083170 - protein, 17 aa, Giardia lamblia
GDLKLGRVSSCHHYSTN

SEQ ID NO: 3083171 - protein, 25 aa, Giardia lamblia
GDNLKWGVLCPCFVLFNEAHYTSLF

SEQ ID NO: 3083172 - protein, 18 aa, Giardia lamblia
GDRYGVTVVHRWGVSGFV

SEQ ID NO: 3083173 - protein, 19 aa, Giardia lamblia
GDSVLACFIILFIYICGRD

SEQ ID NO: 3083174 - protein, 22 aa, Giardia lamblia
GECSPCTIAHCLDCKSDVATCN

SEQ ID NO: 3083175 - protein, 19 aa, Giardia lamblia
GELCFKGKMAVAGNYSGSL

SEQ ID NO: 3083176 - protein, 19 aa, Giardia lamblia
GELHYRIVLTVNKLCSENR

SEQ ID NO: 3083177 - protein, 20 aa, Giardia lamblia
GELKMGILAHIGRIFSGDVL

SEQ ID NO: 3083178 - protein, 17 aa, Giardia lamblia
GELPRVVTFGAIVALGL

SEQ ID NO: 3083179 - protein, 18 aa, Giardia lamblia
GELRIIVISVYFAMFPSL

SEQ ID NO: 3083180 - protein, 23 aa, Giardia lamblia
GELRVPSPLARYASMRPRASSVA

SEQ ID NO: 3083181 - protein, 18 aa, Giardia lamblia
GFCHRFLTVLSMKRSLRK

SEQ ID NO: 3083182 - protein, 19 aa, Giardia lamblia
GFGEATAFLLAIVGLILQT

SEQ ID NO: 3083183 - protein, 22 aa, Giardia lamblia
GFGLAIPRPRLTPNLREYPECI

SEQ ID NO: 3083184 - protein, 19 aa, Giardia lamblia
GFKSRRVCFVHFSRAISKC

SEQ ID NO: 3083185 - protein, 25 aa, Giardia lamblia
GFLIKWAHLPLCLSYGLQLMGQKSP

SEQ ID NO: 3083186 - protein, 22 aa, Giardia lamblia
GFLSIDFWKAFSHLVGNLLTGG

SEQ ID NO: 3083187 - protein, 24 aa, Giardia lamblia
GGRYVVLCGVEFLEESQLNGLINV

SEQ ID NO: 3083188 - protein, 24 aa, Giardia lamblia
GGTSAPEPFVWEVLSQMAYGLRDL

SEQ ID NO: 3083189 - protein, 22 aa, Giardia lamblia
GHADCLFHLFAEAFIRNRDGQL

SEQ ID NO: 3083190 - protein, 23 aa, Giardia lamblia
GHIFHAACLRRWMDETLQCPVDR

SEQ ID NO: 3083191 - protein, 19 aa, Giardia lamblia
GHYRIPWTHLTQFQVAKAP

SEQ ID NO: 3083192 - protein, 21 aa, Giardia lamblia
GIAGRVRYSFTFPDTTYVDNL

SEQ ID NO: 3083193 - protein, 17 aa, Giardia lamblia
GIFCSTCNVASPDLNSF

SEQ ID NO: 3083194 - protein, 21 aa, Giardia lamblia
GIKRLWLNESIICGDVRSDEE

SEQ ID NO: 3083195 - protein, 17 aa, Giardia lamblia
GILYFGVPIWVYYKLPI

SEQ ID NO: 3083196 - protein, 18 aa, Giardia lamblia
GINTRLSLQLSFNLVDKP

SEQ ID NO: 3083197 - protein, 20 aa, Giardia lamblia
GIVFRLWRVYTFIIRMYRHV

SEQ ID NO: 3083198 - protein, 18 aa, Giardia lamblia
GKFTEWLDILPFYNDISD

SEQ ID NO: 3083199 - protein, 23 aa, Giardia lamblia
GKSFLRRYAPAFSEIVETRVLPI

SEQ ID NO: 3083200 - protein, 18 aa, Giardia lamblia
GKSKRKSYVFPIETFMPP

SEQ ID NO: 3083201 - protein, 22 aa, Giardia lamblia
GLAEARLSLRTMDLQKLVSPQT

SEQ ID NO: 3083202 - protein, 18 aa, Giardia lamblia
GLDFDWQLLNGIRYTPLF

SEQ ID NO: 3083203 - protein, 21 aa, Giardia lamblia
GLGGILWAWAYRVLRAAFQFS

SEQ ID NO: 3083204 - protein, 25 aa, Giardia lamblia
GLGTAGLTCAIPFCRGPSQKCNDPK

SEQ ID NO: 3083205 - protein, 23 aa, Giardia lamblia
GLQRSAGILSEFGAYMATVMMDL

SEQ ID NO: 3083206 - protein, 24 aa, Giardia lamblia
GLVSCFFKWLCVSIFQGSVLLMFS

SEQ ID NO: 3083207 - protein, 17 aa, Giardia lamblia
GMCLRTIRYTQFVVFYA

SEQ ID NO: 3083208 - protein, 25 aa, Giardia lamblia
GMLVMICVLAWPALIVVIPTIILYA

SEQ ID NO: 3083209 - protein, 23 aa, Giardia lamblia
GMLWAMVCLIVFPLSLLPRIDFL

SEQ ID NO: 3083210 - protein, 18 aa, Giardia lamblia
GNCKPELALKMDVKCHDI

SEQ ID NO: 3083211 - protein, 23 aa, Giardia lamblia
GNGADFSVCFPIGDGIAGAVGLL

SEQ ID NO: 3083212 - protein, 19 aa, Giardia lamblia
GNVRIRLHLERNFSNLYIS

SEQ ID NO: 3083213 - protein, 22 aa, Giardia lamblia
GPGLSCLCKAAISCLSQLLLSS

SEQ ID NO: 3083214 - protein, 17 aa, Giardia lamblia
GPLRVWPGGLSVSRGIG

SEQ ID NO: 3083215 - protein, 23 aa, Giardia lamblia
GPNKLRLVMCVPEAQQTTRSLMY

SEQ ID NO: 3083216 - protein, 19 aa, Giardia lamblia
GQGEFALKCNDKLLVEYSG

SEQ ID NO: 3083217 - protein, 18 aa, Giardia lamblia
GQGLRYAPLVSQTKLRTQ

SEQ ID NO: 3083218 - protein, 22 aa, Giardia lamblia
GRASEIMMATALWSTVLTGALA

SEQ ID NO: 3083219 - protein, 18 aa, Giardia lamblia
GRASIYWSNTAPIVSLQS

SEQ ID NO: 3083220 - protein, 20 aa, Giardia lamblia
GRCRRCSKGYLLYYGGCYNT

SEQ ID NO: 3083221 - protein, 19 aa, Giardia lamblia
GRFLPDYIVKLGLLPKLKD

SEQ ID NO: 3083222 - protein, 21 aa, Giardia lamblia
GRISIEYSRYLLFRKSTVHSF

SEQ ID NO: 3083223 - protein, 23 aa, Giardia lamblia
GRLISFKTFCLWLLASIVISFMI

SEQ ID NO: 3083224 - protein, 19 aa, Giardia lamblia
GRLKYMLWLVFFYLGVAIT

SEQ ID NO: 3083225 - protein, 20 aa, Giardia lamblia
GRLNFLISRCDSIAKRILDL

SEQ ID NO: 3083226 - protein, 20 aa, Giardia lamblia
GRLPFLSPMPYRAARLSNVQ

SEQ ID NO: 3083227 - protein, 19 aa, Giardia lamblia
GRPVSEYSIAPVMNLSDSH

SEQ ID NO: 3083228 - protein, 24 aa, Giardia lamblia
GRSASCIRLDLLIQYARTEFLTKP

SEQ ID NO: 3083229 - protein, 19 aa, Giardia lamblia
GRSPILFVICRGKLAEGID

SEQ ID NO: 3083230 - protein, 17 aa, Giardia lamblia
GRTALMLAAIYGHADAC

SEQ ID NO: 3083231 - protein, 17 aa, Giardia lamblia
GRTGCPMIFGFLATLIE

SEQ ID NO: 3083232 - protein, 17 aa, Giardia lamblia
GRTGLMIAAERGYLGIM

SEQ ID NO: 3083233 - protein, 23 aa, Giardia lamblia
GSELRVAELLAMAKPRAPLDSPF

SEQ ID NO: 3083234 - protein, 17 aa, Giardia lamblia
GSFKRHRCTLPHELLEL

SEQ ID NO: 3083235 - protein, 19 aa, Giardia lamblia
GSICKAVTWALVHPDRMCC

SEQ ID NO: 3083236 - protein, 18 aa, Giardia lamblia
GSLLRWEVILIAVTLGIV

SEQ ID NO: 3083237 - protein, 18 aa, Giardia lamblia
GSRISFDLVQAMMSGNGV

SEQ ID NO: 3083238 - protein, 26 aa, Giardia lamblia
GSTNKCCYDIESIFSLGMPSDEKSFE

SEQ ID NO: 3083239 - protein, 18 aa, Giardia lamblia
GSVCKRLSIGFSLSLLDF

SEQ ID NO: 3083240 - protein, 18 aa, Giardia lamblia
GSVPRIFLPEAHAFKTGL

SEQ ID NO: 3083241 - protein, 18 aa, Giardia lamblia
GSWLDFNDKIFLSIQGVF

SEQ ID NO: 3083242 - protein, 18 aa, Giardia lamblia
GTEAWVIRNSWGEKWGDY

SEQ ID NO: 3083243 - protein, 19 aa, Giardia lamblia
GTILICYYFGIGSTSNRWL

SEQ ID NO: 3083244 - protein, 18 aa, Giardia lamblia
GTPPRLGQIFGCRCRPGF

SEQ ID NO: 3083245 - protein, 17 aa, Giardia lamblia
GTQRWRTIMKYKSRCKV

SEQ ID NO: 3083246 - protein, 22 aa, Giardia lamblia
GTRLCFIEKALALPLAIASELH

SEQ ID NO: 3083247 - protein, 26 aa, Giardia lamblia
GTVVRACFYTQIAIQWVQYMLYDSEC

SEQ ID NO: 3083248 - protein, 22 aa, Giardia lamblia
GTWPTVPVPQGFSLAKHITDTI

SEQ ID NO: 3083249 - protein, 19 aa, Giardia lamblia
GVCGWSCKGSCAGRTSCGI

SEQ ID NO: 3083250 - protein, 20 aa, Giardia lamblia
GVCLGPWLRKQASTFEETES

SEQ ID NO: 3083251 - protein, 18 aa, Giardia lamblia
GVFLKNWTLFCASFGGFL

SEQ ID NO: 3083252 - protein, 22 aa, Giardia lamblia
GVIRVFLSWDVEWFLRIAGGGY

SEQ ID NO: 3083253 - protein, 20 aa, Giardia lamblia
GVMLPCIFKLQSFSSGTTLN

SEQ ID NO: 3083254 - protein, 18 aa, Giardia lamblia
GVTGSLPYWKFVLATTCF

SEQ ID NO: 3083255 - protein, 18 aa, Giardia lamblia
GWIPASFLYFAFQTRTKH

SEQ ID NO: 3083256 - protein, 17 aa, Giardia lamblia
GWVVALFIMAFAFTYSL

SEQ ID NO: 3083257 - protein, 20 aa, Giardia lamblia
GYAELRLVYISNFPIKQVVV

SEQ ID NO: 3083258 - protein, 17 aa, Giardia lamblia
GYCGYGFFGDSKCMCLP

SEQ ID NO: 3083259 - protein, 18 aa, Giardia lamblia
GYIPFGRRLFVLKVVANE

SEQ ID NO: 3083260 - protein, 18 aa, Giardia lamblia
GYLECVQLIVKRQDLTPD

SEQ ID NO: 3083261 - protein, 26 aa, Giardia lamblia
GYTGYEFVAFKLLYPTGVYVYYIDGI

SEQ ID NO: 3083262 - protein, 25 aa, Giardia lamblia
HASQPAGFLFDWVMSIYGFLKIKAK

SEQ ID NO: 3083263 - protein, 18 aa, Giardia lamblia
HATRLSGLRYCFLNVAPG

SEQ ID NO: 3083264 - protein, 24 aa, Giardia lamblia
HCFCTLPLKIRRVIKDCLAVTLNH

SEQ ID NO: 3083265 - protein, 23 aa, Giardia lamblia
HCQQDRCSSCALAPSSFINPSSM

SEQ ID NO: 3083266 - protein, 21 aa, Giardia lamblia
HCSSCTIINLLYRTSDPVAAH

SEQ ID NO: 3083267 - protein, 17 aa, Giardia lamblia
HCVMYLDHHCPWVGTDV

SEQ ID NO: 3083268 - protein, 24 aa, Giardia lamblia
HDLLLKRYTKVIAELSELQKVSHG

SEQ ID NO: 3083269 - protein, 23 aa, Giardia lamblia
HDTRTKLAYAFQCLDDTNMIITD

SEQ ID NO: 3083270 - protein, 19 aa, Giardia lamblia
HDYCILCLTSMLLQDKHKE

SEQ ID NO: 3083271 - protein, 23 aa, Giardia lamblia
HELKELWLSDSFFSLKHCAFNGH

SEQ ID NO: 3083272 - protein, 19 aa, Giardia lamblia
HFLSLCYHADFTLVGDKRG

SEQ ID NO: 3083273 - protein, 21 aa, Giardia lamblia
HFLTCLAFILSIFYKINNGGF

SEQ ID NO: 3083274 - protein, 22 aa, Giardia lamblia
HFSPDDSYCWNRHLYPSQITST

SEQ ID NO: 3083275 - protein, 18 aa, Giardia lamblia
HIACSACLYHMYETRTRK

SEQ ID NO: 3083276 - protein, 17 aa, Giardia lamblia
HIARADSILGVFSDTIL

SEQ ID NO: 3083277 - protein, 22 aa, Giardia lamblia
HIHYKALYSYALFFTPAGNSPI

SEQ ID NO: 3083278 - protein, 23 aa, Giardia lamblia
HIYCYSCLKLWLTNSRESNCAMC

SEQ ID NO: 3083279 - protein, 19 aa, Giardia lamblia
HIYDMLIYFCRFGNTKKKF

SEQ ID NO: 3083280 - protein, 19 aa, Giardia lamblia
HIYRLYGLDFIRISVDGSV

SEQ ID NO: 3083281 - protein, 26 aa, Giardia lamblia
HKDKYKWVWLGLCVFLMLTRKWVYAV

SEQ ID NO: 3083282 - protein, 20 aa, Giardia lamblia
HKEVIGRVLGLFSELTAMQD

SEQ ID NO: 3083283 - protein, 19 aa, Giardia lamblia
HKMSRLSLHTHQRHHYGIR

SEQ ID NO: 3083284 - protein, 21 aa, Giardia lamblia
HKRFLFKTILELSSIIRDSFA

SEQ ID NO: 3083285 - protein, 20 aa, Giardia lamblia
HLKTRLDLLLTVRHQGMRLI

SEQ ID NO: 3083286 - protein, 17 aa, Giardia lamblia
HLLFPCLFPEPLSKPEV

SEQ ID NO: 3083287 - protein, 26 aa, Giardia lamblia
HLMVTWRRVELMSWNGFFSRVHTQFS

SEQ ID NO: 3083288 - protein, 23 aa, Giardia lamblia
HLRWKEAFALMVARSQVSLLTES

SEQ ID NO: 3083289 - protein, 18 aa, Giardia lamblia
HLSFYFKHVLAICSLGRF

SEQ ID NO: 3083290 - protein, 20 aa, Giardia lamblia
HLTIAWPSSIAFRTNPEENA

SEQ ID NO: 3083291 - protein, 21 aa, Giardia lamblia
HLTVACLRGILAFADETRYAR

SEQ ID NO: 3083292 - protein, 17 aa, Giardia lamblia
HNFIFLCVHYKMTNEIR

SEQ ID NO: 3083293 - protein, 18 aa, Giardia lamblia
HNIFPLRALFIMLLSRET

SEQ ID NO: 3083294 - protein, 20 aa, Giardia lamblia
HNYKAVSILAKWEGEKQDHN

SEQ ID NO: 3083295 - protein, 23 aa, Giardia lamblia
HPPGRAELFLALGEGFVDYVSLT

SEQ ID NO: 3083296 - protein, 19 aa, Giardia lamblia
HPTLSCALYCAVVANNLIA

SEQ ID NO: 3083297 - protein, 18 aa, Giardia lamblia
HQLIKAFEKGAVLGKYPL

SEQ ID NO: 3083298 - protein, 21 aa, Giardia lamblia
HRCYFRMVLVMLFIYDKYVLL

SEQ ID NO: 3083299 - protein, 22 aa, Giardia lamblia
HRGEDFCHLWAFYKNKELIEPL

SEQ ID NO: 3083300 - protein, 17 aa, Giardia lamblia
HRMQFVIYKIVSLTNSR

SEQ ID NO: 3083301 - protein, 18 aa, Giardia lamblia
HRTICAYDRLEILIERTH

SEQ ID NO: 3083302 - protein, 18 aa, Giardia lamblia
HSKMALGMALHFLTEGSD

SEQ ID NO: 3083303 - protein, 24 aa, Giardia lamblia
HSLFWPTCRWKVPPIDSLKGSTGW

SEQ ID NO: 3083304 - protein, 27 aa, Giardia lamblia
HSSCPSELTFLYPRPCIITCIKRLTDD

SEQ ID NO: 3083305 - protein, 22 aa, Giardia lamblia
HSVLKGGDWYSVHAYRSVNQAL

SEQ ID NO: 3083306 - protein, 17 aa, Giardia lamblia
HTFLRLLPVFGQSPSAD

SEQ ID NO: 3083307 - protein, 17 aa, Giardia lamblia
HTKLVVSLLQWLDDVSF

SEQ ID NO: 3083308 - protein, 17 aa, Giardia lamblia
HTSRLGGIIFWIADAVC

SEQ ID NO: 3083309 - protein, 23 aa, Giardia lamblia
HVDFLYRRAVLLMKREVVVAPLA

SEQ ID NO: 3083310 - protein, 23 aa, Giardia lamblia
HVSDCLWAYLILPLLHEIFIVNN

SEQ ID NO: 3083311 - protein, 19 aa, Giardia lamblia
HVTRFGAIMWQRNAIKLSV

SEQ ID NO: 3083312 - protein, 20 aa, Giardia lamblia
HVWRSLATLCIQNGYVDLLK

SEQ ID NO: 3083313 - protein, 19 aa, Giardia lamblia
HWYSLRPLWNVTEDVVKIG

SEQ ID NO: 3083314 - protein, 20 aa, Giardia lamblia
HYERLCTRFALLYLQVYTDF

SEQ ID NO: 3083315 - protein, 20 aa, Giardia lamblia
HYRDISLLLHQGWIIERVDS

SEQ ID NO: 3083316 - protein, 19 aa, Giardia lamblia
HYSFFDVLMTFSFNLSICV

SEQ ID NO: 3083317 - protein, 19 aa, Giardia lamblia
IAAALNLPLAVSMLVSHEK

SEQ ID NO: 3083318 - protein, 18 aa, Giardia lamblia
IACSAVSYPVMAKLNGLV

SEQ ID NO: 3083319 - protein, 18 aa, Giardia lamblia
IADRDGRVALHYCAEKNY

SEQ ID NO: 3083320 - protein, 18 aa, Giardia lamblia
IAFRGCDFILAMPLGCIF

SEQ ID NO: 3083321 - protein, 17 aa, Giardia lamblia
IAISIYISRVFARMKTA

SEQ ID NO: 3083322 - protein, 17 aa, Giardia lamblia
IALRTHKTFFFDHNMGV

SEQ ID NO: 3083323 - protein, 17 aa, Giardia lamblia
IALSKFLVTNSHFNNIK

SEQ ID NO: 3083324 - protein, 17 aa, Giardia lamblia
IAMPLSFYITSMQGRIT

SEQ ID NO: 3083325 - protein, 18 aa, Giardia lamblia
IAPSLAYLMLNRGFLRTT

SEQ ID NO: 3083326 - protein, 17 aa, Giardia lamblia
ICCSTALRKLRLLNKCD

SEQ ID NO: 3083327 - protein, 19 aa, Giardia lamblia
ICDCAFLAINLCDQEVQLE

SEQ ID NO: 3083328 - protein, 18 aa, Giardia lamblia
ICDIVRYVACTTVTSLLS

SEQ ID NO: 3083329 - protein, 17 aa, Giardia lamblia
ICECCKYTALMHAVEVD

SEQ ID NO: 3083330 - protein, 18 aa, Giardia lamblia
ICFTCLYFFTSLVLHTGV

SEQ ID NO: 3083331 - protein, 20 aa, Giardia lamblia
ICMYCVSWLFWAFFAGQIAN

SEQ ID NO: 3083332 - protein, 24 aa, Giardia lamblia
ICSISPRITYAWLVVTVLARYNTI

SEQ ID NO: 3083333 - protein, 17 aa, Giardia lamblia
ICTFCTRPDVAIVALEF

SEQ ID NO: 3083334 - protein, 18 aa, Giardia lamblia
ICTVCRMLKSFGGFGYIE

SEQ ID NO: 3083335 - protein, 18 aa, Giardia lamblia
IDAALDFRNVSIIAKYIK

SEQ ID NO: 3083336 - protein, 19 aa, Giardia lamblia
IDEDLLWAIMIQVLLALSY

SEQ ID NO: 3083337 - protein, 18 aa, Giardia lamblia
IDFRMKLNLTEQISLNMT

SEQ ID NO: 3083338 - protein, 19 aa, Giardia lamblia
IDLSNEFILLSGMAVGDQL

SEQ ID NO: 3083339 - protein, 19 aa, Giardia lamblia
IDPAWRWSDNSMMFINSYK

SEQ ID NO: 3083340 - protein, 22 aa, Giardia lamblia
IDQLGLACLVHLLRTLRDPPTI

SEQ ID NO: 3083341 - protein, 17 aa, Giardia lamblia
IDSATCLPFLSSLSDCL

SEQ ID NO: 3083342 - protein, 20 aa, Giardia lamblia
IDSSKIWLKYYKVITALAGC

SEQ ID NO: 3083343 - protein, 19 aa, Giardia lamblia
IDWFKNWPKAALMDVANSV

SEQ ID NO: 3083344 - protein, 24 aa, Giardia lamblia
IEDERRLRAAIAIRAPFYTTLLVE

SEQ ID NO: 3083345 - protein, 23 aa, Giardia lamblia
IEILSCLKHICIFAKSKHEVVWK

SEQ ID NO: 3083346 - protein, 25 aa, Giardia lamblia
IEMRKKLKILLGLKAFRGVKISSQT

SEQ ID NO: 3083347 - protein, 19 aa, Giardia lamblia
IENMRILISFCWPHKLVLE

SEQ ID NO: 3083348 - protein, 18 aa, Giardia lamblia
IFCVMVFSLPAWVDPGYL

SEQ ID NO: 3083349 - protein, 23 aa, Giardia lamblia
IFFICLACAFLISFVEGGATSLF

SEQ ID NO: 3083350 - protein, 19 aa, Giardia lamblia
IFFNFCGLSIILADELGDN

SEQ ID NO: 3083351 - protein, 19 aa, Giardia lamblia
IFLVSLIWLKGSSRVSEGI

SEQ ID NO: 3083352 - protein, 22 aa, Giardia lamblia
IFMPRLELIILLRIFSGYSASG

SEQ ID NO: 3083353 - protein, 24 aa, Giardia lamblia
IFTELKCVYLAISYYISNILQKME

SEQ ID NO: 3083354 - protein, 18 aa, Giardia lamblia
IFTGCRFATIALVLLFTI

SEQ ID NO: 3083355 - protein, 21 aa, Giardia lamblia
IFYKAVLAFEALAFIKNLNLS

SEQ ID NO: 3083356 - protein, 27 aa, Giardia lamblia
IGFWRAVLPFLRLFPIVRGYRCCHDPA

SEQ ID NO: 3083357 - protein, 21 aa, Giardia lamblia
IGGLHFEYAWPLMLTVGAFFV

SEQ ID NO: 3083358 - protein, 22 aa, Giardia lamblia
IGMVYPRIVYRLGTLTRTLVQF

SEQ ID NO: 3083359 - protein, 23 aa, Giardia lamblia
IHLDCLRSLWTFFQKGTVDVYND

SEQ ID NO: 3083360 - protein, 23 aa, Giardia lamblia
IHLVKGFPILAAMDMLYYAFKPQ

SEQ ID NO: 3083361 - protein, 23 aa, Giardia lamblia
IHMLTALHCPRIPQVIETFYAED

SEQ ID NO: 3083362 - protein, 19 aa, Giardia lamblia
IHTTLQFFICQVYTGSDVL

SEQ ID NO: 3083363 - protein, 19 aa, Giardia lamblia
IIAILCLLSGLNLVGIVMT

SEQ ID NO: 3083364 - protein, 18 aa, Giardia lamblia
IIDPRSGNFILRGVIHHK

SEQ ID NO: 3083365 - protein, 17 aa, Giardia lamblia
IIECDRFNTEIAQNAAL

SEQ ID NO: 3083366 - protein, 19 aa, Giardia lamblia
IIKEFFKTYVARGIIPRDD

SEQ ID NO: 3083367 - protein, 24 aa, Giardia lamblia
IILSRGRIPLLIWDMSNSKELNSV

SEQ ID NO: 3083368 - protein, 22 aa, Giardia lamblia
IIMHLVCLPPVFTDIKSPLKRT

SEQ ID NO: 3083369 - protein, 23 aa, Giardia lamblia
IITKARFSWMQVMFSCFATGFAI

SEQ ID NO: 3083370 - protein, 21 aa, Giardia lamblia
IITMIRLLRYHFLKVAQQLST

SEQ ID NO: 3083371 - protein, 17 aa, Giardia lamblia
IIVISVYFAMFPSLLRW

SEQ ID NO: 3083372 - protein, 21 aa, Giardia lamblia
IKAVDHLLCLLVNSAILVRET

SEQ ID NO: 3083373 - protein, 24 aa, Giardia lamblia
IKCERIIKIVLWSASVLFLGLSAL

SEQ ID NO: 3083374 - protein, 18 aa, Giardia lamblia
IKCTMTGCFACPSSPDIC

SEQ ID NO: 3083375 - protein, 17 aa, Giardia lamblia
IKFLLRILQFFSDESPT

SEQ ID NO: 3083376 - protein, 20 aa, Giardia lamblia
IKKVELSLCFYDESNRPLPS

SEQ ID NO: 3083377 - protein, 17 aa, Giardia lamblia
IKLFLTKVEEWMKMDKS

SEQ ID NO: 3083378 - protein, 20 aa, Giardia lamblia
IKPPELRNAIILETQLLLSF

SEQ ID NO: 3083379 - protein, 19 aa, Giardia lamblia
IKSISWLTRLIRLLIEEIT

SEQ ID NO: 3083380 - protein, 22 aa, Giardia lamblia
IKSLCAVMCSCLMLLLVPANAE

SEQ ID NO: 3083381 - protein, 17 aa, Giardia lamblia
IKTIYLYGGCAQWDSDT

SEQ ID NO: 3083382 - protein, 20 aa, Giardia lamblia
IKYVLCRLFTIILALDKNFP

SEQ ID NO: 3083383 - protein, 21 aa, Giardia lamblia
ILAAEYKYIWSNTVYLKARSS

SEQ ID NO: 3083384 - protein, 17 aa, Giardia lamblia
ILEILILLLRAVQVSQE

SEQ ID NO: 3083385 - protein, 17 aa, Giardia lamblia
ILEKAALERVFVPVYAS

SEQ ID NO: 3083386 - protein, 17 aa, Giardia lamblia
ILFCSFSPLLLAAPRFM

SEQ ID NO: 3083387 - protein, 17 aa, Giardia lamblia
ILFLRFALPLILVLVLY

SEQ ID NO: 3083388 - protein, 21 aa, Giardia lamblia
ILISFCWPHKLVLEASKGLNK

SEQ ID NO: 3083389 - protein, 17 aa, Giardia lamblia
ILIYVAFSIMLRASKQA

SEQ ID NO: 3083390 - protein, 22 aa, Giardia lamblia
ILKAWRYFVRFLYVYFTGKAKS

SEQ ID NO: 3083391 - protein, 17 aa, Giardia lamblia
ILKRSFCTHRSLSNYQF

SEQ ID NO: 3083392 - protein, 17 aa, Giardia lamblia
ILLASLFLDRVARARIP

SEQ ID NO: 3083393 - protein, 25 aa, Giardia lamblia
ILLEFRAGNLLDLWVLAEKQRYNVH

SEQ ID NO: 3083394 - protein, 19 aa, Giardia lamblia
ILLPDGRNAMMMAAGYGAH

SEQ ID NO: 3083395 - protein, 24 aa, Giardia lamblia
ILLQYIKFGFKFLFVTSDLARIII

SEQ ID NO: 3083396 - protein, 18 aa, Giardia lamblia
ILLTRLYVIFKRLINFKN

SEQ ID NO: 3083397 - protein, 22 aa, Giardia lamblia
ILLWYCETMMPLSLIYDITPEI

SEQ ID NO: 3083398 - protein, 17 aa, Giardia lamblia
ILMCKNITLGYGLATAS

SEQ ID NO: 3083399 - protein, 26 aa, Giardia lamblia
ILMLLKGFRIPWSMGDPAMLGLYSVA

SEQ ID NO: 3083400 - protein, 22 aa, Giardia lamblia
ILNGFCPIIFEMCKNIPTGSIP

SEQ ID NO: 3083401 - protein, 19 aa, Giardia lamblia
ILPIFFKLKIKYHKQLEKV

SEQ ID NO: 3083402 - protein, 19 aa, Giardia lamblia
ILRMKVLIHLARMLFPVHL

SEQ ID NO: 3083403 - protein, 17 aa, Giardia lamblia
ILRRTGLTWTNLNFANF

SEQ ID NO: 3083404 - protein, 17 aa, Giardia lamblia
ILSTFALLVSRCAGIFA

SEQ ID NO: 3083405 - protein, 26 aa, Giardia lamblia
ILTVICWLMGFYLYRRFIKSFEACTM

SEQ ID NO: 3083406 - protein, 19 aa, Giardia lamblia
ILVGLKIPVLKARREYMEA

SEQ ID NO: 3083407 - protein, 17 aa, Giardia lamblia
ILVPICFASPYKHLSSF

SEQ ID NO: 3083408 - protein, 18 aa, Giardia lamblia
IMAGLRGAISFALSTALV

SEQ ID NO: 3083409 - protein, 18 aa, Giardia lamblia
IMNCKLEYSKSWRGQIAA

SEQ ID NO: 3083410 - protein, 18 aa, Giardia lamblia
IMRLCAFLSLAEWLSLRG

SEQ ID NO: 3083411 - protein, 23 aa, Giardia lamblia
INFSSEVFLNFIASYPVQVISVV

SEQ ID NO: 3083412 - protein, 20 aa, Giardia lamblia
INIFAAIVLYDFPLGERSQL

SEQ ID NO: 3083413 - protein, 18 aa, Giardia lamblia
INIKIIWRILLFAIPQWF

SEQ ID NO: 3083414 - protein, 18 aa, Giardia lamblia
INLVDFCLFYVLRELHPD

SEQ ID NO: 3083415 - protein, 17 aa, Giardia lamblia
INPRFYINFIMYDTTLM

SEQ ID NO: 3083416 - protein, 17 aa, Giardia lamblia
INRCCPHVLPYMGEYES

SEQ ID NO: 3083417 - protein, 25 aa, Giardia lamblia
INTNCKCIACYKCAKTHLLDSMVQA

SEQ ID NO: 3083418 - protein, 19 aa, Giardia lamblia
IPAYFPLAGYEMYRPYVQR

SEQ ID NO: 3083419 - protein, 22 aa, Giardia lamblia
IPCPVCAATGLLTVVQRPLLSV

SEQ ID NO: 3083420 - protein, 18 aa, Giardia lamblia
IPCQGCFLLTSGFLGCVM

SEQ ID NO: 3083421 - protein, 24 aa, Giardia lamblia
IPDCKELLKVFAYHLVVSFMFTFD

SEQ ID NO: 3083422 - protein, 20 aa, Giardia lamblia
IPEDVWLRYRLCILSFTFND

SEQ ID NO: 3083423 - protein, 19 aa, Giardia lamblia
IPFGIGFQGSLSFGFTEKY

SEQ ID NO: 3083424 - protein, 19 aa, Giardia lamblia
IPGTFCFLGYCLMPLAAYT

SEQ ID NO: 3083425 - protein, 18 aa, Giardia lamblia
IPILRVGFLFTYLAPLVL

SEQ ID NO: 3083426 - protein, 24 aa, Giardia lamblia
IPIWTIKAHKDWVTCLCLDTVTSN

SEQ ID NO: 3083427 - protein, 20 aa, Giardia lamblia
IPKKIKIYIDREMDFNRVLY

SEQ ID NO: 3083428 - protein, 18 aa, Giardia lamblia
IPLAFAFAMAFKSVFSAA

SEQ ID NO: 3083429 - protein, 20 aa, Giardia lamblia
IPLFPRLVLASSFSATTARA

SEQ ID NO: 3083430 - protein, 24 aa, Giardia lamblia
IPLHGGLGFSFRRLFPLNGKVLLR

SEQ ID NO: 3083431 - protein, 18 aa, Giardia lamblia
IPLLFSITACLFAKFPSR

SEQ ID NO: 3083432 - protein, 24 aa, Giardia lamblia
IPPLLCIFGMLFARPMITMLTPKM

SEQ ID NO: 3083433 - protein, 21 aa, Giardia lamblia
IPQEIICFILSFYRRSQLSVR

SEQ ID NO: 3083434 - protein, 20 aa, Giardia lamblia
IPRLVDYSINFACVTSLLAV

SEQ ID NO: 3083435 - protein, 22 aa, Giardia lamblia
IPVDFPGCWDLILQNKTSLKKS

SEQ ID NO: 3083436 - protein, 21 aa, Giardia lamblia
IPVLPCSLFLPVLYMAETLRH

SEQ ID NO: 3083437 - protein, 20 aa, Giardia lamblia
IPYANPWSDLTLRKSVSERP

SEQ ID NO: 3083438 - protein, 17 aa, Giardia lamblia
IPYKWRLLIIMFNVFLP

SEQ ID NO: 3083439 - protein, 17 aa, Giardia lamblia
IQAEFRKAIILLLNEQY

SEQ ID NO: 3083440 - protein, 18 aa, Giardia lamblia
IQELRLCYRAMIDDNSTS

SEQ ID NO: 3083441 - protein, 22 aa, Giardia lamblia
IQHLCRIVHAYFKTIFGFTQSP

SEQ ID NO: 3083442 - protein, 17 aa, Giardia lamblia
IRARFIFQDDTKVDLLN

SEQ ID NO: 3083443 - protein, 18 aa, Giardia lamblia
IRCNPAFFTCFTYCNQNY

SEQ ID NO: 3083444 - protein, 17 aa, Giardia lamblia
IRIQKHIRENHLLALSE

SEQ ID NO: 3083445 - protein, 17 aa, Giardia lamblia
IRIYLPISLVIPHPSLR

SEQ ID NO: 3083446 - protein, 19 aa, Giardia lamblia
IRKSFLWELEKRFYTQTFK

SEQ ID NO: 3083447 - protein, 20 aa, Giardia lamblia
IRLLYAFVVALSFAIIMFPI

SEQ ID NO: 3083448 - protein, 17 aa, Giardia lamblia
IRLSTCTVYLELLRGLN

SEQ ID NO: 3083449 - protein, 26 aa, Giardia lamblia
IRPQGMFPRLVFWVVHENMHYQCVGI

SEQ ID NO: 3083450 - protein, 18 aa, Giardia lamblia
IRPSIKLGLQSAVEIELL

SEQ ID NO: 3083451 - protein, 18 aa, Giardia lamblia
IRSTLKWQLGAFRNMCIG

SEQ ID NO: 3083452 - protein, 19 aa, Giardia lamblia
IRTCLCFYSQLTAEGITPK

SEQ ID NO: 3083453 - protein, 20 aa, Giardia lamblia
IRYRLRFRNLLLYNSIVFDT

SEQ ID NO: 3083454 - protein, 17 aa, Giardia lamblia
IRYYLSFFHIPGESQQI

SEQ ID NO: 3083455 - protein, 17 aa, Giardia lamblia
ISALRLIYVLVFLPTVY

SEQ ID NO: 3083456 - protein, 19 aa, Giardia lamblia
ISAPCWVNSYILIYKDYFS

SEQ ID NO: 3083457 - protein, 17 aa, Giardia lamblia
ISAPGWKGAHGANMVSV

SEQ ID NO: 3083458 - protein, 20 aa, Giardia lamblia
ISASDMVKWARRIDLDLKNG

SEQ ID NO: 3083459 - protein, 17 aa, Giardia lamblia
ISASLSWYVQYYSDILA

SEQ ID NO: 3083460 - protein, 25 aa, Giardia lamblia
ISAYKCMLAMLISYILFIFAHASSG

SEQ ID NO: 3083461 - protein, 18 aa, Giardia lamblia
ISCSIIILSVIGIIITAI

SEQ ID NO: 3083462 - protein, 20 aa, Giardia lamblia
ISELERFAFKYSYPNHELLD

SEQ ID NO: 3083463 - protein, 17 aa, Giardia lamblia
ISFSPVFLIVEEDDPVL

SEQ ID NO: 3083464 - protein, 20 aa, Giardia lamblia
ISIMLHFSWETCLKTVIDPD

SEQ ID NO: 3083465 - protein, 21 aa, Giardia lamblia
ISNSLFAVWSFLPSQKGMKDD

SEQ ID NO: 3083466 - protein, 18 aa, Giardia lamblia
ISRFLRRNSLIFSVVNQT

SEQ ID NO: 3083467 - protein, 21 aa, Giardia lamblia
ISRLRLADIFHRNLPAYCEGL

SEQ ID NO: 3083468 - protein, 21 aa, Giardia lamblia
ISRNRFWGCPIPIWMSADKTQ

SEQ ID NO: 3083469 - protein, 17 aa, Giardia lamblia
ISSIPPLKCSVNLAEVN

SEQ ID NO: 3083470 - protein, 19 aa, Giardia lamblia
ISTTCLLPLFKRYAFGDPH

SEQ ID NO: 3083471 - protein, 17 aa, Giardia lamblia
ISVKFMALWLINSVPIH

SEQ ID NO: 3083472 - protein, 21 aa, Giardia lamblia
ISVLKCCPCAAVKKLYDRTKA

SEQ ID NO: 3083473 - protein, 20 aa, Giardia lamblia
ISYNRLILFYVRQFIFGLAW

SEQ ID NO: 3083474 - protein, 17 aa, Giardia lamblia
ITAIAPDFAVVLTEVSP

SEQ ID NO: 3083475 - protein, 20 aa, Giardia lamblia
ITGCKKCALKTLSGEAESTV

SEQ ID NO: 3083476 - protein, 24 aa, Giardia lamblia
ITIKEIRSFPGLRSMAFTESADIL

SEQ ID NO: 3083477 - protein, 17 aa, Giardia lamblia
ITISVKWGALSKTCPAF

SEQ ID NO: 3083478 - protein, 17 aa, Giardia lamblia
ITLLELWFLPTASDNLS

SEQ ID NO: 3083479 - protein, 20 aa, Giardia lamblia
ITMLTPKMGMLWGETASKEM

SEQ ID NO: 3083480 - protein, 18 aa, Giardia lamblia
ITRRRSEILGAQPSNSFD

SEQ ID NO: 3083481 - protein, 20 aa, Giardia lamblia
ITTLLRRLESFCARIGTTSM

SEQ ID NO: 3083482 - protein, 17 aa, Giardia lamblia
IVALKLVDQLAMPDTSN

SEQ ID NO: 3083483 - protein, 18 aa, Giardia lamblia
IVELLAPHECSFIRHDNM

SEQ ID NO: 3083484 - protein, 18 aa, Giardia lamblia
IVEMLSLTAHDKLNCNRN

SEQ ID NO: 3083485 - protein, 22 aa, Giardia lamblia
IVERMGRRFLLFLGTFILTAML

SEQ ID NO: 3083486 - protein, 17 aa, Giardia lamblia
IVFNFLISRIFKEDYVT

SEQ ID NO: 3083487 - protein, 23 aa, Giardia lamblia
IVFSNLCLICFIGCLITVQTTAV

SEQ ID NO: 3083488 - protein, 21 aa, Giardia lamblia
IVGGGAFMLLSFVSSVGILSL

SEQ ID NO: 3083489 - protein, 21 aa, Giardia lamblia
IVGYCEIDFTFVFNNDEEATL

SEQ ID NO: 3083490 - protein, 22 aa, Giardia lamblia
IVKPCPSTLCSLRARANKNAII

SEQ ID NO: 3083491 - protein, 17 aa, Giardia lamblia
IWAPCIFCCNLCITLTL

SEQ ID NO: 3083492 - protein, 18 aa, Giardia lamblia
IYAGVRWNNFLAMTSNAE

SEQ ID NO: 3083493 - protein, 18 aa, Giardia lamblia
IYPHYSFECNMDFLMIIT

SEQ ID NO: 3083494 - protein, 21 aa, Giardia lamblia
IYPQWSVFILLLFHGADRDMR

SEQ ID NO: 3083495 - protein, 18 aa, Giardia lamblia
IYRKFCYSHFMVWFTELD

SEQ ID NO: 3083496 - protein, 17 aa, Giardia lamblia
IYSDMYWELRVDIYQSV

SEQ ID NO: 3083497 - protein, 20 aa, Giardia lamblia
IYVTEPWFDYGYWKDRTQYH

SEQ ID NO: 3083498 - protein, 19 aa, Giardia lamblia
IYWNARKAIFYSYYPYLPY

SEQ ID NO: 3083499 - protein, 19 aa, Giardia lamblia
KADLPSFVFKHFAQCSQPY

SEQ ID NO: 3083500 - protein, 19 aa, Giardia lamblia
KAGGVTVEFSVTNNFPYGK

SEQ ID NO: 3083501 - protein, 20 aa, Giardia lamblia
KAHGLKESFTYLQAFIRCFL

SEQ ID NO: 3083502 - protein, 17 aa, Giardia lamblia
KAHHKPHLCIRVMFYTT

SEQ ID NO: 3083503 - protein, 26 aa, Giardia lamblia
KAKAMWKRLFYAIVFFHGILLERRKF

SEQ ID NO: 3083504 - protein, 23 aa, Giardia lamblia
KALADCPCCAVELGSDVTLSENW

SEQ ID NO: 3083505 - protein, 18 aa, Giardia lamblia
KASARFAYRISQAQSAPA

SEQ ID NO: 3083506 - protein, 22 aa, Giardia lamblia
KASLRYTDWYSCARRLMASYWN

SEQ ID NO: 3083507 - protein, 18 aa, Giardia lamblia
KASWLRRIFHTNLSLLSG

SEQ ID NO: 3083508 - protein, 17 aa, Giardia lamblia
KATCSSMIAELGYVLNQ

SEQ ID NO: 3083509 - protein, 17 aa, Giardia lamblia
KCFYALPVVLQRVMSNV

SEQ ID NO: 3083510 - protein, 19 aa, Giardia lamblia
KCHVLAFFLFLGVMLSIIA

SEQ ID NO: 3083511 - protein, 19 aa, Giardia lamblia
KCKLALELTDSVPMRIITA

SEQ ID NO: 3083512 - protein, 17 aa, Giardia lamblia
KCVNLYYMGGLERAIHL

SEQ ID NO: 3083513 - protein, 22 aa, Giardia lamblia
KCVPCPKGTWGPRCSTRKCWFT

SEQ ID NO: 3083514 - protein, 23 aa, Giardia lamblia
KCVPCPKGTWGPRCSTRKCWLTT

SEQ ID NO: 3083515 - protein, 17 aa, Giardia lamblia
KCYKSVIVQVYFGVLAV

SEQ ID NO: 3083516 - protein, 24 aa, Giardia lamblia
KDCLLCDGRDALMLAAQVGNTSAV

SEQ ID NO: 3083517 - protein, 23 aa, Giardia lamblia
KDDLLRKRMEAIPTSSSTIYPQG

SEQ ID NO: 3083518 - protein, 19 aa, Giardia lamblia
KDFIKRFYSFVGNLNVDRF

SEQ ID NO: 3083519 - protein, 19 aa, Giardia lamblia
KDIELILSVVFGYKINVLS

SEQ ID NO: 3083520 - protein, 17 aa, Giardia lamblia
KDVYSFKCTPSNSFNLL

SEQ ID NO: 3083521 - protein, 19 aa, Giardia lamblia
KEEIERLIAMRKKNEKLLQ

SEQ ID NO: 3083522 - protein, 23 aa, Giardia lamblia
KEGRTALMFAAWNGYTDCVKLLK

SEQ ID NO: 3083523 - protein, 20 aa, Giardia lamblia
KEHPCVVAIVLNKGGHLGTL

SEQ ID NO: 3083524 - protein, 22 aa, Giardia lamblia
KEIIIKCSMSYHQARLYKTVQQ

SEQ ID NO: 3083525 - protein, 19 aa, Giardia lamblia
KELLKLLVLHIDDSVSEIS

SEQ ID NO: 3083526 - protein, 17 aa, Giardia lamblia
KEMREFAECYTLDGKSV

SEQ ID NO: 3083527 - protein, 23 aa, Giardia lamblia
KENEYKAALLLPPFEVYKPMLNR

SEQ ID NO: 3083528 - protein, 17 aa, Giardia lamblia
KERRWNYDKVWANSDDT

SEQ ID NO: 3083529 - protein, 19 aa, Giardia lamblia
KESRVPLSLLFVFLTGVGS

SEQ ID NO: 3083530 - protein, 18 aa, Giardia lamblia
KFCGIKWLPAKHAVKNLS

SEQ ID NO: 3083531 - protein, 25 aa, Giardia lamblia
KFERMFCYFVILGLCALLFSQWIVN

SEQ ID NO: 3083532 - protein, 18 aa, Giardia lamblia
KFETCLTLQYILENRTTV

SEQ ID NO: 3083533 - protein, 23 aa, Giardia lamblia
KFLARLRALILIFNHIDITRVNK

SEQ ID NO: 3083534 - protein, 21 aa, Giardia lamblia
KFRFLPEYFKKFTSSEKATVI

SEQ ID NO: 3083535 - protein, 20 aa, Giardia lamblia
KFSSWRKYALFRSCYNSCNF

SEQ ID NO: 3083536 - protein, 25 aa, Giardia lamblia
KFSYAYRTYFKLAFPEDTYLESLFR

SEQ ID NO: 3083537 - protein, 18 aa, Giardia lamblia
KGAFSVRTIMHFGQCISA

SEQ ID NO: 3083538 - protein, 18 aa, Giardia lamblia
KGFCSRFKDRLERDFGTK

SEQ ID NO: 3083539 - protein, 27 aa, Giardia lamblia
KGGLKFSTKRLFPLNGRILLKVFLIGM

SEQ ID NO: 3083540 - protein, 18 aa, Giardia lamblia
KGLPQSFINRFLNVYVDV

SEQ ID NO: 3083541 - protein, 19 aa, Giardia lamblia
KGPLYLRMRVLKLSIIIAM

SEQ ID NO: 3083542 - protein, 24 aa, Giardia lamblia
KGSHAFRYLPILARDLMLDNVYPV

SEQ ID NO: 3083543 - protein, 27 aa, Giardia lamblia
KGYCVPKCFRWLFDIDWSTDQDLMTPS

SEQ ID NO: 3083544 - protein, 27 aa, Giardia lamblia
KGYCVPKCFRWLFDIDWSTDQELMTPS

SEQ ID NO: 3083545 - protein, 23 aa, Giardia lamblia
KHLCASCLDGLISEVVYLNDKGT

SEQ ID NO: 3083546 - protein, 19 aa, Giardia lamblia
KHLQCSKAYLKHLPNAVQF

SEQ ID NO: 3083547 - protein, 22 aa, Giardia lamblia
KHMQRLPAPLIYYSISIAIMAV

SEQ ID NO: 3083548 - protein, 21 aa, Giardia lamblia
KHSLCGTPIYTSRDISDKKGG

SEQ ID NO: 3083549 - protein, 18 aa, Giardia lamblia
KIAECFYAPLSVVSLAGL

SEQ ID NO: 3083550 - protein, 20 aa, Giardia lamblia
KIAYSIRKSFLWELEKRFYT

SEQ ID NO: 3083551 - protein, 17 aa, Giardia lamblia
KIDGVRCACFLRHKPGL

SEQ ID NO: 3083552 - protein, 17 aa, Giardia lamblia
KIESWPHYGVSYRVCPN

SEQ ID NO: 3083553 - protein, 21 aa, Giardia lamblia
KIKEIKGLLLFGNHEQEFPLL

SEQ ID NO: 3083554 - protein, 23 aa, Giardia lamblia
KIVHLRARLLYHYNHLEYVRCKM

SEQ ID NO: 3083555 - protein, 22 aa, Giardia lamblia
KKEFTERLLLCLRKRLSTKYFR

SEQ ID NO: 3083556 - protein, 17 aa, Giardia lamblia
KKFRMMHDPSFILRGTH

SEQ ID NO: 3083557 - protein, 23 aa, Giardia lamblia
KKKVAAKVPVWQRLISPAMMLVS

SEQ ID NO: 3083558 - protein, 18 aa, Giardia lamblia
KKKVEHMGLFKAPNLAER

SEQ ID NO: 3083559 - protein, 24 aa, Giardia lamblia
KKQLAMCYCFLPFAYIQSDEKEVF

SEQ ID NO: 3083560 - protein, 18 aa, Giardia lamblia
KKRFCMHENLAAGDEVSG

SEQ ID NO: 3083561 - protein, 19 aa, Giardia lamblia
KKRIVGLTLLLFVALLIFG

SEQ ID NO: 3083562 - protein, 19 aa, Giardia lamblia
KKRPCLWCASKPTSNGITM

SEQ ID NO: 3083563 - protein, 25 aa, Giardia lamblia
KKSNKCLCCTIIFSILGLAILILIT

SEQ ID NO: 3083564 - protein, 19 aa, Giardia lamblia
KKTRIAMEVEMGELALEKD

SEQ ID NO: 3083565 - protein, 17 aa, Giardia lamblia
KKWIVGGFCGLVANSQI

SEQ ID NO: 3083566 - protein, 19 aa, Giardia lamblia
KKWKNWKAWMAIDKLLNDL

SEQ ID NO: 3083567 - protein, 17 aa, Giardia lamblia
KLAEHWVEQDAFKKESS

SEQ ID NO: 3083568 - protein, 20 aa, Giardia lamblia
KLEKGDCGTVTFGLECTAIA

SEQ ID NO: 3083569 - protein, 21 aa, Giardia lamblia
KLGVIFPFVMLKNHQTTASDD

SEQ ID NO: 3083570 - protein, 23 aa, Giardia lamblia
KLIHAFLQLCDFARDTSQAHDSS

SEQ ID NO: 3083571 - protein, 24 aa, Giardia lamblia
KLLADESLCLSSLISESILDGKLP

SEQ ID NO: 3083572 - protein, 19 aa, Giardia lamblia
KLLIPRPGDTVLYLRHSAL

SEQ ID NO: 3083573 - protein, 18 aa, Giardia lamblia
KLPLLFPSGCHKAKHIWG

SEQ ID NO: 3083574 - protein, 18 aa, Giardia lamblia
KLQWALLHRICISIRGAV

SEQ ID NO: 3083575 - protein, 19 aa, Giardia lamblia
KLYLEMCLQYPIFHQLLST

SEQ ID NO: 3083576 - protein, 18 aa, Giardia lamblia
KNAVIGICSAASTLSEYI

SEQ ID NO: 3083577 - protein, 21 aa, Giardia lamblia
KNDIRSVITFDLMLPLSTSTI

SEQ ID NO: 3083578 - protein, 23 aa, Giardia lamblia
KNELKYSPKRGFISAGAEQLITV

SEQ ID NO: 3083579 - protein, 23 aa, Giardia lamblia
KNPEIMGALPKYAVRTIMALLCE

SEQ ID NO: 3083580 - protein, 20 aa, Giardia lamblia
KPAPLRPGLLYGTESNPLSA

SEQ ID NO: 3083581 - protein, 18 aa, Giardia lamblia
KPCFPFVYTTSATPFNSR

SEQ ID NO: 3083582 - protein, 24 aa, Giardia lamblia
KPDDNAWCAQAFPLGLSYNHCAAH

SEQ ID NO: 3083583 - protein, 19 aa, Giardia lamblia
KPEEAWRGLPWNFLCSRSF

SEQ ID NO: 3083584 - protein, 17 aa, Giardia lamblia
KPLELFEVILLAYLFYY

SEQ ID NO: 3083585 - protein, 20 aa, Giardia lamblia
KPRGWLRYSTSAFKWPLFKP

SEQ ID NO: 3083586 - protein, 20 aa, Giardia lamblia
KPRVLKLLLQRGYSLSVSGD

SEQ ID NO: 3083587 - protein, 18 aa, Giardia lamblia
KPTDLRKFISFHYKSFLK

SEQ ID NO: 3083588 - protein, 20 aa, Giardia lamblia
KQCYCAPEILLHLQYSDKSE

SEQ ID NO: 3083589 - protein, 17 aa, Giardia lamblia
KQWRSNFNFTFSKAEGG

SEQ ID NO: 3083590 - protein, 21 aa, Giardia lamblia
KQYERFLRINIALNMFMNRAV

SEQ ID NO: 3083591 - protein, 18 aa, Giardia lamblia
KRAIPWLDLILLLETSIS

SEQ ID NO: 3083592 - protein, 19 aa, Giardia lamblia
KRCSMEWTALMWAAKFGDV

SEQ ID NO: 3083593 - protein, 18 aa, Giardia lamblia
KRDMQTFLALPLFVYMSE

SEQ ID NO: 3083594 - protein, 19 aa, Giardia lamblia
KRFPNLWTEEKIVQLMLDA

SEQ ID NO: 3083595 - protein, 19 aa, Giardia lamblia
KRFRLVMRSIFLVLLLSLF

SEQ ID NO: 3083596 - protein, 17 aa, Giardia lamblia
KRFVLIHVVFAYFDDWL

SEQ ID NO: 3083597 - protein, 20 aa, Giardia lamblia
KRLDRFFAMKYYVSAKPFRS

SEQ ID NO: 3083598 - protein, 19 aa, Giardia lamblia
KRLRLGSKLFGAFITCLTD

SEQ ID NO: 3083599 - protein, 18 aa, Giardia lamblia
KRPDVLIDIVFWSVGVGS

SEQ ID NO: 3083600 - protein, 19 aa, Giardia lamblia
KRPPLYVFKFYMAMEKYGD

SEQ ID NO: 3083601 - protein, 20 aa, Giardia lamblia
KRPSAQFVAMCCRLAQTSEA

SEQ ID NO: 3083602 - protein, 17 aa, Giardia lamblia
KRRRGTLFPEYAFNRAF

SEQ ID NO: 3083603 - protein, 25 aa, Giardia lamblia
KRSFIPWKVIEGLIYLMVITIFFSL

SEQ ID NO: 3083604 - protein, 21 aa, Giardia lamblia
KRSIVTLTFWFRVVLGACAAV

SEQ ID NO: 3083605 - protein, 24 aa, Giardia lamblia
KSENIFLIAIRYYLSFFHIPGESQ

SEQ ID NO: 3083606 - protein, 22 aa, Giardia lamblia
KSFFLNHIIRVMAIDFPTYIIL

SEQ ID NO: 3083607 - protein, 17 aa, Giardia lamblia
KSFKYPVVFVDSYHIVI

SEQ ID NO: 3083608 - protein, 25 aa, Giardia lamblia
KSIAKRYVEFHAMAFLKPSESVFYR

SEQ ID NO: 3083609 - protein, 20 aa, Giardia lamblia
KSLRDMGHMLPLYQEIYEVY

SEQ ID NO: 3083610 - protein, 22 aa, Giardia lamblia
KSNEFMLQILLRPSYSLQAKYL

SEQ ID NO: 3083611 - protein, 21 aa, Giardia lamblia
KSNRHAFHWNRNVFPGCGEGL

SEQ ID NO: 3083612 - protein, 19 aa, Giardia lamblia
KSSFISVLCEFIRLTPEKE

SEQ ID NO: 3083613 - protein, 18 aa, Giardia lamblia
KTDFGGIILLSFAYIVSS

SEQ ID NO: 3083614 - protein, 19 aa, Giardia lamblia
KTECWGRGYCLLDFGGGNC

SEQ ID NO: 3083615 - protein, 18 aa, Giardia lamblia
KTFEILNNIVLDFVQVLE

SEQ ID NO: 3083616 - protein, 26 aa, Giardia lamblia
KTKVPASVCILTFIFLIIVWSSKAFC

SEQ ID NO: 3083617 - protein, 17 aa, Giardia lamblia
KTLFKFILKQPIGGGLL

SEQ ID NO: 3083618 - protein, 20 aa, Giardia lamblia
KTLRGGRGFALGTGASGARG

SEQ ID NO: 3083619 - protein, 19 aa, Giardia lamblia
KTRCAGCSLCCNGCVVCWV

SEQ ID NO: 3083620 - protein, 17 aa, Giardia lamblia
KTSCLACSVGSYQGLQG

SEQ ID NO: 3083621 - protein, 21 aa, Giardia lamblia
KVLNSHLGFKCQYCTTDKSSV

SEQ ID NO: 3083622 - protein, 19 aa, Giardia lamblia
KVQLICFFGLLLPLFLVCT

SEQ ID NO: 3083623 - protein, 18 aa, Giardia lamblia
KVSPDILGSIVFTEDSEQ

SEQ ID NO: 3083624 - protein, 23 aa, Giardia lamblia
KVSSCCLTFCIQRIMILLSTASA

SEQ ID NO: 3083625 - protein, 17 aa, Giardia lamblia
KVSVDWPLFHHTFMVAS

SEQ ID NO: 3083626 - protein, 17 aa, Giardia lamblia
KYFVHKHVEAFSGVDKE

SEQ ID NO: 3083627 - protein, 18 aa, Giardia lamblia
KYISYWPVIAIFMASCLV

SEQ ID NO: 3083628 - protein, 25 aa, Giardia lamblia
KYLLPMVFCPFYMRRQRKFSIWFLD

SEQ ID NO: 3083629 - protein, 20 aa, Giardia lamblia
KYLRYLWFLAQSYRDKVLCM

SEQ ID NO: 3083630 - protein, 21 aa, Giardia lamblia
KYPCCYKKPDPFVFNWKLFLG

SEQ ID NO: 3083631 - protein, 23 aa, Giardia lamblia
KYVDGRTALMWGAFTGHLDCAKA

SEQ ID NO: 3083632 - protein, 17 aa, Giardia lamblia
LAADIAFEFQCQALEEN

SEQ ID NO: 3083633 - protein, 18 aa, Giardia lamblia
LACTAPGPGRCTRCPSDK

SEQ ID NO: 3083634 - protein, 17 aa, Giardia lamblia
LADARFILGNIVDENKF

SEQ ID NO: 3083635 - protein, 17 aa, Giardia lamblia
LADAVHDLSCRRMYYAN

SEQ ID NO: 3083636 - protein, 19 aa, Giardia lamblia
LAIACYYYAPFNPIKIKSI

SEQ ID NO: 3083637 - protein, 24 aa, Giardia lamblia
LAKNRPKCFLSYPSMPCFNDELNV

SEQ ID NO: 3083638 - protein, 18 aa, Giardia lamblia
LALANARLKAGMVQEALT

SEQ ID NO: 3083639 - protein, 18 aa, Giardia lamblia
LALCSLYFYTTHFTRRYT

SEQ ID NO: 3083640 - protein, 19 aa, Giardia lamblia
LALLCPCVNYLDILEHELS

SEQ ID NO: 3083641 - protein, 26 aa, Giardia lamblia
LASNKCMLCVMMVICIIVLIVSIVDL

SEQ ID NO: 3083642 - protein, 17 aa, Giardia lamblia
LATAFMLLFPLASFTLG

SEQ ID NO: 3083643 - protein, 17 aa, Giardia lamblia
LATIALFIEFVYLSSCP

SEQ ID NO: 3083644 - protein, 19 aa, Giardia lamblia
LAVIFSFWGYRQIIDACTY

SEQ ID NO: 3083645 - protein, 20 aa, Giardia lamblia
LAVYSLRCRIALKDPATTVD

SEQ ID NO: 3083646 - protein, 22 aa, Giardia lamblia
LAYFEFVVWWALVTKLKFLDDA

SEQ ID NO: 3083647 - protein, 17 aa, Giardia lamblia
LAYLPGYMDTVLSYHTN

SEQ ID NO: 3083648 - protein, 18 aa, Giardia lamblia
LCAFLSLAEWLSLRGETV

SEQ ID NO: 3083649 - protein, 17 aa, Giardia lamblia
LCDQELMWLLSRNFSIL

SEQ ID NO: 3083650 - protein, 17 aa, Giardia lamblia
LCFALSFDRSFRFEYSA

SEQ ID NO: 3083651 - protein, 24 aa, Giardia lamblia
LCHAPRLLLEGIIEFFQSRVTAAQ

SEQ ID NO: 3083652 - protein, 24 aa, Giardia lamblia
LCIPPLCVIYLLGLIYEFNSEPNY

SEQ ID NO: 3083653 - protein, 20 aa, Giardia lamblia
LCLTCVYPAYSIQPDRRSCS

SEQ ID NO: 3083654 - protein, 20 aa, Giardia lamblia
LCMACTMLGVSMKVNAVEKM

SEQ ID NO: 3083655 - protein, 18 aa, Giardia lamblia
LCSFYSCIDGYMLTETGV

SEQ ID NO: 3083656 - protein, 17 aa, Giardia lamblia
LCTILFVMGCLLPPVLW

SEQ ID NO: 3083657 - protein, 19 aa, Giardia lamblia
LCTVLYCLVGFFGALIFGK

SEQ ID NO: 3083658 - protein, 17 aa, Giardia lamblia
LDACLLYLKLILDPHDS

SEQ ID NO: 3083659 - protein, 22 aa, Giardia lamblia
LDGYWFLGLGFICIKTGRVKDG

SEQ ID NO: 3083660 - protein, 19 aa, Giardia lamblia
LDILKCLTILPSIGDQAIQ

SEQ ID NO: 3083661 - protein, 23 aa, Giardia lamblia
LDLFKKDVDAFIAMLKQKTKNAI

SEQ ID NO: 3083662 - protein, 20 aa, Giardia lamblia
LDLKLKRFWPLKPKIIKTII

SEQ ID NO: 3083663 - protein, 18 aa, Giardia lamblia
LDLSLPLTQMILKKNYVT

SEQ ID NO: 3083664 - protein, 20 aa, Giardia lamblia
LDRLPHCFTILTYSMLQTTI

SEQ ID NO: 3083665 - protein, 25 aa, Giardia lamblia
LDYKKRFTVPMIYDLIIGDHIKNTC

SEQ ID NO: 3083666 - protein, 17 aa, Giardia lamblia
LECGAWLMLYVYKALFR

SEQ ID NO: 3083667 - protein, 17 aa, Giardia lamblia
LEEYKRLLVDIQNHCQA

SEQ ID NO: 3083668 - protein, 17 aa, Giardia lamblia
LEFPRRFFTRFAPKILE

SEQ ID NO: 3083669 - protein, 25 aa, Giardia lamblia
LEGARRLLTLKGFERMLRKRRIGYY

SEQ ID NO: 3083670 - protein, 23 aa, Giardia lamblia
LEILRKAWPYLHRETILSLVHRK

SEQ ID NO: 3083671 - protein, 20 aa, Giardia lamblia
LELRKCYAFRLFVDEAHSIG

SEQ ID NO: 3083672 - protein, 17 aa, Giardia lamblia
LELVKIVAYLKGVDISV

SEQ ID NO: 3083673 - protein, 19 aa, Giardia lamblia
LEPGTGWSGLQFLDFFSVK

SEQ ID NO: 3083674 - protein, 26 aa, Giardia lamblia
LESNRFGAPLAFLIDCYFYRQRPSYE

SEQ ID NO: 3083675 - protein, 17 aa, Giardia lamblia
LETCAIYLLAELDLKMQ

SEQ ID NO: 3083676 - protein, 24 aa, Giardia lamblia
LETIELRKGYGLNEFRDDLKTLFQ

SEQ ID NO: 3083677 - protein, 21 aa, Giardia lamblia
LEVESRLGALVLTDFKGLVSL

SEQ ID NO: 3083678 - protein, 21 aa, Giardia lamblia
LEYRINFLFLIFIVGIIQIML

SEQ ID NO: 3083679 - protein, 19 aa, Giardia lamblia
LFAKELYRYLSIKQSGDNK

SEQ ID NO: 3083680 - protein, 23 aa, Giardia lamblia
LFALVIRFYLKFDNLVVTNLLVT

SEQ ID NO: 3083681 - protein, 18 aa, Giardia lamblia
LFASCFAFLFSLDTIFSA

SEQ ID NO: 3083682 - protein, 18 aa, Giardia lamblia
LFASPSLRVPHTANKVVN

SEQ ID NO: 3083683 - protein, 21 aa, Giardia lamblia
LFFHRCFAVQFLLKAVSLSMG

SEQ ID NO: 3083684 - protein, 19 aa, Giardia lamblia
LFFRRGVCYYDLRRWSDSI

SEQ ID NO: 3083685 - protein, 21 aa, Giardia lamblia
LFIVVLCFIDLSLIVYKASGI

SEQ ID NO: 3083686 - protein, 26 aa, Giardia lamblia
LFLAHLAEAWLCWRAGMAYDQVYSQM

SEQ ID NO: 3083687 - protein, 22 aa, Giardia lamblia
LFLEIVVSLFFSLVVLITLQYN

SEQ ID NO: 3083688 - protein, 19 aa, Giardia lamblia
LFLKFCLFKGSKKLDDFLH

SEQ ID NO: 3083689 - protein, 18 aa, Giardia lamblia
LFLVCTMGWLIAVMVTCR

SEQ ID NO: 3083690 - protein, 17 aa, Giardia lamblia
LFNRGLCAVAFSNGVVT

SEQ ID NO: 3083691 - protein, 21 aa, Giardia lamblia
LFQIKVRWPMHIRSLYASTQS

SEQ ID NO: 3083692 - protein, 25 aa, Giardia lamblia
LFRGDCIHNTFDIVCGIALSFVPSA

SEQ ID NO: 3083693 - protein, 17 aa, Giardia lamblia
LFSRWYVRWPRYQLSQY

SEQ ID NO: 3083694 - protein, 23 aa, Giardia lamblia
LFTPAELVTLCLLASERHKLGVV

SEQ ID NO: 3083695 - protein, 18 aa, Giardia lamblia
LFVLSVSFLDYFTVGHLH

SEQ ID NO: 3083696 - protein, 19 aa, Giardia lamblia
LFVSIWLTMLVFRKTVLQV

SEQ ID NO: 3083697 - protein, 17 aa, Giardia lamblia
LFYNIALIALRASDYSI

SEQ ID NO: 3083698 - protein, 19 aa, Giardia lamblia
LFYRDCDFAAYYRFYSPRI

SEQ ID NO: 3083699 - protein, 18 aa, Giardia lamblia
LGALCLKTPAAWYSLVTF

SEQ ID NO: 3083700 - protein, 20 aa, Giardia lamblia
LGALLRRLWSLFFDSLGSLT

SEQ ID NO: 3083701 - protein, 19 aa, Giardia lamblia
LGELCCNIMLWILLIGTSL

SEQ ID NO: 3083702 - protein, 20 aa, Giardia lamblia
LGFLRFLFDSAFTTEIDRFS

SEQ ID NO: 3083703 - protein, 18 aa, Giardia lamblia
LGFLTGLLINMYSDCDRQ

SEQ ID NO: 3083704 - protein, 17 aa, Giardia lamblia
LGFSGAFISTATPMASS

SEQ ID NO: 3083705 - protein, 17 aa, Giardia lamblia
LGGIIFWIADAVCLNNS

SEQ ID NO: 3083706 - protein, 28 aa, Giardia lamblia
LGGYCMGRAFFPYRLSHITGRITTILSY

SEQ ID NO: 3083707 - protein, 24 aa, Giardia lamblia
LGHEPTCFVLAFGGGPSFDQAELV

SEQ ID NO: 3083708 - protein, 17 aa, Giardia lamblia
LGIEWLESFLFGVGIIV

SEQ ID NO: 3083709 - protein, 18 aa, Giardia lamblia
LGKMSFLYIKYFRSLLLM

SEQ ID NO: 3083710 - protein, 17 aa, Giardia lamblia
LGLGCRCLAEKTAVKVI

SEQ ID NO: 3083711 - protein, 24 aa, Giardia lamblia
LGLRLEIFSTLALSFSDNILYFYR

SEQ ID NO: 3083712 - protein, 21 aa, Giardia lamblia
LGQDVKVCWCNYLNEEMKSIV

SEQ ID NO: 3083713 - protein, 17 aa, Giardia lamblia
LGQIFGCRCRPGFSGEA

SEQ ID NO: 3083714 - protein, 21 aa, Giardia lamblia
LGSLPMGFLFFFSYIPMLQGN

SEQ ID NO: 3083715 - protein, 17 aa, Giardia lamblia
LGSRCLGKMSFLYIKYF

SEQ ID NO: 3083716 - protein, 18 aa, Giardia lamblia
LGTLAFLVDIEWSYSAAS

SEQ ID NO: 3083717 - protein, 18 aa, Giardia lamblia
LGTVFAVGENIVYSKAVE

SEQ ID NO: 3083718 - protein, 18 aa, Giardia lamblia
LHDYRIYYVLTTGASLKF

SEQ ID NO: 3083719 - protein, 18 aa, Giardia lamblia
LHHALFIYSWCSKLLTAI

SEQ ID NO: 3083720 - protein, 18 aa, Giardia lamblia
LHIPHLFLKRECLPGGIR

SEQ ID NO: 3083721 - protein, 20 aa, Giardia lamblia
LHIPSLRYGFNILKSLGMSN

SEQ ID NO: 3083722 - protein, 23 aa, Giardia lamblia
LHKTRQSYAFARNCFSAENKPAD

SEQ ID NO: 3083723 - protein, 18 aa, Giardia lamblia
LHPFIVKYYYSWIETTSD

SEQ ID NO: 3083724 - protein, 19 aa, Giardia lamblia
LHTDLLFFKYLMQNVSQAV

SEQ ID NO: 3083725 - protein, 30 aa, Giardia lamblia
LHYEQFCWLRRLLLPRAFHVFDIDDYVSYM

SEQ ID NO: 3083726 - protein, 27 aa, Giardia lamblia
LHYMMGLRYIYRWLGDFVYQLVITSIV

SEQ ID NO: 3083727 - protein, 22 aa, Giardia lamblia
LHYRLQMDIIFLLRDGKNAARA

SEQ ID NO: 3083728 - protein, 18 aa, Giardia lamblia
LICVPIKALIQGAATPVT

SEQ ID NO: 3083729 - protein, 20 aa, Giardia lamblia
LIELCYCLLTVLLASGVLYM

SEQ ID NO: 3083730 - protein, 17 aa, Giardia lamblia
LIFCRNFVIAIGNVRKL

SEQ ID NO: 3083731 - protein, 19 aa, Giardia lamblia
LIGSVCFGFYLSFKTRTCL

SEQ ID NO: 3083732 - protein, 21 aa, Giardia lamblia
LIGWLRLTQNLTLCYDGALVA

SEQ ID NO: 3083733 - protein, 20 aa, Giardia lamblia
LILRRYASLCIKDHYDTPLV

SEQ ID NO: 3083734 - protein, 29 aa, Giardia lamblia
LITSLKCPVCIPCYLCWIEDNSTYFVTDL

SEQ ID NO: 3083735 - protein, 17 aa, Giardia lamblia
LIVAEAFSALIPCTIAV

SEQ ID NO: 3083736 - protein, 20 aa, Giardia lamblia
LIVKFLLKRHVTMCNAMGVP

SEQ ID NO: 3083737 - protein, 18 aa, Giardia lamblia
LKAALLIRADVPARLSSE

SEQ ID NO: 3083738 - protein, 20 aa, Giardia lamblia
LKAGSAYVPFDFPLSGGSVS

SEQ ID NO: 3083739 - protein, 17 aa, Giardia lamblia
LKEDLHFLLAARDEDNQ

SEQ ID NO: 3083740 - protein, 17 aa, Giardia lamblia
LKGVCLGPWLRKQASTF

SEQ ID NO: 3083741 - protein, 22 aa, Giardia lamblia
LKHVKRAPGAIMHALAEKIGVD

SEQ ID NO: 3083742 - protein, 20 aa, Giardia lamblia
LKIIKLYALFLIEGDAPTAG

SEQ ID NO: 3083743 - protein, 17 aa, Giardia lamblia
LKILFVPILYIPLEAYK

SEQ ID NO: 3083744 - protein, 18 aa, Giardia lamblia
LKKFIEWCLIIRQDDRLS

SEQ ID NO: 3083745 - protein, 17 aa, Giardia lamblia
LKKRRRGTLFPEYAFNR

SEQ ID NO: 3083746 - protein, 22 aa, Giardia lamblia
LKLCDFTCCVYLGDPTGSQELN

SEQ ID NO: 3083747 - protein, 17 aa, Giardia lamblia
LKLFKLQMCLKYNLEMG

SEQ ID NO: 3083748 - protein, 21 aa, Giardia lamblia
LKLFLCLFCHFVGREAKILSD

SEQ ID NO: 3083749 - protein, 18 aa, Giardia lamblia
LKLLVNNLHLCFNTQTDL

SEQ ID NO: 3083750 - protein, 21 aa, Giardia lamblia
LKLNSFRFLKHIFAPSFQYLF

SEQ ID NO: 3083751 - protein, 18 aa, Giardia lamblia
LKLSYLIEHVTCFISSLR

SEQ ID NO: 3083752 - protein, 19 aa, Giardia lamblia
LKMFPIRYVILGWFRLTID

SEQ ID NO: 3083753 - protein, 20 aa, Giardia lamblia
LKMMLCFRTTCTVRYLPRYV

SEQ ID NO: 3083754 - protein, 19 aa, Giardia lamblia
LKPSAAIRVPVKLRPDVIL

SEQ ID NO: 3083755 - protein, 21 aa, Giardia lamblia
LKPWAPFTLEFWGCLATPAPP

SEQ ID NO: 3083756 - protein, 24 aa, Giardia lamblia
LKPYLCLALALLFFFDFNTFNVLK

SEQ ID NO: 3083757 - protein, 24 aa, Giardia lamblia
LKQKARLSLMVLRLLQARIASILS

SEQ ID NO: 3083758 - protein, 18 aa, Giardia lamblia
LKQRGCSTFNASNLLSEA

SEQ ID NO: 3083759 - protein, 18 aa, Giardia lamblia
LKRPGRLLTFLAIDPSEH

SEQ ID NO: 3083760 - protein, 17 aa, Giardia lamblia
LKRTMVMGFRIVDSFYC

SEQ ID NO: 3083761 - protein, 18 aa, Giardia lamblia
LKSLLAFHMIQLIVEKNI

SEQ ID NO: 3083762 - protein, 25 aa, Giardia lamblia
LKSYTARIFIRFAFAILAAVASITI

SEQ ID NO: 3083763 - protein, 20 aa, Giardia lamblia
LKVDCFKLPLSYDIKLATFC

SEQ ID NO: 3083764 - protein, 22 aa, Giardia lamblia
LKVFRPDAFFSILTLLAEGATD

SEQ ID NO: 3083765 - protein, 21 aa, Giardia lamblia
LKVVVRFQGKYGRFMIDRYSS

SEQ ID NO: 3083766 - protein, 24 aa, Giardia lamblia
LKYLMFSGFVFKSSFYAFFDCRKM

SEQ ID NO: 3083767 - protein, 17 aa, Giardia lamblia
LLACRLVITGLLLHRGF

SEQ ID NO: 3083768 - protein, 18 aa, Giardia lamblia
LLAYFCAFGTDTLELITA

SEQ ID NO: 3083769 - protein, 20 aa, Giardia lamblia
LLCAIGSLFGICFSVGMGCA

SEQ ID NO: 3083770 - protein, 18 aa, Giardia lamblia
LLCQFSFTIFFVHMTVSQ

SEQ ID NO: 3083771 - protein, 19 aa, Giardia lamblia
LLCRLCKAISMVSSLDVMG

SEQ ID NO: 3083772 - protein, 18 aa, Giardia lamblia
LLDQRYSIEISRKQLSGW

SEQ ID NO: 3083773 - protein, 17 aa, Giardia lamblia
LLELFGFGVMILGVMIH

SEQ ID NO: 3083774 - protein, 17 aa, Giardia lamblia
LLEPCATYEAVIFKGHE

SEQ ID NO: 3083775 - protein, 20 aa, Giardia lamblia
LLERFIRYLFTQVVSRFESN

SEQ ID NO: 3083776 - protein, 20 aa, Giardia lamblia
LLFERKELYGALLQLAVYVG

SEQ ID NO: 3083777 - protein, 19 aa, Giardia lamblia
LLGAVCHFFAQYACSCDPS

SEQ ID NO: 3083778 - protein, 18 aa, Giardia lamblia
LLGRFGILRITEPFMCRF

SEQ ID NO: 3083779 - protein, 18 aa, Giardia lamblia
LLICSIHLLLSASRLADY

SEQ ID NO: 3083780 - protein, 17 aa, Giardia lamblia
LLIGEGAIHCKIFSDNE

SEQ ID NO: 3083781 - protein, 18 aa, Giardia lamblia
LLIPRPGMEIAQPATAAG

SEQ ID NO: 3083782 - protein, 19 aa, Giardia lamblia
LLIRCLFAGVIAEQVSPSS

SEQ ID NO: 3083783 - protein, 19 aa, Giardia lamblia
LLIRCVLIWLGTYISDPPA

SEQ ID NO: 3083784 - protein, 17 aa, Giardia lamblia
LLITAFYRWSDLARGRH

SEQ ID NO: 3083785 - protein, 25 aa, Giardia lamblia
LLIVPHYRIMLGISKYVFDHQNAPE

SEQ ID NO: 3083786 - protein, 17 aa, Giardia lamblia
LLKRLKIGYSKELLHID

SEQ ID NO: 3083787 - protein, 18 aa, Giardia lamblia
LLLDCFFLRNSPGKDGDQ

SEQ ID NO: 3083788 - protein, 17 aa, Giardia lamblia
LLLHQGWIIERVDSNII

SEQ ID NO: 3083789 - protein, 19 aa, Giardia lamblia
LLLIILLKLAKFSYRKKKE

SEQ ID NO: 3083790 - protein, 18 aa, Giardia lamblia
LLLILAMGIAGHEVLSHV

SEQ ID NO: 3083791 - protein, 23 aa, Giardia lamblia
LLLLRAAIYNGRFDGQLCGAIST

SEQ ID NO: 3083792 - protein, 20 aa, Giardia lamblia
LLLRLLEYYAEIPIIVIAYL

SEQ ID NO: 3083793 - protein, 20 aa, Giardia lamblia
LLMDCPYALFNLILAMIMSQ

SEQ ID NO: 3083794 - protein, 20 aa, Giardia lamblia
LLMICLPISLAVSVGVTVTL

SEQ ID NO: 3083795 - protein, 17 aa, Giardia lamblia
LLNEIFPLPPSIYNNTL

SEQ ID NO: 3083796 - protein, 19 aa, Giardia lamblia
LLNFLLLRGSKLSLHLANS

SEQ ID NO: 3083797 - protein, 18 aa, Giardia lamblia
LLPFLLFVLFGFPNAMSS

SEQ ID NO: 3083798 - protein, 25 aa, Giardia lamblia
LLPVICFFIGIAIIVIFAMAFNRND

SEQ ID NO: 3083799 - protein, 23 aa, Giardia lamblia
LLREHKRAVLLLISLRISELLCQ

SEQ ID NO: 3083800 - protein, 20 aa, Giardia lamblia
LLRGKFRWSTLEATSLSPAI

SEQ ID NO: 3083801 - protein, 23 aa, Giardia lamblia
LLRHIRIPQFMKVLYRILDPKYV

SEQ ID NO: 3083802 - protein, 18 aa, Giardia lamblia
LLRRLSILLILLVRALGD

SEQ ID NO: 3083803 - protein, 19 aa, Giardia lamblia
LLRRMGVADVSDFLYDVLP

SEQ ID NO: 3083804 - protein, 18 aa, Giardia lamblia
LLRRYRMITPQVKRLSNM

SEQ ID NO: 3083805 - protein, 24 aa, Giardia lamblia
LLSEEILRLILLIIYNQIVFVFSL

SEQ ID NO: 3083806 - protein, 18 aa, Giardia lamblia
LLVPNVFSIPGCRQRLLR

SEQ ID NO: 3083807 - protein, 17 aa, Giardia lamblia
LLVRFALVVGFLDFDES

SEQ ID NO: 3083808 - protein, 17 aa, Giardia lamblia
LLVSRCAGIFALRVDSV

SEQ ID NO: 3083809 - protein, 19 aa, Giardia lamblia
LLYNCTFGPLSLYSLNDGK

SEQ ID NO: 3083810 - protein, 17 aa, Giardia lamblia
LLYPTGVYVYYIDGILQ

SEQ ID NO: 3083811 - protein, 23 aa, Giardia lamblia
LMDGAKIAIGWLVDVLQTYLNPL

SEQ ID NO: 3083812 - protein, 17 aa, Giardia lamblia
LMFSNFVDILRDMISVG

SEQ ID NO: 3083813 - protein, 18 aa, Giardia lamblia
LMFVCYLVYMAIEIDPKG

SEQ ID NO: 3083814 - protein, 22 aa, Giardia lamblia
LMLRRCRLRRAAKRHVEKESDR

SEQ ID NO: 3083815 - protein, 20 aa, Giardia lamblia
LMPYMRLVFEIGDLKYASPA

SEQ ID NO: 3083816 - protein, 17 aa, Giardia lamblia
LMVRCISFRTAFRCSSL

SEQ ID NO: 3083817 - protein, 18 aa, Giardia lamblia
LMVYAACEPVLWRPAIEK

SEQ ID NO: 3083818 - protein, 18 aa, Giardia lamblia
LMWSLPFLCIDLFGVEWV

SEQ ID NO: 3083819 - protein, 18 aa, Giardia lamblia
LNEALGLITMDGHVQRTV

SEQ ID NO: 3083820 - protein, 18 aa, Giardia lamblia
LNFSEMFVRSGMAQKYIF

SEQ ID NO: 3083821 - protein, 27 aa, Giardia lamblia
LNGVPTWLYWCANFIYQLCFAVLVYSV

SEQ ID NO: 3083822 - protein, 18 aa, Giardia lamblia
LNIRLLKVFHEMKLISRV

SEQ ID NO: 3083823 - protein, 17 aa, Giardia lamblia
LNLKLSKLVPVPHLGSF

SEQ ID NO: 3083824 - protein, 18 aa, Giardia lamblia
LNMQSVVLARRWLPFLRE

SEQ ID NO: 3083825 - protein, 18 aa, Giardia lamblia
LNPNKGWVILSIIDVAHF

SEQ ID NO: 3083826 - protein, 23 aa, Giardia lamblia
LNQPRLRMKAHFYIYNPPIFSSR

SEQ ID NO: 3083827 - protein, 19 aa, Giardia lamblia
LNRVACLLFYLSLSYYARN

SEQ ID NO: 3083828 - protein, 20 aa, Giardia lamblia
LNRVLGCSNYLYSKSVGMES

SEQ ID NO: 3083829 - protein, 17 aa, Giardia lamblia
LNYCKGGSLLNLRRSVF

SEQ ID NO: 3083830 - protein, 25 aa, Giardia lamblia
LPADHGKLWLCLAYMHFSVRTNLIR

SEQ ID NO: 3083831 - protein, 19 aa, Giardia lamblia
LPALEGMPLPRSMPAVIKP

SEQ ID NO: 3083832 - protein, 17 aa, Giardia lamblia
LPALRRTDLEFSDNHLF

SEQ ID NO: 3083833 - protein, 17 aa, Giardia lamblia
LPCALTYGICPGVNGTI

SEQ ID NO: 3083834 - protein, 20 aa, Giardia lamblia
LPCMADAATIVWPYCVLLNE

SEQ ID NO: 3083835 - protein, 18 aa, Giardia lamblia
LPDFKPSTLYYLAVFCVL

SEQ ID NO: 3083836 - protein, 19 aa, Giardia lamblia
LPENLKALFRSVAMICSQV

SEQ ID NO: 3083837 - protein, 17 aa, Giardia lamblia
LPFKTLIAIALNFSEMF

SEQ ID NO: 3083838 - protein, 24 aa, Giardia lamblia
LPFLDFLHYWFLFRVRPGIKNKDF

SEQ ID NO: 3083839 - protein, 19 aa, Giardia lamblia
LPFRKGCYLAEDLLGNILS

SEQ ID NO: 3083840 - protein, 17 aa, Giardia lamblia
LPGLPGFLIARQAAYGY

SEQ ID NO: 3083841 - protein, 19 aa, Giardia lamblia
LPIISSRTLLGLLIFFVTQ

SEQ ID NO: 3083842 - protein, 19 aa, Giardia lamblia
LPIPLLLRYLRAWKTPSDA

SEQ ID NO: 3083843 - protein, 18 aa, Giardia lamblia
LPLCHKLTHLFDGLKGRD

SEQ ID NO: 3083844 - protein, 18 aa, Giardia lamblia
LPLLPGFNGQVIPPAPCT

SEQ ID NO: 3083845 - protein, 17 aa, Giardia lamblia
LPLSMSQFLATASFIEC

SEQ ID NO: 3083846 - protein, 23 aa, Giardia lamblia
LPLYEILKLAALLWIALGNGSTQ

SEQ ID NO: 3083847 - protein, 23 aa, Giardia lamblia
LPNDCLRLSFITPYELRAPLQRH

SEQ ID NO: 3083848 - protein, 21 aa, Giardia lamblia
LPNYPFVYVIRGHRVPVVPIQ

SEQ ID NO: 3083849 - protein, 18 aa, Giardia lamblia
LPPVCFYGTIKIDYSNYL

SEQ ID NO: 3083850 - protein, 23 aa, Giardia lamblia
LPQFKFISSIAFQPRHFKMLTRE

SEQ ID NO: 3083851 - protein, 21 aa, Giardia lamblia
LPQPIVCLAKLLSGYISMPKV

SEQ ID NO: 3083852 - protein, 18 aa, Giardia lamblia
LPRFSLECKFKFWFHRDP

SEQ ID NO: 3083853 - protein, 18 aa, Giardia lamblia
LPTARKAFSGKFMEECQQ

SEQ ID NO: 3083854 - protein, 19 aa, Giardia lamblia
LPTRLPVSFSAAFISVKAN

SEQ ID NO: 3083855 - protein, 27 aa, Giardia lamblia
LPTTALHRWAFEQVFSWNWSQPFDAVK

SEQ ID NO: 3083856 - protein, 19 aa, Giardia lamblia
LPTTVCFLLNILIWDEAVE

SEQ ID NO: 3083857 - protein, 18 aa, Giardia lamblia
LPYPMDWTIGQPFDRHFP

SEQ ID NO: 3083858 - protein, 20 aa, Giardia lamblia
LQAMAIRYRIDYAIEKASLD

SEQ ID NO: 3083859 - protein, 18 aa, Giardia lamblia
LQIKLCWHLNRLAGEAFT

SEQ ID NO: 3083860 - protein, 18 aa, Giardia lamblia
LQILYTRYYCRLHTIEGL

SEQ ID NO: 3083861 - protein, 18 aa, Giardia lamblia
LQMAKLTIFGSILIGDLS

SEQ ID NO: 3083862 - protein, 18 aa, Giardia lamblia
LQMCLKYNLEMGYYSIVF

SEQ ID NO: 3083863 - protein, 17 aa, Giardia lamblia
LQMKAQRTLPCSSTPSY

SEQ ID NO: 3083864 - protein, 18 aa, Giardia lamblia
LQNLKLYLTHVYWAIQRQ

SEQ ID NO: 3083865 - protein, 21 aa, Giardia lamblia
LQSAYRTALFISIFMVVVLAI

SEQ ID NO: 3083866 - protein, 18 aa, Giardia lamblia
LQVAYGFGRRKLIAVDNF

SEQ ID NO: 3083867 - protein, 19 aa, Giardia lamblia
LRALMRYLGTYAFEVVQPT

SEQ ID NO: 3083868 - protein, 18 aa, Giardia lamblia
LRAPESWSQAKINFIKAF

SEQ ID NO: 3083869 - protein, 18 aa, Giardia lamblia
LRCKYIMPLLPKYGDAPA

SEQ ID NO: 3083870 - protein, 25 aa, Giardia lamblia
LRDKCGRTALIYAIECRNRRVIPFL

SEQ ID NO: 3083871 - protein, 23 aa, Giardia lamblia
LRDLCLPADLPLEAYEFLLDHGI

SEQ ID NO: 3083872 - protein, 18 aa, Giardia lamblia
LRDLIAIALSYKHLCGRR

SEQ ID NO: 3083873 - protein, 19 aa, Giardia lamblia
LRFELHITFVSLAIEIACM

SEQ ID NO: 3083874 - protein, 17 aa, Giardia lamblia
LRFKSVFDDGLYDNQDL

SEQ ID NO: 3083875 - protein, 21 aa, Giardia lamblia
LRFLCRKDFLHIVKTIHERLT

SEQ ID NO: 3083876 - protein, 20 aa, Giardia lamblia
LRGTFGFSRMKPLIEDLQAH

SEQ ID NO: 3083877 - protein, 20 aa, Giardia lamblia
LRILIEWIAIYAPSLLCYYD

SEQ ID NO: 3083878 - protein, 24 aa, Giardia lamblia
LRLFYYFRCNWTFGKQSLEISDTM

SEQ ID NO: 3083879 - protein, 20 aa, Giardia lamblia
LRLIALRLVSAISHEGELTI

SEQ ID NO: 3083880 - protein, 20 aa, Giardia lamblia
LRLILGGLFTVPAQSQLVQE

SEQ ID NO: 3083881 - protein, 17 aa, Giardia lamblia
LRLKLEYSMLYCRLASI

SEQ ID NO: 3083882 - protein, 21 aa, Giardia lamblia
LRLLVAMNCLWPGAGSIQTLL

SEQ ID NO: 3083883 - protein, 20 aa, Giardia lamblia
LRLSMDLPHLPGAPRIVGID

SEQ ID NO: 3083884 - protein, 17 aa, Giardia lamblia
LRLSPEYGRAFYEISVF

SEQ ID NO: 3083885 - protein, 20 aa, Giardia lamblia
LRMRVLKLSIIIAMSLCTVL

SEQ ID NO: 3083886 - protein, 17 aa, Giardia lamblia
LRMWLRLQTISFIYRTL

SEQ ID NO: 3083887 - protein, 23 aa, Giardia lamblia
LRNRLSYFLLMLFILSLLDTDTI

SEQ ID NO: 3083888 - protein, 20 aa, Giardia lamblia
LRPGILSGYLCKSLNMQSVV

SEQ ID NO: 3083889 - protein, 24 aa, Giardia lamblia
LRPIPRIWLPFSLKEYAGTIIELF

SEQ ID NO: 3083890 - protein, 20 aa, Giardia lamblia
LRPPQLVFYEMCMLKHDLSK

SEQ ID NO: 3083891 - protein, 21 aa, Giardia lamblia
LRRKPGVVVLFNYFSQPGRGS

SEQ ID NO: 3083892 - protein, 24 aa, Giardia lamblia
LRRLPACRKSWFIPWFTNKAIVPA

SEQ ID NO: 3083893 - protein, 20 aa, Giardia lamblia
LRRLQGILAPFVLRRVKGDV

SEQ ID NO: 3083894 - protein, 19 aa, Giardia lamblia
LRRPRGYGWAFLRGLKDPV

SEQ ID NO: 3083895 - protein, 18 aa, Giardia lamblia
LRSLLIWVIMVIIYYSTR

SEQ ID NO: 3083896 - protein, 19 aa, Giardia lamblia
LRVGFLFTYLAPLVLVLAV

SEQ ID NO: 3083897 - protein, 20 aa, Giardia lamblia
LRVSAVCFGCMFTWNVPISF

SEQ ID NO: 3083898 - protein, 19 aa, Giardia lamblia
LRWADCLGVTLNLADNPNE

SEQ ID NO: 3083899 - protein, 20 aa, Giardia lamblia
LRYLLSWIIWIVFATDTQGG

SEQ ID NO: 3083900 - protein, 17 aa, Giardia lamblia
LRYNAFHLLYPVGVLAG

SEQ ID NO: 3083901 - protein, 22 aa, Giardia lamblia
LRYPVPNTKLGAWGFINAYVAS

SEQ ID NO: 3083902 - protein, 26 aa, Giardia lamblia
LSAAIRWTILFSCVAWLLNLLVRNAP

SEQ ID NO: 3083903 - protein, 19 aa, Giardia lamblia
LSAEFKAQLVASVCTVAAP

SEQ ID NO: 3083904 - protein, 18 aa, Giardia lamblia
LSAHLGRPCFVFNCDEAF

SEQ ID NO: 3083905 - protein, 19 aa, Giardia lamblia
LSCIAALILLLASNSRVMV

SEQ ID NO: 3083906 - protein, 17 aa, Giardia lamblia
LSGLISRVWVEFSGEGA

SEQ ID NO: 3083907 - protein, 23 aa, Giardia lamblia
LSHELRFLPTYTMSLFLLTSLAN

SEQ ID NO: 3083908 - protein, 18 aa, Giardia lamblia
LSHTPSWRMFLLVVDSFA

SEQ ID NO: 3083909 - protein, 18 aa, Giardia lamblia
LSICGKVLNSHLGFKCQY

SEQ ID NO: 3083910 - protein, 19 aa, Giardia lamblia
LSIDRGRWLSTWIGVGGAV

SEQ ID NO: 3083911 - protein, 17 aa, Giardia lamblia
LSIFAFVIYSLCKVIEF

SEQ ID NO: 3083912 - protein, 17 aa, Giardia lamblia
LSIIIAMSLCTVLYCLV

SEQ ID NO: 3083913 - protein, 18 aa, Giardia lamblia
LSIVEEFNRLHAWMCNYR

SEQ ID NO: 3083914 - protein, 22 aa, Giardia lamblia
LSKYCLCITILLLSVGLFVYQR

SEQ ID NO: 3083915 - protein, 19 aa, Giardia lamblia
LSLLCLKQAFLFTRDTIAA

SEQ ID NO: 3083916 - protein, 18 aa, Giardia lamblia
LSLLTVKFVIIVSVNGPK

SEQ ID NO: 3083917 - protein, 17 aa, Giardia lamblia
LSMCTWVIIKTHRLRSL

SEQ ID NO: 3083918 - protein, 23 aa, Giardia lamblia
LSNDFPKLLGLDFMLIQHRLAPD

SEQ ID NO: 3083919 - protein, 18 aa, Giardia lamblia
LSPEYGRAFYEISVFLRQ

SEQ ID NO: 3083920 - protein, 17 aa, Giardia lamblia
LSPRPPINPAFPYPLCL

SEQ ID NO: 3083921 - protein, 17 aa, Giardia lamblia
LSPWQWSKFSTISSELV

SEQ ID NO: 3083922 - protein, 25 aa, Giardia lamblia
LSRLPECCWIYLLLVRAMETPEQLE

SEQ ID NO: 3083923 - protein, 19 aa, Giardia lamblia
LSSLLRWRHKVEGYSSTQK

SEQ ID NO: 3083924 - protein, 17 aa, Giardia lamblia
LSSPSIYFDLHFDSSSR

SEQ ID NO: 3083925 - protein, 17 aa, Giardia lamblia
LSSSLCSPVFLQFLELV

SEQ ID NO: 3083926 - protein, 23 aa, Giardia lamblia
LSTFILFYSCYNILITIFPLIVG

SEQ ID NO: 3083927 - protein, 23 aa, Giardia lamblia
LSTPWRRFSFSVKRLLLKLSRST

SEQ ID NO: 3083928 - protein, 21 aa, Giardia lamblia
LSVPMTPAWVDAMISRFAFEY

SEQ ID NO: 3083929 - protein, 22 aa, Giardia lamblia
LSVYRLVSILGRLPLFNQGSVL

SEQ ID NO: 3083930 - protein, 17 aa, Giardia lamblia
LSYDRPIVYFARVGYLS

SEQ ID NO: 3083931 - protein, 26 aa, Giardia lamblia
LSYRIPCCRVFLIDVCETLLNSNALP

SEQ ID NO: 3083932 - protein, 18 aa, Giardia lamblia
LSYVGGFAGSCRMGAEVV

SEQ ID NO: 3083933 - protein, 18 aa, Giardia lamblia
LTCSAFAACYYRKLMRKN

SEQ ID NO: 3083934 - protein, 23 aa, Giardia lamblia
LTDDLYKRFQFIWDEFSHINDDM

SEQ ID NO: 3083935 - protein, 19 aa, Giardia lamblia
LTFIPYRFTSNPAKVITAW

SEQ ID NO: 3083936 - protein, 23 aa, Giardia lamblia
LTFRLRMVTFPVINYSNCCLFAS

SEQ ID NO: 3083937 - protein, 17 aa, Giardia lamblia
LTFSAYTEHVWRFCYLR

SEQ ID NO: 3083938 - protein, 20 aa, Giardia lamblia
LTIPFSRVVAIIFYAYSSFR

SEQ ID NO: 3083939 - protein, 17 aa, Giardia lamblia
LTKRMFASIMQHLPRML

SEQ ID NO: 3083940 - protein, 24 aa, Giardia lamblia
LTLFTGKVSYHWSPYGIGFHDPGA

SEQ ID NO: 3083941 - protein, 25 aa, Giardia lamblia
LTLRHWRIIKALIHLFFRYYGILDV

SEQ ID NO: 3083942 - protein, 19 aa, Giardia lamblia
LTLTHLFPCFSLFTSPKAE

SEQ ID NO: 3083943 - protein, 18 aa, Giardia lamblia
LTLYSLLELFGFGVMILG

SEQ ID NO: 3083944 - protein, 19 aa, Giardia lamblia
LTMVCIWALVPLLVLMAVF

SEQ ID NO: 3083945 - protein, 23 aa, Giardia lamblia
LTNGLCFRKGMKILSRESPRLKV

SEQ ID NO: 3083946 - protein, 18 aa, Giardia lamblia
LTPFFKEPFSFHSICSMF

SEQ ID NO: 3083947 - protein, 18 aa, Giardia lamblia
LTPGRCYYYYVPSFTTSD

SEQ ID NO: 3083948 - protein, 26 aa, Giardia lamblia
LTQESLCFIRCFFSLLPRRLSSYLLC

SEQ ID NO: 3083949 - protein, 19 aa, Giardia lamblia
LTRHPGYLGWFIWAVSTQV

SEQ ID NO: 3083950 - protein, 20 aa, Giardia lamblia
LTTVYEFFRRVQIHVEDEND

SEQ ID NO: 3083951 - protein, 17 aa, Giardia lamblia
LTYLPALLLVTLNHQRN

SEQ ID NO: 3083952 - protein, 19 aa, Giardia lamblia
LVASLFLKFCLFKGSKKLD

SEQ ID NO: 3083953 - protein, 19 aa, Giardia lamblia
LVCDSSCIISLLTPYIFER

SEQ ID NO: 3083954 - protein, 24 aa, Giardia lamblia
LVCMFYQRLEAVVAHIQSDAEQAS

SEQ ID NO: 3083955 - protein, 17 aa, Giardia lamblia
LVCVCVAEFTFVKCLQR

SEQ ID NO: 3083956 - protein, 17 aa, Giardia lamblia
LVECYHGGQLKSHIILM

SEQ ID NO: 3083957 - protein, 18 aa, Giardia lamblia
LVGYSNWSDPAILQAPPT

SEQ ID NO: 3083958 - protein, 18 aa, Giardia lamblia
LVLASSFSATTARASKNV

SEQ ID NO: 3083959 - protein, 17 aa, Giardia lamblia
LVLFWSLLEDFSLRVYM

SEQ ID NO: 3083960 - protein, 25 aa, Giardia lamblia
LVLKARGAFTLGFSFLMTYRLQRLA

SEQ ID NO: 3083961 - protein, 23 aa, Giardia lamblia
LVMICVLAWPALIVVIPTIILYA

SEQ ID NO: 3083962 - protein, 24 aa, Giardia lamblia
LVPLVIRYKLPYLRRMSAGRNIDL

SEQ ID NO: 3083963 - protein, 18 aa, Giardia lamblia
LVSGRPIYRYDIKGDTLT

SEQ ID NO: 3083964 - protein, 19 aa, Giardia lamblia
LVTRRAFLGFSDWNSPDIP

SEQ ID NO: 3083965 - protein, 17 aa, Giardia lamblia
LWARAVGLPAILTEHSM

SEQ ID NO: 3083966 - protein, 22 aa, Giardia lamblia
LWEALNLAKLCMKSLTSSKAPI

SEQ ID NO: 3083967 - protein, 21 aa, Giardia lamblia
LWEYRLGFKRTRNMLLQFMHH

SEQ ID NO: 3083968 - protein, 24 aa, Giardia lamblia
LWLCIPFAFYFYWLVTAIFFSKRH

SEQ ID NO: 3083969 - protein, 17 aa, Giardia lamblia
LWLCTGLSVGVLFLLGK

SEQ ID NO: 3083970 - protein, 17 aa, Giardia lamblia
LWLPLSMTQWNPCLFGF

SEQ ID NO: 3083971 - protein, 22 aa, Giardia lamblia
LWMCCTCGRFFCGYTDNEHAKD

SEQ ID NO: 3083972 - protein, 20 aa, Giardia lamblia
LWRVYTFIIRMYRHVLHRKV

SEQ ID NO: 3083973 - protein, 17 aa, Giardia lamblia
LYCTWVFVMSITAIIVC

SEQ ID NO: 3083974 - protein, 17 aa, Giardia lamblia
LYGLRCNVILDKLVDQK

SEQ ID NO: 3083975 - protein, 21 aa, Giardia lamblia
LYKPEIYTLFPLQEGNMRLSV

SEQ ID NO: 3083976 - protein, 17 aa, Giardia lamblia
LYLDWARYRTVLLYLLG

SEQ ID NO: 3083977 - protein, 19 aa, Giardia lamblia
LYLGEDVFLHLLRIYGSSV

SEQ ID NO: 3083978 - protein, 17 aa, Giardia lamblia
LYMCLDDFVFADPEVPS

SEQ ID NO: 3083979 - protein, 17 aa, Giardia lamblia
LYMQIAFTNCLANNVLV

SEQ ID NO: 3083980 - protein, 18 aa, Giardia lamblia
LYNCGWVLGMFCLLLVGL

SEQ ID NO: 3083981 - protein, 19 aa, Giardia lamblia
LYNDCLRYGIILYSRETRR

SEQ ID NO: 3083982 - protein, 17 aa, Giardia lamblia
LYQHLRLFYYFRCNWTF

SEQ ID NO: 3083983 - protein, 18 aa, Giardia lamblia
LYRLDFPISSFLSIASLS

SEQ ID NO: 3083984 - protein, 18 aa, Giardia lamblia
LYRMEYINGGLLFNSLSY

SEQ ID NO: 3083985 - protein, 19 aa, Giardia lamblia
LYRVIKWLVTDARVKPEEV

SEQ ID NO: 3083986 - protein, 18 aa, Giardia lamblia
LYSNVCIMESSQLNFSEN

SEQ ID NO: 3083987 - protein, 18 aa, Giardia lamblia
LYSQFFKKFCSNIVHRAA

SEQ ID NO: 3083988 - protein, 18 aa, Giardia lamblia
LYSVFRYDLIVLFFKLQR

SEQ ID NO: 3083989 - protein, 17 aa, Giardia lamblia
LYVIFKRLINFKNGIKL

SEQ ID NO: 3083990 - protein, 20 aa, Giardia lamblia
LYYCKICGLVTHAADASSPD

SEQ ID NO: 3083991 - protein, 24 aa, Giardia lamblia
MAEFGPLVPVLGCKPSIAQTNITL

SEQ ID NO: 3083992 - protein, 18 aa, Giardia lamblia
MAKIRLSTCTVYLELLRG

SEQ ID NO: 3083993 - protein, 18 aa, Giardia lamblia
MALKRAYRSQADVSRDPD

SEQ ID NO: 3083994 - protein, 17 aa, Giardia lamblia
MATFLIYHICSYVYLLI

SEQ ID NO: 3083995 - protein, 20 aa, Giardia lamblia
MCTTHLWLSLRYLPSVADTD

SEQ ID NO: 3083996 - protein, 19 aa, Giardia lamblia
MCVACDMLGCQYCRILYND

SEQ ID NO: 3083997 - protein, 21 aa, Giardia lamblia
MDINGRTALMYSVEHDRLDIA

SEQ ID NO: 3083998 - protein, 28 aa, Giardia lamblia
MELCCLIRLLDRWRVYLLAADCSTRLLE

SEQ ID NO: 3083999 - protein, 19 aa, Giardia lamblia
MELLCCFYKEVDAVEKDSV

SEQ ID NO: 3084000 - protein, 17 aa, Giardia lamblia
MELLEFEITYGPVVPEA

SEQ ID NO: 3084001 - protein, 20 aa, Giardia lamblia
MFEIIISVSLGFPVLTDDKN

SEQ ID NO: 3084002 - protein, 19 aa, Giardia lamblia
MFICGLTLLIIFLERGPRS

SEQ ID NO: 3084003 - protein, 24 aa, Giardia lamblia
MGPTCPFIFIEVPFFYRYVIESST

SEQ ID NO: 3084004 - protein, 23 aa, Giardia lamblia
MGSLKFGSLPAMYCLRELITHLM

SEQ ID NO: 3084005 - protein, 20 aa, Giardia lamblia
MGTICIISFIALLISIQTAS

SEQ ID NO: 3084006 - protein, 24 aa, Giardia lamblia
MHMYKARPGTYYIILHPHLMCLNT

SEQ ID NO: 3084007 - protein, 23 aa, Giardia lamblia
MHYLGQLLACFDLLHPGEDVFLP

SEQ ID NO: 3084008 - protein, 22 aa, Giardia lamblia
MIDPRVDTIYPFINICLRVPSE

SEQ ID NO: 3084009 - protein, 22 aa, Giardia lamblia
MIFAWPTIFAFLPVGIIFILLL

SEQ ID NO: 3084010 - protein, 24 aa, Giardia lamblia
MILCSALRCILHLQVIEVISNIIT

SEQ ID NO: 3084011 - protein, 26 aa, Giardia lamblia
MIQNLPFLPLCTFLRSVAARSYQTTD

SEQ ID NO: 3084012 - protein, 18 aa, Giardia lamblia
MIRLVDYMMVKFMLELLL

SEQ ID NO: 3084013 - protein, 20 aa, Giardia lamblia
MIRTGCEIHIFRSLPSDSLL

SEQ ID NO: 3084014 - protein, 17 aa, Giardia lamblia
MIRVLIMARPCFKEKEL

SEQ ID NO: 3084015 - protein, 17 aa, Giardia lamblia
MIYKLARMLSFNFRYIL

SEQ ID NO: 3084016 - protein, 18 aa, Giardia lamblia
MLCLPFFSVFVFGVHAVR

SEQ ID NO: 3084017 - protein, 19 aa, Giardia lamblia
MLFHYSLVMLWDLVDSILE

SEQ ID NO: 3084018 - protein, 21 aa, Giardia lamblia
MLLCSRYAYELLHIPIHRQNA

SEQ ID NO: 3084019 - protein, 19 aa, Giardia lamblia
MLLDPLFRRSTLIMSVDDQ

SEQ ID NO: 3084020 - protein, 18 aa, Giardia lamblia
MLNFYKIQSSIILGSGLP

SEQ ID NO: 3084021 - protein, 19 aa, Giardia lamblia
MLSSMICCDIFLTLLLLRR

SEQ ID NO: 3084022 - protein, 26 aa, Giardia lamblia
MLVSFYFTRFLAVPRRVYVDFLPVPL

SEQ ID NO: 3084023 - protein, 18 aa, Giardia lamblia
MMFLLKFGAISVELPADV

SEQ ID NO: 3084024 - protein, 18 aa, Giardia lamblia
MMHTCLIKPIAYTDDQIS

SEQ ID NO: 3084025 - protein, 18 aa, Giardia lamblia
MPCFLADFGPYVFFAGSV

SEQ ID NO: 3084026 - protein, 20 aa, Giardia lamblia
MPILKFLASKECKIKDHKGR

SEQ ID NO: 3084027 - protein, 17 aa, Giardia lamblia
MPTCLHVPMGWVSFGIS

SEQ ID NO: 3084028 - protein, 18 aa, Giardia lamblia
MQLGCPGYILVRPGYYRW

SEQ ID NO: 3084029 - protein, 19 aa, Giardia lamblia
MQRIISWFLVIHVILLVLL

SEQ ID NO: 3084030 - protein, 17 aa, Giardia lamblia
MQSTILLQREVRLKPEL

SEQ ID NO: 3084031 - protein, 18 aa, Giardia lamblia
MRKGVKFIGCIKTLEKEE

SEQ ID NO: 3084032 - protein, 18 aa, Giardia lamblia
MRKLCLKTSLSVSRAARD

SEQ ID NO: 3084033 - protein, 19 aa, Giardia lamblia
MRLKAARLISALRSKSVAL

SEQ ID NO: 3084034 - protein, 24 aa, Giardia lamblia
MRLLLSFFCPYLFYDSTTKKDLQI

SEQ ID NO: 3084035 - protein, 24 aa, Giardia lamblia
MRVMNRWLSFRVNVIMGIFASLVS

SEQ ID NO: 3084036 - protein, 17 aa, Giardia lamblia
MRYLFRFFIDCEASENP

SEQ ID NO: 3084037 - protein, 19 aa, Giardia lamblia
MSFAAILGFVGWSAQDFKS

SEQ ID NO: 3084038 - protein, 20 aa, Giardia lamblia
MSIYLELLSYFGINSKCTSV

SEQ ID NO: 3084039 - protein, 17 aa, Giardia lamblia
MSLLKFRDSILFDGIMD

SEQ ID NO: 3084040 - protein, 21 aa, Giardia lamblia
MSRVRAMIRLVDYMMVKFMLE

SEQ ID NO: 3084041 - protein, 22 aa, Giardia lamblia
MVCKLCPKFFYGNDCAVNPCGI

SEQ ID NO: 3084042 - protein, 20 aa, Giardia lamblia
MVCMRCYMHAYSVWNDPVLV

SEQ ID NO: 3084043 - protein, 22 aa, Giardia lamblia
MVDLRILLLALINLLSNANYTI

SEQ ID NO: 3084044 - protein, 17 aa, Giardia lamblia
MWHGLCRVYDPFTNQLR

SEQ ID NO: 3084045 - protein, 18 aa, Giardia lamblia
MWVFCILMLQLASLLINF

SEQ ID NO: 3084046 - protein, 25 aa, Giardia lamblia
MYAKVFPRLKFCQYFIKQPGTVFHD

SEQ ID NO: 3084047 - protein, 30 aa, Giardia lamblia
MYYANFIDFYLSYCLGRYAIISSLTLDEVM

SEQ ID NO: 3084048 - protein, 22 aa, Giardia lamblia
NAAWPALFPMIAHFPFDTKYET

SEQ ID NO: 3084049 - protein, 23 aa, Giardia lamblia
NACAACGLGMCLQCTPGSPSSPS

SEQ ID NO: 3084050 - protein, 18 aa, Giardia lamblia
NAIAKYLFYRDCDFAAYY

SEQ ID NO: 3084051 - protein, 19 aa, Giardia lamblia
NATWCIGCNKFLMRSNWLS

SEQ ID NO: 3084052 - protein, 22 aa, Giardia lamblia
NCDIALCILRSIPLATGVLAIL

SEQ ID NO: 3084053 - protein, 35 aa, Giardia lamblia
NCSRCKTVVWKQQWGWRFLIGILFFIFWISLAFLD

SEQ ID NO: 3084054 - protein, 25 aa, Giardia lamblia
NDIFLKVTFPWGLYIFFTIVVSLQA

SEQ ID NO: 3084055 - protein, 24 aa, Giardia lamblia
NDKELRLGWLLPFRLGTPPAPNLL

SEQ ID NO: 3084056 - protein, 21 aa, Giardia lamblia
NDLWCAPDLETLWVESHVAKY

SEQ ID NO: 3084057 - protein, 19 aa, Giardia lamblia
NDMDLCLTNLILLFCNEII

SEQ ID NO: 3084058 - protein, 17 aa, Giardia lamblia
NEFKSILFALIFFHAIV

SEQ ID NO: 3084059 - protein, 17 aa, Giardia lamblia
NEGRTALMYALAYDHQG

SEQ ID NO: 3084060 - protein, 19 aa, Giardia lamblia
NEMYCLSGRCVAKCTTTAD

SEQ ID NO: 3084061 - protein, 18 aa, Giardia lamblia
NENCASCNIVTTCDECKP

SEQ ID NO: 3084062 - protein, 19 aa, Giardia lamblia
NEVGMELLCCFYKEVDAVE

SEQ ID NO: 3084063 - protein, 17 aa, Giardia lamblia
NFAELLHRIPVISSAVE

SEQ ID NO: 3084064 - protein, 19 aa, Giardia lamblia
NFGFHRMQFVIYKIVSLTN

SEQ ID NO: 3084065 - protein, 20 aa, Giardia lamblia
NFHSRFALTNAVARIQLYKI

SEQ ID NO: 3084066 - protein, 20 aa, Giardia lamblia
NFLYDAWDAFPYVDTIASLT

SEQ ID NO: 3084067 - protein, 18 aa, Giardia lamblia
NFPFSRVSLVPNWMIGNT

SEQ ID NO: 3084068 - protein, 18 aa, Giardia lamblia
NGCIPRLTTLIHYAKDLY

SEQ ID NO: 3084069 - protein, 20 aa, Giardia lamblia
NHPKMAWGVLVLAIALLTLV

SEQ ID NO: 3084070 - protein, 25 aa, Giardia lamblia
NIAFGRLWVCPDCDRGTFTVRATAV

SEQ ID NO: 3084071 - protein, 17 aa, Giardia lamblia
NIFLKFTRNSFLVQQPQ

SEQ ID NO: 3084072 - protein, 19 aa, Giardia lamblia
NINFWKWYITYFVGKCSSA

SEQ ID NO: 3084073 - protein, 20 aa, Giardia lamblia
NKGWRAASLLIVLIPVHVGQ

SEQ ID NO: 3084074 - protein, 22 aa, Giardia lamblia
NKIRDCPCCDYAIGADIAFQRP

SEQ ID NO: 3084075 - protein, 22 aa, Giardia lamblia
NKLRLRVGLVVDHINNNCVVPQ

SEQ ID NO: 3084076 - protein, 19 aa, Giardia lamblia
NKMRILGCIAYKTDGETPD

SEQ ID NO: 3084077 - protein, 22 aa, Giardia lamblia
NKRFLSVLFRLIKRFSRLLFTD

SEQ ID NO: 3084078 - protein, 18 aa, Giardia lamblia
NKSFCPFANQFFEKLLHE

SEQ ID NO: 3084079 - protein, 28 aa, Giardia lamblia
NKYTANDCFLSFLILAAEYKYIWSNTVY

SEQ ID NO: 3084080 - protein, 18 aa, Giardia lamblia
NLIFDELLLFTGYLRQPA

SEQ ID NO: 3084081 - protein, 17 aa, Giardia lamblia
NLILRIRSSVGLIPTLY

SEQ ID NO: 3084082 - protein, 18 aa, Giardia lamblia
NLLKRYEAGLGMKPLQTT

SEQ ID NO: 3084083 - protein, 17 aa, Giardia lamblia
NLLPLLFLINKLVALYF

SEQ ID NO: 3084084 - protein, 19 aa, Giardia lamblia
NLMNCGWLLGMFFLVLIGV

SEQ ID NO: 3084085 - protein, 22 aa, Giardia lamblia
NLSLPCRVARDFSQSKKQTACS

SEQ ID NO: 3084086 - protein, 25 aa, Giardia lamblia
NMIRGFCNTCTMMLPYISSAYITTA

SEQ ID NO: 3084087 - protein, 17 aa, Giardia lamblia
NNALRMFSLHFVNMRTE

SEQ ID NO: 3084088 - protein, 26 aa, Giardia lamblia
NNRRRCACLLWPLEHAIADRDGISPR

SEQ ID NO: 3084089 - protein, 20 aa, Giardia lamblia
NNWQLVLILSRFEAQKRDSV

SEQ ID NO: 3084090 - protein, 19 aa, Giardia lamblia
NPAFPFLDMLAIHFASTLC

SEQ ID NO: 3084091 - protein, 23 aa, Giardia lamblia
NPDTDCPVVRSFREACSSGQQVL

SEQ ID NO: 3084092 - protein, 17 aa, Giardia lamblia
NPELEWAGQLSLIAVSL

SEQ ID NO: 3084093 - protein, 23 aa, Giardia lamblia
NPIFSWECYSPWVTYSNEHGSVI

SEQ ID NO: 3084094 - protein, 18 aa, Giardia lamblia
NPMVKWTIICYIQKDVVT

SEQ ID NO: 3084095 - protein, 20 aa, Giardia lamblia
NPNICLCASCASTFGSPSCG

SEQ ID NO: 3084096 - protein, 21 aa, Giardia lamblia
NPSRFRFAMPLRRQDLDPPLL

SEQ ID NO: 3084097 - protein, 22 aa, Giardia lamblia
NPSVLRFARFAADNSGTLRDCY

SEQ ID NO: 3084098 - protein, 17 aa, Giardia lamblia
NQFADSVLLQFLLELTF

SEQ ID NO: 3084099 - protein, 23 aa, Giardia lamblia
NQFLKRYIVAMLIFEKYVIVILA

SEQ ID NO: 3084100 - protein, 24 aa, Giardia lamblia
NQGKCGSCWAFATVAAFEACALYD

SEQ ID NO: 3084101 - protein, 21 aa, Giardia lamblia
NQKRLSVLVPTDFGFTELTTT

SEQ ID NO: 3084102 - protein, 17 aa, Giardia lamblia
NRCARCGGKRPEHYCHA

SEQ ID NO: 3084103 - protein, 19 aa, Giardia lamblia
NRFPCPRPQLQQTRQAFAE

SEQ ID NO: 3084104 - protein, 23 aa, Giardia lamblia
NRRVIPFLLREAWLIDFHGKTPL

SEQ ID NO: 3084105 - protein, 27 aa, Giardia lamblia
NSFKCIRITASICLSGFMIGLSSTSTA

SEQ ID NO: 3084106 - protein, 21 aa, Giardia lamblia
NSLEKWAMLVGIKLSISKPTF

SEQ ID NO: 3084107 - protein, 20 aa, Giardia lamblia
NSRLVIRPCIVRRRRKLMRP

SEQ ID NO: 3084108 - protein, 18 aa, Giardia lamblia
NTPMSIAFKRGYTELYNV

SEQ ID NO: 3084109 - protein, 24 aa, Giardia lamblia
NTRTRLRLIGWRLLQSAVCAAPTI

SEQ ID NO: 3084110 - protein, 23 aa, Giardia lamblia
NVFKEALCLPQFTEICVTDTDIA

SEQ ID NO: 3084111 - protein, 25 aa, Giardia lamblia
NVIDSLLFVFGWRARALRHSRLADL

SEQ ID NO: 3084112 - protein, 17 aa, Giardia lamblia
NVMPFKNSFVYIANLTA

SEQ ID NO: 3084113 - protein, 23 aa, Giardia lamblia
NVTKAVSIAENWPVLPDATYATF

SEQ ID NO: 3084114 - protein, 19 aa, Giardia lamblia
NVYFLRARALAIINRLERA

SEQ ID NO: 3084115 - protein, 21 aa, Giardia lamblia
NWMMLGGLFLQIGLAAAFAYI

SEQ ID NO: 3084116 - protein, 21 aa, Giardia lamblia
NYKRLYALIKYSWLYCTVATA

SEQ ID NO: 3084117 - protein, 23 aa, Giardia lamblia
PADLRLILYHSLLRLLYKDGERI

SEQ ID NO: 3084118 - protein, 17 aa, Giardia lamblia
PALFAWKDFCSLSSSAS

SEQ ID NO: 3084119 - protein, 20 aa, Giardia lamblia
PALFRLLLLVTIFQPISIEE

SEQ ID NO: 3084120 - protein, 17 aa, Giardia lamblia
PAPIRFVRDPTLNDLKN

SEQ ID NO: 3084121 - protein, 18 aa, Giardia lamblia
PAPRSGCTTMYIRQNPLS

SEQ ID NO: 3084122 - protein, 24 aa, Giardia lamblia
PAQCIICVSQIYWCEGIHLALEGS

SEQ ID NO: 3084123 - protein, 23 aa, Giardia lamblia
PASLTSWCFLPWESRDRAREESE

SEQ ID NO: 3084124 - protein, 19 aa, Giardia lamblia
PASPVRCIPVLKSSSDMLI

SEQ ID NO: 3084125 - protein, 20 aa, Giardia lamblia
PASVYVRFEYIYVPRISTGS

SEQ ID NO: 3084126 - protein, 19 aa, Giardia lamblia
PAVVREWCEYFSRTHDSAK

SEQ ID NO: 3084127 - protein, 17 aa, Giardia lamblia
PAYDYALNTYHNIFLAL

SEQ ID NO: 3084128 - protein, 18 aa, Giardia lamblia
PCGHALMCHSCMVASISA

SEQ ID NO: 3084129 - protein, 20 aa, Giardia lamblia
PCKMIESIIGPALWDRYGHT

SEQ ID NO: 3084130 - protein, 24 aa, Giardia lamblia
PCLLSRWPRFFFLFDCDINPDWIE

SEQ ID NO: 3084131 - protein, 19 aa, Giardia lamblia
PCPACGAPSQPGASAVLAP

SEQ ID NO: 3084132 - protein, 18 aa, Giardia lamblia
PCYFPIRFIRGPPALTPQ

SEQ ID NO: 3084133 - protein, 20 aa, Giardia lamblia
PDAIRFLALHDRWPTQKEVT

SEQ ID NO: 3084134 - protein, 20 aa, Giardia lamblia
PDILARDGIHSWVPEEVDSP

SEQ ID NO: 3084135 - protein, 20 aa, Giardia lamblia
PDKDRPSLLAAFRNGLRSIT

SEQ ID NO: 3084136 - protein, 17 aa, Giardia lamblia
PDLLKALVYFISTQNPV

SEQ ID NO: 3084137 - protein, 20 aa, Giardia lamblia
PDLRGWRILRSTFYYYLVCC

SEQ ID NO: 3084138 - protein, 21 aa, Giardia lamblia
PDLRMLIHGGVTFESLQSLPL

SEQ ID NO: 3084139 - protein, 23 aa, Giardia lamblia
PDVEGRLAIKGIFTYENKPIAGN

SEQ ID NO: 3084140 - protein, 29 aa, Giardia lamblia
PEESLAHWAFRPELYVNLGVTSTILQIIN

SEQ ID NO: 3084141 - protein, 17 aa, Giardia lamblia
PEFKRPFFARARVRCTV

SEQ ID NO: 3084142 - protein, 20 aa, Giardia lamblia
PEGKPRCKIMAQLYGAILTD

SEQ ID NO: 3084143 - protein, 24 aa, Giardia lamblia
PELLEWINRVLLGPFISYMCYELL

SEQ ID NO: 3084144 - protein, 17 aa, Giardia lamblia
PELSHALALLAGSASKE

SEQ ID NO: 3084145 - protein, 19 aa, Giardia lamblia
PELYGVLLGQCFLMLHESD

SEQ ID NO: 3084146 - protein, 21 aa, Giardia lamblia
PEMFTRGQLKFSYNLLGEQEI

SEQ ID NO: 3084147 - protein, 18 aa, Giardia lamblia
PENVRTALFAKFPDCTGY

SEQ ID NO: 3084148 - protein, 24 aa, Giardia lamblia
PEPRASSCYPEFMLPCLYNPTTRI

SEQ ID NO: 3084149 - protein, 25 aa, Giardia lamblia
PESCLFYMRFCFAVTYDLLGFPSLG

SEQ ID NO: 3084150 - protein, 20 aa, Giardia lamblia
PESISPLVFIIKLLKTEPLE

SEQ ID NO: 3084151 - protein, 17 aa, Giardia lamblia
PESRFISNFGVSPIRPF

SEQ ID NO: 3084152 - protein, 21 aa, Giardia lamblia
PETRMFPGLILGNARSRDLLD

SEQ ID NO: 3084153 - protein, 18 aa, Giardia lamblia
PEYNRVIIIAPISLLLGT

SEQ ID NO: 3084154 - protein, 18 aa, Giardia lamblia
PFHDLLLVDDDIFHNPEA

SEQ ID NO: 3084155 - protein, 25 aa, Giardia lamblia
PFISGLRIFYCLQLKTPQTFNHTLR

SEQ ID NO: 3084156 - protein, 26 aa, Giardia lamblia
PFLFWELLKLLVLSSINLRRVTGPKA

SEQ ID NO: 3084157 - protein, 20 aa, Giardia lamblia
PFQVCNFQAYYALKQFSKLP

SEQ ID NO: 3084158 - protein, 30 aa, Giardia lamblia
PFSTFCYLRQARLRNVFGMTALMLAAKYGN

SEQ ID NO: 3084159 - protein, 18 aa, Giardia lamblia
PFTRKSVVSLQICQQRDQ

SEQ ID NO: 3084160 - protein, 17 aa, Giardia lamblia
PGAHMRLLLQLFGQAMH

SEQ ID NO: 3084161 - protein, 23 aa, Giardia lamblia
PGERTDFRYAYCNAAGVVVVKVE

SEQ ID NO: 3084162 - protein, 18 aa, Giardia lamblia
PGLCAPTPPLPGVSATAT

SEQ ID NO: 3084163 - protein, 17 aa, Giardia lamblia
PHHGRASLMAFYMSILP

SEQ ID NO: 3084164 - protein, 18 aa, Giardia lamblia
PHHWVRAGAVLALGLSAA

SEQ ID NO: 3084165 - protein, 18 aa, Giardia lamblia
PHLGQAWASFSLTQLAMG

SEQ ID NO: 3084166 - protein, 20 aa, Giardia lamblia
PHNAIPVVIPFNFEDLTVHP

SEQ ID NO: 3084167 - protein, 19 aa, Giardia lamblia
PHPGLYCSWIVRNTIAEYT

SEQ ID NO: 3084168 - protein, 20 aa, Giardia lamblia
PHPKQSLTILRVFTTLATAL

SEQ ID NO: 3084169 - protein, 18 aa, Giardia lamblia
PIFRELRKPAAIQRSGNK

SEQ ID NO: 3084170 - protein, 23 aa, Giardia lamblia
PIGEKLCILQLCLTNSCDGIAEM

SEQ ID NO: 3084171 - protein, 19 aa, Giardia lamblia
PIMELCIAISLNLMRMQCT

SEQ ID NO: 3084172 - protein, 20 aa, Giardia lamblia
PIRSYRAAARFNLAKLCAYS

SEQ ID NO: 3084173 - protein, 19 aa, Giardia lamblia
PISSFRVTFAIPKEKIGGK

SEQ ID NO: 3084174 - protein, 24 aa, Giardia lamblia
PITALCFLGQWPLLFSASASGACY

SEQ ID NO: 3084175 - protein, 19 aa, Giardia lamblia
PKGCNALAMAMMSGHKESV

SEQ ID NO: 3084176 - protein, 21 aa, Giardia lamblia
PKKAIKFILRIDISFTEKVHR

SEQ ID NO: 3084177 - protein, 23 aa, Giardia lamblia
PKQRRTPVKWKKPSKVFLLSKEI

SEQ ID NO: 3084178 - protein, 23 aa, Giardia lamblia
PKSTGSVCKLMWSDYTERGKLFS

SEQ ID NO: 3084179 - protein, 20 aa, Giardia lamblia
PKTCSICRRFYNTCLPVVTA

SEQ ID NO: 3084180 - protein, 19 aa, Giardia lamblia
PKTRCVVVGKLRLFQLYNM

SEQ ID NO: 3084181 - protein, 19 aa, Giardia lamblia
PKYVKFVWRLRGIDFATQM

SEQ ID NO: 3084182 - protein, 19 aa, Giardia lamblia
PLASCRPGLYFLRNLTYDE

SEQ ID NO: 3084183 - protein, 19 aa, Giardia lamblia
PLDLAKIYCCLTDLTSGHE

SEQ ID NO: 3084184 - protein, 19 aa, Giardia lamblia
PLFMIILIRFFTPRPPNTF

SEQ ID NO: 3084185 - protein, 18 aa, Giardia lamblia
PLGIKMLYFLLSQFPMTI

SEQ ID NO: 3084186 - protein, 18 aa, Giardia lamblia
PLHLCVINLVIGTLYTVR

SEQ ID NO: 3084187 - protein, 23 aa, Giardia lamblia
PLIFPYCWALFYGAQLISHSKMH

SEQ ID NO: 3084188 - protein, 21 aa, Giardia lamblia
PLIPLPLLACRLVITGLLLHR

SEQ ID NO: 3084189 - protein, 23 aa, Giardia lamblia
PLLAIPRWHFHINIQTQTLIQYK

SEQ ID NO: 3084190 - protein, 17 aa, Giardia lamblia
PLLEYNLGFAFSSDSAD

SEQ ID NO: 3084191 - protein, 24 aa, Giardia lamblia
PLQRFRLLYLISLIVQQFFENIVF

SEQ ID NO: 3084192 - protein, 26 aa, Giardia lamblia
PLSLCARLKGLLFYNSNSAFPHIIQA

SEQ ID NO: 3084193 - protein, 23 aa, Giardia lamblia
PLVLCCLCVTTVLLITVAYMRAA

SEQ ID NO: 3084194 - protein, 17 aa, Giardia lamblia
PMEVFRPLLTVDLIVSI

SEQ ID NO: 3084195 - protein, 23 aa, Giardia lamblia
PMSIDLRPGILLASMRNSQNYIE

SEQ ID NO: 3084196 - protein, 17 aa, Giardia lamblia
PNHFNMLAVIVAAYGVF

SEQ ID NO: 3084197 - protein, 19 aa, Giardia lamblia
PNRFPNVIFYSPRELGGLG

SEQ ID NO: 3084198 - protein, 23 aa, Giardia lamblia
PNTEVQGLLAFFARLMVSGGISS

SEQ ID NO: 3084199 - protein, 18 aa, Giardia lamblia
PPIDSLKGSTGWRTEVRC

SEQ ID NO: 3084200 - protein, 19 aa, Giardia lamblia
PPINPAFPYPLCLLPLPFR

SEQ ID NO: 3084201 - protein, 18 aa, Giardia lamblia
PPQSFIYNWTIPVNMEDI

SEQ ID NO: 3084202 - protein, 18 aa, Giardia lamblia
PPVFRYKYPASLVTSTSP

SEQ ID NO: 3084203 - protein, 19 aa, Giardia lamblia
PQLCKKLGKYISMELDCVY

SEQ ID NO: 3084204 - protein, 17 aa, Giardia lamblia
PQLEMFRQAKIHNIIIE

SEQ ID NO: 3084205 - protein, 18 aa, Giardia lamblia
PQQCSGCFPGYYKSGDKC

SEQ ID NO: 3084206 - protein, 19 aa, Giardia lamblia
PQVVWDYGLDFDWQLLNGI

SEQ ID NO: 3084207 - protein, 17 aa, Giardia lamblia
PQWIQNIMDKFKFRAPG

SEQ ID NO: 3084208 - protein, 19 aa, Giardia lamblia
PRGSFGRACNFCDRSFMLI

SEQ ID NO: 3084209 - protein, 18 aa, Giardia lamblia
PRIVIDWRPLMKLFIRQV

SEQ ID NO: 3084210 - protein, 17 aa, Giardia lamblia
PRLPAFVYLLSPNPCSN

SEQ ID NO: 3084211 - protein, 19 aa, Giardia lamblia
PRPAERFIVVIALSVAATM

SEQ ID NO: 3084212 - protein, 20 aa, Giardia lamblia
PRPASCLALLSSHNGASAIV

SEQ ID NO: 3084213 - protein, 20 aa, Giardia lamblia
PRPVFYILIRNMELLGVSYD

SEQ ID NO: 3084214 - protein, 17 aa, Giardia lamblia
PRWTIFMAGIFMTAGSL

SEQ ID NO: 3084215 - protein, 18 aa, Giardia lamblia
PRYGLKRGIQTGMLSCTF

SEQ ID NO: 3084216 - protein, 18 aa, Giardia lamblia
PRYNCFKLVDLFATKSDI

SEQ ID NO: 3084217 - protein, 17 aa, Giardia lamblia
PSFIGVPCGHALMCHSC

SEQ ID NO: 3084218 - protein, 22 aa, Giardia lamblia
PSIKFLYVCSGLSILYYRIPFV

SEQ ID NO: 3084219 - protein, 19 aa, Giardia lamblia
PSIRSSGLYDFLVSENGVE

SEQ ID NO: 3084220 - protein, 20 aa, Giardia lamblia
PSPLFFKLGEVFVRYFNYMS

SEQ ID NO: 3084221 - protein, 17 aa, Giardia lamblia
PSRISCNIFSPSFEISI

SEQ ID NO: 3084222 - protein, 18 aa, Giardia lamblia
PSWVQFCRGSLSWYEDYG

SEQ ID NO: 3084223 - protein, 30 aa, Giardia lamblia
PTIYRTNCQPWRYWFEFVTFYVSGIYMAVI

SEQ ID NO: 3084224 - protein, 17 aa, Giardia lamblia
PTLSYILNLPLLMGARR

SEQ ID NO: 3084225 - protein, 18 aa, Giardia lamblia
PTMRRLLGITSTDWLPDF

SEQ ID NO: 3084226 - protein, 19 aa, Giardia lamblia
PTTLLRRILGLSFKAQDIM

SEQ ID NO: 3084227 - protein, 20 aa, Giardia lamblia
PVKIVWPREFYTFSIWTSYS

SEQ ID NO: 3084228 - protein, 25 aa, Giardia lamblia
PVPLRLPGDLFLGAVVTRARAGHAL

SEQ ID NO: 3084229 - protein, 18 aa, Giardia lamblia
PVQRLSCRQRFMQNAWGV

SEQ ID NO: 3084230 - protein, 17 aa, Giardia lamblia
PYALDFLGWASTVFEVI

SEQ ID NO: 3084231 - protein, 19 aa, Giardia lamblia
PYCSVFSIRCNLFQLSSRG

SEQ ID NO: 3084232 - protein, 17 aa, Giardia lamblia
PYIFTLMYMRAYYLLKT

SEQ ID NO: 3084233 - protein, 23 aa, Giardia lamblia
PYMCYRDNLAFARPLPLFKTNAI

SEQ ID NO: 3084234 - protein, 22 aa, Giardia lamblia
PYPTDLSLLFAMVNELLTELPD

SEQ ID NO: 3084235 - protein, 21 aa, Giardia lamblia
PYQGYRWPYLYSRPCPDSVSE

SEQ ID NO: 3084236 - protein, 22 aa, Giardia lamblia
PYTRGAMRISFEFPIKSTEKVI

SEQ ID NO: 3084237 - protein, 27 aa, Giardia lamblia
QACKICTRRGLCFGKSLPTIKVREEDV

SEQ ID NO: 3084238 - protein, 24 aa, Giardia lamblia
QAFLEIVRRVSIFLALFGCQISIA

SEQ ID NO: 3084239 - protein, 17 aa, Giardia lamblia
QAFSGWFARVFDTDVGI

SEQ ID NO: 3084240 - protein, 25 aa, Giardia lamblia
QALLCLFIFKYVKPFLISYILIMKA

SEQ ID NO: 3084241 - protein, 18 aa, Giardia lamblia
QALLRCLSCSHNNVSNSV

SEQ ID NO: 3084242 - protein, 18 aa, Giardia lamblia
QALYLLCHGVVWNFLKTG

SEQ ID NO: 3084243 - protein, 17 aa, Giardia lamblia
QCLCNLATFGLGLDIVA

SEQ ID NO: 3084244 - protein, 23 aa, Giardia lamblia
QDIVWTPSMIRLFALLFTSVSNG

SEQ ID NO: 3084245 - protein, 25 aa, Giardia lamblia
QDNHGWSALHWAVFYGCANIVQYLA

SEQ ID NO: 3084246 - protein, 18 aa, Giardia lamblia
QDSVCKFGLLSISADASA

SEQ ID NO: 3084247 - protein, 17 aa, Giardia lamblia
QDVYIIISLLYILQGGG

SEQ ID NO: 3084248 - protein, 18 aa, Giardia lamblia
QEAIEFVRQIALSREERA

SEQ ID NO: 3084249 - protein, 22 aa, Giardia lamblia
QELREVLGWSEGQACQSAYSLS

SEQ ID NO: 3084250 - protein, 19 aa, Giardia lamblia
QELRFSVKLLGTVKQRTDD

SEQ ID NO: 3084251 - protein, 17 aa, Giardia lamblia
QFFGAALYSWLGGNSPW

SEQ ID NO: 3084252 - protein, 21 aa, Giardia lamblia
QFTKAWCCEDVLSLIYHAGFV

SEQ ID NO: 3084253 - protein, 22 aa, Giardia lamblia
QGELSTFCLFLINMLKGRLDQW

SEQ ID NO: 3084254 - protein, 19 aa, Giardia lamblia
QICFTCLYFFTSLVLHTGV

SEQ ID NO: 3084255 - protein, 22 aa, Giardia lamblia
QICMTCGILAIEILALTLKKPM

SEQ ID NO: 3084256 - protein, 25 aa, Giardia lamblia
QIIREFIEILYLYLARFGRHIVVTL

SEQ ID NO: 3084257 - protein, 18 aa, Giardia lamblia
QILAVRYNYQLGMHGFNL

SEQ ID NO: 3084258 - protein, 20 aa, Giardia lamblia
QILTCLYKQWLALIQSPQSY

SEQ ID NO: 3084259 - protein, 27 aa, Giardia lamblia
QISLPRWLSFRLNVIGAFFCGFIALIS

SEQ ID NO: 3084260 - protein, 28 aa, Giardia lamblia
QISLPRWLSFRLNVIGAFFCGFIALISC

SEQ ID NO: 3084261 - protein, 23 aa, Giardia lamblia
QKDKLLCCKKIMYSCLSSKAKEL

SEQ ID NO: 3084262 - protein, 20 aa, Giardia lamblia
QKFGLFVPMVCWQCGILYEM

SEQ ID NO: 3084263 - protein, 23 aa, Giardia lamblia
QKGRRYLIFIGMPIILFSLILLM

SEQ ID NO: 3084264 - protein, 19 aa, Giardia lamblia
QKVPFKWSLMFALINVFVP

SEQ ID NO: 3084265 - protein, 24 aa, Giardia lamblia
QLESRFNPFISRSFQKAVLASCLD

SEQ ID NO: 3084266 - protein, 26 aa, Giardia lamblia
QLICHLIELTVSLALLFNFRQTANLY

SEQ ID NO: 3084267 - protein, 17 aa, Giardia lamblia
QLLNGIRYTPLFTAQTL

SEQ ID NO: 3084268 - protein, 18 aa, Giardia lamblia
QLMERVSFFFAFSKDVGH

SEQ ID NO: 3084269 - protein, 18 aa, Giardia lamblia
QLSCELHMIWPKRDTVVS

SEQ ID NO: 3084270 - protein, 25 aa, Giardia lamblia
QMSVLRRSRFVFCGRIINYMTSLSN

SEQ ID NO: 3084271 - protein, 18 aa, Giardia lamblia
QNTMGWTALCFAADNGHT

SEQ ID NO: 3084272 - protein, 18 aa, Giardia lamblia
QQLPFCLFMGCSSLSHIP

SEQ ID NO: 3084273 - protein, 21 aa, Giardia lamblia
QQSLLRFYKFRGLDLSPDRVA

SEQ ID NO: 3084274 - protein, 18 aa, Giardia lamblia
QRASEFITAFTLINTYLR

SEQ ID NO: 3084275 - protein, 17 aa, Giardia lamblia
QRCGESLMHLCTINDSF

SEQ ID NO: 3084276 - protein, 25 aa, Giardia lamblia
QRIITLYLFCLWLFIKHLKKDDPET

SEQ ID NO: 3084277 - protein, 18 aa, Giardia lamblia
QRLREIAKRYTVLPENHS

SEQ ID NO: 3084278 - protein, 19 aa, Giardia lamblia
QRLTDFSARFGINPNFGID

SEQ ID NO: 3084279 - protein, 23 aa, Giardia lamblia
QRPMARRSFLRFALLLQAGDRIY

SEQ ID NO: 3084280 - protein, 25 aa, Giardia lamblia
QRSRILSALCPFLGLPMTIKAVEDF

SEQ ID NO: 3084281 - protein, 18 aa, Giardia lamblia
QRTCFSRATLVVATNLAI

SEQ ID NO: 3084282 - protein, 22 aa, Giardia lamblia
QRTLRYYYLWSLQFIASPILFP

SEQ ID NO: 3084283 - protein, 17 aa, Giardia lamblia
QRVPWKINWPVRFMVLL

SEQ ID NO: 3084284 - protein, 17 aa, Giardia lamblia
QSCGRESFFSPFMCNCL

SEQ ID NO: 3084285 - protein, 21 aa, Giardia lamblia
QSFLMLYGWDVMNPRTRTTGT

SEQ ID NO: 3084286 - protein, 18 aa, Giardia lamblia
QSLFCFPAGIKPKVSSFI

SEQ ID NO: 3084287 - protein, 17 aa, Giardia lamblia
QSPFRCHLQAQKLKNVS

SEQ ID NO: 3084288 - protein, 25 aa, Giardia lamblia
QSPPIFICFLLMFIFHVLLRSNSVI

SEQ ID NO: 3084289 - protein, 18 aa, Giardia lamblia
QSRFKAPVVYLREVILSG

SEQ ID NO: 3084290 - protein, 21 aa, Giardia lamblia
QSRMPCGLSFYDPLDTPHTSL

SEQ ID NO: 3084291 - protein, 20 aa, Giardia lamblia
QSSKCLACWDDTVGGVANCG

SEQ ID NO: 3084292 - protein, 21 aa, Giardia lamblia
QTCLFTRLNIRTHHSAPTEFD

SEQ ID NO: 3084293 - protein, 24 aa, Giardia lamblia
QTFLLCLRPFFTLLSLLHCTLLRQ

SEQ ID NO: 3084294 - protein, 18 aa, Giardia lamblia
QVALRWADCLGVTLNLAD

SEQ ID NO: 3084295 - protein, 18 aa, Giardia lamblia
QVFLRFLLGDVHLTLENA

SEQ ID NO: 3084296 - protein, 23 aa, Giardia lamblia
QVQLPICASIPFSHFSSILSTGV

SEQ ID NO: 3084297 - protein, 18 aa, Giardia lamblia
QVRTRLRTAVSYRDELEE

SEQ ID NO: 3084298 - protein, 18 aa, Giardia lamblia
QYPRLCFNLLRDANNLKK

SEQ ID NO: 3084299 - protein, 17 aa, Giardia lamblia
QYRELTIPFSRVVAIIF

SEQ ID NO: 3084300 - protein, 27 aa, Giardia lamblia
QYRICAPYARLPLSFAVLYSQLTTVPL

SEQ ID NO: 3084301 - protein, 18 aa, Giardia lamblia
QYYWRVNRYYTFGDPDPN

SEQ ID NO: 3084302 - protein, 25 aa, Giardia lamblia
RAACRRCLSHISMLLGPRNLGTILL

SEQ ID NO: 3084303 - protein, 27 aa, Giardia lamblia
RACGKPALKCKLSWCASATRAEGGPTD

SEQ ID NO: 3084304 - protein, 19 aa, Giardia lamblia
RAIFLVMFLCCLLLSLLLT

SEQ ID NO: 3084305 - protein, 19 aa, Giardia lamblia
RASYVWRTICPDSHFTNCD

SEQ ID NO: 3084306 - protein, 20 aa, Giardia lamblia
RAVYHYAVFFSRQPIFFHQF

SEQ ID NO: 3084307 - protein, 23 aa, Giardia lamblia
RAYHCKICRGCVLKRDHHCPWIG

SEQ ID NO: 3084308 - protein, 18 aa, Giardia lamblia
RCACDLLYILSAQYGCVP

SEQ ID NO: 3084309 - protein, 22 aa, Giardia lamblia
RCFNLKVLEEIILPGLTGYMMR

SEQ ID NO: 3084310 - protein, 19 aa, Giardia lamblia
RCFRHMYYLTQIVKPCPST

SEQ ID NO: 3084311 - protein, 17 aa, Giardia lamblia
RCIKGVCKFFCVLDSDC

SEQ ID NO: 3084312 - protein, 17 aa, Giardia lamblia
RCIRKLAGICASFKLQI

SEQ ID NO: 3084313 - protein, 22 aa, Giardia lamblia
RCKNNMLVFFARLMSLVMMSIW

SEQ ID NO: 3084314 - protein, 19 aa, Giardia lamblia
RCLRLPKGMREWEAYIELQ

SEQ ID NO: 3084315 - protein, 24 aa, Giardia lamblia
RCRCGAIRCPYCGGLGSNMGLISG

SEQ ID NO: 3084316 - protein, 20 aa, Giardia lamblia
RCSQGFWWKVFNNSVFLAVQ

SEQ ID NO: 3084317 - protein, 25 aa, Giardia lamblia
RCTRVCIPRMLLLMAYKHLVISTKG

SEQ ID NO: 3084318 - protein, 19 aa, Giardia lamblia
RCVCAPGWTGYDCSSCSRG

SEQ ID NO: 3084319 - protein, 17 aa, Giardia lamblia
RCVVCLFTEVYCCSEAF

SEQ ID NO: 3084320 - protein, 25 aa, Giardia lamblia
RDIPLAFWCFYRFIKRFGNMYLPSL

SEQ ID NO: 3084321 - protein, 23 aa, Giardia lamblia
RDKWTALMLCAKYNRYEVATELV

SEQ ID NO: 3084322 - protein, 25 aa, Giardia lamblia
RDLCMLVAPLCRFLYVTLSKGIYLT

SEQ ID NO: 3084323 - protein, 20 aa, Giardia lamblia
RDMCCCLTDTILCMSDADTI

SEQ ID NO: 3084324 - protein, 19 aa, Giardia lamblia
RDPSEIYKSIGLCPQHDAY

SEQ ID NO: 3084325 - protein, 24 aa, Giardia lamblia
RDREFCRLWSIFDWEYKVAVSTLA

SEQ ID NO: 3084326 - protein, 23 aa, Giardia lamblia
RDRFIELSAFFPAHETHVLGLTE

SEQ ID NO: 3084327 - protein, 22 aa, Giardia lamblia
RDSCAQNRCVFMGWEELCTQCV

SEQ ID NO: 3084328 - protein, 25 aa, Giardia lamblia
RDYYAAYCNFVYLCSKYCIITVVPV

SEQ ID NO: 3084329 - protein, 17 aa, Giardia lamblia
REACYLCTLVHRGWPQK

SEQ ID NO: 3084330 - protein, 19 aa, Giardia lamblia
REDFIWRVAAVIVFVLEYL

SEQ ID NO: 3084331 - protein, 20 aa, Giardia lamblia
REFLVFRALVLAYAQPPFVQ

SEQ ID NO: 3084332 - protein, 17 aa, Giardia lamblia
REHMGIYILIIVLAVIV

SEQ ID NO: 3084333 - protein, 23 aa, Giardia lamblia
RELFWKKRIGHVISGRLELGLEN

SEQ ID NO: 3084334 - protein, 20 aa, Giardia lamblia
RELLPGPFLIPVIAFPFIIL

SEQ ID NO: 3084335 - protein, 23 aa, Giardia lamblia
RFGSINMFLCWAFLATLSSLCSA

SEQ ID NO: 3084336 - protein, 24 aa, Giardia lamblia
RFLRFHCFLPLFSLINSLTQFNMS

SEQ ID NO: 3084337 - protein, 18 aa, Giardia lamblia
RFSDLPFMFFRNGLATTL

SEQ ID NO: 3084338 - protein, 28 aa, Giardia lamblia
RFVKLISIIAICIGVLFFILSLSLGIEW

SEQ ID NO: 3084339 - protein, 23 aa, Giardia lamblia
RGASCLKALGIIKCMQKYGLLRD

SEQ ID NO: 3084340 - protein, 24 aa, Giardia lamblia
RGMYRGVICFPKYYEGRPMTDCLS

SEQ ID NO: 3084341 - protein, 20 aa, Giardia lamblia
RGPVGVICACLDSEQSMQLL

SEQ ID NO: 3084342 - protein, 18 aa, Giardia lamblia
RGRSELLSFMQVYAGYGA

SEQ ID NO: 3084343 - protein, 18 aa, Giardia lamblia
RHIGCFAAAVSDLLIINV

SEQ ID NO: 3084344 - protein, 17 aa, Giardia lamblia
RHLREFGSRHLLRVEFA

SEQ ID NO: 3084345 - protein, 24 aa, Giardia lamblia
RHNDCKYLTLAIVFGVILIVCLIW

SEQ ID NO: 3084346 - protein, 19 aa, Giardia lamblia
RHRCTLPHELLELAHSHSD

SEQ ID NO: 3084347 - protein, 19 aa, Giardia lamblia
RICRELNIDYMLILYGGMS

SEQ ID NO: 3084348 - protein, 17 aa, Giardia lamblia
RIIFLRAKCELSFMELF

SEQ ID NO: 3084349 - protein, 18 aa, Giardia lamblia
RIMVRMCLRKHASDRISS

SEQ ID NO: 3084350 - protein, 24 aa, Giardia lamblia
RINPLIPSIVRWTSGVPYVPPYTI

SEQ ID NO: 3084351 - protein, 22 aa, Giardia lamblia
RINPYRISHEFLQKSQLIVPGI

SEQ ID NO: 3084352 - protein, 24 aa, Giardia lamblia
RIPSMKFPHVFNFRSVLDPTYLNT

SEQ ID NO: 3084353 - protein, 18 aa, Giardia lamblia
RITDFLAFIPMFTAVPFR

SEQ ID NO: 3084354 - protein, 19 aa, Giardia lamblia
RIYCDTHWTALMFACDSGH

SEQ ID NO: 3084355 - protein, 19 aa, Giardia lamblia
RIYFAKALACYRENNFPLC

SEQ ID NO: 3084356 - protein, 18 aa, Giardia lamblia
RKLGYEVLTHVAQVAHEP

SEQ ID NO: 3084357 - protein, 20 aa, Giardia lamblia
RKPLVICIGDLYFSRYNPLF

SEQ ID NO: 3084358 - protein, 24 aa, Giardia lamblia
RKQLCLLKRACIYIAELKEALHVK

SEQ ID NO: 3084359 - protein, 19 aa, Giardia lamblia
RKRILDPIFRAAREYGSLL

SEQ ID NO: 3084360 - protein, 26 aa, Giardia lamblia
RKRQWKMRWCKKLTYIIIGVDYGLLL

SEQ ID NO: 3084361 - protein, 21 aa, Giardia lamblia
RKRSWIKLSLTFVIDIFPSLL

SEQ ID NO: 3084362 - protein, 26 aa, Giardia lamblia
RLALSLRLKFIVGMVINITLGLVFPL

SEQ ID NO: 3084363 - protein, 21 aa, Giardia lamblia
RLCGCGSKRCRICLRCNSCCY

SEQ ID NO: 3084364 - protein, 22 aa, Giardia lamblia
RLCGLLSEFYLQFFGRDILATF

SEQ ID NO: 3084365 - protein, 24 aa, Giardia lamblia
RLFAFAVVYNVRFPKVFDSRLISC

SEQ ID NO: 3084366 - protein, 18 aa, Giardia lamblia
RLGIPFPYPYSSGLRTNL

SEQ ID NO: 3084367 - protein, 19 aa, Giardia lamblia
RLLPALCISYGRYLEYIKH

SEQ ID NO: 3084368 - protein, 17 aa, Giardia lamblia
RLMPDGRFVMYTREIEE

SEQ ID NO: 3084369 - protein, 17 aa, Giardia lamblia
RLNTIGVFLAHLSQYKS

SEQ ID NO: 3084370 - protein, 26 aa, Giardia lamblia
RLPMCVICARVAIRFTINTNCKCIAC

SEQ ID NO: 3084371 - protein, 18 aa, Giardia lamblia
RLPSFIILHFIPLLVNKA

SEQ ID NO: 3084372 - protein, 17 aa, Giardia lamblia
RLTLMPEFARFILEFIP

SEQ ID NO: 3084373 - protein, 24 aa, Giardia lamblia
RLVFVQACGLEFYRTVLNELVETV

SEQ ID NO: 3084374 - protein, 19 aa, Giardia lamblia
RLYEYFKRLEITDLICEQI

SEQ ID NO: 3084375 - protein, 19 aa, Giardia lamblia
RLYRKYRLSCNITKNKILY

SEQ ID NO: 3084376 - protein, 23 aa, Giardia lamblia
RNDIVAVYCLLPLQAGVQDRNGY

SEQ ID NO: 3084377 - protein, 20 aa, Giardia lamblia
RNIRFTLSYMRFLRDRNDQL

SEQ ID NO: 3084378 - protein, 17 aa, Giardia lamblia
RNMCIGCLVLAIVNAAQ

SEQ ID NO: 3084379 - protein, 18 aa, Giardia lamblia
RNMLRPGILSGYLCKSLN

SEQ ID NO: 3084380 - protein, 20 aa, Giardia lamblia
RPAFGFGEGFLMHLSAIIYS

SEQ ID NO: 3084381 - protein, 19 aa, Giardia lamblia
RPDAAKWSAIYGRHCGVGA

SEQ ID NO: 3084382 - protein, 17 aa, Giardia lamblia
RPDVAIVALEFESRCRL

SEQ ID NO: 3084383 - protein, 18 aa, Giardia lamblia
RPGLEHLSYWAVEEPNVG

SEQ ID NO: 3084384 - protein, 24 aa, Giardia lamblia
RPGYCPVCKLLRVPSDLRLTQRAM

SEQ ID NO: 3084385 - protein, 18 aa, Giardia lamblia
RPHIAPPLPFLDFLHYWF

SEQ ID NO: 3084386 - protein, 20 aa, Giardia lamblia
RPHLLPALKTGWWFATVYES

SEQ ID NO: 3084387 - protein, 20 aa, Giardia lamblia
RPLKKICCLAGLRGSGRSVL

SEQ ID NO: 3084388 - protein, 17 aa, Giardia lamblia
RPLMKLFIRQVFIGTSI

SEQ ID NO: 3084389 - protein, 19 aa, Giardia lamblia
RPSTTIVRLLVKYRDIREV

SEQ ID NO: 3084390 - protein, 23 aa, Giardia lamblia
RQAEKLPDFVLWRILNGLKVGEL

SEQ ID NO: 3084391 - protein, 21 aa, Giardia lamblia
RQCYCCPCSGCDCGGGCASGY

SEQ ID NO: 3084392 - protein, 26 aa, Giardia lamblia
RQIVAVCLRFLLPTVCFMATGVGLSL

SEQ ID NO: 3084393 - protein, 19 aa, Giardia lamblia
RQRIGPCRIIFYMDTKTFA

SEQ ID NO: 3084394 - protein, 18 aa, Giardia lamblia
RRDFWLFMHGLNLLIKND

SEQ ID NO: 3084395 - protein, 17 aa, Giardia lamblia
RRHVWTLSFLDEMLPQL

SEQ ID NO: 3084396 - protein, 19 aa, Giardia lamblia
RRIIDCLAILMHAPLSKIS

SEQ ID NO: 3084397 - protein, 19 aa, Giardia lamblia
RRILKNIIVFPVFISAECK

SEQ ID NO: 3084398 - protein, 21 aa, Giardia lamblia
RRKKQALIHMVVFCSYLLSAD

SEQ ID NO: 3084399 - protein, 20 aa, Giardia lamblia
RRLFPINIKIIWRILLFAIP

SEQ ID NO: 3084400 - protein, 17 aa, Giardia lamblia
RRLFVCIGAVDQYDNQI

SEQ ID NO: 3084401 - protein, 17 aa, Giardia lamblia
RRMLSIFAIYLISAQIP

SEQ ID NO: 3084402 - protein, 17 aa, Giardia lamblia
RRSEILGAQPSNSFDPA

SEQ ID NO: 3084403 - protein, 23 aa, Giardia lamblia
RRSSRPIAFFSMEPIFYRYIEAA

SEQ ID NO: 3084404 - protein, 22 aa, Giardia lamblia
RRTARFSQRFAFDDDLEPDLQQ

SEQ ID NO: 3084405 - protein, 18 aa, Giardia lamblia
RRTCAYSYVPYEMLTFLS

SEQ ID NO: 3084406 - protein, 18 aa, Giardia lamblia
RSDACSLLLRICPLCNVT

SEQ ID NO: 3084407 - protein, 20 aa, Giardia lamblia
RSFLLWPIAMLGSRRIFCIN

SEQ ID NO: 3084408 - protein, 18 aa, Giardia lamblia
RSKVAVFLVDFLDLHDSV

SEQ ID NO: 3084409 - protein, 17 aa, Giardia lamblia
RSLGRFCIVLNCTEALD

SEQ ID NO: 3084410 - protein, 19 aa, Giardia lamblia
RSLRTAWTVYNRLGAQISR

SEQ ID NO: 3084411 - protein, 22 aa, Giardia lamblia
RSMGWKNAIDFAIITPANAEEI

SEQ ID NO: 3084412 - protein, 23 aa, Giardia lamblia
RSMYRRLILIFSQNVEEIWSFCN

SEQ ID NO: 3084413 - protein, 21 aa, Giardia lamblia
RSNLIPHRLFYVLPNDCLRLS

SEQ ID NO: 3084414 - protein, 23 aa, Giardia lamblia
RSRSTFCGLSLCTERLRLIENSA

SEQ ID NO: 3084415 - protein, 20 aa, Giardia lamblia
RSTMRIVFFSLSFIVLAAVV

SEQ ID NO: 3084416 - protein, 17 aa, Giardia lamblia
RSWYGLVIVVGIVAILM

SEQ ID NO: 3084417 - protein, 21 aa, Giardia lamblia
RTCVFCRAYLLGCTKCTISRD

SEQ ID NO: 3084418 - protein, 19 aa, Giardia lamblia
RTDLYWLIVQWYILTEKVS

SEQ ID NO: 3084419 - protein, 19 aa, Giardia lamblia
RTGRLIAMLVMVFFYMLAE

SEQ ID NO: 3084420 - protein, 20 aa, Giardia lamblia
RTGTVLSVFEQAWSIGLINM

SEQ ID NO: 3084421 - protein, 19 aa, Giardia lamblia
RTIMKYKSRCKVLLSGTPI

SEQ ID NO: 3084422 - protein, 23 aa, Giardia lamblia
RTIPSWKVSSAWSNPPSVTSQET

SEQ ID NO: 3084423 - protein, 18 aa, Giardia lamblia
RTLTELAMGIFELIGERQ

SEQ ID NO: 3084424 - protein, 23 aa, Giardia lamblia
RTVGDLFISLACDCWFARNIPIS

SEQ ID NO: 3084425 - protein, 17 aa, Giardia lamblia
RTYYELVGFLMDKCLDY

SEQ ID NO: 3084426 - protein, 24 aa, Giardia lamblia
RVFARESVRLIKLWRANGSTLPKN

SEQ ID NO: 3084427 - protein, 20 aa, Giardia lamblia
RVIRLILWKKVLKNIHSDSR

SEQ ID NO: 3084428 - protein, 23 aa, Giardia lamblia
RVIVLDLLFRCCAANPQELMPHA

SEQ ID NO: 3084429 - protein, 22 aa, Giardia lamblia
RVLAAEMYLELAYVYLESTGIL

SEQ ID NO: 3084430 - protein, 17 aa, Giardia lamblia
RVPLAWRLTELLLQQDS

SEQ ID NO: 3084431 - protein, 20 aa, Giardia lamblia
RVQYSAGLGLWAIVVLYPTI

SEQ ID NO: 3084432 - protein, 24 aa, Giardia lamblia
RVSKFRRLWHLGREIQVCMERMGS

SEQ ID NO: 3084433 - protein, 18 aa, Giardia lamblia
RVTCFFDDLAIFQKLFSA

SEQ ID NO: 3084434 - protein, 18 aa, Giardia lamblia
RVVAIIFYAYSSFRKTLY

SEQ ID NO: 3084435 - protein, 23 aa, Giardia lamblia
RWFGFAKCMLRVSVLDARPVQDP

SEQ ID NO: 3084436 - protein, 23 aa, Giardia lamblia
RWKLSSKDALDWSTWRKRHLLLV

SEQ ID NO: 3084437 - protein, 19 aa, Giardia lamblia
RWRSIICIYELAARLLKIG

SEQ ID NO: 3084438 - protein, 18 aa, Giardia lamblia
RYAFLYSKLFALFITDVV

SEQ ID NO: 3084439 - protein, 19 aa, Giardia lamblia
RYHIRFLTWYYIMWTVSRI

SEQ ID NO: 3084440 - protein, 20 aa, Giardia lamblia
RYIDCAPALPSNRCARCGGK

SEQ ID NO: 3084441 - protein, 17 aa, Giardia lamblia
RYIEAARRLTLFLHGYE

SEQ ID NO: 3084442 - protein, 19 aa, Giardia lamblia
RYLCIPSKCLTSKTGLERI

SEQ ID NO: 3084443 - protein, 18 aa, Giardia lamblia
RYLYLRPYALDFLGWAST

SEQ ID NO: 3084444 - protein, 18 aa, Giardia lamblia
RYPSFYPRKGELLKDAYL

SEQ ID NO: 3084445 - protein, 18 aa, Giardia lamblia
RYRAVPIVAALDMSAFYI

SEQ ID NO: 3084446 - protein, 18 aa, Giardia lamblia
RYRFTRKEMALFDGRHNA

SEQ ID NO: 3084447 - protein, 19 aa, Giardia lamblia
RYTALMIAVLLGWNRAVEA

SEQ ID NO: 3084448 - protein, 20 aa, Giardia lamblia
SAAGCTRCTKGYFLHYGSCF

SEQ ID NO: 3084449 - protein, 26 aa, Giardia lamblia
SAARTAFFWLYCVFSTFKPSYSQESL

SEQ ID NO: 3084450 - protein, 19 aa, Giardia lamblia
SACAVTHIFFKYGCYDRYG

SEQ ID NO: 3084451 - protein, 25 aa, Giardia lamblia
SADYELRCLIVALVVLSCVPAVDYR

SEQ ID NO: 3084452 - protein, 17 aa, Giardia lamblia
SAFPNRYALAIVLDQHS

SEQ ID NO: 3084453 - protein, 18 aa, Giardia lamblia
SAGYVFCRFVIWILLIFV

SEQ ID NO: 3084454 - protein, 30 aa, Giardia lamblia
SAIVKILFAWCFRMQRLLKGVCLGPWLRKQ

SEQ ID NO: 3084455 - protein, 18 aa, Giardia lamblia
SAPEVFAGYCVERTSDTT

SEQ ID NO: 3084456 - protein, 18 aa, Giardia lamblia
SAPFVLKRLRVFLRDLQS

SEQ ID NO: 3084457 - protein, 17 aa, Giardia lamblia
SAPIVKCSVAFMSTNIY

SEQ ID NO: 3084458 - protein, 18 aa, Giardia lamblia
SAVQMRWAGTKGVLILNA

SEQ ID NO: 3084459 - protein, 19 aa, Giardia lamblia
SAYSRRGAAYLKLKNGALA

SEQ ID NO: 3084460 - protein, 29 aa, Giardia lamblia
SAYTEHVWRFCYLRMGMYSGFAITLYTLA

SEQ ID NO: 3084461 - protein, 20 aa, Giardia lamblia
SCAKGSAGVGVFDLEEYGAT

SEQ ID NO: 3084462 - protein, 18 aa, Giardia lamblia
SCCQELFFALATVTYSKA

SEQ ID NO: 3084463 - protein, 18 aa, Giardia lamblia
SCICKFFFSEGFSNSIFW

SEQ ID NO: 3084464 - protein, 17 aa, Giardia lamblia
SCLPLSMSQFLATASFI

SEQ ID NO: 3084465 - protein, 19 aa, Giardia lamblia
SCLYTCLFIQFLLNDNKNL

SEQ ID NO: 3084466 - protein, 23 aa, Giardia lamblia
SCNSELWGSVWQRCVSPILVFQY

SEQ ID NO: 3084467 - protein, 18 aa, Giardia lamblia
SCRMGAEVVASWTRAKIT

SEQ ID NO: 3084468 - protein, 17 aa, Giardia lamblia
SCRPVDCLAKYGHSRPY

SEQ ID NO: 3084469 - protein, 19 aa, Giardia lamblia
SCSISNCLVCLANNRDVCA

SEQ ID NO: 3084470 - protein, 18 aa, Giardia lamblia
SCSLCGGLSTWTAVVCAH

SEQ ID NO: 3084471 - protein, 18 aa, Giardia lamblia
SCTACYPGYSLLYGSGTA

SEQ ID NO: 3084472 - protein, 23 aa, Giardia lamblia
SCTNCPRCRVHAVCNHCHAKIAI

SEQ ID NO: 3084473 - protein, 17 aa, Giardia lamblia
SCTRIASRFSVELDVFL

SEQ ID NO: 3084474 - protein, 19 aa, Giardia lamblia
SCVPCKVSGCSRCTSGYAG

SEQ ID NO: 3084475 - protein, 18 aa, Giardia lamblia
SCVVPLLLQEAGMQSSDG

SEQ ID NO: 3084476 - protein, 18 aa, Giardia lamblia
SCWLSAPGMGWVKKDGIG

SEQ ID NO: 3084477 - protein, 20 aa, Giardia lamblia
SCYMIPYLLAHHGAFTGVQE

SEQ ID NO: 3084478 - protein, 19 aa, Giardia lamblia
SDCKLRLVVDACPVRTSII

SEQ ID NO: 3084479 - protein, 24 aa, Giardia lamblia
SDFHARFKLCFSFIAHYALSLAIY

SEQ ID NO: 3084480 - protein, 25 aa, Giardia lamblia
SDIPPLLQFYDWIAVGFDNVKANDF

SEQ ID NO: 3084481 - protein, 18 aa, Giardia lamblia
SDPGRLATHYSLSVLISR

SEQ ID NO: 3084482 - protein, 21 aa, Giardia lamblia
SDRIIRCMLTFTTLPDARLLT

SEQ ID NO: 3084483 - protein, 19 aa, Giardia lamblia
SDSLFRFTVVPWKSTSVPD

SEQ ID NO: 3084484 - protein, 19 aa, Giardia lamblia
SDSRFTRFINYVSASIIEE

SEQ ID NO: 3084485 - protein, 23 aa, Giardia lamblia
SEDTPKITIAWLIQNDALNFKDE

SEQ ID NO: 3084486 - protein, 24 aa, Giardia lamblia
SEFRYFSALVFKFTFPISLIYTLG

SEQ ID NO: 3084487 - protein, 24 aa, Giardia lamblia
SEGLRSSLALVFWLFSWVWILLLL

SEQ ID NO: 3084488 - protein, 21 aa, Giardia lamblia
SEIFPGSLYLPAMITDQSASL

SEQ ID NO: 3084489 - protein, 19 aa, Giardia lamblia
SEKDGPCIYGLIVKIAKNR

SEQ ID NO: 3084490 - protein, 17 aa, Giardia lamblia
SELRRLNTIGVFLAHLS

SEQ ID NO: 3084491 - protein, 24 aa, Giardia lamblia
SELYRISLYFLRKLLVVALPMPGL

SEQ ID NO: 3084492 - protein, 21 aa, Giardia lamblia
SEPFPEIYALLLYSVNSMTPV

SEQ ID NO: 3084493 - protein, 17 aa, Giardia lamblia
SEVCSKADHALDEKQVD

SEQ ID NO: 3084494 - protein, 20 aa, Giardia lamblia
SFAHRFRAAAGLRRSMYEGF

SEQ ID NO: 3084495 - protein, 25 aa, Giardia lamblia
SFFGHFRLAFPLAFNVSKTGSVTFT

SEQ ID NO: 3084496 - protein, 17 aa, Giardia lamblia
SFIPCYIHNPAFLIMAI

SEQ ID NO: 3084497 - protein, 17 aa, Giardia lamblia
SFISAVLIGARIIKVSV

SEQ ID NO: 3084498 - protein, 19 aa, Giardia lamblia
SFKCPFHDLLLVDDDIFHN

SEQ ID NO: 3084499 - protein, 18 aa, Giardia lamblia
SFLAVSIIRLCSRLKSFV

SEQ ID NO: 3084500 - protein, 26 aa, Giardia lamblia
SFRDYFCLRFWFIPHRRYMKSLYDEK

SEQ ID NO: 3084501 - protein, 21 aa, Giardia lamblia
SFSGEEFISFVGYHSKMSIAL

SEQ ID NO: 3084502 - protein, 18 aa, Giardia lamblia
SFSIFVAGIHRFLSESGV

SEQ ID NO: 3084503 - protein, 21 aa, Giardia lamblia
SFSLFWSRLYKLLLHTDTIHS

SEQ ID NO: 3084504 - protein, 19 aa, Giardia lamblia
SGAFWKWAILLKNVSTYEQ

SEQ ID NO: 3084505 - protein, 20 aa, Giardia lamblia
SGDWKPAFDIANAFQMSTVI

SEQ ID NO: 3084506 - protein, 18 aa, Giardia lamblia
SGECVSAFLTRYQRAFFK

SEQ ID NO: 3084507 - protein, 21 aa, Giardia lamblia
SGFERLYFEYGLRAPQELFLL

SEQ ID NO: 3084508 - protein, 20 aa, Giardia lamblia
SGLWPKLCTHVDFFDPSRNV

SEQ ID NO: 3084509 - protein, 17 aa, Giardia lamblia
SGNFILRGVIHHKAVLD

SEQ ID NO: 3084510 - protein, 22 aa, Giardia lamblia
SGRRGLHCWICDARARKLSKDS

SEQ ID NO: 3084511 - protein, 23 aa, Giardia lamblia
SGVVGFLCWWFICRSKSRPTENP

SEQ ID NO: 3084512 - protein, 21 aa, Giardia lamblia
SGYLLRIFFDILFYIIFLFML

SEQ ID NO: 3084513 - protein, 25 aa, Giardia lamblia
SHPHLKISLIGAVLCFFSKFQKEDQ

SEQ ID NO: 3084514 - protein, 24 aa, Giardia lamblia
SHWKKRWDLRLSLIEETLIRTVHA

SEQ ID NO: 3084515 - protein, 18 aa, Giardia lamblia
SIFDNFFSNFLFRSTIIV

SEQ ID NO: 3084516 - protein, 24 aa, Giardia lamblia
SIFKELRRYISIYSPRYLGIRSTL

SEQ ID NO: 3084517 - protein, 18 aa, Giardia lamblia
SIFPRIVEMLSLTAHDKL

SEQ ID NO: 3084518 - protein, 22 aa, Giardia lamblia
SIFRYVCFLTYFLPSTTSLPLM

SEQ ID NO: 3084519 - protein, 22 aa, Giardia lamblia
SIHPRLLAYLALLVDPTDQSES

SEQ ID NO: 3084520 - protein, 17 aa, Giardia lamblia
SILPRFFGFYDYVYIKP

SEQ ID NO: 3084521 - protein, 24 aa, Giardia lamblia
SIQSPCTPARCHVVGAYIPTLSEL

SEQ ID NO: 3084522 - protein, 17 aa, Giardia lamblia
SIRICLRYNILSVACSL

SEQ ID NO: 3084523 - protein, 23 aa, Giardia lamblia
SISKVCAFEGFLERNIPEHVIRF

SEQ ID NO: 3084524 - protein, 25 aa, Giardia lamblia
SISVLRWILEFVVLAFLIIDIRSLK

SEQ ID NO: 3084525 - protein, 19 aa, Giardia lamblia
SIVEFMTYILLRFAYSVLT

SEQ ID NO: 3084526 - protein, 22 aa, Giardia lamblia
SIYFVYCALVFVNAYLIASRGS

SEQ ID NO: 3084527 - protein, 24 aa, Giardia lamblia
SKAIGGFCGRIFLRDSVVIYEVSS

SEQ ID NO: 3084528 - protein, 21 aa, Giardia lamblia
SKEAYCLAMLRKAHPKVDFSI

SEQ ID NO: 3084529 - protein, 20 aa, Giardia lamblia
SKFGRLQPFFVHSINDLHHH

SEQ ID NO: 3084530 - protein, 21 aa, Giardia lamblia
SKGFDCVFEFSNLFHLSLSMF

SEQ ID NO: 3084531 - protein, 22 aa, Giardia lamblia
SKGRVYIVLFLKRLNDYHSDLA

SEQ ID NO: 3084532 - protein, 23 aa, Giardia lamblia
SKIALHYQIPWLVPRRQKSKPRN

SEQ ID NO: 3084533 - protein, 17 aa, Giardia lamblia
SKPCDWMRNVVDQLATT

SEQ ID NO: 3084534 - protein, 21 aa, Giardia lamblia
SKRILAHYLFIIFLLLASTLG

SEQ ID NO: 3084535 - protein, 23 aa, Giardia lamblia
SKRMSYPNTFTWREEKHHDFQVL

SEQ ID NO: 3084536 - protein, 18 aa, Giardia lamblia
SKSALLRLIWLLIAAFPD

SEQ ID NO: 3084537 - protein, 19 aa, Giardia lamblia
SKTGLDHQVMFAGYGYYQG

SEQ ID NO: 3084538 - protein, 20 aa, Giardia lamblia
SKYRCCCFYTGFAANVIGLC

SEQ ID NO: 3084539 - protein, 18 aa, Giardia lamblia
SLCFPSTFLSTAIMMGPM

SEQ ID NO: 3084540 - protein, 18 aa, Giardia lamblia
SLCSPVFLQFLELVYYLL

SEQ ID NO: 3084541 - protein, 19 aa, Giardia lamblia
SLDFLRGVGILGMTLVHSL

SEQ ID NO: 3084542 - protein, 22 aa, Giardia lamblia
SLDISRPLFWKAFNQSMIERVY

SEQ ID NO: 3084543 - protein, 20 aa, Giardia lamblia
SLEKELLCTLSAVDHSSILT

SEQ ID NO: 3084544 - protein, 19 aa, Giardia lamblia
SLELFLRRHLSILYETEAT

SEQ ID NO: 3084545 - protein, 19 aa, Giardia lamblia
SLFPLRLQKHLALVVFAKL

SEQ ID NO: 3084546 - protein, 18 aa, Giardia lamblia
SLFWRLGTTMSELNNRVG

SEQ ID NO: 3084547 - protein, 17 aa, Giardia lamblia
SLFYQFYAITAFPSSFI

SEQ ID NO: 3084548 - protein, 19 aa, Giardia lamblia
SLFYVWRVSDYFKKVYADP

SEQ ID NO: 3084549 - protein, 20 aa, Giardia lamblia
SLHLKGGFLIPRVPPDLDKS

SEQ ID NO: 3084550 - protein, 24 aa, Giardia lamblia
SLHMSVCIIASYILENVYFILFLK

SEQ ID NO: 3084551 - protein, 17 aa, Giardia lamblia
SLILAARLHYPLIAKEL

SEQ ID NO: 3084552 - protein, 19 aa, Giardia lamblia
SLLPNLRLGTPLKAIWNAY

SEQ ID NO: 3084553 - protein, 18 aa, Giardia lamblia
SLLWSILCTICLTPSAVP

SEQ ID NO: 3084554 - protein, 22 aa, Giardia lamblia
SLLWSLIVSVCYHQYENNEIYL

SEQ ID NO: 3084555 - protein, 19 aa, Giardia lamblia
SLPHFLVYWCKSRYGLRSL

SEQ ID NO: 3084556 - protein, 27 aa, Giardia lamblia
SLQWRVYLLMSRCIFIISYVRAHANKL

SEQ ID NO: 3084557 - protein, 17 aa, Giardia lamblia
SLSRIPLLFSITACLFA

SEQ ID NO: 3084558 - protein, 25 aa, Giardia lamblia
SLTKLRVKRCILCFQVDSTPIASAL

SEQ ID NO: 3084559 - protein, 17 aa, Giardia lamblia
SLVAALFRLAEPERAET

SEQ ID NO: 3084560 - protein, 23 aa, Giardia lamblia
SLVCVRLLLQRMVFQEEVLELSL

SEQ ID NO: 3084561 - protein, 18 aa, Giardia lamblia
SMARRTCMEGSLVYLDKS

SEQ ID NO: 3084562 - protein, 19 aa, Giardia lamblia
SMDRGACYNIILTSYESRY

SEQ ID NO: 3084563 - protein, 17 aa, Giardia lamblia
SMLWGFVTWKYLHVALG

SEQ ID NO: 3084564 - protein, 22 aa, Giardia lamblia
SMSRLKSAFARVFDYIHTIVTQ

SEQ ID NO: 3084565 - protein, 23 aa, Giardia lamblia
SNANLRLGGFIGILENTAVAMHY

SEQ ID NO: 3084566 - protein, 21 aa, Giardia lamblia
SNCCLFASEMILNFHHATLTT

SEQ ID NO: 3084567 - protein, 19 aa, Giardia lamblia
SNQPSFCWGLREDSIIPPL

SEQ ID NO: 3084568 - protein, 18 aa, Giardia lamblia
SNRILDIMGPLVLGLGVL

SEQ ID NO: 3084569 - protein, 17 aa, Giardia lamblia
SNSEVFRRMSAFLASSL

SEQ ID NO: 3084570 - protein, 17 aa, Giardia lamblia
SPMAFTGTFAFTLVSHV

SEQ ID NO: 3084571 - protein, 17 aa, Giardia lamblia
SPQFSIISNVDWLEAAQ

SEQ ID NO: 3084572 - protein, 21 aa, Giardia lamblia
SPVKGPCLAFLVKFMEEILGF

SEQ ID NO: 3084573 - protein, 17 aa, Giardia lamblia
SPWIINFVIIWLLYFGA

SEQ ID NO: 3084574 - protein, 19 aa, Giardia lamblia
SPYRLKLPFYTLGPEASAL

SEQ ID NO: 3084575 - protein, 19 aa, Giardia lamblia
SQFGRLNLALIRFLQPGPA

SEQ ID NO: 3084576 - protein, 25 aa, Giardia lamblia
SQFSANIYLCFLSLFFTSYIGLAQL

SEQ ID NO: 3084577 - protein, 19 aa, Giardia lamblia
SQGVCKLCDFGFARQMSQQ

SEQ ID NO: 3084578 - protein, 17 aa, Giardia lamblia
SQLREFACFITMNPSYK

SEQ ID NO: 3084579 - protein, 22 aa, Giardia lamblia
SQRTLACSFRWWSFTLIVTSIY

SEQ ID NO: 3084580 - protein, 22 aa, Giardia lamblia
SRAKEVLSILGIKFDMFSLILE

SEQ ID NO: 3084581 - protein, 24 aa, Giardia lamblia
SRAWSTRMLKDFEPEWLLSEIDAV

SEQ ID NO: 3084582 - protein, 21 aa, Giardia lamblia
SRCAGIFALRVDSVITFGDLA

SEQ ID NO: 3084583 - protein, 17 aa, Giardia lamblia
SRCPYYLGRALVPQARV

SEQ ID NO: 3084584 - protein, 17 aa, Giardia lamblia
SRCSVQYFFPVLLAVNS

SEQ ID NO: 3084585 - protein, 19 aa, Giardia lamblia
SRCVCAQGFYSLDNQCVER

SEQ ID NO: 3084586 - protein, 21 aa, Giardia lamblia
SREDYKGFSLAYCLAASAYFC

SEQ ID NO: 3084587 - protein, 17 aa, Giardia lamblia
SRFESILNFASSNHLPI

SEQ ID NO: 3084588 - protein, 21 aa, Giardia lamblia
SRFISNFGVSPIRPFIIKNKA

SEQ ID NO: 3084589 - protein, 17 aa, Giardia lamblia
SRFPVCLSNLSVEGLRE

SEQ ID NO: 3084590 - protein, 17 aa, Giardia lamblia
SRIRLFLINALQASASA

SEQ ID NO: 3084591 - protein, 22 aa, Giardia lamblia
SRIYRPIAALIFPPALKPLTME

SEQ ID NO: 3084592 - protein, 19 aa, Giardia lamblia
SRLVAVLMFPVYRFLFSFV

SEQ ID NO: 3084593 - protein, 20 aa, Giardia lamblia
SRPGPVIAHPCFPQQCKEVS

SEQ ID NO: 3084594 - protein, 17 aa, Giardia lamblia
SRRCILGTFLSDMSVLL

SEQ ID NO: 3084595 - protein, 22 aa, Giardia lamblia
SRRSTRILLMISEYVSTHGLFT

SEQ ID NO: 3084596 - protein, 22 aa, Giardia lamblia
SRSTEVLNMMSLQANLRVPDTL

SEQ ID NO: 3084597 - protein, 24 aa, Giardia lamblia
SRSYATVFSICFLKVFRPDAFFSI

SEQ ID NO: 3084598 - protein, 19 aa, Giardia lamblia
SRTGLKLTEFALATRDFSI

SEQ ID NO: 3084599 - protein, 19 aa, Giardia lamblia
SRTSEFAFYLVMFSHSRAS

SEQ ID NO: 3084600 - protein, 17 aa, Giardia lamblia
SRYLVGLLCQQQCVSHY

SEQ ID NO: 3084601 - protein, 18 aa, Giardia lamblia
SSCSESFCGSNCNRNGIC

SEQ ID NO: 3084602 - protein, 21 aa, Giardia lamblia
SSDATCGVGLFVGAQSSSIAK

SEQ ID NO: 3084603 - protein, 26 aa, Giardia lamblia
SSGFAFKQSFGWKLAHLCLPSVHSTF

SEQ ID NO: 3084604 - protein, 19 aa, Giardia lamblia
SSHLMRLIVMMKRGASPLL

SEQ ID NO: 3084605 - protein, 18 aa, Giardia lamblia
SSIREMYRVVPLAKVVDQ

SEQ ID NO: 3084606 - protein, 23 aa, Giardia lamblia
SSKRRYSLCESIYSCKLVQRSKQ

SEQ ID NO: 3084607 - protein, 18 aa, Giardia lamblia
SSLYCSPTIFSQVYGDIF

SEQ ID NO: 3084608 - protein, 19 aa, Giardia lamblia
SSMLFSCITTGFTTKTNQS

SEQ ID NO: 3084609 - protein, 24 aa, Giardia lamblia
SSMLKWDALQGMLLDTGQLQLSLS

SEQ ID NO: 3084610 - protein, 21 aa, Giardia lamblia
SSRDWCLCWILTGSLRLLQKN

SEQ ID NO: 3084611 - protein, 24 aa, Giardia lamblia
SSRRSREVLAMINLRNEVSIFSVE

SEQ ID NO: 3084612 - protein, 18 aa, Giardia lamblia
SSSPFHWNLYPVSQAHDR

SEQ ID NO: 3084613 - protein, 23 aa, Giardia lamblia
SSSRFTRRLVRIHVCVDTWALDR

SEQ ID NO: 3084614 - protein, 18 aa, Giardia lamblia
SSTGLCWPSACFGASSKS

SEQ ID NO: 3084615 - protein, 23 aa, Giardia lamblia
SSVLRGSLLLNFWRTGETAQSGV

SEQ ID NO: 3084616 - protein, 19 aa, Giardia lamblia
SSYHPLCLVLAGGGIWEEG

SEQ ID NO: 3084617 - protein, 24 aa, Giardia lamblia
SSYIPFKFLFYFFLLLSSYWVPQC

SEQ ID NO: 3084618 - protein, 17 aa, Giardia lamblia
SSYKWLIGFSKLEDSFL

SEQ ID NO: 3084619 - protein, 23 aa, Giardia lamblia
STELLSRFSLCLSCFQQFLVDIA

SEQ ID NO: 3084620 - protein, 29 aa, Giardia lamblia
STFYYYLVCCKVCVFKPPDVRSFTAEQLA

SEQ ID NO: 3084621 - protein, 20 aa, Giardia lamblia
STGYWIAFGVCFSISIITII

SEQ ID NO: 3084622 - protein, 19 aa, Giardia lamblia
STILFLFLVFATRLPSPYG

SEQ ID NO: 3084623 - protein, 22 aa, Giardia lamblia
STKACVCLRLFNLCSTDAPEAL

SEQ ID NO: 3084624 - protein, 24 aa, Giardia lamblia
STLEEIGMSFSLFRTFMHNIPVWG

SEQ ID NO: 3084625 - protein, 19 aa, Giardia lamblia
STLFPFLHPDNRVMVATVG

SEQ ID NO: 3084626 - protein, 17 aa, Giardia lamblia
STLKLLLILAMGIAGHE

SEQ ID NO: 3084627 - protein, 20 aa, Giardia lamblia
STLLAPVCSLGYLWVKSYHS

SEQ ID NO: 3084628 - protein, 22 aa, Giardia lamblia
STMGFEMLSVFLTHGSNSLSHL

SEQ ID NO: 3084629 - protein, 17 aa, Giardia lamblia
STNPFWFVHLMSMVKLY

SEQ ID NO: 3084630 - protein, 22 aa, Giardia lamblia
STPWRRFSFSVKRLLLKLSRST

SEQ ID NO: 3084631 - protein, 17 aa, Giardia lamblia
STSPWRVASRLGYIAVL

SEQ ID NO: 3084632 - protein, 27 aa, Giardia lamblia
STSSSDCVFQFPMVWWLVLVSLLQSLV

SEQ ID NO: 3084633 - protein, 27 aa, Giardia lamblia
STVHLKWRPATCGLTYASTVDFWITDR

SEQ ID NO: 3084634 - protein, 22 aa, Giardia lamblia
STVYFCCICDLLPTTDEQEKCI

SEQ ID NO: 3084635 - protein, 26 aa, Giardia lamblia
SVCSLAFTAHGVFNCLLLLDIGLIDF

SEQ ID NO: 3084636 - protein, 23 aa, Giardia lamblia
SVEFLCGAANYFAQFYGNYIYLR

SEQ ID NO: 3084637 - protein, 17 aa, Giardia lamblia
SVFEYWTRIGIKGYPPA

SEQ ID NO: 3084638 - protein, 20 aa, Giardia lamblia
SVGASRPWLLKALSEVTVLE

SEQ ID NO: 3084639 - protein, 18 aa, Giardia lamblia
SVLFAFLLCHCIHSNHME

SEQ ID NO: 3084640 - protein, 20 aa, Giardia lamblia
SVLRRKSVSAANMFALYPRS

SEQ ID NO: 3084641 - protein, 18 aa, Giardia lamblia
SVMAAICTTFPPVAVIKN

SEQ ID NO: 3084642 - protein, 17 aa, Giardia lamblia
SVRRHVWTLSFLDEMLP

SEQ ID NO: 3084643 - protein, 19 aa, Giardia lamblia
SVVIPICLGLIWDFILLDF

SEQ ID NO: 3084644 - protein, 18 aa, Giardia lamblia
SWDPRPASCLALLSSHNG

SEQ ID NO: 3084645 - protein, 18 aa, Giardia lamblia
SWGSCTIMDGSLCSQCAS

SEQ ID NO: 3084646 - protein, 23 aa, Giardia lamblia
SYALGVLCALLFVIPGDQWEEYT

SEQ ID NO: 3084647 - protein, 18 aa, Giardia lamblia
SYIPFTFTEAMIFGEIAD

SEQ ID NO: 3084648 - protein, 18 aa, Giardia lamblia
SYISLRMERCIDNAGHRY

SEQ ID NO: 3084649 - protein, 18 aa, Giardia lamblia
SYKLQGLMNFRSLDLLPN

SEQ ID NO: 3084650 - protein, 21 aa, Giardia lamblia
SYLPVEFLYTIALILFSSINI

SEQ ID NO: 3084651 - protein, 21 aa, Giardia lamblia
SYPLLCYGLRCTIESMFYSPG

SEQ ID NO: 3084652 - protein, 18 aa, Giardia lamblia
SYPTPALLTAFFNILHIN

SEQ ID NO: 3084653 - protein, 17 aa, Giardia lamblia
SYTCVWKSLSSYSSLSF

SEQ ID NO: 3084654 - protein, 24 aa, Giardia lamblia
SYTLFLRYLLRPEAPKTLSDSFKR

SEQ ID NO: 3084655 - protein, 17 aa, Giardia lamblia
SYVPYEMLTFLSPSSAP

SEQ ID NO: 3084656 - protein, 20 aa, Giardia lamblia
TAAGCTFGWFAFENSATRHD

SEQ ID NO: 3084657 - protein, 20 aa, Giardia lamblia
TAHLKYSFPSIIAADKNTID

SEQ ID NO: 3084658 - protein, 21 aa, Giardia lamblia
TAIKELTCPNIVRYKAIHKGS

SEQ ID NO: 3084659 - protein, 25 aa, Giardia lamblia
TAIPCFGCNGMLRNVTWSVAYYERL

SEQ ID NO: 3084660 - protein, 21 aa, Giardia lamblia
TAKKTKKSWCKKKGGYKEDLN

SEQ ID NO: 3084661 - protein, 17 aa, Giardia lamblia
TALMYALAYDHQGCYQF

SEQ ID NO: 3084662 - protein, 21 aa, Giardia lamblia
TATECYLEFLLYSVFSEIDEL

SEQ ID NO: 3084663 - protein, 22 aa, Giardia lamblia
TCGTCFMQGYLLSNVMSDILGP

SEQ ID NO: 3084664 - protein, 18 aa, Giardia lamblia
TCIPDLLSCISREVADVI

SEQ ID NO: 3084665 - protein, 21 aa, Giardia lamblia
TCKYTWYNFIFKFLIEQYQRP

SEQ ID NO: 3084666 - protein, 22 aa, Giardia lamblia
TCLACTAPGPGHCTRCPSGALL

SEQ ID NO: 3084667 - protein, 21 aa, Giardia lamblia
TCLGCTAPGPGRCTRCPSDKL

SEQ ID NO: 3084668 - protein, 17 aa, Giardia lamblia
TCLHVPMGWVSFGISRP

SEQ ID NO: 3084669 - protein, 20 aa, Giardia lamblia
TCRALEAFLVIATRRELNLA

SEQ ID NO: 3084670 - protein, 23 aa, Giardia lamblia
TDFLCCSCFRALVNILHESPSSN

SEQ ID NO: 3084671 - protein, 23 aa, Giardia lamblia
TDLFLLDFLHFFKPYSIQALLDS

SEQ ID NO: 3084672 - protein, 20 aa, Giardia lamblia
TDVFINWSFHECVIEGSESE

SEQ ID NO: 3084673 - protein, 21 aa, Giardia lamblia
TDVYRKMCSSFIFNNSSAGVS

SEQ ID NO: 3084674 - protein, 17 aa, Giardia lamblia
TEAIECFTKYILAELKF

SEQ ID NO: 3084675 - protein, 21 aa, Giardia lamblia
TEDFMFRLLIAFRPTTAETSS

SEQ ID NO: 3084676 - protein, 18 aa, Giardia lamblia
TEQLWSLLAAQLDKFVIS

SEQ ID NO: 3084677 - protein, 23 aa, Giardia lamblia
TESLCCVCFRKARRQKGESDFLT

SEQ ID NO: 3084678 - protein, 20 aa, Giardia lamblia
TFARHLLKLSDWVSDTTVLL

SEQ ID NO: 3084679 - protein, 20 aa, Giardia lamblia
TFFDYVFKWVRCTTHEQISP

SEQ ID NO: 3084680 - protein, 25 aa, Giardia lamblia
TFGAIFFCQYLIWAGLFFGGICQNV

SEQ ID NO: 3084681 - protein, 24 aa, Giardia lamblia
TFGFSRPSLYLAITLSHLYFTPKL

SEQ ID NO: 3084682 - protein, 25 aa, Giardia lamblia
TFGSFFWRWFLERGIITQKPAHTIV

SEQ ID NO: 3084683 - protein, 28 aa, Giardia lamblia
TFGYPLYWAFRCEMRLNLVFSSAYSLFM

SEQ ID NO: 3084684 - protein, 23 aa, Giardia lamblia
TFNCTKPSFFAKLFASSTNQGTD

SEQ ID NO: 3084685 - protein, 18 aa, Giardia lamblia
TFNWCLIFMASLQTKRRQ

SEQ ID NO: 3084686 - protein, 18 aa, Giardia lamblia
TFSYELLDSISLEGSTHA

SEQ ID NO: 3084687 - protein, 30 aa, Giardia lamblia
TFVKCLQRITACLCAGYVVLVFGLQYLPTP

SEQ ID NO: 3084688 - protein, 19 aa, Giardia lamblia
TFVSLPLAVVVAYLLTIIA

SEQ ID NO: 3084689 - protein, 19 aa, Giardia lamblia
TGAPCKWLAPLQTSYQLKS

SEQ ID NO: 3084690 - protein, 18 aa, Giardia lamblia
TGCIIRYCILLPIRAFLF

SEQ ID NO: 3084691 - protein, 18 aa, Giardia lamblia
TGEPEWWRDFWGPTIKDN

SEQ ID NO: 3084692 - protein, 22 aa, Giardia lamblia
TGHATWTSWGFGFLRVMKIYDF

SEQ ID NO: 3084693 - protein, 19 aa, Giardia lamblia
TGKKLNLRRIIPFIASEFQ

SEQ ID NO: 3084694 - protein, 17 aa, Giardia lamblia
TGLMIAAERGYLGIMRL

SEQ ID NO: 3084695 - protein, 19 aa, Giardia lamblia
TGSWRLSRINVFQAVQPTH

SEQ ID NO: 3084696 - protein, 17 aa, Giardia lamblia
THFCLGDAIASIFGGCL

SEQ ID NO: 3084697 - protein, 18 aa, Giardia lamblia
THRCSLSPINVWCCSPTA

SEQ ID NO: 3084698 - protein, 18 aa, Giardia lamblia
THTSFGFVRLCNGYERHF

SEQ ID NO: 3084699 - protein, 19 aa, Giardia lamblia
TIFCDLEFLLQAKVSSDHD

SEQ ID NO: 3084700 - protein, 17 aa, Giardia lamblia
TIVFKETYLMIVFTIGA

SEQ ID NO: 3084701 - protein, 17 aa, Giardia lamblia
TKGSLVSYCQWCPTSSH

SEQ ID NO: 3084702 - protein, 19 aa, Giardia lamblia
TKKAIGVIACNKLERIFFD

SEQ ID NO: 3084703 - protein, 24 aa, Giardia lamblia
TKLRIRISILDWKASVANQIKTYK

SEQ ID NO: 3084704 - protein, 21 aa, Giardia lamblia
TKWKEFAELIGVTTKKLIDAN

SEQ ID NO: 3084705 - protein, 18 aa, Giardia lamblia
TLEGILFKCFRKTRVPQD

SEQ ID NO: 3084706 - protein, 23 aa, Giardia lamblia
TLLLLRRVFHSFTLPQYIFGSIS

SEQ ID NO: 3084707 - protein, 18 aa, Giardia lamblia
TLMECLSCCNPLYRDTVV

SEQ ID NO: 3084708 - protein, 21 aa, Giardia lamblia
TLPILFKRYWRVANSRQDTGE

SEQ ID NO: 3084709 - protein, 25 aa, Giardia lamblia
TLRDWNGWCALMWAASKNNISCVRL

SEQ ID NO: 3084710 - protein, 22 aa, Giardia lamblia
TLSLRLSTLVLMPYSISACDDI

SEQ ID NO: 3084711 - protein, 25 aa, Giardia lamblia
TMRLRCSYLLKYMWRLFSSEYTLPQ

SEQ ID NO: 3084712 - protein, 24 aa, Giardia lamblia
TMRSCCSRCALLWCVNVSLSRPVS

SEQ ID NO: 3084713 - protein, 19 aa, Giardia lamblia
TNARRGWARIIANSINDVD

SEQ ID NO: 3084714 - protein, 18 aa, Giardia lamblia
TNHFNFLLSTHFNEIKAV

SEQ ID NO: 3084715 - protein, 24 aa, Giardia lamblia
TNLLWHLYCSLLFHRRTDVEVDFF

SEQ ID NO: 3084716 - protein, 19 aa, Giardia lamblia
TNQLFKFDICCNLHEGLTM

SEQ ID NO: 3084717 - protein, 17 aa, Giardia lamblia
TNYRKRPTLSYILNLPL

SEQ ID NO: 3084718 - protein, 19 aa, Giardia lamblia
TPCGIDACKACSKSGNGIK

SEQ ID NO: 3084719 - protein, 18 aa, Giardia lamblia
TPIIPVMCRWSEQKEMPE

SEQ ID NO: 3084720 - protein, 18 aa, Giardia lamblia
TPISSLRLVWSMLQNSAS

SEQ ID NO: 3084721 - protein, 17 aa, Giardia lamblia
TPLHYAIRMGCVEAISY

SEQ ID NO: 3084722 - protein, 17 aa, Giardia lamblia
TPLRYTVRLFSDLIQST

SEQ ID NO: 3084723 - protein, 17 aa, Giardia lamblia
TQFRGWRIKYIHGAGYI

SEQ ID NO: 3084724 - protein, 20 aa, Giardia lamblia
TQKKVICDWSLLQASLDRVF

SEQ ID NO: 3084725 - protein, 18 aa, Giardia lamblia
TQNLTLCYDGALVAQLVT

SEQ ID NO: 3084726 - protein, 19 aa, Giardia lamblia
TRFLFKNLRLCAIDKACAS

SEQ ID NO: 3084727 - protein, 19 aa, Giardia lamblia
TRIASRFSVELDVFLQILM

SEQ ID NO: 3084728 - protein, 21 aa, Giardia lamblia
TRLFNCLKLGKAHAIVEDDLM

SEQ ID NO: 3084729 - protein, 19 aa, Giardia lamblia
TRLKCIIHRDLKPDNILLT

SEQ ID NO: 3084730 - protein, 20 aa, Giardia lamblia
TRLNSIFKQKMNWMMLGGLF

SEQ ID NO: 3084731 - protein, 21 aa, Giardia lamblia
TRLRLNLAFKSGWIISHLVFF

SEQ ID NO: 3084732 - protein, 17 aa, Giardia lamblia
TRLSPSWDDLRKGYIDT

SEQ ID NO: 3084733 - protein, 21 aa, Giardia lamblia
TRMAASLGICLQDDAILYEPL

SEQ ID NO: 3084734 - protein, 23 aa, Giardia lamblia
TRMIQAWLRGCRARRLVSTCRAT

SEQ ID NO: 3084735 - protein, 19 aa, Giardia lamblia
TRMQYLYSIVWEQGVLIFD

SEQ ID NO: 3084736 - protein, 21 aa, Giardia lamblia
TRPLLSLNFTRYFPSIDESFV

SEQ ID NO: 3084737 - protein, 18 aa, Giardia lamblia
TRRAIHCEDIYSRPYPYE

SEQ ID NO: 3084738 - protein, 19 aa, Giardia lamblia
TRRFLPDFDLLMSILSSLF

SEQ ID NO: 3084739 - protein, 20 aa, Giardia lamblia
TRRKLDFVKLLAPVEAGKKN

SEQ ID NO: 3084740 - protein, 23 aa, Giardia lamblia
TRSFFKRAACYINIGIIKIIPPV

SEQ ID NO: 3084741 - protein, 22 aa, Giardia lamblia
TRSYRLPFILGYNLGAKKLYLV

SEQ ID NO: 3084742 - protein, 21 aa, Giardia lamblia
TRTRLALAICATVLIGAINLT

SEQ ID NO: 3084743 - protein, 21 aa, Giardia lamblia
TRWPIPVRFVFDGVEISTGEK

SEQ ID NO: 3084744 - protein, 25 aa, Giardia lamblia
TSERGELCLLELREGYQLDSTTLDP

SEQ ID NO: 3084745 - protein, 22 aa, Giardia lamblia
TSFCACLRLYAVDLRWSPHRTP

SEQ ID NO: 3084746 - protein, 25 aa, Giardia lamblia
TSGERRLAVIVGWMVCIVDKLGEIY

SEQ ID NO: 3084747 - protein, 18 aa, Giardia lamblia
TSGYRIAYLMGVIAIIVH

SEQ ID NO: 3084748 - protein, 21 aa, Giardia lamblia
TSLECSVAIPAPVQPKRFSTS

SEQ ID NO: 3084749 - protein, 24 aa, Giardia lamblia
TSLSPALLCGLVFMRNALQLKHKV

SEQ ID NO: 3084750 - protein, 27 aa, Giardia lamblia
TSMSPKVVMSWIFFCLLGRYNPVIANS

SEQ ID NO: 3084751 - protein, 19 aa, Giardia lamblia
TSNKMCLTRPCAEAITPES

SEQ ID NO: 3084752 - protein, 20 aa, Giardia lamblia
TSPPVLYALCRLRRLPRGGG

SEQ ID NO: 3084753 - protein, 19 aa, Giardia lamblia
TSPRFLLVREIICRLQNQR

SEQ ID NO: 3084754 - protein, 19 aa, Giardia lamblia
TSVCLLTFYFGADRIEKQS

SEQ ID NO: 3084755 - protein, 21 aa, Giardia lamblia
TTALPWSRYVAILLPTTEMQM

SEQ ID NO: 3084756 - protein, 23 aa, Giardia lamblia
TTFRCFRQLITFLLANKYTQRTL

SEQ ID NO: 3084757 - protein, 25 aa, Giardia lamblia
TTIICLLAFRHDMVLEFLGLTYFVN

SEQ ID NO: 3084758 - protein, 21 aa, Giardia lamblia
TTIRMLRIRKTFLLLTYDKLL

SEQ ID NO: 3084759 - protein, 25 aa, Giardia lamblia
TTRLLLCLVCAHLLDATTFGAALAE

SEQ ID NO: 3084760 - protein, 24 aa, Giardia lamblia
TTSLLKLTALFARTSYALIAARTH

SEQ ID NO: 3084761 - protein, 19 aa, Giardia lamblia
TTTLSWRMYYIIAKLCSRS

SEQ ID NO: 3084762 - protein, 17 aa, Giardia lamblia
TTVSLCFDLLIGAHVNL

SEQ ID NO: 3084763 - protein, 24 aa, Giardia lamblia
TYMLYKSCSVHFGISEAHEPTTFY

SEQ ID NO: 3084764 - protein, 23 aa, Giardia lamblia
TYPGEIMYGHYFLSYGDRYVYNA

SEQ ID NO: 3084765 - protein, 28 aa, Giardia lamblia
TYPQMRMSFLLKRCEAISIAFLILWFIG

SEQ ID NO: 3084766 - protein, 17 aa, Giardia lamblia
VAAACFLEACKKQEAQG

SEQ ID NO: 3084767 - protein, 21 aa, Giardia lamblia
VAAAGICEWARNIVSYNEIYK

SEQ ID NO: 3084768 - protein, 17 aa, Giardia lamblia
VACALSLVQAVFQMAVI

SEQ ID NO: 3084769 - protein, 17 aa, Giardia lamblia
VAGVLCWFFLKKKKVIK

SEQ ID NO: 3084770 - protein, 25 aa, Giardia lamblia
VAIDYRLQRKLSLIVPVKANNENTL

SEQ ID NO: 3084771 - protein, 22 aa, Giardia lamblia
VAIKCLKYYASFAHHSGNSIIY

SEQ ID NO: 3084772 - protein, 18 aa, Giardia lamblia
VALTWLLFVSVLRRSSPS

SEQ ID NO: 3084773 - protein, 18 aa, Giardia lamblia
VAPFRIRRVISLEIESPD

SEQ ID NO: 3084774 - protein, 25 aa, Giardia lamblia
VASDARLSLKFTRELFMNGVDALQL

SEQ ID NO: 3084775 - protein, 20 aa, Giardia lamblia
VCCRKCVDPLFFINNGACVS

SEQ ID NO: 3084776 - protein, 18 aa, Giardia lamblia
VCFPLSSWERIIVELCLD

SEQ ID NO: 3084777 - protein, 17 aa, Giardia lamblia
VCGIALSFVPSASSTEL

SEQ ID NO: 3084778 - protein, 18 aa, Giardia lamblia
VCIGCVFLSITHINSPNR

SEQ ID NO: 3084779 - protein, 17 aa, Giardia lamblia
VCLWSALATEPTQGINS

SEQ ID NO: 3084780 - protein, 20 aa, Giardia lamblia
VCTFTMACLFIRQYCEAQSG

SEQ ID NO: 3084781 - protein, 25 aa, Giardia lamblia
VCWQCGILYEMGRYTAASSVLKAQE

SEQ ID NO: 3084782 - protein, 24 aa, Giardia lamblia
VDALCKRILWNIVCETVSWYEDES

SEQ ID NO: 3084783 - protein, 17 aa, Giardia lamblia
VDCNPGFGGLRCGNCTT

SEQ ID NO: 3084784 - protein, 18 aa, Giardia lamblia
VDISDEFLIIMFGQTNGG

SEQ ID NO: 3084785 - protein, 17 aa, Giardia lamblia
VDIWRNAMQRHQFYKAG

SEQ ID NO: 3084786 - protein, 23 aa, Giardia lamblia
VDLLLKFIFVFAISSTDDKLCQV

SEQ ID NO: 3084787 - protein, 18 aa, Giardia lamblia
VDPRLQWHFSTFSVDFPS

SEQ ID NO: 3084788 - protein, 19 aa, Giardia lamblia
VDQALKCYFHSVSYVDCIK

SEQ ID NO: 3084789 - protein, 18 aa, Giardia lamblia
VDYVYRFVAGLANSSVKP

SEQ ID NO: 3084790 - protein, 21 aa, Giardia lamblia
VEFPIIYGCLLCIWLSSFVEK

SEQ ID NO: 3084791 - protein, 23 aa, Giardia lamblia
VEFYYEFLRFIGMASILMLDGGM

SEQ ID NO: 3084792 - protein, 18 aa, Giardia lamblia
VEMTRLRLNLAFKSGWII

SEQ ID NO: 3084793 - protein, 23 aa, Giardia lamblia
VERCLRIPVLILDNVETGKDTGY

SEQ ID NO: 3084794 - protein, 20 aa, Giardia lamblia
VEVFLRYALICLLICSIHLL

SEQ ID NO: 3084795 - protein, 26 aa, Giardia lamblia
VFLIRSMFYFFLLRFNVVTILRKPLP

SEQ ID NO: 3084796 - protein, 28 aa, Giardia lamblia
VFLRSVIYSVEILRIIFLRAKCELSFME

SEQ ID NO: 3084797 - protein, 27 aa, Giardia lamblia
VFRPAAYLWRCIYIFASLLDRELSSPD

SEQ ID NO: 3084798 - protein, 19 aa, Giardia lamblia
VFSCKRFVQLILYEGSAIF

SEQ ID NO: 3084799 - protein, 17 aa, Giardia lamblia
VFSGRRGLHCWICDARA

SEQ ID NO: 3084800 - protein, 22 aa, Giardia lamblia
VFSLDMFWRLCVTNAISAVLLF

SEQ ID NO: 3084801 - protein, 22 aa, Giardia lamblia
VFSLDMFWRLCVTNAISTVLLF

SEQ ID NO: 3084802 - protein, 17 aa, Giardia lamblia
VGDGRYGQIPDYDKLYP

SEQ ID NO: 3084803 - protein, 17 aa, Giardia lamblia
VGFLCWWFLCRGKRIGA

SEQ ID NO: 3084804 - protein, 24 aa, Giardia lamblia
VGIGTWKCRVMRKALMHVHNKSHR

SEQ ID NO: 3084805 - protein, 17 aa, Giardia lamblia
VGKRISYLFLIKSDIEE

SEQ ID NO: 3084806 - protein, 17 aa, Giardia lamblia
VGLGCIFMRAGRTEEGQ

SEQ ID NO: 3084807 - protein, 17 aa, Giardia lamblia
VHFYMTYHFIRLVWSTI

SEQ ID NO: 3084808 - protein, 29 aa, Giardia lamblia
VHKEVLKALPLCALFPIFLSSNVIEPEIP

SEQ ID NO: 3084809 - protein, 17 aa, Giardia lamblia
VHLPSMYLFQIVSIMVD

SEQ ID NO: 3084810 - protein, 19 aa, Giardia lamblia
VHPNFRLFISYAPTSDISR

SEQ ID NO: 3084811 - protein, 23 aa, Giardia lamblia
VILLICIFCWIKVMKDYPHLNYD

SEQ ID NO: 3084812 - protein, 19 aa, Giardia lamblia
VILRFLRINALLSISFQIE

SEQ ID NO: 3084813 - protein, 17 aa, Giardia lamblia
VIRDLCLFVHSLPIKAS

SEQ ID NO: 3084814 - protein, 17 aa, Giardia lamblia
VIRLCPRYWGTRNEAGL

SEQ ID NO: 3084815 - protein, 24 aa, Giardia lamblia
VITLLCILCPLGPCVGEVFAIDND

SEQ ID NO: 3084816 - protein, 23 aa, Giardia lamblia
VKACPAFLYLRARIITNMNISLL

SEQ ID NO: 3084817 - protein, 17 aa, Giardia lamblia
VKEFKHMLLKKLNSKLQ

SEQ ID NO: 3084818 - protein, 17 aa, Giardia lamblia
VKFMALWLINSVPIHVL

SEQ ID NO: 3084819 - protein, 17 aa, Giardia lamblia
VKLYGLMVARCTRVCIP

SEQ ID NO: 3084820 - protein, 19 aa, Giardia lamblia
VKNIELWYFLAFFLLTPAV

SEQ ID NO: 3084821 - protein, 21 aa, Giardia lamblia
VKVHGCLEFLSKIPADQYRRI

SEQ ID NO: 3084822 - protein, 22 aa, Giardia lamblia
VKVMPPKLALLFLETIVLAGQY

SEQ ID NO: 3084823 - protein, 17 aa, Giardia lamblia
VKYHIMGPFTLPKLSFI

SEQ ID NO: 3084824 - protein, 17 aa, Giardia lamblia
VLCLCYWVLAAYVDLLL

SEQ ID NO: 3084825 - protein, 23 aa, Giardia lamblia
VLCYKELKPAAAANLGAHMRGVL

SEQ ID NO: 3084826 - protein, 23 aa, Giardia lamblia
VLEFIIQMLLCFCYTDELADDSV

SEQ ID NO: 3084827 - protein, 17 aa, Giardia lamblia
VLFACIFSGPVYTETLT

SEQ ID NO: 3084828 - protein, 25 aa, Giardia lamblia
VLFLFCIALGFTILACFLIQRSYTQ

SEQ ID NO: 3084829 - protein, 25 aa, Giardia lamblia
VLILLEHAWRLLGINLTDFPTATSS

SEQ ID NO: 3084830 - protein, 17 aa, Giardia lamblia
VLLCLGIERASFHILGP

SEQ ID NO: 3084831 - protein, 23 aa, Giardia lamblia
VLLLVCYFLKIAFKTSSEEKDLN

SEQ ID NO: 3084832 - protein, 22 aa, Giardia lamblia
VLLRKAECLFYLSDYIGCVRSC

SEQ ID NO: 3084833 - protein, 18 aa, Giardia lamblia
VLPQRVGPSLAYAASHAP

SEQ ID NO: 3084834 - protein, 17 aa, Giardia lamblia
VLRKFGLVDPFDPANPR

SEQ ID NO: 3084835 - protein, 18 aa, Giardia lamblia
VLSLLCRLCKAISMVSSL

SEQ ID NO: 3084836 - protein, 22 aa, Giardia lamblia
VLTFLLLWGIFYSRLDYPLLPG

SEQ ID NO: 3084837 - protein, 17 aa, Giardia lamblia
VLVPTDFGFTELTTTMH

SEQ ID NO: 3084838 - protein, 20 aa, Giardia lamblia
VMCVPSLLPFVVNLMTVLQN

SEQ ID NO: 3084839 - protein, 17 aa, Giardia lamblia
VMGSLRFYAPPIVETLL

SEQ ID NO: 3084840 - protein, 25 aa, Giardia lamblia
VNDCGIGLPKQCWQHAFFHQQELAD

SEQ ID NO: 3084841 - protein, 24 aa, Giardia lamblia
VNKFIRRQVGIFGYIRVGIPDESN

SEQ ID NO: 3084842 - protein, 19 aa, Giardia lamblia
VPEDIIWKVLVGVLEALAY

SEQ ID NO: 3084843 - protein, 20 aa, Giardia lamblia
VPELLQAILPNWSSKRRYSL

SEQ ID NO: 3084844 - protein, 18 aa, Giardia lamblia
VPEVMLLPLPLELASGNY

SEQ ID NO: 3084845 - protein, 24 aa, Giardia lamblia
VPFKKYCFEFLPTYLTRLGLDKKR

SEQ ID NO: 3084846 - protein, 17 aa, Giardia lamblia
VPHILIRYNLLRDRSNP

SEQ ID NO: 3084847 - protein, 23 aa, Giardia lamblia
VPKMLFGMPCKWLADASSVHLIL

SEQ ID NO: 3084848 - protein, 20 aa, Giardia lamblia
VPLLLRLVQMMFARYSSLLE

SEQ ID NO: 3084849 - protein, 20 aa, Giardia lamblia
VPLSQLWLRKACLEKGIDLS

SEQ ID NO: 3084850 - protein, 18 aa, Giardia lamblia
VPVLAELPPGFEIEPTGG

SEQ ID NO: 3084851 - protein, 19 aa, Giardia lamblia
VPWKINWPVRFMVLLHHAS

SEQ ID NO: 3084852 - protein, 17 aa, Giardia lamblia
VQCFPKMALITTISAPE

SEQ ID NO: 3084853 - protein, 23 aa, Giardia lamblia
VQGQAAICALCFLYCLITRYTHH

SEQ ID NO: 3084854 - protein, 26 aa, Giardia lamblia
VQHKYRLLVMWSICFTQICLAPYLLD

SEQ ID NO: 3084855 - protein, 19 aa, Giardia lamblia
VRERFCSPPGYRISPTRGS

SEQ ID NO: 3084856 - protein, 18 aa, Giardia lamblia
VRKRFQTIYLYDTYLCQL

SEQ ID NO: 3084857 - protein, 20 aa, Giardia lamblia
VRKWLAYGFVLFGRSSVYGP

SEQ ID NO: 3084858 - protein, 24 aa, Giardia lamblia
VRPLHEYRYYIGLSQGTKFSSIVA

SEQ ID NO: 3084859 - protein, 20 aa, Giardia lamblia
VRRCPLRFAPLTQLMKRKIV

SEQ ID NO: 3084860 - protein, 23 aa, Giardia lamblia
VRRCWCERGFLPALDRSECVLPI

SEQ ID NO: 3084861 - protein, 19 aa, Giardia lamblia
VRRDKCLLPNLTMYGNTDT

SEQ ID NO: 3084862 - protein, 24 aa, Giardia lamblia
VRSPKRWTATFSHIYNTRYFTELS

SEQ ID NO: 3084863 - protein, 17 aa, Giardia lamblia
VRYSALVIQHMWRTKLY

SEQ ID NO: 3084864 - protein, 21 aa, Giardia lamblia
VSCLFLLSALCIFEGYQQLSC

SEQ ID NO: 3084865 - protein, 23 aa, Giardia lamblia
VSDWALKFLRLFRQKTQLYFPTS

SEQ ID NO: 3084866 - protein, 23 aa, Giardia lamblia
VSEGVYWFVRWISTVVMSFFSSV

SEQ ID NO: 3084867 - protein, 23 aa, Giardia lamblia
VSFLRLADFMIMDSLYDLAYLTL

SEQ ID NO: 3084868 - protein, 27 aa, Giardia lamblia
VSLKEFMCGSARYPGLLPVLAMYTDAY

SEQ ID NO: 3084869 - protein, 17 aa, Giardia lamblia
VSLPGLPGFLIARQAAY

SEQ ID NO: 3084870 - protein, 23 aa, Giardia lamblia
VSSCNGYCRLLFTILDNPLYAAS

SEQ ID NO: 3084871 - protein, 22 aa, Giardia lamblia
VSVFKCCPCASVKRIYYKQQSK

SEQ ID NO: 3084872 - protein, 18 aa, Giardia lamblia
VSVPRLLYYISHYIVTGN

SEQ ID NO: 3084873 - protein, 23 aa, Giardia lamblia
VSYLFWRYYLRTQMQLLNITPSS

SEQ ID NO: 3084874 - protein, 24 aa, Giardia lamblia
VTFLKRLLFIIPFISHYVVEWFYP

SEQ ID NO: 3084875 - protein, 22 aa, Giardia lamblia
VTGLPCLLPYVVALSIDTKILG

SEQ ID NO: 3084876 - protein, 19 aa, Giardia lamblia
VTNKFTLRLMLNFYKIQSS

SEQ ID NO: 3084877 - protein, 22 aa, Giardia lamblia
VTNWKLTYSLRHMPSYTSPDQQ

SEQ ID NO: 3084878 - protein, 23 aa, Giardia lamblia
VTRARAGHALSVFVNPAFAQGRS

SEQ ID NO: 3084879 - protein, 17 aa, Giardia lamblia
VTSLLSLRDLSDDSQTE

SEQ ID NO: 3084880 - protein, 25 aa, Giardia lamblia
VTTLLLRWIGPRIKDFSFNRYRHAI

SEQ ID NO: 3084881 - protein, 28 aa, Giardia lamblia
VTVLCWACFTFLLSYTFVIRKYRREQAA

SEQ ID NO: 3084882 - protein, 19 aa, Giardia lamblia
VVCLTRLVFGLAFVLIIGL

SEQ ID NO: 3084883 - protein, 18 aa, Giardia lamblia
VVEGVLLYAQRHSISLNT

SEQ ID NO: 3084884 - protein, 17 aa, Giardia lamblia
VVFLCIACSAVSYPVMA

SEQ ID NO: 3084885 - protein, 17 aa, Giardia lamblia
VVITLRPFYEVSIPNFH

SEQ ID NO: 3084886 - protein, 18 aa, Giardia lamblia
VVYNMVICRAHGNISVIE

SEQ ID NO: 3084887 - protein, 18 aa, Giardia lamblia
VVYTLTIIVPFEYDTSVS

SEQ ID NO: 3084888 - protein, 28 aa, Giardia lamblia
VYAYPPFWAMGAYIFVLWSMKLMDARHI

SEQ ID NO: 3084889 - protein, 18 aa, Giardia lamblia
VYIFRGNVRMDWRLLHQN

SEQ ID NO: 3084890 - protein, 21 aa, Giardia lamblia
VYKHYWLGLIWEWTLGMIQSN

SEQ ID NO: 3084891 - protein, 17 aa, Giardia lamblia
VYLKLVYTVLDFEHLKI

SEQ ID NO: 3084892 - protein, 23 aa, Giardia lamblia
VYLLRSIIYFNLCRNGVVTPRKR

SEQ ID NO: 3084893 - protein, 17 aa, Giardia lamblia
VYNRLGAQISRVTTQAA

SEQ ID NO: 3084894 - protein, 18 aa, Giardia lamblia
VYTTRLLYWLFRKNNSLR

SEQ ID NO: 3084895 - protein, 17 aa, Giardia lamblia
WALVPLLVLMAVFLDAL

SEQ ID NO: 3084896 - protein, 17 aa, Giardia lamblia
WAQSLIVCEILLALGKV

SEQ ID NO: 3084897 - protein, 17 aa, Giardia lamblia
WAQTRLGAVFAGRSHGF

SEQ ID NO: 3084898 - protein, 20 aa, Giardia lamblia
WCERGFLPALDRSGCVLPIE

SEQ ID NO: 3084899 - protein, 21 aa, Giardia lamblia
WDILVCPYEWISKSDYYTISA

SEQ ID NO: 3084900 - protein, 18 aa, Giardia lamblia
WEHCMMHYMSLFRVVSPW

SEQ ID NO: 3084901 - protein, 18 aa, Giardia lamblia
WERLLLRLAGWQRGVPIL

SEQ ID NO: 3084902 - protein, 18 aa, Giardia lamblia
WFNRELYIRMALYPLVEQ

SEQ ID NO: 3084903 - protein, 19 aa, Giardia lamblia
WFQTACMFMAMLVCIIAHG

SEQ ID NO: 3084904 - protein, 21 aa, Giardia lamblia
WKALDLLGALTYDLKLVAGYG

SEQ ID NO: 3084905 - protein, 20 aa, Giardia lamblia
WKCAEELLAALSYIQEFKNS

SEQ ID NO: 3084906 - protein, 19 aa, Giardia lamblia
WKLAHLCLPSVHSTFELMH

SEQ ID NO: 3084907 - protein, 17 aa, Giardia lamblia
WLPELNEALGLITMDGH

SEQ ID NO: 3084908 - protein, 21 aa, Giardia lamblia
WLRYRLCILSFTFNDILSGVV

SEQ ID NO: 3084909 - protein, 20 aa, Giardia lamblia
WMPAVFVCLLALPKMSYLES

SEQ ID NO: 3084910 - protein, 18 aa, Giardia lamblia
WMRFGANILTIWIFILCY

SEQ ID NO: 3084911 - protein, 21 aa, Giardia lamblia
WNELLKLLSFNTLRERMADGT

SEQ ID NO: 3084912 - protein, 24 aa, Giardia lamblia
WNVILYDIWRPMVLRKSFLSREFK

SEQ ID NO: 3084913 - protein, 19 aa, Giardia lamblia
WPAGCTALMLAAHSGSVQS

SEQ ID NO: 3084914 - protein, 21 aa, Giardia lamblia
WPAMLLCAFLSMLKAGTFTTA

SEQ ID NO: 3084915 - protein, 19 aa, Giardia lamblia
WPGPRSILLKQLRRNSYSL

SEQ ID NO: 3084916 - protein, 21 aa, Giardia lamblia
WPPKRLRIAFVQRLVQRKGAD

SEQ ID NO: 3084917 - protein, 17 aa, Giardia lamblia
WPYLYSRPCPDSVSEQS

SEQ ID NO: 3084918 - protein, 23 aa, Giardia lamblia
WQVLRPLLLLTFTDFVVLFGTLE

SEQ ID NO: 3084919 - protein, 19 aa, Giardia lamblia
WRGLPWNFLCSRSFYRRKK

SEQ ID NO: 3084920 - protein, 18 aa, Giardia lamblia
WRMHYCFNATSVYSAHKA

SEQ ID NO: 3084921 - protein, 18 aa, Giardia lamblia
WRMYYIIAKLCSRSSFID

SEQ ID NO: 3084922 - protein, 22 aa, Giardia lamblia
WRRKAVSCVRKLLAPSFKKLCQ

SEQ ID NO: 3084923 - protein, 22 aa, Giardia lamblia
WRSNPTYMKAIISFYEKANSLE

SEQ ID NO: 3084924 - protein, 18 aa, Giardia lamblia
WRSPNFWFELLFYLFILI

SEQ ID NO: 3084925 - protein, 20 aa, Giardia lamblia
WRSQLKWWSCRLCSKPPSIK

SEQ ID NO: 3084926 - protein, 18 aa, Giardia lamblia
WRTICPDSHFTNCDQSYM

SEQ ID NO: 3084927 - protein, 17 aa, Giardia lamblia
WTLKRIAPSLAYLMLNR

SEQ ID NO: 3084928 - protein, 18 aa, Giardia lamblia
WTLLRACIIPRKPALGPH

SEQ ID NO: 3084929 - protein, 22 aa, Giardia lamblia
WVELPSRILVVFSLFFLFMLPV

SEQ ID NO: 3084930 - protein, 18 aa, Giardia lamblia
WYILKVCIKFGDLSNPCR

SEQ ID NO: 3084931 - protein, 18 aa, Giardia lamblia
YALICLKSAYSHGDLIST

SEQ ID NO: 3084932 - protein, 22 aa, Giardia lamblia
YAVFFFFRLATPFSLQETGIPA

SEQ ID NO: 3084933 - protein, 23 aa, Giardia lamblia
YCICFPRYYIVSADEGMASKPNS

SEQ ID NO: 3084934 - protein, 17 aa, Giardia lamblia
YCLSWTFLVPRASTRRY

SEQ ID NO: 3084935 - protein, 19 aa, Giardia lamblia
YCSRARRLFLLALFLDCVA

SEQ ID NO: 3084936 - protein, 17 aa, Giardia lamblia
YCWRYRHLRKLLKEKKE

SEQ ID NO: 3084937 - protein, 21 aa, Giardia lamblia
YDAACFFVSLLMRKTVPNDVI

SEQ ID NO: 3084938 - protein, 18 aa, Giardia lamblia
YDDYRPAYDYALNTYHNI

SEQ ID NO: 3084939 - protein, 28 aa, Giardia lamblia
YDICESFDFRLELYISLLQESRKYDEKA

SEQ ID NO: 3084940 - protein, 17 aa, Giardia lamblia
YDILLFVAHTIYLMLSP

SEQ ID NO: 3084941 - protein, 17 aa, Giardia lamblia
YDNILIRNSILMKQIES

SEQ ID NO: 3084942 - protein, 18 aa, Giardia lamblia
YDVIPDYILQFMIQRHVD

SEQ ID NO: 3084943 - protein, 18 aa, Giardia lamblia
YEAGLGMKPLQTTAMMLA

SEQ ID NO: 3084944 - protein, 18 aa, Giardia lamblia
YEEFLLSIVEEFNRLHAW

SEQ ID NO: 3084945 - protein, 17 aa, Giardia lamblia
YELLDSISLEGSTHASA

SEQ ID NO: 3084946 - protein, 23 aa, Giardia lamblia
YELPDPLRLVGCALFGTYLAIAS

SEQ ID NO: 3084947 - protein, 18 aa, Giardia lamblia
YEYLKFVVFTVHLFGRPT

SEQ ID NO: 3084948 - protein, 19 aa, Giardia lamblia
YEYVLRYALKHVDDSLPAE

SEQ ID NO: 3084949 - protein, 17 aa, Giardia lamblia
YFAACFIISYSMLSDLT

SEQ ID NO: 3084950 - protein, 18 aa, Giardia lamblia
YFCAPEYIFHSPLNLNLP

SEQ ID NO: 3084951 - protein, 17 aa, Giardia lamblia
YFCQIKELYHECLHNLP

SEQ ID NO: 3084952 - protein, 18 aa, Giardia lamblia
YFDKRSIVTLTFWFRVVL

SEQ ID NO: 3084953 - protein, 25 aa, Giardia lamblia
YFDLRLIQVYLIFDKFRGCVSTLLF

SEQ ID NO: 3084954 - protein, 26 aa, Giardia lamblia
YFHSLLFYKLCEFFPETISSFIVSVP

SEQ ID NO: 3084955 - protein, 17 aa, Giardia lamblia
YFIELYRSMSVDFPTEK

SEQ ID NO: 3084956 - protein, 20 aa, Giardia lamblia
YFIGYSFRFDDFLSTDQSLS

SEQ ID NO: 3084957 - protein, 18 aa, Giardia lamblia
YFLGVFPMRPFTLSYTDP

SEQ ID NO: 3084958 - protein, 19 aa, Giardia lamblia
YFSFYDICESFDFRLELYI

SEQ ID NO: 3084959 - protein, 24 aa, Giardia lamblia
YGAHKGRPVWILRNSWGTGWGVSG

SEQ ID NO: 3084960 - protein, 26 aa, Giardia lamblia
YGAYKGRPVWILRNSWGTGWGVSGYY

SEQ ID NO: 3084961 - protein, 22 aa, Giardia lamblia
YGFTSLLLLCFVKPPLEQNTAA

SEQ ID NO: 3084962 - protein, 20 aa, Giardia lamblia
YGKKCAKCTKVLINSDQPGI

SEQ ID NO: 3084963 - protein, 23 aa, Giardia lamblia
YGNCCKRCFCLLANHELALTKRS

SEQ ID NO: 3084964 - protein, 20 aa, Giardia lamblia
YGSVSLIFLCFVRPILEQNV

SEQ ID NO: 3084965 - protein, 19 aa, Giardia lamblia
YHVGWQLPYQGYRWPYLYS

SEQ ID NO: 3084966 - protein, 27 aa, Giardia lamblia
YHVSPRLFVELTFILGIDILKVRNYLI

SEQ ID NO: 3084967 - protein, 20 aa, Giardia lamblia
YIFSRIGFTLTFFIIPISLG

SEQ ID NO: 3084968 - protein, 19 aa, Giardia lamblia
YKDFFPPIFVHSSKKKTGF

SEQ ID NO: 3084969 - protein, 20 aa, Giardia lamblia
YKDMLVCFPPPQALDKLSLW

SEQ ID NO: 3084970 - protein, 22 aa, Giardia lamblia
YKELLKGMPIRFYDIAKTLVPT

SEQ ID NO: 3084971 - protein, 17 aa, Giardia lamblia
YKFPDTMLGFYEYRDEV

SEQ ID NO: 3084972 - protein, 19 aa, Giardia lamblia
YKHCNEIKIYPAFVRMLFP

SEQ ID NO: 3084973 - protein, 20 aa, Giardia lamblia
YKLARMLSFNFRYILVTNAS

SEQ ID NO: 3084974 - protein, 19 aa, Giardia lamblia
YKLVVSFLCEAELVDEVPI

SEQ ID NO: 3084975 - protein, 17 aa, Giardia lamblia
YKMLPRLGMFSNHSDVL

SEQ ID NO: 3084976 - protein, 19 aa, Giardia lamblia
YKQILSCFIVLSFGEVMMD

SEQ ID NO: 3084977 - protein, 18 aa, Giardia lamblia
YKRLTLRLRFNTTSIVQR

SEQ ID NO: 3084978 - protein, 20 aa, Giardia lamblia
YKSGPYPGLFFILLPLTPYI

SEQ ID NO: 3084979 - protein, 20 aa, Giardia lamblia
YKTKIGREFPHSFVRLHQSI

SEQ ID NO: 3084980 - protein, 18 aa, Giardia lamblia
YLAPRLLNYVTLFGQMHQ

SEQ ID NO: 3084981 - protein, 22 aa, Giardia lamblia
YLATACMKEWIDVEVLLESPRK

SEQ ID NO: 3084982 - protein, 17 aa, Giardia lamblia
YLCSKYCIITVVPVIQN

SEQ ID NO: 3084983 - protein, 19 aa, Giardia lamblia
YLFMRVIYCPFSEYTFAAN

SEQ ID NO: 3084984 - protein, 22 aa, Giardia lamblia
YLFPECVLFVFTYFRLLDITPT

SEQ ID NO: 3084985 - protein, 17 aa, Giardia lamblia
YLIPRYFHVFNMAINDD

SEQ ID NO: 3084986 - protein, 20 aa, Giardia lamblia
YLLCHGVVWNFLKTGVHEQN

SEQ ID NO: 3084987 - protein, 17 aa, Giardia lamblia
YLLPFVVIVPMTIISAR

SEQ ID NO: 3084988 - protein, 20 aa, Giardia lamblia
YLLYFKRFIKSSIISNLGQR

SEQ ID NO: 3084989 - protein, 18 aa, Giardia lamblia
YLPHIRYLSGLYFMAPPP

SEQ ID NO: 3084990 - protein, 22 aa, Giardia lamblia
YLRRWCTAVLWLLTGGILGIGW

SEQ ID NO: 3084991 - protein, 18 aa, Giardia lamblia
YLRSVKLYGLMVARCTRV

SEQ ID NO: 3084992 - protein, 17 aa, Giardia lamblia
YLSLRSGIYTSMQVPSE

SEQ ID NO: 3084993 - protein, 19 aa, Giardia lamblia
YMIRFYPKPVLSFFSLAYN

SEQ ID NO: 3084994 - protein, 17 aa, Giardia lamblia
YMTWPAMLLCAFLSMLK

SEQ ID NO: 3084995 - protein, 17 aa, Giardia lamblia
YMVEFGVRYDILRDADL

SEQ ID NO: 3084996 - protein, 22 aa, Giardia lamblia
YMVPNCVILYYFLTKAPFIHVL

SEQ ID NO: 3084997 - protein, 18 aa, Giardia lamblia
YNILSVACSLILQNTLRY

SEQ ID NO: 3084998 - protein, 22 aa, Giardia lamblia
YPIQLVPCYKFYTLGRSYIENA

SEQ ID NO: 3084999 - protein, 20 aa, Giardia lamblia
YPLAIGDKVTMVFYKQELTK

SEQ ID NO: 3085000 - protein, 18 aa, Giardia lamblia
YPLCLLPLPFRHVNDDAN

SEQ ID NO: 3085001 - protein, 26 aa, Giardia lamblia
YPQIRLSLLLKRAECISSVLLFLWVS

SEQ ID NO: 3085002 - protein, 17 aa, Giardia lamblia
YPRVIRLILWKKVLKNI

SEQ ID NO: 3085003 - protein, 23 aa, Giardia lamblia
YPYCWRSDTPLIYRAIPSWFVRV

SEQ ID NO: 3085004 - protein, 19 aa, Giardia lamblia
YQFPFTFAVMYGDIGHGII

SEQ ID NO: 3085005 - protein, 20 aa, Giardia lamblia
YQFSVEFLKMLALKNTLFSY

SEQ ID NO: 3085006 - protein, 18 aa, Giardia lamblia
YRIPAMWILILISLIQSL

SEQ ID NO: 3085007 - protein, 21 aa, Giardia lamblia
YRKDGFRLSKWMHLFCDNAIM

SEQ ID NO: 3085008 - protein, 20 aa, Giardia lamblia
YRLAISCLYYYELLYTVVAG

SEQ ID NO: 3085009 - protein, 19 aa, Giardia lamblia
YRLFLKPLYLRRNGPKTTQ

SEQ ID NO: 3085010 - protein, 19 aa, Giardia lamblia
YRLKCVRDGCLFSLYEGNL

SEQ ID NO: 3085011 - protein, 17 aa, Giardia lamblia
YRSAIEYAVKYLADHGL

SEQ ID NO: 3085012 - protein, 20 aa, Giardia lamblia
YRVADFMAFLIVRSSSTFLQ

SEQ ID NO: 3085013 - protein, 17 aa, Giardia lamblia
YRVSEWVVAPAADNTEI

SEQ ID NO: 3085014 - protein, 17 aa, Giardia lamblia
YRYTCIYNFFIFAQLFN

SEQ ID NO: 3085015 - protein, 19 aa, Giardia lamblia
YSCSPCTIDDLALRGGVRR

SEQ ID NO: 3085016 - protein, 20 aa, Giardia lamblia
YSDLCFFTFSAIDAIVQEIQ

SEQ ID NO: 3085017 - protein, 25 aa, Giardia lamblia
YSEFIRPYCCAFIVLLDVCAYLNKR

SEQ ID NO: 3085018 - protein, 25 aa, Giardia lamblia
YSFRKSCLRLRSFFSDNLLIVDPDE

SEQ ID NO: 3085019 - protein, 19 aa, Giardia lamblia
YSIEISRKQLSGWLADQLV

SEQ ID NO: 3085020 - protein, 18 aa, Giardia lamblia
YSKIPIIHFYSSESMRLN

SEQ ID NO: 3085021 - protein, 23 aa, Giardia lamblia
YSLKKRLGYRFFPEVQMAANNTA

SEQ ID NO: 3085022 - protein, 22 aa, Giardia lamblia
YSLRLPLKRVNGIEFRKKGTKV

SEQ ID NO: 3085023 - protein, 18 aa, Giardia lamblia
YSPFVAVFFGTYLALFEV

SEQ ID NO: 3085024 - protein, 25 aa, Giardia lamblia
YSTSAFKWPLFKPFLRPLTCKPILE

SEQ ID NO: 3085025 - protein, 26 aa, Giardia lamblia
YSYLGIACGLAFSCLGSAYGTAKSGK

SEQ ID NO: 3085026 - protein, 23 aa, Giardia lamblia
YTAYWIWLCIAMVIACILIFFDL

SEQ ID NO: 3085027 - protein, 18 aa, Giardia lamblia
YTIFPFRYVMSYLNNVTY

SEQ ID NO: 3085028 - protein, 25 aa, Giardia lamblia
YTNRWLADFTYNFILSFCVAVLLVI

SEQ ID NO: 3085029 - protein, 21 aa, Giardia lamblia
YVARFPIRIQKHIRENHLLAL

SEQ ID NO: 3085030 - protein, 20 aa, Giardia lamblia
YVDCIKWLQYVSGIIDMRPS

SEQ ID NO: 3085031 - protein, 17 aa, Giardia lamblia
YVEALQICQLVWDICGP

SEQ ID NO: 3085032 - protein, 17 aa, Giardia lamblia
YVELVFTLINWYKGAME

SEQ ID NO: 3085033 - protein, 18 aa, Giardia lamblia
YWWRNGRVYYDEGLVAVS

SEQ ID NO: 3085034 - protein, 19 aa, Giardia lamblia
YYFNCFKDPLVVILWDRIS

SEQ ID NO: 3085035 - protein, 23 aa, Giardia lamblia
YYKCMPEFKRAVATVAIGTATVL

SEQ ID NO: 3085036 - protein, 25 aa, Giardia lamblia
YYMSFKGNPEWSWFFSYPFSPLISD

SEQ ID NO: 3085037 - protein, 21 aa, Giardia lamblia
YYNPRIPVVDSFDGFYDPASI

SEQ ID NO: 3085038 - protein, 20 aa, Giardia lamblia
YYPLNIGSFFGRFESDTPLQ

SEQ ID NO: 3085039 - protein, 17 aa, Giardia lamblia
YYVSLRLILGGLFTVPA

SEQ ID NO: 3085040 - protein, 18 aa, Giardia lamblia
QSLGILPLQGIDAPQSLG

SEQ ID NO: 3085041 - protein, 23 aa, Giardia lamblia
DDYACDCYPIYRGGLCQSCDDAN

SEQ ID NO: 3085042 - protein, 18 aa, Giardia lamblia
SLGILPPQGIDAPQSLGI

SEQ ID NO: 3085043 - protein, 24 aa, Giardia lamblia
KGRPVWILRNSWGTGWGVSGYYYI

SEQ ID NO: 3085044 - protein, 24 aa, Giardia lamblia
NCLDPGYYRRGGLGGGAIAAIVIV

SEQ ID NO: 3085045 - protein, 27 aa, Giardia lamblia
EIMSDYYLVFLLLLGSVIVAGRAAREF

SEQ ID NO: 3085046 - protein, 20 aa, Giardia lamblia
RGRCLLKDPGLAGLSADDYA

SEQ ID NO: 3085047 - protein, 25 aa, Giardia lamblia
SASTLRLSVQFLLDNLIGGNYCNGG

SEQ ID NO: 3085048 - protein, 20 aa, Giardia lamblia
SATSCLACYGLDGTLFCERC

SEQ ID NO: 3085049 - protein, 27 aa, Giardia lamblia
SCSGCIRDFLFYRGGCYRTASLINAIC

SEQ ID NO: 3085050 - protein, 21 aa, Giardia lamblia
TNHQVMLVGYGAYKGRPVWIL

SEQ ID NO: 3085051 - protein, 18 aa, Giardia lamblia
YTRGKYLDPQPFPSNYFC

SEQ ID NO: 3085052 - protein, 19 aa, Giardia lamblia
ACDAPRAGFRRVTTNTGKA

SEQ ID NO: 3085053 - protein, 22 aa, Giardia lamblia
AEAKLYAIFRISEVETATFPLE

SEQ ID NO: 3085054 - protein, 27 aa, Giardia lamblia
AECTRIFRTFISYPYHLARLGASFSFT

SEQ ID NO: 3085055 - protein, 17 aa, Giardia lamblia
ATITIVGVANCERCSPK

SEQ ID NO: 3085056 - protein, 27 aa, Giardia lamblia
CAACKDTHLLYYGGCYAKGAAAGTAIC

SEQ ID NO: 3085057 - protein, 26 aa, Giardia lamblia
CAAIPFIVKVLVRKGVRRRTRAMKYD

SEQ ID NO: 3085058 - protein, 17 aa, Giardia lamblia
CAQGYYYHSYAKVCAKC

SEQ ID NO: 3085059 - protein, 20 aa, Giardia lamblia
CAYGDGAHFCQCRRGWAGAA

SEQ ID NO: 3085060 - protein, 25 aa, Giardia lamblia
CDACFEPLIMKEDKTKCFGSCLALG

SEQ ID NO: 3085061 - protein, 18 aa, Giardia lamblia
CDLGTKLFKRACFGINCF

SEQ ID NO: 3085062 - protein, 22 aa, Giardia lamblia
CLCASYYTLVDKDCIPTRCLKD

SEQ ID NO: 3085063 - protein, 19 aa, Giardia lamblia
CLPGYYLYDNLCVRCDDNC

SEQ ID NO: 3085064 - protein, 21 aa, Giardia lamblia
CSSGYMLFYGSCYSVNGPLAQ

SEQ ID NO: 3085065 - protein, 19 aa, Giardia lamblia
CTGSYFLQSGGCYQSTVYP

SEQ ID NO: 3085066 - protein, 23 aa, Giardia lamblia
DCAYGDGAYFCQCRRGWAGAACD

SEQ ID NO: 3085067 - protein, 24 aa, Giardia lamblia
DIKLAKPTILLAVPRVLQKIYNAV

SEQ ID NO: 3085068 - protein, 27 aa, Giardia lamblia
DINVKPLYCDIPAEAKLYAIFRISEVE

SEQ ID NO: 3085069 - protein, 21 aa, Giardia lamblia
DKTKCFGSCLALGPGYYNASG

SEQ ID NO: 3085070 - protein, 21 aa, Giardia lamblia
DKTPMAILRRAIRDDPNSFMS

SEQ ID NO: 3085071 - protein, 28 aa, Giardia lamblia
DRCWTCEDGYYVTWYGGCGACAEGTGGY

SEQ ID NO: 3085072 - protein, 17 aa, Giardia lamblia
DSWVGVSGCRLCEAPKV

SEQ ID NO: 3085073 - protein, 24 aa, Giardia lamblia
DVKSTYFYFSLSNNVDPFYASVKC

SEQ ID NO: 3085074 - protein, 26 aa, Giardia lamblia
ECIPSKCVYRRLLSDPTIACNGLGTC

SEQ ID NO: 3085075 - protein, 19 aa, Giardia lamblia
EDGYFLGAAGDKESKCILC

SEQ ID NO: 3085076 - protein, 25 aa, Giardia lamblia
EFRGLKKLLLWYGKCSYVGSAQICQ

SEQ ID NO: 3085077 - protein, 21 aa, Giardia lamblia
EPPIICGGLGSCGPTGCVCDL

SEQ ID NO: 3085078 - protein, 22 aa, Giardia lamblia
EYTEGSWIKTGTLPWLDNVVFK

SEQ ID NO: 3085079 - protein, 18 aa, Giardia lamblia
FASVFVHAQSDKSFPICV

SEQ ID NO: 3085080 - protein, 25 aa, Giardia lamblia
FLHEGGCYNVLYSPGNRICRTATSG

SEQ ID NO: 3085081 - protein, 24 aa, Giardia lamblia
GAGGGWTGVDGCQRCRLADRVGPV

SEQ ID NO: 3085082 - protein, 26 aa, Giardia lamblia
GAGSLFKLFPFSSYTPSLNALVSITF

SEQ ID NO: 3085083 - protein, 38 aa, Giardia lamblia
GASEMRVVMVLILYFSIWTIIPTILIAAALTALFKDAF

SEQ ID NO: 3085084 - protein, 42 aa, Giardia lamblia
GGAIAAIVIVVLLVLAVAGFLVWWFVFRRGGRPKRGAKYTSL

SEQ ID NO: 3085085 - protein, 43 aa, Giardia lamblia
GGAIAAIVIVVLLVLAVAGFLVWWFVFRRGGRPKRGAKYTSLM

SEQ ID NO: 3085086 - protein, 22 aa, Giardia lamblia
GGVRRCWCERGFLPALDRSGCV

SEQ ID NO: 3085087 - protein, 25 aa, Giardia lamblia
GLCDACSSGFMLFYGSCYSVDGPLA

SEQ ID NO: 3085088 - protein, 18 aa, Giardia lamblia
GPLRERAPQKGSKSSRSK

SEQ ID NO: 3085089 - protein, 24 aa, Giardia lamblia
GTCASPRCIVPVASGLHTVQSVCG

SEQ ID NO: 3085090 - protein, 19 aa, Giardia lamblia
GTILPFVANCGFVDSLSGA

SEQ ID NO: 3085091 - protein, 19 aa, Giardia lamblia
GVCTACTGSYFLQSGGCYQ

SEQ ID NO: 3085092 - protein, 20 aa, Giardia lamblia
GVSGCRLCEAPKVAGPALCK

SEQ ID NO: 3085093 - protein, 28 aa, Giardia lamblia
GYCTSCYKTHLFYEYGCYSRHSSTGFAI

SEQ ID NO: 3085094 - protein, 34 aa, Giardia lamblia
HRFSLMLLVALLLSYLMLFLVVAIYPGSLTRSEV

SEQ ID NO: 3085095 - protein, 27 aa, Giardia lamblia
ILAALTALFVLIWMGVHYTLTSVKSAI

SEQ ID NO: 3085096 - protein, 26 aa, Giardia lamblia
ILKNKELILLWFAYVFQIFCTQLPVA

SEQ ID NO: 3085097 - protein, 31 aa, Giardia lamblia
ITGITLGVAVLVGGAIGLALGLTVCKRGCAG

SEQ ID NO: 3085098 - protein, 20 aa, Giardia lamblia
KFGVYQILRNEGVPASGLII

SEQ ID NO: 3085099 - protein, 20 aa, Giardia lamblia
KFGVYQILRNEGVPASGPIV

SEQ ID NO: 3085100 - protein, 32 aa, Giardia lamblia
KGDRVGIFARNSPLWLLFDFACTAVGAVVVPI

SEQ ID NO: 3085101 - protein, 20 aa, Giardia lamblia
KGVCTGCLRGYMLYMGGCYD

SEQ ID NO: 3085102 - protein, 18 aa, Giardia lamblia
KPCNDPVATITIVGVANC

SEQ ID NO: 3085103 - protein, 27 aa, Giardia lamblia
KPSVTRHLLLLFLSLDLQEHCRSFVSI

SEQ ID NO: 3085104 - protein, 23 aa, Giardia lamblia
KSDGEYHCRCPDMLIAVSGECTS

SEQ ID NO: 3085105 - protein, 17 aa, Giardia lamblia
KSGLKPGVTAAIVILVL

SEQ ID NO: 3085106 - protein, 25 aa, Giardia lamblia
KYCGTCKLGFYISPDDQKCAKGQVE

SEQ ID NO: 3085107 - protein, 19 aa, Giardia lamblia
LCETCSSGYMLFYGSCYSV

SEQ ID NO: 3085108 - protein, 20 aa, Giardia lamblia
LDNRGLLITSLVLALISVIV

SEQ ID NO: 3085109 - protein, 24 aa, Giardia lamblia
LGFYQAAGAVFPFVRDHPKQYEDY

SEQ ID NO: 3085110 - protein, 20 aa, Giardia lamblia
LIGNTLYCFQCGVVTDLLVD

SEQ ID NO: 3085111 - protein, 32 aa, Giardia lamblia
LKPGVTAAIVILVLLLIGVCAAIPFIVKVLVR

SEQ ID NO: 3085112 - protein, 18 aa, Giardia lamblia
LLIGTLAINCPRDHYALG

SEQ ID NO: 3085113 - protein, 19 aa, Giardia lamblia
LSCKKDVYFEVFSGGRGYC

SEQ ID NO: 3085114 - protein, 21 aa, Giardia lamblia
LSFLISLLEVFASLGVLLLRK

SEQ ID NO: 3085115 - protein, 20 aa, Giardia lamblia
LSGIPLMLFYMKKATMAVLP

SEQ ID NO: 3085116 - protein, 19 aa, Giardia lamblia
LTALFKDAFFIHGPAVAAV

SEQ ID NO: 3085117 - protein, 17 aa, Giardia lamblia
LVSITFALITTASVLLL

SEQ ID NO: 3085118 - protein, 28 aa, Giardia lamblia
NACEQWNSAFKWIFSKNGDNNKNGYLCG

SEQ ID NO: 3085119 - protein, 24 aa, Giardia lamblia
NGLLVCVACEQFYRPMNGGTECVQ

SEQ ID NO: 3085120 - protein, 17 aa, Giardia lamblia
NICIEECPVGLLSTSCA

SEQ ID NO: 3085121 - protein, 23 aa, Giardia lamblia
PGEVPINGVCIPLTDPRAVASGC

SEQ ID NO: 3085122 - protein, 21 aa, Giardia lamblia
PNTCTACRAGYYLQSTSCIAC

SEQ ID NO: 3085123 - protein, 24 aa, Giardia lamblia
PQEVWRFMRLCTGARITCGYGLTE

SEQ ID NO: 3085124 - protein, 17 aa, Giardia lamblia
QEDKTPMAILRRAIRDD

SEQ ID NO: 3085125 - protein, 17 aa, Giardia lamblia
QIFLFCKIFIVVQRVHS

SEQ ID NO: 3085126 - protein, 17 aa, Giardia lamblia
RCTECLPGYYLYDNLCV

SEQ ID NO: 3085127 - protein, 38 aa, Giardia lamblia
RGAGLISTIVILGLIIVGFIVATPFLVKLAKKRGVRVS

SEQ ID NO: 3085128 - protein, 19 aa, Giardia lamblia
RGRCLLKDPGLAGLSADDY

SEQ ID NO: 3085129 - protein, 37 aa, Giardia lamblia
SAWNYVLVGALAIVIFFLGRYCMQYYFCAPEYIFHSP

SEQ ID NO: 3085130 - protein, 38 aa, Giardia lamblia
SAWNYVLVGALAIVIFFLGRYCMQYYFCAPEYIFHSPL

SEQ ID NO: 3085131 - protein, 26 aa, Giardia lamblia
SCASGYFLYNGGCYRKGVMPGMLICK

SEQ ID NO: 3085132 - protein, 27 aa, Giardia lamblia
SCTRCGPRFFLHAGGCYEIGRSPGTVL

SEQ ID NO: 3085133 - protein, 27 aa, Giardia lamblia
SGQWQPFQSLVYSYYPYLPIDTTDDQL

SEQ ID NO: 3085134 - protein, 30 aa, Giardia lamblia
SGSRCSLLCYLVFVLLWQGSTQYQGVLINH

SEQ ID NO: 3085135 - protein, 44 aa, Giardia lamblia
STITIAVVVVVLLVLVAVAGFLVWWFVIRPRKSGELRERAPRKG

SEQ ID NO: 3085136 - protein, 20 aa, Giardia lamblia
SVLPTFLDRGAPMSYIFLKQ

SEQ ID NO: 3085137 - protein, 26 aa, Giardia lamblia
TAYGLHCSGLLNKSGLKPGVTAAIVI

SEQ ID NO: 3085138 - protein, 20 aa, Giardia lamblia
TGIDHCDTCLPPKAAGPATC

SEQ ID NO: 3085139 - protein, 26 aa, Giardia lamblia
TTASVLLLHMFFYNTSVAIAFGTVAL

SEQ ID NO: 3085140 - protein, 25 aa, Giardia lamblia
TVGPKIYGIWCSDLPTKSCKSNEFL

SEQ ID NO: 3085141 - protein, 18 aa, Giardia lamblia
VAVQLFTGRCIPKECAGL

SEQ ID NO: 3085142 - protein, 18 aa, Giardia lamblia
VPVNGDCRLLSLSRSICI

SEQ ID NO: 3085143 - protein, 25 aa, Giardia lamblia
VVSAEAPYTMTCQCSPIYTGAKCAE

SEQ ID NO: 3085144 - protein, 25 aa, Giardia lamblia
WYSQEMMTWYAVKHPSPRTRSSTPN

SEQ ID NO: 3085145 - protein, 22 aa, Giardia lamblia
YCTLCVDGFFLDTTSSIHQCKP

SEQ ID NO: 3085146 - protein, 24 aa, Giardia lamblia
YGGLFLFIMIVAVICIIYSIVVQI

SEQ ID NO: 3085147 - protein, 18 aa, Giardia lamblia
YVGLWLSGIPLMLFYMKK

SEQ ID NO: 3085148 - protein, 27 aa, Giardia lamblia
AAAFGNAACIWLLFAEARLENRDGETA

SEQ ID NO: 3085149 - protein, 58 aa, Giardia lamblia
AAAFKLEIKFILTPGERFQLWILSCGLIFVVHIKTGFLLAALSIPNLIYCAYASCMEE

SEQ ID NO: 3085150 - protein, 23 aa, Giardia lamblia
AACFFVSLLMRKTVPNDVIFYKN

SEQ ID NO: 3085151 - protein, 25 aa, Giardia lamblia
AACKDTHLLYYGGCYAKGATAGTAI

SEQ ID NO: 3085152 - protein, 24 aa, Giardia lamblia
AACYLTRFIFFANATVLQEILSLI

SEQ ID NO: 3085153 - protein, 34 aa, Giardia lamblia
AADKALSMLLGFGFLLFVFAYSIYRISTTLENES

SEQ ID NO: 3085154 - protein, 25 aa, Giardia lamblia
AAEELFVSLFRLQYGMDFAMSIFTQ

SEQ ID NO: 3085155 - protein, 24 aa, Giardia lamblia
AAEKNYMSLIPLLCEKEFGRLDRF

SEQ ID NO: 3085156 - protein, 18 aa, Giardia lamblia
AAEMDYIMGVKLLSEHET

SEQ ID NO: 3085157 - protein, 27 aa, Giardia lamblia
AAFMQFLQSFLTTELIAIILSQLLTSI

SEQ ID NO: 3085158 - protein, 17 aa, Giardia lamblia
AAGGGLFRKLNLINLIT

SEQ ID NO: 3085159 - protein, 39 aa, Giardia lamblia
AAGTLLIRSTILPNLLTASLLLFSRSRHVFSIELLGVLL

SEQ ID NO: 3085160 - protein, 23 aa, Giardia lamblia
AAIAIRAPFYTTLLVEWLRHVAS

SEQ ID NO: 3085161 - protein, 24 aa, Giardia lamblia
AAICGHVAAVRLLMPYESRARDGC

SEQ ID NO: 3085162 - protein, 19 aa, Giardia lamblia
AAIINLFQLSLDAASHHIK

SEQ ID NO: 3085163 - protein, 30 aa, Giardia lamblia
AAIISWFSVIFVPQMILLLSKVLPFRINIL

SEQ ID NO: 3085164 - protein, 22 aa, Giardia lamblia
AAILTFIVLVSRFFVDGRQSNS

SEQ ID NO: 3085165 - protein, 17 aa, Giardia lamblia
AAKLPLLVEGVMITFYM

SEQ ID NO: 3085166 - protein, 23 aa, Giardia lamblia
AAKLRLMGLLTEPLVITAQGNSL

SEQ ID NO: 3085167 - protein, 26 aa, Giardia lamblia
AAKSKFRTWQYWKPYVLIAVPSIFDM

SEQ ID NO: 3085168 - protein, 24 aa, Giardia lamblia
AAKTLIVPLPLPLDGSNKASARFA

SEQ ID NO: 3085169 - protein, 24 aa, Giardia lamblia
AAKTVFIRYFQSFTPVQRKIMAQT

SEQ ID NO: 3085170 - protein, 24 aa, Giardia lamblia
AAKYKNELKYSPKRGFISAGAEQL

SEQ ID NO: 3085171 - protein, 32 aa, Giardia lamblia
AALETGQLCMRLLLYLVLCNKGPNGRWNPEVS

SEQ ID NO: 3085172 - protein, 23 aa, Giardia lamblia
AALFNCQESLYLVVNDCGIGLPK

SEQ ID NO: 3085173 - protein, 31 aa, Giardia lamblia
AALGELCCNIMLWILLIGTSLKSLMESLESY

SEQ ID NO: 3085174 - protein, 24 aa, Giardia lamblia
AALGKILQCTVSIAGSLYIATKIG

SEQ ID NO: 3085175 - protein, 19 aa, Giardia lamblia
AALIFAITLILINSSSRFT

SEQ ID NO: 3085176 - protein, 19 aa, Giardia lamblia
AALIKEYLKGLRLLMEERY

SEQ ID NO: 3085177 - protein, 20 aa, Giardia lamblia
AALILLLRIVYRIISNSSAP

SEQ ID NO: 3085178 - protein, 21 aa, Giardia lamblia
AALPFTTPLGVAAFIEKVYGE

SEQ ID NO: 3085179 - protein, 24 aa, Giardia lamblia
AALQSFYVLLKDPFDERTGLIDPF

SEQ ID NO: 3085180 - protein, 28 aa, Giardia lamblia
AALSYLVSSFLLCEARYVRLGTESAFRA

SEQ ID NO: 3085181 - protein, 22 aa, Giardia lamblia
AAMEYILRRFKASRILTSSAGI

SEQ ID NO: 3085182 - protein, 17 aa, Giardia lamblia
AANYFAQFYGNYIYLRK

SEQ ID NO: 3085183 - protein, 27 aa, Giardia lamblia
AAQIKMVLSYMLFKSAFCDEFKYLFLD

SEQ ID NO: 3085184 - protein, 25 aa, Giardia lamblia
AAQQCTKCLPGFFKTSDTACDACGD

SEQ ID NO: 3085185 - protein, 26 aa, Giardia lamblia
AARLQMPAFKKWYFSEREKFTDLNLL

SEQ ID NO: 3085186 - protein, 25 aa, Giardia lamblia
AASALLLFLIVRYSPSNALFNILTG

SEQ ID NO: 3085187 - protein, 25 aa, Giardia lamblia
AASDSPFFLHQQLRGIIISMRNMLY

SEQ ID NO: 3085188 - protein, 24 aa, Giardia lamblia
AASIFGIFVTWIAPLMVIMYMPRI

SEQ ID NO: 3085189 - protein, 19 aa, Giardia lamblia
AASKFFFDTLTPACFNYTV

SEQ ID NO: 3085190 - protein, 19 aa, Giardia lamblia
AASRLDQGPLRFFYDDFVV

SEQ ID NO: 3085191 - protein, 24 aa, Giardia lamblia
AASYNLFNFLPPIGKDDVGKSGSS

SEQ ID NO: 3085192 - protein, 25 aa, Giardia lamblia
AATEDFMFRLLIAFRPTTAETSSFI

SEQ ID NO: 3085193 - protein, 17 aa, Giardia lamblia
AATGLLTVVQRPLLSVS

SEQ ID NO: 3085194 - protein, 25 aa, Giardia lamblia
AATVRKWLAYGFVLFGRSSVYGPFM

SEQ ID NO: 3085195 - protein, 29 aa, Giardia lamblia
AATVSSIEWPYFALPFASVGEEGLSVEII

SEQ ID NO: 3085196 - protein, 29 aa, Giardia lamblia
AAVCLLNNWLFETPKPHFPVLYASQHAGT

SEQ ID NO: 3085197 - protein, 27 aa, Giardia lamblia
AAVCTLFYIIILLVMIVRKSVLPTFLD

SEQ ID NO: 3085198 - protein, 23 aa, Giardia lamblia
AAVKRVFQIFTSVPSQLLTNQDP

SEQ ID NO: 3085199 - protein, 23 aa, Giardia lamblia
AAVTLDYILRQTGSFLSLKATRH

SEQ ID NO: 3085200 - protein, 25 aa, Giardia lamblia
AAYKFVRPPIFPQVPPSHAKVMRPQ

SEQ ID NO: 3085201 - protein, 25 aa, Giardia lamblia
AAYQLKVIYSALVSAALPAPRSGCT

SEQ ID NO: 3085202 - protein, 35 aa, Giardia lamblia
AAYVIPVFKNCPYFRRYPSVKFYREFIRELYASLC

SEQ ID NO: 3085203 - protein, 19 aa, Giardia lamblia
ACALIPPYCAIQIQNALAE

SEQ ID NO: 3085204 - protein, 25 aa, Giardia lamblia
ACAPHNLVKLYANKTRLVCGGSGRI

SEQ ID NO: 3085205 - protein, 18 aa, Giardia lamblia
ACAYPWTYAPESSAGDRV

SEQ ID NO: 3085206 - protein, 25 aa, Giardia lamblia
ACCFLQVFLRFLLGDVHLTLENAKQ

SEQ ID NO: 3085207 - protein, 24 aa, Giardia lamblia
ACCNDFILMRFAISNDFNYYALVD

SEQ ID NO: 3085208 - protein, 19 aa, Giardia lamblia
ACDLPTRLPVSFSAAFISV

SEQ ID NO: 3085209 - protein, 24 aa, Giardia lamblia
ACDVKNCILCIARDGKKCFMCEKG

SEQ ID NO: 3085210 - protein, 19 aa, Giardia lamblia
ACESGRKALTLDGMLLCPR

SEQ ID NO: 3085211 - protein, 28 aa, Giardia lamblia
ACIGLYIHIISMIPFIHVPYSQLVILLD

SEQ ID NO: 3085212 - protein, 22 aa, Giardia lamblia
ACILPAVFYLPAQNKILCLNGT

SEQ ID NO: 3085213 - protein, 17 aa, Giardia lamblia
ACKEIFLPKLPEDLVDA

SEQ ID NO: 3085214 - protein, 32 aa, Giardia lamblia
ACKTSLIYIYDILSPVWAFGKAIKIMKSLLAQ

SEQ ID NO: 3085215 - protein, 17 aa, Giardia lamblia
ACKYYESAWLLSRGAST

SEQ ID NO: 3085216 - protein, 25 aa, Giardia lamblia
ACLNLPVILVIATWTAIICDVLCGY

SEQ ID NO: 3085217 - protein, 30 aa, Giardia lamblia
ACLRCAATHLLYYGGCYKITQPVIEICKQD

SEQ ID NO: 3085218 - protein, 23 aa, Giardia lamblia
ACLRLYAVDLRWSPHRTPVPESP

SEQ ID NO: 3085219 - protein, 18 aa, Giardia lamblia
ACMYKVISQAFSAAPTLW

SEQ ID NO: 3085220 - protein, 26 aa, Giardia lamblia
ACNAILLTLMAIGVTLPYVPCAVSLG

SEQ ID NO: 3085221 - protein, 18 aa, Giardia lamblia
ACPAVIFIVTNLLVLFYI

SEQ ID NO: 3085222 - protein, 19 aa, Giardia lamblia
ACRFLVASEKDCLLCDGRD

SEQ ID NO: 3085223 - protein, 21 aa, Giardia lamblia
ACTFLLPIVLYKLYVALDTTR

SEQ ID NO: 3085224 - protein, 22 aa, Giardia lamblia
ACTTDFLLEEFSYFTIPESYPT

SEQ ID NO: 3085225 - protein, 35 aa, Giardia lamblia
ADCTKLFIEFFSATGPQKALFFYDGERLRYSTDDT

SEQ ID NO: 3085226 - protein, 18 aa, Giardia lamblia
ADDLFRLAVVGSDAALVI

SEQ ID NO: 3085227 - protein, 24 aa, Giardia lamblia
ADEADYVCSCFPIYRGDLCDTCNL

SEQ ID NO: 3085228 - protein, 30 aa, Giardia lamblia
ADELYQHLRLFYYFRCNWTFGKQSLEISDT

SEQ ID NO: 3085229 - protein, 17 aa, Giardia lamblia
ADFHKKFVHICGINPDN

SEQ ID NO: 3085230 - protein, 24 aa, Giardia lamblia
ADFTYNFILSFCVAVLLVIMCYAG

SEQ ID NO: 3085231 - protein, 25 aa, Giardia lamblia
ADGCKNVLLFEIIPAMLLNHESGDW

SEQ ID NO: 3085232 - protein, 17 aa, Giardia lamblia
ADGYFLYEGGCYETSKL

SEQ ID NO: 3085233 - protein, 23 aa, Giardia lamblia
ADHPPFNFHLLKTNALSTFDLGV

SEQ ID NO: 3085234 - protein, 28 aa, Giardia lamblia
ADHSKFRIKYIRALSLYDTYSSTIAELN

SEQ ID NO: 3085235 - protein, 25 aa, Giardia lamblia
ADKVNVFFTNKFRRTARYLMAIHRG

SEQ ID NO: 3085236 - protein, 22 aa, Giardia lamblia
ADLIYLYSCGSATYNLLGNVTV

SEQ ID NO: 3085237 - protein, 20 aa, Giardia lamblia
ADMYLDLPLVLMGNSAVVAN

SEQ ID NO: 3085238 - protein, 29 aa, Giardia lamblia
ADNSVLFPLYQKLLLFEYAYYQPNFANIQ

SEQ ID NO: 3085239 - protein, 28 aa, Giardia lamblia
ADPPPPTNWLSVVLSLALIVVIIVGWVF

SEQ ID NO: 3085240 - protein, 47 aa, Giardia lamblia
ADRLMDIIANFKLVYTPLIEKSLPLLAKLMMNPVLFAFILTAETFDH

SEQ ID NO: 3085241 - protein, 39 aa, Giardia lamblia
ADSPKSAFLLKFQDIVWTPSMIRLFALLFTSVSNGESPL

SEQ ID NO: 3085242 - protein, 21 aa, Giardia lamblia
ADVDCSLYCPITLDYSTRFRK

SEQ ID NO: 3085243 - protein, 26 aa, Giardia lamblia
ADVIPDSLWELLLDGALLSLDNEQSI

SEQ ID NO: 3085244 - protein, 24 aa, Giardia lamblia
ADVLAKFIGPLISGAIALLRTGFH

SEQ ID NO: 3085245 - protein, 21 aa, Giardia lamblia
ADYYRYFIELYRSMSVDFPTE

SEQ ID NO: 3085246 - protein, 17 aa, Giardia lamblia
AEAKMRNWKNETALMLA

SEQ ID NO: 3085247 - protein, 36 aa, Giardia lamblia
AEALSLYLYLNSVILQRQYLDLLKDARLFMGGNLVC

SEQ ID NO: 3085248 - protein, 26 aa, Giardia lamblia
AEATQSHHWYSLRPLWNVTEDVVKIG

SEQ ID NO: 3085249 - protein, 33 aa, Giardia lamblia
AEAVIGMVDLRILLLALINLLSNANYTILVLSY

SEQ ID NO: 3085250 - protein, 18 aa, Giardia lamblia
AECISSVLLFLWVSGDIS

SEQ ID NO: 3085251 - protein, 27 aa, Giardia lamblia
AEDSVCLHHILVIRALYTKKIAECFYA

SEQ ID NO: 3085252 - protein, 21 aa, Giardia lamblia
AEELLPFLIDKANVAWIIEYI

SEQ ID NO: 3085253 - protein, 21 aa, Giardia lamblia
AEFHVLLLELLSSPVALPDEL

SEQ ID NO: 3085254 - protein, 24 aa, Giardia lamblia
AEFRKAIILLLNEQYSQCLCYCTY

SEQ ID NO: 3085255 - protein, 24 aa, Giardia lamblia
AEGAPPLIQAFYLFGPRATAVLST

SEQ ID NO: 3085256 - protein, 25 aa, Giardia lamblia
AEGLVLSDIIFSLSLFKVILDKEKL

SEQ ID NO: 3085257 - protein, 19 aa, Giardia lamblia
AEGYFGTFATPGLGACLAC

SEQ ID NO: 3085258 - protein, 24 aa, Giardia lamblia
AEGYIIKMANYLNALYTLRSEPVY

SEQ ID NO: 3085259 - protein, 26 aa, Giardia lamblia
AEIDFDLPYIQLVYKALLALNMPDIS

SEQ ID NO: 3085260 - protein, 28 aa, Giardia lamblia
AEILVLLRSVDFSKLLKLLLSNANLSFG

SEQ ID NO: 3085261 - protein, 17 aa, Giardia lamblia
AEKGWFIYDPFAEYCRQ

SEQ ID NO: 3085262 - protein, 41 aa, Giardia lamblia
AELGHFIAVFALVVILLILFFFTWYLALVKQLSRYVPILNL

SEQ ID NO: 3085263 - protein, 19 aa, Giardia lamblia
AELIHQFRHALFSCIKPLG

SEQ ID NO: 3085264 - protein, 17 aa, Giardia lamblia
AELSKLLYEQRVRYYTA

SEQ ID NO: 3085265 - protein, 24 aa, Giardia lamblia
AEMRVYIVAYYLYDTLVTQFSSFS

SEQ ID NO: 3085266 - protein, 20 aa, Giardia lamblia
AENRFIPVETMFFAANQIAA

SEQ ID NO: 3085267 - protein, 19 aa, Giardia lamblia
AEPGVNVPVSLLSAAWLGA

SEQ ID NO: 3085268 - protein, 30 aa, Giardia lamblia
AEPIGYVLELLLMKLIRKDTNLPILVISFS

SEQ ID NO: 3085269 - protein, 21 aa, Giardia lamblia
AERLCSWPLYAMLESLVLLFV

SEQ ID NO: 3085270 - protein, 26 aa, Giardia lamblia
AERLRALRYMGFLSSTFLAYVFVAMP

SEQ ID NO: 3085271 - protein, 18 aa, Giardia lamblia
AESLVCVRLLLQRMVFQE

SEQ ID NO: 3085272 - protein, 24 aa, Giardia lamblia
AETCPFLLTAGLDKTLRYVQIYQR

SEQ ID NO: 3085273 - protein, 23 aa, Giardia lamblia
AETSSFIDYYKVLNARGLLEALL

SEQ ID NO: 3085274 - protein, 38 aa, Giardia lamblia
AETVRKFMIAVFIVTILYSTILLILTSGILVPVPFVIS

SEQ ID NO: 3085275 - protein, 25 aa, Giardia lamblia
AEYHGLLSSVLLIQAFFRGTKERLR

SEQ ID NO: 3085276 - protein, 24 aa, Giardia lamblia
AFDILYVVLLVFTLSPITVKIYWA

SEQ ID NO: 3085277 - protein, 25 aa, Giardia lamblia
AFDYASVVRIMIGALLLGCVVCFDE

SEQ ID NO: 3085278 - protein, 26 aa, Giardia lamblia
AFFNLAQLICCPLLLWASEFIGRRII

SEQ ID NO: 3085279 - protein, 28 aa, Giardia lamblia
AFFNLGQLFFCPLWLWLSEIIGRKPVYI

SEQ ID NO: 3085280 - protein, 21 aa, Giardia lamblia
AFFPGLTLTQLALLASMIVEG

SEQ ID NO: 3085281 - protein, 18 aa, Giardia lamblia
AFGIDPAWRWSDNSMMFI

SEQ ID NO: 3085282 - protein, 24 aa, Giardia lamblia
AFGYVYYLWMFIGGPILTAFSASI

SEQ ID NO: 3085283 - protein, 20 aa, Giardia lamblia
AFHRRLPSTKLEKLFTLPYV

SEQ ID NO: 3085284 - protein, 25 aa, Giardia lamblia
AFHSILFYVKLVLAGLFAGILGAML

SEQ ID NO: 3085285 - protein, 18 aa, Giardia lamblia
AFIAAFFESGRIAALLAV

SEQ ID NO: 3085286 - protein, 22 aa, Giardia lamblia
AFIAECKVLLKKNFSTLIHNDI

SEQ ID NO: 3085287 - protein, 27 aa, Giardia lamblia
AFIDANGHIYRLYGLDFIRISVDGSVH

SEQ ID NO: 3085288 - protein, 18 aa, Giardia lamblia
AFIFPYGCFFDHLDRLHD

SEQ ID NO: 3085289 - protein, 20 aa, Giardia lamblia
AFINHCLSLSFGLYTTQFAN

SEQ ID NO: 3085290 - protein, 24 aa, Giardia lamblia
AFIVFFLKLQLMNWMSTLFVVIFP

SEQ ID NO: 3085291 - protein, 17 aa, Giardia lamblia
AFKQSFGWKLAHLCLPS

SEQ ID NO: 3085292 - protein, 27 aa, Giardia lamblia
AFKTGLLRVLPSVYLRGLFIAIGDTEY

SEQ ID NO: 3085293 - protein, 18 aa, Giardia lamblia
AFLRLCRAIVYTPISVLQ

SEQ ID NO: 3085294 - protein, 33 aa, Giardia lamblia
AFLVTPVVYILVVPTFVFLGLHGAGPKKTKASP

SEQ ID NO: 3085295 - protein, 28 aa, Giardia lamblia
AFMSTLLGLRILLTLFRALIASRKSKLV

SEQ ID NO: 3085296 - protein, 18 aa, Giardia lamblia
AFPLAPTNPILVPPIVTR

SEQ ID NO: 3085297 - protein, 32 aa, Giardia lamblia
AFQVLYVLLVLIYLTIYFFPSTTLVNLVNKHS

SEQ ID NO: 3085298 - protein, 19 aa, Giardia lamblia
AFQVMRKVLVKAGRDLSLL

SEQ ID NO: 3085299 - protein, 19 aa, Giardia lamblia
AFRNRPVFDILMEACTSWS

SEQ ID NO: 3085300 - protein, 20 aa, Giardia lamblia
AFRVLFPQLEMFRQAKIHNI

SEQ ID NO: 3085301 - protein, 28 aa, Giardia lamblia
AFSAAMCALYYLILYDSTCAIFKDRRNV

SEQ ID NO: 3085302 - protein, 33 aa, Giardia lamblia
AFSFLSVSPILFGAWYPLALAFLLPISRIVHEL

SEQ ID NO: 3085303 - protein, 26 aa, Giardia lamblia
AFSGTLFSIFLILSGSLSMYPNINNK

SEQ ID NO: 3085304 - protein, 17 aa, Giardia lamblia
AFSSIFTRGPYKSLPSG

SEQ ID NO: 3085305 - protein, 19 aa, Giardia lamblia
AFTPYSFGKLIGASAPIND

SEQ ID NO: 3085306 - protein, 20 aa, Giardia lamblia
AFVPLKEQFIRFGQELVPYL

SEQ ID NO: 3085307 - protein, 26 aa, Giardia lamblia
AFYEISVFLRQFSGLTYKFVAGDIPM

SEQ ID NO: 3085308 - protein, 23 aa, Giardia lamblia
AFYHSLCMYFLTRFAISYNVTEM

SEQ ID NO: 3085309 - protein, 18 aa, Giardia lamblia
AFYLARLDAASPATFPAH

SEQ ID NO: 3085310 - protein, 30 aa, Giardia lamblia
AGAFFISFVSYIILFSYALPICIFVTIELL

SEQ ID NO: 3085311 - protein, 33 aa, Giardia lamblia
AGAIDSVLLLSRFEPLLPNAYGQTPLMSAAGNG

SEQ ID NO: 3085312 - protein, 22 aa, Giardia lamblia
AGFFLLTMWRIEIAPVLPSKLC

SEQ ID NO: 3085313 - protein, 21 aa, Giardia lamblia
AGFLTGYCLRLPIPMSCGRGI

SEQ ID NO: 3085314 - protein, 20 aa, Giardia lamblia
AGHIPLLFNVDQYKAISNTH

SEQ ID NO: 3085315 - protein, 24 aa, Giardia lamblia
AGHLHKHITLRKNLFRYNAKGLIN

SEQ ID NO: 3085316 - protein, 24 aa, Giardia lamblia
AGHLMRLIIILFALFGLLTAWAFK

SEQ ID NO: 3085317 - protein, 26 aa, Giardia lamblia
AGIAHCAKCLPLPRGQRAQCTVCERG

SEQ ID NO: 3085318 - protein, 18 aa, Giardia lamblia
AGIPFVGIPGFPAVFIQL

SEQ ID NO: 3085319 - protein, 38 aa, Giardia lamblia
AGISIVVILVISGVVGFLCWWFICRSKSRPTENPVHTL

SEQ ID NO: 3085320 - protein, 27 aa, Giardia lamblia
AGKSTLLEALLYLLSQERPVYDRIEPK

SEQ ID NO: 3085321 - protein, 20 aa, Giardia lamblia
AGLCLTCVYPAYSIQPDRRS

SEQ ID NO: 3085322 - protein, 25 aa, Giardia lamblia
AGLGLWAIVVLYPTISFQGLNKGQS

SEQ ID NO: 3085323 - protein, 25 aa, Giardia lamblia
AGLLFGYIERLPTPLVLKSAPSVEY

SEQ ID NO: 3085324 - protein, 36 aa, Giardia lamblia
AGLLRLCILEVRMLKLGFLPSIVIFFVAAMAVVAVS

SEQ ID NO: 3085325 - protein, 20 aa, Giardia lamblia
AGLVPLFRRHPELLLGILSD

SEQ ID NO: 3085326 - protein, 40 aa, Giardia lamblia
AGMQTRDIPPYPLYTALMIAVTRRKLDFVKLLAPVEAGKK

SEQ ID NO: 3085327 - protein, 33 aa, Giardia lamblia
AGNKYGFGLIWMFYEFLLKQWKAGPPIEYESCQ

SEQ ID NO: 3085328 - protein, 25 aa, Giardia lamblia
AGQRLRITTPFKAPNPRPVILVLGE

SEQ ID NO: 3085329 - protein, 34 aa, Giardia lamblia
AGQTALMIAVLLARLTLIPLLLEERDLCMTNGVT

SEQ ID NO: 3085330 - protein, 25 aa, Giardia lamblia
AGSLFKLFPFSNYTPSLNALVSITF

SEQ ID NO: 3085331 - protein, 24 aa, Giardia lamblia
AGSPSILELMSLPSPSPAGGTMST

SEQ ID NO: 3085332 - protein, 25 aa, Giardia lamblia
AGSVIDTVFYLVRVEGSFSVTSLGN

SEQ ID NO: 3085333 - protein, 29 aa, Giardia lamblia
AGTCLFNKDIKNFFCYCSDGYINALDNRI

SEQ ID NO: 3085334 - protein, 45 aa, Giardia lamblia
AGVFISEMFYYYIRTIFLFIDIFQPIFLCLLFTSFAFSPVHATFY

SEQ ID NO: 3085335 - protein, 24 aa, Giardia lamblia
AGVIKFREKWYVGTSLRSVLQTQV

SEQ ID NO: 3085336 - protein, 33 aa, Giardia lamblia
AGVLVILLTLLSSAIFNIILFSAAQLLYINLVI

SEQ ID NO: 3085337 - protein, 21 aa, Giardia lamblia
AGWTALMYAAAFGNAACIWLL

SEQ ID NO: 3085338 - protein, 21 aa, Giardia lamblia
AGYLILLRLASLDKDKTRYSP

SEQ ID NO: 3085339 - protein, 28 aa, Giardia lamblia
AHDLLAHPRLCPYIKRLLGPSVTIATFT

SEQ ID NO: 3085340 - protein, 17 aa, Giardia lamblia
AHFLYNCEYLGASPRLV

SEQ ID NO: 3085341 - protein, 17 aa, Giardia lamblia
AHFMKQWTKGEKGLYSC

SEQ ID NO: 3085342 - protein, 21 aa, Giardia lamblia
AHILLQILTARVPFLNLRVLA

SEQ ID NO: 3085343 - protein, 21 aa, Giardia lamblia
AHITLLKYMTLLKIINDTVVR

SEQ ID NO: 3085344 - protein, 25 aa, Giardia lamblia
AHKLTIFQIVLPFNKLTIEYPERWA

SEQ ID NO: 3085345 - protein, 18 aa, Giardia lamblia
AHLISYKQTIYLLSSDVV

SEQ ID NO: 3085346 - protein, 19 aa, Giardia lamblia
AHPIGRILNRLIADTGTCD

SEQ ID NO: 3085347 - protein, 24 aa, Giardia lamblia
AHPNFPFSRVSLVPNWMIGNTITG

SEQ ID NO: 3085348 - protein, 31 aa, Giardia lamblia
AHRCYFRMVLVMLFIYDKYVLLPAGVIMVVV

SEQ ID NO: 3085349 - protein, 26 aa, Giardia lamblia
AHRQQKLSIFAFVIYSLCKVIEFDRY

SEQ ID NO: 3085350 - protein, 26 aa, Giardia lamblia
AHTKTPLHLPPLVTIGVMKLPDSLLL

SEQ ID NO: 3085351 - protein, 26 aa, Giardia lamblia
AHWSNPYVIALLYYSLLLSICNNRAT

SEQ ID NO: 3085352 - protein, 27 aa, Giardia lamblia
AHYDVFRMFMELYILIEEIKNVYLRVS

SEQ ID NO: 3085353 - protein, 18 aa, Giardia lamblia
AHYILENTVLLLPERERG

SEQ ID NO: 3085354 - protein, 24 aa, Giardia lamblia
AIAAIIHIYLAITRAFQSNVLKMA

SEQ ID NO: 3085355 - protein, 32 aa, Giardia lamblia
AIAALFGIAVYWLVPLFIRWKVPEIAAHSRIP

SEQ ID NO: 3085356 - protein, 28 aa, Giardia lamblia
AICSCNQGWTLHGTLCYPSACISGGTLC

SEQ ID NO: 3085357 - protein, 27 aa, Giardia lamblia
AIEAARETLIERIVLMGAAGIWSGEAP

SEQ ID NO: 3085358 - protein, 19 aa, Giardia lamblia
AIEILFFAYRILSEVINSL

SEQ ID NO: 3085359 - protein, 17 aa, Giardia lamblia
AIERVLPLVWKIAKEYT

SEQ ID NO: 3085360 - protein, 25 aa, Giardia lamblia
AIEYYVALSPLYIQQRILQCVFLPV

SEQ ID NO: 3085361 - protein, 17 aa, Giardia lamblia
AIFLEEFVKLKDLFTSV

SEQ ID NO: 3085362 - protein, 18 aa, Giardia lamblia
AIFSVILSSLYRITNKSH

SEQ ID NO: 3085363 - protein, 24 aa, Giardia lamblia
AIGAAFYDALLSLLLEYSDLSLLI

SEQ ID NO: 3085364 - protein, 30 aa, Giardia lamblia
AIGADIAFQRPIVPIPVFTGSLYGQNHTLS

SEQ ID NO: 3085365 - protein, 22 aa, Giardia lamblia
AIGIRLLFVILGVCPLIASIIV

SEQ ID NO: 3085366 - protein, 17 aa, Giardia lamblia
AIGIWKFLSVRKRIVNV

SEQ ID NO: 3085367 - protein, 24 aa, Giardia lamblia
AIGNMFIILDAKNYIHFYLNPVDE

SEQ ID NO: 3085368 - protein, 27 aa, Giardia lamblia
AIGYAVSYLLLLSSHEYKLLPKTSPDE

SEQ ID NO: 3085369 - protein, 18 aa, Giardia lamblia
AIGYPPRVAFLVTPVVYI

SEQ ID NO: 3085370 - protein, 19 aa, Giardia lamblia
AIIDGYLTNIRKYVSTLKE

SEQ ID NO: 3085371 - protein, 19 aa, Giardia lamblia
AIIFPLTIPRSISALNIVS

SEQ ID NO: 3085372 - protein, 20 aa, Giardia lamblia
AIILHNVYIPFSGRHEHRFA

SEQ ID NO: 3085373 - protein, 19 aa, Giardia lamblia
AIKFLAQRILLLSRTVKIS

SEQ ID NO: 3085374 - protein, 39 aa, Giardia lamblia
AIKSFITFYPMYLIYVNAPRLLAALYLSNLQYRLIIAYV

SEQ ID NO: 3085375 - protein, 17 aa, Giardia lamblia
AILHYDALDYHNGIACV

SEQ ID NO: 3085376 - protein, 18 aa, Giardia lamblia
AILPLSLLRNLNSLWLTS

SEQ ID NO: 3085377 - protein, 17 aa, Giardia lamblia
AILTFLEKYYFEVQSIG

SEQ ID NO: 3085378 - protein, 24 aa, Giardia lamblia
AIMDFHERLSPVSLLIGILSSTGR

SEQ ID NO: 3085379 - protein, 20 aa, Giardia lamblia
AIMQAYMPHLLRSCSLEPVR

SEQ ID NO: 3085380 - protein, 37 aa, Giardia lamblia
AIMTIVFSIFFYLIERKVPYPLILFKALQNPIGAMYF

SEQ ID NO: 3085381 - protein, 27 aa, Giardia lamblia
AINNPALFMTIYLDAKGKTGLSWQNSG

SEQ ID NO: 3085382 - protein, 32 aa, Giardia lamblia
AINSPAYRMLWLYTPFFLELLNTLASIVNMPL

SEQ ID NO: 3085383 - protein, 22 aa, Giardia lamblia
AIPLVIFSISFLTVSSASFVFL

SEQ ID NO: 3085384 - protein, 23 aa, Giardia lamblia
AIRALIQIYQTLSTILRPTPSKI

SEQ ID NO: 3085385 - protein, 25 aa, Giardia lamblia
AIRLCSLLQRSAINFIFQLIAGLSQ

SEQ ID NO: 3085386 - protein, 18 aa, Giardia lamblia
AISDLKVTDLTFLAVFHS

SEQ ID NO: 3085387 - protein, 17 aa, Giardia lamblia
AISKCSLCMVPEGAATP

SEQ ID NO: 3085388 - protein, 28 aa, Giardia lamblia
AISNSLFAVWSFLPSQKGMKDDQGMTAL

SEQ ID NO: 3085389 - protein, 25 aa, Giardia lamblia
AISPGSLAFYISWTHPSVSLHLDAA

SEQ ID NO: 3085390 - protein, 20 aa, Giardia lamblia
AITFLLQHVGMFQLRSSSES

SEQ ID NO: 3085391 - protein, 23 aa, Giardia lamblia
AITSFLAACILPYINERVFRLFE

SEQ ID NO: 3085392 - protein, 27 aa, Giardia lamblia
AIVDEFLSKLLALLDRVRLQFAGSIEY

SEQ ID NO: 3085393 - protein, 18 aa, Giardia lamblia
AIVPNIISNIHILMSLKA

SEQ ID NO: 3085394 - protein, 25 aa, Giardia lamblia
AIYALSRIAYSISYWSYLHQYDSIA

SEQ ID NO: 3085395 - protein, 25 aa, Giardia lamblia
AIYLSLFTHPAAMMGLIAFAIAMPL

SEQ ID NO: 3085396 - protein, 19 aa, Giardia lamblia
AIYNILTTGVYLGGSVFVY

SEQ ID NO: 3085397 - protein, 22 aa, Giardia lamblia
AKDFFFIHLSSYIVGLGRAHNF

SEQ ID NO: 3085398 - protein, 31 aa, Giardia lamblia
AKDTKDQCMTCKPGFFMKGSGPGTCVPCDDQ

SEQ ID NO: 3085399 - protein, 26 aa, Giardia lamblia
AKGDAFLYSLLLPSFSMEPMTYEGLR

SEQ ID NO: 3085400 - protein, 23 aa, Giardia lamblia
AKGPSFFRFFRGTKAEIHGIVTY

SEQ ID NO: 3085401 - protein, 25 aa, Giardia lamblia
AKKGLALSLTLYASLFLLSSNRQIV

SEQ ID NO: 3085402 - protein, 24 aa, Giardia lamblia
AKKKDVFYWAARSIAPKPSVRSQV

SEQ ID NO: 3085403 - protein, 26 aa, Giardia lamblia
AKLAFVDIILIRFLTDILGSGNAEVL

SEQ ID NO: 3085404 - protein, 29 aa, Giardia lamblia
AKMARIIEDKLIFCRNFVIAIGNVRKLLP

SEQ ID NO: 3085405 - protein, 20 aa, Giardia lamblia
AKNSLLESLVPLLRDVMAAS

SEQ ID NO: 3085406 - protein, 31 aa, Giardia lamblia
AKPLELFEVILLAYLFYYSTTPLLQEKLLSL

SEQ ID NO: 3085407 - protein, 22 aa, Giardia lamblia
AKPLIIDYIFSIVGGITALLTV

SEQ ID NO: 3085408 - protein, 22 aa, Giardia lamblia
AKRGVRSLLLMKSPLGKEIVEA

SEQ ID NO: 3085409 - protein, 26 aa, Giardia lamblia
AKRLLRLTCYTLFDSTLYPIKDATKF

SEQ ID NO: 3085410 - protein, 25 aa, Giardia lamblia
AKRRIAYYTGFPYLKQLAYGSHMTV

SEQ ID NO: 3085411 - protein, 28 aa, Giardia lamblia
AKSASDNTFFLFYGGCYDTKDFPGSNIC

SEQ ID NO: 3085412 - protein, 21 aa, Giardia lamblia
AKSLSKPAALPKTLKPIQVSH

SEQ ID NO: 3085413 - protein, 30 aa, Giardia lamblia
AKSSSIICMFVIALLIRFYQFQLSRMDEED

SEQ ID NO: 3085414 - protein, 32 aa, Giardia lamblia
AKYFGTAITSILLLLRQMSLIHPSIATVFTDH

SEQ ID NO: 3085415 - protein, 39 aa, Giardia lamblia
ALAAAITVPILVLFVVGFLTYILVKRAIAKREQAKVMNR

SEQ ID NO: 3085416 - protein, 19 aa, Giardia lamblia
ALAIAIPILSLSGSTRAQK

SEQ ID NO: 3085417 - protein, 17 aa, Giardia lamblia
ALALGRYDKLRLPCNSC

SEQ ID NO: 3085418 - protein, 25 aa, Giardia lamblia
ALANLCVGLILINLNKEAETLMHIV

SEQ ID NO: 3085419 - protein, 24 aa, Giardia lamblia
ALAPQIMIYIFTGTILSVTEFADV

SEQ ID NO: 3085420 - protein, 26 aa, Giardia lamblia
ALAQMQSLFLLFTGKAFCMQVSDTLE

SEQ ID NO: 3085421 - protein, 23 aa, Giardia lamblia
ALAVLFAPYDPLGNIAWKVLCNV

SEQ ID NO: 3085422 - protein, 20 aa, Giardia lamblia
ALCKCFLAPQAIPHRLRNLL

SEQ ID NO: 3085423 - protein, 22 aa, Giardia lamblia
ALDAITSIRMSPASRLAEKLKT

SEQ ID NO: 3085424 - protein, 29 aa, Giardia lamblia
ALDALAMWINYFLSLIVHVLYLVHKSPRL

SEQ ID NO: 3085425 - protein, 18 aa, Giardia lamblia
ALDKLHFTSLTRPSVLGK

SEQ ID NO: 3085426 - protein, 20 aa, Giardia lamblia
ALERSAVFFFGPYGPFIKAV

SEQ ID NO: 3085427 - protein, 24 aa, Giardia lamblia
ALERVFVPVYASIFSDLISSTSLA

SEQ ID NO: 3085428 - protein, 27 aa, Giardia lamblia
ALETTELLFNPFIPHPQPSLTLAQCEN

SEQ ID NO: 3085429 - protein, 17 aa, Giardia lamblia
ALFAWKDFCSLSSSASI

SEQ ID NO: 3085430 - protein, 19 aa, Giardia lamblia
ALFCIIPQFSSQLAIFAEF

SEQ ID NO: 3085431 - protein, 25 aa, Giardia lamblia
ALFCQKFLDHLLFGITIRSTGNFGG

SEQ ID NO: 3085432 - protein, 20 aa, Giardia lamblia
ALFKKMLRSIFRSPMSFFDT

SEQ ID NO: 3085433 - protein, 20 aa, Giardia lamblia
ALFSAVRRLLPSISSIRGQV

SEQ ID NO: 3085434 - protein, 29 aa, Giardia lamblia
ALFSSAPIFFFLHITLCIYSCLVAGGYPV

SEQ ID NO: 3085435 - protein, 25 aa, Giardia lamblia
ALGHCEILDLLLPYEACLCTNDANR

SEQ ID NO: 3085436 - protein, 22 aa, Giardia lamblia
ALHNWLSKILSNGVYLTFTSLF

SEQ ID NO: 3085437 - protein, 39 aa, Giardia lamblia
ALHRPLYIHEELHYTILRIVLLLIIVPETGTLDPMYCSQ

SEQ ID NO: 3085438 - protein, 23 aa, Giardia lamblia
ALICTFMLTILSEIRARFIFQDD

SEQ ID NO: 3085439 - protein, 27 aa, Giardia lamblia
ALIFGILMLIIMLPSARQILLSLASSE

SEQ ID NO: 3085440 - protein, 20 aa, Giardia lamblia
ALIHEFLCIFLYCTSLGFVG

SEQ ID NO: 3085441 - protein, 19 aa, Giardia lamblia
ALITPLLIRMGLIGKLSGR

SEQ ID NO: 3085442 - protein, 22 aa, Giardia lamblia
ALITRNLFMLCSNDQILQALGF

SEQ ID NO: 3085443 - protein, 17 aa, Giardia lamblia
ALKATVERLGFSAGLLA

SEQ ID NO: 3085444 - protein, 30 aa, Giardia lamblia
ALKKRDMQTFLALPLFVYMSERTTDKVAVK

SEQ ID NO: 3085445 - protein, 32 aa, Giardia lamblia
ALKRLTIIPDINLHIFTILCAVLQNYVTFDSL

SEQ ID NO: 3085446 - protein, 50 aa, Giardia lamblia
ALLDRNMAIKRVHLWAKKKYGLQQLVTNLLWHLYCSLLFHRRTDVEVDFF

SEQ ID NO: 3085447 - protein, 19 aa, Giardia lamblia
ALLGFVVDLYIFLGLECPC

SEQ ID NO: 3085448 - protein, 23 aa, Giardia lamblia
ALLGLPVYAIYFDISVLTSTVRD

SEQ ID NO: 3085449 - protein, 19 aa, Giardia lamblia
ALLHRNMRLLDAIVPFISS

SEQ ID NO: 3085450 - protein, 19 aa, Giardia lamblia
ALLLKIGGVYLLDILIHRL

SEQ ID NO: 3085451 - protein, 25 aa, Giardia lamblia
ALLLKMYTMLPPLGPQRKAYRDWVI

SEQ ID NO: 3085452 - protein, 18 aa, Giardia lamblia
ALLNLALAVPQECMFGGE

SEQ ID NO: 3085453 - protein, 20 aa, Giardia lamblia
ALLPRGLTVFGWNASITNDD

SEQ ID NO: 3085454 - protein, 32 aa, Giardia lamblia
ALLSTHMLYIFNCTFYILLLLSQNKLAEVEKI

SEQ ID NO: 3085455 - protein, 29 aa, Giardia lamblia
ALLVRNDINPLLQKTFFGGGAVVLASCES

SEQ ID NO: 3085456 - protein, 21 aa, Giardia lamblia
ALMLHIRHALLGAVDTRRFYY

SEQ ID NO: 3085457 - protein, 19 aa, Giardia lamblia
ALMRAAFSGASDIALLLLE

SEQ ID NO: 3085458 - protein, 19 aa, Giardia lamblia
ALNPAWRQPIFNLTSSVEK

SEQ ID NO: 3085459 - protein, 18 aa, Giardia lamblia
ALNRIKIFSKFSALIKRL

SEQ ID NO: 3085460 - protein, 20 aa, Giardia lamblia
ALNRLFLFKERMSAIREIFM

SEQ ID NO: 3085461 - protein, 27 aa, Giardia lamblia
ALNRSLYLLTLCLLAISTSLHAECKDD

SEQ ID NO: 3085462 - protein, 20 aa, Giardia lamblia
ALPDLRLYSQLTNYCRIANI

SEQ ID NO: 3085463 - protein, 18 aa, Giardia lamblia
ALPVYLPLEKLNLSLERF

SEQ ID NO: 3085464 - protein, 20 aa, Giardia lamblia
ALPWSRYVAILLPTTEMQMS

SEQ ID NO: 3085465 - protein, 21 aa, Giardia lamblia
ALQETAFKILIYKITRDNFYE

SEQ ID NO: 3085466 - protein, 20 aa, Giardia lamblia
ALQFALELELLGRFGILRIT

SEQ ID NO: 3085467 - protein, 27 aa, Giardia lamblia
ALQVLVHVLIMSLLVHLLSTEKTTVPF

SEQ ID NO: 3085468 - protein, 31 aa, Giardia lamblia
ALRAELFQIKVRWPMHIRSLYASTQSTDIDV

SEQ ID NO: 3085469 - protein, 22 aa, Giardia lamblia
ALRRFADLLLTFLHDEKRELRD

SEQ ID NO: 3085470 - protein, 31 aa, Giardia lamblia
ALRTFLGIEFWGTKVLLAVAPRLPAFVYLLS

SEQ ID NO: 3085471 - protein, 19 aa, Giardia lamblia
ALSLHWEDELLLPNVEILL

SEQ ID NO: 3085472 - protein, 20 aa, Giardia lamblia
ALSLPMFMRVYPPFDESAEF

SEQ ID NO: 3085473 - protein, 25 aa, Giardia lamblia
ALSLVLPSLGVFWELTYTVSFGFIN

SEQ ID NO: 3085474 - protein, 30 aa, Giardia lamblia
ALSPELTLPMTPYVYLRLERLSLLSSVVTE

SEQ ID NO: 3085475 - protein, 28 aa, Giardia lamblia
ALSSQDLLKIIKLYALFLIEGDAPTAGV

SEQ ID NO: 3085476 - protein, 43 aa, Giardia lamblia
ALSYATINAFWFGHFLLLASRLPIYDPYMLSRVFHLYVTIETE

SEQ ID NO: 3085477 - protein, 20 aa, Giardia lamblia
ALTIAIRMGYQEACAILKDY

SEQ ID NO: 3085478 - protein, 19 aa, Giardia lamblia
ALTKYLKALISNPLAAAIL

SEQ ID NO: 3085479 - protein, 24 aa, Giardia lamblia
ALTLDGMLLCPRDCPTEGFWTSGS

SEQ ID NO: 3085480 - protein, 20 aa, Giardia lamblia
ALTVRMLPHPAYPLEVEIKT

SEQ ID NO: 3085481 - protein, 23 aa, Giardia lamblia
ALVFKFTFPISLIYTLGARVTIV

SEQ ID NO: 3085482 - protein, 33 aa, Giardia lamblia
ALVYMCVQFFILSFWSFCYSILQAYIQRISNVI

SEQ ID NO: 3085483 - protein, 35 aa, Giardia lamblia
ALYLISYHVPIVEKLLLSALLFPIDSIFAHETASI

SEQ ID NO: 3085484 - protein, 17 aa, Giardia lamblia
ALYQYYWNYRRLDTNGA

SEQ ID NO: 3085485 - protein, 30 aa, Giardia lamblia
AMARKHFDIVTYLNTVRNTMFKSALGTLGD

SEQ ID NO: 3085486 - protein, 18 aa, Giardia lamblia
AMDKLDLFSLFQLSDCKL

SEQ ID NO: 3085487 - protein, 20 aa, Giardia lamblia
AMFLAHLYRVTLSPISSFRV

SEQ ID NO: 3085488 - protein, 17 aa, Giardia lamblia
AMFLLTKGTETAPILRT

SEQ ID NO: 3085489 - protein, 18 aa, Giardia lamblia
AMFMLRYIERYLVETPAE

SEQ ID NO: 3085490 - protein, 31 aa, Giardia lamblia
AMHPQDSIVIPWINQFIFSGGVSMNLLSAIF

SEQ ID NO: 3085491 - protein, 30 aa, Giardia lamblia
AMIDKKLLLYILFTLIYGLLMALLVTIFDR

SEQ ID NO: 3085492 - protein, 22 aa, Giardia lamblia
AMILVMLFSYPLLCYGLRCTIE

SEQ ID NO: 3085493 - protein, 21 aa, Giardia lamblia
AMKYWVLQYLINNSTYEETQG

SEQ ID NO: 3085494 - protein, 20 aa, Giardia lamblia
AMLGTIFRGPFHSGLRRLGV

SEQ ID NO: 3085495 - protein, 32 aa, Giardia lamblia
AMLIFEKYVIVILALLLAIFILTSLIECGYSL

SEQ ID NO: 3085496 - protein, 18 aa, Giardia lamblia
AMLLDNVCVPILCTIKHP

SEQ ID NO: 3085497 - protein, 29 aa, Giardia lamblia
AMNPSWYILRYLHVSGPFLLFEVAILPQA

SEQ ID NO: 3085498 - protein, 20 aa, Giardia lamblia
AMNWELFYSYVCMLLSSWHV

SEQ ID NO: 3085499 - protein, 20 aa, Giardia lamblia
AMPAIPLPLSFRLSTIRNFI

SEQ ID NO: 3085500 - protein, 17 aa, Giardia lamblia
AMRLIIPQSSKLSCLTS

SEQ ID NO: 3085501 - protein, 21 aa, Giardia lamblia
AMYALLDRNLFYRTQPEYAAR

SEQ ID NO: 3085502 - protein, 24 aa, Giardia lamblia
ANAFRAYLLSGMLASDLLPMKNAT

SEQ ID NO: 3085503 - protein, 18 aa, Giardia lamblia
ANAIAKYLFYRDCDFAAY

SEQ ID NO: 3085504 - protein, 25 aa, Giardia lamblia
ANDGMPNILWILHHHLNHPRNEKFA

SEQ ID NO: 3085505 - protein, 27 aa, Giardia lamblia
ANEASRILLIILTTALPTVFIYMFKKT

SEQ ID NO: 3085506 - protein, 17 aa, Giardia lamblia
ANFLYICREALGWGPAA

SEQ ID NO: 3085507 - protein, 36 aa, Giardia lamblia
ANFPELLWEKSIGNIFLLIAMYLLASASSTIFAIII

SEQ ID NO: 3085508 - protein, 27 aa, Giardia lamblia
ANFRERFPHLIGIRASGNNFFCTKGVY

SEQ ID NO: 3085509 - protein, 35 aa, Giardia lamblia
ANILKYLDIKRRQFMRFFFLSDNELLIVLSAQDET

SEQ ID NO: 3085510 - protein, 27 aa, Giardia lamblia
ANINARNFYLPRFFYTGITTSSDEASK

SEQ ID NO: 3085511 - protein, 22 aa, Giardia lamblia
ANIRLVMKQIYLSVPRAPDCNE

SEQ ID NO: 3085512 - protein, 33 aa, Giardia lamblia
ANKVTTYFNEIWLSGILFLDLLIDEVQTEIQIE

SEQ ID NO: 3085513 - protein, 24 aa, Giardia lamblia
ANLIILQIISYFMAGYGVYLHGLE

SEQ ID NO: 3085514 - protein, 23 aa, Giardia lamblia
ANLTSSLLCRLDHSTARHQCLCV

SEQ ID NO: 3085515 - protein, 19 aa, Giardia lamblia
ANLWHRLRRHLGEAVCALI

SEQ ID NO: 3085516 - protein, 20 aa, Giardia lamblia
ANLYFLACTVPDSVTPMLQR

SEQ ID NO: 3085517 - protein, 25 aa, Giardia lamblia
ANPIPFYNYVPLYTDFVELQTLINS

SEQ ID NO: 3085518 - protein, 30 aa, Giardia lamblia
ANTGLPTNLLHLHYYMIYGKIVHLRARLLY

SEQ ID NO: 3085519 - protein, 35 aa, Giardia lamblia
ANVYYSHYFFMAAIWALLIPLLFTSWYQSLACFVT

SEQ ID NO: 3085520 - protein, 26 aa, Giardia lamblia
APCFDPLLFLMLDAGASYFFSVQSDD

SEQ ID NO: 3085521 - protein, 24 aa, Giardia lamblia
APDLTHFLAVCQYTLLGALPLMVI

SEQ ID NO: 3085522 - protein, 22 aa, Giardia lamblia
APEILLHLQYSDKSEMWSLGCI

SEQ ID NO: 3085523 - protein, 23 aa, Giardia lamblia
APELSFCIFRLDSKYDKRTQITS

SEQ ID NO: 3085524 - protein, 29 aa, Giardia lamblia
APEVSGKLPPVRYYCDCNAGFYGHSCESY

SEQ ID NO: 3085525 - protein, 18 aa, Giardia lamblia
APFDPTLLTRTLQNCFEN

SEQ ID NO: 3085526 - protein, 22 aa, Giardia lamblia
APFTLIEYKLKLGDITPSPLFI

SEQ ID NO: 3085527 - protein, 17 aa, Giardia lamblia
APIAKYALQAITLLFNA

SEQ ID NO: 3085528 - protein, 18 aa, Giardia lamblia
APKPLLFAAGGFGSTQFG

SEQ ID NO: 3085529 - protein, 18 aa, Giardia lamblia
APLIVDIIFYDSCVAIEI

SEQ ID NO: 3085530 - protein, 24 aa, Giardia lamblia
APLTFAEKYPILCKNFELKLLTLD

SEQ ID NO: 3085531 - protein, 17 aa, Giardia lamblia
APNLLGKQYIYLGTGSW

SEQ ID NO: 3085532 - protein, 23 aa, Giardia lamblia
APQKPSTPILTPLGCFFPDALEC

SEQ ID NO: 3085533 - protein, 20 aa, Giardia lamblia
APRFVFYFDGDVLHPDIRKR

SEQ ID NO: 3085534 - protein, 35 aa, Giardia lamblia
APRGCVFISKIDKTRRFYCGFLENVTENLPTNNLP

SEQ ID NO: 3085535 - protein, 25 aa, Giardia lamblia
APRKKQMPIGALIMGLIVGAVVAQI

SEQ ID NO: 3085536 - protein, 26 aa, Giardia lamblia
APRTKKITFLILMMVSLGLTVTSLIF

SEQ ID NO: 3085537 - protein, 25 aa, Giardia lamblia
APRTNYFALFINKLVKRRLEMQCRV

SEQ ID NO: 3085538 - protein, 25 aa, Giardia lamblia
APSPIQKLLCDVLYTGHAKKARSDS

SEQ ID NO: 3085539 - protein, 21 aa, Giardia lamblia
APTLEGILFKCFRKTRVPQDL

SEQ ID NO: 3085540 - protein, 24 aa, Giardia lamblia
APTPLDIISAIPLQYRYAATSIVN

SEQ ID NO: 3085541 - protein, 18 aa, Giardia lamblia
APTVFLQHIVLDKSLLAG

SEQ ID NO: 3085542 - protein, 18 aa, Giardia lamblia
APVPILVQGTKFYGDLQN

SEQ ID NO: 3085543 - protein, 19 aa, Giardia lamblia
APVSYWVDKVLLNMRPRGG

SEQ ID NO: 3085544 - protein, 17 aa, Giardia lamblia
APVVYLREVILSGTSRM

SEQ ID NO: 3085545 - protein, 23 aa, Giardia lamblia
APYSFLNNAIITDSLEAGGTVKI

SEQ ID NO: 3085546 - protein, 24 aa, Giardia lamblia
AQCELKYVAPTSVPLIGAIAVEGT

SEQ ID NO: 3085547 - protein, 27 aa, Giardia lamblia
AQDLGRKFRFFFTNLDAILISTNSKAK

SEQ ID NO: 3085548 - protein, 26 aa, Giardia lamblia
AQDRYVARFPIRIQKHIRENHLLALS

SEQ ID NO: 3085549 - protein, 20 aa, Giardia lamblia
AQFFVICDQLMQALERVYMP

SEQ ID NO: 3085550 - protein, 24 aa, Giardia lamblia
AQHLYQMYVLPQRVGPSLAYAASH

SEQ ID NO: 3085551 - protein, 25 aa, Giardia lamblia
AQKELFWKLLTKPVPVSTLWLVTLQ

SEQ ID NO: 3085552 - protein, 23 aa, Giardia lamblia
AQKQFLTELLRRTNKFFLSNSRR

SEQ ID NO: 3085553 - protein, 35 aa, Giardia lamblia
AQLEFINQFDPFDGVLFSVMPPRKSWKQICNLSGG

SEQ ID NO: 3085554 - protein, 34 aa, Giardia lamblia
AQLISSISFLLLPPVFMAPILYVSISILREQESQ

SEQ ID NO: 3085555 - protein, 17 aa, Giardia lamblia
AQLLVAFFLIFNSHKRQ

SEQ ID NO: 3085556 - protein, 24 aa, Giardia lamblia
AQNLTPLDLLFNGLLNILRERADQ

SEQ ID NO: 3085557 - protein, 23 aa, Giardia lamblia
AQPGKLIVEYYLGYSITVWPVVS

SEQ ID NO: 3085558 - protein, 31 aa, Giardia lamblia
AQRIKNKWLFLHIFSFPFCHEKFLHKIVKLT

SEQ ID NO: 3085559 - protein, 38 aa, Giardia lamblia
AQRMPGDKYLGMTAFLMACAMNCIGVVKLIMEAAGETG

SEQ ID NO: 3085560 - protein, 23 aa, Giardia lamblia
AQRWMQKYPAYAYGGSLYSWRHV

SEQ ID NO: 3085561 - protein, 24 aa, Giardia lamblia
AQSLIVCEILLALGKVFSLLALKY

SEQ ID NO: 3085562 - protein, 28 aa, Giardia lamblia
AQSVAFLVFIIILVVTFLGLTQSSPQII

SEQ ID NO: 3085563 - protein, 29 aa, Giardia lamblia
AQTSRYMLAYIFFQYFLVQVCGEKYHLIT

SEQ ID NO: 3085564 - protein, 22 aa, Giardia lamblia
AQVAFSLLMQKPSASIGPLQIC

SEQ ID NO: 3085565 - protein, 25 aa, Giardia lamblia
AQYKLLTYQRLCGCAYVVSLSSDKV

SEQ ID NO: 3085566 - protein, 24 aa, Giardia lamblia
ARAYFVLGTTYLNSTRTPLFGYQS

SEQ ID NO: 3085567 - protein, 29 aa, Giardia lamblia
ARDKFCVGLFHWYSLYISVVTGYFYTVKN

SEQ ID NO: 3085568 - protein, 24 aa, Giardia lamblia
ARDPKTIYAKYKLLGLVRTHHGGS

SEQ ID NO: 3085569 - protein, 18 aa, Giardia lamblia
ARELTPVICSLFARDCIL

SEQ ID NO: 3085570 - protein, 25 aa, Giardia lamblia
ARESVRLIKLWRANGSTLPKNTQIF

SEQ ID NO: 3085571 - protein, 28 aa, Giardia lamblia
ARFASAMPYLLMAFIGKTALQGLADAFT

SEQ ID NO: 3085572 - protein, 25 aa, Giardia lamblia
ARFGHLSIIRLLSPLEAGICDNRGK

SEQ ID NO: 3085573 - protein, 20 aa, Giardia lamblia
ARFILEFIPVAPFDEELRGL

SEQ ID NO: 3085574 - protein, 19 aa, Giardia lamblia
ARGPIMKWLVDSINLHDEE

SEQ ID NO: 3085575 - protein, 18 aa, Giardia lamblia
ARILIPYEAGMRSSNSGV

SEQ ID NO: 3085576 - protein, 19 aa, Giardia lamblia
ARIVGKLYSVLYAILSDDS

SEQ ID NO: 3085577 - protein, 27 aa, Giardia lamblia
ARKPKLFVVMLLTLVFGEALALYGLII

SEQ ID NO: 3085578 - protein, 18 aa, Giardia lamblia
ARLLVKGNFILVTAWERY

SEQ ID NO: 3085579 - protein, 18 aa, Giardia lamblia
ARLRKEVLYLAERRLRTS

SEQ ID NO: 3085580 - protein, 19 aa, Giardia lamblia
ARLSDRLTLMPEFARFILE

SEQ ID NO: 3085581 - protein, 17 aa, Giardia lamblia
ARLYLPHIFSNYVPAMP

SEQ ID NO: 3085582 - protein, 26 aa, Giardia lamblia
ARNLALILTSLLFKASCSSLIADPLF

SEQ ID NO: 3085583 - protein, 30 aa, Giardia lamblia
ARPFTKFQKLIYYAVSFLLQIPAVTVRNAI

SEQ ID NO: 3085584 - protein, 26 aa, Giardia lamblia
ARPGYASFFICTLYLMINGCTVYDAV

SEQ ID NO: 3085585 - protein, 48 aa, Giardia lamblia
ARREVILSSRLYFHKLFVILTELLLIPLQPYISTLLSFLHKISNCLLS

SEQ ID NO: 3085586 - protein, 19 aa, Giardia lamblia
ARRFSLAYKLLVTDAMFDL

SEQ ID NO: 3085587 - protein, 35 aa, Giardia lamblia
ARRMTCFLVVSLIHPLSPLLISILLSFKIGSCDCF

SEQ ID NO: 3085588 - protein, 20 aa, Giardia lamblia
ARSAALPVLVTDLKAAGLKG

SEQ ID NO: 3085589 - protein, 28 aa, Giardia lamblia
ARSELYRRILKNIIVFPVFISAECKSFI

SEQ ID NO: 3085590 - protein, 24 aa, Giardia lamblia
ARSLRRQPLLPSTLAEIVFNSAQL

SEQ ID NO: 3085591 - protein, 23 aa, Giardia lamblia
ARSNMYLPPTINPSYMVRDIEHT

SEQ ID NO: 3085592 - protein, 17 aa, Giardia lamblia
ARSRRSTRILLMISEYV

SEQ ID NO: 3085593 - protein, 25 aa, Giardia lamblia
ARTAFFWLYCVFSTFKPSYSQESLA

SEQ ID NO: 3085594 - protein, 25 aa, Giardia lamblia
ARTRLWLIDMVIFPICCNNHWSIYM

SEQ ID NO: 3085595 - protein, 27 aa, Giardia lamblia
ARTSPPVLYALCRLRRLPRGGGGRFLG

SEQ ID NO: 3085596 - protein, 20 aa, Giardia lamblia
ARVEADWLAELLRILCFSDQ

SEQ ID NO: 3085597 - protein, 23 aa, Giardia lamblia
ARVPVNGVCRLLNVSRSICQVPL

SEQ ID NO: 3085598 - protein, 18 aa, Giardia lamblia
ARWSPLICAAATGNLEAA

SEQ ID NO: 3085599 - protein, 27 aa, Giardia lamblia
ASAALTLFYYHFFFNPHIVGSAGASGV

SEQ ID NO: 3085600 - protein, 23 aa, Giardia lamblia
ASADLLEAFLDYVFCFTLYMRAD

SEQ ID NO: 3085601 - protein, 25 aa, Giardia lamblia
ASALIVDFIILTLFVGNDFLPEVPG

SEQ ID NO: 3085602 - protein, 26 aa, Giardia lamblia
ASASTRKWYWLPRYKFSLMTDDYTYQ

SEQ ID NO: 3085603 - protein, 28 aa, Giardia lamblia
ASCAMTHILYMGGCYNPAAPPGSKACAR

SEQ ID NO: 3085604 - protein, 35 aa, Giardia lamblia
ASCDSVYPLLPYDEAIFSAFFPPVVSSWTGVAGQA

SEQ ID NO: 3085605 - protein, 20 aa, Giardia lamblia
ASCFAFLFSLDTIFSASHDG

SEQ ID NO: 3085606 - protein, 24 aa, Giardia lamblia
ASDVLSMLLFRPYTRGAMRISFEF

SEQ ID NO: 3085607 - protein, 17 aa, Giardia lamblia
ASDYSITLLFLCISIYA

SEQ ID NO: 3085608 - protein, 26 aa, Giardia lamblia
ASEDTDIFLFYGGCYSKSEWPGSHIC

SEQ ID NO: 3085609 - protein, 28 aa, Giardia lamblia
ASEFITAFTLINTYLRDIYKTLTLGGDA

SEQ ID NO: 3085610 - protein, 24 aa, Giardia lamblia
ASETNVTYLTWDKAKKNSSYQTTS

SEQ ID NO: 3085611 - protein, 19 aa, Giardia lamblia
ASEVALPVYLPLEKLNLSL

SEQ ID NO: 3085612 - protein, 24 aa, Giardia lamblia
ASFFAKVLFALRRSSRPIAFFSME

SEQ ID NO: 3085613 - protein, 19 aa, Giardia lamblia
ASFSWLLVTRVLFGLFSES

SEQ ID NO: 3085614 - protein, 28 aa, Giardia lamblia
ASGDSRSFLLWPIAMLGSRRIFCINERA

SEQ ID NO: 3085615 - protein, 20 aa, Giardia lamblia
ASGLCQLPHMPYVGSPTGSL

SEQ ID NO: 3085616 - protein, 26 aa, Giardia lamblia
ASGVSQMFILFNINKSKPLRRISRIP

SEQ ID NO: 3085617 - protein, 23 aa, Giardia lamblia
ASGYRYLCIPSKCLTSKTGLERI

SEQ ID NO: 3085618 - protein, 29 aa, Giardia lamblia
ASHTPCEFLWRVLIPLVIHVLNGLFVRSY

SEQ ID NO: 3085619 - protein, 18 aa, Giardia lamblia
ASIAIFTDAHACQRLLNL

SEQ ID NO: 3085620 - protein, 22 aa, Giardia lamblia
ASIDFYRHLPLFARGSLVSVAH

SEQ ID NO: 3085621 - protein, 31 aa, Giardia lamblia
ASIKVFSKKLRRAFLVPLRDGVIMLTSSTGE

SEQ ID NO: 3085622 - protein, 17 aa, Giardia lamblia
ASILSMGLFGDIFSGGE

SEQ ID NO: 3085623 - protein, 18 aa, Giardia lamblia
ASIYFPVSEMLQLIHIEN

SEQ ID NO: 3085624 - protein, 24 aa, Giardia lamblia
ASIYNWIFKVYYLITTFYTIYLIA

SEQ ID NO: 3085625 - protein, 29 aa, Giardia lamblia
ASKAGFQLAYYTRPLLSLNFTRYFPSIDE

SEQ ID NO: 3085626 - protein, 17 aa, Giardia lamblia
ASKLRILYQSNENMRSV

SEQ ID NO: 3085627 - protein, 26 aa, Giardia lamblia
ASKLSLYTLPYYIIRSLNDTEKIRDP

SEQ ID NO: 3085628 - protein, 29 aa, Giardia lamblia
ASKNIMRLCAFLSLAEWLSLRGETVISTY

SEQ ID NO: 3085629 - protein, 23 aa, Giardia lamblia
ASKQLMCEDILNGTARRVGVIRK

SEQ ID NO: 3085630 - protein, 25 aa, Giardia lamblia
ASKRPCLNTLRHGLFDFIVIQEGGG

SEQ ID NO: 3085631 - protein, 29 aa, Giardia lamblia
ASLDVFVVIFCCLLRYHALTISKSKELLS

SEQ ID NO: 3085632 - protein, 21 aa, Giardia lamblia
ASLGSCQFGGSSFSCICVNSS

SEQ ID NO: 3085633 - protein, 25 aa, Giardia lamblia
ASLHLALLCYIKVTEYKLIKDKINR

SEQ ID NO: 3085634 - protein, 25 aa, Giardia lamblia
ASLHYILLSLILQSISLPWPVRESE

SEQ ID NO: 3085635 - protein, 24 aa, Giardia lamblia
ASLMPLPYFGLYHSAKAFLKAYAQ

SEQ ID NO: 3085636 - protein, 22 aa, Giardia lamblia
ASLNQQTMWLYRQLQGFDEDGD

SEQ ID NO: 3085637 - protein, 26 aa, Giardia lamblia
ASLSSLLVNLLYIFTASEPGDFRTSI

SEQ ID NO: 3085638 - protein, 20 aa, Giardia lamblia
ASLTSWCFLPWESRDRAREE

SEQ ID NO: 3085639 - protein, 18 aa, Giardia lamblia
ASLYLSTQQSQTGRFVWR

SEQ ID NO: 3085640 - protein, 27 aa, Giardia lamblia
ASMFELSIPFPVGRFISIPSPSSTICS

SEQ ID NO: 3085641 - protein, 32 aa, Giardia lamblia
ASMLGVFLLFLFALILISIIKCALACKCAANN

SEQ ID NO: 3085642 - protein, 21 aa, Giardia lamblia
ASMLSLFLGKRRWNALSYSAN

SEQ ID NO: 3085643 - protein, 28 aa, Giardia lamblia
ASNAWIRLSVLYAFLPKLVGPWVAHFRK

SEQ ID NO: 3085644 - protein, 24 aa, Giardia lamblia
ASNEKLYFRILGRPETFFVQSPIF

SEQ ID NO: 3085645 - protein, 28 aa, Giardia lamblia
ASNERIPLMPYMRLVFEIGDLKYASPAT

SEQ ID NO: 3085646 - protein, 18 aa, Giardia lamblia
ASNIFQLANALQAAKGTV

SEQ ID NO: 3085647 - protein, 30 aa, Giardia lamblia
ASNKCMLCVMMVICIIVLIVSIVDLAQATK

SEQ ID NO: 3085648 - protein, 17 aa, Giardia lamblia
ASPQMIPMYSESAVRHG

SEQ ID NO: 3085649 - protein, 29 aa, Giardia lamblia
ASPQWRLTWLRQNYALLQDLILDTLLVDL

SEQ ID NO: 3085650 - protein, 26 aa, Giardia lamblia
ASRINSYFTVSWLTGTLSLQLIIDEV

SEQ ID NO: 3085651 - protein, 24 aa, Giardia lamblia
ASRRYFFTNYYPIGGYLGAVTSPS

SEQ ID NO: 3085652 - protein, 27 aa, Giardia lamblia
ASSGLSIRHPVFLRITELKKQLDAMQP

SEQ ID NO: 3085653 - protein, 27 aa, Giardia lamblia
ASSPHPFTFLIHKLGIMPNYISIAYSC

SEQ ID NO: 3085654 - protein, 26 aa, Giardia lamblia
ASSRFMNLLVCMYEIPFAAHLRAKNS

SEQ ID NO: 3085655 - protein, 25 aa, Giardia lamblia
ASSSLFYTIKPYIEQLFSIVKDRHS

SEQ ID NO: 3085656 - protein, 23 aa, Giardia lamblia
ASTAVFFGLLFLSAARCHRTPAR

SEQ ID NO: 3085657 - protein, 25 aa, Giardia lamblia
ASTGLHYYLASYILPLISCNKEKNL

SEQ ID NO: 3085658 - protein, 18 aa, Giardia lamblia
ASTRRHLIRTINSCPFLV

SEQ ID NO: 3085659 - protein, 26 aa, Giardia lamblia
ASTSKYFIPTLFQYLYKYANGAIDIT

SEQ ID NO: 3085660 - protein, 26 aa, Giardia lamblia
ASTSNFCLILWTRTAELFVKYMGTFA

SEQ ID NO: 3085661 - protein, 22 aa, Giardia lamblia
ASTYLRFSAIFLPQCHEHPELK

SEQ ID NO: 3085662 - protein, 20 aa, Giardia lamblia
ASVDPWIGCFFYTRGHSIPC

SEQ ID NO: 3085663 - protein, 28 aa, Giardia lamblia
ASVRVQLIMWLLAILVIVFAYRMQVTFN

SEQ ID NO: 3085664 - protein, 24 aa, Giardia lamblia
ASVTYLIGQLFAKAVPWIGLVFVS

SEQ ID NO: 3085665 - protein, 22 aa, Giardia lamblia
ASYLFIFYKPASFVADETAFAD

SEQ ID NO: 3085666 - protein, 29 aa, Giardia lamblia
ASYWERACMFVLVATIFISALRIMPSLAT

SEQ ID NO: 3085667 - protein, 19 aa, Giardia lamblia
ATAPFMKDLFNLDSRKDQN

SEQ ID NO: 3085668 - protein, 22 aa, Giardia lamblia
ATCGLLYMRFAPVADGAIDLLR

SEQ ID NO: 3085669 - protein, 37 aa, Giardia lamblia
ATCNTLNFMYLLHLDILMFTKYNLPVLLIECMRTKPL

SEQ ID NO: 3085670 - protein, 26 aa, Giardia lamblia
ATCSCNQGWTLHGTLCYPSACVSSGT

SEQ ID NO: 3085671 - protein, 25 aa, Giardia lamblia
ATCSCSQGWTLHGTLCYPSACVSGG

SEQ ID NO: 3085672 - protein, 26 aa, Giardia lamblia
ATCSCSQGWTLHGTLCYPSACVSGGT

SEQ ID NO: 3085673 - protein, 25 aa, Giardia lamblia
ATDQDSIFNLWLNGAIPAVFYPTRS

SEQ ID NO: 3085674 - protein, 24 aa, Giardia lamblia
ATDYSFRRIVYPIVADLAKILYLR

SEQ ID NO: 3085675 - protein, 17 aa, Giardia lamblia
ATECYLEFLLYSVFSEI

SEQ ID NO: 3085676 - protein, 26 aa, Giardia lamblia
ATEEFLISLLPFAIASFIPGASVPSD

SEQ ID NO: 3085677 - protein, 22 aa, Giardia lamblia
ATEVLLFFQALGAQVGMTVKTM

SEQ ID NO: 3085678 - protein, 17 aa, Giardia lamblia
ATIARFVIAIILVFISG

SEQ ID NO: 3085679 - protein, 24 aa, Giardia lamblia
ATIISIIVAPLFISIPLALMSAEL

SEQ ID NO: 3085680 - protein, 28 aa, Giardia lamblia
ATILGPCTVLPFSYLYIKDTSPLEVQIS

SEQ ID NO: 3085681 - protein, 17 aa, Giardia lamblia
ATILKYPLSYPLTDIDM

SEQ ID NO: 3085682 - protein, 18 aa, Giardia lamblia
ATILLVSLISYYFVSFSR

SEQ ID NO: 3085683 - protein, 17 aa, Giardia lamblia
ATKLDLYRDIAVGLSLC

SEQ ID NO: 3085684 - protein, 45 aa, Giardia lamblia
ATKTYRIPAMWILILISLIQSLIVFPLICIFLSHIKPEEAWRGLP

SEQ ID NO: 3085685 - protein, 24 aa, Giardia lamblia
ATLAILIEVLLFLVASGYSNSQMQ

SEQ ID NO: 3085686 - protein, 29 aa, Giardia lamblia
ATLAPVVWIMIFMTFSISFPLARLLDLIS

SEQ ID NO: 3085687 - protein, 25 aa, Giardia lamblia
ATLHDALVVAILFLTVLYADTEALA

SEQ ID NO: 3085688 - protein, 31 aa, Giardia lamblia
ATLIALIFTVTVFVILLLLTNYTTIITETLL

SEQ ID NO: 3085689 - protein, 30 aa, Giardia lamblia
ATLKQKALGCLFLGKLLPIEILIDTNECID

SEQ ID NO: 3085690 - protein, 24 aa, Giardia lamblia
ATLLAPEAIESWISWVCCELQEIH

SEQ ID NO: 3085691 - protein, 41 aa, Giardia lamblia
ATLLMSWPSTFVLVPLLGLFLWMFMGFRAVSPLLRRTTSLL

SEQ ID NO: 3085692 - protein, 18 aa, Giardia lamblia
ATLNLFFDILHQSSILTS

SEQ ID NO: 3085693 - protein, 26 aa, Giardia lamblia
ATLTYVLSILLRYQIITVPSTYMSLV

SEQ ID NO: 3085694 - protein, 25 aa, Giardia lamblia
ATMALLRRYVPISQNFRGLQARRRR

SEQ ID NO: 3085695 - protein, 22 aa, Giardia lamblia
ATQDTLLYKLLEGKPPGGYADA

SEQ ID NO: 3085696 - protein, 26 aa, Giardia lamblia
ATQFQAFFSHIGFSALMLAAELNQYD

SEQ ID NO: 3085697 - protein, 19 aa, Giardia lamblia
ATRIYFTLARMVASALNDL

SEQ ID NO: 3085698 - protein, 17 aa, Giardia lamblia
ATRLYLAPPDWPKNDNY

SEQ ID NO: 3085699 - protein, 28 aa, Giardia lamblia
ATSAQLILFQLLAPFVIRIYNLDSAYYT

SEQ ID NO: 3085700 - protein, 21 aa, Giardia lamblia
ATSFFTRMNMILIIGNCILHL

SEQ ID NO: 3085701 - protein, 18 aa, Giardia lamblia
ATSFLHLLMLPTQPGEFS

SEQ ID NO: 3085702 - protein, 31 aa, Giardia lamblia
ATSINIRFGLQPWDWVWTFPITSGEDKMKVM

SEQ ID NO: 3085703 - protein, 24 aa, Giardia lamblia
ATSLSAFLLSQTTLRPARDIVSRV

SEQ ID NO: 3085704 - protein, 27 aa, Giardia lamblia
ATSNSQFNLLLLPRLIRAAHTNDMEAV

SEQ ID NO: 3085705 - protein, 25 aa, Giardia lamblia
ATSTRLWIHDLWTDLATVSDILTTT

SEQ ID NO: 3085706 - protein, 21 aa, Giardia lamblia
ATTEFLLAEPVLRYGLLCAVA

SEQ ID NO: 3085707 - protein, 29 aa, Giardia lamblia
ATTEKLQWLITQPPFPVEAFSNLITIYIQ

SEQ ID NO: 3085708 - protein, 19 aa, Giardia lamblia
ATVERLGFSAGLLAAVRNN

SEQ ID NO: 3085709 - protein, 23 aa, Giardia lamblia
ATVKLFEMVLYTSVTNTIPLDVF

SEQ ID NO: 3085710 - protein, 25 aa, Giardia lamblia
ATWLPYFMLMLPWLIKCTTESIPSI

SEQ ID NO: 3085711 - protein, 26 aa, Giardia lamblia
ATYFRSLLCMLVLGAIIVITSEVATR

SEQ ID NO: 3085712 - protein, 35 aa, Giardia lamblia
ATYLENLFKFSHDIFLFLLVPIIIFESAYTLDKTS

SEQ ID NO: 3085713 - protein, 34 aa, Giardia lamblia
ATYWINSPWIINFVIIWLLYFGAVSFSFVMASLL

SEQ ID NO: 3085714 - protein, 32 aa, Giardia lamblia
AVAFDVFSSFLFASTPLYVTFHQSFIACHGLI

SEQ ID NO: 3085715 - protein, 25 aa, Giardia lamblia
AVAGFLFIIVFLCVCVVYGDWRRTG

SEQ ID NO: 3085716 - protein, 18 aa, Giardia lamblia
AVAPRLPAFVYLLSPNPC

SEQ ID NO: 3085717 - protein, 31 aa, Giardia lamblia
AVAPVLTFLLLWGIFYSRLDYPLLPGKGTKY

SEQ ID NO: 3085718 - protein, 20 aa, Giardia lamblia
AVARIQLYKIGISSSGLTNR

SEQ ID NO: 3085719 - protein, 18 aa, Giardia lamblia
AVCHMRTYLALDNKTCVS

SEQ ID NO: 3085720 - protein, 19 aa, Giardia lamblia
AVCNAIIDGTRYCSKCTPG

SEQ ID NO: 3085721 - protein, 19 aa, Giardia lamblia
AVCTGCQYGFRLSSSGTCI

SEQ ID NO: 3085722 - protein, 26 aa, Giardia lamblia
AVCTLFYIIILLVMIVRKSVLPTFLD

SEQ ID NO: 3085723 - protein, 21 aa, Giardia lamblia
AVDFATYLFAQAIKSFITFYP

SEQ ID NO: 3085724 - protein, 23 aa, Giardia lamblia
AVDPYLYNVALLSDSSGSAKITI

SEQ ID NO: 3085725 - protein, 23 aa, Giardia lamblia
AVFAAQLYVIRASAFITSACLQR

SEQ ID NO: 3085726 - protein, 28 aa, Giardia lamblia
AVFFFGPYGPFIKAVYTRSLRSITSYKV

SEQ ID NO: 3085727 - protein, 17 aa, Giardia lamblia
AVFVVLAIIAVLVAITC

SEQ ID NO: 3085728 - protein, 23 aa, Giardia lamblia
AVGIFCCIWFVAVSILIPFVQAS

SEQ ID NO: 3085729 - protein, 28 aa, Giardia lamblia
AVGRVARRFWVLGALLRVIVDGVAREAC

SEQ ID NO: 3085730 - protein, 36 aa, Giardia lamblia
AVGVTIAILAIAGVIGFLVWWFVCKKKTNKVNMPPK

SEQ ID NO: 3085731 - protein, 18 aa, Giardia lamblia
AVHALILDKLLNGNKEYL

SEQ ID NO: 3085732 - protein, 24 aa, Giardia lamblia
AVHIITILIEFWVVEVRAVMSFSL

SEQ ID NO: 3085733 - protein, 51 aa, Giardia lamblia
AVICRKLHIVLLEAYIRAFITHKKLSLAIFSPLVPMYVHTFRIPRSSSYQS

SEQ ID NO: 3085734 - protein, 25 aa, Giardia lamblia
AVICTSIFLGLRQLLKLSLQTYSHV

SEQ ID NO: 3085735 - protein, 22 aa, Giardia lamblia
AVIGCAVGVLVWFLCCRRSKAV

SEQ ID NO: 3085736 - protein, 19 aa, Giardia lamblia
AVIHLLIVSVSPLSELCRY

SEQ ID NO: 3085737 - protein, 22 aa, Giardia lamblia
AVIKEYIIMPANPAFSVVFPDK

SEQ ID NO: 3085738 - protein, 24 aa, Giardia lamblia
AVIKNRFIILPQKTKITAGYGFST

SEQ ID NO: 3085739 - protein, 18 aa, Giardia lamblia
AVILAVFYSLYKELPATT

SEQ ID NO: 3085740 - protein, 17 aa, Giardia lamblia
AVIPVVFILATSLLKDL

SEQ ID NO: 3085741 - protein, 26 aa, Giardia lamblia
AVISTLYVRSLCKTHYFLKAEAMLVE

SEQ ID NO: 3085742 - protein, 28 aa, Giardia lamblia
AVIYSSTVFFLPVAFLTIHGTPGLPANF

SEQ ID NO: 3085743 - protein, 28 aa, Giardia lamblia
AVLLCSMLRGYQIPAFVALGTCALPGLK

SEQ ID NO: 3085744 - protein, 25 aa, Giardia lamblia
AVLNTQLFFFETNPLGRILNRLSRD

SEQ ID NO: 3085745 - protein, 30 aa, Giardia lamblia
AVLRGWIPASFLYFAFQTRTKHLRISTAPG

SEQ ID NO: 3085746 - protein, 25 aa, Giardia lamblia
AVLVPLVCVPILPLVLPSLGVIQEY

SEQ ID NO: 3085747 - protein, 20 aa, Giardia lamblia
AVMDLVLFRDAMEHVCRISR

SEQ ID NO: 3085748 - protein, 23 aa, Giardia lamblia
AVMYGCSAVIPLLLKLEAGLQDN

SEQ ID NO: 3085749 - protein, 27 aa, Giardia lamblia
AVPAVIGFLKILVVPVVILKDAILCLA

SEQ ID NO: 3085750 - protein, 23 aa, Giardia lamblia
AVPELVFHLYRLCDYLIVCQTKQ

SEQ ID NO: 3085751 - protein, 23 aa, Giardia lamblia
AVPSPYLVAISKSNCIILVDISA

SEQ ID NO: 3085752 - protein, 26 aa, Giardia lamblia
AVQFLVIMFVIACIASIYTFVRGYVT

SEQ ID NO: 3085753 - protein, 27 aa, Giardia lamblia
AVRKKRHVIIPVLMPNAITLCNNEGKT

SEQ ID NO: 3085754 - protein, 29 aa, Giardia lamblia
AVRPLALLLAFVCLLLSTLVLLQKVMPRG

SEQ ID NO: 3085755 - protein, 19 aa, Giardia lamblia
AVRRIAVAVYMLIGSTKNG

SEQ ID NO: 3085756 - protein, 23 aa, Giardia lamblia
AVRSSFFLGVRVLRTYEARLRLP

SEQ ID NO: 3085757 - protein, 31 aa, Giardia lamblia
AVRYALVCWSEIIVIITFSAGLVVGLRVIAG

SEQ ID NO: 3085758 - protein, 17 aa, Giardia lamblia
AVSAPHCKLSYALLSAF

SEQ ID NO: 3085759 - protein, 26 aa, Giardia lamblia
AVSPPVIYYKLGHVTLPLIDSMGNGV

SEQ ID NO: 3085760 - protein, 24 aa, Giardia lamblia
AVTKLFTLKAIYARVIEFMNLLDI

SEQ ID NO: 3085761 - protein, 24 aa, Giardia lamblia
AVVAQIALFFTNLGSIFPVGYNGI

SEQ ID NO: 3085762 - protein, 21 aa, Giardia lamblia
AVYLLLVYIYRENATATSVSV

SEQ ID NO: 3085763 - protein, 24 aa, Giardia lamblia
AVYPQWISETIFRSLSLDPAERPS

SEQ ID NO: 3085764 - protein, 20 aa, Giardia lamblia
AWHAAFLITPIDALGHEPAI

SEQ ID NO: 3085765 - protein, 20 aa, Giardia lamblia
AWIARILRDPKVAAFVACCF

SEQ ID NO: 3085766 - protein, 25 aa, Giardia lamblia
AWITTFFMFLGESICLVIFYIKRCI

SEQ ID NO: 3085767 - protein, 24 aa, Giardia lamblia
AWSATLIVYVPIPGTTKSKTPTAV

SEQ ID NO: 3085768 - protein, 28 aa, Giardia lamblia
AWSLGCILLTMCTLLEPLSVIDPRASNE

SEQ ID NO: 3085769 - protein, 20 aa, Giardia lamblia
AYALSFLESPLVLELLQFVQ

SEQ ID NO: 3085770 - protein, 20 aa, Giardia lamblia
AYANDLCHCAVYEAAREELF

SEQ ID NO: 3085771 - protein, 19 aa, Giardia lamblia
AYCSCRAPFALVSGKCVSA

SEQ ID NO: 3085772 - protein, 24 aa, Giardia lamblia
AYDHQGCYQFLFPAEGNVVDKLGQ

SEQ ID NO: 3085773 - protein, 24 aa, Giardia lamblia
AYDRLYSLTFPRLKGRELHMFIEP

SEQ ID NO: 3085774 - protein, 17 aa, Giardia lamblia
AYEHRDVYSNRSFPLCI

SEQ ID NO: 3085775 - protein, 27 aa, Giardia lamblia
AYFATILIMFFLCMFLALFLDKHENFI

SEQ ID NO: 3085776 - protein, 19 aa, Giardia lamblia
AYFVTLLIPAIFISAKAIR

SEQ ID NO: 3085777 - protein, 21 aa, Giardia lamblia
AYLLIISQCLPCFTEISLLVA

SEQ ID NO: 3085778 - protein, 22 aa, Giardia lamblia
AYNYRRIFCTISFYPRISRHNS

SEQ ID NO: 3085779 - protein, 32 aa, Giardia lamblia
AYRAQEKMRFYLLPNYPFVYVIRGHRVPVVPI

SEQ ID NO: 3085780 - protein, 20 aa, Giardia lamblia
AYRYVPPAPVILLDINVLPS

SEQ ID NO: 3085781 - protein, 28 aa, Giardia lamblia
AYSSFRKTLYQALQTILLHFGREHGCVN

SEQ ID NO: 3085782 - protein, 29 aa, Giardia lamblia
AYSYSVITLFLLLRIHLEKHIFSSVMDDL

SEQ ID NO: 3085783 - protein, 25 aa, Giardia lamblia
AYTEHVWRFCYLRMGMYSGFAITLY

SEQ ID NO: 3085784 - protein, 23 aa, Giardia lamblia
AYVRNPPRYIVLGDSYHLVVDIS

SEQ ID NO: 3085785 - protein, 17 aa, Giardia lamblia
AYYALKQFSKLPPVSSY

SEQ ID NO: 3085786 - protein, 31 aa, Giardia lamblia
AYYELDALLRIFLVSLIWLKGSSRVSEGILD

SEQ ID NO: 3085787 - protein, 17 aa, Giardia lamblia
CAARNLALILTSLLFKA

SEQ ID NO: 3085788 - protein, 17 aa, Giardia lamblia
CAAVVLRDVPFPTGSLA

SEQ ID NO: 3085789 - protein, 22 aa, Giardia lamblia
CACLLTPTYVVFVCSHGFFYLY

SEQ ID NO: 3085790 - protein, 22 aa, Giardia lamblia
CADGYIRPPEEYIFKHCMKTTC

SEQ ID NO: 3085791 - protein, 17 aa, Giardia lamblia
CADLVLFALVIACLASR

SEQ ID NO: 3085792 - protein, 20 aa, Giardia lamblia
CADRYFQATPLGGPRDCVPC

SEQ ID NO: 3085793 - protein, 23 aa, Giardia lamblia
CAEIYDIYSAVLPYSVVSFYNVR

SEQ ID NO: 3085794 - protein, 29 aa, Giardia lamblia
CAESYSWDPKLQPLPLPPGNRFYDDYVEY

SEQ ID NO: 3085795 - protein, 20 aa, Giardia lamblia
CAFTGLQYQCSCNTGFVLDT

SEQ ID NO: 3085796 - protein, 18 aa, Giardia lamblia
CAKGYFAQFMADDLNNYG

SEQ ID NO: 3085797 - protein, 18 aa, Giardia lamblia
CAPGYYLAGTQCVKCLAN

SEQ ID NO: 3085798 - protein, 21 aa, Giardia lamblia
CASGKYMKYSASGKICVDPSE

SEQ ID NO: 3085799 - protein, 24 aa, Giardia lamblia
CASKRQDFYRHYFGNSNLLIDSLC

SEQ ID NO: 3085800 - protein, 24 aa, Giardia lamblia
CATGYKEYPAPNTLTAIAANANCV

SEQ ID NO: 3085801 - protein, 17 aa, Giardia lamblia
CATNYLPINGKCVDSND

SEQ ID NO: 3085802 - protein, 26 aa, Giardia lamblia
CAYGDGAHFCQCRRGWVGAACDAPRA

SEQ ID NO: 3085803 - protein, 28 aa, Giardia lamblia
CAYNILVISLIFNMFWARTTYREMNVFV

SEQ ID NO: 3085804 - protein, 18 aa, Giardia lamblia
CCCFYTGFAANVIGLCGC

SEQ ID NO: 3085805 - protein, 40 aa, Giardia lamblia
CCDSRIYLVIVANYKLKYIQLFTVLQPVPNLFASSITALS

SEQ ID NO: 3085806 - protein, 19 aa, Giardia lamblia
CCDYAIGADIAFQRPIVPI

SEQ ID NO: 3085807 - protein, 28 aa, Giardia lamblia
CCISKLSLLGLLRSLIFFRSIEVVDRVY

SEQ ID NO: 3085808 - protein, 17 aa, Giardia lamblia
CCLIPDLKLFKAGDLTE

SEQ ID NO: 3085809 - protein, 22 aa, Giardia lamblia
CCNCCLCFCDCKYVMSDTGATF

SEQ ID NO: 3085810 - protein, 25 aa, Giardia lamblia
CCSIDPLRFFKALKIYNPDGSYNQE

SEQ ID NO: 3085811 - protein, 27 aa, Giardia lamblia
CCSIFDNFFSNFLFRSTIIVLSSYIRL

SEQ ID NO: 3085812 - protein, 24 aa, Giardia lamblia
CCSPFVYGITFGGMLVVYSIYEDD

SEQ ID NO: 3085813 - protein, 33 aa, Giardia lamblia
CCTPMSLSFLRKAILHITLGLYALHSKDYVHAD

SEQ ID NO: 3085814 - protein, 33 aa, Giardia lamblia
CDACFEPLIMKEDKTKCFGSCLALGPGYYNNSG

SEQ ID NO: 3085815 - protein, 25 aa, Giardia lamblia
CDACRILVHLLPYKEMREFAECYTL

SEQ ID NO: 3085816 - protein, 21 aa, Giardia lamblia
CDIWSLGSVLYELCTLRPLAD

SEQ ID NO: 3085817 - protein, 19 aa, Giardia lamblia
CDLKLLVNNLHLCFNTQTD

SEQ ID NO: 3085818 - protein, 24 aa, Giardia lamblia
CEACTQGWLWRYDENNHLTCVGVD

SEQ ID NO: 3085819 - protein, 26 aa, Giardia lamblia
CEAISIAFLILWFIGDLLNLISLIVI

SEQ ID NO: 3085820 - protein, 30 aa, Giardia lamblia
CEAITFWTFLWVLPLFWVIVLIINIVSSTI

SEQ ID NO: 3085821 - protein, 23 aa, Giardia lamblia
CEDTFFILARYYDVSEWPSIREE

SEQ ID NO: 3085822 - protein, 24 aa, Giardia lamblia
CEECKDGLYFKAGETPSCVSAEEC

SEQ ID NO: 3085823 - protein, 19 aa, Giardia lamblia
CEEVIAHPYWYEHNSLMHG

SEQ ID NO: 3085824 - protein, 19 aa, Giardia lamblia
CEEVISFNMFHTAPGKCKQ

SEQ ID NO: 3085825 - protein, 18 aa, Giardia lamblia
CEGGSLESLLSREYHYWP

SEQ ID NO: 3085826 - protein, 23 aa, Giardia lamblia
CEHRGAIVLDLLSGLEISVIPPP

SEQ ID NO: 3085827 - protein, 28 aa, Giardia lamblia
CEKCGDGYFLFMGGCYKTTDGPGSEICT

SEQ ID NO: 3085828 - protein, 26 aa, Giardia lamblia
CELRRYIHTLQIARFLGLRTLDQLID

SEQ ID NO: 3085829 - protein, 37 aa, Giardia lamblia
CENYAPVLIDLFNKFVLLNTYFISRNISFINPVFSIL

SEQ ID NO: 3085830 - protein, 20 aa, Giardia lamblia
CETDFNYFKLDLIRSYVPFE

SEQ ID NO: 3085831 - protein, 22 aa, Giardia lamblia
CETISIVCLPGETFVAGACVPN

SEQ ID NO: 3085832 - protein, 23 aa, Giardia lamblia
CFAYLWWFFLGLFGAHRFYLHKY

SEQ ID NO: 3085833 - protein, 20 aa, Giardia lamblia
CFCGSLAWRTLLRGFCVAIA

SEQ ID NO: 3085834 - protein, 25 aa, Giardia lamblia
CFDESFTGLFPIKSPILCKRYLNTD

SEQ ID NO: 3085835 - protein, 30 aa, Giardia lamblia
CFERPYSRPWNWTFPLWVTWATGCIIRYCI

SEQ ID NO: 3085836 - protein, 38 aa, Giardia lamblia
CFGMLRVYINALLRILIEWIAIYAPSLLCYYDVSLSAT

SEQ ID NO: 3085837 - protein, 17 aa, Giardia lamblia
CFILSYQRSGCSGSIML

SEQ ID NO: 3085838 - protein, 25 aa, Giardia lamblia
CFLADFGPYVFFAGSVMVPPLYFAR

SEQ ID NO: 3085839 - protein, 34 aa, Giardia lamblia
CFPGDSSYLLLLTYIPVLTKLFIKRTRLQTQQLI

SEQ ID NO: 3085840 - protein, 17 aa, Giardia lamblia
CFPGYYHSGTKCFKCTD

SEQ ID NO: 3085841 - protein, 24 aa, Giardia lamblia
CFQFMNLFARDILAKVQSFMTNVL

SEQ ID NO: 3085842 - protein, 18 aa, Giardia lamblia
CFQNYYSLTDSATGFVSC

SEQ ID NO: 3085843 - protein, 17 aa, Giardia lamblia
CFSLALKTSFTAKFAGP

SEQ ID NO: 3085844 - protein, 28 aa, Giardia lamblia
CFSVSASYFLFFFKVLRASSLDDKDFVV

SEQ ID NO: 3085845 - protein, 21 aa, Giardia lamblia
CFTICMCVIMMLLCITSFCAC

SEQ ID NO: 3085846 - protein, 33 aa, Giardia lamblia
CGAGYFLHRTVCFTPEFYPQICTKARAGVCEVC

SEQ ID NO: 3085847 - protein, 20 aa, Giardia lamblia
CGCCWAMASAALYEISVRST

SEQ ID NO: 3085848 - protein, 23 aa, Giardia lamblia
CGEGYFLHMNGCYKADQAPGNLV

SEQ ID NO: 3085849 - protein, 24 aa, Giardia lamblia
CGESLMHLCTINDSFMASSSSFWL

SEQ ID NO: 3085850 - protein, 25 aa, Giardia lamblia
CGEYAVMDGVTYCFRCSILSDLPVN

SEQ ID NO: 3085851 - protein, 20 aa, Giardia lamblia
CGGDALAGCVYKPEQQRFGC

SEQ ID NO: 3085852 - protein, 23 aa, Giardia lamblia
CGGDALAGCVYKPEQQRFGCACS

SEQ ID NO: 3085853 - protein, 20 aa, Giardia lamblia
CGGEYFLFMGGCYGIKYRPG

SEQ ID NO: 3085854 - protein, 21 aa, Giardia lamblia
CGIQLTLYFSSHLMRLIVMMK

SEQ ID NO: 3085855 - protein, 17 aa, Giardia lamblia
CGLLGIHFLVLPPGSTV

SEQ ID NO: 3085856 - protein, 17 aa, Giardia lamblia
CGLVDIFLSTCTTDEDC
